United States Patent 7,888,497 (BIOINFORMATICALLY DETECTABLE GROUP OF NOVEL REGULATORY OLIGONUCLEOTIDES AND USES THEREOF) - sequence listing, part 29

SEQ ID NO: 1200158 - DNA, 16 bp, Homo sapiens
ggcagctctccagtca

SEQ ID NO: 1200159 - DNA, 21 bp, Homo sapiens
ggcagctctccagtcaggagg

SEQ ID NO: 1200160 - DNA, 22 bp, Homo sapiens
ggcagctcttctgggcagagcc

SEQ ID NO: 1200161 - DNA, 16 bp, Homo sapiens
ggcagctgagaccagg

SEQ ID NO: 1200162 - DNA, 19 bp, Homo sapiens
ggcagctgagaccagggtc

SEQ ID NO: 1200163 - DNA, 16 bp, Homo sapiens
ggcagctgccagagaa

SEQ ID NO: 1200164 - DNA, 11 bp, Homo sapiens
ggcagctgccc

SEQ ID NO: 1200165 - DNA, 12 bp, Homo sapiens
ggcagctgcccc

SEQ ID NO: 1200166 - DNA, 11 bp, Homo sapiens
ggcagctgcct

SEQ ID NO: 1200167 - DNA, 12 bp, Homo sapiens
ggcagctgcctc

SEQ ID NO: 1200168 - DNA, 15 bp, Homo sapiens
ggcagctgcctctgc

SEQ ID NO: 1200169 - DNA, 17 bp, Homo sapiens
ggcagctgcctctgctc

SEQ ID NO: 1200170 - DNA, 18 bp, Homo sapiens
ggcagctgcctctgctcc

SEQ ID NO: 1200171 - DNA, 19 bp, Homo sapiens
ggcagctgcctggccatgc

SEQ ID NO: 1200172 - DNA, 20 bp, Homo sapiens
ggcagctgcctggccatgct

SEQ ID NO: 1200173 - DNA, 12 bp, Homo sapiens
ggcagctgctct

SEQ ID NO: 1200174 - DNA, 16 bp, Homo sapiens
ggcagctggcccccag

SEQ ID NO: 1200175 - DNA, 23 bp, Homo sapiens
ggcagctggcccccagccctggg

SEQ ID NO: 1200176 - DNA, 12 bp, Homo sapiens
ggcagctgggcc

SEQ ID NO: 1200177 - DNA, 13 bp, Homo sapiens
ggcagctgggccc

SEQ ID NO: 1200178 - DNA, 18 bp, Homo sapiens
ggcagctgggccccacct

SEQ ID NO: 1200179 - DNA, 19 bp, Homo sapiens
ggcagctgggccccaccta

SEQ ID NO: 1200180 - DNA, 21 bp, Homo sapiens
ggcagctgggccccacctact

SEQ ID NO: 1200181 - DNA, 13 bp, Homo sapiens
ggcagctgtagct

SEQ ID NO: 1200182 - DNA, 22 bp, Homo sapiens
ggcagctgtcccctctccctgg

SEQ ID NO: 1200183 - DNA, 14 bp, Homo sapiens
ggcagctgtttctc

SEQ ID NO: 1200184 - DNA, 19 bp, Homo sapiens
ggcagctgtttctcatgaa

SEQ ID NO: 1200185 - DNA, 21 bp, Homo sapiens
ggcagcttaacattgacttct

SEQ ID NO: 1200186 - DNA, 17 bp, Homo sapiens
ggcagcttagggccctg

SEQ ID NO: 1200187 - DNA, 21 bp, Homo sapiens
ggcagcttagggccctggagg

SEQ ID NO: 1200188 - DNA, 22 bp, Homo sapiens
ggcagcttagggccctggaggc

SEQ ID NO: 1200189 - DNA, 20 bp, Homo sapiens
ggcagctttttctgtggagg

SEQ ID NO: 1200190 - DNA, 15 bp, Homo sapiens
ggcaggaacaaacag

SEQ ID NO: 1200191 - DNA, 23 bp, Homo sapiens
ggcaggaagcccaattgctggag

SEQ ID NO: 1200192 - DNA, 23 bp, Homo sapiens
ggcaggaaggagagcctgctgca

SEQ ID NO: 1200193 - DNA, 12 bp, Homo sapiens
ggcaggacacat

SEQ ID NO: 1200194 - DNA, 21 bp, Homo sapiens
ggcaggacacatcccggcctc

SEQ ID NO: 1200195 - DNA, 14 bp, Homo sapiens
ggcaggaccaggac

SEQ ID NO: 1200196 - DNA, 15 bp, Homo sapiens
ggcaggaccaggact

SEQ ID NO: 1200197 - DNA, 16 bp, Homo sapiens
ggcaggaccctgctga

SEQ ID NO: 1200198 - DNA, 17 bp, Homo sapiens
ggcaggaccctgctgac

SEQ ID NO: 1200199 - DNA, 15 bp, Homo sapiens
ggcaggacctcagag

SEQ ID NO: 1200200 - DNA, 13 bp, Homo sapiens
ggcaggacctgcc

SEQ ID NO: 1200201 - DNA, 17 bp, Homo sapiens
ggcaggacctgcctagc

SEQ ID NO: 1200202 - DNA, 23 bp, Homo sapiens
ggcaggaccttcgggctgtgccc

SEQ ID NO: 1200203 - DNA, 15 bp, Homo sapiens
ggcaggactcctggc

SEQ ID NO: 1200204 - DNA, 16 bp, Homo sapiens
ggcaggactcctggca

SEQ ID NO: 1200205 - DNA, 18 bp, Homo sapiens
ggcaggactcctggcagg

SEQ ID NO: 1200206 - DNA, 19 bp, Homo sapiens
ggcaggagaatcagcctgg

SEQ ID NO: 1200207 - DNA, 17 bp, Homo sapiens
ggcaggaggagctgcct

SEQ ID NO: 1200208 - DNA, 18 bp, Homo sapiens
ggcaggaggatcacttga

SEQ ID NO: 1200209 - DNA, 24 bp, Homo sapiens
ggcaggaggattgcttgagcccag

SEQ ID NO: 1200210 - DNA, 14 bp, Homo sapiens
ggcaggagggaggt

SEQ ID NO: 1200211 - DNA, 19 bp, Homo sapiens
ggcaggagtgccaggacca

SEQ ID NO: 1200212 - DNA, 23 bp, Homo sapiens
ggcaggagtgccaggaccagcct

SEQ ID NO: 1200213 - DNA, 18 bp, Homo sapiens
ggcaggatctcaagccag

SEQ ID NO: 1200214 - DNA, 15 bp, Homo sapiens
ggcaggcaagccctt

SEQ ID NO: 1200215 - DNA, 18 bp, Homo sapiens
ggcaggcactgtggccct

SEQ ID NO: 1200216 - DNA, 19 bp, Homo sapiens
ggcaggccagatggcccct

SEQ ID NO: 1200217 - DNA, 16 bp, Homo sapiens
ggcaggccagcaataa

SEQ ID NO: 1200218 - DNA, 19 bp, Homo sapiens
ggcaggccagcaataaaaa

SEQ ID NO: 1200219 - DNA, 10 bp, Homo sapiens
ggcaggcctg

SEQ ID NO: 1200220 - DNA, 14 bp, Homo sapiens
ggcaggcctgaccc

SEQ ID NO: 1200221 - DNA, 15 bp, Homo sapiens
ggcaggcctgaccca

SEQ ID NO: 1200222 - DNA, 14 bp, Homo sapiens
ggcaggcctgggac

SEQ ID NO: 1200223 - DNA, 19 bp, Homo sapiens
ggcaggcctgggacccagc

SEQ ID NO: 1200224 - DNA, 18 bp, Homo sapiens
ggcaggccttgctggggt

SEQ ID NO: 1200225 - DNA, 22 bp, Homo sapiens
ggcaggcgcagaggtcccagcc

SEQ ID NO: 1200226 - DNA, 18 bp, Homo sapiens
ggcaactgcattggcttt

SEQ ID NO: 1200227 - DNA, 12 bp, Homo sapiens
ggcaactggcca

SEQ ID NO: 1200228 - DNA, 21 bp, Homo sapiens
ggcaagaaagcttgagtctca

SEQ ID NO: 1200229 - DNA, 18 bp, Homo sapiens
ggcaagaaggaattgact

SEQ ID NO: 1200230 - DNA, 21 bp, Homo sapiens
ggcaagacagaaaagtgcctg

SEQ ID NO: 1200231 - DNA, 20 bp, Homo sapiens
ggcaagactgcaaacttttt

SEQ ID NO: 1200232 - DNA, 17 bp, Homo sapiens
ggcaagacttttctttg

SEQ ID NO: 1200233 - DNA, 14 bp, Homo sapiens
ggcaagagactggg

SEQ ID NO: 1200234 - DNA, 22 bp, Homo sapiens
ggcaagagcccccttgacaccg

SEQ ID NO: 1200235 - DNA, 19 bp, Homo sapiens
ggcaagagggaaggtgacc

SEQ ID NO: 1200236 - DNA, 12 bp, Homo sapiens
ggcaagcaggga

SEQ ID NO: 1200237 - DNA, 16 bp, Homo sapiens
ggcaagcatgtaactt

SEQ ID NO: 1200238 - DNA, 21 bp, Homo sapiens
ggcaagcatgtaacttatatt

SEQ ID NO: 1200239 - DNA, 12 bp, Homo sapiens
ggcaagccaggg

SEQ ID NO: 1200240 - DNA, 23 bp, Homo sapiens
ggcaagccagggcccagagccct

SEQ ID NO: 1200241 - DNA, 19 bp, Homo sapiens
ggcaagcccctcagccctt

SEQ ID NO: 1200242 - DNA, 14 bp, Homo sapiens
ggcaagctgcaggt

SEQ ID NO: 1200243 - DNA, 23 bp, Homo sapiens
ggcaagctgtgacttctccaggt

SEQ ID NO: 1200244 - DNA, 11 bp, Homo sapiens
ggcaaggaaag

SEQ ID NO: 1200245 - DNA, 18 bp, Homo sapiens
ggcaaggactttgtacat

SEQ ID NO: 1200246 - DNA, 13 bp, Homo sapiens
ggcaaggcaggtg

SEQ ID NO: 1200247 - DNA, 14 bp, Homo sapiens
ggcaaggcaggtgc

SEQ ID NO: 1200248 - DNA, 17 bp, Homo sapiens
ggcaaggcattcctcat

SEQ ID NO: 1200249 - DNA, 12 bp, Homo sapiens
ggcaagggctcc

SEQ ID NO: 1200250 - DNA, 21 bp, Homo sapiens
ggcaaggggtgggactggtgg

SEQ ID NO: 1200251 - DNA, 17 bp, Homo sapiens
ggcaagggtgcctcagg

SEQ ID NO: 1200252 - DNA, 16 bp, Homo sapiens
ggcaaggtctccttac

SEQ ID NO: 1200253 - DNA, 23 bp, Homo sapiens
ggcaaggtctccttactctgagc

SEQ ID NO: 1200254 - DNA, 16 bp, Homo sapiens
ggcaagtccaccccat

SEQ ID NO: 1200255 - DNA, 22 bp, Homo sapiens
ggcaagtccctgactctctgtg

SEQ ID NO: 1200256 - DNA, 23 bp, Homo sapiens
ggcaagtccctgactctctgtga

SEQ ID NO: 1200257 - DNA, 20 bp, Homo sapiens
ggcaagtcgagagggctgtt

SEQ ID NO: 1200258 - DNA, 22 bp, Homo sapiens
ggcaagtcgagagggctgttgg

SEQ ID NO: 1200259 - DNA, 14 bp, Homo sapiens
ggcaagtgagaggg

SEQ ID NO: 1200260 - DNA, 16 bp, Homo sapiens
ggcaagtggaatatct

SEQ ID NO: 1200261 - DNA, 17 bp, Homo sapiens
ggcaagtggatgggaat

SEQ ID NO: 1200262 - DNA, 12 bp, Homo sapiens
ggcaataaactc

SEQ ID NO: 1200263 - DNA, 16 bp, Homo sapiens
ggcaatagggtagaat

SEQ ID NO: 1200264 - DNA, 14 bp, Homo sapiens
ggcaatattaacct

SEQ ID NO: 1200265 - DNA, 15 bp, Homo sapiens
ggcaatgatggcaat

SEQ ID NO: 1200266 - DNA, 16 bp, Homo sapiens
ggcaatgccatcagcc

SEQ ID NO: 1200267 - DNA, 18 bp, Homo sapiens
ggcaatgcttaaactaaa

SEQ ID NO: 1200268 - DNA, 18 bp, Homo sapiens
ggcaatgtcaggaacaga

SEQ ID NO: 1200269 - DNA, 18 bp, Homo sapiens
ggcaattagtgtgacagt

SEQ ID NO: 1200270 - DNA, 22 bp, Homo sapiens
ggcaattatatctattatgtat

SEQ ID NO: 1200271 - DNA, 14 bp, Homo sapiens
ggcaattctggaag

SEQ ID NO: 1200272 - DNA, 19 bp, Homo sapiens
ggcaattttaatcccctgc

SEQ ID NO: 1200273 - DNA, 16 bp, Homo sapiens
ggcaattttagtgtat

SEQ ID NO: 1200274 - DNA, 18 bp, Homo sapiens
ggcaattttagtgtatta

SEQ ID NO: 1200275 - DNA, 11 bp, Homo sapiens
ggcaattttgt

SEQ ID NO: 1200276 - DNA, 14 bp, Homo sapiens
ggcaattttgtaac

SEQ ID NO: 1200277 - DNA, 16 bp, Homo sapiens
ggcacaaactgcagct

SEQ ID NO: 1200278 - DNA, 14 bp, Homo sapiens
ggcacaaagatgga

SEQ ID NO: 1200279 - DNA, 18 bp, Homo sapiens
ggcacaagtcctggatgt

SEQ ID NO: 1200280 - DNA, 17 bp, Homo sapiens
ggcacacaaggggccct

SEQ ID NO: 1200281 - DNA, 20 bp, Homo sapiens
ggcacacaaggggcccttgg

SEQ ID NO: 1200282 - DNA, 13 bp, Homo sapiens
ggcacacacagcc

SEQ ID NO: 1200283 - DNA, 12 bp, Homo sapiens
ggcacacactgt

SEQ ID NO: 1200284 - DNA, 20 bp, Homo sapiens
ggcacacagagattctggat

SEQ ID NO: 1200285 - DNA, 16 bp, Homo sapiens
ggcacacagcagcccc

SEQ ID NO: 1200286 - DNA, 18 bp, Homo sapiens
ggcacacagcagcccccc

SEQ ID NO: 1200287 - DNA, 14 bp, Homo sapiens
ggcacaccactgcc

SEQ ID NO: 1200288 - DNA, 16 bp, Homo sapiens
ggcacaccactgccct

SEQ ID NO: 1200289 - DNA, 18 bp, Homo sapiens
ggcacaccactgccctgc

SEQ ID NO: 1200290 - DNA, 22 bp, Homo sapiens
ggcacaccactgccctgcctgc

SEQ ID NO: 1200291 - DNA, 23 bp, Homo sapiens
ggcacacctagacaaacaaggga

SEQ ID NO: 1200292 - DNA, 12 bp, Homo sapiens
ggcacacgcctc

SEQ ID NO: 1200293 - DNA, 17 bp, Homo sapiens
ggcacacgcctcccact

SEQ ID NO: 1200294 - DNA, 17 bp, Homo sapiens
ggcacactccctctcct

SEQ ID NO: 1200295 - DNA, 21 bp, Homo sapiens
ggcacagacactacatatcta

SEQ ID NO: 1200296 - DNA, 13 bp, Homo sapiens
ggcacagaccagg

SEQ ID NO: 1200297 - DNA, 15 bp, Homo sapiens
ggcacagaccaggcc

SEQ ID NO: 1200298 - DNA, 16 bp, Homo sapiens
ggcacagaccaggcct

SEQ ID NO: 1200299 - DNA, 22 bp, Homo sapiens
ggcacagacttctggaaggctg

SEQ ID NO: 1200300 - DNA, 16 bp, Homo sapiens
ggcacagaggaggtca

SEQ ID NO: 1200301 - DNA, 15 bp, Homo sapiens
ggcacagatgctcca

SEQ ID NO: 1200302 - DNA, 16 bp, Homo sapiens
ggcacagattgaagaa

SEQ ID NO: 1200303 - DNA, 20 bp, Homo sapiens
ggcacagcaggggagccctg

SEQ ID NO: 1200304 - DNA, 12 bp, Homo sapiens
ggcacagccagc

SEQ ID NO: 1200305 - DNA, 13 bp, Homo sapiens
ggcacagccagcc

SEQ ID NO: 1200306 - DNA, 16 bp, Homo sapiens
ggcacagccagcccaa

SEQ ID NO: 1200307 - DNA, 23 bp, Homo sapiens
ggcacagccctcagcgtcagaca

SEQ ID NO: 1200308 - DNA, 15 bp, Homo sapiens
ggcacagcctagggt

SEQ ID NO: 1200309 - DNA, 20 bp, Homo sapiens
ggcacagcggagtctgtcct

SEQ ID NO: 1200310 - DNA, 18 bp, Homo sapiens
ggcacagcggggccccag

SEQ ID NO: 1200311 - DNA, 18 bp, Homo sapiens
ggcacagctgccctgctg

SEQ ID NO: 1200312 - DNA, 20 bp, Homo sapiens
ggcacagctgtctgccaggc

SEQ ID NO: 1200313 - DNA, 12 bp, Homo sapiens
ggcacagggtct

SEQ ID NO: 1200314 - DNA, 17 bp, Homo sapiens
ggcacagggtctgctct

SEQ ID NO: 1200315 - DNA, 18 bp, Homo sapiens
ggcacagggtctgctctt

SEQ ID NO: 1200316 - DNA, 14 bp, Homo sapiens
ggcacagtccagga

SEQ ID NO: 1200317 - DNA, 19 bp, Homo sapiens
ggcacagtgctgccccttg

SEQ ID NO: 1200318 - DNA, 22 bp, Homo sapiens
ggcacagtgctgccccttgcaa

SEQ ID NO: 1200319 - DNA, 17 bp, Homo sapiens
ggcacagtgggagctga

SEQ ID NO: 1200320 - DNA, 18 bp, Homo sapiens
ggcacatcagcacgattt

SEQ ID NO: 1200321 - DNA, 16 bp, Homo sapiens
ggcacatgccccgatg

SEQ ID NO: 1200322 - DNA, 14 bp, Homo sapiens
ggcacatggaggag

SEQ ID NO: 1200323 - DNA, 14 bp, Homo sapiens
ggcacattgcccat

SEQ ID NO: 1200324 - DNA, 18 bp, Homo sapiens
ggcacattgcccatggct

SEQ ID NO: 1200325 - DNA, 19 bp, Homo sapiens
ggcacattgcccatggctg

SEQ ID NO: 1200326 - DNA, 19 bp, Homo sapiens
ggcaccacagagaagacct

SEQ ID NO: 1200327 - DNA, 14 bp, Homo sapiens
ggcaccaccaggag

SEQ ID NO: 1200328 - DNA, 17 bp, Homo sapiens
ggcaccaccaggagcag

SEQ ID NO: 1200329 - DNA, 18 bp, Homo sapiens
ggcaccaccaggagcagc

SEQ ID NO: 1200330 - DNA, 22 bp, Homo sapiens
ggcaccaccaggagcagcagcc

SEQ ID NO: 1200331 - DNA, 24 bp, Homo sapiens
ggcaccaccaggagcagcagccag

SEQ ID NO: 1200332 - DNA, 13 bp, Homo sapiens
ggcaccaccaggg

SEQ ID NO: 1200333 - DNA, 20 bp, Homo sapiens
ggcaccaccagggtggacca

SEQ ID NO: 1200334 - DNA, 22 bp, Homo sapiens
ggcaccagaggctgcagaaggc

SEQ ID NO: 1200335 - DNA, 17 bp, Homo sapiens
ggcaccagatgcaacct

SEQ ID NO: 1200336 - DNA, 16 bp, Homo sapiens
ggcaccagcagcctgg

SEQ ID NO: 1200337 - DNA, 13 bp, Homo sapiens
ggcaccagccagc

SEQ ID NO: 1200338 - DNA, 14 bp, Homo sapiens
ggcaccagccagcg

SEQ ID NO: 1200339 - DNA, 15 bp, Homo sapiens
ggcaccaggaagccg

SEQ ID NO: 1200340 - DNA, 13 bp, Homo sapiens
ggcacccaccctg

SEQ ID NO: 1200341 - DNA, 20 bp, Homo sapiens
ggcacccaccgtggaggagg

SEQ ID NO: 1200342 - DNA, 14 bp, Homo sapiens
ggcacccccatgct

SEQ ID NO: 1200343 - DNA, 15 bp, Homo sapiens
ggcacccccatgctg

SEQ ID NO: 1200344 - DNA, 15 bp, Homo sapiens
ggcaccccctggaga

SEQ ID NO: 1200345 - DNA, 18 bp, Homo sapiens
ggcaccccctggagagaa

SEQ ID NO: 1200346 - DNA, 19 bp, Homo sapiens
ggcaccccctggagagaag

SEQ ID NO: 1200347 - DNA, 13 bp, Homo sapiens
ggcaccctcaggg

SEQ ID NO: 1200348 - DNA, 21 bp, Homo sapiens
ggcaccctcagggagcctccc

SEQ ID NO: 1200349 - DNA, 19 bp, Homo sapiens
ggcaccctggtctgtggag

SEQ ID NO: 1200350 - DNA, 17 bp, Homo sapiens
ggcacccttctttcctc

SEQ ID NO: 1200351 - DNA, 13 bp, Homo sapiens
ggagccccaggcc

SEQ ID NO: 1200352 - DNA, 23 bp, Homo sapiens
ggagccccaggcctctgtgtcct

SEQ ID NO: 1200353 - DNA, 13 bp, Homo sapiens
ggagccccagggt

SEQ ID NO: 1200354 - DNA, 20 bp, Homo sapiens
ggagccccagggtcttccct

SEQ ID NO: 1200355 - DNA, 15 bp, Homo sapiens
ggagcccccagatag

SEQ ID NO: 1200356 - DNA, 22 bp, Homo sapiens
ggagcccccagatagagctggg

SEQ ID NO: 1200357 - DNA, 11 bp, Homo sapiens
ggagccccctc

SEQ ID NO: 1200358 - DNA, 13 bp, Homo sapiens
ggagccccctctg

SEQ ID NO: 1200359 - DNA, 16 bp, Homo sapiens
ggagccccgccacagc

SEQ ID NO: 1200360 - DNA, 20 bp, Homo sapiens
ggagcccctcctcccccggc

SEQ ID NO: 1200361 - DNA, 14 bp, Homo sapiens
ggagcccctgggtg

SEQ ID NO: 1200362 - DNA, 18 bp, Homo sapiens
ggagccccttctgctcag

SEQ ID NO: 1200363 - DNA, 19 bp, Homo sapiens
ggagcccgatattctccct

SEQ ID NO: 1200364 - DNA, 16 bp, Homo sapiens
ggagcccgcaccccca

SEQ ID NO: 1200365 - DNA, 18 bp, Homo sapiens
ggagcccgcacccccacc

SEQ ID NO: 1200366 - DNA, 19 bp, Homo sapiens
ggagcccgcttcaagctct

SEQ ID NO: 1200367 - DNA, 16 bp, Homo sapiens
ggagcccgtctcagtg

SEQ ID NO: 1200368 - DNA, 13 bp, Homo sapiens
ggagccctcagac

SEQ ID NO: 1200369 - DNA, 13 bp, Homo sapiens
ggagccctcaggc

SEQ ID NO: 1200370 - DNA, 20 bp, Homo sapiens
ggagccctcaggctccccag

SEQ ID NO: 1200371 - DNA, 12 bp, Homo sapiens
ggagccctgacc

SEQ ID NO: 1200372 - DNA, 17 bp, Homo sapiens
ggagccgaagcccaggg

SEQ ID NO: 1200373 - DNA, 22 bp, Homo sapiens
ggagccgaccaattagtcactg

SEQ ID NO: 1200374 - DNA, 16 bp, Homo sapiens
ggagccgggaccctca

SEQ ID NO: 1200375 - DNA, 23 bp, Homo sapiens
ggagccggtaactgtcctgtcct

SEQ ID NO: 1200376 - DNA, 17 bp, Homo sapiens
ggagcctagcggagccc

SEQ ID NO: 1200377 - DNA, 17 bp, Homo sapiens
ggagcctagctcctgcc

SEQ ID NO: 1200378 - DNA, 18 bp, Homo sapiens
ggagcctagctcctgcca

SEQ ID NO: 1200379 - DNA, 20 bp, Homo sapiens
ggagcctcatccgaggcagg

SEQ ID NO: 1200380 - DNA, 20 bp, Homo sapiens
ggagcctcatgttctcttcc

SEQ ID NO: 1200381 - DNA, 22 bp, Homo sapiens
ggagcctcatgttctcttccca

SEQ ID NO: 1200382 - DNA, 20 bp, Homo sapiens
ggagcctccactgcctctgg

SEQ ID NO: 1200383 - DNA, 19 bp, Homo sapiens
ggagcctccccatctgtcc

SEQ ID NO: 1200384 - DNA, 17 bp, Homo sapiens
ggagcctccccctcaga

SEQ ID NO: 1200385 - DNA, 22 bp, Homo sapiens
ggagcctcgcccctccagtgtt

SEQ ID NO: 1200386 - DNA, 12 bp, Homo sapiens
ggagcctgctct

SEQ ID NO: 1200387 - DNA, 17 bp, Homo sapiens
ggagcctggggtgtcct

SEQ ID NO: 1200388 - DNA, 13 bp, Homo sapiens
ggagcctgtgtta

SEQ ID NO: 1200389 - DNA, 21 bp, Homo sapiens
ggagccttcccaagttgtgct

SEQ ID NO: 1200390 - DNA, 18 bp, Homo sapiens
ggagccttgctgggccag

SEQ ID NO: 1200391 - DNA, 21 bp, Homo sapiens
ggagcctttggggggccaccc

SEQ ID NO: 1200392 - DNA, 20 bp, Homo sapiens
ggagcctttggttctggcca

SEQ ID NO: 1200393 - DNA, 16 bp, Homo sapiens
ggagcgatccagggga

SEQ ID NO: 1200394 - DNA, 19 bp, Homo sapiens
ggagcgcacctgccccctg

SEQ ID NO: 1200395 - DNA, 21 bp, Homo sapiens
ggagcgcccgccgtctgctcc

SEQ ID NO: 1200396 - DNA, 23 bp, Homo sapiens
ggagcgcccgccgtctgctccgg

SEQ ID NO: 1200397 - DNA, 19 bp, Homo sapiens
ggagcgctagtgccttgcc

SEQ ID NO: 1200398 - DNA, 20 bp, Homo sapiens
ggagcgctagtgccttgccc

SEQ ID NO: 1200399 - DNA, 19 bp, Homo sapiens
ggagcggccgcctgcgggc

SEQ ID NO: 1200400 - DNA, 14 bp, Homo sapiens
ggagcgggcagggc

SEQ ID NO: 1200401 - DNA, 16 bp, Homo sapiens
ggagctaacactggcc

SEQ ID NO: 1200402 - DNA, 19 bp, Homo sapiens
ggagctaacactggcccct

SEQ ID NO: 1200403 - DNA, 17 bp, Homo sapiens
ggagctaagtcacccag

SEQ ID NO: 1200404 - DNA, 22 bp, Homo sapiens
ggagctatgatttttttttcca

SEQ ID NO: 1200405 - DNA, 21 bp, Homo sapiens
ggagctcaccctgcccgctcc

SEQ ID NO: 1200406 - DNA, 20 bp, Homo sapiens
ggagctcactgtggtgtctg

SEQ ID NO: 1200407 - DNA, 22 bp, Homo sapiens
ggagctcaggaagaagagatgc

SEQ ID NO: 1200408 - DNA, 16 bp, Homo sapiens
ggagctcccctgtttg

SEQ ID NO: 1200409 - DNA, 15 bp, Homo sapiens
ggagctcctggccag

SEQ ID NO: 1200410 - DNA, 12 bp, Homo sapiens
ggagctcctggg

SEQ ID NO: 1200411 - DNA, 15 bp, Homo sapiens
ggagctcctgggacc

SEQ ID NO: 1200412 - DNA, 17 bp, Homo sapiens
ggagctcgcattctctt

SEQ ID NO: 1200413 - DNA, 17 bp, Homo sapiens
ggagctctgcgccaggc

SEQ ID NO: 1200414 - DNA, 17 bp, Homo sapiens
ggagctcttcaggcctc

SEQ ID NO: 1200415 - DNA, 20 bp, Homo sapiens
ggagctcttcaggcctccct

SEQ ID NO: 1200416 - DNA, 12 bp, Homo sapiens
ggagctcttgga

SEQ ID NO: 1200417 - DNA, 15 bp, Homo sapiens
ggagctgaaaaatca

SEQ ID NO: 1200418 - DNA, 17 bp, Homo sapiens
ggagctgaaccacagaa

SEQ ID NO: 1200419 - DNA, 21 bp, Homo sapiens
ggagctgagaagaggaggagg

SEQ ID NO: 1200420 - DNA, 15 bp, Homo sapiens
ggagctgagggaggg

SEQ ID NO: 1200421 - DNA, 21 bp, Homo sapiens
ggagctgagtcacctcctcca

SEQ ID NO: 1200422 - DNA, 15 bp, Homo sapiens
ggagctgatggcagc

SEQ ID NO: 1200423 - DNA, 16 bp, Homo sapiens
ggagctgatggcagct

SEQ ID NO: 1200424 - DNA, 18 bp, Homo sapiens
ggagctgatggcagctgg

SEQ ID NO: 1200425 - DNA, 19 bp, Homo sapiens
ctctggaggcctctggccc

SEQ ID NO: 1200426 - DNA, 17 bp, Homo sapiens
ctctggaggctgcagag

SEQ ID NO: 1200427 - DNA, 19 bp, Homo sapiens
ctctggaggggtgtggctc

SEQ ID NO: 1200428 - DNA, 21 bp, Homo sapiens
ctctggagtgatggtgtcctt

SEQ ID NO: 1200429 - DNA, 22 bp, Homo sapiens
ctctggatggaacgggcatggg

SEQ ID NO: 1200430 - DNA, 13 bp, Homo sapiens
ctctggatggcac

SEQ ID NO: 1200431 - DNA, 16 bp, Homo sapiens
ctctggatggcaccag

SEQ ID NO: 1200432 - DNA, 20 bp, Homo sapiens
ctctggattcagccttcttt

SEQ ID NO: 1200433 - DNA, 15 bp, Homo sapiens
ctctggcaaactttt

SEQ ID NO: 1200434 - DNA, 14 bp, Homo sapiens
ctctggcacagtga

SEQ ID NO: 1200435 - DNA, 23 bp, Homo sapiens
ctctggcattagaattatttaaa

SEQ ID NO: 1200436 - DNA, 19 bp, Homo sapiens
ctctggccaaatatgcact

SEQ ID NO: 1200437 - DNA, 20 bp, Homo sapiens
ctctggccaaatatgcactt

SEQ ID NO: 1200438 - DNA, 14 bp, Homo sapiens
ctctggccacaaca

SEQ ID NO: 1200439 - DNA, 17 bp, Homo sapiens
ctctggccaccctggcc

SEQ ID NO: 1200440 - DNA, 15 bp, Homo sapiens
ctctggcccagaaag

SEQ ID NO: 1200441 - DNA, 23 bp, Homo sapiens
ctctggcccagaaagcctctctc

SEQ ID NO: 1200442 - DNA, 18 bp, Homo sapiens
ctctggcccctcacccac

SEQ ID NO: 1200443 - DNA, 23 bp, Homo sapiens
ctctggcccctcacccaccatgg

SEQ ID NO: 1200444 - DNA, 10 bp, Homo sapiens
ctctggccct

SEQ ID NO: 1200445 - DNA, 13 bp, Homo sapiens
ctctggccctcgg

SEQ ID NO: 1200446 - DNA, 13 bp, Homo sapiens
ctctggccctgcc

SEQ ID NO: 1200447 - DNA, 13 bp, Homo sapiens
ctctggccctggc

SEQ ID NO: 1200448 - DNA, 14 bp, Homo sapiens
ctctggccctggcc

SEQ ID NO: 1200449 - DNA, 18 bp, Homo sapiens
ctctggccgccaccccca

SEQ ID NO: 1200450 - DNA, 14 bp, Homo sapiens
ctctggcctcccac

SEQ ID NO: 1200451 - DNA, 16 bp, Homo sapiens
ctctggcctcccaccc

SEQ ID NO: 1200452 - DNA, 17 bp, Homo sapiens
ctctggcctcccacccg

SEQ ID NO: 1200453 - DNA, 16 bp, Homo sapiens
ctctggccttttccta

SEQ ID NO: 1200454 - DNA, 16 bp, Homo sapiens
ctctggcgacagtttt

SEQ ID NO: 1200455 - DNA, 14 bp, Homo sapiens
ctctggctagaggc

SEQ ID NO: 1200456 - DNA, 20 bp, Homo sapiens
ctctggctagaggccagccc

SEQ ID NO: 1200457 - DNA, 17 bp, Homo sapiens
ctctggctcagcctgtc

SEQ ID NO: 1200458 - DNA, 18 bp, Homo sapiens
ctctggctcagcctgtct

SEQ ID NO: 1200459 - DNA, 19 bp, Homo sapiens
ctctggctccagaggacct

SEQ ID NO: 1200460 - DNA, 12 bp, Homo sapiens
ctctggctctca

SEQ ID NO: 1200461 - DNA, 13 bp, Homo sapiens
ctctggctctcat

SEQ ID NO: 1200462 - DNA, 16 bp, Homo sapiens
ctctggctctcatggg

SEQ ID NO: 1200463 - DNA, 14 bp, Homo sapiens
ctctggctctgttc

SEQ ID NO: 1200464 - DNA, 18 bp, Homo sapiens
ctctggctgaaccctgtg

SEQ ID NO: 1200465 - DNA, 23 bp, Homo sapiens
ctctggctggctaactggaagca

SEQ ID NO: 1200466 - DNA, 12 bp, Homo sapiens
ctctggcttcca

SEQ ID NO: 1200467 - DNA, 14 bp, Homo sapiens
ctctggcttccagg

SEQ ID NO: 1200468 - DNA, 17 bp, Homo sapiens
ctctggcttccaggtat

SEQ ID NO: 1200469 - DNA, 14 bp, Homo sapiens
ctctggcttcccat

SEQ ID NO: 1200470 - DNA, 13 bp, Homo sapiens
ctctggcttctga

SEQ ID NO: 1200471 - DNA, 20 bp, Homo sapiens
ctctggcttgccccaggact

SEQ ID NO: 1200472 - DNA, 14 bp, Homo sapiens
ctctggctttccca

SEQ ID NO: 1200473 - DNA, 15 bp, Homo sapiens
ctctggctttcccag

SEQ ID NO: 1200474 - DNA, 16 bp, Homo sapiens
ctctggctttcccagg

SEQ ID NO: 1200475 - DNA, 17 bp, Homo sapiens
ctctggctttcccagga

SEQ ID NO: 1200476 - DNA, 19 bp, Homo sapiens
ctctgggaaataagagaga

SEQ ID NO: 1200477 - DNA, 18 bp, Homo sapiens
ctctgggaacctcccaga

SEQ ID NO: 1200478 - DNA, 20 bp, Homo sapiens
ctctgggaacctcccagagg

SEQ ID NO: 1200479 - DNA, 13 bp, Homo sapiens
ctctgggaactga

SEQ ID NO: 1200480 - DNA, 21 bp, Homo sapiens
ctctgggagaaaatcatcaag

SEQ ID NO: 1200481 - DNA, 16 bp, Homo sapiens
ctctgggatcctgggg

SEQ ID NO: 1200482 - DNA, 19 bp, Homo sapiens
ctctgggatttatgctcat

SEQ ID NO: 1200483 - DNA, 22 bp, Homo sapiens
ctctgggatttatgctcatgaa

SEQ ID NO: 1200484 - DNA, 17 bp, Homo sapiens
ctctgggcacagtgctg

SEQ ID NO: 1200485 - DNA, 19 bp, Homo sapiens
ctctgggcacagtgctgcc

SEQ ID NO: 1200486 - DNA, 17 bp, Homo sapiens
ctctgggcacgcctgct

SEQ ID NO: 1200487 - DNA, 14 bp, Homo sapiens
ctctgggcagcctg

SEQ ID NO: 1200488 - DNA, 11 bp, Homo sapiens
ctctgggcagg

SEQ ID NO: 1200489 - DNA, 15 bp, Homo sapiens
ctctgggcaggacct

SEQ ID NO: 1200490 - DNA, 14 bp, Homo sapiens
ctctgggccacttg

SEQ ID NO: 1200491 - DNA, 18 bp, Homo sapiens
ctctgggccacttggagt

SEQ ID NO: 1200492 - DNA, 13 bp, Homo sapiens
ggagtccccatcc

SEQ ID NO: 1200493 - DNA, 13 bp, Homo sapiens
ggagtcccctccc

SEQ ID NO: 1200494 - DNA, 22 bp, Homo sapiens
ggagtccttacctcggggagag

SEQ ID NO: 1200495 - DNA, 15 bp, Homo sapiens
ggagtcggttagtca

SEQ ID NO: 1200496 - DNA, 24 bp, Homo sapiens
ggagtcgtggggtgtgctgggagc

SEQ ID NO: 1200497 - DNA, 21 bp, Homo sapiens
ggagtctccctccgactccag

SEQ ID NO: 1200498 - DNA, 13 bp, Homo sapiens
ggagtctctgcca

SEQ ID NO: 1200499 - DNA, 15 bp, Homo sapiens
ggagtctctgccacc

SEQ ID NO: 1200500 - DNA, 17 bp, Homo sapiens
ggagtctctgccaccca

SEQ ID NO: 1200501 - DNA, 13 bp, Homo sapiens
ggagtctgaggac

SEQ ID NO: 1200502 - DNA, 23 bp, Homo sapiens
ggagtctgaggactgtcctccca

SEQ ID NO: 1200503 - DNA, 19 bp, Homo sapiens
ggagtgaccgggcactggc

SEQ ID NO: 1200504 - DNA, 19 bp, Homo sapiens
ggagtgagaggtctctctt

SEQ ID NO: 1200505 - DNA, 14 bp, Homo sapiens
ggagtgagcagcta

SEQ ID NO: 1200506 - DNA, 20 bp, Homo sapiens
ggagtgaggcttccaggctc

SEQ ID NO: 1200507 - DNA, 22 bp, Homo sapiens
ggagtgaggcttccaggctctt

SEQ ID NO: 1200508 - DNA, 17 bp, Homo sapiens
ggagtgagggcctcaga

SEQ ID NO: 1200509 - DNA, 21 bp, Homo sapiens
ggagtgagtcacctgctccag

SEQ ID NO: 1200510 - DNA, 21 bp, Homo sapiens
ggagtgagtgtggctcccctc

SEQ ID NO: 1200511 - DNA, 21 bp, Homo sapiens
ggagtgataatattgtttccc

SEQ ID NO: 1200512 - DNA, 15 bp, Homo sapiens
ggagtgatggtgtcc

SEQ ID NO: 1200513 - DNA, 20 bp, Homo sapiens
ggagtgcaatgacacagtct

SEQ ID NO: 1200514 - DNA, 16 bp, Homo sapiens
ggagtgcagagaaaga

SEQ ID NO: 1200515 - DNA, 15 bp, Homo sapiens
ggagtgcagccttct

SEQ ID NO: 1200516 - DNA, 15 bp, Homo sapiens
ggagtgccaggacca

SEQ ID NO: 1200517 - DNA, 16 bp, Homo sapiens
ggagtgccctgcaggc

SEQ ID NO: 1200518 - DNA, 18 bp, Homo sapiens
ggagtgcggaccaccctc

SEQ ID NO: 1200519 - DNA, 19 bp, Homo sapiens
ggagtgctgcttgtgcctc

SEQ ID NO: 1200520 - DNA, 13 bp, Homo sapiens
ggagtggaaggtg

SEQ ID NO: 1200521 - DNA, 23 bp, Homo sapiens
ggagtggacaccgctcagtatta

SEQ ID NO: 1200522 - DNA, 11 bp, Homo sapiens
ggagtggccaa

SEQ ID NO: 1200523 - DNA, 21 bp, Homo sapiens
ggagtggccaaataggaggga

SEQ ID NO: 1200524 - DNA, 17 bp, Homo sapiens
ggagtgggcacctcaga

SEQ ID NO: 1200525 - DNA, 18 bp, Homo sapiens
ggagtgggcacctcagaa

SEQ ID NO: 1200526 - DNA, 20 bp, Homo sapiens
ggagtgggtgacaagagcct

SEQ ID NO: 1200527 - DNA, 17 bp, Homo sapiens
ggagtgggtggaggcag

SEQ ID NO: 1200528 - DNA, 23 bp, Homo sapiens
ggagtgtaaaatgtatattttta

SEQ ID NO: 1200529 - DNA, 12 bp, Homo sapiens
ggagtgtaaacc

SEQ ID NO: 1200530 - DNA, 20 bp, Homo sapiens
ggagtgtatgactgcacatg

SEQ ID NO: 1200531 - DNA, 14 bp, Homo sapiens
ggagtgtcctgccc

SEQ ID NO: 1200532 - DNA, 19 bp, Homo sapiens
ggagtgtgagccacctaag

SEQ ID NO: 1200533 - DNA, 20 bp, Homo sapiens
ggagtgtgagggtcctgcag

SEQ ID NO: 1200534 - DNA, 16 bp, Homo sapiens
ggagtgtgtattgttc

SEQ ID NO: 1200535 - DNA, 17 bp, Homo sapiens
ggagtgtgtattgttcc

SEQ ID NO: 1200536 - DNA, 19 bp, Homo sapiens
ggagtgtgtcagagcccag

SEQ ID NO: 1200537 - DNA, 21 bp, Homo sapiens
ggagtgtgtcagagcccaggg

SEQ ID NO: 1200538 - DNA, 12 bp, Homo sapiens
ggagtgttcccc

SEQ ID NO: 1200539 - DNA, 22 bp, Homo sapiens
ggagttacattaatgttaattc

SEQ ID NO: 1200540 - DNA, 12 bp, Homo sapiens
ggagttatctaa

SEQ ID NO: 1200541 - DNA, 21 bp, Homo sapiens
ggagttcaagaccagcctggg

SEQ ID NO: 1200542 - DNA, 14 bp, Homo sapiens
ggagttccatgaag

SEQ ID NO: 1200543 - DNA, 14 bp, Homo sapiens
ggagttccggcctg

SEQ ID NO: 1200544 - DNA, 19 bp, Homo sapiens
ggagttccggcctgggcac

SEQ ID NO: 1200545 - DNA, 18 bp, Homo sapiens
ggagttcgagaccagcct

SEQ ID NO: 1200546 - DNA, 16 bp, Homo sapiens
ggagttctatgctctc

SEQ ID NO: 1200547 - DNA, 18 bp, Homo sapiens
ggatgagcagagggagga

SEQ ID NO: 1200548 - DNA, 20 bp, Homo sapiens
ggatgaggccgctagaggcc

SEQ ID NO: 1200549 - DNA, 18 bp, Homo sapiens
ggatgagggaagcgaagg

SEQ ID NO: 1200550 - DNA, 20 bp, Homo sapiens
ggatgatggcagagccaggc

SEQ ID NO: 1200551 - DNA, 21 bp, Homo sapiens
ggatgattcagaaattggaac

SEQ ID NO: 1200552 - DNA, 21 bp, Homo sapiens
ggatgatttcagaaggagaag

SEQ ID NO: 1200553 - DNA, 23 bp, Homo sapiens
ggatgatttcatcttctggaata

SEQ ID NO: 1200554 - DNA, 15 bp, Homo sapiens
ggatgcaaggtagca

SEQ ID NO: 1200555 - DNA, 16 bp, Homo sapiens
ggatgcagtgatgtga

SEQ ID NO: 1200556 - DNA, 17 bp, Homo sapiens
ggatgcattcgagatgg

SEQ ID NO: 1200557 - DNA, 23 bp, Homo sapiens
ggatgccaacaccttcttggctt

SEQ ID NO: 1200558 - DNA, 19 bp, Homo sapiens
ggatgcccagatgaactga

SEQ ID NO: 1200559 - DNA, 18 bp, Homo sapiens
ggatgcccccaggcagcc

SEQ ID NO: 1200560 - DNA, 12 bp, Homo sapiens
ggatgccctgga

SEQ ID NO: 1200561 - DNA, 21 bp, Homo sapiens
ggatgcctcaccacacccagg

SEQ ID NO: 1200562 - DNA, 17 bp, Homo sapiens
ggatgccttttctgtga

SEQ ID NO: 1200563 - DNA, 17 bp, Homo sapiens
ggatgcgagcttggcct

SEQ ID NO: 1200564 - DNA, 14 bp, Homo sapiens
ggatgcgcagtgcc

SEQ ID NO: 1200565 - DNA, 13 bp, Homo sapiens
ggatgcggctttc

SEQ ID NO: 1200566 - DNA, 15 bp, Homo sapiens
ggatgcgtgggaggc

SEQ ID NO: 1200567 - DNA, 16 bp, Homo sapiens
ggatgctaacatctaa

SEQ ID NO: 1200568 - DNA, 13 bp, Homo sapiens
ggatgctccaggg

SEQ ID NO: 1200569 - DNA, 16 bp, Homo sapiens
ggatgctccagggcag

SEQ ID NO: 1200570 - DNA, 18 bp, Homo sapiens
ggatgctccagggcagcc

SEQ ID NO: 1200571 - DNA, 19 bp, Homo sapiens
ggatgctccagggcagcct

SEQ ID NO: 1200572 - DNA, 20 bp, Homo sapiens
ggatgctccgaggactggac

SEQ ID NO: 1200573 - DNA, 16 bp, Homo sapiens
ggatgctgacccagga

SEQ ID NO: 1200574 - DNA, 18 bp, Homo sapiens
ggatgctgggctgggccc

SEQ ID NO: 1200575 - DNA, 18 bp, Homo sapiens
ggatgctggtggctggtg

SEQ ID NO: 1200576 - DNA, 14 bp, Homo sapiens
ggatggaaaaataa

SEQ ID NO: 1200577 - DNA, 20 bp, Homo sapiens
ggatggacactaatgcagcc

SEQ ID NO: 1200578 - DNA, 17 bp, Homo sapiens
ggatggacagacacctc

SEQ ID NO: 1200579 - DNA, 19 bp, Homo sapiens
ggatggacagacacctccc

SEQ ID NO: 1200580 - DNA, 23 bp, Homo sapiens
ggatggaccaacctgctctgtcc

SEQ ID NO: 1200581 - DNA, 16 bp, Homo sapiens
ggatggagaggcggcc

SEQ ID NO: 1200582 - DNA, 14 bp, Homo sapiens
ggatggaggagaag

SEQ ID NO: 1200583 - DNA, 14 bp, Homo sapiens
ggatggaggccaga

SEQ ID NO: 1200584 - DNA, 15 bp, Homo sapiens
ggatggaggccagag

SEQ ID NO: 1200585 - DNA, 16 bp, Homo sapiens
ggatggaggccagagt

SEQ ID NO: 1200586 - DNA, 19 bp, Homo sapiens
ggatggaggggtggtcctg

SEQ ID NO: 1200587 - DNA, 12 bp, Homo sapiens
ggatggagggtc

SEQ ID NO: 1200588 - DNA, 16 bp, Homo sapiens
ggatggatgagtcaga

SEQ ID NO: 1200589 - DNA, 14 bp, Homo sapiens
ggatggcacaatga

SEQ ID NO: 1200590 - DNA, 15 bp, Homo sapiens
ggatggcacaatgaa

SEQ ID NO: 1200591 - DNA, 12 bp, Homo sapiens
ggatggcagact

SEQ ID NO: 1200592 - DNA, 14 bp, Homo sapiens
ggatggcagactct

SEQ ID NO: 1200593 - DNA, 20 bp, Homo sapiens
ggatggcatctccatgtaga

SEQ ID NO: 1200594 - DNA, 20 bp, Homo sapiens
ggatggcatttggtctcagg

SEQ ID NO: 1200595 - DNA, 20 bp, Homo sapiens
ggatggcccagcaggcaggc

SEQ ID NO: 1200596 - DNA, 13 bp, Homo sapiens
ggatggcccctcc

SEQ ID NO: 1200597 - DNA, 19 bp, Homo sapiens
ggatggcccctccttgcaa

SEQ ID NO: 1200598 - DNA, 18 bp, Homo sapiens
ggatggccgtggatggcc

SEQ ID NO: 1200599 - DNA, 17 bp, Homo sapiens
ggatggcctttccttcc

SEQ ID NO: 1200600 - DNA, 14 bp, Homo sapiens
ggatgggaggagag

SEQ ID NO: 1200601 - DNA, 16 bp, Homo sapiens
ggatgggaggagagcc

SEQ ID NO: 1200602 - DNA, 22 bp, Homo sapiens
ggatgggatcctctccaccctc

SEQ ID NO: 1200603 - DNA, 13 bp, Homo sapiens
ggatgggcctggc

SEQ ID NO: 1200604 - DNA, 14 bp, Homo sapiens
ggatgggctgagct

SEQ ID NO: 1200605 - DNA, 16 bp, Homo sapiens
ggatgggctgagctag

SEQ ID NO: 1200606 - DNA, 12 bp, Homo sapiens
ggatggggaggg

SEQ ID NO: 1200607 - DNA, 15 bp, Homo sapiens
ggatggggctcccag

SEQ ID NO: 1200608 - DNA, 21 bp, Homo sapiens
ggatggggtatggattctaaa

SEQ ID NO: 1200609 - DNA, 16 bp, Homo sapiens
ggatgggtcagagcta

SEQ ID NO: 1200610 - DNA, 12 bp, Homo sapiens
ggatgggtcccc

SEQ ID NO: 1200611 - DNA, 14 bp, Homo sapiens
ggatgggtgtggga

SEQ ID NO: 1200612 - DNA, 16 bp, Homo sapiens
ggatggtcctggggct

SEQ ID NO: 1200613 - DNA, 22 bp, Homo sapiens
ggatggtcctggggctctgtgc

SEQ ID NO: 1200614 - DNA, 16 bp, Homo sapiens
ggatggtggcacaggc

SEQ ID NO: 1200615 - DNA, 17 bp, Homo sapiens
ggatggtggcacaggca

SEQ ID NO: 1200616 - DNA, 18 bp, Homo sapiens
ggatgtaaacagtgcctg

SEQ ID NO: 1200617 - DNA, 19 bp, Homo sapiens
ggatgtaaacagtgcctgc

SEQ ID NO: 1200618 - DNA, 21 bp, Homo sapiens
ggatgtaaacagtgcctgctg

SEQ ID NO: 1200619 - DNA, 21 bp, Homo sapiens
ggatgtacttaagagtggcat

SEQ ID NO: 1200620 - DNA, 11 bp, Homo sapiens
ggatgtagaac

SEQ ID NO: 1200621 - DNA, 18 bp, Homo sapiens
ggatgtagagagaacagg

SEQ ID NO: 1200622 - DNA, 17 bp, Homo sapiens
ggatgtagtgattaaat

SEQ ID NO: 1200623 - DNA, 14 bp, Homo sapiens
ggatgtataaattt

SEQ ID NO: 1200624 - DNA, 15 bp, Homo sapiens
ggatgtcacagggcc

SEQ ID NO: 1200625 - DNA, 16 bp, Homo sapiens
ggatgtcccctgtccc

SEQ ID NO: 1200626 - DNA, 14 bp, Homo sapiens
ggatgtccctgggc

SEQ ID NO: 1200627 - DNA, 18 bp, Homo sapiens
ggatgtccctgggccagg

SEQ ID NO: 1200628 - DNA, 13 bp, Homo sapiens
ggatgtcttcctt

SEQ ID NO: 1200629 - DNA, 18 bp, Homo sapiens
ggatgtgattgtggaatg

SEQ ID NO: 1200630 - DNA, 18 bp, Homo sapiens
ggatgtggaacctgttta

SEQ ID NO: 1200631 - DNA, 15 bp, Homo sapiens
ggatgtgggagggag

SEQ ID NO: 1200632 - DNA, 18 bp, Homo sapiens
ggatgtgtagccttctcc

SEQ ID NO: 1200633 - DNA, 15 bp, Homo sapiens
ggatgtgtgctttcc

SEQ ID NO: 1200634 - DNA, 17 bp, Homo sapiens
ggatgtgtgggccagga

SEQ ID NO: 1200635 - DNA, 18 bp, Homo sapiens
ggatgtgtgtctcacccc

SEQ ID NO: 1200636 - DNA, 15 bp, Homo sapiens
ggatgttatgaacag

SEQ ID NO: 1200637 - DNA, 20 bp, Homo sapiens
ggatgttatgaacagctgtg

SEQ ID NO: 1200638 - DNA, 23 bp, Homo sapiens
ggatgttattatccttgggggct

SEQ ID NO: 1200639 - DNA, 20 bp, Homo sapiens
ggatgttcagcactgtccct

SEQ ID NO: 1200640 - DNA, 23 bp, Homo sapiens
ggatgttggccaccaggtgcctt

SEQ ID NO: 1200641 - DNA, 18 bp, Homo sapiens
ggatgtttttcatgaaaa

SEQ ID NO: 1200642 - DNA, 17 bp, Homo sapiens
ggattaaaacaattttt

SEQ ID NO: 1200643 - DNA, 18 bp, Homo sapiens
ggattaaaacaatttttt

SEQ ID NO: 1200644 - DNA, 13 bp, Homo sapiens
ggattaaactcag

SEQ ID NO: 1200645 - DNA, 17 bp, Homo sapiens
ggattaacctctgcact

SEQ ID NO: 1200646 - DNA, 18 bp, Homo sapiens
ggattaacctctgcacta

SEQ ID NO: 1200647 - DNA, 14 bp, Homo sapiens
ggattaatatgaaa

SEQ ID NO: 1200648 - DNA, 19 bp, Homo sapiens
ggattacaggcatgagcca

SEQ ID NO: 1200649 - DNA, 20 bp, Homo sapiens
ggattacaggcatgagccac

SEQ ID NO: 1200650 - DNA, 16 bp, Homo sapiens
ggattacaggcatgtg

SEQ ID NO: 1200651 - DNA, 22 bp, Homo sapiens
ggattattcatttaaaatgatt

SEQ ID NO: 1200652 - DNA, 19 bp, Homo sapiens
ggattattctttgaaaaca

SEQ ID NO: 1200653 - DNA, 18 bp, Homo sapiens
ggattatttagaatatgt

SEQ ID NO: 1200654 - DNA, 16 bp, Homo sapiens
ggattcaggggctttg

SEQ ID NO: 1200655 - DNA, 14 bp, Homo sapiens
ggattcatttcctg

SEQ ID NO: 1200656 - DNA, 17 bp, Homo sapiens
ggattcatttcctgccc

SEQ ID NO: 1200657 - DNA, 22 bp, Homo sapiens
ggattcccaccaaggtcttcag

SEQ ID NO: 1200658 - DNA, 15 bp, Homo sapiens
ggattcccccagcca

SEQ ID NO: 1200659 - DNA, 18 bp, Homo sapiens
ggattccccctgccctgt

SEQ ID NO: 1200660 - DNA, 11 bp, Homo sapiens
ggattcccttc

SEQ ID NO: 1200661 - DNA, 11 bp, Homo sapiens
ggattcccttt

SEQ ID NO: 1200662 - DNA, 22 bp, Homo sapiens
ggattcctaaatattttcaaga

SEQ ID NO: 1200663 - DNA, 13 bp, Homo sapiens
ggattcctgaccc

SEQ ID NO: 1200664 - DNA, 16 bp, Homo sapiens
ggattcctgagctggc

SEQ ID NO: 1200665 - DNA, 20 bp, Homo sapiens
ggattctactttaagcacta

SEQ ID NO: 1200666 - DNA, 20 bp, Homo sapiens
ggattctcatgggaagggga

SEQ ID NO: 1200667 - DNA, 16 bp, Homo sapiens
ggattctctactgcca

SEQ ID NO: 1200668 - DNA, 20 bp, Homo sapiens
ggattctgaggccctgccca

SEQ ID NO: 1200669 - DNA, 21 bp, Homo sapiens
ggattctgaggccctgcccaa

SEQ ID NO: 1200670 - DNA, 13 bp, Homo sapiens
ggattctgggagg

SEQ ID NO: 1200671 - DNA, 14 bp, Homo sapiens
ggattctggttcca

SEQ ID NO: 1200672 - DNA, 23 bp, Homo sapiens
ggattctgtgcctccaggaccag

SEQ ID NO: 1200673 - DNA, 19 bp, Homo sapiens
ggattcttaattctctgca

SEQ ID NO: 1200674 - DNA, 14 bp, Homo sapiens
ggattctttccatt

SEQ ID NO: 1200675 - DNA, 14 bp, Homo sapiens
ggattgaagccctc

SEQ ID NO: 1200676 - DNA, 13 bp, Homo sapiens
ggattgagtctgt

SEQ ID NO: 1200677 - DNA, 15 bp, Homo sapiens
ggattgcacgtggcc

SEQ ID NO: 1200678 - DNA, 12 bp, Homo sapiens
ggattgccacag

SEQ ID NO: 1200679 - DNA, 14 bp, Homo sapiens
ggattgccacagct

SEQ ID NO: 1200680 - DNA, 23 bp, Homo sapiens
ggattgctttgcattactgtccc

SEQ ID NO: 1200681 - DNA, 15 bp, Homo sapiens
ggattggacagtaga

SEQ ID NO: 1200682 - DNA, 17 bp, Homo sapiens
ggattggggtccctcta

SEQ ID NO: 1200683 - DNA, 20 bp, Homo sapiens
ggattgtccctgtgttgtcc

SEQ ID NO: 1200684 - DNA, 13 bp, Homo sapiens
ggattgtggaaaa

SEQ ID NO: 1200685 - DNA, 18 bp, Homo sapiens
ggatttaaaaactggaac

SEQ ID NO: 1200686 - DNA, 16 bp, Homo sapiens
ggatttaaaagcctgc

SEQ ID NO: 1200687 - DNA, 18 bp, Homo sapiens
ggatttaaaagcctgctc

SEQ ID NO: 1200688 - DNA, 19 bp, Homo sapiens
ggatttaaaagcctgctca

SEQ ID NO: 1200689 - DNA, 22 bp, Homo sapiens
ggatttaacagaaatgtacagc

SEQ ID NO: 1200690 - DNA, 14 bp, Homo sapiens
ggatttaatttcca

SEQ ID NO: 1200691 - DNA, 16 bp, Homo sapiens
ggatttataaatgcta

SEQ ID NO: 1200692 - DNA, 20 bp, Homo sapiens
ggatttattatataaatata

SEQ ID NO: 1200693 - DNA, 19 bp, Homo sapiens
ggatttatttaaaatagca

SEQ ID NO: 1200694 - DNA, 22 bp, Homo sapiens
ggatttctaacagtccttgctt

SEQ ID NO: 1200695 - DNA, 19 bp, Homo sapiens
ggatttgaacttgctcttt

SEQ ID NO: 1200696 - DNA, 13 bp, Homo sapiens
ggatttgaagcaa

SEQ ID NO: 1200697 - DNA, 16 bp, Homo sapiens
ggatttgcatatttat

SEQ ID NO: 1200698 - DNA, 15 bp, Homo sapiens
ggatttgttgccatg

SEQ ID NO: 1200699 - DNA, 15 bp, Homo sapiens
ggattttaatttcag

SEQ ID NO: 1200700 - DNA, 15 bp, Homo sapiens
ggattttaccaaagc

SEQ ID NO: 1200701 - DNA, 16 bp, Homo sapiens
ggatttttagaattaa

SEQ ID NO: 1200702 - DNA, 16 bp, Homo sapiens
ggatttttcagaaaaa

SEQ ID NO: 1200703 - DNA, 18 bp, Homo sapiens
ggattttttatgtacaac

SEQ ID NO: 1200704 - DNA, 21 bp, Homo sapiens
ggattttttatgtacaaccct

SEQ ID NO: 1200705 - DNA, 23 bp, Homo sapiens
ggattttttatgtacaaccctga

SEQ ID NO: 1200706 - DNA, 22 bp, Homo sapiens
ggcaaaaagaatcccaatgttt

SEQ ID NO: 1200707 - DNA, 15 bp, Homo sapiens
ggcaaaaaggcagga

SEQ ID NO: 1200708 - DNA, 12 bp, Homo sapiens
ggcaaaactcta

SEQ ID NO: 1200709 - DNA, 21 bp, Homo sapiens
ggcaaaagcccattgaagaag

SEQ ID NO: 1200710 - DNA, 18 bp, Homo sapiens
ggcaaaagggcagctgtg

SEQ ID NO: 1200711 - DNA, 20 bp, Homo sapiens
ggcaaaagggcagctgtgat

SEQ ID NO: 1200712 - DNA, 22 bp, Homo sapiens
ggcaaaatcgccataggccaag

SEQ ID NO: 1200713 - DNA, 18 bp, Homo sapiens
ggcaaaatcttgttaatg

SEQ ID NO: 1200714 - DNA, 14 bp, Homo sapiens
ggcaaacctttccc

SEQ ID NO: 1200715 - DNA, 17 bp, Homo sapiens
ggcaaacttcagactga

SEQ ID NO: 1200716 - DNA, 19 bp, Homo sapiens
ggcaaagagctcccgagga

SEQ ID NO: 1200717 - DNA, 22 bp, Homo sapiens
ggcaaagagctcccgaggaagc

SEQ ID NO: 1200718 - DNA, 19 bp, Homo sapiens
ggcaaagatggtggctgtg

SEQ ID NO: 1200719 - DNA, 19 bp, Homo sapiens
ggcaaagccacaaggctgg

SEQ ID NO: 1200720 - DNA, 20 bp, Homo sapiens
ggcaaagccacaaggctggc

SEQ ID NO: 1200721 - DNA, 17 bp, Homo sapiens
ggcaaaggaaggtggat

SEQ ID NO: 1200722 - DNA, 17 bp, Homo sapiens
ggcaaaggacatgaaca

SEQ ID NO: 1200723 - DNA, 16 bp, Homo sapiens
ggcaaaggcagaggaa

SEQ ID NO: 1200724 - DNA, 12 bp, Homo sapiens
ggcaaaggcagg

SEQ ID NO: 1200725 - DNA, 12 bp, Homo sapiens
ggcaaataaaag

SEQ ID NO: 1200726 - DNA, 19 bp, Homo sapiens
ggcaaataatggaaaaata

SEQ ID NO: 1200727 - DNA, 15 bp, Homo sapiens
ggcaaatattgaagt

SEQ ID NO: 1200728 - DNA, 16 bp, Homo sapiens
ggcaaatattgaagtt

SEQ ID NO: 1200729 - DNA, 18 bp, Homo sapiens
ggcaaatcaggggccaga

SEQ ID NO: 1200730 - DNA, 19 bp, Homo sapiens
ggcaaatcaggggccagag

SEQ ID NO: 1200731 - DNA, 15 bp, Homo sapiens
ggcaaatgccagggc

SEQ ID NO: 1200732 - DNA, 18 bp, Homo sapiens
ggcaaatgccagggcccg

SEQ ID NO: 1200733 - DNA, 13 bp, Homo sapiens
ggcaaatgggcag

SEQ ID NO: 1200734 - DNA, 15 bp, Homo sapiens
ggcaaattaactgta

SEQ ID NO: 1200735 - DNA, 14 bp, Homo sapiens
ggcaaattcttttg

SEQ ID NO: 1200736 - DNA, 17 bp, Homo sapiens
ggcaacactgctgtcca

SEQ ID NO: 1200737 - DNA, 11 bp, Homo sapiens
ggcaacattcc

SEQ ID NO: 1200738 - DNA, 17 bp, Homo sapiens
ggcaaccaactgcccca

SEQ ID NO: 1200739 - DNA, 18 bp, Homo sapiens
ggcaaccccagttctgct

SEQ ID NO: 1200740 - DNA, 21 bp, Homo sapiens
ggcaaccccctcggagcctgt

SEQ ID NO: 1200741 - DNA, 19 bp, Homo sapiens
ggcaaccttgtctctatgc

SEQ ID NO: 1200742 - DNA, 15 bp, Homo sapiens
ggcaacgaagaaaaa

SEQ ID NO: 1200743 - DNA, 20 bp, Homo sapiens
ggcaacgaagaaaaaaaata

SEQ ID NO: 1200744 - DNA, 16 bp, Homo sapiens
ggcaacgcacaaaaca

SEQ ID NO: 1200745 - DNA, 19 bp, Homo sapiens
ggcaacgtagcctgggctc

SEQ ID NO: 1200746 - DNA, 15 bp, Homo sapiens
ggcaactgaggcaga

SEQ ID NO: 1200747 - DNA, 23 bp, Homo sapiens
ggcaactgaggcagacagcagct

SEQ ID NO: 1200748 - DNA, 23 bp, Homo sapiens
ggacacaataggtctttctctca

SEQ ID NO: 1200749 - DNA, 13 bp, Homo sapiens
ggacacacaaggt

SEQ ID NO: 1200750 - DNA, 23 bp, Homo sapiens
ggacacaccccacaccccagccc

SEQ ID NO: 1200751 - DNA, 9 bp, Homo sapiens
ggacacact

SEQ ID NO: 1200752 - DNA, 13 bp, Homo sapiens
ggacacagcacaa

SEQ ID NO: 1200753 - DNA, 14 bp, Homo sapiens
ggacacagttcctg

SEQ ID NO: 1200754 - DNA, 17 bp, Homo sapiens
ggacacagttcctggga

SEQ ID NO: 1200755 - DNA, 19 bp, Homo sapiens
ggacacagttcctgggaac

SEQ ID NO: 1200756 - DNA, 21 bp, Homo sapiens
ggacacatcccggcctcttcc

SEQ ID NO: 1200757 - DNA, 16 bp, Homo sapiens
ggacacatgcccctcc

SEQ ID NO: 1200758 - DNA, 13 bp, Homo sapiens
ggacaccaggagt

SEQ ID NO: 1200759 - DNA, 21 bp, Homo sapiens
ggacaccattaccaaaataat

SEQ ID NO: 1200760 - DNA, 13 bp, Homo sapiens
ggacacccctgct

SEQ ID NO: 1200761 - DNA, 14 bp, Homo sapiens
ggacacccctgctc

SEQ ID NO: 1200762 - DNA, 15 bp, Homo sapiens
ggacacccctgctct

SEQ ID NO: 1200763 - DNA, 21 bp, Homo sapiens
ggacaccccttatccaggact

SEQ ID NO: 1200764 - DNA, 15 bp, Homo sapiens
ggacaccgggccagt

SEQ ID NO: 1200765 - DNA, 15 bp, Homo sapiens
ggacaccgtggcctg

SEQ ID NO: 1200766 - DNA, 16 bp, Homo sapiens
ggacaccgtggcctgg

SEQ ID NO: 1200767 - DNA, 17 bp, Homo sapiens
ggacaccgtggcctggg

SEQ ID NO: 1200768 - DNA, 16 bp, Homo sapiens
ggacacctcccagggg

SEQ ID NO: 1200769 - DNA, 18 bp, Homo sapiens
ggacacctcccaggggac

SEQ ID NO: 1200770 - DNA, 14 bp, Homo sapiens
ggacacctgccctg

SEQ ID NO: 1200771 - DNA, 17 bp, Homo sapiens
ggacacctgggccgggc

SEQ ID NO: 1200772 - DNA, 18 bp, Homo sapiens
ggacacctgtaatgtaac

SEQ ID NO: 1200773 - DNA, 13 bp, Homo sapiens
ggacacgagccac

SEQ ID NO: 1200774 - DNA, 21 bp, Homo sapiens
ggacacgagccacaagctgca

SEQ ID NO: 1200775 - DNA, 15 bp, Homo sapiens
ggacactacacccag

SEQ ID NO: 1200776 - DNA, 16 bp, Homo sapiens
ggacactacacccagc

SEQ ID NO: 1200777 - DNA, 19 bp, Homo sapiens
ggacactacacccagcaat

SEQ ID NO: 1200778 - DNA, 14 bp, Homo sapiens
ggacactccagtgc

SEQ ID NO: 1200779 - DNA, 21 bp, Homo sapiens
ggacactccagtgccagcaat

SEQ ID NO: 1200780 - DNA, 17 bp, Homo sapiens
ggacactgacagccttt

SEQ ID NO: 1200781 - DNA, 17 bp, Homo sapiens
ggacactgccttagcct

SEQ ID NO: 1200782 - DNA, 20 bp, Homo sapiens
ggacactgccttagcctctt

SEQ ID NO: 1200783 - DNA, 20 bp, Homo sapiens
ggacactgtggagactttct

SEQ ID NO: 1200784 - DNA, 17 bp, Homo sapiens
ggacacttccctctgtt

SEQ ID NO: 1200785 - DNA, 18 bp, Homo sapiens
ggacacttccctctgttt

SEQ ID NO: 1200786 - DNA, 17 bp, Homo sapiens
ggacacttccctgggcc

SEQ ID NO: 1200787 - DNA, 14 bp, Homo sapiens
ggacacttcctgcc

SEQ ID NO: 1200788 - DNA, 23 bp, Homo sapiens
ggacactttgaaatgtgtttctg

SEQ ID NO: 1200789 - DNA, 22 bp, Homo sapiens
ggacagaacattgccttcctcg

SEQ ID NO: 1200790 - DNA, 14 bp, Homo sapiens
ggacagacacctcc

SEQ ID NO: 1200791 - DNA, 15 bp, Homo sapiens
ggacagacacctccc

SEQ ID NO: 1200792 - DNA, 22 bp, Homo sapiens
ggacagacagatgttgggagga

SEQ ID NO: 1200793 - DNA, 23 bp, Homo sapiens
ggacagactcacaacctgaacct

SEQ ID NO: 1200794 - DNA, 17 bp, Homo sapiens
ggacagagacacctgca

SEQ ID NO: 1200795 - DNA, 21 bp, Homo sapiens
ggacagagacacctgcacctc

SEQ ID NO: 1200796 - DNA, 17 bp, Homo sapiens
ggacagagcaggggctc

SEQ ID NO: 1200797 - DNA, 12 bp, Homo sapiens
ggacagagccac

SEQ ID NO: 1200798 - DNA, 15 bp, Homo sapiens
ggacagaggccaagg

SEQ ID NO: 1200799 - DNA, 18 bp, Homo sapiens
ggacagaggccaaggact

SEQ ID NO: 1200800 - DNA, 14 bp, Homo sapiens
ggacagaggccggg

SEQ ID NO: 1200801 - DNA, 23 bp, Homo sapiens
ggacagaggggactctgggctat

SEQ ID NO: 1200802 - DNA, 22 bp, Homo sapiens
ggacagagtggtttccaatgtg

SEQ ID NO: 1200803 - DNA, 19 bp, Homo sapiens
ggacagatagacagtgctg

SEQ ID NO: 1200804 - DNA, 21 bp, Homo sapiens
ggacagatggacgcaggccct

SEQ ID NO: 1200805 - DNA, 22 bp, Homo sapiens
ggacagatggacgcaggccctg

SEQ ID NO: 1200806 - DNA, 19 bp, Homo sapiens
ggacagatggcccaaggga

SEQ ID NO: 1200807 - DNA, 21 bp, Homo sapiens
ggacagcaaaaccattgcttc

SEQ ID NO: 1200808 - DNA, 14 bp, Homo sapiens
ggacagcagaagcc

SEQ ID NO: 1200809 - DNA, 14 bp, Homo sapiens
ggacagcagcactc

SEQ ID NO: 1200810 - DNA, 22 bp, Homo sapiens
ggacagcagcactcccgctgca

SEQ ID NO: 1200811 - DNA, 21 bp, Homo sapiens
ggacagcatgccccttggctg

SEQ ID NO: 1200812 - DNA, 22 bp, Homo sapiens
ggacagcatgccccttggctgg

SEQ ID NO: 1200813 - DNA, 14 bp, Homo sapiens
ggacagccagcagc

SEQ ID NO: 1200814 - DNA, 18 bp, Homo sapiens
ggacagcccagagcctgg

SEQ ID NO: 1200815 - DNA, 22 bp, Homo sapiens
ggacagcctgtggcggtgcctg

SEQ ID NO: 1200816 - DNA, 13 bp, Homo sapiens
ggacagcggcagt

SEQ ID NO: 1200817 - DNA, 13 bp, Homo sapiens
ggacagcttcctc

SEQ ID NO: 1200818 - DNA, 14 bp, Homo sapiens
ggacagcttcctca

SEQ ID NO: 1200819 - DNA, 12 bp, Homo sapiens
ggacagcttgtg

SEQ ID NO: 1200820 - DNA, 22 bp, Homo sapiens
ggacagcttgtggcaagtgaat

SEQ ID NO: 1200821 - DNA, 23 bp, Homo sapiens
ggacagctttgctccgctcccac

SEQ ID NO: 1200822 - DNA, 15 bp, Homo sapiens
ggacaggaccccagc

SEQ ID NO: 1200823 - DNA, 17 bp, Homo sapiens
ggacaggaccccagctc

SEQ ID NO: 1200824 - DNA, 14 bp, Homo sapiens
ggacaggagcctgg

SEQ ID NO: 1200825 - DNA, 17 bp, Homo sapiens
ggacaggagcctggtcc

SEQ ID NO: 1200826 - DNA, 16 bp, Homo sapiens
ggacaggcagcctcct

SEQ ID NO: 1200827 - DNA, 16 bp, Homo sapiens
ggacaggcaggccaga

SEQ ID NO: 1200828 - DNA, 11 bp, Homo sapiens
ggacaggcccg

SEQ ID NO: 1200829 - DNA, 16 bp, Homo sapiens
ggacaggccgcagctc

SEQ ID NO: 1200830 - DNA, 14 bp, Homo sapiens
ggacaggctctgct

SEQ ID NO: 1200831 - DNA, 13 bp, Homo sapiens
ggacaggctggaa

SEQ ID NO: 1200832 - DNA, 22 bp, Homo sapiens
ggacagggaatgctgaggcctc

SEQ ID NO: 1200833 - DNA, 15 bp, Homo sapiens
ggacagggaggggga

SEQ ID NO: 1200834 - DNA, 11 bp, Homo sapiens
ggacagggcca

SEQ ID NO: 1200835 - DNA, 16 bp, Homo sapiens
ggacagggccagggtt

SEQ ID NO: 1200836 - DNA, 18 bp, Homo sapiens
ggacagggccagggttgc

SEQ ID NO: 1200837 - DNA, 22 bp, Homo sapiens
ggacagggggaagttcagaagg

SEQ ID NO: 1200838 - DNA, 20 bp, Homo sapiens
ggacaggtgggcctggcggc

SEQ ID NO: 1200839 - DNA, 13 bp, Homo sapiens
ggacaggtggggc

SEQ ID NO: 1200840 - DNA, 13 bp, Homo sapiens
ggacagtcctggg

SEQ ID NO: 1200841 - DNA, 22 bp, Homo sapiens
ggacagtgataggcccaaggtc

SEQ ID NO: 1200842 - DNA, 18 bp, Homo sapiens
ggacagtgcttcagcctg

SEQ ID NO: 1200843 - DNA, 17 bp, Homo sapiens
ggacagtggcctcttga

SEQ ID NO: 1200844 - DNA, 17 bp, Homo sapiens
ggacagttacaaaccag

SEQ ID NO: 1200845 - DNA, 22 bp, Homo sapiens
ggacagttacaaaccaggtcac

SEQ ID NO: 1200846 - DNA, 23 bp, Homo sapiens
ggacataaatcacagaaaattta

SEQ ID NO: 1200847 - DNA, 16 bp, Homo sapiens
ggacatactgctggag

SEQ ID NO: 1200848 - DNA, 12 bp, Homo sapiens
ggacatcagcaa

SEQ ID NO: 1200849 - DNA, 14 bp, Homo sapiens
ggacatcagctggt

SEQ ID NO: 1200850 - DNA, 16 bp, Homo sapiens
ggacatcctcctccca

SEQ ID NO: 1200851 - DNA, 18 bp, Homo sapiens
ggacatcctgtataagca

SEQ ID NO: 1200852 - DNA, 15 bp, Homo sapiens
ggacatctctctggc

SEQ ID NO: 1200853 - DNA, 17 bp, Homo sapiens
ggacatctctctggctt

SEQ ID NO: 1200854 - DNA, 18 bp, Homo sapiens
ggacatctctctggcttc

SEQ ID NO: 1200855 - DNA, 22 bp, Homo sapiens
ggacatctctctggcttctgaa

SEQ ID NO: 1200856 - DNA, 22 bp, Homo sapiens
ggacatgagatggagaggctga

SEQ ID NO: 1200857 - DNA, 21 bp, Homo sapiens
ggacatgcggtagccagcaca

SEQ ID NO: 1200858 - DNA, 16 bp, Homo sapiens
ggacatgcgtgtgtca

SEQ ID NO: 1200859 - DNA, 17 bp, Homo sapiens
ggacatgcgtgtgtcag

SEQ ID NO: 1200860 - DNA, 21 bp, Homo sapiens
ggacatgctcacctctagcct

SEQ ID NO: 1200861 - DNA, 20 bp, Homo sapiens
ggacatgcttttctgccact

SEQ ID NO: 1200862 - DNA, 16 bp, Homo sapiens
ggacatggggcaagcc

SEQ ID NO: 1200863 - DNA, 22 bp, Homo sapiens
ggacatggttgggggaatgcac

SEQ ID NO: 1200864 - DNA, 15 bp, Homo sapiens
ggacattcactgctg

SEQ ID NO: 1200865 - DNA, 24 bp, Homo sapiens
ggacattgcagagtggcctagagc

SEQ ID NO: 1200866 - DNA, 15 bp, Homo sapiens
ggacattgtatgcag

SEQ ID NO: 1200867 - DNA, 12 bp, Homo sapiens
ggaccaaagcaa

SEQ ID NO: 1200868 - DNA, 23 bp, Homo sapiens
ggaccaaagggaagtgaggccca

SEQ ID NO: 1200869 - DNA, 14 bp, Homo sapiens
ggaccaaaggggga

SEQ ID NO: 1200870 - DNA, 17 bp, Homo sapiens
ggaccaaagggggagtc

SEQ ID NO: 1200871 - DNA, 17 bp, Homo sapiens
ggaccaaccctgtttcc

SEQ ID NO: 1200872 - DNA, 15 bp, Homo sapiens
ggaccaacctgctct

SEQ ID NO: 1200873 - DNA, 18 bp, Homo sapiens
ctctcatgtccctccagg

SEQ ID NO: 1200874 - DNA, 20 bp, Homo sapiens
ctctcatgttttcaactgcc

SEQ ID NO: 1200875 - DNA, 15 bp, Homo sapiens
ctctcattccccagg

SEQ ID NO: 1200876 - DNA, 21 bp, Homo sapiens
ctctcattccccaggtggctg

SEQ ID NO: 1200877 - DNA, 22 bp, Homo sapiens
ctctccaaatattattcaagtg

SEQ ID NO: 1200878 - DNA, 16 bp, Homo sapiens
ctctccaaccactgtg

SEQ ID NO: 1200879 - DNA, 17 bp, Homo sapiens
ctctccaaccactgtgc

SEQ ID NO: 1200880 - DNA, 21 bp, Homo sapiens
ctctccaaccactgtgccact

SEQ ID NO: 1200881 - DNA, 23 bp, Homo sapiens
ctctccaaccactgtgccactga

SEQ ID NO: 1200882 - DNA, 21 bp, Homo sapiens
ctctccaactgcctaaggccc

SEQ ID NO: 1200883 - DNA, 22 bp, Homo sapiens
ctctccaagggcttctgcaccc

SEQ ID NO: 1200884 - DNA, 23 bp, Homo sapiens
ctctccaagggcttctgcaccct

SEQ ID NO: 1200885 - DNA, 18 bp, Homo sapiens
ctctccaagtctctctgt

SEQ ID NO: 1200886 - DNA, 14 bp, Homo sapiens
ctctccaagtgcca

SEQ ID NO: 1200887 - DNA, 16 bp, Homo sapiens
ctctccaagtgccaga

SEQ ID NO: 1200888 - DNA, 20 bp, Homo sapiens
ctctccaagtgccagaggtg

SEQ ID NO: 1200889 - DNA, 13 bp, Homo sapiens
ctctccacagtgt

SEQ ID NO: 1200890 - DNA, 15 bp, Homo sapiens
ctctccacagtgttg

SEQ ID NO: 1200891 - DNA, 23 bp, Homo sapiens
ctctccacagtgttgtgcccctt

SEQ ID NO: 1200892 - DNA, 12 bp, Homo sapiens
ctctccacctca

SEQ ID NO: 1200893 - DNA, 14 bp, Homo sapiens
ctctccactcttct

SEQ ID NO: 1200894 - DNA, 22 bp, Homo sapiens
ctctccactcttctctcctttc

SEQ ID NO: 1200895 - DNA, 11 bp, Homo sapiens
ctctccactgc

SEQ ID NO: 1200896 - DNA, 12 bp, Homo sapiens
ctctccactgcc

SEQ ID NO: 1200897 - DNA, 14 bp, Homo sapiens
ctctccactgcctt

SEQ ID NO: 1200898 - DNA, 15 bp, Homo sapiens
ctctccactgccttc

SEQ ID NO: 1200899 - DNA, 15 bp, Homo sapiens
ctctccactgctgga

SEQ ID NO: 1200900 - DNA, 18 bp, Homo sapiens
ctctccagaaacagctgc

SEQ ID NO: 1200901 - DNA, 22 bp, Homo sapiens
ctctccagaaacagctgcttct

SEQ ID NO: 1200902 - DNA, 15 bp, Homo sapiens
ctctccagctgacta

SEQ ID NO: 1200903 - DNA, 12 bp, Homo sapiens
ctctccaggcca

SEQ ID NO: 1200904 - DNA, 13 bp, Homo sapiens
ctctccaggccag

SEQ ID NO: 1200905 - DNA, 17 bp, Homo sapiens
ctctccaggccaggtgg

SEQ ID NO: 1200906 - DNA, 15 bp, Homo sapiens
ctctccagggtgctt

SEQ ID NO: 1200907 - DNA, 23 bp, Homo sapiens
ctctccagtttgcacctgtcccc

SEQ ID NO: 1200908 - DNA, 11 bp, Homo sapiens
ctctccatatc

SEQ ID NO: 1200909 - DNA, 23 bp, Homo sapiens
ctctccatgttggcctgtcacca

SEQ ID NO: 1200910 - DNA, 21 bp, Homo sapiens
ctctccattcccgtggaacgt

SEQ ID NO: 1200911 - DNA, 13 bp, Homo sapiens
ctctcccaaaaaa

SEQ ID NO: 1200912 - DNA, 14 bp, Homo sapiens
ctctcccaactctt

SEQ ID NO: 1200913 - DNA, 15 bp, Homo sapiens
ctctcccaagtccac

SEQ ID NO: 1200914 - DNA, 11 bp, Homo sapiens
ctctcccaccc

SEQ ID NO: 1200915 - DNA, 21 bp, Homo sapiens
ctctcccaccccggcctccac

SEQ ID NO: 1200916 - DNA, 14 bp, Homo sapiens
ctctcccacccggc

SEQ ID NO: 1200917 - DNA, 15 bp, Homo sapiens
ctctcccacccggcc

SEQ ID NO: 1200918 - DNA, 17 bp, Homo sapiens
ctctcccaccctaaggg

SEQ ID NO: 1200919 - DNA, 17 bp, Homo sapiens
ctctcccacttcctcct

SEQ ID NO: 1200920 - DNA, 13 bp, Homo sapiens
ctctcccagtgaa

SEQ ID NO: 1200921 - DNA, 23 bp, Homo sapiens
ctctcccagtgaactcctgccag

SEQ ID NO: 1200922 - DNA, 20 bp, Homo sapiens
ctctcccatcacttccctac

SEQ ID NO: 1200923 - DNA, 16 bp, Homo sapiens
ctctcccatccccctg

SEQ ID NO: 1200924 - DNA, 20 bp, Homo sapiens
ctctcccatccccctgccct

SEQ ID NO: 1200925 - DNA, 16 bp, Homo sapiens
ctctcccatcctgggg

SEQ ID NO: 1200926 - DNA, 18 bp, Homo sapiens
ctctcccatcctggggca

SEQ ID NO: 1200927 - DNA, 21 bp, Homo sapiens
ctctcccatcctggggcagca

SEQ ID NO: 1200928 - DNA, 16 bp, Homo sapiens
ctctcccattgtccct

SEQ ID NO: 1200929 - DNA, 18 bp, Homo sapiens
ctctcccattgtccctct

SEQ ID NO: 1200930 - DNA, 21 bp, Homo sapiens
ctctcccattgtccctctgcc

SEQ ID NO: 1200931 - DNA, 16 bp, Homo sapiens
ctctcccatttcagga

SEQ ID NO: 1200932 - DNA, 18 bp, Homo sapiens
ctctccccaatccatgct

SEQ ID NO: 1200933 - DNA, 19 bp, Homo sapiens
ctctccccaatccatgctt

SEQ ID NO: 1200934 - DNA, 12 bp, Homo sapiens
ctctccccacac

SEQ ID NO: 1200935 - DNA, 13 bp, Homo sapiens
ctctccccacact

SEQ ID NO: 1200936 - DNA, 14 bp, Homo sapiens
ctctccccacacta

SEQ ID NO: 1200937 - DNA, 14 bp, Homo sapiens
ctctccccacccct

SEQ ID NO: 1200938 - DNA, 17 bp, Homo sapiens
ctctccccacccctacc

SEQ ID NO: 1200939 - DNA, 18 bp, Homo sapiens
ctctccccaggtccagct

SEQ ID NO: 1200940 - DNA, 12 bp, Homo sapiens
ctctccccagtg

SEQ ID NO: 1200941 - DNA, 16 bp, Homo sapiens
ctctccccagtgcctg

SEQ ID NO: 1200942 - DNA, 20 bp, Homo sapiens
ctctccccagtgcctgccac

SEQ ID NO: 1200943 - DNA, 21 bp, Homo sapiens
ctctccccagtgcctgccact

SEQ ID NO: 1200944 - DNA, 21 bp, Homo sapiens
ctctcccccaaccccctgcaa

SEQ ID NO: 1200945 - DNA, 22 bp, Homo sapiens
ctctcccccaaccccctgcaag

SEQ ID NO: 1200946 - DNA, 17 bp, Homo sapiens
ctctccccctatttatt

SEQ ID NO: 1200947 - DNA, 18 bp, Homo sapiens
ctctccccctcctccagg

SEQ ID NO: 1200948 - DNA, 15 bp, Homo sapiens
ctctccccctctgtc

SEQ ID NO: 1200949 - DNA, 16 bp, Homo sapiens
ctctccccctctgtct

SEQ ID NO: 1200950 - DNA, 19 bp, Homo sapiens
ctctcccccttcagctcct

SEQ ID NO: 1200951 - DNA, 23 bp, Homo sapiens
ctctcccccttggatttgaactt

SEQ ID NO: 1200952 - DNA, 21 bp, Homo sapiens
ctctccccggcaggcctgaga

SEQ ID NO: 1200953 - DNA, 15 bp, Homo sapiens
ctctcccctccctct

SEQ ID NO: 1200954 - DNA, 17 bp, Homo sapiens
ctctcccctcctgctgg

SEQ ID NO: 1200955 - DNA, 14 bp, Homo sapiens
ctctcccctctctg

SEQ ID NO: 1200956 - DNA, 15 bp, Homo sapiens
ctctcccctctctgc

SEQ ID NO: 1200957 - DNA, 17 bp, Homo sapiens
ctctcccctctctgctc

SEQ ID NO: 1200958 - DNA, 15 bp, Homo sapiens
ctctcccctgccctg

SEQ ID NO: 1200959 - DNA, 18 bp, Homo sapiens
ctctcccctgccctgctg

SEQ ID NO: 1200960 - DNA, 15 bp, Homo sapiens
ctctcccggctgcct

SEQ ID NO: 1200961 - DNA, 17 bp, Homo sapiens
ctctcccgtcagggccc

SEQ ID NO: 1200962 - DNA, 14 bp, Homo sapiens
ctctccctacctcc

SEQ ID NO: 1200963 - DNA, 15 bp, Homo sapiens
ctctccctacctccc

SEQ ID NO: 1200964 - DNA, 17 bp, Homo sapiens
ctctccctacctccctc

SEQ ID NO: 1200965 - DNA, 11 bp, Homo sapiens
ctctccctcag

SEQ ID NO: 1200966 - DNA, 17 bp, Homo sapiens
ctctccctcccctgcca

SEQ ID NO: 1200967 - DNA, 20 bp, Homo sapiens
ctctccctcgatcatatttc

SEQ ID NO: 1200968 - DNA, 15 bp, Homo sapiens
ctctccctctggtcc

SEQ ID NO: 1200969 - DNA, 12 bp, Homo sapiens
ctctccctgacc

SEQ ID NO: 1200970 - DNA, 14 bp, Homo sapiens
ctctccctggtctc

SEQ ID NO: 1200971 - DNA, 21 bp, Homo sapiens
ctctccctgtcacacactgga

SEQ ID NO: 1200972 - DNA, 22 bp, Homo sapiens
ctctcccttgtttactctgtta

SEQ ID NO: 1200973 - DNA, 17 bp, Homo sapiens
ctctccgaaagaagaca

SEQ ID NO: 1200974 - DNA, 22 bp, Homo sapiens
ctctccgacttcccctgggcaa

SEQ ID NO: 1200975 - DNA, 20 bp, Homo sapiens
ctctccgggcctttctctgg

SEQ ID NO: 1200976 - DNA, 16 bp, Homo sapiens
ctctcctagcccctct

SEQ ID NO: 1200977 - DNA, 20 bp, Homo sapiens
ctctcctcaatgctgggccc

SEQ ID NO: 1200978 - DNA, 17 bp, Homo sapiens
ctctcctcccagctgct

SEQ ID NO: 1200979 - DNA, 19 bp, Homo sapiens
ctctcctcccagctgcttt

SEQ ID NO: 1200980 - DNA, 20 bp, Homo sapiens
ctctcctcccagctgcttta

SEQ ID NO: 1200981 - DNA, 15 bp, Homo sapiens
ctctcctccccaaat

SEQ ID NO: 1200982 - DNA, 17 bp, Homo sapiens
ctctcctcgagccctcc

SEQ ID NO: 1200983 - DNA, 12 bp, Homo sapiens
ctctcctctctg

SEQ ID NO: 1200984 - DNA, 13 bp, Homo sapiens
ctctcctctctgc

SEQ ID NO: 1200985 - DNA, 14 bp, Homo sapiens
ctctcctcttgcca

SEQ ID NO: 1200986 - DNA, 22 bp, Homo sapiens
ctctcctcttgccactgcctct

SEQ ID NO: 1200987 - DNA, 12 bp, Homo sapiens
ctctcctgccta

SEQ ID NO: 1200988 - DNA, 13 bp, Homo sapiens
ctctcctgcctac

SEQ ID NO: 1200989 - DNA, 16 bp, Homo sapiens
ctctcctgcctcagcc

SEQ ID NO: 1200990 - DNA, 12 bp, Homo sapiens
ctctcctggctc

SEQ ID NO: 1200991 - DNA, 12 bp, Homo sapiens
ctctcctggtgt

SEQ ID NO: 1200992 - DNA, 13 bp, Homo sapiens
ctctcctgtctga

SEQ ID NO: 1200993 - DNA, 20 bp, Homo sapiens
ctctcctgtctgccctctgg

SEQ ID NO: 1200994 - DNA, 21 bp, Homo sapiens
ctctcctgtctgccctctggg

SEQ ID NO: 1200995 - DNA, 22 bp, Homo sapiens
ctctccttcatgacagcctcca

SEQ ID NO: 1200996 - DNA, 13 bp, Homo sapiens
ctctccttcccac

SEQ ID NO: 1200997 - DNA, 14 bp, Homo sapiens
ctctccttcctgtg

SEQ ID NO: 1200998 - DNA, 17 bp, Homo sapiens
ctctccttcgtgtctct

SEQ ID NO: 1200999 - DNA, 17 bp, Homo sapiens
ggaccaacctgctctgt

SEQ ID NO: 1201000 - DNA, 18 bp, Homo sapiens
ggaccaactggcttctgt

SEQ ID NO: 1201001 - DNA, 19 bp, Homo sapiens
ggaccaactggcttctgtg

SEQ ID NO: 1201002 - DNA, 16 bp, Homo sapiens
ggaccaagcatcttgg

SEQ ID NO: 1201003 - DNA, 19 bp, Homo sapiens
ggaccaagcgaccaaggat

SEQ ID NO: 1201004 - DNA, 24 bp, Homo sapiens
ggaccaattctggacagacagatg

SEQ ID NO: 1201005 - DNA, 22 bp, Homo sapiens
ggaccacaaaaatgaaagcatg

SEQ ID NO: 1201006 - DNA, 14 bp, Homo sapiens
ggaccacaggcatg

SEQ ID NO: 1201007 - DNA, 17 bp, Homo sapiens
ggaccacatctgtcctc

SEQ ID NO: 1201008 - DNA, 14 bp, Homo sapiens
ggaccacattttat

SEQ ID NO: 1201009 - DNA, 20 bp, Homo sapiens
ggaccaccagccccagcaag

SEQ ID NO: 1201010 - DNA, 21 bp, Homo sapiens
ggaccactcagcccctaggag

SEQ ID NO: 1201011 - DNA, 21 bp, Homo sapiens
ggaccactcctgtccctgtag

SEQ ID NO: 1201012 - DNA, 21 bp, Homo sapiens
ggaccactgggtgagagagga

SEQ ID NO: 1201013 - DNA, 14 bp, Homo sapiens
ggaccagcccattg

SEQ ID NO: 1201014 - DNA, 15 bp, Homo sapiens
ggaccagcctgtacc

SEQ ID NO: 1201015 - DNA, 17 bp, Homo sapiens
ggaccagcctgttggac

SEQ ID NO: 1201016 - DNA, 22 bp, Homo sapiens
ggaccagctggggcgtggggag

SEQ ID NO: 1201017 - DNA, 14 bp, Homo sapiens
ggaccaggacagga

SEQ ID NO: 1201018 - DNA, 21 bp, Homo sapiens
ggaccaggactatagcccagg

SEQ ID NO: 1201019 - DNA, 12 bp, Homo sapiens
ggaccaggcctg

SEQ ID NO: 1201020 - DNA, 21 bp, Homo sapiens
ggaccaggcctggagggcact

SEQ ID NO: 1201021 - DNA, 17 bp, Homo sapiens
ggaccagggccctgggc

SEQ ID NO: 1201022 - DNA, 14 bp, Homo sapiens
ggaccagggtggag

SEQ ID NO: 1201023 - DNA, 19 bp, Homo sapiens
ggaccagggtggagctgag

SEQ ID NO: 1201024 - DNA, 19 bp, Homo sapiens
ggaccagtcaacctgggca

SEQ ID NO: 1201025 - DNA, 20 bp, Homo sapiens
ggaccagtggtttccagtca

SEQ ID NO: 1201026 - DNA, 22 bp, Homo sapiens
ggaccagtggtttccagtcatg

SEQ ID NO: 1201027 - DNA, 17 bp, Homo sapiens
ggaccatctgctgcagt

SEQ ID NO: 1201028 - DNA, 18 bp, Homo sapiens
ggaccatctgctgcagtt

SEQ ID NO: 1201029 - DNA, 21 bp, Homo sapiens
ggaccatctgctgcagttacc

SEQ ID NO: 1201030 - DNA, 16 bp, Homo sapiens
ggaccatgtgtcactt

SEQ ID NO: 1201031 - DNA, 22 bp, Homo sapiens
ggaccatgtgtcacttgtgctt

SEQ ID NO: 1201032 - DNA, 20 bp, Homo sapiens
ggaccattgacctcagctgc

SEQ ID NO: 1201033 - DNA, 17 bp, Homo sapiens
ggacccaaagcaggatg

SEQ ID NO: 1201034 - DNA, 22 bp, Homo sapiens
ggacccacccatcttcctgctg

SEQ ID NO: 1201035 - DNA, 23 bp, Homo sapiens
ggacccacccatcttcctgctgc

SEQ ID NO: 1201036 - DNA, 21 bp, Homo sapiens
ggacccagaggaaggggccag

SEQ ID NO: 1201037 - DNA, 18 bp, Homo sapiens
ggacccagcgggcaggtt

SEQ ID NO: 1201038 - DNA, 22 bp, Homo sapiens
ggacccagctactctgtccagg

SEQ ID NO: 1201039 - DNA, 16 bp, Homo sapiens
ggacccagctcctctg

SEQ ID NO: 1201040 - DNA, 17 bp, Homo sapiens
ggacccagctcctctga

SEQ ID NO: 1201041 - DNA, 18 bp, Homo sapiens
ggacccagctcctctgag

SEQ ID NO: 1201042 - DNA, 21 bp, Homo sapiens
ggacccagctcctctgagcca

SEQ ID NO: 1201043 - DNA, 12 bp, Homo sapiens
ggacccaggctc

SEQ ID NO: 1201044 - DNA, 13 bp, Homo sapiens
ggacccaggctcc

SEQ ID NO: 1201045 - DNA, 13 bp, Homo sapiens
ggacccagggcct

SEQ ID NO: 1201046 - DNA, 19 bp, Homo sapiens
ggacccatagatcttctga

SEQ ID NO: 1201047 - DNA, 22 bp, Homo sapiens
ggacccatgagttggggtctgg

SEQ ID NO: 1201048 - DNA, 19 bp, Homo sapiens
ggaccccactggctgagaa

SEQ ID NO: 1201049 - DNA, 13 bp, Homo sapiens
ggaccccagctct

SEQ ID NO: 1201050 - DNA, 15 bp, Homo sapiens
ggaccccagctctgc

SEQ ID NO: 1201051 - DNA, 17 bp, Homo sapiens
ggaccccatctgtgaat

SEQ ID NO: 1201052 - DNA, 20 bp, Homo sapiens
ggaccccatctgtgaataag

SEQ ID NO: 1201053 - DNA, 22 bp, Homo sapiens
ggacccccagcccccagggccc

SEQ ID NO: 1201054 - DNA, 20 bp, Homo sapiens
ggacccccgccccctgccct

SEQ ID NO: 1201055 - DNA, 17 bp, Homo sapiens
ggacccccgtcagctgc

SEQ ID NO: 1201056 - DNA, 18 bp, Homo sapiens
ggaccccctcgccagctt

SEQ ID NO: 1201057 - DNA, 16 bp, Homo sapiens
ggaccccctgcccgcc

SEQ ID NO: 1201058 - DNA, 11 bp, Homo sapiens
ggacccctcac

SEQ ID NO: 1201059 - DNA, 16 bp, Homo sapiens
ggacccctcaccaccc

SEQ ID NO: 1201060 - DNA, 17 bp, Homo sapiens
ggacccctcagctcccc

SEQ ID NO: 1201061 - DNA, 13 bp, Homo sapiens
ggacccctcccaa

SEQ ID NO: 1201062 - DNA, 15 bp, Homo sapiens
ggacccctcccaacc

SEQ ID NO: 1201063 - DNA, 21 bp, Homo sapiens
ggacccctcccttgctcagtg

SEQ ID NO: 1201064 - DNA, 17 bp, Homo sapiens
ggacccctggggtggcc

SEQ ID NO: 1201065 - DNA, 14 bp, Homo sapiens
ggacccctgtccag

SEQ ID NO: 1201066 - DNA, 21 bp, Homo sapiens
ggacccgcctgctcccatcct

SEQ ID NO: 1201067 - DNA, 17 bp, Homo sapiens
ggaccctgacctccgcc

SEQ ID NO: 1201068 - DNA, 15 bp, Homo sapiens
ggaccctgcttcacc

SEQ ID NO: 1201069 - DNA, 12 bp, Homo sapiens
ggaccctggaaa

SEQ ID NO: 1201070 - DNA, 20 bp, Homo sapiens
ggaccctggtgacctcctgt

SEQ ID NO: 1201071 - DNA, 12 bp, Homo sapiens
ggaccctgtccg

SEQ ID NO: 1201072 - DNA, 16 bp, Homo sapiens
ggaccctgtcctgcag

SEQ ID NO: 1201073 - DNA, 18 bp, Homo sapiens
ggacccttcccagccctc

SEQ ID NO: 1201074 - DNA, 23 bp, Homo sapiens
ggacccttgagagtatcaggtct

SEQ ID NO: 1201075 - DNA, 21 bp, Homo sapiens
ggacccttgcctgcctcctag

SEQ ID NO: 1201076 - DNA, 22 bp, Homo sapiens
ggaccctttccttccttccctg

SEQ ID NO: 1201077 - DNA, 23 bp, Homo sapiens
ggaccctttccttccttccctgg

SEQ ID NO: 1201078 - DNA, 21 bp, Homo sapiens
ggaccctttgcctttcttctg

SEQ ID NO: 1201079 - DNA, 14 bp, Homo sapiens
ggaccgagatgtga

SEQ ID NO: 1201080 - DNA, 15 bp, Homo sapiens
ggaccgagatgtgag

SEQ ID NO: 1201081 - DNA, 23 bp, Homo sapiens
ggaccgagatgtgagtcctgttg

SEQ ID NO: 1201082 - DNA, 17 bp, Homo sapiens
ggaccgcgtagagagcc

SEQ ID NO: 1201083 - DNA, 21 bp, Homo sapiens
ggaccgcgtagagagccgggc

SEQ ID NO: 1201084 - DNA, 22 bp, Homo sapiens
ggaccgggtgggcctggcctga

SEQ ID NO: 1201085 - DNA, 15 bp, Homo sapiens
ggaccggtgctgcag

SEQ ID NO: 1201086 - DNA, 14 bp, Homo sapiens
ggaccgtccagggg

SEQ ID NO: 1201087 - DNA, 14 bp, Homo sapiens
ggaccgtgccccac

SEQ ID NO: 1201088 - DNA, 15 bp, Homo sapiens
ggaccgtgccccacc

SEQ ID NO: 1201089 - DNA, 21 bp, Homo sapiens
ggaccgtgccccacctcccca

SEQ ID NO: 1201090 - DNA, 18 bp, Homo sapiens
ggaccgtgcgagctgccg

SEQ ID NO: 1201091 - DNA, 17 bp, Homo sapiens
ggacctaatgctggcct

SEQ ID NO: 1201092 - DNA, 13 bp, Homo sapiens
ggacctacctccc

SEQ ID NO: 1201093 - DNA, 14 bp, Homo sapiens
ggacctacctccct

SEQ ID NO: 1201094 - DNA, 16 bp, Homo sapiens
ggacctagcttgaggc

SEQ ID NO: 1201095 - DNA, 16 bp, Homo sapiens
ggacctagggtggcct

SEQ ID NO: 1201096 - DNA, 17 bp, Homo sapiens
ggacctatacagaacag

SEQ ID NO: 1201097 - DNA, 16 bp, Homo sapiens
ggacctatgcagggag

SEQ ID NO: 1201098 - DNA, 17 bp, Homo sapiens
ggacctatgtcctaagg

SEQ ID NO: 1201099 - DNA, 13 bp, Homo sapiens
ggacctcaggagg

SEQ ID NO: 1201100 - DNA, 17 bp, Homo sapiens
ggacctcaggagggcag

SEQ ID NO: 1201101 - DNA, 14 bp, Homo sapiens
ggacctcaggggca

SEQ ID NO: 1201102 - DNA, 19 bp, Homo sapiens
ggacctcaggtgagaagca

SEQ ID NO: 1201103 - DNA, 12 bp, Homo sapiens
ggacctccaggg

SEQ ID NO: 1201104 - DNA, 18 bp, Homo sapiens
ggacctccaggggctcct

SEQ ID NO: 1201105 - DNA, 15 bp, Homo sapiens
ggacctcccaggaca

SEQ ID NO: 1201106 - DNA, 17 bp, Homo sapiens
ggacctcccttccgacc

SEQ ID NO: 1201107 - DNA, 12 bp, Homo sapiens
ggacctctccca

SEQ ID NO: 1201108 - DNA, 14 bp, Homo sapiens
ggacctctcccagg

SEQ ID NO: 1201109 - DNA, 15 bp, Homo sapiens
ggacctctcccaggg

SEQ ID NO: 1201110 - DNA, 13 bp, Homo sapiens
ggacctgagcccg

SEQ ID NO: 1201111 - DNA, 21 bp, Homo sapiens
ggacctgagcctggtcctggc

SEQ ID NO: 1201112 - DNA, 22 bp, Homo sapiens
ggacctgccctccctcagccgt

SEQ ID NO: 1201113 - DNA, 18 bp, Homo sapiens
ggacctggccccaggctg

SEQ ID NO: 1201114 - DNA, 14 bp, Homo sapiens
ggacctggctgcca

SEQ ID NO: 1201115 - DNA, 11 bp, Homo sapiens
ggacctgggaa

SEQ ID NO: 1201116 - DNA, 12 bp, Homo sapiens
ggacctgggggt

SEQ ID NO: 1201117 - DNA, 13 bp, Homo sapiens
ggacctgggggta

SEQ ID NO: 1201118 - DNA, 17 bp, Homo sapiens
ggacctggtgctgcctc

SEQ ID NO: 1201119 - DNA, 15 bp, Homo sapiens
ggacctgtgctttga

SEQ ID NO: 1201120 - DNA, 18 bp, Homo sapiens
ggaccttaggccttcctc

SEQ ID NO: 1201121 - DNA, 15 bp, Homo sapiens
ggaccttatctgtgc

SEQ ID NO: 1201122 - DNA, 22 bp, Homo sapiens
ggaccttatctgtgcgtgaaac

SEQ ID NO: 1201123 - DNA, 18 bp, Homo sapiens
ggaccttcgggctgtgcc

SEQ ID NO: 1201124 - DNA, 18 bp, Homo sapiens
ctctccttgggctcctgg

SEQ ID NO: 1201125 - DNA, 21 bp, Homo sapiens
ctctccttgggctcctggctg

SEQ ID NO: 1201126 - DNA, 14 bp, Homo sapiens
ctctcctttctccc

SEQ ID NO: 1201127 - DNA, 21 bp, Homo sapiens
ctctcctttctccctgcagcc

SEQ ID NO: 1201128 - DNA, 22 bp, Homo sapiens
ctctcctttctccctgcagcct

SEQ ID NO: 1201129 - DNA, 23 bp, Homo sapiens
ctctcctttctccctgcagcctt

SEQ ID NO: 1201130 - DNA, 23 bp, Homo sapiens
ctctcctttctttttcttcttcc

SEQ ID NO: 1201131 - DNA, 21 bp, Homo sapiens
ctctcctttgtgtggctgccc

SEQ ID NO: 1201132 - DNA, 22 bp, Homo sapiens
ctctccttttgaggcttctcct

SEQ ID NO: 1201133 - DNA, 23 bp, Homo sapiens
ctctccttttgaggcttctcctt

SEQ ID NO: 1201134 - DNA, 14 bp, Homo sapiens
ctctcgaccttctg

SEQ ID NO: 1201135 - DNA, 15 bp, Homo sapiens
ctctcgcacacctct

SEQ ID NO: 1201136 - DNA, 18 bp, Homo sapiens
ctctcgcacctttccaaa

SEQ ID NO: 1201137 - DNA, 21 bp, Homo sapiens
ctctcgcttcctcagcctcca

SEQ ID NO: 1201138 - DNA, 18 bp, Homo sapiens
ctctcggaaggctggctg

SEQ ID NO: 1201139 - DNA, 19 bp, Homo sapiens
ctctcggaaggctggctgg

SEQ ID NO: 1201140 - DNA, 15 bp, Homo sapiens
ctctcggctccccat

SEQ ID NO: 1201141 - DNA, 17 bp, Homo sapiens
ctctcggctccccatgt

SEQ ID NO: 1201142 - DNA, 17 bp, Homo sapiens
ctctcgggctctctcac

SEQ ID NO: 1201143 - DNA, 19 bp, Homo sapiens
ctctcgggttgtgtgtctg

SEQ ID NO: 1201144 - DNA, 16 bp, Homo sapiens
ctctcgtaactggttt

SEQ ID NO: 1201145 - DNA, 14 bp, Homo sapiens
ctctcgttctcctt

SEQ ID NO: 1201146 - DNA, 21 bp, Homo sapiens
ctctctaagccacagcttctt

SEQ ID NO: 1201147 - DNA, 19 bp, Homo sapiens
ctctctacaaactcccact

SEQ ID NO: 1201148 - DNA, 15 bp, Homo sapiens
ctctctacagtgcca

SEQ ID NO: 1201149 - DNA, 15 bp, Homo sapiens
ctctctaccagtcta

SEQ ID NO: 1201150 - DNA, 14 bp, Homo sapiens
ctctctacccccca

SEQ ID NO: 1201151 - DNA, 15 bp, Homo sapiens
ctctctaccccccac

SEQ ID NO: 1201152 - DNA, 21 bp, Homo sapiens
ctctctacccggcccagagac

SEQ ID NO: 1201153 - DNA, 15 bp, Homo sapiens
ctctctacctccacc

SEQ ID NO: 1201154 - DNA, 22 bp, Homo sapiens
ctctctactcctacctcagcct

SEQ ID NO: 1201155 - DNA, 20 bp, Homo sapiens
ctctctacttccccttcttg

SEQ ID NO: 1201156 - DNA, 14 bp, Homo sapiens
ctctctaggcctct

SEQ ID NO: 1201157 - DNA, 13 bp, Homo sapiens
ctctctcacacat

SEQ ID NO: 1201158 - DNA, 16 bp, Homo sapiens
ctctctcacccaccag

SEQ ID NO: 1201159 - DNA, 14 bp, Homo sapiens
ctctctcagcccca

SEQ ID NO: 1201160 - DNA, 19 bp, Homo sapiens
ctctctcagccccatcgcc

SEQ ID NO: 1201161 - DNA, 14 bp, Homo sapiens
ctctctcatcttgt

SEQ ID NO: 1201162 - DNA, 14 bp, Homo sapiens
ctctctccagatgt

SEQ ID NO: 1201163 - DNA, 12 bp, Homo sapiens
ctctctcccacc

SEQ ID NO: 1201164 - DNA, 14 bp, Homo sapiens
ctctctcccatttc

SEQ ID NO: 1201165 - DNA, 17 bp, Homo sapiens
ctctctcccatttcagg

SEQ ID NO: 1201166 - DNA, 11 bp, Homo sapiens
ctctctcccta

SEQ ID NO: 1201167 - DNA, 14 bp, Homo sapiens
ctctctccctacct

SEQ ID NO: 1201168 - DNA, 16 bp, Homo sapiens
ctctctccctacctcc

SEQ ID NO: 1201169 - DNA, 21 bp, Homo sapiens
ctctctccctacctccctcct

SEQ ID NO: 1201170 - DNA, 20 bp, Homo sapiens
ctctctccctccctctctca

SEQ ID NO: 1201171 - DNA, 15 bp, Homo sapiens
ctctctccctctgtc

SEQ ID NO: 1201172 - DNA, 16 bp, Homo sapiens
ctctctccctctgtct

SEQ ID NO: 1201173 - DNA, 14 bp, Homo sapiens
ctctctccctgcct

SEQ ID NO: 1201174 - DNA, 16 bp, Homo sapiens
ctctctccctgccttt

SEQ ID NO: 1201175 - DNA, 12 bp, Homo sapiens
ctctctccctgg

SEQ ID NO: 1201176 - DNA, 13 bp, Homo sapiens
ctctctccctggt

SEQ ID NO: 1201177 - DNA, 14 bp, Homo sapiens
ctctctccctgtca

SEQ ID NO: 1201178 - DNA, 13 bp, Homo sapiens
ctctctcctccct

SEQ ID NO: 1201179 - DNA, 11 bp, Homo sapiens
ctctctcctct

SEQ ID NO: 1201180 - DNA, 12 bp, Homo sapiens
ctctctcctctc

SEQ ID NO: 1201181 - DNA, 12 bp, Homo sapiens
ctctctcctggt

SEQ ID NO: 1201182 - DNA, 13 bp, Homo sapiens
ctctctcctggtg

SEQ ID NO: 1201183 - DNA, 19 bp, Homo sapiens
ctctctcctggtgtgggta

SEQ ID NO: 1201184 - DNA, 14 bp, Homo sapiens
ctctctcctgtcca

SEQ ID NO: 1201185 - DNA, 15 bp, Homo sapiens
ctctctcctgtccaa

SEQ ID NO: 1201186 - DNA, 21 bp, Homo sapiens
ctctctcgaccttctggtatc

SEQ ID NO: 1201187 - DNA, 23 bp, Homo sapiens
ctctctcggccccctcaccccag

SEQ ID NO: 1201188 - DNA, 14 bp, Homo sapiens
ctctctctccctcc

SEQ ID NO: 1201189 - DNA, 14 bp, Homo sapiens
ctctctctctctcc

SEQ ID NO: 1201190 - DNA, 12 bp, Homo sapiens
ctctctctgctc

SEQ ID NO: 1201191 - DNA, 14 bp, Homo sapiens
ctctctctgctcca

SEQ ID NO: 1201192 - DNA, 12 bp, Homo sapiens
ctctctctgggc

SEQ ID NO: 1201193 - DNA, 14 bp, Homo sapiens
ctctctctgggtca

SEQ ID NO: 1201194 - DNA, 16 bp, Homo sapiens
ctctctcttcctaccc

SEQ ID NO: 1201195 - DNA, 13 bp, Homo sapiens
ctctctctttgtg

SEQ ID NO: 1201196 - DNA, 20 bp, Homo sapiens
ctctctgaagatgatcattt

SEQ ID NO: 1201197 - DNA, 20 bp, Homo sapiens
ctctctgaagcgactctcct

SEQ ID NO: 1201198 - DNA, 18 bp, Homo sapiens
ctctctgacgtcaaccca

SEQ ID NO: 1201199 - DNA, 22 bp, Homo sapiens
ctctctgatcttgtgctcagca

SEQ ID NO: 1201200 - DNA, 23 bp, Homo sapiens
ctctctgatcttgtgctcagcat

SEQ ID NO: 1201201 - DNA, 15 bp, Homo sapiens
ctctctgatgtccca

SEQ ID NO: 1201202 - DNA, 18 bp, Homo sapiens
ctctctgatgtcccagtg

SEQ ID NO: 1201203 - DNA, 18 bp, Homo sapiens
ctctctgcaccgtactgt

SEQ ID NO: 1201204 - DNA, 16 bp, Homo sapiens
ctctctgcagccagcc

SEQ ID NO: 1201205 - DNA, 18 bp, Homo sapiens
ctctctgcagccagccca

SEQ ID NO: 1201206 - DNA, 21 bp, Homo sapiens
ctctctgcagccagcccagcc

SEQ ID NO: 1201207 - DNA, 16 bp, Homo sapiens
ctctctgcagcccagc

SEQ ID NO: 1201208 - DNA, 17 bp, Homo sapiens
ctctctgcagcccagcc

SEQ ID NO: 1201209 - DNA, 12 bp, Homo sapiens
ctctctgcagct

SEQ ID NO: 1201210 - DNA, 14 bp, Homo sapiens
ctctctgcagctgc

SEQ ID NO: 1201211 - DNA, 15 bp, Homo sapiens
ctctctgcagtcctc

SEQ ID NO: 1201212 - DNA, 16 bp, Homo sapiens
ctctctgcatctgacc

SEQ ID NO: 1201213 - DNA, 12 bp, Homo sapiens
ctctctgccact

SEQ ID NO: 1201214 - DNA, 11 bp, Homo sapiens
ctctctgccct

SEQ ID NO: 1201215 - DNA, 12 bp, Homo sapiens
ctctctgccctg

SEQ ID NO: 1201216 - DNA, 13 bp, Homo sapiens
ctctctgccctgt

SEQ ID NO: 1201217 - DNA, 14 bp, Homo sapiens
ctctctgccctgtg

SEQ ID NO: 1201218 - DNA, 16 bp, Homo sapiens
ctctctgccctgtgta

SEQ ID NO: 1201219 - DNA, 12 bp, Homo sapiens
ctctctgcctct

SEQ ID NO: 1201220 - DNA, 22 bp, Homo sapiens
ctctctgcctctcttcttcccc

SEQ ID NO: 1201221 - DNA, 14 bp, Homo sapiens
ctctctgctccaga

SEQ ID NO: 1201222 - DNA, 13 bp, Homo sapiens
ctctctgctccat

SEQ ID NO: 1201223 - DNA, 18 bp, Homo sapiens
ctctctgctccttcactg

SEQ ID NO: 1201224 - DNA, 12 bp, Homo sapiens
ctctctgctcta

SEQ ID NO: 1201225 - DNA, 13 bp, Homo sapiens
ctctctgctgtac

SEQ ID NO: 1201226 - DNA, 22 bp, Homo sapiens
ctctctggaaagaggctctgga

SEQ ID NO: 1201227 - DNA, 10 bp, Homo sapiens
ctctctggag

SEQ ID NO: 1201228 - DNA, 13 bp, Homo sapiens
ctctctggagccc

SEQ ID NO: 1201229 - DNA, 15 bp, Homo sapiens
ctctctggcctccca

SEQ ID NO: 1201230 - DNA, 20 bp, Homo sapiens
ctctctggcctcccacccga

SEQ ID NO: 1201231 - DNA, 17 bp, Homo sapiens
ctctctggccttttcct

SEQ ID NO: 1201232 - DNA, 16 bp, Homo sapiens
ctctctggctggtctt

SEQ ID NO: 1201233 - DNA, 14 bp, Homo sapiens
ctctctggcttctg

SEQ ID NO: 1201234 - DNA, 22 bp, Homo sapiens
ctctctggcttctgaagagcct

SEQ ID NO: 1201235 - DNA, 12 bp, Homo sapiens
ctctctgggacc

SEQ ID NO: 1201236 - DNA, 16 bp, Homo sapiens
ctctctgggacctcct

SEQ ID NO: 1201237 - DNA, 18 bp, Homo sapiens
ctctctgggactctcctc

SEQ ID NO: 1201238 - DNA, 22 bp, Homo sapiens
ctctctgggatttaccagctta

SEQ ID NO: 1201239 - DNA, 12 bp, Homo sapiens
ctctctgggcct

SEQ ID NO: 1201240 - DNA, 18 bp, Homo sapiens
ctctctggggccctgggc

SEQ ID NO: 1201241 - DNA, 22 bp, Homo sapiens
ctctctgggggaggcagggctg

SEQ ID NO: 1201242 - DNA, 21 bp, Homo sapiens
ctctctgggtcagaaccagag

SEQ ID NO: 1201243 - DNA, 18 bp, Homo sapiens
ctctctgtcccttgctgt

SEQ ID NO: 1201244 - DNA, 23 bp, Homo sapiens
ctctctgtctgtctctccccctc

SEQ ID NO: 1201245 - DNA, 14 bp, Homo sapiens
ctctctgtgaatac

SEQ ID NO: 1201246 - DNA, 16 bp, Homo sapiens
ctctctgtgaatacaa

SEQ ID NO: 1201247 - DNA, 19 bp, Homo sapiens
ctctctgtgggctggcagt

SEQ ID NO: 1201248 - DNA, 17 bp, Homo sapiens
ctctctgtggggctgaa

SEQ ID NO: 1201249 - DNA, 13 bp, Homo sapiens
ctctctgttccct

SEQ ID NO: 1201250 - DNA, 22 bp, Homo sapiens
ctctctgttcccttcctcaccc

SEQ ID NO: 1201251 - DNA, 19 bp, Homo sapiens
ggaccttcgggctgtgccc

SEQ ID NO: 1201252 - DNA, 17 bp, Homo sapiens
ggaccttgacagagcag

SEQ ID NO: 1201253 - DNA, 18 bp, Homo sapiens
ggaccttgacagagcagc

SEQ ID NO: 1201254 - DNA, 11 bp, Homo sapiens
ggaccttggcg

SEQ ID NO: 1201255 - DNA, 14 bp, Homo sapiens
ggacgaggaggaca

SEQ ID NO: 1201256 - DNA, 23 bp, Homo sapiens
ggacgatagcttggagggatgga

SEQ ID NO: 1201257 - DNA, 19 bp, Homo sapiens
ggacgcacgctcgctgcca

SEQ ID NO: 1201258 - DNA, 21 bp, Homo sapiens
ggacgcacgctcgctgccatc

SEQ ID NO: 1201259 - DNA, 22 bp, Homo sapiens
ggacgcacgctcgctgccatca

SEQ ID NO: 1201260 - DNA, 19 bp, Homo sapiens
ggacgccactcatttcatc

SEQ ID NO: 1201261 - DNA, 17 bp, Homo sapiens
ggacgcctgcaggagag

SEQ ID NO: 1201262 - DNA, 19 bp, Homo sapiens
ggacgcctgccctgcccag

SEQ ID NO: 1201263 - DNA, 19 bp, Homo sapiens
ggacgcctgggggtgccag

SEQ ID NO: 1201264 - DNA, 13 bp, Homo sapiens
ggacgcggaggag

SEQ ID NO: 1201265 - DNA, 18 bp, Homo sapiens
ggacgcggaggaggaaga

SEQ ID NO: 1201266 - DNA, 15 bp, Homo sapiens
ggacgctttgtctgt

SEQ ID NO: 1201267 - DNA, 21 bp, Homo sapiens
ggacggccaatggtgcttccc

SEQ ID NO: 1201268 - DNA, 14 bp, Homo sapiens
ggacggccctgcct

SEQ ID NO: 1201269 - DNA, 16 bp, Homo sapiens
ggacggccctgcctgc

SEQ ID NO: 1201270 - DNA, 21 bp, Homo sapiens
ggacggcctgatgctccctcc

SEQ ID NO: 1201271 - DNA, 14 bp, Homo sapiens
ggacggctcctcag

SEQ ID NO: 1201272 - DNA, 17 bp, Homo sapiens
ggacggtgcccaagcca

SEQ ID NO: 1201273 - DNA, 17 bp, Homo sapiens
ggacgtcacgctccctg

SEQ ID NO: 1201274 - DNA, 19 bp, Homo sapiens
ggacgtcacgctccctgac

SEQ ID NO: 1201275 - DNA, 21 bp, Homo sapiens
ggacgtgggccctgcaggctg

SEQ ID NO: 1201276 - DNA, 20 bp, Homo sapiens
ggacgtgtacagcacagaat

SEQ ID NO: 1201277 - DNA, 17 bp, Homo sapiens
ggactaccgcaggcccg

SEQ ID NO: 1201278 - DNA, 20 bp, Homo sapiens
ggactaccgcaggcccggac

SEQ ID NO: 1201279 - DNA, 18 bp, Homo sapiens
ggactagaaaaacttggg

SEQ ID NO: 1201280 - DNA, 21 bp, Homo sapiens
ggactagaacctatctttaaa

SEQ ID NO: 1201281 - DNA, 16 bp, Homo sapiens
ggactagagctttctt

SEQ ID NO: 1201282 - DNA, 20 bp, Homo sapiens
ggactaggacctgagcctgg

SEQ ID NO: 1201283 - DNA, 12 bp, Homo sapiens
ggactagtgtcc

SEQ ID NO: 1201284 - DNA, 21 bp, Homo sapiens
ggactatgatgagaggccagc

SEQ ID NO: 1201285 - DNA, 14 bp, Homo sapiens
ggactattataatt

SEQ ID NO: 1201286 - DNA, 23 bp, Homo sapiens
ggactcaagaggaatctgtttct

SEQ ID NO: 1201287 - DNA, 18 bp, Homo sapiens
ggactcaagggtccagaa

SEQ ID NO: 1201288 - DNA, 14 bp, Homo sapiens
ggactcagcagtga

SEQ ID NO: 1201289 - DNA, 13 bp, Homo sapiens
ggactcagccctg

SEQ ID NO: 1201290 - DNA, 15 bp, Homo sapiens
ggactcagccctgag

SEQ ID NO: 1201291 - DNA, 17 bp, Homo sapiens
ggactcagccctgaggt

SEQ ID NO: 1201292 - DNA, 14 bp, Homo sapiens
ggactcaggaactt

SEQ ID NO: 1201293 - DNA, 15 bp, Homo sapiens
ggactcaggaacttt

SEQ ID NO: 1201294 - DNA, 18 bp, Homo sapiens
ggactcaggatccagtga

SEQ ID NO: 1201295 - DNA, 11 bp, Homo sapiens
ggactcaggga

SEQ ID NO: 1201296 - DNA, 22 bp, Homo sapiens
ggactcagggcagcgccaggct

SEQ ID NO: 1201297 - DNA, 20 bp, Homo sapiens
ggactcagggccatgcctgc

SEQ ID NO: 1201298 - DNA, 14 bp, Homo sapiens
ggactccagctcgt

SEQ ID NO: 1201299 - DNA, 17 bp, Homo sapiens
ggactccatagctcctt

SEQ ID NO: 1201300 - DNA, 14 bp, Homo sapiens
ggactcccagcaga

SEQ ID NO: 1201301 - DNA, 17 bp, Homo sapiens
ggactcccagcagagcc

SEQ ID NO: 1201302 - DNA, 14 bp, Homo sapiens
ggactccccaggcc

SEQ ID NO: 1201303 - DNA, 17 bp, Homo sapiens
ggactccccaggccagg

SEQ ID NO: 1201304 - DNA, 20 bp, Homo sapiens
ggactccctcctcacctctg

SEQ ID NO: 1201305 - DNA, 16 bp, Homo sapiens
ggactccggaggactg

SEQ ID NO: 1201306 - DNA, 22 bp, Homo sapiens
ggactccggaggactgagcccc

SEQ ID NO: 1201307 - DNA, 22 bp, Homo sapiens
ggactcctcaaaccacttgcct

SEQ ID NO: 1201308 - DNA, 23 bp, Homo sapiens
ggactcctcaaaccacttgcctg

SEQ ID NO: 1201309 - DNA, 20 bp, Homo sapiens
ggactcctggcagggccacc

SEQ ID NO: 1201310 - DNA, 23 bp, Homo sapiens
ggactcctttgcatggcagggcc

SEQ ID NO: 1201311 - DNA, 13 bp, Homo sapiens
ggactcgccccca

SEQ ID NO: 1201312 - DNA, 15 bp, Homo sapiens
ggactcggccactgt

SEQ ID NO: 1201313 - DNA, 16 bp, Homo sapiens
ggactcggtgagccgg

SEQ ID NO: 1201314 - DNA, 13 bp, Homo sapiens
ggactctaaagtc

SEQ ID NO: 1201315 - DNA, 13 bp, Homo sapiens
ggactctcaggga

SEQ ID NO: 1201316 - DNA, 15 bp, Homo sapiens
ggactctcagggatt

SEQ ID NO: 1201317 - DNA, 13 bp, Homo sapiens
ggactctcctcct

SEQ ID NO: 1201318 - DNA, 23 bp, Homo sapiens
ggactctcctcctcccctcctct

SEQ ID NO: 1201319 - DNA, 13 bp, Homo sapiens
ggactctgaggct

SEQ ID NO: 1201320 - DNA, 13 bp, Homo sapiens
ggactctgcccca

SEQ ID NO: 1201321 - DNA, 14 bp, Homo sapiens
ggactctgccccaa

SEQ ID NO: 1201322 - DNA, 16 bp, Homo sapiens
ggactctgccccaatc

SEQ ID NO: 1201323 - DNA, 18 bp, Homo sapiens
ggactctgccccacgctg

SEQ ID NO: 1201324 - DNA, 22 bp, Homo sapiens
ggactctgcgggaggctggggc

SEQ ID NO: 1201325 - DNA, 14 bp, Homo sapiens
ggactctggcacag

SEQ ID NO: 1201326 - DNA, 16 bp, Homo sapiens
ggactgaaaacctctc

SEQ ID NO: 1201327 - DNA, 21 bp, Homo sapiens
ggactgaaagaagaaaacagt

SEQ ID NO: 1201328 - DNA, 14 bp, Homo sapiens
ggactgaagcctgc

SEQ ID NO: 1201329 - DNA, 17 bp, Homo sapiens
ggactgaagcctgcagg

SEQ ID NO: 1201330 - DNA, 21 bp, Homo sapiens
ggactgacagcatgtgccctc

SEQ ID NO: 1201331 - DNA, 15 bp, Homo sapiens
ggactgaccctgcag

SEQ ID NO: 1201332 - DNA, 23 bp, Homo sapiens
ggactgagactggcacttagccc

SEQ ID NO: 1201333 - DNA, 16 bp, Homo sapiens
ggactgagcccccacc

SEQ ID NO: 1201334 - DNA, 16 bp, Homo sapiens
ggactgagccctctca

SEQ ID NO: 1201335 - DNA, 20 bp, Homo sapiens
ggactgagccctctcactcc

SEQ ID NO: 1201336 - DNA, 21 bp, Homo sapiens
ggactgagccctctcactcca

SEQ ID NO: 1201337 - DNA, 14 bp, Homo sapiens
ggactgaggagtgg

SEQ ID NO: 1201338 - DNA, 11 bp, Homo sapiens
ggactgagggc

SEQ ID NO: 1201339 - DNA, 18 bp, Homo sapiens
ggactgagtgggaagccc

SEQ ID NO: 1201340 - DNA, 21 bp, Homo sapiens
ggactgcaggggccactccaa

SEQ ID NO: 1201341 - DNA, 21 bp, Homo sapiens
ggactgcagtcggcatgccag

SEQ ID NO: 1201342 - DNA, 16 bp, Homo sapiens
ggactgcagtgtggag

SEQ ID NO: 1201343 - DNA, 11 bp, Homo sapiens
ggactgccaaa

SEQ ID NO: 1201344 - DNA, 22 bp, Homo sapiens
ggactgcccccagaaagcctcc

SEQ ID NO: 1201345 - DNA, 16 bp, Homo sapiens
ggactgcgctggacga

SEQ ID NO: 1201346 - DNA, 16 bp, Homo sapiens
ggactgcggaggaagg

SEQ ID NO: 1201347 - DNA, 18 bp, Homo sapiens
ggactgctaaataaaatt

SEQ ID NO: 1201348 - DNA, 19 bp, Homo sapiens
ggactgctggctcacgccc

SEQ ID NO: 1201349 - DNA, 24 bp, Homo sapiens
ggactggacagctttgctccgctc

SEQ ID NO: 1201350 - DNA, 20 bp, Homo sapiens
ggactggcagactcaagggg

SEQ ID NO: 1201351 - DNA, 22 bp, Homo sapiens
ggactggctagagtcctcactc

SEQ ID NO: 1201352 - DNA, 18 bp, Homo sapiens
ggactgggaccgtgcgag

SEQ ID NO: 1201353 - DNA, 22 bp, Homo sapiens
ggactgggaccgtgcgagctgc

SEQ ID NO: 1201354 - DNA, 12 bp, Homo sapiens
ggactgggaggt

SEQ ID NO: 1201355 - DNA, 19 bp, Homo sapiens
ggactgggggactgggagt

SEQ ID NO: 1201356 - DNA, 18 bp, Homo sapiens
ggactgggtttggacccc

SEQ ID NO: 1201357 - DNA, 21 bp, Homo sapiens
ggactgggtttggaccccagc

SEQ ID NO: 1201358 - DNA, 23 bp, Homo sapiens
ggactgggtttggaccccagctg

SEQ ID NO: 1201359 - DNA, 18 bp, Homo sapiens
ggactgtaaagatttgtt

SEQ ID NO: 1201360 - DNA, 15 bp, Homo sapiens
ggactgtcatagaaa

SEQ ID NO: 1201361 - DNA, 23 bp, Homo sapiens
ggactgtcctcccacagacctgc

SEQ ID NO: 1201362 - DNA, 18 bp, Homo sapiens
ggactgtgcctcaggcca

SEQ ID NO: 1201363 - DNA, 20 bp, Homo sapiens
ggactgtgcctcaggccagg

SEQ ID NO: 1201364 - DNA, 23 bp, Homo sapiens
ggactgttccttatttctctctc

SEQ ID NO: 1201365 - DNA, 20 bp, Homo sapiens
ggactgttttttcctgagct

SEQ ID NO: 1201366 - DNA, 17 bp, Homo sapiens
ggacttaacggctccag

SEQ ID NO: 1201367 - DNA, 13 bp, Homo sapiens
ggacttacaaaat

SEQ ID NO: 1201368 - DNA, 14 bp, Homo sapiens
ggacttacaaaatg

SEQ ID NO: 1201369 - DNA, 16 bp, Homo sapiens
ggacttccacacctcc

SEQ ID NO: 1201370 - DNA, 15 bp, Homo sapiens
ggacttccatgcctt

SEQ ID NO: 1201371 - DNA, 20 bp, Homo sapiens
ggacttccgctccctggata

SEQ ID NO: 1201372 - DNA, 15 bp, Homo sapiens
ggacttcctggggcc

SEQ ID NO: 1201373 - DNA, 15 bp, Homo sapiens
ggacttccttgctct

SEQ ID NO: 1201374 - DNA, 18 bp, Homo sapiens
ggacttccttgctctccc

SEQ ID NO: 1201375 - DNA, 16 bp, Homo sapiens
ctctctgttgcgctcc

SEQ ID NO: 1201376 - DNA, 16 bp, Homo sapiens
ctctcttaaatgcaag

SEQ ID NO: 1201377 - DNA, 17 bp, Homo sapiens
ctctcttcaatctctgg

SEQ ID NO: 1201378 - DNA, 13 bp, Homo sapiens
ctctcttccctca

SEQ ID NO: 1201379 - DNA, 14 bp, Homo sapiens
ctctcttccctcag

SEQ ID NO: 1201380 - DNA, 22 bp, Homo sapiens
ctctcttcctaccctccttcca

SEQ ID NO: 1201381 - DNA, 14 bp, Homo sapiens
ctctcttcctgccc

SEQ ID NO: 1201382 - DNA, 18 bp, Homo sapiens
ctctcttcctgcccctct

SEQ ID NO: 1201383 - DNA, 17 bp, Homo sapiens
ctctcttcgtcctgatc

SEQ ID NO: 1201384 - DNA, 22 bp, Homo sapiens
ctctcttcgtcctgatccctcc

SEQ ID NO: 1201385 - DNA, 16 bp, Homo sapiens
ctctcttctaggccca

SEQ ID NO: 1201386 - DNA, 12 bp, Homo sapiens
ctctcttctgct

SEQ ID NO: 1201387 - DNA, 14 bp, Homo sapiens
ctctcttctgctcc

SEQ ID NO: 1201388 - DNA, 13 bp, Homo sapiens
ctctcttgcaccc

SEQ ID NO: 1201389 - DNA, 16 bp, Homo sapiens
ctctcttgcacccgcc

SEQ ID NO: 1201390 - DNA, 15 bp, Homo sapiens
ctctcttgccccttg

SEQ ID NO: 1201391 - DNA, 14 bp, Homo sapiens
ctctcttggctcta

SEQ ID NO: 1201392 - DNA, 21 bp, Homo sapiens
ctctcttgtgacgtgcactgt

SEQ ID NO: 1201393 - DNA, 21 bp, Homo sapiens
ctctcttgttgtccaggctgg

SEQ ID NO: 1201394 - DNA, 18 bp, Homo sapiens
ctctctttatgcttgctt

SEQ ID NO: 1201395 - DNA, 22 bp, Homo sapiens
ctctctttatgcttgcttgggg

SEQ ID NO: 1201396 - DNA, 21 bp, Homo sapiens
ctctctttccttgagctgttg

SEQ ID NO: 1201397 - DNA, 17 bp, Homo sapiens
ctctctttgggaatgtt

SEQ ID NO: 1201398 - DNA, 18 bp, Homo sapiens
ctctctttgggaatgttt

SEQ ID NO: 1201399 - DNA, 19 bp, Homo sapiens
ctctcttttcctctctgtc

SEQ ID NO: 1201400 - DNA, 20 bp, Homo sapiens
ctctctttttggaggtgctt

SEQ ID NO: 1201401 - DNA, 21 bp, Homo sapiens
ctctgaaaacaaggtttccat

SEQ ID NO: 1201402 - DNA, 17 bp, Homo sapiens
ctctgaaaattctggaa

SEQ ID NO: 1201403 - DNA, 20 bp, Homo sapiens
ctctgaaacatggcctgttt

SEQ ID NO: 1201404 - DNA, 16 bp, Homo sapiens
ctctgaaagagaaaca

SEQ ID NO: 1201405 - DNA, 21 bp, Homo sapiens
ctctgaaagagaaacacgtat

SEQ ID NO: 1201406 - DNA, 15 bp, Homo sapiens
ctctgaaattaaaga

SEQ ID NO: 1201407 - DNA, 19 bp, Homo sapiens
ctctgaaattaaagaaatg

SEQ ID NO: 1201408 - DNA, 22 bp, Homo sapiens
ctctgaaattaaagaaatgaaa

SEQ ID NO: 1201409 - DNA, 20 bp, Homo sapiens
ctctgaactgcaacactgga

SEQ ID NO: 1201410 - DNA, 21 bp, Homo sapiens
ctctgaagagtgggtttcaca

SEQ ID NO: 1201411 - DNA, 18 bp, Homo sapiens
ctctgaagcgactctcct

SEQ ID NO: 1201412 - DNA, 19 bp, Homo sapiens
ctctgaagggcatcatgca

SEQ ID NO: 1201413 - DNA, 23 bp, Homo sapiens
ctctgaagggcatcatgcatctt

SEQ ID NO: 1201414 - DNA, 23 bp, Homo sapiens
ctctgaagtcacatcacaggaca

SEQ ID NO: 1201415 - DNA, 19 bp, Homo sapiens
ctctgaatcagaaaagcta

SEQ ID NO: 1201416 - DNA, 23 bp, Homo sapiens
ctctgaatctgtacatgttcttg

SEQ ID NO: 1201417 - DNA, 17 bp, Homo sapiens
ctctgaatgccccataa

SEQ ID NO: 1201418 - DNA, 17 bp, Homo sapiens
ctctgaatggtccaggg

SEQ ID NO: 1201419 - DNA, 18 bp, Homo sapiens
ctctgaattttcagagac

SEQ ID NO: 1201420 - DNA, 19 bp, Homo sapiens
ctctgacagcagcctgtga

SEQ ID NO: 1201421 - DNA, 20 bp, Homo sapiens
ctctgacagcagcctgtgag

SEQ ID NO: 1201422 - DNA, 13 bp, Homo sapiens
ctctgacagctcc

SEQ ID NO: 1201423 - DNA, 22 bp, Homo sapiens
ctctgacagtccacaggggcca

SEQ ID NO: 1201424 - DNA, 18 bp, Homo sapiens
ctctgacatcccttcctg

SEQ ID NO: 1201425 - DNA, 17 bp, Homo sapiens
ctctgaccacagcccgc

SEQ ID NO: 1201426 - DNA, 20 bp, Homo sapiens
ctctgaccctccttctattt

SEQ ID NO: 1201427 - DNA, 13 bp, Homo sapiens
ctctgaccctggg

SEQ ID NO: 1201428 - DNA, 16 bp, Homo sapiens
ctctgaccgattcctt

SEQ ID NO: 1201429 - DNA, 13 bp, Homo sapiens
ctctgacctctgc

SEQ ID NO: 1201430 - DNA, 14 bp, Homo sapiens
ctctgacctctgct

SEQ ID NO: 1201431 - DNA, 18 bp, Homo sapiens
ctctgacctctgctgagt

SEQ ID NO: 1201432 - DNA, 19 bp, Homo sapiens
ctctgacctctgctgagtg

SEQ ID NO: 1201433 - DNA, 15 bp, Homo sapiens
ctctgacctgcactg

SEQ ID NO: 1201434 - DNA, 16 bp, Homo sapiens
ctctgacctgcaggcc

SEQ ID NO: 1201435 - DNA, 20 bp, Homo sapiens
ctctgacgcaccactgccaa

SEQ ID NO: 1201436 - DNA, 15 bp, Homo sapiens
ctctgacgcttgtga

SEQ ID NO: 1201437 - DNA, 18 bp, Homo sapiens
ctctgacgcttgtgacag

SEQ ID NO: 1201438 - DNA, 14 bp, Homo sapiens
ctctgacgtcaacc

SEQ ID NO: 1201439 - DNA, 17 bp, Homo sapiens
ctctgactcagggctcc

SEQ ID NO: 1201440 - DNA, 14 bp, Homo sapiens
ctctgactctgagt

SEQ ID NO: 1201441 - DNA, 14 bp, Homo sapiens
ctctgacttctgcc

SEQ ID NO: 1201442 - DNA, 17 bp, Homo sapiens
ctctgacttctgcctgg

SEQ ID NO: 1201443 - DNA, 18 bp, Homo sapiens
ctctgacttctgcctgga

SEQ ID NO: 1201444 - DNA, 21 bp, Homo sapiens
ctctgacttctgcctggagac

SEQ ID NO: 1201445 - DNA, 18 bp, Homo sapiens
ctctgagaagaggtcctt

SEQ ID NO: 1201446 - DNA, 21 bp, Homo sapiens
ctctgagaattccaaggagtt

SEQ ID NO: 1201447 - DNA, 13 bp, Homo sapiens
ctctgagacacac

SEQ ID NO: 1201448 - DNA, 16 bp, Homo sapiens
ctctgagatcctggag

SEQ ID NO: 1201449 - DNA, 21 bp, Homo sapiens
ctctgagatctaaggatgtca

SEQ ID NO: 1201450 - DNA, 13 bp, Homo sapiens
ctctgagatgcta

SEQ ID NO: 1201451 - DNA, 16 bp, Homo sapiens
ctctgagcaaatgtgg

SEQ ID NO: 1201452 - DNA, 17 bp, Homo sapiens
ctctgagcaggggcagg

SEQ ID NO: 1201453 - DNA, 13 bp, Homo sapiens
ctctgagcagtga

SEQ ID NO: 1201454 - DNA, 15 bp, Homo sapiens
ctctgagccaaggga

SEQ ID NO: 1201455 - DNA, 21 bp, Homo sapiens
ctctgagccaagggagggaag

SEQ ID NO: 1201456 - DNA, 23 bp, Homo sapiens
ctctgagccaagggagggaaggg

SEQ ID NO: 1201457 - DNA, 11 bp, Homo sapiens
ctctgagccca

SEQ ID NO: 1201458 - DNA, 15 bp, Homo sapiens
ctctgagcccaggcc

SEQ ID NO: 1201459 - DNA, 22 bp, Homo sapiens
ctctgagcccatgttctgcccc

SEQ ID NO: 1201460 - DNA, 16 bp, Homo sapiens
ctctgagcgggaggca

SEQ ID NO: 1201461 - DNA, 14 bp, Homo sapiens
ctctgagctgggga

SEQ ID NO: 1201462 - DNA, 19 bp, Homo sapiens
ctctgaggaagcagttggg

SEQ ID NO: 1201463 - DNA, 23 bp, Homo sapiens
ctctgaggaagcagttggggccc

SEQ ID NO: 1201464 - DNA, 12 bp, Homo sapiens
ctctgaggacag

SEQ ID NO: 1201465 - DNA, 22 bp, Homo sapiens
ctctgaggacagaggccggggt

SEQ ID NO: 1201466 - DNA, 19 bp, Homo sapiens
ctctgaggcaaccccctcg

SEQ ID NO: 1201467 - DNA, 16 bp, Homo sapiens
ctctgaggcactcatc

SEQ ID NO: 1201468 - DNA, 19 bp, Homo sapiens
ctctgaggcttccagagag

SEQ ID NO: 1201469 - DNA, 22 bp, Homo sapiens
ctctgaggggaggcacctccag

SEQ ID NO: 1201470 - DNA, 18 bp, Homo sapiens
ctctgaggtcaataaagc

SEQ ID NO: 1201471 - DNA, 23 bp, Homo sapiens
ctctgaggtcccttcaaggcctc

SEQ ID NO: 1201472 - DNA, 22 bp, Homo sapiens
ctctgaggtgcctgtcccaccc

SEQ ID NO: 1201473 - DNA, 17 bp, Homo sapiens
ctctgagtcacaggtgt

SEQ ID NO: 1201474 - DNA, 19 bp, Homo sapiens
ctctgagtccactgctcca

SEQ ID NO: 1201475 - DNA, 15 bp, Homo sapiens
ctctgagtggaggaa

SEQ ID NO: 1201476 - DNA, 21 bp, Homo sapiens
ctctgagtggaggaagcccac

SEQ ID NO: 1201477 - DNA, 21 bp, Homo sapiens
ctctgagtttaccatttgtaa

SEQ ID NO: 1201478 - DNA, 22 bp, Homo sapiens
ctctgagtttaccatttgtaat

SEQ ID NO: 1201479 - DNA, 18 bp, Homo sapiens
ctctgatacacagtaatt

SEQ ID NO: 1201480 - DNA, 19 bp, Homo sapiens
ctctgatagactttgtgaa

SEQ ID NO: 1201481 - DNA, 20 bp, Homo sapiens
ctctgatagactttgtgaat

SEQ ID NO: 1201482 - DNA, 20 bp, Homo sapiens
ctctgatagctgtttcaaat

SEQ ID NO: 1201483 - DNA, 23 bp, Homo sapiens
ctctgatattccatgaatgtatc

SEQ ID NO: 1201484 - DNA, 21 bp, Homo sapiens
ctctgatcacattcttcaaag

SEQ ID NO: 1201485 - DNA, 12 bp, Homo sapiens
ctctgatccctc

SEQ ID NO: 1201486 - DNA, 21 bp, Homo sapiens
ctctgatccctctacagagct

SEQ ID NO: 1201487 - DNA, 17 bp, Homo sapiens
ctctgatccttcttcct

SEQ ID NO: 1201488 - DNA, 20 bp, Homo sapiens
ctctgatcttgtgctcagca

SEQ ID NO: 1201489 - DNA, 13 bp, Homo sapiens
ctctgatgcagaa

SEQ ID NO: 1201490 - DNA, 12 bp, Homo sapiens
ctctgatgtgga

SEQ ID NO: 1201491 - DNA, 17 bp, Homo sapiens
ctctgattcacctcttc

SEQ ID NO: 1201492 - DNA, 19 bp, Homo sapiens
ctctgattggaatttctgg

SEQ ID NO: 1201493 - DNA, 15 bp, Homo sapiens
ctctgatttccttcc

SEQ ID NO: 1201494 - DNA, 15 bp, Homo sapiens
ctctgattttcaaag

SEQ ID NO: 1201495 - DNA, 15 bp, Homo sapiens
ctctgcaactgcaag

SEQ ID NO: 1201496 - DNA, 19 bp, Homo sapiens
ctctgcaactgcaagaaag

SEQ ID NO: 1201497 - DNA, 22 bp, Homo sapiens
ctctgcaagaattgaagcagga

SEQ ID NO: 1201498 - DNA, 17 bp, Homo sapiens
ctctgcaatgggcactg

SEQ ID NO: 1201499 - DNA, 16 bp, Homo sapiens
ggacttcggaccgctt

SEQ ID NO: 1201500 - DNA, 23 bp, Homo sapiens
ggacttcggaccgcttgtgggga

SEQ ID NO: 1201501 - DNA, 23 bp, Homo sapiens
ggacttctacctgccctcaaggg

SEQ ID NO: 1201502 - DNA, 18 bp, Homo sapiens
ggacttctgcagctatgc

SEQ ID NO: 1201503 - DNA, 13 bp, Homo sapiens
ggacttgaagttg

SEQ ID NO: 1201504 - DNA, 21 bp, Homo sapiens
ggacttggagggtctgggggc

SEQ ID NO: 1201505 - DNA, 15 bp, Homo sapiens
ggacttggcgcgccc

SEQ ID NO: 1201506 - DNA, 16 bp, Homo sapiens
ggacttggctgtcctt

SEQ ID NO: 1201507 - DNA, 22 bp, Homo sapiens
ggacttggtaagatgactctga

SEQ ID NO: 1201508 - DNA, 15 bp, Homo sapiens
ggacttgtaggaatc

SEQ ID NO: 1201509 - DNA, 20 bp, Homo sapiens
ggacttgtaggaatctgcct

SEQ ID NO: 1201510 - DNA, 16 bp, Homo sapiens
ggacttgtgtctctgt

SEQ ID NO: 1201511 - DNA, 15 bp, Homo sapiens
ggacttgttttaacg

SEQ ID NO: 1201512 - DNA, 17 bp, Homo sapiens
ggactttaaaaaaacaa

SEQ ID NO: 1201513 - DNA, 20 bp, Homo sapiens
ggactttccaccccctccct

SEQ ID NO: 1201514 - DNA, 21 bp, Homo sapiens
ggactttccaccccctccctg

SEQ ID NO: 1201515 - DNA, 20 bp, Homo sapiens
ggactttcctaaatgtttaa

SEQ ID NO: 1201516 - DNA, 20 bp, Homo sapiens
ggactttctctaataataaa

SEQ ID NO: 1201517 - DNA, 20 bp, Homo sapiens
ggactttggtaattggtttt

SEQ ID NO: 1201518 - DNA, 19 bp, Homo sapiens
ggacttttaatcagtgaag

SEQ ID NO: 1201519 - DNA, 19 bp, Homo sapiens
ggacttttgatagttctat

SEQ ID NO: 1201520 - DNA, 20 bp, Homo sapiens
ggagaaaaaaaaccttgtaa

SEQ ID NO: 1201521 - DNA, 12 bp, Homo sapiens
ggagaaaaacaa

SEQ ID NO: 1201522 - DNA, 17 bp, Homo sapiens
ggagaaaacccctccca

SEQ ID NO: 1201523 - DNA, 15 bp, Homo sapiens
ggagaaaagagaaac

SEQ ID NO: 1201524 - DNA, 22 bp, Homo sapiens
ggagaaaagtgggctgcagcag

SEQ ID NO: 1201525 - DNA, 12 bp, Homo sapiens
ggagaaaatata

SEQ ID NO: 1201526 - DNA, 20 bp, Homo sapiens
ggagaaaattcaattgtaaa

SEQ ID NO: 1201527 - DNA, 16 bp, Homo sapiens
ggagaaacaaaatcct

SEQ ID NO: 1201528 - DNA, 13 bp, Homo sapiens
ggagaaacagaga

SEQ ID NO: 1201529 - DNA, 12 bp, Homo sapiens
ggagaaaccagc

SEQ ID NO: 1201530 - DNA, 22 bp, Homo sapiens
ggagaaagaccatgcatttaaa

SEQ ID NO: 1201531 - DNA, 17 bp, Homo sapiens
ggagaaagcactgacct

SEQ ID NO: 1201532 - DNA, 19 bp, Homo sapiens
ggagaaagccgggggaggg

SEQ ID NO: 1201533 - DNA, 24 bp, Homo sapiens
ggagaaagcttggttctgtgaaca

SEQ ID NO: 1201534 - DNA, 21 bp, Homo sapiens
ggagaaagggagcgaggtcag

SEQ ID NO: 1201535 - DNA, 17 bp, Homo sapiens
ggagaaatgcaataact

SEQ ID NO: 1201536 - DNA, 21 bp, Homo sapiens
ggagaaccagggctcttctca

SEQ ID NO: 1201537 - DNA, 13 bp, Homo sapiens
ggagaagaagaat

SEQ ID NO: 1201538 - DNA, 14 bp, Homo sapiens
ggagaagaatggct

SEQ ID NO: 1201539 - DNA, 15 bp, Homo sapiens
ggagaagaatggctt

SEQ ID NO: 1201540 - DNA, 14 bp, Homo sapiens
ggagaagagcgcag

SEQ ID NO: 1201541 - DNA, 15 bp, Homo sapiens
ggagaagcaatgggt

SEQ ID NO: 1201542 - DNA, 14 bp, Homo sapiens
ggagaagcacagct

SEQ ID NO: 1201543 - DNA, 18 bp, Homo sapiens
ggagaagcaccagcaatt

SEQ ID NO: 1201544 - DNA, 18 bp, Homo sapiens
ggagaagcatgaaaaagc

SEQ ID NO: 1201545 - DNA, 14 bp, Homo sapiens
ggagaagccacctt

SEQ ID NO: 1201546 - DNA, 14 bp, Homo sapiens
ggagaagcgggctg

SEQ ID NO: 1201547 - DNA, 12 bp, Homo sapiens
ggagaagctgca

SEQ ID NO: 1201548 - DNA, 13 bp, Homo sapiens
ggagaagctgcag

SEQ ID NO: 1201549 - DNA, 22 bp, Homo sapiens
ggagaaggaaggagactcacct

SEQ ID NO: 1201550 - DNA, 13 bp, Homo sapiens
ggagaaggaaggg

SEQ ID NO: 1201551 - DNA, 17 bp, Homo sapiens
ggagaaggaagggcaga

SEQ ID NO: 1201552 - DNA, 20 bp, Homo sapiens
ggagaaggatctagaatgtg

SEQ ID NO: 1201553 - DNA, 13 bp, Homo sapiens
ggagaagtctcag

SEQ ID NO: 1201554 - DNA, 21 bp, Homo sapiens
ggagaagtgggggcagcccag

SEQ ID NO: 1201555 - DNA, 15 bp, Homo sapiens
ggagaataaatttgg

SEQ ID NO: 1201556 - DNA, 12 bp, Homo sapiens
ggagaatatgat

SEQ ID NO: 1201557 - DNA, 20 bp, Homo sapiens
ggagaatcacttgaacccag

SEQ ID NO: 1201558 - DNA, 19 bp, Homo sapiens
ggagaatgcacagtgggtg

SEQ ID NO: 1201559 - DNA, 13 bp, Homo sapiens
ggagaatgcagcc

SEQ ID NO: 1201560 - DNA, 15 bp, Homo sapiens
ggagaatgcagccca

SEQ ID NO: 1201561 - DNA, 22 bp, Homo sapiens
ggagaatggggttcctgctgtg

SEQ ID NO: 1201562 - DNA, 24 bp, Homo sapiens
ggagaatggggttcctgctgtggg

SEQ ID NO: 1201563 - DNA, 15 bp, Homo sapiens
ggagacaaaagagca

SEQ ID NO: 1201564 - DNA, 16 bp, Homo sapiens
ggagacaaggtgctaa

SEQ ID NO: 1201565 - DNA, 17 bp, Homo sapiens
ggagacagaatagagtg

SEQ ID NO: 1201566 - DNA, 13 bp, Homo sapiens
ggagacagaccac

SEQ ID NO: 1201567 - DNA, 21 bp, Homo sapiens
ggagacagaggaaagggctgg

SEQ ID NO: 1201568 - DNA, 16 bp, Homo sapiens
ggagacagcagcctgt

SEQ ID NO: 1201569 - DNA, 17 bp, Homo sapiens
ggagacaggagcctagc

SEQ ID NO: 1201570 - DNA, 21 bp, Homo sapiens
ggagacatctacacacaccag

SEQ ID NO: 1201571 - DNA, 15 bp, Homo sapiens
ggagacatgtgacat

SEQ ID NO: 1201572 - DNA, 22 bp, Homo sapiens
ggagaccaaatgtcggggttgg

SEQ ID NO: 1201573 - DNA, 22 bp, Homo sapiens
ggagacccccccccaactccag

SEQ ID NO: 1201574 - DNA, 22 bp, Homo sapiens
ggagaccctgcaaacagaacag

SEQ ID NO: 1201575 - DNA, 19 bp, Homo sapiens
ggagaccctgccacagcca

SEQ ID NO: 1201576 - DNA, 20 bp, Homo sapiens
ggagaccgcttcacccctgc

SEQ ID NO: 1201577 - DNA, 16 bp, Homo sapiens
ggagacctcatgccat

SEQ ID NO: 1201578 - DNA, 12 bp, Homo sapiens
ggagacctgtgc

SEQ ID NO: 1201579 - DNA, 14 bp, Homo sapiens
ggagacctgtgcta

SEQ ID NO: 1201580 - DNA, 21 bp, Homo sapiens
ggagacctgttggcctgtggg

SEQ ID NO: 1201581 - DNA, 12 bp, Homo sapiens
ggagacgccatg

SEQ ID NO: 1201582 - DNA, 10 bp, Homo sapiens
ggagactaga

SEQ ID NO: 1201583 - DNA, 19 bp, Homo sapiens
ggagactagattgcctttg

SEQ ID NO: 1201584 - DNA, 15 bp, Homo sapiens
ggagactatggcctc

SEQ ID NO: 1201585 - DNA, 19 bp, Homo sapiens
ggagactcacctctgcctc

SEQ ID NO: 1201586 - DNA, 15 bp, Homo sapiens
ctctgcctcctcagc

SEQ ID NO: 1201587 - DNA, 13 bp, Homo sapiens
ctctgcctctctt

SEQ ID NO: 1201588 - DNA, 18 bp, Homo sapiens
ctctgcctctcttcttcc

SEQ ID NO: 1201589 - DNA, 22 bp, Homo sapiens
ctctgcctctcttcttcccctt

SEQ ID NO: 1201590 - DNA, 14 bp, Homo sapiens
ctctgcctctgggc

SEQ ID NO: 1201591 - DNA, 17 bp, Homo sapiens
ctctgcctctgggcagc

SEQ ID NO: 1201592 - DNA, 21 bp, Homo sapiens
ctctgcctctgggcagcctgc

SEQ ID NO: 1201593 - DNA, 22 bp, Homo sapiens
ctctgcctctgggcagcctgct

SEQ ID NO: 1201594 - DNA, 10 bp, Homo sapiens
ctctgcctgc

SEQ ID NO: 1201595 - DNA, 20 bp, Homo sapiens
ctctgcctgccccgccccca

SEQ ID NO: 1201596 - DNA, 13 bp, Homo sapiens
ctctgcctgtccc

SEQ ID NO: 1201597 - DNA, 23 bp, Homo sapiens
ctctgccttttttttttttttaa

SEQ ID NO: 1201598 - DNA, 18 bp, Homo sapiens
ctctgcggatagcatttg

SEQ ID NO: 1201599 - DNA, 20 bp, Homo sapiens
ctctgcgggaggctggggcc

SEQ ID NO: 1201600 - DNA, 21 bp, Homo sapiens
ctctgcgggaggctggggccc

SEQ ID NO: 1201601 - DNA, 20 bp, Homo sapiens
ctctgcgtcggtcctggtgc

SEQ ID NO: 1201602 - DNA, 21 bp, Homo sapiens
ctctgcgtcggtcctggtgcc

SEQ ID NO: 1201603 - DNA, 22 bp, Homo sapiens
ctctgcgtgcagggacaaagag

SEQ ID NO: 1201604 - DNA, 23 bp, Homo sapiens
ctctgcgtgcagggacaaagagg

SEQ ID NO: 1201605 - DNA, 23 bp, Homo sapiens
ctctgctatatataaaacggtgc

SEQ ID NO: 1201606 - DNA, 23 bp, Homo sapiens
ctctgctatatgccttaagccaa

SEQ ID NO: 1201607 - DNA, 22 bp, Homo sapiens
ctctgctcaccgcccatcaggg

SEQ ID NO: 1201608 - DNA, 15 bp, Homo sapiens
ctctgctcaggcctc

SEQ ID NO: 1201609 - DNA, 16 bp, Homo sapiens
ctctgctccaccacat

SEQ ID NO: 1201610 - DNA, 15 bp, Homo sapiens
ctctgctccagcaac

SEQ ID NO: 1201611 - DNA, 22 bp, Homo sapiens
ctctgctccagcaactgccctt

SEQ ID NO: 1201612 - DNA, 23 bp, Homo sapiens
ctctgctccatccccctgcctcc

SEQ ID NO: 1201613 - DNA, 12 bp, Homo sapiens
ctctgctccctc

SEQ ID NO: 1201614 - DNA, 11 bp, Homo sapiens
ctctgctccta

SEQ ID NO: 1201615 - DNA, 21 bp, Homo sapiens
ctctgctcctacatccagctc

SEQ ID NO: 1201616 - DNA, 21 bp, Homo sapiens
ctctgctcgccctcctttctg

SEQ ID NO: 1201617 - DNA, 16 bp, Homo sapiens
ctctgctctagccagg

SEQ ID NO: 1201618 - DNA, 18 bp, Homo sapiens
ctctgctctagccaggag

SEQ ID NO: 1201619 - DNA, 12 bp, Homo sapiens
ctctgctctgcc

SEQ ID NO: 1201620 - DNA, 13 bp, Homo sapiens
ctctgctctgccc

SEQ ID NO: 1201621 - DNA, 14 bp, Homo sapiens
ctctgctctgcctg

SEQ ID NO: 1201622 - DNA, 19 bp, Homo sapiens
ctctgctctgcctggagtg

SEQ ID NO: 1201623 - DNA, 15 bp, Homo sapiens
ctctgctgaatgcag

SEQ ID NO: 1201624 - DNA, 17 bp, Homo sapiens
ctctgctgacctgctga

SEQ ID NO: 1201625 - DNA, 15 bp, Homo sapiens
ctctgctgagctggg

SEQ ID NO: 1201626 - DNA, 13 bp, Homo sapiens
ctctgctgagggc

SEQ ID NO: 1201627 - DNA, 16 bp, Homo sapiens
ggagaggagaaaaaaa

SEQ ID NO: 1201628 - DNA, 23 bp, Homo sapiens
ggagaggcattgccttctctgcc

SEQ ID NO: 1201629 - DNA, 13 bp, Homo sapiens
ggagaggccatga

SEQ ID NO: 1201630 - DNA, 22 bp, Homo sapiens
ggagaggccctctggagtggcc

SEQ ID NO: 1201631 - DNA, 22 bp, Homo sapiens
ggagaggcctggggtgggacag

SEQ ID NO: 1201632 - DNA, 14 bp, Homo sapiens
ggagaggcggcctc

SEQ ID NO: 1201633 - DNA, 19 bp, Homo sapiens
ggagaggctgtctggggcc

SEQ ID NO: 1201634 - DNA, 13 bp, Homo sapiens
ggagagggaagag

SEQ ID NO: 1201635 - DNA, 17 bp, Homo sapiens
ggagagggaagagggag

SEQ ID NO: 1201636 - DNA, 19 bp, Homo sapiens
ggagagggaagagggagac

SEQ ID NO: 1201637 - DNA, 17 bp, Homo sapiens
ggagagggctagccctg

SEQ ID NO: 1201638 - DNA, 22 bp, Homo sapiens
ggagaggggaagggccagtctg

SEQ ID NO: 1201639 - DNA, 15 bp, Homo sapiens
ggagagggggccgga

SEQ ID NO: 1201640 - DNA, 21 bp, Homo sapiens
ggagaggggtgcacccactca

SEQ ID NO: 1201641 - DNA, 17 bp, Homo sapiens
ggagagggtctggagaa

SEQ ID NO: 1201642 - DNA, 16 bp, Homo sapiens
ggagaggtggcaggaa

SEQ ID NO: 1201643 - DNA, 23 bp, Homo sapiens
ggagaggttataggtcactcctg

SEQ ID NO: 1201644 - DNA, 17 bp, Homo sapiens
ggagagtacagtgagcc

SEQ ID NO: 1201645 - DNA, 18 bp, Homo sapiens
ggagagtgcactgacctg

SEQ ID NO: 1201646 - DNA, 21 bp, Homo sapiens
ggagagtgcggcgtgggggca

SEQ ID NO: 1201647 - DNA, 20 bp, Homo sapiens
ggagagtggcaggtgggctg

SEQ ID NO: 1201648 - DNA, 19 bp, Homo sapiens
ggagagtgtgtgggcaggg

SEQ ID NO: 1201649 - DNA, 21 bp, Homo sapiens
ggagagttggggaaggcaaga

SEQ ID NO: 1201650 - DNA, 18 bp, Homo sapiens
ggagataacagcctcttg

SEQ ID NO: 1201651 - DNA, 15 bp, Homo sapiens
ggagatagctggggc

SEQ ID NO: 1201652 - DNA, 16 bp, Homo sapiens
ggagatagctggggct

SEQ ID NO: 1201653 - DNA, 22 bp, Homo sapiens
ggagatatttatggggggagaa

SEQ ID NO: 1201654 - DNA, 13 bp, Homo sapiens
ggagatgaccagg

SEQ ID NO: 1201655 - DNA, 14 bp, Homo sapiens
ggagatgaccaggg

SEQ ID NO: 1201656 - DNA, 17 bp, Homo sapiens
ggagatgaccagggatg

SEQ ID NO: 1201657 - DNA, 15 bp, Homo sapiens
ggagatgaggccaga

SEQ ID NO: 1201658 - DNA, 16 bp, Homo sapiens
ggagatgagttgcagt

SEQ ID NO: 1201659 - DNA, 18 bp, Homo sapiens
ggagatgcatcgggaaag

SEQ ID NO: 1201660 - DNA, 20 bp, Homo sapiens
ggagatggaagttgcagtga

SEQ ID NO: 1201661 - DNA, 12 bp, Homo sapiens
ggagatgggggc

SEQ ID NO: 1201662 - DNA, 13 bp, Homo sapiens
ggagatgggggct

SEQ ID NO: 1201663 - DNA, 21 bp, Homo sapiens
ggagattctgggtttgcccag

SEQ ID NO: 1201664 - DNA, 12 bp, Homo sapiens
ggagattggcca

SEQ ID NO: 1201665 - DNA, 24 bp, Homo sapiens
ggagattggccagtgagaagctga

SEQ ID NO: 1201666 - DNA, 19 bp, Homo sapiens
ggagattttaggtgttgat

SEQ ID NO: 1201667 - DNA, 22 bp, Homo sapiens
ggagatttttttgagtcaaaga

SEQ ID NO: 1201668 - DNA, 14 bp, Homo sapiens
ggagcaaaaggcag

SEQ ID NO: 1201669 - DNA, 18 bp, Homo sapiens
ggagcaaaaggcagctca

SEQ ID NO: 1201670 - DNA, 22 bp, Homo sapiens
ggagcaaaaggcagctcacccc

SEQ ID NO: 1201671 - DNA, 15 bp, Homo sapiens
ggagcaaaccattat

SEQ ID NO: 1201672 - DNA, 18 bp, Homo sapiens
ggagcaagaagaaaatgt

SEQ ID NO: 1201673 - DNA, 23 bp, Homo sapiens
ggagcaagaaggaaggaggcaga

SEQ ID NO: 1201674 - DNA, 15 bp, Homo sapiens
ggagcaatcacagga

SEQ ID NO: 1201675 - DNA, 21 bp, Homo sapiens
ggagcaattacggggtgacct

SEQ ID NO: 1201676 - DNA, 16 bp, Homo sapiens
ggagcacagccctggg

SEQ ID NO: 1201677 - DNA, 17 bp, Homo sapiens
ggagcacaggtcccacc

SEQ ID NO: 1201678 - DNA, 22 bp, Homo sapiens
ggagcacaggtgtctgcctaga

SEQ ID NO: 1201679 - DNA, 19 bp, Homo sapiens
ggagcacccagagcacccc

SEQ ID NO: 1201680 - DNA, 23 bp, Homo sapiens
ggagcacccagagcaccccctgc

SEQ ID NO: 1201681 - DNA, 14 bp, Homo sapiens
ggagcacctgaacc

SEQ ID NO: 1201682 - DNA, 23 bp, Homo sapiens
ggagcacctggaccccctgcccg

SEQ ID NO: 1201683 - DNA, 12 bp, Homo sapiens
ggagcacctgtc

SEQ ID NO: 1201684 - DNA, 15 bp, Homo sapiens
ggagcactggagtgc

SEQ ID NO: 1201685 - DNA, 19 bp, Homo sapiens
ggagcacttgcgtcctgca

SEQ ID NO: 1201686 - DNA, 20 bp, Homo sapiens
ggagcacttgcgtcctgcag

SEQ ID NO: 1201687 - DNA, 21 bp, Homo sapiens
ggagcacttgcgtcctgcaga

SEQ ID NO: 1201688 - DNA, 20 bp, Homo sapiens
ggagcacttgttttaaaatg

SEQ ID NO: 1201689 - DNA, 13 bp, Homo sapiens
ggagcagagagag

SEQ ID NO: 1201690 - DNA, 14 bp, Homo sapiens
ggagcagagagagc

SEQ ID NO: 1201691 - DNA, 12 bp, Homo sapiens
ggagcagagagg

SEQ ID NO: 1201692 - DNA, 14 bp, Homo sapiens
ggagcagagaggtg

SEQ ID NO: 1201693 - DNA, 18 bp, Homo sapiens
ggagcagagaggtggcca

SEQ ID NO: 1201694 - DNA, 12 bp, Homo sapiens
ggagcagagctc

SEQ ID NO: 1201695 - DNA, 21 bp, Homo sapiens
ggagcagagctctcccctcct

SEQ ID NO: 1201696 - DNA, 12 bp, Homo sapiens
ggagcagagggg

SEQ ID NO: 1201697 - DNA, 12 bp, Homo sapiens
ggagcagcaaga

SEQ ID NO: 1201698 - DNA, 21 bp, Homo sapiens
ggagcagcaagaagcagcctg

SEQ ID NO: 1201699 - DNA, 22 bp, Homo sapiens
ggagcagcaagaagcagcctgt

SEQ ID NO: 1201700 - DNA, 19 bp, Homo sapiens
ggagcagcagccagcacca

SEQ ID NO: 1201701 - DNA, 21 bp, Homo sapiens
ggagcagccaaggccgccagc

SEQ ID NO: 1201702 - DNA, 15 bp, Homo sapiens
ggagcagccagagct

SEQ ID NO: 1201703 - DNA, 19 bp, Homo sapiens
ggagcagccagagctgtgc

SEQ ID NO: 1201704 - DNA, 19 bp, Homo sapiens
ggagcagcctcgaggctgg

SEQ ID NO: 1201705 - DNA, 16 bp, Homo sapiens
ggagcagcggctctgg

SEQ ID NO: 1201706 - DNA, 17 bp, Homo sapiens
ggagcagcggctctggt

SEQ ID NO: 1201707 - DNA, 16 bp, Homo sapiens
gctcctcctccctgca

SEQ ID NO: 1201708 - DNA, 16 bp, Homo sapiens
gctcctcctgccctgt

SEQ ID NO: 1201709 - DNA, 20 bp, Homo sapiens
gctcctcctgccctgtccct

SEQ ID NO: 1201710 - DNA, 14 bp, Homo sapiens
gctcctccttccca

SEQ ID NO: 1201711 - DNA, 15 bp, Homo sapiens
gctcctccttcccag

SEQ ID NO: 1201712 - DNA, 16 bp, Homo sapiens
gctcctccttcccagg

SEQ ID NO: 1201713 - DNA, 17 bp, Homo sapiens
gctcctccttcccaggg

SEQ ID NO: 1201714 - DNA, 23 bp, Homo sapiens
gctcctccttcccagggaccagc

SEQ ID NO: 1201715 - DNA, 12 bp, Homo sapiens
gctcctcgcccc

SEQ ID NO: 1201716 - DNA, 13 bp, Homo sapiens
gctcctcgccccc

SEQ ID NO: 1201717 - DNA, 16 bp, Homo sapiens
gctcctcgcccccacc

SEQ ID NO: 1201718 - DNA, 12 bp, Homo sapiens
gctcctctaggg

SEQ ID NO: 1201719 - DNA, 18 bp, Homo sapiens
gctcctctaggggcagcc

SEQ ID NO: 1201720 - DNA, 12 bp, Homo sapiens
gctcctctcagt

SEQ ID NO: 1201721 - DNA, 14 bp, Homo sapiens
gctcctctccaggc

SEQ ID NO: 1201722 - DNA, 15 bp, Homo sapiens
gctcctctccaggca

SEQ ID NO: 1201723 - DNA, 18 bp, Homo sapiens
gctcctctccttgggctc

SEQ ID NO: 1201724 - DNA, 19 bp, Homo sapiens
gctcctctccttgggctcc

SEQ ID NO: 1201725 - DNA, 21 bp, Homo sapiens
gctcctctccttgggctcctg

SEQ ID NO: 1201726 - DNA, 22 bp, Homo sapiens
gctcctctccttgggctcctgg

SEQ ID NO: 1201727 - DNA, 11 bp, Homo sapiens
gctcctctgag

SEQ ID NO: 1201728 - DNA, 13 bp, Homo sapiens
gctcctctgagcc

SEQ ID NO: 1201729 - DNA, 15 bp, Homo sapiens
gctcctctgccttgg

SEQ ID NO: 1201730 - DNA, 18 bp, Homo sapiens
gctcctctgccttggaca

SEQ ID NO: 1201731 - DNA, 11 bp, Homo sapiens
gctcctctggg

SEQ ID NO: 1201732 - DNA, 12 bp, Homo sapiens
gctcctctgggc

SEQ ID NO: 1201733 - DNA, 13 bp, Homo sapiens
gctcctctgggca

SEQ ID NO: 1201734 - DNA, 18 bp, Homo sapiens
gctcctcttaccgtagcc

SEQ ID NO: 1201735 - DNA, 23 bp, Homo sapiens
gctcctcttaccgtagcctccgt

SEQ ID NO: 1201736 - DNA, 18 bp, Homo sapiens
gctcctcttgattcctgg

SEQ ID NO: 1201737 - DNA, 17 bp, Homo sapiens
gctcctctttcccctcc

SEQ ID NO: 1201738 - DNA, 16 bp, Homo sapiens
gctcctgacccctccc

SEQ ID NO: 1201739 - DNA, 20 bp, Homo sapiens
gctcctgacccctccctgca

SEQ ID NO: 1201740 - DNA, 22 bp, Homo sapiens
gctcctgagtagctgggcctgt

SEQ ID NO: 1201741 - DNA, 12 bp, Homo sapiens
gctcctgcactt

SEQ ID NO: 1201742 - DNA, 12 bp, Homo sapiens
gctcctgcccac

SEQ ID NO: 1201743 - DNA, 17 bp, Homo sapiens
gctcctgcccagccacc

SEQ ID NO: 1201744 - DNA, 14 bp, Homo sapiens
gctcctgcttcccc

SEQ ID NO: 1201745 - DNA, 15 bp, Homo sapiens
gctcctgcttttctg

SEQ ID NO: 1201746 - DNA, 18 bp, Homo sapiens
gctcctggaaaggctcag

SEQ ID NO: 1201747 - DNA, 14 bp, Homo sapiens
gctcctggcccact

SEQ ID NO: 1201748 - DNA, 18 bp, Homo sapiens
gctcctggcccactgcat

SEQ ID NO: 1201749 - DNA, 11 bp, Homo sapiens
gctcctggctg

SEQ ID NO: 1201750 - DNA, 14 bp, Homo sapiens
gctcctggctgcca

SEQ ID NO: 1201751 - DNA, 15 bp, Homo sapiens
gctcctggctgccag

SEQ ID NO: 1201752 - DNA, 18 bp, Homo sapiens
gctcctggctgccaggcg

SEQ ID NO: 1201753 - DNA, 16 bp, Homo sapiens
gctcctggctgtgccc

SEQ ID NO: 1201754 - DNA, 20 bp, Homo sapiens
gctcctggctgtgcccagca

SEQ ID NO: 1201755 - DNA, 16 bp, Homo sapiens
gctcctggggagctcc

SEQ ID NO: 1201756 - DNA, 15 bp, Homo sapiens
gctcctggggcagag

SEQ ID NO: 1201757 - DNA, 23 bp, Homo sapiens
gctcctgggggttctttcttcct

SEQ ID NO: 1201758 - DNA, 14 bp, Homo sapiens
gctcctgggttgga

SEQ ID NO: 1201759 - DNA, 19 bp, Homo sapiens
gctcctgggttggagggaa

SEQ ID NO: 1201760 - DNA, 20 bp, Homo sapiens
gctcctgggttggagggaac

SEQ ID NO: 1201761 - DNA, 23 bp, Homo sapiens
gctcctgggttggagggaaccac

SEQ ID NO: 1201762 - DNA, 22 bp, Homo sapiens
gctcctgtacttgtcctcagct

SEQ ID NO: 1201763 - DNA, 15 bp, Homo sapiens
gctcctgtcctccca

SEQ ID NO: 1201764 - DNA, 22 bp, Homo sapiens
gctcctgtcctcccatcccctg

SEQ ID NO: 1201765 - DNA, 18 bp, Homo sapiens
gctcctgtctgccagcca

SEQ ID NO: 1201766 - DNA, 21 bp, Homo sapiens
gctcctgtctgccagccagca

SEQ ID NO: 1201767 - DNA, 20 bp, Homo sapiens
gctcctgtggccccaccctg

SEQ ID NO: 1201768 - DNA, 12 bp, Homo sapiens
gctccttcactg

SEQ ID NO: 1201769 - DNA, 13 bp, Homo sapiens
gctccttcactgt

SEQ ID NO: 1201770 - DNA, 17 bp, Homo sapiens
gctccttcactgttccc

SEQ ID NO: 1201771 - DNA, 23 bp, Homo sapiens
gctccttcactgttccctctggc

SEQ ID NO: 1201772 - DNA, 24 bp, Homo sapiens
gctccttcactgttccctctggct

SEQ ID NO: 1201773 - DNA, 14 bp, Homo sapiens
gctccttcccagga

SEQ ID NO: 1201774 - DNA, 17 bp, Homo sapiens
gctccttcccaggaccc

SEQ ID NO: 1201775 - DNA, 17 bp, Homo sapiens
gctccttcccctgcacc

SEQ ID NO: 1201776 - DNA, 19 bp, Homo sapiens
gctccttcccctgcacctg

SEQ ID NO: 1201777 - DNA, 23 bp, Homo sapiens
gctccttcctggagactgcccag

SEQ ID NO: 1201778 - DNA, 18 bp, Homo sapiens
gctccttgagtaaaaagg

SEQ ID NO: 1201779 - DNA, 19 bp, Homo sapiens
gctccttgcagcagggctg

SEQ ID NO: 1201780 - DNA, 13 bp, Homo sapiens
gctccttggcgga

SEQ ID NO: 1201781 - DNA, 16 bp, Homo sapiens
gctccttggctgcagc

SEQ ID NO: 1201782 - DNA, 15 bp, Homo sapiens
gctcctttaccctct

SEQ ID NO: 1201783 - DNA, 17 bp, Homo sapiens
gctcctttctccagcca

SEQ ID NO: 1201784 - DNA, 18 bp, Homo sapiens
gctcctttctccagccag

SEQ ID NO: 1201785 - DNA, 19 bp, Homo sapiens
gctcctttgtgtgtgtgtc

SEQ ID NO: 1201786 - DNA, 14 bp, Homo sapiens
gctccttttgtccc

SEQ ID NO: 1201787 - DNA, 22 bp, Homo sapiens
gctccttttgtccccagggccc

SEQ ID NO: 1201788 - DNA, 19 bp, Homo sapiens
gctcctttttctccctctg

SEQ ID NO: 1201789 - DNA, 19 bp, Homo sapiens
gctcgagtcacattctgct

SEQ ID NO: 1201790 - DNA, 18 bp, Homo sapiens
gctcgatgtttgccatga

SEQ ID NO: 1201791 - DNA, 17 bp, Homo sapiens
gctcgcatccagacagt

SEQ ID NO: 1201792 - DNA, 20 bp, Homo sapiens
gctcgccacgctcagtgccc

SEQ ID NO: 1201793 - DNA, 21 bp, Homo sapiens
gctcgccatcaaggtccagtg

SEQ ID NO: 1201794 - DNA, 22 bp, Homo sapiens
gctcgccatcaaggtccagtgg

SEQ ID NO: 1201795 - DNA, 23 bp, Homo sapiens
gctcgcccagacaccatgtgcaa

SEQ ID NO: 1201796 - DNA, 13 bp, Homo sapiens
gctcgccccaccc

SEQ ID NO: 1201797 - DNA, 17 bp, Homo sapiens
gctcgcccctcccctca

SEQ ID NO: 1201798 - DNA, 16 bp, Homo sapiens
gctcgccctcctttct

SEQ ID NO: 1201799 - DNA, 20 bp, Homo sapiens
gctcgccctcctttctgtgc

SEQ ID NO: 1201800 - DNA, 18 bp, Homo sapiens
gctcgccgtgtctcagcc

SEQ ID NO: 1201801 - DNA, 12 bp, Homo sapiens
gctcgccttccc

SEQ ID NO: 1201802 - DNA, 13 bp, Homo sapiens
gctcgccttccct

SEQ ID NO: 1201803 - DNA, 13 bp, Homo sapiens
gctcgctcaggtg

SEQ ID NO: 1201804 - DNA, 16 bp, Homo sapiens
gctcgctccctgtagc

SEQ ID NO: 1201805 - DNA, 12 bp, Homo sapiens
gctgagccctgg

SEQ ID NO: 1201806 - DNA, 14 bp, Homo sapiens
gctgagccctggca

SEQ ID NO: 1201807 - DNA, 15 bp, Homo sapiens
gctgagccctggcag

SEQ ID NO: 1201808 - DNA, 13 bp, Homo sapiens
gctgagccctgta

SEQ ID NO: 1201809 - DNA, 22 bp, Homo sapiens
gctgagccctgtacccacccca

SEQ ID NO: 1201810 - DNA, 21 bp, Homo sapiens
gctgagcctcacagcagtgag

SEQ ID NO: 1201811 - DNA, 17 bp, Homo sapiens
gctgagcctcgtgtcca

SEQ ID NO: 1201812 - DNA, 13 bp, Homo sapiens
gctgagcctctgc

SEQ ID NO: 1201813 - DNA, 20 bp, Homo sapiens
gctgagcctctgctccccag

SEQ ID NO: 1201814 - DNA, 15 bp, Homo sapiens
gctgagcctggctgg

SEQ ID NO: 1201815 - DNA, 22 bp, Homo sapiens
gctgagcgtggaagggggagga

SEQ ID NO: 1201816 - DNA, 14 bp, Homo sapiens
gctgagctctctgt

SEQ ID NO: 1201817 - DNA, 15 bp, Homo sapiens
gctgagctgagcttc

SEQ ID NO: 1201818 - DNA, 18 bp, Homo sapiens
gctgagctgagtggccag

SEQ ID NO: 1201819 - DNA, 22 bp, Homo sapiens
gctgagctggaaggggccacgt

SEQ ID NO: 1201820 - DNA, 11 bp, Homo sapiens
gctgagctggg

SEQ ID NO: 1201821 - DNA, 17 bp, Homo sapiens
gctgagctgggcccagc

SEQ ID NO: 1201822 - DNA, 13 bp, Homo sapiens
gctgagctgggga

SEQ ID NO: 1201823 - DNA, 21 bp, Homo sapiens
gctgagcttcggttctccaga

SEQ ID NO: 1201824 - DNA, 15 bp, Homo sapiens
gctgaggaacaggtt

SEQ ID NO: 1201825 - DNA, 23 bp, Homo sapiens
gctgaggactttgcccaggatga

SEQ ID NO: 1201826 - DNA, 19 bp, Homo sapiens
gctgaggagcagccaggac

SEQ ID NO: 1201827 - DNA, 20 bp, Homo sapiens
gctgaggagcagccaggacc

SEQ ID NO: 1201828 - DNA, 18 bp, Homo sapiens
gctgaggaggcacctaca

SEQ ID NO: 1201829 - DNA, 16 bp, Homo sapiens
gctgaggagtctgagg

SEQ ID NO: 1201830 - DNA, 19 bp, Homo sapiens
gctgaggatttcaagcctg

SEQ ID NO: 1201831 - DNA, 18 bp, Homo sapiens
gctgaggatttcctggag

SEQ ID NO: 1201832 - DNA, 16 bp, Homo sapiens
gctgaggcaggagact

SEQ ID NO: 1201833 - DNA, 19 bp, Homo sapiens
gctgaggccacactcagca

SEQ ID NO: 1201834 - DNA, 15 bp, Homo sapiens
gctgaggccagggct

SEQ ID NO: 1201835 - DNA, 19 bp, Homo sapiens
gctgaggcccagtgcatat

SEQ ID NO: 1201836 - DNA, 20 bp, Homo sapiens
gctgaggcctatgcagacat

SEQ ID NO: 1201837 - DNA, 14 bp, Homo sapiens
gctgaggcctggac

SEQ ID NO: 1201838 - DNA, 13 bp, Homo sapiens
gctgaggcctggg

SEQ ID NO: 1201839 - DNA, 20 bp, Homo sapiens
gctgaggcctgggccgctgc

SEQ ID NO: 1201840 - DNA, 21 bp, Homo sapiens
gctgaggccttatcattcatt

SEQ ID NO: 1201841 - DNA, 16 bp, Homo sapiens
gctgaggcgggagaat

SEQ ID NO: 1201842 - DNA, 16 bp, Homo sapiens
gctgaggctggcacag

SEQ ID NO: 1201843 - DNA, 23 bp, Homo sapiens
gctgaggctgggggagagccgtg

SEQ ID NO: 1201844 - DNA, 23 bp, Homo sapiens
gctgagggcctgctggaggcctc

SEQ ID NO: 1201845 - DNA, 11 bp, Homo sapiens
gctgaggggac

SEQ ID NO: 1201846 - DNA, 15 bp, Homo sapiens
gctgaggggcaggga

SEQ ID NO: 1201847 - DNA, 18 bp, Homo sapiens
gctgaggggcctgcgccc

SEQ ID NO: 1201848 - DNA, 20 bp, Homo sapiens
ctccatcatatgcctgaccc

SEQ ID NO: 1201849 - DNA, 12 bp, Homo sapiens
ctccatccaagg

SEQ ID NO: 1201850 - DNA, 13 bp, Homo sapiens
ctccatccaaggc

SEQ ID NO: 1201851 - DNA, 19 bp, Homo sapiens
ctccatccacgtggcctct

SEQ ID NO: 1201852 - DNA, 17 bp, Homo sapiens
ctccatcccaacagcca

SEQ ID NO: 1201853 - DNA, 19 bp, Homo sapiens
ctccatccccatcggccct

SEQ ID NO: 1201854 - DNA, 22 bp, Homo sapiens
ctccatccccatcggccctgtc

SEQ ID NO: 1201855 - DNA, 23 bp, Homo sapiens
ctccatccccctttaccctcttt

SEQ ID NO: 1201856 - DNA, 12 bp, Homo sapiens
ctccatcccctc

SEQ ID NO: 1201857 - DNA, 19 bp, Homo sapiens
ctccatcccctccctgcct

SEQ ID NO: 1201858 - DNA, 12 bp, Homo sapiens
ctccatccctct

SEQ ID NO: 1201859 - DNA, 13 bp, Homo sapiens
ctccatccctgct

SEQ ID NO: 1201860 - DNA, 15 bp, Homo sapiens
ctccatccctgctct

SEQ ID NO: 1201861 - DNA, 16 bp, Homo sapiens
ctccatccgtgctgca

SEQ ID NO: 1201862 - DNA, 18 bp, Homo sapiens
ctccatcgccatcttctt

SEQ ID NO: 1201863 - DNA, 20 bp, Homo sapiens
ctccatcgccatcttcttcc

SEQ ID NO: 1201864 - DNA, 20 bp, Homo sapiens
ctccatcgcccaggcctggg

SEQ ID NO: 1201865 - DNA, 21 bp, Homo sapiens
ctccatcgcgccagcgacctc

SEQ ID NO: 1201866 - DNA, 18 bp, Homo sapiens
ctccatcgtctcatcctc

SEQ ID NO: 1201867 - DNA, 19 bp, Homo sapiens
ctccatcgtctcatcctcc

SEQ ID NO: 1201868 - DNA, 21 bp, Homo sapiens
ctccatcgtctcatcctcctt

SEQ ID NO: 1201869 - DNA, 24 bp, Homo sapiens
ctccatcgtctcatcctcctttca

SEQ ID NO: 1201870 - DNA, 21 bp, Homo sapiens
ctccatctctcatcctccagt

SEQ ID NO: 1201871 - DNA, 12 bp, Homo sapiens
ctccatcttatt

SEQ ID NO: 1201872 - DNA, 22 bp, Homo sapiens
ctccatcttggtagttctgtgc

SEQ ID NO: 1201873 - DNA, 21 bp, Homo sapiens
ctccatgactggctgtctgcc

SEQ ID NO: 1201874 - DNA, 13 bp, Homo sapiens
ctccatgagcacc

SEQ ID NO: 1201875 - DNA, 19 bp, Homo sapiens
ctccatgccccagctctgg

SEQ ID NO: 1201876 - DNA, 16 bp, Homo sapiens
ctccatgctccttgag

SEQ ID NO: 1201877 - DNA, 12 bp, Homo sapiens
ctccatgctgca

SEQ ID NO: 1201878 - DNA, 13 bp, Homo sapiens
ctccatgctgcct

SEQ ID NO: 1201879 - DNA, 21 bp, Homo sapiens
ctccatgctggatactggaca

SEQ ID NO: 1201880 - DNA, 15 bp, Homo sapiens
ctccatggccacccc

SEQ ID NO: 1201881 - DNA, 22 bp, Homo sapiens
ctccatggccaccccgtgccac

SEQ ID NO: 1201882 - DNA, 20 bp, Homo sapiens
ctccatggctaagaccacag

SEQ ID NO: 1201883 - DNA, 15 bp, Homo sapiens
ctccatggcttcctc

SEQ ID NO: 1201884 - DNA, 17 bp, Homo sapiens
ctccatggcttcctcct

SEQ ID NO: 1201885 - DNA, 19 bp, Homo sapiens
ctccatggcttcctcctcc

SEQ ID NO: 1201886 - DNA, 20 bp, Homo sapiens
ctccatggcttcctcctccc

SEQ ID NO: 1201887 - DNA, 17 bp, Homo sapiens
ctccatggggttcgaga

SEQ ID NO: 1201888 - DNA, 18 bp, Homo sapiens
ctccatggggttcgagac

SEQ ID NO: 1201889 - DNA, 19 bp, Homo sapiens
ctccatgtgggtgctaggg

SEQ ID NO: 1201890 - DNA, 18 bp, Homo sapiens
ctccatgttggcctgtca

SEQ ID NO: 1201891 - DNA, 22 bp, Homo sapiens
ctccattaggatttgccccttc

SEQ ID NO: 1201892 - DNA, 14 bp, Homo sapiens
ctccattctatttt

SEQ ID NO: 1201893 - DNA, 20 bp, Homo sapiens
ctccattgggcacagtccag

SEQ ID NO: 1201894 - DNA, 15 bp, Homo sapiens
ctccattgtgtgatc

SEQ ID NO: 1201895 - DNA, 22 bp, Homo sapiens
ctccattgtgtgatccagccct

SEQ ID NO: 1201896 - DNA, 18 bp, Homo sapiens
ctccatttataaccccag

SEQ ID NO: 1201897 - DNA, 21 bp, Homo sapiens
ctccatttataaccccagcct

SEQ ID NO: 1201898 - DNA, 23 bp, Homo sapiens
ctccatttataaccccagcctga

SEQ ID NO: 1201899 - DNA, 13 bp, Homo sapiens
ctccatttctgtc

SEQ ID NO: 1201900 - DNA, 15 bp, Homo sapiens
ctccatttctttctt

SEQ ID NO: 1201901 - DNA, 18 bp, Homo sapiens
ctccatttctttcttcca

SEQ ID NO: 1201902 - DNA, 22 bp, Homo sapiens
ctccatttgagaaaataaagct

SEQ ID NO: 1201903 - DNA, 18 bp, Homo sapiens
ctccatttggaattacaa

SEQ ID NO: 1201904 - DNA, 15 bp, Homo sapiens
ctccattttagccca

SEQ ID NO: 1201905 - DNA, 21 bp, Homo sapiens
ctccattttagcccagtgttt

SEQ ID NO: 1201906 - DNA, 18 bp, Homo sapiens
ctcccaaacgccctttcc

SEQ ID NO: 1201907 - DNA, 20 bp, Homo sapiens
ctcccaaacgccctttcctc

SEQ ID NO: 1201908 - DNA, 20 bp, Homo sapiens
ctcccaaagctcagacttgc

SEQ ID NO: 1201909 - DNA, 20 bp, Homo sapiens
ctcccaaagtgctgggatta

SEQ ID NO: 1201910 - DNA, 22 bp, Homo sapiens
ctcccaaagtgctgggattaca

SEQ ID NO: 1201911 - DNA, 14 bp, Homo sapiens
ctcccaacagcgct

SEQ ID NO: 1201912 - DNA, 15 bp, Homo sapiens
ctcccaacccattca

SEQ ID NO: 1201913 - DNA, 14 bp, Homo sapiens
ctcccaacccccct

SEQ ID NO: 1201914 - DNA, 22 bp, Homo sapiens
ctcccaaccctgggctggggag

SEQ ID NO: 1201915 - DNA, 16 bp, Homo sapiens
ctcccaacctcaatgc

SEQ ID NO: 1201916 - DNA, 23 bp, Homo sapiens
ctcccaacctcaatgccctgcca

SEQ ID NO: 1201917 - DNA, 24 bp, Homo sapiens
ctcccaacctcaatgccctgccat

SEQ ID NO: 1201918 - DNA, 22 bp, Homo sapiens
ctcccaacgagcctcctcaggg

SEQ ID NO: 1201919 - DNA, 21 bp, Homo sapiens
ctcccaagacttcattgtccc

SEQ ID NO: 1201920 - DNA, 18 bp, Homo sapiens
ctcccaagcgttcctggc

SEQ ID NO: 1201921 - DNA, 21 bp, Homo sapiens
ctcccaaggggcccaaattct

SEQ ID NO: 1201922 - DNA, 22 bp, Homo sapiens
ctcccaaggggcccaaattctt

SEQ ID NO: 1201923 - DNA, 18 bp, Homo sapiens
ctcccaaggtcctctcag

SEQ ID NO: 1201924 - DNA, 18 bp, Homo sapiens
ctcccaaggttggagccc

SEQ ID NO: 1201925 - DNA, 16 bp, Homo sapiens
ctcccaagtagctggg

SEQ ID NO: 1201926 - DNA, 21 bp, Homo sapiens
gctgcagcaggtgctgggctg

SEQ ID NO: 1201927 - DNA, 22 bp, Homo sapiens
gctgcagcatgttgctgaggag

SEQ ID NO: 1201928 - DNA, 21 bp, Homo sapiens
gctgcagccatcccgcttagc

SEQ ID NO: 1201929 - DNA, 13 bp, Homo sapiens
gctgcagcctgca

SEQ ID NO: 1201930 - DNA, 15 bp, Homo sapiens
gctgcagctggacag

SEQ ID NO: 1201931 - DNA, 16 bp, Homo sapiens
gctgcagctggacaga

SEQ ID NO: 1201932 - DNA, 19 bp, Homo sapiens
gctgcagctgggccccatg

SEQ ID NO: 1201933 - DNA, 22 bp, Homo sapiens
gctgcagctgggccccatgctc

SEQ ID NO: 1201934 - DNA, 12 bp, Homo sapiens
gctgcaggagtg

SEQ ID NO: 1201935 - DNA, 23 bp, Homo sapiens
gctgcaggagtgtcctgcccatg

SEQ ID NO: 1201936 - DNA, 20 bp, Homo sapiens
gctgcaggctttgccattgt

SEQ ID NO: 1201937 - DNA, 12 bp, Homo sapiens
gctgcagggcac

SEQ ID NO: 1201938 - DNA, 22 bp, Homo sapiens
gctgcagggcacggggacctgg

SEQ ID NO: 1201939 - DNA, 21 bp, Homo sapiens
gctgcaggtacttcctcctga

SEQ ID NO: 1201940 - DNA, 16 bp, Homo sapiens
gctgcagtaggggagg

SEQ ID NO: 1201941 - DNA, 20 bp, Homo sapiens
gctgcagtaggggaggagca

SEQ ID NO: 1201942 - DNA, 14 bp, Homo sapiens
gctgcagtcatcta

SEQ ID NO: 1201943 - DNA, 18 bp, Homo sapiens
gctgcagttaccacagca

SEQ ID NO: 1201944 - DNA, 20 bp, Homo sapiens
gctgcagttaccacagcaac

SEQ ID NO: 1201945 - DNA, 22 bp, Homo sapiens
gctgcagttaccacagcaactg

SEQ ID NO: 1201946 - DNA, 22 bp, Homo sapiens
gctgcagttctactcaggctgg

SEQ ID NO: 1201947 - DNA, 21 bp, Homo sapiens
gctgcatactttgacaaggaa

SEQ ID NO: 1201948 - DNA, 16 bp, Homo sapiens
gctgcatgacctacca

SEQ ID NO: 1201949 - DNA, 23 bp, Homo sapiens
gctgcatgacctaccaggacaga

SEQ ID NO: 1201950 - DNA, 15 bp, Homo sapiens
gctgcattagaaaaa

SEQ ID NO: 1201951 - DNA, 19 bp, Homo sapiens
gctgcatttaaaagataca

SEQ ID NO: 1201952 - DNA, 17 bp, Homo sapiens
gctgccaaaaccacatg

SEQ ID NO: 1201953 - DNA, 13 bp, Homo sapiens
gctgccaaatgcg

SEQ ID NO: 1201954 - DNA, 23 bp, Homo sapiens
gctgccaaggccagagtggcctg

SEQ ID NO: 1201955 - DNA, 15 bp, Homo sapiens
gctgccacaacctgt

SEQ ID NO: 1201956 - DNA, 19 bp, Homo sapiens
gctgccaccacgtctgcca

SEQ ID NO: 1201957 - DNA, 20 bp, Homo sapiens
gctgccaccacgtctgccag

SEQ ID NO: 1201958 - DNA, 15 bp, Homo sapiens
gctgccaccagcccc

SEQ ID NO: 1201959 - DNA, 16 bp, Homo sapiens
gctgccaccagccccc

SEQ ID NO: 1201960 - DNA, 14 bp, Homo sapiens
gctgccacccacct

SEQ ID NO: 1201961 - DNA, 23 bp, Homo sapiens
gctgccacccacctccctgcctc

SEQ ID NO: 1201962 - DNA, 14 bp, Homo sapiens
gctgccacccctct

SEQ ID NO: 1201963 - DNA, 19 bp, Homo sapiens
gctgccacccctcttctgc

SEQ ID NO: 1201964 - DNA, 21 bp, Homo sapiens
gctgccacccctcttctgctc

SEQ ID NO: 1201965 - DNA, 14 bp, Homo sapiens
gctgccactgggca

SEQ ID NO: 1201966 - DNA, 12 bp, Homo sapiens
gctgccagagaa

SEQ ID NO: 1201967 - DNA, 14 bp, Homo sapiens
gctgccagccgggc

SEQ ID NO: 1201968 - DNA, 21 bp, Homo sapiens
gctgccagcctgagcggaggc

SEQ ID NO: 1201969 - DNA, 16 bp, Homo sapiens
gctgccagccttgagc

SEQ ID NO: 1201970 - DNA, 13 bp, Homo sapiens
gctgccaggaaac

SEQ ID NO: 1201971 - DNA, 22 bp, Homo sapiens
gctgccaggaaacaagggaagg

SEQ ID NO: 1201972 - DNA, 17 bp, Homo sapiens
gctgccaggcggccctg

SEQ ID NO: 1201973 - DNA, 18 bp, Homo sapiens
ctcccagaggtccagccc

SEQ ID NO: 1201974 - DNA, 19 bp, Homo sapiens
ctcccagaggtccagccca

SEQ ID NO: 1201975 - DNA, 22 bp, Homo sapiens
ctcccagaggtccagcccatct

SEQ ID NO: 1201976 - DNA, 16 bp, Homo sapiens
ctcccagcactgcctc

SEQ ID NO: 1201977 - DNA, 20 bp, Homo sapiens
ctcccagcactgcctcctgt

SEQ ID NO: 1201978 - DNA, 13 bp, Homo sapiens
ctcccagcagagc

SEQ ID NO: 1201979 - DNA, 15 bp, Homo sapiens
ctcccagcagagccc

SEQ ID NO: 1201980 - DNA, 16 bp, Homo sapiens
ctcccagcccacctca

SEQ ID NO: 1201981 - DNA, 21 bp, Homo sapiens
ctcccagccctatggatgtgg

SEQ ID NO: 1201982 - DNA, 11 bp, Homo sapiens
ctcccagcctg

SEQ ID NO: 1201983 - DNA, 15 bp, Homo sapiens
ctcccagctcctttc

SEQ ID NO: 1201984 - DNA, 20 bp, Homo sapiens
ctcccagctctagacaaccc

SEQ ID NO: 1201985 - DNA, 11 bp, Homo sapiens
ctcccagctgc

SEQ ID NO: 1201986 - DNA, 13 bp, Homo sapiens
ctcccagctgctt

SEQ ID NO: 1201987 - DNA, 14 bp, Homo sapiens
ctcccagctgcttt

SEQ ID NO: 1201988 - DNA, 18 bp, Homo sapiens
ctcccagctgtgctgtgg

SEQ ID NO: 1201989 - DNA, 18 bp, Homo sapiens
ctcccaggaactgggcca

SEQ ID NO: 1201990 - DNA, 11 bp, Homo sapiens
ctcccaggaag

SEQ ID NO: 1201991 - DNA, 14 bp, Homo sapiens
ctcccaggacacat

SEQ ID NO: 1201992 - DNA, 18 bp, Homo sapiens
ctcccaggaccctccact

SEQ ID NO: 1201993 - DNA, 17 bp, Homo sapiens
ctcccaggcaagcagct

SEQ ID NO: 1201994 - DNA, 20 bp, Homo sapiens
ctcccaggcctgcctgcatg

SEQ ID NO: 1201995 - DNA, 17 bp, Homo sapiens
ctcccaggcgccccttc

SEQ ID NO: 1201996 - DNA, 20 bp, Homo sapiens
ctcccaggcgccccttcccc

SEQ ID NO: 1201997 - DNA, 22 bp, Homo sapiens
ctcccaggcgccccttccccct

SEQ ID NO: 1201998 - DNA, 23 bp, Homo sapiens
ctcccaggctgctggagtgcagt

SEQ ID NO: 1201999 - DNA, 12 bp, Homo sapiens
ctcccaggctgg

SEQ ID NO: 1202000 - DNA, 13 bp, Homo sapiens
ctcccaggctgga

SEQ ID NO: 1202001 - DNA, 20 bp, Homo sapiens
ctcccaggctggagtgcagt

SEQ ID NO: 1202002 - DNA, 22 bp, Homo sapiens
ctcccagggccagggccctgca

SEQ ID NO: 1202003 - DNA, 19 bp, Homo sapiens
ctcccaggggactgttcct

SEQ ID NO: 1202004 - DNA, 18 bp, Homo sapiens
ctcccaggggagccagct

SEQ ID NO: 1202005 - DNA, 19 bp, Homo sapiens
ctcccaggggagccagctg

SEQ ID NO: 1202006 - DNA, 23 bp, Homo sapiens
ctcccaggggagccagctgcttg

SEQ ID NO: 1202007 - DNA, 16 bp, Homo sapiens
ctcccaggggtctccc

SEQ ID NO: 1202008 - DNA, 19 bp, Homo sapiens
ctcccaggggtctccctgg

SEQ ID NO: 1202009 - DNA, 21 bp, Homo sapiens
ctcccagggtggaggaaggtg

SEQ ID NO: 1202010 - DNA, 16 bp, Homo sapiens
ctcccaggtagctggg

SEQ ID NO: 1202011 - DNA, 22 bp, Homo sapiens
ctcccaggtagctgggattaca

SEQ ID NO: 1202012 - DNA, 21 bp, Homo sapiens
ctcccaggttcccccagcaag

SEQ ID NO: 1202013 - DNA, 22 bp, Homo sapiens
ctcccaggttcccccagcaagc

SEQ ID NO: 1202014 - DNA, 20 bp, Homo sapiens
ctcccagtccaaatgtcctc

SEQ ID NO: 1202015 - DNA, 17 bp, Homo sapiens
ctcccagtccatttcca

SEQ ID NO: 1202016 - DNA, 16 bp, Homo sapiens
ctcccagtcctccaga

SEQ ID NO: 1202017 - DNA, 18 bp, Homo sapiens
ctcccagtctcatctcct

SEQ ID NO: 1202018 - DNA, 19 bp, Homo sapiens
ctcccagtctcatctcctg

SEQ ID NO: 1202019 - DNA, 21 bp, Homo sapiens
ctcccagtctcatctcctgac

SEQ ID NO: 1202020 - DNA, 15 bp, Homo sapiens
ctcccagtctctgtc

SEQ ID NO: 1202021 - DNA, 16 bp, Homo sapiens
ctcccagtctctgtcg

SEQ ID NO: 1202022 - DNA, 22 bp, Homo sapiens
ctcccagtgaactcctgccagg

SEQ ID NO: 1202023 - DNA, 16 bp, Homo sapiens
ctcccatccagcgtct

SEQ ID NO: 1202024 - DNA, 12 bp, Homo sapiens
ctcccatcccct

SEQ ID NO: 1202025 - DNA, 15 bp, Homo sapiens
ctcccatcccctgga

SEQ ID NO: 1202026 - DNA, 16 bp, Homo sapiens
ctcccatcccctggac

SEQ ID NO: 1202027 - DNA, 14 bp, Homo sapiens
ctcccatctcctga

SEQ ID NO: 1202028 - DNA, 12 bp, Homo sapiens
ctcccatctggg

SEQ ID NO: 1202029 - DNA, 13 bp, Homo sapiens
ctcccatctggga

SEQ ID NO: 1202030 - DNA, 22 bp, Homo sapiens
ctcccatctgggagtccccttt

SEQ ID NO: 1202031 - DNA, 19 bp, Homo sapiens
ctcccatcttggcctccca

SEQ ID NO: 1202032 - DNA, 15 bp, Homo sapiens
ctcccattcctccct

SEQ ID NO: 1202033 - DNA, 16 bp, Homo sapiens
ctcccattctgcacca

SEQ ID NO: 1202034 - DNA, 17 bp, Homo sapiens
ctcccattgtccctctg

SEQ ID NO: 1202035 - DNA, 14 bp, Homo sapiens
ctcccatttcctga

SEQ ID NO: 1202036 - DNA, 17 bp, Homo sapiens
ctcccatttcctgatct

SEQ ID NO: 1202037 - DNA, 16 bp, Homo sapiens
ctccccaaaagaaacc

SEQ ID NO: 1202038 - DNA, 21 bp, Homo sapiens
ctccccaaatcaatacactag

SEQ ID NO: 1202039 - DNA, 22 bp, Homo sapiens
ctccccaacccccattctcatc

SEQ ID NO: 1202040 - DNA, 23 bp, Homo sapiens
ctccccaaccctaggttccctgt

SEQ ID NO: 1202041 - DNA, 15 bp, Homo sapiens
ctccccaaccctgcc

SEQ ID NO: 1202042 - DNA, 18 bp, Homo sapiens
ctccccaaggatgaccac

SEQ ID NO: 1202043 - DNA, 22 bp, Homo sapiens
ctccccaaggatgaccacaccc

SEQ ID NO: 1202044 - DNA, 14 bp, Homo sapiens
ctccccacactcca

SEQ ID NO: 1202045 - DNA, 15 bp, Homo sapiens
ctccccacactccac

SEQ ID NO: 1202046 - DNA, 23 bp, Homo sapiens
ctccccaccccgaaatcagcccc

SEQ ID NO: 1202047 - DNA, 14 bp, Homo sapiens
gctgccgcacccca

SEQ ID NO: 1202048 - DNA, 22 bp, Homo sapiens
gctgccgcaccccagagtgtgg

SEQ ID NO: 1202049 - DNA, 16 bp, Homo sapiens
gctgccgcaggagcac

SEQ ID NO: 1202050 - DNA, 13 bp, Homo sapiens
gctgccgcctccc

SEQ ID NO: 1202051 - DNA, 16 bp, Homo sapiens
gctgccgcctcccagc

SEQ ID NO: 1202052 - DNA, 13 bp, Homo sapiens
gctgccgctgcac

SEQ ID NO: 1202053 - DNA, 15 bp, Homo sapiens
gctgccgctgcacca

SEQ ID NO: 1202054 - DNA, 15 bp, Homo sapiens
gctgccggatctggg

SEQ ID NO: 1202055 - DNA, 13 bp, Homo sapiens
gctgccgtggggc

SEQ ID NO: 1202056 - DNA, 22 bp, Homo sapiens
gctgcctaaatccactctgcag

SEQ ID NO: 1202057 - DNA, 14 bp, Homo sapiens
gctgcctacctaat

SEQ ID NO: 1202058 - DNA, 14 bp, Homo sapiens
gctgcctcagccag

SEQ ID NO: 1202059 - DNA, 22 bp, Homo sapiens
gctgcctcagccagtggcacag

SEQ ID NO: 1202060 - DNA, 13 bp, Homo sapiens
gctgcctccccaa

SEQ ID NO: 1202061 - DNA, 15 bp, Homo sapiens
gctgcctccccaacc

SEQ ID NO: 1202062 - DNA, 21 bp, Homo sapiens
gctgcctccccaaccctgccc

SEQ ID NO: 1202063 - DNA, 18 bp, Homo sapiens
gctgcctcctgctctctg

SEQ ID NO: 1202064 - DNA, 16 bp, Homo sapiens
gctgcctcggactcca

SEQ ID NO: 1202065 - DNA, 21 bp, Homo sapiens
gctgcctctacctgacactcc

SEQ ID NO: 1202066 - DNA, 22 bp, Homo sapiens
gctgcctctgacagcagcctgt

SEQ ID NO: 1202067 - DNA, 11 bp, Homo sapiens
gctgcctctgc

SEQ ID NO: 1202068 - DNA, 11 bp, Homo sapiens
gctgcctctgg

SEQ ID NO: 1202069 - DNA, 15 bp, Homo sapiens
gctgcctctgtggaa

SEQ ID NO: 1202070 - DNA, 20 bp, Homo sapiens
gctgcctcttctcttgacag

SEQ ID NO: 1202071 - DNA, 19 bp, Homo sapiens
gctgcctcttggcttctca

SEQ ID NO: 1202072 - DNA, 22 bp, Homo sapiens
gctgcctgacactgagccccac

SEQ ID NO: 1202073 - DNA, 13 bp, Homo sapiens
gctgcctgcagca

SEQ ID NO: 1202074 - DNA, 19 bp, Homo sapiens
gctgcctgccaaagtagtc

SEQ ID NO: 1202075 - DNA, 20 bp, Homo sapiens
gctgcctggccatgctgtcc

SEQ ID NO: 1202076 - DNA, 22 bp, Homo sapiens
gctgcctggcggggttggccct

SEQ ID NO: 1202077 - DNA, 14 bp, Homo sapiens
gctgcctgggctgt

SEQ ID NO: 1202078 - DNA, 16 bp, Homo sapiens
gctgcctgggctgttg

SEQ ID NO: 1202079 - DNA, 18 bp, Homo sapiens
gctgcctgggctgttggc

SEQ ID NO: 1202080 - DNA, 22 bp, Homo sapiens
gctgcctgggctgttggcactc

SEQ ID NO: 1202081 - DNA, 13 bp, Homo sapiens
gctgcctggggcc

SEQ ID NO: 1202082 - DNA, 17 bp, Homo sapiens
gctgcctggggcccaag

SEQ ID NO: 1202083 - DNA, 18 bp, Homo sapiens
gctgcctggggcccaagt

SEQ ID NO: 1202084 - DNA, 12 bp, Homo sapiens
gctgcctggtct

SEQ ID NO: 1202085 - DNA, 12 bp, Homo sapiens
gctgcctgtagt

SEQ ID NO: 1202086 - DNA, 20 bp, Homo sapiens
gctgcctgtagttaggaaat

SEQ ID NO: 1202087 - DNA, 14 bp, Homo sapiens
gctgccttcaggga

SEQ ID NO: 1202088 - DNA, 16 bp, Homo sapiens
gctgccttcagggaga

SEQ ID NO: 1202089 - DNA, 15 bp, Homo sapiens
gctgccttgctgttc

SEQ ID NO: 1202090 - DNA, 14 bp, Homo sapiens
gctgccttggctca

SEQ ID NO: 1202091 - DNA, 19 bp, Homo sapiens
gctgccttggctcagacat

SEQ ID NO: 1202092 - DNA, 23 bp, Homo sapiens
gctgccttggctcagacatgttt

SEQ ID NO: 1202093 - DNA, 20 bp, Homo sapiens
gctgccttgtttcaccttcc

SEQ ID NO: 1202094 - DNA, 18 bp, Homo sapiens
gctgcctttgatcacagg

SEQ ID NO: 1202095 - DNA, 22 bp, Homo sapiens
gctgcctttgatcacaggagca

SEQ ID NO: 1202096 - DNA, 16 bp, Homo sapiens
gctgcctttgtcccca

SEQ ID NO: 1202097 - DNA, 18 bp, Homo sapiens
gctgcctttgtggtgggc

SEQ ID NO: 1202098 - DNA, 15 bp, Homo sapiens
gctgcgcccccagct

SEQ ID NO: 1202099 - DNA, 16 bp, Homo sapiens
gctgcgcccccagctt

SEQ ID NO: 1202100 - DNA, 17 bp, Homo sapiens
gctgcgcctgcaggcag

SEQ ID NO: 1202101 - DNA, 20 bp, Homo sapiens
gccccacttctggcatggga

SEQ ID NO: 1202102 - DNA, 18 bp, Homo sapiens
gccccacttctggccaca

SEQ ID NO: 1202103 - DNA, 22 bp, Homo sapiens
gccccacttctggccacatcag

SEQ ID NO: 1202104 - DNA, 15 bp, Homo sapiens
gccccagaaggcagg

SEQ ID NO: 1202105 - DNA, 19 bp, Homo sapiens
gccccagaccccagggcag

SEQ ID NO: 1202106 - DNA, 22 bp, Homo sapiens
gccccagactcctttcctctga

SEQ ID NO: 1202107 - DNA, 16 bp, Homo sapiens
gccccagactgagctc

SEQ ID NO: 1202108 - DNA, 24 bp, Homo sapiens
gccccagactgagctctccaggcc

SEQ ID NO: 1202109 - DNA, 18 bp, Homo sapiens
gccccagactgggcccag

SEQ ID NO: 1202110 - DNA, 21 bp, Homo sapiens
gccccagactgggcccaggca

SEQ ID NO: 1202111 - DNA, 17 bp, Homo sapiens
gccccagagactcagag

SEQ ID NO: 1202112 - DNA, 19 bp, Homo sapiens
gccccagagagaccctgca

SEQ ID NO: 1202113 - DNA, 12 bp, Homo sapiens
gccccagagccc

SEQ ID NO: 1202114 - DNA, 11 bp, Homo sapiens
gccccagagga

SEQ ID NO: 1202115 - DNA, 16 bp, Homo sapiens
gccccagagtgcttta

SEQ ID NO: 1202116 - DNA, 20 bp, Homo sapiens
gccccagataccagcccctg

SEQ ID NO: 1202117 - DNA, 20 bp, Homo sapiens
gccccagatcaccagcccgg

SEQ ID NO: 1202118 - DNA, 16 bp, Homo sapiens
gccccagatctgcctg

SEQ ID NO: 1202119 - DNA, 19 bp, Homo sapiens
gccccagatctgcctgggc

SEQ ID NO: 1202120 - DNA, 22 bp, Homo sapiens
gccccagatctgcctgggcctg

SEQ ID NO: 1202121 - DNA, 19 bp, Homo sapiens
gccccagcactaaagcagt

SEQ ID NO: 1202122 - DNA, 10 bp, Homo sapiens
gccccagcca

SEQ ID NO: 1202123 - DNA, 19 bp, Homo sapiens
gccccagccagagttcctg

SEQ ID NO: 1202124 - DNA, 18 bp, Homo sapiens
gccccagcccctaagccc

SEQ ID NO: 1202125 - DNA, 12 bp, Homo sapiens
gccccagcccga

SEQ ID NO: 1202126 - DNA, 15 bp, Homo sapiens
gccccagccctgctg

SEQ ID NO: 1202127 - DNA, 18 bp, Homo sapiens
gccccagccctgctgggg

SEQ ID NO: 1202128 - DNA, 14 bp, Homo sapiens
gccccagcctgggc

SEQ ID NO: 1202129 - DNA, 15 bp, Homo sapiens
gccccagcctgggcc

SEQ ID NO: 1202130 - DNA, 14 bp, Homo sapiens
gccccagctctggc

SEQ ID NO: 1202131 - DNA, 17 bp, Homo sapiens
gccccagctgacatgga

SEQ ID NO: 1202132 - DNA, 12 bp, Homo sapiens
gccccagctgcc

SEQ ID NO: 1202133 - DNA, 13 bp, Homo sapiens
gccccagctgcca

SEQ ID NO: 1202134 - DNA, 19 bp, Homo sapiens
gccccagctgccaggcggc

SEQ ID NO: 1202135 - DNA, 22 bp, Homo sapiens
gccccaggaaaggcccagccac

SEQ ID NO: 1202136 - DNA, 21 bp, Homo sapiens
gccccaggacctggctgccat

SEQ ID NO: 1202137 - DNA, 18 bp, Homo sapiens
gccccaggactctggcac

SEQ ID NO: 1202138 - DNA, 19 bp, Homo sapiens
gccccaggactctggcact

SEQ ID NO: 1202139 - DNA, 12 bp, Homo sapiens
gccccaggcagg

SEQ ID NO: 1202140 - DNA, 19 bp, Homo sapiens
gccccaggcaggctgtgcg

SEQ ID NO: 1202141 - DNA, 12 bp, Homo sapiens
gccccaggccag

SEQ ID NO: 1202142 - DNA, 19 bp, Homo sapiens
gccccaggccccagacagg

SEQ ID NO: 1202143 - DNA, 16 bp, Homo sapiens
gccccaggccctacta

SEQ ID NO: 1202144 - DNA, 14 bp, Homo sapiens
gccccaggccctcc

SEQ ID NO: 1202145 - DNA, 16 bp, Homo sapiens
gccccaggccctccct

SEQ ID NO: 1202146 - DNA, 17 bp, Homo sapiens
gccccaggccctccctg

SEQ ID NO: 1202147 - DNA, 16 bp, Homo sapiens
gccccaggccggagcc

SEQ ID NO: 1202148 - DNA, 17 bp, Homo sapiens
gccccaggccggagccc

SEQ ID NO: 1202149 - DNA, 15 bp, Homo sapiens
gccccaggcctgaaa

SEQ ID NO: 1202150 - DNA, 15 bp, Homo sapiens
gccccaggcctggac

SEQ ID NO: 1202151 - DNA, 12 bp, Homo sapiens
gccccagggaca

SEQ ID NO: 1202152 - DNA, 17 bp, Homo sapiens
gccccagggacagaggc

SEQ ID NO: 1202153 - DNA, 15 bp, Homo sapiens
gccccagggcctggg

SEQ ID NO: 1202154 - DNA, 15 bp, Homo sapiens
gccccaggggcagca

SEQ ID NO: 1202155 - DNA, 19 bp, Homo sapiens
gccccaggggcagcaaggc

SEQ ID NO: 1202156 - DNA, 20 bp, Homo sapiens
gccccagggtcttccctacc

SEQ ID NO: 1202157 - DNA, 14 bp, Homo sapiens
gccccagtcttcct

SEQ ID NO: 1202158 - DNA, 14 bp, Homo sapiens
gccccagtgacagc

SEQ ID NO: 1202159 - DNA, 16 bp, Homo sapiens
gccccagtgctggaag

SEQ ID NO: 1202160 - DNA, 16 bp, Homo sapiens
gccccagtttggggtg

SEQ ID NO: 1202161 - DNA, 21 bp, Homo sapiens
gccccataattttttttttcc

SEQ ID NO: 1202162 - DNA, 13 bp, Homo sapiens
gccccatcactgc

SEQ ID NO: 1202163 - DNA, 16 bp, Homo sapiens
gccccatcagctgcca

SEQ ID NO: 1202164 - DNA, 14 bp, Homo sapiens
gccccatccctgct

SEQ ID NO: 1202165 - DNA, 15 bp, Homo sapiens
gccccatccctgctt

SEQ ID NO: 1202166 - DNA, 23 bp, Homo sapiens
gccccatccctgcttgcccgctc

SEQ ID NO: 1202167 - DNA, 14 bp, Homo sapiens
gccccatcctccag

SEQ ID NO: 1202168 - DNA, 17 bp, Homo sapiens
gccccatcctccagcag

SEQ ID NO: 1202169 - DNA, 17 bp, Homo sapiens
gccccatctcatcctgg

SEQ ID NO: 1202170 - DNA, 18 bp, Homo sapiens
gccccatctcatcctggc

SEQ ID NO: 1202171 - DNA, 20 bp, Homo sapiens
gccccatcttgatctttgag

SEQ ID NO: 1202172 - DNA, 15 bp, Homo sapiens
gccccatgtctctca

SEQ ID NO: 1202173 - DNA, 15 bp, Homo sapiens
gccccatgtgccttg

SEQ ID NO: 1202174 - DNA, 15 bp, Homo sapiens
gccccattcctaaga

SEQ ID NO: 1202175 - DNA, 20 bp, Homo sapiens
gccccattcttttgtaattt

SEQ ID NO: 1202176 - DNA, 22 bp, Homo sapiens
gccccattcttttgtaatttaa

SEQ ID NO: 1202177 - DNA, 23 bp, Homo sapiens
gccccattcttttgtaatttaaa

SEQ ID NO: 1202178 - DNA, 15 bp, Homo sapiens
gcccccaacacaggc

SEQ ID NO: 1202179 - DNA, 16 bp, Homo sapiens
gcccccaacacaggca

SEQ ID NO: 1202180 - DNA, 14 bp, Homo sapiens
gcccaggccttgct

SEQ ID NO: 1202181 - DNA, 13 bp, Homo sapiens
gcccaggctggga

SEQ ID NO: 1202182 - DNA, 15 bp, Homo sapiens
gcccaggctgggaac

SEQ ID NO: 1202183 - DNA, 22 bp, Homo sapiens
gcccaggctgtgcagcgcagct

SEQ ID NO: 1202184 - DNA, 19 bp, Homo sapiens
gcccagggacattgcagag

SEQ ID NO: 1202185 - DNA, 20 bp, Homo sapiens
gcccagggcccgggcaccca

SEQ ID NO: 1202186 - DNA, 17 bp, Homo sapiens
gcccagggctcagcctg

SEQ ID NO: 1202187 - DNA, 15 bp, Homo sapiens
gcccagggctgggag

SEQ ID NO: 1202188 - DNA, 24 bp, Homo sapiens
gcccaggggagaatgcagcccacc

SEQ ID NO: 1202189 - DNA, 14 bp, Homo sapiens
gcccaggggtcagc

SEQ ID NO: 1202190 - DNA, 17 bp, Homo sapiens
gcccaggggtgccccct

SEQ ID NO: 1202191 - DNA, 16 bp, Homo sapiens
gcccagggtcctgtgc

SEQ ID NO: 1202192 - DNA, 15 bp, Homo sapiens
gcccagggtgcagtg

SEQ ID NO: 1202193 - DNA, 18 bp, Homo sapiens
gcccagggtggctgccag

SEQ ID NO: 1202194 - DNA, 16 bp, Homo sapiens
gcccagggttccccca

SEQ ID NO: 1202195 - DNA, 17 bp, Homo sapiens
gcccagggttcccccag

SEQ ID NO: 1202196 - DNA, 23 bp, Homo sapiens
gcccagggttcccccagccctgt

SEQ ID NO: 1202197 - DNA, 15 bp, Homo sapiens
gcccaggtcctctga

SEQ ID NO: 1202198 - DNA, 17 bp, Homo sapiens
gcccaggtggcctcctg

SEQ ID NO: 1202199 - DNA, 19 bp, Homo sapiens
gcccagtacatttaaattt

SEQ ID NO: 1202200 - DNA, 12 bp, Homo sapiens
gcccagtcctgg

SEQ ID NO: 1202201 - DNA, 14 bp, Homo sapiens
gcccagtccttcca

SEQ ID NO: 1202202 - DNA, 18 bp, Homo sapiens
gcccagtccttccacctc

SEQ ID NO: 1202203 - DNA, 15 bp, Homo sapiens
gcccagtctgttgag

SEQ ID NO: 1202204 - DNA, 14 bp, Homo sapiens
gcccagtgaagcct

SEQ ID NO: 1202205 - DNA, 21 bp, Homo sapiens
gcccagtgacaaagactcctc

SEQ ID NO: 1202206 - DNA, 24 bp, Homo sapiens
gcccagtgacaaagactcctctgg

SEQ ID NO: 1202207 - DNA, 18 bp, Homo sapiens
gcccagtgcaaaccactt

SEQ ID NO: 1202208 - DNA, 15 bp, Homo sapiens
gcccagtgccactgc

SEQ ID NO: 1202209 - DNA, 16 bp, Homo sapiens
gcccagtgggctgcac

SEQ ID NO: 1202210 - DNA, 23 bp, Homo sapiens
gcccagtgggctgcacgctcccc

SEQ ID NO: 1202211 - DNA, 18 bp, Homo sapiens
gcccagtggtgaggaaag

SEQ ID NO: 1202212 - DNA, 18 bp, Homo sapiens
gcccagtgttgtttgtaa

SEQ ID NO: 1202213 - DNA, 20 bp, Homo sapiens
gcccatacccgtgacagtgg

SEQ ID NO: 1202214 - DNA, 21 bp, Homo sapiens
gcccatacccgtgacagtggc

SEQ ID NO: 1202215 - DNA, 14 bp, Homo sapiens
gcccatactgagcc

SEQ ID NO: 1202216 - DNA, 16 bp, Homo sapiens
gcccatactgagcctg

SEQ ID NO: 1202217 - DNA, 23 bp, Homo sapiens
gcccatacttttggctcctctag

SEQ ID NO: 1202218 - DNA, 16 bp, Homo sapiens
gcccatcaagtgcagt

SEQ ID NO: 1202219 - DNA, 22 bp, Homo sapiens
gcccatcacagggttgggccca

SEQ ID NO: 1202220 - DNA, 12 bp, Homo sapiens
gcccatcacctc

SEQ ID NO: 1202221 - DNA, 18 bp, Homo sapiens
gcccatcagtgacagact

SEQ ID NO: 1202222 - DNA, 22 bp, Homo sapiens
gcccatccattaggccagcaac

SEQ ID NO: 1202223 - DNA, 18 bp, Homo sapiens
gcccatccccaggcacct

SEQ ID NO: 1202224 - DNA, 14 bp, Homo sapiens
gcccatcctgacca

SEQ ID NO: 1202225 - DNA, 15 bp, Homo sapiens
gcccatcctgaccag

SEQ ID NO: 1202226 - DNA, 16 bp, Homo sapiens
gcccatcctgaccagc

SEQ ID NO: 1202227 - DNA, 13 bp, Homo sapiens
gcccatcctgcca

SEQ ID NO: 1202228 - DNA, 12 bp, Homo sapiens
gcccatccttcc

SEQ ID NO: 1202229 - DNA, 15 bp, Homo sapiens
gcccatctcagcctc

SEQ ID NO: 1202230 - DNA, 20 bp, Homo sapiens
gcccatctcagcctcctgag

SEQ ID NO: 1202231 - DNA, 23 bp, Homo sapiens
gcccatctcagcctcctgagcct

SEQ ID NO: 1202232 - DNA, 17 bp, Homo sapiens
gcccatctcaggtgcca

SEQ ID NO: 1202233 - DNA, 19 bp, Homo sapiens
gcccatctcaggtgccact

SEQ ID NO: 1202234 - DNA, 20 bp, Homo sapiens
gcccatctcaggtgccactc

SEQ ID NO: 1202235 - DNA, 13 bp, Homo sapiens
gcccatctcggag

SEQ ID NO: 1202236 - DNA, 13 bp, Homo sapiens
gcccatgcccacc

SEQ ID NO: 1202237 - DNA, 15 bp, Homo sapiens
gcccatgcccacctg

SEQ ID NO: 1202238 - DNA, 18 bp, Homo sapiens
gcccatgcccccttcgct

SEQ ID NO: 1202239 - DNA, 20 bp, Homo sapiens
gcccatggacaggctggctc

SEQ ID NO: 1202240 - DNA, 16 bp, Homo sapiens
gcccatggcccccaat

SEQ ID NO: 1202241 - DNA, 18 bp, Homo sapiens
gcccatggcccccaataa

SEQ ID NO: 1202242 - DNA, 19 bp, Homo sapiens
gcccatgggagccaggccc

SEQ ID NO: 1202243 - DNA, 20 bp, Homo sapiens
gcccatgggagctggttaga

SEQ ID NO: 1202244 - DNA, 13 bp, Homo sapiens
gcccatgtcttct

SEQ ID NO: 1202245 - DNA, 20 bp, Homo sapiens
gcccatgtgtacattctgcc

SEQ ID NO: 1202246 - DNA, 21 bp, Homo sapiens
gcccatgtgtacattctgcct

SEQ ID NO: 1202247 - DNA, 14 bp, Homo sapiens
gcccatgtgtcccc

SEQ ID NO: 1202248 - DNA, 18 bp, Homo sapiens
gcccatgtgtcccctcac

SEQ ID NO: 1202249 - DNA, 16 bp, Homo sapiens
gcccatgttctgcccc

SEQ ID NO: 1202250 - DNA, 22 bp, Homo sapiens
gcccatgttctgcccccagccc

SEQ ID NO: 1202251 - DNA, 11 bp, Homo sapiens
gcccattccta

SEQ ID NO: 1202252 - DNA, 13 bp, Homo sapiens
gctgctgcttgga

SEQ ID NO: 1202253 - DNA, 12 bp, Homo sapiens
gctgctggagaa

SEQ ID NO: 1202254 - DNA, 20 bp, Homo sapiens
gctgctggatcacagctgct

SEQ ID NO: 1202255 - DNA, 12 bp, Homo sapiens
gctgctggccat

SEQ ID NO: 1202256 - DNA, 20 bp, Homo sapiens
gctgctggctgacctgggcc

SEQ ID NO: 1202257 - DNA, 13 bp, Homo sapiens
gctgctggcttca

SEQ ID NO: 1202258 - DNA, 18 bp, Homo sapiens
gctgctggggcctcagac

SEQ ID NO: 1202259 - DNA, 13 bp, Homo sapiens
gctgctgtaaata

SEQ ID NO: 1202260 - DNA, 20 bp, Homo sapiens
gctgctgtaactgctgagcc

SEQ ID NO: 1202261 - DNA, 23 bp, Homo sapiens
gctgctgtaactgctgagccact

SEQ ID NO: 1202262 - DNA, 18 bp, Homo sapiens
gctgctgtccctccccct

SEQ ID NO: 1202263 - DNA, 22 bp, Homo sapiens
gctgctgtccctcccccttgtc

SEQ ID NO: 1202264 - DNA, 23 bp, Homo sapiens
gctgctgtccctcccccttgtcc

SEQ ID NO: 1202265 - DNA, 10 bp, Homo sapiens
gctgctgtga

SEQ ID NO: 1202266 - DNA, 13 bp, Homo sapiens
gctgctgtgaatt

SEQ ID NO: 1202267 - DNA, 14 bp, Homo sapiens
gctgctgtgcccca

SEQ ID NO: 1202268 - DNA, 12 bp, Homo sapiens
gctgctgtgctt

SEQ ID NO: 1202269 - DNA, 15 bp, Homo sapiens
gctgctgttctcagg

SEQ ID NO: 1202270 - DNA, 21 bp, Homo sapiens
gctgcttaataccaaacatgc

SEQ ID NO: 1202271 - DNA, 18 bp, Homo sapiens
gctgcttagacataacaa

SEQ ID NO: 1202272 - DNA, 17 bp, Homo sapiens
gctgcttccaggctggg

SEQ ID NO: 1202273 - DNA, 18 bp, Homo sapiens
gctgcttccaggctgggc

SEQ ID NO: 1202274 - DNA, 11 bp, Homo sapiens
gctgcttctcc

SEQ ID NO: 1202275 - DNA, 18 bp, Homo sapiens
gctgcttctccccccatc

SEQ ID NO: 1202276 - DNA, 21 bp, Homo sapiens
gctgcttctgctgcctaggtt

SEQ ID NO: 1202277 - DNA, 16 bp, Homo sapiens
gctgcttgcagccagg

SEQ ID NO: 1202278 - DNA, 14 bp, Homo sapiens
gctgcttgcttttg

SEQ ID NO: 1202279 - DNA, 19 bp, Homo sapiens
gctgcttgtcctgctctct

SEQ ID NO: 1202280 - DNA, 16 bp, Homo sapiens
gctgcttgtgcctccc

SEQ ID NO: 1202281 - DNA, 17 bp, Homo sapiens
gctgcttgtgcctccct

SEQ ID NO: 1202282 - DNA, 15 bp, Homo sapiens
gctgcttgtgggccc

SEQ ID NO: 1202283 - DNA, 14 bp, Homo sapiens
gctgctttcccctg

SEQ ID NO: 1202284 - DNA, 15 bp, Homo sapiens
gctgctttcccctgt

SEQ ID NO: 1202285 - DNA, 16 bp, Homo sapiens
gctgctttcccctgtg

SEQ ID NO: 1202286 - DNA, 17 bp, Homo sapiens
gctgctttcccctgtgg

SEQ ID NO: 1202287 - DNA, 18 bp, Homo sapiens
gctgctttcccctgtggg

SEQ ID NO: 1202288 - DNA, 19 bp, Homo sapiens
gctgctttcccctgtgggg

SEQ ID NO: 1202289 - DNA, 19 bp, Homo sapiens
gctgctttctgttgtcatt

SEQ ID NO: 1202290 - DNA, 14 bp, Homo sapiens
gctgctttgacaag

SEQ ID NO: 1202291 - DNA, 11 bp, Homo sapiens
gctgcttttct

SEQ ID NO: 1202292 - DNA, 15 bp, Homo sapiens
gctggaaaagggtct

SEQ ID NO: 1202293 - DNA, 22 bp, Homo sapiens
gctggaaacaagtgaccccagg

SEQ ID NO: 1202294 - DNA, 21 bp, Homo sapiens
gctggaaagcagagcctcctg

SEQ ID NO: 1202295 - DNA, 22 bp, Homo sapiens
gctggaaagcagagcctcctgg

SEQ ID NO: 1202296 - DNA, 21 bp, Homo sapiens
gctggaacctgcaaaaaatac

SEQ ID NO: 1202297 - DNA, 14 bp, Homo sapiens
gctggaagatcctg

SEQ ID NO: 1202298 - DNA, 13 bp, Homo sapiens
gctggaagcccag

SEQ ID NO: 1202299 - DNA, 15 bp, Homo sapiens
gctggaaggcagggc

SEQ ID NO: 1202300 - DNA, 23 bp, Homo sapiens
gctggaaggcagggcagagggaa

SEQ ID NO: 1202301 - DNA, 20 bp, Homo sapiens
gctggaaggggcagcaggag

SEQ ID NO: 1202302 - DNA, 20 bp, Homo sapiens
gctggaaggggccacgtgga

SEQ ID NO: 1202303 - DNA, 14 bp, Homo sapiens
gctggaatgaggga

SEQ ID NO: 1202304 - DNA, 17 bp, Homo sapiens
gctggaatgagggaggc

SEQ ID NO: 1202305 - DNA, 18 bp, Homo sapiens
gctggaatgggagacctg

SEQ ID NO: 1202306 - DNA, 21 bp, Homo sapiens
gctggaatttctgctgtggtc

SEQ ID NO: 1202307 - DNA, 22 bp, Homo sapiens
gctggacagaggggactctggg

SEQ ID NO: 1202308 - DNA, 15 bp, Homo sapiens
gctggaccagctggc

SEQ ID NO: 1202309 - DNA, 20 bp, Homo sapiens
gctggaccagctggcctggg

SEQ ID NO: 1202310 - DNA, 21 bp, Homo sapiens
gctggaccctgcttcaccctc

SEQ ID NO: 1202311 - DNA, 13 bp, Homo sapiens
gctggactctgca

SEQ ID NO: 1202312 - DNA, 23 bp, Homo sapiens
gctggactggaggcccctggagc

SEQ ID NO: 1202313 - DNA, 20 bp, Homo sapiens
ctccccccagctccctgcac

SEQ ID NO: 1202314 - DNA, 15 bp, Homo sapiens
ctcccccgacactgc

SEQ ID NO: 1202315 - DNA, 21 bp, Homo sapiens
ctcccccgacactgctgcacc

SEQ ID NO: 1202316 - DNA, 22 bp, Homo sapiens
ctcccccgcagtccccagccct

SEQ ID NO: 1202317 - DNA, 15 bp, Homo sapiens
ctcccccgccctgcc

SEQ ID NO: 1202318 - DNA, 11 bp, Homo sapiens
ctcccccgcct

SEQ ID NO: 1202319 - DNA, 13 bp, Homo sapiens
ctccccctcaacc

SEQ ID NO: 1202320 - DNA, 14 bp, Homo sapiens
ctccccctcctcca

SEQ ID NO: 1202321 - DNA, 16 bp, Homo sapiens
ctccccctcctccagg

SEQ ID NO: 1202322 - DNA, 13 bp, Homo sapiens
ctccccctctgtc

SEQ ID NO: 1202323 - DNA, 13 bp, Homo sapiens
ctccccctgcaac

SEQ ID NO: 1202324 - DNA, 18 bp, Homo sapiens
ctccccctgccagtgcct

SEQ ID NO: 1202325 - DNA, 19 bp, Homo sapiens
ctccccctgccagtgcctt

SEQ ID NO: 1202326 - DNA, 11 bp, Homo sapiens
ctccccctggg

SEQ ID NO: 1202327 - DNA, 23 bp, Homo sapiens
ctccccctgggctctgccccagc

SEQ ID NO: 1202328 - DNA, 13 bp, Homo sapiens
ctcccccttcagc

SEQ ID NO: 1202329 - DNA, 16 bp, Homo sapiens
ctcccccttcagctcc

SEQ ID NO: 1202330 - DNA, 18 bp, Homo sapiens
ctcccccttcagctcctg

SEQ ID NO: 1202331 - DNA, 19 bp, Homo sapiens
ctcccccttcagctcctga

SEQ ID NO: 1202332 - DNA, 11 bp, Homo sapiens
ctcccccttct

SEQ ID NO: 1202333 - DNA, 17 bp, Homo sapiens
ctcccccttgtcttccc

SEQ ID NO: 1202334 - DNA, 14 bp, Homo sapiens
ctccccgaggctgc

SEQ ID NO: 1202335 - DNA, 15 bp, Homo sapiens
ctccccgcccctgtg

SEQ ID NO: 1202336 - DNA, 20 bp, Homo sapiens
ctccccgctccgtctctgtc

SEQ ID NO: 1202337 - DNA, 15 bp, Homo sapiens
ctccccgctgccctt

SEQ ID NO: 1202338 - DNA, 14 bp, Homo sapiens
ctccccgcttctgc

SEQ ID NO: 1202339 - DNA, 16 bp, Homo sapiens
ctccccggccctacca

SEQ ID NO: 1202340 - DNA, 14 bp, Homo sapiens
ctccccggctcgag

SEQ ID NO: 1202341 - DNA, 13 bp, Homo sapiens
ctccccggtaatg

SEQ ID NO: 1202342 - DNA, 21 bp, Homo sapiens
ctccccgtttcagtggaccct

SEQ ID NO: 1202343 - DNA, 23 bp, Homo sapiens
ctcccctaaagcctcaaaacaaa

SEQ ID NO: 1202344 - DNA, 18 bp, Homo sapiens
ctcccctaaccctacttt

SEQ ID NO: 1202345 - DNA, 20 bp, Homo sapiens
ctcccctaacctcttttctg

SEQ ID NO: 1202346 - DNA, 17 bp, Homo sapiens
ctcccctatccacccag

SEQ ID NO: 1202347 - DNA, 11 bp, Homo sapiens
ctcccctcaca

SEQ ID NO: 1202348 - DNA, 13 bp, Homo sapiens
ctcccctcacaca

SEQ ID NO: 1202349 - DNA, 13 bp, Homo sapiens
ctcccctcacatc

SEQ ID NO: 1202350 - DNA, 19 bp, Homo sapiens
ctcccctcagagcccatgg

SEQ ID NO: 1202351 - DNA, 16 bp, Homo sapiens
ctcccctcagagtgca

SEQ ID NO: 1202352 - DNA, 13 bp, Homo sapiens
ctcccctcagcct

SEQ ID NO: 1202353 - DNA, 15 bp, Homo sapiens
ctcccctcagcctgc

SEQ ID NO: 1202354 - DNA, 16 bp, Homo sapiens
ctcccctcagcgcagg

SEQ ID NO: 1202355 - DNA, 17 bp, Homo sapiens
ctcccctcagcgcaggc

SEQ ID NO: 1202356 - DNA, 15 bp, Homo sapiens
ctcccctccacagct

SEQ ID NO: 1202357 - DNA, 17 bp, Homo sapiens
ctcccctccatccccat

SEQ ID NO: 1202358 - DNA, 14 bp, Homo sapiens
ctcccctcccagtc

SEQ ID NO: 1202359 - DNA, 16 bp, Homo sapiens
ctcccctcccagtcct

SEQ ID NO: 1202360 - DNA, 18 bp, Homo sapiens
ctcccctccccagcccaa

SEQ ID NO: 1202361 - DNA, 16 bp, Homo sapiens
ctcccctcccctgggg

SEQ ID NO: 1202362 - DNA, 16 bp, Homo sapiens
ctcccctccctcttcc

SEQ ID NO: 1202363 - DNA, 22 bp, Homo sapiens
ctcccctcctggcgagttctct

SEQ ID NO: 1202364 - DNA, 17 bp, Homo sapiens
ctcccctcgtgtcagct

SEQ ID NO: 1202365 - DNA, 21 bp, Homo sapiens
ctcccctctatttagcatgac

SEQ ID NO: 1202366 - DNA, 13 bp, Homo sapiens
ctcccctctcaga

SEQ ID NO: 1202367 - DNA, 14 bp, Homo sapiens
ctcccctctcccag

SEQ ID NO: 1202368 - DNA, 15 bp, Homo sapiens
ctcccctctcccagg

SEQ ID NO: 1202369 - DNA, 20 bp, Homo sapiens
ctcccctctcgccccatccc

SEQ ID NO: 1202370 - DNA, 14 bp, Homo sapiens
ctcccctctctgct

SEQ ID NO: 1202371 - DNA, 17 bp, Homo sapiens
ctcccctctcttgcacc

SEQ ID NO: 1202372 - DNA, 13 bp, Homo sapiens
ctcccctctggaa

SEQ ID NO: 1202373 - DNA, 14 bp, Homo sapiens
ctcccctctggaat

SEQ ID NO: 1202374 - DNA, 15 bp, Homo sapiens
ctcccctcttcctct

SEQ ID NO: 1202375 - DNA, 19 bp, Homo sapiens
ctcccctgaggatggcctg

SEQ ID NO: 1202376 - DNA, 12 bp, Homo sapiens
ctcccctgccac

SEQ ID NO: 1202377 - DNA, 13 bp, Homo sapiens
ctcccctgccctg

SEQ ID NO: 1202378 - DNA, 15 bp, Homo sapiens
ctcccctgccctgct

SEQ ID NO: 1202379 - DNA, 14 bp, Homo sapiens
ctcccctgccctgg

SEQ ID NO: 1202380 - DNA, 22 bp, Homo sapiens
ctcccctgttcccctctccctt

SEQ ID NO: 1202381 - DNA, 17 bp, Homo sapiens
ctcccctgtttgcatga

SEQ ID NO: 1202382 - DNA, 19 bp, Homo sapiens
ctccccttcctcactgccc

SEQ ID NO: 1202383 - DNA, 14 bp, Homo sapiens
ctccccttcctgga

SEQ ID NO: 1202384 - DNA, 17 bp, Homo sapiens
ctccccttcctggacac

SEQ ID NO: 1202385 - DNA, 20 bp, Homo sapiens
ctccccttcctggacacact

SEQ ID NO: 1202386 - DNA, 15 bp, Homo sapiens
ctccccttcttcccg

SEQ ID NO: 1202387 - DNA, 16 bp, Homo sapiens
ctccccttgagctgag

SEQ ID NO: 1202388 - DNA, 22 bp, Homo sapiens
ctccccttgatttaaacacaca

SEQ ID NO: 1202389 - DNA, 23 bp, Homo sapiens
ctccccttgatttaaacacacag

SEQ ID NO: 1202390 - DNA, 16 bp, Homo sapiens
ctccccttggacctcc

SEQ ID NO: 1202391 - DNA, 19 bp, Homo sapiens
ctccccttggacctccagg

SEQ ID NO: 1202392 - DNA, 20 bp, Homo sapiens
ctccccttggacctccaggg

SEQ ID NO: 1202393 - DNA, 18 bp, Homo sapiens
ctccccttggttctgcac

SEQ ID NO: 1202394 - DNA, 20 bp, Homo sapiens
ctccccttggttctgcactg

SEQ ID NO: 1202395 - DNA, 18 bp, Homo sapiens
ctccccttttaccactcc

SEQ ID NO: 1202396 - DNA, 19 bp, Homo sapiens
ctccccttttaccactccc

SEQ ID NO: 1202397 - DNA, 16 bp, Homo sapiens
ctccccttttctatgt

SEQ ID NO: 1202398 - DNA, 20 bp, Homo sapiens
ctccccttttttcttctatt

SEQ ID NO: 1202399 - DNA, 14 bp, Homo sapiens
ctcccgaagccacc

SEQ ID NO: 1202400 - DNA, 20 bp, Homo sapiens
ctcccgacagcccatcacct

SEQ ID NO: 1202401 - DNA, 18 bp, Homo sapiens
ctcccgagctcctcttcc

SEQ ID NO: 1202402 - DNA, 14 bp, Homo sapiens
ctcccgaggaagca

SEQ ID NO: 1202403 - DNA, 18 bp, Homo sapiens
ctcccgaggaagcacagc

SEQ ID NO: 1202404 - DNA, 22 bp, Homo sapiens
ctcccgagtagctgggattaca

SEQ ID NO: 1202405 - DNA, 13 bp, Homo sapiens
ctcccgcaccttc

SEQ ID NO: 1202406 - DNA, 18 bp, Homo sapiens
ctcccgcaccttcctcct

SEQ ID NO: 1202407 - DNA, 21 bp, Homo sapiens
ctcccgcaccttcctcctccc

SEQ ID NO: 1202408 - DNA, 22 bp, Homo sapiens
ctcccgccccccacacttccct

SEQ ID NO: 1202409 - DNA, 16 bp, Homo sapiens
ctcccgccccgggctg

SEQ ID NO: 1202410 - DNA, 23 bp, Homo sapiens
ctcccgccccgggctggccctgt

SEQ ID NO: 1202411 - DNA, 19 bp, Homo sapiens
ctcccggaggttgggtggg

SEQ ID NO: 1202412 - DNA, 20 bp, Homo sapiens
ctcccggaggttgggtgggc

SEQ ID NO: 1202413 - DNA, 19 bp, Homo sapiens
ctcccggcatgggaaagcc

SEQ ID NO: 1202414 - DNA, 15 bp, Homo sapiens
ctcccggcccgcctg

SEQ ID NO: 1202415 - DNA, 16 bp, Homo sapiens
ctcccggcccgcctgc

SEQ ID NO: 1202416 - DNA, 20 bp, Homo sapiens
ctcccggcccgcctgcccag

SEQ ID NO: 1202417 - DNA, 19 bp, Homo sapiens
ctcccgggccacgccccag

SEQ ID NO: 1202418 - DNA, 16 bp, Homo sapiens
ctcccgggccctccct

SEQ ID NO: 1202419 - DNA, 16 bp, Homo sapiens
ctcccggggcccagga

SEQ ID NO: 1202420 - DNA, 15 bp, Homo sapiens
ctcccgggggcccca

SEQ ID NO: 1202421 - DNA, 17 bp, Homo sapiens
ctcccgggtccttggcc

SEQ ID NO: 1202422 - DNA, 16 bp, Homo sapiens
ctcccggttcttccag

SEQ ID NO: 1202423 - DNA, 18 bp, Homo sapiens
ctcccgtagtctcctggg

SEQ ID NO: 1202424 - DNA, 20 bp, Homo sapiens
ctcccgttgcgtcaagtcta

SEQ ID NO: 1202425 - DNA, 14 bp, Homo sapiens
ctccctaaactgta

SEQ ID NO: 1202426 - DNA, 19 bp, Homo sapiens
ctccctaaactttggcctt

SEQ ID NO: 1202427 - DNA, 16 bp, Homo sapiens
ctccctaagccagcct

SEQ ID NO: 1202428 - DNA, 18 bp, Homo sapiens
ctccctaagccagcctgg

SEQ ID NO: 1202429 - DNA, 19 bp, Homo sapiens
ctccctaatttatgtgcta

SEQ ID NO: 1202430 - DNA, 16 bp, Homo sapiens
ctccctacattcccca

SEQ ID NO: 1202431 - DNA, 16 bp, Homo sapiens
ctccctacccaatgtc

SEQ ID NO: 1202432 - DNA, 17 bp, Homo sapiens
ctccctacctccctcct

SEQ ID NO: 1202433 - DNA, 19 bp, Homo sapiens
ctccctacttccaagaaaa

SEQ ID NO: 1202434 - DNA, 15 bp, Homo sapiens
ctccctagactgcat

SEQ ID NO: 1202435 - DNA, 18 bp, Homo sapiens
ctccctagcccttccagc

SEQ ID NO: 1202436 - DNA, 21 bp, Homo sapiens
ctccctagcccttccagcctg

SEQ ID NO: 1202437 - DNA, 23 bp, Homo sapiens
ctccctagcccttccagcctggg

SEQ ID NO: 1202438 - DNA, 19 bp, Homo sapiens
ctccctagtgtagagcaag

SEQ ID NO: 1202439 - DNA, 14 bp, Homo sapiens
gctggactgtagaa

SEQ ID NO: 1202440 - DNA, 18 bp, Homo sapiens
gctggactgtagaaggtg

SEQ ID NO: 1202441 - DNA, 22 bp, Homo sapiens
gctggactgttccaggccctcc

SEQ ID NO: 1202442 - DNA, 23 bp, Homo sapiens
gctggactgttccaggccctcca

SEQ ID NO: 1202443 - DNA, 20 bp, Homo sapiens
gctggagactggaccgctga

SEQ ID NO: 1202444 - DNA, 14 bp, Homo sapiens
gctggagcagcgga

SEQ ID NO: 1202445 - DNA, 24 bp, Homo sapiens
gctggagcagcggattgctctgga

SEQ ID NO: 1202446 - DNA, 15 bp, Homo sapiens
gctggagcccacagc

SEQ ID NO: 1202447 - DNA, 20 bp, Homo sapiens
gctggagcccacagcgagcc

SEQ ID NO: 1202448 - DNA, 16 bp, Homo sapiens
gctggagcctggggtg

SEQ ID NO: 1202449 - DNA, 22 bp, Homo sapiens
gctggagctggcgtctgtcttc

SEQ ID NO: 1202450 - DNA, 12 bp, Homo sapiens
gctggaggcagg

SEQ ID NO: 1202451 - DNA, 14 bp, Homo sapiens
gctggaggcagggc

SEQ ID NO: 1202452 - DNA, 15 bp, Homo sapiens
gctggaggcagggcc

SEQ ID NO: 1202453 - DNA, 16 bp, Homo sapiens
gctggaggcccaggct

SEQ ID NO: 1202454 - DNA, 19 bp, Homo sapiens
gctggaggggctgtcctcc

SEQ ID NO: 1202455 - DNA, 20 bp, Homo sapiens
gctggaggggctgtcctcct

SEQ ID NO: 1202456 - DNA, 13 bp, Homo sapiens
gctggaggtgctg

SEQ ID NO: 1202457 - DNA, 14 bp, Homo sapiens
gctggagtcctctc

SEQ ID NO: 1202458 - DNA, 15 bp, Homo sapiens
gctggagtcctctcc

SEQ ID NO: 1202459 - DNA, 16 bp, Homo sapiens
gctggagtcctctcca

SEQ ID NO: 1202460 - DNA, 20 bp, Homo sapiens
gctggagtgcaatggtgtga

SEQ ID NO: 1202461 - DNA, 14 bp, Homo sapiens
gctggagtgcagtg

SEQ ID NO: 1202462 - DNA, 15 bp, Homo sapiens
gctggagtgcagtga

SEQ ID NO: 1202463 - DNA, 19 bp, Homo sapiens
gctggagtgctgcttgtgc

SEQ ID NO: 1202464 - DNA, 18 bp, Homo sapiens
gctggagttccggcctgg

SEQ ID NO: 1202465 - DNA, 22 bp, Homo sapiens
gctggagttccggcctgggcac

SEQ ID NO: 1202466 - DNA, 15 bp, Homo sapiens
gctggataaaatgag

SEQ ID NO: 1202467 - DNA, 14 bp, Homo sapiens
gctggatagacttg

SEQ ID NO: 1202468 - DNA, 20 bp, Homo sapiens
gctggatgagacttccaaac

SEQ ID NO: 1202469 - DNA, 14 bp, Homo sapiens
gctggatggacaga

SEQ ID NO: 1202470 - DNA, 17 bp, Homo sapiens
gctggatggacagacac

SEQ ID NO: 1202471 - DNA, 22 bp, Homo sapiens
gctggatggacagacacctccc

SEQ ID NO: 1202472 - DNA, 18 bp, Homo sapiens
gctggattaatgttttgt

SEQ ID NO: 1202473 - DNA, 15 bp, Homo sapiens
gctggattgtgcttt

SEQ ID NO: 1202474 - DNA, 15 bp, Homo sapiens
gctggcaaaggtggc

SEQ ID NO: 1202475 - DNA, 17 bp, Homo sapiens
gctggcaccgccttctc

SEQ ID NO: 1202476 - DNA, 19 bp, Homo sapiens
gctggcacgtgacaggctc

SEQ ID NO: 1202477 - DNA, 17 bp, Homo sapiens
gctggcactgagcctgc

SEQ ID NO: 1202478 - DNA, 21 bp, Homo sapiens
gctggcagaacggaggaggct

SEQ ID NO: 1202479 - DNA, 14 bp, Homo sapiens
gctggcagctctcc

SEQ ID NO: 1202480 - DNA, 16 bp, Homo sapiens
gctggcagctctccag

SEQ ID NO: 1202481 - DNA, 17 bp, Homo sapiens
gctggcagctctccagt

SEQ ID NO: 1202482 - DNA, 18 bp, Homo sapiens
gctggcagctctccagtc

SEQ ID NO: 1202483 - DNA, 12 bp, Homo sapiens
gctggcagggcc

SEQ ID NO: 1202484 - DNA, 18 bp, Homo sapiens
gctggcagggccagggca

SEQ ID NO: 1202485 - DNA, 23 bp, Homo sapiens
gctggcagggccagggcaatgcc

SEQ ID NO: 1202486 - DNA, 16 bp, Homo sapiens
gctggccaaagagcct

SEQ ID NO: 1202487 - DNA, 18 bp, Homo sapiens
gctggccaaggtgtccag

SEQ ID NO: 1202488 - DNA, 19 bp, Homo sapiens
gctggccaaggtgtccagg

SEQ ID NO: 1202489 - DNA, 18 bp, Homo sapiens
gctggccagcaaggcagg

SEQ ID NO: 1202490 - DNA, 19 bp, Homo sapiens
gctggccagcaaggcaggt

SEQ ID NO: 1202491 - DNA, 16 bp, Homo sapiens
gctggccagcaccctc

SEQ ID NO: 1202492 - DNA, 23 bp, Homo sapiens
gctggccagcaccctctcctggg

SEQ ID NO: 1202493 - DNA, 17 bp, Homo sapiens
gctggccagtccaggct

SEQ ID NO: 1202494 - DNA, 12 bp, Homo sapiens
gctggccagtct

SEQ ID NO: 1202495 - DNA, 22 bp, Homo sapiens
gctggccatgaatctctgcctc

SEQ ID NO: 1202496 - DNA, 12 bp, Homo sapiens
gctggcccagcc

SEQ ID NO: 1202497 - DNA, 18 bp, Homo sapiens
gctggcccagccggcctc

SEQ ID NO: 1202498 - DNA, 20 bp, Homo sapiens
gctggcccagccggcctctc

SEQ ID NO: 1202499 - DNA, 23 bp, Homo sapiens
gctggcccagccggcctctctgg

SEQ ID NO: 1202500 - DNA, 15 bp, Homo sapiens
gctggccccagccct

SEQ ID NO: 1202501 - DNA, 12 bp, Homo sapiens
gctggcccccag

SEQ ID NO: 1202502 - DNA, 14 bp, Homo sapiens
gctggcccccagga

SEQ ID NO: 1202503 - DNA, 23 bp, Homo sapiens
gctggcccctcacctgggcacct

SEQ ID NO: 1202504 - DNA, 22 bp, Homo sapiens
gctggccctacttccaggatgg

SEQ ID NO: 1202505 - DNA, 21 bp, Homo sapiens
gctggccgacccactgaccca

SEQ ID NO: 1202506 - DNA, 15 bp, Homo sapiens
gctggccgagggtcc

SEQ ID NO: 1202507 - DNA, 22 bp, Homo sapiens
gctggcctcccaaatgagccat

SEQ ID NO: 1202508 - DNA, 23 bp, Homo sapiens
gctggcctctggctctcatgggg

SEQ ID NO: 1202509 - DNA, 19 bp, Homo sapiens
gctggcctggaccattcct

SEQ ID NO: 1202510 - DNA, 12 bp, Homo sapiens
gctggcctggat

SEQ ID NO: 1202511 - DNA, 15 bp, Homo sapiens
gctggcctggatctc

SEQ ID NO: 1202512 - DNA, 12 bp, Homo sapiens
gctggccttcct

SEQ ID NO: 1202513 - DNA, 13 bp, Homo sapiens
gctggccttcctg

SEQ ID NO: 1202514 - DNA, 16 bp, Homo sapiens
gctggccttcctgccc

SEQ ID NO: 1202515 - DNA, 22 bp, Homo sapiens
gctggccttggtatgtgccagg

SEQ ID NO: 1202516 - DNA, 23 bp, Homo sapiens
gctggcctttcaggtccaggcca

SEQ ID NO: 1202517 - DNA, 16 bp, Homo sapiens
gctggcgcagccaagg

SEQ ID NO: 1202518 - DNA, 20 bp, Homo sapiens
gctggcgcagccaaggccga

SEQ ID NO: 1202519 - DNA, 15 bp, Homo sapiens
gctggcgcttggatc

SEQ ID NO: 1202520 - DNA, 16 bp, Homo sapiens
gctggctcacagtaca

SEQ ID NO: 1202521 - DNA, 17 bp, Homo sapiens
gctggctcacagtacag

SEQ ID NO: 1202522 - DNA, 18 bp, Homo sapiens
gctggctcacagtacagc

SEQ ID NO: 1202523 - DNA, 11 bp, Homo sapiens
gctggctcacc

SEQ ID NO: 1202524 - DNA, 17 bp, Homo sapiens
gctggctccagatgcag

SEQ ID NO: 1202525 - DNA, 13 bp, Homo sapiens
gctggctcccagg

SEQ ID NO: 1202526 - DNA, 17 bp, Homo sapiens
gctggctccccctcccc

SEQ ID NO: 1202527 - DNA, 23 bp, Homo sapiens
gctggctccccctccccaggctg

SEQ ID NO: 1202528 - DNA, 13 bp, Homo sapiens
gctggctcctgat

SEQ ID NO: 1202529 - DNA, 21 bp, Homo sapiens
gctggctcctgatccactttg

SEQ ID NO: 1202530 - DNA, 22 bp, Homo sapiens
gctggctctaccttcctgtccc

SEQ ID NO: 1202531 - DNA, 18 bp, Homo sapiens
gctggctctgagaatcac

SEQ ID NO: 1202532 - DNA, 16 bp, Homo sapiens
gctggctctgagcgcc

SEQ ID NO: 1202533 - DNA, 14 bp, Homo sapiens
gctggctgagctga

SEQ ID NO: 1202534 - DNA, 14 bp, Homo sapiens
gctggctgccttag

SEQ ID NO: 1202535 - DNA, 20 bp, Homo sapiens
gctggctgccttagaacctt

SEQ ID NO: 1202536 - DNA, 20 bp, Homo sapiens
gctggctgcttgcagccagg

SEQ ID NO: 1202537 - DNA, 15 bp, Homo sapiens
gctggctgggcatgg

SEQ ID NO: 1202538 - DNA, 18 bp, Homo sapiens
gctggcttgtttgatttc

SEQ ID NO: 1202539 - DNA, 12 bp, Homo sapiens
gctggcttttca

SEQ ID NO: 1202540 - DNA, 20 bp, Homo sapiens
gctggcttttcaccccagag

SEQ ID NO: 1202541 - DNA, 21 bp, Homo sapiens
gctggcttttcaccccagagg

SEQ ID NO: 1202542 - DNA, 14 bp, Homo sapiens
gctgggaaagcata

SEQ ID NO: 1202543 - DNA, 19 bp, Homo sapiens
gctgggaaccccgcagccc

SEQ ID NO: 1202544 - DNA, 20 bp, Homo sapiens
gctgggaaccccgcagcccg

SEQ ID NO: 1202545 - DNA, 21 bp, Homo sapiens
gctgggaacctagcacacctg

SEQ ID NO: 1202546 - DNA, 21 bp, Homo sapiens
gctgggaacgtgtgtccaggc

SEQ ID NO: 1202547 - DNA, 22 bp, Homo sapiens
gctgggacccctcccaacctca

SEQ ID NO: 1202548 - DNA, 17 bp, Homo sapiens
gctgggacctaatgctg

SEQ ID NO: 1202549 - DNA, 19 bp, Homo sapiens
gctgggacgatcgcccagg

SEQ ID NO: 1202550 - DNA, 19 bp, Homo sapiens
gctgggacgtggctcagcc

SEQ ID NO: 1202551 - DNA, 21 bp, Homo sapiens
gctgggacgtggctcagccag

SEQ ID NO: 1202552 - DNA, 16 bp, Homo sapiens
gctgggactacaggtg

SEQ ID NO: 1202553 - DNA, 17 bp, Homo sapiens
gctgggactacaggtgt

SEQ ID NO: 1202554 - DNA, 14 bp, Homo sapiens
gctgggagaagaaa

SEQ ID NO: 1202555 - DNA, 14 bp, Homo sapiens
gctgggagcactgg

SEQ ID NO: 1202556 - DNA, 20 bp, Homo sapiens
gctgggagccagtgtgccca

SEQ ID NO: 1202557 - DNA, 14 bp, Homo sapiens
gctgggagctccac

SEQ ID NO: 1202558 - DNA, 13 bp, Homo sapiens
gctgggagctgaa

SEQ ID NO: 1202559 - DNA, 16 bp, Homo sapiens
gctgggaggcaagagg

SEQ ID NO: 1202560 - DNA, 14 bp, Homo sapiens
gctgggaggcatgg

SEQ ID NO: 1202561 - DNA, 20 bp, Homo sapiens
gctgggagtccttacctcgg

SEQ ID NO: 1202562 - DNA, 22 bp, Homo sapiens
gctgggattacaggcgtgagcc

SEQ ID NO: 1202563 - DNA, 13 bp, Homo sapiens
ctccctcaactga

SEQ ID NO: 1202564 - DNA, 16 bp, Homo sapiens
ctccctcaactgaagg

SEQ ID NO: 1202565 - DNA, 18 bp, Homo sapiens
ctccctcaccctgagccc

SEQ ID NO: 1202566 - DNA, 17 bp, Homo sapiens
ctccctcagcccccagg

SEQ ID NO: 1202567 - DNA, 14 bp, Homo sapiens
ctccctcagcccct

SEQ ID NO: 1202568 - DNA, 15 bp, Homo sapiens
ctccctcagcccctc

SEQ ID NO: 1202569 - DNA, 17 bp, Homo sapiens
ctccctcagctctctgg

SEQ ID NO: 1202570 - DNA, 14 bp, Homo sapiens
ctccctcatcggcc

SEQ ID NO: 1202571 - DNA, 13 bp, Homo sapiens
ctccctcattcca

SEQ ID NO: 1202572 - DNA, 18 bp, Homo sapiens
ctccctccaagcctggca

SEQ ID NO: 1202573 - DNA, 19 bp, Homo sapiens
ctccctccaagcctggcac

SEQ ID NO: 1202574 - DNA, 15 bp, Homo sapiens
ctccctccaccagcc

SEQ ID NO: 1202575 - DNA, 17 bp, Homo sapiens
ctccctccaccagcctg

SEQ ID NO: 1202576 - DNA, 19 bp, Homo sapiens
ctccctccaccagcctgct

SEQ ID NO: 1202577 - DNA, 20 bp, Homo sapiens
ctccctccaccagcctgctg

SEQ ID NO: 1202578 - DNA, 18 bp, Homo sapiens
ctccctccaccccaggac

SEQ ID NO: 1202579 - DNA, 12 bp, Homo sapiens
ctccctcccaca

SEQ ID NO: 1202580 - DNA, 11 bp, Homo sapiens
ctccctcccag

SEQ ID NO: 1202581 - DNA, 12 bp, Homo sapiens
ctccctcccaga

SEQ ID NO: 1202582 - DNA, 19 bp, Homo sapiens
ctccctcccatcctccagc

SEQ ID NO: 1202583 - DNA, 14 bp, Homo sapiens
ctccctccccaccc

SEQ ID NO: 1202584 - DNA, 17 bp, Homo sapiens
ctccctccccacccaag

SEQ ID NO: 1202585 - DNA, 12 bp, Homo sapiens
ctccctccccag

SEQ ID NO: 1202586 - DNA, 15 bp, Homo sapiens
ctccctccccagctc

SEQ ID NO: 1202587 - DNA, 19 bp, Homo sapiens
ctccctcccccagccacca

SEQ ID NO: 1202588 - DNA, 15 bp, Homo sapiens
ctccctcccctgcca

SEQ ID NO: 1202589 - DNA, 14 bp, Homo sapiens
ctccctcccggctg

SEQ ID NO: 1202590 - DNA, 15 bp, Homo sapiens
ctccctcccggctgc

SEQ ID NO: 1202591 - DNA, 21 bp, Homo sapiens
ctccctcccgtagtctcctgg

SEQ ID NO: 1202592 - DNA, 22 bp, Homo sapiens
ctccctcccgtagtctcctggg

SEQ ID NO: 1202593 - DNA, 15 bp, Homo sapiens
ctccctccctagccc

SEQ ID NO: 1202594 - DNA, 20 bp, Homo sapiens
ctccctccctagcccttcca

SEQ ID NO: 1202595 - DNA, 12 bp, Homo sapiens
ctccctccctct

SEQ ID NO: 1202596 - DNA, 14 bp, Homo sapiens
ctccctccctctcc

SEQ ID NO: 1202597 - DNA, 15 bp, Homo sapiens
ctccctccctctttc

SEQ ID NO: 1202598 - DNA, 13 bp, Homo sapiens
ctccctcccttcc

SEQ ID NO: 1202599 - DNA, 17 bp, Homo sapiens
ctccctccgactccaga

SEQ ID NO: 1202600 - DNA, 18 bp, Homo sapiens
ctccctccgatccttcct

SEQ ID NO: 1202601 - DNA, 17 bp, Homo sapiens
ctccctccggcttgacc

SEQ ID NO: 1202602 - DNA, 18 bp, Homo sapiens
ctccctcctcacctctgg

SEQ ID NO: 1202603 - DNA, 21 bp, Homo sapiens
ctccctcctcacctctggact

SEQ ID NO: 1202604 - DNA, 13 bp, Homo sapiens
ctccctcctctgg

SEQ ID NO: 1202605 - DNA, 14 bp, Homo sapiens
ctccctcctctggc

SEQ ID NO: 1202606 - DNA, 15 bp, Homo sapiens
ctccctcctggagca

SEQ ID NO: 1202607 - DNA, 16 bp, Homo sapiens
ctccctccttctcctt

SEQ ID NO: 1202608 - DNA, 16 bp, Homo sapiens
ctccctcgggggctct

SEQ ID NO: 1202609 - DNA, 19 bp, Homo sapiens
ctccctcgggggctcttcc

SEQ ID NO: 1202610 - DNA, 20 bp, Homo sapiens
ctccctcgggggctcttccc

SEQ ID NO: 1202611 - DNA, 13 bp, Homo sapiens
ctccctcgtgggc

SEQ ID NO: 1202612 - DNA, 16 bp, Homo sapiens
ctccctctactcttcc

SEQ ID NO: 1202613 - DNA, 17 bp, Homo sapiens
ctccctctcatgtccct

SEQ ID NO: 1202614 - DNA, 20 bp, Homo sapiens
ctccctctcatgtccctcca

SEQ ID NO: 1202615 - DNA, 23 bp, Homo sapiens
ctccctctcatgtccctccaggg

SEQ ID NO: 1202616 - DNA, 15 bp, Homo sapiens
ctccctctcctgcct

SEQ ID NO: 1202617 - DNA, 17 bp, Homo sapiens
ctccctctcctgcctac

SEQ ID NO: 1202618 - DNA, 15 bp, Homo sapiens
ctccctctctcttct

SEQ ID NO: 1202619 - DNA, 12 bp, Homo sapiens
ctccctctctgg

SEQ ID NO: 1202620 - DNA, 16 bp, Homo sapiens
ctccctctctggtttc

SEQ ID NO: 1202621 - DNA, 22 bp, Homo sapiens
ctccctctcttccgggagctgg

SEQ ID NO: 1202622 - DNA, 14 bp, Homo sapiens
ctccctctgcccca

SEQ ID NO: 1202623 - DNA, 20 bp, Homo sapiens
ctccctctgccccaagcagc

SEQ ID NO: 1202624 - DNA, 22 bp, Homo sapiens
ctccctctgccccaagcagcca

SEQ ID NO: 1202625 - DNA, 14 bp, Homo sapiens
ctccctctgccttc

SEQ ID NO: 1202626 - DNA, 14 bp, Homo sapiens
ctccctctggatca

SEQ ID NO: 1202627 - DNA, 16 bp, Homo sapiens
ctccctctggatcaaa

SEQ ID NO: 1202628 - DNA, 19 bp, Homo sapiens
ctccctctggccctgcctt

SEQ ID NO: 1202629 - DNA, 11 bp, Homo sapiens
ctccctcttcc

SEQ ID NO: 1202630 - DNA, 19 bp, Homo sapiens
ctccctcttcctctccata

SEQ ID NO: 1202631 - DNA, 17 bp, Homo sapiens
ctccctcttccttcccc

SEQ ID NO: 1202632 - DNA, 19 bp, Homo sapiens
ctccctcttccttccccca

SEQ ID NO: 1202633 - DNA, 15 bp, Homo sapiens
ctccctcttctgccc

SEQ ID NO: 1202634 - DNA, 20 bp, Homo sapiens
ctccctctttcccaccctcc

SEQ ID NO: 1202635 - DNA, 21 bp, Homo sapiens
ctccctgaaaatgtttttctg

SEQ ID NO: 1202636 - DNA, 23 bp, Homo sapiens
ctccctgaaaatgtttttctgcc

SEQ ID NO: 1202637 - DNA, 18 bp, Homo sapiens
ctccctgaaacactgctt

SEQ ID NO: 1202638 - DNA, 18 bp, Homo sapiens
ctccctgactccctgtgg

SEQ ID NO: 1202639 - DNA, 13 bp, Homo sapiens
ctccctgacttct

SEQ ID NO: 1202640 - DNA, 16 bp, Homo sapiens
ctccctgacttctccc

SEQ ID NO: 1202641 - DNA, 14 bp, Homo sapiens
ctccctgagcctgc

SEQ ID NO: 1202642 - DNA, 16 bp, Homo sapiens
ctccctgagctttggg

SEQ ID NO: 1202643 - DNA, 17 bp, Homo sapiens
ctccctgagctttgggg

SEQ ID NO: 1202644 - DNA, 18 bp, Homo sapiens
ctccctgagtctggacct

SEQ ID NO: 1202645 - DNA, 15 bp, Homo sapiens
ctccctgatggaccc

SEQ ID NO: 1202646 - DNA, 19 bp, Homo sapiens
ctccctgcaccgccgcaga

SEQ ID NO: 1202647 - DNA, 20 bp, Homo sapiens
ctccctgcactccctcctgg

SEQ ID NO: 1202648 - DNA, 12 bp, Homo sapiens
ctccctgcagcc

SEQ ID NO: 1202649 - DNA, 14 bp, Homo sapiens
ctccctgcaggggc

SEQ ID NO: 1202650 - DNA, 15 bp, Homo sapiens
ctccctgcaggggct

SEQ ID NO: 1202651 - DNA, 20 bp, Homo sapiens
ctccctgcatcctgaggcca

SEQ ID NO: 1202652 - DNA, 13 bp, Homo sapiens
ctccctgccatcc

SEQ ID NO: 1202653 - DNA, 20 bp, Homo sapiens
ctccctgccattttttaaga

SEQ ID NO: 1202654 - DNA, 15 bp, Homo sapiens
ctccctgccccaaat

SEQ ID NO: 1202655 - DNA, 12 bp, Homo sapiens
ctccctgccccc

SEQ ID NO: 1202656 - DNA, 21 bp, Homo sapiens
ctccctgcccctcccttcaac

SEQ ID NO: 1202657 - DNA, 15 bp, Homo sapiens
ctccctgccgcctca

SEQ ID NO: 1202658 - DNA, 14 bp, Homo sapiens
ctccctgcctccag

SEQ ID NO: 1202659 - DNA, 14 bp, Homo sapiens
ctccctgcctgagg

SEQ ID NO: 1202660 - DNA, 13 bp, Homo sapiens
ctccctgcctgct

SEQ ID NO: 1202661 - DNA, 12 bp, Homo sapiens
ctccctgcctgg

SEQ ID NO: 1202662 - DNA, 16 bp, Homo sapiens
ctccctgcctggcccc

SEQ ID NO: 1202663 - DNA, 13 bp, Homo sapiens
ctccctgccttta

SEQ ID NO: 1202664 - DNA, 17 bp, Homo sapiens
ctccctgctcctcatgg

SEQ ID NO: 1202665 - DNA, 19 bp, Homo sapiens
ctccctgctcctcatggga

SEQ ID NO: 1202666 - DNA, 20 bp, Homo sapiens
ctccctgcttgcacacttcc

SEQ ID NO: 1202667 - DNA, 20 bp, Homo sapiens
ctccctggagaagcaccagc

SEQ ID NO: 1202668 - DNA, 18 bp, Homo sapiens
ctccctggagccagactc

SEQ ID NO: 1202669 - DNA, 21 bp, Homo sapiens
ctccctggagccagactctgg

SEQ ID NO: 1202670 - DNA, 13 bp, Homo sapiens
ctccctggagccc

SEQ ID NO: 1202671 - DNA, 12 bp, Homo sapiens
ctccctggagtg

SEQ ID NO: 1202672 - DNA, 15 bp, Homo sapiens
ctccctggctcccat

SEQ ID NO: 1202673 - DNA, 18 bp, Homo sapiens
ctccctggctctcagaag

SEQ ID NO: 1202674 - DNA, 14 bp, Homo sapiens
ctccctggctgccc

SEQ ID NO: 1202675 - DNA, 15 bp, Homo sapiens
ctccctggctgccct

SEQ ID NO: 1202676 - DNA, 19 bp, Homo sapiens
ctccctggctgccctggcc

SEQ ID NO: 1202677 - DNA, 19 bp, Homo sapiens
ctccctgggacacagaccc

SEQ ID NO: 1202678 - DNA, 13 bp, Homo sapiens
ctccctgggagcc

SEQ ID NO: 1202679 - DNA, 11 bp, Homo sapiens
ctccctgggcc

SEQ ID NO: 1202680 - DNA, 17 bp, Homo sapiens
ctccctgggccacctcc

SEQ ID NO: 1202681 - DNA, 23 bp, Homo sapiens
ctccctggggatatgcaaccctt

SEQ ID NO: 1202682 - DNA, 15 bp, Homo sapiens
ctccctgggtctggg

SEQ ID NO: 1202683 - DNA, 15 bp, Homo sapiens
ctccctggtcccctc

SEQ ID NO: 1202684 - DNA, 14 bp, Homo sapiens
ctccctggtgcctc

SEQ ID NO: 1202685 - DNA, 18 bp, Homo sapiens
ctccctggtgcctctgtg

SEQ ID NO: 1202686 - DNA, 22 bp, Homo sapiens
ctccctggttgcctctcttgcc

SEQ ID NO: 1202687 - DNA, 15 bp, Homo sapiens
ctccctgtacagtgt

SEQ ID NO: 1202688 - DNA, 14 bp, Homo sapiens
ctccctgtcacaca

SEQ ID NO: 1202689 - DNA, 16 bp, Homo sapiens
ctccctgtcacacact

SEQ ID NO: 1202690 - DNA, 17 bp, Homo sapiens
gctgggattacaggtgt

SEQ ID NO: 1202691 - DNA, 22 bp, Homo sapiens
gctgggattataggcatgagcc

SEQ ID NO: 1202692 - DNA, 22 bp, Homo sapiens
gctgggatttcttcgctgctct

SEQ ID NO: 1202693 - DNA, 15 bp, Homo sapiens
gctgggcaccgtgtc

SEQ ID NO: 1202694 - DNA, 21 bp, Homo sapiens
gctgggcaccgtgtcctcctc

SEQ ID NO: 1202695 - DNA, 16 bp, Homo sapiens
gctgggcacctgactt

SEQ ID NO: 1202696 - DNA, 15 bp, Homo sapiens
gctgggcactgctcc

SEQ ID NO: 1202697 - DNA, 21 bp, Homo sapiens
gctgggcactgctccaaggga

SEQ ID NO: 1202698 - DNA, 11 bp, Homo sapiens
gctgggcagcc

SEQ ID NO: 1202699 - DNA, 13 bp, Homo sapiens
gctgggcagggtg

SEQ ID NO: 1202700 - DNA, 19 bp, Homo sapiens
gctgggcagggtgagaagc

SEQ ID NO: 1202701 - DNA, 16 bp, Homo sapiens
gctgggcatactttct

SEQ ID NO: 1202702 - DNA, 20 bp, Homo sapiens
gctgggcatggtggtgcgtg

SEQ ID NO: 1202703 - DNA, 13 bp, Homo sapiens
gctgggccactgg

SEQ ID NO: 1202704 - DNA, 15 bp, Homo sapiens
gctgggccagggaaa

SEQ ID NO: 1202705 - DNA, 19 bp, Homo sapiens
gctgggccatgtccaaaga

SEQ ID NO: 1202706 - DNA, 18 bp, Homo sapiens
gctgggcccacccaggga

SEQ ID NO: 1202707 - DNA, 17 bp, Homo sapiens
gctgggcccagcccctc

SEQ ID NO: 1202708 - DNA, 15 bp, Homo sapiens
gctgggccccaccta

SEQ ID NO: 1202709 - DNA, 14 bp, Homo sapiens
gctgggccccatgc

SEQ ID NO: 1202710 - DNA, 23 bp, Homo sapiens
gctgggccccatgctctgcccca

SEQ ID NO: 1202711 - DNA, 15 bp, Homo sapiens
gctgggcccctgggg

SEQ ID NO: 1202712 - DNA, 24 bp, Homo sapiens
gctgggcccctggggacagagcca

SEQ ID NO: 1202713 - DNA, 15 bp, Homo sapiens
gctgggccctctctt

SEQ ID NO: 1202714 - DNA, 17 bp, Homo sapiens
gctgggccctctcttct

SEQ ID NO: 1202715 - DNA, 18 bp, Homo sapiens
gctgggccctctcttctc

SEQ ID NO: 1202716 - DNA, 21 bp, Homo sapiens
gctgggccctctttccctgcg

SEQ ID NO: 1202717 - DNA, 20 bp, Homo sapiens
gctgggccgcaagggcctgg

SEQ ID NO: 1202718 - DNA, 17 bp, Homo sapiens
gctgggcctcccctggg

SEQ ID NO: 1202719 - DNA, 19 bp, Homo sapiens
gctgggcctgcgagaccca

SEQ ID NO: 1202720 - DNA, 13 bp, Homo sapiens
gctgggcctgtgc

SEQ ID NO: 1202721 - DNA, 14 bp, Homo sapiens
gctgggcctgtgca

SEQ ID NO: 1202722 - DNA, 19 bp, Homo sapiens
gctgggcctgtgcactggg

SEQ ID NO: 1202723 - DNA, 16 bp, Homo sapiens
gctgggcgtctgttct

SEQ ID NO: 1202724 - DNA, 17 bp, Homo sapiens
gctgggcgtgctagagg

SEQ ID NO: 1202725 - DNA, 15 bp, Homo sapiens
gctgggcgtgtgtga

SEQ ID NO: 1202726 - DNA, 19 bp, Homo sapiens
gctgggcgtgtgtgacact

SEQ ID NO: 1202727 - DNA, 23 bp, Homo sapiens
gctgggctaggcataggtctctt

SEQ ID NO: 1202728 - DNA, 20 bp, Homo sapiens
gctgggctctccacctcagc

SEQ ID NO: 1202729 - DNA, 22 bp, Homo sapiens
gctgggctctccacctcagcct

SEQ ID NO: 1202730 - DNA, 13 bp, Homo sapiens
gctgggctctgca

SEQ ID NO: 1202731 - DNA, 14 bp, Homo sapiens
gctgggctctgcca

SEQ ID NO: 1202732 - DNA, 11 bp, Homo sapiens
gctgggctgag

SEQ ID NO: 1202733 - DNA, 13 bp, Homo sapiens
gctgggctgagcc

SEQ ID NO: 1202734 - DNA, 17 bp, Homo sapiens
gctgggctgagcccctg

SEQ ID NO: 1202735 - DNA, 12 bp, Homo sapiens
gctgggctgagt

SEQ ID NO: 1202736 - DNA, 13 bp, Homo sapiens
gctgggctgggct

SEQ ID NO: 1202737 - DNA, 13 bp, Homo sapiens
gctgggctgtctc

SEQ ID NO: 1202738 - DNA, 17 bp, Homo sapiens
gctgggcttggcctgga

SEQ ID NO: 1202739 - DNA, 23 bp, Homo sapiens
gctggggaaatcaaaagggccaa

SEQ ID NO: 1202740 - DNA, 16 bp, Homo sapiens
gctggggacctggtac

SEQ ID NO: 1202741 - DNA, 13 bp, Homo sapiens
gctggggactcag

SEQ ID NO: 1202742 - DNA, 15 bp, Homo sapiens
gctggggactctggc

SEQ ID NO: 1202743 - DNA, 13 bp, Homo sapiens
gctggggaggagc

SEQ ID NO: 1202744 - DNA, 17 bp, Homo sapiens
gctggggaggaggagag

SEQ ID NO: 1202745 - DNA, 18 bp, Homo sapiens
gctggggaggaggagaga

SEQ ID NO: 1202746 - DNA, 15 bp, Homo sapiens
gctggggagggggta

SEQ ID NO: 1202747 - DNA, 13 bp, Homo sapiens
gctggggaggtgc

SEQ ID NO: 1202748 - DNA, 23 bp, Homo sapiens
gctggggaggtgggaggccaggc

SEQ ID NO: 1202749 - DNA, 23 bp, Homo sapiens
gctggggatccccgcctggccag

SEQ ID NO: 1202750 - DNA, 17 bp, Homo sapiens
gctggggcaagtccctg

SEQ ID NO: 1202751 - DNA, 13 bp, Homo sapiens
gctggggcagagg

SEQ ID NO: 1202752 - DNA, 12 bp, Homo sapiens
gctggggcaggg

SEQ ID NO: 1202753 - DNA, 13 bp, Homo sapiens
gctggggcagggg

SEQ ID NO: 1202754 - DNA, 17 bp, Homo sapiens
gctggggcaggggcctg

SEQ ID NO: 1202755 - DNA, 18 bp, Homo sapiens
gctggggcaggggcctgg

SEQ ID NO: 1202756 - DNA, 13 bp, Homo sapiens
gctggggccacaa

SEQ ID NO: 1202757 - DNA, 19 bp, Homo sapiens
gctggggccacctttgtgc

SEQ ID NO: 1202758 - DNA, 16 bp, Homo sapiens
gctggggccagaggct

SEQ ID NO: 1202759 - DNA, 13 bp, Homo sapiens
gctggggccagcg

SEQ ID NO: 1202760 - DNA, 14 bp, Homo sapiens
gctggggccccatc

SEQ ID NO: 1202761 - DNA, 14 bp, Homo sapiens
gctggggcctcaga

SEQ ID NO: 1202762 - DNA, 16 bp, Homo sapiens
gctggggcctcagacc

SEQ ID NO: 1202763 - DNA, 17 bp, Homo sapiens
gctggggcctcagacga

SEQ ID NO: 1202764 - DNA, 23 bp, Homo sapiens
gctggggctcacggggcctccaa

SEQ ID NO: 1202765 - DNA, 13 bp, Homo sapiens
gctggggctgaac

SEQ ID NO: 1202766 - DNA, 17 bp, Homo sapiens
gctggggctgccagcct

SEQ ID NO: 1202767 - DNA, 16 bp, Homo sapiens
gctggggctgctcccc

SEQ ID NO: 1202768 - DNA, 16 bp, Homo sapiens
gctgggggaagggtgg

SEQ ID NO: 1202769 - DNA, 21 bp, Homo sapiens
gctgggggaatgagcccagag

SEQ ID NO: 1202770 - DNA, 18 bp, Homo sapiens
gctgggggcaactggcca

SEQ ID NO: 1202771 - DNA, 19 bp, Homo sapiens
gctgggggcacagctgtct

SEQ ID NO: 1202772 - DNA, 13 bp, Homo sapiens
gctgggggcagga

SEQ ID NO: 1202773 - DNA, 23 bp, Homo sapiens
gctgggggcaggagggccctacc

SEQ ID NO: 1202774 - DNA, 23 bp, Homo sapiens
gctgggggccagggctggatgga

SEQ ID NO: 1202775 - DNA, 16 bp, Homo sapiens
gctgggggccatgagc

SEQ ID NO: 1202776 - DNA, 22 bp, Homo sapiens
gctgggggctgccgagccacca

SEQ ID NO: 1202777 - DNA, 13 bp, Homo sapiens
gctgggggtagcc

SEQ ID NO: 1202778 - DNA, 19 bp, Homo sapiens
gctgggggtagcctggatg

SEQ ID NO: 1202779 - DNA, 15 bp, Homo sapiens
gctgggggtgggcca

SEQ ID NO: 1202780 - DNA, 19 bp, Homo sapiens
gctgggggtgggccaggct

SEQ ID NO: 1202781 - DNA, 23 bp, Homo sapiens
gctggggtaggctgtctgtgcca

SEQ ID NO: 1202782 - DNA, 18 bp, Homo sapiens
gctggggtccagggctgt

SEQ ID NO: 1202783 - DNA, 15 bp, Homo sapiens
gctggggtctgggca

SEQ ID NO: 1202784 - DNA, 18 bp, Homo sapiens
gctggggtgagagaggaa

SEQ ID NO: 1202785 - DNA, 20 bp, Homo sapiens
gctgggtataagcagagagg

SEQ ID NO: 1202786 - DNA, 19 bp, Homo sapiens
gctgggtcaaaagagccct

SEQ ID NO: 1202787 - DNA, 12 bp, Homo sapiens
gctgggtcagtg

SEQ ID NO: 1202788 - DNA, 20 bp, Homo sapiens
gctgggtctccctttccatg

SEQ ID NO: 1202789 - DNA, 23 bp, Homo sapiens
gctgggtctccctttccatggca

SEQ ID NO: 1202790 - DNA, 15 bp, Homo sapiens
gctgggtgccctctc

SEQ ID NO: 1202791 - DNA, 14 bp, Homo sapiens
gctgggtgcctgca

SEQ ID NO: 1202792 - DNA, 19 bp, Homo sapiens
gctgggtgcctgcagcgcc

SEQ ID NO: 1202793 - DNA, 14 bp, Homo sapiens
gctgggtggcctgt

SEQ ID NO: 1202794 - DNA, 12 bp, Homo sapiens
gctgggtggggc

SEQ ID NO: 1202795 - DNA, 16 bp, Homo sapiens
gctgggttccgggagg

SEQ ID NO: 1202796 - DNA, 13 bp, Homo sapiens
gctggtagcagca

SEQ ID NO: 1202797 - DNA, 19 bp, Homo sapiens
gctggtaggctcctgccag

SEQ ID NO: 1202798 - DNA, 15 bp, Homo sapiens
gctggtatctcagaa

SEQ ID NO: 1202799 - DNA, 18 bp, Homo sapiens
gctggtcactctgccctc

SEQ ID NO: 1202800 - DNA, 19 bp, Homo sapiens
gctggtcactctgccctct

SEQ ID NO: 1202801 - DNA, 20 bp, Homo sapiens
gctggtcactctgccctctg

SEQ ID NO: 1202802 - DNA, 21 bp, Homo sapiens
gctggtcactctgccctctgc

SEQ ID NO: 1202803 - DNA, 22 bp, Homo sapiens
gctggtcactctgccctctgct

SEQ ID NO: 1202804 - DNA, 16 bp, Homo sapiens
gctggtcagagagacc

SEQ ID NO: 1202805 - DNA, 20 bp, Homo sapiens
gctggtcagagagacctcat

SEQ ID NO: 1202806 - DNA, 19 bp, Homo sapiens
gctggtcaggtccccatgg

SEQ ID NO: 1202807 - DNA, 21 bp, Homo sapiens
gctggtcaggtccccatggct

SEQ ID NO: 1202808 - DNA, 16 bp, Homo sapiens
gctggtcatccttggt

SEQ ID NO: 1202809 - DNA, 18 bp, Homo sapiens
gctggtcatccttggtgc

SEQ ID NO: 1202810 - DNA, 13 bp, Homo sapiens
gctggtcctgtgg

SEQ ID NO: 1202811 - DNA, 18 bp, Homo sapiens
gctggtccttatttattt

SEQ ID NO: 1202812 - DNA, 18 bp, Homo sapiens
gctggtctagtcacgcat

SEQ ID NO: 1202813 - DNA, 20 bp, Homo sapiens
gctggtctcaaactcctgac

SEQ ID NO: 1202814 - DNA, 19 bp, Homo sapiens
gctggtctcaaactcctgg

SEQ ID NO: 1202815 - DNA, 12 bp, Homo sapiens
ctccctgtccca

SEQ ID NO: 1202816 - DNA, 14 bp, Homo sapiens
ctccctgtctccag

SEQ ID NO: 1202817 - DNA, 16 bp, Homo sapiens
ctccctgtctccagct

SEQ ID NO: 1202818 - DNA, 18 bp, Homo sapiens
ctccctgtctccagctgc

SEQ ID NO: 1202819 - DNA, 21 bp, Homo sapiens
ctccctgtctccagctgcctg

SEQ ID NO: 1202820 - DNA, 23 bp, Homo sapiens
ctccctgtctccagggcccccac

SEQ ID NO: 1202821 - DNA, 22 bp, Homo sapiens
ctccctgtggcactcagggagc

SEQ ID NO: 1202822 - DNA, 21 bp, Homo sapiens
ctccctgtgggggtggccatc

SEQ ID NO: 1202823 - DNA, 13 bp, Homo sapiens
ctccctgtgtcca

SEQ ID NO: 1202824 - DNA, 21 bp, Homo sapiens
ctccctgtgtccacctgtggg

SEQ ID NO: 1202825 - DNA, 14 bp, Homo sapiens
ctccctgtgttctg

SEQ ID NO: 1202826 - DNA, 20 bp, Homo sapiens
ctccctgtgttctgggctgg

SEQ ID NO: 1202827 - DNA, 22 bp, Homo sapiens
ctccctgttcacggtgacacag

SEQ ID NO: 1202828 - DNA, 17 bp, Homo sapiens
ctccctgtttctccaca

SEQ ID NO: 1202829 - DNA, 17 bp, Homo sapiens
ctcccttaaggtctcca

SEQ ID NO: 1202830 - DNA, 14 bp, Homo sapiens
ctcccttaccctcc

SEQ ID NO: 1202831 - DNA, 17 bp, Homo sapiens
ctcccttaccctcctct

SEQ ID NO: 1202832 - DNA, 20 bp, Homo sapiens
ctcccttaccctcctctgct

SEQ ID NO: 1202833 - DNA, 21 bp, Homo sapiens
ctcccttaccctcctctgctg

SEQ ID NO: 1202834 - DNA, 18 bp, Homo sapiens
ctcccttcaaccattccc

SEQ ID NO: 1202835 - DNA, 22 bp, Homo sapiens
ctcccttcaaccattccccatg

SEQ ID NO: 1202836 - DNA, 22 bp, Homo sapiens
ctcccttcccacctactgcact

SEQ ID NO: 1202837 - DNA, 14 bp, Homo sapiens
ctcccttccctcct

SEQ ID NO: 1202838 - DNA, 20 bp, Homo sapiens
ctcccttccgaccctctggg

SEQ ID NO: 1202839 - DNA, 21 bp, Homo sapiens
ctcccttccgaccctctggga

SEQ ID NO: 1202840 - DNA, 17 bp, Homo sapiens
ctcccttcctctctcct

SEQ ID NO: 1202841 - DNA, 15 bp, Homo sapiens
ctcccttcctggcct

SEQ ID NO: 1202842 - DNA, 18 bp, Homo sapiens
ctcccttcctggcctcac

SEQ ID NO: 1202843 - DNA, 18 bp, Homo sapiens
ctcccttccttgggcaga

SEQ ID NO: 1202844 - DNA, 16 bp, Homo sapiens
ctcccttctccctgga

SEQ ID NO: 1202845 - DNA, 16 bp, Homo sapiens
ctcccttctgctactg

SEQ ID NO: 1202846 - DNA, 12 bp, Homo sapiens
ctcccttcttgg

SEQ ID NO: 1202847 - DNA, 17 bp, Homo sapiens
ctcccttgatggggtcc

SEQ ID NO: 1202848 - DNA, 22 bp, Homo sapiens
ctcccttgcctttcgaggcctg

SEQ ID NO: 1202849 - DNA, 16 bp, Homo sapiens
ctcccttgctcagtgc

SEQ ID NO: 1202850 - DNA, 22 bp, Homo sapiens
ctcccttgctcagtgcctcctg

SEQ ID NO: 1202851 - DNA, 12 bp, Homo sapiens
ctcccttgctgg

SEQ ID NO: 1202852 - DNA, 22 bp, Homo sapiens
ctcccttgctggccccagccct

SEQ ID NO: 1202853 - DNA, 19 bp, Homo sapiens
ctcccttggaaacctgccc

SEQ ID NO: 1202854 - DNA, 16 bp, Homo sapiens
ctcccttgggctggaa

SEQ ID NO: 1202855 - DNA, 19 bp, Homo sapiens
ctcccttggggcctatgca

SEQ ID NO: 1202856 - DNA, 18 bp, Homo sapiens
ctcccttgggttctgata

SEQ ID NO: 1202857 - DNA, 20 bp, Homo sapiens
ctcccttggtggcaagagcc

SEQ ID NO: 1202858 - DNA, 20 bp, Homo sapiens
ctcccttgtttactctgtta

SEQ ID NO: 1202859 - DNA, 15 bp, Homo sapiens
ctccctttcccttct

SEQ ID NO: 1202860 - DNA, 15 bp, Homo sapiens
ctccctttgcgcagc

SEQ ID NO: 1202861 - DNA, 20 bp, Homo sapiens
ctcccttttacattctgtgt

SEQ ID NO: 1202862 - DNA, 21 bp, Homo sapiens
ctcccttttacattctgtgtg

SEQ ID NO: 1202863 - DNA, 15 bp, Homo sapiens
ctcccttttctcctc

SEQ ID NO: 1202864 - DNA, 21 bp, Homo sapiens
ctccctttttatatcccattt

SEQ ID NO: 1202865 - DNA, 11 bp, Homo sapiens
ctccgaacccc

SEQ ID NO: 1202866 - DNA, 20 bp, Homo sapiens
ctccgacttcccctgggcaa

SEQ ID NO: 1202867 - DNA, 23 bp, Homo sapiens
ctccgagagcagtgggcaggtgg

SEQ ID NO: 1202868 - DNA, 19 bp, Homo sapiens
ctccgagaggcagccagac

SEQ ID NO: 1202869 - DNA, 14 bp, Homo sapiens
ctccgagaggtggg

SEQ ID NO: 1202870 - DNA, 16 bp, Homo sapiens
ctccgaggactggact

SEQ ID NO: 1202871 - DNA, 13 bp, Homo sapiens
ctccgaggctccc

SEQ ID NO: 1202872 - DNA, 17 bp, Homo sapiens
ctccgaggctccccgcc

SEQ ID NO: 1202873 - DNA, 12 bp, Homo sapiens
ctccgagtgagt

SEQ ID NO: 1202874 - DNA, 16 bp, Homo sapiens
ctccgatccttcctcc

SEQ ID NO: 1202875 - DNA, 15 bp, Homo sapiens
ctccgcattggaaga

SEQ ID NO: 1202876 - DNA, 22 bp, Homo sapiens
ctccgccagaccccgtggctct

SEQ ID NO: 1202877 - DNA, 15 bp, Homo sapiens
ctccgcccagcctct

SEQ ID NO: 1202878 - DNA, 15 bp, Homo sapiens
ctccgcccccagcct

SEQ ID NO: 1202879 - DNA, 16 bp, Homo sapiens
ctccgcccccagccta

SEQ ID NO: 1202880 - DNA, 20 bp, Homo sapiens
ctccgcccccagcctatgag

SEQ ID NO: 1202881 - DNA, 15 bp, Homo sapiens
ctccgccgtgccggc

SEQ ID NO: 1202882 - DNA, 15 bp, Homo sapiens
ctccgcctcccatcc

SEQ ID NO: 1202883 - DNA, 15 bp, Homo sapiens
ctccgcctgggatct

SEQ ID NO: 1202884 - DNA, 19 bp, Homo sapiens
ctccgccttcactccggtg

SEQ ID NO: 1202885 - DNA, 14 bp, Homo sapiens
ctccgccttccggg

SEQ ID NO: 1202886 - DNA, 21 bp, Homo sapiens
ctccgcgccctccgacctctc

SEQ ID NO: 1202887 - DNA, 20 bp, Homo sapiens
ctccgcgccgatgccaccgg

SEQ ID NO: 1202888 - DNA, 19 bp, Homo sapiens
ctccggaatagatgtcttc

SEQ ID NO: 1202889 - DNA, 13 bp, Homo sapiens
ctccggagacagg

SEQ ID NO: 1202890 - DNA, 14 bp, Homo sapiens
ctccggaggagcag

SEQ ID NO: 1202891 - DNA, 20 bp, Homo sapiens
ctccggcctgatgacagagc

SEQ ID NO: 1202892 - DNA, 12 bp, Homo sapiens
ctccggcctgta

SEQ ID NO: 1202893 - DNA, 19 bp, Homo sapiens
ctccggcgtcttgcccagc

SEQ ID NO: 1202894 - DNA, 12 bp, Homo sapiens
ctccgggcaaat

SEQ ID NO: 1202895 - DNA, 13 bp, Homo sapiens
ctccgggcgtgtg

SEQ ID NO: 1202896 - DNA, 18 bp, Homo sapiens
ctccggggagcgcccgcg

SEQ ID NO: 1202897 - DNA, 21 bp, Homo sapiens
ctccggggagcgcccgcgccc

SEQ ID NO: 1202898 - DNA, 17 bp, Homo sapiens
ctccggggtctgtgctg

SEQ ID NO: 1202899 - DNA, 18 bp, Homo sapiens
ctccggggtctgtgctgt

SEQ ID NO: 1202900 - DNA, 20 bp, Homo sapiens
ctccgggtgtggcctcagcc

SEQ ID NO: 1202901 - DNA, 23 bp, Homo sapiens
ctccgggtgtggcctcagccctc

SEQ ID NO: 1202902 - DNA, 18 bp, Homo sapiens
ctccggtgtgcctgcagc

SEQ ID NO: 1202903 - DNA, 19 bp, Homo sapiens
ctccggtgtgcctgcagcc

SEQ ID NO: 1202904 - DNA, 20 bp, Homo sapiens
ctccggtttgggctgtctta

SEQ ID NO: 1202905 - DNA, 14 bp, Homo sapiens
ctccgtccacccag

SEQ ID NO: 1202906 - DNA, 19 bp, Homo sapiens
ctccgtccacccaggctgc

SEQ ID NO: 1202907 - DNA, 20 bp, Homo sapiens
ctccgtccacccaggctgca

SEQ ID NO: 1202908 - DNA, 23 bp, Homo sapiens
ctccgtccacccaggctgcactg

SEQ ID NO: 1202909 - DNA, 22 bp, Homo sapiens
ctccgtccagccgccattgcca

SEQ ID NO: 1202910 - DNA, 19 bp, Homo sapiens
ctccgtccaggagcctggc

SEQ ID NO: 1202911 - DNA, 13 bp, Homo sapiens
ctccgtccatatc

SEQ ID NO: 1202912 - DNA, 17 bp, Homo sapiens
ctccgtctctgtcctcg

SEQ ID NO: 1202913 - DNA, 18 bp, Homo sapiens
ctccgtctgaccctctgc

SEQ ID NO: 1202914 - DNA, 22 bp, Homo sapiens
ctccgtcttagaagtggaccag

SEQ ID NO: 1202915 - DNA, 14 bp, Homo sapiens
ctccgtgcctccac

SEQ ID NO: 1202916 - DNA, 12 bp, Homo sapiens
ctccgtggaaca

SEQ ID NO: 1202917 - DNA, 17 bp, Homo sapiens
ctccgtggaacattctg

SEQ ID NO: 1202918 - DNA, 20 bp, Homo sapiens
ctccgtggaacattctggat

SEQ ID NO: 1202919 - DNA, 13 bp, Homo sapiens
ctccgtggactgc

SEQ ID NO: 1202920 - DNA, 18 bp, Homo sapiens
ctccgtggaggaggttgg

SEQ ID NO: 1202921 - DNA, 15 bp, Homo sapiens
ctccgtgtgcctggg

SEQ ID NO: 1202922 - DNA, 16 bp, Homo sapiens
ctccgtgtgcctgggg

SEQ ID NO: 1202923 - DNA, 14 bp, Homo sapiens
ctccgtgtggagca

SEQ ID NO: 1202924 - DNA, 20 bp, Homo sapiens
ctccgtgtggagcacgtgga

SEQ ID NO: 1202925 - DNA, 18 bp, Homo sapiens
ctccgtgttcctcggtgg

SEQ ID NO: 1202926 - DNA, 21 bp, Homo sapiens
ctccgttagctcctgtggccc

SEQ ID NO: 1202927 - DNA, 17 bp, Homo sapiens
ctccgtttatgggcctt

SEQ ID NO: 1202928 - DNA, 19 bp, Homo sapiens
ctccgtttatgggccttgc

SEQ ID NO: 1202929 - DNA, 13 bp, Homo sapiens
ctcctaaaacaac

SEQ ID NO: 1202930 - DNA, 17 bp, Homo sapiens
ctcctaaggaaattgag

SEQ ID NO: 1202931 - DNA, 19 bp, Homo sapiens
ctcctaaggctccccaccc

SEQ ID NO: 1202932 - DNA, 15 bp, Homo sapiens
ctcctacatccagct

SEQ ID NO: 1202933 - DNA, 16 bp, Homo sapiens
ctcctacatccagctc

SEQ ID NO: 1202934 - DNA, 18 bp, Homo sapiens
ctcctacatccagctcct

SEQ ID NO: 1202935 - DNA, 15 bp, Homo sapiens
ctcctaccagcaaac

SEQ ID NO: 1202936 - DNA, 17 bp, Homo sapiens
ctcctaccccttcctgt

SEQ ID NO: 1202937 - DNA, 18 bp, Homo sapiens
ctcctaccccttcctgtc

SEQ ID NO: 1202938 - DNA, 13 bp, Homo sapiens
ctcctaccctccc

SEQ ID NO: 1202939 - DNA, 20 bp, Homo sapiens
gctggtctggagtcccaccc

SEQ ID NO: 1202940 - DNA, 19 bp, Homo sapiens
gctggtcttaaactcctgg

SEQ ID NO: 1202941 - DNA, 14 bp, Homo sapiens
gctggtgacagcct

SEQ ID NO: 1202942 - DNA, 17 bp, Homo sapiens
gctggtgacagccttgg

SEQ ID NO: 1202943 - DNA, 18 bp, Homo sapiens
gctggtgactttggggac

SEQ ID NO: 1202944 - DNA, 13 bp, Homo sapiens
gctggtgagaccc

SEQ ID NO: 1202945 - DNA, 17 bp, Homo sapiens
gctggtgcattacagag

SEQ ID NO: 1202946 - DNA, 18 bp, Homo sapiens
gctggtgcattacagaga

SEQ ID NO: 1202947 - DNA, 20 bp, Homo sapiens
gctggtgcattacagagagg

SEQ ID NO: 1202948 - DNA, 21 bp, Homo sapiens
gctggtgcattctgtttcctc

SEQ ID NO: 1202949 - DNA, 19 bp, Homo sapiens
gctggtgccaaatagcccc

SEQ ID NO: 1202950 - DNA, 14 bp, Homo sapiens
gctggtgcccatga

SEQ ID NO: 1202951 - DNA, 15 bp, Homo sapiens
gctggtgctgtggcc

SEQ ID NO: 1202952 - DNA, 19 bp, Homo sapiens
gctggtggccctgtgcctg

SEQ ID NO: 1202953 - DNA, 14 bp, Homo sapiens
gctggtggcctctg

SEQ ID NO: 1202954 - DNA, 20 bp, Homo sapiens
gctggtggctggtgagaccc

SEQ ID NO: 1202955 - DNA, 22 bp, Homo sapiens
gctggtggttaaggccagggcc

SEQ ID NO: 1202956 - DNA, 22 bp, Homo sapiens
gctggtggtttgatcatttctg

SEQ ID NO: 1202957 - DNA, 16 bp, Homo sapiens
gctggtgtccccttcc

SEQ ID NO: 1202958 - DNA, 18 bp, Homo sapiens
gctggtgtccccttcccc

SEQ ID NO: 1202959 - DNA, 14 bp, Homo sapiens
gctggttaatgtag

SEQ ID NO: 1202960 - DNA, 12 bp, Homo sapiens
gctggttctgta

SEQ ID NO: 1202961 - DNA, 24 bp, Homo sapiens
gctggttgtcatttttgcagtaga

SEQ ID NO: 1202962 - DNA, 23 bp, Homo sapiens
gctggtttctgagagagtgccat

SEQ ID NO: 1202963 - DNA, 12 bp, Homo sapiens
gctggttttcct

SEQ ID NO: 1202964 - DNA, 17 bp, Homo sapiens
gctggttttggcatctc

SEQ ID NO: 1202965 - DNA, 22 bp, Homo sapiens
gctggttttgtaagatgctggg

SEQ ID NO: 1202966 - DNA, 23 bp, Homo sapiens
gctgtaaaatttgtgtaaatttg

SEQ ID NO: 1202967 - DNA, 22 bp, Homo sapiens
gctgtaaatcctagacttgaaa

SEQ ID NO: 1202968 - DNA, 16 bp, Homo sapiens
gctgtaactgctgagc

SEQ ID NO: 1202969 - DNA, 17 bp, Homo sapiens
gctgtaactgctgagcc

SEQ ID NO: 1202970 - DNA, 16 bp, Homo sapiens
gctgtaagaagagact

SEQ ID NO: 1202971 - DNA, 19 bp, Homo sapiens
gctgtaagcattctgagct

SEQ ID NO: 1202972 - DNA, 17 bp, Homo sapiens
gctgtaaggcatgaagg

SEQ ID NO: 1202973 - DNA, 19 bp, Homo sapiens
gctgtaaggcatgaaggat

SEQ ID NO: 1202974 - DNA, 16 bp, Homo sapiens
gctgtaagggcagtgc

SEQ ID NO: 1202975 - DNA, 19 bp, Homo sapiens
gctgtaccacatctgctct

SEQ ID NO: 1202976 - DNA, 20 bp, Homo sapiens
gctgtacccttccacctcct

SEQ ID NO: 1202977 - DNA, 17 bp, Homo sapiens
gctgtaccctttaagat

SEQ ID NO: 1202978 - DNA, 15 bp, Homo sapiens
gctgtacctgttcct

SEQ ID NO: 1202979 - DNA, 17 bp, Homo sapiens
gctgtactagtgccatt

SEQ ID NO: 1202980 - DNA, 15 bp, Homo sapiens
gctgtactataagta

SEQ ID NO: 1202981 - DNA, 18 bp, Homo sapiens
gctgtactataagtagtt

SEQ ID NO: 1202982 - DNA, 13 bp, Homo sapiens
gctgtactcagag

SEQ ID NO: 1202983 - DNA, 17 bp, Homo sapiens
gctgtactcttgctgat

SEQ ID NO: 1202984 - DNA, 23 bp, Homo sapiens
gctgtactgctcaggctgcagct

SEQ ID NO: 1202985 - DNA, 20 bp, Homo sapiens
gctgtacttcttgaatataa

SEQ ID NO: 1202986 - DNA, 22 bp, Homo sapiens
gctgtacttgtggttctctttt

SEQ ID NO: 1202987 - DNA, 21 bp, Homo sapiens
gctgtagccatggctcaggca

SEQ ID NO: 1202988 - DNA, 21 bp, Homo sapiens
gctgtagtagccctttctgtg

SEQ ID NO: 1202989 - DNA, 20 bp, Homo sapiens
gctgtagtcctcataaaaag

SEQ ID NO: 1202990 - DNA, 16 bp, Homo sapiens
gctgtatctatttttt

SEQ ID NO: 1202991 - DNA, 16 bp, Homo sapiens
gctgtatctgtaatta

SEQ ID NO: 1202992 - DNA, 16 bp, Homo sapiens
gctgtatcttgttttt

SEQ ID NO: 1202993 - DNA, 18 bp, Homo sapiens
gctgtatcttgtttttcc

SEQ ID NO: 1202994 - DNA, 15 bp, Homo sapiens
gctgtatgatttgtt

SEQ ID NO: 1202995 - DNA, 21 bp, Homo sapiens
gctgtatgatttgttttgaat

SEQ ID NO: 1202996 - DNA, 15 bp, Homo sapiens
gctgtatgctgatca

SEQ ID NO: 1202997 - DNA, 13 bp, Homo sapiens
gctgtatggccca

SEQ ID NO: 1202998 - DNA, 16 bp, Homo sapiens
gctgtatggcccaggc

SEQ ID NO: 1202999 - DNA, 18 bp, Homo sapiens
gctgtatggcccaggcag

SEQ ID NO: 1203000 - DNA, 16 bp, Homo sapiens
gctgtattaagtgact

SEQ ID NO: 1203001 - DNA, 15 bp, Homo sapiens
gctgtattgccccca

SEQ ID NO: 1203002 - DNA, 14 bp, Homo sapiens
gctgtattgtctga

SEQ ID NO: 1203003 - DNA, 16 bp, Homo sapiens
gctgtatttacagaca

SEQ ID NO: 1203004 - DNA, 17 bp, Homo sapiens
gctgtatttacagacac

SEQ ID NO: 1203005 - DNA, 20 bp, Homo sapiens
gctgtattttggctttctcc

SEQ ID NO: 1203006 - DNA, 21 bp, Homo sapiens
gctgtattttggctttctccc

SEQ ID NO: 1203007 - DNA, 21 bp, Homo sapiens
gctgtcaaaactactgacagg

SEQ ID NO: 1203008 - DNA, 22 bp, Homo sapiens
gctgtcaagccggatgcctaag

SEQ ID NO: 1203009 - DNA, 21 bp, Homo sapiens
gctgtcaaggccgagggccag

SEQ ID NO: 1203010 - DNA, 16 bp, Homo sapiens
gctgtcaataaatgac

SEQ ID NO: 1203011 - DNA, 19 bp, Homo sapiens
gctgtcacctgctcacagg

SEQ ID NO: 1203012 - DNA, 17 bp, Homo sapiens
gctgtcactggcagagc

SEQ ID NO: 1203013 - DNA, 21 bp, Homo sapiens
gctgtcactggcagagcacag

SEQ ID NO: 1203014 - DNA, 21 bp, Homo sapiens
gctgtcagtgtatggggcagc

SEQ ID NO: 1203015 - DNA, 16 bp, Homo sapiens
gctgtcatctgtgcac

SEQ ID NO: 1203016 - DNA, 21 bp, Homo sapiens
gctgtcatgtggaaactattt

SEQ ID NO: 1203017 - DNA, 19 bp, Homo sapiens
gctgtccacatgacctcca

SEQ ID NO: 1203018 - DNA, 13 bp, Homo sapiens
gctgtccagcctt

SEQ ID NO: 1203019 - DNA, 12 bp, Homo sapiens
gctgtccaggca

SEQ ID NO: 1203020 - DNA, 14 bp, Homo sapiens
gctgtccaggcagc

SEQ ID NO: 1203021 - DNA, 19 bp, Homo sapiens
gctgtccaggcagctccct

SEQ ID NO: 1203022 - DNA, 22 bp, Homo sapiens
gctgtccaggcagctccctcct

SEQ ID NO: 1203023 - DNA, 11 bp, Homo sapiens
gctgtcccagc

SEQ ID NO: 1203024 - DNA, 14 bp, Homo sapiens
gctgtcccagcccc

SEQ ID NO: 1203025 - DNA, 12 bp, Homo sapiens
gctgtcccaggc

SEQ ID NO: 1203026 - DNA, 15 bp, Homo sapiens
gctgtcccaggcatg

SEQ ID NO: 1203027 - DNA, 16 bp, Homo sapiens
gctgtcccaggcatgc

SEQ ID NO: 1203028 - DNA, 19 bp, Homo sapiens
gctgtcccaggcatgcagc

SEQ ID NO: 1203029 - DNA, 18 bp, Homo sapiens
gctgtcccctctccctgg

SEQ ID NO: 1203030 - DNA, 15 bp, Homo sapiens
gctgtcccctctgtc

SEQ ID NO: 1203031 - DNA, 19 bp, Homo sapiens
gctgtccctgcactgtgcc

SEQ ID NO: 1203032 - DNA, 11 bp, Homo sapiens
gctgtccctgt

SEQ ID NO: 1203033 - DNA, 16 bp, Homo sapiens
gctgtcctaggccaca

SEQ ID NO: 1203034 - DNA, 14 bp, Homo sapiens
gctgtcctccttcc

SEQ ID NO: 1203035 - DNA, 12 bp, Homo sapiens
gctgtcctctcc

SEQ ID NO: 1203036 - DNA, 13 bp, Homo sapiens
gctgtcctctccc

SEQ ID NO: 1203037 - DNA, 16 bp, Homo sapiens
gctgtcctctccccct

SEQ ID NO: 1203038 - DNA, 22 bp, Homo sapiens
gctgtcctctcccccttcagct

SEQ ID NO: 1203039 - DNA, 13 bp, Homo sapiens
gctgtcctgaacc

SEQ ID NO: 1203040 - DNA, 14 bp, Homo sapiens
gctgtcctgatctg

SEQ ID NO: 1203041 - DNA, 13 bp, Homo sapiens
gctgtcctgcgtt

SEQ ID NO: 1203042 - DNA, 15 bp, Homo sapiens
gctgtcctgcgttca

SEQ ID NO: 1203043 - DNA, 21 bp, Homo sapiens
gctgtcctgcgttcagcccct

SEQ ID NO: 1203044 - DNA, 14 bp, Homo sapiens
gctgtccttcccct

SEQ ID NO: 1203045 - DNA, 22 bp, Homo sapiens
gctgtccttccccttccccgtc

SEQ ID NO: 1203046 - DNA, 14 bp, Homo sapiens
gctgtcgccccagg

SEQ ID NO: 1203047 - DNA, 16 bp, Homo sapiens
gctgtcgccccaggcc

SEQ ID NO: 1203048 - DNA, 22 bp, Homo sapiens
gctgtcgtctgactctgggttc

SEQ ID NO: 1203049 - DNA, 13 bp, Homo sapiens
gctgtctagaatg

SEQ ID NO: 1203050 - DNA, 14 bp, Homo sapiens
gctgtctagaatgt

SEQ ID NO: 1203051 - DNA, 19 bp, Homo sapiens
gctgtctcatcacataaaa

SEQ ID NO: 1203052 - DNA, 15 bp, Homo sapiens
gctgtctccagaccc

SEQ ID NO: 1203053 - DNA, 17 bp, Homo sapiens
gctgtctccatgtttga

SEQ ID NO: 1203054 - DNA, 12 bp, Homo sapiens
gctgtctctctg

SEQ ID NO: 1203055 - DNA, 13 bp, Homo sapiens
gctgtctctctgg

SEQ ID NO: 1203056 - DNA, 15 bp, Homo sapiens
gctgtctctctgggc

SEQ ID NO: 1203057 - DNA, 19 bp, Homo sapiens
gctgtctctctgggctgca

SEQ ID NO: 1203058 - DNA, 12 bp, Homo sapiens
gctgtctctgct

SEQ ID NO: 1203059 - DNA, 14 bp, Homo sapiens
gctgtctctgctcg

SEQ ID NO: 1203060 - DNA, 12 bp, Homo sapiens
gctgtctgactg

SEQ ID NO: 1203061 - DNA, 13 bp, Homo sapiens
gctgtctgactgc

SEQ ID NO: 1203062 - DNA, 18 bp, Homo sapiens
gctgtctgaggctaggtg

SEQ ID NO: 1203063 - DNA, 14 bp, Homo sapiens
gctgtctgccaggc

SEQ ID NO: 1203064 - DNA, 19 bp, Homo sapiens
ctcctaccctcccaccaga

SEQ ID NO: 1203065 - DNA, 13 bp, Homo sapiens
ctcctacctgggg

SEQ ID NO: 1203066 - DNA, 19 bp, Homo sapiens
ctcctacgcagatgctgtc

SEQ ID NO: 1203067 - DNA, 18 bp, Homo sapiens
ctcctactgcgcgttttc

SEQ ID NO: 1203068 - DNA, 18 bp, Homo sapiens
ctcctacttagggaagaa

SEQ ID NO: 1203069 - DNA, 20 bp, Homo sapiens
ctcctacttagggaagaaaa

SEQ ID NO: 1203070 - DNA, 21 bp, Homo sapiens
ctcctacttagggaagaaaaa

SEQ ID NO: 1203071 - DNA, 18 bp, Homo sapiens
ctcctagagacagaagca

SEQ ID NO: 1203072 - DNA, 18 bp, Homo sapiens
ctcctagagggaggggcc

SEQ ID NO: 1203073 - DNA, 18 bp, Homo sapiens
ctcctagaggtgggcagc

SEQ ID NO: 1203074 - DNA, 19 bp, Homo sapiens
ctcctagaggtgggcagct

SEQ ID NO: 1203075 - DNA, 20 bp, Homo sapiens
ctcctagaggtgggcagctg

SEQ ID NO: 1203076 - DNA, 21 bp, Homo sapiens
ctcctagaggtgggcagctgg

SEQ ID NO: 1203077 - DNA, 22 bp, Homo sapiens
ctcctagcacaaggagtgcccg

SEQ ID NO: 1203078 - DNA, 16 bp, Homo sapiens
ctcctagcagacagaa

SEQ ID NO: 1203079 - DNA, 21 bp, Homo sapiens
ctcctagcagacagaaactgg

SEQ ID NO: 1203080 - DNA, 14 bp, Homo sapiens
ctcctagccccttc

SEQ ID NO: 1203081 - DNA, 16 bp, Homo sapiens
ctcctagctctcccag

SEQ ID NO: 1203082 - DNA, 18 bp, Homo sapiens
ctcctagctctcccagtg

SEQ ID NO: 1203083 - DNA, 13 bp, Homo sapiens
ctcctaggagagc

SEQ ID NO: 1203084 - DNA, 16 bp, Homo sapiens
ctcctaggagagccaa

SEQ ID NO: 1203085 - DNA, 19 bp, Homo sapiens
ctcctaggagagccaacct

SEQ ID NO: 1203086 - DNA, 15 bp, Homo sapiens
ctcctagggcattgt

SEQ ID NO: 1203087 - DNA, 15 bp, Homo sapiens
ctcctaggggaaggg

SEQ ID NO: 1203088 - DNA, 17 bp, Homo sapiens
ctcctagtttgtggggg

SEQ ID NO: 1203089 - DNA, 21 bp, Homo sapiens
ctcctataatctgtcaaaaca

SEQ ID NO: 1203090 - DNA, 15 bp, Homo sapiens
ctcctatatcattat

SEQ ID NO: 1203091 - DNA, 15 bp, Homo sapiens
ctcctatccttggag

SEQ ID NO: 1203092 - DNA, 13 bp, Homo sapiens
ctcctatctgtgt

SEQ ID NO: 1203093 - DNA, 15 bp, Homo sapiens
ctcctatctgtgttt

SEQ ID NO: 1203094 - DNA, 18 bp, Homo sapiens
ctcctatctttcctccct

SEQ ID NO: 1203095 - DNA, 23 bp, Homo sapiens
ctcctatctttcctccctatcca

SEQ ID NO: 1203096 - DNA, 13 bp, Homo sapiens
ctcctatgtgtaa

SEQ ID NO: 1203097 - DNA, 21 bp, Homo sapiens
ctcctatgtgtgcctcctaga

SEQ ID NO: 1203098 - DNA, 18 bp, Homo sapiens
ctcctatgtttggctgct

SEQ ID NO: 1203099 - DNA, 22 bp, Homo sapiens
ctcctattctcttaatttttct

SEQ ID NO: 1203100 - DNA, 21 bp, Homo sapiens
ctcctattgaaagaccagatc

SEQ ID NO: 1203101 - DNA, 19 bp, Homo sapiens
ctcctcaaaccacttgcct

SEQ ID NO: 1203102 - DNA, 14 bp, Homo sapiens
ctcctcaactcacc

SEQ ID NO: 1203103 - DNA, 19 bp, Homo sapiens
ctcctcacacaccctgagg

SEQ ID NO: 1203104 - DNA, 22 bp, Homo sapiens
ctcctcacagacctctgcttgg

SEQ ID NO: 1203105 - DNA, 14 bp, Homo sapiens
ctcctcacccccag

SEQ ID NO: 1203106 - DNA, 17 bp, Homo sapiens
ctcctcacccccagctt

SEQ ID NO: 1203107 - DNA, 14 bp, Homo sapiens
ctcctcacctcatg

SEQ ID NO: 1203108 - DNA, 16 bp, Homo sapiens
ctcctcacctcatgcc

SEQ ID NO: 1203109 - DNA, 19 bp, Homo sapiens
ctcctcacctcatgcccac

SEQ ID NO: 1203110 - DNA, 20 bp, Homo sapiens
ctcctcacctcatgcccacc

SEQ ID NO: 1203111 - DNA, 13 bp, Homo sapiens
ctcctcacctctg

SEQ ID NO: 1203112 - DNA, 16 bp, Homo sapiens
ctcctcacctctggac

SEQ ID NO: 1203113 - DNA, 15 bp, Homo sapiens
ctcctcactctgtcc

SEQ ID NO: 1203114 - DNA, 17 bp, Homo sapiens
ctcctcagagcgccagg

SEQ ID NO: 1203115 - DNA, 21 bp, Homo sapiens
ctcctcagagcgccaggaagc

SEQ ID NO: 1203116 - DNA, 22 bp, Homo sapiens
ctcctcagccatgggaacctca

SEQ ID NO: 1203117 - DNA, 18 bp, Homo sapiens
ctcctcagcccccaggcc

SEQ ID NO: 1203118 - DNA, 15 bp, Homo sapiens
ctcctcagctgcatg

SEQ ID NO: 1203119 - DNA, 16 bp, Homo sapiens
ctcctcagctgcatgg

SEQ ID NO: 1203120 - DNA, 21 bp, Homo sapiens
ctcctcagctgcatggagcct

SEQ ID NO: 1203121 - DNA, 19 bp, Homo sapiens
ctcctcaggaccctcagcc

SEQ ID NO: 1203122 - DNA, 13 bp, Homo sapiens
ctcctcaggagcc

SEQ ID NO: 1203123 - DNA, 19 bp, Homo sapiens
ctcctcaggcacacagcta

SEQ ID NO: 1203124 - DNA, 21 bp, Homo sapiens
ctcctcaggcacacagctact

SEQ ID NO: 1203125 - DNA, 21 bp, Homo sapiens
ctcctcaggcccagctgctcc

SEQ ID NO: 1203126 - DNA, 23 bp, Homo sapiens
ctcctcaggcccagctgctcccc

SEQ ID NO: 1203127 - DNA, 11 bp, Homo sapiens
ctcctcagggg

SEQ ID NO: 1203128 - DNA, 16 bp, Homo sapiens
ctcctcagggggtagg

SEQ ID NO: 1203129 - DNA, 20 bp, Homo sapiens
ctcctcagggggtaggagag

SEQ ID NO: 1203130 - DNA, 21 bp, Homo sapiens
ctcctcagggggtaggagagc

SEQ ID NO: 1203131 - DNA, 11 bp, Homo sapiens
ctcctcagggt

SEQ ID NO: 1203132 - DNA, 14 bp, Homo sapiens
ctcctcagggtggg

SEQ ID NO: 1203133 - DNA, 17 bp, Homo sapiens
ctcctcagtttacatct

SEQ ID NO: 1203134 - DNA, 18 bp, Homo sapiens
ctcctcatcagtgtgtaa

SEQ ID NO: 1203135 - DNA, 18 bp, Homo sapiens
ctcctcatccatttcttt

SEQ ID NO: 1203136 - DNA, 18 bp, Homo sapiens
ctcctccaaaggaagtct

SEQ ID NO: 1203137 - DNA, 13 bp, Homo sapiens
ctcctccacagtg

SEQ ID NO: 1203138 - DNA, 18 bp, Homo sapiens
ctcctccacagtgctgct

SEQ ID NO: 1203139 - DNA, 19 bp, Homo sapiens
ctcctccactcactccagc

SEQ ID NO: 1203140 - DNA, 16 bp, Homo sapiens
ctcctccactccacct

SEQ ID NO: 1203141 - DNA, 13 bp, Homo sapiens
ctcctccagccct

SEQ ID NO: 1203142 - DNA, 14 bp, Homo sapiens
ctcctccagccctg

SEQ ID NO: 1203143 - DNA, 15 bp, Homo sapiens
ctcctccagccctgc

SEQ ID NO: 1203144 - DNA, 15 bp, Homo sapiens
ctcctccagcccttc

SEQ ID NO: 1203145 - DNA, 21 bp, Homo sapiens
ctcctccagcccttcagacga

SEQ ID NO: 1203146 - DNA, 22 bp, Homo sapiens
ctcctccagcccttcagacgag

SEQ ID NO: 1203147 - DNA, 15 bp, Homo sapiens
ctcctccagccgcca

SEQ ID NO: 1203148 - DNA, 19 bp, Homo sapiens
ctcctccaggcctgcctcc

SEQ ID NO: 1203149 - DNA, 23 bp, Homo sapiens
ctcctccaggcctgcctcccact

SEQ ID NO: 1203150 - DNA, 24 bp, Homo sapiens
ctcctccagggaaggtggccacag

SEQ ID NO: 1203151 - DNA, 19 bp, Homo sapiens
ctcctccagggccacgtgc

SEQ ID NO: 1203152 - DNA, 21 bp, Homo sapiens
ctcctccagggtgattttatg

SEQ ID NO: 1203153 - DNA, 22 bp, Homo sapiens
ctcctccagggtggcagcaaca

SEQ ID NO: 1203154 - DNA, 14 bp, Homo sapiens
ctcctccatcacct

SEQ ID NO: 1203155 - DNA, 18 bp, Homo sapiens
ctcctccatctttctaca

SEQ ID NO: 1203156 - DNA, 15 bp, Homo sapiens
ctcctcccacccggc

SEQ ID NO: 1203157 - DNA, 14 bp, Homo sapiens
ctcctcccactggg

SEQ ID NO: 1203158 - DNA, 16 bp, Homo sapiens
ctcctcccactgggac

SEQ ID NO: 1203159 - DNA, 15 bp, Homo sapiens
ctcctcccacttctc

SEQ ID NO: 1203160 - DNA, 11 bp, Homo sapiens
ctcctcccagc

SEQ ID NO: 1203161 - DNA, 12 bp, Homo sapiens
ctcctcccagct

SEQ ID NO: 1203162 - DNA, 23 bp, Homo sapiens
ctcctcccagcttgtaggagctg

SEQ ID NO: 1203163 - DNA, 17 bp, Homo sapiens
ctcctcccaggcgcccc

SEQ ID NO: 1203164 - DNA, 14 bp, Homo sapiens
ctcctcccagggcc

SEQ ID NO: 1203165 - DNA, 19 bp, Homo sapiens
ctcctcccagggcctcctg

SEQ ID NO: 1203166 - DNA, 20 bp, Homo sapiens
ctcctcccatgtcactgcag

SEQ ID NO: 1203167 - DNA, 13 bp, Homo sapiens
ctcctccccacct

SEQ ID NO: 1203168 - DNA, 16 bp, Homo sapiens
ctcctccccacctgta

SEQ ID NO: 1203169 - DNA, 17 bp, Homo sapiens
ctcctccccacctgtag

SEQ ID NO: 1203170 - DNA, 20 bp, Homo sapiens
ctcctccccacctgtagctg

SEQ ID NO: 1203171 - DNA, 12 bp, Homo sapiens
ctcctcccccag

SEQ ID NO: 1203172 - DNA, 14 bp, Homo sapiens
ctcctcccccggct

SEQ ID NO: 1203173 - DNA, 21 bp, Homo sapiens
ctcctcccccggctgggcctc

SEQ ID NO: 1203174 - DNA, 18 bp, Homo sapiens
ctcctccccctcctaggg

SEQ ID NO: 1203175 - DNA, 14 bp, Homo sapiens
ctcctccccctttg

SEQ ID NO: 1203176 - DNA, 15 bp, Homo sapiens
ctcctccccctttgg

SEQ ID NO: 1203177 - DNA, 16 bp, Homo sapiens
ctcctccccctttggg

SEQ ID NO: 1203178 - DNA, 15 bp, Homo sapiens
ctcctcccctactct

SEQ ID NO: 1203179 - DNA, 17 bp, Homo sapiens
ctcctcccgaaaaatgt

SEQ ID NO: 1203180 - DNA, 14 bp, Homo sapiens
ctcctcccggtgcc

SEQ ID NO: 1203181 - DNA, 11 bp, Homo sapiens
ctcctccctca

SEQ ID NO: 1203182 - DNA, 22 bp, Homo sapiens
ctcctccctcagctctctggga

SEQ ID NO: 1203183 - DNA, 21 bp, Homo sapiens
ctcctccctccaagcctggca

SEQ ID NO: 1203184 - DNA, 16 bp, Homo sapiens
ctcctccctgcatctg

SEQ ID NO: 1203185 - DNA, 12 bp, Homo sapiens
ctcctccctgcc

SEQ ID NO: 1203186 - DNA, 17 bp, Homo sapiens
ctcctccctgcccccca

SEQ ID NO: 1203187 - DNA, 17 bp, Homo sapiens
ctcctccctgctcctca

SEQ ID NO: 1203188 - DNA, 12 bp, Homo sapiens
ctcctccctggc

SEQ ID NO: 1203189 - DNA, 17 bp, Homo sapiens
gctgtctgccaggcact

SEQ ID NO: 1203190 - DNA, 12 bp, Homo sapiens
gctgtctgcctg

SEQ ID NO: 1203191 - DNA, 17 bp, Homo sapiens
gctgtctgcctgtattt

SEQ ID NO: 1203192 - DNA, 15 bp, Homo sapiens
gctgtctggccctgg

SEQ ID NO: 1203193 - DNA, 13 bp, Homo sapiens
gctgtctgtcacc

SEQ ID NO: 1203194 - DNA, 18 bp, Homo sapiens
gctgtctgtctgcagtgc

SEQ ID NO: 1203195 - DNA, 13 bp, Homo sapiens
gctgtctgtgaat

SEQ ID NO: 1203196 - DNA, 24 bp, Homo sapiens
gctgtcttctggacaggctctgct

SEQ ID NO: 1203197 - DNA, 20 bp, Homo sapiens
gctgtcttgatgactgctga

SEQ ID NO: 1203198 - DNA, 13 bp, Homo sapiens
gctgtcttgcccc

SEQ ID NO: 1203199 - DNA, 14 bp, Homo sapiens
gctgtctttctcta

SEQ ID NO: 1203200 - DNA, 12 bp, Homo sapiens
gctgtctttgtg

SEQ ID NO: 1203201 - DNA, 21 bp, Homo sapiens
gctgtgaaccctggggcctga

SEQ ID NO: 1203202 - DNA, 23 bp, Homo sapiens
gctgtgaaccctggggcctgact

SEQ ID NO: 1203203 - DNA, 18 bp, Homo sapiens
gctgtgacaaccctggcc

SEQ ID NO: 1203204 - DNA, 20 bp, Homo sapiens
gctgtgacaaccctggcctc

SEQ ID NO: 1203205 - DNA, 23 bp, Homo sapiens
gctgtgacaaccctggcctcact

SEQ ID NO: 1203206 - DNA, 15 bp, Homo sapiens
gctgtgacgcagccg

SEQ ID NO: 1203207 - DNA, 23 bp, Homo sapiens
gctgtgagacagtgggaaatatt

SEQ ID NO: 1203208 - DNA, 23 bp, Homo sapiens
gctgtgaggaatgctctgtgcca

SEQ ID NO: 1203209 - DNA, 17 bp, Homo sapiens
gctgtgaggctgtcctg

SEQ ID NO: 1203210 - DNA, 15 bp, Homo sapiens
gctgtgagggagggg

SEQ ID NO: 1203211 - DNA, 15 bp, Homo sapiens
gctgtgagtgcgcct

SEQ ID NO: 1203212 - DNA, 22 bp, Homo sapiens
gctgtgagtgtaagtgtgagta

SEQ ID NO: 1203213 - DNA, 17 bp, Homo sapiens
gctgtgatgccgtcctg

SEQ ID NO: 1203214 - DNA, 13 bp, Homo sapiens
gctgtgatgctgt

SEQ ID NO: 1203215 - DNA, 14 bp, Homo sapiens
gctgtgatgctgtg

SEQ ID NO: 1203216 - DNA, 17 bp, Homo sapiens
gctgtgatgctgtgtgc

SEQ ID NO: 1203217 - DNA, 19 bp, Homo sapiens
gctgtgatggcgggcactg

SEQ ID NO: 1203218 - DNA, 18 bp, Homo sapiens
gctgtgatttgctgtgta

SEQ ID NO: 1203219 - DNA, 18 bp, Homo sapiens
gctgtgcagcgcagctgg

SEQ ID NO: 1203220 - DNA, 13 bp, Homo sapiens
gctgtgccacagg

SEQ ID NO: 1203221 - DNA, 14 bp, Homo sapiens
gctgtgccacaggc

SEQ ID NO: 1203222 - DNA, 20 bp, Homo sapiens
gctgtgccacaggcttaggg

SEQ ID NO: 1203223 - DNA, 14 bp, Homo sapiens
gctgtgccagcagg

SEQ ID NO: 1203224 - DNA, 16 bp, Homo sapiens
gctgtgcccctgatgc

SEQ ID NO: 1203225 - DNA, 18 bp, Homo sapiens
gctgtgcccggccccacc

SEQ ID NO: 1203226 - DNA, 19 bp, Homo sapiens
gctgtgcccggccccaccc

SEQ ID NO: 1203227 - DNA, 17 bp, Homo sapiens
gctgtgcctcccaaaat

SEQ ID NO: 1203228 - DNA, 18 bp, Homo sapiens
gctgtgcctgctagagca

SEQ ID NO: 1203229 - DNA, 20 bp, Homo sapiens
gctgtgcctgctagagcaac

SEQ ID NO: 1203230 - DNA, 17 bp, Homo sapiens
gctgtgcctgctcagca

SEQ ID NO: 1203231 - DNA, 18 bp, Homo sapiens
gctgtgcctgctcagcag

SEQ ID NO: 1203232 - DNA, 13 bp, Homo sapiens
gctgtgcctgctt

SEQ ID NO: 1203233 - DNA, 16 bp, Homo sapiens
gctgtgcctgcttctg

SEQ ID NO: 1203234 - DNA, 15 bp, Homo sapiens
gctgtgcgctgctct

SEQ ID NO: 1203235 - DNA, 20 bp, Homo sapiens
gctgtgcggcctcaccaggc

SEQ ID NO: 1203236 - DNA, 15 bp, Homo sapiens
gctgtgctatgaatt

SEQ ID NO: 1203237 - DNA, 12 bp, Homo sapiens
gctgtgctcaga

SEQ ID NO: 1203238 - DNA, 14 bp, Homo sapiens
gctgtgctcagaga

SEQ ID NO: 1203239 - DNA, 16 bp, Homo sapiens
gctgtgctgccctgaa

SEQ ID NO: 1203240 - DNA, 20 bp, Homo sapiens
gctgtgcttttgatctctgc

SEQ ID NO: 1203241 - DNA, 14 bp, Homo sapiens
gctgtggactgtcc

SEQ ID NO: 1203242 - DNA, 17 bp, Homo sapiens
gctgtggactgtcctga

SEQ ID NO: 1203243 - DNA, 21 bp, Homo sapiens
gctgtggactgtcctgaggag

SEQ ID NO: 1203244 - DNA, 17 bp, Homo sapiens
gctgtggaggattgcta

SEQ ID NO: 1203245 - DNA, 15 bp, Homo sapiens
gctgtggaggcctga

SEQ ID NO: 1203246 - DNA, 16 bp, Homo sapiens
gctgtggaggcctgat

SEQ ID NO: 1203247 - DNA, 13 bp, Homo sapiens
gctgtggcagccg

SEQ ID NO: 1203248 - DNA, 23 bp, Homo sapiens
gctgtggcagccgtcccaggcca

SEQ ID NO: 1203249 - DNA, 18 bp, Homo sapiens
gctgtggcatttccaaac

SEQ ID NO: 1203250 - DNA, 22 bp, Homo sapiens
gctgtggcatttccaaacatcc

SEQ ID NO: 1203251 - DNA, 13 bp, Homo sapiens
gctgtggccaggc

SEQ ID NO: 1203252 - DNA, 15 bp, Homo sapiens
gctgtggccaggcct

SEQ ID NO: 1203253 - DNA, 20 bp, Homo sapiens
gctgtggccaggcctgcaga

SEQ ID NO: 1203254 - DNA, 21 bp, Homo sapiens
gctgtggccagggtgagagct

SEQ ID NO: 1203255 - DNA, 14 bp, Homo sapiens
gctgtggccccctg

SEQ ID NO: 1203256 - DNA, 18 bp, Homo sapiens
gctgtggccccctgtccc

SEQ ID NO: 1203257 - DNA, 13 bp, Homo sapiens
gctgtggccctgc

SEQ ID NO: 1203258 - DNA, 15 bp, Homo sapiens
gctgtggccctgccc

SEQ ID NO: 1203259 - DNA, 19 bp, Homo sapiens
gctgtggccgtctcctccc

SEQ ID NO: 1203260 - DNA, 20 bp, Homo sapiens
gctgtggccgtctcctccct

SEQ ID NO: 1203261 - DNA, 15 bp, Homo sapiens
gctgtggcctgggca

SEQ ID NO: 1203262 - DNA, 16 bp, Homo sapiens
gctgtgggactccagg

SEQ ID NO: 1203263 - DNA, 13 bp, Homo sapiens
gctgtgggcagca

SEQ ID NO: 1203264 - DNA, 18 bp, Homo sapiens
gctgtgggcagcaccctc

SEQ ID NO: 1203265 - DNA, 20 bp, Homo sapiens
gctgtgggcagcaccctccc

SEQ ID NO: 1203266 - DNA, 22 bp, Homo sapiens
gctgtgggcaggcaagcccttc

SEQ ID NO: 1203267 - DNA, 18 bp, Homo sapiens
gctgtgggcctcaaggac

SEQ ID NO: 1203268 - DNA, 19 bp, Homo sapiens
gctgtgggcctcaaggact

SEQ ID NO: 1203269 - DNA, 17 bp, Homo sapiens
gctgtggggctacagga

SEQ ID NO: 1203270 - DNA, 16 bp, Homo sapiens
gctgtggggtctggct

SEQ ID NO: 1203271 - DNA, 19 bp, Homo sapiens
gctgtggggtggagcactg

SEQ ID NO: 1203272 - DNA, 14 bp, Homo sapiens
gctgtggggtgggc

SEQ ID NO: 1203273 - DNA, 19 bp, Homo sapiens
gctgtggggtgggctggag

SEQ ID NO: 1203274 - DNA, 18 bp, Homo sapiens
gctgtggtacaaatgtga

SEQ ID NO: 1203275 - DNA, 20 bp, Homo sapiens
gctgtggtctataaaataaa

SEQ ID NO: 1203276 - DNA, 23 bp, Homo sapiens
gctgtggtgtgtccccctctgtc

SEQ ID NO: 1203277 - DNA, 23 bp, Homo sapiens
gctgtgtaagatttgtttttaaa

SEQ ID NO: 1203278 - DNA, 15 bp, Homo sapiens
gctgtgtcctccctc

SEQ ID NO: 1203279 - DNA, 18 bp, Homo sapiens
gctgtgtccttgcacctg

SEQ ID NO: 1203280 - DNA, 15 bp, Homo sapiens
gctgtgtctaaactg

SEQ ID NO: 1203281 - DNA, 19 bp, Homo sapiens
gctgtgtctgccaaacaca

SEQ ID NO: 1203282 - DNA, 21 bp, Homo sapiens
gctgtgtctgcccaatgaata

SEQ ID NO: 1203283 - DNA, 20 bp, Homo sapiens
gctgtgtgaatacctgctca

SEQ ID NO: 1203284 - DNA, 18 bp, Homo sapiens
gctgtgtgaccctgggca

SEQ ID NO: 1203285 - DNA, 22 bp, Homo sapiens
gctgtgtgcccaagtgggcagt

SEQ ID NO: 1203286 - DNA, 18 bp, Homo sapiens
gctgtgtgctttttttgt

SEQ ID NO: 1203287 - DNA, 22 bp, Homo sapiens
gctgtgtggacttcatctcaag

SEQ ID NO: 1203288 - DNA, 12 bp, Homo sapiens
gctgtgtggcca

SEQ ID NO: 1203289 - DNA, 14 bp, Homo sapiens
gctgtgtggccaac

SEQ ID NO: 1203290 - DNA, 12 bp, Homo sapiens
gctgtgtgtgag

SEQ ID NO: 1203291 - DNA, 17 bp, Homo sapiens
gctgtgttaactgttca

SEQ ID NO: 1203292 - DNA, 16 bp, Homo sapiens
gctgtgttaagaggac

SEQ ID NO: 1203293 - DNA, 17 bp, Homo sapiens
gctgtgttaagaggact

SEQ ID NO: 1203294 - DNA, 17 bp, Homo sapiens
gctgtgttcgggggagc

SEQ ID NO: 1203295 - DNA, 12 bp, Homo sapiens
gctgtgttgccc

SEQ ID NO: 1203296 - DNA, 19 bp, Homo sapiens
gctgtgttgggtagaatag

SEQ ID NO: 1203297 - DNA, 16 bp, Homo sapiens
gctgttaaatacagga

SEQ ID NO: 1203298 - DNA, 20 bp, Homo sapiens
gctgttactgcttctctttg

SEQ ID NO: 1203299 - DNA, 23 bp, Homo sapiens
gctgttactttctttcagatgtt

SEQ ID NO: 1203300 - DNA, 23 bp, Homo sapiens
gctgttagggctgaatcttctgg

SEQ ID NO: 1203301 - DNA, 20 bp, Homo sapiens
gctgttagttataaaactat

SEQ ID NO: 1203302 - DNA, 14 bp, Homo sapiens
gctgttattatgaa

SEQ ID NO: 1203303 - DNA, 13 bp, Homo sapiens
gctgttcagctgg

SEQ ID NO: 1203304 - DNA, 14 bp, Homo sapiens
gctgttcagctggt

SEQ ID NO: 1203305 - DNA, 21 bp, Homo sapiens
gctgttcagtgctttttcctt

SEQ ID NO: 1203306 - DNA, 23 bp, Homo sapiens
gctgttcagttgccactaagaga

SEQ ID NO: 1203307 - DNA, 14 bp, Homo sapiens
gctgttccagactc

SEQ ID NO: 1203308 - DNA, 19 bp, Homo sapiens
gctgttccagactcaggtt

SEQ ID NO: 1203309 - DNA, 16 bp, Homo sapiens
gctgttccccctgccg

SEQ ID NO: 1203310 - DNA, 16 bp, Homo sapiens
gctgttcctgctccat

SEQ ID NO: 1203311 - DNA, 13 bp, Homo sapiens
gctgttcctgtgt

SEQ ID NO: 1203312 - DNA, 14 bp, Homo sapiens
gctgttcctgtgtt

SEQ ID NO: 1203313 - DNA, 18 bp, Homo sapiens
gctgttcttgaagctggg

SEQ ID NO: 1203314 - DNA, 21 bp, Homo sapiens
ctcctccctgtgcccccagcc

SEQ ID NO: 1203315 - DNA, 22 bp, Homo sapiens
ctcctcccttccttttccctgc

SEQ ID NO: 1203316 - DNA, 17 bp, Homo sapiens
ctcctccgtctgaccct

SEQ ID NO: 1203317 - DNA, 14 bp, Homo sapiens
ctcctcctcaccca

SEQ ID NO: 1203318 - DNA, 16 bp, Homo sapiens
ctcctcctcccctcct

SEQ ID NO: 1203319 - DNA, 14 bp, Homo sapiens
ctcctcctccctgc

SEQ ID NO: 1203320 - DNA, 13 bp, Homo sapiens
ctcctcctctttc

SEQ ID NO: 1203321 - DNA, 16 bp, Homo sapiens
ctcctcctctttctct

SEQ ID NO: 1203322 - DNA, 15 bp, Homo sapiens
ctcctcctgccctgt

SEQ ID NO: 1203323 - DNA, 20 bp, Homo sapiens
ctcctcctgggggctggctc

SEQ ID NO: 1203324 - DNA, 17 bp, Homo sapiens
ctcctccttcccaggga

SEQ ID NO: 1203325 - DNA, 13 bp, Homo sapiens
ctcctccttgccc

SEQ ID NO: 1203326 - DNA, 13 bp, Homo sapiens
ctcctcgagccct

SEQ ID NO: 1203327 - DNA, 16 bp, Homo sapiens
ctcctcgagccctccc

SEQ ID NO: 1203328 - DNA, 19 bp, Homo sapiens
ctcctcgcccccaccagtg

SEQ ID NO: 1203329 - DNA, 23 bp, Homo sapiens
ctcctcgcccccaccagtgtagc

SEQ ID NO: 1203330 - DNA, 23 bp, Homo sapiens
ctcctcggaaccgctcacctaga

SEQ ID NO: 1203331 - DNA, 17 bp, Homo sapiens
ctcctcggagagcagca

SEQ ID NO: 1203332 - DNA, 21 bp, Homo sapiens
ctcctcggagagcagcagcac

SEQ ID NO: 1203333 - DNA, 20 bp, Homo sapiens
ctcctcggccccctccatcg

SEQ ID NO: 1203334 - DNA, 17 bp, Homo sapiens
ctcctcggttcaaggtc

SEQ ID NO: 1203335 - DNA, 13 bp, Homo sapiens
ctcctcgttcctt

SEQ ID NO: 1203336 - DNA, 19 bp, Homo sapiens
ctcctcgttcctttctcct

SEQ ID NO: 1203337 - DNA, 13 bp, Homo sapiens
ctcctctaagcca

SEQ ID NO: 1203338 - DNA, 18 bp, Homo sapiens
ctcctctaggggcagcct

SEQ ID NO: 1203339 - DNA, 17 bp, Homo sapiens
ctcctctcaactgcctc

SEQ ID NO: 1203340 - DNA, 19 bp, Homo sapiens
ctcctctcaactgcctcag

SEQ ID NO: 1203341 - DNA, 18 bp, Homo sapiens
ctcctctcacctctccct

SEQ ID NO: 1203342 - DNA, 15 bp, Homo sapiens
ctcctctcactcccc

SEQ ID NO: 1203343 - DNA, 12 bp, Homo sapiens
ctcctctccagg

SEQ ID NO: 1203344 - DNA, 15 bp, Homo sapiens
ctcctctccaggcac

SEQ ID NO: 1203345 - DNA, 21 bp, Homo sapiens
ctcctctccattttagcccag

SEQ ID NO: 1203346 - DNA, 22 bp, Homo sapiens
ctcctctcccacagagtgctgg

SEQ ID NO: 1203347 - DNA, 18 bp, Homo sapiens
ctcctctcccatccttga

SEQ ID NO: 1203348 - DNA, 23 bp, Homo sapiens
ctcctctcccattgtccctctgc

SEQ ID NO: 1203349 - DNA, 24 bp, Homo sapiens
ctcctctccccaatccatgcttca

SEQ ID NO: 1203350 - DNA, 15 bp, Homo sapiens
ctcctctccgcgccc

SEQ ID NO: 1203351 - DNA, 17 bp, Homo sapiens
ctcctctccttgggctc

SEQ ID NO: 1203352 - DNA, 20 bp, Homo sapiens
ctcctctccttgggctcctg

SEQ ID NO: 1203353 - DNA, 21 bp, Homo sapiens
ctcctctccttgggctcctgg

SEQ ID NO: 1203354 - DNA, 23 bp, Homo sapiens
ctcctctccttgggctcctggct

SEQ ID NO: 1203355 - DNA, 12 bp, Homo sapiens
ctcctctctctc

SEQ ID NO: 1203356 - DNA, 14 bp, Homo sapiens
ctcctctctctcag

SEQ ID NO: 1203357 - DNA, 16 bp, Homo sapiens
ctcctctctgggcctt

SEQ ID NO: 1203358 - DNA, 13 bp, Homo sapiens
ctcctctgactca

SEQ ID NO: 1203359 - DNA, 22 bp, Homo sapiens
ctcctctgaggaagcagttggg

SEQ ID NO: 1203360 - DNA, 13 bp, Homo sapiens
ctcctctgccttg

SEQ ID NO: 1203361 - DNA, 11 bp, Homo sapiens
ctcctctgctg

SEQ ID NO: 1203362 - DNA, 12 bp, Homo sapiens
ctcctctgctga

SEQ ID NO: 1203363 - DNA, 20 bp, Homo sapiens
ctcctctgctgacctgctga

SEQ ID NO: 1203364 - DNA, 15 bp, Homo sapiens
ctcctctgctgggaa

SEQ ID NO: 1203365 - DNA, 14 bp, Homo sapiens
ctcctctgcttctt

SEQ ID NO: 1203366 - DNA, 21 bp, Homo sapiens
ctcctctgcttctttgcctcc

SEQ ID NO: 1203367 - DNA, 21 bp, Homo sapiens
ctcctctggacggcaggctca

SEQ ID NO: 1203368 - DNA, 14 bp, Homo sapiens
ctcctctggcaggc

SEQ ID NO: 1203369 - DNA, 21 bp, Homo sapiens
ctcctctggcaggcttccccc

SEQ ID NO: 1203370 - DNA, 23 bp, Homo sapiens
ctcctctggcaggcttccccctt

SEQ ID NO: 1203371 - DNA, 18 bp, Homo sapiens
ctcctctggctttcccag

SEQ ID NO: 1203372 - DNA, 13 bp, Homo sapiens
ctcctctgggcag

SEQ ID NO: 1203373 - DNA, 14 bp, Homo sapiens
ctcctctgggcctg

SEQ ID NO: 1203374 - DNA, 16 bp, Homo sapiens
ctcctctgggcctggg

SEQ ID NO: 1203375 - DNA, 22 bp, Homo sapiens
ctcctctgggcctggggtgcat

SEQ ID NO: 1203376 - DNA, 12 bp, Homo sapiens
ctcctctgtcca

SEQ ID NO: 1203377 - DNA, 15 bp, Homo sapiens
ctcctctgtccaggg

SEQ ID NO: 1203378 - DNA, 18 bp, Homo sapiens
ctcctctgtccagggccc

SEQ ID NO: 1203379 - DNA, 19 bp, Homo sapiens
ctcctcttaaaaaataaaa

SEQ ID NO: 1203380 - DNA, 16 bp, Homo sapiens
ctcctcttccatgctg

SEQ ID NO: 1203381 - DNA, 20 bp, Homo sapiens
ctcctcttccatgctgtgcg

SEQ ID NO: 1203382 - DNA, 17 bp, Homo sapiens
ctcctcttccgagctgc

SEQ ID NO: 1203383 - DNA, 19 bp, Homo sapiens
ctcctcttctgacgtgcct

SEQ ID NO: 1203384 - DNA, 18 bp, Homo sapiens
ctcctcttgattcctggt

SEQ ID NO: 1203385 - DNA, 12 bp, Homo sapiens
ctcctcttgcca

SEQ ID NO: 1203386 - DNA, 15 bp, Homo sapiens
ctcctcttgccactg

SEQ ID NO: 1203387 - DNA, 16 bp, Homo sapiens
ctcctcttgccactgc

SEQ ID NO: 1203388 - DNA, 14 bp, Homo sapiens
ctcctcttggaatt

SEQ ID NO: 1203389 - DNA, 20 bp, Homo sapiens
ctcctcttgtaaataaagcc

SEQ ID NO: 1203390 - DNA, 12 bp, Homo sapiens
ctcctctttctc

SEQ ID NO: 1203391 - DNA, 15 bp, Homo sapiens
ctcctctttctctcc

SEQ ID NO: 1203392 - DNA, 16 bp, Homo sapiens
ctcctgaagggaaggc

SEQ ID NO: 1203393 - DNA, 21 bp, Homo sapiens
ctcctgaagggaaggcaaagg

SEQ ID NO: 1203394 - DNA, 21 bp, Homo sapiens
ctcctgaatctaacacatttc

SEQ ID NO: 1203395 - DNA, 16 bp, Homo sapiens
ctcctgacagaaggtg

SEQ ID NO: 1203396 - DNA, 20 bp, Homo sapiens
ctcctgacccctctcctcaa

SEQ ID NO: 1203397 - DNA, 16 bp, Homo sapiens
ctcctgacccctgcct

SEQ ID NO: 1203398 - DNA, 15 bp, Homo sapiens
ctcctgaccctccca

SEQ ID NO: 1203399 - DNA, 16 bp, Homo sapiens
ctcctgaccctcccac

SEQ ID NO: 1203400 - DNA, 19 bp, Homo sapiens
ctcctgaccctcccactcc

SEQ ID NO: 1203401 - DNA, 17 bp, Homo sapiens
ctcctgaccttgtgatc

SEQ ID NO: 1203402 - DNA, 20 bp, Homo sapiens
ctcctgacgtctgaagcttg

SEQ ID NO: 1203403 - DNA, 20 bp, Homo sapiens
ctcctgagaaggcgaggaga

SEQ ID NO: 1203404 - DNA, 15 bp, Homo sapiens
ctcctgaggacagct

SEQ ID NO: 1203405 - DNA, 16 bp, Homo sapiens
ctcctgaggacagctg

SEQ ID NO: 1203406 - DNA, 19 bp, Homo sapiens
ctcctgaggacagctgtcc

SEQ ID NO: 1203407 - DNA, 19 bp, Homo sapiens
ctcctgagggaggacctgg

SEQ ID NO: 1203408 - DNA, 19 bp, Homo sapiens
ctcctgagggctccatgct

SEQ ID NO: 1203409 - DNA, 22 bp, Homo sapiens
ctcctgaggggcatctgcccct

SEQ ID NO: 1203410 - DNA, 21 bp, Homo sapiens
ctcctgagtagctggattaca

SEQ ID NO: 1203411 - DNA, 19 bp, Homo sapiens
ctcctgagtagctgggcct

SEQ ID NO: 1203412 - DNA, 20 bp, Homo sapiens
ctcctgagtagctgggcctg

SEQ ID NO: 1203413 - DNA, 21 bp, Homo sapiens
ctcctgagtagctgggcctgt

SEQ ID NO: 1203414 - DNA, 24 bp, Homo sapiens
ctcctgagtagctgggcctgtgca

SEQ ID NO: 1203415 - DNA, 23 bp, Homo sapiens
ctcctgagtatgtaacttgcaat

SEQ ID NO: 1203416 - DNA, 19 bp, Homo sapiens
ctcctgagtgccccacttc

SEQ ID NO: 1203417 - DNA, 23 bp, Homo sapiens
ctcctgatccgtccgaggctgct

SEQ ID NO: 1203418 - DNA, 21 bp, Homo sapiens
ctcctgatgccctcttctcct

SEQ ID NO: 1203419 - DNA, 23 bp, Homo sapiens
ctcctgatgccctcttctccttg

SEQ ID NO: 1203420 - DNA, 20 bp, Homo sapiens
ctcctgatggagtgtgcaga

SEQ ID NO: 1203421 - DNA, 14 bp, Homo sapiens
ctcctgatggccaa

SEQ ID NO: 1203422 - DNA, 15 bp, Homo sapiens
ctcctgatggccaag

SEQ ID NO: 1203423 - DNA, 19 bp, Homo sapiens
ctcctgatggccaagagca

SEQ ID NO: 1203424 - DNA, 22 bp, Homo sapiens
ctcctgatggtgtcattctgcc

SEQ ID NO: 1203425 - DNA, 18 bp, Homo sapiens
ctcctgatttctctgaac

SEQ ID NO: 1203426 - DNA, 17 bp, Homo sapiens
ctcctgcacttacttgc

SEQ ID NO: 1203427 - DNA, 19 bp, Homo sapiens
ctcctgcacttacttgctt

SEQ ID NO: 1203428 - DNA, 20 bp, Homo sapiens
ctcctgcagacacctggact

SEQ ID NO: 1203429 - DNA, 22 bp, Homo sapiens
ctcctgcagacacctggactga

SEQ ID NO: 1203430 - DNA, 14 bp, Homo sapiens
ctcctgcagaccac

SEQ ID NO: 1203431 - DNA, 17 bp, Homo sapiens
ctcctgcagtttgggag

SEQ ID NO: 1203432 - DNA, 18 bp, Homo sapiens
ctcctgccacatggagcc

SEQ ID NO: 1203433 - DNA, 14 bp, Homo sapiens
ctcctgccaccagc

SEQ ID NO: 1203434 - DNA, 14 bp, Homo sapiens
ctcctgccacccct

SEQ ID NO: 1203435 - DNA, 16 bp, Homo sapiens
ctcctgccaccccttc

SEQ ID NO: 1203436 - DNA, 19 bp, Homo sapiens
ctcctgccaccccttcctc

SEQ ID NO: 1203437 - DNA, 23 bp, Homo sapiens
ctcctgccaggcacacacagccc

SEQ ID NO: 1203438 - DNA, 19 bp, Homo sapiens
gctgttcttgaagctgggc

SEQ ID NO: 1203439 - DNA, 20 bp, Homo sapiens
gctgttcttgaagctgggct

SEQ ID NO: 1203440 - DNA, 23 bp, Homo sapiens
gctgttctttagtagcaactaaa

SEQ ID NO: 1203441 - DNA, 23 bp, Homo sapiens
gctgttcttttttgtacttttct

SEQ ID NO: 1203442 - DNA, 14 bp, Homo sapiens
gctgttgacatatt

SEQ ID NO: 1203443 - DNA, 13 bp, Homo sapiens
gctgttgagaaaa

SEQ ID NO: 1203444 - DNA, 18 bp, Homo sapiens
gctgttgagggccacttt

SEQ ID NO: 1203445 - DNA, 16 bp, Homo sapiens
gctgttgaggtggctg

SEQ ID NO: 1203446 - DNA, 18 bp, Homo sapiens
gctgttgaggtggctgta

SEQ ID NO: 1203447 - DNA, 21 bp, Homo sapiens
gctgttgaggtggctgtagat

SEQ ID NO: 1203448 - DNA, 18 bp, Homo sapiens
gctgttgatttctttcca

SEQ ID NO: 1203449 - DNA, 17 bp, Homo sapiens
gctgttgctagggagag

SEQ ID NO: 1203450 - DNA, 16 bp, Homo sapiens
gctgttgctatttgta

SEQ ID NO: 1203451 - DNA, 17 bp, Homo sapiens
gctgttgctatttgtat

SEQ ID NO: 1203452 - DNA, 21 bp, Homo sapiens
gctgttggacagctgcttgtg

SEQ ID NO: 1203453 - DNA, 16 bp, Homo sapiens
gctgttggcactcaca

SEQ ID NO: 1203454 - DNA, 23 bp, Homo sapiens
gctgttggcctctgcaaaggaaa

SEQ ID NO: 1203455 - DNA, 16 bp, Homo sapiens
gctgttggtcctctct

SEQ ID NO: 1203456 - DNA, 21 bp, Homo sapiens
gctgttgtgaagctaatgtca

SEQ ID NO: 1203457 - DNA, 18 bp, Homo sapiens
gctgttgttccattgaag

SEQ ID NO: 1203458 - DNA, 22 bp, Homo sapiens
gctgtttaaagtcacatccctg

SEQ ID NO: 1203459 - DNA, 23 bp, Homo sapiens
gctgtttactcccttctgtagtt

SEQ ID NO: 1203460 - DNA, 21 bp, Homo sapiens
gctgtttactgcttttcatta

SEQ ID NO: 1203461 - DNA, 22 bp, Homo sapiens
gctgtttagcttcctccagagg

SEQ ID NO: 1203462 - DNA, 14 bp, Homo sapiens
gctgtttatggcct

SEQ ID NO: 1203463 - DNA, 22 bp, Homo sapiens
gctgtttatggcctcagctgcc

SEQ ID NO: 1203464 - DNA, 12 bp, Homo sapiens
gctgtttctcat

SEQ ID NO: 1203465 - DNA, 20 bp, Homo sapiens
gctgtttcttgtctgttatg

SEQ ID NO: 1203466 - DNA, 13 bp, Homo sapiens
gctgtttgaggat

SEQ ID NO: 1203467 - DNA, 17 bp, Homo sapiens
gctgtttgccaagctga

SEQ ID NO: 1203468 - DNA, 16 bp, Homo sapiens
gctgtttgcgtgaatg

SEQ ID NO: 1203469 - DNA, 17 bp, Homo sapiens
gctgtttgtcctgagat

SEQ ID NO: 1203470 - DNA, 15 bp, Homo sapiens
gctgttttcctccct

SEQ ID NO: 1203471 - DNA, 21 bp, Homo sapiens
gctgttttgattcccgggctt

SEQ ID NO: 1203472 - DNA, 14 bp, Homo sapiens
gctgttttgttata

SEQ ID NO: 1203473 - DNA, 18 bp, Homo sapiens
gctgttttgttctgtggt

SEQ ID NO: 1203474 - DNA, 19 bp, Homo sapiens
gctgttttgttgacattct

SEQ ID NO: 1203475 - DNA, 23 bp, Homo sapiens
gctgttttgttgacattctgaat

SEQ ID NO: 1203476 - DNA, 14 bp, Homo sapiens
gctgtttttgttgt

SEQ ID NO: 1203477 - DNA, 15 bp, Homo sapiens
gctgtttttgttgtg

SEQ ID NO: 1203478 - DNA, 17 bp, Homo sapiens
gcttaaaaatacttcta

SEQ ID NO: 1203479 - DNA, 21 bp, Homo sapiens
gcttaaaataagcaggtggat

SEQ ID NO: 1203480 - DNA, 13 bp, Homo sapiens
gcttaaaatacaa

SEQ ID NO: 1203481 - DNA, 11 bp, Homo sapiens
gcttaaaatat

SEQ ID NO: 1203482 - DNA, 23 bp, Homo sapiens
gcttaaaatatatagtgaaaaat

SEQ ID NO: 1203483 - DNA, 15 bp, Homo sapiens
gcttaaaatatgtga

SEQ ID NO: 1203484 - DNA, 12 bp, Homo sapiens
gcttaaacaaag

SEQ ID NO: 1203485 - DNA, 18 bp, Homo sapiens
gcttaaacaaagcagtat

SEQ ID NO: 1203486 - DNA, 19 bp, Homo sapiens
gcttaaacacaagaaggaa

SEQ ID NO: 1203487 - DNA, 18 bp, Homo sapiens
gcttaaacccatacaatg

SEQ ID NO: 1203488 - DNA, 17 bp, Homo sapiens
gcttaaactaaataatg

SEQ ID NO: 1203489 - DNA, 12 bp, Homo sapiens
gcttaaagatgt

SEQ ID NO: 1203490 - DNA, 14 bp, Homo sapiens
gcttaaagccccct

SEQ ID NO: 1203491 - DNA, 19 bp, Homo sapiens
gcttaaagtgaaggaaata

SEQ ID NO: 1203492 - DNA, 17 bp, Homo sapiens
gcttaaataggaaagtt

SEQ ID NO: 1203493 - DNA, 17 bp, Homo sapiens
gcttaaattgcttttgt

SEQ ID NO: 1203494 - DNA, 16 bp, Homo sapiens
gcttaaatttcttatg

SEQ ID NO: 1203495 - DNA, 20 bp, Homo sapiens
gcttaacattagatgtcatg

SEQ ID NO: 1203496 - DNA, 22 bp, Homo sapiens
gcttaacctttccgctgtcgcc

SEQ ID NO: 1203497 - DNA, 16 bp, Homo sapiens
gcttaacttcacatat

SEQ ID NO: 1203498 - DNA, 20 bp, Homo sapiens
gcttaagagtccaactcact

SEQ ID NO: 1203499 - DNA, 21 bp, Homo sapiens
gcttaagcatccgtgtatttg

SEQ ID NO: 1203500 - DNA, 16 bp, Homo sapiens
gcttaagtcatcatta

SEQ ID NO: 1203501 - DNA, 20 bp, Homo sapiens
gcttaagtgagcagaacagg

SEQ ID NO: 1203502 - DNA, 17 bp, Homo sapiens
gcttaagtgtaaatgaa

SEQ ID NO: 1203503 - DNA, 16 bp, Homo sapiens
gcttaataaattccat

SEQ ID NO: 1203504 - DNA, 19 bp, Homo sapiens
gcttaatagccctccccct

SEQ ID NO: 1203505 - DNA, 15 bp, Homo sapiens
gcttaatcattttca

SEQ ID NO: 1203506 - DNA, 21 bp, Homo sapiens
gcttaatcattttcattccta

SEQ ID NO: 1203507 - DNA, 21 bp, Homo sapiens
gcttaatccaatattttgcct

SEQ ID NO: 1203508 - DNA, 22 bp, Homo sapiens
gcttaatccaatattttgcctt

SEQ ID NO: 1203509 - DNA, 18 bp, Homo sapiens
gcttaatgacactagcta

SEQ ID NO: 1203510 - DNA, 20 bp, Homo sapiens
gcttaatggctgataatttt

SEQ ID NO: 1203511 - DNA, 15 bp, Homo sapiens
gcttaattctccttc

SEQ ID NO: 1203512 - DNA, 16 bp, Homo sapiens
gcttaattctccttcc

SEQ ID NO: 1203513 - DNA, 17 bp, Homo sapiens
gcttaattctccttccc

SEQ ID NO: 1203514 - DNA, 12 bp, Homo sapiens
gcttaatttcct

SEQ ID NO: 1203515 - DNA, 20 bp, Homo sapiens
gcttaatttccttctgttaa

SEQ ID NO: 1203516 - DNA, 21 bp, Homo sapiens
gcttaatttccttctgttaag

SEQ ID NO: 1203517 - DNA, 15 bp, Homo sapiens
gcttaatttctgcct

SEQ ID NO: 1203518 - DNA, 17 bp, Homo sapiens
gcttaatttctgccttt

SEQ ID NO: 1203519 - DNA, 22 bp, Homo sapiens
gcttacaagccagctggagaaa

SEQ ID NO: 1203520 - DNA, 19 bp, Homo sapiens
gcttacacaagaagtgagg

SEQ ID NO: 1203521 - DNA, 13 bp, Homo sapiens
gcttacactgagg

SEQ ID NO: 1203522 - DNA, 14 bp, Homo sapiens
gcttacagaaatga

SEQ ID NO: 1203523 - DNA, 23 bp, Homo sapiens
gcttaccatctctaccatcatcc

SEQ ID NO: 1203524 - DNA, 17 bp, Homo sapiens
gcttacccaagctgtgg

SEQ ID NO: 1203525 - DNA, 13 bp, Homo sapiens
gcttacctgacct

SEQ ID NO: 1203526 - DNA, 23 bp, Homo sapiens
gcttacctgacctcttgctgtct

SEQ ID NO: 1203527 - DNA, 19 bp, Homo sapiens
gcttactaatgtgccccat

SEQ ID NO: 1203528 - DNA, 13 bp, Homo sapiens
gcttactatttct

SEQ ID NO: 1203529 - DNA, 11 bp, Homo sapiens
gcttacttttt

SEQ ID NO: 1203530 - DNA, 20 bp, Homo sapiens
gcttagacaccacctggagt

SEQ ID NO: 1203531 - DNA, 15 bp, Homo sapiens
gcttagacataacaa

SEQ ID NO: 1203532 - DNA, 16 bp, Homo sapiens
gcttagacctcagcct

SEQ ID NO: 1203533 - DNA, 13 bp, Homo sapiens
gcttagagagagg

SEQ ID NO: 1203534 - DNA, 17 bp, Homo sapiens
gcttagagtgcccagca

SEQ ID NO: 1203535 - DNA, 12 bp, Homo sapiens
gcttagcctgcc

SEQ ID NO: 1203536 - DNA, 14 bp, Homo sapiens
gcttagcctgcctc

SEQ ID NO: 1203537 - DNA, 20 bp, Homo sapiens
gcttagccttgtgccctgcc

SEQ ID NO: 1203538 - DNA, 15 bp, Homo sapiens
gcttagcgctctgga

SEQ ID NO: 1203539 - DNA, 17 bp, Homo sapiens
gcttagcttatctttct

SEQ ID NO: 1203540 - DNA, 22 bp, Homo sapiens
gcttaggagacagatcactcct

SEQ ID NO: 1203541 - DNA, 23 bp, Homo sapiens
gcttaggagacagatcactcctg

SEQ ID NO: 1203542 - DNA, 13 bp, Homo sapiens
gcttaggagagac

SEQ ID NO: 1203543 - DNA, 22 bp, Homo sapiens
gcttaggatgtgtgcatgtgtg

SEQ ID NO: 1203544 - DNA, 15 bp, Homo sapiens
gcttagggccctgga

SEQ ID NO: 1203545 - DNA, 18 bp, Homo sapiens
gcttagggccctggaggc

SEQ ID NO: 1203546 - DNA, 16 bp, Homo sapiens
gcttagtatttctcag

SEQ ID NO: 1203547 - DNA, 19 bp, Homo sapiens
gcttagtatttctcaggaa

SEQ ID NO: 1203548 - DNA, 14 bp, Homo sapiens
gcttagttcttgaa

SEQ ID NO: 1203549 - DNA, 21 bp, Homo sapiens
gcttagtttgtgtgttgtctc

SEQ ID NO: 1203550 - DNA, 14 bp, Homo sapiens
gcttataaacacat

SEQ ID NO: 1203551 - DNA, 19 bp, Homo sapiens
gcttataaacacattgaat

SEQ ID NO: 1203552 - DNA, 12 bp, Homo sapiens
gcttatacactt

SEQ ID NO: 1203553 - DNA, 15 bp, Homo sapiens
gcttatacccagtga

SEQ ID NO: 1203554 - DNA, 16 bp, Homo sapiens
gcttatacccagtgag

SEQ ID NO: 1203555 - DNA, 11 bp, Homo sapiens
gcttatatctg

SEQ ID NO: 1203556 - DNA, 17 bp, Homo sapiens
gcttatatctggcctct

SEQ ID NO: 1203557 - DNA, 13 bp, Homo sapiens
gcttatcctgcta

SEQ ID NO: 1203558 - DNA, 15 bp, Homo sapiens
gcttatctcttttat

SEQ ID NO: 1203559 - DNA, 21 bp, Homo sapiens
gcttatctcttttatatttgt

SEQ ID NO: 1203560 - DNA, 17 bp, Homo sapiens
gcttatgaatatattta

SEQ ID NO: 1203561 - DNA, 21 bp, Homo sapiens
gcttatgaatatttataacag

SEQ ID NO: 1203562 - DNA, 23 bp, Homo sapiens
ctcctgccatgggtgcagaccct

SEQ ID NO: 1203563 - DNA, 12 bp, Homo sapiens
ctcctgcccaga

SEQ ID NO: 1203564 - DNA, 14 bp, Homo sapiens
ctcctgcccagcca

SEQ ID NO: 1203565 - DNA, 16 bp, Homo sapiens
ctcctgcccaggactg

SEQ ID NO: 1203566 - DNA, 17 bp, Homo sapiens
ctcctgcccaggagagc

SEQ ID NO: 1203567 - DNA, 13 bp, Homo sapiens
ctcctgccctcgt

SEQ ID NO: 1203568 - DNA, 14 bp, Homo sapiens
ctcctgccctctgc

SEQ ID NO: 1203569 - DNA, 15 bp, Homo sapiens
ctcctgccctctgct

SEQ ID NO: 1203570 - DNA, 17 bp, Homo sapiens
ctcctgccctctgctct

SEQ ID NO: 1203571 - DNA, 16 bp, Homo sapiens
ctcctgccgactcctg

SEQ ID NO: 1203572 - DNA, 13 bp, Homo sapiens
ctcctgcctactc

SEQ ID NO: 1203573 - DNA, 16 bp, Homo sapiens
ctcctgcctactcacg

SEQ ID NO: 1203574 - DNA, 21 bp, Homo sapiens
ctcctgcctcagcctcctgag

SEQ ID NO: 1203575 - DNA, 19 bp, Homo sapiens
ctcctgcctcagccttcca

SEQ ID NO: 1203576 - DNA, 14 bp, Homo sapiens
ctcctgcctgcccc

SEQ ID NO: 1203577 - DNA, 12 bp, Homo sapiens
ctcctgcctggg

SEQ ID NO: 1203578 - DNA, 16 bp, Homo sapiens
ctcctgcctggggtgg

SEQ ID NO: 1203579 - DNA, 14 bp, Homo sapiens
ctcctgcctgtgct

SEQ ID NO: 1203580 - DNA, 21 bp, Homo sapiens
ctcctgcggctcagccttgca

SEQ ID NO: 1203581 - DNA, 12 bp, Homo sapiens
ctcctgctcctc

SEQ ID NO: 1203582 - DNA, 18 bp, Homo sapiens
ctcctgctcctccctgcc

SEQ ID NO: 1203583 - DNA, 14 bp, Homo sapiens
ctcctgctctctgg

SEQ ID NO: 1203584 - DNA, 18 bp, Homo sapiens
ctcctgctgaccttctgc

SEQ ID NO: 1203585 - DNA, 14 bp, Homo sapiens
ctcctgctgccaca

SEQ ID NO: 1203586 - DNA, 23 bp, Homo sapiens
ctcctgctgccttttctggagtt

SEQ ID NO: 1203587 - DNA, 15 bp, Homo sapiens
ctcctgctggctctc

SEQ ID NO: 1203588 - DNA, 14 bp, Homo sapiens
ctcctgctgtgcct

SEQ ID NO: 1203589 - DNA, 23 bp, Homo sapiens
ctcctgctgtgcctcgcatccta

SEQ ID NO: 1203590 - DNA, 22 bp, Homo sapiens
ctcctgcttcccctccctaccc

SEQ ID NO: 1203591 - DNA, 21 bp, Homo sapiens
ctcctgcttgtactaagccag

SEQ ID NO: 1203592 - DNA, 22 bp, Homo sapiens
ctcctgcttttctgtcctgggc

SEQ ID NO: 1203593 - DNA, 11 bp, Homo sapiens
ctcctggaaat

SEQ ID NO: 1203594 - DNA, 20 bp, Homo sapiens
ctcctggaaccttgctgtcc

SEQ ID NO: 1203595 - DNA, 15 bp, Homo sapiens
ctcctggaagctgtg

SEQ ID NO: 1203596 - DNA, 20 bp, Homo sapiens
ctcctggaagctgtgtcctt

SEQ ID NO: 1203597 - DNA, 17 bp, Homo sapiens
ctcctggactccggagg

SEQ ID NO: 1203598 - DNA, 20 bp, Homo sapiens
ctcctggactccggaggact

SEQ ID NO: 1203599 - DNA, 24 bp, Homo sapiens
ctcctggactccggaggactgagc

SEQ ID NO: 1203600 - DNA, 17 bp, Homo sapiens
ctcctggagcatcccag

SEQ ID NO: 1203601 - DNA, 19 bp, Homo sapiens
ctcctggagcatcccaggc

SEQ ID NO: 1203602 - DNA, 16 bp, Homo sapiens
ctcctggaggaccaga

SEQ ID NO: 1203603 - DNA, 17 bp, Homo sapiens
ctcctggaggcaggggc

SEQ ID NO: 1203604 - DNA, 21 bp, Homo sapiens
ctcctggcaatcaatacagct

SEQ ID NO: 1203605 - DNA, 14 bp, Homo sapiens
ctcctggcagggcc

SEQ ID NO: 1203606 - DNA, 24 bp, Homo sapiens
ctcctggcagggccacctgcagga

SEQ ID NO: 1203607 - DNA, 16 bp, Homo sapiens
ctcctggcccactgca

SEQ ID NO: 1203608 - DNA, 21 bp, Homo sapiens
ctcctggcccgccctcacctc

SEQ ID NO: 1203609 - DNA, 22 bp, Homo sapiens
ctcctggcccgccctcacctct

SEQ ID NO: 1203610 - DNA, 14 bp, Homo sapiens
ctcctggcctcaag

SEQ ID NO: 1203611 - DNA, 21 bp, Homo sapiens
ctcctggcgagttctctttgg

SEQ ID NO: 1203612 - DNA, 16 bp, Homo sapiens
ctcctggctccctccc

SEQ ID NO: 1203613 - DNA, 13 bp, Homo sapiens
ctcctggctgcca

SEQ ID NO: 1203614 - DNA, 16 bp, Homo sapiens
ctcctggctgccaggc

SEQ ID NO: 1203615 - DNA, 19 bp, Homo sapiens
ctcctggctgccaggcgtt

SEQ ID NO: 1203616 - DNA, 15 bp, Homo sapiens
ctcctggctgtgccc

SEQ ID NO: 1203617 - DNA, 19 bp, Homo sapiens
ctcctggctgtgcccagca

SEQ ID NO: 1203618 - DNA, 22 bp, Homo sapiens
ctcctggctgtgcccagcaggc

SEQ ID NO: 1203619 - DNA, 23 bp, Homo sapiens
ctcctgggaacacatctggctgc

SEQ ID NO: 1203620 - DNA, 13 bp, Homo sapiens
ctcctgggaccct

SEQ ID NO: 1203621 - DNA, 18 bp, Homo sapiens
ctcctgggattggctgtg

SEQ ID NO: 1203622 - DNA, 19 bp, Homo sapiens
ctcctgggcccaagtgatc

SEQ ID NO: 1203623 - DNA, 13 bp, Homo sapiens
ctcctgggctcag

SEQ ID NO: 1203624 - DNA, 18 bp, Homo sapiens
ctcctgggctctgaacac

SEQ ID NO: 1203625 - DNA, 23 bp, Homo sapiens
ctcctggggagaaagaggggcct

SEQ ID NO: 1203626 - DNA, 14 bp, Homo sapiens
ctcctggggagctc

SEQ ID NO: 1203627 - DNA, 22 bp, Homo sapiens
ctcctggggagctcctgggacc

SEQ ID NO: 1203628 - DNA, 12 bp, Homo sapiens
ctcctggggcag

SEQ ID NO: 1203629 - DNA, 17 bp, Homo sapiens
ctcctgggggctggctc

SEQ ID NO: 1203630 - DNA, 21 bp, Homo sapiens
ctcctgggggctggctcccag

SEQ ID NO: 1203631 - DNA, 22 bp, Homo sapiens
ctcctgggggctggctcccagg

SEQ ID NO: 1203632 - DNA, 14 bp, Homo sapiens
ctcctgggggttct

SEQ ID NO: 1203633 - DNA, 18 bp, Homo sapiens
ctcctgggggttctttct

SEQ ID NO: 1203634 - DNA, 20 bp, Homo sapiens
ctcctgggggttctttcttc

SEQ ID NO: 1203635 - DNA, 23 bp, Homo sapiens
ctcctgggttggagggaaccacc

SEQ ID NO: 1203636 - DNA, 21 bp, Homo sapiens
ctcctgggttttgtattctct

SEQ ID NO: 1203637 - DNA, 13 bp, Homo sapiens
ctcctggtcctgg

SEQ ID NO: 1203638 - DNA, 18 bp, Homo sapiens
ctcctggtcctggacacc

SEQ ID NO: 1203639 - DNA, 23 bp, Homo sapiens
ctcctggtcctggacacctccca

SEQ ID NO: 1203640 - DNA, 23 bp, Homo sapiens
ctcctggtcttgagatgtcttct

SEQ ID NO: 1203641 - DNA, 18 bp, Homo sapiens
ctcctggtgttctgcagt

SEQ ID NO: 1203642 - DNA, 17 bp, Homo sapiens
ctcctggtttcctttct

SEQ ID NO: 1203643 - DNA, 18 bp, Homo sapiens
ctcctggtttgatttgat

SEQ ID NO: 1203644 - DNA, 21 bp, Homo sapiens
ctcctgtaaatggtgtacata

SEQ ID NO: 1203645 - DNA, 22 bp, Homo sapiens
ctcctgtaacatactggcctgg

SEQ ID NO: 1203646 - DNA, 23 bp, Homo sapiens
ctcctgtaacatactggcctgga

SEQ ID NO: 1203647 - DNA, 14 bp, Homo sapiens
ctcctgtaattcct

SEQ ID NO: 1203648 - DNA, 18 bp, Homo sapiens
ctcctgtaattcctacct

SEQ ID NO: 1203649 - DNA, 18 bp, Homo sapiens
ctcctgtacttgtcctca

SEQ ID NO: 1203650 - DNA, 17 bp, Homo sapiens
ctcctgtactttttcca

SEQ ID NO: 1203651 - DNA, 13 bp, Homo sapiens
ctcctgtcaccta

SEQ ID NO: 1203652 - DNA, 14 bp, Homo sapiens
ctcctgtcactcac

SEQ ID NO: 1203653 - DNA, 17 bp, Homo sapiens
ctcctgtcactcactga

SEQ ID NO: 1203654 - DNA, 18 bp, Homo sapiens
ctcctgtcactcactgag

SEQ ID NO: 1203655 - DNA, 19 bp, Homo sapiens
ctcctgtcactcactgagg

SEQ ID NO: 1203656 - DNA, 20 bp, Homo sapiens
ctcctgtccctgtagctcag

SEQ ID NO: 1203657 - DNA, 21 bp, Homo sapiens
ctcctgtccctgtagctcagt

SEQ ID NO: 1203658 - DNA, 13 bp, Homo sapiens
ctcctgtcctccc

SEQ ID NO: 1203659 - DNA, 11 bp, Homo sapiens
ctcctgtcctt

SEQ ID NO: 1203660 - DNA, 13 bp, Homo sapiens
ctcctgtccttta

SEQ ID NO: 1203661 - DNA, 11 bp, Homo sapiens
ctcctgtctgc

SEQ ID NO: 1203662 - DNA, 22 bp, Homo sapiens
ctcctgtctgccagccagcagc

SEQ ID NO: 1203663 - DNA, 23 bp, Homo sapiens
ctcctgtctgccagccagcagcc

SEQ ID NO: 1203664 - DNA, 13 bp, Homo sapiens
ctcctgtctgccc

SEQ ID NO: 1203665 - DNA, 17 bp, Homo sapiens
ctcctgtctgccctctg

SEQ ID NO: 1203666 - DNA, 12 bp, Homo sapiens
ctcctgtctggc

SEQ ID NO: 1203667 - DNA, 14 bp, Homo sapiens
ctcctgtctggctc

SEQ ID NO: 1203668 - DNA, 18 bp, Homo sapiens
ctcctgtcttatggtcca

SEQ ID NO: 1203669 - DNA, 17 bp, Homo sapiens
ctcctgtgaatggaggc

SEQ ID NO: 1203670 - DNA, 17 bp, Homo sapiens
ctcctgtgcaactttcc

SEQ ID NO: 1203671 - DNA, 11 bp, Homo sapiens
ctcctgtgccc

SEQ ID NO: 1203672 - DNA, 14 bp, Homo sapiens
ctcctgtgcccaca

SEQ ID NO: 1203673 - DNA, 15 bp, Homo sapiens
ctcctgtgccccagc

SEQ ID NO: 1203674 - DNA, 16 bp, Homo sapiens
ctcctgtgcctggccc

SEQ ID NO: 1203675 - DNA, 20 bp, Homo sapiens
ctcctgtggccccaccctgg

SEQ ID NO: 1203676 - DNA, 13 bp, Homo sapiens
ctcctgtgtgctt

SEQ ID NO: 1203677 - DNA, 18 bp, Homo sapiens
ctcctgttccgtgtgggc

SEQ ID NO: 1203678 - DNA, 15 bp, Homo sapiens
ctcctgttctgccca

SEQ ID NO: 1203679 - DNA, 15 bp, Homo sapiens
ctcctgtttggaacg

SEQ ID NO: 1203680 - DNA, 18 bp, Homo sapiens
ctcctgttttctccctct

SEQ ID NO: 1203681 - DNA, 19 bp, Homo sapiens
ctcctgttttctccctctc

SEQ ID NO: 1203682 - DNA, 15 bp, Homo sapiens
ctccttactctgagc

SEQ ID NO: 1203683 - DNA, 16 bp, Homo sapiens
ctccttactctgagcc

SEQ ID NO: 1203684 - DNA, 21 bp, Homo sapiens
ctccttactctgagcccaggc

SEQ ID NO: 1203685 - DNA, 14 bp, Homo sapiens
ctccttagaaaaaa

SEQ ID NO: 1203686 - DNA, 19 bp, Homo sapiens
ctccttagtcttctcatag

SEQ ID NO: 1203687 - DNA, 22 bp, Homo sapiens
gcttatgacatcacttgtacaa

SEQ ID NO: 1203688 - DNA, 23 bp, Homo sapiens
gcttatgacatcacttgtacaaa

SEQ ID NO: 1203689 - DNA, 17 bp, Homo sapiens
gcttatgagatactttg

SEQ ID NO: 1203690 - DNA, 18 bp, Homo sapiens
gcttatgagatctaatgt

SEQ ID NO: 1203691 - DNA, 21 bp, Homo sapiens
gcttatgagatctaatgtgaa

SEQ ID NO: 1203692 - DNA, 22 bp, Homo sapiens
gcttatgatgagccatattaat

SEQ ID NO: 1203693 - DNA, 17 bp, Homo sapiens
gcttatgcttgtgtata

SEQ ID NO: 1203694 - DNA, 20 bp, Homo sapiens
gcttatgttaatagtaattc

SEQ ID NO: 1203695 - DNA, 17 bp, Homo sapiens
gcttattgatcccacat

SEQ ID NO: 1203696 - DNA, 17 bp, Homo sapiens
gcttattgttccaagac

SEQ ID NO: 1203697 - DNA, 20 bp, Homo sapiens
gcttattgttccaagacatt

SEQ ID NO: 1203698 - DNA, 21 bp, Homo sapiens
gcttattgttccaagacattg

SEQ ID NO: 1203699 - DNA, 23 bp, Homo sapiens
gcttatttctatgacaaattcaa

SEQ ID NO: 1203700 - DNA, 22 bp, Homo sapiens
gcttatttggaaattttagtta

SEQ ID NO: 1203701 - DNA, 11 bp, Homo sapiens
gcttattttat

SEQ ID NO: 1203702 - DNA, 12 bp, Homo sapiens
gcttatttttat

SEQ ID NO: 1203703 - DNA, 19 bp, Homo sapiens
gcttattttttaaaatatt

SEQ ID NO: 1203704 - DNA, 20 bp, Homo sapiens
gcttattttttaaaatattt

SEQ ID NO: 1203705 - DNA, 22 bp, Homo sapiens
gcttcaacattctttgcaagat

SEQ ID NO: 1203706 - DNA, 19 bp, Homo sapiens
gcttcaagtgttgctcttg

SEQ ID NO: 1203707 - DNA, 15 bp, Homo sapiens
gcttcaatataagaa

SEQ ID NO: 1203708 - DNA, 18 bp, Homo sapiens
gcttcaatataagaagca

SEQ ID NO: 1203709 - DNA, 22 bp, Homo sapiens
gcttcaatcggcttgtgggtga

SEQ ID NO: 1203710 - DNA, 18 bp, Homo sapiens
gcttcacagtagagccag

SEQ ID NO: 1203711 - DNA, 16 bp, Homo sapiens
gcttcaccagtctgtc

SEQ ID NO: 1203712 - DNA, 17 bp, Homo sapiens
gcttcaccatggcctta

SEQ ID NO: 1203713 - DNA, 20 bp, Homo sapiens
gcttcaccatggccttatga

SEQ ID NO: 1203714 - DNA, 17 bp, Homo sapiens
gcttcacggaagagcct

SEQ ID NO: 1203715 - DNA, 18 bp, Homo sapiens
gcttcacggaagagcctt

SEQ ID NO: 1203716 - DNA, 21 bp, Homo sapiens
gcttcactcatgcaaactgct

SEQ ID NO: 1203717 - DNA, 22 bp, Homo sapiens
gcttcactctccctgacggctg

SEQ ID NO: 1203718 - DNA, 17 bp, Homo sapiens
gcttcagaattaaaact

SEQ ID NO: 1203719 - DNA, 23 bp, Homo sapiens
gcttcagaccatcagttacagag

SEQ ID NO: 1203720 - DNA, 17 bp, Homo sapiens
gcttcagagtttgtgtg

SEQ ID NO: 1203721 - DNA, 20 bp, Homo sapiens
gcttcagagtttgtgtgtat

SEQ ID NO: 1203722 - DNA, 23 bp, Homo sapiens
gcttcagcactttaaagaggctg

SEQ ID NO: 1203723 - DNA, 17 bp, Homo sapiens
gcttcagcatatttata

SEQ ID NO: 1203724 - DNA, 19 bp, Homo sapiens
gcttcagcatatttatagc

SEQ ID NO: 1203725 - DNA, 22 bp, Homo sapiens
gcttcagcccccaccaggggaa

SEQ ID NO: 1203726 - DNA, 13 bp, Homo sapiens
gcttcagccctgg

SEQ ID NO: 1203727 - DNA, 21 bp, Homo sapiens
gcttcagccctggcccctgtg

SEQ ID NO: 1203728 - DNA, 22 bp, Homo sapiens
gcttcagccctggcccctgtgg

SEQ ID NO: 1203729 - DNA, 23 bp, Homo sapiens
gcttcagggagggttagcctgca

SEQ ID NO: 1203730 - DNA, 18 bp, Homo sapiens
gcttcagtcatcagccag

SEQ ID NO: 1203731 - DNA, 14 bp, Homo sapiens
gcttcataaatgaa

SEQ ID NO: 1203732 - DNA, 14 bp, Homo sapiens
gcttcatctggcaa

SEQ ID NO: 1203733 - DNA, 13 bp, Homo sapiens
gcttcatgccttt

SEQ ID NO: 1203734 - DNA, 15 bp, Homo sapiens
gcttcatgcctttgt

SEQ ID NO: 1203735 - DNA, 14 bp, Homo sapiens
gcttcatgctcagc

SEQ ID NO: 1203736 - DNA, 18 bp, Homo sapiens
gcttcatgctcagccctg

SEQ ID NO: 1203737 - DNA, 21 bp, Homo sapiens
gcttcattatctgagttgcat

SEQ ID NO: 1203738 - DNA, 22 bp, Homo sapiens
gcttcattcaatattgacattt

SEQ ID NO: 1203739 - DNA, 15 bp, Homo sapiens
gcttcatttcaatca

SEQ ID NO: 1203740 - DNA, 18 bp, Homo sapiens
gcttcattttatttttga

SEQ ID NO: 1203741 - DNA, 23 bp, Homo sapiens
gcttcattttatttttgacgtca

SEQ ID NO: 1203742 - DNA, 18 bp, Homo sapiens
gcttcattttggagcttg

SEQ ID NO: 1203743 - DNA, 14 bp, Homo sapiens
gcttccacaaaatt

SEQ ID NO: 1203744 - DNA, 23 bp, Homo sapiens
gcttccacccgtctctctgccca

SEQ ID NO: 1203745 - DNA, 12 bp, Homo sapiens
gcttccacctca

SEQ ID NO: 1203746 - DNA, 20 bp, Homo sapiens
gcttccagagagtcctctgg

SEQ ID NO: 1203747 - DNA, 21 bp, Homo sapiens
gcttccagagagtcctctgga

SEQ ID NO: 1203748 - DNA, 12 bp, Homo sapiens
gcttccaggctc

SEQ ID NO: 1203749 - DNA, 19 bp, Homo sapiens
gcttccaggtatctccagg

SEQ ID NO: 1203750 - DNA, 20 bp, Homo sapiens
gcttccaggtatctccagga

SEQ ID NO: 1203751 - DNA, 21 bp, Homo sapiens
gcttccaggtatctccaggat

SEQ ID NO: 1203752 - DNA, 22 bp, Homo sapiens
gcttccaggtatctccaggatt

SEQ ID NO: 1203753 - DNA, 23 bp, Homo sapiens
gcttccattattgagttcctcct

SEQ ID NO: 1203754 - DNA, 12 bp, Homo sapiens
gcttcccatcct

SEQ ID NO: 1203755 - DNA, 18 bp, Homo sapiens
gcttccccatcagctccc

SEQ ID NO: 1203756 - DNA, 17 bp, Homo sapiens
gcttcccccacccctcc

SEQ ID NO: 1203757 - DNA, 18 bp, Homo sapiens
gcttcccccacccctcca

SEQ ID NO: 1203758 - DNA, 24 bp, Homo sapiens
gcttcccctccctaccctcggaaa

SEQ ID NO: 1203759 - DNA, 16 bp, Homo sapiens
gcttccccttcctaag

SEQ ID NO: 1203760 - DNA, 20 bp, Homo sapiens
gcttccccttgccacggttt

SEQ ID NO: 1203761 - DNA, 19 bp, Homo sapiens
gcttccctaaactgcagcc

SEQ ID NO: 1203762 - DNA, 13 bp, Homo sapiens
gcttccctaatct

SEQ ID NO: 1203763 - DNA, 19 bp, Homo sapiens
gcttccctctgcctgtccc

SEQ ID NO: 1203764 - DNA, 22 bp, Homo sapiens
gcttccgagatccccagggcag

SEQ ID NO: 1203765 - DNA, 12 bp, Homo sapiens
gcttccgccact

SEQ ID NO: 1203766 - DNA, 18 bp, Homo sapiens
gcttccgccactcagcca

SEQ ID NO: 1203767 - DNA, 12 bp, Homo sapiens
gcttccgcgccc

SEQ ID NO: 1203768 - DNA, 12 bp, Homo sapiens
gcttcctccaga

SEQ ID NO: 1203769 - DNA, 18 bp, Homo sapiens
gcttcctgacaatcaact

SEQ ID NO: 1203770 - DNA, 17 bp, Homo sapiens
gcttcctgctgggactg

SEQ ID NO: 1203771 - DNA, 12 bp, Homo sapiens
gcttcctgctgt

SEQ ID NO: 1203772 - DNA, 23 bp, Homo sapiens
gcttcctggctgtaaatcctaga

SEQ ID NO: 1203773 - DNA, 22 bp, Homo sapiens
gcttcctggtgtatttttcagg

SEQ ID NO: 1203774 - DNA, 17 bp, Homo sapiens
gcttcctgtccactctc

SEQ ID NO: 1203775 - DNA, 19 bp, Homo sapiens
gcttcctgtccactctcgg

SEQ ID NO: 1203776 - DNA, 19 bp, Homo sapiens
gcttcctgtgccctcaccc

SEQ ID NO: 1203777 - DNA, 20 bp, Homo sapiens
gcttccttcagtttgtaaag

SEQ ID NO: 1203778 - DNA, 22 bp, Homo sapiens
gcttccttctgggactggacag

SEQ ID NO: 1203779 - DNA, 22 bp, Homo sapiens
gcttccttggcatcacagggca

SEQ ID NO: 1203780 - DNA, 12 bp, Homo sapiens
gcttcctttctc

SEQ ID NO: 1203781 - DNA, 14 bp, Homo sapiens
gcttcctttctctc

SEQ ID NO: 1203782 - DNA, 17 bp, Homo sapiens
gcttcctttctctcctg

SEQ ID NO: 1203783 - DNA, 13 bp, Homo sapiens
gcttcgactactg

SEQ ID NO: 1203784 - DNA, 21 bp, Homo sapiens
gcttcgactactgctcctgtg

SEQ ID NO: 1203785 - DNA, 24 bp, Homo sapiens
gcttcgactactgctcctgtggca

SEQ ID NO: 1203786 - DNA, 13 bp, Homo sapiens
gcttcgaggacag

SEQ ID NO: 1203787 - DNA, 15 bp, Homo sapiens
gcttcgaggacagga

SEQ ID NO: 1203788 - DNA, 19 bp, Homo sapiens
gcttcgaggcccagcgacc

SEQ ID NO: 1203789 - DNA, 21 bp, Homo sapiens
gcttcggagggccgcagggcc

SEQ ID NO: 1203790 - DNA, 16 bp, Homo sapiens
gcttcggccacaggca

SEQ ID NO: 1203791 - DNA, 16 bp, Homo sapiens
gcttcggccgcgccac

SEQ ID NO: 1203792 - DNA, 20 bp, Homo sapiens
gcttcgggcccttcccacag

SEQ ID NO: 1203793 - DNA, 20 bp, Homo sapiens
gcttcgtcttgtgtttgctg

SEQ ID NO: 1203794 - DNA, 18 bp, Homo sapiens
gcttcgtgctggaggaac

SEQ ID NO: 1203795 - DNA, 13 bp, Homo sapiens
gcttcgttttcag

SEQ ID NO: 1203796 - DNA, 13 bp, Homo sapiens
gcttctaaagcag

SEQ ID NO: 1203797 - DNA, 14 bp, Homo sapiens
gcttctaatattag

SEQ ID NO: 1203798 - DNA, 15 bp, Homo sapiens
gcttctacatgatgc

SEQ ID NO: 1203799 - DNA, 18 bp, Homo sapiens
gcttctagaaactctggc

SEQ ID NO: 1203800 - DNA, 16 bp, Homo sapiens
gcttctagctgacttg

SEQ ID NO: 1203801 - DNA, 15 bp, Homo sapiens
gcttctaggagtcaa

SEQ ID NO: 1203802 - DNA, 18 bp, Homo sapiens
gcttctataattttgcct

SEQ ID NO: 1203803 - DNA, 14 bp, Homo sapiens
gcttctatcccagg

SEQ ID NO: 1203804 - DNA, 18 bp, Homo sapiens
gcttctatcccaggaggt

SEQ ID NO: 1203805 - DNA, 20 bp, Homo sapiens
gcttctatcccaggaggtgg

SEQ ID NO: 1203806 - DNA, 17 bp, Homo sapiens
gcttctcactgccatgc

SEQ ID NO: 1203807 - DNA, 21 bp, Homo sapiens
gcttctcagatttctgaggaa

SEQ ID NO: 1203808 - DNA, 22 bp, Homo sapiens
gcttctcagatttctgaggaaa

SEQ ID NO: 1203809 - DNA, 14 bp, Homo sapiens
gcttctcagcccct

SEQ ID NO: 1203810 - DNA, 17 bp, Homo sapiens
ctccttagttggctgga

SEQ ID NO: 1203811 - DNA, 19 bp, Homo sapiens
ctccttatttggcgtgacc

SEQ ID NO: 1203812 - DNA, 23 bp, Homo sapiens
ctccttcactgttccctctggct

SEQ ID NO: 1203813 - DNA, 13 bp, Homo sapiens
ctccttcagacac

SEQ ID NO: 1203814 - DNA, 19 bp, Homo sapiens
ctccttcatgacagcctcc

SEQ ID NO: 1203815 - DNA, 22 bp, Homo sapiens
ctccttcattaatgatgatctt

SEQ ID NO: 1203816 - DNA, 14 bp, Homo sapiens
ctccttccacatgt

SEQ ID NO: 1203817 - DNA, 18 bp, Homo sapiens
ctccttccacctccctcc

SEQ ID NO: 1203818 - DNA, 15 bp, Homo sapiens
ctccttccagacctt

SEQ ID NO: 1203819 - DNA, 15 bp, Homo sapiens
ctccttcccacaaaa

SEQ ID NO: 1203820 - DNA, 13 bp, Homo sapiens
ctccttcccagat

SEQ ID NO: 1203821 - DNA, 15 bp, Homo sapiens
ctccttcccagggac

SEQ ID NO: 1203822 - DNA, 16 bp, Homo sapiens
ctccttccccatttcc

SEQ ID NO: 1203823 - DNA, 14 bp, Homo sapiens
ctccttcccctgca

SEQ ID NO: 1203824 - DNA, 20 bp, Homo sapiens
ctccttcccctgcacctggc

SEQ ID NO: 1203825 - DNA, 23 bp, Homo sapiens
ctccttcccctgcacctggcctg

SEQ ID NO: 1203826 - DNA, 21 bp, Homo sapiens
ctccttcccgccgcccgaccc

SEQ ID NO: 1203827 - DNA, 22 bp, Homo sapiens
ctccttcctgattgtttacagt

SEQ ID NO: 1203828 - DNA, 12 bp, Homo sapiens
ctccttcctggc

SEQ ID NO: 1203829 - DNA, 16 bp, Homo sapiens
ctccttcctggcctga

SEQ ID NO: 1203830 - DNA, 18 bp, Homo sapiens
ctccttcctggcctgaga

SEQ ID NO: 1203831 - DNA, 13 bp, Homo sapiens
ctccttcctgtgt

SEQ ID NO: 1203832 - DNA, 15 bp, Homo sapiens
ctccttcctgtgtgt

SEQ ID NO: 1203833 - DNA, 12 bp, Homo sapiens
ctccttcctgtt

SEQ ID NO: 1203834 - DNA, 16 bp, Homo sapiens
ctccttcctgtttgtt

SEQ ID NO: 1203835 - DNA, 17 bp, Homo sapiens
ctccttccttcaggact

SEQ ID NO: 1203836 - DNA, 18 bp, Homo sapiens
ctccttccttcaggactc

SEQ ID NO: 1203837 - DNA, 19 bp, Homo sapiens
ctccttcgcaggcatgtcc

SEQ ID NO: 1203838 - DNA, 22 bp, Homo sapiens
ctccttcgtatcccgagtctgg

SEQ ID NO: 1203839 - DNA, 20 bp, Homo sapiens
ctccttcgtgtctctcccac

SEQ ID NO: 1203840 - DNA, 20 bp, Homo sapiens
ctccttctaaaaacttctca

SEQ ID NO: 1203841 - DNA, 18 bp, Homo sapiens
ctccttctattttcccta

SEQ ID NO: 1203842 - DNA, 18 bp, Homo sapiens
ctccttctcctagctctg

SEQ ID NO: 1203843 - DNA, 17 bp, Homo sapiens
ctccttgagaggagaaa

SEQ ID NO: 1203844 - DNA, 23 bp, Homo sapiens
ctccttgagaggagaaatgcaat

SEQ ID NO: 1203845 - DNA, 14 bp, Homo sapiens
ctccttgcaaccag

SEQ ID NO: 1203846 - DNA, 15 bp, Homo sapiens
ctccttgcaaccagg

SEQ ID NO: 1203847 - DNA, 16 bp, Homo sapiens
ctccttgcaaccaggc

SEQ ID NO: 1203848 - DNA, 17 bp, Homo sapiens
ctccttgcaaccaggca

SEQ ID NO: 1203849 - DNA, 18 bp, Homo sapiens
ctccttgcaaccaggcag

SEQ ID NO: 1203850 - DNA, 15 bp, Homo sapiens
ctccttgcagcaggg

SEQ ID NO: 1203851 - DNA, 17 bp, Homo sapiens
ctccttgcctcctgtgt

SEQ ID NO: 1203852 - DNA, 13 bp, Homo sapiens
ctccttgctgacc

SEQ ID NO: 1203853 - DNA, 19 bp, Homo sapiens
ctccttgctgaccccaggt

SEQ ID NO: 1203854 - DNA, 15 bp, Homo sapiens
ctccttggcaccccc

SEQ ID NO: 1203855 - DNA, 16 bp, Homo sapiens
ctccttggccacagac

SEQ ID NO: 1203856 - DNA, 12 bp, Homo sapiens
ctccttggcgga

SEQ ID NO: 1203857 - DNA, 19 bp, Homo sapiens
ctccttggctgcagccatc

SEQ ID NO: 1203858 - DNA, 16 bp, Homo sapiens
ctccttggctgtctgt

SEQ ID NO: 1203859 - DNA, 13 bp, Homo sapiens
ctccttggcttac

SEQ ID NO: 1203860 - DNA, 16 bp, Homo sapiens
ctccttggcttacctg

SEQ ID NO: 1203861 - DNA, 17 bp, Homo sapiens
ctccttggcttacctga

SEQ ID NO: 1203862 - DNA, 19 bp, Homo sapiens
ctccttggcttacctgacc

SEQ ID NO: 1203863 - DNA, 20 bp, Homo sapiens
ctccttggcttacctgacct

SEQ ID NO: 1203864 - DNA, 12 bp, Homo sapiens
ctccttgggccc

SEQ ID NO: 1203865 - DNA, 19 bp, Homo sapiens
ctccttgggctcctggctg

SEQ ID NO: 1203866 - DNA, 20 bp, Homo sapiens
ctccttgggctcctggctgc

SEQ ID NO: 1203867 - DNA, 17 bp, Homo sapiens
ctccttggtttgctagt

SEQ ID NO: 1203868 - DNA, 19 bp, Homo sapiens
ctccttgtggcctttttta

SEQ ID NO: 1203869 - DNA, 14 bp, Homo sapiens
ctccttgtgttact

SEQ ID NO: 1203870 - DNA, 23 bp, Homo sapiens
ctccttgtgttgcactgaacagg

SEQ ID NO: 1203871 - DNA, 23 bp, Homo sapiens
ctcctttaccagtcctatttttc

SEQ ID NO: 1203872 - DNA, 14 bp, Homo sapiens
ctcctttaccctct

SEQ ID NO: 1203873 - DNA, 15 bp, Homo sapiens
ctcctttaccctctt

SEQ ID NO: 1203874 - DNA, 16 bp, Homo sapiens
ctcctttaccctcttg

SEQ ID NO: 1203875 - DNA, 18 bp, Homo sapiens
ctcctttactgcagcctg

SEQ ID NO: 1203876 - DNA, 20 bp, Homo sapiens
ctcctttagcaggtggtcct

SEQ ID NO: 1203877 - DNA, 16 bp, Homo sapiens
ctcctttatctgtaat

SEQ ID NO: 1203878 - DNA, 22 bp, Homo sapiens
ctcctttatctgtaattgtaat

SEQ ID NO: 1203879 - DNA, 16 bp, Homo sapiens
ctcctttcacaacctt

SEQ ID NO: 1203880 - DNA, 14 bp, Homo sapiens
ctcctttcagggcc

SEQ ID NO: 1203881 - DNA, 17 bp, Homo sapiens
ctcctttctccagccag

SEQ ID NO: 1203882 - DNA, 15 bp, Homo sapiens
ctcctttctccctgc

SEQ ID NO: 1203883 - DNA, 15 bp, Homo sapiens
ctcctttctcctgtg

SEQ ID NO: 1203884 - DNA, 18 bp, Homo sapiens
ctcctttctcctgtgaat

SEQ ID NO: 1203885 - DNA, 17 bp, Homo sapiens
ctcctttctgactgtcc

SEQ ID NO: 1203886 - DNA, 22 bp, Homo sapiens
ctcctttctgactgtccctgcc

SEQ ID NO: 1203887 - DNA, 17 bp, Homo sapiens
ctcctttctgtgcccta

SEQ ID NO: 1203888 - DNA, 18 bp, Homo sapiens
ctcctttgcactgagggc

SEQ ID NO: 1203889 - DNA, 14 bp, Homo sapiens
ctcctttgcatggc

SEQ ID NO: 1203890 - DNA, 17 bp, Homo sapiens
ctcctttggccattcca

SEQ ID NO: 1203891 - DNA, 21 bp, Homo sapiens
ctcctttgtcttttttttcat

SEQ ID NO: 1203892 - DNA, 12 bp, Homo sapiens
ctcctttgtgtg

SEQ ID NO: 1203893 - DNA, 17 bp, Homo sapiens
ctcctttgtgtggctgc

SEQ ID NO: 1203894 - DNA, 19 bp, Homo sapiens
ctcctttgtgtggctgccc

SEQ ID NO: 1203895 - DNA, 18 bp, Homo sapiens
ctccttttatctggtgcc

SEQ ID NO: 1203896 - DNA, 13 bp, Homo sapiens
ctccttttcactt

SEQ ID NO: 1203897 - DNA, 20 bp, Homo sapiens
ctccttttcactttattgct

SEQ ID NO: 1203898 - DNA, 18 bp, Homo sapiens
ctccttttgctgtctttc

SEQ ID NO: 1203899 - DNA, 20 bp, Homo sapiens
ctccttttgtccccagggcc

SEQ ID NO: 1203900 - DNA, 16 bp, Homo sapiens
ctcctttttattttag

SEQ ID NO: 1203901 - DNA, 21 bp, Homo sapiens
ctcctttttattttaggcact

SEQ ID NO: 1203902 - DNA, 15 bp, Homo sapiens
ctcctttttctccct

SEQ ID NO: 1203903 - DNA, 19 bp, Homo sapiens
ctcctttttctccctctgg

SEQ ID NO: 1203904 - DNA, 19 bp, Homo sapiens
ctcgaaacacagaaacctt

SEQ ID NO: 1203905 - DNA, 20 bp, Homo sapiens
ctcgaaacacagaaaccttt

SEQ ID NO: 1203906 - DNA, 20 bp, Homo sapiens
ctcgaactattttcaaagac

SEQ ID NO: 1203907 - DNA, 14 bp, Homo sapiens
ctcgaactcctgac

SEQ ID NO: 1203908 - DNA, 15 bp, Homo sapiens
ctcgaactcctgacc

SEQ ID NO: 1203909 - DNA, 17 bp, Homo sapiens
ctcgaactcctgacctc

SEQ ID NO: 1203910 - DNA, 16 bp, Homo sapiens
ctcgaactcctggcct

SEQ ID NO: 1203911 - DNA, 13 bp, Homo sapiens
ctcgaatctctgt

SEQ ID NO: 1203912 - DNA, 16 bp, Homo sapiens
ctcgaatctctgtgcc

SEQ ID NO: 1203913 - DNA, 17 bp, Homo sapiens
ctcgaatctctgtgcct

SEQ ID NO: 1203914 - DNA, 14 bp, Homo sapiens
ctcgaatctgtgtg

SEQ ID NO: 1203915 - DNA, 20 bp, Homo sapiens
ctcgaatgtaattggaatct

SEQ ID NO: 1203916 - DNA, 21 bp, Homo sapiens
ctcgaatgtaattggaatctt

SEQ ID NO: 1203917 - DNA, 23 bp, Homo sapiens
ctcgacacgtgggctcccctctt

SEQ ID NO: 1203918 - DNA, 12 bp, Homo sapiens
ctcgactcagca

SEQ ID NO: 1203919 - DNA, 15 bp, Homo sapiens
ctcgactcagcacca

SEQ ID NO: 1203920 - DNA, 16 bp, Homo sapiens
ctcgactcagcaccac

SEQ ID NO: 1203921 - DNA, 20 bp, Homo sapiens
ctcgagaccatcctggcccc

SEQ ID NO: 1203922 - DNA, 23 bp, Homo sapiens
ctcgagcagtcctgcctcagcct

SEQ ID NO: 1203923 - DNA, 15 bp, Homo sapiens
ctcgagcccagatgg

SEQ ID NO: 1203924 - DNA, 23 bp, Homo sapiens
ctcgagccccctggatgtcccct

SEQ ID NO: 1203925 - DNA, 20 bp, Homo sapiens
ctcgaggcaccggcgctgca

SEQ ID NO: 1203926 - DNA, 21 bp, Homo sapiens
ctcgaggcctacagaggaggc

SEQ ID NO: 1203927 - DNA, 23 bp, Homo sapiens
ctcgagggcagggaccacaccct

SEQ ID NO: 1203928 - DNA, 13 bp, Homo sapiens
ctcgagggccgcc

SEQ ID NO: 1203929 - DNA, 16 bp, Homo sapiens
ctcgagggccgcctgc

SEQ ID NO: 1203930 - DNA, 20 bp, Homo sapiens
ctcgagggccgcctgcctta

SEQ ID NO: 1203931 - DNA, 19 bp, Homo sapiens
ctcgaggggtgggctggta

SEQ ID NO: 1203932 - DNA, 22 bp, Homo sapiens
ctcgatcatatttccccttgga

SEQ ID NO: 1203933 - DNA, 13 bp, Homo sapiens
ctcgattttgtat

SEQ ID NO: 1203934 - DNA, 14 bp, Homo sapiens
ctcgattttgtatc

SEQ ID NO: 1203935 - DNA, 16 bp, Homo sapiens
ctcgattttgtatctg

SEQ ID NO: 1203936 - DNA, 15 bp, Homo sapiens
ctcgcaaccctgcct

SEQ ID NO: 1203937 - DNA, 13 bp, Homo sapiens
ctcgcaagagggt

SEQ ID NO: 1203938 - DNA, 18 bp, Homo sapiens
ctcgcacaatgcatgtgc

SEQ ID NO: 1203939 - DNA, 14 bp, Homo sapiens
ctcgcacacagggc

SEQ ID NO: 1203940 - DNA, 20 bp, Homo sapiens
ctcgcacacagggctcacag

SEQ ID NO: 1203941 - DNA, 14 bp, Homo sapiens
ctcgcacaggccct

SEQ ID NO: 1203942 - DNA, 13 bp, Homo sapiens
ctcgcactgccca

SEQ ID NO: 1203943 - DNA, 22 bp, Homo sapiens
ctcgcactgcccacatgggacc

SEQ ID NO: 1203944 - DNA, 17 bp, Homo sapiens
ctcgcacttgcagagga

SEQ ID NO: 1203945 - DNA, 20 bp, Homo sapiens
ctcgcagcacccacagcacc

SEQ ID NO: 1203946 - DNA, 14 bp, Homo sapiens
ctcgcagcctgaag

SEQ ID NO: 1203947 - DNA, 21 bp, Homo sapiens
ctcgcagcctgaagcctggat

SEQ ID NO: 1203948 - DNA, 21 bp, Homo sapiens
ctcgcagggaatgcagcagga

SEQ ID NO: 1203949 - DNA, 16 bp, Homo sapiens
ctcgcagggtgcagga

SEQ ID NO: 1203950 - DNA, 15 bp, Homo sapiens
ctcgcagtcgcagga

SEQ ID NO: 1203951 - DNA, 18 bp, Homo sapiens
ctcgcagtcgcaggatcc

SEQ ID NO: 1203952 - DNA, 19 bp, Homo sapiens
ctcgcataggacctttcca

SEQ ID NO: 1203953 - DNA, 15 bp, Homo sapiens
ctcgcatccagacag

SEQ ID NO: 1203954 - DNA, 20 bp, Homo sapiens
ctcgcatccagacagtcgct

SEQ ID NO: 1203955 - DNA, 22 bp, Homo sapiens
ctcgcatttgtcaatgacagtt

SEQ ID NO: 1203956 - DNA, 16 bp, Homo sapiens
ctcgccacgctcagtg

SEQ ID NO: 1203957 - DNA, 19 bp, Homo sapiens
ctcgccacgctcagtgccc

SEQ ID NO: 1203958 - DNA, 13 bp, Homo sapiens
ctcgccagcttgg

SEQ ID NO: 1203959 - DNA, 14 bp, Homo sapiens
ctcgccagcttggc

SEQ ID NO: 1203960 - DNA, 11 bp, Homo sapiens
ctcgccatcaa

SEQ ID NO: 1203961 - DNA, 20 bp, Homo sapiens
ctcgccatcaaggtccagtg

SEQ ID NO: 1203962 - DNA, 24 bp, Homo sapiens
ctcgccatgatcagacatacagct

SEQ ID NO: 1203963 - DNA, 17 bp, Homo sapiens
ctcgccatgccgggggt

SEQ ID NO: 1203964 - DNA, 15 bp, Homo sapiens
ctcgccatttcctca

SEQ ID NO: 1203965 - DNA, 20 bp, Homo sapiens
ctcgccatttcctcacgtgc

SEQ ID NO: 1203966 - DNA, 17 bp, Homo sapiens
ctcgcccagcaggagag

SEQ ID NO: 1203967 - DNA, 19 bp, Homo sapiens
ctcgcccatacccgtgaca

SEQ ID NO: 1203968 - DNA, 14 bp, Homo sapiens
ctcgccccagcagg

SEQ ID NO: 1203969 - DNA, 16 bp, Homo sapiens
ctcgcccctccagtgt

SEQ ID NO: 1203970 - DNA, 18 bp, Homo sapiens
ctcgcccctccagtgttg

SEQ ID NO: 1203971 - DNA, 12 bp, Homo sapiens
ctcgcccctccc

SEQ ID NO: 1203972 - DNA, 16 bp, Homo sapiens
ctcgcccctcccctca

SEQ ID NO: 1203973 - DNA, 19 bp, Homo sapiens
ctcgcccctcccctcagcc

SEQ ID NO: 1203974 - DNA, 12 bp, Homo sapiens
ctcgcccgccca

SEQ ID NO: 1203975 - DNA, 20 bp, Homo sapiens
ctcgcccgcccactgtcctg

SEQ ID NO: 1203976 - DNA, 15 bp, Homo sapiens
ctcgccctcctttct

SEQ ID NO: 1203977 - DNA, 20 bp, Homo sapiens
ctcgccgtgtctcagcctct

SEQ ID NO: 1203978 - DNA, 18 bp, Homo sapiens
ctcgcctaggcctgtgag

SEQ ID NO: 1203979 - DNA, 23 bp, Homo sapiens
ctcgcctgacaaccactggtctg

SEQ ID NO: 1203980 - DNA, 16 bp, Homo sapiens
ctcgccttccctcctg

SEQ ID NO: 1203981 - DNA, 13 bp, Homo sapiens
ctcgcgcgactga

SEQ ID NO: 1203982 - DNA, 16 bp, Homo sapiens
ctcgcgctcagtaaac

SEQ ID NO: 1203983 - DNA, 13 bp, Homo sapiens
ctcgctagtcagt

SEQ ID NO: 1203984 - DNA, 22 bp, Homo sapiens
ctcgctcaccgctggcccttag

SEQ ID NO: 1203985 - DNA, 13 bp, Homo sapiens
ctcgctcaggtga

SEQ ID NO: 1203986 - DNA, 19 bp, Homo sapiens
ctcgctcccctctggaatc

SEQ ID NO: 1203987 - DNA, 15 bp, Homo sapiens
ctcgctccctgtagc

SEQ ID NO: 1203988 - DNA, 22 bp, Homo sapiens
ctcgctccctgtagctctgcct

SEQ ID NO: 1203989 - DNA, 16 bp, Homo sapiens
ctcgctcctccttccc

SEQ ID NO: 1203990 - DNA, 19 bp, Homo sapiens
ctcgctcctccttcccagg

SEQ ID NO: 1203991 - DNA, 22 bp, Homo sapiens
ctcgctcctccttcccagggac

SEQ ID NO: 1203992 - DNA, 23 bp, Homo sapiens
ctcgctcctccttcccagggacc

SEQ ID NO: 1203993 - DNA, 12 bp, Homo sapiens
ctcgctgagggc

SEQ ID NO: 1203994 - DNA, 12 bp, Homo sapiens
ctcgctgccagc

SEQ ID NO: 1203995 - DNA, 21 bp, Homo sapiens
ctcgctgccatcaccgctggg

SEQ ID NO: 1203996 - DNA, 12 bp, Homo sapiens
ctcgctgctgct

SEQ ID NO: 1203997 - DNA, 14 bp, Homo sapiens
ctcgctgctgctac

SEQ ID NO: 1203998 - DNA, 18 bp, Homo sapiens
ctcgcttcctcagcctcc

SEQ ID NO: 1203999 - DNA, 22 bp, Homo sapiens
ctcgcttggacggctgggcaca

SEQ ID NO: 1204000 - DNA, 17 bp, Homo sapiens
ctcgctttgttgcccag

SEQ ID NO: 1204001 - DNA, 18 bp, Homo sapiens
ctcggaagccgtctgact

SEQ ID NO: 1204002 - DNA, 16 bp, Homo sapiens
ctcggaaggctggctg

SEQ ID NO: 1204003 - DNA, 20 bp, Homo sapiens
ctcggaaggctggctgggca

SEQ ID NO: 1204004 - DNA, 20 bp, Homo sapiens
ctcggacccaccccaactct

SEQ ID NO: 1204005 - DNA, 15 bp, Homo sapiens
ctcggactccatggc

SEQ ID NO: 1204006 - DNA, 17 bp, Homo sapiens
ctcggacttgaatgctg

SEQ ID NO: 1204007 - DNA, 19 bp, Homo sapiens
ctcggacttgaatgctgcc

SEQ ID NO: 1204008 - DNA, 17 bp, Homo sapiens
ctcggagaagagcgcag

SEQ ID NO: 1204009 - DNA, 19 bp, Homo sapiens
ctcggagactatggcctcg

SEQ ID NO: 1204010 - DNA, 22 bp, Homo sapiens
ctcggagcatcccggaggaaat

SEQ ID NO: 1204011 - DNA, 14 bp, Homo sapiens
ctcggagctggctg

SEQ ID NO: 1204012 - DNA, 15 bp, Homo sapiens
ctcggagctggctgt

SEQ ID NO: 1204013 - DNA, 16 bp, Homo sapiens
ctcggagctggctgtg

SEQ ID NO: 1204014 - DNA, 19 bp, Homo sapiens
ctcggagctggttcctctc

SEQ ID NO: 1204015 - DNA, 21 bp, Homo sapiens
ctcggatgacaccctggcctg

SEQ ID NO: 1204016 - DNA, 24 bp, Homo sapiens
ctcggatggaccaacctgctctgt

SEQ ID NO: 1204017 - DNA, 21 bp, Homo sapiens
ctcggcacctccccggcctct

SEQ ID NO: 1204018 - DNA, 14 bp, Homo sapiens
ctcggccactgtgt

SEQ ID NO: 1204019 - DNA, 15 bp, Homo sapiens
ctcggccactgtgtc

SEQ ID NO: 1204020 - DNA, 17 bp, Homo sapiens
ctcggccactgtgtctc

SEQ ID NO: 1204021 - DNA, 19 bp, Homo sapiens
ctcggccactgtgtctctg

SEQ ID NO: 1204022 - DNA, 13 bp, Homo sapiens
ctcggccaggcat

SEQ ID NO: 1204023 - DNA, 20 bp, Homo sapiens
ctcggccccacccaccctct

SEQ ID NO: 1204024 - DNA, 23 bp, Homo sapiens
ctcggccccctcaccccagctcc

SEQ ID NO: 1204025 - DNA, 16 bp, Homo sapiens
ctcggccccctccatc

SEQ ID NO: 1204026 - DNA, 14 bp, Homo sapiens
ctcggcccctctga

SEQ ID NO: 1204027 - DNA, 14 bp, Homo sapiens
ctcggccctgaacc

SEQ ID NO: 1204028 - DNA, 15 bp, Homo sapiens
ctcggccctgaacca

SEQ ID NO: 1204029 - DNA, 16 bp, Homo sapiens
ctcggccctgaaccac

SEQ ID NO: 1204030 - DNA, 21 bp, Homo sapiens
ctcggccctgaaccacgaggc

SEQ ID NO: 1204031 - DNA, 16 bp, Homo sapiens
ctcggcctcccaaagt

SEQ ID NO: 1204032 - DNA, 23 bp, Homo sapiens
ctcggcctcccaaagtgctagga

SEQ ID NO: 1204033 - DNA, 22 bp, Homo sapiens
ctcggcctcccaaagtgctggg

SEQ ID NO: 1204034 - DNA, 18 bp, Homo sapiens
ctcggcctccgaggctcc

SEQ ID NO: 1204035 - DNA, 17 bp, Homo sapiens
ctcggccttcacaatct

SEQ ID NO: 1204036 - DNA, 21 bp, Homo sapiens
ctcggcgttagtccctagccg

SEQ ID NO: 1204037 - DNA, 16 bp, Homo sapiens
ctcggcttgtgggctg

SEQ ID NO: 1204038 - DNA, 18 bp, Homo sapiens
ctcggcttgtgggctggt

SEQ ID NO: 1204039 - DNA, 17 bp, Homo sapiens
ctcgggactagctgcct

SEQ ID NO: 1204040 - DNA, 14 bp, Homo sapiens
ctcgggagctgcac

SEQ ID NO: 1204041 - DNA, 17 bp, Homo sapiens
ctcgggagctgcacaca

SEQ ID NO: 1204042 - DNA, 19 bp, Homo sapiens
ctcgggatcaaacctttct

SEQ ID NO: 1204043 - DNA, 14 bp, Homo sapiens
ctcgggcccacctg

SEQ ID NO: 1204044 - DNA, 17 bp, Homo sapiens
ctcgggcccacctggcc

SEQ ID NO: 1204045 - DNA, 19 bp, Homo sapiens
ctcgggcccacctggccac

SEQ ID NO: 1204046 - DNA, 15 bp, Homo sapiens
ctcgggctctctcac

SEQ ID NO: 1204047 - DNA, 19 bp, Homo sapiens
ctcgggctggagcctccga

SEQ ID NO: 1204048 - DNA, 16 bp, Homo sapiens
ctcggggagaggggga

SEQ ID NO: 1204049 - DNA, 13 bp, Homo sapiens
ctcggggaggcag

SEQ ID NO: 1204050 - DNA, 15 bp, Homo sapiens
ctcggggatggggag

SEQ ID NO: 1204051 - DNA, 14 bp, Homo sapiens
ctcggggctgctgt

SEQ ID NO: 1204052 - DNA, 19 bp, Homo sapiens
ctcgggggtgctggggcca

SEQ ID NO: 1204053 - DNA, 14 bp, Homo sapiens
ctcgggtgcatttg

SEQ ID NO: 1204054 - DNA, 11 bp, Homo sapiens
ctcgggtgggg

SEQ ID NO: 1204055 - DNA, 14 bp, Homo sapiens
ctcggtcagcgact

SEQ ID NO: 1204056 - DNA, 19 bp, Homo sapiens
ctcggtcagcgactggatg

SEQ ID NO: 1204057 - DNA, 21 bp, Homo sapiens
ctcggtcagcgactggatgct

SEQ ID NO: 1204058 - DNA, 13 bp, Homo sapiens
ctcggtctccctt

SEQ ID NO: 1204059 - DNA, 20 bp, Homo sapiens
ctcggtctcccttccgtcca

SEQ ID NO: 1204060 - DNA, 11 bp, Homo sapiens
gcttctcccat

SEQ ID NO: 1204061 - DNA, 18 bp, Homo sapiens
gcttctcccatttcctga

SEQ ID NO: 1204062 - DNA, 17 bp, Homo sapiens
gcttctcccggggacgc

SEQ ID NO: 1204063 - DNA, 16 bp, Homo sapiens
gcttctccgccagcct

SEQ ID NO: 1204064 - DNA, 17 bp, Homo sapiens
gcttctccgccagcctc

SEQ ID NO: 1204065 - DNA, 23 bp, Homo sapiens
gcttctccgccagcctcctctgg

SEQ ID NO: 1204066 - DNA, 24 bp, Homo sapiens
gcttctccgccagcctcctctgga

SEQ ID NO: 1204067 - DNA, 12 bp, Homo sapiens
gcttctcctgac

SEQ ID NO: 1204068 - DNA, 14 bp, Homo sapiens
gcttctcctgaccc

SEQ ID NO: 1204069 - DNA, 17 bp, Homo sapiens
gcttctccttctccttc

SEQ ID NO: 1204070 - DNA, 17 bp, Homo sapiens
gcttctcggccagcccg

SEQ ID NO: 1204071 - DNA, 19 bp, Homo sapiens
gcttctctagctctctagg

SEQ ID NO: 1204072 - DNA, 12 bp, Homo sapiens
gcttctctcagc

SEQ ID NO: 1204073 - DNA, 16 bp, Homo sapiens
gcttctctccacagtg

SEQ ID NO: 1204074 - DNA, 18 bp, Homo sapiens
gcttctctccacagtgtt

SEQ ID NO: 1204075 - DNA, 14 bp, Homo sapiens
gcttctctctccct

SEQ ID NO: 1204076 - DNA, 20 bp, Homo sapiens
gcttctctctccctgtcaca

SEQ ID NO: 1204077 - DNA, 14 bp, Homo sapiens
gcttctctctgtgg

SEQ ID NO: 1204078 - DNA, 16 bp, Homo sapiens
gcttctctctgtggga

SEQ ID NO: 1204079 - DNA, 14 bp, Homo sapiens
gcttctctgacttc

SEQ ID NO: 1204080 - DNA, 21 bp, Homo sapiens
gcttctctgacttctgcctgg

SEQ ID NO: 1204081 - DNA, 11 bp, Homo sapiens
gcttctctgca

SEQ ID NO: 1204082 - DNA, 13 bp, Homo sapiens
gcttctctgcagt

SEQ ID NO: 1204083 - DNA, 15 bp, Homo sapiens
gcttctctgcagtaa

SEQ ID NO: 1204084 - DNA, 23 bp, Homo sapiens
gcttctctgcagtaaaacacatt

SEQ ID NO: 1204085 - DNA, 18 bp, Homo sapiens
gcttctctgtctctgtgg

SEQ ID NO: 1204086 - DNA, 19 bp, Homo sapiens
gcttctctgtgaacgattt

SEQ ID NO: 1204087 - DNA, 22 bp, Homo sapiens
gcttctctgtgaacgatttaga

SEQ ID NO: 1204088 - DNA, 14 bp, Homo sapiens
gcttctctttgtgc

SEQ ID NO: 1204089 - DNA, 20 bp, Homo sapiens
gcttctcttttcctcgcaga

SEQ ID NO: 1204090 - DNA, 13 bp, Homo sapiens
gcttctgaatcac

SEQ ID NO: 1204091 - DNA, 12 bp, Homo sapiens
gcttctgcaccc

SEQ ID NO: 1204092 - DNA, 14 bp, Homo sapiens
gcttctgcaccctc

SEQ ID NO: 1204093 - DNA, 15 bp, Homo sapiens
gcttctgcaccctcc

SEQ ID NO: 1204094 - DNA, 18 bp, Homo sapiens
gcttctgcaccctccacc

SEQ ID NO: 1204095 - DNA, 13 bp, Homo sapiens
gcttctgcctgca

SEQ ID NO: 1204096 - DNA, 17 bp, Homo sapiens
gcttctgcgtccaccag

SEQ ID NO: 1204097 - DNA, 21 bp, Homo sapiens
gcttctgcgtccaccaggcct

SEQ ID NO: 1204098 - DNA, 23 bp, Homo sapiens
gcttctgcgtccaccaggcctca

SEQ ID NO: 1204099 - DNA, 15 bp, Homo sapiens
gcttctgctccagcc

SEQ ID NO: 1204100 - DNA, 17 bp, Homo sapiens
gcttctgctccagcccc

SEQ ID NO: 1204101 - DNA, 22 bp, Homo sapiens
gcttctgctggaggaggggaag

SEQ ID NO: 1204102 - DNA, 16 bp, Homo sapiens
gcttctgcttcaaacc

SEQ ID NO: 1204103 - DNA, 16 bp, Homo sapiens
gcttctgcttttctgc

SEQ ID NO: 1204104 - DNA, 13 bp, Homo sapiens
gcttctggagccc

SEQ ID NO: 1204105 - DNA, 17 bp, Homo sapiens
gcttctggagcccttgg

SEQ ID NO: 1204106 - DNA, 20 bp, Homo sapiens
gcttctgtagtactccttaa

SEQ ID NO: 1204107 - DNA, 14 bp, Homo sapiens
gcttctgtccagga

SEQ ID NO: 1204108 - DNA, 20 bp, Homo sapiens
gcttctgtgatgagctgatc

SEQ ID NO: 1204109 - DNA, 12 bp, Homo sapiens
gcttctgttctc

SEQ ID NO: 1204110 - DNA, 19 bp, Homo sapiens
gcttctgttctctgctgag

SEQ ID NO: 1204111 - DNA, 21 bp, Homo sapiens
gcttctgttctctgctgaggg

SEQ ID NO: 1204112 - DNA, 22 bp, Homo sapiens
gcttctgttctctgctgagggc

SEQ ID NO: 1204113 - DNA, 15 bp, Homo sapiens
gcttctgttgtaata

SEQ ID NO: 1204114 - DNA, 16 bp, Homo sapiens
gcttcttaaaaactgt

SEQ ID NO: 1204115 - DNA, 17 bp, Homo sapiens
gcttcttaaaaactgtg

SEQ ID NO: 1204116 - DNA, 21 bp, Homo sapiens
gcttcttaaaaactgtgtatc

SEQ ID NO: 1204117 - DNA, 18 bp, Homo sapiens
gcttcttactattaagca

SEQ ID NO: 1204118 - DNA, 20 bp, Homo sapiens
gcttcttactattaagcagt

SEQ ID NO: 1204119 - DNA, 21 bp, Homo sapiens
gcttcttattaatcatacaaa

SEQ ID NO: 1204120 - DNA, 23 bp, Homo sapiens
gcttcttcagagtgaagaatctt

SEQ ID NO: 1204121 - DNA, 19 bp, Homo sapiens
gcttcttcctcacactgct

SEQ ID NO: 1204122 - DNA, 21 bp, Homo sapiens
gcttcttcctcacactgctgt

SEQ ID NO: 1204123 - DNA, 23 bp, Homo sapiens
gcttcttcctcacactgctgtcc

SEQ ID NO: 1204124 - DNA, 13 bp, Homo sapiens
gcttcttgcctct

SEQ ID NO: 1204125 - DNA, 16 bp, Homo sapiens
gcttcttgcctctgtg

SEQ ID NO: 1204126 - DNA, 18 bp, Homo sapiens
gcttcttgcctctgtgct

SEQ ID NO: 1204127 - DNA, 21 bp, Homo sapiens
gcttcttgcctctgtgctgtg

SEQ ID NO: 1204128 - DNA, 19 bp, Homo sapiens
gcttcttggagctttggaa

SEQ ID NO: 1204129 - DNA, 22 bp, Homo sapiens
gcttcttgggctgagtgcagcc

SEQ ID NO: 1204130 - DNA, 23 bp, Homo sapiens
gcttcttgggctgagtgcagcca

SEQ ID NO: 1204131 - DNA, 16 bp, Homo sapiens
gcttcttgtttccttg

SEQ ID NO: 1204132 - DNA, 15 bp, Homo sapiens
gcttctttctagaaa

SEQ ID NO: 1204133 - DNA, 15 bp, Homo sapiens
gcttcttttgaactg

SEQ ID NO: 1204134 - DNA, 18 bp, Homo sapiens
gcttgaacctgcttcctg

SEQ ID NO: 1204135 - DNA, 21 bp, Homo sapiens
gcttgaacctgggaagtggag

SEQ ID NO: 1204136 - DNA, 20 bp, Homo sapiens
gcttgaactaggctgagcaa

SEQ ID NO: 1204137 - DNA, 22 bp, Homo sapiens
gcttgaagatcgttagtatcta

SEQ ID NO: 1204138 - DNA, 12 bp, Homo sapiens
gcttgaagccaa

SEQ ID NO: 1204139 - DNA, 14 bp, Homo sapiens
gcttgaagccaaag

SEQ ID NO: 1204140 - DNA, 16 bp, Homo sapiens
gcttgaagccaaagaa

SEQ ID NO: 1204141 - DNA, 18 bp, Homo sapiens
gcttgaagccaaagaaaa

SEQ ID NO: 1204142 - DNA, 14 bp, Homo sapiens
gcttgaagccaagt

SEQ ID NO: 1204143 - DNA, 14 bp, Homo sapiens
gcttgaaggactgc

SEQ ID NO: 1204144 - DNA, 20 bp, Homo sapiens
gcttgaccaggcttggcctt

SEQ ID NO: 1204145 - DNA, 20 bp, Homo sapiens
gcttgaccgtactctcacat

SEQ ID NO: 1204146 - DNA, 23 bp, Homo sapiens
gcttgactcaggatttaaaaact

SEQ ID NO: 1204147 - DNA, 14 bp, Homo sapiens
gcttgactctcact

SEQ ID NO: 1204148 - DNA, 20 bp, Homo sapiens
gcttgagaaatatggacact

SEQ ID NO: 1204149 - DNA, 23 bp, Homo sapiens
gcttgagacaaatcctttctgcc

SEQ ID NO: 1204150 - DNA, 13 bp, Homo sapiens
gcttgagcccagg

SEQ ID NO: 1204151 - DNA, 12 bp, Homo sapiens
gcttgagccggg

SEQ ID NO: 1204152 - DNA, 17 bp, Homo sapiens
gcttgagccgggcccct

SEQ ID NO: 1204153 - DNA, 22 bp, Homo sapiens
gcttgagccgggcccctgggct

SEQ ID NO: 1204154 - DNA, 14 bp, Homo sapiens
gcttgagtctcaag

SEQ ID NO: 1204155 - DNA, 20 bp, Homo sapiens
gcttgataatatataaacaa

SEQ ID NO: 1204156 - DNA, 13 bp, Homo sapiens
gcttgatccagaa

SEQ ID NO: 1204157 - DNA, 21 bp, Homo sapiens
gcttgatccagaagagcccat

SEQ ID NO: 1204158 - DNA, 13 bp, Homo sapiens
gcttgatctgtga

SEQ ID NO: 1204159 - DNA, 14 bp, Homo sapiens
gcttgatctgtgat

SEQ ID NO: 1204160 - DNA, 19 bp, Homo sapiens
gcttgcaatctaatctgaa

SEQ ID NO: 1204161 - DNA, 20 bp, Homo sapiens
gcttgcaatctaatctgaac

SEQ ID NO: 1204162 - DNA, 15 bp, Homo sapiens
gcttgcacacttccc

SEQ ID NO: 1204163 - DNA, 19 bp, Homo sapiens
gcttgcactttgtaacatg

SEQ ID NO: 1204164 - DNA, 14 bp, Homo sapiens
gcttgcagccagga

SEQ ID NO: 1204165 - DNA, 14 bp, Homo sapiens
gcttgccaaagtac

SEQ ID NO: 1204166 - DNA, 21 bp, Homo sapiens
gcttgccagaggccctcggtc

SEQ ID NO: 1204167 - DNA, 23 bp, Homo sapiens
gcttgcccagtacatttaaattt

SEQ ID NO: 1204168 - DNA, 21 bp, Homo sapiens
gcttgccccactctgcctgcc

SEQ ID NO: 1204169 - DNA, 13 bp, Homo sapiens
gcttgccccagga

SEQ ID NO: 1204170 - DNA, 14 bp, Homo sapiens
gcttgccccaggac

SEQ ID NO: 1204171 - DNA, 19 bp, Homo sapiens
gcttgcccgctcccacagc

SEQ ID NO: 1204172 - DNA, 13 bp, Homo sapiens
gcttgcctagggc

SEQ ID NO: 1204173 - DNA, 17 bp, Homo sapiens
gcttgcctagggcctgg

SEQ ID NO: 1204174 - DNA, 20 bp, Homo sapiens
gcttgcctgggctgggcagc

SEQ ID NO: 1204175 - DNA, 23 bp, Homo sapiens
gcttgcctggtcaccctggggct

SEQ ID NO: 1204176 - DNA, 21 bp, Homo sapiens
gcttgcctggtgggggaaggg

SEQ ID NO: 1204177 - DNA, 16 bp, Homo sapiens
gcttgcgtatgtctgt

SEQ ID NO: 1204178 - DNA, 12 bp, Homo sapiens
gcttgctccaga

SEQ ID NO: 1204179 - DNA, 21 bp, Homo sapiens
gcttgctccagattctgatgc

SEQ ID NO: 1204180 - DNA, 15 bp, Homo sapiens
gcttgctccagggtc

SEQ ID NO: 1204181 - DNA, 13 bp, Homo sapiens
gcttgctccctgt

SEQ ID NO: 1204182 - DNA, 23 bp, Homo sapiens
gcttgctcttcagtgggagaaaa

SEQ ID NO: 1204183 - DNA, 21 bp, Homo sapiens
gcttgcttagagtgcccagca

SEQ ID NO: 1204184 - DNA, 11 bp, Homo sapiens
ctcggtgcctt

SEQ ID NO: 1204185 - DNA, 20 bp, Homo sapiens
ctcggtggctctggggtatg

SEQ ID NO: 1204186 - DNA, 16 bp, Homo sapiens
ctcggtgggccagagc

SEQ ID NO: 1204187 - DNA, 17 bp, Homo sapiens
ctcggtgggccagagct

SEQ ID NO: 1204188 - DNA, 19 bp, Homo sapiens
ctcggtgggccagagctga

SEQ ID NO: 1204189 - DNA, 13 bp, Homo sapiens
ctcggtttctcca

SEQ ID NO: 1204190 - DNA, 21 bp, Homo sapiens
ctcgtatcccaaatctgtcag

SEQ ID NO: 1204191 - DNA, 18 bp, Homo sapiens
ctcgtcaagagcatgcac

SEQ ID NO: 1204192 - DNA, 16 bp, Homo sapiens
ctcgtcagccacctgg

SEQ ID NO: 1204193 - DNA, 19 bp, Homo sapiens
ctcgtcagccacctgggaa

SEQ ID NO: 1204194 - DNA, 15 bp, Homo sapiens
ctcgtccacaggggc

SEQ ID NO: 1204195 - DNA, 21 bp, Homo sapiens
ctcgtccacaggggcaggcct

SEQ ID NO: 1204196 - DNA, 14 bp, Homo sapiens
ctcgtccccctccc

SEQ ID NO: 1204197 - DNA, 16 bp, Homo sapiens
ctcgtccccctccctg

SEQ ID NO: 1204198 - DNA, 14 bp, Homo sapiens
ctcgtccgtctgtc

SEQ ID NO: 1204199 - DNA, 17 bp, Homo sapiens
ctcgtcctccccctgcc

SEQ ID NO: 1204200 - DNA, 18 bp, Homo sapiens
ctcgtcctccccctgcca

SEQ ID NO: 1204201 - DNA, 20 bp, Homo sapiens
ctcgtcctccccctgccagt

SEQ ID NO: 1204202 - DNA, 13 bp, Homo sapiens
ctcgtcctgtccc

SEQ ID NO: 1204203 - DNA, 15 bp, Homo sapiens
ctcgtcctgtcccag

SEQ ID NO: 1204204 - DNA, 18 bp, Homo sapiens
ctcgtcttccgtctcccc

SEQ ID NO: 1204205 - DNA, 13 bp, Homo sapiens
ctcgtctttactt

SEQ ID NO: 1204206 - DNA, 19 bp, Homo sapiens
ctcgtgcatccctgagaca

SEQ ID NO: 1204207 - DNA, 12 bp, Homo sapiens
ctcgtgccagca

SEQ ID NO: 1204208 - DNA, 17 bp, Homo sapiens
ctcgtgccagcagcctc

SEQ ID NO: 1204209 - DNA, 19 bp, Homo sapiens
ctcgtgccagcagcctcgc

SEQ ID NO: 1204210 - DNA, 19 bp, Homo sapiens
ctcgtgccatgatctgtat

SEQ ID NO: 1204211 - DNA, 22 bp, Homo sapiens
ctcgtgcccatcaagtgcagtc

SEQ ID NO: 1204212 - DNA, 12 bp, Homo sapiens
ctcgtggccagc

SEQ ID NO: 1204213 - DNA, 16 bp, Homo sapiens
ctcgtggccagcccgg

SEQ ID NO: 1204214 - DNA, 11 bp, Homo sapiens
ctcgtggcctt

SEQ ID NO: 1204215 - DNA, 19 bp, Homo sapiens
ctcgtgggcttgtgctcgg

SEQ ID NO: 1204216 - DNA, 17 bp, Homo sapiens
ctcgtggtagaagccag

SEQ ID NO: 1204217 - DNA, 21 bp, Homo sapiens
ctcgtggtaggactgtagaaa

SEQ ID NO: 1204218 - DNA, 17 bp, Homo sapiens
ctcgtgtatcctggggc

SEQ ID NO: 1204219 - DNA, 15 bp, Homo sapiens
ctcgtgtcagctcag

SEQ ID NO: 1204220 - DNA, 22 bp, Homo sapiens
ctcgtgtcagctcaggcagctc

SEQ ID NO: 1204221 - DNA, 15 bp, Homo sapiens
ctcgtgtcagtaatt

SEQ ID NO: 1204222 - DNA, 12 bp, Homo sapiens
ctcgtgtccaga

SEQ ID NO: 1204223 - DNA, 18 bp, Homo sapiens
ctcgtgtgatttcctaca

SEQ ID NO: 1204224 - DNA, 16 bp, Homo sapiens
ctcgtgtgtcctcatg

SEQ ID NO: 1204225 - DNA, 12 bp, Homo sapiens
ctcgtgtttgct

SEQ ID NO: 1204226 - DNA, 14 bp, Homo sapiens
ctcgtgtttgctta

SEQ ID NO: 1204227 - DNA, 21 bp, Homo sapiens
ctcgttcccctcctcttccga

SEQ ID NO: 1204228 - DNA, 19 bp, Homo sapiens
ctcgttccggtccccacag

SEQ ID NO: 1204229 - DNA, 17 bp, Homo sapiens
ctcgttcctttctcctg

SEQ ID NO: 1204230 - DNA, 16 bp, Homo sapiens
ctcgttctccttcccc

SEQ ID NO: 1204231 - DNA, 23 bp, Homo sapiens
ctcgttctccttccccatttcca

SEQ ID NO: 1204232 - DNA, 16 bp, Homo sapiens
ctcgttggatgtctgt

SEQ ID NO: 1204233 - DNA, 17 bp, Homo sapiens
ctcgttggatgtctgtg

SEQ ID NO: 1204234 - DNA, 22 bp, Homo sapiens
ctcgttgggccgctctgatttc

SEQ ID NO: 1204235 - DNA, 16 bp, Homo sapiens
ctcgtttttcagcacc

SEQ ID NO: 1204236 - DNA, 20 bp, Homo sapiens
ctcgtttttcagcaccccca

SEQ ID NO: 1204237 - DNA, 21 bp, Homo sapiens
ctcgtttttcttcttaagact

SEQ ID NO: 1204238 - DNA, 13 bp, Homo sapiens
ctctaaaagatcc

SEQ ID NO: 1204239 - DNA, 22 bp, Homo sapiens
ctctaaacagacaggaatttag

SEQ ID NO: 1204240 - DNA, 23 bp, Homo sapiens
ctctaaagaaaaatgcctgtctc

SEQ ID NO: 1204241 - DNA, 14 bp, Homo sapiens
ctctaaagaaactt

SEQ ID NO: 1204242 - DNA, 23 bp, Homo sapiens
ctctaaagcaataatggtcccat

SEQ ID NO: 1204243 - DNA, 19 bp, Homo sapiens
ctctaaagccaagcacttt

SEQ ID NO: 1204244 - DNA, 13 bp, Homo sapiens
ctctaaattaaga

SEQ ID NO: 1204245 - DNA, 18 bp, Homo sapiens
ctctaaccattcaaatga

SEQ ID NO: 1204246 - DNA, 20 bp, Homo sapiens
ctctaactgtatatttgtat

SEQ ID NO: 1204247 - DNA, 21 bp, Homo sapiens
ctctaactgtatatttgtatg

SEQ ID NO: 1204248 - DNA, 14 bp, Homo sapiens
ctctaacttctcaa

SEQ ID NO: 1204249 - DNA, 19 bp, Homo sapiens
ctctaagccactcttccaa

SEQ ID NO: 1204250 - DNA, 23 bp, Homo sapiens
ctctaagcgtgctgacatcagat

SEQ ID NO: 1204251 - DNA, 14 bp, Homo sapiens
ctctaagctggagc

SEQ ID NO: 1204252 - DNA, 15 bp, Homo sapiens
ctctaagctggagct

SEQ ID NO: 1204253 - DNA, 20 bp, Homo sapiens
ctctaagctggagctcttgg

SEQ ID NO: 1204254 - DNA, 17 bp, Homo sapiens
ctctaagtcatgtatgt

SEQ ID NO: 1204255 - DNA, 18 bp, Homo sapiens
ctctaagtcatgtatgtt

SEQ ID NO: 1204256 - DNA, 20 bp, Homo sapiens
ctctaagtcatgtatgtttc

SEQ ID NO: 1204257 - DNA, 22 bp, Homo sapiens
ctctaagtcatgtatgtttctc

SEQ ID NO: 1204258 - DNA, 16 bp, Homo sapiens
ctctaagttccactga

SEQ ID NO: 1204259 - DNA, 20 bp, Homo sapiens
ctctaagttccactgagctc

SEQ ID NO: 1204260 - DNA, 12 bp, Homo sapiens
ctctaataataa

SEQ ID NO: 1204261 - DNA, 15 bp, Homo sapiens
ctctaataataaata

SEQ ID NO: 1204262 - DNA, 14 bp, Homo sapiens
ctctaatcagtcct

SEQ ID NO: 1204263 - DNA, 13 bp, Homo sapiens
ctctaatctggat

SEQ ID NO: 1204264 - DNA, 15 bp, Homo sapiens
ctctaattcacagtg

SEQ ID NO: 1204265 - DNA, 21 bp, Homo sapiens
ctctacaaaaagtaaaaatta

SEQ ID NO: 1204266 - DNA, 14 bp, Homo sapiens
ctctacactaaggg

SEQ ID NO: 1204267 - DNA, 13 bp, Homo sapiens
ctctacactgaaa

SEQ ID NO: 1204268 - DNA, 20 bp, Homo sapiens
ctctacagagcttccctgac

SEQ ID NO: 1204269 - DNA, 21 bp, Homo sapiens
ctctacaggaatatatttttt

SEQ ID NO: 1204270 - DNA, 23 bp, Homo sapiens
ctctacaggtcggggaccaaagg

SEQ ID NO: 1204271 - DNA, 13 bp, Homo sapiens
ctctacatgctct

SEQ ID NO: 1204272 - DNA, 14 bp, Homo sapiens
ctctacatgctctt

SEQ ID NO: 1204273 - DNA, 17 bp, Homo sapiens
ctctaccaaataatttc

SEQ ID NO: 1204274 - DNA, 18 bp, Homo sapiens
ctctaccatcatccggtt

SEQ ID NO: 1204275 - DNA, 15 bp, Homo sapiens
ctctacccatgagcc

SEQ ID NO: 1204276 - DNA, 16 bp, Homo sapiens
ctctacccatgagcct

SEQ ID NO: 1204277 - DNA, 22 bp, Homo sapiens
ctctaccccaaagaattcctga

SEQ ID NO: 1204278 - DNA, 14 bp, Homo sapiens
ctctaccccaattt

SEQ ID NO: 1204279 - DNA, 13 bp, Homo sapiens
ctctacccctgct

SEQ ID NO: 1204280 - DNA, 13 bp, Homo sapiens
ctctacccctttc

SEQ ID NO: 1204281 - DNA, 15 bp, Homo sapiens
ctctacccctttctt

SEQ ID NO: 1204282 - DNA, 17 bp, Homo sapiens
ctctaccctcccacccc

SEQ ID NO: 1204283 - DNA, 18 bp, Homo sapiens
ctctaccctcccaccccc

SEQ ID NO: 1204284 - DNA, 13 bp, Homo sapiens
ctctaccctggca

SEQ ID NO: 1204285 - DNA, 13 bp, Homo sapiens
ctctaccctgtct

SEQ ID NO: 1204286 - DNA, 17 bp, Homo sapiens
ctctacctaatgtctca

SEQ ID NO: 1204287 - DNA, 22 bp, Homo sapiens
ctctacctaatgtctcactgtt

SEQ ID NO: 1204288 - DNA, 20 bp, Homo sapiens
ctctacctcatatcagtttg

SEQ ID NO: 1204289 - DNA, 11 bp, Homo sapiens
ctctacctcca

SEQ ID NO: 1204290 - DNA, 13 bp, Homo sapiens
ctctacctctctc

SEQ ID NO: 1204291 - DNA, 12 bp, Homo sapiens
ctctacctgaca

SEQ ID NO: 1204292 - DNA, 21 bp, Homo sapiens
ctctactaacaatcagctcct

SEQ ID NO: 1204293 - DNA, 20 bp, Homo sapiens
ctctactaatgcctcttcat

SEQ ID NO: 1204294 - DNA, 19 bp, Homo sapiens
ctctactaccacaaggaaa

SEQ ID NO: 1204295 - DNA, 19 bp, Homo sapiens
ctctactcctacctcagcc

SEQ ID NO: 1204296 - DNA, 22 bp, Homo sapiens
ctctactcttacagagccttga

SEQ ID NO: 1204297 - DNA, 14 bp, Homo sapiens
ctctactcttcctg

SEQ ID NO: 1204298 - DNA, 17 bp, Homo sapiens
ctctactcttcctgtcc

SEQ ID NO: 1204299 - DNA, 13 bp, Homo sapiens
ctctactgttgca

SEQ ID NO: 1204300 - DNA, 19 bp, Homo sapiens
ctctactgttgcacagcca

SEQ ID NO: 1204301 - DNA, 17 bp, Homo sapiens
ctctacttaatccaatg

SEQ ID NO: 1204302 - DNA, 16 bp, Homo sapiens
ctctacttagcatgtc

SEQ ID NO: 1204303 - DNA, 19 bp, Homo sapiens
ctctacttagcatgtccct

SEQ ID NO: 1204304 - DNA, 12 bp, Homo sapiens
ctctacttcccc

SEQ ID NO: 1204305 - DNA, 14 bp, Homo sapiens
ctctagaaaaaagg

SEQ ID NO: 1204306 - DNA, 18 bp, Homo sapiens
ctctagaaataggttaaa

SEQ ID NO: 1204307 - DNA, 15 bp, Homo sapiens
ctctagaagccaagg

SEQ ID NO: 1204308 - DNA, 18 bp, Homo sapiens
ctctagaagccaagggaa

SEQ ID NO: 1204309 - DNA, 19 bp, Homo sapiens
ctctagaagccaagggaaa

SEQ ID NO: 1204310 - DNA, 23 bp, Homo sapiens
gcttgcttagagtgcccagcaga

SEQ ID NO: 1204311 - DNA, 12 bp, Homo sapiens
gcttgcttgccg

SEQ ID NO: 1204312 - DNA, 21 bp, Homo sapiens
gcttggaaagcatcacctcag

SEQ ID NO: 1204313 - DNA, 21 bp, Homo sapiens
gcttggaacccggtgctccct

SEQ ID NO: 1204314 - DNA, 18 bp, Homo sapiens
gcttggagcagaggggct

SEQ ID NO: 1204315 - DNA, 12 bp, Homo sapiens
gcttggagtgca

SEQ ID NO: 1204316 - DNA, 15 bp, Homo sapiens
gcttggatcctgggc

SEQ ID NO: 1204317 - DNA, 21 bp, Homo sapiens
gcttggatctggggtgggagt

SEQ ID NO: 1204318 - DNA, 15 bp, Homo sapiens
gcttggcatctgtgt

SEQ ID NO: 1204319 - DNA, 16 bp, Homo sapiens
gcttggcatctgtgtg

SEQ ID NO: 1204320 - DNA, 13 bp, Homo sapiens
gcttggccagaag

SEQ ID NO: 1204321 - DNA, 18 bp, Homo sapiens
gcttggccagaagggggc

SEQ ID NO: 1204322 - DNA, 12 bp, Homo sapiens
gcttggcccagc

SEQ ID NO: 1204323 - DNA, 16 bp, Homo sapiens
gcttggcccgcggcct

SEQ ID NO: 1204324 - DNA, 14 bp, Homo sapiens
gcttggcctggaga

SEQ ID NO: 1204325 - DNA, 15 bp, Homo sapiens
gcttggcctggagag

SEQ ID NO: 1204326 - DNA, 15 bp, Homo sapiens
gcttggccttgtgtc

SEQ ID NO: 1204327 - DNA, 13 bp, Homo sapiens
gcttggctcccga

SEQ ID NO: 1204328 - DNA, 22 bp, Homo sapiens
gcttggcttcctcttcttgttg

SEQ ID NO: 1204329 - DNA, 23 bp, Homo sapiens
gcttgggacgtgtacagcacaga

SEQ ID NO: 1204330 - DNA, 16 bp, Homo sapiens
gcttgggactcaggtc

SEQ ID NO: 1204331 - DNA, 18 bp, Homo sapiens
gcttgggactcaggtctg

SEQ ID NO: 1204332 - DNA, 21 bp, Homo sapiens
gcttgggactcaggtctgtaa

SEQ ID NO: 1204333 - DNA, 16 bp, Homo sapiens
gcttgggctgacccag

SEQ ID NO: 1204334 - DNA, 21 bp, Homo sapiens
gcttgggctgacccagcatct

SEQ ID NO: 1204335 - DNA, 15 bp, Homo sapiens
gcttgggctggtcag

SEQ ID NO: 1204336 - DNA, 16 bp, Homo sapiens
gcttgggctggtcaga

SEQ ID NO: 1204337 - DNA, 23 bp, Homo sapiens
gcttgggcttccatttgtgtgtg

SEQ ID NO: 1204338 - DNA, 12 bp, Homo sapiens
gcttggggaaaa

SEQ ID NO: 1204339 - DNA, 20 bp, Homo sapiens
gcttggggccaccaaagctg

SEQ ID NO: 1204340 - DNA, 23 bp, Homo sapiens
gcttggggccaccaaagctgccc

SEQ ID NO: 1204341 - DNA, 23 bp, Homo sapiens
gcttggggctgcacctcctaccc

SEQ ID NO: 1204342 - DNA, 21 bp, Homo sapiens
gcttgggtcaggttcttgcct

SEQ ID NO: 1204343 - DNA, 21 bp, Homo sapiens
gcttgggtgtaacaggtctcc

SEQ ID NO: 1204344 - DNA, 22 bp, Homo sapiens
gcttgggtgtaacaggtctcct

SEQ ID NO: 1204345 - DNA, 23 bp, Homo sapiens
gcttgggtgtaacaggtctcctc

SEQ ID NO: 1204346 - DNA, 23 bp, Homo sapiens
gcttggtcaaactttttccagca

SEQ ID NO: 1204347 - DNA, 20 bp, Homo sapiens
gcttggtggggctcgtggcc

SEQ ID NO: 1204348 - DNA, 21 bp, Homo sapiens
gcttggtggggctcgtggcct

SEQ ID NO: 1204349 - DNA, 15 bp, Homo sapiens
gcttggttggctggc

SEQ ID NO: 1204350 - DNA, 15 bp, Homo sapiens
gcttgtaacaagaaa

SEQ ID NO: 1204351 - DNA, 22 bp, Homo sapiens
gcttgtaactaaaataattttg

SEQ ID NO: 1204352 - DNA, 23 bp, Homo sapiens
gcttgtaactaaaataattttgt

SEQ ID NO: 1204353 - DNA, 19 bp, Homo sapiens
gcttgtacataatgcgtgc

SEQ ID NO: 1204354 - DNA, 19 bp, Homo sapiens
gcttgtaccacttttgcaa

SEQ ID NO: 1204355 - DNA, 23 bp, Homo sapiens
gcttgtagaatttttaaaaaagt

SEQ ID NO: 1204356 - DNA, 17 bp, Homo sapiens
gcttgtatcaacactgt

SEQ ID NO: 1204357 - DNA, 14 bp, Homo sapiens
gcttgtattgtaaa

SEQ ID NO: 1204358 - DNA, 18 bp, Homo sapiens
gcttgtcattgagcctgg

SEQ ID NO: 1204359 - DNA, 21 bp, Homo sapiens
gcttgtcctgctctcttcagg

SEQ ID NO: 1204360 - DNA, 12 bp, Homo sapiens
gcttgtgacagt

SEQ ID NO: 1204361 - DNA, 21 bp, Homo sapiens
gcttgtgcctcccttcccagt

SEQ ID NO: 1204362 - DNA, 22 bp, Homo sapiens
gcttgtgcctcccttcccagtg

SEQ ID NO: 1204363 - DNA, 18 bp, Homo sapiens
gcttgtggcaagtgaatt

SEQ ID NO: 1204364 - DNA, 16 bp, Homo sapiens
gcttgtgggctggtgc

SEQ ID NO: 1204365 - DNA, 22 bp, Homo sapiens
gcttgtgggctggtgccccaca

SEQ ID NO: 1204366 - DNA, 17 bp, Homo sapiens
gcttgtggggacccagg

SEQ ID NO: 1204367 - DNA, 19 bp, Homo sapiens
gcttgtggggacccaggct

SEQ ID NO: 1204368 - DNA, 21 bp, Homo sapiens
gcttgtggggacccaggctcc

SEQ ID NO: 1204369 - DNA, 21 bp, Homo sapiens
gcttgtgtatatgtataaatt

SEQ ID NO: 1204370 - DNA, 14 bp, Homo sapiens
gcttgttaaatttt

SEQ ID NO: 1204371 - DNA, 13 bp, Homo sapiens
gcttgttaatgct

SEQ ID NO: 1204372 - DNA, 19 bp, Homo sapiens
gcttgttagagagaaagag

SEQ ID NO: 1204373 - DNA, 15 bp, Homo sapiens
gcttgttatttataa

SEQ ID NO: 1204374 - DNA, 14 bp, Homo sapiens
gcttgttctctgga

SEQ ID NO: 1204375 - DNA, 16 bp, Homo sapiens
gcttgttctctggaac

SEQ ID NO: 1204376 - DNA, 13 bp, Homo sapiens
gcttgttgacatc

SEQ ID NO: 1204377 - DNA, 20 bp, Homo sapiens
gcttgttgggattcctgacc

SEQ ID NO: 1204378 - DNA, 21 bp, Homo sapiens
gcttgttgggattcctgaccc

SEQ ID NO: 1204379 - DNA, 24 bp, Homo sapiens
gcttgttgggattcctgacccagg

SEQ ID NO: 1204380 - DNA, 19 bp, Homo sapiens
gcttgtttgatttcaacat

SEQ ID NO: 1204381 - DNA, 23 bp, Homo sapiens
gcttgttttataaaattttgctt

SEQ ID NO: 1204382 - DNA, 22 bp, Homo sapiens
gcttgttttccaaagaaaagta

SEQ ID NO: 1204383 - DNA, 14 bp, Homo sapiens
gcttgttttccagt

SEQ ID NO: 1204384 - DNA, 23 bp, Homo sapiens
gcttgttttcttgccaatgaggt

SEQ ID NO: 1204385 - DNA, 13 bp, Homo sapiens
gctttaaacaaat

SEQ ID NO: 1204386 - DNA, 17 bp, Homo sapiens
gctttaaactaccctcc

SEQ ID NO: 1204387 - DNA, 18 bp, Homo sapiens
gctttaaactaccctcca

SEQ ID NO: 1204388 - DNA, 18 bp, Homo sapiens
gctttaaactcagggaca

SEQ ID NO: 1204389 - DNA, 21 bp, Homo sapiens
gctttaaactcagggacagag

SEQ ID NO: 1204390 - DNA, 22 bp, Homo sapiens
gctttaaactcagggacagagc

SEQ ID NO: 1204391 - DNA, 22 bp, Homo sapiens
gctttaaataaattaagatcct

SEQ ID NO: 1204392 - DNA, 18 bp, Homo sapiens
gctttaacttaaatagta

SEQ ID NO: 1204393 - DNA, 16 bp, Homo sapiens
gctttaagctccagct

SEQ ID NO: 1204394 - DNA, 23 bp, Homo sapiens
gctttaagctccagctttaaggg

SEQ ID NO: 1204395 - DNA, 23 bp, Homo sapiens
gctttaataaaggccacaggaga

SEQ ID NO: 1204396 - DNA, 12 bp, Homo sapiens
gctttaattgta

SEQ ID NO: 1204397 - DNA, 13 bp, Homo sapiens
gctttaattgtat

SEQ ID NO: 1204398 - DNA, 20 bp, Homo sapiens
gctttaattgtataagtcaa

SEQ ID NO: 1204399 - DNA, 21 bp, Homo sapiens
gctttaatttttttaaccaaa

SEQ ID NO: 1204400 - DNA, 19 bp, Homo sapiens
gctttacatactttatcaa

SEQ ID NO: 1204401 - DNA, 18 bp, Homo sapiens
gctttacatattcctttg

SEQ ID NO: 1204402 - DNA, 12 bp, Homo sapiens
gctttacatgca

SEQ ID NO: 1204403 - DNA, 17 bp, Homo sapiens
gctttacatgctgtgct

SEQ ID NO: 1204404 - DNA, 18 bp, Homo sapiens
gctttacctaagtgttga

SEQ ID NO: 1204405 - DNA, 21 bp, Homo sapiens
gctttaccttttcagggctgg

SEQ ID NO: 1204406 - DNA, 18 bp, Homo sapiens
gctttacgctcatcacct

SEQ ID NO: 1204407 - DNA, 20 bp, Homo sapiens
gctttactcaagcagatctc

SEQ ID NO: 1204408 - DNA, 13 bp, Homo sapiens
gctttactgcctt

SEQ ID NO: 1204409 - DNA, 17 bp, Homo sapiens
gctttactgtttctcaa

SEQ ID NO: 1204410 - DNA, 13 bp, Homo sapiens
gctttaggcagag

SEQ ID NO: 1204411 - DNA, 16 bp, Homo sapiens
gctttatactctctcc

SEQ ID NO: 1204412 - DNA, 13 bp, Homo sapiens
gctttatctttgt

SEQ ID NO: 1204413 - DNA, 14 bp, Homo sapiens
gctttatctttgtg

SEQ ID NO: 1204414 - DNA, 17 bp, Homo sapiens
gctttattccagaatgc

SEQ ID NO: 1204415 - DNA, 20 bp, Homo sapiens
gctttattgaattagaaaat

SEQ ID NO: 1204416 - DNA, 14 bp, Homo sapiens
gctttattgtgatt

SEQ ID NO: 1204417 - DNA, 13 bp, Homo sapiens
gctttatttttct

SEQ ID NO: 1204418 - DNA, 17 bp, Homo sapiens
gctttatttttcttttc

SEQ ID NO: 1204419 - DNA, 23 bp, Homo sapiens
gctttcaaaggagctcgaaggat

SEQ ID NO: 1204420 - DNA, 20 bp, Homo sapiens
gctttcaagacccctgtctt

SEQ ID NO: 1204421 - DNA, 17 bp, Homo sapiens
gctttcaaggctggggc

SEQ ID NO: 1204422 - DNA, 15 bp, Homo sapiens
gctttcaagtgcctt

SEQ ID NO: 1204423 - DNA, 14 bp, Homo sapiens
gctttcacattgta

SEQ ID NO: 1204424 - DNA, 20 bp, Homo sapiens
gctttcacggaaactcccga

SEQ ID NO: 1204425 - DNA, 14 bp, Homo sapiens
gctttcactaggaa

SEQ ID NO: 1204426 - DNA, 20 bp, Homo sapiens
gctttcataaatcatgttgt

SEQ ID NO: 1204427 - DNA, 15 bp, Homo sapiens
gctttcatcctgtgt

SEQ ID NO: 1204428 - DNA, 20 bp, Homo sapiens
gctttcatcctgtgtcccct

SEQ ID NO: 1204429 - DNA, 22 bp, Homo sapiens
gctttcatgaccactgggcctg

SEQ ID NO: 1204430 - DNA, 18 bp, Homo sapiens
gctttcatgattagcaag

SEQ ID NO: 1204431 - DNA, 20 bp, Homo sapiens
gctttccaggcaccctcagg

SEQ ID NO: 1204432 - DNA, 23 bp, Homo sapiens
gctttccaggcaccctcagggag

SEQ ID NO: 1204433 - DNA, 21 bp, Homo sapiens
ctctagacactgccacacagg

SEQ ID NO: 1204434 - DNA, 22 bp, Homo sapiens
ctctagagagagggagaaacaa

SEQ ID NO: 1204435 - DNA, 16 bp, Homo sapiens
ctctagagcagggatt

SEQ ID NO: 1204436 - DNA, 21 bp, Homo sapiens
ctctagagggttgctgccttt

SEQ ID NO: 1204437 - DNA, 17 bp, Homo sapiens
ctctagcagcacctcct

SEQ ID NO: 1204438 - DNA, 13 bp, Homo sapiens
ctctagcaggcct

SEQ ID NO: 1204439 - DNA, 20 bp, Homo sapiens
ctctagccaggagtctgtgc

SEQ ID NO: 1204440 - DNA, 23 bp, Homo sapiens
ctctagccaggagtctgtgctct

SEQ ID NO: 1204441 - DNA, 15 bp, Homo sapiens
ctctagccatccctt

SEQ ID NO: 1204442 - DNA, 19 bp, Homo sapiens
ctctagccatcccttgggg

SEQ ID NO: 1204443 - DNA, 23 bp, Homo sapiens
ctctagccatcccttggggaagg

SEQ ID NO: 1204444 - DNA, 23 bp, Homo sapiens
ctctagcccactccctgcctaca

SEQ ID NO: 1204445 - DNA, 15 bp, Homo sapiens
ctctagcctgggcca

SEQ ID NO: 1204446 - DNA, 21 bp, Homo sapiens
ctctagcctgggccagagaag

SEQ ID NO: 1204447 - DNA, 13 bp, Homo sapiens
ctctagctggcag

SEQ ID NO: 1204448 - DNA, 19 bp, Homo sapiens
ctctagctggcaggacaca

SEQ ID NO: 1204449 - DNA, 17 bp, Homo sapiens
ctctagctgttctggac

SEQ ID NO: 1204450 - DNA, 14 bp, Homo sapiens
ctctagcttttcta

SEQ ID NO: 1204451 - DNA, 21 bp, Homo sapiens
ctctaggaagacatttttccg

SEQ ID NO: 1204452 - DNA, 16 bp, Homo sapiens
ctctaggatgtatatt

SEQ ID NO: 1204453 - DNA, 16 bp, Homo sapiens
ctctaggcctctccag

SEQ ID NO: 1204454 - DNA, 17 bp, Homo sapiens
ctctaggcctctccagt

SEQ ID NO: 1204455 - DNA, 15 bp, Homo sapiens
ctctagggcagggaa

SEQ ID NO: 1204456 - DNA, 21 bp, Homo sapiens
ctctagggcagggtgggagcc

SEQ ID NO: 1204457 - DNA, 22 bp, Homo sapiens
ctctagggcagggtgggagccg

SEQ ID NO: 1204458 - DNA, 15 bp, Homo sapiens
ctctaggggcagcct

SEQ ID NO: 1204459 - DNA, 17 bp, Homo sapiens
ctctaggggcagcctcc

SEQ ID NO: 1204460 - DNA, 14 bp, Homo sapiens
ctctaggtgtttct

SEQ ID NO: 1204461 - DNA, 14 bp, Homo sapiens
ctctaggttataca

SEQ ID NO: 1204462 - DNA, 12 bp, Homo sapiens
ctctagtagtgt

SEQ ID NO: 1204463 - DNA, 18 bp, Homo sapiens
ctctagtagtgtggcctg

SEQ ID NO: 1204464 - DNA, 19 bp, Homo sapiens
ctctagtagtgtggcctgt

SEQ ID NO: 1204465 - DNA, 21 bp, Homo sapiens
ctctagtagtgtggcctgtgc

SEQ ID NO: 1204466 - DNA, 15 bp, Homo sapiens
ctctagtgacttcct

SEQ ID NO: 1204467 - DNA, 22 bp, Homo sapiens
ctctagtgacttcctggtgagg

SEQ ID NO: 1204468 - DNA, 14 bp, Homo sapiens
ctctagtgccctcc

SEQ ID NO: 1204469 - DNA, 17 bp, Homo sapiens
ctctagtgctgtgaaaa

SEQ ID NO: 1204470 - DNA, 19 bp, Homo sapiens
ctctagtgctgtgaaaaaa

SEQ ID NO: 1204471 - DNA, 13 bp, Homo sapiens
ctctagtgggaca

SEQ ID NO: 1204472 - DNA, 20 bp, Homo sapiens
ctctagtgggacagcccaga

SEQ ID NO: 1204473 - DNA, 22 bp, Homo sapiens
ctctagtgggacagcccagagc

SEQ ID NO: 1204474 - DNA, 23 bp, Homo sapiens
ctctagtgggacagcccagagcc

SEQ ID NO: 1204475 - DNA, 22 bp, Homo sapiens
ctctagtgtagctgccacattg

SEQ ID NO: 1204476 - DNA, 22 bp, Homo sapiens
ctctagttctgttgttttgtgt

SEQ ID NO: 1204477 - DNA, 18 bp, Homo sapiens
ctctagttctttgttcat

SEQ ID NO: 1204478 - DNA, 19 bp, Homo sapiens
ctctagtttgattaaattc

SEQ ID NO: 1204479 - DNA, 21 bp, Homo sapiens
ctctagtttgattaaattctt

SEQ ID NO: 1204480 - DNA, 15 bp, Homo sapiens
ctctatacatctctc

SEQ ID NO: 1204481 - DNA, 15 bp, Homo sapiens
ctctatattatgtct

SEQ ID NO: 1204482 - DNA, 16 bp, Homo sapiens
ctctatattatgtctt

SEQ ID NO: 1204483 - DNA, 21 bp, Homo sapiens
ctctatattatgtcttctttt

SEQ ID NO: 1204484 - DNA, 11 bp, Homo sapiens
ctctatattta

SEQ ID NO: 1204485 - DNA, 21 bp, Homo sapiens
ctctatccccatccaggtctt

SEQ ID NO: 1204486 - DNA, 17 bp, Homo sapiens
ctctatgccctgcagag

SEQ ID NO: 1204487 - DNA, 21 bp, Homo sapiens
ctctatgccctgcagagcaat

SEQ ID NO: 1204488 - DNA, 16 bp, Homo sapiens
ctctatgcctgcactg

SEQ ID NO: 1204489 - DNA, 18 bp, Homo sapiens
ctctatgcctgcactggg

SEQ ID NO: 1204490 - DNA, 19 bp, Homo sapiens
ctctatgcctgcactggga

SEQ ID NO: 1204491 - DNA, 23 bp, Homo sapiens
ctctatgctggcttttcacccca

SEQ ID NO: 1204492 - DNA, 15 bp, Homo sapiens
ctctatgtctgcctt

SEQ ID NO: 1204493 - DNA, 16 bp, Homo sapiens
ctctatgtctgccttc

SEQ ID NO: 1204494 - DNA, 22 bp, Homo sapiens
ctctattaatgaggtctttaaa

SEQ ID NO: 1204495 - DNA, 13 bp, Homo sapiens
ctctattctttaa

SEQ ID NO: 1204496 - DNA, 20 bp, Homo sapiens
ctctattgtagcatttcttg

SEQ ID NO: 1204497 - DNA, 12 bp, Homo sapiens
ctctatttaata

SEQ ID NO: 1204498 - DNA, 14 bp, Homo sapiens
ctctatttaatatt

SEQ ID NO: 1204499 - DNA, 16 bp, Homo sapiens
ctctatttaatattta

SEQ ID NO: 1204500 - DNA, 16 bp, Homo sapiens
ctctatttatgtttgc

SEQ ID NO: 1204501 - DNA, 17 bp, Homo sapiens
ctctatttgaattattt

SEQ ID NO: 1204502 - DNA, 23 bp, Homo sapiens
ctctattttaatgtatatttgct

SEQ ID NO: 1204503 - DNA, 15 bp, Homo sapiens
ctctattttgtgatg

SEQ ID NO: 1204504 - DNA, 17 bp, Homo sapiens
ctctcaaaagtctattt

SEQ ID NO: 1204505 - DNA, 18 bp, Homo sapiens
ctctcaaaagtctatttt

SEQ ID NO: 1204506 - DNA, 17 bp, Homo sapiens
ctctcaactgcctcagc

SEQ ID NO: 1204507 - DNA, 15 bp, Homo sapiens
ctctcaagaccagag

SEQ ID NO: 1204508 - DNA, 14 bp, Homo sapiens
ctctcaagtaatat

SEQ ID NO: 1204509 - DNA, 18 bp, Homo sapiens
ctctcaagtgatgagaca

SEQ ID NO: 1204510 - DNA, 20 bp, Homo sapiens
ctctcacactggttctcaat

SEQ ID NO: 1204511 - DNA, 22 bp, Homo sapiens
ctctcacactggttctcaatga

SEQ ID NO: 1204512 - DNA, 22 bp, Homo sapiens
ctctcaccatgatgtgaagagt

SEQ ID NO: 1204513 - DNA, 14 bp, Homo sapiens
ctctcacccaccag

SEQ ID NO: 1204514 - DNA, 19 bp, Homo sapiens
ctctcacccaccagctcca

SEQ ID NO: 1204515 - DNA, 16 bp, Homo sapiens
ctctcacccagcctgg

SEQ ID NO: 1204516 - DNA, 14 bp, Homo sapiens
ctctcacctggccc

SEQ ID NO: 1204517 - DNA, 16 bp, Homo sapiens
ctctcacgccaccccc

SEQ ID NO: 1204518 - DNA, 19 bp, Homo sapiens
ctctcacgggccctgcccc

SEQ ID NO: 1204519 - DNA, 19 bp, Homo sapiens
ctctcactccagccaaaga

SEQ ID NO: 1204520 - DNA, 14 bp, Homo sapiens
ctctcactccccat

SEQ ID NO: 1204521 - DNA, 13 bp, Homo sapiens
ctctcagaacata

SEQ ID NO: 1204522 - DNA, 14 bp, Homo sapiens
ctctcagagcagca

SEQ ID NO: 1204523 - DNA, 16 bp, Homo sapiens
ctctcagatacccagt

SEQ ID NO: 1204524 - DNA, 15 bp, Homo sapiens
ctctcagcatagcct

SEQ ID NO: 1204525 - DNA, 20 bp, Homo sapiens
ctctcagcatagcctgcctg

SEQ ID NO: 1204526 - DNA, 22 bp, Homo sapiens
ctctcagcatagcctgcctgat

SEQ ID NO: 1204527 - DNA, 23 bp, Homo sapiens
ctctcagccaacgagtaatttat

SEQ ID NO: 1204528 - DNA, 19 bp, Homo sapiens
ctctcagccacctgttact

SEQ ID NO: 1204529 - DNA, 15 bp, Homo sapiens
ctctcagcctcccac

SEQ ID NO: 1204530 - DNA, 16 bp, Homo sapiens
ctctcagctcagcgcc

SEQ ID NO: 1204531 - DNA, 15 bp, Homo sapiens
ctctcagctccaggt

SEQ ID NO: 1204532 - DNA, 17 bp, Homo sapiens
ctctcaggaccaaagct

SEQ ID NO: 1204533 - DNA, 17 bp, Homo sapiens
ctctcaggagcacaggc

SEQ ID NO: 1204534 - DNA, 18 bp, Homo sapiens
ctctcaggagcacaggca

SEQ ID NO: 1204535 - DNA, 16 bp, Homo sapiens
ctctcaggagtatctt

SEQ ID NO: 1204536 - DNA, 14 bp, Homo sapiens
ctctcaggatcaag

SEQ ID NO: 1204537 - DNA, 14 bp, Homo sapiens
ctctcaggattgct

SEQ ID NO: 1204538 - DNA, 18 bp, Homo sapiens
ctctcaggcatgcctgtg

SEQ ID NO: 1204539 - DNA, 21 bp, Homo sapiens
ctctcaggcatgcctgtgtga

SEQ ID NO: 1204540 - DNA, 15 bp, Homo sapiens
ctctcaggggccagt

SEQ ID NO: 1204541 - DNA, 18 bp, Homo sapiens
ctctcaggggccagtgag

SEQ ID NO: 1204542 - DNA, 20 bp, Homo sapiens
ctctcaggggccagtgaggg

SEQ ID NO: 1204543 - DNA, 15 bp, Homo sapiens
ctctcagtctctgag

SEQ ID NO: 1204544 - DNA, 16 bp, Homo sapiens
ctctcagtctctgagc

SEQ ID NO: 1204545 - DNA, 18 bp, Homo sapiens
ctctcagtctctgagcag

SEQ ID NO: 1204546 - DNA, 12 bp, Homo sapiens
ctctcagtgttt

SEQ ID NO: 1204547 - DNA, 22 bp, Homo sapiens
ctctcagtgttttggactccat

SEQ ID NO: 1204548 - DNA, 18 bp, Homo sapiens
ctctcagttaaaatgtga

SEQ ID NO: 1204549 - DNA, 15 bp, Homo sapiens
ctctcagttctctcc

SEQ ID NO: 1204550 - DNA, 16 bp, Homo sapiens
ctctcatcaactgaat

SEQ ID NO: 1204551 - DNA, 23 bp, Homo sapiens
ctctcatcatttgcattgggcat

SEQ ID NO: 1204552 - DNA, 12 bp, Homo sapiens
ctctcatccccc

SEQ ID NO: 1204553 - DNA, 14 bp, Homo sapiens
ctctcatcttgttc

SEQ ID NO: 1204554 - DNA, 13 bp, Homo sapiens
ctctcatgcgtgt

SEQ ID NO: 1204555 - DNA, 18 bp, Homo sapiens
ctctcatgtccccttcct

SEQ ID NO: 1204556 - DNA, 15 bp, Homo sapiens
ctctcatgtccctcc

SEQ ID NO: 1204557 - DNA, 21 bp, Homo sapiens
gctttcccatatcttgccttc

SEQ ID NO: 1204558 - DNA, 14 bp, Homo sapiens
gctttcccctgtgg

SEQ ID NO: 1204559 - DNA, 15 bp, Homo sapiens
gctttcccctgtggg

SEQ ID NO: 1204560 - DNA, 16 bp, Homo sapiens
gctttcccctgtgggg

SEQ ID NO: 1204561 - DNA, 15 bp, Homo sapiens
gctttccctgaggaa

SEQ ID NO: 1204562 - DNA, 11 bp, Homo sapiens
gctttcctccg

SEQ ID NO: 1204563 - DNA, 11 bp, Homo sapiens
gctttcctgcc

SEQ ID NO: 1204564 - DNA, 12 bp, Homo sapiens
gctttcctgccc

SEQ ID NO: 1204565 - DNA, 19 bp, Homo sapiens
gctttcctgccccaggcct

SEQ ID NO: 1204566 - DNA, 16 bp, Homo sapiens
gctttccttttctctg

SEQ ID NO: 1204567 - DNA, 19 bp, Homo sapiens
gctttcgtctccagcccct

SEQ ID NO: 1204568 - DNA, 18 bp, Homo sapiens
gctttctatgctgtttgt

SEQ ID NO: 1204569 - DNA, 15 bp, Homo sapiens
gctttctccggggtc

SEQ ID NO: 1204570 - DNA, 21 bp, Homo sapiens
gctttctccggggtctgtgct

SEQ ID NO: 1204571 - DNA, 17 bp, Homo sapiens
gctttctcctctgctat

SEQ ID NO: 1204572 - DNA, 12 bp, Homo sapiens
gctttctcctgg

SEQ ID NO: 1204573 - DNA, 16 bp, Homo sapiens
gctttctcctgtgccc

SEQ ID NO: 1204574 - DNA, 19 bp, Homo sapiens
gctttctcgcgccctcccc

SEQ ID NO: 1204575 - DNA, 19 bp, Homo sapiens
gctttctgaagctttacca

SEQ ID NO: 1204576 - DNA, 14 bp, Homo sapiens
gctttctgggatgt

SEQ ID NO: 1204577 - DNA, 22 bp, Homo sapiens
gctttctgggatgtcacagtcc

SEQ ID NO: 1204578 - DNA, 23 bp, Homo sapiens
gctttctggggcctagcgatctc

SEQ ID NO: 1204579 - DNA, 12 bp, Homo sapiens
gctttctgttcc

SEQ ID NO: 1204580 - DNA, 15 bp, Homo sapiens
gctttctgttccaaa

SEQ ID NO: 1204581 - DNA, 16 bp, Homo sapiens
gctttctgttgtcatt

SEQ ID NO: 1204582 - DNA, 23 bp, Homo sapiens
gctttctgttgtcattgctgttg

SEQ ID NO: 1204583 - DNA, 13 bp, Homo sapiens
gctttcttctttc

SEQ ID NO: 1204584 - DNA, 15 bp, Homo sapiens
gctttcttctttcct

SEQ ID NO: 1204585 - DNA, 13 bp, Homo sapiens
gctttcttgctgg

SEQ ID NO: 1204586 - DNA, 14 bp, Homo sapiens
gctttcttgctggt

SEQ ID NO: 1204587 - DNA, 21 bp, Homo sapiens
gctttctttggcctacattct

SEQ ID NO: 1204588 - DNA, 17 bp, Homo sapiens
gctttgaataaatgtgt

SEQ ID NO: 1204589 - DNA, 20 bp, Homo sapiens
gctttgacgtattatctgtt

SEQ ID NO: 1204590 - DNA, 14 bp, Homo sapiens
gctttgactcacct

SEQ ID NO: 1204591 - DNA, 17 bp, Homo sapiens
gctttgaggctctgtca

SEQ ID NO: 1204592 - DNA, 15 bp, Homo sapiens
gctttgattcatagt

SEQ ID NO: 1204593 - DNA, 12 bp, Homo sapiens
gctttgcaaaga

SEQ ID NO: 1204594 - DNA, 19 bp, Homo sapiens
gctttgcaggctctgggct

SEQ ID NO: 1204595 - DNA, 13 bp, Homo sapiens
gctttgccagagc

SEQ ID NO: 1204596 - DNA, 16 bp, Homo sapiens
gctttgccagagcagg

SEQ ID NO: 1204597 - DNA, 21 bp, Homo sapiens
gctttgccatgggcctgctgc

SEQ ID NO: 1204598 - DNA, 16 bp, Homo sapiens
gctttgccattgtgaa

SEQ ID NO: 1204599 - DNA, 13 bp, Homo sapiens
gctttgccttcca

SEQ ID NO: 1204600 - DNA, 22 bp, Homo sapiens
gctttgctacaaatttatgcat

SEQ ID NO: 1204601 - DNA, 16 bp, Homo sapiens
gctttgctaccaaagc

SEQ ID NO: 1204602 - DNA, 18 bp, Homo sapiens
gctttgctccgctcccac

SEQ ID NO: 1204603 - DNA, 23 bp, Homo sapiens
gctttgctccgctcccaccgccc

SEQ ID NO: 1204604 - DNA, 19 bp, Homo sapiens
gctttgctgcacagcagga

SEQ ID NO: 1204605 - DNA, 21 bp, Homo sapiens
gctttgctgcacagcaggacc

SEQ ID NO: 1204606 - DNA, 13 bp, Homo sapiens
gctttgctgctat

SEQ ID NO: 1204607 - DNA, 15 bp, Homo sapiens
gctttgctgctatga

SEQ ID NO: 1204608 - DNA, 12 bp, Homo sapiens
gctttgctgctg

SEQ ID NO: 1204609 - DNA, 19 bp, Homo sapiens
gctttgctttctgctcagc

SEQ ID NO: 1204610 - DNA, 17 bp, Homo sapiens
gctttgggaggccaagg

SEQ ID NO: 1204611 - DNA, 18 bp, Homo sapiens
gctttgggcagttggcca

SEQ ID NO: 1204612 - DNA, 16 bp, Homo sapiens
gctttgggcccaagaa

SEQ ID NO: 1204613 - DNA, 22 bp, Homo sapiens
gctttgggctttgcaggctctg

SEQ ID NO: 1204614 - DNA, 19 bp, Homo sapiens
gctttggggacagttggca

SEQ ID NO: 1204615 - DNA, 18 bp, Homo sapiens
gctttggggacttccgct

SEQ ID NO: 1204616 - DNA, 23 bp, Homo sapiens
gctttgggggagtgggcgcagtg

SEQ ID NO: 1204617 - DNA, 17 bp, Homo sapiens
gctttggttaaaaatgg

SEQ ID NO: 1204618 - DNA, 16 bp, Homo sapiens
gctttgtaggtgtctc

SEQ ID NO: 1204619 - DNA, 15 bp, Homo sapiens
gctttgtatgcactt

SEQ ID NO: 1204620 - DNA, 16 bp, Homo sapiens
gctttgtctggcctca

SEQ ID NO: 1204621 - DNA, 15 bp, Homo sapiens
gctttgtgatttttg

SEQ ID NO: 1204622 - DNA, 20 bp, Homo sapiens
gctttgtgcttggggctatt

SEQ ID NO: 1204623 - DNA, 15 bp, Homo sapiens
gctttgtgtgattga

SEQ ID NO: 1204624 - DNA, 17 bp, Homo sapiens
gctttgtgtttactttt

SEQ ID NO: 1204625 - DNA, 19 bp, Homo sapiens
gctttgtgtttactttttg

SEQ ID NO: 1204626 - DNA, 13 bp, Homo sapiens
gctttgttgctgg

SEQ ID NO: 1204627 - DNA, 23 bp, Homo sapiens
gctttgttttgcacactttgcca

SEQ ID NO: 1204628 - DNA, 15 bp, Homo sapiens
gcttttaaaaaatat

SEQ ID NO: 1204629 - DNA, 17 bp, Homo sapiens
gcttttaagaaaaacaa

SEQ ID NO: 1204630 - DNA, 19 bp, Homo sapiens
gcttttaagaaaaacaaag

SEQ ID NO: 1204631 - DNA, 15 bp, Homo sapiens
gcttttaagaaacac

SEQ ID NO: 1204632 - DNA, 20 bp, Homo sapiens
gcttttaatgaaaaggaatc

SEQ ID NO: 1204633 - DNA, 19 bp, Homo sapiens
gcttttaattctcatttgt

SEQ ID NO: 1204634 - DNA, 20 bp, Homo sapiens
gcttttaccatgcccctgag

SEQ ID NO: 1204635 - DNA, 13 bp, Homo sapiens
gcttttactttat

SEQ ID NO: 1204636 - DNA, 12 bp, Homo sapiens
gcttttagaaaa

SEQ ID NO: 1204637 - DNA, 19 bp, Homo sapiens
gcttttagaaggtaatttg

SEQ ID NO: 1204638 - DNA, 16 bp, Homo sapiens
gcttttatagaggcta

SEQ ID NO: 1204639 - DNA, 19 bp, Homo sapiens
gcttttatatatgaagttg

SEQ ID NO: 1204640 - DNA, 16 bp, Homo sapiens
gcttttatatggccca

SEQ ID NO: 1204641 - DNA, 17 bp, Homo sapiens
gcttttattaaatttgt

SEQ ID NO: 1204642 - DNA, 22 bp, Homo sapiens
gcttttattaatgcactttcta

SEQ ID NO: 1204643 - DNA, 18 bp, Homo sapiens
gcttttattcgtcctttg

SEQ ID NO: 1204644 - DNA, 23 bp, Homo sapiens
gcttttattcgtcctttgacaaa

SEQ ID NO: 1204645 - DNA, 13 bp, Homo sapiens
gcttttcaaacaa

SEQ ID NO: 1204646 - DNA, 14 bp, Homo sapiens
gcttttcaaacaaa

SEQ ID NO: 1204647 - DNA, 13 bp, Homo sapiens
gcttttcactgct

SEQ ID NO: 1204648 - DNA, 14 bp, Homo sapiens
gcttttcactgctg

SEQ ID NO: 1204649 - DNA, 18 bp, Homo sapiens
gcttttcactgctggctg

SEQ ID NO: 1204650 - DNA, 20 bp, Homo sapiens
gcttttcactttctgtctag

SEQ ID NO: 1204651 - DNA, 16 bp, Homo sapiens
gcttttcatggaagtg

SEQ ID NO: 1204652 - DNA, 15 bp, Homo sapiens
gcttttccaggatcc

SEQ ID NO: 1204653 - DNA, 14 bp, Homo sapiens
gcttttcccaggag

SEQ ID NO: 1204654 - DNA, 17 bp, Homo sapiens
gcttttccctcttttct

SEQ ID NO: 1204655 - DNA, 12 bp, Homo sapiens
gcttttccttga

SEQ ID NO: 1204656 - DNA, 18 bp, Homo sapiens
gcttttctgccctggctg

SEQ ID NO: 1204657 - DNA, 19 bp, Homo sapiens
gcttttctgccctggctgc

SEQ ID NO: 1204658 - DNA, 22 bp, Homo sapiens
gcttttctgccctggctgctgc

SEQ ID NO: 1204659 - DNA, 14 bp, Homo sapiens
gcttttctgtattt

SEQ ID NO: 1204660 - DNA, 16 bp, Homo sapiens
gcttttctgtcctggg

SEQ ID NO: 1204661 - DNA, 18 bp, Homo sapiens
gcttttctgtctctgcct

SEQ ID NO: 1204662 - DNA, 18 bp, Homo sapiens
gcttttgaaaactgctga

SEQ ID NO: 1204663 - DNA, 14 bp, Homo sapiens
gcttttgaattgca

SEQ ID NO: 1204664 - DNA, 16 bp, Homo sapiens
gcttttgagtgggccc

SEQ ID NO: 1204665 - DNA, 19 bp, Homo sapiens
gcttttgagtgggccctgc

SEQ ID NO: 1204666 - DNA, 13 bp, Homo sapiens
gcttttgcatttc

SEQ ID NO: 1204667 - DNA, 13 bp, Homo sapiens
gcttttgccatta

SEQ ID NO: 1204668 - DNA, 14 bp, Homo sapiens
gcttttgcctctgc

SEQ ID NO: 1204669 - DNA, 23 bp, Homo sapiens
gcttttgcggttcaggaaaattg

SEQ ID NO: 1204670 - DNA, 12 bp, Homo sapiens
gcttttgctgct

SEQ ID NO: 1204671 - DNA, 15 bp, Homo sapiens
gcttttgctgctgct

SEQ ID NO: 1204672 - DNA, 18 bp, Homo sapiens
gcttttgctgctgcttaa

SEQ ID NO: 1204673 - DNA, 21 bp, Homo sapiens
gcttttgtctaattaaaacac

SEQ ID NO: 1204674 - DNA, 13 bp, Homo sapiens
gcttttgtgcatt

SEQ ID NO: 1204675 - DNA, 19 bp, Homo sapiens
gcttttgtgcattatctag

SEQ ID NO: 1204676 - DNA, 13 bp, Homo sapiens
gcttttgttctag

SEQ ID NO: 1204677 - DNA, 14 bp, Homo sapiens
gcttttgttctaga

SEQ ID NO: 1204678 - DNA, 15 bp, Homo sapiens
gcttttgttgtgact

SEQ ID NO: 1204679 - DNA, 14 bp, Homo sapiens
gcttttgttttttt

SEQ ID NO: 1204680 - DNA, 23 bp, Homo sapiens
gctttttaaaatatatgtattta

SEQ ID NO: 1204681 - DNA, 16 bp, Homo sapiens
gctttttaatagcact

SEQ ID NO: 1204682 - DNA, 14 bp, Homo sapiens
gctttttattattt

SEQ ID NO: 1204683 - DNA, 19 bp, Homo sapiens
gcgtgaaacacaccaggct

SEQ ID NO: 1204684 - DNA, 20 bp, Homo sapiens
gcgtgaaacacaccaggctg

SEQ ID NO: 1204685 - DNA, 20 bp, Homo sapiens
gcgtgaacccaggaggcgga

SEQ ID NO: 1204686 - DNA, 12 bp, Homo sapiens
gcgtgaatctgt

SEQ ID NO: 1204687 - DNA, 13 bp, Homo sapiens
gcgtgacaataaa

SEQ ID NO: 1204688 - DNA, 22 bp, Homo sapiens
gcgtgacccgtccattcttcag

SEQ ID NO: 1204689 - DNA, 13 bp, Homo sapiens
gcgtgactcaccc

SEQ ID NO: 1204690 - DNA, 16 bp, Homo sapiens
gcgtgagacccagtgc

SEQ ID NO: 1204691 - DNA, 14 bp, Homo sapiens
gcgtgagccactgc

SEQ ID NO: 1204692 - DNA, 12 bp, Homo sapiens
gcgtgagcttaa

SEQ ID NO: 1204693 - DNA, 17 bp, Homo sapiens
gcgtgagtgtgtgagcg

SEQ ID NO: 1204694 - DNA, 14 bp, Homo sapiens
gctaatatactttt

SEQ ID NO: 1204695 - DNA, 20 bp, Homo sapiens
gctaatatcaatagaaggat

SEQ ID NO: 1204696 - DNA, 18 bp, Homo sapiens
gctaatcaaagccagggt

SEQ ID NO: 1204697 - DNA, 19 bp, Homo sapiens
gctaatcaaagccagggtc

SEQ ID NO: 1204698 - DNA, 14 bp, Homo sapiens
gctaatcagcattc

SEQ ID NO: 1204699 - DNA, 20 bp, Homo sapiens
gctaatctgtagggctggac

SEQ ID NO: 1204700 - DNA, 21 bp, Homo sapiens
gctaatctgtagggctggacc

SEQ ID NO: 1204701 - DNA, 22 bp, Homo sapiens
gctaatctgtagggctggacct

SEQ ID NO: 1204702 - DNA, 12 bp, Homo sapiens
gctaatgttgat

SEQ ID NO: 1204703 - DNA, 11 bp, Homo sapiens
gctaatgtttg

SEQ ID NO: 1204704 - DNA, 21 bp, Homo sapiens
gctaattagaaatcaacttgt

SEQ ID NO: 1204705 - DNA, 16 bp, Homo sapiens
gctaattataattcag

SEQ ID NO: 1204706 - DNA, 20 bp, Homo sapiens
gctaattcccagagtgtgaa

SEQ ID NO: 1204707 - DNA, 12 bp, Homo sapiens
gctaattgagac

SEQ ID NO: 1204708 - DNA, 21 bp, Homo sapiens
gctaattgtactaatctgaga

SEQ ID NO: 1204709 - DNA, 20 bp, Homo sapiens
gctaatttatcctgaaattt

SEQ ID NO: 1204710 - DNA, 16 bp, Homo sapiens
gctaatttttgtatgt

SEQ ID NO: 1204711 - DNA, 20 bp, Homo sapiens
gctaattttttgttgtttct

SEQ ID NO: 1204712 - DNA, 14 bp, Homo sapiens
gctacaaaaattga

SEQ ID NO: 1204713 - DNA, 20 bp, Homo sapiens
gctacaaatactcttaggaa

SEQ ID NO: 1204714 - DNA, 20 bp, Homo sapiens
gctacaaatttatgcatttc

SEQ ID NO: 1204715 - DNA, 15 bp, Homo sapiens
gctacaagtgtttta

SEQ ID NO: 1204716 - DNA, 19 bp, Homo sapiens
gctacaatcttcatttaat

SEQ ID NO: 1204717 - DNA, 18 bp, Homo sapiens
gctacaatttgtttttgc

SEQ ID NO: 1204718 - DNA, 20 bp, Homo sapiens
gctacaattttctcccagga

SEQ ID NO: 1204719 - DNA, 21 bp, Homo sapiens
gctacaattttctcccaggaa

SEQ ID NO: 1204720 - DNA, 19 bp, Homo sapiens
gctacacccttttccagct

SEQ ID NO: 1204721 - DNA, 12 bp, Homo sapiens
gctacactgagc

SEQ ID NO: 1204722 - DNA, 18 bp, Homo sapiens
gctacactgagcagggag

SEQ ID NO: 1204723 - DNA, 22 bp, Homo sapiens
gctacaggaagcaccccatgcc

SEQ ID NO: 1204724 - DNA, 23 bp, Homo sapiens
gctacaggaagcaccccatgcca

SEQ ID NO: 1204725 - DNA, 16 bp, Homo sapiens
gctacaggttgtgaaa

SEQ ID NO: 1204726 - DNA, 20 bp, Homo sapiens
gctacagttttgtgaatctt

SEQ ID NO: 1204727 - DNA, 16 bp, Homo sapiens
gctacatcagactcta

SEQ ID NO: 1204728 - DNA, 22 bp, Homo sapiens
gctacatcagactctagaaaaa

SEQ ID NO: 1204729 - DNA, 18 bp, Homo sapiens
gctacattcacacactca

SEQ ID NO: 1204730 - DNA, 15 bp, Homo sapiens
gctacattcctcagc

SEQ ID NO: 1204731 - DNA, 19 bp, Homo sapiens
gctacattcctcagctgcc

SEQ ID NO: 1204732 - DNA, 20 bp, Homo sapiens
gctaccaaagcaccttagct

SEQ ID NO: 1204733 - DNA, 18 bp, Homo sapiens
gctaccaacggccaggaa

SEQ ID NO: 1204734 - DNA, 16 bp, Homo sapiens
gctaccagagctctat

SEQ ID NO: 1204735 - DNA, 23 bp, Homo sapiens
gctaccagcgccaaatgttcatc

SEQ ID NO: 1204736 - DNA, 13 bp, Homo sapiens
gctaccaggaaag

SEQ ID NO: 1204737 - DNA, 18 bp, Homo sapiens
gctaccagtatttagaag

SEQ ID NO: 1204738 - DNA, 19 bp, Homo sapiens
gctaccagtatttagaagc

SEQ ID NO: 1204739 - DNA, 20 bp, Homo sapiens
gctacccctcgactcagcac

SEQ ID NO: 1204740 - DNA, 21 bp, Homo sapiens
gctaccccttctttgcagggc

SEQ ID NO: 1204741 - DNA, 17 bp, Homo sapiens
gctaccccttgtgggca

SEQ ID NO: 1204742 - DNA, 22 bp, Homo sapiens
gctaccctaaagggagaaggaa

SEQ ID NO: 1204743 - DNA, 12 bp, Homo sapiens
gctaccctgagc

SEQ ID NO: 1204744 - DNA, 19 bp, Homo sapiens
gctaccctgagctgaggca

SEQ ID NO: 1204745 - DNA, 20 bp, Homo sapiens
gctaccctgagctgaggcag

SEQ ID NO: 1204746 - DNA, 18 bp, Homo sapiens
gctaccctttttctccag

SEQ ID NO: 1204747 - DNA, 21 bp, Homo sapiens
gctaccctttttctccagctg

SEQ ID NO: 1204748 - DNA, 16 bp, Homo sapiens
gctaccgccctgggct

SEQ ID NO: 1204749 - DNA, 12 bp, Homo sapiens
gctacctccctc

SEQ ID NO: 1204750 - DNA, 14 bp, Homo sapiens
gctacctctctgtc

SEQ ID NO: 1204751 - DNA, 16 bp, Homo sapiens
gctacctctctgtccc

SEQ ID NO: 1204752 - DNA, 15 bp, Homo sapiens
gctacgaatcttccg

SEQ ID NO: 1204753 - DNA, 12 bp, Homo sapiens
gctacgcctctt

SEQ ID NO: 1204754 - DNA, 15 bp, Homo sapiens
gctacgcctcttctg

SEQ ID NO: 1204755 - DNA, 17 bp, Homo sapiens
gctacgcctcttctgtc

SEQ ID NO: 1204756 - DNA, 20 bp, Homo sapiens
gctacggggaaaatgcattt

SEQ ID NO: 1204757 - DNA, 16 bp, Homo sapiens
gctacgttagcagccc

SEQ ID NO: 1204758 - DNA, 16 bp, Homo sapiens
gctactaacgataaaa

SEQ ID NO: 1204759 - DNA, 22 bp, Homo sapiens
gctactatgatttaatttgaaa

SEQ ID NO: 1204760 - DNA, 17 bp, Homo sapiens
gctactcaagaggctga

SEQ ID NO: 1204761 - DNA, 20 bp, Homo sapiens
gctactcaagaggctgaggc

SEQ ID NO: 1204762 - DNA, 21 bp, Homo sapiens
gctactcaagaggctgaggca

SEQ ID NO: 1204763 - DNA, 23 bp, Homo sapiens
gctactcagaaatggacaaagaa

SEQ ID NO: 1204764 - DNA, 14 bp, Homo sapiens
gctactcagaagcc

SEQ ID NO: 1204765 - DNA, 17 bp, Homo sapiens
gctactcagaagcctga

SEQ ID NO: 1204766 - DNA, 18 bp, Homo sapiens
gctactcagaagcctgag

SEQ ID NO: 1204767 - DNA, 17 bp, Homo sapiens
gctactcagcagccctc

SEQ ID NO: 1204768 - DNA, 18 bp, Homo sapiens
gctactcagcagccctcc

SEQ ID NO: 1204769 - DNA, 24 bp, Homo sapiens
gctactcagcagccctcctcaccc

SEQ ID NO: 1204770 - DNA, 16 bp, Homo sapiens
gctactcaggaggctg

SEQ ID NO: 1204771 - DNA, 22 bp, Homo sapiens
gctactcaggaggctgaggcag

SEQ ID NO: 1204772 - DNA, 23 bp, Homo sapiens
gctactcaggaggctgaggcagg

SEQ ID NO: 1204773 - DNA, 14 bp, Homo sapiens
gctactcctgtgct

SEQ ID NO: 1204774 - DNA, 23 bp, Homo sapiens
gctactcgggaggctgaggcagg

SEQ ID NO: 1204775 - DNA, 16 bp, Homo sapiens
gctactctagttctgt

SEQ ID NO: 1204776 - DNA, 22 bp, Homo sapiens
gctactctccccacgagggctg

SEQ ID NO: 1204777 - DNA, 23 bp, Homo sapiens
gctactctccccacgagggctgg

SEQ ID NO: 1204778 - DNA, 14 bp, Homo sapiens
gctactctgtccag

SEQ ID NO: 1204779 - DNA, 15 bp, Homo sapiens
gctactctgtccagg

SEQ ID NO: 1204780 - DNA, 20 bp, Homo sapiens
gctactctgtccaggccact

SEQ ID NO: 1204781 - DNA, 18 bp, Homo sapiens
gctactctgttccttcac

SEQ ID NO: 1204782 - DNA, 17 bp, Homo sapiens
gctactgaaccagccac

SEQ ID NO: 1204783 - DNA, 18 bp, Homo sapiens
gctactgcactccagcct

SEQ ID NO: 1204784 - DNA, 14 bp, Homo sapiens
gctactgccactgt

SEQ ID NO: 1204785 - DNA, 15 bp, Homo sapiens
gctactgccactgtg

SEQ ID NO: 1204786 - DNA, 23 bp, Homo sapiens
gctactgcccctctccgaaagaa

SEQ ID NO: 1204787 - DNA, 14 bp, Homo sapiens
gctactggaaatat

SEQ ID NO: 1204788 - DNA, 13 bp, Homo sapiens
gctactggcagct

SEQ ID NO: 1204789 - DNA, 15 bp, Homo sapiens
gctactggcagctcc

SEQ ID NO: 1204790 - DNA, 16 bp, Homo sapiens
gctactggcagctcct

SEQ ID NO: 1204791 - DNA, 18 bp, Homo sapiens
gctactgtgtgtgtgaat

SEQ ID NO: 1204792 - DNA, 21 bp, Homo sapiens
gctacttaattcctttctcat

SEQ ID NO: 1204793 - DNA, 14 bp, Homo sapiens
gctacttatcattt

SEQ ID NO: 1204794 - DNA, 18 bp, Homo sapiens
gctacttatcatttttgt

SEQ ID NO: 1204795 - DNA, 23 bp, Homo sapiens
gctacttgggagcctgaggcagg

SEQ ID NO: 1204796 - DNA, 23 bp, Homo sapiens
gctactttgctgctatggttttc

SEQ ID NO: 1204797 - DNA, 14 bp, Homo sapiens
gctagaacatggtt

SEQ ID NO: 1204798 - DNA, 15 bp, Homo sapiens
gctagaaggccacat

SEQ ID NO: 1204799 - DNA, 21 bp, Homo sapiens
gctagaagtgggccaggacag

SEQ ID NO: 1204800 - DNA, 21 bp, Homo sapiens
gctagaattgagtgtttaaag

SEQ ID NO: 1204801 - DNA, 22 bp, Homo sapiens
gctagacacatgaaggtaaata

SEQ ID NO: 1204802 - DNA, 19 bp, Homo sapiens
gctagacagaaaccaagcc

SEQ ID NO: 1204803 - DNA, 20 bp, Homo sapiens
gctagagcaacccctgtacc

SEQ ID NO: 1204804 - DNA, 17 bp, Homo sapiens
gctagaggattagtaag

SEQ ID NO: 1204805 - DNA, 19 bp, Homo sapiens
gctagaggccagccccacc

SEQ ID NO: 1204806 - DNA, 18 bp, Homo sapiens
gctagaggttcaaagata

SEQ ID NO: 1204807 - DNA, 19 bp, Homo sapiens
gctagaggttcaaagatat

SEQ ID NO: 1204808 - DNA, 13 bp, Homo sapiens
gctagagtcctca

SEQ ID NO: 1204809 - DNA, 18 bp, Homo sapiens
gctagatggaatggaaaa

SEQ ID NO: 1204810 - DNA, 14 bp, Homo sapiens
gctagcagcccttg

SEQ ID NO: 1204811 - DNA, 12 bp, Homo sapiens
gctagccagagg

SEQ ID NO: 1204812 - DNA, 13 bp, Homo sapiens
gctagccagaggg

SEQ ID NO: 1204813 - DNA, 21 bp, Homo sapiens
ctcagagctctcgaggaaagt

SEQ ID NO: 1204814 - DNA, 17 bp, Homo sapiens
ctcagagcttgaagatt

SEQ ID NO: 1204815 - DNA, 17 bp, Homo sapiens
gctagcctccagctttg

SEQ ID NO: 1204816 - DNA, 13 bp, Homo sapiens
gctagcctttctt

SEQ ID NO: 1204817 - DNA, 15 bp, Homo sapiens
gctagcgcaccgccg

SEQ ID NO: 1204818 - DNA, 15 bp, Homo sapiens
gctagctagccagcc

SEQ ID NO: 1204819 - DNA, 16 bp, Homo sapiens
gctagctagccagcca

SEQ ID NO: 1204820 - DNA, 13 bp, Homo sapiens
gctagctgtagaa

SEQ ID NO: 1204821 - DNA, 12 bp, Homo sapiens
gctagcttctgc

SEQ ID NO: 1204822 - DNA, 16 bp, Homo sapiens
gctagcttttaggaaa

SEQ ID NO: 1204823 - DNA, 21 bp, Homo sapiens
gctagcttttaggaaaatcac

SEQ ID NO: 1204824 - DNA, 20 bp, Homo sapiens
gctaggaagagcaggactcc

SEQ ID NO: 1204825 - DNA, 17 bp, Homo sapiens
gctaggaagaggagtgg

SEQ ID NO: 1204826 - DNA, 13 bp, Homo sapiens
gctaggaagagtc

SEQ ID NO: 1204827 - DNA, 12 bp, Homo sapiens
gctaggccagag

SEQ ID NO: 1204828 - DNA, 19 bp, Homo sapiens
gctaggcgagtgccaggac

SEQ ID NO: 1204829 - DNA, 18 bp, Homo sapiens
gctagggaaacttcccgt

SEQ ID NO: 1204830 - DNA, 23 bp, Homo sapiens
gctagggagagggaagagggaga

SEQ ID NO: 1204831 - DNA, 18 bp, Homo sapiens
gctagggctgctgcttct

SEQ ID NO: 1204832 - DNA, 23 bp, Homo sapiens
gctaggggcgggggcggaggagg

SEQ ID NO: 1204833 - DNA, 14 bp, Homo sapiens
gctaggtgggccag

SEQ ID NO: 1204834 - DNA, 20 bp, Homo sapiens
gctaggtgggccagcccctc

SEQ ID NO: 1204835 - DNA, 14 bp, Homo sapiens
gctagtaatgcttt

SEQ ID NO: 1204836 - DNA, 19 bp, Homo sapiens
gctagtactggggagaaat

SEQ ID NO: 1204837 - DNA, 17 bp, Homo sapiens
gctagtagcaatgtgcc

SEQ ID NO: 1204838 - DNA, 19 bp, Homo sapiens
gctagtcaagctcctcctc

SEQ ID NO: 1204839 - DNA, 22 bp, Homo sapiens
gctagtcctttctgtgaagcta

SEQ ID NO: 1204840 - DNA, 12 bp, Homo sapiens
gctagtcttttg

SEQ ID NO: 1204841 - DNA, 22 bp, Homo sapiens
gctagtcttttgcttttgccca

SEQ ID NO: 1204842 - DNA, 14 bp, Homo sapiens
gctagtgacttgtg

SEQ ID NO: 1204843 - DNA, 11 bp, Homo sapiens
gctagtgcctt

SEQ ID NO: 1204844 - DNA, 13 bp, Homo sapiens
gctagtgccttgc

SEQ ID NO: 1204845 - DNA, 19 bp, Homo sapiens
gctagtgggccctctctct

SEQ ID NO: 1204846 - DNA, 22 bp, Homo sapiens
gctagtgtacctcctctcagtg

SEQ ID NO: 1204847 - DNA, 13 bp, Homo sapiens
gctagtgtcttat

SEQ ID NO: 1204848 - DNA, 16 bp, Homo sapiens
gctagtgtgagtggca

SEQ ID NO: 1204849 - DNA, 12 bp, Homo sapiens
gctagttctgct

SEQ ID NO: 1204850 - DNA, 19 bp, Homo sapiens
gctagttctgctgccctct

SEQ ID NO: 1204851 - DNA, 21 bp, Homo sapiens
gctagttttttgcttctcttt

SEQ ID NO: 1204852 - DNA, 21 bp, Homo sapiens
gctataaagcagtatttttct

SEQ ID NO: 1204853 - DNA, 15 bp, Homo sapiens
gctataaatatataa

SEQ ID NO: 1204854 - DNA, 22 bp, Homo sapiens
gctataacagtgtctttctagc

SEQ ID NO: 1204855 - DNA, 15 bp, Homo sapiens
gctataactaagcat

SEQ ID NO: 1204856 - DNA, 13 bp, Homo sapiens
gctataatcatta

SEQ ID NO: 1204857 - DNA, 18 bp, Homo sapiens
gctataatcattagtttt

SEQ ID NO: 1204858 - DNA, 22 bp, Homo sapiens
gctataatcattagttttagag

SEQ ID NO: 1204859 - DNA, 23 bp, Homo sapiens
gctataatcattagttttagagg

SEQ ID NO: 1204860 - DNA, 18 bp, Homo sapiens
gctatactggaaatgtaa

SEQ ID NO: 1204861 - DNA, 21 bp, Homo sapiens
gctatagatgtcttttcccat

SEQ ID NO: 1204862 - DNA, 18 bp, Homo sapiens
gctatagctacaggaagc

SEQ ID NO: 1204863 - DNA, 14 bp, Homo sapiens
gctatagtatttga

SEQ ID NO: 1204864 - DNA, 22 bp, Homo sapiens
gctatataattgtgaagtatta

SEQ ID NO: 1204865 - DNA, 18 bp, Homo sapiens
gctatatccagttcctgc

SEQ ID NO: 1204866 - DNA, 21 bp, Homo sapiens
gctatatccatgtactgtagt

SEQ ID NO: 1204867 - DNA, 19 bp, Homo sapiens
gctatattgcccaggctgg

SEQ ID NO: 1204868 - DNA, 22 bp, Homo sapiens
gctatattgcccaggctggtct

SEQ ID NO: 1204869 - DNA, 14 bp, Homo sapiens
gctatatttcagtg

SEQ ID NO: 1204870 - DNA, 20 bp, Homo sapiens
gctatcacctagcagcctca

SEQ ID NO: 1204871 - DNA, 23 bp, Homo sapiens
gctatcagaccctattctcggct

SEQ ID NO: 1204872 - DNA, 14 bp, Homo sapiens
gctatccagtgact

SEQ ID NO: 1204873 - DNA, 19 bp, Homo sapiens
gctatccccatctccctgc

SEQ ID NO: 1204874 - DNA, 22 bp, Homo sapiens
gctatccccatctccctgcctg

SEQ ID NO: 1204875 - DNA, 13 bp, Homo sapiens
gctatccttggct

SEQ ID NO: 1204876 - DNA, 14 bp, Homo sapiens
gctatcgccctcct

SEQ ID NO: 1204877 - DNA, 19 bp, Homo sapiens
gctatcgccctcctttccc

SEQ ID NO: 1204878 - DNA, 13 bp, Homo sapiens
gctatctaatttt

SEQ ID NO: 1204879 - DNA, 21 bp, Homo sapiens
gctatctactaccagaagggc

SEQ ID NO: 1204880 - DNA, 20 bp, Homo sapiens
gctatctgttcctatctgca

SEQ ID NO: 1204881 - DNA, 15 bp, Homo sapiens
gctatcttcatgtaa

SEQ ID NO: 1204882 - DNA, 18 bp, Homo sapiens
gctatcttcatgtaaatt

SEQ ID NO: 1204883 - DNA, 17 bp, Homo sapiens
gctatgaaaatgagccc

SEQ ID NO: 1204884 - DNA, 21 bp, Homo sapiens
gctatgaagagctagagaaat

SEQ ID NO: 1204885 - DNA, 20 bp, Homo sapiens
gctatgcaaaaaattcttta

SEQ ID NO: 1204886 - DNA, 21 bp, Homo sapiens
gctatgcaaaaaattctttag

SEQ ID NO: 1204887 - DNA, 13 bp, Homo sapiens
gctatgcatttga

SEQ ID NO: 1204888 - DNA, 12 bp, Homo sapiens
gctatgcatttt

SEQ ID NO: 1204889 - DNA, 19 bp, Homo sapiens
gctatgcgcaatgtggcat

SEQ ID NO: 1204890 - DNA, 13 bp, Homo sapiens
gctatgctgaaga

SEQ ID NO: 1204891 - DNA, 16 bp, Homo sapiens
gctatggacacagggt

SEQ ID NO: 1204892 - DNA, 18 bp, Homo sapiens
gctatggacacagggtga

SEQ ID NO: 1204893 - DNA, 18 bp, Homo sapiens
gctatgggagccccaggg

SEQ ID NO: 1204894 - DNA, 19 bp, Homo sapiens
gctatgggagccccagggt

SEQ ID NO: 1204895 - DNA, 21 bp, Homo sapiens
gctatggttgccaccccaacc

SEQ ID NO: 1204896 - DNA, 13 bp, Homo sapiens
gctatggttttct

SEQ ID NO: 1204897 - DNA, 12 bp, Homo sapiens
gctatgtaaggg

SEQ ID NO: 1204898 - DNA, 16 bp, Homo sapiens
gctatgtcccaagagc

SEQ ID NO: 1204899 - DNA, 18 bp, Homo sapiens
gctatgttctgtcttccc

SEQ ID NO: 1204900 - DNA, 21 bp, Homo sapiens
gctatgttctgtcttcccaaa

SEQ ID NO: 1204901 - DNA, 19 bp, Homo sapiens
gctatgttgcccaagctgg

SEQ ID NO: 1204902 - DNA, 15 bp, Homo sapiens
gctattaatatttgt

SEQ ID NO: 1204903 - DNA, 23 bp, Homo sapiens
gctattactaaggagtaatctgt

SEQ ID NO: 1204904 - DNA, 15 bp, Homo sapiens
gctattactgtctgg

SEQ ID NO: 1204905 - DNA, 22 bp, Homo sapiens
gctattcacctcagtagaaaag

SEQ ID NO: 1204906 - DNA, 21 bp, Homo sapiens
gctattcccagggaaccccag

SEQ ID NO: 1204907 - DNA, 14 bp, Homo sapiens
gctattcctttccc

SEQ ID NO: 1204908 - DNA, 16 bp, Homo sapiens
gctattcctttccctt

SEQ ID NO: 1204909 - DNA, 17 bp, Homo sapiens
gctattcctttcccttc

SEQ ID NO: 1204910 - DNA, 20 bp, Homo sapiens
gctattctgtgttgaacaca

SEQ ID NO: 1204911 - DNA, 15 bp, Homo sapiens
gctattgacaataaa

SEQ ID NO: 1204912 - DNA, 13 bp, Homo sapiens
gctattgtaaata

SEQ ID NO: 1204913 - DNA, 16 bp, Homo sapiens
gctattgtaaatatgt

SEQ ID NO: 1204914 - DNA, 18 bp, Homo sapiens
gctattgtaaggtctttg

SEQ ID NO: 1204915 - DNA, 19 bp, Homo sapiens
gctattgtaaggtctttgt

SEQ ID NO: 1204916 - DNA, 12 bp, Homo sapiens
gctattgttgtg

SEQ ID NO: 1204917 - DNA, 15 bp, Homo sapiens
gctattgttgtgggc

SEQ ID NO: 1204918 - DNA, 16 bp, Homo sapiens
gctattgttgtgggct

SEQ ID NO: 1204919 - DNA, 21 bp, Homo sapiens
gctatttaatatctggcactg

SEQ ID NO: 1204920 - DNA, 11 bp, Homo sapiens
gctatttatgc

SEQ ID NO: 1204921 - DNA, 12 bp, Homo sapiens
gctatttcaata

SEQ ID NO: 1204922 - DNA, 17 bp, Homo sapiens
gctatttcagcctcctg

SEQ ID NO: 1204923 - DNA, 18 bp, Homo sapiens
gctatttccattccagaa

SEQ ID NO: 1204924 - DNA, 15 bp, Homo sapiens
gctatttctctcccc

SEQ ID NO: 1204925 - DNA, 17 bp, Homo sapiens
gctatttgtaaatctgc

SEQ ID NO: 1204926 - DNA, 12 bp, Homo sapiens
gctattttcctt

SEQ ID NO: 1204927 - DNA, 22 bp, Homo sapiens
gctattttctaaagacttgtat

SEQ ID NO: 1204928 - DNA, 13 bp, Homo sapiens
gctattttgtgaa

SEQ ID NO: 1204929 - DNA, 13 bp, Homo sapiens
gctcaaaactttc

SEQ ID NO: 1204930 - DNA, 21 bp, Homo sapiens
gctcaaaataaaaagcctcag

SEQ ID NO: 1204931 - DNA, 14 bp, Homo sapiens
gctcaaagaaatct

SEQ ID NO: 1204932 - DNA, 21 bp, Homo sapiens
gctcaaataggtcatcatgaa

SEQ ID NO: 1204933 - DNA, 23 bp, Homo sapiens
gctcaaatctattcagacaagca

SEQ ID NO: 1204934 - DNA, 19 bp, Homo sapiens
gctcaacccccctcccaga

SEQ ID NO: 1204935 - DNA, 22 bp, Homo sapiens
gctcaactaattttatttctat

SEQ ID NO: 1204936 - DNA, 20 bp, Homo sapiens
gctcaactcacagcttctcc

SEQ ID NO: 1204937 - DNA, 13 bp, Homo sapiens
ctcaggggacccc

SEQ ID NO: 1204938 - DNA, 14 bp, Homo sapiens
ctcaggggacccca

SEQ ID NO: 1204939 - DNA, 18 bp, Homo sapiens
ctcaggggaccccactcc

SEQ ID NO: 1204940 - DNA, 15 bp, Homo sapiens
ctcaggggagcaagc

SEQ ID NO: 1204941 - DNA, 18 bp, Homo sapiens
ctcaggggatgtttacct

SEQ ID NO: 1204942 - DNA, 22 bp, Homo sapiens
ctcaggggatgtttacctggtg

SEQ ID NO: 1204943 - DNA, 21 bp, Homo sapiens
gctcaagaagacatggagact

SEQ ID NO: 1204944 - DNA, 20 bp, Homo sapiens
gctcaagcaatcctcctgcc

SEQ ID NO: 1204945 - DNA, 21 bp, Homo sapiens
gctcaagcaatcctcctgcct

SEQ ID NO: 1204946 - DNA, 23 bp, Homo sapiens
gctcaagcaatcctcctgcctca

SEQ ID NO: 1204947 - DNA, 22 bp, Homo sapiens
gctcaagccctgaatttcttct

SEQ ID NO: 1204948 - DNA, 16 bp, Homo sapiens
gctcaaggctgtgcag

SEQ ID NO: 1204949 - DNA, 17 bp, Homo sapiens
gctcaagtcttccctga

SEQ ID NO: 1204950 - DNA, 16 bp, Homo sapiens
gctcaagtttaaaagc

SEQ ID NO: 1204951 - DNA, 16 bp, Homo sapiens
gctcaatccctgagga

SEQ ID NO: 1204952 - DNA, 16 bp, Homo sapiens
gctcaatcctctaagc

SEQ ID NO: 1204953 - DNA, 17 bp, Homo sapiens
gctcaatggactggaag

SEQ ID NO: 1204954 - DNA, 17 bp, Homo sapiens
gctcaattcaagtgaca

SEQ ID NO: 1204955 - DNA, 13 bp, Homo sapiens
gctcacacacctg

SEQ ID NO: 1204956 - DNA, 20 bp, Homo sapiens
gctcacacatccccagccag

SEQ ID NO: 1204957 - DNA, 14 bp, Homo sapiens
gctcacaccccatt

SEQ ID NO: 1204958 - DNA, 22 bp, Homo sapiens
gctcacaccccattggtggact

SEQ ID NO: 1204959 - DNA, 23 bp, Homo sapiens
gctcacactgatgggctggggca

SEQ ID NO: 1204960 - DNA, 14 bp, Homo sapiens
gctcacagggatgc

SEQ ID NO: 1204961 - DNA, 16 bp, Homo sapiens
gctcacagggatgctg

SEQ ID NO: 1204962 - DNA, 21 bp, Homo sapiens
gctcacagggatgctggtggc

SEQ ID NO: 1204963 - DNA, 14 bp, Homo sapiens
gctcacagggcagg

SEQ ID NO: 1204964 - DNA, 22 bp, Homo sapiens
gctcacagggcaggccttgctg

SEQ ID NO: 1204965 - DNA, 21 bp, Homo sapiens
gctcacagttcctcgccctgg

SEQ ID NO: 1204966 - DNA, 14 bp, Homo sapiens
gctcaccagccctg

SEQ ID NO: 1204967 - DNA, 17 bp, Homo sapiens
gctcaccagccctgcag

SEQ ID NO: 1204968 - DNA, 18 bp, Homo sapiens
gctcaccagccctgcagc

SEQ ID NO: 1204969 - DNA, 21 bp, Homo sapiens
gctcaccagccctgcagccca

SEQ ID NO: 1204970 - DNA, 20 bp, Homo sapiens
gctcacccaataaacattaa

SEQ ID NO: 1204971 - DNA, 20 bp, Homo sapiens
gctcacccccttctccatcc

SEQ ID NO: 1204972 - DNA, 22 bp, Homo sapiens
gctcacccccttctccatccac

SEQ ID NO: 1204973 - DNA, 11 bp, Homo sapiens
gctcacccctg

SEQ ID NO: 1204974 - DNA, 15 bp, Homo sapiens
gctcacccctgggca

SEQ ID NO: 1204975 - DNA, 15 bp, Homo sapiens
gctcaccgctggccc

SEQ ID NO: 1204976 - DNA, 21 bp, Homo sapiens
gctcaccgctggcccttagag

SEQ ID NO: 1204977 - DNA, 13 bp, Homo sapiens
gctcacctagagc

SEQ ID NO: 1204978 - DNA, 16 bp, Homo sapiens
gctcacctagagccag

SEQ ID NO: 1204979 - DNA, 18 bp, Homo sapiens
gctcacctagagccagac

SEQ ID NO: 1204980 - DNA, 21 bp, Homo sapiens
gctcacctttagaacaggaga

SEQ ID NO: 1204981 - DNA, 19 bp, Homo sapiens
gctcacgactcttcctgca

SEQ ID NO: 1204982 - DNA, 19 bp, Homo sapiens
gctcacgccccgctgtgtc

SEQ ID NO: 1204983 - DNA, 20 bp, Homo sapiens
gctcacgccccgctgtgtcc

SEQ ID NO: 1204984 - DNA, 21 bp, Homo sapiens
gctcacgcctgtaatcccagc

SEQ ID NO: 1204985 - DNA, 18 bp, Homo sapiens
gctcacgctcccccgcag

SEQ ID NO: 1204986 - DNA, 23 bp, Homo sapiens
gctcacgctcccccgcagtcccc

SEQ ID NO: 1204987 - DNA, 22 bp, Homo sapiens
gctcacggggcctccaacccat

SEQ ID NO: 1204988 - DNA, 13 bp, Homo sapiens
gctcacgtgtgtg

SEQ ID NO: 1204989 - DNA, 19 bp, Homo sapiens
gctcactcccaagggacag

SEQ ID NO: 1204990 - DNA, 20 bp, Homo sapiens
gctcactcccaagggacagc

SEQ ID NO: 1204991 - DNA, 17 bp, Homo sapiens
gctcactgcaacctccg

SEQ ID NO: 1204992 - DNA, 16 bp, Homo sapiens
gctcactgcagccttg

SEQ ID NO: 1204993 - DNA, 14 bp, Homo sapiens
gctcactgccaggc

SEQ ID NO: 1204994 - DNA, 17 bp, Homo sapiens
gctcactgccaggccag

SEQ ID NO: 1204995 - DNA, 22 bp, Homo sapiens
gctcactgccaggccagcctcc

SEQ ID NO: 1204996 - DNA, 18 bp, Homo sapiens
gctcactgtgctggggca

SEQ ID NO: 1204997 - DNA, 17 bp, Homo sapiens
gctcactgtggtgtctg

SEQ ID NO: 1204998 - DNA, 15 bp, Homo sapiens
gctcacttctgggct

SEQ ID NO: 1204999 - DNA, 23 bp, Homo sapiens
gctcagaacccagggctctgccc

SEQ ID NO: 1205000 - DNA, 17 bp, Homo sapiens
gctcagaacttgctgct

SEQ ID NO: 1205001 - DNA, 15 bp, Homo sapiens
gctcagaagtgacca

SEQ ID NO: 1205002 - DNA, 20 bp, Homo sapiens
gctcagaataaggcaggcat

SEQ ID NO: 1205003 - DNA, 17 bp, Homo sapiens
gctcagaatagatctga

SEQ ID NO: 1205004 - DNA, 20 bp, Homo sapiens
gctcagaatagatctgatgg

SEQ ID NO: 1205005 - DNA, 21 bp, Homo sapiens
gctcagaatagatctgatggt

SEQ ID NO: 1205006 - DNA, 15 bp, Homo sapiens
gctcagaatccaagt

SEQ ID NO: 1205007 - DNA, 21 bp, Homo sapiens
gctcagacatgttttccgtga

SEQ ID NO: 1205008 - DNA, 11 bp, Homo sapiens
gctcagacccc

SEQ ID NO: 1205009 - DNA, 14 bp, Homo sapiens
gctcagaccccacc

SEQ ID NO: 1205010 - DNA, 16 bp, Homo sapiens
gctcagaccccaccct

SEQ ID NO: 1205011 - DNA, 21 bp, Homo sapiens
gctcagaccccaccctacgct

SEQ ID NO: 1205012 - DNA, 15 bp, Homo sapiens
gctcagacccccact

SEQ ID NO: 1205013 - DNA, 22 bp, Homo sapiens
gctcagacttgccaggctccct

SEQ ID NO: 1205014 - DNA, 14 bp, Homo sapiens
gctcagagctttgt

SEQ ID NO: 1205015 - DNA, 18 bp, Homo sapiens
gctcagaggcgcactgtg

SEQ ID NO: 1205016 - DNA, 19 bp, Homo sapiens
gctcagaggcgcactgtga

SEQ ID NO: 1205017 - DNA, 20 bp, Homo sapiens
gctcagaggcgcactgtgac

SEQ ID NO: 1205018 - DNA, 21 bp, Homo sapiens
gctcagaggcgcactgtgacc

SEQ ID NO: 1205019 - DNA, 20 bp, Homo sapiens
gctcagagggggactgctgc

SEQ ID NO: 1205020 - DNA, 21 bp, Homo sapiens
gctcagagtgaccctcagctg

SEQ ID NO: 1205021 - DNA, 20 bp, Homo sapiens
gctcagcaaaagatgcttct

SEQ ID NO: 1205022 - DNA, 22 bp, Homo sapiens
gctcagcaaaagatgcttctca

SEQ ID NO: 1205023 - DNA, 13 bp, Homo sapiens
gctcagcagccag

SEQ ID NO: 1205024 - DNA, 16 bp, Homo sapiens
gctcagcagccagtct

SEQ ID NO: 1205025 - DNA, 20 bp, Homo sapiens
gctcagcagccagtctcaga

SEQ ID NO: 1205026 - DNA, 22 bp, Homo sapiens
gctcagcagccagtctcagaga

SEQ ID NO: 1205027 - DNA, 19 bp, Homo sapiens
gctcagccaaatttcctgt

SEQ ID NO: 1205028 - DNA, 15 bp, Homo sapiens
gctcagccacagcct

SEQ ID NO: 1205029 - DNA, 17 bp, Homo sapiens
gctcagccacagcctga

SEQ ID NO: 1205030 - DNA, 13 bp, Homo sapiens
gctcagccagcac

SEQ ID NO: 1205031 - DNA, 11 bp, Homo sapiens
gctcagcccac

SEQ ID NO: 1205032 - DNA, 16 bp, Homo sapiens
gctcagcccacccccc

SEQ ID NO: 1205033 - DNA, 18 bp, Homo sapiens
gctcagccccgagctgtc

SEQ ID NO: 1205034 - DNA, 19 bp, Homo sapiens
gctcagccccgagctgtcc

SEQ ID NO: 1205035 - DNA, 12 bp, Homo sapiens
gctcagccctcc

SEQ ID NO: 1205036 - DNA, 15 bp, Homo sapiens
gctcagccctccctg

SEQ ID NO: 1205037 - DNA, 18 bp, Homo sapiens
gctcagccctccctgccc

SEQ ID NO: 1205038 - DNA, 19 bp, Homo sapiens
gctcagccctccctgcccc

SEQ ID NO: 1205039 - DNA, 21 bp, Homo sapiens
gctcagccctccctgcccctc

SEQ ID NO: 1205040 - DNA, 12 bp, Homo sapiens
gctcagccctgg

SEQ ID NO: 1205041 - DNA, 18 bp, Homo sapiens
gctcagccctggcctggc

SEQ ID NO: 1205042 - DNA, 21 bp, Homo sapiens
gctcagccctggcctggctgg

SEQ ID NO: 1205043 - DNA, 22 bp, Homo sapiens
gctcagccctggcctggctggg

SEQ ID NO: 1205044 - DNA, 14 bp, Homo sapiens
gctcagccttgcac

SEQ ID NO: 1205045 - DNA, 16 bp, Homo sapiens
gctcagccttgcacac

SEQ ID NO: 1205046 - DNA, 17 bp, Homo sapiens
gctcagccttgcacacc

SEQ ID NO: 1205047 - DNA, 22 bp, Homo sapiens
gctcagccttgcacacccactg

SEQ ID NO: 1205048 - DNA, 15 bp, Homo sapiens
gctcagcgccagcct

SEQ ID NO: 1205049 - DNA, 14 bp, Homo sapiens
gctcagctctggtc

SEQ ID NO: 1205050 - DNA, 13 bp, Homo sapiens
gctcaggaaaacg

SEQ ID NO: 1205051 - DNA, 16 bp, Homo sapiens
gctcaggaagaagaga

SEQ ID NO: 1205052 - DNA, 15 bp, Homo sapiens
gctcaggacccaggc

SEQ ID NO: 1205053 - DNA, 21 bp, Homo sapiens
gctcaggacccaggccctcca

SEQ ID NO: 1205054 - DNA, 15 bp, Homo sapiens
gctcaggaggcttgg

SEQ ID NO: 1205055 - DNA, 17 bp, Homo sapiens
gctcaggaggcttggaa

SEQ ID NO: 1205056 - DNA, 11 bp, Homo sapiens
gctcaggaggg

SEQ ID NO: 1205057 - DNA, 23 bp, Homo sapiens
gctcaggaggtcaagaccagcct

SEQ ID NO: 1205058 - DNA, 19 bp, Homo sapiens
gctccatccccctgcctcc

SEQ ID NO: 1205059 - DNA, 20 bp, Homo sapiens
gctccatcgcccaggcctgg

SEQ ID NO: 1205060 - DNA, 16 bp, Homo sapiens
gctccatgcctctgga

SEQ ID NO: 1205061 - DNA, 17 bp, Homo sapiens
gctccatgtgcatataa

SEQ ID NO: 1205062 - DNA, 23 bp, Homo sapiens
gctccatttataaccccagcctg

SEQ ID NO: 1205063 - DNA, 22 bp, Homo sapiens
gctccattttcttattgcgctg

SEQ ID NO: 1205064 - DNA, 14 bp, Homo sapiens
gctcccaacccccc

SEQ ID NO: 1205065 - DNA, 18 bp, Homo sapiens
gctcccaacccccctcct

SEQ ID NO: 1205066 - DNA, 18 bp, Homo sapiens
gctcccaacgagcctcct

SEQ ID NO: 1205067 - DNA, 20 bp, Homo sapiens
gctcccacacttgtgccagc

SEQ ID NO: 1205068 - DNA, 19 bp, Homo sapiens
gctcccacagaacacagca

SEQ ID NO: 1205069 - DNA, 12 bp, Homo sapiens
gctcccacagct

SEQ ID NO: 1205070 - DNA, 15 bp, Homo sapiens
gctcccacaggccct

SEQ ID NO: 1205071 - DNA, 20 bp, Homo sapiens
gctcccacaggcccttcctc

SEQ ID NO: 1205072 - DNA, 22 bp, Homo sapiens
gctcccacaggcccttcctctc

SEQ ID NO: 1205073 - DNA, 16 bp, Homo sapiens
ctcatagcattaacta

SEQ ID NO: 1205074 - DNA, 21 bp, Homo sapiens
ctcataggaaaagtacattta

SEQ ID NO: 1205075 - DNA, 23 bp, Homo sapiens
ctcataggaaaagtacatttaat

SEQ ID NO: 1205076 - DNA, 16 bp, Homo sapiens
ctcataggagactgcg

SEQ ID NO: 1205077 - DNA, 22 bp, Homo sapiens
ctcataggttaaaaaaaaaagt

SEQ ID NO: 1205078 - DNA, 19 bp, Homo sapiens
ctcataggttgagcaattt

SEQ ID NO: 1205079 - DNA, 13 bp, Homo sapiens
ctcatataagaca

SEQ ID NO: 1205080 - DNA, 15 bp, Homo sapiens
ctcatatatttaagc

SEQ ID NO: 1205081 - DNA, 15 bp, Homo sapiens
ctcatatcagtttgc

SEQ ID NO: 1205082 - DNA, 22 bp, Homo sapiens
ctcatatgcgtcccaagcagcc

SEQ ID NO: 1205083 - DNA, 19 bp, Homo sapiens
ctcatatggcccagtgtca

SEQ ID NO: 1205084 - DNA, 19 bp, Homo sapiens
ctcatattgtgattctgcc

SEQ ID NO: 1205085 - DNA, 21 bp, Homo sapiens
ctcatattgtgattctgcctt

SEQ ID NO: 1205086 - DNA, 13 bp, Homo sapiens
ctcatatttaaag

SEQ ID NO: 1205087 - DNA, 21 bp, Homo sapiens
ctcatattttgtatatatctg

SEQ ID NO: 1205088 - DNA, 16 bp, Homo sapiens
ctcatcaactgaatga

SEQ ID NO: 1205089 - DNA, 18 bp, Homo sapiens
ctcatcaacttaaaagtc

SEQ ID NO: 1205090 - DNA, 15 bp, Homo sapiens
ctcatcaccccagag

SEQ ID NO: 1205091 - DNA, 12 bp, Homo sapiens
ctcatcactgga

SEQ ID NO: 1205092 - DNA, 14 bp, Homo sapiens
ctcatcactggact

SEQ ID NO: 1205093 - DNA, 19 bp, Homo sapiens
ctcatcactggactgcatg

SEQ ID NO: 1205094 - DNA, 12 bp, Homo sapiens
ctcatcaggatg

SEQ ID NO: 1205095 - DNA, 16 bp, Homo sapiens
ctcatcaggatgaacc

SEQ ID NO: 1205096 - DNA, 20 bp, Homo sapiens
ctcatcaggatgaacccagg

SEQ ID NO: 1205097 - DNA, 12 bp, Homo sapiens
ctcatcataaaa

SEQ ID NO: 1205098 - DNA, 18 bp, Homo sapiens
ctcatcatattccaaccc

SEQ ID NO: 1205099 - DNA, 19 bp, Homo sapiens
ctcatcatattccaaccca

SEQ ID NO: 1205100 - DNA, 15 bp, Homo sapiens
ctcatcatattgtat

SEQ ID NO: 1205101 - DNA, 17 bp, Homo sapiens
ctcatcatattgtatgt

SEQ ID NO: 1205102 - DNA, 19 bp, Homo sapiens
ctcatcatccacccgctgc

SEQ ID NO: 1205103 - DNA, 21 bp, Homo sapiens
ctcatcatccacccgctgccc

SEQ ID NO: 1205104 - DNA, 23 bp, Homo sapiens
ctcatcatccacccgctgcccct

SEQ ID NO: 1205105 - DNA, 14 bp, Homo sapiens
ctcatcattctctg

SEQ ID NO: 1205106 - DNA, 15 bp, Homo sapiens
ctcatcattctctgt

SEQ ID NO: 1205107 - DNA, 18 bp, Homo sapiens
ctcatcattctctgtctc

SEQ ID NO: 1205108 - DNA, 21 bp, Homo sapiens
ctcatcatttgcattgggcat

SEQ ID NO: 1205109 - DNA, 15 bp, Homo sapiens
ctcatcattttctac

SEQ ID NO: 1205110 - DNA, 19 bp, Homo sapiens
ctcatccaccccatccctc

SEQ ID NO: 1205111 - DNA, 16 bp, Homo sapiens
ctcatccatcatcatg

SEQ ID NO: 1205112 - DNA, 17 bp, Homo sapiens
ctcatccatgcacttta

SEQ ID NO: 1205113 - DNA, 14 bp, Homo sapiens
ctcatccatttctt

SEQ ID NO: 1205114 - DNA, 16 bp, Homo sapiens
ctcatcccaacctctt

SEQ ID NO: 1205115 - DNA, 23 bp, Homo sapiens
ctcatcccacttcctttcctact

SEQ ID NO: 1205116 - DNA, 22 bp, Homo sapiens
ctcatccccaggggtcccagcc

SEQ ID NO: 1205117 - DNA, 23 bp, Homo sapiens
ctcatccccaggggtcccagcca

SEQ ID NO: 1205118 - DNA, 14 bp, Homo sapiens
ctcatcccccagtt

SEQ ID NO: 1205119 - DNA, 15 bp, Homo sapiens
ctcatccccccaccc

SEQ ID NO: 1205120 - DNA, 22 bp, Homo sapiens
ctcatccccccacccgacttct

SEQ ID NO: 1205121 - DNA, 15 bp, Homo sapiens
ctcatcccccctgct

SEQ ID NO: 1205122 - DNA, 19 bp, Homo sapiens
ctcatcccccctgctgccc

SEQ ID NO: 1205123 - DNA, 15 bp, Homo sapiens
ctcatccccctgtgg

SEQ ID NO: 1205124 - DNA, 17 bp, Homo sapiens
ctcatcccctcgtcctg

SEQ ID NO: 1205125 - DNA, 16 bp, Homo sapiens
ctcatcccgtgttctc

SEQ ID NO: 1205126 - DNA, 22 bp, Homo sapiens
ctcatccgaagatggtggccac

SEQ ID NO: 1205127 - DNA, 22 bp, Homo sapiens
ctcatcctccagtaccttgctt

SEQ ID NO: 1205128 - DNA, 23 bp, Homo sapiens
ctcatcctccagtaccttgcttc

SEQ ID NO: 1205129 - DNA, 13 bp, Homo sapiens
ctcatcctcctgg

SEQ ID NO: 1205130 - DNA, 15 bp, Homo sapiens
ctcatcctcctggaa

SEQ ID NO: 1205131 - DNA, 23 bp, Homo sapiens
ctcatcctcctggaaccttgctg

SEQ ID NO: 1205132 - DNA, 13 bp, Homo sapiens
ctcatcctccttt

SEQ ID NO: 1205133 - DNA, 24 bp, Homo sapiens
ctcatcctgctcttttgtgatgaa

SEQ ID NO: 1205134 - DNA, 16 bp, Homo sapiens
ctcatcctgcttctct

SEQ ID NO: 1205135 - DNA, 18 bp, Homo sapiens
ctcatcctggcacgccct

SEQ ID NO: 1205136 - DNA, 17 bp, Homo sapiens
ctcatcctttccctctc

SEQ ID NO: 1205137 - DNA, 22 bp, Homo sapiens
ctcatcctttccctctcccagt

SEQ ID NO: 1205138 - DNA, 16 bp, Homo sapiens
ctcatcctttcctcta

SEQ ID NO: 1205139 - DNA, 17 bp, Homo sapiens
ctcatcgccagacaact

SEQ ID NO: 1205140 - DNA, 15 bp, Homo sapiens
ctcatctaactgatg

SEQ ID NO: 1205141 - DNA, 14 bp, Homo sapiens
ctcatctatctcaa

SEQ ID NO: 1205142 - DNA, 20 bp, Homo sapiens
ctcatctatgaggaaaggtt

SEQ ID NO: 1205143 - DNA, 12 bp, Homo sapiens
ctcatctcaggt

SEQ ID NO: 1205144 - DNA, 20 bp, Homo sapiens
ctcatctccaaggatcctct

SEQ ID NO: 1205145 - DNA, 22 bp, Homo sapiens
ctcatctccaaggatcctctcc

SEQ ID NO: 1205146 - DNA, 21 bp, Homo sapiens
ctcatctcctgaccctcccac

SEQ ID NO: 1205147 - DNA, 24 bp, Homo sapiens
ctcatctctacaaaaagtaaaaat

SEQ ID NO: 1205148 - DNA, 17 bp, Homo sapiens
ctcatctcttcaggttc

SEQ ID NO: 1205149 - DNA, 15 bp, Homo sapiens
ctcatctgagaggct

SEQ ID NO: 1205150 - DNA, 15 bp, Homo sapiens
ctcatctgcaccctt

SEQ ID NO: 1205151 - DNA, 20 bp, Homo sapiens
ctcatctgcacccttctttt

SEQ ID NO: 1205152 - DNA, 13 bp, Homo sapiens
ctcatctgctggt

SEQ ID NO: 1205153 - DNA, 20 bp, Homo sapiens
ctcatctgctggtccgtggg

SEQ ID NO: 1205154 - DNA, 15 bp, Homo sapiens
ctcatctgtccctcc

SEQ ID NO: 1205155 - DNA, 17 bp, Homo sapiens
ctcatctgtccctccgg

SEQ ID NO: 1205156 - DNA, 23 bp, Homo sapiens
ctcatctgtggagctgccacaga

SEQ ID NO: 1205157 - DNA, 17 bp, Homo sapiens
ctcatcttcttcaccat

SEQ ID NO: 1205158 - DNA, 14 bp, Homo sapiens
ctcatctttctcct

SEQ ID NO: 1205159 - DNA, 14 bp, Homo sapiens
ctcatgaagcagga

SEQ ID NO: 1205160 - DNA, 18 bp, Homo sapiens
ctcatgaatgaaaataca

SEQ ID NO: 1205161 - DNA, 16 bp, Homo sapiens
ctcatgaggaccaggg

SEQ ID NO: 1205162 - DNA, 14 bp, Homo sapiens
ctcatgaggggaga

SEQ ID NO: 1205163 - DNA, 21 bp, Homo sapiens
ctcatgataccacctttactg

SEQ ID NO: 1205164 - DNA, 16 bp, Homo sapiens
ctcatgcaaactgctt

SEQ ID NO: 1205165 - DNA, 16 bp, Homo sapiens
ctcatgcaaatcaatt

SEQ ID NO: 1205166 - DNA, 22 bp, Homo sapiens
ctcatgccatggtctttgctag

SEQ ID NO: 1205167 - DNA, 13 bp, Homo sapiens
ctcatgcccaccc

SEQ ID NO: 1205168 - DNA, 17 bp, Homo sapiens
ctcatgcccaccccctg

SEQ ID NO: 1205169 - DNA, 20 bp, Homo sapiens
ctcatgcccaccccctgccc

SEQ ID NO: 1205170 - DNA, 21 bp, Homo sapiens
ctcatgcccaccccctgccct

SEQ ID NO: 1205171 - DNA, 15 bp, Homo sapiens
ctcatgcccagctct

SEQ ID NO: 1205172 - DNA, 23 bp, Homo sapiens
ctcatgcccagctctctgacgct

SEQ ID NO: 1205173 - DNA, 22 bp, Homo sapiens
ctcatgccccctttcagatgtc

SEQ ID NO: 1205174 - DNA, 19 bp, Homo sapiens
ctcatgctgtgtttgtttt

SEQ ID NO: 1205175 - DNA, 22 bp, Homo sapiens
ctcatggcagctgtttctcatg

SEQ ID NO: 1205176 - DNA, 14 bp, Homo sapiens
ctcatggcccctct

SEQ ID NO: 1205177 - DNA, 19 bp, Homo sapiens
ctcatggcgtaatgggcct

SEQ ID NO: 1205178 - DNA, 20 bp, Homo sapiens
ctcatggcgtaatgggcctg

SEQ ID NO: 1205179 - DNA, 18 bp, Homo sapiens
ctacttttgcatgaaaat

SEQ ID NO: 1205180 - DNA, 16 bp, Homo sapiens
ctactttttaattttt

SEQ ID NO: 1205181 - DNA, 21 bp, Homo sapiens
ctactttttaatttttaagag

SEQ ID NO: 1205182 - DNA, 15 bp, Homo sapiens
ctactttttatactc

SEQ ID NO: 1205183 - DNA, 14 bp, Homo sapiens
ctagaaaaataaaa

SEQ ID NO: 1205184 - DNA, 16 bp, Homo sapiens
ctagaaacagatcttg

SEQ ID NO: 1205185 - DNA, 17 bp, Homo sapiens
ctagaaacccaagctcc

SEQ ID NO: 1205186 - DNA, 17 bp, Homo sapiens
ctagaaactctggctca

SEQ ID NO: 1205187 - DNA, 14 bp, Homo sapiens
ctagaaacttccaa

SEQ ID NO: 1205188 - DNA, 23 bp, Homo sapiens
ctagaaagaaaagaccctgagac

SEQ ID NO: 1205189 - DNA, 22 bp, Homo sapiens
ctagaaagcctgttcccctcac

SEQ ID NO: 1205190 - DNA, 16 bp, Homo sapiens
ctagaaatatctttct

SEQ ID NO: 1205191 - DNA, 19 bp, Homo sapiens
ctagaaatatctttctctt

SEQ ID NO: 1205192 - DNA, 17 bp, Homo sapiens
ctagaaatatgatttta

SEQ ID NO: 1205193 - DNA, 19 bp, Homo sapiens
ctagaaatgtgaatgagga

SEQ ID NO: 1205194 - DNA, 15 bp, Homo sapiens
ctagaacaacttgaa

SEQ ID NO: 1205195 - DNA, 19 bp, Homo sapiens
ctagaacacaggcaaaatc

SEQ ID NO: 1205196 - DNA, 21 bp, Homo sapiens
ctagaacacaggcaaaatcct

SEQ ID NO: 1205197 - DNA, 19 bp, Homo sapiens
ctagaacactaactcacca

SEQ ID NO: 1205198 - DNA, 22 bp, Homo sapiens
ctagaacactaactcaccagcc

SEQ ID NO: 1205199 - DNA, 18 bp, Homo sapiens
ctagaacatccctgggca

SEQ ID NO: 1205200 - DNA, 15 bp, Homo sapiens
ctagaacatgcacat

SEQ ID NO: 1205201 - DNA, 19 bp, Homo sapiens
ctagaacgtgcatccttgt

SEQ ID NO: 1205202 - DNA, 17 bp, Homo sapiens
ctagaagaaaagcccat

SEQ ID NO: 1205203 - DNA, 18 bp, Homo sapiens
ctagaagaaaagcccatt

SEQ ID NO: 1205204 - DNA, 18 bp, Homo sapiens
ctagaagaaccaaatacc

SEQ ID NO: 1205205 - DNA, 19 bp, Homo sapiens
ctagaagaaccaaatacct

SEQ ID NO: 1205206 - DNA, 23 bp, Homo sapiens
ctagaagagcacagagccctgag

SEQ ID NO: 1205207 - DNA, 20 bp, Homo sapiens
ctagaagagtctattgtctc

SEQ ID NO: 1205208 - DNA, 21 bp, Homo sapiens
ctagaagatccacatcctcta

SEQ ID NO: 1205209 - DNA, 16 bp, Homo sapiens
ctagaagatgtgtaaa

SEQ ID NO: 1205210 - DNA, 11 bp, Homo sapiens
ctagaagcaca

SEQ ID NO: 1205211 - DNA, 13 bp, Homo sapiens
ctagaagcacatg

SEQ ID NO: 1205212 - DNA, 16 bp, Homo sapiens
ctagaagcacatgtgt

SEQ ID NO: 1205213 - DNA, 20 bp, Homo sapiens
ctagaagcccctgtcgccca

SEQ ID NO: 1205214 - DNA, 23 bp, Homo sapiens
ctagaagctggtaaaaatgacaa

SEQ ID NO: 1205215 - DNA, 14 bp, Homo sapiens
ctagaaggccacat

SEQ ID NO: 1205216 - DNA, 22 bp, Homo sapiens
ctagaaggcgtccatgtttatt

SEQ ID NO: 1205217 - DNA, 12 bp, Homo sapiens
ctagaagtattt

SEQ ID NO: 1205218 - DNA, 21 bp, Homo sapiens
ctagaagtatttttgtctctt

SEQ ID NO: 1205219 - DNA, 14 bp, Homo sapiens
ctagaatacttttt

SEQ ID NO: 1205220 - DNA, 20 bp, Homo sapiens
ctagaatgtcagatttctgg

SEQ ID NO: 1205221 - DNA, 21 bp, Homo sapiens
ctagaatgtcagatttctggt

SEQ ID NO: 1205222 - DNA, 23 bp, Homo sapiens
ctagaatgtctgaagtacaaaca

SEQ ID NO: 1205223 - DNA, 15 bp, Homo sapiens
ctagaatgtggattt

SEQ ID NO: 1205224 - DNA, 18 bp, Homo sapiens
ctagaattctagtgctgc

SEQ ID NO: 1205225 - DNA, 19 bp, Homo sapiens
ctagaattgagtgtttaaa

SEQ ID NO: 1205226 - DNA, 12 bp, Homo sapiens
ctagaatttatt

SEQ ID NO: 1205227 - DNA, 15 bp, Homo sapiens
ctagaatttattcaa

SEQ ID NO: 1205228 - DNA, 19 bp, Homo sapiens
ctagacaacctttctgtag

SEQ ID NO: 1205229 - DNA, 23 bp, Homo sapiens
ctagacaagatattgtacataaa

SEQ ID NO: 1205230 - DNA, 14 bp, Homo sapiens
ctagacacatgaag

SEQ ID NO: 1205231 - DNA, 22 bp, Homo sapiens
ctagacacatgaaggtaaataa

SEQ ID NO: 1205232 - DNA, 12 bp, Homo sapiens
ctagacagtatt

SEQ ID NO: 1205233 - DNA, 11 bp, Homo sapiens
ctagaccaata

SEQ ID NO: 1205234 - DNA, 17 bp, Homo sapiens
ctagaccagcagacaga

SEQ ID NO: 1205235 - DNA, 22 bp, Homo sapiens
ctagaccagcagacagagccag

SEQ ID NO: 1205236 - DNA, 22 bp, Homo sapiens
ctagaccagtgagcgcttgggc

SEQ ID NO: 1205237 - DNA, 21 bp, Homo sapiens
ctagacccactggactcacct

SEQ ID NO: 1205238 - DNA, 19 bp, Homo sapiens
ctagacctccccctcactt

SEQ ID NO: 1205239 - DNA, 16 bp, Homo sapiens
ctagacgcccctccca

SEQ ID NO: 1205240 - DNA, 18 bp, Homo sapiens
ctagacgcccctcccaag

SEQ ID NO: 1205241 - DNA, 22 bp, Homo sapiens
ctagactactcaatattaaagg

SEQ ID NO: 1205242 - DNA, 14 bp, Homo sapiens
ctagactataaatg

SEQ ID NO: 1205243 - DNA, 16 bp, Homo sapiens
ctagactataaatgtt

SEQ ID NO: 1205244 - DNA, 19 bp, Homo sapiens
ctagactcaaaacctggag

SEQ ID NO: 1205245 - DNA, 14 bp, Homo sapiens
ctagactggagtga

SEQ ID NO: 1205246 - DNA, 14 bp, Homo sapiens
ctagacttccccat

SEQ ID NO: 1205247 - DNA, 16 bp, Homo sapiens
ctagacttccccatcc

SEQ ID NO: 1205248 - DNA, 23 bp, Homo sapiens
ctagacttgaaagttttccagta

SEQ ID NO: 1205249 - DNA, 17 bp, Homo sapiens
ctagagaagaggctggt

SEQ ID NO: 1205250 - DNA, 12 bp, Homo sapiens
ctagagacacat

SEQ ID NO: 1205251 - DNA, 17 bp, Homo sapiens
ctagagacacattggac

SEQ ID NO: 1205252 - DNA, 22 bp, Homo sapiens
ctagagagagggagaaacaagt

SEQ ID NO: 1205253 - DNA, 21 bp, Homo sapiens
ctagagagggaggcaagccct

SEQ ID NO: 1205254 - DNA, 17 bp, Homo sapiens
ctagagatattttgtaa

SEQ ID NO: 1205255 - DNA, 21 bp, Homo sapiens
ctataagactataaataaaaa

SEQ ID NO: 1205256 - DNA, 21 bp, Homo sapiens
ctataagagaattatatattt

SEQ ID NO: 1205257 - DNA, 22 bp, Homo sapiens
ctataagagaattatatatttc

SEQ ID NO: 1205258 - DNA, 23 bp, Homo sapiens
ctataagattccaaaaagcacat

SEQ ID NO: 1205259 - DNA, 19 bp, Homo sapiens
ctataagcttaaataggaa

SEQ ID NO: 1205260 - DNA, 22 bp, Homo sapiens
ctataagtagttggtttgtatg

SEQ ID NO: 1205261 - DNA, 12 bp, Homo sapiens
ctataagtgctc

SEQ ID NO: 1205262 - DNA, 12 bp, Homo sapiens
ctataagttgta

SEQ ID NO: 1205263 - DNA, 15 bp, Homo sapiens
ctataagttgtacca

SEQ ID NO: 1205264 - DNA, 16 bp, Homo sapiens
ctataagttgtaccaa

SEQ ID NO: 1205265 - DNA, 19 bp, Homo sapiens
ctataagttttagaatctt

SEQ ID NO: 1205266 - DNA, 19 bp, Homo sapiens
ctataataaaatggcacct

SEQ ID NO: 1205267 - DNA, 15 bp, Homo sapiens
ctataataaagaagt

SEQ ID NO: 1205268 - DNA, 14 bp, Homo sapiens
ctataataagtttt

SEQ ID NO: 1205269 - DNA, 16 bp, Homo sapiens
ctataataagttttga

SEQ ID NO: 1205270 - DNA, 17 bp, Homo sapiens
ctataatacttgcaact

SEQ ID NO: 1205271 - DNA, 12 bp, Homo sapiens
ctataatcatta

SEQ ID NO: 1205272 - DNA, 12 bp, Homo sapiens
ctataatctgtc

SEQ ID NO: 1205273 - DNA, 13 bp, Homo sapiens
ctataatctgtca

SEQ ID NO: 1205274 - DNA, 18 bp, Homo sapiens
ctataatctgtcaaaaca

SEQ ID NO: 1205275 - DNA, 18 bp, Homo sapiens
ctataatcttatacaaca

SEQ ID NO: 1205276 - DNA, 21 bp, Homo sapiens
ctataatgatctaagaagcta

SEQ ID NO: 1205277 - DNA, 17 bp, Homo sapiens
ctataatggaaacattt

SEQ ID NO: 1205278 - DNA, 11 bp, Homo sapiens
ctataatgtga

SEQ ID NO: 1205279 - DNA, 20 bp, Homo sapiens
ctataattccctatctttta

SEQ ID NO: 1205280 - DNA, 21 bp, Homo sapiens
ctatacaaattttcagaaggt

SEQ ID NO: 1205281 - DNA, 15 bp, Homo sapiens
ctatacacacacaca

SEQ ID NO: 1205282 - DNA, 14 bp, Homo sapiens
ctatacactagaca

SEQ ID NO: 1205283 - DNA, 20 bp, Homo sapiens
ctatacagaacagagggcca

SEQ ID NO: 1205284 - DNA, 14 bp, Homo sapiens
ctatacatagagct

SEQ ID NO: 1205285 - DNA, 14 bp, Homo sapiens
ctatacatatcttt

SEQ ID NO: 1205286 - DNA, 15 bp, Homo sapiens
ctatacatttctgtt

SEQ ID NO: 1205287 - DNA, 21 bp, Homo sapiens
ctataccatatgtctgcttct

SEQ ID NO: 1205288 - DNA, 19 bp, Homo sapiens
ctatacctgccttttaagt

SEQ ID NO: 1205289 - DNA, 15 bp, Homo sapiens
ctatactgaaagatc

SEQ ID NO: 1205290 - DNA, 17 bp, Homo sapiens
ctatacttaatctaaga

SEQ ID NO: 1205291 - DNA, 15 bp, Homo sapiens
ctatacttctccttt

SEQ ID NO: 1205292 - DNA, 16 bp, Homo sapiens
ctatagaaatagaaca

SEQ ID NO: 1205293 - DNA, 12 bp, Homo sapiens
ctatagactcta

SEQ ID NO: 1205294 - DNA, 21 bp, Homo sapiens
ctatagagagggggctctcca

SEQ ID NO: 1205295 - DNA, 14 bp, Homo sapiens
ctatagatgtcttt

SEQ ID NO: 1205296 - DNA, 16 bp, Homo sapiens
ctatagatgtcttttc

SEQ ID NO: 1205297 - DNA, 19 bp, Homo sapiens
ctatagccatcgactcctg

SEQ ID NO: 1205298 - DNA, 15 bp, Homo sapiens
ctatagcccaggtcc

SEQ ID NO: 1205299 - DNA, 19 bp, Homo sapiens
ctatagcctggactttcct

SEQ ID NO: 1205300 - DNA, 14 bp, Homo sapiens
ctataggaaagtct

SEQ ID NO: 1205301 - DNA, 15 bp, Homo sapiens
ctataggaaagtctg

SEQ ID NO: 1205302 - DNA, 15 bp, Homo sapiens
ctataggcagcttct

SEQ ID NO: 1205303 - DNA, 19 bp, Homo sapiens
ctataggcagcttctaaga

SEQ ID NO: 1205304 - DNA, 22 bp, Homo sapiens
ctataggctggagaagctcacc

SEQ ID NO: 1205305 - DNA, 21 bp, Homo sapiens
ctataggttttggttccacaa

SEQ ID NO: 1205306 - DNA, 14 bp, Homo sapiens
ctatagtcccagct

SEQ ID NO: 1205307 - DNA, 15 bp, Homo sapiens
ctatagtcccagcta

SEQ ID NO: 1205308 - DNA, 16 bp, Homo sapiens
ctatagtggtgagatg

SEQ ID NO: 1205309 - DNA, 16 bp, Homo sapiens
ctatagtgtaataatg

SEQ ID NO: 1205310 - DNA, 19 bp, Homo sapiens
ctatagtgtataccacctg

SEQ ID NO: 1205311 - DNA, 16 bp, Homo sapiens
ctatagttactgtcct

SEQ ID NO: 1205312 - DNA, 22 bp, Homo sapiens
ctatataaaataactaaaatgt

SEQ ID NO: 1205313 - DNA, 17 bp, Homo sapiens
ctatataaaatgtattc

SEQ ID NO: 1205314 - DNA, 19 bp, Homo sapiens
ctatataaaatgtattcaa

SEQ ID NO: 1205315 - DNA, 19 bp, Homo sapiens
ctatataagacaagaactc

SEQ ID NO: 1205316 - DNA, 16 bp, Homo sapiens
ctatataatttatttc

SEQ ID NO: 1205317 - DNA, 16 bp, Homo sapiens
ctatatacatatatat

SEQ ID NO: 1205318 - DNA, 22 bp, Homo sapiens
ctatatacatcacgttaaagta

SEQ ID NO: 1205319 - DNA, 14 bp, Homo sapiens
ctatatagagatgt

SEQ ID NO: 1205320 - DNA, 16 bp, Homo sapiens
ctatatagttccttgc

SEQ ID NO: 1205321 - DNA, 15 bp, Homo sapiens
gcctgacagaaacca

SEQ ID NO: 1205322 - DNA, 17 bp, Homo sapiens
gcctgacagccttcccc

SEQ ID NO: 1205323 - DNA, 22 bp, Homo sapiens
gcctgacatttggagtgttccc

SEQ ID NO: 1205324 - DNA, 16 bp, Homo sapiens
gcctgacccacggggc

SEQ ID NO: 1205325 - DNA, 18 bp, Homo sapiens
gcctgacccacggggcag

SEQ ID NO: 1205326 - DNA, 20 bp, Homo sapiens
gcctgaccccttgctccctt

SEQ ID NO: 1205327 - DNA, 17 bp, Homo sapiens
gcctgacctgagactgt

SEQ ID NO: 1205328 - DNA, 15 bp, Homo sapiens
gcctgaccttccttc

SEQ ID NO: 1205329 - DNA, 16 bp, Homo sapiens
gcctgactgccaggac

SEQ ID NO: 1205330 - DNA, 22 bp, Homo sapiens
gcctgactgccaggaccccagg

SEQ ID NO: 1205331 - DNA, 14 bp, Homo sapiens
gcctgactgctcag

SEQ ID NO: 1205332 - DNA, 19 bp, Homo sapiens
gcctgactggttgtcagaa

SEQ ID NO: 1205333 - DNA, 19 bp, Homo sapiens
gcctgagaatgagtgggaa

SEQ ID NO: 1205334 - DNA, 19 bp, Homo sapiens
gcctgagacagcaccactg

SEQ ID NO: 1205335 - DNA, 22 bp, Homo sapiens
gcctgagacagcaccactgctg

SEQ ID NO: 1205336 - DNA, 13 bp, Homo sapiens
gcctgagagtatt

SEQ ID NO: 1205337 - DNA, 20 bp, Homo sapiens
gcctgagagtcagctctctg

SEQ ID NO: 1205338 - DNA, 13 bp, Homo sapiens
gcctgagcaacat

SEQ ID NO: 1205339 - DNA, 17 bp, Homo sapiens
gcctgagcccaggagct

SEQ ID NO: 1205340 - DNA, 22 bp, Homo sapiens
gcctgagccctactccctgcag

SEQ ID NO: 1205341 - DNA, 18 bp, Homo sapiens
gcctgagcggaggctcgg

SEQ ID NO: 1205342 - DNA, 17 bp, Homo sapiens
gcctgagctcactcggc

SEQ ID NO: 1205343 - DNA, 16 bp, Homo sapiens
gcctgagctggggcca

SEQ ID NO: 1205344 - DNA, 18 bp, Homo sapiens
gcctgagctggggccaca

SEQ ID NO: 1205345 - DNA, 12 bp, Homo sapiens
gcctgaggagga

SEQ ID NO: 1205346 - DNA, 21 bp, Homo sapiens
gcctgaggatgagctggaagg

SEQ ID NO: 1205347 - DNA, 18 bp, Homo sapiens
gcctgagggcccctctgc

SEQ ID NO: 1205348 - DNA, 19 bp, Homo sapiens
gcctgagggcccctctgcc

SEQ ID NO: 1205349 - DNA, 20 bp, Homo sapiens
gcctgagggcccctctgccc

SEQ ID NO: 1205350 - DNA, 15 bp, Homo sapiens
gcctgagggtggaga

SEQ ID NO: 1205351 - DNA, 16 bp, Homo sapiens
gcctgaggtcccctcg

SEQ ID NO: 1205352 - DNA, 13 bp, Homo sapiens
gcctgaggtctgt

SEQ ID NO: 1205353 - DNA, 18 bp, Homo sapiens
gcctgaggtctgtacgtt

SEQ ID NO: 1205354 - DNA, 13 bp, Homo sapiens
gcctgagtcacct

SEQ ID NO: 1205355 - DNA, 15 bp, Homo sapiens
gcctgagtctcctgt

SEQ ID NO: 1205356 - DNA, 16 bp, Homo sapiens
gcctgagtctcctgtg

SEQ ID NO: 1205357 - DNA, 23 bp, Homo sapiens
gcctgagtgagtgtgtgtgcttg

SEQ ID NO: 1205358 - DNA, 22 bp, Homo sapiens
gcctgatccctgaacccctggc

SEQ ID NO: 1205359 - DNA, 15 bp, Homo sapiens
gcctgatctcttcct

SEQ ID NO: 1205360 - DNA, 12 bp, Homo sapiens
gcctgatgacag

SEQ ID NO: 1205361 - DNA, 17 bp, Homo sapiens
gcctgatgacagagcga

SEQ ID NO: 1205362 - DNA, 19 bp, Homo sapiens
gcctgatgagactccactc

SEQ ID NO: 1205363 - DNA, 20 bp, Homo sapiens
gcctgatgagactccactca

SEQ ID NO: 1205364 - DNA, 17 bp, Homo sapiens
gcctgatgctccctccc

SEQ ID NO: 1205365 - DNA, 19 bp, Homo sapiens
gcctgatgctccctcccct

SEQ ID NO: 1205366 - DNA, 16 bp, Homo sapiens
gcctgatgctgccccg

SEQ ID NO: 1205367 - DNA, 17 bp, Homo sapiens
gcctgatgctgccccgt

SEQ ID NO: 1205368 - DNA, 13 bp, Homo sapiens
gcctgatggccaa

SEQ ID NO: 1205369 - DNA, 14 bp, Homo sapiens
gcctgatggccaag

SEQ ID NO: 1205370 - DNA, 17 bp, Homo sapiens
gcctgcactccctggcc

SEQ ID NO: 1205371 - DNA, 18 bp, Homo sapiens
gcctgcactccctggcct

SEQ ID NO: 1205372 - DNA, 11 bp, Homo sapiens
gcctgcagaga

SEQ ID NO: 1205373 - DNA, 14 bp, Homo sapiens
gcctgcagagagaa

SEQ ID NO: 1205374 - DNA, 17 bp, Homo sapiens
gcctgcagagagaagcc

SEQ ID NO: 1205375 - DNA, 21 bp, Homo sapiens
gcctgcagaggtctgtgctga

SEQ ID NO: 1205376 - DNA, 14 bp, Homo sapiens
gcctgcagcacatg

SEQ ID NO: 1205377 - DNA, 11 bp, Homo sapiens
gcctgcagccc

SEQ ID NO: 1205378 - DNA, 22 bp, Homo sapiens
gcctgctgggctctccacctca

SEQ ID NO: 1205379 - DNA, 13 bp, Homo sapiens
gcctgctgtattt

SEQ ID NO: 1205380 - DNA, 16 bp, Homo sapiens
gcctgctgtgctggga

SEQ ID NO: 1205381 - DNA, 18 bp, Homo sapiens
gcctgctgtgtccttcct

SEQ ID NO: 1205382 - DNA, 20 bp, Homo sapiens
gcctgctgtgttaagaggac

SEQ ID NO: 1205383 - DNA, 21 bp, Homo sapiens
gcctgctgttggtcctctctc

SEQ ID NO: 1205384 - DNA, 12 bp, Homo sapiens
gcctgcttctgt

SEQ ID NO: 1205385 - DNA, 22 bp, Homo sapiens
gcctgcttcttctctccacatg

SEQ ID NO: 1205386 - DNA, 16 bp, Homo sapiens
gcctgcttttccagga

SEQ ID NO: 1205387 - DNA, 19 bp, Homo sapiens
gcctgcttttccaggatcc

SEQ ID NO: 1205388 - DNA, 16 bp, Homo sapiens
gcctgctttttggaaa

SEQ ID NO: 1205389 - DNA, 21 bp, Homo sapiens
gcctgctttttggaaagtcag

SEQ ID NO: 1205390 - DNA, 19 bp, Homo sapiens
gcctggaaccagggaggag

SEQ ID NO: 1205391 - DNA, 20 bp, Homo sapiens
gcctggaaccagggaggaga

SEQ ID NO: 1205392 - DNA, 21 bp, Homo sapiens
gcctggaaccagggaggagag

SEQ ID NO: 1205393 - DNA, 16 bp, Homo sapiens
gcctggaataaaatat

SEQ ID NO: 1205394 - DNA, 16 bp, Homo sapiens
gcctggacaaaccctt

SEQ ID NO: 1205395 - DNA, 22 bp, Homo sapiens
gcctggacagtatcccacatcc

SEQ ID NO: 1205396 - DNA, 15 bp, Homo sapiens
gcctggaccaaaggg

SEQ ID NO: 1205397 - DNA, 20 bp, Homo sapiens
gcctggaccattcctgtccc

SEQ ID NO: 1205398 - DNA, 17 bp, Homo sapiens
gcctggaccgagatgtg

SEQ ID NO: 1205399 - DNA, 15 bp, Homo sapiens
gcctggacctatgca

SEQ ID NO: 1205400 - DNA, 14 bp, Homo sapiens
gcctggacctgcct

SEQ ID NO: 1205401 - DNA, 23 bp, Homo sapiens
gcctggacctgcctcctgcctgc

SEQ ID NO: 1205402 - DNA, 14 bp, Homo sapiens
gcctggacgggccc

SEQ ID NO: 1205403 - DNA, 18 bp, Homo sapiens
gcctggacgggccctcct

SEQ ID NO: 1205404 - DNA, 21 bp, Homo sapiens
gcctggacgggccctccttcc

SEQ ID NO: 1205405 - DNA, 22 bp, Homo sapiens
gcctggactctaagctggagct

SEQ ID NO: 1205406 - DNA, 16 bp, Homo sapiens
gcctggactctgcccc

SEQ ID NO: 1205407 - DNA, 17 bp, Homo sapiens
gcctggactctgcccca

SEQ ID NO: 1205408 - DNA, 18 bp, Homo sapiens
gcctggactttcctgcaa

SEQ ID NO: 1205409 - DNA, 13 bp, Homo sapiens
gcctggagaagct

SEQ ID NO: 1205410 - DNA, 16 bp, Homo sapiens
gcctggagacagatac

SEQ ID NO: 1205411 - DNA, 19 bp, Homo sapiens
gcctggagacttagggcac

SEQ ID NO: 1205412 - DNA, 16 bp, Homo sapiens
gcctggagatcctcct

SEQ ID NO: 1205413 - DNA, 19 bp, Homo sapiens
gcctggagatcctcctgca

SEQ ID NO: 1205414 - DNA, 12 bp, Homo sapiens
gcctggagcccc

SEQ ID NO: 1205415 - DNA, 18 bp, Homo sapiens
gcctggagccccatcggc

SEQ ID NO: 1205416 - DNA, 19 bp, Homo sapiens
gcctggagccctgggcgga

SEQ ID NO: 1205417 - DNA, 14 bp, Homo sapiens
gcctggaggctcag

SEQ ID NO: 1205418 - DNA, 22 bp, Homo sapiens
gcctggagggatgcccccaggc

SEQ ID NO: 1205419 - DNA, 12 bp, Homo sapiens
gcctggagggca

SEQ ID NO: 1205420 - DNA, 13 bp, Homo sapiens
gcctggagggcac

SEQ ID NO: 1205421 - DNA, 24 bp, Homo sapiens
gcctggagtgtatgactgcacatg

SEQ ID NO: 1205422 - DNA, 23 bp, Homo sapiens
gcctggagtgtcggatcctgtga

SEQ ID NO: 1205423 - DNA, 15 bp, Homo sapiens
gcctggatggcccct

SEQ ID NO: 1205424 - DNA, 22 bp, Homo sapiens
gcctggatggcccctccttgca

SEQ ID NO: 1205425 - DNA, 17 bp, Homo sapiens
gcctggatgtgggccaa

SEQ ID NO: 1205426 - DNA, 18 bp, Homo sapiens
gcctggatgtgggccaag

SEQ ID NO: 1205427 - DNA, 20 bp, Homo sapiens
gcctggatgttgctgtgcac

SEQ ID NO: 1205428 - DNA, 20 bp, Homo sapiens
gcctggattcatttcctgcc

SEQ ID NO: 1205429 - DNA, 18 bp, Homo sapiens
gcctggattccagcagtg

SEQ ID NO: 1205430 - DNA, 19 bp, Homo sapiens
gcctggcaacagagcgaga

SEQ ID NO: 1205431 - DNA, 12 bp, Homo sapiens
gcctggcaaggc

SEQ ID NO: 1205432 - DNA, 20 bp, Homo sapiens
gcctggcaaggcattcctca

SEQ ID NO: 1205433 - DNA, 16 bp, Homo sapiens
gcctggcacagaccag

SEQ ID NO: 1205434 - DNA, 12 bp, Homo sapiens
gcctggcaccca

SEQ ID NO: 1205435 - DNA, 13 bp, Homo sapiens
gcctggcacgaag

SEQ ID NO: 1205436 - DNA, 18 bp, Homo sapiens
gcctggcacgaaggcccc

SEQ ID NO: 1205437 - DNA, 13 bp, Homo sapiens
gcctggcagaact

SEQ ID NO: 1205438 - DNA, 20 bp, Homo sapiens
gcctggcagccgtgccttca

SEQ ID NO: 1205439 - DNA, 13 bp, Homo sapiens
gcctggcatctgt

SEQ ID NO: 1205440 - DNA, 16 bp, Homo sapiens
gcctggcatctgtgcg

SEQ ID NO: 1205441 - DNA, 18 bp, Homo sapiens
gcctggcatctgtgcgtg

SEQ ID NO: 1205442 - DNA, 16 bp, Homo sapiens
gcctggcatctgtgtg

SEQ ID NO: 1205443 - DNA, 20 bp, Homo sapiens
gcctggcattcttgtacagt

SEQ ID NO: 1205444 - DNA, 22 bp, Homo sapiens
gcctggcattcttgtacagtgt

SEQ ID NO: 1205445 - DNA, 13 bp, Homo sapiens
gcctggccagaca

SEQ ID NO: 1205446 - DNA, 15 bp, Homo sapiens
gcctggccaggcacc

SEQ ID NO: 1205447 - DNA, 23 bp, Homo sapiens
gcctggccaggcagatctgtgcc

SEQ ID NO: 1205448 - DNA, 13 bp, Homo sapiens
gcctggccagtcc

SEQ ID NO: 1205449 - DNA, 18 bp, Homo sapiens
gcctggccatactgtgtc

SEQ ID NO: 1205450 - DNA, 14 bp, Homo sapiens
gcctggccatctcc

SEQ ID NO: 1205451 - DNA, 21 bp, Homo sapiens
ctatgatggatggcagactct

SEQ ID NO: 1205452 - DNA, 19 bp, Homo sapiens
ctatgatttaatttgaaat

SEQ ID NO: 1205453 - DNA, 20 bp, Homo sapiens
ctatgcaaaaaattctttag

SEQ ID NO: 1205454 - DNA, 18 bp, Homo sapiens
ctatgcaataatccaccc

SEQ ID NO: 1205455 - DNA, 17 bp, Homo sapiens
ctatgcagacatctctg

SEQ ID NO: 1205456 - DNA, 18 bp, Homo sapiens
ctatgcagacatctctgg

SEQ ID NO: 1205457 - DNA, 19 bp, Homo sapiens
ctatgcagacatctctgga

SEQ ID NO: 1205458 - DNA, 16 bp, Homo sapiens
ctatgcagggaggcca

SEQ ID NO: 1205459 - DNA, 20 bp, Homo sapiens
ctatgcataaaaaaatgatg

SEQ ID NO: 1205460 - DNA, 21 bp, Homo sapiens
ctatgcatttgaaaattttga

SEQ ID NO: 1205461 - DNA, 17 bp, Homo sapiens
ctatgcattttcttcac

SEQ ID NO: 1205462 - DNA, 15 bp, Homo sapiens
ctatgccaaagatca

SEQ ID NO: 1205463 - DNA, 17 bp, Homo sapiens
ctatgccaaagatcact

SEQ ID NO: 1205464 - DNA, 18 bp, Homo sapiens
ctatgccaaagatcactt

SEQ ID NO: 1205465 - DNA, 22 bp, Homo sapiens
ctatgccaaagatcacttgttg

SEQ ID NO: 1205466 - DNA, 20 bp, Homo sapiens
ctatgccagctcagtcccat

SEQ ID NO: 1205467 - DNA, 17 bp, Homo sapiens
ctatgcccacataccca

SEQ ID NO: 1205468 - DNA, 13 bp, Homo sapiens
ctatgccctgcag

SEQ ID NO: 1205469 - DNA, 14 bp, Homo sapiens
ctatgccctgcaga

SEQ ID NO: 1205470 - DNA, 17 bp, Homo sapiens
ctatgccctgcagagca

SEQ ID NO: 1205471 - DNA, 18 bp, Homo sapiens
ctatgccctgcagagcaa

SEQ ID NO: 1205472 - DNA, 22 bp, Homo sapiens
ctatgccctgcagagcaataac

SEQ ID NO: 1205473 - DNA, 12 bp, Homo sapiens
ctatgccctgcc

SEQ ID NO: 1205474 - DNA, 19 bp, Homo sapiens
ctatgccctgcccttcctc

SEQ ID NO: 1205475 - DNA, 13 bp, Homo sapiens
ctatgcctgcact

SEQ ID NO: 1205476 - DNA, 23 bp, Homo sapiens
ctatgcctgcactgggaaggaaa

SEQ ID NO: 1205477 - DNA, 13 bp, Homo sapiens
ctatgcctgtggt

SEQ ID NO: 1205478 - DNA, 12 bp, Homo sapiens
ctatgccttgca

SEQ ID NO: 1205479 - DNA, 19 bp, Homo sapiens
ctatgcggaggaaagcaag

SEQ ID NO: 1205480 - DNA, 19 bp, Homo sapiens
ctatgctattgacaataaa

SEQ ID NO: 1205481 - DNA, 18 bp, Homo sapiens
ctatgctggggtacacag

SEQ ID NO: 1205482 - DNA, 20 bp, Homo sapiens
ctatgcttaataaaagaaca

SEQ ID NO: 1205483 - DNA, 16 bp, Homo sapiens
ctatggaaaatcagct

SEQ ID NO: 1205484 - DNA, 13 bp, Homo sapiens
ctatggaaacatt

SEQ ID NO: 1205485 - DNA, 14 bp, Homo sapiens
ctatggaaacattt

SEQ ID NO: 1205486 - DNA, 16 bp, Homo sapiens
ctatggaaacatttta

SEQ ID NO: 1205487 - DNA, 15 bp, Homo sapiens
ctatggaaagatggc

SEQ ID NO: 1205488 - DNA, 21 bp, Homo sapiens
ctatggaaatgtgagaaatgt

SEQ ID NO: 1205489 - DNA, 22 bp, Homo sapiens
ctatggaaatgtgagaaatgtc

SEQ ID NO: 1205490 - DNA, 22 bp, Homo sapiens
ctatggatcaaagaaattcaga

SEQ ID NO: 1205491 - DNA, 16 bp, Homo sapiens
ctatggatggcttcta

SEQ ID NO: 1205492 - DNA, 10 bp, Homo sapiens
ctatggatgt

SEQ ID NO: 1205493 - DNA, 18 bp, Homo sapiens
ctatggatgtggggtccc

SEQ ID NO: 1205494 - DNA, 20 bp, Homo sapiens
ctatggcaggataagaaagc

SEQ ID NO: 1205495 - DNA, 14 bp, Homo sapiens
ctatggcccagaaa

SEQ ID NO: 1205496 - DNA, 15 bp, Homo sapiens
ctatggcccagaaac

SEQ ID NO: 1205497 - DNA, 20 bp, Homo sapiens
ctatggctgatttatttcta

SEQ ID NO: 1205498 - DNA, 16 bp, Homo sapiens
ctatggcttatttcta

SEQ ID NO: 1205499 - DNA, 19 bp, Homo sapiens
ctatggctttaaataaatt

SEQ ID NO: 1205500 - DNA, 23 bp, Homo sapiens
gcctgtggtgaagtgtggctggt

SEQ ID NO: 1205501 - DNA, 12 bp, Homo sapiens
gcctgtgtccag

SEQ ID NO: 1205502 - DNA, 14 bp, Homo sapiens
gcctgtgtccagca

SEQ ID NO: 1205503 - DNA, 15 bp, Homo sapiens
gcctgtgtccagcag

SEQ ID NO: 1205504 - DNA, 17 bp, Homo sapiens
gcctgtgtccagcagct

SEQ ID NO: 1205505 - DNA, 12 bp, Homo sapiens
gcctgtgtccat

SEQ ID NO: 1205506 - DNA, 15 bp, Homo sapiens
gcctgtgtcccatga

SEQ ID NO: 1205507 - DNA, 19 bp, Homo sapiens
gcctgtgtcccatgaccca

SEQ ID NO: 1205508 - DNA, 20 bp, Homo sapiens
gcctgtgttagtgtctgtcc

SEQ ID NO: 1205509 - DNA, 21 bp, Homo sapiens
gcctgtgttagtgtctgtcca

SEQ ID NO: 1205510 - DNA, 21 bp, Homo sapiens
gcctgttaatttataatgtat

SEQ ID NO: 1205511 - DNA, 17 bp, Homo sapiens
gcctgttcccctcactg

SEQ ID NO: 1205512 - DNA, 11 bp, Homo sapiens
gcctgttcctt

SEQ ID NO: 1205513 - DNA, 18 bp, Homo sapiens
gcctgttctatgccttta

SEQ ID NO: 1205514 - DNA, 16 bp, Homo sapiens
gcctgttctgcttcga

SEQ ID NO: 1205515 - DNA, 23 bp, Homo sapiens
gcctgttgaaggtacatcgtttg

SEQ ID NO: 1205516 - DNA, 19 bp, Homo sapiens
gcctgttggacccgctctg

SEQ ID NO: 1205517 - DNA, 21 bp, Homo sapiens
gcctgttggacccgctctgga

SEQ ID NO: 1205518 - DNA, 17 bp, Homo sapiens
gcctgttggcaggccca

SEQ ID NO: 1205519 - DNA, 22 bp, Homo sapiens
gcctgttggcaggcccactccc

SEQ ID NO: 1205520 - DNA, 19 bp, Homo sapiens
gcctgtttctgcagccctt

SEQ ID NO: 1205521 - DNA, 17 bp, Homo sapiens
gcctgtttgatgtatgt

SEQ ID NO: 1205522 - DNA, 21 bp, Homo sapiens
gcctgtttgatgtatgtgtga

SEQ ID NO: 1205523 - DNA, 22 bp, Homo sapiens
gcctgtttggcgtttcccagag

SEQ ID NO: 1205524 - DNA, 12 bp, Homo sapiens
gcctgtttggga

SEQ ID NO: 1205525 - DNA, 16 bp, Homo sapiens
gccttaaacctgaaga

SEQ ID NO: 1205526 - DNA, 19 bp, Homo sapiens
gccttaaagagggacaggc

SEQ ID NO: 1205527 - DNA, 21 bp, Homo sapiens
gccttaaatttttgtcatttt

SEQ ID NO: 1205528 - DNA, 23 bp, Homo sapiens
gccttaactaagactcccgcccc

SEQ ID NO: 1205529 - DNA, 15 bp, Homo sapiens
gccttaagaactgtg

SEQ ID NO: 1205530 - DNA, 13 bp, Homo sapiens
gccttaagcaaat

SEQ ID NO: 1205531 - DNA, 16 bp, Homo sapiens
gccttaagctgatcct

SEQ ID NO: 1205532 - DNA, 18 bp, Homo sapiens
gccttaagctgatcctgc

SEQ ID NO: 1205533 - DNA, 20 bp, Homo sapiens
gccttaatagacttctctta

SEQ ID NO: 1205534 - DNA, 20 bp, Homo sapiens
gccttaatgacattcccctc

SEQ ID NO: 1205535 - DNA, 19 bp, Homo sapiens
gccttaatttcctttttga

SEQ ID NO: 1205536 - DNA, 17 bp, Homo sapiens
gccttaatttgcacagt

SEQ ID NO: 1205537 - DNA, 13 bp, Homo sapiens
gccttacactgaa

SEQ ID NO: 1205538 - DNA, 13 bp, Homo sapiens
gccttacatctgg

SEQ ID NO: 1205539 - DNA, 19 bp, Homo sapiens
gccttacatcttttctaat

SEQ ID NO: 1205540 - DNA, 17 bp, Homo sapiens
gccttacctcctgccca

SEQ ID NO: 1205541 - DNA, 19 bp, Homo sapiens
gccttacctcctgcccagg

SEQ ID NO: 1205542 - DNA, 20 bp, Homo sapiens
gccttacctcctgcccagga

SEQ ID NO: 1205543 - DNA, 22 bp, Homo sapiens
gccttacctcctgcccaggaga

SEQ ID NO: 1205544 - DNA, 23 bp, Homo sapiens
gccttagaaatgtaaactgccat

SEQ ID NO: 1205545 - DNA, 16 bp, Homo sapiens
gccttagaacctttct

SEQ ID NO: 1205546 - DNA, 15 bp, Homo sapiens
gccttagacaaatga

SEQ ID NO: 1205547 - DNA, 19 bp, Homo sapiens
gccttagcctcttggaaat

SEQ ID NO: 1205548 - DNA, 15 bp, Homo sapiens
gccttagctgccagt

SEQ ID NO: 1205549 - DNA, 15 bp, Homo sapiens
gccttaggcctacct

SEQ ID NO: 1205550 - DNA, 20 bp, Homo sapiens
gccttagtgggccagggctg

SEQ ID NO: 1205551 - DNA, 13 bp, Homo sapiens
gccttatcaagtg

SEQ ID NO: 1205552 - DNA, 19 bp, Homo sapiens
gccttatcgggctccagcc

SEQ ID NO: 1205553 - DNA, 23 bp, Homo sapiens
gccttatcgggctccagccatct

SEQ ID NO: 1205554 - DNA, 13 bp, Homo sapiens
gccttatgtgtta

SEQ ID NO: 1205555 - DNA, 16 bp, Homo sapiens
gccttatgtgttacat

SEQ ID NO: 1205556 - DNA, 19 bp, Homo sapiens
gccttatgtgttacattat

SEQ ID NO: 1205557 - DNA, 16 bp, Homo sapiens
gccttatgttgaaaaa

SEQ ID NO: 1205558 - DNA, 21 bp, Homo sapiens
gccttatttctcattgcctct

SEQ ID NO: 1205559 - DNA, 22 bp, Homo sapiens
gccttatttgtctgtaaaaaat

SEQ ID NO: 1205560 - DNA, 15 bp, Homo sapiens
gccttattttgaact

SEQ ID NO: 1205561 - DNA, 23 bp, Homo sapiens
gccttcaaggactgtttcagtgt

SEQ ID NO: 1205562 - DNA, 22 bp, Homo sapiens
gccttcacacagatagaccttt

SEQ ID NO: 1205563 - DNA, 20 bp, Homo sapiens
gccttcactccggtgtgcct

SEQ ID NO: 1205564 - DNA, 19 bp, Homo sapiens
gccttcagaatgctcctga

SEQ ID NO: 1205565 - DNA, 13 bp, Homo sapiens
gccttcagctcca

SEQ ID NO: 1205566 - DNA, 13 bp, Homo sapiens
gccttcagctcta

SEQ ID NO: 1205567 - DNA, 13 bp, Homo sapiens
gccttcagtagga

SEQ ID NO: 1205568 - DNA, 20 bp, Homo sapiens
gccttcatgaatctttcata

SEQ ID NO: 1205569 - DNA, 16 bp, Homo sapiens
gccttcattctgcaag

SEQ ID NO: 1205570 - DNA, 19 bp, Homo sapiens
gccttccaaaacctgcttc

SEQ ID NO: 1205571 - DNA, 21 bp, Homo sapiens
gccttccaaaacctgcttcct

SEQ ID NO: 1205572 - DNA, 23 bp, Homo sapiens
gccttccaactagctgggactac

SEQ ID NO: 1205573 - DNA, 19 bp, Homo sapiens
gccttccacgctgtctcca

SEQ ID NO: 1205574 - DNA, 22 bp, Homo sapiens
gccttccacgctgtctccagac

SEQ ID NO: 1205575 - DNA, 23 bp, Homo sapiens
gccttccacgctgtctccagacc

SEQ ID NO: 1205576 - DNA, 15 bp, Homo sapiens
gccttccagcccaga

SEQ ID NO: 1205577 - DNA, 23 bp, Homo sapiens
gccttccagcccagacccccagt

SEQ ID NO: 1205578 - DNA, 13 bp, Homo sapiens
gccttccagctgc

SEQ ID NO: 1205579 - DNA, 14 bp, Homo sapiens
gccttccagctgct

SEQ ID NO: 1205580 - DNA, 12 bp, Homo sapiens
ctattatttgga

SEQ ID NO: 1205581 - DNA, 17 bp, Homo sapiens
ctattcagacaagcaac

SEQ ID NO: 1205582 - DNA, 17 bp, Homo sapiens
ctattcagtaataactc

SEQ ID NO: 1205583 - DNA, 22 bp, Homo sapiens
ctattcattaagtaatcttttt

SEQ ID NO: 1205584 - DNA, 16 bp, Homo sapiens
ctattccctttgactt

SEQ ID NO: 1205585 - DNA, 23 bp, Homo sapiens
ctattccctttgacttcagctgc

SEQ ID NO: 1205586 - DNA, 18 bp, Homo sapiens
ctattcctgtaaataaga

SEQ ID NO: 1205587 - DNA, 12 bp, Homo sapiens
ctattcctttcc

SEQ ID NO: 1205588 - DNA, 15 bp, Homo sapiens
ctattcctttccctt

SEQ ID NO: 1205589 - DNA, 16 bp, Homo sapiens
ctattcctttcccttc

SEQ ID NO: 1205590 - DNA, 17 bp, Homo sapiens
ctattcctttcccttcc

SEQ ID NO: 1205591 - DNA, 22 bp, Homo sapiens
ctattcctttcccttcctcttc

SEQ ID NO: 1205592 - DNA, 21 bp, Homo sapiens
ctattctatccatctcctggt

SEQ ID NO: 1205593 - DNA, 15 bp, Homo sapiens
ctattctgagccttg

SEQ ID NO: 1205594 - DNA, 16 bp, Homo sapiens
ctattctgagccttga

SEQ ID NO: 1205595 - DNA, 19 bp, Homo sapiens
ctattctgtcagtgttaaa

SEQ ID NO: 1205596 - DNA, 15 bp, Homo sapiens
ctattctgtgttgaa

SEQ ID NO: 1205597 - DNA, 21 bp, Homo sapiens
ctattctgtttctaggctgtt

SEQ ID NO: 1205598 - DNA, 15 bp, Homo sapiens
ctattcttaagcact

SEQ ID NO: 1205599 - DNA, 21 bp, Homo sapiens
ctattcttgatttatttgctt

SEQ ID NO: 1205600 - DNA, 23 bp, Homo sapiens
ctattcttgatttatttgcttct

SEQ ID NO: 1205601 - DNA, 17 bp, Homo sapiens
ctattcttgggaaacac

SEQ ID NO: 1205602 - DNA, 17 bp, Homo sapiens
ctattgacaagtcattt

SEQ ID NO: 1205603 - DNA, 14 bp, Homo sapiens
ctattgacaataaa

SEQ ID NO: 1205604 - DNA, 15 bp, Homo sapiens
ctattgatgtacagt

SEQ ID NO: 1205605 - DNA, 19 bp, Homo sapiens
ctattgatgtacagtctgt

SEQ ID NO: 1205606 - DNA, 16 bp, Homo sapiens
ctattgcgctctcaag

SEQ ID NO: 1205607 - DNA, 19 bp, Homo sapiens
ctattgcgctctcaagacc

SEQ ID NO: 1205608 - DNA, 15 bp, Homo sapiens
ctattgctgtctggt

SEQ ID NO: 1205609 - DNA, 18 bp, Homo sapiens
ctattgcttggacttaac

SEQ ID NO: 1205610 - DNA, 21 bp, Homo sapiens
ctattggctgatctatgcctt

SEQ ID NO: 1205611 - DNA, 16 bp, Homo sapiens
ctattgggacagcatg

SEQ ID NO: 1205612 - DNA, 20 bp, Homo sapiens
ctattgggcacagcctaggg

SEQ ID NO: 1205613 - DNA, 22 bp, Homo sapiens
ctattgtaaggtctttgtaaaa

SEQ ID NO: 1205614 - DNA, 12 bp, Homo sapiens
ctattgtaatat

SEQ ID NO: 1205615 - DNA, 20 bp, Homo sapiens
ctattgtaatcgtgtgccat

SEQ ID NO: 1205616 - DNA, 21 bp, Homo sapiens
ctattgtaatcgtgtgccatg

SEQ ID NO: 1205617 - DNA, 16 bp, Homo sapiens
ctattgttactctggt

SEQ ID NO: 1205618 - DNA, 15 bp, Homo sapiens
ctatttaaaaaagag

SEQ ID NO: 1205619 - DNA, 14 bp, Homo sapiens
ctatttaaaattgg

SEQ ID NO: 1205620 - DNA, 13 bp, Homo sapiens
ctatttaaatgaa

SEQ ID NO: 1205621 - DNA, 21 bp, Homo sapiens
ctcaactaattttatttctat

SEQ ID NO: 1205622 - DNA, 19 bp, Homo sapiens
ctcaactccagagcccctt

SEQ ID NO: 1205623 - DNA, 13 bp, Homo sapiens
ctcaactgaaggg

SEQ ID NO: 1205624 - DNA, 23 bp, Homo sapiens
ctcaactgcctactccaaaatgt

SEQ ID NO: 1205625 - DNA, 12 bp, Homo sapiens
ctcaactgcctc

SEQ ID NO: 1205626 - DNA, 15 bp, Homo sapiens
ctcaactgcctcagc

SEQ ID NO: 1205627 - DNA, 15 bp, Homo sapiens
ctcaacttctttcct

SEQ ID NO: 1205628 - DNA, 20 bp, Homo sapiens
ctcaactttggttcctgtga

SEQ ID NO: 1205629 - DNA, 14 bp, Homo sapiens
ctcaagaaaggccc

SEQ ID NO: 1205630 - DNA, 21 bp, Homo sapiens
ctcaagaaataaaaggaagcc

SEQ ID NO: 1205631 - DNA, 23 bp, Homo sapiens
ctcaagaaataaaaggaagccaa

SEQ ID NO: 1205632 - DNA, 15 bp, Homo sapiens
ctcaagaacaaacac

SEQ ID NO: 1205633 - DNA, 12 bp, Homo sapiens
ctcaagaataaa

SEQ ID NO: 1205634 - DNA, 11 bp, Homo sapiens
ctcaagacaat

SEQ ID NO: 1205635 - DNA, 21 bp, Homo sapiens
ctcaagacccccatttgtccc

SEQ ID NO: 1205636 - DNA, 22 bp, Homo sapiens
ctcaagacccccatttgtccca

SEQ ID NO: 1205637 - DNA, 23 bp, Homo sapiens
ctcaagacccccatttgtcccag

SEQ ID NO: 1205638 - DNA, 14 bp, Homo sapiens
ctcaagacctgagt

SEQ ID NO: 1205639 - DNA, 12 bp, Homo sapiens
ctcaagactttg

SEQ ID NO: 1205640 - DNA, 15 bp, Homo sapiens
ctcaagactttgatc

SEQ ID NO: 1205641 - DNA, 21 bp, Homo sapiens
ctcaagactttgatccttgga

SEQ ID NO: 1205642 - DNA, 16 bp, Homo sapiens
ctcaagaggctgaggc

SEQ ID NO: 1205643 - DNA, 17 bp, Homo sapiens
ctcaagaggctgaggca

SEQ ID NO: 1205644 - DNA, 19 bp, Homo sapiens
ctcaagagttcagtgctca

SEQ ID NO: 1205645 - DNA, 15 bp, Homo sapiens
ctcaagatgggggca

SEQ ID NO: 1205646 - DNA, 21 bp, Homo sapiens
ctcaagatgggggcagggctg

SEQ ID NO: 1205647 - DNA, 19 bp, Homo sapiens
ctcaagcaatccacctgcc

SEQ ID NO: 1205648 - DNA, 21 bp, Homo sapiens
ctcaagcaatccacctgcctt

SEQ ID NO: 1205649 - DNA, 22 bp, Homo sapiens
ctcaagcaatccacctgccttg

SEQ ID NO: 1205650 - DNA, 18 bp, Homo sapiens
ctcaagcaatcctcctgc

SEQ ID NO: 1205651 - DNA, 20 bp, Homo sapiens
ctcaagcaatcctcctgcct

SEQ ID NO: 1205652 - DNA, 22 bp, Homo sapiens
ctcaagcaatcctcctgcctca

SEQ ID NO: 1205653 - DNA, 23 bp, Homo sapiens
ctcaagcaatccttctgccttgg

SEQ ID NO: 1205654 - DNA, 22 bp, Homo sapiens
ctcaagccagccccctccagct

SEQ ID NO: 1205655 - DNA, 18 bp, Homo sapiens
ctcaagccccatttcctc

SEQ ID NO: 1205656 - DNA, 12 bp, Homo sapiens
ctcaagccctga

SEQ ID NO: 1205657 - DNA, 19 bp, Homo sapiens
ctcaagcccttggggaggg

SEQ ID NO: 1205658 - DNA, 13 bp, Homo sapiens
ctcaagcctgtgg

SEQ ID NO: 1205659 - DNA, 16 bp, Homo sapiens
ctcaagcctgtgggca

SEQ ID NO: 1205660 - DNA, 17 bp, Homo sapiens
ctcaagcgattctcctg

SEQ ID NO: 1205661 - DNA, 18 bp, Homo sapiens
ctcaagcgggtggctctg

SEQ ID NO: 1205662 - DNA, 13 bp, Homo sapiens
ctcaagctagcca

SEQ ID NO: 1205663 - DNA, 17 bp, Homo sapiens
ctcaagctagccagagg

SEQ ID NO: 1205664 - DNA, 17 bp, Homo sapiens
ctcaagctagtgtttct

SEQ ID NO: 1205665 - DNA, 21 bp, Homo sapiens
ctcaagctatgatcagaagac

SEQ ID NO: 1205666 - DNA, 13 bp, Homo sapiens
ctcaaggacagga

SEQ ID NO: 1205667 - DNA, 17 bp, Homo sapiens
ctcaaggacaggagcct

SEQ ID NO: 1205668 - DNA, 21 bp, Homo sapiens
ctcaaggacaggagcctggtc

SEQ ID NO: 1205669 - DNA, 22 bp, Homo sapiens
ctcaaggactttgcagccggca

SEQ ID NO: 1205670 - DNA, 20 bp, Homo sapiens
ctcaaggataccttcttatt

SEQ ID NO: 1205671 - DNA, 15 bp, Homo sapiens
ctcaaggcccagcca

SEQ ID NO: 1205672 - DNA, 19 bp, Homo sapiens
ctcaaggccctcggagctg

SEQ ID NO: 1205673 - DNA, 14 bp, Homo sapiens
ctcaagggacaggg

SEQ ID NO: 1205674 - DNA, 15 bp, Homo sapiens
ctcaagggtccagaa

SEQ ID NO: 1205675 - DNA, 16 bp, Homo sapiens
ctcaagggtccagaag

SEQ ID NO: 1205676 - DNA, 19 bp, Homo sapiens
ctcaagggtggcaggtcac

SEQ ID NO: 1205677 - DNA, 16 bp, Homo sapiens
ctcaaggtgagaatta

SEQ ID NO: 1205678 - DNA, 19 bp, Homo sapiens
ctcaaggtgggccttgcta

SEQ ID NO: 1205679 - DNA, 17 bp, Homo sapiens
ctcaaggttctcatttc

SEQ ID NO: 1205680 - DNA, 19 bp, Homo sapiens
ctcaagtatcttctatttt

SEQ ID NO: 1205681 - DNA, 16 bp, Homo sapiens
ctcaagtcttccctga

SEQ ID NO: 1205682 - DNA, 18 bp, Homo sapiens
ctcaagtgttaaattatt

SEQ ID NO: 1205683 - DNA, 14 bp, Homo sapiens
ctcaagttcttgga

SEQ ID NO: 1205684 - DNA, 18 bp, Homo sapiens
ctcaagttcttggaccag

SEQ ID NO: 1205685 - DNA, 22 bp, Homo sapiens
ctcaagttgattagaaagacca

SEQ ID NO: 1205686 - DNA, 13 bp, Homo sapiens
ctcaagtttaaaa

SEQ ID NO: 1205687 - DNA, 16 bp, Homo sapiens
ctcaatagatctccag

SEQ ID NO: 1205688 - DNA, 18 bp, Homo sapiens
ctcaatattcctgaatga

SEQ ID NO: 1205689 - DNA, 16 bp, Homo sapiens
ctcaatcagtctcaga

SEQ ID NO: 1205690 - DNA, 16 bp, Homo sapiens
ctcaatcatgacttct

SEQ ID NO: 1205691 - DNA, 14 bp, Homo sapiens
ctcaatcctaattt

SEQ ID NO: 1205692 - DNA, 23 bp, Homo sapiens
ctcaatcctaatttctcctccct

SEQ ID NO: 1205693 - DNA, 17 bp, Homo sapiens
ctcaatctaaggccttc

SEQ ID NO: 1205694 - DNA, 12 bp, Homo sapiens
ctcaatgaaaaa

SEQ ID NO: 1205695 - DNA, 16 bp, Homo sapiens
ctcaatgagctcttcc

SEQ ID NO: 1205696 - DNA, 14 bp, Homo sapiens
ctcaatgcagtcag

SEQ ID NO: 1205697 - DNA, 22 bp, Homo sapiens
ctcaatgcagtcagtgtttctt

SEQ ID NO: 1205698 - DNA, 20 bp, Homo sapiens
ctcaatgcattgtcttgtgg

SEQ ID NO: 1205699 - DNA, 21 bp, Homo sapiens
ctcaatgcattgtcttgtgga

SEQ ID NO: 1205700 - DNA, 19 bp, Homo sapiens
ctcaatgctttatttgtaa

SEQ ID NO: 1205701 - DNA, 14 bp, Homo sapiens
ctcaatggactgga

SEQ ID NO: 1205702 - DNA, 15 bp, Homo sapiens
ctcaatggaggtttg

SEQ ID NO: 1205703 - DNA, 20 bp, Homo sapiens
ctcaatgtgaatcagaccct

SEQ ID NO: 1205704 - DNA, 14 bp, Homo sapiens
ctcaatgtgaccag

SEQ ID NO: 1205705 - DNA, 15 bp, Homo sapiens
ctcaatgtgaccagg

SEQ ID NO: 1205706 - DNA, 22 bp, Homo sapiens
ctcaatttttgtttttgagtac

SEQ ID NO: 1205707 - DNA, 18 bp, Homo sapiens
ctcacaaaatcactttaa

SEQ ID NO: 1205708 - DNA, 22 bp, Homo sapiens
ctcacaaaccatgcaaatgcta

SEQ ID NO: 1205709 - DNA, 15 bp, Homo sapiens
gccttgtgccctgcc

SEQ ID NO: 1205710 - DNA, 16 bp, Homo sapiens
gccttgtgccctgccc

SEQ ID NO: 1205711 - DNA, 17 bp, Homo sapiens
gccttgtgccctgcccc

SEQ ID NO: 1205712 - DNA, 12 bp, Homo sapiens
gccttgtgtaca

SEQ ID NO: 1205713 - DNA, 22 bp, Homo sapiens
gccttgtgtcagagctgggagt

SEQ ID NO: 1205714 - DNA, 18 bp, Homo sapiens
gccttgtgtgtcaggccc

SEQ ID NO: 1205715 - DNA, 15 bp, Homo sapiens
gccttgttcctcagc

SEQ ID NO: 1205716 - DNA, 19 bp, Homo sapiens
gccttgtttgagtttttcc

SEQ ID NO: 1205717 - DNA, 14 bp, Homo sapiens
gcctttaagaacct

SEQ ID NO: 1205718 - DNA, 20 bp, Homo sapiens
gcctttaagaaccttaatga

SEQ ID NO: 1205719 - DNA, 16 bp, Homo sapiens
gcctttaagccaaaga

SEQ ID NO: 1205720 - DNA, 20 bp, Homo sapiens
gcctttaatattttgtaata

SEQ ID NO: 1205721 - DNA, 14 bp, Homo sapiens
gcctttagaaaata

SEQ ID NO: 1205722 - DNA, 13 bp, Homo sapiens
gcctttagcctgg

SEQ ID NO: 1205723 - DNA, 19 bp, Homo sapiens
gcctttaggggtgtgtatt

SEQ ID NO: 1205724 - DNA, 15 bp, Homo sapiens
gcctttatctcagcc

SEQ ID NO: 1205725 - DNA, 14 bp, Homo sapiens
gcctttatggtttc

SEQ ID NO: 1205726 - DNA, 22 bp, Homo sapiens
gcctttatgttttttgtaagat

SEQ ID NO: 1205727 - DNA, 23 bp, Homo sapiens
gcctttatgttttttgtaagata

SEQ ID NO: 1205728 - DNA, 21 bp, Homo sapiens
gcctttattaaaaactgagtg

SEQ ID NO: 1205729 - DNA, 18 bp, Homo sapiens
gcctttcaggtccaggcc

SEQ ID NO: 1205730 - DNA, 19 bp, Homo sapiens
gcctttcaggtccaggcca

SEQ ID NO: 1205731 - DNA, 21 bp, Homo sapiens
gcctttccagagaactgcaga

SEQ ID NO: 1205732 - DNA, 22 bp, Homo sapiens
gcctttccagagaactgcagac

SEQ ID NO: 1205733 - DNA, 24 bp, Homo sapiens
gcctttccagagaactgcagacct

SEQ ID NO: 1205734 - DNA, 14 bp, Homo sapiens
gcctttcctcaaaa

SEQ ID NO: 1205735 - DNA, 21 bp, Homo sapiens
gcctttcctcaaaactggagt

SEQ ID NO: 1205736 - DNA, 22 bp, Homo sapiens
gcctttcctcggtctcccttcc

SEQ ID NO: 1205737 - DNA, 17 bp, Homo sapiens
gcctttcctgtagcctt

SEQ ID NO: 1205738 - DNA, 13 bp, Homo sapiens
gcctttcctgtgc

SEQ ID NO: 1205739 - DNA, 14 bp, Homo sapiens
gcctttccttccct

SEQ ID NO: 1205740 - DNA, 19 bp, Homo sapiens
gcctttccttccctctctg

SEQ ID NO: 1205741 - DNA, 20 bp, Homo sapiens
gcctttccttccctctctga

SEQ ID NO: 1205742 - DNA, 23 bp, Homo sapiens
gcgctgcagcagggcaggaaggg

SEQ ID NO: 1205743 - DNA, 11 bp, Homo sapiens
gcgctgcaggt

SEQ ID NO: 1205744 - DNA, 22 bp, Homo sapiens
gcgctgcgcggactcgccccca

SEQ ID NO: 1205745 - DNA, 10 bp, Homo sapiens
gcgctgctaa

SEQ ID NO: 1205746 - DNA, 20 bp, Homo sapiens
gcgctgctctgcaggctggg

SEQ ID NO: 1205747 - DNA, 13 bp, Homo sapiens
gcgctgctggtgt

SEQ ID NO: 1205748 - DNA, 10 bp, Homo sapiens
gcgctggccc

SEQ ID NO: 1205749 - DNA, 14 bp, Homo sapiens
gcgctggcccagcc

SEQ ID NO: 1205750 - DNA, 15 bp, Homo sapiens
gcgctggcccagccg

SEQ ID NO: 1205751 - DNA, 16 bp, Homo sapiens
gcgctggcccagccgg

SEQ ID NO: 1205752 - DNA, 12 bp, Homo sapiens
gcgctgggaagg

SEQ ID NO: 1205753 - DNA, 23 bp, Homo sapiens
gcgctggggaagtacgtcccagc

SEQ ID NO: 1205754 - DNA, 14 bp, Homo sapiens
gcgctgtcccaggc

SEQ ID NO: 1205755 - DNA, 17 bp, Homo sapiens
gcgctgtcccaggcatg

SEQ ID NO: 1205756 - DNA, 12 bp, Homo sapiens
gcgctgtggact

SEQ ID NO: 1205757 - DNA, 18 bp, Homo sapiens
gcgctgtttttgttgtgt

SEQ ID NO: 1205758 - DNA, 15 bp, Homo sapiens
gcgcttactcctctg

SEQ ID NO: 1205759 - DNA, 15 bp, Homo sapiens
gcgcttcatctcatg

SEQ ID NO: 1205760 - DNA, 11 bp, Homo sapiens
gcgcttcctgg

SEQ ID NO: 1205761 - DNA, 14 bp, Homo sapiens
gcgcttctggtctg

SEQ ID NO: 1205762 - DNA, 22 bp, Homo sapiens
gcgcttgggcgccgtgctgggc

SEQ ID NO: 1205763 - DNA, 21 bp, Homo sapiens
gcgcttggtaggtgtggtggc

SEQ ID NO: 1205764 - DNA, 21 bp, Homo sapiens
gcggaaagtgagagccagcag

SEQ ID NO: 1205765 - DNA, 20 bp, Homo sapiens
gcggaacaaggagtcagaca

SEQ ID NO: 1205766 - DNA, 19 bp, Homo sapiens
gcggaactatgaaaagtgg

SEQ ID NO: 1205767 - DNA, 12 bp, Homo sapiens
gcggaagccata

SEQ ID NO: 1205768 - DNA, 18 bp, Homo sapiens
gcggaagccatagggggc

SEQ ID NO: 1205769 - DNA, 22 bp, Homo sapiens
gcggaagccatagggggctgca

SEQ ID NO: 1205770 - DNA, 23 bp, Homo sapiens
gcggaagccatagggggctgcac

SEQ ID NO: 1205771 - DNA, 21 bp, Homo sapiens
gcggaattcaccagtgttcct

SEQ ID NO: 1205772 - DNA, 20 bp, Homo sapiens
gcggacaaaagggccaggtg

SEQ ID NO: 1205773 - DNA, 18 bp, Homo sapiens
gcggacaccgtggcctgg

SEQ ID NO: 1205774 - DNA, 20 bp, Homo sapiens
gcggacaccgtggcctgggc

SEQ ID NO: 1205775 - DNA, 14 bp, Homo sapiens
gcggacgggctgtc

SEQ ID NO: 1205776 - DNA, 14 bp, Homo sapiens
gcggacgtgctggc

SEQ ID NO: 1205777 - DNA, 22 bp, Homo sapiens
gcggagagggctagccctgagc

SEQ ID NO: 1205778 - DNA, 15 bp, Homo sapiens
gcggagagtacagtg

SEQ ID NO: 1205779 - DNA, 14 bp, Homo sapiens
gcggagcccagcct

SEQ ID NO: 1205780 - DNA, 13 bp, Homo sapiens
gcggagcgggagg

SEQ ID NO: 1205781 - DNA, 14 bp, Homo sapiens
gcggagctggcccc

SEQ ID NO: 1205782 - DNA, 19 bp, Homo sapiens
gcggagctggggtctgggc

SEQ ID NO: 1205783 - DNA, 21 bp, Homo sapiens
gcggagctggggtctgggcag

SEQ ID NO: 1205784 - DNA, 22 bp, Homo sapiens
gcggagctggggtctgggcagt

SEQ ID NO: 1205785 - DNA, 23 bp, Homo sapiens
gcggagctggggtctgggcagtg

SEQ ID NO: 1205786 - DNA, 21 bp, Homo sapiens
gcggaggaggaagagggtaga

SEQ ID NO: 1205787 - DNA, 21 bp, Homo sapiens
gcggaggaggaagtcatggga

SEQ ID NO: 1205788 - DNA, 13 bp, Homo sapiens
gcggaggaggagg

SEQ ID NO: 1205789 - DNA, 16 bp, Homo sapiens
gcggaggaggctggtg

SEQ ID NO: 1205790 - DNA, 21 bp, Homo sapiens
gcggaggtgtggagccgaggc

SEQ ID NO: 1205791 - DNA, 15 bp, Homo sapiens
gcggaggttgcaggg

SEQ ID NO: 1205792 - DNA, 19 bp, Homo sapiens
gcggaggttgcagtgagct

SEQ ID NO: 1205793 - DNA, 18 bp, Homo sapiens
gcggagtgaagaggggca

SEQ ID NO: 1205794 - DNA, 20 bp, Homo sapiens
gcggagtgaagaggggcagc

SEQ ID NO: 1205795 - DNA, 21 bp, Homo sapiens
gcggagtgaagaggggcagcc

SEQ ID NO: 1205796 - DNA, 21 bp, Homo sapiens
gcggatggatggaaggttgga

SEQ ID NO: 1205797 - DNA, 19 bp, Homo sapiens
gcggattgctctggagcag

SEQ ID NO: 1205798 - DNA, 20 bp, Homo sapiens
gcggattgctctggagcagc

SEQ ID NO: 1205799 - DNA, 14 bp, Homo sapiens
gcggcaaaaggaaa

SEQ ID NO: 1205800 - DNA, 16 bp, Homo sapiens
gcggcaaaaggaaagc

SEQ ID NO: 1205801 - DNA, 20 bp, Homo sapiens
gcggcacgccaacagccccc

SEQ ID NO: 1205802 - DNA, 14 bp, Homo sapiens
gcggcagcagccat

SEQ ID NO: 1205803 - DNA, 15 bp, Homo sapiens
gcggcagccccactt

SEQ ID NO: 1205804 - DNA, 18 bp, Homo sapiens
gcggcagctcttctgggc

SEQ ID NO: 1205805 - DNA, 21 bp, Homo sapiens
gcggcagctcttctgggcaga

SEQ ID NO: 1205806 - DNA, 22 bp, Homo sapiens
gcggcaggagggaggtttgtga

SEQ ID NO: 1205807 - DNA, 14 bp, Homo sapiens
gcggcagtgggcct

SEQ ID NO: 1205808 - DNA, 17 bp, Homo sapiens
gcggcatgaaccctctt

SEQ ID NO: 1205809 - DNA, 18 bp, Homo sapiens
gcggcatgaaccctcttg

SEQ ID NO: 1205810 - DNA, 19 bp, Homo sapiens
gcggccactgcgccactgc

SEQ ID NO: 1205811 - DNA, 19 bp, Homo sapiens
gcggccagggcggccaggg

SEQ ID NO: 1205812 - DNA, 21 bp, Homo sapiens
gcggccagggcggccagggac

SEQ ID NO: 1205813 - DNA, 23 bp, Homo sapiens
gcggccagggcggccagggaccc

SEQ ID NO: 1205814 - DNA, 15 bp, Homo sapiens
gcggcccagacccag

SEQ ID NO: 1205815 - DNA, 16 bp, Homo sapiens
gcggcccagacccagc

SEQ ID NO: 1205816 - DNA, 20 bp, Homo sapiens
gcggccccaactcgggctcc

SEQ ID NO: 1205817 - DNA, 22 bp, Homo sapiens
gcggccccccgcacagccaccc

SEQ ID NO: 1205818 - DNA, 15 bp, Homo sapiens
gcggcccgtggacac

SEQ ID NO: 1205819 - DNA, 14 bp, Homo sapiens
gcggccctcagtgc

SEQ ID NO: 1205820 - DNA, 14 bp, Homo sapiens
gcggccctggggag

SEQ ID NO: 1205821 - DNA, 16 bp, Homo sapiens
gcggccgcattccctg

SEQ ID NO: 1205822 - DNA, 17 bp, Homo sapiens
gcggccgcattccctga

SEQ ID NO: 1205823 - DNA, 15 bp, Homo sapiens
gcggccggccgagct

SEQ ID NO: 1205824 - DNA, 21 bp, Homo sapiens
gcggccggccgagctgcctgg

SEQ ID NO: 1205825 - DNA, 15 bp, Homo sapiens
gcggcctcaccaggc

SEQ ID NO: 1205826 - DNA, 24 bp, Homo sapiens
gcggcctcaccaggcccacgagga

SEQ ID NO: 1205827 - DNA, 15 bp, Homo sapiens
gcggcctcagggtct

SEQ ID NO: 1205828 - DNA, 21 bp, Homo sapiens
gcggcctcagggtctaaggag

SEQ ID NO: 1205829 - DNA, 21 bp, Homo sapiens
gcggcctgcaccgaccccggg

SEQ ID NO: 1205830 - DNA, 21 bp, Homo sapiens
gcggcctgcaccgacccgagg

SEQ ID NO: 1205831 - DNA, 22 bp, Homo sapiens
gcggcctggggggaacggatgc

SEQ ID NO: 1205832 - DNA, 16 bp, Homo sapiens
gcggccttccgggtct

SEQ ID NO: 1205833 - DNA, 16 bp, Homo sapiens
gcggcctttggcttca

SEQ ID NO: 1205834 - DNA, 16 bp, Homo sapiens
gcggcggagctggccc

SEQ ID NO: 1205835 - DNA, 20 bp, Homo sapiens
gcggcggagctggccccgcc

SEQ ID NO: 1205836 - DNA, 15 bp, Homo sapiens
gcggcggctctgccc

SEQ ID NO: 1205837 - DNA, 17 bp, Homo sapiens
gcggcggtcccagctcc

SEQ ID NO: 1205838 - DNA, 16 bp, Homo sapiens
gcggctcagccttgca

SEQ ID NO: 1205839 - DNA, 14 bp, Homo sapiens
gcggctcctcgccc

SEQ ID NO: 1205840 - DNA, 18 bp, Homo sapiens
gcggctctgagcaggggc

SEQ ID NO: 1205841 - DNA, 16 bp, Homo sapiens
ctaaacagacaggaat

SEQ ID NO: 1205842 - DNA, 17 bp, Homo sapiens
ctaaacagatataaatg

SEQ ID NO: 1205843 - DNA, 16 bp, Homo sapiens
ctaaacataattgtgg

SEQ ID NO: 1205844 - DNA, 18 bp, Homo sapiens
ctaaacatccaatatttt

SEQ ID NO: 1205845 - DNA, 16 bp, Homo sapiens
ctaaaccaagttattt

SEQ ID NO: 1205846 - DNA, 19 bp, Homo sapiens
ctaaaccacttctctgctg

SEQ ID NO: 1205847 - DNA, 16 bp, Homo sapiens
ctaaacccctgtccca

SEQ ID NO: 1205848 - DNA, 12 bp, Homo sapiens
ctaaacctcagt

SEQ ID NO: 1205849 - DNA, 13 bp, Homo sapiens
ctaaacctcagtt

SEQ ID NO: 1205850 - DNA, 20 bp, Homo sapiens
ctaaacgagtcaatcccctc

SEQ ID NO: 1205851 - DNA, 15 bp, Homo sapiens
ctaaacggattccaa

SEQ ID NO: 1205852 - DNA, 12 bp, Homo sapiens
ctaaactccagg

SEQ ID NO: 1205853 - DNA, 14 bp, Homo sapiens
ctaaactccttcct

SEQ ID NO: 1205854 - DNA, 15 bp, Homo sapiens
ctaaactccttcctg

SEQ ID NO: 1205855 - DNA, 21 bp, Homo sapiens
ctaaactgagctcgcagcccc

SEQ ID NO: 1205856 - DNA, 12 bp, Homo sapiens
ctaaactgcaaa

SEQ ID NO: 1205857 - DNA, 23 bp, Homo sapiens
ctaaactgcagcctctctggctg

SEQ ID NO: 1205858 - DNA, 16 bp, Homo sapiens
ctaaactggtacaatt

SEQ ID NO: 1205859 - DNA, 16 bp, Homo sapiens
ctaaactgttaaacaa

SEQ ID NO: 1205860 - DNA, 18 bp, Homo sapiens
ctaaactttatttgtaaa

SEQ ID NO: 1205861 - DNA, 18 bp, Homo sapiens
ctaaactttttttctgta

SEQ ID NO: 1205862 - DNA, 21 bp, Homo sapiens
ctaaagaaagattacttagag

SEQ ID NO: 1205863 - DNA, 22 bp, Homo sapiens
ctaaagaaatatattattcatc

SEQ ID NO: 1205864 - DNA, 16 bp, Homo sapiens
ctaaagagcccttgcc

SEQ ID NO: 1205865 - DNA, 19 bp, Homo sapiens
ctaaagagcccttgcctcc

SEQ ID NO: 1205866 - DNA, 23 bp, Homo sapiens
ctaaagagcccttgcctccccat

SEQ ID NO: 1205867 - DNA, 12 bp, Homo sapiens
ctaaagagctgc

SEQ ID NO: 1205868 - DNA, 22 bp, Homo sapiens
ctaaagagttattcaaatgaag

SEQ ID NO: 1205869 - DNA, 19 bp, Homo sapiens
ctaaagatatcagagctct

SEQ ID NO: 1205870 - DNA, 22 bp, Homo sapiens
ctaaagatatcagagctcttaa

SEQ ID NO: 1205871 - DNA, 16 bp, Homo sapiens
ctaaagatgggaggag

SEQ ID NO: 1205872 - DNA, 23 bp, Homo sapiens
ctaaagatgggaggagaccagcg

SEQ ID NO: 1205873 - DNA, 16 bp, Homo sapiens
ctaaagcaaattgttt

SEQ ID NO: 1205874 - DNA, 18 bp, Homo sapiens
ctaaagcaaattgtttca

SEQ ID NO: 1205875 - DNA, 18 bp, Homo sapiens
ctaaagcactggtttcaa

SEQ ID NO: 1205876 - DNA, 14 bp, Homo sapiens
ctaaagcactttgc

SEQ ID NO: 1205877 - DNA, 18 bp, Homo sapiens
ctaaagcattttttaaaa

SEQ ID NO: 1205878 - DNA, 17 bp, Homo sapiens
ctaaagccaaccagcct

SEQ ID NO: 1205879 - DNA, 18 bp, Homo sapiens
ctaaagccaaccagcctt

SEQ ID NO: 1205880 - DNA, 21 bp, Homo sapiens
ctaaagcctaccctattctat

SEQ ID NO: 1205881 - DNA, 22 bp, Homo sapiens
ctaaagctttatctttgtgtaa

SEQ ID NO: 1205882 - DNA, 17 bp, Homo sapiens
ctaaaggcatccttgtc

SEQ ID NO: 1205883 - DNA, 16 bp, Homo sapiens
ctaaaggctacctttg

SEQ ID NO: 1205884 - DNA, 16 bp, Homo sapiens
ctaaagggaccatctg

SEQ ID NO: 1205885 - DNA, 20 bp, Homo sapiens
ctaaagggaccatctgctgc

SEQ ID NO: 1205886 - DNA, 19 bp, Homo sapiens
ctaaagggagaaatgccag

SEQ ID NO: 1205887 - DNA, 15 bp, Homo sapiens
ctaaagggagaagga

SEQ ID NO: 1205888 - DNA, 19 bp, Homo sapiens
ctaaagggagaaggaaggg

SEQ ID NO: 1205889 - DNA, 17 bp, Homo sapiens
ctaaaggtgtatttaaa

SEQ ID NO: 1205890 - DNA, 24 bp, Homo sapiens
ctaaagtaaaattgaagcaactac

SEQ ID NO: 1205891 - DNA, 19 bp, Homo sapiens
ctaaagtatacaactgcct

SEQ ID NO: 1205892 - DNA, 20 bp, Homo sapiens
ctaaagtatgtaaagtatgt

SEQ ID NO: 1205893 - DNA, 18 bp, Homo sapiens
ctaaagtgcctaccccag

SEQ ID NO: 1205894 - DNA, 15 bp, Homo sapiens
ctaaagtgctggaac

SEQ ID NO: 1205895 - DNA, 19 bp, Homo sapiens
ctaaagtgtgttgttgctt

SEQ ID NO: 1205896 - DNA, 10 bp, Homo sapiens
ctaaagtgtt

SEQ ID NO: 1205897 - DNA, 16 bp, Homo sapiens
ctaaagtgtttagctg

SEQ ID NO: 1205898 - DNA, 11 bp, Homo sapiens
ctaaagttata

SEQ ID NO: 1205899 - DNA, 23 bp, Homo sapiens
ctaaagttttcttcccagagaga

SEQ ID NO: 1205900 - DNA, 20 bp, Homo sapiens
ctaaagttttgcaacaatta

SEQ ID NO: 1205901 - DNA, 18 bp, Homo sapiens
ctaaataaaaatatgtaa

SEQ ID NO: 1205902 - DNA, 20 bp, Homo sapiens
ctaaataaacacgattttat

SEQ ID NO: 1205903 - DNA, 24 bp, Homo sapiens
ctaaataaacagatgtattatgct

SEQ ID NO: 1205904 - DNA, 12 bp, Homo sapiens
ctaaataaatgg

SEQ ID NO: 1205905 - DNA, 16 bp, Homo sapiens
ctaaataacacagata

SEQ ID NO: 1205906 - DNA, 18 bp, Homo sapiens
ctaaataagaaaataaca

SEQ ID NO: 1205907 - DNA, 19 bp, Homo sapiens
ctaaataaggaatttcctc

SEQ ID NO: 1205908 - DNA, 12 bp, Homo sapiens
ctaaataatgaa

SEQ ID NO: 1205909 - DNA, 22 bp, Homo sapiens
ctaaatactgactgctggacat

SEQ ID NO: 1205910 - DNA, 23 bp, Homo sapiens
ctaaatactttaaaatttgtcct

SEQ ID NO: 1205911 - DNA, 15 bp, Homo sapiens
ctaaatagttctatc

SEQ ID NO: 1205912 - DNA, 13 bp, Homo sapiens
ctaaatatatgtc

SEQ ID NO: 1205913 - DNA, 16 bp, Homo sapiens
ctaaatatatgtctgt

SEQ ID NO: 1205914 - DNA, 18 bp, Homo sapiens
ctaaatatccaaagactg

SEQ ID NO: 1205915 - DNA, 14 bp, Homo sapiens
ctaaatatctgtca

SEQ ID NO: 1205916 - DNA, 14 bp, Homo sapiens
ctaaatatttcctt

SEQ ID NO: 1205917 - DNA, 22 bp, Homo sapiens
ctaaatatttccttaaactgtg

SEQ ID NO: 1205918 - DNA, 16 bp, Homo sapiens
ctaaatattttcaaga

SEQ ID NO: 1205919 - DNA, 17 bp, Homo sapiens
ctaaatcccaagaaatg

SEQ ID NO: 1205920 - DNA, 23 bp, Homo sapiens
ctaaatccttttgttttgaagct

SEQ ID NO: 1205921 - DNA, 21 bp, Homo sapiens
ctaaatctccaaaataaaact

SEQ ID NO: 1205922 - DNA, 19 bp, Homo sapiens
ctaaatctccaagacctgg

SEQ ID NO: 1205923 - DNA, 11 bp, Homo sapiens
ctaaatgaagt

SEQ ID NO: 1205924 - DNA, 22 bp, Homo sapiens
ctaaatgaatgagccaaaatga

SEQ ID NO: 1205925 - DNA, 15 bp, Homo sapiens
ctaaatgaatgttta

SEQ ID NO: 1205926 - DNA, 14 bp, Homo sapiens
ctaaatgcaaagca

SEQ ID NO: 1205927 - DNA, 20 bp, Homo sapiens
ctaaatgcaccaagaaagct

SEQ ID NO: 1205928 - DNA, 16 bp, Homo sapiens
ctaaatgccatgttta

SEQ ID NO: 1205929 - DNA, 18 bp, Homo sapiens
ctaaatgccatgtttatc

SEQ ID NO: 1205930 - DNA, 15 bp, Homo sapiens
ctaaatgcccagttc

SEQ ID NO: 1205931 - DNA, 15 bp, Homo sapiens
ctaaatggaaccact

SEQ ID NO: 1205932 - DNA, 21 bp, Homo sapiens
ctaaatggtcgcccaggagac

SEQ ID NO: 1205933 - DNA, 13 bp, Homo sapiens
ctaaatgtaaaat

SEQ ID NO: 1205934 - DNA, 18 bp, Homo sapiens
ctaaatgtgcaatagaag

SEQ ID NO: 1205935 - DNA, 19 bp, Homo sapiens
ctaaattacaattgtcatt

SEQ ID NO: 1205936 - DNA, 18 bp, Homo sapiens
ctaaattacagtgcagtt

SEQ ID NO: 1205937 - DNA, 15 bp, Homo sapiens
ctaaattagataaat

SEQ ID NO: 1205938 - DNA, 15 bp, Homo sapiens
ctaaatttaatgctg

SEQ ID NO: 1205939 - DNA, 16 bp, Homo sapiens
ctaaatttattaaata

SEQ ID NO: 1205940 - DNA, 13 bp, Homo sapiens
ctaaatttcttct

SEQ ID NO: 1205941 - DNA, 14 bp, Homo sapiens
ctaaattttaaagc

SEQ ID NO: 1205942 - DNA, 23 bp, Homo sapiens
ctaaattttcttttaagcatttg

SEQ ID NO: 1205943 - DNA, 13 bp, Homo sapiens
ctaacaaaatgag

SEQ ID NO: 1205944 - DNA, 15 bp, Homo sapiens
ctaacaaaatgagat

SEQ ID NO: 1205945 - DNA, 18 bp, Homo sapiens
ctaacaagaatgtaactc

SEQ ID NO: 1205946 - DNA, 22 bp, Homo sapiens
ctaacaagtcataggttaatat

SEQ ID NO: 1205947 - DNA, 22 bp, Homo sapiens
ctaacaatcagctccttcctgg

SEQ ID NO: 1205948 - DNA, 15 bp, Homo sapiens
ctaacacattaaatg

SEQ ID NO: 1205949 - DNA, 15 bp, Homo sapiens
ctaacaccagacaga

SEQ ID NO: 1205950 - DNA, 13 bp, Homo sapiens
ctaacaccagcgt

SEQ ID NO: 1205951 - DNA, 20 bp, Homo sapiens
ctaacactggcatgttcaaa

SEQ ID NO: 1205952 - DNA, 14 bp, Homo sapiens
ctaacactggcccc

SEQ ID NO: 1205953 - DNA, 19 bp, Homo sapiens
gcccttagcacagagaggg

SEQ ID NO: 1205954 - DNA, 20 bp, Homo sapiens
gcccttagcacagagaggga

SEQ ID NO: 1205955 - DNA, 17 bp, Homo sapiens
gcccttattttcaagaa

SEQ ID NO: 1205956 - DNA, 20 bp, Homo sapiens
gcccttattttcaagaaact

SEQ ID NO: 1205957 - DNA, 15 bp, Homo sapiens
gcccttcactgccat

SEQ ID NO: 1205958 - DNA, 21 bp, Homo sapiens
gcccttcagtctgctccacca

SEQ ID NO: 1205959 - DNA, 15 bp, Homo sapiens
gcccttccagcctgg

SEQ ID NO: 1205960 - DNA, 19 bp, Homo sapiens
gcccttccagcctgggaca

SEQ ID NO: 1205961 - DNA, 14 bp, Homo sapiens
gcccttccagtggg

SEQ ID NO: 1205962 - DNA, 12 bp, Homo sapiens
gcccttcccact

SEQ ID NO: 1205963 - DNA, 16 bp, Homo sapiens
gcccttcccactggag

SEQ ID NO: 1205964 - DNA, 23 bp, Homo sapiens
gcccttcccctcccccactcctc

SEQ ID NO: 1205965 - DNA, 14 bp, Homo sapiens
gcccttccctctgg

SEQ ID NO: 1205966 - DNA, 18 bp, Homo sapiens
gcccttccctctgggcac

SEQ ID NO: 1205967 - DNA, 13 bp, Homo sapiens
gcccttccctgag

SEQ ID NO: 1205968 - DNA, 14 bp, Homo sapiens
ctaacatctttacg

SEQ ID NO: 1205969 - DNA, 22 bp, Homo sapiens
ctaacatctttacgtactgtaa

SEQ ID NO: 1205970 - DNA, 16 bp, Homo sapiens
ctaacatggtttaaaa

SEQ ID NO: 1205971 - DNA, 20 bp, Homo sapiens
ctaacatgttatcaaatctg

SEQ ID NO: 1205972 - DNA, 17 bp, Homo sapiens
ctaacattattactttt

SEQ ID NO: 1205973 - DNA, 19 bp, Homo sapiens
ctaaccaaattctccctgg

SEQ ID NO: 1205974 - DNA, 15 bp, Homo sapiens
ctaaccaagaggctg

SEQ ID NO: 1205975 - DNA, 20 bp, Homo sapiens
ctaaccaagctgagtttcct

SEQ ID NO: 1205976 - DNA, 15 bp, Homo sapiens
ctaaccaatgccttt

SEQ ID NO: 1205977 - DNA, 18 bp, Homo sapiens
ctaaccagatggaacact

SEQ ID NO: 1205978 - DNA, 16 bp, Homo sapiens
ctaaccagcattccct

SEQ ID NO: 1205979 - DNA, 21 bp, Homo sapiens
ctaaccagggaagctgtccct

SEQ ID NO: 1205980 - DNA, 19 bp, Homo sapiens
ctaaccagtacctctgtat

SEQ ID NO: 1205981 - DNA, 20 bp, Homo sapiens
ctaaccagtacctctgtata

SEQ ID NO: 1205982 - DNA, 14 bp, Homo sapiens
ctaaccatccccaa

SEQ ID NO: 1205983 - DNA, 19 bp, Homo sapiens
ctaaccatccccaactcca

SEQ ID NO: 1205984 - DNA, 13 bp, Homo sapiens
ctaaccattcaaa

SEQ ID NO: 1205985 - DNA, 23 bp, Homo sapiens
ctaacccaagacatgacattctt

SEQ ID NO: 1205986 - DNA, 16 bp, Homo sapiens
ctaacccaatgcctgt

SEQ ID NO: 1205987 - DNA, 19 bp, Homo sapiens
ctaacccaggtatccaaaa

SEQ ID NO: 1205988 - DNA, 22 bp, Homo sapiens
ctaacccccagcccacagagcc

SEQ ID NO: 1205989 - DNA, 14 bp, Homo sapiens
ctaacccctttcct

SEQ ID NO: 1205990 - DNA, 20 bp, Homo sapiens
ctaaccctcccatggcacct

SEQ ID NO: 1205991 - DNA, 14 bp, Homo sapiens
ctaaccctgtggaa

SEQ ID NO: 1205992 - DNA, 22 bp, Homo sapiens
ctaaccctgtggaagcatggct

SEQ ID NO: 1205993 - DNA, 17 bp, Homo sapiens
ctaacccttaaaaatgc

SEQ ID NO: 1205994 - DNA, 12 bp, Homo sapiens
ctaacctcatct

SEQ ID NO: 1205995 - DNA, 15 bp, Homo sapiens
ctaacctcatcttct

SEQ ID NO: 1205996 - DNA, 15 bp, Homo sapiens
ctaacctctaaccct

SEQ ID NO: 1205997 - DNA, 12 bp, Homo sapiens
ctaacctggaaa

SEQ ID NO: 1205998 - DNA, 17 bp, Homo sapiens
ctaacctggacctggaa

SEQ ID NO: 1205999 - DNA, 18 bp, Homo sapiens
ctaacctggacctggaac

SEQ ID NO: 1206000 - DNA, 23 bp, Homo sapiens
ctaaccttcatgcttttttccca

SEQ ID NO: 1206001 - DNA, 21 bp, Homo sapiens
ctaaccttgaatgctgccagt

SEQ ID NO: 1206002 - DNA, 18 bp, Homo sapiens
ctaaccttgagtcagaaa

SEQ ID NO: 1206003 - DNA, 17 bp, Homo sapiens
ctaaccttgcctggtac

SEQ ID NO: 1206004 - DNA, 20 bp, Homo sapiens
ctaacgacttcagggcaggg

SEQ ID NO: 1206005 - DNA, 22 bp, Homo sapiens
ctaacgttgagcccctggaggc

SEQ ID NO: 1206006 - DNA, 16 bp, Homo sapiens
ctaactaaataccatt

SEQ ID NO: 1206007 - DNA, 19 bp, Homo sapiens
ctaactcagaaacatcagt

SEQ ID NO: 1206008 - DNA, 18 bp, Homo sapiens
ctaactctgcccaccctc

SEQ ID NO: 1206009 - DNA, 19 bp, Homo sapiens
ctaactctgcccaccctcc

SEQ ID NO: 1206010 - DNA, 18 bp, Homo sapiens
ctaactgatgagtaaact

SEQ ID NO: 1206011 - DNA, 11 bp, Homo sapiens
ctaactgcttc

SEQ ID NO: 1206012 - DNA, 23 bp, Homo sapiens
ctaactggtaaaaagatccaggg

SEQ ID NO: 1206013 - DNA, 19 bp, Homo sapiens
ctaactgtatatttgtatg

SEQ ID NO: 1206014 - DNA, 23 bp, Homo sapiens
ctaactgtgatttgtagatttac

SEQ ID NO: 1206015 - DNA, 20 bp, Homo sapiens
ctaactgtggaatataaata

SEQ ID NO: 1206016 - DNA, 23 bp, Homo sapiens
ctaactgtggaatataaatagct

SEQ ID NO: 1206017 - DNA, 19 bp, Homo sapiens
ctaacttttcaatgacatt

SEQ ID NO: 1206018 - DNA, 22 bp, Homo sapiens
ctaagaaaaaaagcacaaagtt

SEQ ID NO: 1206019 - DNA, 13 bp, Homo sapiens
ctaagaaaatgta

SEQ ID NO: 1206020 - DNA, 17 bp, Homo sapiens
ctaagaaaccctctgtc

SEQ ID NO: 1206021 - DNA, 19 bp, Homo sapiens
ctaagaaagaggagtgctt

SEQ ID NO: 1206022 - DNA, 20 bp, Homo sapiens
ctaagaaagaggagtgcttg

SEQ ID NO: 1206023 - DNA, 21 bp, Homo sapiens
ctaagaaatcaagtaatgaat

SEQ ID NO: 1206024 - DNA, 22 bp, Homo sapiens
ctaagaaatcaagtaatgaatc

SEQ ID NO: 1206025 - DNA, 19 bp, Homo sapiens
ctaagaagacattttgtta

SEQ ID NO: 1206026 - DNA, 20 bp, Homo sapiens
ctaagaaggaaaagaagaag

SEQ ID NO: 1206027 - DNA, 17 bp, Homo sapiens
ctaagaagttattttct

SEQ ID NO: 1206028 - DNA, 15 bp, Homo sapiens
ctaagaataataaaa

SEQ ID NO: 1206029 - DNA, 18 bp, Homo sapiens
ctaagaattttgttttac

SEQ ID NO: 1206030 - DNA, 13 bp, Homo sapiens
ctaagaatttttc

SEQ ID NO: 1206031 - DNA, 15 bp, Homo sapiens
ctaagacacaaatgc

SEQ ID NO: 1206032 - DNA, 14 bp, Homo sapiens
ctaagactgccttc

SEQ ID NO: 1206033 - DNA, 18 bp, Homo sapiens
ctaagactgccttcagta

SEQ ID NO: 1206034 - DNA, 13 bp, Homo sapiens
ctaagagaagtag

SEQ ID NO: 1206035 - DNA, 16 bp, Homo sapiens
ctaagagattcttcta

SEQ ID NO: 1206036 - DNA, 16 bp, Homo sapiens
ctaagagctagcgctg

SEQ ID NO: 1206037 - DNA, 19 bp, Homo sapiens
ctaagagctagcgctgccg

SEQ ID NO: 1206038 - DNA, 16 bp, Homo sapiens
ctaagaggtttttcct

SEQ ID NO: 1206039 - DNA, 15 bp, Homo sapiens
ctaagatacactgca

SEQ ID NO: 1206040 - DNA, 12 bp, Homo sapiens
ctaagatgaaat

SEQ ID NO: 1206041 - DNA, 17 bp, Homo sapiens
ctaagatgaaatgcact

SEQ ID NO: 1206042 - DNA, 19 bp, Homo sapiens
ctaagatgaaatgcactgt

SEQ ID NO: 1206043 - DNA, 13 bp, Homo sapiens
ctaagatgaaatt

SEQ ID NO: 1206044 - DNA, 17 bp, Homo sapiens
ctaagatgaaattgcca

SEQ ID NO: 1206045 - DNA, 18 bp, Homo sapiens
ctaagatgtgttcttatt

SEQ ID NO: 1206046 - DNA, 19 bp, Homo sapiens
ctaagattacaaatcagaa

SEQ ID NO: 1206047 - DNA, 21 bp, Homo sapiens
ctaagattacaaatcagaagt

SEQ ID NO: 1206048 - DNA, 22 bp, Homo sapiens
ctaagattacaaatcagaagtc

SEQ ID NO: 1206049 - DNA, 16 bp, Homo sapiens
ctaagatttggtttgg

SEQ ID NO: 1206050 - DNA, 14 bp, Homo sapiens
ctaagcaagtgagt

SEQ ID NO: 1206051 - DNA, 13 bp, Homo sapiens
ctaagcagaggag

SEQ ID NO: 1206052 - DNA, 14 bp, Homo sapiens
ctaagcagaggagg

SEQ ID NO: 1206053 - DNA, 15 bp, Homo sapiens
ctaagcagaggaggg

SEQ ID NO: 1206054 - DNA, 16 bp, Homo sapiens
ctaagcagaggagggg

SEQ ID NO: 1206055 - DNA, 18 bp, Homo sapiens
ctaagcagaggaggggcc

SEQ ID NO: 1206056 - DNA, 17 bp, Homo sapiens
ctaagcagccaggaggg

SEQ ID NO: 1206057 - DNA, 18 bp, Homo sapiens
ctaagcagccaggaggga

SEQ ID NO: 1206058 - DNA, 18 bp, Homo sapiens
ctaagcaggggagaagcg

SEQ ID NO: 1206059 - DNA, 16 bp, Homo sapiens
ctaagcatgtagccag

SEQ ID NO: 1206060 - DNA, 24 bp, Homo sapiens
ctaagcatgtgtcccaggagcagg

SEQ ID NO: 1206061 - DNA, 14 bp, Homo sapiens
ctaagcccccaggg

SEQ ID NO: 1206062 - DNA, 21 bp, Homo sapiens
ctaagcccccagggcctccag

SEQ ID NO: 1206063 - DNA, 12 bp, Homo sapiens
ctaagccctgtc

SEQ ID NO: 1206064 - DNA, 17 bp, Homo sapiens
ctaagccctttgccatc

SEQ ID NO: 1206065 - DNA, 14 bp, Homo sapiens
ctaagcctcctttt

SEQ ID NO: 1206066 - DNA, 15 bp, Homo sapiens
ctaagcctgtcccca

SEQ ID NO: 1206067 - DNA, 18 bp, Homo sapiens
ctaagcctgtccccagac

SEQ ID NO: 1206068 - DNA, 19 bp, Homo sapiens
ctaagcctgtccccagacc

SEQ ID NO: 1206069 - DNA, 11 bp, Homo sapiens
ctaagcctgtt

SEQ ID NO: 1206070 - DNA, 23 bp, Homo sapiens
ctaagcctgttgctgaagtcatt

SEQ ID NO: 1206071 - DNA, 22 bp, Homo sapiens
ctaagcgcacattcatgtgggc

SEQ ID NO: 1206072 - DNA, 17 bp, Homo sapiens
ctaagcgtgctgacatc

SEQ ID NO: 1206073 - DNA, 22 bp, Homo sapiens
ctaagctaggaatgaaatcctg

SEQ ID NO: 1206074 - DNA, 22 bp, Homo sapiens
ctaagctattcagtaataactc

SEQ ID NO: 1206075 - DNA, 12 bp, Homo sapiens
gccgcagggccc

SEQ ID NO: 1206076 - DNA, 15 bp, Homo sapiens
gccgcagggcccacc

SEQ ID NO: 1206077 - DNA, 14 bp, Homo sapiens
gccgcataggccca

SEQ ID NO: 1206078 - DNA, 15 bp, Homo sapiens
gccgcataggcccag

SEQ ID NO: 1206079 - DNA, 17 bp, Homo sapiens
gccgcatcttctccatc

SEQ ID NO: 1206080 - DNA, 20 bp, Homo sapiens
gccgccacccccatcttcca

SEQ ID NO: 1206081 - DNA, 14 bp, Homo sapiens
gccgccaccctgcc

SEQ ID NO: 1206082 - DNA, 20 bp, Homo sapiens
gccgccactaggtgtcccca

SEQ ID NO: 1206083 - DNA, 21 bp, Homo sapiens
gccgccactcccgggccaaga

SEQ ID NO: 1206084 - DNA, 14 bp, Homo sapiens
gccgccaggactgt

SEQ ID NO: 1206085 - DNA, 16 bp, Homo sapiens
gccgccatagccccag

SEQ ID NO: 1206086 - DNA, 18 bp, Homo sapiens
gccgccatagccccagta

SEQ ID NO: 1206087 - DNA, 20 bp, Homo sapiens
gccgccatctgcgcagggtg

SEQ ID NO: 1206088 - DNA, 16 bp, Homo sapiens
gccgccatgctcctgg

SEQ ID NO: 1206089 - DNA, 17 bp, Homo sapiens
gccgccattgccaccag

SEQ ID NO: 1206090 - DNA, 17 bp, Homo sapiens
gccgccccagccccttc

SEQ ID NO: 1206091 - DNA, 13 bp, Homo sapiens
gccgcccccacct

SEQ ID NO: 1206092 - DNA, 22 bp, Homo sapiens
gccgcccccacctgcggccgcc

SEQ ID NO: 1206093 - DNA, 22 bp, Homo sapiens
gccgccccccgcccctcgcccg

SEQ ID NO: 1206094 - DNA, 16 bp, Homo sapiens
gccgccccctcctgaa

SEQ ID NO: 1206095 - DNA, 13 bp, Homo sapiens
ctaaggcccccaa

SEQ ID NO: 1206096 - DNA, 22 bp, Homo sapiens
ctaaggcccccaaacatagccc

SEQ ID NO: 1206097 - DNA, 17 bp, Homo sapiens
ctaaggccttccctgtc

SEQ ID NO: 1206098 - DNA, 18 bp, Homo sapiens
ctaaggctccccaccccg

SEQ ID NO: 1206099 - DNA, 16 bp, Homo sapiens
ctaaggctcctccttg

SEQ ID NO: 1206100 - DNA, 16 bp, Homo sapiens
ctaaggctcctgtttt

SEQ ID NO: 1206101 - DNA, 16 bp, Homo sapiens
ctaaggctgctggctt

SEQ ID NO: 1206102 - DNA, 14 bp, Homo sapiens
ctaagggaaaggga

SEQ ID NO: 1206103 - DNA, 14 bp, Homo sapiens
ctaagggcagccct

SEQ ID NO: 1206104 - DNA, 20 bp, Homo sapiens
ctaaggggacctacagacag

SEQ ID NO: 1206105 - DNA, 12 bp, Homo sapiens
ctaaggggcccg

SEQ ID NO: 1206106 - DNA, 18 bp, Homo sapiens
ctaaggggcccggccagc

SEQ ID NO: 1206107 - DNA, 20 bp, Homo sapiens
ctaagggggtagaagtagtt

SEQ ID NO: 1206108 - DNA, 14 bp, Homo sapiens
ctaaggtcatttct

SEQ ID NO: 1206109 - DNA, 14 bp, Homo sapiens
ctaaggtccctggg

SEQ ID NO: 1206110 - DNA, 22 bp, Homo sapiens
ctaaggtccctgggggtgcaga

SEQ ID NO: 1206111 - DNA, 15 bp, Homo sapiens
ctaaggttttgttgt

SEQ ID NO: 1206112 - DNA, 14 bp, Homo sapiens
ctaagtaaatacaa

SEQ ID NO: 1206113 - DNA, 15 bp, Homo sapiens
ctaagtaaatacaat

SEQ ID NO: 1206114 - DNA, 16 bp, Homo sapiens
ctaagtaaatacaatt

SEQ ID NO: 1206115 - DNA, 18 bp, Homo sapiens
ctaagtaagtttcttcct

SEQ ID NO: 1206116 - DNA, 15 bp, Homo sapiens
ctaagtaatttagaa

SEQ ID NO: 1206117 - DNA, 19 bp, Homo sapiens
ctaagtacacaataagcaa

SEQ ID NO: 1206118 - DNA, 19 bp, Homo sapiens
ctaagtatttaaatgttct

SEQ ID NO: 1206119 - DNA, 18 bp, Homo sapiens
ctaagtcatgtatgtttc

SEQ ID NO: 1206120 - DNA, 14 bp, Homo sapiens
ctaagtcccttcct

SEQ ID NO: 1206121 - DNA, 15 bp, Homo sapiens
ctaagtcctttatgt

SEQ ID NO: 1206122 - DNA, 14 bp, Homo sapiens
ctaagtgaaaaggt

SEQ ID NO: 1206123 - DNA, 14 bp, Homo sapiens
ctaagtgatataaa

SEQ ID NO: 1206124 - DNA, 16 bp, Homo sapiens
ctaagtgatataaatc

SEQ ID NO: 1206125 - DNA, 17 bp, Homo sapiens
ctaagtgcttattacat

SEQ ID NO: 1206126 - DNA, 21 bp, Homo sapiens
ctaagtgcttattacatttta

SEQ ID NO: 1206127 - DNA, 23 bp, Homo sapiens
ctaagtgtaacctcagtatttat

SEQ ID NO: 1206128 - DNA, 13 bp, Homo sapiens
ctaagtgttgatt

SEQ ID NO: 1206129 - DNA, 14 bp, Homo sapiens
ctaagttagactct

SEQ ID NO: 1206130 - DNA, 18 bp, Homo sapiens
ctaagttattacctctcc

SEQ ID NO: 1206131 - DNA, 18 bp, Homo sapiens
ctaagttcacattagaat

SEQ ID NO: 1206132 - DNA, 15 bp, Homo sapiens
ctaagttcagttctg

SEQ ID NO: 1206133 - DNA, 22 bp, Homo sapiens
ctaagttcatgtttgtaaatta

SEQ ID NO: 1206134 - DNA, 20 bp, Homo sapiens
ctaagttgctgggattacag

SEQ ID NO: 1206135 - DNA, 13 bp, Homo sapiens
ctaagtttcagtt

SEQ ID NO: 1206136 - DNA, 19 bp, Homo sapiens
ctaagttttgtgtgtatat

SEQ ID NO: 1206137 - DNA, 20 bp, Homo sapiens
ctaagtttttatggcttttg

SEQ ID NO: 1206138 - DNA, 22 bp, Homo sapiens
ctaataaaaagcttttgtctac

SEQ ID NO: 1206139 - DNA, 13 bp, Homo sapiens
ctaataaaagcat

SEQ ID NO: 1206140 - DNA, 18 bp, Homo sapiens
ctaataaactaataattg

SEQ ID NO: 1206141 - DNA, 18 bp, Homo sapiens
ctaataaactgtattaaa

SEQ ID NO: 1206142 - DNA, 21 bp, Homo sapiens
ctaataaatatactatgaaat

SEQ ID NO: 1206143 - DNA, 22 bp, Homo sapiens
ctaataaggcatgcgaaatgtt

SEQ ID NO: 1206144 - DNA, 13 bp, Homo sapiens
ctaataataaata

SEQ ID NO: 1206145 - DNA, 14 bp, Homo sapiens
ctaataataaatag

SEQ ID NO: 1206146 - DNA, 16 bp, Homo sapiens
ctaataataaatagtt

SEQ ID NO: 1206147 - DNA, 17 bp, Homo sapiens
ctaataataaatagttc

SEQ ID NO: 1206148 - DNA, 19 bp, Homo sapiens
ctaatacagcaacaattta

SEQ ID NO: 1206149 - DNA, 21 bp, Homo sapiens
ctaatacctcttactttgctt

SEQ ID NO: 1206150 - DNA, 13 bp, Homo sapiens
ctaatagaactca

SEQ ID NO: 1206151 - DNA, 20 bp, Homo sapiens
ctaatagaataaaggcagtt

SEQ ID NO: 1206152 - DNA, 19 bp, Homo sapiens
ctaatagacaatttattat

SEQ ID NO: 1206153 - DNA, 16 bp, Homo sapiens
ctaatagtttttcact

SEQ ID NO: 1206154 - DNA, 13 bp, Homo sapiens
ctaatatactttt

SEQ ID NO: 1206155 - DNA, 18 bp, Homo sapiens
ctaatatatatgaataaa

SEQ ID NO: 1206156 - DNA, 15 bp, Homo sapiens
ctaatatatggacct

SEQ ID NO: 1206157 - DNA, 16 bp, Homo sapiens
ctaatatatggaccta

SEQ ID NO: 1206158 - DNA, 11 bp, Homo sapiens
ctaatatattt

SEQ ID NO: 1206159 - DNA, 14 bp, Homo sapiens
ctaatatatttaaa

SEQ ID NO: 1206160 - DNA, 15 bp, Homo sapiens
ctaatatatttaaaa

SEQ ID NO: 1206161 - DNA, 17 bp, Homo sapiens
ctaatatatttaaaaat

SEQ ID NO: 1206162 - DNA, 21 bp, Homo sapiens
ctaatatatttttatatttag

SEQ ID NO: 1206163 - DNA, 17 bp, Homo sapiens
ctaatatattttttcca

SEQ ID NO: 1206164 - DNA, 22 bp, Homo sapiens
ctaatatcttaattctttgttc

SEQ ID NO: 1206165 - DNA, 23 bp, Homo sapiens
ctaatatgatagcgggaaaagga

SEQ ID NO: 1206166 - DNA, 17 bp, Homo sapiens
ctaatatggcaaccatt

SEQ ID NO: 1206167 - DNA, 22 bp, Homo sapiens
ctaatattagttggctttcata

SEQ ID NO: 1206168 - DNA, 14 bp, Homo sapiens
ctaatattttatgt

SEQ ID NO: 1206169 - DNA, 22 bp, Homo sapiens
ctaatcaaaaaggtctcaccac

SEQ ID NO: 1206170 - DNA, 16 bp, Homo sapiens
ctaatcacagtgttgc

SEQ ID NO: 1206171 - DNA, 18 bp, Homo sapiens
ctaatcaccatgtaagca

SEQ ID NO: 1206172 - DNA, 20 bp, Homo sapiens
ctaatcagggaggtcatttt

SEQ ID NO: 1206173 - DNA, 21 bp, Homo sapiens
ctaatcagggaggtcattttg

SEQ ID NO: 1206174 - DNA, 19 bp, Homo sapiens
ctaatccattatcctttat

SEQ ID NO: 1206175 - DNA, 20 bp, Homo sapiens
ctaatccattatcctttatt

SEQ ID NO: 1206176 - DNA, 21 bp, Homo sapiens
ctaatcccgtgcccctttcct

SEQ ID NO: 1206177 - DNA, 19 bp, Homo sapiens
ctaatccctgggcattgct

SEQ ID NO: 1206178 - DNA, 22 bp, Homo sapiens
ctaatccctgggcattgctttc

SEQ ID NO: 1206179 - DNA, 23 bp, Homo sapiens
ctaatccctgggcattgctttcc

SEQ ID NO: 1206180 - DNA, 14 bp, Homo sapiens
ctaatctattgggt

SEQ ID NO: 1206181 - DNA, 14 bp, Homo sapiens
ctaatctctgtaaa

SEQ ID NO: 1206182 - DNA, 20 bp, Homo sapiens
ctaatctctgtaaagctaaa

SEQ ID NO: 1206183 - DNA, 16 bp, Homo sapiens
ctaatctcttattcta

SEQ ID NO: 1206184 - DNA, 12 bp, Homo sapiens
ctaatctgcctg

SEQ ID NO: 1206185 - DNA, 22 bp, Homo sapiens
ctaatctgtagggctggaccta

SEQ ID NO: 1206186 - DNA, 18 bp, Homo sapiens
ctaatcttattcattttc

SEQ ID NO: 1206187 - DNA, 19 bp, Homo sapiens
ctaatcttattcattttct

SEQ ID NO: 1206188 - DNA, 16 bp, Homo sapiens
ctaatcttgaatgttt

SEQ ID NO: 1206189 - DNA, 14 bp, Homo sapiens
ctaatcttgtccct

SEQ ID NO: 1206190 - DNA, 22 bp, Homo sapiens
ctaatctttcacttgaaagatt

SEQ ID NO: 1206191 - DNA, 15 bp, Homo sapiens
ctaatgaaaaacaaa

SEQ ID NO: 1206192 - DNA, 19 bp, Homo sapiens
ctaatgaaaaacaaaaagc

SEQ ID NO: 1206193 - DNA, 15 bp, Homo sapiens
ctaatgaacaaatat

SEQ ID NO: 1206194 - DNA, 20 bp, Homo sapiens
ctaatgaacaaatatgcttt

SEQ ID NO: 1206195 - DNA, 17 bp, Homo sapiens
ctaatgaactctttcaa

SEQ ID NO: 1206196 - DNA, 23 bp, Homo sapiens
ctaatgaagggaaaggatatttt

SEQ ID NO: 1206197 - DNA, 19 bp, Homo sapiens
gccggtcgggcagccagca

SEQ ID NO: 1206198 - DNA, 14 bp, Homo sapiens
gccggtgaggggag

SEQ ID NO: 1206199 - DNA, 13 bp, Homo sapiens
gccggtgcctggc

SEQ ID NO: 1206200 - DNA, 19 bp, Homo sapiens
gccggtgctgggggcacag

SEQ ID NO: 1206201 - DNA, 18 bp, Homo sapiens
gccggtgggaccctgtcc

SEQ ID NO: 1206202 - DNA, 17 bp, Homo sapiens
gccggtgtccctggatg

SEQ ID NO: 1206203 - DNA, 14 bp, Homo sapiens
gccgtaatttaact

SEQ ID NO: 1206204 - DNA, 14 bp, Homo sapiens
gccgtaccccaccc

SEQ ID NO: 1206205 - DNA, 16 bp, Homo sapiens
gccgtaccccaccctc

SEQ ID NO: 1206206 - DNA, 19 bp, Homo sapiens
gccgtagggagtacctgct

SEQ ID NO: 1206207 - DNA, 14 bp, Homo sapiens
gccgtatctgtcac

SEQ ID NO: 1206208 - DNA, 15 bp, Homo sapiens
gccgtatctgtcaca

SEQ ID NO: 1206209 - DNA, 16 bp, Homo sapiens
gccgtatctgtcacaa

SEQ ID NO: 1206210 - DNA, 23 bp, Homo sapiens
gccgtattttacatgaagctgta

SEQ ID NO: 1206211 - DNA, 15 bp, Homo sapiens
gccgtcaccaccacc

SEQ ID NO: 1206212 - DNA, 12 bp, Homo sapiens
gccgtcacgctt

SEQ ID NO: 1206213 - DNA, 20 bp, Homo sapiens
gccgtcagccatcagccatg

SEQ ID NO: 1206214 - DNA, 14 bp, Homo sapiens
gccgtccatggcac

SEQ ID NO: 1206215 - DNA, 19 bp, Homo sapiens
gccgtccatggcaccagcc

SEQ ID NO: 1206216 - DNA, 21 bp, Homo sapiens
gccgtccatggcaccagcccc

SEQ ID NO: 1206217 - DNA, 15 bp, Homo sapiens
gccgtcccaggccac

SEQ ID NO: 1206218 - DNA, 16 bp, Homo sapiens
gccgtcccctctcccc

SEQ ID NO: 1206219 - DNA, 19 bp, Homo sapiens
gccgtcccgcgttcaagac

SEQ ID NO: 1206220 - DNA, 23 bp, Homo sapiens
gccgtcctaacctcgggcctgct

SEQ ID NO: 1206221 - DNA, 14 bp, Homo sapiens
gccgtcctcccggg

SEQ ID NO: 1206222 - DNA, 13 bp, Homo sapiens
gccgtccttgtct

SEQ ID NO: 1206223 - DNA, 14 bp, Homo sapiens
ctaattaaataata

SEQ ID NO: 1206224 - DNA, 21 bp, Homo sapiens
ctaattaatatattaaaattc

SEQ ID NO: 1206225 - DNA, 19 bp, Homo sapiens
ctaattaattgtaatctga

SEQ ID NO: 1206226 - DNA, 15 bp, Homo sapiens
ctaattagagaactg

SEQ ID NO: 1206227 - DNA, 16 bp, Homo sapiens
ctaattatactacttt

SEQ ID NO: 1206228 - DNA, 12 bp, Homo sapiens
ctaattatttaa

SEQ ID NO: 1206229 - DNA, 16 bp, Homo sapiens
ctaattcaaggaattt

SEQ ID NO: 1206230 - DNA, 16 bp, Homo sapiens
ctaattcacagtgctc

SEQ ID NO: 1206231 - DNA, 22 bp, Homo sapiens
ctaattcacagtgctcttttct

SEQ ID NO: 1206232 - DNA, 10 bp, Homo sapiens
ctaattcata

SEQ ID NO: 1206233 - DNA, 13 bp, Homo sapiens
ctaattcatttat

SEQ ID NO: 1206234 - DNA, 15 bp, Homo sapiens
ctaattccacacctt

SEQ ID NO: 1206235 - DNA, 20 bp, Homo sapiens
ctaattcccaacatttctta

SEQ ID NO: 1206236 - DNA, 14 bp, Homo sapiens
ctaattcccagagt

SEQ ID NO: 1206237 - DNA, 16 bp, Homo sapiens
ctaattcccagagtgt

SEQ ID NO: 1206238 - DNA, 17 bp, Homo sapiens
ctaattcccattttgca

SEQ ID NO: 1206239 - DNA, 19 bp, Homo sapiens
ctaattgcatctcaaaatt

SEQ ID NO: 1206240 - DNA, 21 bp, Homo sapiens
ctaattggaagaaattcctgt

SEQ ID NO: 1206241 - DNA, 17 bp, Homo sapiens
ctaattgtaagtgaaat

SEQ ID NO: 1206242 - DNA, 21 bp, Homo sapiens
ctaattgtaagtgaaattaag

SEQ ID NO: 1206243 - DNA, 14 bp, Homo sapiens
ctaatttaaagaga

SEQ ID NO: 1206244 - DNA, 17 bp, Homo sapiens
ctaatttaacccagctc

SEQ ID NO: 1206245 - DNA, 12 bp, Homo sapiens
ctaatttataaa

SEQ ID NO: 1206246 - DNA, 19 bp, Homo sapiens
ctaatttatattatccata

SEQ ID NO: 1206247 - DNA, 20 bp, Homo sapiens
ctaatttatattatccatag

SEQ ID NO: 1206248 - DNA, 21 bp, Homo sapiens
ctaatttatcctgaaatttca

SEQ ID NO: 1206249 - DNA, 23 bp, Homo sapiens
ctaatttatcctgaaatttcaga

SEQ ID NO: 1206250 - DNA, 21 bp, Homo sapiens
ctaatttatcttgtctctggg

SEQ ID NO: 1206251 - DNA, 14 bp, Homo sapiens
ctaatttctcctcc

SEQ ID NO: 1206252 - DNA, 15 bp, Homo sapiens
ctaatttctcctccc

SEQ ID NO: 1206253 - DNA, 16 bp, Homo sapiens
ctaatttgaggctcag

SEQ ID NO: 1206254 - DNA, 22 bp, Homo sapiens
ctaatttgcattaaattcacaa

SEQ ID NO: 1206255 - DNA, 14 bp, Homo sapiens
ctaattttaaataa

SEQ ID NO: 1206256 - DNA, 15 bp, Homo sapiens
ctaattttatttcta

SEQ ID NO: 1206257 - DNA, 23 bp, Homo sapiens
ctaattttctttccgacacattt

SEQ ID NO: 1206258 - DNA, 18 bp, Homo sapiens
ctaattttgtacatactg

SEQ ID NO: 1206259 - DNA, 21 bp, Homo sapiens
ctaatttttgcttaacattag

SEQ ID NO: 1206260 - DNA, 13 bp, Homo sapiens
ctaatttttgtat

SEQ ID NO: 1206261 - DNA, 19 bp, Homo sapiens
ctaatttttgtattatttt

SEQ ID NO: 1206262 - DNA, 20 bp, Homo sapiens
ctaatttttgtatttttagt

SEQ ID NO: 1206263 - DNA, 15 bp, Homo sapiens
ctaattttttatcct

SEQ ID NO: 1206264 - DNA, 13 bp, Homo sapiens
ctaatttttttgt

SEQ ID NO: 1206265 - DNA, 16 bp, Homo sapiens
ctaatttttttgtatt

SEQ ID NO: 1206266 - DNA, 23 bp, Homo sapiens
ctacaaaaaattagaaattggct

SEQ ID NO: 1206267 - DNA, 22 bp, Homo sapiens
ctacaaaaaccctaattttgta

SEQ ID NO: 1206268 - DNA, 18 bp, Homo sapiens
ctacaaaatttgaaattt

SEQ ID NO: 1206269 - DNA, 18 bp, Homo sapiens
ctacaaacaaaagcagcc

SEQ ID NO: 1206270 - DNA, 16 bp, Homo sapiens
ctacaaagctttgcta

SEQ ID NO: 1206271 - DNA, 17 bp, Homo sapiens
ctacaaagctttgctac

SEQ ID NO: 1206272 - DNA, 19 bp, Homo sapiens
ctacaaagctttgctacaa

SEQ ID NO: 1206273 - DNA, 10 bp, Homo sapiens
ctacaaatca

SEQ ID NO: 1206274 - DNA, 15 bp, Homo sapiens
ctacaaatttatgca

SEQ ID NO: 1206275 - DNA, 20 bp, Homo sapiens
ctacaaatttatgcatttca

SEQ ID NO: 1206276 - DNA, 21 bp, Homo sapiens
ctacaaatttatgcatttcat

SEQ ID NO: 1206277 - DNA, 20 bp, Homo sapiens
ctacaaccaagctctctgca

SEQ ID NO: 1206278 - DNA, 12 bp, Homo sapiens
ctacaaccaatt

SEQ ID NO: 1206279 - DNA, 15 bp, Homo sapiens
ctacaaccccagcct

SEQ ID NO: 1206280 - DNA, 20 bp, Homo sapiens
ctacaactaaaaataaatta

SEQ ID NO: 1206281 - DNA, 19 bp, Homo sapiens
ctacaactggagttttttt

SEQ ID NO: 1206282 - DNA, 17 bp, Homo sapiens
ctacaacttcagcagta

SEQ ID NO: 1206283 - DNA, 15 bp, Homo sapiens
ctacaacttttgttt

SEQ ID NO: 1206284 - DNA, 15 bp, Homo sapiens
ctacaagcatatttg

SEQ ID NO: 1206285 - DNA, 21 bp, Homo sapiens
ctacaaggactccattggatc

SEQ ID NO: 1206286 - DNA, 18 bp, Homo sapiens
ctacaagtatatgtgaaa

SEQ ID NO: 1206287 - DNA, 16 bp, Homo sapiens
ctacaataaaaagaaa

SEQ ID NO: 1206288 - DNA, 19 bp, Homo sapiens
ctacaatacatatatctac

SEQ ID NO: 1206289 - DNA, 19 bp, Homo sapiens
ctacaatgtgaactttatt

SEQ ID NO: 1206290 - DNA, 21 bp, Homo sapiens
ctacaattaatagtttgtcta

SEQ ID NO: 1206291 - DNA, 22 bp, Homo sapiens
ctacaattaatagtttgtctat

SEQ ID NO: 1206292 - DNA, 13 bp, Homo sapiens
ctacaattcctct

SEQ ID NO: 1206293 - DNA, 16 bp, Homo sapiens
ctacaatttgtttttg

SEQ ID NO: 1206294 - DNA, 16 bp, Homo sapiens
ctacaattttctccca

SEQ ID NO: 1206295 - DNA, 23 bp, Homo sapiens
ctacaattttctcccaggaagct

SEQ ID NO: 1206296 - DNA, 13 bp, Homo sapiens
ctacacaaagcag

SEQ ID NO: 1206297 - DNA, 17 bp, Homo sapiens
ctacacacacagcctat

SEQ ID NO: 1206298 - DNA, 15 bp, Homo sapiens
ctacacactgcatgt

SEQ ID NO: 1206299 - DNA, 14 bp, Homo sapiens
ctacacagacccct

SEQ ID NO: 1206300 - DNA, 17 bp, Homo sapiens
ctacacagcacaccagc

SEQ ID NO: 1206301 - DNA, 19 bp, Homo sapiens
ctacacagcacaccagccg

SEQ ID NO: 1206302 - DNA, 23 bp, Homo sapiens
ctacacagcacaccagccgctgc

SEQ ID NO: 1206303 - DNA, 12 bp, Homo sapiens
ctacacaggagt

SEQ ID NO: 1206304 - DNA, 22 bp, Homo sapiens
ctacacaggggccctgtacagt

SEQ ID NO: 1206305 - DNA, 21 bp, Homo sapiens
ctacacatatgtattcctgat

SEQ ID NO: 1206306 - DNA, 23 bp, Homo sapiens
ctacacatgtaaaatatgtaaaa

SEQ ID NO: 1206307 - DNA, 16 bp, Homo sapiens
ctacacccaagcctga

SEQ ID NO: 1206308 - DNA, 12 bp, Homo sapiens
ctacacccagca

SEQ ID NO: 1206309 - DNA, 13 bp, Homo sapiens
ctacacccagcaa

SEQ ID NO: 1206310 - DNA, 14 bp, Homo sapiens
ctacacccagcaat

SEQ ID NO: 1206311 - DNA, 20 bp, Homo sapiens
ctacacggactgaggtgcct

SEQ ID NO: 1206312 - DNA, 14 bp, Homo sapiens
ctacactccagcct

SEQ ID NO: 1206313 - DNA, 16 bp, Homo sapiens
ctacactccagcctga

SEQ ID NO: 1206314 - DNA, 17 bp, Homo sapiens
ctacactccagcctgag

SEQ ID NO: 1206315 - DNA, 18 bp, Homo sapiens
ctacactccagcctgagc

SEQ ID NO: 1206316 - DNA, 15 bp, Homo sapiens
ctacagaaaagaaat

SEQ ID NO: 1206317 - DNA, 17 bp, Homo sapiens
ctacagaacttcagaaa

SEQ ID NO: 1206318 - DNA, 20 bp, Homo sapiens
ctacagaagtggaagtgctt

SEQ ID NO: 1206319 - DNA, 12 bp, Homo sapiens
ctacctccaccc

SEQ ID NO: 1206320 - DNA, 20 bp, Homo sapiens
ctacctccagagttgttgaa

SEQ ID NO: 1206321 - DNA, 23 bp, Homo sapiens
ctacctccctccccgtctcattc

SEQ ID NO: 1206322 - DNA, 13 bp, Homo sapiens
ctacctccctcct

SEQ ID NO: 1206323 - DNA, 17 bp, Homo sapiens
ctacctccctcctcagg

SEQ ID NO: 1206324 - DNA, 11 bp, Homo sapiens
ctacctctctc

SEQ ID NO: 1206325 - DNA, 14 bp, Homo sapiens
ctacctctctcctc

SEQ ID NO: 1206326 - DNA, 14 bp, Homo sapiens
ctacctctctgtcc

SEQ ID NO: 1206327 - DNA, 14 bp, Homo sapiens
ctacctctctttct

SEQ ID NO: 1206328 - DNA, 14 bp, Homo sapiens
ctacctgagctaaa

SEQ ID NO: 1206329 - DNA, 20 bp, Homo sapiens
ctacctgattggtgcaaccc

SEQ ID NO: 1206330 - DNA, 12 bp, Homo sapiens
ctacctgccctc

SEQ ID NO: 1206331 - DNA, 14 bp, Homo sapiens
ctacctgccctcaa

SEQ ID NO: 1206332 - DNA, 16 bp, Homo sapiens
ctacctgctgctgcta

SEQ ID NO: 1206333 - DNA, 16 bp, Homo sapiens
ctacctgcttggtctt

SEQ ID NO: 1206334 - DNA, 11 bp, Homo sapiens
ctacctggagg

SEQ ID NO: 1206335 - DNA, 22 bp, Homo sapiens
ctacctgtgtttttttctaaaa

SEQ ID NO: 1206336 - DNA, 16 bp, Homo sapiens
ctacctgttcagtgtc

SEQ ID NO: 1206337 - DNA, 20 bp, Homo sapiens
ctacctgttcagtgtcccgg

SEQ ID NO: 1206338 - DNA, 13 bp, Homo sapiens
ctacctgttctgt

SEQ ID NO: 1206339 - DNA, 14 bp, Homo sapiens
ctacctgttctgta

SEQ ID NO: 1206340 - DNA, 19 bp, Homo sapiens
ctaccttaaaatgtaaaac

SEQ ID NO: 1206341 - DNA, 14 bp, Homo sapiens
ctaccttattttcc

SEQ ID NO: 1206342 - DNA, 16 bp, Homo sapiens
ctaccttcaccaccta

SEQ ID NO: 1206343 - DNA, 19 bp, Homo sapiens
ctaccttgaaaataagaat

SEQ ID NO: 1206344 - DNA, 22 bp, Homo sapiens
ctaccttgaggtcttttgacat

SEQ ID NO: 1206345 - DNA, 23 bp, Homo sapiens
ctaccttgaggtcttttgacatg

SEQ ID NO: 1206346 - DNA, 18 bp, Homo sapiens
ctaccttgctagctagcc

SEQ ID NO: 1206347 - DNA, 13 bp, Homo sapiens
ctaccttgctttt

SEQ ID NO: 1206348 - DNA, 17 bp, Homo sapiens
ctacctttgtattctct

SEQ ID NO: 1206349 - DNA, 14 bp, Homo sapiens
ctacctttttatat

SEQ ID NO: 1206350 - DNA, 15 bp, Homo sapiens
ctacctttttatatt

SEQ ID NO: 1206351 - DNA, 13 bp, Homo sapiens
ctacgaatcttcc

SEQ ID NO: 1206352 - DNA, 15 bp, Homo sapiens
ctacgcagatgctgt

SEQ ID NO: 1206353 - DNA, 17 bp, Homo sapiens
ctacggagaaactcatc

SEQ ID NO: 1206354 - DNA, 19 bp, Homo sapiens
gcctcacagcagtgagact

SEQ ID NO: 1206355 - DNA, 19 bp, Homo sapiens
gcctcacatttttttctac

SEQ ID NO: 1206356 - DNA, 17 bp, Homo sapiens
gcctcacccacccctgc

SEQ ID NO: 1206357 - DNA, 20 bp, Homo sapiens
gcctcacccacccctgcaca

SEQ ID NO: 1206358 - DNA, 16 bp, Homo sapiens
gcctcacctgcccctc

SEQ ID NO: 1206359 - DNA, 22 bp, Homo sapiens
gcctcacgggaccgtcagcatg

SEQ ID NO: 1206360 - DNA, 21 bp, Homo sapiens
gcctcacgtatttcacagagc

SEQ ID NO: 1206361 - DNA, 22 bp, Homo sapiens
gcctcacgtatttcacagagca

SEQ ID NO: 1206362 - DNA, 17 bp, Homo sapiens
gcctcacgtgtctcaga

SEQ ID NO: 1206363 - DNA, 14 bp, Homo sapiens
gcctcactggctca

SEQ ID NO: 1206364 - DNA, 17 bp, Homo sapiens
gcctcactggctcatgc

SEQ ID NO: 1206365 - DNA, 19 bp, Homo sapiens
gcctcactggctcatgccc

SEQ ID NO: 1206366 - DNA, 15 bp, Homo sapiens
gcctcactggctggg

SEQ ID NO: 1206367 - DNA, 22 bp, Homo sapiens
gcctcactggctggggcagagg

SEQ ID NO: 1206368 - DNA, 20 bp, Homo sapiens
gcctcacttgattcatctct

SEQ ID NO: 1206369 - DNA, 15 bp, Homo sapiens
gcctcagaaggcccc

SEQ ID NO: 1206370 - DNA, 21 bp, Homo sapiens
gcctcagaaggccccagagag

SEQ ID NO: 1206371 - DNA, 23 bp, Homo sapiens
gcctcagaaggccccagagagac

SEQ ID NO: 1206372 - DNA, 20 bp, Homo sapiens
gcctcagacgttgcctgaga

SEQ ID NO: 1206373 - DNA, 18 bp, Homo sapiens
gcctcagagaccagggct

SEQ ID NO: 1206374 - DNA, 12 bp, Homo sapiens
gcctcagagcct

SEQ ID NO: 1206375 - DNA, 14 bp, Homo sapiens
gcctcagagcctga

SEQ ID NO: 1206376 - DNA, 15 bp, Homo sapiens
gcctcagagcctgac

SEQ ID NO: 1206377 - DNA, 13 bp, Homo sapiens
gcctcagccagag

SEQ ID NO: 1206378 - DNA, 15 bp, Homo sapiens
gcctcagccattcac

SEQ ID NO: 1206379 - DNA, 12 bp, Homo sapiens
gcctcagcccaa

SEQ ID NO: 1206380 - DNA, 13 bp, Homo sapiens
gcctcagccctca

SEQ ID NO: 1206381 - DNA, 19 bp, Homo sapiens
gcctcagccctcagttcct

SEQ ID NO: 1206382 - DNA, 22 bp, Homo sapiens
gcctcagccctgaccctgtgga

SEQ ID NO: 1206383 - DNA, 14 bp, Homo sapiens
gcctcagcctactc

SEQ ID NO: 1206384 - DNA, 16 bp, Homo sapiens
gcctcagcctcccaag

SEQ ID NO: 1206385 - DNA, 16 bp, Homo sapiens
gcctcagcctcctgag

SEQ ID NO: 1206386 - DNA, 14 bp, Homo sapiens
gcctcagcctgggg

SEQ ID NO: 1206387 - DNA, 16 bp, Homo sapiens
gcctcagcctggggct

SEQ ID NO: 1206388 - DNA, 21 bp, Homo sapiens
gcctcagcctggggctctctg

SEQ ID NO: 1206389 - DNA, 22 bp, Homo sapiens
gcctcagccttccaactagctg

SEQ ID NO: 1206390 - DNA, 19 bp, Homo sapiens
gcctcagctgaatgcctcc

SEQ ID NO: 1206391 - DNA, 15 bp, Homo sapiens
gcctcagctgcctca

SEQ ID NO: 1206392 - DNA, 16 bp, Homo sapiens
gcctcaggccagggct

SEQ ID NO: 1206393 - DNA, 16 bp, Homo sapiens
gcctcagggtcctgcc

SEQ ID NO: 1206394 - DNA, 19 bp, Homo sapiens
gcctcagggtcctgccctc

SEQ ID NO: 1206395 - DNA, 17 bp, Homo sapiens
gcctcaggtgctgtcca

SEQ ID NO: 1206396 - DNA, 20 bp, Homo sapiens
gcctcaggtgctgtccatgg

SEQ ID NO: 1206397 - DNA, 24 bp, Homo sapiens
gcctcagtgccacttgacattcct

SEQ ID NO: 1206398 - DNA, 11 bp, Homo sapiens
gcctcagtgga

SEQ ID NO: 1206399 - DNA, 21 bp, Homo sapiens
gcctcagtggactttccaccc

SEQ ID NO: 1206400 - DNA, 16 bp, Homo sapiens
gcctcagttcaacctg

SEQ ID NO: 1206401 - DNA, 13 bp, Homo sapiens
gcctcagttccca

SEQ ID NO: 1206402 - DNA, 15 bp, Homo sapiens
gcctcagttcccagc

SEQ ID NO: 1206403 - DNA, 16 bp, Homo sapiens
gcctcagttcccagct

SEQ ID NO: 1206404 - DNA, 17 bp, Homo sapiens
gcctcagttcccagctc

SEQ ID NO: 1206405 - DNA, 22 bp, Homo sapiens
gcctcagtttctccatcagctt

SEQ ID NO: 1206406 - DNA, 15 bp, Homo sapiens
gcctcagttttcctt

SEQ ID NO: 1206407 - DNA, 16 bp, Homo sapiens
gcctcagttttccttc

SEQ ID NO: 1206408 - DNA, 19 bp, Homo sapiens
gcctcatactcctgggctc

SEQ ID NO: 1206409 - DNA, 16 bp, Homo sapiens
gcctcatagcatagcc

SEQ ID NO: 1206410 - DNA, 13 bp, Homo sapiens
gcctcatatttaa

SEQ ID NO: 1206411 - DNA, 14 bp, Homo sapiens
gcctcatccctcgg

SEQ ID NO: 1206412 - DNA, 24 bp, Homo sapiens
gcctcatccctcggaagccgtctg

SEQ ID NO: 1206413 - DNA, 17 bp, Homo sapiens
gcctcatccgaggcagg

SEQ ID NO: 1206414 - DNA, 18 bp, Homo sapiens
gcctcatccgaggcaggg

SEQ ID NO: 1206415 - DNA, 19 bp, Homo sapiens
gcctcatccgaggcagggt

SEQ ID NO: 1206416 - DNA, 20 bp, Homo sapiens
gcctcatcctccccaggacc

SEQ ID NO: 1206417 - DNA, 13 bp, Homo sapiens
gcctcatctcacc

SEQ ID NO: 1206418 - DNA, 13 bp, Homo sapiens
gcctcatgccaca

SEQ ID NO: 1206419 - DNA, 13 bp, Homo sapiens
gcctcatgtggct

SEQ ID NO: 1206420 - DNA, 14 bp, Homo sapiens
gcctcatgtggctg

SEQ ID NO: 1206421 - DNA, 18 bp, Homo sapiens
gcctcatgtggctggaag

SEQ ID NO: 1206422 - DNA, 19 bp, Homo sapiens
gcctcatgtggctggaaga

SEQ ID NO: 1206423 - DNA, 13 bp, Homo sapiens
gcctcatgttctg

SEQ ID NO: 1206424 - DNA, 15 bp, Homo sapiens
gcctcattgtgccaa

SEQ ID NO: 1206425 - DNA, 16 bp, Homo sapiens
gcctcattgtgccaag

SEQ ID NO: 1206426 - DNA, 17 bp, Homo sapiens
gcctcattgtgccaagc

SEQ ID NO: 1206427 - DNA, 23 bp, Homo sapiens
gcctcattgtgccaagccttctg

SEQ ID NO: 1206428 - DNA, 20 bp, Homo sapiens
gcctcatttcttcctctgca

SEQ ID NO: 1206429 - DNA, 21 bp, Homo sapiens
gcctcatttcttcctctgcat

SEQ ID NO: 1206430 - DNA, 21 bp, Homo sapiens
gcctccaaaatattaacattc

SEQ ID NO: 1206431 - DNA, 22 bp, Homo sapiens
gcctccaaagtggagctgggag

SEQ ID NO: 1206432 - DNA, 17 bp, Homo sapiens
gcctccaaatgccaact

SEQ ID NO: 1206433 - DNA, 13 bp, Homo sapiens
gcctccaagcctg

SEQ ID NO: 1206434 - DNA, 23 bp, Homo sapiens
gcctccaaggaggggctgtaaaa

SEQ ID NO: 1206435 - DNA, 16 bp, Homo sapiens
gcctccaattggtgct

SEQ ID NO: 1206436 - DNA, 15 bp, Homo sapiens
gcctccacagcgagg

SEQ ID NO: 1206437 - DNA, 20 bp, Homo sapiens
gcctccacagcgagggcagc

SEQ ID NO: 1206438 - DNA, 21 bp, Homo sapiens
gcctccacagcgagggcagct

SEQ ID NO: 1206439 - DNA, 19 bp, Homo sapiens
gcctccacatgctgcctgg

SEQ ID NO: 1206440 - DNA, 22 bp, Homo sapiens
gcctccacatgctgcctggcac

SEQ ID NO: 1206441 - DNA, 18 bp, Homo sapiens
gcccccagtccccacccc

SEQ ID NO: 1206442 - DNA, 12 bp, Homo sapiens
gcccccagtggg

SEQ ID NO: 1206443 - DNA, 20 bp, Homo sapiens
gcccccagtggggacaggga

SEQ ID NO: 1206444 - DNA, 16 bp, Homo sapiens
gcccccatccagccac

SEQ ID NO: 1206445 - DNA, 13 bp, Homo sapiens
gcccccatctcat

SEQ ID NO: 1206446 - DNA, 18 bp, Homo sapiens
gcccccatctcatgcccc

SEQ ID NO: 1206447 - DNA, 15 bp, Homo sapiens
gcccccatctcccca

SEQ ID NO: 1206448 - DNA, 16 bp, Homo sapiens
gcccccatctccccag

SEQ ID NO: 1206449 - DNA, 18 bp, Homo sapiens
gcccccatctccccaggc

SEQ ID NO: 1206450 - DNA, 16 bp, Homo sapiens
gccccccacacttccc

SEQ ID NO: 1206451 - DNA, 14 bp, Homo sapiens
gccccccacctttg

SEQ ID NO: 1206452 - DNA, 18 bp, Homo sapiens
gccccccagagccagggc

SEQ ID NO: 1206453 - DNA, 23 bp, Homo sapiens
gccccccagagccagggctgtcc

SEQ ID NO: 1206454 - DNA, 14 bp, Homo sapiens
gcccccccacccac

SEQ ID NO: 1206455 - DNA, 23 bp, Homo sapiens
gcccccccacccacccccaggcc

SEQ ID NO: 1206456 - DNA, 16 bp, Homo sapiens
gcccccccctcaaggg

SEQ ID NO: 1206457 - DNA, 21 bp, Homo sapiens
gccccccctcttttggccttg

SEQ ID NO: 1206458 - DNA, 13 bp, Homo sapiens
gcccccccttcca

SEQ ID NO: 1206459 - DNA, 15 bp, Homo sapiens
gcccccccttccact

SEQ ID NO: 1206460 - DNA, 17 bp, Homo sapiens
gccccccgaggctgcta

SEQ ID NO: 1206461 - DNA, 18 bp, Homo sapiens
gccccccgcgctcgccca

SEQ ID NO: 1206462 - DNA, 11 bp, Homo sapiens
gcccccctcaa

SEQ ID NO: 1206463 - DNA, 14 bp, Homo sapiens
gcccccctcaaacc

SEQ ID NO: 1206464 - DNA, 14 bp, Homo sapiens
gcccccctcctcca

SEQ ID NO: 1206465 - DNA, 13 bp, Homo sapiens
gcccccctttggc

SEQ ID NO: 1206466 - DNA, 23 bp, Homo sapiens
gcccccgacccccgcagaggcag

SEQ ID NO: 1206467 - DNA, 16 bp, Homo sapiens
gcccccgacggctgtg

SEQ ID NO: 1206468 - DNA, 17 bp, Homo sapiens
gcccccgagccctgact

SEQ ID NO: 1206469 - DNA, 17 bp, Homo sapiens
gcccccgccccaggctt

SEQ ID NO: 1206470 - DNA, 16 bp, Homo sapiens
gcccccgcctgccacc

SEQ ID NO: 1206471 - DNA, 23 bp, Homo sapiens
gcccccgcgccctccctccgcct

SEQ ID NO: 1206472 - DNA, 20 bp, Homo sapiens
gcccccggctttcctccgga

SEQ ID NO: 1206473 - DNA, 15 bp, Homo sapiens
gcccccgggacaccg

SEQ ID NO: 1206474 - DNA, 14 bp, Homo sapiens
gcccccgggcctgc

SEQ ID NO: 1206475 - DNA, 15 bp, Homo sapiens
gcccccgtcagggag

SEQ ID NO: 1206476 - DNA, 21 bp, Homo sapiens
gcccccgtcagggagaggtca

SEQ ID NO: 1206477 - DNA, 12 bp, Homo sapiens
gccccctaggat

SEQ ID NO: 1206478 - DNA, 19 bp, Homo sapiens
gccccctcaccccagctcc

SEQ ID NO: 1206479 - DNA, 16 bp, Homo sapiens
gccccctcattcagag

SEQ ID NO: 1206480 - DNA, 15 bp, Homo sapiens
gccccctccagctca

SEQ ID NO: 1206481 - DNA, 15 bp, Homo sapiens
gccccctccaggaga

SEQ ID NO: 1206482 - DNA, 19 bp, Homo sapiens
gccccctccccccagactc

SEQ ID NO: 1206483 - DNA, 16 bp, Homo sapiens
gccccctcccttcaca

SEQ ID NO: 1206484 - DNA, 20 bp, Homo sapiens
gccccctccgccctgccact

SEQ ID NO: 1206485 - DNA, 21 bp, Homo sapiens
gccccctcctctagctgtggg

SEQ ID NO: 1206486 - DNA, 19 bp, Homo sapiens
gccccctcctctcccatcc

SEQ ID NO: 1206487 - DNA, 12 bp, Homo sapiens
gccccctcctga

SEQ ID NO: 1206488 - DNA, 21 bp, Homo sapiens
gccccctcctgaaccgcacag

SEQ ID NO: 1206489 - DNA, 22 bp, Homo sapiens
gccccctcctgaaccgcacagc

SEQ ID NO: 1206490 - DNA, 18 bp, Homo sapiens
gccccctcgggggcctgt

SEQ ID NO: 1206491 - DNA, 20 bp, Homo sapiens
gccccctcgggggcctgtgg

SEQ ID NO: 1206492 - DNA, 12 bp, Homo sapiens
gccccctctcgg

SEQ ID NO: 1206493 - DNA, 22 bp, Homo sapiens
gccccctgccagccgaccctcc

SEQ ID NO: 1206494 - DNA, 13 bp, Homo sapiens
gccccctgccagt

SEQ ID NO: 1206495 - DNA, 21 bp, Homo sapiens
gccccctgcttggccaggagg

SEQ ID NO: 1206496 - DNA, 20 bp, Homo sapiens
gccccctggcagctgcccct

SEQ ID NO: 1206497 - DNA, 21 bp, Homo sapiens
gccccctggcagctgcccctc

SEQ ID NO: 1206498 - DNA, 13 bp, Homo sapiens
gccccctggcctc

SEQ ID NO: 1206499 - DNA, 19 bp, Homo sapiens
gccccctggcctctgtgcc

SEQ ID NO: 1206500 - DNA, 12 bp, Homo sapiens
gccccctgggct

SEQ ID NO: 1206501 - DNA, 17 bp, Homo sapiens
gccccctgggctggggc

SEQ ID NO: 1206502 - DNA, 21 bp, Homo sapiens
gccccctggtggacagtcctg

SEQ ID NO: 1206503 - DNA, 12 bp, Homo sapiens
gccccctgtggc

SEQ ID NO: 1206504 - DNA, 15 bp, Homo sapiens
gcccccttccccagc

SEQ ID NO: 1206505 - DNA, 16 bp, Homo sapiens
gcccccttcgctcctc

SEQ ID NO: 1206506 - DNA, 19 bp, Homo sapiens
gcccccttcggttacagga

SEQ ID NO: 1206507 - DNA, 16 bp, Homo sapiens
gcccccttctcccaca

SEQ ID NO: 1206508 - DNA, 17 bp, Homo sapiens
gcccccttctcccacac

SEQ ID NO: 1206509 - DNA, 19 bp, Homo sapiens
gcccccttctcccacactg

SEQ ID NO: 1206510 - DNA, 15 bp, Homo sapiens
gcccccttgcccatc

SEQ ID NO: 1206511 - DNA, 13 bp, Homo sapiens
gcccccttgccct

SEQ ID NO: 1206512 - DNA, 14 bp, Homo sapiens
gcccccttgccctc

SEQ ID NO: 1206513 - DNA, 19 bp, Homo sapiens
gcccccttgccctccgcct

SEQ ID NO: 1206514 - DNA, 16 bp, Homo sapiens
gccccctttcagatgt

SEQ ID NO: 1206515 - DNA, 23 bp, Homo sapiens
gccccctttcagatgtcttctgc

SEQ ID NO: 1206516 - DNA, 23 bp, Homo sapiens
gccccctttcccgggctgtccac

SEQ ID NO: 1206517 - DNA, 17 bp, Homo sapiens
gccccctttgaccttcc

SEQ ID NO: 1206518 - DNA, 19 bp, Homo sapiens
gccccctttgaccttcccc

SEQ ID NO: 1206519 - DNA, 13 bp, Homo sapiens
gccccgacacacg

SEQ ID NO: 1206520 - DNA, 12 bp, Homo sapiens
gccccgactcca

SEQ ID NO: 1206521 - DNA, 14 bp, Homo sapiens
gccccgactccagc

SEQ ID NO: 1206522 - DNA, 16 bp, Homo sapiens
gccccgactccagcca

SEQ ID NO: 1206523 - DNA, 18 bp, Homo sapiens
gccccgactccagccagc

SEQ ID NO: 1206524 - DNA, 20 bp, Homo sapiens
gccccgactccagccagcgc

SEQ ID NO: 1206525 - DNA, 13 bp, Homo sapiens
gccccgagctgtc

SEQ ID NO: 1206526 - DNA, 13 bp, Homo sapiens
gccccgcaccccc

SEQ ID NO: 1206527 - DNA, 17 bp, Homo sapiens
cggagttcctaacagga

SEQ ID NO: 1206528 - DNA, 21 bp, Homo sapiens
cggataggcaggaacatacag

SEQ ID NO: 1206529 - DNA, 23 bp, Homo sapiens
cggataggcaggaacatacagac

SEQ ID NO: 1206530 - DNA, 18 bp, Homo sapiens
cggatcagagcaggacct

SEQ ID NO: 1206531 - DNA, 12 bp, Homo sapiens
cggatcctgtga

SEQ ID NO: 1206532 - DNA, 18 bp, Homo sapiens
cggatgacaccctggcct

SEQ ID NO: 1206533 - DNA, 13 bp, Homo sapiens
cggatgaccaaac

SEQ ID NO: 1206534 - DNA, 15 bp, Homo sapiens
cggatgaccaaacca

SEQ ID NO: 1206535 - DNA, 20 bp, Homo sapiens
cggatgaccaaaccagcctt

SEQ ID NO: 1206536 - DNA, 20 bp, Homo sapiens
cggatggaccaacctgctct

SEQ ID NO: 1206537 - DNA, 22 bp, Homo sapiens
cggatggaccaacctgctctgt

SEQ ID NO: 1206538 - DNA, 16 bp, Homo sapiens
cggatggcaggatcca

SEQ ID NO: 1206539 - DNA, 19 bp, Homo sapiens
cggatggcaggatccaagg

SEQ ID NO: 1206540 - DNA, 16 bp, Homo sapiens
cggatgggcacacaca

SEQ ID NO: 1206541 - DNA, 13 bp, Homo sapiens
cggatgtgctttt

SEQ ID NO: 1206542 - DNA, 21 bp, Homo sapiens
cggatttattatataaatata

SEQ ID NO: 1206543 - DNA, 12 bp, Homo sapiens
cggatttctaac

SEQ ID NO: 1206544 - DNA, 15 bp, Homo sapiens
cggcaaacctttccc

SEQ ID NO: 1206545 - DNA, 20 bp, Homo sapiens
cggcaaccacatgtcccaga

SEQ ID NO: 1206546 - DNA, 21 bp, Homo sapiens
cggcaaccccagttctgctcc

SEQ ID NO: 1206547 - DNA, 18 bp, Homo sapiens
cggcaacgtagcctgggc

SEQ ID NO: 1206548 - DNA, 20 bp, Homo sapiens
cggcaacgtagcctgggctc

SEQ ID NO: 1206549 - DNA, 23 bp, Homo sapiens
cggcaacgtagcctgggctcact

SEQ ID NO: 1206550 - DNA, 16 bp, Homo sapiens
cggcacacactgtgcc

SEQ ID NO: 1206551 - DNA, 14 bp, Homo sapiens
cggcacagatgctc

SEQ ID NO: 1206552 - DNA, 18 bp, Homo sapiens
cggcacagggtctgctct

SEQ ID NO: 1206553 - DNA, 19 bp, Homo sapiens
cggcacagggtctgctctt

SEQ ID NO: 1206554 - DNA, 21 bp, Homo sapiens
cggcacagggtctgctctttc

SEQ ID NO: 1206555 - DNA, 14 bp, Homo sapiens
cggcaccctggtct

SEQ ID NO: 1206556 - DNA, 16 bp, Homo sapiens
cggcaccctggtctgt

SEQ ID NO: 1206557 - DNA, 22 bp, Homo sapiens
cggcagaaaggaaaacctgaag

SEQ ID NO: 1206558 - DNA, 16 bp, Homo sapiens
cggcagcccccccctc

SEQ ID NO: 1206559 - DNA, 20 bp, Homo sapiens
cggcagcccccccctcaagg

SEQ ID NO: 1206560 - DNA, 21 bp, Homo sapiens
cggcagctcttctgggcagag

SEQ ID NO: 1206561 - DNA, 23 bp, Homo sapiens
cggcagctcttctgggcagagcc

SEQ ID NO: 1206562 - DNA, 19 bp, Homo sapiens
cggcaggcctgagaatgag

SEQ ID NO: 1206563 - DNA, 14 bp, Homo sapiens
cggcaggctcactg

SEQ ID NO: 1206564 - DNA, 22 bp, Homo sapiens
cggcaggctcactgccaggcca

SEQ ID NO: 1206565 - DNA, 18 bp, Homo sapiens
cggcagggaacctagtgc

SEQ ID NO: 1206566 - DNA, 22 bp, Homo sapiens
cggcatcgcatccgtcctgggc

SEQ ID NO: 1206567 - DNA, 13 bp, Homo sapiens
cggcatgccagga

SEQ ID NO: 1206568 - DNA, 18 bp, Homo sapiens
cggcatgtttccagcaga

SEQ ID NO: 1206569 - DNA, 13 bp, Homo sapiens
cggcatttgtttc

SEQ ID NO: 1206570 - DNA, 18 bp, Homo sapiens
cggccaatggtgcttccc

SEQ ID NO: 1206571 - DNA, 19 bp, Homo sapiens
cggccacacccagcggccc

SEQ ID NO: 1206572 - DNA, 14 bp, Homo sapiens
cggccacagctgct

SEQ ID NO: 1206573 - DNA, 15 bp, Homo sapiens
cggccacagctgctg

SEQ ID NO: 1206574 - DNA, 17 bp, Homo sapiens
cggccacagctgctgga

SEQ ID NO: 1206575 - DNA, 14 bp, Homo sapiens
cggccaccactgca

SEQ ID NO: 1206576 - DNA, 10 bp, Homo sapiens
cggccaccct

SEQ ID NO: 1206577 - DNA, 21 bp, Homo sapiens
cggccacgtcatgtctctaaa

SEQ ID NO: 1206578 - DNA, 17 bp, Homo sapiens
cggccactgtgtctctg

SEQ ID NO: 1206579 - DNA, 20 bp, Homo sapiens
cggccagcccgtcctcctct

SEQ ID NO: 1206580 - DNA, 19 bp, Homo sapiens
cggccaggctggagtgcag

SEQ ID NO: 1206581 - DNA, 17 bp, Homo sapiens
cggccagggacccaaag

SEQ ID NO: 1206582 - DNA, 19 bp, Homo sapiens
cggccagggacccaaagca

SEQ ID NO: 1206583 - DNA, 21 bp, Homo sapiens
cggccagggacccaaagcagg

SEQ ID NO: 1206584 - DNA, 16 bp, Homo sapiens
cggccagggcggccag

SEQ ID NO: 1206585 - DNA, 23 bp, Homo sapiens
cggccatgagactgatccctggc

SEQ ID NO: 1206586 - DNA, 12 bp, Homo sapiens
cggcccacagct

SEQ ID NO: 1206587 - DNA, 19 bp, Homo sapiens
cggcccacagctcccaccc

SEQ ID NO: 1206588 - DNA, 22 bp, Homo sapiens
cggcccacagctcccaccccac

SEQ ID NO: 1206589 - DNA, 18 bp, Homo sapiens
cggcccagaagtttccct

SEQ ID NO: 1206590 - DNA, 23 bp, Homo sapiens
cggcccagacccactctgcggcc

SEQ ID NO: 1206591 - DNA, 17 bp, Homo sapiens
cggcccagatgtgtccc

SEQ ID NO: 1206592 - DNA, 13 bp, Homo sapiens
cggcccagtgcca

SEQ ID NO: 1206593 - DNA, 15 bp, Homo sapiens
cggcccagtgccact

SEQ ID NO: 1206594 - DNA, 16 bp, Homo sapiens
cggcccagtgccagct

SEQ ID NO: 1206595 - DNA, 20 bp, Homo sapiens
cggccccacccaccctctgg

SEQ ID NO: 1206596 - DNA, 17 bp, Homo sapiens
cggccccacctccctgc

SEQ ID NO: 1206597 - DNA, 13 bp, Homo sapiens
cggccccatctct

SEQ ID NO: 1206598 - DNA, 23 bp, Homo sapiens
cggccccccctcttttggccttg

SEQ ID NO: 1206599 - DNA, 22 bp, Homo sapiens
cggccccccgcacagccacccg

SEQ ID NO: 1206600 - DNA, 23 bp, Homo sapiens
cggccccccgcgctcgcccagca

SEQ ID NO: 1206601 - DNA, 12 bp, Homo sapiens
cggcccccctct

SEQ ID NO: 1206602 - DNA, 20 bp, Homo sapiens
cggccccctccccccagact

SEQ ID NO: 1206603 - DNA, 18 bp, Homo sapiens
cggcccctcaccctctgt

SEQ ID NO: 1206604 - DNA, 21 bp, Homo sapiens
cggcccctcaccctctgtccc

SEQ ID NO: 1206605 - DNA, 14 bp, Homo sapiens
cggcccctccccct

SEQ ID NO: 1206606 - DNA, 22 bp, Homo sapiens
cggcccctgcatccccttggct

SEQ ID NO: 1206607 - DNA, 23 bp, Homo sapiens
cggcccctggcagcacagcccag

SEQ ID NO: 1206608 - DNA, 15 bp, Homo sapiens
cggcccgcagcctgg

SEQ ID NO: 1206609 - DNA, 13 bp, Homo sapiens
cggcccgcctgcc

SEQ ID NO: 1206610 - DNA, 16 bp, Homo sapiens
cggcccggagcagcag

SEQ ID NO: 1206611 - DNA, 13 bp, Homo sapiens
cggcccggcccct

SEQ ID NO: 1206612 - DNA, 16 bp, Homo sapiens
cggcccggcccctcac

SEQ ID NO: 1206613 - DNA, 16 bp, Homo sapiens
cggcccgtggacaccc

SEQ ID NO: 1206614 - DNA, 12 bp, Homo sapiens
cggccctaaggg

SEQ ID NO: 1206615 - DNA, 14 bp, Homo sapiens
cggccctagcattg

SEQ ID NO: 1206616 - DNA, 20 bp, Homo sapiens
cggccctagcattgcacttg

SEQ ID NO: 1206617 - DNA, 21 bp, Homo sapiens
cggccctcagtagtccctgca

SEQ ID NO: 1206618 - DNA, 13 bp, Homo sapiens
cggccctcagtgc

SEQ ID NO: 1206619 - DNA, 18 bp, Homo sapiens
cggccctcatctatgagg

SEQ ID NO: 1206620 - DNA, 19 bp, Homo sapiens
cggccctcccccagctcct

SEQ ID NO: 1206621 - DNA, 17 bp, Homo sapiens
cggccctgcaggagcag

SEQ ID NO: 1206622 - DNA, 20 bp, Homo sapiens
cggccctgcaggagcagggc

SEQ ID NO: 1206623 - DNA, 18 bp, Homo sapiens
cggccctgcctgcctctt

SEQ ID NO: 1206624 - DNA, 10 bp, Homo sapiens
cggccctgcg

SEQ ID NO: 1206625 - DNA, 17 bp, Homo sapiens
cggccctgtcccctgga

SEQ ID NO: 1206626 - DNA, 20 bp, Homo sapiens
cggcccttcctgcagcgcct

SEQ ID NO: 1206627 - DNA, 15 bp, Homo sapiens
cggccgcattccctg

SEQ ID NO: 1206628 - DNA, 18 bp, Homo sapiens
cggccgccatagccccag

SEQ ID NO: 1206629 - DNA, 21 bp, Homo sapiens
cggccgccatagccccagtag

SEQ ID NO: 1206630 - DNA, 20 bp, Homo sapiens
cggccgccccccgcccctcg

SEQ ID NO: 1206631 - DNA, 15 bp, Homo sapiens
cggccgccgccagga

SEQ ID NO: 1206632 - DNA, 13 bp, Homo sapiens
cggccgcgccacc

SEQ ID NO: 1206633 - DNA, 15 bp, Homo sapiens
cggccggacctctga

SEQ ID NO: 1206634 - DNA, 23 bp, Homo sapiens
cggccggccagcccctggcccca

SEQ ID NO: 1206635 - DNA, 22 bp, Homo sapiens
cggcctcaccaggcccacgagg

SEQ ID NO: 1206636 - DNA, 10 bp, Homo sapiens
cggcctccac

SEQ ID NO: 1206637 - DNA, 12 bp, Homo sapiens
cggcctccactc

SEQ ID NO: 1206638 - DNA, 21 bp, Homo sapiens
cggcctccactcccccacctg

SEQ ID NO: 1206639 - DNA, 12 bp, Homo sapiens
cggcctccagga

SEQ ID NO: 1206640 - DNA, 14 bp, Homo sapiens
cggcctccaggagg

SEQ ID NO: 1206641 - DNA, 15 bp, Homo sapiens
cggcctcccaaagtg

SEQ ID NO: 1206642 - DNA, 16 bp, Homo sapiens
cggcctccgaggctcc

SEQ ID NO: 1206643 - DNA, 21 bp, Homo sapiens
cggcctccgaggctccccgcc

SEQ ID NO: 1206644 - DNA, 22 bp, Homo sapiens
cggcctccgtccaggagcctgg

SEQ ID NO: 1206645 - DNA, 19 bp, Homo sapiens
cggcctctctcttcccagc

SEQ ID NO: 1206646 - DNA, 16 bp, Homo sapiens
cggcctctctggcctc

SEQ ID NO: 1206647 - DNA, 12 bp, Homo sapiens
cggcctctgctg

SEQ ID NO: 1206648 - DNA, 13 bp, Homo sapiens
cggcctcttccac

SEQ ID NO: 1206649 - DNA, 17 bp, Homo sapiens
cggcctcttccacccat

SEQ ID NO: 1206650 - DNA, 16 bp, Homo sapiens
cggcctgatgctccct

SEQ ID NO: 1206651 - DNA, 23 bp, Homo sapiens
cggcctgcaccgaccccgggccg

SEQ ID NO: 1206652 - DNA, 17 bp, Homo sapiens
gccccgcacccccgcca

SEQ ID NO: 1206653 - DNA, 13 bp, Homo sapiens
gccccgcacgggc

SEQ ID NO: 1206654 - DNA, 22 bp, Homo sapiens
gccccgcacgggctgtctgggt

SEQ ID NO: 1206655 - DNA, 15 bp, Homo sapiens
gccccgcactgtgcc

SEQ ID NO: 1206656 - DNA, 13 bp, Homo sapiens
gccccgccagggc

SEQ ID NO: 1206657 - DNA, 14 bp, Homo sapiens
gccccgccagggct

SEQ ID NO: 1206658 - DNA, 19 bp, Homo sapiens
gccccgccagggctgggga

SEQ ID NO: 1206659 - DNA, 22 bp, Homo sapiens
gccccgccccacattccgacaa

SEQ ID NO: 1206660 - DNA, 21 bp, Homo sapiens
gccccgcccccagtccccacc

SEQ ID NO: 1206661 - DNA, 15 bp, Homo sapiens
gccccgccccccaga

SEQ ID NO: 1206662 - DNA, 16 bp, Homo sapiens
gccccgccccccagag

SEQ ID NO: 1206663 - DNA, 18 bp, Homo sapiens
gccccgcccccgccccgc

SEQ ID NO: 1206664 - DNA, 15 bp, Homo sapiens
gccccgccctcttcc

SEQ ID NO: 1206665 - DNA, 17 bp, Homo sapiens
gccccgccctcttcctg

SEQ ID NO: 1206666 - DNA, 18 bp, Homo sapiens
gccccgccctcttcctga

SEQ ID NO: 1206667 - DNA, 13 bp, Homo sapiens
gccccgccgcctg

SEQ ID NO: 1206668 - DNA, 23 bp, Homo sapiens
gccccgcctgtcacaataaagtt

SEQ ID NO: 1206669 - DNA, 13 bp, Homo sapiens
gccccgccttcct

SEQ ID NO: 1206670 - DNA, 23 bp, Homo sapiens
gccccgccttcgtgtgctgctgc

SEQ ID NO: 1206671 - DNA, 17 bp, Homo sapiens
gccccgcgcctccttcc

SEQ ID NO: 1206672 - DNA, 14 bp, Homo sapiens
gccccgcgcgccgg

SEQ ID NO: 1206673 - DNA, 14 bp, Homo sapiens
gccccgctcccacc

SEQ ID NO: 1206674 - DNA, 15 bp, Homo sapiens
gccccgctcccacct

SEQ ID NO: 1206675 - DNA, 15 bp, Homo sapiens
gccccgctgtgtcct

SEQ ID NO: 1206676 - DNA, 17 bp, Homo sapiens
gccccgctgtgtcctcc

SEQ ID NO: 1206677 - DNA, 18 bp, Homo sapiens
gccccgctgtgtcctccc

SEQ ID NO: 1206678 - DNA, 21 bp, Homo sapiens
gccccgctgtgtcctccctcc

SEQ ID NO: 1206679 - DNA, 16 bp, Homo sapiens
gccccgcttgtccagc

SEQ ID NO: 1206680 - DNA, 15 bp, Homo sapiens
gccccggatcagagc

SEQ ID NO: 1206681 - DNA, 17 bp, Homo sapiens
gccccggatcagagcag

SEQ ID NO: 1206682 - DNA, 18 bp, Homo sapiens
gccccggatcagagcagg

SEQ ID NO: 1206683 - DNA, 22 bp, Homo sapiens
gccccggatcagagcaggacct

SEQ ID NO: 1206684 - DNA, 18 bp, Homo sapiens
gccccggcaagccacagg

SEQ ID NO: 1206685 - DNA, 18 bp, Homo sapiens
gccccggccccagccaga

SEQ ID NO: 1206686 - DNA, 17 bp, Homo sapiens
gccccgggctctggcca

SEQ ID NO: 1206687 - DNA, 12 bp, Homo sapiens
gccccgggctgg

SEQ ID NO: 1206688 - DNA, 15 bp, Homo sapiens
gccccgggctggccc

SEQ ID NO: 1206689 - DNA, 17 bp, Homo sapiens
gccccgggctggccctg

SEQ ID NO: 1206690 - DNA, 22 bp, Homo sapiens
gccccgggctggccctgtgcag

SEQ ID NO: 1206691 - DNA, 21 bp, Homo sapiens
gccccggggactcgcagcacc

SEQ ID NO: 1206692 - DNA, 15 bp, Homo sapiens
gccccggggctggca

SEQ ID NO: 1206693 - DNA, 19 bp, Homo sapiens
gccccgggtgcctcagagc

SEQ ID NO: 1206694 - DNA, 23 bp, Homo sapiens
gccccgggtgcctcagagcaggc

SEQ ID NO: 1206695 - DNA, 15 bp, Homo sapiens
gccccgtagagaatg

SEQ ID NO: 1206696 - DNA, 23 bp, Homo sapiens
gccccgtcaccatctcaggccac

SEQ ID NO: 1206697 - DNA, 21 bp, Homo sapiens
gccccgtccccctctggctcc

SEQ ID NO: 1206698 - DNA, 23 bp, Homo sapiens
gccccgtcccctaacccccagtc

SEQ ID NO: 1206699 - DNA, 17 bp, Homo sapiens
gccccgttccctgtcag

SEQ ID NO: 1206700 - DNA, 21 bp, Homo sapiens
gcccctaagttattacctctc

SEQ ID NO: 1206701 - DNA, 15 bp, Homo sapiens
gcccctaatctctgt

SEQ ID NO: 1206702 - DNA, 19 bp, Homo sapiens
gcccctaatctctgtagga

SEQ ID NO: 1206703 - DNA, 19 bp, Homo sapiens
gcccctacccctgccctgc

SEQ ID NO: 1206704 - DNA, 19 bp, Homo sapiens
gcccctagaaacccaagct

SEQ ID NO: 1206705 - DNA, 20 bp, Homo sapiens
gcccctaggatgctgcagca

SEQ ID NO: 1206706 - DNA, 16 bp, Homo sapiens
gcccctagggtccctc

SEQ ID NO: 1206707 - DNA, 16 bp, Homo sapiens
gcccctcacatcctct

SEQ ID NO: 1206708 - DNA, 14 bp, Homo sapiens
gcccctcaccccaa

SEQ ID NO: 1206709 - DNA, 18 bp, Homo sapiens
gcccctcaccctctgtcc

SEQ ID NO: 1206710 - DNA, 20 bp, Homo sapiens
gcccctcacctgggcacctg

SEQ ID NO: 1206711 - DNA, 16 bp, Homo sapiens
gcccctcacctgggcc

SEQ ID NO: 1206712 - DNA, 21 bp, Homo sapiens
gcccctcagcccttgccccca

SEQ ID NO: 1206713 - DNA, 18 bp, Homo sapiens
gcccctcagggggccagc

SEQ ID NO: 1206714 - DNA, 19 bp, Homo sapiens
gcccctcagggggccagct

SEQ ID NO: 1206715 - DNA, 21 bp, Homo sapiens
gcccctcagggggccagctgg

SEQ ID NO: 1206716 - DNA, 15 bp, Homo sapiens
gcccctccacgcctc

SEQ ID NO: 1206717 - DNA, 20 bp, Homo sapiens
gcccctccacgcctcctggc

SEQ ID NO: 1206718 - DNA, 21 bp, Homo sapiens
gcccctccacgcctcctggcc

SEQ ID NO: 1206719 - DNA, 23 bp, Homo sapiens
gcccctccacgcctcctggccag

SEQ ID NO: 1206720 - DNA, 12 bp, Homo sapiens
gcccctccactg

SEQ ID NO: 1206721 - DNA, 23 bp, Homo sapiens
gcccctccagaccctgcctgagc

SEQ ID NO: 1206722 - DNA, 14 bp, Homo sapiens
gcccctccagtgtt

SEQ ID NO: 1206723 - DNA, 16 bp, Homo sapiens
gcccctccagtgttgc

SEQ ID NO: 1206724 - DNA, 23 bp, Homo sapiens
gcccctccagtgttgcctcctcc

SEQ ID NO: 1206725 - DNA, 14 bp, Homo sapiens
gcccctcccaagcg

SEQ ID NO: 1206726 - DNA, 21 bp, Homo sapiens
gcccctcccaagcgttcctgg

SEQ ID NO: 1206727 - DNA, 22 bp, Homo sapiens
gcccctcccaagcgttcctggc

SEQ ID NO: 1206728 - DNA, 15 bp, Homo sapiens
gcccctcccacacac

SEQ ID NO: 1206729 - DNA, 14 bp, Homo sapiens
gcccctcccaccac

SEQ ID NO: 1206730 - DNA, 17 bp, Homo sapiens
gcccctccccaaaagaa

SEQ ID NO: 1206731 - DNA, 22 bp, Homo sapiens
gcccctccccagccagcccttc

SEQ ID NO: 1206732 - DNA, 15 bp, Homo sapiens
gcccctcccccaacc

SEQ ID NO: 1206733 - DNA, 21 bp, Homo sapiens
gcccctcccccaacccccacc

SEQ ID NO: 1206734 - DNA, 17 bp, Homo sapiens
gcccctccccgtccctg

SEQ ID NO: 1206735 - DNA, 15 bp, Homo sapiens
gcccctcccctcagc

SEQ ID NO: 1206736 - DNA, 13 bp, Homo sapiens
gcccctccctcag

SEQ ID NO: 1206737 - DNA, 12 bp, Homo sapiens
gcccctcccttc

SEQ ID NO: 1206738 - DNA, 14 bp, Homo sapiens
gcccctcccttcaa

SEQ ID NO: 1206739 - DNA, 15 bp, Homo sapiens
gcccctcccttcaac

SEQ ID NO: 1206740 - DNA, 15 bp, Homo sapiens
gcccctcctccagcc

SEQ ID NO: 1206741 - DNA, 20 bp, Homo sapiens
gcccctcctccagcccctgt

SEQ ID NO: 1206742 - DNA, 22 bp, Homo sapiens
gcccctcctctgccacctcccc

SEQ ID NO: 1206743 - DNA, 21 bp, Homo sapiens
gcccctcctggagcagaaagt

SEQ ID NO: 1206744 - DNA, 20 bp, Homo sapiens
gcccctccttgcaaccaggc

SEQ ID NO: 1206745 - DNA, 23 bp, Homo sapiens
gcccctccttgcaaccaggcagc

SEQ ID NO: 1206746 - DNA, 14 bp, Homo sapiens
gcccctcgaggcct

SEQ ID NO: 1206747 - DNA, 15 bp, Homo sapiens
gcccctcgaggccta

SEQ ID NO: 1206748 - DNA, 15 bp, Homo sapiens
gcccctcgcacacag

SEQ ID NO: 1206749 - DNA, 16 bp, Homo sapiens
gcccctcgcacacagg

SEQ ID NO: 1206750 - DNA, 18 bp, Homo sapiens
gcccctcgcacacagggc

SEQ ID NO: 1206751 - DNA, 20 bp, Homo sapiens
gcccctcgcacacagggctc

SEQ ID NO: 1206752 - DNA, 15 bp, Homo sapiens
gcccctcgcccgccc

SEQ ID NO: 1206753 - DNA, 23 bp, Homo sapiens
gcccctcgcctgtggagctcagc

SEQ ID NO: 1206754 - DNA, 16 bp, Homo sapiens
gcccctcgctgctgct

SEQ ID NO: 1206755 - DNA, 17 bp, Homo sapiens
gcccctcgctgctgcta

SEQ ID NO: 1206756 - DNA, 19 bp, Homo sapiens
gcccctcggctctggaggc

SEQ ID NO: 1206757 - DNA, 15 bp, Homo sapiens
gcccctctcaccaaa

SEQ ID NO: 1206758 - DNA, 22 bp, Homo sapiens
gcccctctccaaacaccggcag

SEQ ID NO: 1206759 - DNA, 18 bp, Homo sapiens
gcccctctcccctctctg

SEQ ID NO: 1206760 - DNA, 14 bp, Homo sapiens
gcccctctctcaca

SEQ ID NO: 1206761 - DNA, 13 bp, Homo sapiens
gcccctctgattg

SEQ ID NO: 1206762 - DNA, 21 bp, Homo sapiens
gcccctctgcccagcttgggc

SEQ ID NO: 1206763 - DNA, 12 bp, Homo sapiens
gcccctctggat

SEQ ID NO: 1206764 - DNA, 20 bp, Homo sapiens
gcccctctggattccctttt

SEQ ID NO: 1206765 - DNA, 19 bp, Homo sapiens
gcccctctggtcgctcctg

SEQ ID NO: 1206766 - DNA, 14 bp, Homo sapiens
gcccctctgttctc

SEQ ID NO: 1206767 - DNA, 20 bp, Homo sapiens
gcccctctgttctctcccct

SEQ ID NO: 1206768 - DNA, 22 bp, Homo sapiens
gcccctcttggagaagtctcag

SEQ ID NO: 1206769 - DNA, 15 bp, Homo sapiens
gcccctctttctctt

SEQ ID NO: 1206770 - DNA, 16 bp, Homo sapiens
gcccctgagcccagag

SEQ ID NO: 1206771 - DNA, 15 bp, Homo sapiens
gcccctgaggactgg

SEQ ID NO: 1206772 - DNA, 16 bp, Homo sapiens
gcccctgaggactgga

SEQ ID NO: 1206773 - DNA, 16 bp, Homo sapiens
gcccctgaggcttcac

SEQ ID NO: 1206774 - DNA, 19 bp, Homo sapiens
gcccctgaggcttcacgcc

SEQ ID NO: 1206775 - DNA, 20 bp, Homo sapiens
gcccctgatctctgacctct

SEQ ID NO: 1206776 - DNA, 23 bp, Homo sapiens
cggcctgcaccgacccgaggccc

SEQ ID NO: 1206777 - DNA, 13 bp, Homo sapiens
cggcctgcagtgg

SEQ ID NO: 1206778 - DNA, 16 bp, Homo sapiens
cggcctgcagtggtgt

SEQ ID NO: 1206779 - DNA, 14 bp, Homo sapiens
cggcctgcgtctcc

SEQ ID NO: 1206780 - DNA, 18 bp, Homo sapiens
cggcctgctcccagcagc

SEQ ID NO: 1206781 - DNA, 23 bp, Homo sapiens
cggcctgtaatcagctctcctgg

SEQ ID NO: 1206782 - DNA, 12 bp, Homo sapiens
cggcctgtgggt

SEQ ID NO: 1206783 - DNA, 21 bp, Homo sapiens
cggccttcttggtttcagcca

SEQ ID NO: 1206784 - DNA, 15 bp, Homo sapiens
cggccttgaagacag

SEQ ID NO: 1206785 - DNA, 19 bp, Homo sapiens
cggccttgaagacagagca

SEQ ID NO: 1206786 - DNA, 15 bp, Homo sapiens
cggcctttctagcct

SEQ ID NO: 1206787 - DNA, 15 bp, Homo sapiens
cggcctttggcttca

SEQ ID NO: 1206788 - DNA, 22 bp, Homo sapiens
cggcgagggggccggggggagg

SEQ ID NO: 1206789 - DNA, 15 bp, Homo sapiens
cggcgcccccagtgt

SEQ ID NO: 1206790 - DNA, 12 bp, Homo sapiens
cggcgcctgccc

SEQ ID NO: 1206791 - DNA, 14 bp, Homo sapiens
cggcgcctgccctg

SEQ ID NO: 1206792 - DNA, 13 bp, Homo sapiens
cggcgcggtggct

SEQ ID NO: 1206793 - DNA, 18 bp, Homo sapiens
cggcgctgattcctcgtg

SEQ ID NO: 1206794 - DNA, 23 bp, Homo sapiens
cggcggcagccccacttcacccc

SEQ ID NO: 1206795 - DNA, 17 bp, Homo sapiens
cggcggctctgagcagg

SEQ ID NO: 1206796 - DNA, 20 bp, Homo sapiens
cggcggctctgagcaggggc

SEQ ID NO: 1206797 - DNA, 19 bp, Homo sapiens
cggcgggatcctccacaga

SEQ ID NO: 1206798 - DNA, 15 bp, Homo sapiens
cggcggtcccagctc

SEQ ID NO: 1206799 - DNA, 14 bp, Homo sapiens
cggctaacttattc

SEQ ID NO: 1206800 - DNA, 22 bp, Homo sapiens
cggctaatgtttgtatttttag

SEQ ID NO: 1206801 - DNA, 18 bp, Homo sapiens
cggctaatttttgtattt

SEQ ID NO: 1206802 - DNA, 23 bp, Homo sapiens
cggctacccctcgactcagcacc

SEQ ID NO: 1206803 - DNA, 16 bp, Homo sapiens
cggctactcagcagcc

SEQ ID NO: 1206804 - DNA, 21 bp, Homo sapiens
cggctactcagcagccctcct

SEQ ID NO: 1206805 - DNA, 15 bp, Homo sapiens
cggctactctggaat

SEQ ID NO: 1206806 - DNA, 23 bp, Homo sapiens
gcccctggggacagagccacccc

SEQ ID NO: 1206807 - DNA, 20 bp, Homo sapiens
gcccctggggatcttgcccc

SEQ ID NO: 1206808 - DNA, 20 bp, Homo sapiens
gcccctggggcccagcccct

SEQ ID NO: 1206809 - DNA, 13 bp, Homo sapiens
gcccctggggctg

SEQ ID NO: 1206810 - DNA, 19 bp, Homo sapiens
gcccctgggtccttctagc

SEQ ID NO: 1206811 - DNA, 18 bp, Homo sapiens
gcccctggtaagcagagg

SEQ ID NO: 1206812 - DNA, 19 bp, Homo sapiens
gcccctgtaaggtttcaat

SEQ ID NO: 1206813 - DNA, 20 bp, Homo sapiens
gcccctgtaaggtttcaatg

SEQ ID NO: 1206814 - DNA, 17 bp, Homo sapiens
gcccctgtcccacctgg

SEQ ID NO: 1206815 - DNA, 17 bp, Homo sapiens
gcccctgtgctgcgggg

SEQ ID NO: 1206816 - DNA, 13 bp, Homo sapiens
gcccctgtggcca

SEQ ID NO: 1206817 - DNA, 21 bp, Homo sapiens
gcccctgtggggaacaggtct

SEQ ID NO: 1206818 - DNA, 10 bp, Homo sapiens
gccccttcca

SEQ ID NO: 1206819 - DNA, 20 bp, Homo sapiens
gccccttccttgctctgcac

SEQ ID NO: 1206820 - DNA, 14 bp, Homo sapiens
gccccttcctttaa

SEQ ID NO: 1206821 - DNA, 12 bp, Homo sapiens
gccccttctccc

SEQ ID NO: 1206822 - DNA, 16 bp, Homo sapiens
gccccttctccccttc

SEQ ID NO: 1206823 - DNA, 18 bp, Homo sapiens
gccccttctgctcagctc

SEQ ID NO: 1206824 - DNA, 20 bp, Homo sapiens
gccccttctgctcagctctg

SEQ ID NO: 1206825 - DNA, 23 bp, Homo sapiens
gccccttctgctcagctctgggc

SEQ ID NO: 1206826 - DNA, 17 bp, Homo sapiens
gccccttcttccaagga

SEQ ID NO: 1206827 - DNA, 20 bp, Homo sapiens
gccccttcttgggccccaga

SEQ ID NO: 1206828 - DNA, 15 bp, Homo sapiens
gccccttgcaagcca

SEQ ID NO: 1206829 - DNA, 16 bp, Homo sapiens
gccccttgcaagccat

SEQ ID NO: 1206830 - DNA, 20 bp, Homo sapiens
gccccttgctctcccctgcc

SEQ ID NO: 1206831 - DNA, 21 bp, Homo sapiens
gccccttgggcatccacccag

SEQ ID NO: 1206832 - DNA, 23 bp, Homo sapiens
gccccttgggcatccacccagtg

SEQ ID NO: 1206833 - DNA, 23 bp, Homo sapiens
gccccttgtcgcgcgtctcccat

SEQ ID NO: 1206834 - DNA, 22 bp, Homo sapiens
gcccctttacggacaccccctc

SEQ ID NO: 1206835 - DNA, 12 bp, Homo sapiens
gcccctttataa

SEQ ID NO: 1206836 - DNA, 13 bp, Homo sapiens
gcccctttcccca

SEQ ID NO: 1206837 - DNA, 15 bp, Homo sapiens
gcccctttccccacg

SEQ ID NO: 1206838 - DNA, 20 bp, Homo sapiens
gccccttttctctgctcttg

SEQ ID NO: 1206839 - DNA, 18 bp, Homo sapiens
gcccctttttactcccct

SEQ ID NO: 1206840 - DNA, 17 bp, Homo sapiens
gcccgacaggtgggcct

SEQ ID NO: 1206841 - DNA, 17 bp, Homo sapiens
gcccgacagtgccatcc

SEQ ID NO: 1206842 - DNA, 23 bp, Homo sapiens
gcccgacagtgccatccccacct

SEQ ID NO: 1206843 - DNA, 13 bp, Homo sapiens
gcccgagctggtg

SEQ ID NO: 1206844 - DNA, 15 bp, Homo sapiens
gcccgagctggtgca

SEQ ID NO: 1206845 - DNA, 16 bp, Homo sapiens
gcccgaggaagctgga

SEQ ID NO: 1206846 - DNA, 18 bp, Homo sapiens
gcccgagtccgcccatcc

SEQ ID NO: 1206847 - DNA, 13 bp, Homo sapiens
gcccgcacacctg

SEQ ID NO: 1206848 - DNA, 17 bp, Homo sapiens
gcccgcacccccaccct

SEQ ID NO: 1206849 - DNA, 21 bp, Homo sapiens
gcccgcacccccaccctttgg

SEQ ID NO: 1206850 - DNA, 21 bp, Homo sapiens
gcccgcacccctccctgcttg

SEQ ID NO: 1206851 - DNA, 17 bp, Homo sapiens
gcccgcagcccagaccc

SEQ ID NO: 1206852 - DNA, 19 bp, Homo sapiens
gcccgcaggaactgggctg

SEQ ID NO: 1206853 - DNA, 15 bp, Homo sapiens
gcccgcatgtgtgcc

SEQ ID NO: 1206854 - DNA, 13 bp, Homo sapiens
gcccgccagcctc

SEQ ID NO: 1206855 - DNA, 16 bp, Homo sapiens
gcccgccagcctcagt

SEQ ID NO: 1206856 - DNA, 18 bp, Homo sapiens
gcccgccagcctcagtgc

SEQ ID NO: 1206857 - DNA, 20 bp, Homo sapiens
gcccgccagcctcagtgcca

SEQ ID NO: 1206858 - DNA, 13 bp, Homo sapiens
gcccgcccactgt

SEQ ID NO: 1206859 - DNA, 19 bp, Homo sapiens
gcccgcccactgtcctggg

SEQ ID NO: 1206860 - DNA, 14 bp, Homo sapiens
gcccgcccgccacc

SEQ ID NO: 1206861 - DNA, 18 bp, Homo sapiens
gcccgccgcccgcccctc

SEQ ID NO: 1206862 - DNA, 14 bp, Homo sapiens
gcccgccgccctgg

SEQ ID NO: 1206863 - DNA, 16 bp, Homo sapiens
gcccgccgtctgcagg

SEQ ID NO: 1206864 - DNA, 18 bp, Homo sapiens
gcccgcctaggagttgag

SEQ ID NO: 1206865 - DNA, 15 bp, Homo sapiens
gcccgcgctcaggag

SEQ ID NO: 1206866 - DNA, 13 bp, Homo sapiens
gcccgcggcctgc

SEQ ID NO: 1206867 - DNA, 17 bp, Homo sapiens
gcccgcggcctgcaccg

SEQ ID NO: 1206868 - DNA, 15 bp, Homo sapiens
gcccgcggcctggac

SEQ ID NO: 1206869 - DNA, 16 bp, Homo sapiens
gcccgcggcctggacc

SEQ ID NO: 1206870 - DNA, 18 bp, Homo sapiens
gcccgcggcgcgaccctc

SEQ ID NO: 1206871 - DNA, 22 bp, Homo sapiens
gcccgcgggagacagcttctct

SEQ ID NO: 1206872 - DNA, 14 bp, Homo sapiens
gcccgcgggcacag

SEQ ID NO: 1206873 - DNA, 23 bp, Homo sapiens
gcccgcgggcacagccagcccaa

SEQ ID NO: 1206874 - DNA, 19 bp, Homo sapiens
gcccgctcccaacccccct

SEQ ID NO: 1206875 - DNA, 12 bp, Homo sapiens
gcccgctcccac

SEQ ID NO: 1206876 - DNA, 14 bp, Homo sapiens
gcccgctcccacag

SEQ ID NO: 1206877 - DNA, 22 bp, Homo sapiens
gcccgctcccttcctgccactg

SEQ ID NO: 1206878 - DNA, 22 bp, Homo sapiens
gcccgctgagctgagtggccag

SEQ ID NO: 1206879 - DNA, 15 bp, Homo sapiens
gcccgctgagtgggg

SEQ ID NO: 1206880 - DNA, 20 bp, Homo sapiens
gcccgctgcaatgcctagac

SEQ ID NO: 1206881 - DNA, 14 bp, Homo sapiens
gcccgctgcctctt

SEQ ID NO: 1206882 - DNA, 16 bp, Homo sapiens
gcccgctgcctcttgg

SEQ ID NO: 1206883 - DNA, 21 bp, Homo sapiens
gcccgctgcgtgccatcactc

SEQ ID NO: 1206884 - DNA, 12 bp, Homo sapiens
gcccgctgggct

SEQ ID NO: 1206885 - DNA, 16 bp, Homo sapiens
gcccgcttcaagctct

SEQ ID NO: 1206886 - DNA, 19 bp, Homo sapiens
gcccggaagcgccaggctg

SEQ ID NO: 1206887 - DNA, 14 bp, Homo sapiens
gcccggagcagcag

SEQ ID NO: 1206888 - DNA, 19 bp, Homo sapiens
gcccggaggggactggtcc

SEQ ID NO: 1206889 - DNA, 20 bp, Homo sapiens
gcccggagtaatcaggcagc

SEQ ID NO: 1206890 - DNA, 16 bp, Homo sapiens
gcccggattctgggag

SEQ ID NO: 1206891 - DNA, 17 bp, Homo sapiens
gcccggattctgggagg

SEQ ID NO: 1206892 - DNA, 15 bp, Homo sapiens
gcccggcagggcggg

SEQ ID NO: 1206893 - DNA, 22 bp, Homo sapiens
gcccggccacacccagcggccc

SEQ ID NO: 1206894 - DNA, 16 bp, Homo sapiens
gcccggcccctcaccc

SEQ ID NO: 1206895 - DNA, 21 bp, Homo sapiens
gcccggccctcccccagctcc

SEQ ID NO: 1206896 - DNA, 14 bp, Homo sapiens
gcccggcctgctcc

SEQ ID NO: 1206897 - DNA, 15 bp, Homo sapiens
gcccggcctgctccc

SEQ ID NO: 1206898 - DNA, 14 bp, Homo sapiens
gcccggcgcctgcc

SEQ ID NO: 1206899 - DNA, 13 bp, Homo sapiens
gcccggctgctgc

SEQ ID NO: 1206900 - DNA, 18 bp, Homo sapiens
gcccggctgctgcttgga

SEQ ID NO: 1206901 - DNA, 14 bp, Homo sapiens
gcccggctggtttt

SEQ ID NO: 1206902 - DNA, 13 bp, Homo sapiens
gcccgggcaccca

SEQ ID NO: 1206903 - DNA, 13 bp, Homo sapiens
gcccgggcaggcc

SEQ ID NO: 1206904 - DNA, 15 bp, Homo sapiens
cgggagtgacccagc

SEQ ID NO: 1206905 - DNA, 16 bp, Homo sapiens
cgggagtgacccagct

SEQ ID NO: 1206906 - DNA, 17 bp, Homo sapiens
cgggagtgacccagcta

SEQ ID NO: 1206907 - DNA, 20 bp, Homo sapiens
cgggatcaaacctttctggc

SEQ ID NO: 1206908 - DNA, 18 bp, Homo sapiens
cgggatcctccacagaga

SEQ ID NO: 1206909 - DNA, 23 bp, Homo sapiens
cgggatcctccacagagaggagg

SEQ ID NO: 1206910 - DNA, 17 bp, Homo sapiens
cgggatgcgtgggaggc

SEQ ID NO: 1206911 - DNA, 16 bp, Homo sapiens
cgggatggtcctgggg

SEQ ID NO: 1206912 - DNA, 21 bp, Homo sapiens
cgggattgaagggtcctgccg

SEQ ID NO: 1206913 - DNA, 22 bp, Homo sapiens
cgggcaaatgccagggcccgca

SEQ ID NO: 1206914 - DNA, 18 bp, Homo sapiens
cgggcaagtgagagggga

SEQ ID NO: 1206915 - DNA, 14 bp, Homo sapiens
cgggcacagccagc

SEQ ID NO: 1206916 - DNA, 14 bp, Homo sapiens
cgggcaccagccag

SEQ ID NO: 1206917 - DNA, 15 bp, Homo sapiens
cgggcaccagccagc

SEQ ID NO: 1206918 - DNA, 14 bp, Homo sapiens
cgggcacccacaag

SEQ ID NO: 1206919 - DNA, 16 bp, Homo sapiens
cgggcacccacaagcc

SEQ ID NO: 1206920 - DNA, 18 bp, Homo sapiens
cgggcacccacaagcccg

SEQ ID NO: 1206921 - DNA, 14 bp, Homo sapiens
cgggcagccacagg

SEQ ID NO: 1206922 - DNA, 15 bp, Homo sapiens
cgggcagccacagga

SEQ ID NO: 1206923 - DNA, 18 bp, Homo sapiens
cgggcagccacaggactg

SEQ ID NO: 1206924 - DNA, 20 bp, Homo sapiens
cgggcagccaggctgggccg

SEQ ID NO: 1206925 - DNA, 12 bp, Homo sapiens
cgggcagccccg

SEQ ID NO: 1206926 - DNA, 10 bp, Homo sapiens
cgggcagggg

SEQ ID NO: 1206927 - DNA, 20 bp, Homo sapiens
cgggcaggggtcagagcact

SEQ ID NO: 1206928 - DNA, 13 bp, Homo sapiens
gcccgtctcagtg

SEQ ID NO: 1206929 - DNA, 15 bp, Homo sapiens
gcccgtcttcagcct

SEQ ID NO: 1206930 - DNA, 17 bp, Homo sapiens
gcccgtcttcagcctag

SEQ ID NO: 1206931 - DNA, 18 bp, Homo sapiens
gcccgtcttcagcctagc

SEQ ID NO: 1206932 - DNA, 14 bp, Homo sapiens
gcccgtgaagcagt

SEQ ID NO: 1206933 - DNA, 22 bp, Homo sapiens
gcccgtgcccagccctaaagtt

SEQ ID NO: 1206934 - DNA, 16 bp, Homo sapiens
gcccgtgcccgcagga

SEQ ID NO: 1206935 - DNA, 15 bp, Homo sapiens
gcccgtgtggcccct

SEQ ID NO: 1206936 - DNA, 18 bp, Homo sapiens
gcccgttttaccaataaa

SEQ ID NO: 1206937 - DNA, 19 bp, Homo sapiens
gccctaaaattccactgcg

SEQ ID NO: 1206938 - DNA, 15 bp, Homo sapiens
gccctaagcccccag

SEQ ID NO: 1206939 - DNA, 17 bp, Homo sapiens
gccctaagcccccaggg

SEQ ID NO: 1206940 - DNA, 18 bp, Homo sapiens
gccctaagcccccagggc

SEQ ID NO: 1206941 - DNA, 16 bp, Homo sapiens
gccctaagcctgtccc

SEQ ID NO: 1206942 - DNA, 19 bp, Homo sapiens
gccctaagcctgtccccag

SEQ ID NO: 1206943 - DNA, 15 bp, Homo sapiens
gccctaaggatctct

SEQ ID NO: 1206944 - DNA, 17 bp, Homo sapiens
gccctacagagctgtgg

SEQ ID NO: 1206945 - DNA, 20 bp, Homo sapiens
gccctacagaggtctctgcc

SEQ ID NO: 1206946 - DNA, 13 bp, Homo sapiens
gccctaccagcgc

SEQ ID NO: 1206947 - DNA, 20 bp, Homo sapiens
gccctaccagcgcccgctgg

SEQ ID NO: 1206948 - DNA, 13 bp, Homo sapiens
gccctactccact

SEQ ID NO: 1206949 - DNA, 18 bp, Homo sapiens
gccctactccactgccct

SEQ ID NO: 1206950 - DNA, 17 bp, Homo sapiens
gccctactccctgcaga

SEQ ID NO: 1206951 - DNA, 13 bp, Homo sapiens
gccctactcctgc

SEQ ID NO: 1206952 - DNA, 23 bp, Homo sapiens
gccctacttccaggatggatgca

SEQ ID NO: 1206953 - DNA, 20 bp, Homo sapiens
gccctagatgcacgtggggc

SEQ ID NO: 1206954 - DNA, 14 bp, Homo sapiens
gccctagcccagac

SEQ ID NO: 1206955 - DNA, 16 bp, Homo sapiens
gccctagcccagactc

SEQ ID NO: 1206956 - DNA, 17 bp, Homo sapiens
gccctagcccagactct

SEQ ID NO: 1206957 - DNA, 22 bp, Homo sapiens
gccctagcccagactctgagct

SEQ ID NO: 1206958 - DNA, 19 bp, Homo sapiens
gccctagcctgacccggag

SEQ ID NO: 1206959 - DNA, 19 bp, Homo sapiens
gccctagcgctctcttcca

SEQ ID NO: 1206960 - DNA, 14 bp, Homo sapiens
gccctagctgaccc

SEQ ID NO: 1206961 - DNA, 21 bp, Homo sapiens
gccctaggataaaaagccagg

SEQ ID NO: 1206962 - DNA, 14 bp, Homo sapiens
gccctatgctgtgc

SEQ ID NO: 1206963 - DNA, 14 bp, Homo sapiens
gccctatggatgtg

SEQ ID NO: 1206964 - DNA, 13 bp, Homo sapiens
gccctatgggcct

SEQ ID NO: 1206965 - DNA, 15 bp, Homo sapiens
gccctatttttgcaa

SEQ ID NO: 1206966 - DNA, 13 bp, Homo sapiens
gccctcaagggtg

SEQ ID NO: 1206967 - DNA, 12 bp, Homo sapiens
gccctcaccacc

SEQ ID NO: 1206968 - DNA, 12 bp, Homo sapiens
gccctcacccca

SEQ ID NO: 1206969 - DNA, 17 bp, Homo sapiens
gccctcaccccaatccc

SEQ ID NO: 1206970 - DNA, 23 bp, Homo sapiens
gccctcaccccaatccctgccac

SEQ ID NO: 1206971 - DNA, 16 bp, Homo sapiens
gccctcacctctgagg

SEQ ID NO: 1206972 - DNA, 18 bp, Homo sapiens
gccctcacctctgaggac

SEQ ID NO: 1206973 - DNA, 23 bp, Homo sapiens
gccctcacctctgaggacagagg

SEQ ID NO: 1206974 - DNA, 16 bp, Homo sapiens
gccctcacctgcagag

SEQ ID NO: 1206975 - DNA, 19 bp, Homo sapiens
gccctcactaagccccggc

SEQ ID NO: 1206976 - DNA, 17 bp, Homo sapiens
gccctcactccctctgc

SEQ ID NO: 1206977 - DNA, 18 bp, Homo sapiens
gccctcactccctctgca

SEQ ID NO: 1206978 - DNA, 16 bp, Homo sapiens
gccctcactgagcctc

SEQ ID NO: 1206979 - DNA, 15 bp, Homo sapiens
gccctcagatgtccc

SEQ ID NO: 1206980 - DNA, 18 bp, Homo sapiens
gccctcagatgtcccttg

SEQ ID NO: 1206981 - DNA, 11 bp, Homo sapiens
gccctcaggcc

SEQ ID NO: 1206982 - DNA, 12 bp, Homo sapiens
gccctcaggcca

SEQ ID NO: 1206983 - DNA, 21 bp, Homo sapiens
gccctcaggccattccccaac

SEQ ID NO: 1206984 - DNA, 17 bp, Homo sapiens
gccctcagggactgcac

SEQ ID NO: 1206985 - DNA, 22 bp, Homo sapiens
gccctcaggggcctctctcctg

SEQ ID NO: 1206986 - DNA, 22 bp, Homo sapiens
gccctcagtcacccccacttcc

SEQ ID NO: 1206987 - DNA, 22 bp, Homo sapiens
gccctcagtcagttcccggagc

SEQ ID NO: 1206988 - DNA, 17 bp, Homo sapiens
gccctcagttccttcat

SEQ ID NO: 1206989 - DNA, 24 bp, Homo sapiens
gccctcataaaccaatgtggcaag

SEQ ID NO: 1206990 - DNA, 21 bp, Homo sapiens
gccctcatctatgaggaaagg

SEQ ID NO: 1206991 - DNA, 16 bp, Homo sapiens
gccctcatggcccctc

SEQ ID NO: 1206992 - DNA, 18 bp, Homo sapiens
gccctcatggcccctctg

SEQ ID NO: 1206993 - DNA, 23 bp, Homo sapiens
gccctcatgggtcctagcccttc

SEQ ID NO: 1206994 - DNA, 18 bp, Homo sapiens
gccctcattactgggcct

SEQ ID NO: 1206995 - DNA, 21 bp, Homo sapiens
gccctcattactgggccttag

SEQ ID NO: 1206996 - DNA, 20 bp, Homo sapiens
gccctccactccagctctga

SEQ ID NO: 1206997 - DNA, 16 bp, Homo sapiens
gccctccatccgtgct

SEQ ID NO: 1206998 - DNA, 15 bp, Homo sapiens
gccctcccaccaccc

SEQ ID NO: 1206999 - DNA, 17 bp, Homo sapiens
gccctcccaccacccca

SEQ ID NO: 1207000 - DNA, 12 bp, Homo sapiens
gccctcccagcc

SEQ ID NO: 1207001 - DNA, 23 bp, Homo sapiens
gccctcccagcccattgctgcca

SEQ ID NO: 1207002 - DNA, 12 bp, Homo sapiens
gccctcccaggc

SEQ ID NO: 1207003 - DNA, 21 bp, Homo sapiens
gccctcccaggctctcaacag

SEQ ID NO: 1207004 - DNA, 23 bp, Homo sapiens
gccctcccatgttgcatgcctat

SEQ ID NO: 1207005 - DNA, 17 bp, Homo sapiens
gccctccccagagcact

SEQ ID NO: 1207006 - DNA, 17 bp, Homo sapiens
gccctccccatcccatg

SEQ ID NO: 1207007 - DNA, 15 bp, Homo sapiens
gccctcccccagctc

SEQ ID NO: 1207008 - DNA, 14 bp, Homo sapiens
gccctccccccagc

SEQ ID NO: 1207009 - DNA, 16 bp, Homo sapiens
gccctccccccagctc

SEQ ID NO: 1207010 - DNA, 19 bp, Homo sapiens
gccctccccccagctccct

SEQ ID NO: 1207011 - DNA, 13 bp, Homo sapiens
gccctccccctca

SEQ ID NO: 1207012 - DNA, 14 bp, Homo sapiens
gccctccccctcaa

SEQ ID NO: 1207013 - DNA, 23 bp, Homo sapiens
gccctcccccttccccttctgtg

SEQ ID NO: 1207014 - DNA, 13 bp, Homo sapiens
gccctcccctcag

SEQ ID NO: 1207015 - DNA, 14 bp, Homo sapiens
gccctcccctcagc

SEQ ID NO: 1207016 - DNA, 18 bp, Homo sapiens
gccctcccctcagcgcag

SEQ ID NO: 1207017 - DNA, 20 bp, Homo sapiens
gccctcccctcagcgcaggc

SEQ ID NO: 1207018 - DNA, 22 bp, Homo sapiens
gccctcccctcagcgcaggctg

SEQ ID NO: 1207019 - DNA, 23 bp, Homo sapiens
gccctcccctcagcgcaggctgc

SEQ ID NO: 1207020 - DNA, 16 bp, Homo sapiens
gccctccctcagccgt

SEQ ID NO: 1207021 - DNA, 23 bp, Homo sapiens
gccctccctcagccgtcagccat

SEQ ID NO: 1207022 - DNA, 19 bp, Homo sapiens
gccctccctcagcggaggg

SEQ ID NO: 1207023 - DNA, 21 bp, Homo sapiens
gccctccctcagcggaggggt

SEQ ID NO: 1207024 - DNA, 22 bp, Homo sapiens
gccctccctcccagcgctctgg

SEQ ID NO: 1207025 - DNA, 17 bp, Homo sapiens
gccctccctccctagcc

SEQ ID NO: 1207026 - DNA, 23 bp, Homo sapiens
gccctccctccctagcccttcca

SEQ ID NO: 1207027 - DNA, 14 bp, Homo sapiens
gccctccctccgcc

SEQ ID NO: 1207028 - DNA, 21 bp, Homo sapiens
gccctccctgactccctgtgg

SEQ ID NO: 1207029 - DNA, 16 bp, Homo sapiens
gccctccctgtcctcc

SEQ ID NO: 1207030 - DNA, 13 bp, Homo sapiens
gccctccctgtct

SEQ ID NO: 1207031 - DNA, 22 bp, Homo sapiens
gccctccctgtctccagggccc

SEQ ID NO: 1207032 - DNA, 15 bp, Homo sapiens
cgggggctgctgggc

SEQ ID NO: 1207033 - DNA, 21 bp, Homo sapiens
cggggggggtaggagaggaga

SEQ ID NO: 1207034 - DNA, 17 bp, Homo sapiens
cggggtattcccactca

SEQ ID NO: 1207035 - DNA, 22 bp, Homo sapiens
cggggtattcccactcaccagc

SEQ ID NO: 1207036 - DNA, 13 bp, Homo sapiens
cggggtctcctgg

SEQ ID NO: 1207037 - DNA, 16 bp, Homo sapiens
cggggtgcccacaggc

SEQ ID NO: 1207038 - DNA, 17 bp, Homo sapiens
cggggtggggtgggggt

SEQ ID NO: 1207039 - DNA, 21 bp, Homo sapiens
cggggtgggtgggtgggcagg

SEQ ID NO: 1207040 - DNA, 19 bp, Homo sapiens
cggggtggtgggaaccatg

SEQ ID NO: 1207041 - DNA, 23 bp, Homo sapiens
cggggtgtaacttcctgctgcac

SEQ ID NO: 1207042 - DNA, 21 bp, Homo sapiens
cggggttagagccaagctgca

SEQ ID NO: 1207043 - DNA, 22 bp, Homo sapiens
cggggttagagccaagctgcac

SEQ ID NO: 1207044 - DNA, 23 bp, Homo sapiens
cggggttccccacacagggcact

SEQ ID NO: 1207045 - DNA, 18 bp, Homo sapiens
cggggttcggttgcaggg

SEQ ID NO: 1207046 - DNA, 14 bp, Homo sapiens
cggggttggggtgg

SEQ ID NO: 1207047 - DNA, 18 bp, Homo sapiens
cggggttggggtgggagg

SEQ ID NO: 1207048 - DNA, 16 bp, Homo sapiens
cggggtttcaccatgt

SEQ ID NO: 1207049 - DNA, 11 bp, Homo sapiens
aaaaagacaag

SEQ ID NO: 1207050 - DNA, 14 bp, Homo sapiens
aaaaagacctggcc

SEQ ID NO: 1207051 - DNA, 22 bp, Homo sapiens
aaaaagactgaacatgtttaca

SEQ ID NO: 1207052 - DNA, 15 bp, Homo sapiens
aaaaagagacatcca

SEQ ID NO: 1207053 - DNA, 12 bp, Homo sapiens
aaaaagattcta

SEQ ID NO: 1207054 - DNA, 13 bp, Homo sapiens
aaaaagatttgtt

SEQ ID NO: 1207055 - DNA, 10 bp, Homo sapiens
aaaaagcaaa

SEQ ID NO: 1207056 - DNA, 11 bp, Homo sapiens
aaaaagcaaaa

SEQ ID NO: 1207057 - DNA, 15 bp, Homo sapiens
aaaaagcaaaaatga

SEQ ID NO: 1207058 - DNA, 22 bp, Homo sapiens
aaaaagcagagtggactgcatt

SEQ ID NO: 1207059 - DNA, 23 bp, Homo sapiens
aaaaagcagagtggactgcattt

SEQ ID NO: 1207060 - DNA, 13 bp, Homo sapiens
aaaaagcagctac

SEQ ID NO: 1207061 - DNA, 21 bp, Homo sapiens
aaaaagcagctaccaggtgtt

SEQ ID NO: 1207062 - DNA, 18 bp, Homo sapiens
aaaaagcatgatgggaaa

SEQ ID NO: 1207063 - DNA, 20 bp, Homo sapiens
aaaaagcctacattctccag

SEQ ID NO: 1207064 - DNA, 23 bp, Homo sapiens
aaaaagcctccaagggtttcgac

SEQ ID NO: 1207065 - DNA, 19 bp, Homo sapiens
aaaaagctaacatctttac

SEQ ID NO: 1207066 - DNA, 22 bp, Homo sapiens
aaaaagctatgtatcgctccta

SEQ ID NO: 1207067 - DNA, 14 bp, Homo sapiens
aaaaagctctgaaa

SEQ ID NO: 1207068 - DNA, 20 bp, Homo sapiens
aaaaagcttaaaactttgaa

SEQ ID NO: 1207069 - DNA, 19 bp, Homo sapiens
aaaaagcttccatgattct

SEQ ID NO: 1207070 - DNA, 12 bp, Homo sapiens
aaaaaggaaaaa

SEQ ID NO: 1207071 - DNA, 19 bp, Homo sapiens
aaaaaggaaaaaattaata

SEQ ID NO: 1207072 - DNA, 14 bp, Homo sapiens
aaaaaggaaaaata

SEQ ID NO: 1207073 - DNA, 11 bp, Homo sapiens
aaaaaggaaat

SEQ ID NO: 1207074 - DNA, 12 bp, Homo sapiens
aaaaaggaagga

SEQ ID NO: 1207075 - DNA, 16 bp, Homo sapiens
aaaaaggacatcagca

SEQ ID NO: 1207076 - DNA, 21 bp, Homo sapiens
aaaaaggatgcacagagttgt

SEQ ID NO: 1207077 - DNA, 14 bp, Homo sapiens
aaaaaggcaaataa

SEQ ID NO: 1207078 - DNA, 15 bp, Homo sapiens
aaaaaggcaaatatt

SEQ ID NO: 1207079 - DNA, 13 bp, Homo sapiens
aaaaagggaaaag

SEQ ID NO: 1207080 - DNA, 18 bp, Homo sapiens
aaaaaggggcctgagtgg

SEQ ID NO: 1207081 - DNA, 14 bp, Homo sapiens
aaaaaggtaaatgg

SEQ ID NO: 1207082 - DNA, 15 bp, Homo sapiens
aaaaaggtaactaac

SEQ ID NO: 1207083 - DNA, 18 bp, Homo sapiens
aaaaaggtggtatgtaat

SEQ ID NO: 1207084 - DNA, 14 bp, Homo sapiens
aaaaaggtgtttat

SEQ ID NO: 1207085 - DNA, 21 bp, Homo sapiens
aaaaagtaagtaccactcagg

SEQ ID NO: 1207086 - DNA, 14 bp, Homo sapiens
aaaaagtataaaat

SEQ ID NO: 1207087 - DNA, 18 bp, Homo sapiens
aaaaagtcagagacagat

SEQ ID NO: 1207088 - DNA, 16 bp, Homo sapiens
aaaaagtcagatgttt

SEQ ID NO: 1207089 - DNA, 23 bp, Homo sapiens
aaaaagtccaattttaatttagt

SEQ ID NO: 1207090 - DNA, 17 bp, Homo sapiens
aaaaagtgaaaaaaaga

SEQ ID NO: 1207091 - DNA, 12 bp, Homo sapiens
aaaaagtgaact

SEQ ID NO: 1207092 - DNA, 14 bp, Homo sapiens
aaaaagtgaacttt

SEQ ID NO: 1207093 - DNA, 16 bp, Homo sapiens
aaaaagtgaacttttg

SEQ ID NO: 1207094 - DNA, 20 bp, Homo sapiens
aaaaagtgaacttttgtaat

SEQ ID NO: 1207095 - DNA, 13 bp, Homo sapiens
aaaaagtgacaca

SEQ ID NO: 1207096 - DNA, 14 bp, Homo sapiens
aaaaagtgacacag

SEQ ID NO: 1207097 - DNA, 20 bp, Homo sapiens
aaaaagtgacacagcagctt

SEQ ID NO: 1207098 - DNA, 12 bp, Homo sapiens
aaaaagtgtcaa

SEQ ID NO: 1207099 - DNA, 13 bp, Homo sapiens
aaaaagtgtttat

SEQ ID NO: 1207100 - DNA, 23 bp, Homo sapiens
aaaaagtgtttatttttcatatt

SEQ ID NO: 1207101 - DNA, 13 bp, Homo sapiens
aaaaagttgaagg

SEQ ID NO: 1207102 - DNA, 13 bp, Homo sapiens
aaaaagttttgat

SEQ ID NO: 1207103 - DNA, 23 bp, Homo sapiens
aaaaagtttttttaaaaaagcaa

SEQ ID NO: 1207104 - DNA, 14 bp, Homo sapiens
aaaaataaaactgt

SEQ ID NO: 1207105 - DNA, 24 bp, Homo sapiens
aaaaataaatatatctaccccaga

SEQ ID NO: 1207106 - DNA, 19 bp, Homo sapiens
aaaaataaattaataaatt

SEQ ID NO: 1207107 - DNA, 14 bp, Homo sapiens
aaaaataagaagaa

SEQ ID NO: 1207108 - DNA, 22 bp, Homo sapiens
aaaaataagaagaatgcttaat

SEQ ID NO: 1207109 - DNA, 18 bp, Homo sapiens
aaaaataagtcaacagta

SEQ ID NO: 1207110 - DNA, 19 bp, Homo sapiens
aaaaataatctatttctat

SEQ ID NO: 1207111 - DNA, 13 bp, Homo sapiens
aaaaataccattg

SEQ ID NO: 1207112 - DNA, 14 bp, Homo sapiens
aaaaataccattga

SEQ ID NO: 1207113 - DNA, 14 bp, Homo sapiens
aaaaatactaccta

SEQ ID NO: 1207114 - DNA, 22 bp, Homo sapiens
aaaaatactctttcaataaatg

SEQ ID NO: 1207115 - DNA, 22 bp, Homo sapiens
aaaaatacttgtcaatatttaa

SEQ ID NO: 1207116 - DNA, 18 bp, Homo sapiens
aaaaatagacatgtagtt

SEQ ID NO: 1207117 - DNA, 13 bp, Homo sapiens
aaaaatagagaga

SEQ ID NO: 1207118 - DNA, 21 bp, Homo sapiens
aaaaatagagagagaggtatt

SEQ ID NO: 1207119 - DNA, 15 bp, Homo sapiens
aaaaatagtaaacat

SEQ ID NO: 1207120 - DNA, 14 bp, Homo sapiens
aaaaatagtttgga

SEQ ID NO: 1207121 - DNA, 14 bp, Homo sapiens
aaaaatataatgtt

SEQ ID NO: 1207122 - DNA, 21 bp, Homo sapiens
aaaaatatatatatatattta

SEQ ID NO: 1207123 - DNA, 13 bp, Homo sapiens
aaaaatatatgct

SEQ ID NO: 1207124 - DNA, 13 bp, Homo sapiens
aaaaatatctcct

SEQ ID NO: 1207125 - DNA, 16 bp, Homo sapiens
aaaaatatctcctcca

SEQ ID NO: 1207126 - DNA, 12 bp, Homo sapiens
aaaaatatgaac

SEQ ID NO: 1207127 - DNA, 22 bp, Homo sapiens
aaaaatatgaacctattttcat

SEQ ID NO: 1207128 - DNA, 16 bp, Homo sapiens
aaaaatattataactt

SEQ ID NO: 1207129 - DNA, 19 bp, Homo sapiens
aaaaatattcaagtaacac

SEQ ID NO: 1207130 - DNA, 22 bp, Homo sapiens
aaaaatattcaagtaacacttt

SEQ ID NO: 1207131 - DNA, 12 bp, Homo sapiens
aaaaatattgct

SEQ ID NO: 1207132 - DNA, 19 bp, Homo sapiens
aaaaatattgctaaaagtg

SEQ ID NO: 1207133 - DNA, 12 bp, Homo sapiens
aaaaatattgtt

SEQ ID NO: 1207134 - DNA, 21 bp, Homo sapiens
aaaaatattttaagaaagaga

SEQ ID NO: 1207135 - DNA, 22 bp, Homo sapiens
aaaaatattttctctgtacttt

SEQ ID NO: 1207136 - DNA, 15 bp, Homo sapiens
aaaaatcaaagaaca

SEQ ID NO: 1207137 - DNA, 13 bp, Homo sapiens
aaaaatcaatcaa

SEQ ID NO: 1207138 - DNA, 16 bp, Homo sapiens
aaaaatcaattaacca

SEQ ID NO: 1207139 - DNA, 16 bp, Homo sapiens
aaaaatcagtgtttaa

SEQ ID NO: 1207140 - DNA, 17 bp, Homo sapiens
aaaaatcagtgtttaaa

SEQ ID NO: 1207141 - DNA, 20 bp, Homo sapiens
aaaaatcatgccagtatttt

SEQ ID NO: 1207142 - DNA, 16 bp, Homo sapiens
aaaaatccagaaagaa

SEQ ID NO: 1207143 - DNA, 21 bp, Homo sapiens
aaaaatccattttacacagca

SEQ ID NO: 1207144 - DNA, 12 bp, Homo sapiens
aaaaatctagtt

SEQ ID NO: 1207145 - DNA, 13 bp, Homo sapiens
aaaaatctgagaa

SEQ ID NO: 1207146 - DNA, 18 bp, Homo sapiens
aaaaatctgcagaaggaa

SEQ ID NO: 1207147 - DNA, 20 bp, Homo sapiens
aaaaatcttgtgctagaata

SEQ ID NO: 1207148 - DNA, 15 bp, Homo sapiens
aaaaatgaaaagcaa

SEQ ID NO: 1207149 - DNA, 12 bp, Homo sapiens
aaaaatgaaagc

SEQ ID NO: 1207150 - DNA, 15 bp, Homo sapiens
aaaaatgacaacaga

SEQ ID NO: 1207151 - DNA, 20 bp, Homo sapiens
aaaaatgactaaaaatatta

SEQ ID NO: 1207152 - DNA, 22 bp, Homo sapiens
aaaaatgagcttgattaaatca

SEQ ID NO: 1207153 - DNA, 14 bp, Homo sapiens
aaaaatgaggaata

SEQ ID NO: 1207154 - DNA, 16 bp, Homo sapiens
aaaaatgatttcagta

SEQ ID NO: 1207155 - DNA, 21 bp, Homo sapiens
aaaaatgcacgtagctgaggc

SEQ ID NO: 1207156 - DNA, 22 bp, Homo sapiens
aaaaatgcccatttttgctaat

SEQ ID NO: 1207157 - DNA, 18 bp, Homo sapiens
aaaaatgcccttaaatca

SEQ ID NO: 1207158 - DNA, 15 bp, Homo sapiens
aaaaatgctgaacat

SEQ ID NO: 1207159 - DNA, 12 bp, Homo sapiens
aaaaatgctgct

SEQ ID NO: 1207160 - DNA, 17 bp, Homo sapiens
aaaaatggaaaaaaaca

SEQ ID NO: 1207161 - DNA, 23 bp, Homo sapiens
aaaaatggatattattagaaatt

SEQ ID NO: 1207162 - DNA, 19 bp, Homo sapiens
aaaaatggctaactgatga

SEQ ID NO: 1207163 - DNA, 19 bp, Homo sapiens
aaaaatggtatcaaaatta

SEQ ID NO: 1207164 - DNA, 21 bp, Homo sapiens
aaaaatggttgatggaaaata

SEQ ID NO: 1207165 - DNA, 22 bp, Homo sapiens
aaaaatggttgatggaaaataa

SEQ ID NO: 1207166 - DNA, 23 bp, Homo sapiens
aaaaatgtaaatactcatgaatg

SEQ ID NO: 1207167 - DNA, 13 bp, Homo sapiens
aaaaatgtaacat

SEQ ID NO: 1207168 - DNA, 21 bp, Homo sapiens
aaaaatgtaacatcataatta

SEQ ID NO: 1207169 - DNA, 15 bp, Homo sapiens
aaaaatgtacattta

SEQ ID NO: 1207170 - DNA, 17 bp, Homo sapiens
aaaaatgtacatttatt

SEQ ID NO: 1207171 - DNA, 18 bp, Homo sapiens
aaaaatgtataaaaatta

SEQ ID NO: 1207172 - DNA, 14 bp, Homo sapiens
aaaactaatttcat

SEQ ID NO: 1207173 - DNA, 17 bp, Homo sapiens
aaaactaatttcatact

SEQ ID NO: 1207174 - DNA, 21 bp, Homo sapiens
aaaactacaaatcaagtattt

SEQ ID NO: 1207175 - DNA, 19 bp, Homo sapiens
aaaactactttttggtcat

SEQ ID NO: 1207176 - DNA, 14 bp, Homo sapiens
aaaactataaaaaa

SEQ ID NO: 1207177 - DNA, 22 bp, Homo sapiens
aaaactatgtgctatcacatgt

SEQ ID NO: 1207178 - DNA, 13 bp, Homo sapiens
aaaactatgtgtt

SEQ ID NO: 1207179 - DNA, 23 bp, Homo sapiens
aaaactatgtgttcaatgaaata

SEQ ID NO: 1207180 - DNA, 13 bp, Homo sapiens
aaaactatttaaa

SEQ ID NO: 1207181 - DNA, 19 bp, Homo sapiens
aaaactatttaaaattggc

SEQ ID NO: 1207182 - DNA, 13 bp, Homo sapiens
aaaactcaggatt

SEQ ID NO: 1207183 - DNA, 21 bp, Homo sapiens
aaaactccagggtcccctgcc

SEQ ID NO: 1207184 - DNA, 17 bp, Homo sapiens
aaaactcccaatacaaa

SEQ ID NO: 1207185 - DNA, 20 bp, Homo sapiens
aaaactcccaatacaaagat

SEQ ID NO: 1207186 - DNA, 19 bp, Homo sapiens
aaaactccgcccccagcct

SEQ ID NO: 1207187 - DNA, 22 bp, Homo sapiens
aaaactcctgtgtcggtcagaa

SEQ ID NO: 1207188 - DNA, 21 bp, Homo sapiens
aaaactctacttaatccaatg

SEQ ID NO: 1207189 - DNA, 19 bp, Homo sapiens
aaaactcttataaatttct

SEQ ID NO: 1207190 - DNA, 15 bp, Homo sapiens
aaaactctttcggta

SEQ ID NO: 1207191 - DNA, 12 bp, Homo sapiens
aaaactgaaata

SEQ ID NO: 1207192 - DNA, 13 bp, Homo sapiens
aaaactgaaataa

SEQ ID NO: 1207193 - DNA, 12 bp, Homo sapiens
aaaactgaagaa

SEQ ID NO: 1207194 - DNA, 23 bp, Homo sapiens
aaaactgaaggttttttttttaa

SEQ ID NO: 1207195 - DNA, 13 bp, Homo sapiens
aaaactgagcata

SEQ ID NO: 1207196 - DNA, 22 bp, Homo sapiens
aaaactgctcctcctcctgtat

SEQ ID NO: 1207197 - DNA, 23 bp, Homo sapiens
aaaactgctgactgttttctctt

SEQ ID NO: 1207198 - DNA, 19 bp, Homo sapiens
aaaactgctttgtgcatat

SEQ ID NO: 1207199 - DNA, 21 bp, Homo sapiens
aaaactgtaaataaaatgtgt

SEQ ID NO: 1207200 - DNA, 22 bp, Homo sapiens
aaaactgtaaataaaatgtgta

SEQ ID NO: 1207201 - DNA, 16 bp, Homo sapiens
aaaactgtgggaagat

SEQ ID NO: 1207202 - DNA, 12 bp, Homo sapiens
aaaactgtgtat

SEQ ID NO: 1207203 - DNA, 17 bp, Homo sapiens
aaaacttaacatattta

SEQ ID NO: 1207204 - DNA, 19 bp, Homo sapiens
aaaacttaacatatttact

SEQ ID NO: 1207205 - DNA, 14 bp, Homo sapiens
aaaacttcaaagct

SEQ ID NO: 1207206 - DNA, 23 bp, Homo sapiens
aaaacttcaagacatcaccatca

SEQ ID NO: 1207207 - DNA, 21 bp, Homo sapiens
aaaacttcacatttatgtggc

SEQ ID NO: 1207208 - DNA, 20 bp, Homo sapiens
aaaacttcttagaaaattaa

SEQ ID NO: 1207209 - DNA, 12 bp, Homo sapiens
aaaacttctttt

SEQ ID NO: 1207210 - DNA, 19 bp, Homo sapiens
aaaacttggttttatggtt

SEQ ID NO: 1207211 - DNA, 15 bp, Homo sapiens
aaaacttgtgctata

SEQ ID NO: 1207212 - DNA, 11 bp, Homo sapiens
aaaactttatt

SEQ ID NO: 1207213 - DNA, 12 bp, Homo sapiens
aaaactttattt

SEQ ID NO: 1207214 - DNA, 16 bp, Homo sapiens
aaaactttattttata

SEQ ID NO: 1207215 - DNA, 23 bp, Homo sapiens
aaaactttattttatataataaa

SEQ ID NO: 1207216 - DNA, 21 bp, Homo sapiens
aaaacttttataaattaaata

SEQ ID NO: 1207217 - DNA, 14 bp, Homo sapiens
aaaacttttgtaaa

SEQ ID NO: 1207218 - DNA, 12 bp, Homo sapiens
aaaagaaaaaaa

SEQ ID NO: 1207219 - DNA, 22 bp, Homo sapiens
aaaagaaaaaaaaagaaaaaag

SEQ ID NO: 1207220 - DNA, 15 bp, Homo sapiens
aaaagaaaaaacaac

SEQ ID NO: 1207221 - DNA, 13 bp, Homo sapiens
aaaagaaaagttt

SEQ ID NO: 1207222 - DNA, 14 bp, Homo sapiens
aaaagaaaataaaa

SEQ ID NO: 1207223 - DNA, 13 bp, Homo sapiens
aaaagaaaatatt

SEQ ID NO: 1207224 - DNA, 15 bp, Homo sapiens
aaaagaaaatttttg

SEQ ID NO: 1207225 - DNA, 10 bp, Homo sapiens
aaaagaaaca

SEQ ID NO: 1207226 - DNA, 11 bp, Homo sapiens
aaaagaaagca

SEQ ID NO: 1207227 - DNA, 11 bp, Homo sapiens
aaaagaaatat

SEQ ID NO: 1207228 - DNA, 21 bp, Homo sapiens
aaaagaaatcaatagttgaat

SEQ ID NO: 1207229 - DNA, 19 bp, Homo sapiens
aaaagaaatcatgtccata

SEQ ID NO: 1207230 - DNA, 12 bp, Homo sapiens
aaaagaaatctg

SEQ ID NO: 1207231 - DNA, 17 bp, Homo sapiens
aaaagaaatcttgtctt

SEQ ID NO: 1207232 - DNA, 14 bp, Homo sapiens
aaaagaaatgaaca

SEQ ID NO: 1207233 - DNA, 20 bp, Homo sapiens
aaaagaagagaggggaagaa

SEQ ID NO: 1207234 - DNA, 15 bp, Homo sapiens
aaaagaagagtttta

SEQ ID NO: 1207235 - DNA, 14 bp, Homo sapiens
aaaagaagtagtgt

SEQ ID NO: 1207236 - DNA, 16 bp, Homo sapiens
aaaagaatacagaaag

SEQ ID NO: 1207237 - DNA, 19 bp, Homo sapiens
aaaagaatccctgttcatt

SEQ ID NO: 1207238 - DNA, 11 bp, Homo sapiens
aaaagaatgac

SEQ ID NO: 1207239 - DNA, 24 bp, Homo sapiens
aaaagaattttagtgttaatgact

SEQ ID NO: 1207240 - DNA, 13 bp, Homo sapiens
aaaagacattttt

SEQ ID NO: 1207241 - DNA, 14 bp, Homo sapiens
aaaagacctggcct

SEQ ID NO: 1207242 - DNA, 15 bp, Homo sapiens
aaaagacctggcctt

SEQ ID NO: 1207243 - DNA, 18 bp, Homo sapiens
aaaagacggatggcagga

SEQ ID NO: 1207244 - DNA, 16 bp, Homo sapiens
aaaagactcagtgttc

SEQ ID NO: 1207245 - DNA, 13 bp, Homo sapiens
aaaagagaaaaga

SEQ ID NO: 1207246 - DNA, 22 bp, Homo sapiens
aaaagagaccacccatatcatg

SEQ ID NO: 1207247 - DNA, 16 bp, Homo sapiens
aaaagagatattttaa

SEQ ID NO: 1207248 - DNA, 21 bp, Homo sapiens
aaaagagcagtggtaagaata

SEQ ID NO: 1207249 - DNA, 16 bp, Homo sapiens
aaaagagctttatccc

SEQ ID NO: 1207250 - DNA, 16 bp, Homo sapiens
aaaagaggtgtcatgc

SEQ ID NO: 1207251 - DNA, 16 bp, Homo sapiens
aaaagagtcagccctt

SEQ ID NO: 1207252 - DNA, 12 bp, Homo sapiens
aaaagataaaga

SEQ ID NO: 1207253 - DNA, 20 bp, Homo sapiens
aaaagataaagatgatctac

SEQ ID NO: 1207254 - DNA, 13 bp, Homo sapiens
aaaagataaattt

SEQ ID NO: 1207255 - DNA, 11 bp, Homo sapiens
aaaagatatat

SEQ ID NO: 1207256 - DNA, 16 bp, Homo sapiens
aaaagatatattaaaa

SEQ ID NO: 1207257 - DNA, 15 bp, Homo sapiens
aaaagatcaccttgt

SEQ ID NO: 1207258 - DNA, 16 bp, Homo sapiens
aaaagatcctttttaa

SEQ ID NO: 1207259 - DNA, 18 bp, Homo sapiens
aaaagatggcctttgctt

SEQ ID NO: 1207260 - DNA, 19 bp, Homo sapiens
aaaagatggttgtagcatt

SEQ ID NO: 1207261 - DNA, 13 bp, Homo sapiens
aaaagatgtagat

SEQ ID NO: 1207262 - DNA, 14 bp, Homo sapiens
aaaagatgtagatt

SEQ ID NO: 1207263 - DNA, 23 bp, Homo sapiens
aaaagatgtagatttatttcatc

SEQ ID NO: 1207264 - DNA, 16 bp, Homo sapiens
aaaagattgctgaaat

SEQ ID NO: 1207265 - DNA, 15 bp, Homo sapiens
aaaagattttaatca

SEQ ID NO: 1207266 - DNA, 12 bp, Homo sapiens
aaaagattttat

SEQ ID NO: 1207267 - DNA, 15 bp, Homo sapiens
aaaagattttattta

SEQ ID NO: 1207268 - DNA, 19 bp, Homo sapiens
aaaagcaaaaatgacaaca

SEQ ID NO: 1207269 - DNA, 14 bp, Homo sapiens
aaaagcaaaatcat

SEQ ID NO: 1207270 - DNA, 10 bp, Homo sapiens
aaaagcaaat

SEQ ID NO: 1207271 - DNA, 14 bp, Homo sapiens
aaaagcaaatcatt

SEQ ID NO: 1207272 - DNA, 14 bp, Homo sapiens
aaaagcaacattca

SEQ ID NO: 1207273 - DNA, 14 bp, Homo sapiens
aaaagcaacttcat

SEQ ID NO: 1207274 - DNA, 20 bp, Homo sapiens
aaaagcaagtgttcactgct

SEQ ID NO: 1207275 - DNA, 12 bp, Homo sapiens
aaaagcaattct

SEQ ID NO: 1207276 - DNA, 18 bp, Homo sapiens
aaaagcaattctgactgt

SEQ ID NO: 1207277 - DNA, 17 bp, Homo sapiens
aaaagcacaagtacttt

SEQ ID NO: 1207278 - DNA, 20 bp, Homo sapiens
aaaagcacaatcactaaact

SEQ ID NO: 1207279 - DNA, 18 bp, Homo sapiens
aaaagcacacacaataaa

SEQ ID NO: 1207280 - DNA, 18 bp, Homo sapiens
aaaagcacagctgtatat

SEQ ID NO: 1207281 - DNA, 22 bp, Homo sapiens
aaaagcagaattttaatgtgaa

SEQ ID NO: 1207282 - DNA, 15 bp, Homo sapiens
aaaagcagcagaggt

SEQ ID NO: 1207283 - DNA, 18 bp, Homo sapiens
aaaagcagcgtcactcta

SEQ ID NO: 1207284 - DNA, 20 bp, Homo sapiens
aaaagcatgatgggaaaata

SEQ ID NO: 1207285 - DNA, 15 bp, Homo sapiens
aaaagcatttgggca

SEQ ID NO: 1207286 - DNA, 19 bp, Homo sapiens
aaaatgtaacatcataatt

SEQ ID NO: 1207287 - DNA, 20 bp, Homo sapiens
aaaatgtaagaaaagctgat

SEQ ID NO: 1207288 - DNA, 16 bp, Homo sapiens
aaaatgtagaatattc

SEQ ID NO: 1207289 - DNA, 21 bp, Homo sapiens
aaaatgtagggttataataat

SEQ ID NO: 1207290 - DNA, 15 bp, Homo sapiens
aaaatgtataaatta

SEQ ID NO: 1207291 - DNA, 14 bp, Homo sapiens
aaaatgtatatgca

SEQ ID NO: 1207292 - DNA, 17 bp, Homo sapiens
aaaatgtatattttgat

SEQ ID NO: 1207293 - DNA, 18 bp, Homo sapiens
aaaatgtatattttgatg

SEQ ID NO: 1207294 - DNA, 21 bp, Homo sapiens
aaaatgtatccaaggaaacat

SEQ ID NO: 1207295 - DNA, 19 bp, Homo sapiens
aaaatgtatccagaggaat

SEQ ID NO: 1207296 - DNA, 22 bp, Homo sapiens
aaaatgtcaaagagaaaactta

SEQ ID NO: 1207297 - DNA, 16 bp, Homo sapiens
aaaatgtcctgccttt

SEQ ID NO: 1207298 - DNA, 17 bp, Homo sapiens
aaaatgtcctgcctttt

SEQ ID NO: 1207299 - DNA, 12 bp, Homo sapiens
aaaatgtctgta

SEQ ID NO: 1207300 - DNA, 17 bp, Homo sapiens
aaaatgtctgtaataat

SEQ ID NO: 1207301 - DNA, 20 bp, Homo sapiens
aaaatgtgaaatctcagaat

SEQ ID NO: 1207302 - DNA, 15 bp, Homo sapiens
aaaatgtgaaatgct

SEQ ID NO: 1207303 - DNA, 19 bp, Homo sapiens
aaaatgtgacccagatcct

SEQ ID NO: 1207304 - DNA, 13 bp, Homo sapiens
aaaatgtgatttt

SEQ ID NO: 1207305 - DNA, 19 bp, Homo sapiens
aaaatgtgctatactgcat

SEQ ID NO: 1207306 - DNA, 11 bp, Homo sapiens
aaaatgtgtaa

SEQ ID NO: 1207307 - DNA, 13 bp, Homo sapiens
aaaatgtgtacag

SEQ ID NO: 1207308 - DNA, 14 bp, Homo sapiens
aaaatgtgtacagt

SEQ ID NO: 1207309 - DNA, 20 bp, Homo sapiens
aaaatgttaaacccttacca

SEQ ID NO: 1207310 - DNA, 22 bp, Homo sapiens
aaaatgttacgtgaagaaataa

SEQ ID NO: 1207311 - DNA, 15 bp, Homo sapiens
aaaatgttctttgga

SEQ ID NO: 1207312 - DNA, 19 bp, Homo sapiens
aaaatgttgaaaagtcaaa

SEQ ID NO: 1207313 - DNA, 13 bp, Homo sapiens
aaaatgttggctg

SEQ ID NO: 1207314 - DNA, 15 bp, Homo sapiens
aaaatgttggctgcg

SEQ ID NO: 1207315 - DNA, 21 bp, Homo sapiens
aaaatgttggtcattttatgt

SEQ ID NO: 1207316 - DNA, 11 bp, Homo sapiens
aaaatgtttaa

SEQ ID NO: 1207317 - DNA, 21 bp, Homo sapiens
aaaatgtttcattatgcactt

SEQ ID NO: 1207318 - DNA, 14 bp, Homo sapiens
aaaatgttttacat

SEQ ID NO: 1207319 - DNA, 15 bp, Homo sapiens
aaaatgttttttgat

SEQ ID NO: 1207320 - DNA, 18 bp, Homo sapiens
aaaattaaacacaaagtg

SEQ ID NO: 1207321 - DNA, 13 bp, Homo sapiens
aaaattaaagccc

SEQ ID NO: 1207322 - DNA, 17 bp, Homo sapiens
aaaattaacaaatttct

SEQ ID NO: 1207323 - DNA, 20 bp, Homo sapiens
aaactaatgagtatgaactt

SEQ ID NO: 1207324 - DNA, 16 bp, Homo sapiens
aaactaatgtactgta

SEQ ID NO: 1207325 - DNA, 18 bp, Homo sapiens
aaactaatgtactgtaca

SEQ ID NO: 1207326 - DNA, 20 bp, Homo sapiens
aaactaatgtactgtacata

SEQ ID NO: 1207327 - DNA, 14 bp, Homo sapiens
aaactacaaacaaa

SEQ ID NO: 1207328 - DNA, 12 bp, Homo sapiens
aaactacatttc

SEQ ID NO: 1207329 - DNA, 16 bp, Homo sapiens
aaactacattttgcaa

SEQ ID NO: 1207330 - DNA, 16 bp, Homo sapiens
aaactacccatgtctt

SEQ ID NO: 1207331 - DNA, 17 bp, Homo sapiens
aaactaccctccagagt

SEQ ID NO: 1207332 - DNA, 21 bp, Homo sapiens
aaactactgcctttagaaaat

SEQ ID NO: 1207333 - DNA, 15 bp, Homo sapiens
aaactacttcatttt

SEQ ID NO: 1207334 - DNA, 17 bp, Homo sapiens
aaactacttttctaaaa

SEQ ID NO: 1207335 - DNA, 15 bp, Homo sapiens
aaactaggtaaaatt

SEQ ID NO: 1207336 - DNA, 21 bp, Homo sapiens
aaactagtttaagggtggaaa

SEQ ID NO: 1207337 - DNA, 14 bp, Homo sapiens
aaactagtttttcc

SEQ ID NO: 1207338 - DNA, 17 bp, Homo sapiens
aaactataaaaaagaaa

SEQ ID NO: 1207339 - DNA, 21 bp, Homo sapiens
aaactataaaaaagaaagaat

SEQ ID NO: 1207340 - DNA, 19 bp, Homo sapiens
aaactatactacaaggcta

SEQ ID NO: 1207341 - DNA, 17 bp, Homo sapiens
aaactatgaagatctga

SEQ ID NO: 1207342 - DNA, 17 bp, Homo sapiens
aaactatgatcacagtg

SEQ ID NO: 1207343 - DNA, 20 bp, Homo sapiens
aaactatggctttaaactac

SEQ ID NO: 1207344 - DNA, 13 bp, Homo sapiens
aaactatgtgttt

SEQ ID NO: 1207345 - DNA, 16 bp, Homo sapiens
aaactatgtgtttttc

SEQ ID NO: 1207346 - DNA, 19 bp, Homo sapiens
aaactatgtgtttttctca

SEQ ID NO: 1207347 - DNA, 17 bp, Homo sapiens
aaactatgttcctaaca

SEQ ID NO: 1207348 - DNA, 17 bp, Homo sapiens
aaactattgagccttgc

SEQ ID NO: 1207349 - DNA, 20 bp, Homo sapiens
aaactatttaaaattggcac

SEQ ID NO: 1207350 - DNA, 21 bp, Homo sapiens
aaactatttaaaattggcacc

SEQ ID NO: 1207351 - DNA, 13 bp, Homo sapiens
aaactatttatct

SEQ ID NO: 1207352 - DNA, 16 bp, Homo sapiens
aaactatttttttctt

SEQ ID NO: 1207353 - DNA, 18 bp, Homo sapiens
aaactcaaaacacccaaa

SEQ ID NO: 1207354 - DNA, 18 bp, Homo sapiens
aaactcaaaacttaacat

SEQ ID NO: 1207355 - DNA, 19 bp, Homo sapiens
aaactcaaaacttaacata

SEQ ID NO: 1207356 - DNA, 22 bp, Homo sapiens
aaactcaaaacttaacatattt

SEQ ID NO: 1207357 - DNA, 15 bp, Homo sapiens
aaactcaaacttttc

SEQ ID NO: 1207358 - DNA, 17 bp, Homo sapiens
aaactcaaccagagtca

SEQ ID NO: 1207359 - DNA, 16 bp, Homo sapiens
aaactcaccatgtaaa

SEQ ID NO: 1207360 - DNA, 18 bp, Homo sapiens
aaactcacctgctggccc

SEQ ID NO: 1207361 - DNA, 13 bp, Homo sapiens
aaactcaccttga

SEQ ID NO: 1207362 - DNA, 15 bp, Homo sapiens
aaactcagatctgat

SEQ ID NO: 1207363 - DNA, 19 bp, Homo sapiens
aaactcaggcaaagaaaat

SEQ ID NO: 1207364 - DNA, 13 bp, Homo sapiens
aaactcagggaca

SEQ ID NO: 1207365 - DNA, 14 bp, Homo sapiens
aaactcagttaaaa

SEQ ID NO: 1207366 - DNA, 22 bp, Homo sapiens
aaactcatattacaaaaacaaa

SEQ ID NO: 1207367 - DNA, 17 bp, Homo sapiens
aaactcatgatcaagat

SEQ ID NO: 1207368 - DNA, 18 bp, Homo sapiens
aaactccacatctgcctt

SEQ ID NO: 1207369 - DNA, 17 bp, Homo sapiens
aaactccccttccctgg

SEQ ID NO: 1207370 - DNA, 19 bp, Homo sapiens
aaactccccttccctgggg

SEQ ID NO: 1207371 - DNA, 23 bp, Homo sapiens
aaactcctggcctcaagcaatcc

SEQ ID NO: 1207372 - DNA, 12 bp, Homo sapiens
aaactcctgtgt

SEQ ID NO: 1207373 - DNA, 20 bp, Homo sapiens
aaactccttcctggcctgag

SEQ ID NO: 1207374 - DNA, 20 bp, Homo sapiens
aaactcctttactgcagcct

SEQ ID NO: 1207375 - DNA, 19 bp, Homo sapiens
aaactccttttgctgtctt

SEQ ID NO: 1207376 - DNA, 11 bp, Homo sapiens
aaactctctag

SEQ ID NO: 1207377 - DNA, 17 bp, Homo sapiens
aaactctctagcttaag

SEQ ID NO: 1207378 - DNA, 22 bp, Homo sapiens
aaactctctttgggaatgtttg

SEQ ID NO: 1207379 - DNA, 23 bp, Homo sapiens
aaactctctttgggaatgtttgt

SEQ ID NO: 1207380 - DNA, 23 bp, Homo sapiens
aaactctgcatccagagattcat

SEQ ID NO: 1207381 - DNA, 15 bp, Homo sapiens
aaactctgccagaaa

SEQ ID NO: 1207382 - DNA, 22 bp, Homo sapiens
aaactctgggaaataagagaga

SEQ ID NO: 1207383 - DNA, 21 bp, Homo sapiens
aaactctgggtcttggccatg

SEQ ID NO: 1207384 - DNA, 23 bp, Homo sapiens
aaactcttaaaacccaagtgcct

SEQ ID NO: 1207385 - DNA, 18 bp, Homo sapiens
aaactcttaatctgtgtg

SEQ ID NO: 1207386 - DNA, 16 bp, Homo sapiens
aaactcttcagttaat

SEQ ID NO: 1207387 - DNA, 22 bp, Homo sapiens
aaactcttcagttaattcttag

SEQ ID NO: 1207388 - DNA, 16 bp, Homo sapiens
aaactctttaacttct

SEQ ID NO: 1207389 - DNA, 16 bp, Homo sapiens
aaactgaaaaatgtca

SEQ ID NO: 1207390 - DNA, 12 bp, Homo sapiens
aaactgaaaatc

SEQ ID NO: 1207391 - DNA, 13 bp, Homo sapiens
aaactgaaaatct

SEQ ID NO: 1207392 - DNA, 17 bp, Homo sapiens
aaactgaaaatctaata

SEQ ID NO: 1207393 - DNA, 18 bp, Homo sapiens
aaactgaaaatctaatat

SEQ ID NO: 1207394 - DNA, 19 bp, Homo sapiens
aaactgaaaatctaatatt

SEQ ID NO: 1207395 - DNA, 14 bp, Homo sapiens
aaactgaaataaac

SEQ ID NO: 1207396 - DNA, 13 bp, Homo sapiens
aaactgaaccaca

SEQ ID NO: 1207397 - DNA, 18 bp, Homo sapiens
aaactgaagcagcctctc

SEQ ID NO: 1207398 - DNA, 22 bp, Homo sapiens
aaactgaagcagcctctcccca

SEQ ID NO: 1207399 - DNA, 13 bp, Homo sapiens
aaactgaaggttt

SEQ ID NO: 1207400 - DNA, 15 bp, Homo sapiens
aaactgaatattttg

SEQ ID NO: 1207401 - DNA, 17 bp, Homo sapiens
aaactgaatattttgga

SEQ ID NO: 1207402 - DNA, 20 bp, Homo sapiens
aaactgaatctatggcttta

SEQ ID NO: 1207403 - DNA, 13 bp, Homo sapiens
aaactgaatgtca

SEQ ID NO: 1207404 - DNA, 14 bp, Homo sapiens
aaactgacagtatt

SEQ ID NO: 1207405 - DNA, 22 bp, Homo sapiens
aaactgacagtattaagggtag

SEQ ID NO: 1207406 - DNA, 11 bp, Homo sapiens
aaactgagcat

SEQ ID NO: 1207407 - DNA, 11 bp, Homo sapiens
aaactgagcct

SEQ ID NO: 1207408 - DNA, 22 bp, Homo sapiens
aaactgagcctcacttgccctc

SEQ ID NO: 1207409 - DNA, 14 bp, Homo sapiens
aaactgagcgaccc

SEQ ID NO: 1207410 - DNA, 19 bp, Homo sapiens
aaactgaggaatttcacct

SEQ ID NO: 1207411 - DNA, 18 bp, Homo sapiens
aaactgagtccatgaaaa

SEQ ID NO: 1207412 - DNA, 19 bp, Homo sapiens
aaactgagtccatgaaaat

SEQ ID NO: 1207413 - DNA, 17 bp, Homo sapiens
aaactgatgctgaggat

SEQ ID NO: 1207414 - DNA, 21 bp, Homo sapiens
aaactgatggaccgggtgggc

SEQ ID NO: 1207415 - DNA, 13 bp, Homo sapiens
aaactgatttctt

SEQ ID NO: 1207416 - DNA, 17 bp, Homo sapiens
aaactgatttcttcaga

SEQ ID NO: 1207417 - DNA, 14 bp, Homo sapiens
aaactgcacatcta

SEQ ID NO: 1207418 - DNA, 11 bp, Homo sapiens
aaactgcagcc

SEQ ID NO: 1207419 - DNA, 23 bp, Homo sapiens
aaactgcagcctctctggctggt

SEQ ID NO: 1207420 - DNA, 14 bp, Homo sapiens
aaactgcatctgga

SEQ ID NO: 1207421 - DNA, 17 bp, Homo sapiens
aaactgcatgaaaaatc

SEQ ID NO: 1207422 - DNA, 20 bp, Homo sapiens
aaactgccagttttgtttcc

SEQ ID NO: 1207423 - DNA, 20 bp, Homo sapiens
aaactgctgtcaataaatga

SEQ ID NO: 1207424 - DNA, 21 bp, Homo sapiens
aaactgctgtcaataaatgac

SEQ ID NO: 1207425 - DNA, 22 bp, Homo sapiens
aaactgctgtcaataaatgaca

SEQ ID NO: 1207426 - DNA, 12 bp, Homo sapiens
aaactgcttata

SEQ ID NO: 1207427 - DNA, 19 bp, Homo sapiens
aaactgctttgtgcatatg

SEQ ID NO: 1207428 - DNA, 22 bp, Homo sapiens
aaactgcttttttttttccagc

SEQ ID NO: 1207429 - DNA, 20 bp, Homo sapiens
aaactggaacggtgaaggtg

SEQ ID NO: 1207430 - DNA, 15 bp, Homo sapiens
aaactggaattcttt

SEQ ID NO: 1207431 - DNA, 16 bp, Homo sapiens
aaactggattaaactt

SEQ ID NO: 1207432 - DNA, 21 bp, Homo sapiens
aaactggctggcccagagttt

SEQ ID NO: 1207433 - DNA, 11 bp, Homo sapiens
aaactgtacag

SEQ ID NO: 1207434 - DNA, 17 bp, Homo sapiens
aaactgtacatactgca

SEQ ID NO: 1207435 - DNA, 17 bp, Homo sapiens
aaactgtacatttaaaa

SEQ ID NO: 1207436 - DNA, 22 bp, Homo sapiens
aaactgtacatttaaaattgct

SEQ ID NO: 1207437 - DNA, 18 bp, Homo sapiens
aaactgtatcaaatctgt

SEQ ID NO: 1207438 - DNA, 13 bp, Homo sapiens
aaatatttcctga

SEQ ID NO: 1207439 - DNA, 12 bp, Homo sapiens
aaatatttgaat

SEQ ID NO: 1207440 - DNA, 18 bp, Homo sapiens
aaatatttgacttgcatg

SEQ ID NO: 1207441 - DNA, 12 bp, Homo sapiens
aaatatttggag

SEQ ID NO: 1207442 - DNA, 15 bp, Homo sapiens
aaatatttgtacata

SEQ ID NO: 1207443 - DNA, 22 bp, Homo sapiens
aaatatttgtacatagttattt

SEQ ID NO: 1207444 - DNA, 19 bp, Homo sapiens
aaatatttgtctttaaaca

SEQ ID NO: 1207445 - DNA, 14 bp, Homo sapiens
aaatattttaaaga

SEQ ID NO: 1207446 - DNA, 23 bp, Homo sapiens
aaatattttaaagaattgtgtca

SEQ ID NO: 1207447 - DNA, 14 bp, Homo sapiens
aaatattttagcct

SEQ ID NO: 1207448 - DNA, 15 bp, Homo sapiens
aaatattttctattt

SEQ ID NO: 1207449 - DNA, 21 bp, Homo sapiens
aaatattttctctgtactttt

SEQ ID NO: 1207450 - DNA, 16 bp, Homo sapiens
aaatattttctgggtt

SEQ ID NO: 1207451 - DNA, 12 bp, Homo sapiens
aaatattttgat

SEQ ID NO: 1207452 - DNA, 14 bp, Homo sapiens
aaatattttggaat

SEQ ID NO: 1207453 - DNA, 12 bp, Homo sapiens
aaatattttgtc

SEQ ID NO: 1207454 - DNA, 14 bp, Homo sapiens
aaatattttgtcta

SEQ ID NO: 1207455 - DNA, 17 bp, Homo sapiens
aaatattttgtctaaaa

SEQ ID NO: 1207456 - DNA, 14 bp, Homo sapiens
aaatatttttagta

SEQ ID NO: 1207457 - DNA, 17 bp, Homo sapiens
aaatatttttggggcat

SEQ ID NO: 1207458 - DNA, 18 bp, Homo sapiens
aaatattttttgcaagtt

SEQ ID NO: 1207459 - DNA, 22 bp, Homo sapiens
aaatcaaaagggccaaagaacc

SEQ ID NO: 1207460 - DNA, 22 bp, Homo sapiens
aaatcaacagaagcatttgtat

SEQ ID NO: 1207461 - DNA, 13 bp, Homo sapiens
aaatcaacatgac

SEQ ID NO: 1207462 - DNA, 16 bp, Homo sapiens
aaatcaacttaacatg

SEQ ID NO: 1207463 - DNA, 13 bp, Homo sapiens
aaatcaaggaaag

SEQ ID NO: 1207464 - DNA, 17 bp, Homo sapiens
aaatcaagtttgaccag

SEQ ID NO: 1207465 - DNA, 13 bp, Homo sapiens
aaatcaataagaa

SEQ ID NO: 1207466 - DNA, 15 bp, Homo sapiens
aaatcaatagttgaa

SEQ ID NO: 1207467 - DNA, 16 bp, Homo sapiens
aaatcaatatgcagaa

SEQ ID NO: 1207468 - DNA, 23 bp, Homo sapiens
aaatcaatcaggaatgagtcaat

SEQ ID NO: 1207469 - DNA, 23 bp, Homo sapiens
aaatcaattactggtccaaaaga

SEQ ID NO: 1207470 - DNA, 13 bp, Homo sapiens
aaatcacaaaaac

SEQ ID NO: 1207471 - DNA, 18 bp, Homo sapiens
aaatcacagaaaatttaa

SEQ ID NO: 1207472 - DNA, 23 bp, Homo sapiens
aaatcacagatgggtattaaact

SEQ ID NO: 1207473 - DNA, 19 bp, Homo sapiens
aaatcacatattttaaaat

SEQ ID NO: 1207474 - DNA, 12 bp, Homo sapiens
aaatcacatcct

SEQ ID NO: 1207475 - DNA, 16 bp, Homo sapiens
aaatcacattttaagt

SEQ ID NO: 1207476 - DNA, 20 bp, Homo sapiens
aaatcacattttaagtgctt

SEQ ID NO: 1207477 - DNA, 20 bp, Homo sapiens
aaatcacgctttttgaaaaa

SEQ ID NO: 1207478 - DNA, 11 bp, Homo sapiens
aaatcactgtg

SEQ ID NO: 1207479 - DNA, 16 bp, Homo sapiens
aaatcactgtgaaatt

SEQ ID NO: 1207480 - DNA, 23 bp, Homo sapiens
aaatcactgtgaaatttcatgat

SEQ ID NO: 1207481 - DNA, 17 bp, Homo sapiens
aaatcacttcagatctc

SEQ ID NO: 1207482 - DNA, 14 bp, Homo sapiens
aaatcactttcata

SEQ ID NO: 1207483 - DNA, 17 bp, Homo sapiens
aaatcagaaagtaacaa

SEQ ID NO: 1207484 - DNA, 18 bp, Homo sapiens
aaatcagaaagtaacaat

SEQ ID NO: 1207485 - DNA, 14 bp, Homo sapiens
aaatcagaatttct

SEQ ID NO: 1207486 - DNA, 17 bp, Homo sapiens
aaatcagcatgacaaaa

SEQ ID NO: 1207487 - DNA, 23 bp, Homo sapiens
aaatcagcatgacaaaaataaca

SEQ ID NO: 1207488 - DNA, 19 bp, Homo sapiens
aaatcagccgtgtaaccat

SEQ ID NO: 1207489 - DNA, 16 bp, Homo sapiens
aaatcagctgctacta

SEQ ID NO: 1207490 - DNA, 17 bp, Homo sapiens
aaatcaggaaaggctgt

SEQ ID NO: 1207491 - DNA, 11 bp, Homo sapiens
aaatcaggtag

SEQ ID NO: 1207492 - DNA, 22 bp, Homo sapiens
aaatcaggtgttttaagactga

SEQ ID NO: 1207493 - DNA, 22 bp, Homo sapiens
aaatcaggttttcttttaagaa

SEQ ID NO: 1207494 - DNA, 13 bp, Homo sapiens
aaatcagtaagag

SEQ ID NO: 1207495 - DNA, 17 bp, Homo sapiens
aaatcagtatcagaata

SEQ ID NO: 1207496 - DNA, 22 bp, Homo sapiens
aaatcagtatttttttttaatt

SEQ ID NO: 1207497 - DNA, 14 bp, Homo sapiens
aaatcagtcttcct

SEQ ID NO: 1207498 - DNA, 16 bp, Homo sapiens
aaatcagtgatctatg

SEQ ID NO: 1207499 - DNA, 21 bp, Homo sapiens
aaatcagtgcctggtgttctg

SEQ ID NO: 1207500 - DNA, 22 bp, Homo sapiens
aaatcagtgtttaaataaagac

SEQ ID NO: 1207501 - DNA, 16 bp, Homo sapiens
aaatcagtttttcata

SEQ ID NO: 1207502 - DNA, 13 bp, Homo sapiens
aaatcataaagtc

SEQ ID NO: 1207503 - DNA, 14 bp, Homo sapiens
aaatcataaagtca

SEQ ID NO: 1207504 - DNA, 22 bp, Homo sapiens
aaatcataggaaagtatttttt

SEQ ID NO: 1207505 - DNA, 13 bp, Homo sapiens
aaatcatcaagaa

SEQ ID NO: 1207506 - DNA, 19 bp, Homo sapiens
aaatcatcctgttttctct

SEQ ID NO: 1207507 - DNA, 23 bp, Homo sapiens
aaatcatcctgttttctctgtga

SEQ ID NO: 1207508 - DNA, 14 bp, Homo sapiens
aaatcatgtatgtt

SEQ ID NO: 1207509 - DNA, 18 bp, Homo sapiens
aaatcatgtatgttatga

SEQ ID NO: 1207510 - DNA, 21 bp, Homo sapiens
aaatcatgtatgttatgatat

SEQ ID NO: 1207511 - DNA, 17 bp, Homo sapiens
aaatcatgtgctcagaa

SEQ ID NO: 1207512 - DNA, 17 bp, Homo sapiens
aaatcatgttgttgtgt

SEQ ID NO: 1207513 - DNA, 17 bp, Homo sapiens
aaatcatgttttgatga

SEQ ID NO: 1207514 - DNA, 15 bp, Homo sapiens
aaatcattatgtttc

SEQ ID NO: 1207515 - DNA, 21 bp, Homo sapiens
aaatcattcttactaaaaagt

SEQ ID NO: 1207516 - DNA, 21 bp, Homo sapiens
aaatcattgctttgaagcagt

SEQ ID NO: 1207517 - DNA, 14 bp, Homo sapiens
aaatcattgtagaa

SEQ ID NO: 1207518 - DNA, 20 bp, Homo sapiens
aaatcatttggcttgctgtt

SEQ ID NO: 1207519 - DNA, 16 bp, Homo sapiens
aaatcattttatatgt

SEQ ID NO: 1207520 - DNA, 20 bp, Homo sapiens
aaatcattttatatgtcaaa

SEQ ID NO: 1207521 - DNA, 14 bp, Homo sapiens
aaatccagaaagaa

SEQ ID NO: 1207522 - DNA, 18 bp, Homo sapiens
aaatccagccccttgctt

SEQ ID NO: 1207523 - DNA, 17 bp, Homo sapiens
aaatccagtattatatt

SEQ ID NO: 1207524 - DNA, 22 bp, Homo sapiens
aaatccatagatttattttaca

SEQ ID NO: 1207525 - DNA, 15 bp, Homo sapiens
aaatcccatttaaaa

SEQ ID NO: 1207526 - DNA, 13 bp, Homo sapiens
aaatcccatttct

SEQ ID NO: 1207527 - DNA, 17 bp, Homo sapiens
aaatccccccttcagaa

SEQ ID NO: 1207528 - DNA, 18 bp, Homo sapiens
aaatcccctcagcctctt

SEQ ID NO: 1207529 - DNA, 14 bp, Homo sapiens
aaatccctggatca

SEQ ID NO: 1207530 - DNA, 15 bp, Homo sapiens
aaatgagaagtactt

SEQ ID NO: 1207531 - DNA, 18 bp, Homo sapiens
aaatgagaattttatatt

SEQ ID NO: 1207532 - DNA, 13 bp, Homo sapiens
aaatgagactttt

SEQ ID NO: 1207533 - DNA, 17 bp, Homo sapiens
aaatgagactttttcag

SEQ ID NO: 1207534 - DNA, 17 bp, Homo sapiens
aaatgagattatatgtg

SEQ ID NO: 1207535 - DNA, 19 bp, Homo sapiens
aaatgagcctggcaagaat

SEQ ID NO: 1207536 - DNA, 16 bp, Homo sapiens
aaatgaggaggtacat

SEQ ID NO: 1207537 - DNA, 19 bp, Homo sapiens
aaatgagggaagaacatta

SEQ ID NO: 1207538 - DNA, 21 bp, Homo sapiens
aaatgagggaagaacattatt

SEQ ID NO: 1207539 - DNA, 22 bp, Homo sapiens
aaatgagggctgcacattgcct

SEQ ID NO: 1207540 - DNA, 15 bp, Homo sapiens
aaatgagtaaaaact

SEQ ID NO: 1207541 - DNA, 18 bp, Homo sapiens
aaatgagtaaaaactaga

SEQ ID NO: 1207542 - DNA, 13 bp, Homo sapiens
aaatgagtaacat

SEQ ID NO: 1207543 - DNA, 18 bp, Homo sapiens
aaatgagtaacatttgct

SEQ ID NO: 1207544 - DNA, 13 bp, Homo sapiens
aaatgagtcattt

SEQ ID NO: 1207545 - DNA, 17 bp, Homo sapiens
aaatgagtcatttgttt

SEQ ID NO: 1207546 - DNA, 21 bp, Homo sapiens
aaatgagtttgtattattaca

SEQ ID NO: 1207547 - DNA, 13 bp, Homo sapiens
aaatgataaagac

SEQ ID NO: 1207548 - DNA, 16 bp, Homo sapiens
aaatgataaagacttt

SEQ ID NO: 1207549 - DNA, 20 bp, Homo sapiens
aaatgatctgagtcccagga

SEQ ID NO: 1207550 - DNA, 18 bp, Homo sapiens
aaatgatggaatttttct

SEQ ID NO: 1207551 - DNA, 18 bp, Homo sapiens
aaatgatgtgtacccaaa

SEQ ID NO: 1207552 - DNA, 14 bp, Homo sapiens
aaatgattccaaat

SEQ ID NO: 1207553 - DNA, 23 bp, Homo sapiens
aaatgattggaatattacaatac

SEQ ID NO: 1207554 - DNA, 14 bp, Homo sapiens
aaatgattgtagta

SEQ ID NO: 1207555 - DNA, 12 bp, Homo sapiens
aaatgattttaa

SEQ ID NO: 1207556 - DNA, 18 bp, Homo sapiens
aaatgattttaattttat

SEQ ID NO: 1207557 - DNA, 21 bp, Homo sapiens
aaatgattttatctgtgaatt

SEQ ID NO: 1207558 - DNA, 17 bp, Homo sapiens
aaatgcaaatgaatcat

SEQ ID NO: 1207559 - DNA, 14 bp, Homo sapiens
aaatgcaaatttct

SEQ ID NO: 1207560 - DNA, 17 bp, Homo sapiens
aaatgcaaccagaattg

SEQ ID NO: 1207561 - DNA, 12 bp, Homo sapiens
aaatgcaataac

SEQ ID NO: 1207562 - DNA, 14 bp, Homo sapiens
aaatgcaataactc

SEQ ID NO: 1207563 - DNA, 14 bp, Homo sapiens
aaatgcaatattaa

SEQ ID NO: 1207564 - DNA, 17 bp, Homo sapiens
aaatgcaatattaatgc

SEQ ID NO: 1207565 - DNA, 18 bp, Homo sapiens
aaatgcaatttaaaatta

SEQ ID NO: 1207566 - DNA, 22 bp, Homo sapiens
aaatgcacatttcagaaattcc

SEQ ID NO: 1207567 - DNA, 14 bp, Homo sapiens
aaatgcacctggaa

SEQ ID NO: 1207568 - DNA, 15 bp, Homo sapiens
aaatgcagaaccaca

SEQ ID NO: 1207569 - DNA, 22 bp, Homo sapiens
aaatgcagacaacaccttcctc

SEQ ID NO: 1207570 - DNA, 18 bp, Homo sapiens
aaatgcagttttaagaat

SEQ ID NO: 1207571 - DNA, 20 bp, Homo sapiens
aaatgcatactgttgataca

SEQ ID NO: 1207572 - DNA, 22 bp, Homo sapiens
aaatgcatactgttgatacaaa

SEQ ID NO: 1207573 - DNA, 16 bp, Homo sapiens
aaatgcatccattcct

SEQ ID NO: 1207574 - DNA, 21 bp, Homo sapiens
aaatgggggcaggaaagccac

SEQ ID NO: 1207575 - DNA, 22 bp, Homo sapiens
aaatggggtttgggcccctcag

SEQ ID NO: 1207576 - DNA, 19 bp, Homo sapiens
aaatgggtagagaaacact

SEQ ID NO: 1207577 - DNA, 22 bp, Homo sapiens
aaatggtagcattttaaacaaa

SEQ ID NO: 1207578 - DNA, 21 bp, Homo sapiens
aaatggtccaattagtttcct

SEQ ID NO: 1207579 - DNA, 22 bp, Homo sapiens
aaatggtcccaattaagaaatt

SEQ ID NO: 1207580 - DNA, 20 bp, Homo sapiens
aaatggtgagcgatcattta

SEQ ID NO: 1207581 - DNA, 14 bp, Homo sapiens
aaatggtgatttaa

SEQ ID NO: 1207582 - DNA, 20 bp, Homo sapiens
aaatggtgtacataatgtat

SEQ ID NO: 1207583 - DNA, 14 bp, Homo sapiens
aaatggtgttacat

SEQ ID NO: 1207584 - DNA, 22 bp, Homo sapiens
aaatggtgttttcatgtaaata

SEQ ID NO: 1207585 - DNA, 18 bp, Homo sapiens
aaatggttcttacttttc

SEQ ID NO: 1207586 - DNA, 19 bp, Homo sapiens
aaatggttgatggaaaata

SEQ ID NO: 1207587 - DNA, 20 bp, Homo sapiens
aaatggttgatggaaaataa

SEQ ID NO: 1207588 - DNA, 17 bp, Homo sapiens
aaatgtaaaaatgaagg

SEQ ID NO: 1207589 - DNA, 19 bp, Homo sapiens
aaatgtaaaaatgaaggaa

SEQ ID NO: 1207590 - DNA, 22 bp, Homo sapiens
aaatgtaaaactccattcatag

SEQ ID NO: 1207591 - DNA, 16 bp, Homo sapiens
aaatgtaaactgccat

SEQ ID NO: 1207592 - DNA, 13 bp, Homo sapiens
aaatgtaaatgtt

SEQ ID NO: 1207593 - DNA, 11 bp, Homo sapiens
aaatgtaacat

SEQ ID NO: 1207594 - DNA, 13 bp, Homo sapiens
aaatgtaacatga

SEQ ID NO: 1207595 - DNA, 13 bp, Homo sapiens
aaatgtaactgtc

SEQ ID NO: 1207596 - DNA, 21 bp, Homo sapiens
aaatgtaactgtccgtagtat

SEQ ID NO: 1207597 - DNA, 17 bp, Homo sapiens
aaatgtaacttttgtaa

SEQ ID NO: 1207598 - DNA, 18 bp, Homo sapiens
aaatgtaacttttgtaag

SEQ ID NO: 1207599 - DNA, 17 bp, Homo sapiens
aaatgtaaggctgtgta

SEQ ID NO: 1207600 - DNA, 20 bp, Homo sapiens
aaatgtaaggctgtgtaaga

SEQ ID NO: 1207601 - DNA, 14 bp, Homo sapiens
aaatgtaatactgg

SEQ ID NO: 1207602 - DNA, 15 bp, Homo sapiens
aaatgtaatactgga

SEQ ID NO: 1207603 - DNA, 22 bp, Homo sapiens
aaatgtaatactggaataattt

SEQ ID NO: 1207604 - DNA, 22 bp, Homo sapiens
aaatgtaattaactgtaaactt

SEQ ID NO: 1207605 - DNA, 12 bp, Homo sapiens
aaatgtacattt

SEQ ID NO: 1207606 - DNA, 22 bp, Homo sapiens
aaatgtacatttccaaatgaac

SEQ ID NO: 1207607 - DNA, 22 bp, Homo sapiens
aaatgtaccgatgatactgttt

SEQ ID NO: 1207608 - DNA, 13 bp, Homo sapiens
aaatgtataaaaa

SEQ ID NO: 1207609 - DNA, 22 bp, Homo sapiens
aaatgtataattaacttaactg

SEQ ID NO: 1207610 - DNA, 21 bp, Homo sapiens
aaatgtatcctgataaacatt

SEQ ID NO: 1207611 - DNA, 23 bp, Homo sapiens
aaatgtatcctgataaacattaa

SEQ ID NO: 1207612 - DNA, 15 bp, Homo sapiens
aaatgtatctaagaa

SEQ ID NO: 1207613 - DNA, 20 bp, Homo sapiens
aaatgtatctaagaataata

SEQ ID NO: 1207614 - DNA, 14 bp, Homo sapiens
aaatgtattgattc

SEQ ID NO: 1207615 - DNA, 15 bp, Homo sapiens
aaatgtatttcctga

SEQ ID NO: 1207616 - DNA, 14 bp, Homo sapiens
aaatgtcacagtaa

SEQ ID NO: 1207617 - DNA, 14 bp, Homo sapiens
aaatgtcagagcta

SEQ ID NO: 1207618 - DNA, 14 bp, Homo sapiens
aaatgtccagatgt

SEQ ID NO: 1207619 - DNA, 11 bp, Homo sapiens
aaatgtccctc

SEQ ID NO: 1207620 - DNA, 22 bp, Homo sapiens
aaatgtcctccagaagcctctg

SEQ ID NO: 1207621 - DNA, 13 bp, Homo sapiens
aaatgtcctgcat

SEQ ID NO: 1207622 - DNA, 18 bp, Homo sapiens
aaatgtcgatcaagagaa

SEQ ID NO: 1207623 - DNA, 22 bp, Homo sapiens
aaatgtcggggttggggtggga

SEQ ID NO: 1207624 - DNA, 24 bp, Homo sapiens
aaatgtctagttgtaacaccatga

SEQ ID NO: 1207625 - DNA, 16 bp, Homo sapiens
aaatgtctattaaggt

SEQ ID NO: 1207626 - DNA, 15 bp, Homo sapiens
aaatgtctctgctcc

SEQ ID NO: 1207627 - DNA, 13 bp, Homo sapiens
aaatgtctgctgg

SEQ ID NO: 1207628 - DNA, 17 bp, Homo sapiens
aaatgtcttttagaaga

SEQ ID NO: 1207629 - DNA, 18 bp, Homo sapiens
aaatgtgaaatctcagaa

SEQ ID NO: 1207630 - DNA, 18 bp, Homo sapiens
aaatgtgaaatgctttta

SEQ ID NO: 1207631 - DNA, 17 bp, Homo sapiens
aaatgtgaatcgcagct

SEQ ID NO: 1207632 - DNA, 16 bp, Homo sapiens
aaatgtgagtgttttt

SEQ ID NO: 1207633 - DNA, 13 bp, Homo sapiens
aaatgtgattttt

SEQ ID NO: 1207634 - DNA, 15 bp, Homo sapiens
aaatgtgcattttgt

SEQ ID NO: 1207635 - DNA, 22 bp, Homo sapiens
aaatgtgccatactaatgatga

SEQ ID NO: 1207636 - DNA, 15 bp, Homo sapiens
aaatgtggattttgt

SEQ ID NO: 1207637 - DNA, 19 bp, Homo sapiens
aaatgtggattttgtagat

SEQ ID NO: 1207638 - DNA, 15 bp, Homo sapiens
aaatgtggctcctgg

SEQ ID NO: 1207639 - DNA, 22 bp, Homo sapiens
aaatgtggttttcctgaaatca

SEQ ID NO: 1207640 - DNA, 12 bp, Homo sapiens
aaatgtgtacag

SEQ ID NO: 1207641 - DNA, 17 bp, Homo sapiens
aaatgtgtacagtgaat

SEQ ID NO: 1207642 - DNA, 22 bp, Homo sapiens
aaatgtgtacagtgaattgtct

SEQ ID NO: 1207643 - DNA, 24 bp, Homo sapiens
aaatgtgtacagtgaattgtcttt

SEQ ID NO: 1207644 - DNA, 12 bp, Homo sapiens
aaatgtgtacat

SEQ ID NO: 1207645 - DNA, 21 bp, Homo sapiens
aaatgtgtatatttttgtatg

SEQ ID NO: 1207646 - DNA, 21 bp, Homo sapiens
aaatgtgtcctatctatcttc

SEQ ID NO: 1207647 - DNA, 17 bp, Homo sapiens
aaatgtgtttttctata

SEQ ID NO: 1207648 - DNA, 21 bp, Homo sapiens
aaatgtgtttttctatatagt

SEQ ID NO: 1207649 - DNA, 16 bp, Homo sapiens
aaatgttaaaccctta

SEQ ID NO: 1207650 - DNA, 15 bp, Homo sapiens
aaatgttaactgcca

SEQ ID NO: 1207651 - DNA, 20 bp, Homo sapiens
aaatgttacgtgaagaaata

SEQ ID NO: 1207652 - DNA, 19 bp, Homo sapiens
aaatgttatcttttaaatc

SEQ ID NO: 1207653 - DNA, 22 bp, Homo sapiens
aaatgttatgactatgtaaact

SEQ ID NO: 1207654 - DNA, 15 bp, Homo sapiens
aaatgttatttaaca

SEQ ID NO: 1207655 - DNA, 20 bp, Homo sapiens
aaatgttattttttaattat

SEQ ID NO: 1207656 - DNA, 13 bp, Homo sapiens
aaatgttcacttt

SEQ ID NO: 1207657 - DNA, 16 bp, Homo sapiens
aaatgttcacttttga

SEQ ID NO: 1207658 - DNA, 22 bp, Homo sapiens
aaatgttctatttaacaactgg

SEQ ID NO: 1207659 - DNA, 15 bp, Homo sapiens
aaatgttctcaaata

SEQ ID NO: 1207660 - DNA, 11 bp, Homo sapiens
aaatgttggct

SEQ ID NO: 1207661 - DNA, 15 bp, Homo sapiens
aaatgtttatactgt

SEQ ID NO: 1207662 - DNA, 18 bp, Homo sapiens
aaatgtttatttaaaaga

SEQ ID NO: 1207663 - DNA, 22 bp, Homo sapiens
aaatgtttatttaaaagagcag

SEQ ID NO: 1207664 - DNA, 11 bp, Homo sapiens
aaatgtttcct

SEQ ID NO: 1207665 - DNA, 21 bp, Homo sapiens
aaatgtttcctccaaatctga

SEQ ID NO: 1207666 - DNA, 21 bp, Homo sapiens
aaatgtttccttaaacatgaa

SEQ ID NO: 1207667 - DNA, 14 bp, Homo sapiens
aaatgtttccttgt

SEQ ID NO: 1207668 - DNA, 11 bp, Homo sapiens
aaatgtttctt

SEQ ID NO: 1207669 - DNA, 19 bp, Homo sapiens
aaatgtttgaaaacaaaaa

SEQ ID NO: 1207670 - DNA, 18 bp, Homo sapiens
aaatgtttgttatttaca

SEQ ID NO: 1207671 - DNA, 22 bp, Homo sapiens
aaatgtttgttatttacactgg

SEQ ID NO: 1207672 - DNA, 20 bp, Homo sapiens
aaatgttttaaagtttaatg

SEQ ID NO: 1207673 - DNA, 22 bp, Homo sapiens
aaatgttttgctcaatagattg

SEQ ID NO: 1207674 - DNA, 14 bp, Homo sapiens
aaatgttttgtaaa

SEQ ID NO: 1207675 - DNA, 17 bp, Homo sapiens
aaatgttttgtaaacat

SEQ ID NO: 1207676 - DNA, 21 bp, Homo sapiens
aaatgtttttctgccagggag

SEQ ID NO: 1207677 - DNA, 23 bp, Homo sapiens
aaatgtttttctgccagggagct

SEQ ID NO: 1207678 - DNA, 14 bp, Homo sapiens
aaatgttttttgat

SEQ ID NO: 1207679 - DNA, 15 bp, Homo sapiens
aaattaaaaaaaaat

SEQ ID NO: 1207680 - DNA, 14 bp, Homo sapiens
aaattaaaatgtaa

SEQ ID NO: 1207681 - DNA, 15 bp, Homo sapiens
aaattaaacaattta

SEQ ID NO: 1207682 - DNA, 14 bp, Homo sapiens
aaattaaacatttt

SEQ ID NO: 1207683 - DNA, 12 bp, Homo sapiens
aaattaaagaaa

SEQ ID NO: 1207684 - DNA, 13 bp, Homo sapiens
aaattaaagcatt

SEQ ID NO: 1207685 - DNA, 17 bp, Homo sapiens
aaattaaagtatgcaaa

SEQ ID NO: 1207686 - DNA, 16 bp, Homo sapiens
aaattaaataaactgt

SEQ ID NO: 1207687 - DNA, 16 bp, Homo sapiens
aaattaaatatatgta

SEQ ID NO: 1207688 - DNA, 20 bp, Homo sapiens
aaattaaatatatgtatgta

SEQ ID NO: 1207689 - DNA, 13 bp, Homo sapiens
aaattaaatctag

SEQ ID NO: 1207690 - DNA, 22 bp, Homo sapiens
aaattatagaaacaatactgtt

SEQ ID NO: 1207691 - DNA, 23 bp, Homo sapiens
aaattatagaaacaatactgttc

SEQ ID NO: 1207692 - DNA, 22 bp, Homo sapiens
aaattatatttgtgctatagta

SEQ ID NO: 1207693 - DNA, 19 bp, Homo sapiens
aaattatcaaaaagctaat

SEQ ID NO: 1207694 - DNA, 20 bp, Homo sapiens
aaattatcttgatacattca

SEQ ID NO: 1207695 - DNA, 13 bp, Homo sapiens
aaattatgacaat

SEQ ID NO: 1207696 - DNA, 21 bp, Homo sapiens
aaattatggaaacagatgaaa

SEQ ID NO: 1207697 - DNA, 18 bp, Homo sapiens
aaattatggcatttctat

SEQ ID NO: 1207698 - DNA, 13 bp, Homo sapiens
aaattatgtaatg

SEQ ID NO: 1207699 - DNA, 21 bp, Homo sapiens
aaattatgtgaccataatgta

SEQ ID NO: 1207700 - DNA, 20 bp, Homo sapiens
aaattattaattgtcctgtg

SEQ ID NO: 1207701 - DNA, 21 bp, Homo sapiens
aaattattaattgtcctgtgt

SEQ ID NO: 1207702 - DNA, 23 bp, Homo sapiens
aaattattaattgtcctgtgtct

SEQ ID NO: 1207703 - DNA, 13 bp, Homo sapiens
aaattattagaac

SEQ ID NO: 1207704 - DNA, 17 bp, Homo sapiens
aaattattagaacattc

SEQ ID NO: 1207705 - DNA, 21 bp, Homo sapiens
aaattattgatgattttgtaa

SEQ ID NO: 1207706 - DNA, 20 bp, Homo sapiens
aaattattgtaaactttttc

SEQ ID NO: 1207707 - DNA, 13 bp, Homo sapiens
aaattatttctta

SEQ ID NO: 1207708 - DNA, 13 bp, Homo sapiens
aaattatttgcta

SEQ ID NO: 1207709 - DNA, 14 bp, Homo sapiens
aaattatttgctaa

SEQ ID NO: 1207710 - DNA, 23 bp, Homo sapiens
aaattatttgtgtaatagaaaac

SEQ ID NO: 1207711 - DNA, 15 bp, Homo sapiens
aaattattttaaaca

SEQ ID NO: 1207712 - DNA, 17 bp, Homo sapiens
aaattcaaaacctgcag

SEQ ID NO: 1207713 - DNA, 19 bp, Homo sapiens
aaattcaaaacctgcagtt

SEQ ID NO: 1207714 - DNA, 15 bp, Homo sapiens
aaattcaaaatgctc

SEQ ID NO: 1207715 - DNA, 14 bp, Homo sapiens
aaattcaaagcatg

SEQ ID NO: 1207716 - DNA, 19 bp, Homo sapiens
aaattcacaagttgtgttt

SEQ ID NO: 1207717 - DNA, 19 bp, Homo sapiens
aaattcacatgatgcactt

SEQ ID NO: 1207718 - DNA, 21 bp, Homo sapiens
aaattcacatgatgcacttca

SEQ ID NO: 1207719 - DNA, 17 bp, Homo sapiens
aaattcactaatcttga

SEQ ID NO: 1207720 - DNA, 21 bp, Homo sapiens
aaattcactgtttcactgaaa

SEQ ID NO: 1207721 - DNA, 15 bp, Homo sapiens
aaattcagtctctga

SEQ ID NO: 1207722 - DNA, 18 bp, Homo sapiens
aaattcagttataaagtc

SEQ ID NO: 1207723 - DNA, 14 bp, Homo sapiens
aaattcagtttcat

SEQ ID NO: 1207724 - DNA, 19 bp, Homo sapiens
aaattcagtttttgtatct

SEQ ID NO: 1207725 - DNA, 15 bp, Homo sapiens
aaattcatataaaag

SEQ ID NO: 1207726 - DNA, 21 bp, Homo sapiens
aaattcatggcatgcttaaat

SEQ ID NO: 1207727 - DNA, 16 bp, Homo sapiens
aaattcatttctaatt

SEQ ID NO: 1207728 - DNA, 24 bp, Homo sapiens
aaattcatttttaagatagaacac

SEQ ID NO: 1207729 - DNA, 13 bp, Homo sapiens
aaattcatttttt

SEQ ID NO: 1207730 - DNA, 22 bp, Homo sapiens
aaattcatttttttcactggag

SEQ ID NO: 1207731 - DNA, 13 bp, Homo sapiens
aaattccactgga

SEQ ID NO: 1207732 - DNA, 17 bp, Homo sapiens
aaattccagaaaggata

SEQ ID NO: 1207733 - DNA, 24 bp, Homo sapiens
aaattccagaggactctgcttaaa

SEQ ID NO: 1207734 - DNA, 18 bp, Homo sapiens
aaattccagcaataagaa

SEQ ID NO: 1207735 - DNA, 19 bp, Homo sapiens
aaattccatacttctctca

SEQ ID NO: 1207736 - DNA, 19 bp, Homo sapiens
aaattcccaacctgctcat

SEQ ID NO: 1207737 - DNA, 13 bp, Homo sapiens
aaattcccttcct

SEQ ID NO: 1207738 - DNA, 17 bp, Homo sapiens
aacagatgtttcttttg

SEQ ID NO: 1207739 - DNA, 24 bp, Homo sapiens
aacagatgtttcttttgtatgtaa

SEQ ID NO: 1207740 - DNA, 18 bp, Homo sapiens
aacagattcaggccagcc

SEQ ID NO: 1207741 - DNA, 21 bp, Homo sapiens
aacagattcaggccagcccag

SEQ ID NO: 1207742 - DNA, 13 bp, Homo sapiens
aacagattctgat

SEQ ID NO: 1207743 - DNA, 13 bp, Homo sapiens
aacagatttttac

SEQ ID NO: 1207744 - DNA, 17 bp, Homo sapiens
aacagatttttacaaat

SEQ ID NO: 1207745 - DNA, 20 bp, Homo sapiens
aacagcaaatgcaaaaactc

SEQ ID NO: 1207746 - DNA, 13 bp, Homo sapiens
aacagcaactaca

SEQ ID NO: 1207747 - DNA, 17 bp, Homo sapiens
aacagcatgctgctttg

SEQ ID NO: 1207748 - DNA, 14 bp, Homo sapiens
aacagcattgcttt

SEQ ID NO: 1207749 - DNA, 15 bp, Homo sapiens
aacagcattgctttc

SEQ ID NO: 1207750 - DNA, 15 bp, Homo sapiens
aacagccaacaggtg

SEQ ID NO: 1207751 - DNA, 16 bp, Homo sapiens
aacagccaacaggtgg

SEQ ID NO: 1207752 - DNA, 19 bp, Homo sapiens
aacagccaactagcccctg

SEQ ID NO: 1207753 - DNA, 12 bp, Homo sapiens
aacagccagcaa

SEQ ID NO: 1207754 - DNA, 13 bp, Homo sapiens
aacagcccaggca

SEQ ID NO: 1207755 - DNA, 19 bp, Homo sapiens
aacagccccagtcttcctt

SEQ ID NO: 1207756 - DNA, 22 bp, Homo sapiens
aacagccgtcagccaaatgtaa

SEQ ID NO: 1207757 - DNA, 18 bp, Homo sapiens
aacagcctgacaacattt

SEQ ID NO: 1207758 - DNA, 15 bp, Homo sapiens
aacagcctgcctgtc

SEQ ID NO: 1207759 - DNA, 17 bp, Homo sapiens
aacagccttagctgcca

SEQ ID NO: 1207760 - DNA, 23 bp, Homo sapiens
aacagccttagctgccagtgctg

SEQ ID NO: 1207761 - DNA, 20 bp, Homo sapiens
aacagcgggagacctgtgct

SEQ ID NO: 1207762 - DNA, 19 bp, Homo sapiens
aacagctatgggagcccca

SEQ ID NO: 1207763 - DNA, 22 bp, Homo sapiens
aacagctatgggagccccaggg

SEQ ID NO: 1207764 - DNA, 18 bp, Homo sapiens
aacagctcaagtcttccc

SEQ ID NO: 1207765 - DNA, 11 bp, Homo sapiens
aacagctcaga

SEQ ID NO: 1207766 - DNA, 12 bp, Homo sapiens
aacagctcccag

SEQ ID NO: 1207767 - DNA, 21 bp, Homo sapiens
aacagctctcgttctccttcc

SEQ ID NO: 1207768 - DNA, 17 bp, Homo sapiens
aacagctgcattagaaa

SEQ ID NO: 1207769 - DNA, 18 bp, Homo sapiens
aacagctgcattagaaaa

SEQ ID NO: 1207770 - DNA, 13 bp, Homo sapiens
aacagctgcttct

SEQ ID NO: 1207771 - DNA, 14 bp, Homo sapiens
aacagctgcttctc

SEQ ID NO: 1207772 - DNA, 18 bp, Homo sapiens
aacagctgcttctccccc

SEQ ID NO: 1207773 - DNA, 19 bp, Homo sapiens
aacagctggaggaatacat

SEQ ID NO: 1207774 - DNA, 20 bp, Homo sapiens
aacagctggaggaatacatt

SEQ ID NO: 1207775 - DNA, 20 bp, Homo sapiens
aacagctgtatttatataag

SEQ ID NO: 1207776 - DNA, 22 bp, Homo sapiens
aacagctgtgagccatgcctcc

SEQ ID NO: 1207777 - DNA, 14 bp, Homo sapiens
aacagctgtgtctg

SEQ ID NO: 1207778 - DNA, 20 bp, Homo sapiens
aacagcttcagaaagagctc

SEQ ID NO: 1207779 - DNA, 14 bp, Homo sapiens
aacagcttgctgtc

SEQ ID NO: 1207780 - DNA, 16 bp, Homo sapiens
aacagctttcaagtgc

SEQ ID NO: 1207781 - DNA, 19 bp, Homo sapiens
aacagcttttcccaggaga

SEQ ID NO: 1207782 - DNA, 17 bp, Homo sapiens
aacaggaaaaaaacttt

SEQ ID NO: 1207783 - DNA, 19 bp, Homo sapiens
aacaggaactagtaaacat

SEQ ID NO: 1207784 - DNA, 15 bp, Homo sapiens
aacaggaattttatt

SEQ ID NO: 1207785 - DNA, 20 bp, Homo sapiens
aacaggaattttattttgct

SEQ ID NO: 1207786 - DNA, 19 bp, Homo sapiens
aacaggacttaaaatgaca

SEQ ID NO: 1207787 - DNA, 16 bp, Homo sapiens
aacaggcaaagtttta

SEQ ID NO: 1207788 - DNA, 18 bp, Homo sapiens
aacaggcaggggcccact

SEQ ID NO: 1207789 - DNA, 23 bp, Homo sapiens
aacaggcccagcattgctggttc

SEQ ID NO: 1207790 - DNA, 21 bp, Homo sapiens
aacaggctcaatattcctgaa

SEQ ID NO: 1207791 - DNA, 13 bp, Homo sapiens
aacaggctgattt

SEQ ID NO: 1207792 - DNA, 17 bp, Homo sapiens
aacagggacaaagaaat

SEQ ID NO: 1207793 - DNA, 20 bp, Homo sapiens
aacagggactacgtattttt

SEQ ID NO: 1207794 - DNA, 16 bp, Homo sapiens
aacagggcccaggcct

SEQ ID NO: 1207795 - DNA, 21 bp, Homo sapiens
aacagggcccaggcctggagc

SEQ ID NO: 1207796 - DNA, 15 bp, Homo sapiens
aacaggggaggaaaa

SEQ ID NO: 1207797 - DNA, 18 bp, Homo sapiens
aacaggggaggaaaaaag

SEQ ID NO: 1207798 - DNA, 17 bp, Homo sapiens
aacaggtatatactttg

SEQ ID NO: 1207799 - DNA, 13 bp, Homo sapiens
aacaggtctcctc

SEQ ID NO: 1207800 - DNA, 22 bp, Homo sapiens
aacaggtggcaggaccaggact

SEQ ID NO: 1207801 - DNA, 14 bp, Homo sapiens
aacaggtgtgtgtg

SEQ ID NO: 1207802 - DNA, 17 bp, Homo sapiens
aacaggtttatctgaag

SEQ ID NO: 1207803 - DNA, 13 bp, Homo sapiens
aacagtaaaccac

SEQ ID NO: 1207804 - DNA, 18 bp, Homo sapiens
aacagtaaaccactgaaa

SEQ ID NO: 1207805 - DNA, 19 bp, Homo sapiens
aacagtaaaccactgaaaa

SEQ ID NO: 1207806 - DNA, 20 bp, Homo sapiens
aacagtacagaaggcaaagt

SEQ ID NO: 1207807 - DNA, 16 bp, Homo sapiens
aacagtagttgtattc

SEQ ID NO: 1207808 - DNA, 13 bp, Homo sapiens
aacagtcatgtat

SEQ ID NO: 1207809 - DNA, 13 bp, Homo sapiens
aacagtcatttaa

SEQ ID NO: 1207810 - DNA, 14 bp, Homo sapiens
aacagtccttgctt

SEQ ID NO: 1207811 - DNA, 12 bp, Homo sapiens
aacagtgagaaa

SEQ ID NO: 1207812 - DNA, 13 bp, Homo sapiens
aacagtgagcctg

SEQ ID NO: 1207813 - DNA, 21 bp, Homo sapiens
aacagtgagcctgaattttgt

SEQ ID NO: 1207814 - DNA, 16 bp, Homo sapiens
aacagtgcaagatttt

SEQ ID NO: 1207815 - DNA, 13 bp, Homo sapiens
aacagtgcctgct

SEQ ID NO: 1207816 - DNA, 14 bp, Homo sapiens
aacagtgcctgctg

SEQ ID NO: 1207817 - DNA, 11 bp, Homo sapiens
aacagtggctg

SEQ ID NO: 1207818 - DNA, 19 bp, Homo sapiens
aacagtgtctttctagcca

SEQ ID NO: 1207819 - DNA, 15 bp, Homo sapiens
aacagtgtttcccat

SEQ ID NO: 1207820 - DNA, 21 bp, Homo sapiens
aacagtgtttcccataatttt

SEQ ID NO: 1207821 - DNA, 17 bp, Homo sapiens
aacagttaactttcaga

SEQ ID NO: 1207822 - DNA, 18 bp, Homo sapiens
aacagttaactttcagaa

SEQ ID NO: 1207823 - DNA, 17 bp, Homo sapiens
aacagttatatttttgt

SEQ ID NO: 1207824 - DNA, 16 bp, Homo sapiens
aacagttcatgtttgc

SEQ ID NO: 1207825 - DNA, 16 bp, Homo sapiens
aacagttctcactggg

SEQ ID NO: 1207826 - DNA, 13 bp, Homo sapiens
aacagttctgagc

SEQ ID NO: 1207827 - DNA, 14 bp, Homo sapiens
aacagttgcatgta

SEQ ID NO: 1207828 - DNA, 17 bp, Homo sapiens
aacagttggtaactttt

SEQ ID NO: 1207829 - DNA, 21 bp, Homo sapiens
aacagttggtaacttttgtga

SEQ ID NO: 1207830 - DNA, 20 bp, Homo sapiens
aacagttgtgtcataaatta

SEQ ID NO: 1207831 - DNA, 20 bp, Homo sapiens
aacagtttatttttattatt

SEQ ID NO: 1207832 - DNA, 23 bp, Homo sapiens
aacagtttcttgcttggaagcca

SEQ ID NO: 1207833 - DNA, 15 bp, Homo sapiens
aacagtttgcctgct

SEQ ID NO: 1207834 - DNA, 22 bp, Homo sapiens
aacagtttgcctgctgtattta

SEQ ID NO: 1207835 - DNA, 15 bp, Homo sapiens
aacagttttccatga

SEQ ID NO: 1207836 - DNA, 15 bp, Homo sapiens
aacagttttgagtaa

SEQ ID NO: 1207837 - DNA, 21 bp, Homo sapiens
aacagttttttatgctaatca

SEQ ID NO: 1207838 - DNA, 15 bp, Homo sapiens
aacataaaaaggaca

SEQ ID NO: 1207839 - DNA, 13 bp, Homo sapiens
aacataaaaatga

SEQ ID NO: 1207840 - DNA, 16 bp, Homo sapiens
aacataaaatctgtga

SEQ ID NO: 1207841 - DNA, 19 bp, Homo sapiens
aacataaagcaaatagaca

SEQ ID NO: 1207842 - DNA, 16 bp, Homo sapiens
aacataaggagaatgt

SEQ ID NO: 1207843 - DNA, 23 bp, Homo sapiens
aacataatggttgtgaaatgtaa

SEQ ID NO: 1207844 - DNA, 18 bp, Homo sapiens
aacataattcttgtatat

SEQ ID NO: 1207845 - DNA, 19 bp, Homo sapiens
aacataattgtggattata

SEQ ID NO: 1207846 - DNA, 17 bp, Homo sapiens
aacatacaagaaaatgt

SEQ ID NO: 1207847 - DNA, 18 bp, Homo sapiens
aacatacaaggacattca

SEQ ID NO: 1207848 - DNA, 15 bp, Homo sapiens
aacatacagacacat

SEQ ID NO: 1207849 - DNA, 14 bp, Homo sapiens
aacatactgattgg

SEQ ID NO: 1207850 - DNA, 13 bp, Homo sapiens
aacatacttacat

SEQ ID NO: 1207851 - DNA, 17 bp, Homo sapiens
aacatacttacatttca

SEQ ID NO: 1207852 - DNA, 14 bp, Homo sapiens
aacatacttcaaaa

SEQ ID NO: 1207853 - DNA, 23 bp, Homo sapiens
aacatagaaatggaaattttgct

SEQ ID NO: 1207854 - DNA, 21 bp, Homo sapiens
tgaggagatgaccagggatgc

SEQ ID NO: 1207855 - DNA, 12 bp, Homo sapiens
tgaggagcagcc

SEQ ID NO: 1207856 - DNA, 16 bp, Homo sapiens
tgaggagcagccagga

SEQ ID NO: 1207857 - DNA, 11 bp, Homo sapiens
tgaggagcccc

SEQ ID NO: 1207858 - DNA, 12 bp, Homo sapiens
aacgtatttagc

SEQ ID NO: 1207859 - DNA, 16 bp, Homo sapiens
aacgtatttagccatt

SEQ ID NO: 1207860 - DNA, 19 bp, Homo sapiens
aacgtatttagccattacc

SEQ ID NO: 1207861 - DNA, 19 bp, Homo sapiens
aacgtatttctccagaccc

SEQ ID NO: 1207862 - DNA, 20 bp, Homo sapiens
aacgtatttctccagaccca

SEQ ID NO: 1207863 - DNA, 22 bp, Homo sapiens
aacgtatttctccagacccaga

SEQ ID NO: 1207864 - DNA, 17 bp, Homo sapiens
aacgtgatgttttgaat

SEQ ID NO: 1207865 - DNA, 18 bp, Homo sapiens
aacgtgattgattcagta

SEQ ID NO: 1207866 - DNA, 19 bp, Homo sapiens
aacgtgattgattcagtat

SEQ ID NO: 1207867 - DNA, 22 bp, Homo sapiens
aacgtgattgattcagtatctt

SEQ ID NO: 1207868 - DNA, 13 bp, Homo sapiens
aacgtgcccccag

SEQ ID NO: 1207869 - DNA, 16 bp, Homo sapiens
aacgtggctctgctgg

SEQ ID NO: 1207870 - DNA, 15 bp, Homo sapiens
aacgtggcttgtaga

SEQ ID NO: 1207871 - DNA, 17 bp, Homo sapiens
aacgtggcttgtagaat

SEQ ID NO: 1207872 - DNA, 23 bp, Homo sapiens
aacgtgggagttcagctgcttct

SEQ ID NO: 1207873 - DNA, 18 bp, Homo sapiens
aacgtgggcttaaagcag

SEQ ID NO: 1207874 - DNA, 21 bp, Homo sapiens
aacgtgggcttaaagcagaag

SEQ ID NO: 1207875 - DNA, 23 bp, Homo sapiens
aacgtggtttgcctgaggctgta

SEQ ID NO: 1207876 - DNA, 12 bp, Homo sapiens
aacgtgtaaatt

SEQ ID NO: 1207877 - DNA, 17 bp, Homo sapiens
aacgtgttcaatatttt

SEQ ID NO: 1207878 - DNA, 15 bp, Homo sapiens
aacgttttattgtgt

SEQ ID NO: 1207879 - DNA, 20 bp, Homo sapiens
aacgttttcttctttccctg

SEQ ID NO: 1207880 - DNA, 21 bp, Homo sapiens
aacgttttcttctttccctgg

SEQ ID NO: 1207881 - DNA, 15 bp, Homo sapiens
aacgttttgaactaa

SEQ ID NO: 1207882 - DNA, 17 bp, Homo sapiens
aacgtttttcctgttct

SEQ ID NO: 1207883 - DNA, 16 bp, Homo sapiens
aactaaaaataaatta

SEQ ID NO: 1207884 - DNA, 22 bp, Homo sapiens
aactaaaatctgttaccattct

SEQ ID NO: 1207885 - DNA, 16 bp, Homo sapiens
aactaaactagttttt

SEQ ID NO: 1207886 - DNA, 19 bp, Homo sapiens
aactaaactagtttttcct

SEQ ID NO: 1207887 - DNA, 18 bp, Homo sapiens
aactaaactcttaccata

SEQ ID NO: 1207888 - DNA, 23 bp, Homo sapiens
aactaaactcttaccatatgttt

SEQ ID NO: 1207889 - DNA, 15 bp, Homo sapiens
aactaaagagctgca

SEQ ID NO: 1207890 - DNA, 14 bp, Homo sapiens
aactaaataatgaa

SEQ ID NO: 1207891 - DNA, 15 bp, Homo sapiens
aactaaataatgaat

SEQ ID NO: 1207892 - DNA, 16 bp, Homo sapiens
aactaaataatgaata

SEQ ID NO: 1207893 - DNA, 18 bp, Homo sapiens
aactaaataccattcact

SEQ ID NO: 1207894 - DNA, 14 bp, Homo sapiens
aactaaatatatgt

SEQ ID NO: 1207895 - DNA, 19 bp, Homo sapiens
aactaaatgagattatatg

SEQ ID NO: 1207896 - DNA, 17 bp, Homo sapiens
aactaaatttttcatag

SEQ ID NO: 1207897 - DNA, 11 bp, Homo sapiens
aactaacatgt

SEQ ID NO: 1207898 - DNA, 15 bp, Homo sapiens
aactaaccagcattc

SEQ ID NO: 1207899 - DNA, 21 bp, Homo sapiens
aactaactgcttcatctcctt

SEQ ID NO: 1207900 - DNA, 14 bp, Homo sapiens
aactaagattcttt

SEQ ID NO: 1207901 - DNA, 22 bp, Homo sapiens
aactaagccaacttgatgtgaa

SEQ ID NO: 1207902 - DNA, 13 bp, Homo sapiens
aactaaggacaaa

SEQ ID NO: 1207903 - DNA, 16 bp, Homo sapiens
aactaaggcttttatt

SEQ ID NO: 1207904 - DNA, 21 bp, Homo sapiens
aactaaggcttttatttctgt

SEQ ID NO: 1207905 - DNA, 18 bp, Homo sapiens
aactaatacgtgccagat

SEQ ID NO: 1207906 - DNA, 22 bp, Homo sapiens
aactaatatgggcattgtagtt

SEQ ID NO: 1207907 - DNA, 22 bp, Homo sapiens
aactaatctattgggttcatta

SEQ ID NO: 1207908 - DNA, 21 bp, Homo sapiens
aactaatgaacaaatatgctt

SEQ ID NO: 1207909 - DNA, 14 bp, Homo sapiens
aactaatgtactgt

SEQ ID NO: 1207910 - DNA, 21 bp, Homo sapiens
aactaatgtactgtacataaa

SEQ ID NO: 1207911 - DNA, 16 bp, Homo sapiens
aactaattcaataaaa

SEQ ID NO: 1207912 - DNA, 15 bp, Homo sapiens
aactaatttagtaat

SEQ ID NO: 1207913 - DNA, 12 bp, Homo sapiens
aactacaaagta

SEQ ID NO: 1207914 - DNA, 18 bp, Homo sapiens
aatagacttctcttacat

SEQ ID NO: 1207915 - DNA, 20 bp, Homo sapiens
aatagacttctcttacattt

SEQ ID NO: 1207916 - DNA, 18 bp, Homo sapiens
aatagagactgtagattg

SEQ ID NO: 1207917 - DNA, 11 bp, Homo sapiens
aatagagagag

SEQ ID NO: 1207918 - DNA, 14 bp, Homo sapiens
aatagagataagtc

SEQ ID NO: 1207919 - DNA, 15 bp, Homo sapiens
aatagagtatatgca

SEQ ID NO: 1207920 - DNA, 16 bp, Homo sapiens
aatagagtatatgcac

SEQ ID NO: 1207921 - DNA, 18 bp, Homo sapiens
aatagagtatatgcactt

SEQ ID NO: 1207922 - DNA, 19 bp, Homo sapiens
aatagagttgggacaattg

SEQ ID NO: 1207923 - DNA, 22 bp, Homo sapiens
aatagagtttgctattagagca

SEQ ID NO: 1207924 - DNA, 20 bp, Homo sapiens
aatagataagagtagaaact

SEQ ID NO: 1207925 - DNA, 20 bp, Homo sapiens
aatagataaggtttcctgct

SEQ ID NO: 1207926 - DNA, 18 bp, Homo sapiens
aatagatacagcagaggc

SEQ ID NO: 1207927 - DNA, 19 bp, Homo sapiens
aatagatggaatttggaac

SEQ ID NO: 1207928 - DNA, 16 bp, Homo sapiens
aatagatgtgatcact

SEQ ID NO: 1207929 - DNA, 20 bp, Homo sapiens
aatagattactgatgtgata

SEQ ID NO: 1207930 - DNA, 16 bp, Homo sapiens
aatagattaggtttgc

SEQ ID NO: 1207931 - DNA, 15 bp, Homo sapiens
aatagattatagttg

SEQ ID NO: 1207932 - DNA, 19 bp, Homo sapiens
aatagattatttcatatac

SEQ ID NO: 1207933 - DNA, 23 bp, Homo sapiens
aatagattatttcatatactata

SEQ ID NO: 1207934 - DNA, 22 bp, Homo sapiens
aatagattgctcaaatcaggtt

SEQ ID NO: 1207935 - DNA, 17 bp, Homo sapiens
aatagattttctctgga

SEQ ID NO: 1207936 - DNA, 21 bp, Homo sapiens
aatagattttctctggaaata

SEQ ID NO: 1207937 - DNA, 19 bp, Homo sapiens
aatagcaaaagaagaagtt

SEQ ID NO: 1207938 - DNA, 15 bp, Homo sapiens
aatagcaaagaattg

SEQ ID NO: 1207939 - DNA, 17 bp, Homo sapiens
aatagcaacttttgtgt

SEQ ID NO: 1207940 - DNA, 14 bp, Homo sapiens
aatagcagcctttc

SEQ ID NO: 1207941 - DNA, 18 bp, Homo sapiens
aatagcatactgtgtatg

SEQ ID NO: 1207942 - DNA, 20 bp, Homo sapiens
aatagcatactgtgtatgtt

SEQ ID NO: 1207943 - DNA, 16 bp, Homo sapiens
aatagcctaaatgatg

SEQ ID NO: 1207944 - DNA, 18 bp, Homo sapiens
aatagcctaaatgatggt

SEQ ID NO: 1207945 - DNA, 21 bp, Homo sapiens
aatagctaaatacctcaatca

SEQ ID NO: 1207946 - DNA, 15 bp, Homo sapiens
aatagctatatccat

SEQ ID NO: 1207947 - DNA, 21 bp, Homo sapiens
aatagctatatccatgtactg

SEQ ID NO: 1207948 - DNA, 22 bp, Homo sapiens
aatagctatatccatgtactgt

SEQ ID NO: 1207949 - DNA, 19 bp, Homo sapiens
aatagctctttcagggggg

SEQ ID NO: 1207950 - DNA, 15 bp, Homo sapiens
aatagctgaaaaggg

SEQ ID NO: 1207951 - DNA, 17 bp, Homo sapiens
aatagctgccttcaagg

SEQ ID NO: 1207952 - DNA, 16 bp, Homo sapiens
aatagctgttttgtgt

SEQ ID NO: 1207953 - DNA, 20 bp, Homo sapiens
aatagcttattatagaattg

SEQ ID NO: 1207954 - DNA, 19 bp, Homo sapiens
aatagcttgtatagtgtaa

SEQ ID NO: 1207955 - DNA, 14 bp, Homo sapiens
aatagcttgtttct

SEQ ID NO: 1207956 - DNA, 14 bp, Homo sapiens
aataggaccagagc

SEQ ID NO: 1207957 - DNA, 17 bp, Homo sapiens
aataggagggaaacctt

SEQ ID NO: 1207958 - DNA, 11 bp, Homo sapiens
aataggagtct

SEQ ID NO: 1207959 - DNA, 17 bp, Homo sapiens
aataggagtgagtgtat

SEQ ID NO: 1207960 - DNA, 22 bp, Homo sapiens
aataggattgcttcaattaaaa

SEQ ID NO: 1207961 - DNA, 23 bp, Homo sapiens
aataggattgcttcaattaaaat

SEQ ID NO: 1207962 - DNA, 15 bp, Homo sapiens
aataggatttttaga

SEQ ID NO: 1207963 - DNA, 17 bp, Homo sapiens
aataggcactttaaaac

SEQ ID NO: 1207964 - DNA, 18 bp, Homo sapiens
aataggcactttaaaaca

SEQ ID NO: 1207965 - DNA, 14 bp, Homo sapiens
aataggcaggaagc

SEQ ID NO: 1207966 - DNA, 22 bp, Homo sapiens
aataggcattaacacaaaggag

SEQ ID NO: 1207967 - DNA, 14 bp, Homo sapiens
aataggcattttaa

SEQ ID NO: 1207968 - DNA, 16 bp, Homo sapiens
aataggcattttaagt

SEQ ID NO: 1207969 - DNA, 17 bp, Homo sapiens
aataggcattttaagta

SEQ ID NO: 1207970 - DNA, 22 bp, Homo sapiens
aatagggaaaatacctatttta

SEQ ID NO: 1207971 - DNA, 23 bp, Homo sapiens
aatagggagacagggtaggaaag

SEQ ID NO: 1207972 - DNA, 20 bp, Homo sapiens
aatagggctaaatgtttaaa

SEQ ID NO: 1207973 - DNA, 22 bp, Homo sapiens
aatagggctaaatgtttaaaga

SEQ ID NO: 1207974 - DNA, 21 bp, Homo sapiens
aatagggctgagctctctgtg

SEQ ID NO: 1207975 - DNA, 22 bp, Homo sapiens
aatagggtagaatgattaatca

SEQ ID NO: 1207976 - DNA, 19 bp, Homo sapiens
aatagggtatattttccta

SEQ ID NO: 1207977 - DNA, 20 bp, Homo sapiens
aatagggtatattttcctat

SEQ ID NO: 1207978 - DNA, 17 bp, Homo sapiens
aataggtaaatgtattt

SEQ ID NO: 1207979 - DNA, 23 bp, Homo sapiens
aataggtagagtcattcatattt

SEQ ID NO: 1207980 - DNA, 11 bp, Homo sapiens
aataggtcccg

SEQ ID NO: 1207981 - DNA, 17 bp, Homo sapiens
aataggtctttctctca

SEQ ID NO: 1207982 - DNA, 19 bp, Homo sapiens
aataggtctttctctcagt

SEQ ID NO: 1207983 - DNA, 23 bp, Homo sapiens
aataggtgggggaaaatgaattt

SEQ ID NO: 1207984 - DNA, 14 bp, Homo sapiens
aataggttcttctt

SEQ ID NO: 1207985 - DNA, 19 bp, Homo sapiens
aatagtaaacattaagtaa

SEQ ID NO: 1207986 - DNA, 15 bp, Homo sapiens
aatagtaatttgtaa

SEQ ID NO: 1207987 - DNA, 22 bp, Homo sapiens
aatagtagatgtggcctttgaa

SEQ ID NO: 1207988 - DNA, 15 bp, Homo sapiens
aatagtatagaagtc

SEQ ID NO: 1207989 - DNA, 21 bp, Homo sapiens
aatagtatgggaaaaaaactg

SEQ ID NO: 1207990 - DNA, 16 bp, Homo sapiens
aatagtatttcccatt

SEQ ID NO: 1207991 - DNA, 15 bp, Homo sapiens
aatagtcagaaaaca

SEQ ID NO: 1207992 - DNA, 15 bp, Homo sapiens
aatagtccaatattt

SEQ ID NO: 1207993 - DNA, 16 bp, Homo sapiens
aatagtccaatatttg

SEQ ID NO: 1207994 - DNA, 17 bp, Homo sapiens
aatagtccaatatttgg

SEQ ID NO: 1207995 - DNA, 22 bp, Homo sapiens
aatagtcgtgaatcttgttcaa

SEQ ID NO: 1207996 - DNA, 18 bp, Homo sapiens
aatagtcttttgcatgtc

SEQ ID NO: 1207997 - DNA, 22 bp, Homo sapiens
aatagtcttttgcatgtcgcac

SEQ ID NO: 1207998 - DNA, 22 bp, Homo sapiens
aatagtgatttccttaatgaaa

SEQ ID NO: 1207999 - DNA, 21 bp, Homo sapiens
aatagtgcaacatctctgaat

SEQ ID NO: 1208000 - DNA, 20 bp, Homo sapiens
aatagtgcttaaaaatcatt

SEQ ID NO: 1208001 - DNA, 20 bp, Homo sapiens
aatagtgtcatataaactca

SEQ ID NO: 1208002 - DNA, 15 bp, Homo sapiens
aatagtgtgaaatat

SEQ ID NO: 1208003 - DNA, 15 bp, Homo sapiens
aatagtgtgatgttt

SEQ ID NO: 1208004 - DNA, 13 bp, Homo sapiens
aatagtgtgttct

SEQ ID NO: 1208005 - DNA, 22 bp, Homo sapiens
aatagttaagacatgatttcct

SEQ ID NO: 1208006 - DNA, 15 bp, Homo sapiens
aatagttagccctca

SEQ ID NO: 1208007 - DNA, 23 bp, Homo sapiens
aatagttcagtagaattaccatt

SEQ ID NO: 1208008 - DNA, 20 bp, Homo sapiens
aatagtttaggaaaatgaga

SEQ ID NO: 1208009 - DNA, 23 bp, Homo sapiens
aatagtttgtctattttaaaata

SEQ ID NO: 1208010 - DNA, 23 bp, Homo sapiens
aatagtttttcactttgtgtatt

SEQ ID NO: 1208011 - DNA, 14 bp, Homo sapiens
aatagttttttact

SEQ ID NO: 1208012 - DNA, 11 bp, Homo sapiens
aatataaaact

SEQ ID NO: 1208013 - DNA, 14 bp, Homo sapiens
aatataaaactgcg

SEQ ID NO: 1208014 - DNA, 23 bp, Homo sapiens
aatataaaatatgaagacataaa

SEQ ID NO: 1208015 - DNA, 16 bp, Homo sapiens
aatataaagtattcaa

SEQ ID NO: 1208016 - DNA, 17 bp, Homo sapiens
aatataaatagctaatg

SEQ ID NO: 1208017 - DNA, 18 bp, Homo sapiens
aatataaatagctgaaaa

SEQ ID NO: 1208018 - DNA, 20 bp, Homo sapiens
aatataaatatccccaggga

SEQ ID NO: 1208019 - DNA, 13 bp, Homo sapiens
aatataaatgtgt

SEQ ID NO: 1208020 - DNA, 20 bp, Homo sapiens
aatataaatgtgtgtatgtg

SEQ ID NO: 1208021 - DNA, 18 bp, Homo sapiens
aatataaatttaagcaaa

SEQ ID NO: 1208022 - DNA, 15 bp, Homo sapiens
aatataaccattaca

SEQ ID NO: 1208023 - DNA, 19 bp, Homo sapiens
aatataaccattacatgtt

SEQ ID NO: 1208024 - DNA, 21 bp, Homo sapiens
aatataaccattacatgttta

SEQ ID NO: 1208025 - DNA, 21 bp, Homo sapiens
aatataagaaaagtaatgaag

SEQ ID NO: 1208026 - DNA, 14 bp, Homo sapiens
aatataagacattt

SEQ ID NO: 1208027 - DNA, 23 bp, Homo sapiens
aatataaggaaagcaataaatga

SEQ ID NO: 1208028 - DNA, 14 bp, Homo sapiens
aatataataaaaga

SEQ ID NO: 1208029 - DNA, 14 bp, Homo sapiens
aatataataatgat

SEQ ID NO: 1208030 - DNA, 14 bp, Homo sapiens
aatataatactgta

SEQ ID NO: 1208031 - DNA, 15 bp, Homo sapiens
aatatacattttcta

SEQ ID NO: 1208032 - DNA, 16 bp, Homo sapiens
aatatacattttctaa

SEQ ID NO: 1208033 - DNA, 17 bp, Homo sapiens
aatatacattttctaaa

SEQ ID NO: 1208034 - DNA, 19 bp, Homo sapiens
aatatacattttctaaata

SEQ ID NO: 1208035 - DNA, 20 bp, Homo sapiens
aatataccttaacaggctga

SEQ ID NO: 1208036 - DNA, 19 bp, Homo sapiens
aatatacgaaaagccagct

SEQ ID NO: 1208037 - DNA, 21 bp, Homo sapiens
aatatactcaagtttcaggta

SEQ ID NO: 1208038 - DNA, 23 bp, Homo sapiens
aatatacttcactggtgtacatc

SEQ ID NO: 1208039 - DNA, 22 bp, Homo sapiens
aatatactttttttgttataga

SEQ ID NO: 1208040 - DNA, 19 bp, Homo sapiens
aatatagaaagttgatatt

SEQ ID NO: 1208041 - DNA, 20 bp, Homo sapiens
aatatagacattctcacata

SEQ ID NO: 1208042 - DNA, 21 bp, Homo sapiens
aatatagagacaggacagaat

SEQ ID NO: 1208043 - DNA, 23 bp, Homo sapiens
aatatagagacaggacagaatgt

SEQ ID NO: 1208044 - DNA, 15 bp, Homo sapiens
aatatagcaaatgca

SEQ ID NO: 1208045 - DNA, 15 bp, Homo sapiens
aatatagctgagact

SEQ ID NO: 1208046 - DNA, 16 bp, Homo sapiens
aatatagctgtacaaa

SEQ ID NO: 1208047 - DNA, 22 bp, Homo sapiens
aatatagctgtacaaatataag

SEQ ID NO: 1208048 - DNA, 18 bp, Homo sapiens
aatataggaacttaaata

SEQ ID NO: 1208049 - DNA, 21 bp, Homo sapiens
aatataggaacttaaataatg

SEQ ID NO: 1208050 - DNA, 23 bp, Homo sapiens
aatataggtctcttctcccagaa

SEQ ID NO: 1208051 - DNA, 20 bp, Homo sapiens
aatatagtaggggttgaaga

SEQ ID NO: 1208052 - DNA, 11 bp, Homo sapiens
aatatataaac

SEQ ID NO: 1208053 - DNA, 13 bp, Homo sapiens
aatatataaacac

SEQ ID NO: 1208054 - DNA, 13 bp, Homo sapiens
aatatataaatat

SEQ ID NO: 1208055 - DNA, 16 bp, Homo sapiens
aatatatagcttgaaa

SEQ ID NO: 1208056 - DNA, 12 bp, Homo sapiens
aatatatataaa

SEQ ID NO: 1208057 - DNA, 21 bp, Homo sapiens
aatatatatatatataaaata

SEQ ID NO: 1208058 - DNA, 17 bp, Homo sapiens
aatatatatatatattt

SEQ ID NO: 1208059 - DNA, 19 bp, Homo sapiens
aatatatatatatatttaa

SEQ ID NO: 1208060 - DNA, 22 bp, Homo sapiens
aatatatatctatctatttgag

SEQ ID NO: 1208061 - DNA, 15 bp, Homo sapiens
aatatatatgatcat

SEQ ID NO: 1208062 - DNA, 13 bp, Homo sapiens
aatatatattaag

SEQ ID NO: 1208063 - DNA, 16 bp, Homo sapiens
aatatatattaagtgt

SEQ ID NO: 1208064 - DNA, 21 bp, Homo sapiens
aatatatatttttcaaataga

SEQ ID NO: 1208065 - DNA, 16 bp, Homo sapiens
aatatatcagaatctg

SEQ ID NO: 1208066 - DNA, 22 bp, Homo sapiens
aatatatcccagaaattagaaa

SEQ ID NO: 1208067 - DNA, 13 bp, Homo sapiens
aatatatcttaag

SEQ ID NO: 1208068 - DNA, 20 bp, Homo sapiens
aatatatgccttgtataata

SEQ ID NO: 1208069 - DNA, 21 bp, Homo sapiens
aatatatggcagagttgtaaa

SEQ ID NO: 1208070 - DNA, 14 bp, Homo sapiens
aatatatgtatata

SEQ ID NO: 1208071 - DNA, 12 bp, Homo sapiens
aatatatgtatg

SEQ ID NO: 1208072 - DNA, 14 bp, Homo sapiens
aatatatgtatgta

SEQ ID NO: 1208073 - DNA, 19 bp, Homo sapiens
aatatatgtatgtaaaaat

SEQ ID NO: 1208074 - DNA, 22 bp, Homo sapiens
aatatatgtatttttatataat

SEQ ID NO: 1208075 - DNA, 13 bp, Homo sapiens
aatatatgtctat

SEQ ID NO: 1208076 - DNA, 12 bp, Homo sapiens
aatatatgtctg

SEQ ID NO: 1208077 - DNA, 14 bp, Homo sapiens
aatatatgtgaaag

SEQ ID NO: 1208078 - DNA, 13 bp, Homo sapiens
aatatatgttctg

SEQ ID NO: 1208079 - DNA, 22 bp, Homo sapiens
aatatattattcatcttttcat

SEQ ID NO: 1208080 - DNA, 23 bp, Homo sapiens
aatatattgaacttttgtactga

SEQ ID NO: 1208081 - DNA, 13 bp, Homo sapiens
aatatattgaata

SEQ ID NO: 1208082 - DNA, 14 bp, Homo sapiens
aatatattgtacaa

SEQ ID NO: 1208083 - DNA, 15 bp, Homo sapiens
aatatattgtacaaa

SEQ ID NO: 1208084 - DNA, 16 bp, Homo sapiens
aatatattgtacaaat

SEQ ID NO: 1208085 - DNA, 20 bp, Homo sapiens
aatatatttcttcttctaag

SEQ ID NO: 1208086 - DNA, 14 bp, Homo sapiens
aatatatttgcaga

SEQ ID NO: 1208087 - DNA, 21 bp, Homo sapiens
aatatattttctgttttcttt

SEQ ID NO: 1208088 - DNA, 14 bp, Homo sapiens
aatatatttttaga

SEQ ID NO: 1208089 - DNA, 15 bp, Homo sapiens
aatatatttttatat

SEQ ID NO: 1208090 - DNA, 19 bp, Homo sapiens
aatatatttttatatttag

SEQ ID NO: 1208091 - DNA, 19 bp, Homo sapiens
aatatcaaataaaattatt

SEQ ID NO: 1208092 - DNA, 14 bp, Homo sapiens
aatatcaaataata

SEQ ID NO: 1208093 - DNA, 12 bp, Homo sapiens
aatatcacctag

SEQ ID NO: 1208094 - DNA, 22 bp, Homo sapiens
aatatcactaatttcttcttta

SEQ ID NO: 1208095 - DNA, 15 bp, Homo sapiens
aatatcactcattaa

SEQ ID NO: 1208096 - DNA, 16 bp, Homo sapiens
aatatcagacaagcac

SEQ ID NO: 1208097 - DNA, 18 bp, Homo sapiens
aatatcagacaagcacta

SEQ ID NO: 1208098 - DNA, 15 bp, Homo sapiens
aatatcagactagtg

SEQ ID NO: 1208099 - DNA, 23 bp, Homo sapiens
aatatcagtattctgacatgtaa

SEQ ID NO: 1208100 - DNA, 21 bp, Homo sapiens
aatatcagttactcagccctg

SEQ ID NO: 1208101 - DNA, 13 bp, Homo sapiens
aatatcataaagc

SEQ ID NO: 1208102 - DNA, 15 bp, Homo sapiens
aatatcataaagcat

SEQ ID NO: 1208103 - DNA, 18 bp, Homo sapiens
aatatcataaagcatttt

SEQ ID NO: 1208104 - DNA, 23 bp, Homo sapiens
aatatcatttattttttacatta

SEQ ID NO: 1208105 - DNA, 19 bp, Homo sapiens
aatatccaaagactgtact

SEQ ID NO: 1208106 - DNA, 17 bp, Homo sapiens
aatatcccaacattctg

SEQ ID NO: 1208107 - DNA, 22 bp, Homo sapiens
aatatcccaacattctgcaatg

SEQ ID NO: 1208108 - DNA, 22 bp, Homo sapiens
aatatcccagagaacaatcact

SEQ ID NO: 1208109 - DNA, 17 bp, Homo sapiens
aatatccctacatgtat

SEQ ID NO: 1208110 - DNA, 18 bp, Homo sapiens
aatatccctacatgtatt

SEQ ID NO: 1208111 - DNA, 18 bp, Homo sapiens
aatatccctcttgtaagt

SEQ ID NO: 1208112 - DNA, 21 bp, Homo sapiens
aatatcctgtaactacaatga

SEQ ID NO: 1208113 - DNA, 14 bp, Homo sapiens
aatatctaaagtta

SEQ ID NO: 1208114 - DNA, 20 bp, Homo sapiens
aatatctaaagttatatttc

SEQ ID NO: 1208115 - DNA, 16 bp, Homo sapiens
aatctaggatgtgatg

SEQ ID NO: 1208116 - DNA, 19 bp, Homo sapiens
aatctaggtgtggctgtga

SEQ ID NO: 1208117 - DNA, 19 bp, Homo sapiens
aatctagtatttcatgctg

SEQ ID NO: 1208118 - DNA, 21 bp, Homo sapiens
aatctagttttttttgtaaac

SEQ ID NO: 1208119 - DNA, 22 bp, Homo sapiens
aatctatattaaatgagggttt

SEQ ID NO: 1208120 - DNA, 16 bp, Homo sapiens
aatctatgccaaagat

SEQ ID NO: 1208121 - DNA, 18 bp, Homo sapiens
aatctatggcttatttct

SEQ ID NO: 1208122 - DNA, 13 bp, Homo sapiens
aatctatggcttt

SEQ ID NO: 1208123 - DNA, 17 bp, Homo sapiens
aatctatgtgtttctgt

SEQ ID NO: 1208124 - DNA, 17 bp, Homo sapiens
aatctattagattttag

SEQ ID NO: 1208125 - DNA, 22 bp, Homo sapiens
aatctattatttggagcctgcc

SEQ ID NO: 1208126 - DNA, 12 bp, Homo sapiens
aatctattcaga

SEQ ID NO: 1208127 - DNA, 13 bp, Homo sapiens
aatctattcagac

SEQ ID NO: 1208128 - DNA, 18 bp, Homo sapiens
aatctattcagacaagca

SEQ ID NO: 1208129 - DNA, 18 bp, Homo sapiens
aatctattcctgtaaata

SEQ ID NO: 1208130 - DNA, 16 bp, Homo sapiens
aatctatttattaata

SEQ ID NO: 1208131 - DNA, 12 bp, Homo sapiens
aatctcaaaatt

SEQ ID NO: 1208132 - DNA, 22 bp, Homo sapiens
aatctcaaaggagaaaaaaaac

SEQ ID NO: 1208133 - DNA, 12 bp, Homo sapiens
aatctcaaatag

SEQ ID NO: 1208134 - DNA, 22 bp, Homo sapiens
aatctcaaataggctattaaaa

SEQ ID NO: 1208135 - DNA, 12 bp, Homo sapiens
aatctcaaattt

SEQ ID NO: 1208136 - DNA, 21 bp, Homo sapiens
aatctcagaaccttgtcccag

SEQ ID NO: 1208137 - DNA, 21 bp, Homo sapiens
aatctcagaatttatctccct

SEQ ID NO: 1208138 - DNA, 16 bp, Homo sapiens
aatctcagcaaagcta

SEQ ID NO: 1208139 - DNA, 19 bp, Homo sapiens
aatctcagcaaagctacag

SEQ ID NO: 1208140 - DNA, 15 bp, Homo sapiens
aatctcagtgctttc

SEQ ID NO: 1208141 - DNA, 16 bp, Homo sapiens
aatctcagtgctttcc

SEQ ID NO: 1208142 - DNA, 17 bp, Homo sapiens
aatctcataattggaat

SEQ ID NO: 1208143 - DNA, 19 bp, Homo sapiens
aatctcatccccccacccg

SEQ ID NO: 1208144 - DNA, 19 bp, Homo sapiens
aatctcatctctacaaaaa

SEQ ID NO: 1208145 - DNA, 14 bp, Homo sapiens
aatctccagggctc

SEQ ID NO: 1208146 - DNA, 16 bp, Homo sapiens
aatctccagggctcca

SEQ ID NO: 1208147 - DNA, 15 bp, Homo sapiens
aatctccagtattct

SEQ ID NO: 1208148 - DNA, 11 bp, Homo sapiens
aatctccatta

SEQ ID NO: 1208149 - DNA, 19 bp, Homo sapiens
aatctcccagcccacctca

SEQ ID NO: 1208150 - DNA, 18 bp, Homo sapiens
aatctcccattttggaat

SEQ ID NO: 1208151 - DNA, 22 bp, Homo sapiens
aatctcccattttggaatttgc

SEQ ID NO: 1208152 - DNA, 13 bp, Homo sapiens
aatctcctgctga

SEQ ID NO: 1208153 - DNA, 17 bp, Homo sapiens
aatctcggctcactgca

SEQ ID NO: 1208154 - DNA, 20 bp, Homo sapiens
aatctctacgactaatcacc

SEQ ID NO: 1208155 - DNA, 16 bp, Homo sapiens
aatctctccattcccg

SEQ ID NO: 1208156 - DNA, 15 bp, Homo sapiens
aatctctctgcagct

SEQ ID NO: 1208157 - DNA, 13 bp, Homo sapiens
aatctctgcctct

SEQ ID NO: 1208158 - DNA, 14 bp, Homo sapiens
aatctctgttctgc

SEQ ID NO: 1208159 - DNA, 22 bp, Homo sapiens
aatctctgttctgtttggcact

SEQ ID NO: 1208160 - DNA, 23 bp, Homo sapiens
aatctctgttctgtttggcactt

SEQ ID NO: 1208161 - DNA, 20 bp, Homo sapiens
aatctcttaatattgagaat

SEQ ID NO: 1208162 - DNA, 15 bp, Homo sapiens
aatctcttattctaa

SEQ ID NO: 1208163 - DNA, 24 bp, Homo sapiens
aatctcttcatgcttgacatacct

SEQ ID NO: 1208164 - DNA, 16 bp, Homo sapiens
aatctcttgattataa

SEQ ID NO: 1208165 - DNA, 20 bp, Homo sapiens
aatctctttttgctttcgaa

SEQ ID NO: 1208166 - DNA, 17 bp, Homo sapiens
aatctgaaagacttgaa

SEQ ID NO: 1208167 - DNA, 22 bp, Homo sapiens
aatctgaaattcaaaatgctct

SEQ ID NO: 1208168 - DNA, 15 bp, Homo sapiens
aatctgaactgctct

SEQ ID NO: 1208169 - DNA, 21 bp, Homo sapiens
aatctgatctttttatacaca

SEQ ID NO: 1208170 - DNA, 14 bp, Homo sapiens
aatctgatggcctt

SEQ ID NO: 1208171 - DNA, 23 bp, Homo sapiens
aatctgatggccttaatttcctt

SEQ ID NO: 1208172 - DNA, 21 bp, Homo sapiens
aatctgatttaatgttttctg

SEQ ID NO: 1208173 - DNA, 14 bp, Homo sapiens
aatctgcagaagga

SEQ ID NO: 1208174 - DNA, 17 bp, Homo sapiens
aatctgcagtgatgcaa

SEQ ID NO: 1208175 - DNA, 16 bp, Homo sapiens
aatctgcattattgga

SEQ ID NO: 1208176 - DNA, 21 bp, Homo sapiens
aatctgctgttgccatagccc

SEQ ID NO: 1208177 - DNA, 21 bp, Homo sapiens
aatctggaaatctgttttgta

SEQ ID NO: 1208178 - DNA, 18 bp, Homo sapiens
aatctggactcctctgtc

SEQ ID NO: 1208179 - DNA, 20 bp, Homo sapiens
aatctggactcctctgtcca

SEQ ID NO: 1208180 - DNA, 14 bp, Homo sapiens
aatctggagaccag

SEQ ID NO: 1208181 - DNA, 15 bp, Homo sapiens
aatctggagaccagg

SEQ ID NO: 1208182 - DNA, 14 bp, Homo sapiens
aatctgggagggaa

SEQ ID NO: 1208183 - DNA, 19 bp, Homo sapiens
aatctggggaagaggtttt

SEQ ID NO: 1208184 - DNA, 15 bp, Homo sapiens
aatctggtctcttct

SEQ ID NO: 1208185 - DNA, 22 bp, Homo sapiens
aatctgtaacccccaaggagga

SEQ ID NO: 1208186 - DNA, 15 bp, Homo sapiens
aatctgtagggctgg

SEQ ID NO: 1208187 - DNA, 17 bp, Homo sapiens
aatctgtcaaaacactg

SEQ ID NO: 1208188 - DNA, 21 bp, Homo sapiens
aatctgtcaaaacactgtgga

SEQ ID NO: 1208189 - DNA, 23 bp, Homo sapiens
aatctgtcaaaacactgtggaac

SEQ ID NO: 1208190 - DNA, 13 bp, Homo sapiens
aatctgtcaagag

SEQ ID NO: 1208191 - DNA, 16 bp, Homo sapiens
aatctgtcagcatctg

SEQ ID NO: 1208192 - DNA, 21 bp, Homo sapiens
aatctgtccaaaggaggctgg

SEQ ID NO: 1208193 - DNA, 23 bp, Homo sapiens
aatctgtgaattaaaaaagctca

SEQ ID NO: 1208194 - DNA, 16 bp, Homo sapiens
aatctgtgcaaacagt

SEQ ID NO: 1208195 - DNA, 16 bp, Homo sapiens
aatctgtgctggccat

SEQ ID NO: 1208196 - DNA, 14 bp, Homo sapiens
aatctgtgtgaagt

SEQ ID NO: 1208197 - DNA, 17 bp, Homo sapiens
aatctgtgtgtgccctg

SEQ ID NO: 1208198 - DNA, 20 bp, Homo sapiens
aatctgttatgtactagtgt

SEQ ID NO: 1208199 - DNA, 17 bp, Homo sapiens
aatctgtttctctgctg

SEQ ID NO: 1208200 - DNA, 19 bp, Homo sapiens
aatctgtttgtgcaaacat

SEQ ID NO: 1208201 - DNA, 17 bp, Homo sapiens
aatctgttttgtatatg

SEQ ID NO: 1208202 - DNA, 15 bp, Homo sapiens
aatctgtttttctaa

SEQ ID NO: 1208203 - DNA, 16 bp, Homo sapiens
aatctgtttttctaac

SEQ ID NO: 1208204 - DNA, 20 bp, Homo sapiens
aatcttaaacaatgtataaa

SEQ ID NO: 1208205 - DNA, 17 bp, Homo sapiens
aatcttgttttgaaaat

SEQ ID NO: 1208206 - DNA, 20 bp, Homo sapiens
aatcttgttttgtttgcttc

SEQ ID NO: 1208207 - DNA, 20 bp, Homo sapiens
aatctttacctgtatacagt

SEQ ID NO: 1208208 - DNA, 14 bp, Homo sapiens
aatctttatactgg

SEQ ID NO: 1208209 - DNA, 14 bp, Homo sapiens
aatctttattgaga

SEQ ID NO: 1208210 - DNA, 21 bp, Homo sapiens
aatctttcaaaccagcttcat

SEQ ID NO: 1208211 - DNA, 18 bp, Homo sapiens
aatctttcacttgaaaga

SEQ ID NO: 1208212 - DNA, 20 bp, Homo sapiens
aatctttcacttgaaagatt

SEQ ID NO: 1208213 - DNA, 19 bp, Homo sapiens
aatctttcatacatatata

SEQ ID NO: 1208214 - DNA, 13 bp, Homo sapiens
aatctttcatgtc

SEQ ID NO: 1208215 - DNA, 15 bp, Homo sapiens
aatctttcatgtctt

SEQ ID NO: 1208216 - DNA, 20 bp, Homo sapiens
aatctttcatgtcttgtcat

SEQ ID NO: 1208217 - DNA, 20 bp, Homo sapiens
aatctttctacctctttttt

SEQ ID NO: 1208218 - DNA, 20 bp, Homo sapiens
aatctttctatataaaatgt

SEQ ID NO: 1208219 - DNA, 15 bp, Homo sapiens
aatctttctcctggt

SEQ ID NO: 1208220 - DNA, 19 bp, Homo sapiens
aatctttctcctggtgact

SEQ ID NO: 1208221 - DNA, 13 bp, Homo sapiens
aatctttctgcag

SEQ ID NO: 1208222 - DNA, 15 bp, Homo sapiens
aatctttctttacct

SEQ ID NO: 1208223 - DNA, 22 bp, Homo sapiens
aatctttctttacctgagacca

SEQ ID NO: 1208224 - DNA, 13 bp, Homo sapiens
aatctttgaaata

SEQ ID NO: 1208225 - DNA, 14 bp, Homo sapiens
aatctttgaaataa

SEQ ID NO: 1208226 - DNA, 23 bp, Homo sapiens
aatcttttacaactgcctcgaaa

SEQ ID NO: 1208227 - DNA, 15 bp, Homo sapiens
aatcttttacatttt

SEQ ID NO: 1208228 - DNA, 18 bp, Homo sapiens
aatcttttagtgtttact

SEQ ID NO: 1208229 - DNA, 18 bp, Homo sapiens
aatcttttataatgattc

SEQ ID NO: 1208230 - DNA, 13 bp, Homo sapiens
aatcttttcttat

SEQ ID NO: 1208231 - DNA, 17 bp, Homo sapiens
aatctttttatcccatt

SEQ ID NO: 1208232 - DNA, 13 bp, Homo sapiens
aatctttttctcc

SEQ ID NO: 1208233 - DNA, 15 bp, Homo sapiens
aatctttttgcttct

SEQ ID NO: 1208234 - DNA, 22 bp, Homo sapiens
aatcttttttttatataaatat

SEQ ID NO: 1208235 - DNA, 18 bp, Homo sapiens
aatgaaaaacaaaaagct

SEQ ID NO: 1208236 - DNA, 13 bp, Homo sapiens
aatgaaaaacaca

SEQ ID NO: 1208237 - DNA, 21 bp, Homo sapiens
aatgaaaaatagtgtctttgt

SEQ ID NO: 1208238 - DNA, 23 bp, Homo sapiens
aatgaaaaatgtaatttagaaac

SEQ ID NO: 1208239 - DNA, 21 bp, Homo sapiens
aatgaaaaatttaagcattgt

SEQ ID NO: 1208240 - DNA, 12 bp, Homo sapiens
aatgaaaacaat

SEQ ID NO: 1208241 - DNA, 13 bp, Homo sapiens
aatgaaaactttt

SEQ ID NO: 1208242 - DNA, 17 bp, Homo sapiens
aatgaaaacttttgtaa

SEQ ID NO: 1208243 - DNA, 13 bp, Homo sapiens
aatgaaaagagaa

SEQ ID NO: 1208244 - DNA, 14 bp, Homo sapiens
aatgaaaagcaata

SEQ ID NO: 1208245 - DNA, 22 bp, Homo sapiens
aatgaaaataaaacacacctcg

SEQ ID NO: 1208246 - DNA, 13 bp, Homo sapiens
aatgaaaatgtca

SEQ ID NO: 1208247 - DNA, 20 bp, Homo sapiens
aatgaaaatgtcagaaacca

SEQ ID NO: 1208248 - DNA, 13 bp, Homo sapiens
aatgaaaattgta

SEQ ID NO: 1208249 - DNA, 21 bp, Homo sapiens
aatgaaacaaaaaaaaaatga

SEQ ID NO: 1208250 - DNA, 16 bp, Homo sapiens
aatgaaacaaagagtt

SEQ ID NO: 1208251 - DNA, 23 bp, Homo sapiens
aatgaaacaaagagttcaagaaa

SEQ ID NO: 1208252 - DNA, 16 bp, Homo sapiens
aatgaaacaccttctc

SEQ ID NO: 1208253 - DNA, 19 bp, Homo sapiens
aatgaaacagatgataaat

SEQ ID NO: 1208254 - DNA, 17 bp, Homo sapiens
aatgaaacattttgtca

SEQ ID NO: 1208255 - DNA, 16 bp, Homo sapiens
aatgaaagactgtaca

SEQ ID NO: 1208256 - DNA, 21 bp, Homo sapiens
aatgaaagactgtacaaagta

SEQ ID NO: 1208257 - DNA, 21 bp, Homo sapiens
aatgaaagagagctctaacca

SEQ ID NO: 1208258 - DNA, 21 bp, Homo sapiens
aatgaaaggagtttaaaaaca

SEQ ID NO: 1208259 - DNA, 21 bp, Homo sapiens
aatgaaagggaaagtcagctt

SEQ ID NO: 1208260 - DNA, 13 bp, Homo sapiens
aatgaaagtgact

SEQ ID NO: 1208261 - DNA, 12 bp, Homo sapiens
aatgaaataatc

SEQ ID NO: 1208262 - DNA, 14 bp, Homo sapiens
aatgaaatacacaa

SEQ ID NO: 1208263 - DNA, 20 bp, Homo sapiens
aatgaaatactccagcacct

SEQ ID NO: 1208264 - DNA, 23 bp, Homo sapiens
aatgaaataggagggaaaccttt

SEQ ID NO: 1208265 - DNA, 18 bp, Homo sapiens
aatgaaatattgctgtat

SEQ ID NO: 1208266 - DNA, 15 bp, Homo sapiens
aatgaaatgtatgtg

SEQ ID NO: 1208267 - DNA, 21 bp, Homo sapiens
aatgaaattaaaaataaaatt

SEQ ID NO: 1208268 - DNA, 18 bp, Homo sapiens
aatgaacaaaagattgga

SEQ ID NO: 1208269 - DNA, 16 bp, Homo sapiens
aatgaacaaatatgct

SEQ ID NO: 1208270 - DNA, 21 bp, Homo sapiens
aatgaacactcttttgcttta

SEQ ID NO: 1208271 - DNA, 23 bp, Homo sapiens
aatgaacattttgtggagtttgt

SEQ ID NO: 1208272 - DNA, 17 bp, Homo sapiens
aatgaaccccactgggt

SEQ ID NO: 1208273 - DNA, 21 bp, Homo sapiens
aatgaacccccatgatgtaag

SEQ ID NO: 1208274 - DNA, 22 bp, Homo sapiens
aatgaacccccatgatgtaagt

SEQ ID NO: 1208275 - DNA, 18 bp, Homo sapiens
aatgaaccctcctccttt

SEQ ID NO: 1208276 - DNA, 20 bp, Homo sapiens
aatgaactcaagaaggaatt

SEQ ID NO: 1208277 - DNA, 15 bp, Homo sapiens
aatgaactgcttttc

SEQ ID NO: 1208278 - DNA, 16 bp, Homo sapiens
aatgaactgtggaatt

SEQ ID NO: 1208279 - DNA, 14 bp, Homo sapiens
aatgaactttaaaa

SEQ ID NO: 1208280 - DNA, 21 bp, Homo sapiens
aatgaacttttacagaatgca

SEQ ID NO: 1208281 - DNA, 11 bp, Homo sapiens
aatgaagaaag

SEQ ID NO: 1208282 - DNA, 22 bp, Homo sapiens
aatgaagaaagtcaaaaaatta

SEQ ID NO: 1208283 - DNA, 14 bp, Homo sapiens
aatgaagaagtttc

SEQ ID NO: 1208284 - DNA, 23 bp, Homo sapiens
aatgaagaattatgtaatatatt

SEQ ID NO: 1208285 - DNA, 15 bp, Homo sapiens
aatgaagcagcttta

SEQ ID NO: 1208286 - DNA, 16 bp, Homo sapiens
aatgaagcagtatttt

SEQ ID NO: 1208287 - DNA, 12 bp, Homo sapiens
aatgaagggaaa

SEQ ID NO: 1208288 - DNA, 18 bp, Homo sapiens
aatgaagggaaattgttt

SEQ ID NO: 1208289 - DNA, 14 bp, Homo sapiens
aatgaataaactga

SEQ ID NO: 1208290 - DNA, 17 bp, Homo sapiens
aatgaataatggaaaat

SEQ ID NO: 1208291 - DNA, 21 bp, Homo sapiens
aatgaataatttattattaag

SEQ ID NO: 1208292 - DNA, 13 bp, Homo sapiens
aatgaatagcttg

SEQ ID NO: 1208293 - DNA, 14 bp, Homo sapiens
aatgaatgaaacat

SEQ ID NO: 1208294 - DNA, 17 bp, Homo sapiens
aatgaattataacagtt

SEQ ID NO: 1208295 - DNA, 22 bp, Homo sapiens
aatgaattataacagttatatt

SEQ ID NO: 1208296 - DNA, 16 bp, Homo sapiens
aatgaattcctagaat

SEQ ID NO: 1208297 - DNA, 17 bp, Homo sapiens
aatgaattcctagaatt

SEQ ID NO: 1208298 - DNA, 20 bp, Homo sapiens
aatgaattcgatgcgtattc

SEQ ID NO: 1208299 - DNA, 23 bp, Homo sapiens
aatgaattcgatgcgtattctgt

SEQ ID NO: 1208300 - DNA, 19 bp, Homo sapiens
aatgaatttatctttacca

SEQ ID NO: 1208301 - DNA, 13 bp, Homo sapiens
aatgaattttgtt

SEQ ID NO: 1208302 - DNA, 15 bp, Homo sapiens
aatgacaacacttaa

SEQ ID NO: 1208303 - DNA, 20 bp, Homo sapiens
aatgacaacagaaaaacaat

SEQ ID NO: 1208304 - DNA, 14 bp, Homo sapiens
aatgacaacagaag

SEQ ID NO: 1208305 - DNA, 15 bp, Homo sapiens
aatgactgaaagaag

SEQ ID NO: 1208306 - DNA, 21 bp, Homo sapiens
aatgactgccggtcatttgaa

SEQ ID NO: 1208307 - DNA, 19 bp, Homo sapiens
aatgactggggagggctgc

SEQ ID NO: 1208308 - DNA, 14 bp, Homo sapiens
aatgacttactgta

SEQ ID NO: 1208309 - DNA, 18 bp, Homo sapiens
aatgacttactgtacatg

SEQ ID NO: 1208310 - DNA, 15 bp, Homo sapiens
aatgacttagaaact

SEQ ID NO: 1208311 - DNA, 15 bp, Homo sapiens
aatgacttatttctg

SEQ ID NO: 1208312 - DNA, 20 bp, Homo sapiens
aatgacttatttctgctctg

SEQ ID NO: 1208313 - DNA, 19 bp, Homo sapiens
aatgactttatttttctaa

SEQ ID NO: 1208314 - DNA, 15 bp, Homo sapiens
aatgacttttcttaa

SEQ ID NO: 1208315 - DNA, 12 bp, Homo sapiens
aatgagaaaaaa

SEQ ID NO: 1208316 - DNA, 13 bp, Homo sapiens
aatgagaaatgga

SEQ ID NO: 1208317 - DNA, 13 bp, Homo sapiens
aatgagaatctac

SEQ ID NO: 1208318 - DNA, 18 bp, Homo sapiens
aatgagacttactgggtg

SEQ ID NO: 1208319 - DNA, 21 bp, Homo sapiens
aatgagactttctaaatcaaa

SEQ ID NO: 1208320 - DNA, 17 bp, Homo sapiens
aatgagagcgacacaga

SEQ ID NO: 1208321 - DNA, 18 bp, Homo sapiens
aatgagagcgacacagac

SEQ ID NO: 1208322 - DNA, 22 bp, Homo sapiens
aatgagagcgacacagacgtta

SEQ ID NO: 1208323 - DNA, 17 bp, Homo sapiens
aatgagaggttcctaag

SEQ ID NO: 1208324 - DNA, 15 bp, Homo sapiens
aatgagattgaattt

SEQ ID NO: 1208325 - DNA, 16 bp, Homo sapiens
aatgagattgaatttc

SEQ ID NO: 1208326 - DNA, 13 bp, Homo sapiens
aatgagcacctcc

SEQ ID NO: 1208327 - DNA, 17 bp, Homo sapiens
aatgagccatcactaga

SEQ ID NO: 1208328 - DNA, 12 bp, Homo sapiens
aatgagccctgg

SEQ ID NO: 1208329 - DNA, 13 bp, Homo sapiens
aatgagccctggc

SEQ ID NO: 1208330 - DNA, 14 bp, Homo sapiens
aatgagccctggct

SEQ ID NO: 1208331 - DNA, 16 bp, Homo sapiens
aatgagccctggctcc

SEQ ID NO: 1208332 - DNA, 13 bp, Homo sapiens
aatgagcctggca

SEQ ID NO: 1208333 - DNA, 14 bp, Homo sapiens
aatgagcctggcaa

SEQ ID NO: 1208334 - DNA, 18 bp, Homo sapiens
aatgagctagtgtcttat

SEQ ID NO: 1208335 - DNA, 17 bp, Homo sapiens
aatgagcttgattaaat

SEQ ID NO: 1208336 - DNA, 18 bp, Homo sapiens
aatgagcttgattaaatc

SEQ ID NO: 1208337 - DNA, 19 bp, Homo sapiens
aatgagcttgattaaatca

SEQ ID NO: 1208338 - DNA, 21 bp, Homo sapiens
aatgaggaaaccaagataaat

SEQ ID NO: 1208339 - DNA, 13 bp, Homo sapiens
aatgaggaatgta

SEQ ID NO: 1208340 - DNA, 16 bp, Homo sapiens
aatgaggagagaaaat

SEQ ID NO: 1208341 - DNA, 18 bp, Homo sapiens
aatgagggaaatctgtaa

SEQ ID NO: 1208342 - DNA, 21 bp, Homo sapiens
aatgagggaaattgctatttt

SEQ ID NO: 1208343 - DNA, 21 bp, Homo sapiens
aatgagggactggaaccaggg

SEQ ID NO: 1208344 - DNA, 14 bp, Homo sapiens
aatgagggccaaga

SEQ ID NO: 1208345 - DNA, 15 bp, Homo sapiens
aatgagggtttctga

SEQ ID NO: 1208346 - DNA, 23 bp, Homo sapiens
aatgagggtttctgatctgtact

SEQ ID NO: 1208347 - DNA, 19 bp, Homo sapiens
aatgaggtctgaaatggag

SEQ ID NO: 1208348 - DNA, 23 bp, Homo sapiens
aatgaggtgggaggtggaagaag

SEQ ID NO: 1208349 - DNA, 21 bp, Homo sapiens
aatgaggttgggggaaccagc

SEQ ID NO: 1208350 - DNA, 18 bp, Homo sapiens
aatgagtaaaaactagaa

SEQ ID NO: 1208351 - DNA, 17 bp, Homo sapiens
aatgagtcaatcagcct

SEQ ID NO: 1208352 - DNA, 18 bp, Homo sapiens
aatgagtcatttgtttaa

SEQ ID NO: 1208353 - DNA, 21 bp, Homo sapiens
aatgagtcatttgtttaaaca

SEQ ID NO: 1208354 - DNA, 22 bp, Homo sapiens
aatgagtcatttgtttaaacaa

SEQ ID NO: 1208355 - DNA, 18 bp, Homo sapiens
aatgagtggccagcgcca

SEQ ID NO: 1208356 - DNA, 13 bp, Homo sapiens
aatgagtgggaat

SEQ ID NO: 1208357 - DNA, 14 bp, Homo sapiens
aatgagtgggaatc

SEQ ID NO: 1208358 - DNA, 15 bp, Homo sapiens
aatgagttacttaga

SEQ ID NO: 1208359 - DNA, 14 bp, Homo sapiens
aatgataaaataaa

SEQ ID NO: 1208360 - DNA, 22 bp, Homo sapiens
aatgataaaataaataatttta

SEQ ID NO: 1208361 - DNA, 15 bp, Homo sapiens
aatgatagcccagaa

SEQ ID NO: 1208362 - DNA, 17 bp, Homo sapiens
aatgatatgcttgtaac

SEQ ID NO: 1208363 - DNA, 22 bp, Homo sapiens
aatgatatttaggtttttggct

SEQ ID NO: 1208364 - DNA, 14 bp, Homo sapiens
aatgatcaaaacat

SEQ ID NO: 1208365 - DNA, 23 bp, Homo sapiens
aatgatcacatctaaagctttat

SEQ ID NO: 1208366 - DNA, 20 bp, Homo sapiens
aatgatccccagctgtttat

SEQ ID NO: 1208367 - DNA, 22 bp, Homo sapiens
aatgatccccagctgtttatgc

SEQ ID NO: 1208368 - DNA, 13 bp, Homo sapiens
aatgatcttgtgt

SEQ ID NO: 1208369 - DNA, 19 bp, Homo sapiens
aatgatgacaaaaaatgtt

SEQ ID NO: 1208370 - DNA, 13 bp, Homo sapiens
aatgatgagcatt

SEQ ID NO: 1208371 - DNA, 21 bp, Homo sapiens
aatgatgatcctaggcatttg

SEQ ID NO: 1208372 - DNA, 12 bp, Homo sapiens
aatgatgatgac

SEQ ID NO: 1208373 - DNA, 18 bp, Homo sapiens
aatgatgatgataatgat

SEQ ID NO: 1208374 - DNA, 20 bp, Homo sapiens
aatgatgcagctgttgagaa

SEQ ID NO: 1208375 - DNA, 16 bp, Homo sapiens
aatgatggaatttttc

SEQ ID NO: 1208376 - DNA, 19 bp, Homo sapiens
aatgatggcaattttgtaa

SEQ ID NO: 1208377 - DNA, 23 bp, Homo sapiens
aatgatggtgttaaagctgtaca

SEQ ID NO: 1208378 - DNA, 18 bp, Homo sapiens
aatgatgtccagaagaat

SEQ ID NO: 1208379 - DNA, 14 bp, Homo sapiens
aatgatgtgaccct

SEQ ID NO: 1208380 - DNA, 22 bp, Homo sapiens
aatgatgttttaaaaaaatttg

SEQ ID NO: 1208381 - DNA, 13 bp, Homo sapiens
aatgattatattc

SEQ ID NO: 1208382 - DNA, 19 bp, Homo sapiens
aatgattcaaattgctgct

SEQ ID NO: 1208383 - DNA, 20 bp, Homo sapiens
aatgattcaaattgctgctt

SEQ ID NO: 1208384 - DNA, 22 bp, Homo sapiens
aatgattcaaattgctgcttgg

SEQ ID NO: 1208385 - DNA, 13 bp, Homo sapiens
aatgattcagtgt

SEQ ID NO: 1208386 - DNA, 14 bp, Homo sapiens
aatgattcagtgtt

SEQ ID NO: 1208387 - DNA, 22 bp, Homo sapiens
aatgattcagtgttaaatgtga

SEQ ID NO: 1208388 - DNA, 15 bp, Homo sapiens
aatgattccaaataa

SEQ ID NO: 1208389 - DNA, 16 bp, Homo sapiens
aatgattgtgcctctg

SEQ ID NO: 1208390 - DNA, 13 bp, Homo sapiens
aatgatttcatgc

SEQ ID NO: 1208391 - DNA, 21 bp, Homo sapiens
aatgcaaaaattagccgggcg

SEQ ID NO: 1208392 - DNA, 20 bp, Homo sapiens
aatgcaaacacacaaaggta

SEQ ID NO: 1208393 - DNA, 23 bp, Homo sapiens
aatgcaaattaaaacatatttca

SEQ ID NO: 1208394 - DNA, 13 bp, Homo sapiens
aatgcaacagaaa

SEQ ID NO: 1208395 - DNA, 17 bp, Homo sapiens
aatgcaaccatttgaaa

SEQ ID NO: 1208396 - DNA, 18 bp, Homo sapiens
aatgcaaccatttgaaac

SEQ ID NO: 1208397 - DNA, 15 bp, Homo sapiens
aatgcaagcaaagta

SEQ ID NO: 1208398 - DNA, 22 bp, Homo sapiens
aatgcaagcaaagtatcaaaga

SEQ ID NO: 1208399 - DNA, 17 bp, Homo sapiens
aatgcaagctagtggct

SEQ ID NO: 1208400 - DNA, 16 bp, Homo sapiens
aatgcaataattttac

SEQ ID NO: 1208401 - DNA, 16 bp, Homo sapiens
aatgcaatattaatgc

SEQ ID NO: 1208402 - DNA, 24 bp, Homo sapiens
aatgcaatctccccttgatttaaa

SEQ ID NO: 1208403 - DNA, 21 bp, Homo sapiens
aatgcaatgtaagcatacttt

SEQ ID NO: 1208404 - DNA, 13 bp, Homo sapiens
aatgcacactagc

SEQ ID NO: 1208405 - DNA, 16 bp, Homo sapiens
aatgcacctaaagaaa

SEQ ID NO: 1208406 - DNA, 11 bp, Homo sapiens
aatgcactttc

SEQ ID NO: 1208407 - DNA, 22 bp, Homo sapiens
aatgcactttctatcctctgta

SEQ ID NO: 1208408 - DNA, 16 bp, Homo sapiens
aatgcagattcctggg

SEQ ID NO: 1208409 - DNA, 17 bp, Homo sapiens
aatgcagattcctgggc

SEQ ID NO: 1208410 - DNA, 22 bp, Homo sapiens
aatgcagcagggatgccctgga

SEQ ID NO: 1208411 - DNA, 20 bp, Homo sapiens
aatgcagccacgattggaga

SEQ ID NO: 1208412 - DNA, 18 bp, Homo sapiens
aatgcaggtgaacttttt

SEQ ID NO: 1208413 - DNA, 20 bp, Homo sapiens
aatgcagtacaggacatata

SEQ ID NO: 1208414 - DNA, 22 bp, Homo sapiens
aatgcagtcagtgtttctttta

SEQ ID NO: 1208415 - DNA, 13 bp, Homo sapiens
aatgcataatgtt

SEQ ID NO: 1208416 - DNA, 14 bp, Homo sapiens
aatgcatacaagtt

SEQ ID NO: 1208417 - DNA, 18 bp, Homo sapiens
aatgcatacaataaaaga

SEQ ID NO: 1208418 - DNA, 21 bp, Homo sapiens
aatgtacagcaaggagattta

SEQ ID NO: 1208419 - DNA, 23 bp, Homo sapiens
aatgtacagcaaggagatttaca

SEQ ID NO: 1208420 - DNA, 15 bp, Homo sapiens
aatgtacattaatta

SEQ ID NO: 1208421 - DNA, 22 bp, Homo sapiens
aatgtacatttccaaatgaact

SEQ ID NO: 1208422 - DNA, 16 bp, Homo sapiens
aatgtactatgtctga

SEQ ID NO: 1208423 - DNA, 17 bp, Homo sapiens
aatgtactgatttcagt

SEQ ID NO: 1208424 - DNA, 18 bp, Homo sapiens
aatgtactgcatatgaaa

SEQ ID NO: 1208425 - DNA, 14 bp, Homo sapiens
aatgtactgtacat

SEQ ID NO: 1208426 - DNA, 18 bp, Homo sapiens
aatgtactgtacataaat

SEQ ID NO: 1208427 - DNA, 19 bp, Homo sapiens
aatgtactgtacataaatt

SEQ ID NO: 1208428 - DNA, 18 bp, Homo sapiens
aatgtacttgtttgaata

SEQ ID NO: 1208429 - DNA, 18 bp, Homo sapiens
aatgtagaagtctttcag

SEQ ID NO: 1208430 - DNA, 17 bp, Homo sapiens
aatgtagaataggcagg

SEQ ID NO: 1208431 - DNA, 17 bp, Homo sapiens
aatgtagaattgaaaat

SEQ ID NO: 1208432 - DNA, 23 bp, Homo sapiens
aatgtagcgactgtcaacagcgt

SEQ ID NO: 1208433 - DNA, 21 bp, Homo sapiens
aatgtagctggtttcctcatt

SEQ ID NO: 1208434 - DNA, 17 bp, Homo sapiens
aatgtagcttcagtcat

SEQ ID NO: 1208435 - DNA, 13 bp, Homo sapiens
aatgtagcttcca

SEQ ID NO: 1208436 - DNA, 14 bp, Homo sapiens
aatgtagcttccac

SEQ ID NO: 1208437 - DNA, 18 bp, Homo sapiens
aatgtaggcacttttatt

SEQ ID NO: 1208438 - DNA, 20 bp, Homo sapiens
aatgtaggcacttttatttt

SEQ ID NO: 1208439 - DNA, 19 bp, Homo sapiens
aatgtaggcttagtttgtg

SEQ ID NO: 1208440 - DNA, 12 bp, Homo sapiens
aatgtagggcct

SEQ ID NO: 1208441 - DNA, 19 bp, Homo sapiens
aatgtagggttatatttgg

SEQ ID NO: 1208442 - DNA, 19 bp, Homo sapiens
aatgtataaaaattatcaa

SEQ ID NO: 1208443 - DNA, 22 bp, Homo sapiens
aatgtataaaaattatcaaaaa

SEQ ID NO: 1208444 - DNA, 18 bp, Homo sapiens
aatgtataaagattgtac

SEQ ID NO: 1208445 - DNA, 17 bp, Homo sapiens
aatgtataattaactta

SEQ ID NO: 1208446 - DNA, 17 bp, Homo sapiens
aatgtatatttgctgca

SEQ ID NO: 1208447 - DNA, 14 bp, Homo sapiens
aatgtatattttta

SEQ ID NO: 1208448 - DNA, 19 bp, Homo sapiens
aatgtatatttttaaagaa

SEQ ID NO: 1208449 - DNA, 20 bp, Homo sapiens
aatgtatcagccagccttcc

SEQ ID NO: 1208450 - DNA, 19 bp, Homo sapiens
aatgtatcatagaaatgta

SEQ ID NO: 1208451 - DNA, 13 bp, Homo sapiens
aatgtatcatttt

SEQ ID NO: 1208452 - DNA, 19 bp, Homo sapiens
aatgtatcatttttgtgca

SEQ ID NO: 1208453 - DNA, 20 bp, Homo sapiens
aatgtatcatttttgtgcac

SEQ ID NO: 1208454 - DNA, 13 bp, Homo sapiens
aatgtatctaaga

SEQ ID NO: 1208455 - DNA, 21 bp, Homo sapiens
aatgtatctatttgtacaatt

SEQ ID NO: 1208456 - DNA, 17 bp, Homo sapiens
aatgtatctttattaaa

SEQ ID NO: 1208457 - DNA, 21 bp, Homo sapiens
aatgtatctttattaaaacaa

SEQ ID NO: 1208458 - DNA, 13 bp, Homo sapiens
aatgtatgtacaa

SEQ ID NO: 1208459 - DNA, 13 bp, Homo sapiens
aatgtatgtctgg

SEQ ID NO: 1208460 - DNA, 19 bp, Homo sapiens
aatgtatgtgtaagtattc

SEQ ID NO: 1208461 - DNA, 15 bp, Homo sapiens
aatgtatgtgtggct

SEQ ID NO: 1208462 - DNA, 17 bp, Homo sapiens
aatgtatgtgtggctgt

SEQ ID NO: 1208463 - DNA, 13 bp, Homo sapiens
aatgtatgttacc

SEQ ID NO: 1208464 - DNA, 17 bp, Homo sapiens
aatgtatgttaccaaaa

SEQ ID NO: 1208465 - DNA, 21 bp, Homo sapiens
aatgtatgttaccaaaaataa

SEQ ID NO: 1208466 - DNA, 16 bp, Homo sapiens
aatgtattatgagcca

SEQ ID NO: 1208467 - DNA, 18 bp, Homo sapiens
aatgtattattctgcagc

SEQ ID NO: 1208468 - DNA, 13 bp, Homo sapiens
aatgtattcaagc

SEQ ID NO: 1208469 - DNA, 14 bp, Homo sapiens
aatgtattcaagca

SEQ ID NO: 1208470 - DNA, 17 bp, Homo sapiens
aatgtattcaagcaaac

SEQ ID NO: 1208471 - DNA, 19 bp, Homo sapiens
aatgtattcaagcaaacat

SEQ ID NO: 1208472 - DNA, 14 bp, Homo sapiens
aatgtattgattca

SEQ ID NO: 1208473 - DNA, 15 bp, Homo sapiens
aatgtattgattcaa

SEQ ID NO: 1208474 - DNA, 13 bp, Homo sapiens
aatgtatttgaaa

SEQ ID NO: 1208475 - DNA, 17 bp, Homo sapiens
aatgtattttaaaataa

SEQ ID NO: 1208476 - DNA, 20 bp, Homo sapiens
aatgtattttcagctcaatt

SEQ ID NO: 1208477 - DNA, 19 bp, Homo sapiens
aatgtcacaaattgatcaa

SEQ ID NO: 1208478 - DNA, 18 bp, Homo sapiens
aatgtcacaacctctctg

SEQ ID NO: 1208479 - DNA, 17 bp, Homo sapiens
aatgtcacattctattt

SEQ ID NO: 1208480 - DNA, 17 bp, Homo sapiens
aatgtcacatttgaatt

SEQ ID NO: 1208481 - DNA, 18 bp, Homo sapiens
aatgtcacatttgaattc

SEQ ID NO: 1208482 - DNA, 19 bp, Homo sapiens
aatgtcaccaccttcccag

SEQ ID NO: 1208483 - DNA, 20 bp, Homo sapiens
aatgtcaccaccttcccagc

SEQ ID NO: 1208484 - DNA, 17 bp, Homo sapiens
aatgtcactatatcttc

SEQ ID NO: 1208485 - DNA, 10 bp, Homo sapiens
aatgtcactg

SEQ ID NO: 1208486 - DNA, 12 bp, Homo sapiens
aatgtcactgcc

SEQ ID NO: 1208487 - DNA, 17 bp, Homo sapiens
aatgtcactgtagtttt

SEQ ID NO: 1208488 - DNA, 21 bp, Homo sapiens
aatgtcagaaaataacagatg

SEQ ID NO: 1208489 - DNA, 21 bp, Homo sapiens
aatgtcagactttgctgcatt

SEQ ID NO: 1208490 - DNA, 22 bp, Homo sapiens
aatgtcagactttgctgcattt

SEQ ID NO: 1208491 - DNA, 20 bp, Homo sapiens
aatgtcagagctatgttccc

SEQ ID NO: 1208492 - DNA, 16 bp, Homo sapiens
aatgtcagatttctgg

SEQ ID NO: 1208493 - DNA, 16 bp, Homo sapiens
aatgtcagcctttgtt

SEQ ID NO: 1208494 - DNA, 18 bp, Homo sapiens
aatgtcagttctgatatg

SEQ ID NO: 1208495 - DNA, 21 bp, Homo sapiens
aatgtcataaagtgagaaaac

SEQ ID NO: 1208496 - DNA, 23 bp, Homo sapiens
aatgtcataaagtgagaaaactg

SEQ ID NO: 1208497 - DNA, 17 bp, Homo sapiens
aatgtcattacatagaa

SEQ ID NO: 1208498 - DNA, 19 bp, Homo sapiens
aatgtcattgaaaaactaa

SEQ ID NO: 1208499 - DNA, 20 bp, Homo sapiens
aatgtcattgctaaaaaata

SEQ ID NO: 1208500 - DNA, 13 bp, Homo sapiens
aatgtcattgtct

SEQ ID NO: 1208501 - DNA, 22 bp, Homo sapiens
aatgtccaccatgaacttgata

SEQ ID NO: 1208502 - DNA, 19 bp, Homo sapiens
aattaaaacatatttcatt

SEQ ID NO: 1208503 - DNA, 22 bp, Homo sapiens
aattaaaacatatttcatttta

SEQ ID NO: 1208504 - DNA, 21 bp, Homo sapiens
aattaaaagcaaatcatttgt

SEQ ID NO: 1208505 - DNA, 16 bp, Homo sapiens
aattaaaagtcttttt

SEQ ID NO: 1208506 - DNA, 17 bp, Homo sapiens
aattaaaataaaacaca

SEQ ID NO: 1208507 - DNA, 12 bp, Homo sapiens
aattaaaatagg

SEQ ID NO: 1208508 - DNA, 23 bp, Homo sapiens
aattaaaatattatttgatatct

SEQ ID NO: 1208509 - DNA, 13 bp, Homo sapiens
aattaaaatggat

SEQ ID NO: 1208510 - DNA, 14 bp, Homo sapiens
aattaaacatgaaa

SEQ ID NO: 1208511 - DNA, 16 bp, Homo sapiens
aattaaacatgctgtt

SEQ ID NO: 1208512 - DNA, 14 bp, Homo sapiens
aattaaactaaaga

SEQ ID NO: 1208513 - DNA, 21 bp, Homo sapiens
aattaaacttccaaagaaagt

SEQ ID NO: 1208514 - DNA, 22 bp, Homo sapiens
aattaaacttccaaagaaagtt

SEQ ID NO: 1208515 - DNA, 13 bp, Homo sapiens
aattaaagaaatg

SEQ ID NO: 1208516 - DNA, 14 bp, Homo sapiens
aattaaagaaatga

SEQ ID NO: 1208517 - DNA, 15 bp, Homo sapiens
aattaaagatgccat

SEQ ID NO: 1208518 - DNA, 18 bp, Homo sapiens
aattaaagatgccatagc

SEQ ID NO: 1208519 - DNA, 20 bp, Homo sapiens
aattaaagatgccatagcat

SEQ ID NO: 1208520 - DNA, 23 bp, Homo sapiens
aattaaagatgccatagcataat

SEQ ID NO: 1208521 - DNA, 14 bp, Homo sapiens
aattaaagtacttt

SEQ ID NO: 1208522 - DNA, 17 bp, Homo sapiens
aattaaagtatgcaaaa

SEQ ID NO: 1208523 - DNA, 15 bp, Homo sapiens
aattaaatagtgtga

SEQ ID NO: 1208524 - DNA, 14 bp, Homo sapiens
aattaaatatatgt

SEQ ID NO: 1208525 - DNA, 16 bp, Homo sapiens
aattaaatctctttaa

SEQ ID NO: 1208526 - DNA, 19 bp, Homo sapiens
aattaaatgccttgtataa

SEQ ID NO: 1208527 - DNA, 12 bp, Homo sapiens
aattaaatgtag

SEQ ID NO: 1208528 - DNA, 14 bp, Homo sapiens
aattaaatgtattt

SEQ ID NO: 1208529 - DNA, 17 bp, Homo sapiens
aattaaatgtatttaat

SEQ ID NO: 1208530 - DNA, 18 bp, Homo sapiens
aattaacacagtgtttca

SEQ ID NO: 1208531 - DNA, 16 bp, Homo sapiens
aattaaccatttaata

SEQ ID NO: 1208532 - DNA, 22 bp, Homo sapiens
aattaaccatttaataaagaaa

SEQ ID NO: 1208533 - DNA, 15 bp, Homo sapiens
aattaacctggtgct

SEQ ID NO: 1208534 - DNA, 16 bp, Homo sapiens
aattaacctggtgctg

SEQ ID NO: 1208535 - DNA, 21 bp, Homo sapiens
aattaactgggtaatgaaaca

SEQ ID NO: 1208536 - DNA, 11 bp, Homo sapiens
aattaactgta

SEQ ID NO: 1208537 - DNA, 12 bp, Homo sapiens
aattaactgtat

SEQ ID NO: 1208538 - DNA, 17 bp, Homo sapiens
aattaacttacttccaa

SEQ ID NO: 1208539 - DNA, 17 bp, Homo sapiens
aattaacttgagtttta

SEQ ID NO: 1208540 - DNA, 13 bp, Homo sapiens
aattaacttttat

SEQ ID NO: 1208541 - DNA, 18 bp, Homo sapiens
aattaacttttataaact

SEQ ID NO: 1208542 - DNA, 20 bp, Homo sapiens
aattaacttttataaacttt

SEQ ID NO: 1208543 - DNA, 20 bp, Homo sapiens
aattaagaaatactcatgtg

SEQ ID NO: 1208544 - DNA, 19 bp, Homo sapiens
aattaagaaggcaaaaatg

SEQ ID NO: 1208545 - DNA, 23 bp, Homo sapiens
aattaagaaggcaaaaatgtaaa

SEQ ID NO: 1208546 - DNA, 13 bp, Homo sapiens
aattaagacaaaa

SEQ ID NO: 1208547 - DNA, 18 bp, Homo sapiens
aattaagacaaaaagcct

SEQ ID NO: 1208548 - DNA, 18 bp, Homo sapiens
aattaagatcctaaactc

SEQ ID NO: 1208549 - DNA, 22 bp, Homo sapiens
aattaagatcctaaactctcta

SEQ ID NO: 1208550 - DNA, 16 bp, Homo sapiens
aattaaggcataagaa

SEQ ID NO: 1208551 - DNA, 12 bp, Homo sapiens
aattaagttgaa

SEQ ID NO: 1208552 - DNA, 14 bp, Homo sapiens
aattaagttgaaaa

SEQ ID NO: 1208553 - DNA, 12 bp, Homo sapiens
aattaataaatt

SEQ ID NO: 1208554 - DNA, 15 bp, Homo sapiens
aattaatacattcta

SEQ ID NO: 1208555 - DNA, 17 bp, Homo sapiens
aattaatagcttttgat

SEQ ID NO: 1208556 - DNA, 20 bp, Homo sapiens
aattaatagtttgtctattt

SEQ ID NO: 1208557 - DNA, 13 bp, Homo sapiens
aattaatatcttt

SEQ ID NO: 1208558 - DNA, 16 bp, Homo sapiens
aattaatgaaatgata

SEQ ID NO: 1208559 - DNA, 21 bp, Homo sapiens
aattaatgaaatgataaagac

SEQ ID NO: 1208560 - DNA, 16 bp, Homo sapiens
aattaatggaatcttc

SEQ ID NO: 1208561 - DNA, 13 bp, Homo sapiens
aattaattaagta

SEQ ID NO: 1208562 - DNA, 12 bp, Homo sapiens
aattaattgtaa

SEQ ID NO: 1208563 - DNA, 15 bp, Homo sapiens
aattaattgtcatta

SEQ ID NO: 1208564 - DNA, 14 bp, Homo sapiens
aattaatttgtgaa

SEQ ID NO: 1208565 - DNA, 13 bp, Homo sapiens
aattaattttact

SEQ ID NO: 1208566 - DNA, 23 bp, Homo sapiens
aattacacagtaagtcatttaac

SEQ ID NO: 1208567 - DNA, 16 bp, Homo sapiens
aattacacttgtcttt

SEQ ID NO: 1208568 - DNA, 15 bp, Homo sapiens
aattacatacagatt

SEQ ID NO: 1208569 - DNA, 13 bp, Homo sapiens
aattcctaacttt

SEQ ID NO: 1208570 - DNA, 15 bp, Homo sapiens
aattcctacagcact

SEQ ID NO: 1208571 - DNA, 19 bp, Homo sapiens
aattcctacagcactactg

SEQ ID NO: 1208572 - DNA, 22 bp, Homo sapiens
aattcctatacgcagcgtgctt

SEQ ID NO: 1208573 - DNA, 18 bp, Homo sapiens
aattcctctttgctttgc

SEQ ID NO: 1208574 - DNA, 22 bp, Homo sapiens
aattccttcgaaaggccttcag

SEQ ID NO: 1208575 - DNA, 23 bp, Homo sapiens
aattccttcgaaaggccttcaga

SEQ ID NO: 1208576 - DNA, 14 bp, Homo sapiens
aattcggggcctgc

SEQ ID NO: 1208577 - DNA, 20 bp, Homo sapiens
aattcggtgtgctgccaact

SEQ ID NO: 1208578 - DNA, 23 bp, Homo sapiens
aattcgtacataataagtttcat

SEQ ID NO: 1208579 - DNA, 18 bp, Homo sapiens
aattcgtgttatgaatct

SEQ ID NO: 1208580 - DNA, 19 bp, Homo sapiens
aattctaagttatttactt

SEQ ID NO: 1208581 - DNA, 21 bp, Homo sapiens
aattctacctccttgtgttgc

SEQ ID NO: 1208582 - DNA, 18 bp, Homo sapiens
aattctagtattttatct

SEQ ID NO: 1208583 - DNA, 14 bp, Homo sapiens
aattctatgttaaa

SEQ ID NO: 1208584 - DNA, 13 bp, Homo sapiens
aattctatttctc

SEQ ID NO: 1208585 - DNA, 15 bp, Homo sapiens
aattctatttctcta

SEQ ID NO: 1208586 - DNA, 16 bp, Homo sapiens
aattctatttctctat

SEQ ID NO: 1208587 - DNA, 18 bp, Homo sapiens
aattctcattaaaagaat

SEQ ID NO: 1208588 - DNA, 22 bp, Homo sapiens
aattctccaggattttaatttc

SEQ ID NO: 1208589 - DNA, 20 bp, Homo sapiens
aattctcctgcctcagcctc

SEQ ID NO: 1208590 - DNA, 15 bp, Homo sapiens
aattctctagtttga

SEQ ID NO: 1208591 - DNA, 23 bp, Homo sapiens
aattctctccccctatttattga

SEQ ID NO: 1208592 - DNA, 13 bp, Homo sapiens
aattctctgttcc

SEQ ID NO: 1208593 - DNA, 18 bp, Homo sapiens
aattctctgttccttttg

SEQ ID NO: 1208594 - DNA, 15 bp, Homo sapiens
aattctcttaaataa

SEQ ID NO: 1208595 - DNA, 23 bp, Homo sapiens
aattctcttaatcactactgtat

SEQ ID NO: 1208596 - DNA, 15 bp, Homo sapiens
aattctcttatccaa

SEQ ID NO: 1208597 - DNA, 12 bp, Homo sapiens
aattctctttct

SEQ ID NO: 1208598 - DNA, 15 bp, Homo sapiens
aattctgaaacaact

SEQ ID NO: 1208599 - DNA, 16 bp, Homo sapiens
aattctgaaatacttt

SEQ ID NO: 1208600 - DNA, 13 bp, Homo sapiens
aattctgactgtc

SEQ ID NO: 1208601 - DNA, 15 bp, Homo sapiens
aattctgactgtcca

SEQ ID NO: 1208602 - DNA, 17 bp, Homo sapiens
aattctgagttttgtgt

SEQ ID NO: 1208603 - DNA, 16 bp, Homo sapiens
aattctgcatgtacta

SEQ ID NO: 1208604 - DNA, 14 bp, Homo sapiens
aattctgccttggt

SEQ ID NO: 1208605 - DNA, 23 bp, Homo sapiens
aattctgccttggttctggccac

SEQ ID NO: 1208606 - DNA, 13 bp, Homo sapiens
aattctggaagct

SEQ ID NO: 1208607 - DNA, 17 bp, Homo sapiens
aattctggaagctgatt

SEQ ID NO: 1208608 - DNA, 19 bp, Homo sapiens
aattctgtaattacatatt

SEQ ID NO: 1208609 - DNA, 11 bp, Homo sapiens
aattctgtccc

SEQ ID NO: 1208610 - DNA, 12 bp, Homo sapiens
aattctgtccct

SEQ ID NO: 1208611 - DNA, 20 bp, Homo sapiens
aattctgtcttgttcatttt

SEQ ID NO: 1208612 - DNA, 16 bp, Homo sapiens
aattctgtgccttgtt

SEQ ID NO: 1208613 - DNA, 22 bp, Homo sapiens
aattctgttggtgccacgcttt

SEQ ID NO: 1208614 - DNA, 22 bp, Homo sapiens
aattctgttgttccattttatg

SEQ ID NO: 1208615 - DNA, 21 bp, Homo sapiens
aattctgtttttaatgctatt

SEQ ID NO: 1208616 - DNA, 18 bp, Homo sapiens
aattctgtttttctaggc

SEQ ID NO: 1208617 - DNA, 15 bp, Homo sapiens
aattcttacatgttt

SEQ ID NO: 1208618 - DNA, 14 bp, Homo sapiens
aattcttatgctta

SEQ ID NO: 1208619 - DNA, 23 bp, Homo sapiens
aattcttcacctaagtctctgtg

SEQ ID NO: 1208620 - DNA, 21 bp, Homo sapiens
aattcttccaaaggatcttat

SEQ ID NO: 1208621 - DNA, 16 bp, Homo sapiens
aattcttcctcctctg

SEQ ID NO: 1208622 - DNA, 15 bp, Homo sapiens
aattcttcctctcct

SEQ ID NO: 1208623 - DNA, 20 bp, Homo sapiens
aattcttcctctccttccca

SEQ ID NO: 1208624 - DNA, 13 bp, Homo sapiens
aattcttgaagtt

SEQ ID NO: 1208625 - DNA, 16 bp, Homo sapiens
aattcttgatctctaa

SEQ ID NO: 1208626 - DNA, 19 bp, Homo sapiens
aattcttgatctctaatga

SEQ ID NO: 1208627 - DNA, 20 bp, Homo sapiens
aattcttgcaaagtatccct

SEQ ID NO: 1208628 - DNA, 19 bp, Homo sapiens
aattcttggttgaggaaac

SEQ ID NO: 1208629 - DNA, 14 bp, Homo sapiens
aattcttgtatatt

SEQ ID NO: 1208630 - DNA, 16 bp, Homo sapiens
aattcttgtatattat

SEQ ID NO: 1208631 - DNA, 23 bp, Homo sapiens
aattcttttatctttattttagt

SEQ ID NO: 1208632 - DNA, 14 bp, Homo sapiens
aattcttttctgag

SEQ ID NO: 1208633 - DNA, 14 bp, Homo sapiens
aattgaaaatgcat

SEQ ID NO: 1208634 - DNA, 15 bp, Homo sapiens
aattgaaagaactta

SEQ ID NO: 1208635 - DNA, 22 bp, Homo sapiens
aattgaaaggcattctctgaag

SEQ ID NO: 1208636 - DNA, 17 bp, Homo sapiens
aattgaaagtattcaga

SEQ ID NO: 1208637 - DNA, 15 bp, Homo sapiens
aattgaaatgtaagg

SEQ ID NO: 1208638 - DNA, 18 bp, Homo sapiens
aattgaacgactgtatat

SEQ ID NO: 1208639 - DNA, 23 bp, Homo sapiens
aattgaacgactgtatattgcta

SEQ ID NO: 1208640 - DNA, 23 bp, Homo sapiens
aattgaactctctgcctgtaaat

SEQ ID NO: 1208641 - DNA, 18 bp, Homo sapiens
aattgaagtaaacttttt

SEQ ID NO: 1208642 - DNA, 16 bp, Homo sapiens
aattgaagtgtcttct

SEQ ID NO: 1208643 - DNA, 16 bp, Homo sapiens
aattgaagtttcaagt

SEQ ID NO: 1208644 - DNA, 20 bp, Homo sapiens
aattgaagtttcaagtttta

SEQ ID NO: 1208645 - DNA, 21 bp, Homo sapiens
aattgacataggcaataataa

SEQ ID NO: 1208646 - DNA, 18 bp, Homo sapiens
aattgacattgaaatcta

SEQ ID NO: 1208647 - DNA, 18 bp, Homo sapiens
aattgaccatctgctttt

SEQ ID NO: 1208648 - DNA, 19 bp, Homo sapiens
aattgaccatctgctttta

SEQ ID NO: 1208649 - DNA, 17 bp, Homo sapiens
aattgaccctagccaga

SEQ ID NO: 1208650 - DNA, 11 bp, Homo sapiens
aattgactacc

SEQ ID NO: 1208651 - DNA, 14 bp, Homo sapiens
aattgacttagata

SEQ ID NO: 1208652 - DNA, 21 bp, Homo sapiens
aattgacttagatattaaaat

SEQ ID NO: 1208653 - DNA, 14 bp, Homo sapiens
aattgacttattta

SEQ ID NO: 1208654 - DNA, 18 bp, Homo sapiens
aattgagggcccgggacg

SEQ ID NO: 1208655 - DNA, 22 bp, Homo sapiens
aattgagtagctgcatgctgtt

SEQ ID NO: 1208656 - DNA, 21 bp, Homo sapiens
aattgagtgcactaaacaaat

SEQ ID NO: 1208657 - DNA, 19 bp, Homo sapiens
aattgatacttcaggtgct

SEQ ID NO: 1208658 - DNA, 15 bp, Homo sapiens
aattgatagcagata

SEQ ID NO: 1208659 - DNA, 22 bp, Homo sapiens
aattgatcataggtatttcaaa

SEQ ID NO: 1208660 - DNA, 15 bp, Homo sapiens
aattgatgtatatgt

SEQ ID NO: 1208661 - DNA, 18 bp, Homo sapiens
aattgattaaaatctctt

SEQ ID NO: 1208662 - DNA, 22 bp, Homo sapiens
aattgattattctgattccact

SEQ ID NO: 1208663 - DNA, 12 bp, Homo sapiens
aattgatttctt

SEQ ID NO: 1208664 - DNA, 14 bp, Homo sapiens
aattgatttgcatt

SEQ ID NO: 1208665 - DNA, 15 bp, Homo sapiens
aattgatttgttatg

SEQ ID NO: 1208666 - DNA, 22 bp, Homo sapiens
aattgatttttctcttcatttt

SEQ ID NO: 1208667 - DNA, 20 bp, Homo sapiens
aattgcacaccttggaattc

SEQ ID NO: 1208668 - DNA, 22 bp, Homo sapiens
aattgcacgcggagtgagtttt

SEQ ID NO: 1208669 - DNA, 18 bp, Homo sapiens
aattgcacttttaaacct

SEQ ID NO: 1208670 - DNA, 17 bp, Homo sapiens
aattgcatgaaactagg

SEQ ID NO: 1208671 - DNA, 11 bp, Homo sapiens
aattgcattga

SEQ ID NO: 1208672 - DNA, 17 bp, Homo sapiens
aattgccagcaaataaa

SEQ ID NO: 1208673 - DNA, 19 bp, Homo sapiens
aattgctagtcagggtgaa

SEQ ID NO: 1208674 - DNA, 14 bp, Homo sapiens
aattgctatgttac

SEQ ID NO: 1208675 - DNA, 19 bp, Homo sapiens
aattgctatgttactattt

SEQ ID NO: 1208676 - DNA, 21 bp, Homo sapiens
aattgctatgttactattttc

SEQ ID NO: 1208677 - DNA, 15 bp, Homo sapiens
aattgctattttatt

SEQ ID NO: 1208678 - DNA, 22 bp, Homo sapiens
aattgctattttatttgtattc

SEQ ID NO: 1208679 - DNA, 18 bp, Homo sapiens
aattgctcataagcaata

SEQ ID NO: 1208680 - DNA, 20 bp, Homo sapiens
aattgcttacatttttacaa

SEQ ID NO: 1208681 - DNA, 19 bp, Homo sapiens
aattgcttactcattaaaa

SEQ ID NO: 1208682 - DNA, 13 bp, Homo sapiens
aattgcttctgtg

SEQ ID NO: 1208683 - DNA, 10 bp, Homo sapiens
aattgctttg

SEQ ID NO: 1208684 - DNA, 20 bp, Homo sapiens
aattggaagctgccctgccc

SEQ ID NO: 1208685 - DNA, 18 bp, Homo sapiens
aattggaagtctaagaac

SEQ ID NO: 1208686 - DNA, 10 bp, Homo sapiens
aattggaatc

SEQ ID NO: 1208687 - DNA, 18 bp, Homo sapiens
aattggaatcttcacctc

SEQ ID NO: 1208688 - DNA, 11 bp, Homo sapiens
aattggatttc

SEQ ID NO: 1208689 - DNA, 15 bp, Homo sapiens
aattggcagtgactt

SEQ ID NO: 1208690 - DNA, 18 bp, Homo sapiens
aattggcataatttgtct

SEQ ID NO: 1208691 - DNA, 16 bp, Homo sapiens
aattgggacaacagtg

SEQ ID NO: 1208692 - DNA, 19 bp, Homo sapiens
aattgggagtccaggcaca

SEQ ID NO: 1208693 - DNA, 18 bp, Homo sapiens
aattgggatctgtcttgg

SEQ ID NO: 1208694 - DNA, 20 bp, Homo sapiens
aatttagagcgtttggttaa

SEQ ID NO: 1208695 - DNA, 19 bp, Homo sapiens
aatttagcaaactgatgct

SEQ ID NO: 1208696 - DNA, 22 bp, Homo sapiens
aatttagcaaactgatgctgag

SEQ ID NO: 1208697 - DNA, 18 bp, Homo sapiens
aatttaggtttttattag

SEQ ID NO: 1208698 - DNA, 15 bp, Homo sapiens
aatttagtaaatgtt

SEQ ID NO: 1208699 - DNA, 18 bp, Homo sapiens
aatttagtacactatgtt

SEQ ID NO: 1208700 - DNA, 22 bp, Homo sapiens
aatttagtgtttttttatttct

SEQ ID NO: 1208701 - DNA, 22 bp, Homo sapiens
aatttataaactaattttgtac

SEQ ID NO: 1208702 - DNA, 21 bp, Homo sapiens
aatttggagcacaaaattcaa

SEQ ID NO: 1208703 - DNA, 15 bp, Homo sapiens
aatttggagcattaa

SEQ ID NO: 1208704 - DNA, 21 bp, Homo sapiens
aatttggataataaaaattgt

SEQ ID NO: 1208705 - DNA, 23 bp, Homo sapiens
aatttggatttaaaagcctgctc

SEQ ID NO: 1208706 - DNA, 14 bp, Homo sapiens
aatttggcaaaaca

SEQ ID NO: 1208707 - DNA, 14 bp, Homo sapiens
aatttggccttaag

SEQ ID NO: 1208708 - DNA, 18 bp, Homo sapiens
aatttggccttaagaact

SEQ ID NO: 1208709 - DNA, 12 bp, Homo sapiens
aatttggctgct

SEQ ID NO: 1208710 - DNA, 17 bp, Homo sapiens
aatttgggatactaaag

SEQ ID NO: 1208711 - DNA, 19 bp, Homo sapiens
aatttgggcctcttgtaca

SEQ ID NO: 1208712 - DNA, 18 bp, Homo sapiens
aatttgggggaaaattta

SEQ ID NO: 1208713 - DNA, 14 bp, Homo sapiens
aatttggtataatt

SEQ ID NO: 1208714 - DNA, 22 bp, Homo sapiens
aatttggttctaatagaactca

SEQ ID NO: 1208715 - DNA, 23 bp, Homo sapiens
aatttgtaaaaacagcattgctt

SEQ ID NO: 1208716 - DNA, 13 bp, Homo sapiens
acaaagactgagt

SEQ ID NO: 1208717 - DNA, 14 bp, Homo sapiens
acaaagagaaaaag

SEQ ID NO: 1208718 - DNA, 20 bp, Homo sapiens
acaaagagaaaaagaaatgc

SEQ ID NO: 1208719 - DNA, 15 bp, Homo sapiens
acaaagcacagtgtt

SEQ ID NO: 1208720 - DNA, 16 bp, Homo sapiens
acaaagcacagtttga

SEQ ID NO: 1208721 - DNA, 19 bp, Homo sapiens
acaaagcacataactggat

SEQ ID NO: 1208722 - DNA, 12 bp, Homo sapiens
acaaagcagcca

SEQ ID NO: 1208723 - DNA, 13 bp, Homo sapiens
acaaagcaggagt

SEQ ID NO: 1208724 - DNA, 18 bp, Homo sapiens
acaaagccaaacaaaact

SEQ ID NO: 1208725 - DNA, 15 bp, Homo sapiens
acaaagccattcttt

SEQ ID NO: 1208726 - DNA, 13 bp, Homo sapiens
acaaagcccaagg

SEQ ID NO: 1208727 - DNA, 15 bp, Homo sapiens
acaaagcccttttat

SEQ ID NO: 1208728 - DNA, 18 bp, Homo sapiens
acaaagcggctttctaat

SEQ ID NO: 1208729 - DNA, 18 bp, Homo sapiens
acaaagcgtttctttact

SEQ ID NO: 1208730 - DNA, 20 bp, Homo sapiens
acaaagcgtttctttacttc

SEQ ID NO: 1208731 - DNA, 19 bp, Homo sapiens
acaaagctgttaaactgtt

SEQ ID NO: 1208732 - DNA, 22 bp, Homo sapiens
acaaagcttctatcccaggagg

SEQ ID NO: 1208733 - DNA, 20 bp, Homo sapiens
acaaagctttgctacaaatt

SEQ ID NO: 1208734 - DNA, 13 bp, Homo sapiens
acaaaggaactaa

SEQ ID NO: 1208735 - DNA, 13 bp, Homo sapiens
acaaaggagcctt

SEQ ID NO: 1208736 - DNA, 22 bp, Homo sapiens
acaaaggagccttgataatact

SEQ ID NO: 1208737 - DNA, 22 bp, Homo sapiens
acaaaggtgaaaattgtttgta

SEQ ID NO: 1208738 - DNA, 24 bp, Homo sapiens
acaaaggtggaataaacattaatt

SEQ ID NO: 1208739 - DNA, 14 bp, Homo sapiens
acaaagtaattcct

SEQ ID NO: 1208740 - DNA, 16 bp, Homo sapiens
acaaagtaatttggaa

SEQ ID NO: 1208741 - DNA, 16 bp, Homo sapiens
acaaagtactctttaa

SEQ ID NO: 1208742 - DNA, 17 bp, Homo sapiens
acaaagtgccgtgataa

SEQ ID NO: 1208743 - DNA, 11 bp, Homo sapiens
acaaagtgcct

SEQ ID NO: 1208744 - DNA, 17 bp, Homo sapiens
acaaagtgggtgtgtgg

SEQ ID NO: 1208745 - DNA, 12 bp, Homo sapiens
acaaagtgtgta

SEQ ID NO: 1208746 - DNA, 16 bp, Homo sapiens
acaaagtgttgaaaat

SEQ ID NO: 1208747 - DNA, 19 bp, Homo sapiens
acaaagttccaaaatgcca

SEQ ID NO: 1208748 - DNA, 16 bp, Homo sapiens
acaaagttctcagagc

SEQ ID NO: 1208749 - DNA, 19 bp, Homo sapiens
acaaagtttacattgtcct

SEQ ID NO: 1208750 - DNA, 14 bp, Homo sapiens
acaaagtttcagag

SEQ ID NO: 1208751 - DNA, 12 bp, Homo sapiens
acaaataaaagt

SEQ ID NO: 1208752 - DNA, 12 bp, Homo sapiens
acaaataaacag

SEQ ID NO: 1208753 - DNA, 13 bp, Homo sapiens
acaaataatcaca

SEQ ID NO: 1208754 - DNA, 13 bp, Homo sapiens
acaaataatttag

SEQ ID NO: 1208755 - DNA, 14 bp, Homo sapiens
acaaataatttaga

SEQ ID NO: 1208756 - DNA, 14 bp, Homo sapiens
acaaatacagatga

SEQ ID NO: 1208757 - DNA, 15 bp, Homo sapiens
acaaatactcttagg

SEQ ID NO: 1208758 - DNA, 14 bp, Homo sapiens
acaaatagattttt

SEQ ID NO: 1208759 - DNA, 23 bp, Homo sapiens
acaaataggagtgagtgtatgtg

SEQ ID NO: 1208760 - DNA, 19 bp, Homo sapiens
acaaatataagaataaaat

SEQ ID NO: 1208761 - DNA, 14 bp, Homo sapiens
acaaatatattata

SEQ ID NO: 1208762 - DNA, 22 bp, Homo sapiens
acaaatatgaaaaatgtaaata

SEQ ID NO: 1208763 - DNA, 11 bp, Homo sapiens
acaaatatgca

SEQ ID NO: 1208764 - DNA, 19 bp, Homo sapiens
acaaatatgcaaaaggttc

SEQ ID NO: 1208765 - DNA, 21 bp, Homo sapiens
acaaatattatttgtgtttcc

SEQ ID NO: 1208766 - DNA, 21 bp, Homo sapiens
acaaatattggtgttgtcagt

SEQ ID NO: 1208767 - DNA, 19 bp, Homo sapiens
acaaatattttagaagcta

SEQ ID NO: 1208768 - DNA, 23 bp, Homo sapiens
acaaatcaacagaagcatttgta

SEQ ID NO: 1208769 - DNA, 14 bp, Homo sapiens
acaaatcagaagtc

SEQ ID NO: 1208770 - DNA, 20 bp, Homo sapiens
acaaatcagaagtcatcttg

SEQ ID NO: 1208771 - DNA, 12 bp, Homo sapiens
acaaatcagtaa

SEQ ID NO: 1208772 - DNA, 17 bp, Homo sapiens
acaaatcgtttctcaga

SEQ ID NO: 1208773 - DNA, 14 bp, Homo sapiens
acaaatgaaaatga

SEQ ID NO: 1208774 - DNA, 15 bp, Homo sapiens
acaaatgaagaaagt

SEQ ID NO: 1208775 - DNA, 15 bp, Homo sapiens
acaaatgacactgca

SEQ ID NO: 1208776 - DNA, 18 bp, Homo sapiens
acaaatgcatgaacaagt

SEQ ID NO: 1208777 - DNA, 17 bp, Homo sapiens
acaaatgggcgcccccc

SEQ ID NO: 1208778 - DNA, 22 bp, Homo sapiens
acaaatgggcgcccccccctcc

SEQ ID NO: 1208779 - DNA, 15 bp, Homo sapiens
acaaatgtcattgtc

SEQ ID NO: 1208780 - DNA, 18 bp, Homo sapiens
acaaatgtcattgtctac

SEQ ID NO: 1208781 - DNA, 22 bp, Homo sapiens
acaaatgtgtatcggatgcttt

SEQ ID NO: 1208782 - DNA, 22 bp, Homo sapiens
acaaatgtgtgggtttttaaaa

SEQ ID NO: 1208783 - DNA, 18 bp, Homo sapiens
acaaatgtgtttttctat

SEQ ID NO: 1208784 - DNA, 21 bp, Homo sapiens
acaaatgtgtttttctatata

SEQ ID NO: 1208785 - DNA, 21 bp, Homo sapiens
acaaatgtttataactctagg

SEQ ID NO: 1208786 - DNA, 23 bp, Homo sapiens
acaaatgtttataactctaggga

SEQ ID NO: 1208787 - DNA, 16 bp, Homo sapiens
acaaattagcatgcaa

SEQ ID NO: 1208788 - DNA, 18 bp, Homo sapiens
acaaattagcatgcaagc

SEQ ID NO: 1208789 - DNA, 22 bp, Homo sapiens
acaaattatgttacatctgttt

SEQ ID NO: 1208790 - DNA, 22 bp, Homo sapiens
acaaattcaagagctagaaaaa

SEQ ID NO: 1208791 - DNA, 15 bp, Homo sapiens
acaaattcagtctct

SEQ ID NO: 1208792 - DNA, 19 bp, Homo sapiens
acaaattcagtctctgaat

SEQ ID NO: 1208793 - DNA, 23 bp, Homo sapiens
acaaattccgattagacctttat

SEQ ID NO: 1208794 - DNA, 20 bp, Homo sapiens
acaaatttggccttaagaac

SEQ ID NO: 1208795 - DNA, 22 bp, Homo sapiens
acaaatttggccttaagaactg

SEQ ID NO: 1208796 - DNA, 23 bp, Homo sapiens
acaaatttggccttaagaactgt

SEQ ID NO: 1208797 - DNA, 20 bp, Homo sapiens
acaaattttgtataactttt

SEQ ID NO: 1208798 - DNA, 17 bp, Homo sapiens
acaacaaaaagcttccc

SEQ ID NO: 1208799 - DNA, 15 bp, Homo sapiens
acaacaacctggtca

SEQ ID NO: 1208800 - DNA, 13 bp, Homo sapiens
acaacaagagttt

SEQ ID NO: 1208801 - DNA, 22 bp, Homo sapiens
acaacaccttcctcctgcagac

SEQ ID NO: 1208802 - DNA, 21 bp, Homo sapiens
acaacactgattcctggagag

SEQ ID NO: 1208803 - DNA, 14 bp, Homo sapiens
acaacagaaaaaca

SEQ ID NO: 1208804 - DNA, 15 bp, Homo sapiens
acaacagaaaaacaa

SEQ ID NO: 1208805 - DNA, 16 bp, Homo sapiens
acaacagaaaaacaat

SEQ ID NO: 1208806 - DNA, 12 bp, Homo sapiens
acaacagactga

SEQ ID NO: 1208807 - DNA, 22 bp, Homo sapiens
acaacagagtgaaaaatcttaa

SEQ ID NO: 1208808 - DNA, 18 bp, Homo sapiens
acaacagcaaaccctgat

SEQ ID NO: 1208809 - DNA, 12 bp, Homo sapiens
acaacagcccag

SEQ ID NO: 1208810 - DNA, 16 bp, Homo sapiens
acaacagccctgcctg

SEQ ID NO: 1208811 - DNA, 13 bp, Homo sapiens
acaacagcctggg

SEQ ID NO: 1208812 - DNA, 23 bp, Homo sapiens
acaacagctctcgttctccttcc

SEQ ID NO: 1208813 - DNA, 14 bp, Homo sapiens
acaacaggagagag

SEQ ID NO: 1208814 - DNA, 16 bp, Homo sapiens
acaacaggcccttggg

SEQ ID NO: 1208815 - DNA, 16 bp, Homo sapiens
acaacaggtaaaacag

SEQ ID NO: 1208816 - DNA, 20 bp, Homo sapiens
acaacagtgctttgtaaatt

SEQ ID NO: 1208817 - DNA, 22 bp, Homo sapiens
acaacagttctgagctgtaatt

SEQ ID NO: 1208818 - DNA, 20 bp, Homo sapiens
acaacatcagaaagaattga

SEQ ID NO: 1208819 - DNA, 17 bp, Homo sapiens
acaacatcccacagtgg

SEQ ID NO: 1208820 - DNA, 18 bp, Homo sapiens
acaacatttagtttaaac

SEQ ID NO: 1208821 - DNA, 20 bp, Homo sapiens
acaacatttctatagccaaa

SEQ ID NO: 1208822 - DNA, 15 bp, Homo sapiens
acaaccactggtctg

SEQ ID NO: 1208823 - DNA, 14 bp, Homo sapiens
acaaccattccaga

SEQ ID NO: 1208824 - DNA, 18 bp, Homo sapiens
acaaccccctccaccccc

SEQ ID NO: 1208825 - DNA, 19 bp, Homo sapiens
acaaccctgaccgtgaccg

SEQ ID NO: 1208826 - DNA, 14 bp, Homo sapiens
acaaccctggcctc

SEQ ID NO: 1208827 - DNA, 15 bp, Homo sapiens
acaaccctggcctca

SEQ ID NO: 1208828 - DNA, 17 bp, Homo sapiens
acaaccctgttttatac

SEQ ID NO: 1208829 - DNA, 19 bp, Homo sapiens
acaaccgtcctgctgtccc

SEQ ID NO: 1208830 - DNA, 13 bp, Homo sapiens
acaaccgttggaa

SEQ ID NO: 1208831 - DNA, 15 bp, Homo sapiens
acaacctcaactgcc

SEQ ID NO: 1208832 - DNA, 20 bp, Homo sapiens
acaacctcaccaaactagta

SEQ ID NO: 1208833 - DNA, 18 bp, Homo sapiens
acaacctgaacctaggag

SEQ ID NO: 1208834 - DNA, 14 bp, Homo sapiens
acaacctgaatctt

SEQ ID NO: 1208835 - DNA, 16 bp, Homo sapiens
acaacctgaatctttt

SEQ ID NO: 1208836 - DNA, 17 bp, Homo sapiens
acaacgatgaatttctt

SEQ ID NO: 1208837 - DNA, 23 bp, Homo sapiens
acaacgcattgccacggaaacat

SEQ ID NO: 1208838 - DNA, 18 bp, Homo sapiens
acaacgggcagaaatcga

SEQ ID NO: 1208839 - DNA, 15 bp, Homo sapiens
acaactaaaaataaa

SEQ ID NO: 1208840 - DNA, 15 bp, Homo sapiens
acaactaaaattagg

SEQ ID NO: 1208841 - DNA, 19 bp, Homo sapiens
acaactcactccttttaaa

SEQ ID NO: 1208842 - DNA, 21 bp, Homo sapiens
acaactcactccttttaaaga

SEQ ID NO: 1208843 - DNA, 19 bp, Homo sapiens
acaactgcataacctttac

SEQ ID NO: 1208844 - DNA, 21 bp, Homo sapiens
acaactgcctcgaaacacaga

SEQ ID NO: 1208845 - DNA, 22 bp, Homo sapiens
acaactgcctcgaaacacagaa

SEQ ID NO: 1208846 - DNA, 12 bp, Homo sapiens
acaactgcggtg

SEQ ID NO: 1208847 - DNA, 17 bp, Homo sapiens
acaactggagttttttt

SEQ ID NO: 1208848 - DNA, 15 bp, Homo sapiens
acaacttaatggaaa

SEQ ID NO: 1208849 - DNA, 21 bp, Homo sapiens
acaacttatttaaaaatattt

SEQ ID NO: 1208850 - DNA, 17 bp, Homo sapiens
acaacttcaagtgcatg

SEQ ID NO: 1208851 - DNA, 18 bp, Homo sapiens
acaacttgattttttcaa

SEQ ID NO: 1208852 - DNA, 15 bp, Homo sapiens
acaacttggcatttc

SEQ ID NO: 1208853 - DNA, 17 bp, Homo sapiens
acaacttggcatttcta

SEQ ID NO: 1208854 - DNA, 14 bp, Homo sapiens
acaacttgggttct

SEQ ID NO: 1208855 - DNA, 14 bp, Homo sapiens
acaacttgtagcag

SEQ ID NO: 1208856 - DNA, 14 bp, Homo sapiens
acaactttcacttc

SEQ ID NO: 1208857 - DNA, 19 bp, Homo sapiens
acaactttcacttcttcct

SEQ ID NO: 1208858 - DNA, 13 bp, Homo sapiens
acaactttcagtg

SEQ ID NO: 1208859 - DNA, 15 bp, Homo sapiens
acaactttcagtggc

SEQ ID NO: 1208860 - DNA, 15 bp, Homo sapiens
acaactttgcaaatt

SEQ ID NO: 1208861 - DNA, 20 bp, Homo sapiens
acaactttgtcgtggttctt

SEQ ID NO: 1208862 - DNA, 22 bp, Homo sapiens
acaagaaaccaagtgggctggt

SEQ ID NO: 1208863 - DNA, 13 bp, Homo sapiens
acaagaagaaata

SEQ ID NO: 1208864 - DNA, 14 bp, Homo sapiens
acaagaagaaatat

SEQ ID NO: 1208865 - DNA, 18 bp, Homo sapiens
acaagaagaaatatgaaa

SEQ ID NO: 1208866 - DNA, 19 bp, Homo sapiens
acaagaagaaatatgaaat

SEQ ID NO: 1208867 - DNA, 14 bp, Homo sapiens
acaagaagaagggc

SEQ ID NO: 1208868 - DNA, 17 bp, Homo sapiens
acaagaagcattttgta

SEQ ID NO: 1208869 - DNA, 18 bp, Homo sapiens
acaagaagcattttgtaa

SEQ ID NO: 1208870 - DNA, 13 bp, Homo sapiens
acaagaagcccag

SEQ ID NO: 1208871 - DNA, 14 bp, Homo sapiens
acaagaatggatca

SEQ ID NO: 1208872 - DNA, 19 bp, Homo sapiens
acaagaccaccacttcgaa

SEQ ID NO: 1208873 - DNA, 17 bp, Homo sapiens
acaagaccacgtttcta

SEQ ID NO: 1208874 - DNA, 17 bp, Homo sapiens
acaagaccgccccaggg

SEQ ID NO: 1208875 - DNA, 18 bp, Homo sapiens
acaagaccgccccagggc

SEQ ID NO: 1208876 - DNA, 21 bp, Homo sapiens
acaagacttcagtatgttgtc

SEQ ID NO: 1208877 - DNA, 15 bp, Homo sapiens
acaagagcactacat

SEQ ID NO: 1208878 - DNA, 21 bp, Homo sapiens
acaagagcactacattcattt

SEQ ID NO: 1208879 - DNA, 15 bp, Homo sapiens
acaagagcagcctgt

SEQ ID NO: 1208880 - DNA, 19 bp, Homo sapiens
acaagagcagcctgtggca

SEQ ID NO: 1208881 - DNA, 18 bp, Homo sapiens
acaagagcttaacagtgt

SEQ ID NO: 1208882 - DNA, 19 bp, Homo sapiens
acaagagcttaacagtgtg

SEQ ID NO: 1208883 - DNA, 17 bp, Homo sapiens
acaagaggacacaatgg

SEQ ID NO: 1208884 - DNA, 18 bp, Homo sapiens
acaagaggttaaggtggg

SEQ ID NO: 1208885 - DNA, 17 bp, Homo sapiens
acaagagtccctttgaa

SEQ ID NO: 1208886 - DNA, 22 bp, Homo sapiens
acaagagtttatttccaaataa

SEQ ID NO: 1208887 - DNA, 15 bp, Homo sapiens
acaagatattgtaca

SEQ ID NO: 1208888 - DNA, 13 bp, Homo sapiens
acaagatctttca

SEQ ID NO: 1208889 - DNA, 14 bp, Homo sapiens
acaagatctttcag

SEQ ID NO: 1208890 - DNA, 15 bp, Homo sapiens
acaagatctttcagg

SEQ ID NO: 1208891 - DNA, 17 bp, Homo sapiens
acaagattcccagagac

SEQ ID NO: 1208892 - DNA, 14 bp, Homo sapiens
acaagatttagaaa

SEQ ID NO: 1208893 - DNA, 14 bp, Homo sapiens
acaagatttcctta

SEQ ID NO: 1208894 - DNA, 16 bp, Homo sapiens
acaagcactattttat

SEQ ID NO: 1208895 - DNA, 14 bp, Homo sapiens
acaagcatatttga

SEQ ID NO: 1208896 - DNA, 18 bp, Homo sapiens
acaagcatgtctctctgc

SEQ ID NO: 1208897 - DNA, 20 bp, Homo sapiens
acaagcatgtctctctgcca

SEQ ID NO: 1208898 - DNA, 21 bp, Homo sapiens
acaagcatgtctctctgccaa

SEQ ID NO: 1208899 - DNA, 20 bp, Homo sapiens
acaagccaaaagtccctccc

SEQ ID NO: 1208900 - DNA, 20 bp, Homo sapiens
acaagccacaagtcttccag

SEQ ID NO: 1208901 - DNA, 13 bp, Homo sapiens
acaagccacagaa

SEQ ID NO: 1208902 - DNA, 17 bp, Homo sapiens
acaagcccccccttcca

SEQ ID NO: 1208903 - DNA, 22 bp, Homo sapiens
acaagcccgttagccccaggga

SEQ ID NO: 1208904 - DNA, 17 bp, Homo sapiens
acaagcctcctgtacct

SEQ ID NO: 1208905 - DNA, 16 bp, Homo sapiens
acaagcctcttctgaa

SEQ ID NO: 1208906 - DNA, 10 bp, Homo sapiens
acaagcctta

SEQ ID NO: 1208907 - DNA, 23 bp, Homo sapiens
acaagcgtcacttctcctgctgc

SEQ ID NO: 1208908 - DNA, 23 bp, Homo sapiens
acaagctattccctcaaatctga

SEQ ID NO: 1208909 - DNA, 16 bp, Homo sapiens
acaagctcctggtctt

SEQ ID NO: 1208910 - DNA, 14 bp, Homo sapiens
acaagctgacttgg

SEQ ID NO: 1208911 - DNA, 19 bp, Homo sapiens
acaagctgacttggcactt

SEQ ID NO: 1208912 - DNA, 17 bp, Homo sapiens
acaagctgcactgtgaa

SEQ ID NO: 1208913 - DNA, 15 bp, Homo sapiens
acaagctgcctctga

SEQ ID NO: 1208914 - DNA, 12 bp, Homo sapiens
acaagctgtgca

SEQ ID NO: 1208915 - DNA, 17 bp, Homo sapiens
acaagcttaaagcttga

SEQ ID NO: 1208916 - DNA, 20 bp, Homo sapiens
acaagcttttttacacaaat

SEQ ID NO: 1208917 - DNA, 11 bp, Homo sapiens
acaaggaaaat

SEQ ID NO: 1208918 - DNA, 22 bp, Homo sapiens
acaaggaatttccctgtgtgga

SEQ ID NO: 1208919 - DNA, 23 bp, Homo sapiens
acaaggaatttccctgtgtggat

SEQ ID NO: 1208920 - DNA, 19 bp, Homo sapiens
acaaggacattcactgctg

SEQ ID NO: 1208921 - DNA, 9 bp, Homo sapiens
acaaggact

SEQ ID NO: 1208922 - DNA, 10 bp, Homo sapiens
acaaggactc

SEQ ID NO: 1208923 - DNA, 15 bp, Homo sapiens
acaaggagtgcccgc

SEQ ID NO: 1208924 - DNA, 17 bp, Homo sapiens
acaaggcattcaagtgt

SEQ ID NO: 1208925 - DNA, 23 bp, Homo sapiens
acaaggcattcaagtgtacagtg

SEQ ID NO: 1208926 - DNA, 15 bp, Homo sapiens
acaaggccccagaga

SEQ ID NO: 1208927 - DNA, 22 bp, Homo sapiens
acaaggctgaccaagagagaaa

SEQ ID NO: 1208928 - DNA, 15 bp, Homo sapiens
acaaggctggccagc

SEQ ID NO: 1208929 - DNA, 15 bp, Homo sapiens
acaaggctgttgcat

SEQ ID NO: 1208930 - DNA, 12 bp, Homo sapiens
acaagggaaggg

SEQ ID NO: 1208931 - DNA, 22 bp, Homo sapiens
acaagggaaggggcctccctcc

SEQ ID NO: 1208932 - DNA, 13 bp, Homo sapiens
acaaggggccctt

SEQ ID NO: 1208933 - DNA, 22 bp, Homo sapiens
acaaggggcccttggagcgtgg

SEQ ID NO: 1208934 - DNA, 22 bp, Homo sapiens
acaagggtccgtggaccaggag

SEQ ID NO: 1208935 - DNA, 20 bp, Homo sapiens
acaagggtctagggagagac

SEQ ID NO: 1208936 - DNA, 22 bp, Homo sapiens
acaaggtaattgttttttaaag

SEQ ID NO: 1208937 - DNA, 20 bp, Homo sapiens
acaaggtcaagagatagaga

SEQ ID NO: 1208938 - DNA, 14 bp, Homo sapiens
acaaggtccactcc

SEQ ID NO: 1208939 - DNA, 20 bp, Homo sapiens
acaaggtctcttccttaccc

SEQ ID NO: 1208940 - DNA, 12 bp, Homo sapiens
acaaggtgctaa

SEQ ID NO: 1208941 - DNA, 15 bp, Homo sapiens
acaaggtgctaacat

SEQ ID NO: 1208942 - DNA, 19 bp, Homo sapiens
acaaggtgctaacatagat

SEQ ID NO: 1208943 - DNA, 19 bp, Homo sapiens
acaaggttggcaccccagc

SEQ ID NO: 1208944 - DNA, 16 bp, Homo sapiens
acaagtaatattatta

SEQ ID NO: 1208945 - DNA, 16 bp, Homo sapiens
acaagtaatttcagtg

SEQ ID NO: 1208946 - DNA, 18 bp, Homo sapiens
acaagtactggtaagatt

SEQ ID NO: 1208947 - DNA, 13 bp, Homo sapiens
acaagtacttttg

SEQ ID NO: 1208948 - DNA, 11 bp, Homo sapiens
acaagtagttc

SEQ ID NO: 1208949 - DNA, 13 bp, Homo sapiens
acaagtatataat

SEQ ID NO: 1208950 - DNA, 14 bp, Homo sapiens
acaagtatttgtta

SEQ ID NO: 1208951 - DNA, 22 bp, Homo sapiens
acaagtatttgttaatttagaa

SEQ ID NO: 1208952 - DNA, 12 bp, Homo sapiens
acaagtattttt

SEQ ID NO: 1208953 - DNA, 17 bp, Homo sapiens
acaagtcacagctgcag

SEQ ID NO: 1208954 - DNA, 16 bp, Homo sapiens
acaagtccctgtaatt

SEQ ID NO: 1208955 - DNA, 19 bp, Homo sapiens
acaagtcctgtgaatttct

SEQ ID NO: 1208956 - DNA, 13 bp, Homo sapiens
acaagtcttccag

SEQ ID NO: 1208957 - DNA, 18 bp, Homo sapiens
acaagtgaaaaacatcca

SEQ ID NO: 1208958 - DNA, 17 bp, Homo sapiens
acaagtgaccccagggc

SEQ ID NO: 1208959 - DNA, 19 bp, Homo sapiens
acaagtgactgtatctgtg

SEQ ID NO: 1208960 - DNA, 20 bp, Homo sapiens
acaagtgactgtatctgtgt

SEQ ID NO: 1208961 - DNA, 22 bp, Homo sapiens
acaagtgactgtatctgtgtag

SEQ ID NO: 1208962 - DNA, 17 bp, Homo sapiens
acaagtgagacaaaaag

SEQ ID NO: 1208963 - DNA, 12 bp, Homo sapiens
acaagtgccact

SEQ ID NO: 1208964 - DNA, 17 bp, Homo sapiens
acaagtgccgcaaattg

SEQ ID NO: 1208965 - DNA, 20 bp, Homo sapiens
acaagtgccgcaaattgtac

SEQ ID NO: 1208966 - DNA, 14 bp, Homo sapiens
acaagtgcctcctg

SEQ ID NO: 1208967 - DNA, 19 bp, Homo sapiens
acaagtggctccccacctg

SEQ ID NO: 1208968 - DNA, 20 bp, Homo sapiens
acaagtggctccccacctgg

SEQ ID NO: 1208969 - DNA, 16 bp, Homo sapiens
acaagtggtgaccaaa

SEQ ID NO: 1208970 - DNA, 21 bp, Homo sapiens
acaagtgttttagatgttact

SEQ ID NO: 1208971 - DNA, 22 bp, Homo sapiens
acaagttatttaaatctgtttt

SEQ ID NO: 1208972 - DNA, 22 bp, Homo sapiens
acaagttgcgacggagagaaaa

SEQ ID NO: 1208973 - DNA, 15 bp, Homo sapiens
acaagttgtgtttga

SEQ ID NO: 1208974 - DNA, 20 bp, Homo sapiens
acaagtttgctaaaagaaga

SEQ ID NO: 1208975 - DNA, 12 bp, Homo sapiens
acaagttttaga

SEQ ID NO: 1208976 - DNA, 14 bp, Homo sapiens
acaagttttagaaa

SEQ ID NO: 1208977 - DNA, 21 bp, Homo sapiens
acaagttttgtataaataata

SEQ ID NO: 1208978 - DNA, 11 bp, Homo sapiens
acaataaaaga

SEQ ID NO: 1208979 - DNA, 12 bp, Homo sapiens
acaataaaagag

SEQ ID NO: 1208980 - DNA, 14 bp, Homo sapiens
acaataaaattttt

SEQ ID NO: 1208981 - DNA, 13 bp, Homo sapiens
acaataaacagga

SEQ ID NO: 1208982 - DNA, 20 bp, Homo sapiens
acaataaaccaaacccagcc

SEQ ID NO: 1208983 - DNA, 21 bp, Homo sapiens
acaataaaccaaacccagcca

SEQ ID NO: 1208984 - DNA, 10 bp, Homo sapiens
acaataaact

SEQ ID NO: 1208985 - DNA, 17 bp, Homo sapiens
acaataaagcagtcctg

SEQ ID NO: 1208986 - DNA, 15 bp, Homo sapiens
acaataaatattctg

SEQ ID NO: 1208987 - DNA, 16 bp, Homo sapiens
acaataacccagttac

SEQ ID NO: 1208988 - DNA, 19 bp, Homo sapiens
acaataacccagttacttt

SEQ ID NO: 1208989 - DNA, 16 bp, Homo sapiens
acaataactactgtgt

SEQ ID NO: 1208990 - DNA, 17 bp, Homo sapiens
acaataactactgtgtt

SEQ ID NO: 1208991 - DNA, 12 bp, Homo sapiens
acaataatttca

SEQ ID NO: 1208992 - DNA, 12 bp, Homo sapiens
acaataatttta

SEQ ID NO: 1208993 - DNA, 14 bp, Homo sapiens
acaatacaaatgga

SEQ ID NO: 1208994 - DNA, 15 bp, Homo sapiens
acaatacaaatggat

SEQ ID NO: 1208995 - DNA, 16 bp, Homo sapiens
acaatacaaatggatt

SEQ ID NO: 1208996 - DNA, 16 bp, Homo sapiens
acaatacaatgtacaa

SEQ ID NO: 1208997 - DNA, 16 bp, Homo sapiens
acaatacatgagaaag

SEQ ID NO: 1208998 - DNA, 20 bp, Homo sapiens
acaataccactggttaaaat

SEQ ID NO: 1208999 - DNA, 13 bp, Homo sapiens
acaataggtcttt

SEQ ID NO: 1209000 - DNA, 19 bp, Homo sapiens
acaataggtctttctctca

SEQ ID NO: 1209001 - DNA, 18 bp, Homo sapiens
acaataggtgcttattct

SEQ ID NO: 1209002 - DNA, 22 bp, Homo sapiens
acaatagttcttagctttgaaa

SEQ ID NO: 1209003 - DNA, 16 bp, Homo sapiens
acaatatctgcagcgt

SEQ ID NO: 1209004 - DNA, 15 bp, Homo sapiens
acaatatgaatacag

SEQ ID NO: 1209005 - DNA, 21 bp, Homo sapiens
acaatatgaatacagggcatg

SEQ ID NO: 1209006 - DNA, 14 bp, Homo sapiens
acaatatgtgagtg

SEQ ID NO: 1209007 - DNA, 12 bp, Homo sapiens
acaatatttctt

SEQ ID NO: 1209008 - DNA, 16 bp, Homo sapiens
acaatatttcttttgt

SEQ ID NO: 1209009 - DNA, 17 bp, Homo sapiens
acaatatttcttttgtt

SEQ ID NO: 1209010 - DNA, 20 bp, Homo sapiens
acaatatttcttttgttgta

SEQ ID NO: 1209011 - DNA, 15 bp, Homo sapiens
acaatattttatggt

SEQ ID NO: 1209012 - DNA, 17 bp, Homo sapiens
acaatattttgtggctt

SEQ ID NO: 1209013 - DNA, 14 bp, Homo sapiens
acaatcaaaggaaa

SEQ ID NO: 1209014 - DNA, 19 bp, Homo sapiens
acaatcaaaggaaaatagt

SEQ ID NO: 1209015 - DNA, 21 bp, Homo sapiens
acaatcaaatctcctgctgat

SEQ ID NO: 1209016 - DNA, 20 bp, Homo sapiens
acaatcactattcttaagca

SEQ ID NO: 1209017 - DNA, 23 bp, Homo sapiens
acaatcactattcttaagcactt

SEQ ID NO: 1209018 - DNA, 16 bp, Homo sapiens
acaatcagtcccctcc

SEQ ID NO: 1209019 - DNA, 17 bp, Homo sapiens
acaatcagtcccctccc

SEQ ID NO: 1209020 - DNA, 18 bp, Homo sapiens
acaatcagtcccctccca

SEQ ID NO: 1209021 - DNA, 13 bp, Homo sapiens
acaatcagtttat

SEQ ID NO: 1209022 - DNA, 19 bp, Homo sapiens
acaatcatgaaatatgcat

SEQ ID NO: 1209023 - DNA, 17 bp, Homo sapiens
acaccaggagtccctgg

SEQ ID NO: 1209024 - DNA, 12 bp, Homo sapiens
acaccaggccgt

SEQ ID NO: 1209025 - DNA, 18 bp, Homo sapiens
acaccaggctgtgggcct

SEQ ID NO: 1209026 - DNA, 23 bp, Homo sapiens
acaccagtcacctcgtctccctg

SEQ ID NO: 1209027 - DNA, 15 bp, Homo sapiens
acaccagtgcaagca

SEQ ID NO: 1209028 - DNA, 17 bp, Homo sapiens
acaccataggtagaatg

SEQ ID NO: 1209029 - DNA, 15 bp, Homo sapiens
acaccatcctggcta

SEQ ID NO: 1209030 - DNA, 21 bp, Homo sapiens
acaccatcttttattcttttt

SEQ ID NO: 1209031 - DNA, 23 bp, Homo sapiens
acaccatgtttgagctcagaccc

SEQ ID NO: 1209032 - DNA, 15 bp, Homo sapiens
acaccattaccaaaa

SEQ ID NO: 1209033 - DNA, 19 bp, Homo sapiens
acaccattataaaaacact

SEQ ID NO: 1209034 - DNA, 19 bp, Homo sapiens
acacccaaagaggtattta

SEQ ID NO: 1209035 - DNA, 13 bp, Homo sapiens
acacccaacactt

SEQ ID NO: 1209036 - DNA, 15 bp, Homo sapiens
acacccacccttttt

SEQ ID NO: 1209037 - DNA, 21 bp, Homo sapiens
acacccaccctttttttgggg

SEQ ID NO: 1209038 - DNA, 17 bp, Homo sapiens
acacccactgccccgtg

SEQ ID NO: 1209039 - DNA, 14 bp, Homo sapiens
acacccagaccttc

SEQ ID NO: 1209040 - DNA, 13 bp, Homo sapiens
acacccagcaata

SEQ ID NO: 1209041 - DNA, 18 bp, Homo sapiens
acacccagcggccccccg

SEQ ID NO: 1209042 - DNA, 13 bp, Homo sapiens
acacccaggaagg

SEQ ID NO: 1209043 - DNA, 15 bp, Homo sapiens
acacccaggaaggga

SEQ ID NO: 1209044 - DNA, 19 bp, Homo sapiens
acacccaggtgatttcctc

SEQ ID NO: 1209045 - DNA, 21 bp, Homo sapiens
acaccccaacttggcagcttt

SEQ ID NO: 1209046 - DNA, 19 bp, Homo sapiens
acacggcagcccccccctc

SEQ ID NO: 1209047 - DNA, 13 bp, Homo sapiens
acacggcagctgt

SEQ ID NO: 1209048 - DNA, 20 bp, Homo sapiens
acacgggcgagctttctctc

SEQ ID NO: 1209049 - DNA, 19 bp, Homo sapiens
acacggttttggcagctga

SEQ ID NO: 1209050 - DNA, 20 bp, Homo sapiens
acacggttttggcagctgac

SEQ ID NO: 1209051 - DNA, 13 bp, Homo sapiens
acacgtatttata

SEQ ID NO: 1209052 - DNA, 19 bp, Homo sapiens
acacgtatttatatttgga

SEQ ID NO: 1209053 - DNA, 19 bp, Homo sapiens
acacgtcgttctaattaaa

SEQ ID NO: 1209054 - DNA, 17 bp, Homo sapiens
acacgtggaggaatgct

SEQ ID NO: 1209055 - DNA, 20 bp, Homo sapiens
acacgtggaggaatgctccc

SEQ ID NO: 1209056 - DNA, 24 bp, Homo sapiens
acacgtggaggaatgctcccccat

SEQ ID NO: 1209057 - DNA, 21 bp, Homo sapiens
acacgtgggctcccctcttcc

SEQ ID NO: 1209058 - DNA, 14 bp, Homo sapiens
acacgtgtctataa

SEQ ID NO: 1209059 - DNA, 21 bp, Homo sapiens
acacgttctgatttctgccct

SEQ ID NO: 1209060 - DNA, 12 bp, Homo sapiens
acactaaaattt

SEQ ID NO: 1209061 - DNA, 15 bp, Homo sapiens
acactaaactctggg

SEQ ID NO: 1209062 - DNA, 22 bp, Homo sapiens
acactaaatgctgattatttag

SEQ ID NO: 1209063 - DNA, 16 bp, Homo sapiens
acactaacgaaatatc

SEQ ID NO: 1209064 - DNA, 19 bp, Homo sapiens
acactaagttatagtatat

SEQ ID NO: 1209065 - DNA, 19 bp, Homo sapiens
acactaatatatggaccta

SEQ ID NO: 1209066 - DNA, 13 bp, Homo sapiens
acactaatatatt

SEQ ID NO: 1209067 - DNA, 17 bp, Homo sapiens
acactaatatatttaaa

SEQ ID NO: 1209068 - DNA, 15 bp, Homo sapiens
acactacacccagca

SEQ ID NO: 1209069 - DNA, 23 bp, Homo sapiens
acactacacccagcaatagagac

SEQ ID NO: 1209070 - DNA, 20 bp, Homo sapiens
acactaccgaatgtgtcttt

SEQ ID NO: 1209071 - DNA, 21 bp, Homo sapiens
acactacctcttttgagactt

SEQ ID NO: 1209072 - DNA, 18 bp, Homo sapiens
acactagaggccagggat

SEQ ID NO: 1209073 - DNA, 23 bp, Homo sapiens
acactagccttggcctctttcct

SEQ ID NO: 1209074 - DNA, 22 bp, Homo sapiens
acactagctaatatcaatagaa

SEQ ID NO: 1209075 - DNA, 15 bp, Homo sapiens
acactagcttgaact

SEQ ID NO: 1209076 - DNA, 22 bp, Homo sapiens
acactagggactatcaggtaat

SEQ ID NO: 1209077 - DNA, 15 bp, Homo sapiens
acactcaaaagctgg

SEQ ID NO: 1209078 - DNA, 21 bp, Homo sapiens
acactcaaaagctgggcaggt

SEQ ID NO: 1209079 - DNA, 21 bp, Homo sapiens
acactcaaggacaggagcctg

SEQ ID NO: 1209080 - DNA, 23 bp, Homo sapiens
acactcaaggacaggagcctggt

SEQ ID NO: 1209081 - DNA, 20 bp, Homo sapiens
acactcaccagtggcctttc

SEQ ID NO: 1209082 - DNA, 22 bp, Homo sapiens
acactcaccagtggcctttcag

SEQ ID NO: 1209083 - DNA, 19 bp, Homo sapiens
acactcaccccagcctcat

SEQ ID NO: 1209084 - DNA, 19 bp, Homo sapiens
acactcagacctgaattct

SEQ ID NO: 1209085 - DNA, 13 bp, Homo sapiens
acactcagggcag

SEQ ID NO: 1209086 - DNA, 20 bp, Homo sapiens
acactcagggcagctgcctg

SEQ ID NO: 1209087 - DNA, 21 bp, Homo sapiens
acactcagggcagctgcctgg

SEQ ID NO: 1209088 - DNA, 18 bp, Homo sapiens
acactcagtcccccacca

SEQ ID NO: 1209089 - DNA, 23 bp, Homo sapiens
acactcagtggcccatggcattt

SEQ ID NO: 1209090 - DNA, 13 bp, Homo sapiens
acactcatccctg

SEQ ID NO: 1209091 - DNA, 15 bp, Homo sapiens
acactcatccctggt

SEQ ID NO: 1209092 - DNA, 16 bp, Homo sapiens
acactccaagatatgg

SEQ ID NO: 1209093 - DNA, 16 bp, Homo sapiens
acactccactctgatt

SEQ ID NO: 1209094 - DNA, 15 bp, Homo sapiens
acactccagcctgag

SEQ ID NO: 1209095 - DNA, 17 bp, Homo sapiens
acactccagcctgagca

SEQ ID NO: 1209096 - DNA, 21 bp, Homo sapiens
acactccagtgccagcaatga

SEQ ID NO: 1209097 - DNA, 15 bp, Homo sapiens
acactccagtggcag

SEQ ID NO: 1209098 - DNA, 16 bp, Homo sapiens
acactccccacgggaa

SEQ ID NO: 1209099 - DNA, 23 bp, Homo sapiens
acactcgcccgcccactgtcctg

SEQ ID NO: 1209100 - DNA, 20 bp, Homo sapiens
acactctagtgacttcctgg

SEQ ID NO: 1209101 - DNA, 20 bp, Homo sapiens
acactctcatgtccccttcc

SEQ ID NO: 1209102 - DNA, 13 bp, Homo sapiens
acactctctgcag

SEQ ID NO: 1209103 - DNA, 17 bp, Homo sapiens
acactctctgcagccca

SEQ ID NO: 1209104 - DNA, 18 bp, Homo sapiens
acactctctgcagcccag

SEQ ID NO: 1209105 - DNA, 14 bp, Homo sapiens
acactctctggaag

SEQ ID NO: 1209106 - DNA, 13 bp, Homo sapiens
acactctgatttt

SEQ ID NO: 1209107 - DNA, 16 bp, Homo sapiens
acactctgctctgccc

SEQ ID NO: 1209108 - DNA, 16 bp, Homo sapiens
acactctgctgtttga

SEQ ID NO: 1209109 - DNA, 21 bp, Homo sapiens
acactcttttgctttattcca

SEQ ID NO: 1209110 - DNA, 15 bp, Homo sapiens
acactgaaaaaatac

SEQ ID NO: 1209111 - DNA, 23 bp, Homo sapiens
acactgaaaaatctaagtgatat

SEQ ID NO: 1209112 - DNA, 13 bp, Homo sapiens
acactgaaaaatt

SEQ ID NO: 1209113 - DNA, 16 bp, Homo sapiens
acactgaaaaattata

SEQ ID NO: 1209114 - DNA, 22 bp, Homo sapiens
acactgaaaagaaggaaagatg

SEQ ID NO: 1209115 - DNA, 18 bp, Homo sapiens
acactgaaagttttgtaa

SEQ ID NO: 1209116 - DNA, 12 bp, Homo sapiens
acactgaactta

SEQ ID NO: 1209117 - DNA, 19 bp, Homo sapiens
acactgaagttaacagaga

SEQ ID NO: 1209118 - DNA, 18 bp, Homo sapiens
acactgaatatttatatt

SEQ ID NO: 1209119 - DNA, 15 bp, Homo sapiens
acactgaatcatgtt

SEQ ID NO: 1209120 - DNA, 21 bp, Homo sapiens
acactgaatctcccctcctca

SEQ ID NO: 1209121 - DNA, 16 bp, Homo sapiens
acactgaattgaatct

SEQ ID NO: 1209122 - DNA, 17 bp, Homo sapiens
acactgagccccacctc

SEQ ID NO: 1209123 - DNA, 18 bp, Homo sapiens
acactgagcttctgagac

SEQ ID NO: 1209124 - DNA, 23 bp, Homo sapiens
acactgagttctatcagttatcc

SEQ ID NO: 1209125 - DNA, 21 bp, Homo sapiens
acactgatacataaaaattaa

SEQ ID NO: 1209126 - DNA, 20 bp, Homo sapiens
acactgatgggctggggcag

SEQ ID NO: 1209127 - DNA, 18 bp, Homo sapiens
acactgcaagagccttgg

SEQ ID NO: 1209128 - DNA, 19 bp, Homo sapiens
acactgcactttgtttaga

SEQ ID NO: 1209129 - DNA, 13 bp, Homo sapiens
acactgcaggaca

SEQ ID NO: 1209130 - DNA, 17 bp, Homo sapiens
acactgccttagcctct

SEQ ID NO: 1209131 - DNA, 13 bp, Homo sapiens
acactgctctaac

SEQ ID NO: 1209132 - DNA, 14 bp, Homo sapiens
acactgctctaaca

SEQ ID NO: 1209133 - DNA, 18 bp, Homo sapiens
acactgctcttaagaaac

SEQ ID NO: 1209134 - DNA, 19 bp, Homo sapiens
acactgctcttaagaaact

SEQ ID NO: 1209135 - DNA, 24 bp, Homo sapiens
acactgctgtccacatgacctcca

SEQ ID NO: 1209136 - DNA, 16 bp, Homo sapiens
acactgctgtcctctc

SEQ ID NO: 1209137 - DNA, 23 bp, Homo sapiens
acactgctgtcctctcccccttc

SEQ ID NO: 1209138 - DNA, 19 bp, Homo sapiens
acactggaccccactggct

SEQ ID NO: 1209139 - DNA, 14 bp, Homo sapiens
acactggacctggg

SEQ ID NO: 1209140 - DNA, 21 bp, Homo sapiens
acactggagaagaatatcaaa

SEQ ID NO: 1209141 - DNA, 23 bp, Homo sapiens
acactggagaagaatatcaaata

SEQ ID NO: 1209142 - DNA, 18 bp, Homo sapiens
acactggaggagagaaga

SEQ ID NO: 1209143 - DNA, 19 bp, Homo sapiens
acactggccccacaggagt

SEQ ID NO: 1209144 - DNA, 16 bp, Homo sapiens
acactggcccctagaa

SEQ ID NO: 1209145 - DNA, 13 bp, Homo sapiens
acactggcccctc

SEQ ID NO: 1209146 - DNA, 14 bp, Homo sapiens
acactggcccctca

SEQ ID NO: 1209147 - DNA, 22 bp, Homo sapiens
acactggctaaagataattgct

SEQ ID NO: 1209148 - DNA, 14 bp, Homo sapiens
acactgggaaacag

SEQ ID NO: 1209149 - DNA, 22 bp, Homo sapiens
acactgggagaggtgccagcaa

SEQ ID NO: 1209150 - DNA, 16 bp, Homo sapiens
acactgggcagcaagg

SEQ ID NO: 1209151 - DNA, 13 bp, Homo sapiens
acactgggcctgg

SEQ ID NO: 1209152 - DNA, 15 bp, Homo sapiens
acactgggtgcgtct

SEQ ID NO: 1209153 - DNA, 16 bp, Homo sapiens
acactgggtgcgtctc

SEQ ID NO: 1209154 - DNA, 19 bp, Homo sapiens
acactgggtgcgtctccag

SEQ ID NO: 1209155 - DNA, 19 bp, Homo sapiens
acactgggtggtggcctgg

SEQ ID NO: 1209156 - DNA, 23 bp, Homo sapiens
acactgggtggtggcctggtccc

SEQ ID NO: 1209157 - DNA, 16 bp, Homo sapiens
acactggtaaatgtta

SEQ ID NO: 1209158 - DNA, 16 bp, Homo sapiens
acactggtatttatat

SEQ ID NO: 1209159 - DNA, 15 bp, Homo sapiens
acactggtcacaggc

SEQ ID NO: 1209160 - DNA, 10 bp, Homo sapiens
acactggtct

SEQ ID NO: 1209161 - DNA, 17 bp, Homo sapiens
acactggtctaatgttt

SEQ ID NO: 1209162 - DNA, 20 bp, Homo sapiens
acactggtctaatgtttgtg

SEQ ID NO: 1209163 - DNA, 18 bp, Homo sapiens
acactggtgctgagtgac

SEQ ID NO: 1209164 - DNA, 17 bp, Homo sapiens
acactggtgtgtccctc

SEQ ID NO: 1209165 - DNA, 14 bp, Homo sapiens
acactggttctcaa

SEQ ID NO: 1209166 - DNA, 15 bp, Homo sapiens
acactggttctcaat

SEQ ID NO: 1209167 - DNA, 18 bp, Homo sapiens
acactgtatgttatagaa

SEQ ID NO: 1209168 - DNA, 20 bp, Homo sapiens
acactgtatgttatagaact

SEQ ID NO: 1209169 - DNA, 14 bp, Homo sapiens
acactgtctggggc

SEQ ID NO: 1209170 - DNA, 20 bp, Homo sapiens
acactgtgcacatctgtgtc

SEQ ID NO: 1209171 - DNA, 23 bp, Homo sapiens
acactgtgcccagcccggacctt

SEQ ID NO: 1209172 - DNA, 16 bp, Homo sapiens
acactgtgccctggtg

SEQ ID NO: 1209173 - DNA, 18 bp, Homo sapiens
acactgtgccctggtgga

SEQ ID NO: 1209174 - DNA, 19 bp, Homo sapiens
acactgtggaactaataaa

SEQ ID NO: 1209175 - DNA, 12 bp, Homo sapiens
acactgtggcca

SEQ ID NO: 1209176 - DNA, 13 bp, Homo sapiens
acactgtggccag

SEQ ID NO: 1209177 - DNA, 23 bp, Homo sapiens
acactgtgtaaatacccatatgt

SEQ ID NO: 1209178 - DNA, 11 bp, Homo sapiens
acactgtgtcc

SEQ ID NO: 1209179 - DNA, 18 bp, Homo sapiens
acactgtgtcctggtgct

SEQ ID NO: 1209180 - DNA, 21 bp, Homo sapiens
acactgtgtcctggtgctctc

SEQ ID NO: 1209181 - DNA, 21 bp, Homo sapiens
acactgtgtgaggctgtgtct

SEQ ID NO: 1209182 - DNA, 22 bp, Homo sapiens
acactgtgtgaggctgtgtctc

SEQ ID NO: 1209183 - DNA, 23 bp, Homo sapiens
acactgtgtgaggctgtgtctct

SEQ ID NO: 1209184 - DNA, 14 bp, Homo sapiens
acactgttggcact

SEQ ID NO: 1209185 - DNA, 17 bp, Homo sapiens
acactgttggcacttat

SEQ ID NO: 1209186 - DNA, 16 bp, Homo sapiens
acactgtttcaaactt

SEQ ID NO: 1209187 - DNA, 18 bp, Homo sapiens
acactgtttcaaacttta

SEQ ID NO: 1209188 - DNA, 13 bp, Homo sapiens
acacttaacagat

SEQ ID NO: 1209189 - DNA, 16 bp, Homo sapiens
acacttacactttatg

SEQ ID NO: 1209190 - DNA, 22 bp, Homo sapiens
acacttagtgatcatttaaaaa

SEQ ID NO: 1209191 - DNA, 20 bp, Homo sapiens
acacttattggaactctgct

SEQ ID NO: 1209192 - DNA, 17 bp, Homo sapiens
acacttatttatgaatt

SEQ ID NO: 1209193 - DNA, 20 bp, Homo sapiens
acacttcagacacaggaaaa

SEQ ID NO: 1209194 - DNA, 18 bp, Homo sapiens
acacttcagagagctggt

SEQ ID NO: 1209195 - DNA, 19 bp, Homo sapiens
acacttcagagagctggta

SEQ ID NO: 1209196 - DNA, 13 bp, Homo sapiens
acacttccagtct

SEQ ID NO: 1209197 - DNA, 14 bp, Homo sapiens
acacttccagtctg

SEQ ID NO: 1209198 - DNA, 15 bp, Homo sapiens
acacttcccaccccc

SEQ ID NO: 1209199 - DNA, 14 bp, Homo sapiens
acacttcctgccta

SEQ ID NO: 1209200 - DNA, 15 bp, Homo sapiens
acacttcctgtcctt

SEQ ID NO: 1209201 - DNA, 13 bp, Homo sapiens
acacttctattta

SEQ ID NO: 1209202 - DNA, 13 bp, Homo sapiens
acacttctgcttt

SEQ ID NO: 1209203 - DNA, 15 bp, Homo sapiens
acacttctgctttca

SEQ ID NO: 1209204 - DNA, 17 bp, Homo sapiens
acacttctgtatgcatc

SEQ ID NO: 1209205 - DNA, 10 bp, Homo sapiens
acacttctta

SEQ ID NO: 1209206 - DNA, 22 bp, Homo sapiens
acacttcttcttggtcttattt

SEQ ID NO: 1209207 - DNA, 16 bp, Homo sapiens
acacttcttgaaacag

SEQ ID NO: 1209208 - DNA, 14 bp, Homo sapiens
acacttcttttgaa

SEQ ID NO: 1209209 - DNA, 18 bp, Homo sapiens
acacttgagaggatgaat

SEQ ID NO: 1209210 - DNA, 21 bp, Homo sapiens
acacttgagaggatgaatgta

SEQ ID NO: 1209211 - DNA, 18 bp, Homo sapiens
acacttgctcatgccctg

SEQ ID NO: 1209212 - DNA, 13 bp, Homo sapiens
acacttggagccc

SEQ ID NO: 1209213 - DNA, 14 bp, Homo sapiens
acacttgtgccagc

SEQ ID NO: 1209214 - DNA, 23 bp, Homo sapiens
acacttgtgtgtgggctgtgagt

SEQ ID NO: 1209215 - DNA, 19 bp, Homo sapiens
acacttgttccagctcttt

SEQ ID NO: 1209216 - DNA, 20 bp, Homo sapiens
acacttgttccagctctttg

SEQ ID NO: 1209217 - DNA, 20 bp, Homo sapiens
acacttgttgattaatggaa

SEQ ID NO: 1209218 - DNA, 23 bp, Homo sapiens
acacttgttgattaatggaaatg

SEQ ID NO: 1209219 - DNA, 20 bp, Homo sapiens
acactttaaaaccagttacc

SEQ ID NO: 1209220 - DNA, 22 bp, Homo sapiens
acactttaattaccaacctgtt

SEQ ID NO: 1209221 - DNA, 12 bp, Homo sapiens
acactttctctt

SEQ ID NO: 1209222 - DNA, 21 bp, Homo sapiens
acactttgaaatgtgtttctg

SEQ ID NO: 1209223 - DNA, 17 bp, Homo sapiens
acactttgccaaggctc

SEQ ID NO: 1209224 - DNA, 21 bp, Homo sapiens
acactttgccaaggctctccc

SEQ ID NO: 1209225 - DNA, 16 bp, Homo sapiens
acacttttaaaaaaca

SEQ ID NO: 1209226 - DNA, 16 bp, Homo sapiens
acagaaaaagcatgat

SEQ ID NO: 1209227 - DNA, 14 bp, Homo sapiens
acagaaaaatactt

SEQ ID NO: 1209228 - DNA, 22 bp, Homo sapiens
acagaaaaatcttgtgctagaa

SEQ ID NO: 1209229 - DNA, 20 bp, Homo sapiens
acagaaaacaaaagagagaa

SEQ ID NO: 1209230 - DNA, 18 bp, Homo sapiens
acagaaaacaacaaaaga

SEQ ID NO: 1209231 - DNA, 22 bp, Homo sapiens
acagaaaacattctgatttgga

SEQ ID NO: 1209232 - DNA, 19 bp, Homo sapiens
acagaaaagtgcctgagct

SEQ ID NO: 1209233 - DNA, 12 bp, Homo sapiens
acagaaaattta

SEQ ID NO: 1209234 - DNA, 12 bp, Homo sapiens
acagaaacaaaa

SEQ ID NO: 1209235 - DNA, 15 bp, Homo sapiens
acagaaacacaaacg

SEQ ID NO: 1209236 - DNA, 19 bp, Homo sapiens
acagaaaccaagccattaa

SEQ ID NO: 1209237 - DNA, 22 bp, Homo sapiens
acagaaacctatcctcactgcc

SEQ ID NO: 1209238 - DNA, 20 bp, Homo sapiens
acagaaacctttttaaaaat

SEQ ID NO: 1209239 - DNA, 21 bp, Homo sapiens
acagaaacgtgttaaaggttt

SEQ ID NO: 1209240 - DNA, 14 bp, Homo sapiens
acagaaactacatt

SEQ ID NO: 1209241 - DNA, 20 bp, Homo sapiens
acagaaagagactccgtctc

SEQ ID NO: 1209242 - DNA, 13 bp, Homo sapiens
acagaaagctgcc

SEQ ID NO: 1209243 - DNA, 22 bp, Homo sapiens
acagaaaggcaggtttcatttc

SEQ ID NO: 1209244 - DNA, 16 bp, Homo sapiens
acagaaataacagctg

SEQ ID NO: 1209245 - DNA, 20 bp, Homo sapiens
acagaaatcagaggagagac

SEQ ID NO: 1209246 - DNA, 14 bp, Homo sapiens
acagaaatgctgct

SEQ ID NO: 1209247 - DNA, 15 bp, Homo sapiens
acagaaatgctgctg

SEQ ID NO: 1209248 - DNA, 16 bp, Homo sapiens
acagaaatgctgctgg

SEQ ID NO: 1209249 - DNA, 21 bp, Homo sapiens
acagaaatgctgctggccaaa

SEQ ID NO: 1209250 - DNA, 14 bp, Homo sapiens
acagaaatgttttt

SEQ ID NO: 1209251 - DNA, 15 bp, Homo sapiens
acagaaattctgcaa

SEQ ID NO: 1209252 - DNA, 17 bp, Homo sapiens
acagaaattgaaaatga

SEQ ID NO: 1209253 - DNA, 19 bp, Homo sapiens
acagaaattgtatattgta

SEQ ID NO: 1209254 - DNA, 16 bp, Homo sapiens
acagaacagaataata

SEQ ID NO: 1209255 - DNA, 16 bp, Homo sapiens
acagaacatagacaga

SEQ ID NO: 1209256 - DNA, 17 bp, Homo sapiens
acagaacatcattagaa

SEQ ID NO: 1209257 - DNA, 13 bp, Homo sapiens
acagaaccctttg

SEQ ID NO: 1209258 - DNA, 22 bp, Homo sapiens
acagaacctactgttcctttca

SEQ ID NO: 1209259 - DNA, 18 bp, Homo sapiens
acagaaccttcaacccag

SEQ ID NO: 1209260 - DNA, 18 bp, Homo sapiens
acagaactcgatgcactg

SEQ ID NO: 1209261 - DNA, 18 bp, Homo sapiens
acagaactctttcaaaac

SEQ ID NO: 1209262 - DNA, 19 bp, Homo sapiens
acagaacttcagaaagact

SEQ ID NO: 1209263 - DNA, 20 bp, Homo sapiens
acagaacttgaatgtgtcag

SEQ ID NO: 1209264 - DNA, 16 bp, Homo sapiens
acagaactttccccaa

SEQ ID NO: 1209265 - DNA, 12 bp, Homo sapiens
acagaagaaaca

SEQ ID NO: 1209266 - DNA, 14 bp, Homo sapiens
acagaagacagcag

SEQ ID NO: 1209267 - DNA, 16 bp, Homo sapiens
acagaagcagcttctt

SEQ ID NO: 1209268 - DNA, 12 bp, Homo sapiens
acagaagcattt

SEQ ID NO: 1209269 - DNA, 13 bp, Homo sapiens
acagaagcatttg

SEQ ID NO: 1209270 - DNA, 20 bp, Homo sapiens
acagaagcatttgtattttg

SEQ ID NO: 1209271 - DNA, 22 bp, Homo sapiens
acagaagcatttgtattttgtg

SEQ ID NO: 1209272 - DNA, 20 bp, Homo sapiens
acagaagccaagctccctgg

SEQ ID NO: 1209273 - DNA, 15 bp, Homo sapiens
acagaagcccatgtc

SEQ ID NO: 1209274 - DNA, 18 bp, Homo sapiens
acagaagcccatgtcttc

SEQ ID NO: 1209275 - DNA, 19 bp, Homo sapiens
acagaagcccatgtcttct

SEQ ID NO: 1209276 - DNA, 21 bp, Homo sapiens
acagaagctgaagtgcatcca

SEQ ID NO: 1209277 - DNA, 18 bp, Homo sapiens
acagaagcttcagaagtt

SEQ ID NO: 1209278 - DNA, 13 bp, Homo sapiens
acagaagcttcca

SEQ ID NO: 1209279 - DNA, 12 bp, Homo sapiens
acagaaggcaaa

SEQ ID NO: 1209280 - DNA, 11 bp, Homo sapiens
acagaataatc

SEQ ID NO: 1209281 - DNA, 19 bp, Homo sapiens
acagaatagaatacattga

SEQ ID NO: 1209282 - DNA, 15 bp, Homo sapiens
acagaatagggtggc

SEQ ID NO: 1209283 - DNA, 22 bp, Homo sapiens
acagaatcagtgttaaattcat

SEQ ID NO: 1209284 - DNA, 22 bp, Homo sapiens
acagaatcatatgattctgctt

SEQ ID NO: 1209285 - DNA, 14 bp, Homo sapiens
acagaatcttctgg

SEQ ID NO: 1209286 - DNA, 18 bp, Homo sapiens
acagaatcttgttttgaa

SEQ ID NO: 1209287 - DNA, 19 bp, Homo sapiens
acagaatcttgttttgaaa

SEQ ID NO: 1209288 - DNA, 14 bp, Homo sapiens
acagaatgcattaa

SEQ ID NO: 1209289 - DNA, 15 bp, Homo sapiens
acagaatgctcaggg

SEQ ID NO: 1209290 - DNA, 16 bp, Homo sapiens
acagaatgtcaccagt

SEQ ID NO: 1209291 - DNA, 18 bp, Homo sapiens
acagaattgactgcagtt

SEQ ID NO: 1209292 - DNA, 13 bp, Homo sapiens
acagaatttgaat

SEQ ID NO: 1209293 - DNA, 10 bp, Homo sapiens
acagaatttt

SEQ ID NO: 1209294 - DNA, 18 bp, Homo sapiens
acagacaaaaacagcctc

SEQ ID NO: 1209295 - DNA, 20 bp, Homo sapiens
acagacaaaaacagcctcac

SEQ ID NO: 1209296 - DNA, 14 bp, Homo sapiens
acagacaacagaag

SEQ ID NO: 1209297 - DNA, 19 bp, Homo sapiens
acagacacaatatgtatgc

SEQ ID NO: 1209298 - DNA, 14 bp, Homo sapiens
acagacacacgcac

SEQ ID NO: 1209299 - DNA, 15 bp, Homo sapiens
acagacacctccccc

SEQ ID NO: 1209300 - DNA, 18 bp, Homo sapiens
acagacacctccccctac

SEQ ID NO: 1209301 - DNA, 15 bp, Homo sapiens
acagacactgttgca

SEQ ID NO: 1209302 - DNA, 14 bp, Homo sapiens
acagacaggagaaa

SEQ ID NO: 1209303 - DNA, 15 bp, Homo sapiens
acagacaggagaaat

SEQ ID NO: 1209304 - DNA, 15 bp, Homo sapiens
acagacaggctctta

SEQ ID NO: 1209305 - DNA, 12 bp, Homo sapiens
acagacatacat

SEQ ID NO: 1209306 - DNA, 16 bp, Homo sapiens
acagacatacatagac

SEQ ID NO: 1209307 - DNA, 14 bp, Homo sapiens
acagacatatttaa

SEQ ID NO: 1209308 - DNA, 15 bp, Homo sapiens
acagacatctctgca

SEQ ID NO: 1209309 - DNA, 15 bp, Homo sapiens
acagacatgctcttt

SEQ ID NO: 1209310 - DNA, 22 bp, Homo sapiens
acagacatggagatgtaaaatg

SEQ ID NO: 1209311 - DNA, 14 bp, Homo sapiens
acagaccacttgcc

SEQ ID NO: 1209312 - DNA, 12 bp, Homo sapiens
acagacccagga

SEQ ID NO: 1209313 - DNA, 13 bp, Homo sapiens
acagacccagtga

SEQ ID NO: 1209314 - DNA, 21 bp, Homo sapiens
acagaccgagaggccagttga

SEQ ID NO: 1209315 - DNA, 13 bp, Homo sapiens
acagacctctgct

SEQ ID NO: 1209316 - DNA, 20 bp, Homo sapiens
acagacctggagcccctggg

SEQ ID NO: 1209317 - DNA, 20 bp, Homo sapiens
acagacgttaggcatttcct

SEQ ID NO: 1209318 - DNA, 21 bp, Homo sapiens
acagacgttaggcatttcctg

SEQ ID NO: 1209319 - DNA, 23 bp, Homo sapiens
acagactagcaggctactgggac

SEQ ID NO: 1209320 - DNA, 23 bp, Homo sapiens
acagactatttttagattttctt

SEQ ID NO: 1209321 - DNA, 20 bp, Homo sapiens
acagactcaaatgctcagac

SEQ ID NO: 1209322 - DNA, 18 bp, Homo sapiens
acagactcccactcagta

SEQ ID NO: 1209323 - DNA, 20 bp, Homo sapiens
acagactcttacgtggagag

SEQ ID NO: 1209324 - DNA, 17 bp, Homo sapiens
acagactgcagacattc

SEQ ID NO: 1209325 - DNA, 22 bp, Homo sapiens
acagactgcagacattctcaaa

SEQ ID NO: 1209326 - DNA, 23 bp, Homo sapiens
acagactgcagacattctcaaag

SEQ ID NO: 1209327 - DNA, 14 bp, Homo sapiens
acagactgccccag

SEQ ID NO: 1209328 - DNA, 19 bp, Homo sapiens
acagactgttttactgttt

SEQ ID NO: 1209329 - DNA, 21 bp, Homo sapiens
acagactgttttactgtttta

SEQ ID NO: 1209330 - DNA, 21 bp, Homo sapiens
acagacttctggaaggctggc

SEQ ID NO: 1209331 - DNA, 14 bp, Homo sapiens
acagacttgagaac

SEQ ID NO: 1209332 - DNA, 15 bp, Homo sapiens
acagacttgagaact

SEQ ID NO: 1209333 - DNA, 18 bp, Homo sapiens
acagacttgagaacttga

SEQ ID NO: 1209334 - DNA, 12 bp, Homo sapiens
acagactttctg

SEQ ID NO: 1209335 - DNA, 22 bp, Homo sapiens
acagactttggacagtggcctc

SEQ ID NO: 1209336 - DNA, 23 bp, Homo sapiens
acagactttggacagtggcctct

SEQ ID NO: 1209337 - DNA, 16 bp, Homo sapiens
acagagaaagaaaagg

SEQ ID NO: 1209338 - DNA, 16 bp, Homo sapiens
acagagaaatacaaaa

SEQ ID NO: 1209339 - DNA, 16 bp, Homo sapiens
acagagaatttctaaa

SEQ ID NO: 1209340 - DNA, 15 bp, Homo sapiens
acagagacaggccca

SEQ ID NO: 1209341 - DNA, 13 bp, Homo sapiens
acagagagaatga

SEQ ID NO: 1209342 - DNA, 18 bp, Homo sapiens
acagagaggagaaacaca

SEQ ID NO: 1209343 - DNA, 18 bp, Homo sapiens
acagagaggatacattta

SEQ ID NO: 1209344 - DNA, 13 bp, Homo sapiens
acagagagggaca

SEQ ID NO: 1209345 - DNA, 21 bp, Homo sapiens
acagagattctggatctcctg

SEQ ID NO: 1209346 - DNA, 17 bp, Homo sapiens
acagagcaaagcgccca

SEQ ID NO: 1209347 - DNA, 15 bp, Homo sapiens
acagagcaagactct

SEQ ID NO: 1209348 - DNA, 14 bp, Homo sapiens
acagagcacactta

SEQ ID NO: 1209349 - DNA, 19 bp, Homo sapiens
acagagcacacttatttat

SEQ ID NO: 1209350 - DNA, 20 bp, Homo sapiens
acagagcacacttatttatg

SEQ ID NO: 1209351 - DNA, 19 bp, Homo sapiens
acagagcacatttgtcagt

SEQ ID NO: 1209352 - DNA, 13 bp, Homo sapiens
acagagcacgcct

SEQ ID NO: 1209353 - DNA, 15 bp, Homo sapiens
acagagcacgcctgc

SEQ ID NO: 1209354 - DNA, 19 bp, Homo sapiens
acagagcacgcctgccatc

SEQ ID NO: 1209355 - DNA, 12 bp, Homo sapiens
acagagcacttg

SEQ ID NO: 1209356 - DNA, 19 bp, Homo sapiens
acagagccaccccatgagc

SEQ ID NO: 1209357 - DNA, 11 bp, Homo sapiens
acagagccagg

SEQ ID NO: 1209358 - DNA, 13 bp, Homo sapiens
acagagccaggag

SEQ ID NO: 1209359 - DNA, 16 bp, Homo sapiens
acagagccaggagaag

SEQ ID NO: 1209360 - DNA, 17 bp, Homo sapiens
acagagccaggagaagc

SEQ ID NO: 1209361 - DNA, 22 bp, Homo sapiens
acagagccaggagaagctcagc

SEQ ID NO: 1209362 - DNA, 16 bp, Homo sapiens
acagagccccacgctg

SEQ ID NO: 1209363 - DNA, 21 bp, Homo sapiens
acagagcctcgggacatcaaa

SEQ ID NO: 1209364 - DNA, 22 bp, Homo sapiens
acagagcctgaatttgtaagca

SEQ ID NO: 1209365 - DNA, 11 bp, Homo sapiens
acagagcctgg

SEQ ID NO: 1209366 - DNA, 13 bp, Homo sapiens
acagagcctggcc

SEQ ID NO: 1209367 - DNA, 20 bp, Homo sapiens
acagagcctggccccaggcc

SEQ ID NO: 1209368 - DNA, 20 bp, Homo sapiens
acagagcgtccttccccctg

SEQ ID NO: 1209369 - DNA, 10 bp, Homo sapiens
acagagctga

SEQ ID NO: 1209370 - DNA, 22 bp, Homo sapiens
acagagctgaggatttcctgga

SEQ ID NO: 1209371 - DNA, 14 bp, Homo sapiens
acagagcttccctg

SEQ ID NO: 1209372 - DNA, 17 bp, Homo sapiens
acagagctttcttttgt

SEQ ID NO: 1209373 - DNA, 19 bp, Homo sapiens
acagaggaagaatttgtta

SEQ ID NO: 1209374 - DNA, 20 bp, Homo sapiens
acagaggaagaatttgttat

SEQ ID NO: 1209375 - DNA, 14 bp, Homo sapiens
acagaggaagagca

SEQ ID NO: 1209376 - DNA, 16 bp, Homo sapiens
acagaggaagagcagg

SEQ ID NO: 1209377 - DNA, 17 bp, Homo sapiens
acagaggaagagcaggc

SEQ ID NO: 1209378 - DNA, 17 bp, Homo sapiens
acagaggagagtcccag

SEQ ID NO: 1209379 - DNA, 17 bp, Homo sapiens
acagaggagcttttctg

SEQ ID NO: 1209380 - DNA, 19 bp, Homo sapiens
acagaggatgccttttctg

SEQ ID NO: 1209381 - DNA, 20 bp, Homo sapiens
acagaggatgccttttctgt

SEQ ID NO: 1209382 - DNA, 15 bp, Homo sapiens
acagaggcaggagtg

SEQ ID NO: 1209383 - DNA, 10 bp, Homo sapiens
acagaggccc

SEQ ID NO: 1209384 - DNA, 21 bp, Homo sapiens
acagaggccctgccacgtccc

SEQ ID NO: 1209385 - DNA, 17 bp, Homo sapiens
acagagggctcattttc

SEQ ID NO: 1209386 - DNA, 17 bp, Homo sapiens
acagagggtcccattgt

SEQ ID NO: 1209387 - DNA, 18 bp, Homo sapiens
acagagggtgataaatct

SEQ ID NO: 1209388 - DNA, 20 bp, Homo sapiens
acagaggtccgggtttagta

SEQ ID NO: 1209389 - DNA, 18 bp, Homo sapiens
acagagtacgttaaaagc

SEQ ID NO: 1209390 - DNA, 14 bp, Homo sapiens
acagagtatttctg

SEQ ID NO: 1209391 - DNA, 21 bp, Homo sapiens
acagagtgaaaaatcttaagt

SEQ ID NO: 1209392 - DNA, 17 bp, Homo sapiens
acagagtgagccagtga

SEQ ID NO: 1209393 - DNA, 23 bp, Homo sapiens
acagctggtcctccactttgctg

SEQ ID NO: 1209394 - DNA, 12 bp, Homo sapiens
acagctggtgcc

SEQ ID NO: 1209395 - DNA, 17 bp, Homo sapiens
acagctgtatttatata

SEQ ID NO: 1209396 - DNA, 21 bp, Homo sapiens
acagctgtattttggctttct

SEQ ID NO: 1209397 - DNA, 16 bp, Homo sapiens
acagctgtccctgtca

SEQ ID NO: 1209398 - DNA, 11 bp, Homo sapiens
acagctgtctg

SEQ ID NO: 1209399 - DNA, 14 bp, Homo sapiens
acagctgtctgcca

SEQ ID NO: 1209400 - DNA, 16 bp, Homo sapiens
acagctgtgagccatg

SEQ ID NO: 1209401 - DNA, 22 bp, Homo sapiens
acagctgtgagccatgcctccc

SEQ ID NO: 1209402 - DNA, 23 bp, Homo sapiens
acagctgtgagccatgcctccct

SEQ ID NO: 1209403 - DNA, 12 bp, Homo sapiens
acagctgtgtct

SEQ ID NO: 1209404 - DNA, 12 bp, Homo sapiens
acagctgtgtta

SEQ ID NO: 1209405 - DNA, 12 bp, Homo sapiens
acagctgttcct

SEQ ID NO: 1209406 - DNA, 16 bp, Homo sapiens
acagcttagatttcat

SEQ ID NO: 1209407 - DNA, 17 bp, Homo sapiens
acagcttcaccctgtca

SEQ ID NO: 1209408 - DNA, 17 bp, Homo sapiens
acagcttcatgcctttg

SEQ ID NO: 1209409 - DNA, 19 bp, Homo sapiens
acagcttcatgcctttgta

SEQ ID NO: 1209410 - DNA, 11 bp, Homo sapiens
acagcttcctc

SEQ ID NO: 1209411 - DNA, 13 bp, Homo sapiens
acagcttcctcac

SEQ ID NO: 1209412 - DNA, 13 bp, Homo sapiens
acagcttctccaa

SEQ ID NO: 1209413 - DNA, 15 bp, Homo sapiens
acagcttctctgcag

SEQ ID NO: 1209414 - DNA, 14 bp, Homo sapiens
acagcttcttctgc

SEQ ID NO: 1209415 - DNA, 16 bp, Homo sapiens
acagcttgagccgggc

SEQ ID NO: 1209416 - DNA, 16 bp, Homo sapiens
acagcttgctgtcact

SEQ ID NO: 1209417 - DNA, 17 bp, Homo sapiens
acagctttctgggatgt

SEQ ID NO: 1209418 - DNA, 19 bp, Homo sapiens
acagctttctgggatgtca

SEQ ID NO: 1209419 - DNA, 11 bp, Homo sapiens
acagctttgct

SEQ ID NO: 1209420 - DNA, 15 bp, Homo sapiens
acagctttgctccgc

SEQ ID NO: 1209421 - DNA, 16 bp, Homo sapiens
acagctttgctccgct

SEQ ID NO: 1209422 - DNA, 22 bp, Homo sapiens
acagctttgctccgctcccacc

SEQ ID NO: 1209423 - DNA, 15 bp, Homo sapiens
acagctttgctgctg

SEQ ID NO: 1209424 - DNA, 20 bp, Homo sapiens
acagcttttcccaggagacc

SEQ ID NO: 1209425 - DNA, 12 bp, Homo sapiens
acagcttttgca

SEQ ID NO: 1209426 - DNA, 14 bp, Homo sapiens
acagcttttgcaac

SEQ ID NO: 1209427 - DNA, 22 bp, Homo sapiens
acagcttttgcaacttaatact

SEQ ID NO: 1209428 - DNA, 17 bp, Homo sapiens
acaggaaagagtcacac

SEQ ID NO: 1209429 - DNA, 16 bp, Homo sapiens
acaggaaagccctccc

SEQ ID NO: 1209430 - DNA, 21 bp, Homo sapiens
acaggaacggccctgcaggag

SEQ ID NO: 1209431 - DNA, 23 bp, Homo sapiens
acaggaacggccctgcaggagca

SEQ ID NO: 1209432 - DNA, 17 bp, Homo sapiens
acaggaaggaggggaga

SEQ ID NO: 1209433 - DNA, 22 bp, Homo sapiens
acaggaaggaggggagagacag

SEQ ID NO: 1209434 - DNA, 16 bp, Homo sapiens
acaggaaggcaggagg

SEQ ID NO: 1209435 - DNA, 20 bp, Homo sapiens
acaggaaggtggtgcttaca

SEQ ID NO: 1209436 - DNA, 17 bp, Homo sapiens
acaggacacgaaggctg

SEQ ID NO: 1209437 - DNA, 12 bp, Homo sapiens
acaggaccccag

SEQ ID NO: 1209438 - DNA, 17 bp, Homo sapiens
acatcaaataaatttct

SEQ ID NO: 1209439 - DNA, 20 bp, Homo sapiens
acatcaaatttgccaccact

SEQ ID NO: 1209440 - DNA, 16 bp, Homo sapiens
acatcaacatcttggt

SEQ ID NO: 1209441 - DNA, 18 bp, Homo sapiens
acatcaacatcttggtca

SEQ ID NO: 1209442 - DNA, 15 bp, Homo sapiens
acatcaagcatgcaa

SEQ ID NO: 1209443 - DNA, 16 bp, Homo sapiens
acatcaagcttttctg

SEQ ID NO: 1209444 - DNA, 15 bp, Homo sapiens
acatcaatcctggta

SEQ ID NO: 1209445 - DNA, 21 bp, Homo sapiens
acatcaattaattaaatgaac

SEQ ID NO: 1209446 - DNA, 20 bp, Homo sapiens
acatcaattaattgattcct

SEQ ID NO: 1209447 - DNA, 13 bp, Homo sapiens
acatcacaggaca

SEQ ID NO: 1209448 - DNA, 21 bp, Homo sapiens
acatcaccctatatataattt

SEQ ID NO: 1209449 - DNA, 22 bp, Homo sapiens
acatcactgcttgatgaagcaa

SEQ ID NO: 1209450 - DNA, 19 bp, Homo sapiens
acatcacttgtacaaaata

SEQ ID NO: 1209451 - DNA, 16 bp, Homo sapiens
acatcactttgtgaat

SEQ ID NO: 1209452 - DNA, 18 bp, Homo sapiens
acatcagcaagactttat

SEQ ID NO: 1209453 - DNA, 19 bp, Homo sapiens
acatcagcaatttcagaac

SEQ ID NO: 1209454 - DNA, 18 bp, Homo sapiens
acatcagcacgatttctg

SEQ ID NO: 1209455 - DNA, 20 bp, Homo sapiens
acatcagcacgatttctgtt

SEQ ID NO: 1209456 - DNA, 21 bp, Homo sapiens
acatcagcacgatttctgttt

SEQ ID NO: 1209457 - DNA, 22 bp, Homo sapiens
acatcagcacgatttctgttta

SEQ ID NO: 1209458 - DNA, 14 bp, Homo sapiens
acatcagccatttt

SEQ ID NO: 1209459 - DNA, 18 bp, Homo sapiens
acatcagccatttttaga

SEQ ID NO: 1209460 - DNA, 23 bp, Homo sapiens
acatcaggagactgggctctggc

SEQ ID NO: 1209461 - DNA, 19 bp, Homo sapiens
acatcagtagcatttttct

SEQ ID NO: 1209462 - DNA, 20 bp, Homo sapiens
acatcagtagcatttttcta

SEQ ID NO: 1209463 - DNA, 23 bp, Homo sapiens
acatcagtggcatggctccagtc

SEQ ID NO: 1209464 - DNA, 20 bp, Homo sapiens
acatcagtgtctgtttcaga

SEQ ID NO: 1209465 - DNA, 20 bp, Homo sapiens
acatcagttactctgaaggg

SEQ ID NO: 1209466 - DNA, 16 bp, Homo sapiens
acatcataaggtttta

SEQ ID NO: 1209467 - DNA, 15 bp, Homo sapiens
acatcataattacat

SEQ ID NO: 1209468 - DNA, 17 bp, Homo sapiens
acatcataattacattc

SEQ ID NO: 1209469 - DNA, 21 bp, Homo sapiens
acatcatattctattgtttac

SEQ ID NO: 1209470 - DNA, 17 bp, Homo sapiens
acatcatggaccaaatg

SEQ ID NO: 1209471 - DNA, 19 bp, Homo sapiens
acatcattcatgacaacat

SEQ ID NO: 1209472 - DNA, 22 bp, Homo sapiens
acatcattcatgacaacatgaa

SEQ ID NO: 1209473 - DNA, 15 bp, Homo sapiens
acatcattctgtgtc

SEQ ID NO: 1209474 - DNA, 19 bp, Homo sapiens
acatccaactccagcaact

SEQ ID NO: 1209475 - DNA, 15 bp, Homo sapiens
acatccaactggaaa

SEQ ID NO: 1209476 - DNA, 13 bp, Homo sapiens
acatccaaggaga

SEQ ID NO: 1209477 - DNA, 13 bp, Homo sapiens
acatccagctcct

SEQ ID NO: 1209478 - DNA, 14 bp, Homo sapiens
acatccagctcctc

SEQ ID NO: 1209479 - DNA, 15 bp, Homo sapiens
acatccagctcctct

SEQ ID NO: 1209480 - DNA, 18 bp, Homo sapiens
acatccagctcctctagg

SEQ ID NO: 1209481 - DNA, 13 bp, Homo sapiens
acatccataaaga

SEQ ID NO: 1209482 - DNA, 14 bp, Homo sapiens
acatcccaaacttt

SEQ ID NO: 1209483 - DNA, 18 bp, Homo sapiens
acatcccaaactttaaaa

SEQ ID NO: 1209484 - DNA, 14 bp, Homo sapiens
acatcccacagtgg

SEQ ID NO: 1209485 - DNA, 20 bp, Homo sapiens
acatcccactggatctggct

SEQ ID NO: 1209486 - DNA, 13 bp, Homo sapiens
acatcccagcagc

SEQ ID NO: 1209487 - DNA, 14 bp, Homo sapiens
acatcccagcctgt

SEQ ID NO: 1209488 - DNA, 18 bp, Homo sapiens
acatcccagcctgtggtt

SEQ ID NO: 1209489 - DNA, 16 bp, Homo sapiens
acatcccattgccctg

SEQ ID NO: 1209490 - DNA, 17 bp, Homo sapiens
acatccccagagcccag

SEQ ID NO: 1209491 - DNA, 20 bp, Homo sapiens
acatccccagagcccagctc

SEQ ID NO: 1209492 - DNA, 23 bp, Homo sapiens
acatccccagagcccagctcttg

SEQ ID NO: 1209493 - DNA, 18 bp, Homo sapiens
acatccccagccagggag

SEQ ID NO: 1209494 - DNA, 18 bp, Homo sapiens
acatccctcctgctttta

SEQ ID NO: 1209495 - DNA, 12 bp, Homo sapiens
acatcccttcct

SEQ ID NO: 1209496 - DNA, 17 bp, Homo sapiens
acatcccttcctggaaa

SEQ ID NO: 1209497 - DNA, 20 bp, Homo sapiens
acatcccttcctggaaacag

SEQ ID NO: 1209498 - DNA, 19 bp, Homo sapiens
acatccgtcattgctgctg

SEQ ID NO: 1209499 - DNA, 12 bp, Homo sapiens
acatcctcctgc

SEQ ID NO: 1209500 - DNA, 19 bp, Homo sapiens
acatcctcctgcccagctc

SEQ ID NO: 1209501 - DNA, 11 bp, Homo sapiens
acatcctctcc

SEQ ID NO: 1209502 - DNA, 16 bp, Homo sapiens
acatcctctgatagct

SEQ ID NO: 1209503 - DNA, 19 bp, Homo sapiens
acatcctgggatccagtgt

SEQ ID NO: 1209504 - DNA, 14 bp, Homo sapiens
acatcctgtgtttc

SEQ ID NO: 1209505 - DNA, 23 bp, Homo sapiens
acatcctgtgtttctagggaaat

SEQ ID NO: 1209506 - DNA, 14 bp, Homo sapiens
acatccttccttcc

SEQ ID NO: 1209507 - DNA, 18 bp, Homo sapiens
acatcctttctaaacaag

SEQ ID NO: 1209508 - DNA, 14 bp, Homo sapiens
acatcgaatgtgta

SEQ ID NO: 1209509 - DNA, 16 bp, Homo sapiens
acatcgatatgtatat

SEQ ID NO: 1209510 - DNA, 20 bp, Homo sapiens
acatcgttgccgcagcggtg

SEQ ID NO: 1209511 - DNA, 15 bp, Homo sapiens
acatcgtttactttt

SEQ ID NO: 1209512 - DNA, 18 bp, Homo sapiens
acatcgtttactttttaa

SEQ ID NO: 1209513 - DNA, 13 bp, Homo sapiens
acatctaaagctt

SEQ ID NO: 1209514 - DNA, 22 bp, Homo sapiens
acatctaaagctttatctttgt

SEQ ID NO: 1209515 - DNA, 17 bp, Homo sapiens
acatctaacctcatctt

SEQ ID NO: 1209516 - DNA, 13 bp, Homo sapiens
acatctaagcctg

SEQ ID NO: 1209517 - DNA, 15 bp, Homo sapiens
accaaagcctcttca

SEQ ID NO: 1209518 - DNA, 14 bp, Homo sapiens
accaaagctgccca

SEQ ID NO: 1209519 - DNA, 18 bp, Homo sapiens
accaaagctgcccactgt

SEQ ID NO: 1209520 - DNA, 16 bp, Homo sapiens
accaaagctgcctgtg

SEQ ID NO: 1209521 - DNA, 21 bp, Homo sapiens
accaaagctgcctgtgccatg

SEQ ID NO: 1209522 - DNA, 13 bp, Homo sapiens
accaaagggggag

SEQ ID NO: 1209523 - DNA, 15 bp, Homo sapiens
accaaagtatttttt

SEQ ID NO: 1209524 - DNA, 13 bp, Homo sapiens
accaaagtctgcc

SEQ ID NO: 1209525 - DNA, 14 bp, Homo sapiens
accaaatacctcaa

SEQ ID NO: 1209526 - DNA, 15 bp, Homo sapiens
accaaatacctcaat

SEQ ID NO: 1209527 - DNA, 16 bp, Homo sapiens
accaaatattaaagat

SEQ ID NO: 1209528 - DNA, 14 bp, Homo sapiens
accaaatattttag

SEQ ID NO: 1209529 - DNA, 20 bp, Homo sapiens
accaaatgtgctttgagaag

SEQ ID NO: 1209530 - DNA, 20 bp, Homo sapiens
accaaattaacttacttcca

SEQ ID NO: 1209531 - DNA, 14 bp, Homo sapiens
accaaattatcttg

SEQ ID NO: 1209532 - DNA, 23 bp, Homo sapiens
accaaattcagcctactgcctcg

SEQ ID NO: 1209533 - DNA, 16 bp, Homo sapiens
accaaattgcttctag

SEQ ID NO: 1209534 - DNA, 23 bp, Homo sapiens
accaaattgcttctaggagtcaa

SEQ ID NO: 1209535 - DNA, 15 bp, Homo sapiens
accaaattgcttgag

SEQ ID NO: 1209536 - DNA, 18 bp, Homo sapiens
accaaattgcttgagcct

SEQ ID NO: 1209537 - DNA, 13 bp, Homo sapiens
accaaatttgtac

SEQ ID NO: 1209538 - DNA, 23 bp, Homo sapiens
accaacataaaaatgatctaaac

SEQ ID NO: 1209539 - DNA, 21 bp, Homo sapiens
accaacatcccattgccctgg

SEQ ID NO: 1209540 - DNA, 22 bp, Homo sapiens
accaacatctttgcgaaaagat

SEQ ID NO: 1209541 - DNA, 19 bp, Homo sapiens
accaaccccgcggcccaga

SEQ ID NO: 1209542 - DNA, 14 bp, Homo sapiens
accaaccctgggac

SEQ ID NO: 1209543 - DNA, 17 bp, Homo sapiens
accaaccctgtttcctg

SEQ ID NO: 1209544 - DNA, 19 bp, Homo sapiens
accaaccctgtttcctgag

SEQ ID NO: 1209545 - DNA, 15 bp, Homo sapiens
accaacctcactgcc

SEQ ID NO: 1209546 - DNA, 23 bp, Homo sapiens
accaacctccagtgtcagggtcc

SEQ ID NO: 1209547 - DNA, 23 bp, Homo sapiens
accaacctgggcaacatagtgag

SEQ ID NO: 1209548 - DNA, 20 bp, Homo sapiens
accaaccttccattcacacc

SEQ ID NO: 1209549 - DNA, 21 bp, Homo sapiens
accaacgttactcagggctcc

SEQ ID NO: 1209550 - DNA, 16 bp, Homo sapiens
accaactacaaccaag

SEQ ID NO: 1209551 - DNA, 16 bp, Homo sapiens
accaactatccaagtg

SEQ ID NO: 1209552 - DNA, 23 bp, Homo sapiens
accaactctgcactccatggcca

SEQ ID NO: 1209553 - DNA, 16 bp, Homo sapiens
accaactgccccaggg

SEQ ID NO: 1209554 - DNA, 13 bp, Homo sapiens
accaactgcccta

SEQ ID NO: 1209555 - DNA, 20 bp, Homo sapiens
accaactgccctaagccccc

SEQ ID NO: 1209556 - DNA, 11 bp, Homo sapiens
accaactgtgt

SEQ ID NO: 1209557 - DNA, 13 bp, Homo sapiens
accaactgtgttg

SEQ ID NO: 1209558 - DNA, 15 bp, Homo sapiens
accaactgtgttgta

SEQ ID NO: 1209559 - DNA, 21 bp, Homo sapiens
accaactgtgttgtattaaca

SEQ ID NO: 1209560 - DNA, 12 bp, Homo sapiens
accaacttacaa

SEQ ID NO: 1209561 - DNA, 15 bp, Homo sapiens
accaacttcctctgc

SEQ ID NO: 1209562 - DNA, 17 bp, Homo sapiens
accaacttcctctgcca

SEQ ID NO: 1209563 - DNA, 22 bp, Homo sapiens
accaacttggttctgcttcaat

SEQ ID NO: 1209564 - DNA, 15 bp, Homo sapiens
accaagaaagctcac

SEQ ID NO: 1209565 - DNA, 15 bp, Homo sapiens
accaagaactgcatg

SEQ ID NO: 1209566 - DNA, 19 bp, Homo sapiens
accaagaagcctttcctgt

SEQ ID NO: 1209567 - DNA, 20 bp, Homo sapiens
accaagaagcctttcctgta

SEQ ID NO: 1209568 - DNA, 13 bp, Homo sapiens
accaagagagaaa

SEQ ID NO: 1209569 - DNA, 20 bp, Homo sapiens
accaagagagaaagaagtag

SEQ ID NO: 1209570 - DNA, 16 bp, Homo sapiens
accaagaggctggttt

SEQ ID NO: 1209571 - DNA, 20 bp, Homo sapiens
accaagatacttaagtgctg

SEQ ID NO: 1209572 - DNA, 23 bp, Homo sapiens
accaagattatgtgacttgcaat

SEQ ID NO: 1209573 - DNA, 16 bp, Homo sapiens
accaagcacagcagcc

SEQ ID NO: 1209574 - DNA, 16 bp, Homo sapiens
accaagcatcaggggg

SEQ ID NO: 1209575 - DNA, 14 bp, Homo sapiens
accaagcatcttgg

SEQ ID NO: 1209576 - DNA, 15 bp, Homo sapiens
accaagccgtggctt

SEQ ID NO: 1209577 - DNA, 18 bp, Homo sapiens
accaagccgtggcttccc

SEQ ID NO: 1209578 - DNA, 11 bp, Homo sapiens
accaagccttg

SEQ ID NO: 1209579 - DNA, 17 bp, Homo sapiens
accaagcgaccaaggat

SEQ ID NO: 1209580 - DNA, 17 bp, Homo sapiens
accaagctgagtttcct

SEQ ID NO: 1209581 - DNA, 11 bp, Homo sapiens
accaaggaaac

SEQ ID NO: 1209582 - DNA, 18 bp, Homo sapiens
accaaggaaggagcccct

SEQ ID NO: 1209583 - DNA, 20 bp, Homo sapiens
accaaggaaggagcccctga

SEQ ID NO: 1209584 - DNA, 16 bp, Homo sapiens
accaaggacccctcac

SEQ ID NO: 1209585 - DNA, 18 bp, Homo sapiens
accaaggacccctcacct

SEQ ID NO: 1209586 - DNA, 16 bp, Homo sapiens
accaaggcaaggcagg

SEQ ID NO: 1209587 - DNA, 17 bp, Homo sapiens
accaaggcaaggcaggt

SEQ ID NO: 1209588 - DNA, 13 bp, Homo sapiens
accaaggcagcct

SEQ ID NO: 1209589 - DNA, 18 bp, Homo sapiens
accaaggcagcctccaga

SEQ ID NO: 1209590 - DNA, 24 bp, Homo sapiens
accaaggcagcctccagagccagc

SEQ ID NO: 1209591 - DNA, 14 bp, Homo sapiens
accaaggcagtgca

SEQ ID NO: 1209592 - DNA, 20 bp, Homo sapiens
accaaggggctcttgaaccc

SEQ ID NO: 1209593 - DNA, 23 bp, Homo sapiens
accaagtaaccaggccccagcct

SEQ ID NO: 1209594 - DNA, 23 bp, Homo sapiens
accaagtctaaaaagacctggcc

SEQ ID NO: 1209595 - DNA, 16 bp, Homo sapiens
accaagtggaccttga

SEQ ID NO: 1209596 - DNA, 14 bp, Homo sapiens
accaagtgtctaga

SEQ ID NO: 1209597 - DNA, 13 bp, Homo sapiens
accaagtgtgctc

SEQ ID NO: 1209598 - DNA, 23 bp, Homo sapiens
accaagttataaatcaatgtcac

SEQ ID NO: 1209599 - DNA, 23 bp, Homo sapiens
accaagttggaacatccttggaa

SEQ ID NO: 1209600 - DNA, 22 bp, Homo sapiens
accaatattaacacgctgcctg

SEQ ID NO: 1209601 - DNA, 15 bp, Homo sapiens
accaatattgtacag

SEQ ID NO: 1209602 - DNA, 12 bp, Homo sapiens
accaatctgccc

SEQ ID NO: 1209603 - DNA, 14 bp, Homo sapiens
accaatgaaaaaat

SEQ ID NO: 1209604 - DNA, 17 bp, Homo sapiens
accaatgcatgcagcca

SEQ ID NO: 1209605 - DNA, 23 bp, Homo sapiens
accaatgcctttttagatgtatt

SEQ ID NO: 1209606 - DNA, 16 bp, Homo sapiens
accaatggcattatta

SEQ ID NO: 1209607 - DNA, 22 bp, Homo sapiens
accaatggcattattaggtctt

SEQ ID NO: 1209608 - DNA, 14 bp, Homo sapiens
accaatgggaagca

SEQ ID NO: 1209609 - DNA, 22 bp, Homo sapiens
accaatggtgatcctctatttt

SEQ ID NO: 1209610 - DNA, 17 bp, Homo sapiens
accaatgtgttttctgt

SEQ ID NO: 1209611 - DNA, 18 bp, Homo sapiens
accaattcaccaacacag

SEQ ID NO: 1209612 - DNA, 22 bp, Homo sapiens
accaattgactctcacactgaa

SEQ ID NO: 1209613 - DNA, 24 bp, Homo sapiens
accaattgatgttttacgtgcaaa

SEQ ID NO: 1209614 - DNA, 13 bp, Homo sapiens
accaattgtgctg

SEQ ID NO: 1209615 - DNA, 16 bp, Homo sapiens
accaatttcttccttc

SEQ ID NO: 1209616 - DNA, 22 bp, Homo sapiens
accaatttcttccttccacagt

SEQ ID NO: 1209617 - DNA, 14 bp, Homo sapiens
accacaaaaatgaa

SEQ ID NO: 1209618 - DNA, 16 bp, Homo sapiens
accacaaaccctgctg

SEQ ID NO: 1209619 - DNA, 18 bp, Homo sapiens
accacaaacggagcccct

SEQ ID NO: 1209620 - DNA, 15 bp, Homo sapiens
accacaaccttgcag

SEQ ID NO: 1209621 - DNA, 13 bp, Homo sapiens
accacaagactct

SEQ ID NO: 1209622 - DNA, 14 bp, Homo sapiens
accacaagactctt

SEQ ID NO: 1209623 - DNA, 14 bp, Homo sapiens
accacaagctgagc

SEQ ID NO: 1209624 - DNA, 16 bp, Homo sapiens
accacaagctgagcag

SEQ ID NO: 1209625 - DNA, 21 bp, Homo sapiens
accacaaggctgttgcatggg

SEQ ID NO: 1209626 - DNA, 20 bp, Homo sapiens
accacaagtgaatctttctc

SEQ ID NO: 1209627 - DNA, 17 bp, Homo sapiens
accacaatgtttcttca

SEQ ID NO: 1209628 - DNA, 19 bp, Homo sapiens
accacaatgtttcttcatt

SEQ ID NO: 1209629 - DNA, 22 bp, Homo sapiens
accacacccgaagtcctgtcac

SEQ ID NO: 1209630 - DNA, 17 bp, Homo sapiens
accacaccctgtactgt

SEQ ID NO: 1209631 - DNA, 15 bp, Homo sapiens
accacacctccctga

SEQ ID NO: 1209632 - DNA, 16 bp, Homo sapiens
accacacctccctgaa

SEQ ID NO: 1209633 - DNA, 22 bp, Homo sapiens
accacactgggtgcgtctccag

SEQ ID NO: 1209634 - DNA, 21 bp, Homo sapiens
accacacttcctgtccagaga

SEQ ID NO: 1209635 - DNA, 18 bp, Homo sapiens
accacacttcttgaaaca

SEQ ID NO: 1209636 - DNA, 18 bp, Homo sapiens
accacagacacacacacg

SEQ ID NO: 1209637 - DNA, 23 bp, Homo sapiens
accacagatttgtgcccattcct

SEQ ID NO: 1209638 - DNA, 14 bp, Homo sapiens
accacagcaactga

SEQ ID NO: 1209639 - DNA, 17 bp, Homo sapiens
acatgcgggctcgccca

SEQ ID NO: 1209640 - DNA, 17 bp, Homo sapiens
acatgcggtagccagca

SEQ ID NO: 1209641 - DNA, 22 bp, Homo sapiens
acatgcggtagccagcacacag

SEQ ID NO: 1209642 - DNA, 16 bp, Homo sapiens
acatgcgtgtgtcagg

SEQ ID NO: 1209643 - DNA, 17 bp, Homo sapiens
acatgctaagagaagta

SEQ ID NO: 1209644 - DNA, 15 bp, Homo sapiens
acatgctcacctcta

SEQ ID NO: 1209645 - DNA, 20 bp, Homo sapiens
acatgctcacctctagcctt

SEQ ID NO: 1209646 - DNA, 18 bp, Homo sapiens
acatgctgaggttttgaa

SEQ ID NO: 1209647 - DNA, 14 bp, Homo sapiens
acatgctgcctggc

SEQ ID NO: 1209648 - DNA, 23 bp, Homo sapiens
acatgctggttacctgttccatt

SEQ ID NO: 1209649 - DNA, 14 bp, Homo sapiens
acatgctgtctggc

SEQ ID NO: 1209650 - DNA, 15 bp, Homo sapiens
acatgctgtctggcc

SEQ ID NO: 1209651 - DNA, 18 bp, Homo sapiens
acatgctgtctggccctg

SEQ ID NO: 1209652 - DNA, 17 bp, Homo sapiens
acatgctgtgctctttg

SEQ ID NO: 1209653 - DNA, 14 bp, Homo sapiens
acatgcttactttt

SEQ ID NO: 1209654 - DNA, 16 bp, Homo sapiens
acatgcttacttttta

SEQ ID NO: 1209655 - DNA, 14 bp, Homo sapiens
acatgcttgaataa

SEQ ID NO: 1209656 - DNA, 13 bp, Homo sapiens
acatgctttgtga

SEQ ID NO: 1209657 - DNA, 20 bp, Homo sapiens
acatgcttttctgccactcc

SEQ ID NO: 1209658 - DNA, 23 bp, Homo sapiens
acatggaaaacagagtatttctg

SEQ ID NO: 1209659 - DNA, 14 bp, Homo sapiens
acatggaagagaga

SEQ ID NO: 1209660 - DNA, 20 bp, Homo sapiens
acatggaataacatgtaatt

SEQ ID NO: 1209661 - DNA, 12 bp, Homo sapiens
acatggacccgg

SEQ ID NO: 1209662 - DNA, 22 bp, Homo sapiens
acatggacccggagctaacact

SEQ ID NO: 1209663 - DNA, 15 bp, Homo sapiens
acatggacttgtata

SEQ ID NO: 1209664 - DNA, 13 bp, Homo sapiens
acatggagatgta

SEQ ID NO: 1209665 - DNA, 21 bp, Homo sapiens
acatggagatgtaaaatgagt

SEQ ID NO: 1209666 - DNA, 14 bp, Homo sapiens
acatggattcagtt

SEQ ID NO: 1209667 - DNA, 19 bp, Homo sapiens
acatggattcagtttctaa

SEQ ID NO: 1209668 - DNA, 19 bp, Homo sapiens
accacagcaggtgtcatat

SEQ ID NO: 1209669 - DNA, 16 bp, Homo sapiens
accacagcatcatttt

SEQ ID NO: 1209670 - DNA, 20 bp, Homo sapiens
accacagccagcacctggca

SEQ ID NO: 1209671 - DNA, 19 bp, Homo sapiens
accacagcccgctctctgg

SEQ ID NO: 1209672 - DNA, 13 bp, Homo sapiens
accacagccctgt

SEQ ID NO: 1209673 - DNA, 14 bp, Homo sapiens
accacagccctgtc

SEQ ID NO: 1209674 - DNA, 16 bp, Homo sapiens
accacagccctgtcag

SEQ ID NO: 1209675 - DNA, 20 bp, Homo sapiens
accacagctgggcagggtga

SEQ ID NO: 1209676 - DNA, 22 bp, Homo sapiens
accacagggttcaaaatgtctg

SEQ ID NO: 1209677 - DNA, 22 bp, Homo sapiens
accacaggttcatgccaccatg

SEQ ID NO: 1209678 - DNA, 19 bp, Homo sapiens
accacagtgagcctgagag

SEQ ID NO: 1209679 - DNA, 16 bp, Homo sapiens
accacataatttttgt

SEQ ID NO: 1209680 - DNA, 18 bp, Homo sapiens
accacataatttttgtac

SEQ ID NO: 1209681 - DNA, 21 bp, Homo sapiens
accacataatttttgtacatc

SEQ ID NO: 1209682 - DNA, 14 bp, Homo sapiens
accacatagaacat

SEQ ID NO: 1209683 - DNA, 19 bp, Homo sapiens
accacatagcatgaggcca

SEQ ID NO: 1209684 - DNA, 22 bp, Homo sapiens
accacatagcatgcttcctttc

SEQ ID NO: 1209685 - DNA, 23 bp, Homo sapiens
accacatagcatgcttcctttct

SEQ ID NO: 1209686 - DNA, 20 bp, Homo sapiens
accacatataacacttaact

SEQ ID NO: 1209687 - DNA, 13 bp, Homo sapiens
accacatctgcca

SEQ ID NO: 1209688 - DNA, 13 bp, Homo sapiens
accacatctgtcc

SEQ ID NO: 1209689 - DNA, 14 bp, Homo sapiens
accacatctgtcct

SEQ ID NO: 1209690 - DNA, 18 bp, Homo sapiens
accacatggccttgcctc

SEQ ID NO: 1209691 - DNA, 12 bp, Homo sapiens
accacatgggct

SEQ ID NO: 1209692 - DNA, 14 bp, Homo sapiens
accacatgtcccag

SEQ ID NO: 1209693 - DNA, 14 bp, Homo sapiens
accacattgcctca

SEQ ID NO: 1209694 - DNA, 18 bp, Homo sapiens
accacattggggaaattt

SEQ ID NO: 1209695 - DNA, 19 bp, Homo sapiens
accacattttatatttatt

SEQ ID NO: 1209696 - DNA, 16 bp, Homo sapiens
accaccaagccaaggg

SEQ ID NO: 1209697 - DNA, 14 bp, Homo sapiens
accaccactggcca

SEQ ID NO: 1209698 - DNA, 15 bp, Homo sapiens
accaccactggccac

SEQ ID NO: 1209699 - DNA, 22 bp, Homo sapiens
accaccactggccaccaggctg

SEQ ID NO: 1209700 - DNA, 17 bp, Homo sapiens
accaccagccccagcaa

SEQ ID NO: 1209701 - DNA, 10 bp, Homo sapiens
accaccagcg

SEQ ID NO: 1209702 - DNA, 20 bp, Homo sapiens
accaccagcgttcccttctc

SEQ ID NO: 1209703 - DNA, 14 bp, Homo sapiens
accaccagggtgga

SEQ ID NO: 1209704 - DNA, 21 bp, Homo sapiens
accaccagggtggaccaggcc

SEQ ID NO: 1209705 - DNA, 23 bp, Homo sapiens
accaccagggtggaccaggcctg

SEQ ID NO: 1209706 - DNA, 13 bp, Homo sapiens
accacccagccct

SEQ ID NO: 1209707 - DNA, 14 bp, Homo sapiens
accacccagccctt

SEQ ID NO: 1209708 - DNA, 17 bp, Homo sapiens
accacccagcccttcct

SEQ ID NO: 1209709 - DNA, 21 bp, Homo sapiens
accacccccaaacacaaaaca

SEQ ID NO: 1209710 - DNA, 22 bp, Homo sapiens
accacccccccccatccccgct

SEQ ID NO: 1209711 - DNA, 14 bp, Homo sapiens
accaccccctgttc

SEQ ID NO: 1209712 - DNA, 16 bp, Homo sapiens
accaccccctgttccc

SEQ ID NO: 1209713 - DNA, 15 bp, Homo sapiens
accaccccttcctgt

SEQ ID NO: 1209714 - DNA, 20 bp, Homo sapiens
accaccctagtcccttcccc

SEQ ID NO: 1209715 - DNA, 19 bp, Homo sapiens
accaccctcactggctctc

SEQ ID NO: 1209716 - DNA, 11 bp, Homo sapiens
accaccctccc

SEQ ID NO: 1209717 - DNA, 13 bp, Homo sapiens
accaccctcccct

SEQ ID NO: 1209718 - DNA, 14 bp, Homo sapiens
accaccctcccctc

SEQ ID NO: 1209719 - DNA, 15 bp, Homo sapiens
accaccctctgggga

SEQ ID NO: 1209720 - DNA, 14 bp, Homo sapiens
accaccctgagccg

SEQ ID NO: 1209721 - DNA, 16 bp, Homo sapiens
accaccgcatatgcat

SEQ ID NO: 1209722 - DNA, 17 bp, Homo sapiens
accaccgcatatgcatg

SEQ ID NO: 1209723 - DNA, 23 bp, Homo sapiens
accaccgcctctggccgccaccc

SEQ ID NO: 1209724 - DNA, 13 bp, Homo sapiens
accaccgctcccc

SEQ ID NO: 1209725 - DNA, 18 bp, Homo sapiens
accaccgctccccagccc

SEQ ID NO: 1209726 - DNA, 19 bp, Homo sapiens
accaccgctccccagccca

SEQ ID NO: 1209727 - DNA, 21 bp, Homo sapiens
accaccgctccccagcccagg

SEQ ID NO: 1209728 - DNA, 17 bp, Homo sapiens
accaccgtctgtctcag

SEQ ID NO: 1209729 - DNA, 19 bp, Homo sapiens
accaccgttcagtcatttt

SEQ ID NO: 1209730 - DNA, 16 bp, Homo sapiens
accacctacacaggag

SEQ ID NO: 1209731 - DNA, 16 bp, Homo sapiens
accacctaggccactc

SEQ ID NO: 1209732 - DNA, 17 bp, Homo sapiens
accacctaggccactcc

SEQ ID NO: 1209733 - DNA, 20 bp, Homo sapiens
accacctaggccactcctcc

SEQ ID NO: 1209734 - DNA, 22 bp, Homo sapiens
accacctatatccagaagggga

SEQ ID NO: 1209735 - DNA, 15 bp, Homo sapiens
accacctcagaaagg

SEQ ID NO: 1209736 - DNA, 13 bp, Homo sapiens
accacctccaacc

SEQ ID NO: 1209737 - DNA, 20 bp, Homo sapiens
accaccttcccagctctccc

SEQ ID NO: 1209738 - DNA, 17 bp, Homo sapiens
accaccttggactcctc

SEQ ID NO: 1209739 - DNA, 19 bp, Homo sapiens
accaccttggactcctccc

SEQ ID NO: 1209740 - DNA, 21 bp, Homo sapiens
accaccttggactcctcccac

SEQ ID NO: 1209741 - DNA, 18 bp, Homo sapiens
accacctttggctggtag

SEQ ID NO: 1209742 - DNA, 13 bp, Homo sapiens
accacgactggcc

SEQ ID NO: 1209743 - DNA, 13 bp, Homo sapiens
accacgaggaaaa

SEQ ID NO: 1209744 - DNA, 15 bp, Homo sapiens
accacgaggctgccc

SEQ ID NO: 1209745 - DNA, 20 bp, Homo sapiens
accacgaggctgcccccatc

SEQ ID NO: 1209746 - DNA, 17 bp, Homo sapiens
accacgatgtggccctg

SEQ ID NO: 1209747 - DNA, 19 bp, Homo sapiens
accacgatgtggccctggc

SEQ ID NO: 1209748 - DNA, 19 bp, Homo sapiens
accacgcccgtcctgcctg

SEQ ID NO: 1209749 - DNA, 20 bp, Homo sapiens
accacgccgccctccatccg

SEQ ID NO: 1209750 - DNA, 21 bp, Homo sapiens
accacggacgtttccatcagg

SEQ ID NO: 1209751 - DNA, 15 bp, Homo sapiens
accacgtctgccagg

SEQ ID NO: 1209752 - DNA, 18 bp, Homo sapiens
accacgtctgccaggccc

SEQ ID NO: 1209753 - DNA, 23 bp, Homo sapiens
accacgtctgccaggcccatctc

SEQ ID NO: 1209754 - DNA, 17 bp, Homo sapiens
accacgtctggctccct

SEQ ID NO: 1209755 - DNA, 22 bp, Homo sapiens
accacgtgaaatttgcctctgt

SEQ ID NO: 1209756 - DNA, 15 bp, Homo sapiens
accactaaccatccc

SEQ ID NO: 1209757 - DNA, 11 bp, Homo sapiens
accactacagt

SEQ ID NO: 1209758 - DNA, 13 bp, Homo sapiens
accactcagcccc

SEQ ID NO: 1209759 - DNA, 12 bp, Homo sapiens
accactcctctc

SEQ ID NO: 1209760 - DNA, 17 bp, Homo sapiens
accactcctgtccctgt

SEQ ID NO: 1209761 - DNA, 21 bp, Homo sapiens
accactcctgtccctgtagct

SEQ ID NO: 1209762 - DNA, 19 bp, Homo sapiens
accactgccaatgctgtac

SEQ ID NO: 1209763 - DNA, 21 bp, Homo sapiens
accactgccccctgctgccat

SEQ ID NO: 1209764 - DNA, 16 bp, Homo sapiens
accactgcctgactgc

SEQ ID NO: 1209765 - DNA, 21 bp, Homo sapiens
accactgctgatattttctct

SEQ ID NO: 1209766 - DNA, 12 bp, Homo sapiens
accactgcttct

SEQ ID NO: 1209767 - DNA, 16 bp, Homo sapiens
accactgcttctcttt

SEQ ID NO: 1209768 - DNA, 12 bp, Homo sapiens
accactggccac

SEQ ID NO: 1209769 - DNA, 14 bp, Homo sapiens
accactggccacca

SEQ ID NO: 1209770 - DNA, 15 bp, Homo sapiens
accactggccaccag

SEQ ID NO: 1209771 - DNA, 14 bp, Homo sapiens
accactgggcctgc

SEQ ID NO: 1209772 - DNA, 16 bp, Homo sapiens
accactgggcctgcta

SEQ ID NO: 1209773 - DNA, 16 bp, Homo sapiens
accactggttaaaata

SEQ ID NO: 1209774 - DNA, 17 bp, Homo sapiens
accactgtagttctctc

SEQ ID NO: 1209775 - DNA, 14 bp, Homo sapiens
accactgtgaacat

SEQ ID NO: 1209776 - DNA, 14 bp, Homo sapiens
accactgtgccact

SEQ ID NO: 1209777 - DNA, 23 bp, Homo sapiens
accactgtgccactgacttgctg

SEQ ID NO: 1209778 - DNA, 12 bp, Homo sapiens
accacttacagt

SEQ ID NO: 1209779 - DNA, 18 bp, Homo sapiens
accacttagcctctttct

SEQ ID NO: 1209780 - DNA, 14 bp, Homo sapiens
accacttcagctga

SEQ ID NO: 1209781 - DNA, 16 bp, Homo sapiens
accccacccagctcca

SEQ ID NO: 1209782 - DNA, 16 bp, Homo sapiens
accccaccccaccccc

SEQ ID NO: 1209783 - DNA, 12 bp, Homo sapiens
accccaccccct

SEQ ID NO: 1209784 - DNA, 21 bp, Homo sapiens
accccacccccttcagtgccc

SEQ ID NO: 1209785 - DNA, 22 bp, Homo sapiens
accccacccccttcagtgccca

SEQ ID NO: 1209786 - DNA, 14 bp, Homo sapiens
accccaccctcagc

SEQ ID NO: 1209787 - DNA, 18 bp, Homo sapiens
accccactcaggggaccc

SEQ ID NO: 1209788 - DNA, 15 bp, Homo sapiens
accccactcccctca

SEQ ID NO: 1209789 - DNA, 19 bp, Homo sapiens
accccactgggccagccct

SEQ ID NO: 1209790 - DNA, 15 bp, Homo sapiens
accccagaaatcact

SEQ ID NO: 1209791 - DNA, 11 bp, Homo sapiens
accccagaggc

SEQ ID NO: 1209792 - DNA, 16 bp, Homo sapiens
accccagaggccttgt

SEQ ID NO: 1209793 - DNA, 18 bp, Homo sapiens
accccagcacagccacct

SEQ ID NO: 1209794 - DNA, 13 bp, Homo sapiens
accccagccccaa

SEQ ID NO: 1209795 - DNA, 12 bp, Homo sapiens
accccagcctcc

SEQ ID NO: 1209796 - DNA, 15 bp, Homo sapiens
accccagcctgacct

SEQ ID NO: 1209797 - DNA, 16 bp, Homo sapiens
accccagcctgacctg

SEQ ID NO: 1209798 - DNA, 21 bp, Homo sapiens
accccagcgtcaggcctacct

SEQ ID NO: 1209799 - DNA, 11 bp, Homo sapiens
accccagctcc

SEQ ID NO: 1209800 - DNA, 14 bp, Homo sapiens
accccagctcccta

SEQ ID NO: 1209801 - DNA, 23 bp, Homo sapiens
accccagctccctaggagaccaa

SEQ ID NO: 1209802 - DNA, 11 bp, Homo sapiens
accccagctct

SEQ ID NO: 1209803 - DNA, 15 bp, Homo sapiens
accccagctgggagg

SEQ ID NO: 1209804 - DNA, 20 bp, Homo sapiens
accccagctgggaggcaaga

SEQ ID NO: 1209805 - DNA, 17 bp, Homo sapiens
accccaggacgccactc

SEQ ID NO: 1209806 - DNA, 23 bp, Homo sapiens
accccaggacgccactcatttca

SEQ ID NO: 1209807 - DNA, 17 bp, Homo sapiens
accccagggcctgtctc

SEQ ID NO: 1209808 - DNA, 13 bp, Homo sapiens
accccaggtcagc

SEQ ID NO: 1209809 - DNA, 18 bp, Homo sapiens
accccaggtcagccctgt

SEQ ID NO: 1209810 - DNA, 19 bp, Homo sapiens
accccaggtcagccctgtg

SEQ ID NO: 1209811 - DNA, 20 bp, Homo sapiens
accccaggtcagccctgtgt

SEQ ID NO: 1209812 - DNA, 17 bp, Homo sapiens
accccaggtcaggggct

SEQ ID NO: 1209813 - DNA, 19 bp, Homo sapiens
accccaggtcaggggctcc

SEQ ID NO: 1209814 - DNA, 23 bp, Homo sapiens
accccaggtcaggggctccctac

SEQ ID NO: 1209815 - DNA, 14 bp, Homo sapiens
accccagtgggaac

SEQ ID NO: 1209816 - DNA, 19 bp, Homo sapiens
accccagttctaggggaga

SEQ ID NO: 1209817 - DNA, 15 bp, Homo sapiens
accccagtttcttct

SEQ ID NO: 1209818 - DNA, 15 bp, Homo sapiens
accccagtttttgtt

SEQ ID NO: 1209819 - DNA, 17 bp, Homo sapiens
accccatccagttcatg

SEQ ID NO: 1209820 - DNA, 16 bp, Homo sapiens
accccatcccaccagc

SEQ ID NO: 1209821 - DNA, 18 bp, Homo sapiens
accccatctgtgaataag

SEQ ID NO: 1209822 - DNA, 21 bp, Homo sapiens
accccatgcacctcagggcca

SEQ ID NO: 1209823 - DNA, 14 bp, Homo sapiens
accccatgggcttg

SEQ ID NO: 1209824 - DNA, 21 bp, Homo sapiens
accccatggtgctaggaagag

SEQ ID NO: 1209825 - DNA, 16 bp, Homo sapiens
accccattttctgtgg

SEQ ID NO: 1209826 - DNA, 15 bp, Homo sapiens
acccccaacccccag

SEQ ID NO: 1209827 - DNA, 18 bp, Homo sapiens
acccccaagcctgggctt

SEQ ID NO: 1209828 - DNA, 23 bp, Homo sapiens
acccccaataaaccttgaacagt

SEQ ID NO: 1209829 - DNA, 14 bp, Homo sapiens
accccctgccctgc

SEQ ID NO: 1209830 - DNA, 19 bp, Homo sapiens
accccctgctccaccagca

SEQ ID NO: 1209831 - DNA, 21 bp, Homo sapiens
accccctgctccaccagcagc

SEQ ID NO: 1209832 - DNA, 13 bp, Homo sapiens
accccctgggcag

SEQ ID NO: 1209833 - DNA, 20 bp, Homo sapiens
accccctgtcccattctaga

SEQ ID NO: 1209834 - DNA, 22 bp, Homo sapiens
accccctgtcccattctagatc

SEQ ID NO: 1209835 - DNA, 16 bp, Homo sapiens
accccctgttccctgt

SEQ ID NO: 1209836 - DNA, 16 bp, Homo sapiens
acccccttcagtgccc

SEQ ID NO: 1209837 - DNA, 18 bp, Homo sapiens
acccccttcagtgcccac

SEQ ID NO: 1209838 - DNA, 18 bp, Homo sapiens
acccccttctctgctcca

SEQ ID NO: 1209839 - DNA, 19 bp, Homo sapiens
acccccttctctgctccac

SEQ ID NO: 1209840 - DNA, 20 bp, Homo sapiens
acccccttctctgctccacc

SEQ ID NO: 1209841 - DNA, 15 bp, Homo sapiens
accccctttcccttc

SEQ ID NO: 1209842 - DNA, 13 bp, Homo sapiens
accccctttgctg

SEQ ID NO: 1209843 - DNA, 22 bp, Homo sapiens
accccgaaatcagcccccagcc

SEQ ID NO: 1209844 - DNA, 20 bp, Homo sapiens
accccgagggctgaggagca

SEQ ID NO: 1209845 - DNA, 12 bp, Homo sapiens
accccgcactgc

SEQ ID NO: 1209846 - DNA, 13 bp, Homo sapiens
accccgcactgca

SEQ ID NO: 1209847 - DNA, 15 bp, Homo sapiens
accccgcagacacct

SEQ ID NO: 1209848 - DNA, 18 bp, Homo sapiens
accccgcagacaccttgg

SEQ ID NO: 1209849 - DNA, 19 bp, Homo sapiens
accccgcctgccctcatgg

SEQ ID NO: 1209850 - DNA, 16 bp, Homo sapiens
accccgcggcccagac

SEQ ID NO: 1209851 - DNA, 17 bp, Homo sapiens
accccgcggcccagacc

SEQ ID NO: 1209852 - DNA, 22 bp, Homo sapiens
accccgcttttgcagcagagga

SEQ ID NO: 1209853 - DNA, 23 bp, Homo sapiens
accccggaggcgtggaggagagg

SEQ ID NO: 1209854 - DNA, 16 bp, Homo sapiens
accccgggatgcaagg

SEQ ID NO: 1209855 - DNA, 18 bp, Homo sapiens
acccgcctagctgctgtc

SEQ ID NO: 1209856 - DNA, 20 bp, Homo sapiens
acccgcctgctcccatcctc

SEQ ID NO: 1209857 - DNA, 13 bp, Homo sapiens
acccgctctggac

SEQ ID NO: 1209858 - DNA, 15 bp, Homo sapiens
acccgctctggacca

SEQ ID NO: 1209859 - DNA, 13 bp, Homo sapiens
acccgctgcccct

SEQ ID NO: 1209860 - DNA, 16 bp, Homo sapiens
acccgctgcccctccc

SEQ ID NO: 1209861 - DNA, 17 bp, Homo sapiens
acccgctggagcccaca

SEQ ID NO: 1209862 - DNA, 20 bp, Homo sapiens
acccgctggagcccacagcg

SEQ ID NO: 1209863 - DNA, 23 bp, Homo sapiens
accctgtcttctgggcacagtgg

SEQ ID NO: 1209864 - DNA, 19 bp, Homo sapiens
accctgtgacatggtgcct

SEQ ID NO: 1209865 - DNA, 21 bp, Homo sapiens
accctgtgacatggtgcctga

SEQ ID NO: 1209866 - DNA, 12 bp, Homo sapiens
accctgtggaag

SEQ ID NO: 1209867 - DNA, 15 bp, Homo sapiens
accctgtggccaggt

SEQ ID NO: 1209868 - DNA, 17 bp, Homo sapiens
accctgtggtcttcctc

SEQ ID NO: 1209869 - DNA, 24 bp, Homo sapiens
accctgtggttgcctgccctcctg

SEQ ID NO: 1209870 - DNA, 18 bp, Homo sapiens
accggcctgtgggtctct

SEQ ID NO: 1209871 - DNA, 22 bp, Homo sapiens
accggcctgtgggtctctgaag

SEQ ID NO: 1209872 - DNA, 18 bp, Homo sapiens
accgggagaaggcatgag

SEQ ID NO: 1209873 - DNA, 19 bp, Homo sapiens
accgggagaaggcatgaga

SEQ ID NO: 1209874 - DNA, 19 bp, Homo sapiens
accgggatgaacctatcct

SEQ ID NO: 1209875 - DNA, 12 bp, Homo sapiens
accgggcccccc

SEQ ID NO: 1209876 - DNA, 19 bp, Homo sapiens
accgggccctgggttcctc

SEQ ID NO: 1209877 - DNA, 21 bp, Homo sapiens
accgggctgcaggtgctgctg

SEQ ID NO: 1209878 - DNA, 22 bp, Homo sapiens
accgggctggctgcttgcagcc

SEQ ID NO: 1209879 - DNA, 23 bp, Homo sapiens
accgggctggctgcttgcagcca

SEQ ID NO: 1209880 - DNA, 23 bp, Homo sapiens
accgggctgggagctctgcagag

SEQ ID NO: 1209881 - DNA, 15 bp, Homo sapiens
accgggggctgctgg

SEQ ID NO: 1209882 - DNA, 18 bp, Homo sapiens
accgggggctgctgggcg

SEQ ID NO: 1209883 - DNA, 18 bp, Homo sapiens
accgggtgggcctggcct

SEQ ID NO: 1209884 - DNA, 19 bp, Homo sapiens
accgggtgggcctggcctg

SEQ ID NO: 1209885 - DNA, 14 bp, Homo sapiens
accggtcagtgcct

SEQ ID NO: 1209886 - DNA, 16 bp, Homo sapiens
accggtccagctggcc

SEQ ID NO: 1209887 - DNA, 15 bp, Homo sapiens
accggtgctgcagga

SEQ ID NO: 1209888 - DNA, 16 bp, Homo sapiens
accgtaaaggtttatt

SEQ ID NO: 1209889 - DNA, 19 bp, Homo sapiens
accgtactccctgcaccgt

SEQ ID NO: 1209890 - DNA, 14 bp, Homo sapiens
accgtactctcaca

SEQ ID NO: 1209891 - DNA, 22 bp, Homo sapiens
accgtccaggggagatggggag

SEQ ID NO: 1209892 - DNA, 14 bp, Homo sapiens
accgtccgccctgc

SEQ ID NO: 1209893 - DNA, 21 bp, Homo sapiens
accgtcctgctgtccctgtca

SEQ ID NO: 1209894 - DNA, 19 bp, Homo sapiens
accgtcctttcacacatct

SEQ ID NO: 1209895 - DNA, 15 bp, Homo sapiens
accgtcgacaagaat

SEQ ID NO: 1209896 - DNA, 14 bp, Homo sapiens
accgtcgaccagga

SEQ ID NO: 1209897 - DNA, 19 bp, Homo sapiens
accgtctcactgtgtgtct

SEQ ID NO: 1209898 - DNA, 16 bp, Homo sapiens
accgtctcggccctga

SEQ ID NO: 1209899 - DNA, 18 bp, Homo sapiens
accgtctcggccctgaac

SEQ ID NO: 1209900 - DNA, 14 bp, Homo sapiens
accgtcttccttca

SEQ ID NO: 1209901 - DNA, 22 bp, Homo sapiens
accgtgacatcagcgtagtgtt

SEQ ID NO: 1209902 - DNA, 23 bp, Homo sapiens
accgtgatttggaagagaggcac

SEQ ID NO: 1209903 - DNA, 17 bp, Homo sapiens
accgtgccaaccccacc

SEQ ID NO: 1209904 - DNA, 21 bp, Homo sapiens
accgtgccattgtactccagc

SEQ ID NO: 1209905 - DNA, 12 bp, Homo sapiens
accgtgccccac

SEQ ID NO: 1209906 - DNA, 17 bp, Homo sapiens
accgtgccccacctccc

SEQ ID NO: 1209907 - DNA, 16 bp, Homo sapiens
accgtgcgagctgccg

SEQ ID NO: 1209908 - DNA, 22 bp, Homo sapiens
accgtggaggaggaaggcaaga

SEQ ID NO: 1209909 - DNA, 14 bp, Homo sapiens
accgtggcctgggc

SEQ ID NO: 1209910 - DNA, 19 bp, Homo sapiens
accgtggcctgggcttggc

SEQ ID NO: 1209911 - DNA, 19 bp, Homo sapiens
accgtgtcaagctgctctg

SEQ ID NO: 1209912 - DNA, 21 bp, Homo sapiens
accgtgtcccaaggagctgat

SEQ ID NO: 1209913 - DNA, 16 bp, Homo sapiens
accgtgtcctcctctg

SEQ ID NO: 1209914 - DNA, 17 bp, Homo sapiens
accgtgtcctcctctga

SEQ ID NO: 1209915 - DNA, 20 bp, Homo sapiens
accgtgttagccaggatggt

SEQ ID NO: 1209916 - DNA, 21 bp, Homo sapiens
accgttcagtgtcccaggcag

SEQ ID NO: 1209917 - DNA, 14 bp, Homo sapiens
accgttctgtgcac

SEQ ID NO: 1209918 - DNA, 22 bp, Homo sapiens
accgtttcttcctgccagcagg

SEQ ID NO: 1209919 - DNA, 18 bp, Homo sapiens
accgttttcatcctggcc

SEQ ID NO: 1209920 - DNA, 20 bp, Homo sapiens
accgttttcatcctggcctc

SEQ ID NO: 1209921 - DNA, 18 bp, Homo sapiens
accgtttttatattactt

SEQ ID NO: 1209922 - DNA, 21 bp, Homo sapiens
accgtttttatattacttttg

SEQ ID NO: 1209923 - DNA, 21 bp, Homo sapiens
acctaaaaggaaatctcaccc

SEQ ID NO: 1209924 - DNA, 14 bp, Homo sapiens
acctaaaagtatta

SEQ ID NO: 1209925 - DNA, 13 bp, Homo sapiens
acctaaagaaaaa

SEQ ID NO: 1209926 - DNA, 10 bp, Homo sapiens
acctaaagac

SEQ ID NO: 1209927 - DNA, 21 bp, Homo sapiens
acctaaagcctaccctattct

SEQ ID NO: 1209928 - DNA, 20 bp, Homo sapiens
acctaaataaacacatagat

SEQ ID NO: 1209929 - DNA, 12 bp, Homo sapiens
acctaaatactg

SEQ ID NO: 1209930 - DNA, 21 bp, Homo sapiens
acctaacacattaaatgtgga

SEQ ID NO: 1209931 - DNA, 15 bp, Homo sapiens
acctaacccctttcc

SEQ ID NO: 1209932 - DNA, 16 bp, Homo sapiens
acctaacccctttcct

SEQ ID NO: 1209933 - DNA, 18 bp, Homo sapiens
acctaacccctttcctgc

SEQ ID NO: 1209934 - DNA, 15 bp, Homo sapiens
acctaagtcaggtaa

SEQ ID NO: 1209935 - DNA, 19 bp, Homo sapiens
acctaagtcaggtaatata

SEQ ID NO: 1209936 - DNA, 18 bp, Homo sapiens
acctaagtctctgtgaat

SEQ ID NO: 1209937 - DNA, 16 bp, Homo sapiens
acctaatcaggctgag

SEQ ID NO: 1209938 - DNA, 21 bp, Homo sapiens
acctaatgctggcctgactgg

SEQ ID NO: 1209939 - DNA, 12 bp, Homo sapiens
acctaatgttta

SEQ ID NO: 1209940 - DNA, 19 bp, Homo sapiens
acctaatgtttatgagcca

SEQ ID NO: 1209941 - DNA, 15 bp, Homo sapiens
acctaattaatatat

SEQ ID NO: 1209942 - DNA, 20 bp, Homo sapiens
acctacagacagacatacat

SEQ ID NO: 1209943 - DNA, 17 bp, Homo sapiens
acctacagtgtacagtc

SEQ ID NO: 1209944 - DNA, 17 bp, Homo sapiens
acctacagttttaactg

SEQ ID NO: 1209945 - DNA, 19 bp, Homo sapiens
acctaccacagtgtctgta

SEQ ID NO: 1209946 - DNA, 13 bp, Homo sapiens
acctacctcccac

SEQ ID NO: 1209947 - DNA, 13 bp, Homo sapiens
acctacctccctc

SEQ ID NO: 1209948 - DNA, 16 bp, Homo sapiens
acctacctccctccct

SEQ ID NO: 1209949 - DNA, 17 bp, Homo sapiens
acctacgtttgcaccgc

SEQ ID NO: 1209950 - DNA, 14 bp, Homo sapiens
acctccccaaagca

SEQ ID NO: 1209951 - DNA, 21 bp, Homo sapiens
acctccccagcattccagccc

SEQ ID NO: 1209952 - DNA, 14 bp, Homo sapiens
acctccccccactg

SEQ ID NO: 1209953 - DNA, 16 bp, Homo sapiens
acctccccccactgca

SEQ ID NO: 1209954 - DNA, 15 bp, Homo sapiens
acctccccctaccca

SEQ ID NO: 1209955 - DNA, 15 bp, Homo sapiens
acctccccctcactt

SEQ ID NO: 1209956 - DNA, 19 bp, Homo sapiens
acctccccctcccccttct

SEQ ID NO: 1209957 - DNA, 20 bp, Homo sapiens
acctccccctcccccttctc

SEQ ID NO: 1209958 - DNA, 11 bp, Homo sapiens
acctccccctt

SEQ ID NO: 1209959 - DNA, 21 bp, Homo sapiens
acctccccctttcacactgga

SEQ ID NO: 1209960 - DNA, 20 bp, Homo sapiens
acctccccggcctctctctt

SEQ ID NO: 1209961 - DNA, 21 bp, Homo sapiens
acctcccctatccacccagcc

SEQ ID NO: 1209962 - DNA, 23 bp, Homo sapiens
acctcccctatccacccagccca

SEQ ID NO: 1209963 - DNA, 14 bp, Homo sapiens
acctcccctgcctt

SEQ ID NO: 1209964 - DNA, 20 bp, Homo sapiens
acctcccctgccttgctgtt

SEQ ID NO: 1209965 - DNA, 14 bp, Homo sapiens
acctccctccccag

SEQ ID NO: 1209966 - DNA, 22 bp, Homo sapiens
acctccctccccagctccggag

SEQ ID NO: 1209967 - DNA, 13 bp, Homo sapiens
acctccctgcctc

SEQ ID NO: 1209968 - DNA, 13 bp, Homo sapiens
acctccctgtctc

SEQ ID NO: 1209969 - DNA, 15 bp, Homo sapiens
acctccctgtctccc

SEQ ID NO: 1209970 - DNA, 17 bp, Homo sapiens
acctccctgtctcccgg

SEQ ID NO: 1209971 - DNA, 12 bp, Homo sapiens
acctcccttccc

SEQ ID NO: 1209972 - DNA, 21 bp, Homo sapiens
acctcccttcccacctactgc

SEQ ID NO: 1209973 - DNA, 22 bp, Homo sapiens
acctcccttccgaccctctggg

SEQ ID NO: 1209974 - DNA, 18 bp, Homo sapiens
acctccgagaggcagcca

SEQ ID NO: 1209975 - DNA, 14 bp, Homo sapiens
acctccgcccctgc

SEQ ID NO: 1209976 - DNA, 15 bp, Homo sapiens
acctccgcccctgcc

SEQ ID NO: 1209977 - DNA, 13 bp, Homo sapiens
acctccgcctctc

SEQ ID NO: 1209978 - DNA, 14 bp, Homo sapiens
acctccgcgggctg

SEQ ID NO: 1209979 - DNA, 13 bp, Homo sapiens
acctccggctgcc

SEQ ID NO: 1209980 - DNA, 14 bp, Homo sapiens
acctcctaaaacaa

SEQ ID NO: 1209981 - DNA, 17 bp, Homo sapiens
acctcctaaatgcccca

SEQ ID NO: 1209982 - DNA, 14 bp, Homo sapiens
acctcctacccctt

SEQ ID NO: 1209983 - DNA, 15 bp, Homo sapiens
acctcctaccccttc

SEQ ID NO: 1209984 - DNA, 17 bp, Homo sapiens
acctcctaccccttcct

SEQ ID NO: 1209985 - DNA, 12 bp, Homo sapiens
acctcctaccct

SEQ ID NO: 1209986 - DNA, 16 bp, Homo sapiens
acctcctaccctccca

SEQ ID NO: 1209987 - DNA, 15 bp, Homo sapiens
acctcctagaggtgg

SEQ ID NO: 1209988 - DNA, 23 bp, Homo sapiens
acctcctagaggtgggcagctgg

SEQ ID NO: 1209989 - DNA, 16 bp, Homo sapiens
acctcctatatcatta

SEQ ID NO: 1209990 - DNA, 18 bp, Homo sapiens
acctcctatatcattatt

SEQ ID NO: 1209991 - DNA, 17 bp, Homo sapiens
acctcctatccttggag

SEQ ID NO: 1209992 - DNA, 21 bp, Homo sapiens
acctcctatccttggagagca

SEQ ID NO: 1209993 - DNA, 10 bp, Homo sapiens
acctcctccc

SEQ ID NO: 1209994 - DNA, 21 bp, Homo sapiens
acctcctccctaatgctcacc

SEQ ID NO: 1209995 - DNA, 19 bp, Homo sapiens
acctcctccctcattcatc

SEQ ID NO: 1209996 - DNA, 21 bp, Homo sapiens
acctcctgacaacgtctcttc

SEQ ID NO: 1209997 - DNA, 13 bp, Homo sapiens
acctcctgagaaa

SEQ ID NO: 1209998 - DNA, 19 bp, Homo sapiens
acctcctgagaaggcgagg

SEQ ID NO: 1209999 - DNA, 14 bp, Homo sapiens
acctcctgcccagg

SEQ ID NO: 1210000 - DNA, 19 bp, Homo sapiens
acctcctgcccaggagagc

SEQ ID NO: 1210001 - DNA, 20 bp, Homo sapiens
acctcctgcccaggagagcc

SEQ ID NO: 1210002 - DNA, 16 bp, Homo sapiens
acctcctgcggctcag

SEQ ID NO: 1210003 - DNA, 21 bp, Homo sapiens
acctcctgcggctcagccttg

SEQ ID NO: 1210004 - DNA, 22 bp, Homo sapiens
acctcctgcggctcagccttgc

SEQ ID NO: 1210005 - DNA, 13 bp, Homo sapiens
acctcctgctgtg

SEQ ID NO: 1210006 - DNA, 13 bp, Homo sapiens
acctcctggtggt

SEQ ID NO: 1210007 - DNA, 19 bp, Homo sapiens
acctccttagccctgtctg

SEQ ID NO: 1210008 - DNA, 22 bp, Homo sapiens
acctcctttcatcacactgggt

SEQ ID NO: 1210009 - DNA, 13 bp, Homo sapiens
acctcgctcccct

SEQ ID NO: 1210010 - DNA, 14 bp, Homo sapiens
acctcgctgagggc

SEQ ID NO: 1210011 - DNA, 18 bp, Homo sapiens
acctcggggacaccagag

SEQ ID NO: 1210012 - DNA, 14 bp, Homo sapiens
acctcggggagagg

SEQ ID NO: 1210013 - DNA, 17 bp, Homo sapiens
acctcggtgccttcctc

SEQ ID NO: 1210014 - DNA, 14 bp, Homo sapiens
acctcgtcctcccc

SEQ ID NO: 1210015 - DNA, 21 bp, Homo sapiens
acctcgtcctccccctgccag

SEQ ID NO: 1210016 - DNA, 22 bp, Homo sapiens
acctcgtcctccccctgccagt

SEQ ID NO: 1210017 - DNA, 19 bp, Homo sapiens
acctctacccaaaccctag

SEQ ID NO: 1210018 - DNA, 19 bp, Homo sapiens
acctctagccttaaggggg

SEQ ID NO: 1210019 - DNA, 16 bp, Homo sapiens
acctctagctgttctt

SEQ ID NO: 1210020 - DNA, 15 bp, Homo sapiens
acctctatccaaaga

SEQ ID NO: 1210021 - DNA, 19 bp, Homo sapiens
acctctcacgggccctgcc

SEQ ID NO: 1210022 - DNA, 19 bp, Homo sapiens
acctctcagcatagcctgc

SEQ ID NO: 1210023 - DNA, 11 bp, Homo sapiens
acctctccaag

SEQ ID NO: 1210024 - DNA, 23 bp, Homo sapiens
acctctccaagtctctctgtgaa

SEQ ID NO: 1210025 - DNA, 14 bp, Homo sapiens
acctctcctcatgt

SEQ ID NO: 1210026 - DNA, 15 bp, Homo sapiens
acctctcctgacccc

SEQ ID NO: 1210027 - DNA, 20 bp, Homo sapiens
acctctcctttggccattcc

SEQ ID NO: 1210028 - DNA, 23 bp, Homo sapiens
acctctctcctttgctgaggcct

SEQ ID NO: 1210029 - DNA, 13 bp, Homo sapiens
acctctctgcctc

SEQ ID NO: 1210030 - DNA, 17 bp, Homo sapiens
acctctctgcctctctt

SEQ ID NO: 1210031 - DNA, 20 bp, Homo sapiens
acctctctgcctctcttctt

SEQ ID NO: 1210032 - DNA, 14 bp, Homo sapiens
acctctctgggacc

SEQ ID NO: 1210033 - DNA, 22 bp, Homo sapiens
acctctctgggacctaggggga

SEQ ID NO: 1210034 - DNA, 20 bp, Homo sapiens
acctctctgtagtttatggc

SEQ ID NO: 1210035 - DNA, 14 bp, Homo sapiens
acctctctgtcatg

SEQ ID NO: 1210036 - DNA, 16 bp, Homo sapiens
acctctctgtcatgtg

SEQ ID NO: 1210037 - DNA, 12 bp, Homo sapiens
acctctctgtcc

SEQ ID NO: 1210038 - DNA, 14 bp, Homo sapiens
acctctctgtccct

SEQ ID NO: 1210039 - DNA, 14 bp, Homo sapiens
acctctcttcagcc

SEQ ID NO: 1210040 - DNA, 21 bp, Homo sapiens
acctctcttttcctctctgtc

SEQ ID NO: 1210041 - DNA, 13 bp, Homo sapiens
acctctgaaggca

SEQ ID NO: 1210042 - DNA, 19 bp, Homo sapiens
acctctgaaggcaaatata

SEQ ID NO: 1210043 - DNA, 12 bp, Homo sapiens
acctctgaggac

SEQ ID NO: 1210044 - DNA, 21 bp, Homo sapiens
acctctgaggacagaggccgg

SEQ ID NO: 1210045 - DNA, 15 bp, Homo sapiens
acctctgatacctca

SEQ ID NO: 1210046 - DNA, 20 bp, Homo sapiens
acctctgatagactttgtga

SEQ ID NO: 1210047 - DNA, 13 bp, Homo sapiens
acctctgcccttc

SEQ ID NO: 1210048 - DNA, 15 bp, Homo sapiens
acctctgcccttccc

SEQ ID NO: 1210049 - DNA, 12 bp, Homo sapiens
acctctgcctca

SEQ ID NO: 1210050 - DNA, 13 bp, Homo sapiens
acctctgcctcaa

SEQ ID NO: 1210051 - DNA, 19 bp, Homo sapiens
acctctgccttacaaaata

SEQ ID NO: 1210052 - DNA, 12 bp, Homo sapiens
acctctgctctg

SEQ ID NO: 1210053 - DNA, 19 bp, Homo sapiens
acctctgctgagtgctggg

SEQ ID NO: 1210054 - DNA, 20 bp, Homo sapiens
acctctggaaccccccaggc

SEQ ID NO: 1210055 - DNA, 23 bp, Homo sapiens
acctctggaaccccccaggccct

SEQ ID NO: 1210056 - DNA, 19 bp, Homo sapiens
acctctggactggctagag

SEQ ID NO: 1210057 - DNA, 18 bp, Homo sapiens
acctctggattcattgtc

SEQ ID NO: 1210058 - DNA, 9 bp, Homo sapiens
acctctggc

SEQ ID NO: 1210059 - DNA, 14 bp, Homo sapiens
acctctggcccttg

SEQ ID NO: 1210060 - DNA, 15 bp, Homo sapiens
acctctggcccttgg

SEQ ID NO: 1210061 - DNA, 16 bp, Homo sapiens
acctctggcccttgga

SEQ ID NO: 1210062 - DNA, 13 bp, Homo sapiens
acctctgggcttc

SEQ ID NO: 1210063 - DNA, 18 bp, Homo sapiens
acctctgggtccttggct

SEQ ID NO: 1210064 - DNA, 17 bp, Homo sapiens
acctctggttaatttat

SEQ ID NO: 1210065 - DNA, 18 bp, Homo sapiens
acctctggttatcctgta

SEQ ID NO: 1210066 - DNA, 20 bp, Homo sapiens
acctctgtctcatcctcctg

SEQ ID NO: 1210067 - DNA, 21 bp, Homo sapiens
acctctgtctcatcctcctgg

SEQ ID NO: 1210068 - DNA, 19 bp, Homo sapiens
acctctgtcttggctttca

SEQ ID NO: 1210069 - DNA, 21 bp, Homo sapiens
acctctgtgggcactggtggg

SEQ ID NO: 1210070 - DNA, 23 bp, Homo sapiens
acctctgttcatttcacacagtg

SEQ ID NO: 1210071 - DNA, 16 bp, Homo sapiens
acctctgttgtcctcc

SEQ ID NO: 1210072 - DNA, 20 bp, Homo sapiens
acctcttaacaatttctgtc

SEQ ID NO: 1210073 - DNA, 12 bp, Homo sapiens
acctcttcctct

SEQ ID NO: 1210074 - DNA, 19 bp, Homo sapiens
acctcttcctctggttcct

SEQ ID NO: 1210075 - DNA, 14 bp, Homo sapiens
acctcttgctgtct

SEQ ID NO: 1210076 - DNA, 18 bp, Homo sapiens
accgcctgccctgcctgg

SEQ ID NO: 1210077 - DNA, 18 bp, Homo sapiens
accgcctggccctccctc

SEQ ID NO: 1210078 - DNA, 12 bp, Homo sapiens
accgccttctct

SEQ ID NO: 1210079 - DNA, 18 bp, Homo sapiens
accgcgttgtaaaatata

SEQ ID NO: 1210080 - DNA, 18 bp, Homo sapiens
accgctcacctagagcca

SEQ ID NO: 1210081 - DNA, 14 bp, Homo sapiens
accgctcagtatta

SEQ ID NO: 1210082 - DNA, 22 bp, Homo sapiens
accgctcagtattactttctgc

SEQ ID NO: 1210083 - DNA, 16 bp, Homo sapiens
accgctcagtgtcagc

SEQ ID NO: 1210084 - DNA, 13 bp, Homo sapiens
accgctccccagc

SEQ ID NO: 1210085 - DNA, 14 bp, Homo sapiens
accgctccccagcc

SEQ ID NO: 1210086 - DNA, 19 bp, Homo sapiens
accgctccccagcccaggg

SEQ ID NO: 1210087 - DNA, 16 bp, Homo sapiens
accgctgccagcacag

SEQ ID NO: 1210088 - DNA, 20 bp, Homo sapiens
accgctgcctaagtggctgc

SEQ ID NO: 1210089 - DNA, 15 bp, Homo sapiens
accgcttcacccctg

SEQ ID NO: 1210090 - DNA, 15 bp, Homo sapiens
accggaactgggctg

SEQ ID NO: 1210091 - DNA, 20 bp, Homo sapiens
accggaactgggctggcgct

SEQ ID NO: 1210092 - DNA, 22 bp, Homo sapiens
accggaaggaggccaaccagcc

SEQ ID NO: 1210093 - DNA, 15 bp, Homo sapiens
accggaaggttttta

SEQ ID NO: 1210094 - DNA, 16 bp, Homo sapiens
accggacttttctgca

SEQ ID NO: 1210095 - DNA, 23 bp, Homo sapiens
accggagctttcaaagaaggaat

SEQ ID NO: 1210096 - DNA, 16 bp, Homo sapiens
acctcttgctgtctct

SEQ ID NO: 1210097 - DNA, 17 bp, Homo sapiens
acctcttgctgtctctg

SEQ ID NO: 1210098 - DNA, 20 bp, Homo sapiens
acctcttgctgtctctgctc

SEQ ID NO: 1210099 - DNA, 20 bp, Homo sapiens
acctcttgtgcaaggtggcc

SEQ ID NO: 1210100 - DNA, 19 bp, Homo sapiens
acctctttattttttgatt

SEQ ID NO: 1210101 - DNA, 18 bp, Homo sapiens
acctcttttctgcatcat

SEQ ID NO: 1210102 - DNA, 20 bp, Homo sapiens
acctcttttgagactttgcc

SEQ ID NO: 1210103 - DNA, 23 bp, Homo sapiens
acctcttttgagactttgcccag

SEQ ID NO: 1210104 - DNA, 14 bp, Homo sapiens
acctctttttcctc

SEQ ID NO: 1210105 - DNA, 19 bp, Homo sapiens
acctgaaaaaaagtttaca

SEQ ID NO: 1210106 - DNA, 20 bp, Homo sapiens
acctgaaaacactgtgcaca

SEQ ID NO: 1210107 - DNA, 21 bp, Homo sapiens
acctgaaaacactgtgcacat

SEQ ID NO: 1210108 - DNA, 12 bp, Homo sapiens
acctgaaaagta

SEQ ID NO: 1210109 - DNA, 15 bp, Homo sapiens
acctgaaacactgga

SEQ ID NO: 1210110 - DNA, 16 bp, Homo sapiens
acctgaaacactggac

SEQ ID NO: 1210111 - DNA, 13 bp, Homo sapiens
acctgaaagcctg

SEQ ID NO: 1210112 - DNA, 14 bp, Homo sapiens
acctgaaagcctgt

SEQ ID NO: 1210113 - DNA, 16 bp, Homo sapiens
acctgaaagcctgtct

SEQ ID NO: 1210114 - DNA, 17 bp, Homo sapiens
acctgaaagcctgtctc

SEQ ID NO: 1210115 - DNA, 16 bp, Homo sapiens
acctgaaaggaaggtt

SEQ ID NO: 1210116 - DNA, 21 bp, Homo sapiens
acctgaaataatatatttctt

SEQ ID NO: 1210117 - DNA, 22 bp, Homo sapiens
acctgaaattaatttgtgaatt

SEQ ID NO: 1210118 - DNA, 18 bp, Homo sapiens
acctgaaccccatgggct

SEQ ID NO: 1210119 - DNA, 16 bp, Homo sapiens
acctgaactgaacacc

SEQ ID NO: 1210120 - DNA, 23 bp, Homo sapiens
acctgaagagcgctcctctgcct

SEQ ID NO: 1210121 - DNA, 20 bp, Homo sapiens
acctgaagatgtctcctcaa

SEQ ID NO: 1210122 - DNA, 22 bp, Homo sapiens
acctgaagatgtctcctcaagc

SEQ ID NO: 1210123 - DNA, 20 bp, Homo sapiens
acctgaaggtattggcctgt

SEQ ID NO: 1210124 - DNA, 21 bp, Homo sapiens
acctgaaggtattggcctgtt

SEQ ID NO: 1210125 - DNA, 15 bp, Homo sapiens
acctgaatcagctgg

SEQ ID NO: 1210126 - DNA, 19 bp, Homo sapiens
acctgacacaccaggcgct

SEQ ID NO: 1210127 - DNA, 21 bp, Homo sapiens
acctgacacaccaggcgctaa

SEQ ID NO: 1210128 - DNA, 12 bp, Homo sapiens
acctgacagatg

SEQ ID NO: 1210129 - DNA, 17 bp, Homo sapiens
acctgacctcttgctgt

SEQ ID NO: 1210130 - DNA, 18 bp, Homo sapiens
acctgacctcttgctgtc

SEQ ID NO: 1210131 - DNA, 20 bp, Homo sapiens
acctgacctcttgctgtctc

SEQ ID NO: 1210132 - DNA, 17 bp, Homo sapiens
acctgacggctggggac

SEQ ID NO: 1210133 - DNA, 20 bp, Homo sapiens
acctgactattgaagttgca

SEQ ID NO: 1210134 - DNA, 15 bp, Homo sapiens
acctgactctgaaat

SEQ ID NO: 1210135 - DNA, 16 bp, Homo sapiens
acctgacttggctggg

SEQ ID NO: 1210136 - DNA, 18 bp, Homo sapiens
acctgagaccctactgaa

SEQ ID NO: 1210137 - DNA, 16 bp, Homo sapiens
acctgagaccctggga

SEQ ID NO: 1210138 - DNA, 20 bp, Homo sapiens
acctgagaccctgggagaga

SEQ ID NO: 1210139 - DNA, 21 bp, Homo sapiens
acctgagaccctgggagagaa

SEQ ID NO: 1210140 - DNA, 23 bp, Homo sapiens
acctgagacgggcatcgcaggag

SEQ ID NO: 1210141 - DNA, 21 bp, Homo sapiens
acctgagactgtcggagaggc

SEQ ID NO: 1210142 - DNA, 18 bp, Homo sapiens
acctgagcccgcagccca

SEQ ID NO: 1210143 - DNA, 23 bp, Homo sapiens
acctgagcccggatgcttctcca

SEQ ID NO: 1210144 - DNA, 18 bp, Homo sapiens
acctgagcggcaccctgg

SEQ ID NO: 1210145 - DNA, 20 bp, Homo sapiens
acctgagcggcaccctggtc

SEQ ID NO: 1210146 - DNA, 15 bp, Homo sapiens
acctgaggcagatga

SEQ ID NO: 1210147 - DNA, 14 bp, Homo sapiens
acctgaggctggtt

SEQ ID NO: 1210148 - DNA, 14 bp, Homo sapiens
acctgaggctgtgg

SEQ ID NO: 1210149 - DNA, 12 bp, Homo sapiens
acctgagggcaa

SEQ ID NO: 1210150 - DNA, 15 bp, Homo sapiens
acctgagggcaaaga

SEQ ID NO: 1210151 - DNA, 22 bp, Homo sapiens
acctgaggtgggcccaggacca

SEQ ID NO: 1210152 - DNA, 20 bp, Homo sapiens
acctgaggtgggctggggct

SEQ ID NO: 1210153 - DNA, 16 bp, Homo sapiens
acctgatacatttaca

SEQ ID NO: 1210154 - DNA, 21 bp, Homo sapiens
acctgatgccccttccccaag

SEQ ID NO: 1210155 - DNA, 16 bp, Homo sapiens
acctgattgatcacac

SEQ ID NO: 1210156 - DNA, 17 bp, Homo sapiens
acctgattgatcacaca

SEQ ID NO: 1210157 - DNA, 14 bp, Homo sapiens
acctgattgtattt

SEQ ID NO: 1210158 - DNA, 23 bp, Homo sapiens
acctgattgtattttttttttaa

SEQ ID NO: 1210159 - DNA, 11 bp, Homo sapiens
acctgattttt

SEQ ID NO: 1210160 - DNA, 13 bp, Homo sapiens
acctgcaaaaaat

SEQ ID NO: 1210161 - DNA, 17 bp, Homo sapiens
acctgcacctcccccca

SEQ ID NO: 1210162 - DNA, 17 bp, Homo sapiens
acctgcactaacagagt

SEQ ID NO: 1210163 - DNA, 11 bp, Homo sapiens
acctgcactga

SEQ ID NO: 1210164 - DNA, 18 bp, Homo sapiens
acctgcagcgggcaaaga

SEQ ID NO: 1210165 - DNA, 19 bp, Homo sapiens
acctgcaggccaagagcag

SEQ ID NO: 1210166 - DNA, 12 bp, Homo sapiens
acctgcaggctc

SEQ ID NO: 1210167 - DNA, 17 bp, Homo sapiens
acctgcaggctcccgag

SEQ ID NO: 1210168 - DNA, 22 bp, Homo sapiens
acctgcatccgtagttccctga

SEQ ID NO: 1210169 - DNA, 14 bp, Homo sapiens
acctgcatggtgtt

SEQ ID NO: 1210170 - DNA, 23 bp, Homo sapiens
acctgccacaaaccaccaggact

SEQ ID NO: 1210171 - DNA, 16 bp, Homo sapiens
acctgccaccagggag

SEQ ID NO: 1210172 - DNA, 18 bp, Homo sapiens
acctgccaccagggagct

SEQ ID NO: 1210173 - DNA, 15 bp, Homo sapiens
acctgccacccccag

SEQ ID NO: 1210174 - DNA, 15 bp, Homo sapiens
acctgccagcctggc

SEQ ID NO: 1210175 - DNA, 18 bp, Homo sapiens
acctgccagcctggcttc

SEQ ID NO: 1210176 - DNA, 21 bp, Homo sapiens
acctgccagcctggcttctgg

SEQ ID NO: 1210177 - DNA, 15 bp, Homo sapiens
acctgccagtcccag

SEQ ID NO: 1210178 - DNA, 19 bp, Homo sapiens
acctgccatttgcaccctc

SEQ ID NO: 1210179 - DNA, 21 bp, Homo sapiens
acctgcccaacctgctctcct

SEQ ID NO: 1210180 - DNA, 18 bp, Homo sapiens
acctgcccagctccccaa

SEQ ID NO: 1210181 - DNA, 12 bp, Homo sapiens
acctgccccctt

SEQ ID NO: 1210182 - DNA, 16 bp, Homo sapiens
acctgcccccttctcc

SEQ ID NO: 1210183 - DNA, 17 bp, Homo sapiens
acctgcccccttctccc

SEQ ID NO: 1210184 - DNA, 23 bp, Homo sapiens
acctgcccccttctcccacactg

SEQ ID NO: 1210185 - DNA, 23 bp, Homo sapiens
acctgccccgcccagctgcacct

SEQ ID NO: 1210186 - DNA, 20 bp, Homo sapiens
acctgccccgtagagaatgt

SEQ ID NO: 1210187 - DNA, 18 bp, Homo sapiens
acctgcccctctgttctc

SEQ ID NO: 1210188 - DNA, 11 bp, Homo sapiens
acctgcccctg

SEQ ID NO: 1210189 - DNA, 15 bp, Homo sapiens
acctgccctccctca

SEQ ID NO: 1210190 - DNA, 14 bp, Homo sapiens
acctgccctgcctg

SEQ ID NO: 1210191 - DNA, 17 bp, Homo sapiens
acctgccctgcctgagg

SEQ ID NO: 1210192 - DNA, 20 bp, Homo sapiens
acctgccgacctcgtcctcc

SEQ ID NO: 1210193 - DNA, 17 bp, Homo sapiens
acctgccgcatgctccc

SEQ ID NO: 1210194 - DNA, 17 bp, Homo sapiens
acctgcctagcatgggg

SEQ ID NO: 1210195 - DNA, 13 bp, Homo sapiens
acctgcctcagga

SEQ ID NO: 1210196 - DNA, 18 bp, Homo sapiens
acctgcctcctcgttcct

SEQ ID NO: 1210197 - DNA, 14 bp, Homo sapiens
acctgcctcctgcc

SEQ ID NO: 1210198 - DNA, 17 bp, Homo sapiens
acctgcctcctgcctgc

SEQ ID NO: 1210199 - DNA, 18 bp, Homo sapiens
acctgcctgccgctgcag

SEQ ID NO: 1210200 - DNA, 21 bp, Homo sapiens
acctgcctgccgctgcaggaa

SEQ ID NO: 1210201 - DNA, 19 bp, Homo sapiens
acctgcctttgtatgtgga

SEQ ID NO: 1210202 - DNA, 18 bp, Homo sapiens
acctgccttttaagtttg

SEQ ID NO: 1210203 - DNA, 23 bp, Homo sapiens
acctgcgagggccgcccgctccc

SEQ ID NO: 1210204 - DNA, 17 bp, Homo sapiens
acctgcgagtgttatga

SEQ ID NO: 1210205 - DNA, 20 bp, Homo sapiens
acctgcgcttctgctggagg

SEQ ID NO: 1210206 - DNA, 21 bp, Homo sapiens
acctgcgcttctgctggagga

SEQ ID NO: 1210207 - DNA, 21 bp, Homo sapiens
acctgcgggtcctcagctgct

SEQ ID NO: 1210208 - DNA, 22 bp, Homo sapiens
acctgctccagaagatgccagc

SEQ ID NO: 1210209 - DNA, 18 bp, Homo sapiens
acctgctccgccaggaaa

SEQ ID NO: 1210210 - DNA, 17 bp, Homo sapiens
acctgctccgctgctcc

SEQ ID NO: 1210211 - DNA, 22 bp, Homo sapiens
acctgctccgctgctccttggc

SEQ ID NO: 1210212 - DNA, 12 bp, Homo sapiens
acctgctctcct

SEQ ID NO: 1210213 - DNA, 17 bp, Homo sapiens
acctgctctcctcttgc

SEQ ID NO: 1210214 - DNA, 13 bp, Homo sapiens
acctgctctcttg

SEQ ID NO: 1210215 - DNA, 18 bp, Homo sapiens
acctgctgacctgtgcac

SEQ ID NO: 1210216 - DNA, 16 bp, Homo sapiens
acctgctgagagaccc

SEQ ID NO: 1210217 - DNA, 14 bp, Homo sapiens
acctgctgcgtccc

SEQ ID NO: 1210218 - DNA, 19 bp, Homo sapiens
acctgctgcgtccccactc

SEQ ID NO: 1210219 - DNA, 15 bp, Homo sapiens
acctgctggcccctc

SEQ ID NO: 1210220 - DNA, 20 bp, Homo sapiens
acggcaacgtagcctgggct

SEQ ID NO: 1210221 - DNA, 22 bp, Homo sapiens
acggcaacgtagcctgggctca

SEQ ID NO: 1210222 - DNA, 23 bp, Homo sapiens
acggcacctcggggacaccagag

SEQ ID NO: 1210223 - DNA, 21 bp, Homo sapiens
acggcagcccccccctcaagg

SEQ ID NO: 1210224 - DNA, 22 bp, Homo sapiens
acggcagcccccccctcaaggg

SEQ ID NO: 1210225 - DNA, 21 bp, Homo sapiens
acggcaggcgtgtggcagcca

SEQ ID NO: 1210226 - DNA, 23 bp, Homo sapiens
acggcaggcgtgtggcagccaca

SEQ ID NO: 1210227 - DNA, 19 bp, Homo sapiens
acggcatcgcatccgtcct

SEQ ID NO: 1210228 - DNA, 19 bp, Homo sapiens
acggccaatggtgcttccc

SEQ ID NO: 1210229 - DNA, 18 bp, Homo sapiens
acggccacatcaaagagg

SEQ ID NO: 1210230 - DNA, 15 bp, Homo sapiens
acggccaccctcctt

SEQ ID NO: 1210231 - DNA, 18 bp, Homo sapiens
acggccaccctccttccc

SEQ ID NO: 1210232 - DNA, 20 bp, Homo sapiens
acggccaccctccttcccgc

SEQ ID NO: 1210233 - DNA, 22 bp, Homo sapiens
acggccaggaaaagccctcatc

SEQ ID NO: 1210234 - DNA, 14 bp, Homo sapiens
acggcccgcagcct

SEQ ID NO: 1210235 - DNA, 20 bp, Homo sapiens
acggcccggcccctcaccct

SEQ ID NO: 1210236 - DNA, 19 bp, Homo sapiens
acggccctgcaggagcagg

SEQ ID NO: 1210237 - DNA, 13 bp, Homo sapiens
acggccctgctgg

SEQ ID NO: 1210238 - DNA, 22 bp, Homo sapiens
acggcctaggggtggcgctcag

SEQ ID NO: 1210239 - DNA, 23 bp, Homo sapiens
acggcctaggggtggcgctcaga

SEQ ID NO: 1210240 - DNA, 15 bp, Homo sapiens
acggcctgatgctcc

SEQ ID NO: 1210241 - DNA, 19 bp, Homo sapiens
acggcctgatgctccctcc

SEQ ID NO: 1210242 - DNA, 21 bp, Homo sapiens
acggccttcaactgaaaagac

SEQ ID NO: 1210243 - DNA, 16 bp, Homo sapiens
acggcgctgcctcagg

SEQ ID NO: 1210244 - DNA, 18 bp, Homo sapiens
acggcgggatcctccaca

SEQ ID NO: 1210245 - DNA, 23 bp, Homo sapiens
acggcgggatcctccacagagag

SEQ ID NO: 1210246 - DNA, 13 bp, Homo sapiens
acggctcctcccc

SEQ ID NO: 1210247 - DNA, 17 bp, Homo sapiens
acggctcctccccgatc

SEQ ID NO: 1210248 - DNA, 18 bp, Homo sapiens
acggctcctccccgatcc

SEQ ID NO: 1210249 - DNA, 12 bp, Homo sapiens
acggctggggac

SEQ ID NO: 1210250 - DNA, 16 bp, Homo sapiens
acggctggggacccac

SEQ ID NO: 1210251 - DNA, 20 bp, Homo sapiens
acggctggggacccacccag

SEQ ID NO: 1210252 - DNA, 18 bp, Homo sapiens
acggctggtcactctgcc

SEQ ID NO: 1210253 - DNA, 23 bp, Homo sapiens
acggcttagacttcgactcagga

SEQ ID NO: 1210254 - DNA, 15 bp, Homo sapiens
acgggaatgcctagg

SEQ ID NO: 1210255 - DNA, 16 bp, Homo sapiens
acgggactgacgcaac

SEQ ID NO: 1210256 - DNA, 18 bp, Homo sapiens
acgggactgcggaggaag

SEQ ID NO: 1210257 - DNA, 21 bp, Homo sapiens
acgggcaagtgagaggggagg

SEQ ID NO: 1210258 - DNA, 21 bp, Homo sapiens
acgggcagccacaggactgag

SEQ ID NO: 1210259 - DNA, 12 bp, Homo sapiens
acgggcaggggt

SEQ ID NO: 1210260 - DNA, 17 bp, Homo sapiens
acgggcagtctgctctg

SEQ ID NO: 1210261 - DNA, 16 bp, Homo sapiens
acgggcatgggcctct

SEQ ID NO: 1210262 - DNA, 19 bp, Homo sapiens
acgggcatgggcctctctg

SEQ ID NO: 1210263 - DNA, 21 bp, Homo sapiens
acgggcatgggcctctctggg

SEQ ID NO: 1210264 - DNA, 22 bp, Homo sapiens
acgggcatgggcctctctgggg

SEQ ID NO: 1210265 - DNA, 14 bp, Homo sapiens
acgggcatgtatta

SEQ ID NO: 1210266 - DNA, 22 bp, Homo sapiens
acgggccagtttctctgccttc

SEQ ID NO: 1210267 - DNA, 21 bp, Homo sapiens
acgggccctccttccctcctg

SEQ ID NO: 1210268 - DNA, 18 bp, Homo sapiens
acgggctccttcccctgc

SEQ ID NO: 1210269 - DNA, 23 bp, Homo sapiens
acggggaggccaagtgcaggctg

SEQ ID NO: 1210270 - DNA, 23 bp, Homo sapiens
acggggcagttagagcagcctcg

SEQ ID NO: 1210271 - DNA, 23 bp, Homo sapiens
acggggccacgtgtgctgtggcc

SEQ ID NO: 1210272 - DNA, 20 bp, Homo sapiens
acggggccgacattgtctcc

SEQ ID NO: 1210273 - DNA, 11 bp, Homo sapiens
acggggcctcc

SEQ ID NO: 1210274 - DNA, 14 bp, Homo sapiens
acggggtccttcaa

SEQ ID NO: 1210275 - DNA, 21 bp, Homo sapiens
acggggtcggacggggcaggc

SEQ ID NO: 1210276 - DNA, 14 bp, Homo sapiens
acggggtggggagg

SEQ ID NO: 1210277 - DNA, 16 bp, Homo sapiens
acggggtggggagggt

SEQ ID NO: 1210278 - DNA, 20 bp, Homo sapiens
acggggttggctgttccaga

SEQ ID NO: 1210279 - DNA, 23 bp, Homo sapiens
acgggtctcacttataccaaagg

SEQ ID NO: 1210280 - DNA, 18 bp, Homo sapiens
acgggtctgagactgaaa

SEQ ID NO: 1210281 - DNA, 22 bp, Homo sapiens
acggtagcagccacacttcctt

SEQ ID NO: 1210282 - DNA, 19 bp, Homo sapiens
acggtatcctccctgccca

SEQ ID NO: 1210283 - DNA, 15 bp, Homo sapiens
acggtcaggtttaac

SEQ ID NO: 1210284 - DNA, 20 bp, Homo sapiens
acggtcaggtttaacatttg

SEQ ID NO: 1210285 - DNA, 15 bp, Homo sapiens
acggtccgcggcctg

SEQ ID NO: 1210286 - DNA, 20 bp, Homo sapiens
acggtcctttaggcagcctg

SEQ ID NO: 1210287 - DNA, 16 bp, Homo sapiens
acggtcgccacctggc

SEQ ID NO: 1210288 - DNA, 16 bp, Homo sapiens
acggtctggggaagag

SEQ ID NO: 1210289 - DNA, 19 bp, Homo sapiens
acggtgactctgtccagct

SEQ ID NO: 1210290 - DNA, 17 bp, Homo sapiens
acggtgcagtctgggtg

SEQ ID NO: 1210291 - DNA, 23 bp, Homo sapiens
acggtgccaagggccccaggggc

SEQ ID NO: 1210292 - DNA, 18 bp, Homo sapiens
acggtgcccatcctgcca

SEQ ID NO: 1210293 - DNA, 20 bp, Homo sapiens
acggtgcgtggctgtggcac

SEQ ID NO: 1210294 - DNA, 23 bp, Homo sapiens
acggtgctatatccagttcctgc

SEQ ID NO: 1210295 - DNA, 21 bp, Homo sapiens
acggtggggcgtagacttgac

SEQ ID NO: 1210296 - DNA, 17 bp, Homo sapiens
acggtgttttgccatgt

SEQ ID NO: 1210297 - DNA, 15 bp, Homo sapiens
acggttaacttgtat

SEQ ID NO: 1210298 - DNA, 21 bp, Homo sapiens
acggttcagtttcttctgcgc

SEQ ID NO: 1210299 - DNA, 20 bp, Homo sapiens
acggtttctagcctctgaga

SEQ ID NO: 1210300 - DNA, 15 bp, Homo sapiens
acggttttactgcag

SEQ ID NO: 1210301 - DNA, 13 bp, Homo sapiens
acgtaaaacattt

SEQ ID NO: 1210302 - DNA, 14 bp, Homo sapiens
acgtaaaatttaca

SEQ ID NO: 1210303 - DNA, 19 bp, Homo sapiens
acgtaaagaattttcatcc

SEQ ID NO: 1210304 - DNA, 17 bp, Homo sapiens
acgtaaagctagaaatg

SEQ ID NO: 1210305 - DNA, 18 bp, Homo sapiens
acgtaaccacggaaaaga

SEQ ID NO: 1210306 - DNA, 18 bp, Homo sapiens
acgtactacggagaaact

SEQ ID NO: 1210307 - DNA, 14 bp, Homo sapiens
acgtactgtaactg

SEQ ID NO: 1210308 - DNA, 24 bp, Homo sapiens
acgtagcttctaccatgaacagaa

SEQ ID NO: 1210309 - DNA, 15 bp, Homo sapiens
acgtagggggctctg

SEQ ID NO: 1210310 - DNA, 16 bp, Homo sapiens
acgtataaatatcagt

SEQ ID NO: 1210311 - DNA, 18 bp, Homo sapiens
acgtataaatatcagtat

SEQ ID NO: 1210312 - DNA, 23 bp, Homo sapiens
acgtataaatatcagtattctga

SEQ ID NO: 1210313 - DNA, 15 bp, Homo sapiens
acgtatatataaaca

SEQ ID NO: 1210314 - DNA, 16 bp, Homo sapiens
acgtattgctgtgtct

SEQ ID NO: 1210315 - DNA, 13 bp, Homo sapiens
acgtatttaatag

SEQ ID NO: 1210316 - DNA, 22 bp, Homo sapiens
acgtatttatatttggaaagag

SEQ ID NO: 1210317 - DNA, 21 bp, Homo sapiens
acgtcaacccaagctctgggg

SEQ ID NO: 1210318 - DNA, 16 bp, Homo sapiens
acgtcacgctccctga

SEQ ID NO: 1210319 - DNA, 17 bp, Homo sapiens
acgtcatgtattttatg

SEQ ID NO: 1210320 - DNA, 17 bp, Homo sapiens
acgtcccaccccacctc

SEQ ID NO: 1210321 - DNA, 21 bp, Homo sapiens
acgtcccaccccacctcttgt

SEQ ID NO: 1210322 - DNA, 20 bp, Homo sapiens
acgtcccagcatccctggag

SEQ ID NO: 1210323 - DNA, 21 bp, Homo sapiens
acgtcccagcatccctggagc

SEQ ID NO: 1210324 - DNA, 21 bp, Homo sapiens
acgtcccagcggcctcagggt

SEQ ID NO: 1210325 - DNA, 15 bp, Homo sapiens
acgtcccgctgcctc

SEQ ID NO: 1210326 - DNA, 20 bp, Homo sapiens
acgtcctcgaattctcagac

SEQ ID NO: 1210327 - DNA, 16 bp, Homo sapiens
acgtcctgagaaagct

SEQ ID NO: 1210328 - DNA, 17 bp, Homo sapiens
acgtctagctatgctgt

SEQ ID NO: 1210329 - DNA, 19 bp, Homo sapiens
acgtctagctatgctgtat

SEQ ID NO: 1210330 - DNA, 12 bp, Homo sapiens
acgtctgccagg

SEQ ID NO: 1210331 - DNA, 17 bp, Homo sapiens
acgtctgccaggcccat

SEQ ID NO: 1210332 - DNA, 18 bp, Homo sapiens
acgtctgccaggcccatc

SEQ ID NO: 1210333 - DNA, 17 bp, Homo sapiens
acgtctggccaggcact

SEQ ID NO: 1210334 - DNA, 17 bp, Homo sapiens
acgtctgggagaaattg

SEQ ID NO: 1210335 - DNA, 22 bp, Homo sapiens
acgtctgggagaaattgacaga

SEQ ID NO: 1210336 - DNA, 17 bp, Homo sapiens
acgtgaaatttgcctct

SEQ ID NO: 1210337 - DNA, 18 bp, Homo sapiens
acgtgaaatttgcctctg

SEQ ID NO: 1210338 - DNA, 16 bp, Homo sapiens
acgtgaagaaataaat

SEQ ID NO: 1210339 - DNA, 14 bp, Homo sapiens
acgtgacaacacaa

SEQ ID NO: 1210340 - DNA, 19 bp, Homo sapiens
acgtgacagtgcctgggaa

SEQ ID NO: 1210341 - DNA, 21 bp, Homo sapiens
acgtgaccggacttttctgca

SEQ ID NO: 1210342 - DNA, 20 bp, Homo sapiens
acgtgatcctctcacctcag

SEQ ID NO: 1210343 - DNA, 17 bp, Homo sapiens
acgttttcttctttccc

SEQ ID NO: 1210344 - DNA, 19 bp, Homo sapiens
acgttttcttctttccctg

SEQ ID NO: 1210345 - DNA, 19 bp, Homo sapiens
acgtttttgtgctgtgggc

SEQ ID NO: 1210346 - DNA, 18 bp, Homo sapiens
acgttttttcctcagtgc

SEQ ID NO: 1210347 - DNA, 16 bp, Homo sapiens
actaaaaaaaaaaagg

SEQ ID NO: 1210348 - DNA, 16 bp, Homo sapiens
actaaaaagaaggaaa

SEQ ID NO: 1210349 - DNA, 17 bp, Homo sapiens
actaaaaaggaaacttc

SEQ ID NO: 1210350 - DNA, 21 bp, Homo sapiens
actaaaaagtataaaatagta

SEQ ID NO: 1210351 - DNA, 21 bp, Homo sapiens
actaaaaataaattaataaat

SEQ ID NO: 1210352 - DNA, 18 bp, Homo sapiens
actaaaacattatatgta

SEQ ID NO: 1210353 - DNA, 12 bp, Homo sapiens
actaaaactcag

SEQ ID NO: 1210354 - DNA, 16 bp, Homo sapiens
actaaaactcagagaa

SEQ ID NO: 1210355 - DNA, 14 bp, Homo sapiens
actaaaatatttat

SEQ ID NO: 1210356 - DNA, 23 bp, Homo sapiens
actaaaattaggactgtataagt

SEQ ID NO: 1210357 - DNA, 22 bp, Homo sapiens
actaaaattttaggcactctta

SEQ ID NO: 1210358 - DNA, 13 bp, Homo sapiens
actaaacaaataa

SEQ ID NO: 1210359 - DNA, 11 bp, Homo sapiens
actaaacagaa

SEQ ID NO: 1210360 - DNA, 13 bp, Homo sapiens
actaaacattttg

SEQ ID NO: 1210361 - DNA, 13 bp, Homo sapiens
actaaaccacttc

SEQ ID NO: 1210362 - DNA, 18 bp, Homo sapiens
actaaaccacttctctgc

SEQ ID NO: 1210363 - DNA, 19 bp, Homo sapiens
actaaaccacttctctgct

SEQ ID NO: 1210364 - DNA, 21 bp, Homo sapiens
actaaaccacttctctgctgc

SEQ ID NO: 1210365 - DNA, 23 bp, Homo sapiens
actaaacttggtgcttattgata

SEQ ID NO: 1210366 - DNA, 13 bp, Homo sapiens
actaaactttacc

SEQ ID NO: 1210367 - DNA, 19 bp, Homo sapiens
actaaactttatttgtaaa

SEQ ID NO: 1210368 - DNA, 12 bp, Homo sapiens
actaaagagaga

SEQ ID NO: 1210369 - DNA, 16 bp, Homo sapiens
actaaagatccaagaa

SEQ ID NO: 1210370 - DNA, 15 bp, Homo sapiens
actaaagcaaattgt

SEQ ID NO: 1210371 - DNA, 16 bp, Homo sapiens
actaaagcaaattgtt

SEQ ID NO: 1210372 - DNA, 17 bp, Homo sapiens
actaaagcagtagaaat

SEQ ID NO: 1210373 - DNA, 14 bp, Homo sapiens
actaaagtatgtaa

SEQ ID NO: 1210374 - DNA, 21 bp, Homo sapiens
actaaataacacagatattgt

SEQ ID NO: 1210375 - DNA, 22 bp, Homo sapiens
actaaataatgaataaactgaa

SEQ ID NO: 1210376 - DNA, 13 bp, Homo sapiens
actaaatatatgt

SEQ ID NO: 1210377 - DNA, 21 bp, Homo sapiens
actaaatatatgtctgtgtgt

SEQ ID NO: 1210378 - DNA, 13 bp, Homo sapiens
actaaatatctgt

SEQ ID NO: 1210379 - DNA, 19 bp, Homo sapiens
actaaatatgctctgagta

SEQ ID NO: 1210380 - DNA, 14 bp, Homo sapiens
actaaatctctaat

SEQ ID NO: 1210381 - DNA, 17 bp, Homo sapiens
actaaatctctaatatg

SEQ ID NO: 1210382 - DNA, 20 bp, Homo sapiens
actaaatggtgttacattaa

SEQ ID NO: 1210383 - DNA, 18 bp, Homo sapiens
actaaattcaaagaagta

SEQ ID NO: 1210384 - DNA, 18 bp, Homo sapiens
actaaattgtatacattt

SEQ ID NO: 1210385 - DNA, 13 bp, Homo sapiens
actaacagataag

SEQ ID NO: 1210386 - DNA, 18 bp, Homo sapiens
actaacaggccaaagagt

SEQ ID NO: 1210387 - DNA, 20 bp, Homo sapiens
actaacataaaatctgtgaa

SEQ ID NO: 1210388 - DNA, 15 bp, Homo sapiens
actaacatataatgt

SEQ ID NO: 1210389 - DNA, 17 bp, Homo sapiens
actaacatataatgttg

SEQ ID NO: 1210390 - DNA, 16 bp, Homo sapiens
actaaccagcagaaat

SEQ ID NO: 1210391 - DNA, 17 bp, Homo sapiens
actaaccagcagaaatg

SEQ ID NO: 1210392 - DNA, 14 bp, Homo sapiens
actaaccatcccca

SEQ ID NO: 1210393 - DNA, 17 bp, Homo sapiens
actaaccatccccaact

SEQ ID NO: 1210394 - DNA, 19 bp, Homo sapiens
actaaccatccccaactcc

SEQ ID NO: 1210395 - DNA, 20 bp, Homo sapiens
actaaccatccccaactcca

SEQ ID NO: 1210396 - DNA, 21 bp, Homo sapiens
actaaccttgagtcagaaaac

SEQ ID NO: 1210397 - DNA, 17 bp, Homo sapiens
actaacgataaaaggta

SEQ ID NO: 1210398 - DNA, 14 bp, Homo sapiens
actaactaaactct

SEQ ID NO: 1210399 - DNA, 23 bp, Homo sapiens
actagaattctagtgctgctgaa

SEQ ID NO: 1210400 - DNA, 15 bp, Homo sapiens
actagaatttattca

SEQ ID NO: 1210401 - DNA, 15 bp, Homo sapiens
actagactactcaat

SEQ ID NO: 1210402 - DNA, 22 bp, Homo sapiens
actagagaatgttcccaatttg

SEQ ID NO: 1210403 - DNA, 17 bp, Homo sapiens
actagagacaaatcttt

SEQ ID NO: 1210404 - DNA, 14 bp, Homo sapiens
actagagatattct

SEQ ID NO: 1210405 - DNA, 19 bp, Homo sapiens
actagagatattttgtaaa

SEQ ID NO: 1210406 - DNA, 14 bp, Homo sapiens
actagaggcaggga

SEQ ID NO: 1210407 - DNA, 16 bp, Homo sapiens
actagaggcagggagg

SEQ ID NO: 1210408 - DNA, 14 bp, Homo sapiens
actagaggccaggg

SEQ ID NO: 1210409 - DNA, 20 bp, Homo sapiens
actagagggacctctcccag

SEQ ID NO: 1210410 - DNA, 11 bp, Homo sapiens
actagagggcc

SEQ ID NO: 1210411 - DNA, 21 bp, Homo sapiens
actagagggcccatcaggcag

SEQ ID NO: 1210412 - DNA, 14 bp, Homo sapiens
actagaggtgagaa

SEQ ID NO: 1210413 - DNA, 20 bp, Homo sapiens
actagagtctgaacagctgt

SEQ ID NO: 1210414 - DNA, 17 bp, Homo sapiens
actagatgtagtatttt

SEQ ID NO: 1210415 - DNA, 18 bp, Homo sapiens
actagatttgtcctttta

SEQ ID NO: 1210416 - DNA, 18 bp, Homo sapiens
actagcaaaataaaacat

SEQ ID NO: 1210417 - DNA, 11 bp, Homo sapiens
actagcaggca

SEQ ID NO: 1210418 - DNA, 19 bp, Homo sapiens
actagcatacttaaaatat

SEQ ID NO: 1210419 - DNA, 17 bp, Homo sapiens
actagcattacattatt

SEQ ID NO: 1210420 - DNA, 18 bp, Homo sapiens
actagcattacattatta

SEQ ID NO: 1210421 - DNA, 12 bp, Homo sapiens
actagccaaggc

SEQ ID NO: 1210422 - DNA, 15 bp, Homo sapiens
actagccactcctgc

SEQ ID NO: 1210423 - DNA, 21 bp, Homo sapiens
actagccatgataactgcaat

SEQ ID NO: 1210424 - DNA, 17 bp, Homo sapiens
actagcccaatgaaatg

SEQ ID NO: 1210425 - DNA, 16 bp, Homo sapiens
actagccccttttctg

SEQ ID NO: 1210426 - DNA, 15 bp, Homo sapiens
actagcctctccagg

SEQ ID NO: 1210427 - DNA, 15 bp, Homo sapiens
actagcgcctggcct

SEQ ID NO: 1210428 - DNA, 23 bp, Homo sapiens
actagctagaagtgggccaggac

SEQ ID NO: 1210429 - DNA, 14 bp, Homo sapiens
actagctgccttcg

SEQ ID NO: 1210430 - DNA, 21 bp, Homo sapiens
actagctgggactacaggtgc

SEQ ID NO: 1210431 - DNA, 12 bp, Homo sapiens
actaggaaaatc

SEQ ID NO: 1210432 - DNA, 13 bp, Homo sapiens
actaggaaacgtg

SEQ ID NO: 1210433 - DNA, 11 bp, Homo sapiens
actaggaattc

SEQ ID NO: 1210434 - DNA, 14 bp, Homo sapiens
actaggactcagaa

SEQ ID NO: 1210435 - DNA, 16 bp, Homo sapiens
actaggactctgaggc

SEQ ID NO: 1210436 - DNA, 17 bp, Homo sapiens
actaggcatacactgta

SEQ ID NO: 1210437 - DNA, 20 bp, Homo sapiens
actaggcccccacttgcctc

SEQ ID NO: 1210438 - DNA, 22 bp, Homo sapiens
actaggctcttatgtgtgcctt

SEQ ID NO: 1210439 - DNA, 23 bp, Homo sapiens
actaggctgagcaatctgaccct

SEQ ID NO: 1210440 - DNA, 16 bp, Homo sapiens
actaggcttctgtaat

SEQ ID NO: 1210441 - DNA, 21 bp, Homo sapiens
actagggactatcaggtaata

SEQ ID NO: 1210442 - DNA, 16 bp, Homo sapiens
actagggatccctcat

SEQ ID NO: 1210443 - DNA, 19 bp, Homo sapiens
actagggattcaggctgct

SEQ ID NO: 1210444 - DNA, 19 bp, Homo sapiens
actagggctgaggggcctg

SEQ ID NO: 1210445 - DNA, 16 bp, Homo sapiens
actaggtaacttcata

SEQ ID NO: 1210446 - DNA, 23 bp, Homo sapiens
actaggtatttctaacgccagca

SEQ ID NO: 1210447 - DNA, 18 bp, Homo sapiens
actaggtcaaaaatctgt

SEQ ID NO: 1210448 - DNA, 15 bp, Homo sapiens
actaggtgtccccaa

SEQ ID NO: 1210449 - DNA, 19 bp, Homo sapiens
actagtaataccaaagact

SEQ ID NO: 1210450 - DNA, 17 bp, Homo sapiens
actagtagatttctatg

SEQ ID NO: 1210451 - DNA, 23 bp, Homo sapiens
actagtctacttcttaaaattca

SEQ ID NO: 1210452 - DNA, 14 bp, Homo sapiens
actagtgacagctt

SEQ ID NO: 1210453 - DNA, 18 bp, Homo sapiens
actagtgacagtttcttt

SEQ ID NO: 1210454 - DNA, 19 bp, Homo sapiens
actagtgagtcagcacctt

SEQ ID NO: 1210455 - DNA, 16 bp, Homo sapiens
actagtgcaaatcata

SEQ ID NO: 1210456 - DNA, 23 bp, Homo sapiens
actagtgcaattccaagaaaata

SEQ ID NO: 1210457 - DNA, 21 bp, Homo sapiens
actagtgccaatgatgtgacc

SEQ ID NO: 1210458 - DNA, 15 bp, Homo sapiens
actagtgttgcttgg

SEQ ID NO: 1210459 - DNA, 13 bp, Homo sapiens
actagttacacat

SEQ ID NO: 1210460 - DNA, 18 bp, Homo sapiens
actagttacacatcttca

SEQ ID NO: 1210461 - DNA, 14 bp, Homo sapiens
actagtttatgcta

SEQ ID NO: 1210462 - DNA, 17 bp, Homo sapiens
actagttttagttttct

SEQ ID NO: 1210463 - DNA, 17 bp, Homo sapiens
actagtttttatagcta

SEQ ID NO: 1210464 - DNA, 23 bp, Homo sapiens
actagtttttatagctatcaaca

SEQ ID NO: 1210465 - DNA, 14 bp, Homo sapiens
actataaaaaagaa

SEQ ID NO: 1210466 - DNA, 19 bp, Homo sapiens
actataaaaatcatgtgat

SEQ ID NO: 1210467 - DNA, 18 bp, Homo sapiens
actataaacttaagggca

SEQ ID NO: 1210468 - DNA, 18 bp, Homo sapiens
actataagactataaata

SEQ ID NO: 1210469 - DNA, 21 bp, Homo sapiens
actataagtagttggtttgta

SEQ ID NO: 1210470 - DNA, 11 bp, Homo sapiens
actataatgta

SEQ ID NO: 1210471 - DNA, 12 bp, Homo sapiens
actataatgtaa

SEQ ID NO: 1210472 - DNA, 13 bp, Homo sapiens
actataatgtaag

SEQ ID NO: 1210473 - DNA, 21 bp, Homo sapiens
actataatgtaagctctactg

SEQ ID NO: 1210474 - DNA, 21 bp, Homo sapiens
actataatgtgaaatgtaact

SEQ ID NO: 1210475 - DNA, 22 bp, Homo sapiens
actataattgtaaatattttga

SEQ ID NO: 1210476 - DNA, 12 bp, Homo sapiens
actataatttga

SEQ ID NO: 1210477 - DNA, 15 bp, Homo sapiens
actatacccgggacc

SEQ ID NO: 1210478 - DNA, 19 bp, Homo sapiens
actatacttgatagtttgg

SEQ ID NO: 1210479 - DNA, 16 bp, Homo sapiens
actatagcaaagtagt

SEQ ID NO: 1210480 - DNA, 15 bp, Homo sapiens
actataggtccagaa

SEQ ID NO: 1210481 - DNA, 17 bp, Homo sapiens
actatagtctcttgttt

SEQ ID NO: 1210482 - DNA, 18 bp, Homo sapiens
actatagtctcttgtttg

SEQ ID NO: 1210483 - DNA, 18 bp, Homo sapiens
actatatacatatatatt

SEQ ID NO: 1210484 - DNA, 18 bp, Homo sapiens
actatatagagatgtttt

SEQ ID NO: 1210485 - DNA, 24 bp, Homo sapiens
actatatataaatgacctgttttc

SEQ ID NO: 1210486 - DNA, 20 bp, Homo sapiens
actatatgatcagtgttact

SEQ ID NO: 1210487 - DNA, 18 bp, Homo sapiens
actatattatcatgcaaa

SEQ ID NO: 1210488 - DNA, 13 bp, Homo sapiens
actatatttgcta

SEQ ID NO: 1210489 - DNA, 19 bp, Homo sapiens
actatcaaactgaagccag

SEQ ID NO: 1210490 - DNA, 22 bp, Homo sapiens
actatcagtttgtcctgtagag

SEQ ID NO: 1210491 - DNA, 18 bp, Homo sapiens
actatcatctcttaaatt

SEQ ID NO: 1210492 - DNA, 20 bp, Homo sapiens
actatccccaaactccttta

SEQ ID NO: 1210493 - DNA, 23 bp, Homo sapiens
actatccccaaactcctttactg

SEQ ID NO: 1210494 - DNA, 18 bp, Homo sapiens
actatcctgattccaaat

SEQ ID NO: 1210495 - DNA, 17 bp, Homo sapiens
actatctcacttccaga

SEQ ID NO: 1210496 - DNA, 17 bp, Homo sapiens
actatctgcattatcta

SEQ ID NO: 1210497 - DNA, 12 bp, Homo sapiens
actatctgggtg

SEQ ID NO: 1210498 - DNA, 22 bp, Homo sapiens
actatctgtgcgtagaagttct

SEQ ID NO: 1210499 - DNA, 16 bp, Homo sapiens
actatcttggtgaatt

SEQ ID NO: 1210500 - DNA, 16 bp, Homo sapiens
actatgaaaatgctgg

SEQ ID NO: 1210501 - DNA, 18 bp, Homo sapiens
actatgaacttctctcag

SEQ ID NO: 1210502 - DNA, 19 bp, Homo sapiens
actatgaacttctctcaga

SEQ ID NO: 1210503 - DNA, 21 bp, Homo sapiens
actatgaacttctctcagact

SEQ ID NO: 1210504 - DNA, 15 bp, Homo sapiens
actatgactgctccc

SEQ ID NO: 1210505 - DNA, 16 bp, Homo sapiens
actatgatcacagtga

SEQ ID NO: 1210506 - DNA, 17 bp, Homo sapiens
actatgatcacagtgac

SEQ ID NO: 1210507 - DNA, 17 bp, Homo sapiens
actatgatcagaagaac

SEQ ID NO: 1210508 - DNA, 16 bp, Homo sapiens
actatgcaaaagtaca

SEQ ID NO: 1210509 - DNA, 16 bp, Homo sapiens
actatgcacaatttaa

SEQ ID NO: 1210510 - DNA, 16 bp, Homo sapiens
actatgcagtatctct

SEQ ID NO: 1210511 - DNA, 19 bp, Homo sapiens
actatgcgtggctggaacc

SEQ ID NO: 1210512 - DNA, 13 bp, Homo sapiens
actatggaaaatc

SEQ ID NO: 1210513 - DNA, 14 bp, Homo sapiens
actatggaaaatca

SEQ ID NO: 1210514 - DNA, 20 bp, Homo sapiens
actatggaaaatcagctgct

SEQ ID NO: 1210515 - DNA, 18 bp, Homo sapiens
actatggccagtctgccc

SEQ ID NO: 1210516 - DNA, 15 bp, Homo sapiens
actatgggatgagaa

SEQ ID NO: 1210517 - DNA, 19 bp, Homo sapiens
actatggtatgctggccag

SEQ ID NO: 1210518 - DNA, 15 bp, Homo sapiens
actatggtatttgag

SEQ ID NO: 1210519 - DNA, 17 bp, Homo sapiens
actatggttcccaataa

SEQ ID NO: 1210520 - DNA, 21 bp, Homo sapiens
actatggttcccaataaaagt

SEQ ID NO: 1210521 - DNA, 22 bp, Homo sapiens
actatggttcccaataaaagtg

SEQ ID NO: 1210522 - DNA, 12 bp, Homo sapiens
actatgtaaact

SEQ ID NO: 1210523 - DNA, 12 bp, Homo sapiens
actatgtatcaa

SEQ ID NO: 1210524 - DNA, 22 bp, Homo sapiens
actaactaaactctctttggga

SEQ ID NO: 1210525 - DNA, 16 bp, Homo sapiens
actaactatgcaataa

SEQ ID NO: 1210526 - DNA, 23 bp, Homo sapiens
actaactgcttcatctccttttg

SEQ ID NO: 1210527 - DNA, 13 bp, Homo sapiens
actaactggcagg

SEQ ID NO: 1210528 - DNA, 17 bp, Homo sapiens
actaacttgacttttaa

SEQ ID NO: 1210529 - DNA, 21 bp, Homo sapiens
actaacttttttttttttaac

SEQ ID NO: 1210530 - DNA, 23 bp, Homo sapiens
actaacttttttttttttaacat

SEQ ID NO: 1210531 - DNA, 23 bp, Homo sapiens
actaagaaatattccaaatgtct

SEQ ID NO: 1210532 - DNA, 21 bp, Homo sapiens
actaagaataacaagaagccc

SEQ ID NO: 1210533 - DNA, 18 bp, Homo sapiens
actaagaccctggtctga

SEQ ID NO: 1210534 - DNA, 16 bp, Homo sapiens
actaagactcccgccc

SEQ ID NO: 1210535 - DNA, 17 bp, Homo sapiens
actaagagaagttgtaa

SEQ ID NO: 1210536 - DNA, 13 bp, Homo sapiens
actaagattcttt

SEQ ID NO: 1210537 - DNA, 17 bp, Homo sapiens
actaagcaatttccccc

SEQ ID NO: 1210538 - DNA, 21 bp, Homo sapiens
actaagccaacttgatgtgaa

SEQ ID NO: 1210539 - DNA, 16 bp, Homo sapiens
actaagccacaagaaa

SEQ ID NO: 1210540 - DNA, 13 bp, Homo sapiens
actaagccaggag

SEQ ID NO: 1210541 - DNA, 15 bp, Homo sapiens
actaagccaggcctg

SEQ ID NO: 1210542 - DNA, 17 bp, Homo sapiens
actaagccaggcctggc

SEQ ID NO: 1210543 - DNA, 21 bp, Homo sapiens
actaagccctcgaaccaaggc

SEQ ID NO: 1210544 - DNA, 23 bp, Homo sapiens
actaagccctcgaaccaaggcag

SEQ ID NO: 1210545 - DNA, 20 bp, Homo sapiens
actaaggagtaatctgtgta

SEQ ID NO: 1210546 - DNA, 16 bp, Homo sapiens
actaaggatttttcaa

SEQ ID NO: 1210547 - DNA, 21 bp, Homo sapiens
actaaggatttttcaagagat

SEQ ID NO: 1210548 - DNA, 18 bp, Homo sapiens
actaagtagcccataagg

SEQ ID NO: 1210549 - DNA, 15 bp, Homo sapiens
actaagtcaggagtg

SEQ ID NO: 1210550 - DNA, 16 bp, Homo sapiens
actaagtgatgctgtg

SEQ ID NO: 1210551 - DNA, 13 bp, Homo sapiens
actaagttcacat

SEQ ID NO: 1210552 - DNA, 13 bp, Homo sapiens
actaagttttgtg

SEQ ID NO: 1210553 - DNA, 15 bp, Homo sapiens
actaagtttttatgg

SEQ ID NO: 1210554 - DNA, 14 bp, Homo sapiens
actaataaatacat

SEQ ID NO: 1210555 - DNA, 12 bp, Homo sapiens
actaataaattg

SEQ ID NO: 1210556 - DNA, 14 bp, Homo sapiens
actaatagaaaagt

SEQ ID NO: 1210557 - DNA, 16 bp, Homo sapiens
actaatataacttgaa

SEQ ID NO: 1210558 - DNA, 15 bp, Homo sapiens
actaatatatggacc

SEQ ID NO: 1210559 - DNA, 19 bp, Homo sapiens
actaatatatggacctagc

SEQ ID NO: 1210560 - DNA, 15 bp, Homo sapiens
actaatatgggcatt

SEQ ID NO: 1210561 - DNA, 22 bp, Homo sapiens
actaatatgggcattgtagtta

SEQ ID NO: 1210562 - DNA, 19 bp, Homo sapiens
actaatattttatgtgaga

SEQ ID NO: 1210563 - DNA, 20 bp, Homo sapiens
actaatcagatgatggccat

SEQ ID NO: 1210564 - DNA, 19 bp, Homo sapiens
actaatccattatccttta

SEQ ID NO: 1210565 - DNA, 22 bp, Homo sapiens
actaatccattatcctttattt

SEQ ID NO: 1210566 - DNA, 22 bp, Homo sapiens
actaatctattgggttcattat

SEQ ID NO: 1210567 - DNA, 19 bp, Homo sapiens
actaatctgggaagggaag

SEQ ID NO: 1210568 - DNA, 18 bp, Homo sapiens
actaatcttgaatgtttg

SEQ ID NO: 1210569 - DNA, 14 bp, Homo sapiens
actaatctttctgc

SEQ ID NO: 1210570 - DNA, 13 bp, Homo sapiens
actaatgcagcca

SEQ ID NO: 1210571 - DNA, 19 bp, Homo sapiens
actaatgtactgtacataa

SEQ ID NO: 1210572 - DNA, 23 bp, Homo sapiens
actaatgttggacagacactgtt

SEQ ID NO: 1210573 - DNA, 19 bp, Homo sapiens
actaatgtttgaacaaagc

SEQ ID NO: 1210574 - DNA, 18 bp, Homo sapiens
actaattaaaatctggaa

SEQ ID NO: 1210575 - DNA, 20 bp, Homo sapiens
actcacggaccactcgaggc

SEQ ID NO: 1210576 - DNA, 14 bp, Homo sapiens
actcacgtttgctt

SEQ ID NO: 1210577 - DNA, 14 bp, Homo sapiens
actcactaggcccc

SEQ ID NO: 1210578 - DNA, 17 bp, Homo sapiens
actcactaggcccccac

SEQ ID NO: 1210579 - DNA, 21 bp, Homo sapiens
actcactaggcccccacttgc

SEQ ID NO: 1210580 - DNA, 12 bp, Homo sapiens
actcactccaag

SEQ ID NO: 1210581 - DNA, 20 bp, Homo sapiens
actcactccaagaccaccag

SEQ ID NO: 1210582 - DNA, 16 bp, Homo sapiens
actcactccccactcc

SEQ ID NO: 1210583 - DNA, 19 bp, Homo sapiens
actcactccccactccccc

SEQ ID NO: 1210584 - DNA, 18 bp, Homo sapiens
actcactccttttaaaga

SEQ ID NO: 1210585 - DNA, 14 bp, Homo sapiens
actcactctgggct

SEQ ID NO: 1210586 - DNA, 12 bp, Homo sapiens
actcactgaagc

SEQ ID NO: 1210587 - DNA, 13 bp, Homo sapiens
actcactgaagcc

SEQ ID NO: 1210588 - DNA, 18 bp, Homo sapiens
actcactgaagcctgcgt

SEQ ID NO: 1210589 - DNA, 21 bp, Homo sapiens
actcactgaggccatcagggc

SEQ ID NO: 1210590 - DNA, 23 bp, Homo sapiens
actcactgaggccatcagggccc

SEQ ID NO: 1210591 - DNA, 13 bp, Homo sapiens
actcactgcctag

SEQ ID NO: 1210592 - DNA, 15 bp, Homo sapiens
actcactgcctagga

SEQ ID NO: 1210593 - DNA, 20 bp, Homo sapiens
actcactgcctaggaggctg

SEQ ID NO: 1210594 - DNA, 15 bp, Homo sapiens
actcactgctcaaga

SEQ ID NO: 1210595 - DNA, 22 bp, Homo sapiens
actcactgctcaagaagacatg

SEQ ID NO: 1210596 - DNA, 18 bp, Homo sapiens
actcactgtgatcaatat

SEQ ID NO: 1210597 - DNA, 14 bp, Homo sapiens
actcacttccagtg

SEQ ID NO: 1210598 - DNA, 14 bp, Homo sapiens
actcagaaacatca

SEQ ID NO: 1210599 - DNA, 14 bp, Homo sapiens
actcagaaattttt

SEQ ID NO: 1210600 - DNA, 12 bp, Homo sapiens
actcagaagaga

SEQ ID NO: 1210601 - DNA, 13 bp, Homo sapiens
actcagaagcctg

SEQ ID NO: 1210602 - DNA, 16 bp, Homo sapiens
actcagaagcctgagg

SEQ ID NO: 1210603 - DNA, 17 bp, Homo sapiens
actcagaagcctgaggc

SEQ ID NO: 1210604 - DNA, 18 bp, Homo sapiens
actcagaagcctgaggct

SEQ ID NO: 1210605 - DNA, 22 bp, Homo sapiens
actcagaatataacatgtaaaa

SEQ ID NO: 1210606 - DNA, 12 bp, Homo sapiens
actcagacctga

SEQ ID NO: 1210607 - DNA, 22 bp, Homo sapiens
actcagagaaaaatgctcccca

SEQ ID NO: 1210608 - DNA, 20 bp, Homo sapiens
actcagagaaccagtgcaga

SEQ ID NO: 1210609 - DNA, 11 bp, Homo sapiens
actcagagcag

SEQ ID NO: 1210610 - DNA, 12 bp, Homo sapiens
actcagagcaga

SEQ ID NO: 1210611 - DNA, 15 bp, Homo sapiens
actcagagcagagca

SEQ ID NO: 1210612 - DNA, 18 bp, Homo sapiens
actcagaggcccccagtg

SEQ ID NO: 1210613 - DNA, 13 bp, Homo sapiens
actcagatctgat

SEQ ID NO: 1210614 - DNA, 16 bp, Homo sapiens
actcagatgaccccag

SEQ ID NO: 1210615 - DNA, 23 bp, Homo sapiens
actcagatgaccccagaaactga

SEQ ID NO: 1210616 - DNA, 16 bp, Homo sapiens
actcagatgaggacag

SEQ ID NO: 1210617 - DNA, 12 bp, Homo sapiens
actcagatgtcc

SEQ ID NO: 1210618 - DNA, 22 bp, Homo sapiens
actcagatgtctctggcgtgtg

SEQ ID NO: 1210619 - DNA, 15 bp, Homo sapiens
actcagcagaatggt

SEQ ID NO: 1210620 - DNA, 14 bp, Homo sapiens
actcagcagcagag

SEQ ID NO: 1210621 - DNA, 16 bp, Homo sapiens
actcagcagcagagag

SEQ ID NO: 1210622 - DNA, 22 bp, Homo sapiens
actcagcagccctcctcacccc

SEQ ID NO: 1210623 - DNA, 23 bp, Homo sapiens
actcagcagccctcctcaccccg

SEQ ID NO: 1210624 - DNA, 14 bp, Homo sapiens
actcagcagtgacc

SEQ ID NO: 1210625 - DNA, 13 bp, Homo sapiens
actcagcagttga

SEQ ID NO: 1210626 - DNA, 23 bp, Homo sapiens
actcagcatttgattaacatttg

SEQ ID NO: 1210627 - DNA, 18 bp, Homo sapiens
actcagccaccctgagtt

SEQ ID NO: 1210628 - DNA, 16 bp, Homo sapiens
actcagcccctacccc

SEQ ID NO: 1210629 - DNA, 16 bp, Homo sapiens
actcagcccctaggag

SEQ ID NO: 1210630 - DNA, 17 bp, Homo sapiens
actcagcccctaggagt

SEQ ID NO: 1210631 - DNA, 13 bp, Homo sapiens
actcagccctggg

SEQ ID NO: 1210632 - DNA, 11 bp, Homo sapiens
actcagccttc

SEQ ID NO: 1210633 - DNA, 20 bp, Homo sapiens
actcagctttctttaaagtt

SEQ ID NO: 1210634 - DNA, 12 bp, Homo sapiens
actcaggaactt

SEQ ID NO: 1210635 - DNA, 13 bp, Homo sapiens
actcaggaggctg

SEQ ID NO: 1210636 - DNA, 16 bp, Homo sapiens
actcaggaggctgagg

SEQ ID NO: 1210637 - DNA, 20 bp, Homo sapiens
actcaggaggctgaggcaca

SEQ ID NO: 1210638 - DNA, 17 bp, Homo sapiens
actcaggaggctgaggg

SEQ ID NO: 1210639 - DNA, 22 bp, Homo sapiens
actcaggatttaaaaactggaa

SEQ ID NO: 1210640 - DNA, 19 bp, Homo sapiens
actcaggccacagtggggc

SEQ ID NO: 1210641 - DNA, 15 bp, Homo sapiens
actcaggctttcact

SEQ ID NO: 1210642 - DNA, 17 bp, Homo sapiens
actcagggaccggtgct

SEQ ID NO: 1210643 - DNA, 17 bp, Homo sapiens
actcagggcagcgccag

SEQ ID NO: 1210644 - DNA, 22 bp, Homo sapiens
actcagggcagcgccaggctga

SEQ ID NO: 1210645 - DNA, 19 bp, Homo sapiens
actcagggcagctgcctgg

SEQ ID NO: 1210646 - DNA, 23 bp, Homo sapiens
actcagggcagctgcctggccat

SEQ ID NO: 1210647 - DNA, 15 bp, Homo sapiens
actcagggccccagc

SEQ ID NO: 1210648 - DNA, 22 bp, Homo sapiens
actcagggccccagcactaaag

SEQ ID NO: 1210649 - DNA, 16 bp, Homo sapiens
actcagggctcctccc

SEQ ID NO: 1210650 - DNA, 17 bp, Homo sapiens
actcagggctcctccca

SEQ ID NO: 1210651 - DNA, 18 bp, Homo sapiens
actcagggctcctcccag

SEQ ID NO: 1210652 - DNA, 16 bp, Homo sapiens
actcagggctcctggg

SEQ ID NO: 1210653 - DNA, 14 bp, Homo sapiens
actcaggggacccc

SEQ ID NO: 1210654 - DNA, 21 bp, Homo sapiens
actcaggggaccccactcccc

SEQ ID NO: 1210655 - DNA, 21 bp, Homo sapiens
actcaggggatgtttacctgg

SEQ ID NO: 1210656 - DNA, 16 bp, Homo sapiens
actcaggtctgtaact

SEQ ID NO: 1210657 - DNA, 17 bp, Homo sapiens
actcaggtctgtaactg

SEQ ID NO: 1210658 - DNA, 22 bp, Homo sapiens
actcaggttccagaacagccct

SEQ ID NO: 1210659 - DNA, 21 bp, Homo sapiens
actcaggttcttcagggccag

SEQ ID NO: 1210660 - DNA, 22 bp, Homo sapiens
actcaggttgtagtaaagaaat

SEQ ID NO: 1210661 - DNA, 14 bp, Homo sapiens
actcagtaatttgt

SEQ ID NO: 1210662 - DNA, 23 bp, Homo sapiens
actcagtatagcattgaacattt

SEQ ID NO: 1210663 - DNA, 20 bp, Homo sapiens
actcagtatgctttccctga

SEQ ID NO: 1210664 - DNA, 23 bp, Homo sapiens
actcagtatgctttccctgagga

SEQ ID NO: 1210665 - DNA, 14 bp, Homo sapiens
actcagtcccccac

SEQ ID NO: 1210666 - DNA, 16 bp, Homo sapiens
actcagtcccccacca

SEQ ID NO: 1210667 - DNA, 19 bp, Homo sapiens
actcagtctctcttctctc

SEQ ID NO: 1210668 - DNA, 16 bp, Homo sapiens
actcagtgttagagaa

SEQ ID NO: 1210669 - DNA, 20 bp, Homo sapiens
actcagtgttagagaaatcc

SEQ ID NO: 1210670 - DNA, 21 bp, Homo sapiens
actcagtgttagagaaatcct

SEQ ID NO: 1210671 - DNA, 22 bp, Homo sapiens
actcagttaaaatgtctgtttc

SEQ ID NO: 1210672 - DNA, 20 bp, Homo sapiens
actcagttaaatctttgaag

SEQ ID NO: 1210673 - DNA, 17 bp, Homo sapiens
actcatacctttaaagg

SEQ ID NO: 1210674 - DNA, 17 bp, Homo sapiens
actcatagattgcaaat

SEQ ID NO: 1210675 - DNA, 23 bp, Homo sapiens
actcatcagagcagctagctctt

SEQ ID NO: 1210676 - DNA, 14 bp, Homo sapiens
actcatcataaaat

SEQ ID NO: 1210677 - DNA, 17 bp, Homo sapiens
actcatcgggcccaggg

SEQ ID NO: 1210678 - DNA, 19 bp, Homo sapiens
actcatcgggcccagggac

SEQ ID NO: 1210679 - DNA, 15 bp, Homo sapiens
actcatctgttatcc

SEQ ID NO: 1210680 - DNA, 20 bp, Homo sapiens
actcatctgttatcctgcta

SEQ ID NO: 1210681 - DNA, 21 bp, Homo sapiens
actcatgatcaagatatatgt

SEQ ID NO: 1210682 - DNA, 19 bp, Homo sapiens
actcatgcaaactgcttta

SEQ ID NO: 1210683 - DNA, 19 bp, Homo sapiens
actcatggaaatagaatga

SEQ ID NO: 1210684 - DNA, 15 bp, Homo sapiens
actcatggcagctgt

SEQ ID NO: 1210685 - DNA, 15 bp, Homo sapiens
actcatgggtaataa

SEQ ID NO: 1210686 - DNA, 21 bp, Homo sapiens
actcatgtgcaataggtgaga

SEQ ID NO: 1210687 - DNA, 23 bp, Homo sapiens
actcattagaattaccatttgtt

SEQ ID NO: 1210688 - DNA, 21 bp, Homo sapiens
actccgagagcagtgggcagg

SEQ ID NO: 1210689 - DNA, 22 bp, Homo sapiens
actccgagaggtgggccagtct

SEQ ID NO: 1210690 - DNA, 15 bp, Homo sapiens
actccgcccagcctc

SEQ ID NO: 1210691 - DNA, 18 bp, Homo sapiens
actccgcccagcctctcc

SEQ ID NO: 1210692 - DNA, 18 bp, Homo sapiens
actccgcccccagcctat

SEQ ID NO: 1210693 - DNA, 16 bp, Homo sapiens
actccgcgccgatgcc

SEQ ID NO: 1210694 - DNA, 17 bp, Homo sapiens
actccgcgccgatgcca

SEQ ID NO: 1210695 - DNA, 23 bp, Homo sapiens
actccgcgccgatgccaccggcc

SEQ ID NO: 1210696 - DNA, 17 bp, Homo sapiens
actccgctcactgaact

SEQ ID NO: 1210697 - DNA, 16 bp, Homo sapiens
actccggagacagggt

SEQ ID NO: 1210698 - DNA, 16 bp, Homo sapiens
actccggaggactgag

SEQ ID NO: 1210699 - DNA, 19 bp, Homo sapiens
actccggaggactgagccc

SEQ ID NO: 1210700 - DNA, 23 bp, Homo sapiens
actccggaggactgagcccccac

SEQ ID NO: 1210701 - DNA, 14 bp, Homo sapiens
actccggccctcct

SEQ ID NO: 1210702 - DNA, 15 bp, Homo sapiens
actccggccctccta

SEQ ID NO: 1210703 - DNA, 23 bp, Homo sapiens
actccggcctgatgacagagcga

SEQ ID NO: 1210704 - DNA, 17 bp, Homo sapiens
actccggggagcgcccg

SEQ ID NO: 1210705 - DNA, 20 bp, Homo sapiens
actccggtcagcccctggca

SEQ ID NO: 1210706 - DNA, 20 bp, Homo sapiens
actccggtgtgcctgcagcc

SEQ ID NO: 1210707 - DNA, 15 bp, Homo sapiens
actccgttggccact

SEQ ID NO: 1210708 - DNA, 20 bp, Homo sapiens
actcctacaagatttagaaa

SEQ ID NO: 1210709 - DNA, 14 bp, Homo sapiens
actcctacctcagc

SEQ ID NO: 1210710 - DNA, 14 bp, Homo sapiens
actcctagaagaac

SEQ ID NO: 1210711 - DNA, 20 bp, Homo sapiens
actcctagactttgggatca

SEQ ID NO: 1210712 - DNA, 14 bp, Homo sapiens
actcctaggagagc

SEQ ID NO: 1210713 - DNA, 20 bp, Homo sapiens
actcctaggagagccaacct

SEQ ID NO: 1210714 - DNA, 21 bp, Homo sapiens
actcctaggagagccaacctc

SEQ ID NO: 1210715 - DNA, 17 bp, Homo sapiens
actcctataaggagagt

SEQ ID NO: 1210716 - DNA, 14 bp, Homo sapiens
actcctcaaaccac

SEQ ID NO: 1210717 - DNA, 17 bp, Homo sapiens
actcctcaaaccacttg

SEQ ID NO: 1210718 - DNA, 21 bp, Homo sapiens
actcctcaagactttgatcct

SEQ ID NO: 1210719 - DNA, 18 bp, Homo sapiens
actcctcacttttcaatt

SEQ ID NO: 1210720 - DNA, 21 bp, Homo sapiens
actcctcccctcttctctttt

SEQ ID NO: 1210721 - DNA, 15 bp, Homo sapiens
actcctcctctttct

SEQ ID NO: 1210722 - DNA, 15 bp, Homo sapiens
actcctcctgctcct

SEQ ID NO: 1210723 - DNA, 16 bp, Homo sapiens
actcctcctgggggct

SEQ ID NO: 1210724 - DNA, 17 bp, Homo sapiens
actcctcctgggggctg

SEQ ID NO: 1210725 - DNA, 21 bp, Homo sapiens
actcctcctgggggctggctc

SEQ ID NO: 1210726 - DNA, 23 bp, Homo sapiens
actcctctaagccactcttccaa

SEQ ID NO: 1210727 - DNA, 21 bp, Homo sapiens
actcctctcaactgcctcagc

SEQ ID NO: 1210728 - DNA, 14 bp, Homo sapiens
actcctctcccttg

SEQ ID NO: 1210729 - DNA, 12 bp, Homo sapiens
actcctctgcag

SEQ ID NO: 1210730 - DNA, 17 bp, Homo sapiens
actcctctgcagtgcct

SEQ ID NO: 1210731 - DNA, 16 bp, Homo sapiens
actcctctgctgacct

SEQ ID NO: 1210732 - DNA, 22 bp, Homo sapiens
actcctctggctttcccaggag

SEQ ID NO: 1210733 - DNA, 14 bp, Homo sapiens
actgaatcatgtta

SEQ ID NO: 1210734 - DNA, 21 bp, Homo sapiens
actgaatctcataattggaat

SEQ ID NO: 1210735 - DNA, 13 bp, Homo sapiens
actgaatgacctc

SEQ ID NO: 1210736 - DNA, 21 bp, Homo sapiens
actgaatgcataatgtttaaa

SEQ ID NO: 1210737 - DNA, 19 bp, Homo sapiens
actgaatgtttattccttg

SEQ ID NO: 1210738 - DNA, 20 bp, Homo sapiens
actgaatgttttatttatca

SEQ ID NO: 1210739 - DNA, 13 bp, Homo sapiens
actgaattaatca

SEQ ID NO: 1210740 - DNA, 18 bp, Homo sapiens
actgaattctgccttggt

SEQ ID NO: 1210741 - DNA, 17 bp, Homo sapiens
actgaattgtccccagt

SEQ ID NO: 1210742 - DNA, 16 bp, Homo sapiens
actgaatttgggcctc

SEQ ID NO: 1210743 - DNA, 15 bp, Homo sapiens
actgaatttttttgt

SEQ ID NO: 1210744 - DNA, 14 bp, Homo sapiens
actgacaacattat

SEQ ID NO: 1210745 - DNA, 14 bp, Homo sapiens
actgacaccctggg

SEQ ID NO: 1210746 - DNA, 15 bp, Homo sapiens
actgacacttcctgt

SEQ ID NO: 1210747 - DNA, 18 bp, Homo sapiens
actgacacttcctgtcct

SEQ ID NO: 1210748 - DNA, 12 bp, Homo sapiens
actgacagcatg

SEQ ID NO: 1210749 - DNA, 18 bp, Homo sapiens
actgacagcctcccaccc

SEQ ID NO: 1210750 - DNA, 13 bp, Homo sapiens
actgacagggagc

SEQ ID NO: 1210751 - DNA, 15 bp, Homo sapiens
actgacattgctcca

SEQ ID NO: 1210752 - DNA, 20 bp, Homo sapiens
actgacattttttcctaagg

SEQ ID NO: 1210753 - DNA, 20 bp, Homo sapiens
actgaccagcctccatgctg

SEQ ID NO: 1210754 - DNA, 22 bp, Homo sapiens
actgaccatccactctaccctc

SEQ ID NO: 1210755 - DNA, 18 bp, Homo sapiens
actgaccccctcccctga

SEQ ID NO: 1210756 - DNA, 13 bp, Homo sapiens
actgaccctgagg

SEQ ID NO: 1210757 - DNA, 21 bp, Homo sapiens
actgacctgagcggcaccctg

SEQ ID NO: 1210758 - DNA, 17 bp, Homo sapiens
actgacctgccagccgg

SEQ ID NO: 1210759 - DNA, 22 bp, Homo sapiens
actgactgatagcttacactga

SEQ ID NO: 1210760 - DNA, 16 bp, Homo sapiens
actgacttcagtggga

SEQ ID NO: 1210761 - DNA, 15 bp, Homo sapiens
actgacttgctgtgt

SEQ ID NO: 1210762 - DNA, 15 bp, Homo sapiens
actgactttatcctc

SEQ ID NO: 1210763 - DNA, 16 bp, Homo sapiens
actgactttgcttgct

SEQ ID NO: 1210764 - DNA, 12 bp, Homo sapiens
actgagaacttt

SEQ ID NO: 1210765 - DNA, 20 bp, Homo sapiens
actgagaaggcaggcctccg

SEQ ID NO: 1210766 - DNA, 15 bp, Homo sapiens
actgagaaggctcac

SEQ ID NO: 1210767 - DNA, 13 bp, Homo sapiens
actgagacagggt

SEQ ID NO: 1210768 - DNA, 15 bp, Homo sapiens
actgagacagggtgc

SEQ ID NO: 1210769 - DNA, 20 bp, Homo sapiens
actgagacttgttcttggtt

SEQ ID NO: 1210770 - DNA, 12 bp, Homo sapiens
actgagaggcct

SEQ ID NO: 1210771 - DNA, 15 bp, Homo sapiens
actgagatgctgggc

SEQ ID NO: 1210772 - DNA, 18 bp, Homo sapiens
actgagatgctgggctgt

SEQ ID NO: 1210773 - DNA, 12 bp, Homo sapiens
actgagatgttt

SEQ ID NO: 1210774 - DNA, 23 bp, Homo sapiens
actgagcaatggtaactgcacct

SEQ ID NO: 1210775 - DNA, 21 bp, Homo sapiens
actgagcaccctctggattct

SEQ ID NO: 1210776 - DNA, 12 bp, Homo sapiens
actgagcagccg

SEQ ID NO: 1210777 - DNA, 19 bp, Homo sapiens
actgagccaaggaggcctg

SEQ ID NO: 1210778 - DNA, 20 bp, Homo sapiens
actgagccagtcccaggggc

SEQ ID NO: 1210779 - DNA, 15 bp, Homo sapiens
actgagccatcattt

SEQ ID NO: 1210780 - DNA, 19 bp, Homo sapiens
actgagccatcatttcctg

SEQ ID NO: 1210781 - DNA, 14 bp, Homo sapiens
actgagcccccacc

SEQ ID NO: 1210782 - DNA, 13 bp, Homo sapiens
actgagccctctc

SEQ ID NO: 1210783 - DNA, 14 bp, Homo sapiens
actgagccctctca

SEQ ID NO: 1210784 - DNA, 16 bp, Homo sapiens
actgagccctctcact

SEQ ID NO: 1210785 - DNA, 19 bp, Homo sapiens
actgagccctctcactcca

SEQ ID NO: 1210786 - DNA, 23 bp, Homo sapiens
actgagccctctcactccagcca

SEQ ID NO: 1210787 - DNA, 16 bp, Homo sapiens
actgagctccatgtgc

SEQ ID NO: 1210788 - DNA, 13 bp, Homo sapiens
actgagctcccca

SEQ ID NO: 1210789 - DNA, 15 bp, Homo sapiens
actgagctccccaga

SEQ ID NO: 1210790 - DNA, 16 bp, Homo sapiens
actgagctcctctggg

SEQ ID NO: 1210791 - DNA, 18 bp, Homo sapiens
actgagctctccaggcca

SEQ ID NO: 1210792 - DNA, 20 bp, Homo sapiens
actgagctctccaggccagg

SEQ ID NO: 1210793 - DNA, 21 bp, Homo sapiens
actgagctctccaggccaggt

SEQ ID NO: 1210794 - DNA, 15 bp, Homo sapiens
actgagctgaatgtt

SEQ ID NO: 1210795 - DNA, 17 bp, Homo sapiens
actgagcttctctgtga

SEQ ID NO: 1210796 - DNA, 19 bp, Homo sapiens
actgaggaatttcacctgt

SEQ ID NO: 1210797 - DNA, 19 bp, Homo sapiens
actgaggacaaagtggagg

SEQ ID NO: 1210798 - DNA, 13 bp, Homo sapiens
actgaggactgtg

SEQ ID NO: 1210799 - DNA, 22 bp, Homo sapiens
actgaggagatgaccagggatg

SEQ ID NO: 1210800 - DNA, 10 bp, Homo sapiens
actgaggcca

SEQ ID NO: 1210801 - DNA, 20 bp, Homo sapiens
actgaggccatcagggccct

SEQ ID NO: 1210802 - DNA, 11 bp, Homo sapiens
actgaggccct

SEQ ID NO: 1210803 - DNA, 14 bp, Homo sapiens
actgaggccctgtg

SEQ ID NO: 1210804 - DNA, 21 bp, Homo sapiens
actgaggcctaaaagtaaaca

SEQ ID NO: 1210805 - DNA, 12 bp, Homo sapiens
actgagggcagt

SEQ ID NO: 1210806 - DNA, 22 bp, Homo sapiens
actgagggccacactattacca

SEQ ID NO: 1210807 - DNA, 15 bp, Homo sapiens
actgaggtaaaatgt

SEQ ID NO: 1210808 - DNA, 18 bp, Homo sapiens
actgaggtatggccatgc

SEQ ID NO: 1210809 - DNA, 13 bp, Homo sapiens
actgaggtgcctg

SEQ ID NO: 1210810 - DNA, 14 bp, Homo sapiens
actgaggtgcctgc

SEQ ID NO: 1210811 - DNA, 14 bp, Homo sapiens
actgagtaaattgg

SEQ ID NO: 1210812 - DNA, 22 bp, Homo sapiens
actgagtacgttgtgcatttgg

SEQ ID NO: 1210813 - DNA, 23 bp, Homo sapiens
actgagtacgttgtgcatttggt

SEQ ID NO: 1210814 - DNA, 17 bp, Homo sapiens
actgagtccatgaaaat

SEQ ID NO: 1210815 - DNA, 18 bp, Homo sapiens
actgagtccatgaaaata

SEQ ID NO: 1210816 - DNA, 19 bp, Homo sapiens
actgagtccatgaaaatac

SEQ ID NO: 1210817 - DNA, 14 bp, Homo sapiens
actgagtgggaagc

SEQ ID NO: 1210818 - DNA, 16 bp, Homo sapiens
actgagtgggaagccc

SEQ ID NO: 1210819 - DNA, 13 bp, Homo sapiens
actgataagactg

SEQ ID NO: 1210820 - DNA, 19 bp, Homo sapiens
actgatacataaaaattaa

SEQ ID NO: 1210821 - DNA, 21 bp, Homo sapiens
actgatactacaacttttgtt

SEQ ID NO: 1210822 - DNA, 22 bp, Homo sapiens
actgatatatcatgagtgaata

SEQ ID NO: 1210823 - DNA, 21 bp, Homo sapiens
actgatcagtgtaaaaaggaa

SEQ ID NO: 1210824 - DNA, 16 bp, Homo sapiens
actgatcatccaggcc

SEQ ID NO: 1210825 - DNA, 17 bp, Homo sapiens
actgatcatccaggcct

SEQ ID NO: 1210826 - DNA, 18 bp, Homo sapiens
actgatcattagagaaat

SEQ ID NO: 1210827 - DNA, 13 bp, Homo sapiens
actgatccctggc

SEQ ID NO: 1210828 - DNA, 17 bp, Homo sapiens
actgatctctactacca

SEQ ID NO: 1210829 - DNA, 23 bp, Homo sapiens
actgatgaaatctgctagaaagt

SEQ ID NO: 1210830 - DNA, 20 bp, Homo sapiens
actgatgaagaaatttatga

SEQ ID NO: 1210831 - DNA, 13 bp, Homo sapiens
actgatgctgagg

SEQ ID NO: 1210832 - DNA, 15 bp, Homo sapiens
actgatgcttagatg

SEQ ID NO: 1210833 - DNA, 17 bp, Homo sapiens
actgatggaaaatacca

SEQ ID NO: 1210834 - DNA, 21 bp, Homo sapiens
actgatggaccgggtgggcct

SEQ ID NO: 1210835 - DNA, 22 bp, Homo sapiens
actgatggctcaagacaaggct

SEQ ID NO: 1210836 - DNA, 16 bp, Homo sapiens
actgatgggacatcaa

SEQ ID NO: 1210837 - DNA, 17 bp, Homo sapiens
actgatgggacatcaaa

SEQ ID NO: 1210838 - DNA, 16 bp, Homo sapiens
actgatgggctggggc

SEQ ID NO: 1210839 - DNA, 17 bp, Homo sapiens
actgatgggctggggca

SEQ ID NO: 1210840 - DNA, 22 bp, Homo sapiens
actgctcgtggactgtgctggt

SEQ ID NO: 1210841 - DNA, 19 bp, Homo sapiens
actgctctgaatattttgt

SEQ ID NO: 1210842 - DNA, 13 bp, Homo sapiens
actgctctgagaa

SEQ ID NO: 1210843 - DNA, 16 bp, Homo sapiens
actgctcttgaacatt

SEQ ID NO: 1210844 - DNA, 18 bp, Homo sapiens
actgctcttgtttctttt

SEQ ID NO: 1210845 - DNA, 22 bp, Homo sapiens
actgctctttattgcagaatgt

SEQ ID NO: 1210846 - DNA, 12 bp, Homo sapiens
actgctgaagat

SEQ ID NO: 1210847 - DNA, 15 bp, Homo sapiens
actgctgagccactc

SEQ ID NO: 1210848 - DNA, 14 bp, Homo sapiens
actgctgagctggc

SEQ ID NO: 1210849 - DNA, 18 bp, Homo sapiens
actgctgaggagtctgag

SEQ ID NO: 1210850 - DNA, 23 bp, Homo sapiens
actgctgatcgtagaaaatttgc

SEQ ID NO: 1210851 - DNA, 13 bp, Homo sapiens
actgctgattctt

SEQ ID NO: 1210852 - DNA, 14 bp, Homo sapiens
actgctgattcttg

SEQ ID NO: 1210853 - DNA, 15 bp, Homo sapiens
actgctgattcttgt

SEQ ID NO: 1210854 - DNA, 16 bp, Homo sapiens
actgctgattcttgta

SEQ ID NO: 1210855 - DNA, 17 bp, Homo sapiens
actgctgattcttgtaa

SEQ ID NO: 1210856 - DNA, 15 bp, Homo sapiens
actgctgcaaggtgg

SEQ ID NO: 1210857 - DNA, 17 bp, Homo sapiens
actgctgcaaggtggcc

SEQ ID NO: 1210858 - DNA, 15 bp, Homo sapiens
actgctgcaccagag

SEQ ID NO: 1210859 - DNA, 13 bp, Homo sapiens
actgctgctactg

SEQ ID NO: 1210860 - DNA, 12 bp, Homo sapiens
actgctgctccc

SEQ ID NO: 1210861 - DNA, 12 bp, Homo sapiens
actgctgctcct

SEQ ID NO: 1210862 - DNA, 15 bp, Homo sapiens
actgctgctgcctgg

SEQ ID NO: 1210863 - DNA, 11 bp, Homo sapiens
actgctgctgt

SEQ ID NO: 1210864 - DNA, 12 bp, Homo sapiens
actgctggacat

SEQ ID NO: 1210865 - DNA, 10 bp, Homo sapiens
actgctggct

SEQ ID NO: 1210866 - DNA, 12 bp, Homo sapiens
actgctggggag

SEQ ID NO: 1210867 - DNA, 16 bp, Homo sapiens
actgctggggagtccc

SEQ ID NO: 1210868 - DNA, 14 bp, Homo sapiens
actgctgtcctctc

SEQ ID NO: 1210869 - DNA, 16 bp, Homo sapiens
actgctgtcctctccc

SEQ ID NO: 1210870 - DNA, 17 bp, Homo sapiens
actgctgtcctctcccc

SEQ ID NO: 1210871 - DNA, 19 bp, Homo sapiens
actgctgtcctctccccct

SEQ ID NO: 1210872 - DNA, 18 bp, Homo sapiens
actgctgtgagtgcgcct

SEQ ID NO: 1210873 - DNA, 15 bp, Homo sapiens
actgctgtggccccc

SEQ ID NO: 1210874 - DNA, 19 bp, Homo sapiens
actgctgttcctgctccat

SEQ ID NO: 1210875 - DNA, 14 bp, Homo sapiens
actgctgttttcta

SEQ ID NO: 1210876 - DNA, 17 bp, Homo sapiens
actgcttctcggccagc

SEQ ID NO: 1210877 - DNA, 18 bp, Homo sapiens
actgcttctcggccagcc

SEQ ID NO: 1210878 - DNA, 20 bp, Homo sapiens
actgcttctcggccagcccg

SEQ ID NO: 1210879 - DNA, 16 bp, Homo sapiens
actgcttctctttgtg

SEQ ID NO: 1210880 - DNA, 23 bp, Homo sapiens
actgcttgaactaggctgagcaa

SEQ ID NO: 1210881 - DNA, 14 bp, Homo sapiens
actgcttgaggaaa

SEQ ID NO: 1210882 - DNA, 15 bp, Homo sapiens
actgcttgaggaaaa

SEQ ID NO: 1210883 - DNA, 16 bp, Homo sapiens
actgcttgatgaagca

SEQ ID NO: 1210884 - DNA, 20 bp, Homo sapiens
actgcttgatgaagcaagga

SEQ ID NO: 1210885 - DNA, 23 bp, Homo sapiens
actgcttgatgaagcaaggaaga

SEQ ID NO: 1210886 - DNA, 14 bp, Homo sapiens
actgcttggccaga

SEQ ID NO: 1210887 - DNA, 15 bp, Homo sapiens
actgctttattttcc

SEQ ID NO: 1210888 - DNA, 18 bp, Homo sapiens
actgctttctgttccaaa

SEQ ID NO: 1210889 - DNA, 17 bp, Homo sapiens
actgctttctttcgttt

SEQ ID NO: 1210890 - DNA, 23 bp, Homo sapiens
actgctttgggatttaatttcca

SEQ ID NO: 1210891 - DNA, 17 bp, Homo sapiens
actgctttgtgcatatg

SEQ ID NO: 1210892 - DNA, 14 bp, Homo sapiens
actgcttttcatta

SEQ ID NO: 1210893 - DNA, 20 bp, Homo sapiens
actgcttttcctcaagcaat

SEQ ID NO: 1210894 - DNA, 22 bp, Homo sapiens
actgcttttcctcaagcaataa

SEQ ID NO: 1210895 - DNA, 19 bp, Homo sapiens
actgcttttttttttccag

SEQ ID NO: 1210896 - DNA, 20 bp, Homo sapiens
actggaaaacagaacactta

SEQ ID NO: 1210897 - DNA, 22 bp, Homo sapiens
actggaaaatcttctagcatgt

SEQ ID NO: 1210898 - DNA, 19 bp, Homo sapiens
actggaaatgtagcactta

SEQ ID NO: 1210899 - DNA, 17 bp, Homo sapiens
actggaacatggctagc

SEQ ID NO: 1210900 - DNA, 21 bp, Homo sapiens
actggaacatggctagccttt

SEQ ID NO: 1210901 - DNA, 16 bp, Homo sapiens
actggaaccagggaga

SEQ ID NO: 1210902 - DNA, 16 bp, Homo sapiens
actggaagacacttca

SEQ ID NO: 1210903 - DNA, 19 bp, Homo sapiens
actggaagacacttcagat

SEQ ID NO: 1210904 - DNA, 14 bp, Homo sapiens
actggaagcacagc

SEQ ID NO: 1210905 - DNA, 13 bp, Homo sapiens
actggaagttgtg

SEQ ID NO: 1210906 - DNA, 17 bp, Homo sapiens
actgtgcatcaaccagg

SEQ ID NO: 1210907 - DNA, 13 bp, Homo sapiens
actgtgccctggt

SEQ ID NO: 1210908 - DNA, 17 bp, Homo sapiens
actgtgccctggtggag

SEQ ID NO: 1210909 - DNA, 18 bp, Homo sapiens
actgtgccctggtggaga

SEQ ID NO: 1210910 - DNA, 16 bp, Homo sapiens
actgtgcctagttcct

SEQ ID NO: 1210911 - DNA, 19 bp, Homo sapiens
actgtgcctcagagaccag

SEQ ID NO: 1210912 - DNA, 19 bp, Homo sapiens
actgtgcctttgcaaatca

SEQ ID NO: 1210913 - DNA, 13 bp, Homo sapiens
actgtgccttttc

SEQ ID NO: 1210914 - DNA, 12 bp, Homo sapiens
actgtgctgtgc

SEQ ID NO: 1210915 - DNA, 22 bp, Homo sapiens
actgtgctttaataggtagcat

SEQ ID NO: 1210916 - DNA, 15 bp, Homo sapiens
actgtggaatataaa

SEQ ID NO: 1210917 - DNA, 19 bp, Homo sapiens
actgtggaatataaatagc

SEQ ID NO: 1210918 - DNA, 19 bp, Homo sapiens
actgtggagactttctgtt

SEQ ID NO: 1210919 - DNA, 15 bp, Homo sapiens
actgtggccagagct

SEQ ID NO: 1210920 - DNA, 16 bp, Homo sapiens
actgtggccagagctg

SEQ ID NO: 1210921 - DNA, 21 bp, Homo sapiens
actgtggccagagctggaagg

SEQ ID NO: 1210922 - DNA, 14 bp, Homo sapiens
actgtggccaggcc

SEQ ID NO: 1210923 - DNA, 20 bp, Homo sapiens
actgtggcccttctgtccac

SEQ ID NO: 1210924 - DNA, 12 bp, Homo sapiens
actgtggctgct

SEQ ID NO: 1210925 - DNA, 18 bp, Homo sapiens
actgtggtttcagatgtg

SEQ ID NO: 1210926 - DNA, 13 bp, Homo sapiens
actgtgtaattag

SEQ ID NO: 1210927 - DNA, 12 bp, Homo sapiens
actgtgtacata

SEQ ID NO: 1210928 - DNA, 18 bp, Homo sapiens
actgtgtacataactgaa

SEQ ID NO: 1210929 - DNA, 12 bp, Homo sapiens
actgtgtataga

SEQ ID NO: 1210930 - DNA, 16 bp, Homo sapiens
actgtgtatcattaaa

SEQ ID NO: 1210931 - DNA, 24 bp, Homo sapiens
actgtgtatcattaaaatatatgt

SEQ ID NO: 1210932 - DNA, 20 bp, Homo sapiens
actgtgtatgttttatatca

SEQ ID NO: 1210933 - DNA, 15 bp, Homo sapiens
actgtgtattccaag

SEQ ID NO: 1210934 - DNA, 14 bp, Homo sapiens
actgtgtcctggtg

SEQ ID NO: 1210935 - DNA, 12 bp, Homo sapiens
actgtgtctctg

SEQ ID NO: 1210936 - DNA, 19 bp, Homo sapiens
actgtgtctctgtttcctg

SEQ ID NO: 1210937 - DNA, 22 bp, Homo sapiens
actgtgtctggcgttctcaaga

SEQ ID NO: 1210938 - DNA, 21 bp, Homo sapiens
actgtgtgaggctgtgtctct

SEQ ID NO: 1210939 - DNA, 15 bp, Homo sapiens
actgtgtgccttctg

SEQ ID NO: 1210940 - DNA, 20 bp, Homo sapiens
actgtgtgccttctgccaac

SEQ ID NO: 1210941 - DNA, 19 bp, Homo sapiens
actgtgtggactgtgatgc

SEQ ID NO: 1210942 - DNA, 19 bp, Homo sapiens
actgtgttactgctttgca

SEQ ID NO: 1210943 - DNA, 23 bp, Homo sapiens
actgtgttactgctttgcaaaga

SEQ ID NO: 1210944 - DNA, 14 bp, Homo sapiens
actgtgttgccaca

SEQ ID NO: 1210945 - DNA, 14 bp, Homo sapiens
actgtgttgtatta

SEQ ID NO: 1210946 - DNA, 17 bp, Homo sapiens
actgttacaagaggcca

SEQ ID NO: 1210947 - DNA, 15 bp, Homo sapiens
actgttacagtaatg

SEQ ID NO: 1210948 - DNA, 16 bp, Homo sapiens
actgttacagtaatgt

SEQ ID NO: 1210949 - DNA, 18 bp, Homo sapiens
actgttactctaaataga

SEQ ID NO: 1210950 - DNA, 20 bp, Homo sapiens
actgttagaaaatggacact

SEQ ID NO: 1210951 - DNA, 18 bp, Homo sapiens
actgttagaattctttta

SEQ ID NO: 1210952 - DNA, 23 bp, Homo sapiens
actgttagatgctgaatatctgt

SEQ ID NO: 1210953 - DNA, 15 bp, Homo sapiens
actgttagcactgtt

SEQ ID NO: 1210954 - DNA, 16 bp, Homo sapiens
actgttagcactgttg

SEQ ID NO: 1210955 - DNA, 21 bp, Homo sapiens
actgttagcactgttgatgta

SEQ ID NO: 1210956 - DNA, 19 bp, Homo sapiens
actgttatgaaataaagaa

SEQ ID NO: 1210957 - DNA, 20 bp, Homo sapiens
actgttcaatggttctgaaa

SEQ ID NO: 1210958 - DNA, 23 bp, Homo sapiens
actgttcaatggttctgaaataa

SEQ ID NO: 1210959 - DNA, 21 bp, Homo sapiens
actgttggaatggatttttct

SEQ ID NO: 1210960 - DNA, 15 bp, Homo sapiens
actgttggcacttat

SEQ ID NO: 1210961 - DNA, 17 bp, Homo sapiens
actgttgtagcattttc

SEQ ID NO: 1210962 - DNA, 19 bp, Homo sapiens
actgttgtagcattttcct

SEQ ID NO: 1210963 - DNA, 19 bp, Homo sapiens
actgtttaacaacatggct

SEQ ID NO: 1210964 - DNA, 18 bp, Homo sapiens
actgtttaatgttctgtg

SEQ ID NO: 1210965 - DNA, 17 bp, Homo sapiens
actgtttatacactgtg

SEQ ID NO: 1210966 - DNA, 14 bp, Homo sapiens
actgtttattactt

SEQ ID NO: 1210967 - DNA, 20 bp, Homo sapiens
actgtttattacttccatga

SEQ ID NO: 1210968 - DNA, 24 bp, Homo sapiens
actgtttattacttccatgaattt

SEQ ID NO: 1210969 - DNA, 13 bp, Homo sapiens
actgtttcagtgt

SEQ ID NO: 1210970 - DNA, 16 bp, Homo sapiens
actgtttcatctaagt

SEQ ID NO: 1210971 - DNA, 13 bp, Homo sapiens
actgtttcattca

SEQ ID NO: 1210972 - DNA, 17 bp, Homo sapiens
actgtttcctgggcacg

SEQ ID NO: 1210973 - DNA, 13 bp, Homo sapiens
actgtttctcaag

SEQ ID NO: 1210974 - DNA, 22 bp, Homo sapiens
actgtttctcaagtgttttgga

SEQ ID NO: 1210975 - DNA, 12 bp, Homo sapiens
actgtttctctg

SEQ ID NO: 1210976 - DNA, 14 bp, Homo sapiens
actgtttctctgct

SEQ ID NO: 1210977 - DNA, 16 bp, Homo sapiens
actgtttctcttgagc

SEQ ID NO: 1210978 - DNA, 19 bp, Homo sapiens
actgtttcttgcactgaat

SEQ ID NO: 1210979 - DNA, 21 bp, Homo sapiens
actgtttgaaaacttcagaag

SEQ ID NO: 1210980 - DNA, 22 bp, Homo sapiens
actgtttgatataccaaattaa

SEQ ID NO: 1210981 - DNA, 19 bp, Homo sapiens
actgtttggcttataaaca

SEQ ID NO: 1210982 - DNA, 21 bp, Homo sapiens
actgtttggcttataaacaca

SEQ ID NO: 1210983 - DNA, 22 bp, Homo sapiens
actgtttgtttttatttaaatt

SEQ ID NO: 1210984 - DNA, 15 bp, Homo sapiens
actgttttaattgta

SEQ ID NO: 1210985 - DNA, 17 bp, Homo sapiens
actgttttaattgtagt

SEQ ID NO: 1210986 - DNA, 15 bp, Homo sapiens
actgttttatgttga

SEQ ID NO: 1210987 - DNA, 23 bp, Homo sapiens
actgttttatgttgatctgcata

SEQ ID NO: 1210988 - DNA, 14 bp, Homo sapiens
actgttttcaagtc

SEQ ID NO: 1210989 - DNA, 13 bp, Homo sapiens
actgttttcaata

SEQ ID NO: 1210990 - DNA, 22 bp, Homo sapiens
actgttttgaataaattttcaa

SEQ ID NO: 1210991 - DNA, 14 bp, Homo sapiens
actgttttgggcct

SEQ ID NO: 1210992 - DNA, 17 bp, Homo sapiens
actgttttgggcctcca

SEQ ID NO: 1210993 - DNA, 12 bp, Homo sapiens
actgtttttaat

SEQ ID NO: 1210994 - DNA, 22 bp, Homo sapiens
actgtttttaatgttcacattt

SEQ ID NO: 1210995 - DNA, 19 bp, Homo sapiens
actgtttttattccttcca

SEQ ID NO: 1210996 - DNA, 19 bp, Homo sapiens
actgtttttcggacagttt

SEQ ID NO: 1210997 - DNA, 23 bp, Homo sapiens
actgtttttgaaaaattacagct

SEQ ID NO: 1210998 - DNA, 19 bp, Homo sapiens
actgtttttgataaagtaa

SEQ ID NO: 1210999 - DNA, 13 bp, Homo sapiens
actgttttttaag

SEQ ID NO: 1211000 - DNA, 19 bp, Homo sapiens
actgttttttttgcagggg

SEQ ID NO: 1211001 - DNA, 14 bp, Homo sapiens
acttaaaaaaatga

SEQ ID NO: 1211002 - DNA, 16 bp, Homo sapiens
acttaaaaaaatgaca

SEQ ID NO: 1211003 - DNA, 17 bp, Homo sapiens
acttaaaaaaatgacag

SEQ ID NO: 1211004 - DNA, 22 bp, Homo sapiens
acttaaaaaaatgacagatgtt

SEQ ID NO: 1211005 - DNA, 13 bp, Homo sapiens
acttaaaaaactt

SEQ ID NO: 1211006 - DNA, 16 bp, Homo sapiens
acttaaaaaatgtcca

SEQ ID NO: 1211007 - DNA, 14 bp, Homo sapiens
acttaaaagtattc

SEQ ID NO: 1211008 - DNA, 23 bp, Homo sapiens
acttaaaataggggatatttaag

SEQ ID NO: 1211009 - DNA, 22 bp, Homo sapiens
acttaaaatattcctgcatttg

SEQ ID NO: 1211010 - DNA, 13 bp, Homo sapiens
acttaaaatattt

SEQ ID NO: 1211011 - DNA, 18 bp, Homo sapiens
acttaaaattagtctttt

SEQ ID NO: 1211012 - DNA, 21 bp, Homo sapiens
acttaaaattgtaacctgcat

SEQ ID NO: 1211013 - DNA, 22 bp, Homo sapiens
acttaaagaagtatttttagaa

SEQ ID NO: 1211014 - DNA, 13 bp, Homo sapiens
acttaaagactgt

SEQ ID NO: 1211015 - DNA, 22 bp, Homo sapiens
acttaaagcaaaatagtattgc

SEQ ID NO: 1211016 - DNA, 22 bp, Homo sapiens
acttaaagcccgcctgacagaa

SEQ ID NO: 1211017 - DNA, 21 bp, Homo sapiens
acttaaagggcccaatgaatt

SEQ ID NO: 1211018 - DNA, 19 bp, Homo sapiens
acttaaagttgattttgaa

SEQ ID NO: 1211019 - DNA, 18 bp, Homo sapiens
acttaaataatgtgaaac

SEQ ID NO: 1211020 - DNA, 20 bp, Homo sapiens
acttaaataatgtgaaactg

SEQ ID NO: 1211021 - DNA, 14 bp, Homo sapiens
acttaaattatgtt

SEQ ID NO: 1211022 - DNA, 15 bp, Homo sapiens
acttaaattcttttg

SEQ ID NO: 1211023 - DNA, 20 bp, Homo sapiens
acttaaatttgaatctgagt

SEQ ID NO: 1211024 - DNA, 14 bp, Homo sapiens
acttaacagatgca

SEQ ID NO: 1211025 - DNA, 21 bp, Homo sapiens
acttaacagatgcaatgtgct

SEQ ID NO: 1211026 - DNA, 14 bp, Homo sapiens
acttaacatattta

SEQ ID NO: 1211027 - DNA, 17 bp, Homo sapiens
acttaacatttcattgt

SEQ ID NO: 1211028 - DNA, 19 bp, Homo sapiens
acttaacatttcattgtac

SEQ ID NO: 1211029 - DNA, 12 bp, Homo sapiens
acttaactgaag

SEQ ID NO: 1211030 - DNA, 13 bp, Homo sapiens
acttaagagaata

SEQ ID NO: 1211031 - DNA, 15 bp, Homo sapiens
acttaagagaatatt

SEQ ID NO: 1211032 - DNA, 22 bp, Homo sapiens
acttaagatgggcctgtatgag

SEQ ID NO: 1211033 - DNA, 14 bp, Homo sapiens
acttaagcaaaaga

SEQ ID NO: 1211034 - DNA, 20 bp, Homo sapiens
acttaagcaaaagaaaaaga

SEQ ID NO: 1211035 - DNA, 21 bp, Homo sapiens
acttaagcccagtgcactgaa

SEQ ID NO: 1211036 - DNA, 17 bp, Homo sapiens
acttaagggagaaaaaa

SEQ ID NO: 1211037 - DNA, 16 bp, Homo sapiens
acttaagtgcactttt

SEQ ID NO: 1211038 - DNA, 22 bp, Homo sapiens
acttaagttctttgatttgtac

SEQ ID NO: 1211039 - DNA, 17 bp, Homo sapiens
acttaataactgtgtac

SEQ ID NO: 1211040 - DNA, 18 bp, Homo sapiens
acttaatactaccttgaa

SEQ ID NO: 1211041 - DNA, 15 bp, Homo sapiens
acttaatagcaacag

SEQ ID NO: 1211042 - DNA, 15 bp, Homo sapiens
acttaatctaaatgg

SEQ ID NO: 1211043 - DNA, 16 bp, Homo sapiens
acttaatctaaatgga

SEQ ID NO: 1211044 - DNA, 14 bp, Homo sapiens
acttaatctttcta

SEQ ID NO: 1211045 - DNA, 18 bp, Homo sapiens
acttaatgaaaacaatgc

SEQ ID NO: 1211046 - DNA, 16 bp, Homo sapiens
acttaatgagacttta

SEQ ID NO: 1211047 - DNA, 22 bp, Homo sapiens
acttaatggctgttgagggcca

SEQ ID NO: 1211048 - DNA, 23 bp, Homo sapiens
acttaatggctgttgagggccac

SEQ ID NO: 1211049 - DNA, 17 bp, Homo sapiens
acttaatgtttcttaga

SEQ ID NO: 1211050 - DNA, 18 bp, Homo sapiens
acttaattgccagcaaat

SEQ ID NO: 1211051 - DNA, 16 bp, Homo sapiens
acttaatttgtaaact

SEQ ID NO: 1211052 - DNA, 23 bp, Homo sapiens
acttacaaaatgccaagggggtg

SEQ ID NO: 1211053 - DNA, 17 bp, Homo sapiens
acttacatttgtacttt

SEQ ID NO: 1211054 - DNA, 19 bp, Homo sapiens
acttaccaattgatgtttt

SEQ ID NO: 1211055 - DNA, 16 bp, Homo sapiens
acttaccatatgtgct

SEQ ID NO: 1211056 - DNA, 16 bp, Homo sapiens
acttaccgccctgcgg

SEQ ID NO: 1211057 - DNA, 17 bp, Homo sapiens
acttacctagatttaca

SEQ ID NO: 1211058 - DNA, 15 bp, Homo sapiens
acttacctagtgaaa

SEQ ID NO: 1211059 - DNA, 17 bp, Homo sapiens
acttacgtaaaacattt

SEQ ID NO: 1211060 - DNA, 15 bp, Homo sapiens
acttacgtcactact

SEQ ID NO: 1211061 - DNA, 20 bp, Homo sapiens
acttactgggtgaggaaatc

SEQ ID NO: 1211062 - DNA, 13 bp, Homo sapiens
acttacttgctta

SEQ ID NO: 1211063 - DNA, 15 bp, Homo sapiens
acttacttgcttatt

SEQ ID NO: 1211064 - DNA, 13 bp, Homo sapiens
acttactttttct

SEQ ID NO: 1211065 - DNA, 21 bp, Homo sapiens
acttactttttctggtctcta

SEQ ID NO: 1211066 - DNA, 22 bp, Homo sapiens
acttagaagtagtatgttattc

SEQ ID NO: 1211067 - DNA, 17 bp, Homo sapiens
acttagaatgccataaa

SEQ ID NO: 1211068 - DNA, 19 bp, Homo sapiens
acttagacctatactgaaa

SEQ ID NO: 1211069 - DNA, 19 bp, Homo sapiens
acttagactctagtattta

SEQ ID NO: 1211070 - DNA, 12 bp, Homo sapiens
acttagaggaaa

SEQ ID NO: 1211071 - DNA, 15 bp, Homo sapiens
acttagaggaaaagg

SEQ ID NO: 1211072 - DNA, 20 bp, Homo sapiens
acttagaggtggggagcaga

SEQ ID NO: 1211073 - DNA, 15 bp, Homo sapiens
acttagagtttctgt

SEQ ID NO: 1211074 - DNA, 21 bp, Homo sapiens
acttagagtttctgtttgatt

SEQ ID NO: 1211075 - DNA, 17 bp, Homo sapiens
acttagatattaaaatt

SEQ ID NO: 1211076 - DNA, 21 bp, Homo sapiens
acttagatattaaaatttggt

SEQ ID NO: 1211077 - DNA, 16 bp, Homo sapiens
acttagattgtgttcc

SEQ ID NO: 1211078 - DNA, 14 bp, Homo sapiens
acttagcaggcacc

SEQ ID NO: 1211079 - DNA, 12 bp, Homo sapiens
acttagccagag

SEQ ID NO: 1211080 - DNA, 16 bp, Homo sapiens
acttagccattgaaat

SEQ ID NO: 1211081 - DNA, 13 bp, Homo sapiens
acttagcccaaga

SEQ ID NO: 1211082 - DNA, 23 bp, Homo sapiens
acttagcccaagaggtctgagcc

SEQ ID NO: 1211083 - DNA, 23 bp, Homo sapiens
acttagccgcaccctgcacctgc

SEQ ID NO: 1211084 - DNA, 21 bp, Homo sapiens
acttagccgtccatggcacca

SEQ ID NO: 1211085 - DNA, 19 bp, Homo sapiens
acttagcgtcaagacattt

SEQ ID NO: 1211086 - DNA, 18 bp, Homo sapiens
acttagctgtactataag

SEQ ID NO: 1211087 - DNA, 22 bp, Homo sapiens
acttaggtaaaataaaagacta

SEQ ID NO: 1211088 - DNA, 15 bp, Homo sapiens
acttaggtgtggggg

SEQ ID NO: 1211089 - DNA, 23 bp, Homo sapiens
acttaggttattttgctttggtt

SEQ ID NO: 1211090 - DNA, 15 bp, Homo sapiens
acttagtagattaaa

SEQ ID NO: 1211091 - DNA, 20 bp, Homo sapiens
acttagtagattaaaaatta

SEQ ID NO: 1211092 - DNA, 19 bp, Homo sapiens
acttagtagtttttacaaa

SEQ ID NO: 1211093 - DNA, 19 bp, Homo sapiens
acttagtatgcagttgata

SEQ ID NO: 1211094 - DNA, 18 bp, Homo sapiens
acttagtgatcatttaaa

SEQ ID NO: 1211095 - DNA, 16 bp, Homo sapiens
acttagtggtatgtct

SEQ ID NO: 1211096 - DNA, 20 bp, Homo sapiens
acttagtggtatgtctcttt

SEQ ID NO: 1211097 - DNA, 21 bp, Homo sapiens
acttagttaaaattgatttct

SEQ ID NO: 1211098 - DNA, 16 bp, Homo sapiens
acttataccaaaggga

SEQ ID NO: 1211099 - DNA, 17 bp, Homo sapiens
acttatagtacatgata

SEQ ID NO: 1211100 - DNA, 12 bp, Homo sapiens
acttatattgaa

SEQ ID NO: 1211101 - DNA, 20 bp, Homo sapiens
acttatattgtaagaaatac

SEQ ID NO: 1211102 - DNA, 21 bp, Homo sapiens
acttatattgtaagaaatact

SEQ ID NO: 1211103 - DNA, 22 bp, Homo sapiens
acttatattttatgaacattgt

SEQ ID NO: 1211104 - DNA, 16 bp, Homo sapiens
acttatattttgattt

SEQ ID NO: 1211105 - DNA, 19 bp, Homo sapiens
acttatcatttttgtataa

SEQ ID NO: 1211106 - DNA, 23 bp, Homo sapiens
acttatcatttttgtataaaaag

SEQ ID NO: 1211107 - DNA, 14 bp, Homo sapiens
acttatcttatgcc

SEQ ID NO: 1211108 - DNA, 22 bp, Homo sapiens
acttatgcaaaaccttgtgaac

SEQ ID NO: 1211109 - DNA, 14 bp, Homo sapiens
acttatgctgattt

SEQ ID NO: 1211110 - DNA, 12 bp, Homo sapiens
acttatgctgct

SEQ ID NO: 1211111 - DNA, 14 bp, Homo sapiens
acttatgctgctgt

SEQ ID NO: 1211112 - DNA, 20 bp, Homo sapiens
acttattaaaaaatttgtat

SEQ ID NO: 1211113 - DNA, 20 bp, Homo sapiens
acttattactgctaagtatt

SEQ ID NO: 1211114 - DNA, 16 bp, Homo sapiens
acttattatgcataaa

SEQ ID NO: 1211115 - DNA, 15 bp, Homo sapiens
acttattcaaagaga

SEQ ID NO: 1211116 - DNA, 17 bp, Homo sapiens
acttattcatagtttta

SEQ ID NO: 1211117 - DNA, 13 bp, Homo sapiens
acttattccaagt

SEQ ID NO: 1211118 - DNA, 13 bp, Homo sapiens
acttattgaatat

SEQ ID NO: 1211119 - DNA, 17 bp, Homo sapiens
acttattgaatatatga

SEQ ID NO: 1211120 - DNA, 18 bp, Homo sapiens
acttattgaatatatgat

SEQ ID NO: 1211121 - DNA, 21 bp, Homo sapiens
acttattggaactctgcttga

SEQ ID NO: 1211122 - DNA, 20 bp, Homo sapiens
acttatttaaaaatatttca

SEQ ID NO: 1211123 - DNA, 12 bp, Homo sapiens
acttatttatga

SEQ ID NO: 1211124 - DNA, 15 bp, Homo sapiens
acttatttatgaatt

SEQ ID NO: 1211125 - DNA, 16 bp, Homo sapiens
acttatttatgaattg

SEQ ID NO: 1211126 - DNA, 21 bp, Homo sapiens
acttattttcagtgcatcatt

SEQ ID NO: 1211127 - DNA, 15 bp, Homo sapiens
acttattttctctgt

SEQ ID NO: 1211128 - DNA, 21 bp, Homo sapiens
acttattttgtcttattctta

SEQ ID NO: 1211129 - DNA, 15 bp, Homo sapiens
acttatttttcacca

SEQ ID NO: 1211130 - DNA, 16 bp, Homo sapiens
acttatttttgacagt

SEQ ID NO: 1211131 - DNA, 20 bp, Homo sapiens
acttcaaaaacatttcatgc

SEQ ID NO: 1211132 - DNA, 15 bp, Homo sapiens
acttcaaaagtttgt

SEQ ID NO: 1211133 - DNA, 15 bp, Homo sapiens
acttcaaaatattga

SEQ ID NO: 1211134 - DNA, 16 bp, Homo sapiens
acttcaaaatattgag

SEQ ID NO: 1211135 - DNA, 23 bp, Homo sapiens
acttcaagacatcaccatcagca

SEQ ID NO: 1211136 - DNA, 22 bp, Homo sapiens
acttcaagtgcatgctctctgc

SEQ ID NO: 1211137 - DNA, 16 bp, Homo sapiens
acttcaagttaaagtg

SEQ ID NO: 1211138 - DNA, 19 bp, Homo sapiens
acttcaatgggctcttcca

SEQ ID NO: 1211139 - DNA, 14 bp, Homo sapiens
acttcacactgcaa

SEQ ID NO: 1211140 - DNA, 16 bp, Homo sapiens
acttcacactgcaaga

SEQ ID NO: 1211141 - DNA, 19 bp, Homo sapiens
acttcacactgcaagagcc

SEQ ID NO: 1211142 - DNA, 19 bp, Homo sapiens
acttcacatattgatttcc

SEQ ID NO: 1211143 - DNA, 18 bp, Homo sapiens
acttcacattaaaaaatg

SEQ ID NO: 1211144 - DNA, 15 bp, Homo sapiens
acttcaccaccccct

SEQ ID NO: 1211145 - DNA, 15 bp, Homo sapiens
acttcacccccaact

SEQ ID NO: 1211146 - DNA, 15 bp, Homo sapiens
acttcacccgagttc

SEQ ID NO: 1211147 - DNA, 17 bp, Homo sapiens
acttcactggtgtacat

SEQ ID NO: 1211148 - DNA, 11 bp, Homo sapiens
acttcactgta

SEQ ID NO: 1211149 - DNA, 15 bp, Homo sapiens
acttcactgtatata

SEQ ID NO: 1211150 - DNA, 16 bp, Homo sapiens
acttcactgtatataa

SEQ ID NO: 1211151 - DNA, 17 bp, Homo sapiens
acttcactgtatataaa

SEQ ID NO: 1211152 - DNA, 21 bp, Homo sapiens
acttcactgtatataaacata

SEQ ID NO: 1211153 - DNA, 13 bp, Homo sapiens
acttcactgtgag

SEQ ID NO: 1211154 - DNA, 14 bp, Homo sapiens
acttcactgtgagg

SEQ ID NO: 1211155 - DNA, 23 bp, Homo sapiens
acttcagaaacccggcttcctgt

SEQ ID NO: 1211156 - DNA, 13 bp, Homo sapiens
acttcagactgaa

SEQ ID NO: 1211157 - DNA, 17 bp, Homo sapiens
acttcagagagctggta

SEQ ID NO: 1211158 - DNA, 15 bp, Homo sapiens
acttcagatctctaa

SEQ ID NO: 1211159 - DNA, 16 bp, Homo sapiens
acttcagctgactttt

SEQ ID NO: 1211160 - DNA, 15 bp, Homo sapiens
acttcagctgcctga

SEQ ID NO: 1211161 - DNA, 16 bp, Homo sapiens
acttcagctgcctgaa

SEQ ID NO: 1211162 - DNA, 17 bp, Homo sapiens
acttcaggccaacaagg

SEQ ID NO: 1211163 - DNA, 19 bp, Homo sapiens
acttcagggcagggctctg

SEQ ID NO: 1211164 - DNA, 18 bp, Homo sapiens
acttcaggtccgtgggcc

SEQ ID NO: 1211165 - DNA, 17 bp, Homo sapiens
acttcaggtgcttttga

SEQ ID NO: 1211166 - DNA, 21 bp, Homo sapiens
acttcagtatgttgtcaaaga

SEQ ID NO: 1211167 - DNA, 15 bp, Homo sapiens
acttcagtcctgctc

SEQ ID NO: 1211168 - DNA, 17 bp, Homo sapiens
acttcatagaaacctct

SEQ ID NO: 1211169 - DNA, 14 bp, Homo sapiens
acttcatattgctg

SEQ ID NO: 1211170 - DNA, 19 bp, Homo sapiens
acttcattctaaaccaaaa

SEQ ID NO: 1211171 - DNA, 15 bp, Homo sapiens
acttcattgtccctc

SEQ ID NO: 1211172 - DNA, 20 bp, Homo sapiens
acttccaaacctgacagatg

SEQ ID NO: 1211173 - DNA, 16 bp, Homo sapiens
acttccaaactaattt

SEQ ID NO: 1211174 - DNA, 18 bp, Homo sapiens
acttccaaactaattttt

SEQ ID NO: 1211175 - DNA, 15 bp, Homo sapiens
acttccaaagaaagt

SEQ ID NO: 1211176 - DNA, 16 bp, Homo sapiens
acttccaaagaaagtt

SEQ ID NO: 1211177 - DNA, 17 bp, Homo sapiens
acttccaaagaaagttc

SEQ ID NO: 1211178 - DNA, 21 bp, Homo sapiens
acttccacctcgggcacattt

SEQ ID NO: 1211179 - DNA, 20 bp, Homo sapiens
acttccacttgtgtatattt

SEQ ID NO: 1211180 - DNA, 19 bp, Homo sapiens
acttccagatatccacata

SEQ ID NO: 1211181 - DNA, 18 bp, Homo sapiens
acttccaggggaacctgc

SEQ ID NO: 1211182 - DNA, 20 bp, Homo sapiens
acttccaggtgttactgtaa

SEQ ID NO: 1211183 - DNA, 18 bp, Homo sapiens
acttccagtctggagagc

SEQ ID NO: 1211184 - DNA, 13 bp, Homo sapiens
acttccagtggct

SEQ ID NO: 1211185 - DNA, 22 bp, Homo sapiens
acttccagtgttggctgtgtga

SEQ ID NO: 1211186 - DNA, 13 bp, Homo sapiens
acttccatgaatt

SEQ ID NO: 1211187 - DNA, 14 bp, Homo sapiens
acttccatgcctta

SEQ ID NO: 1211188 - DNA, 17 bp, Homo sapiens
acttcccaacagcctta

SEQ ID NO: 1211189 - DNA, 17 bp, Homo sapiens
acttcccacccccaggc

SEQ ID NO: 1211190 - DNA, 17 bp, Homo sapiens
acttcccatctggctca

SEQ ID NO: 1211191 - DNA, 18 bp, Homo sapiens
acttcccatctggctcag

SEQ ID NO: 1211192 - DNA, 19 bp, Homo sapiens
acttcccattttggaagtt

SEQ ID NO: 1211193 - DNA, 21 bp, Homo sapiens
acttccccatcccgaagccat

SEQ ID NO: 1211194 - DNA, 14 bp, Homo sapiens
acttcccctgggca

SEQ ID NO: 1211195 - DNA, 13 bp, Homo sapiens
acttccccttcct

SEQ ID NO: 1211196 - DNA, 14 bp, Homo sapiens
acttccccttcttg

SEQ ID NO: 1211197 - DNA, 18 bp, Homo sapiens
acttcccgggccagggct

SEQ ID NO: 1211198 - DNA, 15 bp, Homo sapiens
acttccctagtcccc

SEQ ID NO: 1211199 - DNA, 20 bp, Homo sapiens
acttccctctgtttctcttt

SEQ ID NO: 1211200 - DNA, 22 bp, Homo sapiens
acttccctgattgacctgctcc

SEQ ID NO: 1211201 - DNA, 12 bp, Homo sapiens
acttccctggtc

SEQ ID NO: 1211202 - DNA, 14 bp, Homo sapiens
acttccctggtcac

SEQ ID NO: 1211203 - DNA, 15 bp, Homo sapiens
acttccctggtcacc

SEQ ID NO: 1211204 - DNA, 17 bp, Homo sapiens
acttccgctccctggat

SEQ ID NO: 1211205 - DNA, 18 bp, Homo sapiens
acttccgctccctggata

SEQ ID NO: 1211206 - DNA, 15 bp, Homo sapiens
acttcctccacagtc

SEQ ID NO: 1211207 - DNA, 14 bp, Homo sapiens
acttcctcctacct

SEQ ID NO: 1211208 - DNA, 16 bp, Homo sapiens
acttcctcctacctgg

SEQ ID NO: 1211209 - DNA, 17 bp, Homo sapiens
acttcctcctacctggg

SEQ ID NO: 1211210 - DNA, 19 bp, Homo sapiens
acttcctcctacctgggga

SEQ ID NO: 1211211 - DNA, 23 bp, Homo sapiens
acttcctcctacctggggactcc

SEQ ID NO: 1211212 - DNA, 17 bp, Homo sapiens
acttcctcctccccact

SEQ ID NO: 1211213 - DNA, 20 bp, Homo sapiens
acttcctcctgatggccaag

SEQ ID NO: 1211214 - DNA, 16 bp, Homo sapiens
acttcctgactctcac

SEQ ID NO: 1211215 - DNA, 19 bp, Homo sapiens
acttcctgactctcacctg

SEQ ID NO: 1211216 - DNA, 13 bp, Homo sapiens
acttcctgctgca

SEQ ID NO: 1211217 - DNA, 18 bp, Homo sapiens
acttcctgctgcaccctg

SEQ ID NO: 1211218 - DNA, 14 bp, Homo sapiens
acttcctggcctct

SEQ ID NO: 1211219 - DNA, 22 bp, Homo sapiens
acttcctggcctcttctgggct

SEQ ID NO: 1211220 - DNA, 13 bp, Homo sapiens
acttcctggggcc

SEQ ID NO: 1211221 - DNA, 12 bp, Homo sapiens
acttcctgtcca

SEQ ID NO: 1211222 - DNA, 22 bp, Homo sapiens
acttccttattgggacttttct

SEQ ID NO: 1211223 - DNA, 22 bp, Homo sapiens
acttcctttcctactgtcctgg

SEQ ID NO: 1211224 - DNA, 16 bp, Homo sapiens
acttcgctagaaaaaa

SEQ ID NO: 1211225 - DNA, 17 bp, Homo sapiens
acttcgggaggtcgagg

SEQ ID NO: 1211226 - DNA, 20 bp, Homo sapiens
acttcgggaggtcgaggcag

SEQ ID NO: 1211227 - DNA, 16 bp, Homo sapiens
acttcggggaagatac

SEQ ID NO: 1211228 - DNA, 15 bp, Homo sapiens
acttcgtcttctaat

SEQ ID NO: 1211229 - DNA, 19 bp, Homo sapiens
acttcgtcttctaatttca

SEQ ID NO: 1211230 - DNA, 11 bp, Homo sapiens
acttctaatat

SEQ ID NO: 1211231 - DNA, 16 bp, Homo sapiens
acttctagcagagacc

SEQ ID NO: 1211232 - DNA, 16 bp, Homo sapiens
acttctagctgtctgt

SEQ ID NO: 1211233 - DNA, 13 bp, Homo sapiens
acttctatatttt

SEQ ID NO: 1211234 - DNA, 19 bp, Homo sapiens
acttctatattttaataga

SEQ ID NO: 1211235 - DNA, 14 bp, Homo sapiens
acttctatgttggt

SEQ ID NO: 1211236 - DNA, 20 bp, Homo sapiens
acttctatgttggtttcagt

SEQ ID NO: 1211237 - DNA, 17 bp, Homo sapiens
acttctatttaatgctt

SEQ ID NO: 1211238 - DNA, 17 bp, Homo sapiens
acttctcactaatttgt

SEQ ID NO: 1211239 - DNA, 16 bp, Homo sapiens
acttctcactcaccac

SEQ ID NO: 1211240 - DNA, 22 bp, Homo sapiens
acttctcatcatattgtatgta

SEQ ID NO: 1211241 - DNA, 12 bp, Homo sapiens
acttctccccag

SEQ ID NO: 1211242 - DNA, 18 bp, Homo sapiens
acttctcccccgccctgc

SEQ ID NO: 1211243 - DNA, 13 bp, Homo sapiens
acttctcccctgc

SEQ ID NO: 1211244 - DNA, 12 bp, Homo sapiens
acttctctgctg

SEQ ID NO: 1211245 - DNA, 14 bp, Homo sapiens
acttctctgctgcc

SEQ ID NO: 1211246 - DNA, 15 bp, Homo sapiens
acttctctgctgcct

SEQ ID NO: 1211247 - DNA, 15 bp, Homo sapiens
acttctcttacattt

SEQ ID NO: 1211248 - DNA, 17 bp, Homo sapiens
acttctcttgctttcta

SEQ ID NO: 1211249 - DNA, 17 bp, Homo sapiens
acttgaagcacttaagt

SEQ ID NO: 1211250 - DNA, 22 bp, Homo sapiens
acttgaaggatggatgagtcag

SEQ ID NO: 1211251 - DNA, 15 bp, Homo sapiens
acttgaaggattgca

SEQ ID NO: 1211252 - DNA, 19 bp, Homo sapiens
acttgaaggattgcatcct

SEQ ID NO: 1211253 - DNA, 11 bp, Homo sapiens
acttgaagttg

SEQ ID NO: 1211254 - DNA, 12 bp, Homo sapiens
acttgaagttgt

SEQ ID NO: 1211255 - DNA, 13 bp, Homo sapiens
acttgaagttgtt

SEQ ID NO: 1211256 - DNA, 18 bp, Homo sapiens
acttgaatagtattgtgt

SEQ ID NO: 1211257 - DNA, 16 bp, Homo sapiens
acttgaatatggaaca

SEQ ID NO: 1211258 - DNA, 17 bp, Homo sapiens
acttgaatatggaacat

SEQ ID NO: 1211259 - DNA, 19 bp, Homo sapiens
acttgaatatggaacatat

SEQ ID NO: 1211260 - DNA, 16 bp, Homo sapiens
acttgaatcaaagcag

SEQ ID NO: 1211261 - DNA, 24 bp, Homo sapiens
acttgaatgctagttatacttatt

SEQ ID NO: 1211262 - DNA, 14 bp, Homo sapiens
acttgaatgctgcc

SEQ ID NO: 1211263 - DNA, 19 bp, Homo sapiens
acttgaatggttaataaaa

SEQ ID NO: 1211264 - DNA, 15 bp, Homo sapiens
acttgaatgtgtcag

SEQ ID NO: 1211265 - DNA, 19 bp, Homo sapiens
acttgacaacatcccacag

SEQ ID NO: 1211266 - DNA, 12 bp, Homo sapiens
acttgacagtgg

SEQ ID NO: 1211267 - DNA, 15 bp, Homo sapiens
acttgaccctttcct

SEQ ID NO: 1211268 - DNA, 22 bp, Homo sapiens
acttgaccgtttttatattact

SEQ ID NO: 1211269 - DNA, 22 bp, Homo sapiens
acttgactcatttaaagctaaa

SEQ ID NO: 1211270 - DNA, 17 bp, Homo sapiens
acttgacttttaaggct

SEQ ID NO: 1211271 - DNA, 17 bp, Homo sapiens
acttgagaacttgacaa

SEQ ID NO: 1211272 - DNA, 23 bp, Homo sapiens
acttgagaacttgacaagttgcg

SEQ ID NO: 1211273 - DNA, 15 bp, Homo sapiens
acttgagacaatgtt

SEQ ID NO: 1211274 - DNA, 19 bp, Homo sapiens
acttgagaggatgaatgta

SEQ ID NO: 1211275 - DNA, 16 bp, Homo sapiens
acttgagatctgtata

SEQ ID NO: 1211276 - DNA, 18 bp, Homo sapiens
acttgagatctgtataaa

SEQ ID NO: 1211277 - DNA, 19 bp, Homo sapiens
acttgagatgtatgaaggc

SEQ ID NO: 1211278 - DNA, 21 bp, Homo sapiens
acttgagatgtatgaaggctt

SEQ ID NO: 1211279 - DNA, 22 bp, Homo sapiens
acttgagatgtatgaaggcttt

SEQ ID NO: 1211280 - DNA, 14 bp, Homo sapiens
acttgagccactcc

SEQ ID NO: 1211281 - DNA, 19 bp, Homo sapiens
acttgagctctgtaactta

SEQ ID NO: 1211282 - DNA, 15 bp, Homo sapiens
acttgagggcccaga

SEQ ID NO: 1211283 - DNA, 21 bp, Homo sapiens
acttgagggcccagagcagga

SEQ ID NO: 1211284 - DNA, 13 bp, Homo sapiens
acttgaggtcagg

SEQ ID NO: 1211285 - DNA, 22 bp, Homo sapiens
acttgagtgttcctttttaaat

SEQ ID NO: 1211286 - DNA, 22 bp, Homo sapiens
acttgagttggagtactatatt

SEQ ID NO: 1211287 - DNA, 23 bp, Homo sapiens
acttgagttggagtactatattt

SEQ ID NO: 1211288 - DNA, 24 bp, Homo sapiens
acttgagttggagtactatattta

SEQ ID NO: 1211289 - DNA, 18 bp, Homo sapiens
acttgataatattagtga

SEQ ID NO: 1211290 - DNA, 15 bp, Homo sapiens
acttgatgtcaagca

SEQ ID NO: 1211291 - DNA, 18 bp, Homo sapiens
acttgatgtgccatttta

SEQ ID NO: 1211292 - DNA, 14 bp, Homo sapiens
acttgattgagaaa

SEQ ID NO: 1211293 - DNA, 12 bp, Homo sapiens
acttgatttgat

SEQ ID NO: 1211294 - DNA, 21 bp, Homo sapiens
acttgatttgatgtgactttt

SEQ ID NO: 1211295 - DNA, 16 bp, Homo sapiens
acttgatttgcatgga

SEQ ID NO: 1211296 - DNA, 18 bp, Homo sapiens
acttgatttgcatggatt

SEQ ID NO: 1211297 - DNA, 21 bp, Homo sapiens
acttgcaaccgtctgttatgc

SEQ ID NO: 1211298 - DNA, 17 bp, Homo sapiens
acttgcaactaaggaca

SEQ ID NO: 1211299 - DNA, 21 bp, Homo sapiens
acttgcacagggattctcaca

SEQ ID NO: 1211300 - DNA, 15 bp, Homo sapiens
acttgcactctttaa

SEQ ID NO: 1211301 - DNA, 19 bp, Homo sapiens
acttgcactctttaacaca

SEQ ID NO: 1211302 - DNA, 20 bp, Homo sapiens
acttgcactctttaacacat

SEQ ID NO: 1211303 - DNA, 21 bp, Homo sapiens
acttgcaggggtccctgctag

SEQ ID NO: 1211304 - DNA, 13 bp, Homo sapiens
acttgcagttgtg

SEQ ID NO: 1211305 - DNA, 15 bp, Homo sapiens
acttgcagttgtgat

SEQ ID NO: 1211306 - DNA, 19 bp, Homo sapiens
acttgcatccaactccagg

SEQ ID NO: 1211307 - DNA, 15 bp, Homo sapiens
acttgcatggagcag

SEQ ID NO: 1211308 - DNA, 19 bp, Homo sapiens
acttgcatttttgcaggag

SEQ ID NO: 1211309 - DNA, 17 bp, Homo sapiens
acttgccaaaatgttgg

SEQ ID NO: 1211310 - DNA, 22 bp, Homo sapiens
acttgccaaaatgttggctgcg

SEQ ID NO: 1211311 - DNA, 23 bp, Homo sapiens
acttgccatgcaggaagaggccc

SEQ ID NO: 1211312 - DNA, 24 bp, Homo sapiens
acttgccatgcaggaagaggccca

SEQ ID NO: 1211313 - DNA, 21 bp, Homo sapiens
acttgccattccaaaatatta

SEQ ID NO: 1211314 - DNA, 19 bp, Homo sapiens
acttgccattgccaggaga

SEQ ID NO: 1211315 - DNA, 17 bp, Homo sapiens
acttgccctgttctctt

SEQ ID NO: 1211316 - DNA, 13 bp, Homo sapiens
acttgcctctgca

SEQ ID NO: 1211317 - DNA, 11 bp, Homo sapiens
acttgcctgga

SEQ ID NO: 1211318 - DNA, 21 bp, Homo sapiens
acttgcctggggtctgagcat

SEQ ID NO: 1211319 - DNA, 20 bp, Homo sapiens
acttgccttcttcacccagc

SEQ ID NO: 1211320 - DNA, 22 bp, Homo sapiens
acttgcgagaaattcgtgtgtt

SEQ ID NO: 1211321 - DNA, 21 bp, Homo sapiens
acttgcgagtccaaggccagt

SEQ ID NO: 1211322 - DNA, 14 bp, Homo sapiens
acttgcgcagaaaa

SEQ ID NO: 1211323 - DNA, 16 bp, Homo sapiens
acttgcgtcctgcaga

SEQ ID NO: 1211324 - DNA, 17 bp, Homo sapiens
acttgcgtcctgcagag

SEQ ID NO: 1211325 - DNA, 18 bp, Homo sapiens
acttgcgtcctgcagagg

SEQ ID NO: 1211326 - DNA, 20 bp, Homo sapiens
acttgcgtcctgcagaggac

SEQ ID NO: 1211327 - DNA, 13 bp, Homo sapiens
acttgctaaagca

SEQ ID NO: 1211328 - DNA, 17 bp, Homo sapiens
acttgctaaagcacttt

SEQ ID NO: 1211329 - DNA, 14 bp, Homo sapiens
acttgctaccctga

SEQ ID NO: 1211330 - DNA, 14 bp, Homo sapiens
acttgctcccaacc

SEQ ID NO: 1211331 - DNA, 23 bp, Homo sapiens
acttgctgcctgaagaacagtaa

SEQ ID NO: 1211332 - DNA, 16 bp, Homo sapiens
acttgctgctgtgcct

SEQ ID NO: 1211333 - DNA, 19 bp, Homo sapiens
acttgctgctgtgcctgcg

SEQ ID NO: 1211334 - DNA, 15 bp, Homo sapiens
acttgctggggctca

SEQ ID NO: 1211335 - DNA, 15 bp, Homo sapiens
acttgctgtgtgacc

SEQ ID NO: 1211336 - DNA, 21 bp, Homo sapiens
acttgctgtgtgaccctgggc

SEQ ID NO: 1211337 - DNA, 23 bp, Homo sapiens
acttgcttaaatttcttatgtga

SEQ ID NO: 1211338 - DNA, 23 bp, Homo sapiens
acttgcttctaaatgcccagttc

SEQ ID NO: 1211339 - DNA, 22 bp, Homo sapiens
acttggaaaaatccagaaagaa

SEQ ID NO: 1211340 - DNA, 22 bp, Homo sapiens
acttggaaacggtatcctccct

SEQ ID NO: 1211341 - DNA, 16 bp, Homo sapiens
acttggaatttgtaac

SEQ ID NO: 1211342 - DNA, 21 bp, Homo sapiens
acttggaatttgtaacctcag

SEQ ID NO: 1211343 - DNA, 16 bp, Homo sapiens
acttggacatctctct

SEQ ID NO: 1211344 - DNA, 23 bp, Homo sapiens
acttggacatctctctggcttct

SEQ ID NO: 1211345 - DNA, 20 bp, Homo sapiens
acttggacccaaaaaatcat

SEQ ID NO: 1211346 - DNA, 21 bp, Homo sapiens
acttggagactcctggtctgt

SEQ ID NO: 1211347 - DNA, 14 bp, Homo sapiens
acttggagagcaaa

SEQ ID NO: 1211348 - DNA, 22 bp, Homo sapiens
acttggagagcaaaggcccatg

SEQ ID NO: 1211349 - DNA, 22 bp, Homo sapiens
acttggagagggggccggaccc

SEQ ID NO: 1211350 - DNA, 13 bp, Homo sapiens
acttggagtaatt

SEQ ID NO: 1211351 - DNA, 11 bp, Homo sapiens
acttggatgga

SEQ ID NO: 1211352 - DNA, 16 bp, Homo sapiens
acttggattctttcca

SEQ ID NO: 1211353 - DNA, 18 bp, Homo sapiens
acttggattctttccatt

SEQ ID NO: 1211354 - DNA, 22 bp, Homo sapiens
acttggattctttccatttgca

SEQ ID NO: 1211355 - DNA, 15 bp, Homo sapiens
acttggatttcattt

SEQ ID NO: 1211356 - DNA, 13 bp, Homo sapiens
acttggcacttaa

SEQ ID NO: 1211357 - DNA, 11 bp, Homo sapiens
acttggcagct

SEQ ID NO: 1211358 - DNA, 20 bp, Homo sapiens
acttggcagctttttctgtg

SEQ ID NO: 1211359 - DNA, 21 bp, Homo sapiens
acttggcagctttttctgtgg

SEQ ID NO: 1211360 - DNA, 20 bp, Homo sapiens
acttggcatacaaaatattt

SEQ ID NO: 1211361 - DNA, 21 bp, Homo sapiens
acttggccctcttgcgggcct

SEQ ID NO: 1211362 - DNA, 12 bp, Homo sapiens
acttggcctcca

SEQ ID NO: 1211363 - DNA, 21 bp, Homo sapiens
acttggctggaatttctgctg

SEQ ID NO: 1211364 - DNA, 22 bp, Homo sapiens
acttggctggggaggaccaggg

SEQ ID NO: 1211365 - DNA, 14 bp, Homo sapiens
acttggctgtcctt

SEQ ID NO: 1211366 - DNA, 13 bp, Homo sapiens
acttggctttcat

SEQ ID NO: 1211367 - DNA, 14 bp, Homo sapiens
acttgggaaatttt

SEQ ID NO: 1211368 - DNA, 13 bp, Homo sapiens
acttgggagcctg

SEQ ID NO: 1211369 - DNA, 15 bp, Homo sapiens
acttgggagcctgag

SEQ ID NO: 1211370 - DNA, 22 bp, Homo sapiens
acttgggaggctgaggcaggag

SEQ ID NO: 1211371 - DNA, 19 bp, Homo sapiens
acttgggccatcggggggt

SEQ ID NO: 1211372 - DNA, 23 bp, Homo sapiens
acttgggctctctctagctcccc

SEQ ID NO: 1211373 - DNA, 12 bp, Homo sapiens
actgtagggcca

SEQ ID NO: 1211374 - DNA, 15 bp, Homo sapiens
actgtagggccaggg

SEQ ID NO: 1211375 - DNA, 18 bp, Homo sapiens
actgtagtttagttctgt

SEQ ID NO: 1211376 - DNA, 23 bp, Homo sapiens
actgtagtttagttctgttgacc

SEQ ID NO: 1211377 - DNA, 16 bp, Homo sapiens
actgtagtttttgaaa

SEQ ID NO: 1211378 - DNA, 20 bp, Homo sapiens
actgtagtttttgaaaatta

SEQ ID NO: 1211379 - DNA, 20 bp, Homo sapiens
actgtatataaacatatttt

SEQ ID NO: 1211380 - DNA, 14 bp, Homo sapiens
actgtatatgtatt

SEQ ID NO: 1211381 - DNA, 15 bp, Homo sapiens
actgtatatttgtat

SEQ ID NO: 1211382 - DNA, 17 bp, Homo sapiens
actgtatatttgtatga

SEQ ID NO: 1211383 - DNA, 19 bp, Homo sapiens
actgtatatttgtatgata

SEQ ID NO: 1211384 - DNA, 16 bp, Homo sapiens
actgtatcatgacaaa

SEQ ID NO: 1211385 - DNA, 11 bp, Homo sapiens
actgtatcctt

SEQ ID NO: 1211386 - DNA, 22 bp, Homo sapiens
actgtatctctaatacagtgtg

SEQ ID NO: 1211387 - DNA, 15 bp, Homo sapiens
actgtatgatttata

SEQ ID NO: 1211388 - DNA, 17 bp, Homo sapiens
actgtatgccttctgta

SEQ ID NO: 1211389 - DNA, 21 bp, Homo sapiens
actgtatgttatagaacttca

SEQ ID NO: 1211390 - DNA, 16 bp, Homo sapiens
actgtattgctcctcc

SEQ ID NO: 1211391 - DNA, 19 bp, Homo sapiens
actgtattgggccttttgg

SEQ ID NO: 1211392 - DNA, 20 bp, Homo sapiens
actgtatttcagtattttcc

SEQ ID NO: 1211393 - DNA, 21 bp, Homo sapiens
actgtatttcagtattttcca

SEQ ID NO: 1211394 - DNA, 21 bp, Homo sapiens
actgtattttgtattgtttca

SEQ ID NO: 1211395 - DNA, 19 bp, Homo sapiens
actgtatttttgaagacta

SEQ ID NO: 1211396 - DNA, 15 bp, Homo sapiens
actgtcaaatgatgt

SEQ ID NO: 1211397 - DNA, 19 bp, Homo sapiens
actgtcaaattttcaaata

SEQ ID NO: 1211398 - DNA, 20 bp, Homo sapiens
actgtcaaggctgcttagaa

SEQ ID NO: 1211399 - DNA, 15 bp, Homo sapiens
actttgctcctcaca

SEQ ID NO: 1211400 - DNA, 14 bp, Homo sapiens
actttgctgcattt

SEQ ID NO: 1211401 - DNA, 22 bp, Homo sapiens
actttgctgttactgcttctct

SEQ ID NO: 1211402 - DNA, 12 bp, Homo sapiens
actttgcttcat

SEQ ID NO: 1211403 - DNA, 23 bp, Homo sapiens
actttgcttccgccactcagcca

SEQ ID NO: 1211404 - DNA, 18 bp, Homo sapiens
actttgcttgagaatcct

SEQ ID NO: 1211405 - DNA, 15 bp, Homo sapiens
actttgcttgctttg

SEQ ID NO: 1211406 - DNA, 15 bp, Homo sapiens
actttggaaccagac

SEQ ID NO: 1211407 - DNA, 17 bp, Homo sapiens
actttggaaccagactc

SEQ ID NO: 1211408 - DNA, 16 bp, Homo sapiens
actttggacagtggcc

SEQ ID NO: 1211409 - DNA, 22 bp, Homo sapiens
actttggagtcccctcacctcc

SEQ ID NO: 1211410 - DNA, 19 bp, Homo sapiens
actttggcttctcctgtga

SEQ ID NO: 1211411 - DNA, 17 bp, Homo sapiens
actttgggaggccaagg

SEQ ID NO: 1211412 - DNA, 17 bp, Homo sapiens
actttgggaggctgagg

SEQ ID NO: 1211413 - DNA, 19 bp, Homo sapiens
actttgggaggctgaggtg

SEQ ID NO: 1211414 - DNA, 18 bp, Homo sapiens
actttgggatatggtctt

SEQ ID NO: 1211415 - DNA, 19 bp, Homo sapiens
actttgggattctttccat

SEQ ID NO: 1211416 - DNA, 21 bp, Homo sapiens
actttggtactgctgtcttcc

SEQ ID NO: 1211417 - DNA, 16 bp, Homo sapiens
actttggttcctgtga

SEQ ID NO: 1211418 - DNA, 13 bp, Homo sapiens
actttgtaaattc

SEQ ID NO: 1211419 - DNA, 14 bp, Homo sapiens
actttgtacttgtg

SEQ ID NO: 1211420 - DNA, 16 bp, Homo sapiens
actttgtatacaagta

SEQ ID NO: 1211421 - DNA, 22 bp, Homo sapiens
actttgtattacttaggttatt

SEQ ID NO: 1211422 - DNA, 21 bp, Homo sapiens
actttgtcattatgatttcat

SEQ ID NO: 1211423 - DNA, 20 bp, Homo sapiens
actttgtcctaagagattta

SEQ ID NO: 1211424 - DNA, 19 bp, Homo sapiens
actttgtcgtggttcttaa

SEQ ID NO: 1211425 - DNA, 14 bp, Homo sapiens
actttgtctgaaaa

SEQ ID NO: 1211426 - DNA, 13 bp, Homo sapiens
actttgtctgtac

SEQ ID NO: 1211427 - DNA, 15 bp, Homo sapiens
actttgtctgtacat

SEQ ID NO: 1211428 - DNA, 18 bp, Homo sapiens
actttgtctgtacatact

SEQ ID NO: 1211429 - DNA, 14 bp, Homo sapiens
actttgtgcctttg

SEQ ID NO: 1211430 - DNA, 18 bp, Homo sapiens
actttgtggtctaaagtg

SEQ ID NO: 1211431 - DNA, 18 bp, Homo sapiens
actttgtgttcatttcat

SEQ ID NO: 1211432 - DNA, 11 bp, Homo sapiens
actttgtgttt

SEQ ID NO: 1211433 - DNA, 20 bp, Homo sapiens
actttgttctttaggagatt

SEQ ID NO: 1211434 - DNA, 21 bp, Homo sapiens
actttgttgcaagatgtgaat

SEQ ID NO: 1211435 - DNA, 21 bp, Homo sapiens
actttgttggcccttccagtg

SEQ ID NO: 1211436 - DNA, 17 bp, Homo sapiens
actttgtttatgcatat

SEQ ID NO: 1211437 - DNA, 20 bp, Homo sapiens
actttgtttcgtggggaggt

SEQ ID NO: 1211438 - DNA, 18 bp, Homo sapiens
acttttaaaaaacaaaaa

SEQ ID NO: 1211439 - DNA, 18 bp, Homo sapiens
acttttaaaagtaggaaa

SEQ ID NO: 1211440 - DNA, 20 bp, Homo sapiens
acttttaaactgtgtacata

SEQ ID NO: 1211441 - DNA, 23 bp, Homo sapiens
acttttaaagctcatgcatttca

SEQ ID NO: 1211442 - DNA, 22 bp, Homo sapiens
acttttaaaggaatgtgaaatt

SEQ ID NO: 1211443 - DNA, 14 bp, Homo sapiens
acttttaaggcagt

SEQ ID NO: 1211444 - DNA, 15 bp, Homo sapiens
acttttaatcagtga

SEQ ID NO: 1211445 - DNA, 18 bp, Homo sapiens
acttttaatgaacaaatg

SEQ ID NO: 1211446 - DNA, 13 bp, Homo sapiens
acttttacaagta

SEQ ID NO: 1211447 - DNA, 19 bp, Homo sapiens
acttttacagaatgcatta

SEQ ID NO: 1211448 - DNA, 16 bp, Homo sapiens
acttttaccactattt

SEQ ID NO: 1211449 - DNA, 16 bp, Homo sapiens
acttttactctgccta

SEQ ID NO: 1211450 - DNA, 18 bp, Homo sapiens
acttttataaattaaata

SEQ ID NO: 1211451 - DNA, 23 bp, Homo sapiens
acttttatactctttctgtatat

SEQ ID NO: 1211452 - DNA, 12 bp, Homo sapiens
acttttcagtga

SEQ ID NO: 1211453 - DNA, 17 bp, Homo sapiens
acttttcattccctgta

SEQ ID NO: 1211454 - DNA, 18 bp, Homo sapiens
acttttcattctctttta

SEQ ID NO: 1211455 - DNA, 16 bp, Homo sapiens
acttttccaagccctt

SEQ ID NO: 1211456 - DNA, 15 bp, Homo sapiens
acttttccagtctgt

SEQ ID NO: 1211457 - DNA, 22 bp, Homo sapiens
acttttcccctgttaaacagta

SEQ ID NO: 1211458 - DNA, 14 bp, Homo sapiens
acttttccttttct

SEQ ID NO: 1211459 - DNA, 15 bp, Homo sapiens
acttttccttttctt

SEQ ID NO: 1211460 - DNA, 12 bp, Homo sapiens
acttttcgttaa

SEQ ID NO: 1211461 - DNA, 17 bp, Homo sapiens
acttttcgttaacattg

SEQ ID NO: 1211462 - DNA, 18 bp, Homo sapiens
acttttctaaaatctaaa

SEQ ID NO: 1211463 - DNA, 15 bp, Homo sapiens
acttttctaaagtgc

SEQ ID NO: 1211464 - DNA, 15 bp, Homo sapiens
acttttctaagaaaa

SEQ ID NO: 1211465 - DNA, 23 bp, Homo sapiens
acttttctagaattatttttcac

SEQ ID NO: 1211466 - DNA, 18 bp, Homo sapiens
acttttctctttaatttt

SEQ ID NO: 1211467 - DNA, 18 bp, Homo sapiens
acttttctggttccaaac

SEQ ID NO: 1211468 - DNA, 11 bp, Homo sapiens
acttttctgta

SEQ ID NO: 1211469 - DNA, 20 bp, Homo sapiens
acttttctgtaattcaggtt

SEQ ID NO: 1211470 - DNA, 16 bp, Homo sapiens
acttttcttaaacctt

SEQ ID NO: 1211471 - DNA, 15 bp, Homo sapiens
acttttcttcttcct

SEQ ID NO: 1211472 - DNA, 18 bp, Homo sapiens
agaaaagttgctcttaaa

SEQ ID NO: 1211473 - DNA, 23 bp, Homo sapiens
agaaaagtttcgacttatttctt

SEQ ID NO: 1211474 - DNA, 16 bp, Homo sapiens
agaaaataaaaaaaag

SEQ ID NO: 1211475 - DNA, 19 bp, Homo sapiens
agaaaataaaaaaaagaaa

SEQ ID NO: 1211476 - DNA, 15 bp, Homo sapiens
agaaaataaactcat

SEQ ID NO: 1211477 - DNA, 22 bp, Homo sapiens
agaaaataacaagagttttaac

SEQ ID NO: 1211478 - DNA, 15 bp, Homo sapiens
agaaaatacaataaa

SEQ ID NO: 1211479 - DNA, 16 bp, Homo sapiens
agaaaatacaataaac

SEQ ID NO: 1211480 - DNA, 20 bp, Homo sapiens
agaaaataggggatggtcca

SEQ ID NO: 1211481 - DNA, 19 bp, Homo sapiens
agaaaatagtggtgtgatt

SEQ ID NO: 1211482 - DNA, 20 bp, Homo sapiens
agaaaatataaggacttttt

SEQ ID NO: 1211483 - DNA, 17 bp, Homo sapiens
agaaaatatatgtattt

SEQ ID NO: 1211484 - DNA, 11 bp, Homo sapiens
agaaaatattc

SEQ ID NO: 1211485 - DNA, 18 bp, Homo sapiens
agaaaatattttgtctaa

SEQ ID NO: 1211486 - DNA, 21 bp, Homo sapiens
agaaaatattttgtctaaaat

SEQ ID NO: 1211487 - DNA, 22 bp, Homo sapiens
agaaaatattttgtctaaaatg

SEQ ID NO: 1211488 - DNA, 23 bp, Homo sapiens
agaaaatcccggtgcttgcagta

SEQ ID NO: 1211489 - DNA, 23 bp, Homo sapiens
agaaaatcttcatggaattcaca

SEQ ID NO: 1211490 - DNA, 17 bp, Homo sapiens
agaaaatgaaatgcata

SEQ ID NO: 1211491 - DNA, 11 bp, Homo sapiens
agaaaatgaag

SEQ ID NO: 1211492 - DNA, 20 bp, Homo sapiens
agaaaatgacttatttctgc

SEQ ID NO: 1211493 - DNA, 15 bp, Homo sapiens
agaaaatgactttat

SEQ ID NO: 1211494 - DNA, 22 bp, Homo sapiens
agaaaatgcctcaattcacata

SEQ ID NO: 1211495 - DNA, 15 bp, Homo sapiens
agaaaatgcgagact

SEQ ID NO: 1211496 - DNA, 15 bp, Homo sapiens
agaaaatggacactg

SEQ ID NO: 1211497 - DNA, 10 bp, Homo sapiens
agaaaatgtc

SEQ ID NO: 1211498 - DNA, 12 bp, Homo sapiens
agaaaatgtctt

SEQ ID NO: 1211499 - DNA, 16 bp, Homo sapiens
agaaaatgttatttaa

SEQ ID NO: 1211500 - DNA, 18 bp, Homo sapiens
agaaaatgttatttaaca

SEQ ID NO: 1211501 - DNA, 19 bp, Homo sapiens
agaaaatgttatttaacag

SEQ ID NO: 1211502 - DNA, 14 bp, Homo sapiens
agaaaatgttctgt

SEQ ID NO: 1211503 - DNA, 18 bp, Homo sapiens
agaaaattaaaataggca

SEQ ID NO: 1211504 - DNA, 15 bp, Homo sapiens
agaaaattcaattgt

SEQ ID NO: 1211505 - DNA, 17 bp, Homo sapiens
agaaaattcaattgtaa

SEQ ID NO: 1211506 - DNA, 16 bp, Homo sapiens
agaaaattcctataag

SEQ ID NO: 1211507 - DNA, 16 bp, Homo sapiens
agaaaattctgtgcct

SEQ ID NO: 1211508 - DNA, 20 bp, Homo sapiens
agaaaattgttgcaaactat

SEQ ID NO: 1211509 - DNA, 12 bp, Homo sapiens
agaaaatttaca

SEQ ID NO: 1211510 - DNA, 14 bp, Homo sapiens
agaaaattttgtat

SEQ ID NO: 1211511 - DNA, 22 bp, Homo sapiens
agaaaatttttgtagtagcgtt

SEQ ID NO: 1211512 - DNA, 16 bp, Homo sapiens
agaaacaaatgacata

SEQ ID NO: 1211513 - DNA, 20 bp, Homo sapiens
agaaacaactctttgagaaa

SEQ ID NO: 1211514 - DNA, 15 bp, Homo sapiens
agaaacaatactgtt

SEQ ID NO: 1211515 - DNA, 14 bp, Homo sapiens
agaaacacaatatt

SEQ ID NO: 1211516 - DNA, 15 bp, Homo sapiens
agaaacacagttttg

SEQ ID NO: 1211517 - DNA, 16 bp, Homo sapiens
agaaacacagttttga

SEQ ID NO: 1211518 - DNA, 16 bp, Homo sapiens
agaaacacattcttat

SEQ ID NO: 1211519 - DNA, 15 bp, Homo sapiens
agaaacacccctctg

SEQ ID NO: 1211520 - DNA, 19 bp, Homo sapiens
agaaacacccctctgtcta

SEQ ID NO: 1211521 - DNA, 13 bp, Homo sapiens
agaaacactcaag

SEQ ID NO: 1211522 - DNA, 15 bp, Homo sapiens
agaaacactgaaaag

SEQ ID NO: 1211523 - DNA, 16 bp, Homo sapiens
agaaacactgaaaaga

SEQ ID NO: 1211524 - DNA, 17 bp, Homo sapiens
agaaacactgaaaagaa

SEQ ID NO: 1211525 - DNA, 19 bp, Homo sapiens
agaaacactgaaaagaagg

SEQ ID NO: 1211526 - DNA, 16 bp, Homo sapiens
agaaacactgcctgcc

SEQ ID NO: 1211527 - DNA, 19 bp, Homo sapiens
agaaacagagacaggccca

SEQ ID NO: 1211528 - DNA, 21 bp, Homo sapiens
agaaacagagtggcctccctg

SEQ ID NO: 1211529 - DNA, 19 bp, Homo sapiens
agaaacagggacaaagaaa

SEQ ID NO: 1211530 - DNA, 21 bp, Homo sapiens
agaaacagggacaaagaaatc

SEQ ID NO: 1211531 - DNA, 14 bp, Homo sapiens
agaaacagggcagc

SEQ ID NO: 1211532 - DNA, 18 bp, Homo sapiens
agaaacagtgggagccct

SEQ ID NO: 1211533 - DNA, 20 bp, Homo sapiens
agaaacagtgggagccctga

SEQ ID NO: 1211534 - DNA, 13 bp, Homo sapiens
agaaacagttaac

SEQ ID NO: 1211535 - DNA, 20 bp, Homo sapiens
agaaacagttaactttcaga

SEQ ID NO: 1211536 - DNA, 17 bp, Homo sapiens
agaaacagttggtaact

SEQ ID NO: 1211537 - DNA, 13 bp, Homo sapiens
agaaacagtttct

SEQ ID NO: 1211538 - DNA, 21 bp, Homo sapiens
agaaacatcagttactctgaa

SEQ ID NO: 1211539 - DNA, 20 bp, Homo sapiens
agaaacatctctggcccaga

SEQ ID NO: 1211540 - DNA, 14 bp, Homo sapiens
agaaacattgtaaa

SEQ ID NO: 1211541 - DNA, 18 bp, Homo sapiens
agaaacattgtaaatatt

SEQ ID NO: 1211542 - DNA, 15 bp, Homo sapiens
agaaaccatgacaaa

SEQ ID NO: 1211543 - DNA, 16 bp, Homo sapiens
agaaacccaagctcct

SEQ ID NO: 1211544 - DNA, 17 bp, Homo sapiens
agaaacccaagctcctc

SEQ ID NO: 1211545 - DNA, 19 bp, Homo sapiens
agaaacccaagctcctcct

SEQ ID NO: 1211546 - DNA, 18 bp, Homo sapiens
agaaacccggcttcctgt

SEQ ID NO: 1211547 - DNA, 21 bp, Homo sapiens
agaaaccctcattgtgtttct

SEQ ID NO: 1211548 - DNA, 13 bp, Homo sapiens
agaaaccctgtct

SEQ ID NO: 1211549 - DNA, 14 bp, Homo sapiens
agaaacgaaaagga

SEQ ID NO: 1211550 - DNA, 20 bp, Homo sapiens
agaaacgaagccatctttct

SEQ ID NO: 1211551 - DNA, 22 bp, Homo sapiens
agaaacgcgctccttggcggac

SEQ ID NO: 1211552 - DNA, 15 bp, Homo sapiens
agaaacgtcttctaa

SEQ ID NO: 1211553 - DNA, 16 bp, Homo sapiens
agaaacgtcttctaaa

SEQ ID NO: 1211554 - DNA, 18 bp, Homo sapiens
agaaacgtcttctaaact

SEQ ID NO: 1211555 - DNA, 17 bp, Homo sapiens
agaaactaaacagaaaa

SEQ ID NO: 1211556 - DNA, 17 bp, Homo sapiens
agaaactacaaatatag

SEQ ID NO: 1211557 - DNA, 22 bp, Homo sapiens
agaaactatttttgtgtttgaa

SEQ ID NO: 1211558 - DNA, 13 bp, Homo sapiens
actttttttagta

SEQ ID NO: 1211559 - DNA, 15 bp, Homo sapiens
actttttttcagttc

SEQ ID NO: 1211560 - DNA, 19 bp, Homo sapiens
actttttttctatattatt

SEQ ID NO: 1211561 - DNA, 20 bp, Homo sapiens
actttttttctgtaccagtt

SEQ ID NO: 1211562 - DNA, 15 bp, Homo sapiens
actttttttctgtga

SEQ ID NO: 1211563 - DNA, 20 bp, Homo sapiens
actttttttctgtgacattt

SEQ ID NO: 1211564 - DNA, 18 bp, Homo sapiens
actttttttcttctactt

SEQ ID NO: 1211565 - DNA, 13 bp, Homo sapiens
actttttttcttt

SEQ ID NO: 1211566 - DNA, 14 bp, Homo sapiens
actttttttgtaga

SEQ ID NO: 1211567 - DNA, 17 bp, Homo sapiens
actttttttgtatgtgt

SEQ ID NO: 1211568 - DNA, 15 bp, Homo sapiens
acttttttttaagtt

SEQ ID NO: 1211569 - DNA, 16 bp, Homo sapiens
acttttttttgagaat

SEQ ID NO: 1211570 - DNA, 20 bp, Homo sapiens
acttttttttttttaacatc

SEQ ID NO: 1211571 - DNA, 22 bp, Homo sapiens
acttttttttttttaacatctt

SEQ ID NO: 1211572 - DNA, 17 bp, Homo sapiens
actttttttttttttcc

SEQ ID NO: 1211573 - DNA, 16 bp, Homo sapiens
agaaaaaaaaaagaaa

SEQ ID NO: 1211574 - DNA, 15 bp, Homo sapiens
agaaaaaaaaaagat

SEQ ID NO: 1211575 - DNA, 15 bp, Homo sapiens
agaaaaaaaaagaaa

SEQ ID NO: 1211576 - DNA, 18 bp, Homo sapiens
agaaaaaaaaagaaaaaa

SEQ ID NO: 1211577 - DNA, 19 bp, Homo sapiens
agaaaaaaaaagaaaaaag

SEQ ID NO: 1211578 - DNA, 22 bp, Homo sapiens
agaaaaaaaaagtgaaaaaaag

SEQ ID NO: 1211579 - DNA, 23 bp, Homo sapiens
agaaaaaaaaagtgaaaaaaaga

SEQ ID NO: 1211580 - DNA, 12 bp, Homo sapiens
agaaaaaaaacc

SEQ ID NO: 1211581 - DNA, 19 bp, Homo sapiens
agaaaaaaaaccttgtaaa

SEQ ID NO: 1211582 - DNA, 17 bp, Homo sapiens
agaaaaaaaataacaca

SEQ ID NO: 1211583 - DNA, 19 bp, Homo sapiens
agaaaaaaaataacacaga

SEQ ID NO: 1211584 - DNA, 13 bp, Homo sapiens
agaaaaaaagaaa

SEQ ID NO: 1211585 - DNA, 16 bp, Homo sapiens
agaaaaaaagaaaaaa

SEQ ID NO: 1211586 - DNA, 21 bp, Homo sapiens
agaaaaaaagtttgccagaag

SEQ ID NO: 1211587 - DNA, 15 bp, Homo sapiens
agaaaaaaataacta

SEQ ID NO: 1211588 - DNA, 22 bp, Homo sapiens
agaaaaaaataactattttgtt

SEQ ID NO: 1211589 - DNA, 13 bp, Homo sapiens
agaaaaaaattca

SEQ ID NO: 1211590 - DNA, 11 bp, Homo sapiens
agaaaaaacaa

SEQ ID NO: 1211591 - DNA, 10 bp, Homo sapiens
agaaaaaaga

SEQ ID NO: 1211592 - DNA, 12 bp, Homo sapiens
agaaaaaagttg

SEQ ID NO: 1211593 - DNA, 17 bp, Homo sapiens
agaaaaaatattttccc

SEQ ID NO: 1211594 - DNA, 17 bp, Homo sapiens
agaaaaaatattttcct

SEQ ID NO: 1211595 - DNA, 23 bp, Homo sapiens
agaaaaaatattttcctgccagg

SEQ ID NO: 1211596 - DNA, 17 bp, Homo sapiens
agaaaaaatcactgttt

SEQ ID NO: 1211597 - DNA, 22 bp, Homo sapiens
agaaaaaattccctcatttaaa

SEQ ID NO: 1211598 - DNA, 22 bp, Homo sapiens
agaaaaacaatggtaacatttt

SEQ ID NO: 1211599 - DNA, 13 bp, Homo sapiens
agaaaaacattta

SEQ ID NO: 1211600 - DNA, 17 bp, Homo sapiens
agaaaaacatttaaact

SEQ ID NO: 1211601 - DNA, 16 bp, Homo sapiens
agaaaaactggctctg

SEQ ID NO: 1211602 - DNA, 10 bp, Homo sapiens
agaaaaagaa

SEQ ID NO: 1211603 - DNA, 13 bp, Homo sapiens
agaaaaagaaaca

SEQ ID NO: 1211604 - DNA, 12 bp, Homo sapiens
agaaaaagatat

SEQ ID NO: 1211605 - DNA, 17 bp, Homo sapiens
agaaaaaggatgcacag

SEQ ID NO: 1211606 - DNA, 14 bp, Homo sapiens
agaaaaaggcagtg

SEQ ID NO: 1211607 - DNA, 14 bp, Homo sapiens
agaaaaaggggcct

SEQ ID NO: 1211608 - DNA, 15 bp, Homo sapiens
agaaaaagtaaaaga

SEQ ID NO: 1211609 - DNA, 16 bp, Homo sapiens
agaaaaataaaatgtt

SEQ ID NO: 1211610 - DNA, 14 bp, Homo sapiens
agaaaaatactttg

SEQ ID NO: 1211611 - DNA, 11 bp, Homo sapiens
agaaaaatagg

SEQ ID NO: 1211612 - DNA, 12 bp, Homo sapiens
agaaaaatatga

SEQ ID NO: 1211613 - DNA, 18 bp, Homo sapiens
agaaaaatattcaagtaa

SEQ ID NO: 1211614 - DNA, 14 bp, Homo sapiens
agaaaaatcatgtt

SEQ ID NO: 1211615 - DNA, 21 bp, Homo sapiens
agaaaaatcatgtttgctctc

SEQ ID NO: 1211616 - DNA, 21 bp, Homo sapiens
agaaaaatcttgtgctagaat

SEQ ID NO: 1211617 - DNA, 23 bp, Homo sapiens
agaaaaatcttgtgctagaatac

SEQ ID NO: 1211618 - DNA, 22 bp, Homo sapiens
agaaaaatgaaaacttttgtaa

SEQ ID NO: 1211619 - DNA, 21 bp, Homo sapiens
agaaaaatgagcatacatctt

SEQ ID NO: 1211620 - DNA, 17 bp, Homo sapiens
agaaaaatgcctgtctc

SEQ ID NO: 1211621 - DNA, 13 bp, Homo sapiens
agaaaaatgttct

SEQ ID NO: 1211622 - DNA, 14 bp, Homo sapiens
agaaaaattcacaa

SEQ ID NO: 1211623 - DNA, 16 bp, Homo sapiens
agaaaaatttcacgat

SEQ ID NO: 1211624 - DNA, 21 bp, Homo sapiens
agaaaacaaaaaacgaatgaa

SEQ ID NO: 1211625 - DNA, 23 bp, Homo sapiens
agaaaacaaaggagcattaagcc

SEQ ID NO: 1211626 - DNA, 21 bp, Homo sapiens
agaaaacaacttggcatttct

SEQ ID NO: 1211627 - DNA, 22 bp, Homo sapiens
agaaaacaacttggcatttcta

SEQ ID NO: 1211628 - DNA, 15 bp, Homo sapiens
agaaaacaagtatat

SEQ ID NO: 1211629 - DNA, 22 bp, Homo sapiens
agaaaacaggaaaaaaactttt

SEQ ID NO: 1211630 - DNA, 23 bp, Homo sapiens
agaaaacaggaaaaaaactttta

SEQ ID NO: 1211631 - DNA, 23 bp, Homo sapiens
agaaaacataatcttctgccttc

SEQ ID NO: 1211632 - DNA, 20 bp, Homo sapiens
agaaaacatgtataaatata

SEQ ID NO: 1211633 - DNA, 13 bp, Homo sapiens
agaaaacatttaa

SEQ ID NO: 1211634 - DNA, 16 bp, Homo sapiens
agaaaacatttaacat

SEQ ID NO: 1211635 - DNA, 13 bp, Homo sapiens
agaaaacccgagg

SEQ ID NO: 1211636 - DNA, 17 bp, Homo sapiens
agaaaaccgagaatatt

SEQ ID NO: 1211637 - DNA, 21 bp, Homo sapiens
agaaaacggagagtgcttggg

SEQ ID NO: 1211638 - DNA, 15 bp, Homo sapiens
agggatggagaaaga

SEQ ID NO: 1211639 - DNA, 17 bp, Homo sapiens
agggatggagaaagaag

SEQ ID NO: 1211640 - DNA, 18 bp, Homo sapiens
agggatggagaggcggcc

SEQ ID NO: 1211641 - DNA, 19 bp, Homo sapiens
agggatggagatgggaagg

SEQ ID NO: 1211642 - DNA, 16 bp, Homo sapiens
agggatgggcctggca

SEQ ID NO: 1211643 - DNA, 12 bp, Homo sapiens
agggatggggga

SEQ ID NO: 1211644 - DNA, 20 bp, Homo sapiens
agggatgggggatgggccag

SEQ ID NO: 1211645 - DNA, 13 bp, Homo sapiens
agggatggtgccc

SEQ ID NO: 1211646 - DNA, 14 bp, Homo sapiens
agggattcaggctg

SEQ ID NO: 1211647 - DNA, 19 bp, Homo sapiens
agggattcaggctgcttgg

SEQ ID NO: 1211648 - DNA, 22 bp, Homo sapiens
agggccagtcctgcctggccag

SEQ ID NO: 1211649 - DNA, 15 bp, Homo sapiens
agggccagtggggcc

SEQ ID NO: 1211650 - DNA, 19 bp, Homo sapiens
agggccagtggggcctgtg

SEQ ID NO: 1211651 - DNA, 22 bp, Homo sapiens
agggccatacttttgagagggg

SEQ ID NO: 1211652 - DNA, 19 bp, Homo sapiens
agggccatgctgaagggac

SEQ ID NO: 1211653 - DNA, 19 bp, Homo sapiens
agggcccaccttggaccct

SEQ ID NO: 1211654 - DNA, 12 bp, Homo sapiens
agggcccagagc

SEQ ID NO: 1211655 - DNA, 15 bp, Homo sapiens
agggcccagagcagg

SEQ ID NO: 1211656 - DNA, 17 bp, Homo sapiens
agggcccagagcaggaa

SEQ ID NO: 1211657 - DNA, 18 bp, Homo sapiens
agggcccagccaggagca

SEQ ID NO: 1211658 - DNA, 14 bp, Homo sapiens
agggcccagcccag

SEQ ID NO: 1211659 - DNA, 19 bp, Homo sapiens
agggcccagctgtagccat

SEQ ID NO: 1211660 - DNA, 14 bp, Homo sapiens
agggcccaggcagg

SEQ ID NO: 1211661 - DNA, 18 bp, Homo sapiens
agggcccaggcctggagc

SEQ ID NO: 1211662 - DNA, 16 bp, Homo sapiens
agggcccatcaggcag

SEQ ID NO: 1211663 - DNA, 18 bp, Homo sapiens
agggccccagaaggcagg

SEQ ID NO: 1211664 - DNA, 14 bp, Homo sapiens
agggccccagcact

SEQ ID NO: 1211665 - DNA, 18 bp, Homo sapiens
agggccccaggggcagca

SEQ ID NO: 1211666 - DNA, 13 bp, Homo sapiens
agggcccccctcc

SEQ ID NO: 1211667 - DNA, 21 bp, Homo sapiens
agggcccccctccccccactt

SEQ ID NO: 1211668 - DNA, 13 bp, Homo sapiens
agggcccctccct

SEQ ID NO: 1211669 - DNA, 15 bp, Homo sapiens
agggctggggacaga

SEQ ID NO: 1211670 - DNA, 16 bp, Homo sapiens
agggctggggactggg

SEQ ID NO: 1211671 - DNA, 13 bp, Homo sapiens
agggctggggcgg

SEQ ID NO: 1211672 - DNA, 15 bp, Homo sapiens
agggctggggcggag

SEQ ID NO: 1211673 - DNA, 17 bp, Homo sapiens
agggctggggtgagcct

SEQ ID NO: 1211674 - DNA, 17 bp, Homo sapiens
agggctggtccttattt

SEQ ID NO: 1211675 - DNA, 19 bp, Homo sapiens
agggctggtccttatttat

SEQ ID NO: 1211676 - DNA, 14 bp, Homo sapiens
agggctggtcttgg

SEQ ID NO: 1211677 - DNA, 18 bp, Homo sapiens
agggctgtcatctgtgca

SEQ ID NO: 1211678 - DNA, 20 bp, Homo sapiens
agggctgtcatctgtgcact

SEQ ID NO: 1211679 - DNA, 14 bp, Homo sapiens
agggctgtcccagc

SEQ ID NO: 1211680 - DNA, 21 bp, Homo sapiens
agggctgtgcttgaaggccct

SEQ ID NO: 1211681 - DNA, 21 bp, Homo sapiens
agggctgtgtgggtaaatgct

SEQ ID NO: 1211682 - DNA, 12 bp, Homo sapiens
agggctgttgct

SEQ ID NO: 1211683 - DNA, 19 bp, Homo sapiens
agggctgttgctagggaga

SEQ ID NO: 1211684 - DNA, 21 bp, Homo sapiens
agggctgttgctagggagagg

SEQ ID NO: 1211685 - DNA, 20 bp, Homo sapiens
agggctgttggacagctgct

SEQ ID NO: 1211686 - DNA, 15 bp, Homo sapiens
agggcttactatttc

SEQ ID NO: 1211687 - DNA, 20 bp, Homo sapiens
agggcttccccatcagctcc

SEQ ID NO: 1211688 - DNA, 22 bp, Homo sapiens
agggcttcctctagaagccaag

SEQ ID NO: 1211689 - DNA, 19 bp, Homo sapiens
agggcttcggccacaggca

SEQ ID NO: 1211690 - DNA, 13 bp, Homo sapiens
agggcttctgcac

SEQ ID NO: 1211691 - DNA, 17 bp, Homo sapiens
agggcttctgcaccctc

SEQ ID NO: 1211692 - DNA, 21 bp, Homo sapiens
agggcttggcccagcgccaag

SEQ ID NO: 1211693 - DNA, 13 bp, Homo sapiens
agggcttggggct

SEQ ID NO: 1211694 - DNA, 16 bp, Homo sapiens
agggcttggggctgca

SEQ ID NO: 1211695 - DNA, 22 bp, Homo sapiens
agggcttggggctgcacctcct

SEQ ID NO: 1211696 - DNA, 22 bp, Homo sapiens
agggctttgagggtggaaggat

SEQ ID NO: 1211697 - DNA, 19 bp, Homo sapiens
agggctttggttccttctc

SEQ ID NO: 1211698 - DNA, 15 bp, Homo sapiens
aggggaaaaaaatgt

SEQ ID NO: 1211699 - DNA, 17 bp, Homo sapiens
aggggaaaaaaatgttg

SEQ ID NO: 1211700 - DNA, 18 bp, Homo sapiens
aggggaaaatcagcctgc

SEQ ID NO: 1211701 - DNA, 21 bp, Homo sapiens
aggggaaagaaagggaaaagg

SEQ ID NO: 1211702 - DNA, 14 bp, Homo sapiens
aggggaagaattta

SEQ ID NO: 1211703 - DNA, 23 bp, Homo sapiens
aggggaagagacaaagtgggtgt

SEQ ID NO: 1211704 - DNA, 16 bp, Homo sapiens
aggggaagagatgttt

SEQ ID NO: 1211705 - DNA, 17 bp, Homo sapiens
aggggaagccagtgaca

SEQ ID NO: 1211706 - DNA, 22 bp, Homo sapiens
aggggaagctgccacccctctt

SEQ ID NO: 1211707 - DNA, 16 bp, Homo sapiens
aggggaagctgggccc

SEQ ID NO: 1211708 - DNA, 12 bp, Homo sapiens
aggggaaggaag

SEQ ID NO: 1211709 - DNA, 12 bp, Homo sapiens
aggggaaggccc

SEQ ID NO: 1211710 - DNA, 16 bp, Homo sapiens
aggggaaggccctgag

SEQ ID NO: 1211711 - DNA, 16 bp, Homo sapiens
aggggaaggggccggg

SEQ ID NO: 1211712 - DNA, 19 bp, Homo sapiens
aggggaaggggccggggag

SEQ ID NO: 1211713 - DNA, 13 bp, Homo sapiens
aggggaagggggt

SEQ ID NO: 1211714 - DNA, 22 bp, Homo sapiens
aggggaagggggtgcaaagact

SEQ ID NO: 1211715 - DNA, 16 bp, Homo sapiens
aggggaattttctctc

SEQ ID NO: 1211716 - DNA, 23 bp, Homo sapiens
aggggacaagggaggcagtggct

SEQ ID NO: 1211717 - DNA, 22 bp, Homo sapiens
aggggacaagggatttgaggtg

SEQ ID NO: 1211718 - DNA, 15 bp, Homo sapiens
aggggacagagctga

SEQ ID NO: 1211719 - DNA, 14 bp, Homo sapiens
aggggacaggcctc

SEQ ID NO: 1211720 - DNA, 17 bp, Homo sapiens
aggggacaggcctcacc

SEQ ID NO: 1211721 - DNA, 21 bp, Homo sapiens
aggggaccaattctggacaga

SEQ ID NO: 1211722 - DNA, 15 bp, Homo sapiens
aggggacccagctcc

SEQ ID NO: 1211723 - DNA, 19 bp, Homo sapiens
aggggacccagctcctctg

SEQ ID NO: 1211724 - DNA, 16 bp, Homo sapiens
aggggacccatggggg

SEQ ID NO: 1211725 - DNA, 17 bp, Homo sapiens
aggggacccatgggggc

SEQ ID NO: 1211726 - DNA, 16 bp, Homo sapiens
aggggaccccactccc

SEQ ID NO: 1211727 - DNA, 21 bp, Homo sapiens
aggggacgggcaagtgagagg

SEQ ID NO: 1211728 - DNA, 16 bp, Homo sapiens
aggggacgtgggccct

SEQ ID NO: 1211729 - DNA, 17 bp, Homo sapiens
aggggacgtgggccctg

SEQ ID NO: 1211730 - DNA, 19 bp, Homo sapiens
aggggactatttatgaagg

SEQ ID NO: 1211731 - DNA, 22 bp, Homo sapiens
aggggactcagccctgaggtga

SEQ ID NO: 1211732 - DNA, 15 bp, Homo sapiens
aggggagaaaattaa

SEQ ID NO: 1211733 - DNA, 15 bp, Homo sapiens
aggggagaaactgaa

SEQ ID NO: 1211734 - DNA, 16 bp, Homo sapiens
aggggagaagctgaag

SEQ ID NO: 1211735 - DNA, 17 bp, Homo sapiens
aggggagaagctgaagc

SEQ ID NO: 1211736 - DNA, 15 bp, Homo sapiens
aggggagacaggagc

SEQ ID NO: 1211737 - DNA, 14 bp, Homo sapiens
aggggagagacagg

SEQ ID NO: 1211738 - DNA, 15 bp, Homo sapiens
aggggagagcctgct

SEQ ID NO: 1211739 - DNA, 10 bp, Homo sapiens
aggggagagg

SEQ ID NO: 1211740 - DNA, 17 bp, Homo sapiens
aggggagcacaaggcct

SEQ ID NO: 1211741 - DNA, 20 bp, Homo sapiens
aggggagcagcggctctggt

SEQ ID NO: 1211742 - DNA, 22 bp, Homo sapiens
aggggagcagcggctctggtcc

SEQ ID NO: 1211743 - DNA, 20 bp, Homo sapiens
aggggagccagaaatgggca

SEQ ID NO: 1211744 - DNA, 21 bp, Homo sapiens
aggggagccagaaatgggcag

SEQ ID NO: 1211745 - DNA, 14 bp, Homo sapiens
aggggagccagctg

SEQ ID NO: 1211746 - DNA, 16 bp, Homo sapiens
aggggagccagggtag

SEQ ID NO: 1211747 - DNA, 19 bp, Homo sapiens
aggggagcttgggactcag

SEQ ID NO: 1211748 - DNA, 11 bp, Homo sapiens
aggggaggagg

SEQ ID NO: 1211749 - DNA, 12 bp, Homo sapiens
aggggaggaggg

SEQ ID NO: 1211750 - DNA, 13 bp, Homo sapiens
aggggagggcagg

SEQ ID NO: 1211751 - DNA, 14 bp, Homo sapiens
aggggagggcaggc

SEQ ID NO: 1211752 - DNA, 17 bp, Homo sapiens
aggggagggctcctggg

SEQ ID NO: 1211753 - DNA, 21 bp, Homo sapiens
aggggagggctcctggggcag

SEQ ID NO: 1211754 - DNA, 16 bp, Homo sapiens
aggggaggggcctagg

SEQ ID NO: 1211755 - DNA, 21 bp, Homo sapiens
aggggaggggcctagggagcc

SEQ ID NO: 1211756 - DNA, 16 bp, Homo sapiens
aggggaggggcctccc

SEQ ID NO: 1211757 - DNA, 18 bp, Homo sapiens
aggggagggggatccgac

SEQ ID NO: 1211758 - DNA, 16 bp, Homo sapiens
aggggagtcaccttcc

SEQ ID NO: 1211759 - DNA, 17 bp, Homo sapiens
aggggatataggagagg

SEQ ID NO: 1211760 - DNA, 21 bp, Homo sapiens
aggggatatttaaggtagctt

SEQ ID NO: 1211761 - DNA, 16 bp, Homo sapiens
aggggatatttactgc

SEQ ID NO: 1211762 - DNA, 20 bp, Homo sapiens
aggggatatttactgctctt

SEQ ID NO: 1211763 - DNA, 19 bp, Homo sapiens
aggggatgaggggcttcct

SEQ ID NO: 1211764 - DNA, 17 bp, Homo sapiens
aggggatgcccagaaga

SEQ ID NO: 1211765 - DNA, 19 bp, Homo sapiens
aggggatggacacccccag

SEQ ID NO: 1211766 - DNA, 18 bp, Homo sapiens
aggggatggaggccagag

SEQ ID NO: 1211767 - DNA, 20 bp, Homo sapiens
aggggatggaggccagagtc

SEQ ID NO: 1211768 - DNA, 21 bp, Homo sapiens
aggggatggaggccagagtct

SEQ ID NO: 1211769 - DNA, 21 bp, Homo sapiens
aggggatgtttacctggtgct

SEQ ID NO: 1211770 - DNA, 18 bp, Homo sapiens
aggggattaatatgaaaa

SEQ ID NO: 1211771 - DNA, 19 bp, Homo sapiens
aggggcaaccaactgcccc

SEQ ID NO: 1211772 - DNA, 23 bp, Homo sapiens
aggggcaagctcttgccccactc

SEQ ID NO: 1211773 - DNA, 15 bp, Homo sapiens
aggggcacaccactg

SEQ ID NO: 1211774 - DNA, 18 bp, Homo sapiens
aggggcacctccggctgc

SEQ ID NO: 1211775 - DNA, 22 bp, Homo sapiens
aggggcacctccggctgcctag

SEQ ID NO: 1211776 - DNA, 16 bp, Homo sapiens
aggggcactctcccct

SEQ ID NO: 1211777 - DNA, 17 bp, Homo sapiens
aggggcagaaaaactct

SEQ ID NO: 1211778 - DNA, 17 bp, Homo sapiens
aggggcagagaggaagt

SEQ ID NO: 1211779 - DNA, 22 bp, Homo sapiens
aggggcagagaggaagtggtct

SEQ ID NO: 1211780 - DNA, 13 bp, Homo sapiens
aggggcagagcca

SEQ ID NO: 1211781 - DNA, 13 bp, Homo sapiens
aggggcagcaagg

SEQ ID NO: 1211782 - DNA, 14 bp, Homo sapiens
aggggcagcaggag

SEQ ID NO: 1211783 - DNA, 12 bp, Homo sapiens
aggggcagccct

SEQ ID NO: 1211784 - DNA, 14 bp, Homo sapiens
aggggcagccctga

SEQ ID NO: 1211785 - DNA, 17 bp, Homo sapiens
aggggcagccctgagtg

SEQ ID NO: 1211786 - DNA, 18 bp, Homo sapiens
aggggcaggcagggctgc

SEQ ID NO: 1211787 - DNA, 13 bp, Homo sapiens
aggggcaggcctg

SEQ ID NO: 1211788 - DNA, 18 bp, Homo sapiens
aggggcaggcctgggacc

SEQ ID NO: 1211789 - DNA, 12 bp, Homo sapiens
aggggcaggcgc

SEQ ID NO: 1211790 - DNA, 22 bp, Homo sapiens
aggggcaggcgcagaggtccca

SEQ ID NO: 1211791 - DNA, 12 bp, Homo sapiens
aggggcagggag

SEQ ID NO: 1211792 - DNA, 14 bp, Homo sapiens
aggggcagggagag

SEQ ID NO: 1211793 - DNA, 16 bp, Homo sapiens
aggggcagggagagcg

SEQ ID NO: 1211794 - DNA, 15 bp, Homo sapiens
aggggcatctgcccc

SEQ ID NO: 1211795 - DNA, 22 bp, Homo sapiens
aggggcatctgcccctccccca

SEQ ID NO: 1211796 - DNA, 21 bp, Homo sapiens
aggggcatgtattggcctgga

SEQ ID NO: 1211797 - DNA, 23 bp, Homo sapiens
aggggcatgtattggcctggagg

SEQ ID NO: 1211798 - DNA, 23 bp, Homo sapiens
aggggcatttcacagtgcccaag

SEQ ID NO: 1211799 - DNA, 11 bp, Homo sapiens
aggggccacct

SEQ ID NO: 1211800 - DNA, 13 bp, Homo sapiens
aggggccacctcc

SEQ ID NO: 1211801 - DNA, 18 bp, Homo sapiens
aggggccacctcctcccc

SEQ ID NO: 1211802 - DNA, 21 bp, Homo sapiens
aggggccacgtggatgggcaa

SEQ ID NO: 1211803 - DNA, 16 bp, Homo sapiens
aggggccagagagcag

SEQ ID NO: 1211804 - DNA, 22 bp, Homo sapiens
aggggccagagagcaggggagc

SEQ ID NO: 1211805 - DNA, 13 bp, Homo sapiens
aggggccagaggc

SEQ ID NO: 1211806 - DNA, 16 bp, Homo sapiens
aggggccaggggtggg

SEQ ID NO: 1211807 - DNA, 17 bp, Homo sapiens
aggggccagtgagggct

SEQ ID NO: 1211808 - DNA, 19 bp, Homo sapiens
aggggccagtgagggctgg

SEQ ID NO: 1211809 - DNA, 15 bp, Homo sapiens
aggggccatgcccca

SEQ ID NO: 1211810 - DNA, 19 bp, Homo sapiens
aggggcccaagccccatct

SEQ ID NO: 1211811 - DNA, 19 bp, Homo sapiens
aggggcccacagggaaccc

SEQ ID NO: 1211812 - DNA, 20 bp, Homo sapiens
aggggccccagatctgcctg

SEQ ID NO: 1211813 - DNA, 17 bp, Homo sapiens
aggggccccggggctgg

SEQ ID NO: 1211814 - DNA, 17 bp, Homo sapiens
aggggccctcaggccat

SEQ ID NO: 1211815 - DNA, 21 bp, Homo sapiens
aggggccctcaggccattccc

SEQ ID NO: 1211816 - DNA, 19 bp, Homo sapiens
aggggccctccatgcgcag

SEQ ID NO: 1211817 - DNA, 17 bp, Homo sapiens
aggggcccttgggacag

SEQ ID NO: 1211818 - DNA, 21 bp, Homo sapiens
aggggcccttgggacagccag

SEQ ID NO: 1211819 - DNA, 16 bp, Homo sapiens
aggggccgctgccacc

SEQ ID NO: 1211820 - DNA, 16 bp, Homo sapiens
aggggccggctggcct

SEQ ID NO: 1211821 - DNA, 20 bp, Homo sapiens
aggggccggctggcctggag

SEQ ID NO: 1211822 - DNA, 15 bp, Homo sapiens
aggggcctagggagc

SEQ ID NO: 1211823 - DNA, 16 bp, Homo sapiens
aggggcctagggagcc

SEQ ID NO: 1211824 - DNA, 15 bp, Homo sapiens
aggggcctctctcct

SEQ ID NO: 1211825 - DNA, 19 bp, Homo sapiens
aggggcctctctcctgcct

SEQ ID NO: 1211826 - DNA, 23 bp, Homo sapiens
aggggcctctctcctgcctgccc

SEQ ID NO: 1211827 - DNA, 19 bp, Homo sapiens
aggggcctgcgcccagagc

SEQ ID NO: 1211828 - DNA, 21 bp, Homo sapiens
aggggcctgcgcccagagctg

SEQ ID NO: 1211829 - DNA, 22 bp, Homo sapiens
aggggcctgcgcccagagctgg

SEQ ID NO: 1211830 - DNA, 12 bp, Homo sapiens
aggggcctggag

SEQ ID NO: 1211831 - DNA, 21 bp, Homo sapiens
aggggcctggagatcctcctg

SEQ ID NO: 1211832 - DNA, 18 bp, Homo sapiens
aggggcctggcagccgtg

SEQ ID NO: 1211833 - DNA, 23 bp, Homo sapiens
aggggcctggcagccgtgccttc

SEQ ID NO: 1211834 - DNA, 20 bp, Homo sapiens
aggggcctgggcagccccac

SEQ ID NO: 1211835 - DNA, 13 bp, Homo sapiens
aggggcctgggcc

SEQ ID NO: 1211836 - DNA, 14 bp, Homo sapiens
aggggcctgggccg

SEQ ID NO: 1211837 - DNA, 23 bp, Homo sapiens
aggggcctgggccggcgaggggg

SEQ ID NO: 1211838 - DNA, 17 bp, Homo sapiens
aggggccttagggcact

SEQ ID NO: 1211839 - DNA, 19 bp, Homo sapiens
aggggccttagggcactgg

SEQ ID NO: 1211840 - DNA, 21 bp, Homo sapiens
aggggccttgctctgagcaca

SEQ ID NO: 1211841 - DNA, 23 bp, Homo sapiens
aggggcgccgcaaaccacactgg

SEQ ID NO: 1211842 - DNA, 20 bp, Homo sapiens
aggggcgccttttcagccct

SEQ ID NO: 1211843 - DNA, 17 bp, Homo sapiens
aggggcgctggcccagc

SEQ ID NO: 1211844 - DNA, 20 bp, Homo sapiens
aggggcgctggcccagccgg

SEQ ID NO: 1211845 - DNA, 13 bp, Homo sapiens
aggggcgctgtcc

SEQ ID NO: 1211846 - DNA, 14 bp, Homo sapiens
aggggcggcaggag

SEQ ID NO: 1211847 - DNA, 17 bp, Homo sapiens
aggggcgggctcagagc

SEQ ID NO: 1211848 - DNA, 14 bp, Homo sapiens
aggggcggggcagg

SEQ ID NO: 1211849 - DNA, 20 bp, Homo sapiens
aggggcgtgggagtggcctg

SEQ ID NO: 1211850 - DNA, 14 bp, Homo sapiens
aggggctcctggaa

SEQ ID NO: 1211851 - DNA, 23 bp, Homo sapiens
aggggctcctggaaaggctcagt

SEQ ID NO: 1211852 - DNA, 13 bp, Homo sapiens
aggggctcctggg

SEQ ID NO: 1211853 - DNA, 15 bp, Homo sapiens
aggggctcctgggtt

SEQ ID NO: 1211854 - DNA, 20 bp, Homo sapiens
aggggctgcgctagcagccc

SEQ ID NO: 1211855 - DNA, 15 bp, Homo sapiens
aggggctgctgcctt

SEQ ID NO: 1211856 - DNA, 16 bp, Homo sapiens
aggggctgcttcctcc

SEQ ID NO: 1211857 - DNA, 20 bp, Homo sapiens
aggggctgcttcctcctgga

SEQ ID NO: 1211858 - DNA, 23 bp, Homo sapiens
aggggctggccttcctgccctac

SEQ ID NO: 1211859 - DNA, 13 bp, Homo sapiens
aggggctgggctg

SEQ ID NO: 1211860 - DNA, 14 bp, Homo sapiens
aggggctgggctgg

SEQ ID NO: 1211861 - DNA, 18 bp, Homo sapiens
aggggctgggctgggctg

SEQ ID NO: 1211862 - DNA, 18 bp, Homo sapiens
aggggctggggcaggctc

SEQ ID NO: 1211863 - DNA, 19 bp, Homo sapiens
aggggctgtggccgtctcc

SEQ ID NO: 1211864 - DNA, 14 bp, Homo sapiens
aggggcttgagaag

SEQ ID NO: 1211865 - DNA, 15 bp, Homo sapiens
aggggctttctcttc

SEQ ID NO: 1211866 - DNA, 21 bp, Homo sapiens
aggggctttctcttccccttc

SEQ ID NO: 1211867 - DNA, 22 bp, Homo sapiens
aggggctttctcttccccttcc

SEQ ID NO: 1211868 - DNA, 14 bp, Homo sapiens
aggggctttctgga

SEQ ID NO: 1211869 - DNA, 20 bp, Homo sapiens
aggggctttctggagaggag

SEQ ID NO: 1211870 - DNA, 22 bp, Homo sapiens
aggggcttttcccaccttcacc

SEQ ID NO: 1211871 - DNA, 15 bp, Homo sapiens
agggggaagaagcag

SEQ ID NO: 1211872 - DNA, 15 bp, Homo sapiens
agggggaagagaaat

SEQ ID NO: 1211873 - DNA, 23 bp, Homo sapiens
agggggaagcaaaggggggaggt

SEQ ID NO: 1211874 - DNA, 23 bp, Homo sapiens
agggggacctgccaccagggagc

SEQ ID NO: 1211875 - DNA, 21 bp, Homo sapiens
agggggactgctgctgcctgg

SEQ ID NO: 1211876 - DNA, 20 bp, Homo sapiens
agggggagggggttacaaac

SEQ ID NO: 1211877 - DNA, 18 bp, Homo sapiens
agggggagtagccaagct

SEQ ID NO: 1211878 - DNA, 20 bp, Homo sapiens
agggggatatgggtcctctg

SEQ ID NO: 1211879 - DNA, 19 bp, Homo sapiens
agggggatccgactgcttt

SEQ ID NO: 1211880 - DNA, 17 bp, Homo sapiens
agggggattggagggaa

SEQ ID NO: 1211881 - DNA, 11 bp, Homo sapiens
agggggccagc

SEQ ID NO: 1211882 - DNA, 14 bp, Homo sapiens
agggggccagctgg

SEQ ID NO: 1211883 - DNA, 15 bp, Homo sapiens
agggggccagctggg

SEQ ID NO: 1211884 - DNA, 19 bp, Homo sapiens
agggggccccgccagggct

SEQ ID NO: 1211885 - DNA, 15 bp, Homo sapiens
agggggccctgcccc

SEQ ID NO: 1211886 - DNA, 21 bp, Homo sapiens
agggggccctgccccacccca

SEQ ID NO: 1211887 - DNA, 20 bp, Homo sapiens
agggggccttgcggaagcca

SEQ ID NO: 1211888 - DNA, 23 bp, Homo sapiens
agggggccttgcggaagccatag

SEQ ID NO: 1211889 - DNA, 19 bp, Homo sapiens
agggggcgctcaggaccca

SEQ ID NO: 1211890 - DNA, 16 bp, Homo sapiens
agggggcggcagggct

SEQ ID NO: 1211891 - DNA, 20 bp, Homo sapiens
agggggcggggactgctggc

SEQ ID NO: 1211892 - DNA, 11 bp, Homo sapiens
agggggctctc

SEQ ID NO: 1211893 - DNA, 21 bp, Homo sapiens
agggggctctgccccaggccc

SEQ ID NO: 1211894 - DNA, 16 bp, Homo sapiens
agggggcttgaagcca

SEQ ID NO: 1211895 - DNA, 13 bp, Homo sapiens
aggggggagctgg

SEQ ID NO: 1211896 - DNA, 13 bp, Homo sapiens
aggggggagggtc

SEQ ID NO: 1211897 - DNA, 13 bp, Homo sapiens
aggggggctgtgc

SEQ ID NO: 1211898 - DNA, 14 bp, Homo sapiens
aggggggctgtgcc

SEQ ID NO: 1211899 - DNA, 24 bp, Homo sapiens
aggggggtcggaagcctgtcctca

SEQ ID NO: 1211900 - DNA, 20 bp, Homo sapiens
aggggggttgcagtggagag

SEQ ID NO: 1211901 - DNA, 16 bp, Homo sapiens
agggggtacctcatga

SEQ ID NO: 1211902 - DNA, 12 bp, Homo sapiens
agggggtaggag

SEQ ID NO: 1211903 - DNA, 15 bp, Homo sapiens
agggggtaggagagc

SEQ ID NO: 1211904 - DNA, 20 bp, Homo sapiens
agggggtgcaaagactctga

SEQ ID NO: 1211905 - DNA, 21 bp, Homo sapiens
agggggtgcaaagactctgag

SEQ ID NO: 1211906 - DNA, 20 bp, Homo sapiens
agggggtgggaaggggatgg

SEQ ID NO: 1211907 - DNA, 22 bp, Homo sapiens
agggggtgtcagaagctgggaa

SEQ ID NO: 1211908 - DNA, 19 bp, Homo sapiens
agggggtgtcatctgagga

SEQ ID NO: 1211909 - DNA, 19 bp, Homo sapiens
agggggtgtgcgtgcgtgt

SEQ ID NO: 1211910 - DNA, 12 bp, Homo sapiens
agggggttacaa

SEQ ID NO: 1211911 - DNA, 19 bp, Homo sapiens
agggggttacaaactgcaa

SEQ ID NO: 1211912 - DNA, 20 bp, Homo sapiens
agggggttacaaactgcaat

SEQ ID NO: 1211913 - DNA, 23 bp, Homo sapiens
agggggttcacggtcaaactgaa

SEQ ID NO: 1211914 - DNA, 21 bp, Homo sapiens
agggggttcttattttgcatt

SEQ ID NO: 1211915 - DNA, 16 bp, Homo sapiens
aggggtaacctggcca

SEQ ID NO: 1211916 - DNA, 17 bp, Homo sapiens
aggggtagctggtggtt

SEQ ID NO: 1211917 - DNA, 19 bp, Homo sapiens
aggggtaggcagagccttt

SEQ ID NO: 1211918 - DNA, 22 bp, Homo sapiens
aggggtatgttccctcttgtcc

SEQ ID NO: 1211919 - DNA, 23 bp, Homo sapiens
aggggtatgttccctcttgtccc

SEQ ID NO: 1211920 - DNA, 13 bp, Homo sapiens
aggggtcaggctc

SEQ ID NO: 1211921 - DNA, 14 bp, Homo sapiens
aggggtcaggtgtc

SEQ ID NO: 1211922 - DNA, 13 bp, Homo sapiens
aggggtcctgcag

SEQ ID NO: 1211923 - DNA, 15 bp, Homo sapiens
aggggtcctgcaggg

SEQ ID NO: 1211924 - DNA, 17 bp, Homo sapiens
aggggtctccctggagt

SEQ ID NO: 1211925 - DNA, 19 bp, Homo sapiens
aggggtctccctggagtgc

SEQ ID NO: 1211926 - DNA, 18 bp, Homo sapiens
aggggtctccctggctcc

SEQ ID NO: 1211927 - DNA, 19 bp, Homo sapiens
aggggtctgttctgcagtg

SEQ ID NO: 1211928 - DNA, 22 bp, Homo sapiens
aggggtgatttcagagagggca

SEQ ID NO: 1211929 - DNA, 22 bp, Homo sapiens
aggggtgcacccactcaccagg

SEQ ID NO: 1211930 - DNA, 13 bp, Homo sapiens
aggggtgccccct

SEQ ID NO: 1211931 - DNA, 17 bp, Homo sapiens
aggggtgccccctcctc

SEQ ID NO: 1211932 - DNA, 20 bp, Homo sapiens
aggggtgccccctcctctcc

SEQ ID NO: 1211933 - DNA, 21 bp, Homo sapiens
aggggtgccccctcctctccc

SEQ ID NO: 1211934 - DNA, 22 bp, Homo sapiens
aggggtgcggcggtcccagctc

SEQ ID NO: 1211935 - DNA, 14 bp, Homo sapiens
aggggtggagaagt

SEQ ID NO: 1211936 - DNA, 13 bp, Homo sapiens
aggggtgggctgg

SEQ ID NO: 1211937 - DNA, 18 bp, Homo sapiens
aggggtggggagatgctt

SEQ ID NO: 1211938 - DNA, 21 bp, Homo sapiens
aggggtgggttcctcttcccc

SEQ ID NO: 1211939 - DNA, 18 bp, Homo sapiens
aggggtggtcctgactca

SEQ ID NO: 1211940 - DNA, 19 bp, Homo sapiens
aggggtgtccgagaggctg

SEQ ID NO: 1211941 - DNA, 22 bp, Homo sapiens
aggggtgtcttgggcagagctg

SEQ ID NO: 1211942 - DNA, 18 bp, Homo sapiens
aggggtgtggcagtggtt

SEQ ID NO: 1211943 - DNA, 18 bp, Homo sapiens
aggggttcccttgagggc

SEQ ID NO: 1211944 - DNA, 20 bp, Homo sapiens
aggggttcccttgagggctg

SEQ ID NO: 1211945 - DNA, 20 bp, Homo sapiens
aggggttcctcaaatttttt

SEQ ID NO: 1211946 - DNA, 20 bp, Homo sapiens
aggggttctatttattcctg

SEQ ID NO: 1211947 - DNA, 18 bp, Homo sapiens
aggggttggggtgacagt

SEQ ID NO: 1211948 - DNA, 11 bp, Homo sapiens
agggtaaatca

SEQ ID NO: 1211949 - DNA, 21 bp, Homo sapiens
agggtaactggggggccacca

SEQ ID NO: 1211950 - DNA, 23 bp, Homo sapiens
agggtaagaagtttgtgtctttg

SEQ ID NO: 1211951 - DNA, 12 bp, Homo sapiens
agggtaagtatt

SEQ ID NO: 1211952 - DNA, 21 bp, Homo sapiens
agggtaatttcctttgcttca

SEQ ID NO: 1211953 - DNA, 21 bp, Homo sapiens
agggtaccctttggggagcag

SEQ ID NO: 1211954 - DNA, 20 bp, Homo sapiens
agggtaggagggtgggaagg

SEQ ID NO: 1211955 - DNA, 21 bp, Homo sapiens
agggtaggaggtttggatggg

SEQ ID NO: 1211956 - DNA, 14 bp, Homo sapiens
agggtaggatgttg

SEQ ID NO: 1211957 - DNA, 19 bp, Homo sapiens
agggtagggataatttatt

SEQ ID NO: 1211958 - DNA, 16 bp, Homo sapiens
agggtataagttgctg

SEQ ID NO: 1211959 - DNA, 22 bp, Homo sapiens
agggtataagttgctgtaaaat

SEQ ID NO: 1211960 - DNA, 21 bp, Homo sapiens
agggtatattttcctatatta

SEQ ID NO: 1211961 - DNA, 22 bp, Homo sapiens
agggtatgaagagctgtcttcc

SEQ ID NO: 1211962 - DNA, 21 bp, Homo sapiens
agggtatggactatctgtctg

SEQ ID NO: 1211963 - DNA, 17 bp, Homo sapiens
agggtatgggaagccat

SEQ ID NO: 1211964 - DNA, 22 bp, Homo sapiens
agggtattaagaattaagagga

SEQ ID NO: 1211965 - DNA, 13 bp, Homo sapiens
agggtattccaga

SEQ ID NO: 1211966 - DNA, 14 bp, Homo sapiens
agggtatttgaccc

SEQ ID NO: 1211967 - DNA, 15 bp, Homo sapiens
agggtcaagcctctt

SEQ ID NO: 1211968 - DNA, 15 bp, Homo sapiens
agggtcaccctggcc

SEQ ID NO: 1211969 - DNA, 17 bp, Homo sapiens
agggtcaccctggcctg

SEQ ID NO: 1211970 - DNA, 21 bp, Homo sapiens
agggtcagacgcctgaggaac

SEQ ID NO: 1211971 - DNA, 14 bp, Homo sapiens
agggtcaggagagg

SEQ ID NO: 1211972 - DNA, 18 bp, Homo sapiens
agggtccaatcctaggac

SEQ ID NO: 1211973 - DNA, 22 bp, Homo sapiens
agggtccaggagagcctggggg

SEQ ID NO: 1211974 - DNA, 14 bp, Homo sapiens
agggtcccaggaag

SEQ ID NO: 1211975 - DNA, 15 bp, Homo sapiens
agggtcccagggctg

SEQ ID NO: 1211976 - DNA, 15 bp, Homo sapiens
agggtcccattgtgc

SEQ ID NO: 1211977 - DNA, 20 bp, Homo sapiens
agggtcccatttctcactga

SEQ ID NO: 1211978 - DNA, 18 bp, Homo sapiens
agggtccccacctgggac

SEQ ID NO: 1211979 - DNA, 13 bp, Homo sapiens
agggtcccctccc

SEQ ID NO: 1211980 - DNA, 19 bp, Homo sapiens
agggtcccctccccagctc

SEQ ID NO: 1211981 - DNA, 22 bp, Homo sapiens
agggtcccggtgtatcctggcc

SEQ ID NO: 1211982 - DNA, 21 bp, Homo sapiens
agggttgttaatggtgcaaat

SEQ ID NO: 1211983 - DNA, 17 bp, Homo sapiens
agggtttcgactggtcc

SEQ ID NO: 1211984 - DNA, 18 bp, Homo sapiens
agggtttcgactggtcca

SEQ ID NO: 1211985 - DNA, 14 bp, Homo sapiens
agggtttggaccac

SEQ ID NO: 1211986 - DNA, 20 bp, Homo sapiens
agggtttggctgtgtctaaa

SEQ ID NO: 1211987 - DNA, 22 bp, Homo sapiens
agggtttggctgtgtctaaact

SEQ ID NO: 1211988 - DNA, 14 bp, Homo sapiens
agggtttgtggctg

SEQ ID NO: 1211989 - DNA, 15 bp, Homo sapiens
agggttttccaccct

SEQ ID NO: 1211990 - DNA, 15 bp, Homo sapiens
agggttttctcataa

SEQ ID NO: 1211991 - DNA, 15 bp, Homo sapiens
agggttttgcaataa

SEQ ID NO: 1211992 - DNA, 17 bp, Homo sapiens
agggtttttagagaatg

SEQ ID NO: 1211993 - DNA, 13 bp, Homo sapiens
aggtaaaatcact

SEQ ID NO: 1211994 - DNA, 14 bp, Homo sapiens
aggtaaaatcactt

SEQ ID NO: 1211995 - DNA, 18 bp, Homo sapiens
aggtaaaatcacttcaga

SEQ ID NO: 1211996 - DNA, 21 bp, Homo sapiens
aggtaaatggttaaattttac

SEQ ID NO: 1211997 - DNA, 23 bp, Homo sapiens
aggtaaatggttaaattttacat

SEQ ID NO: 1211998 - DNA, 15 bp, Homo sapiens
aggtaacatgtttat

SEQ ID NO: 1211999 - DNA, 21 bp, Homo sapiens
aggtaacatttatagaagaaa

SEQ ID NO: 1212000 - DNA, 19 bp, Homo sapiens
aggtaactaactgcttcat

SEQ ID NO: 1212001 - DNA, 20 bp, Homo sapiens
aggtaactactgctaatgtt

SEQ ID NO: 1212002 - DNA, 15 bp, Homo sapiens
aggtaagaagtttta

SEQ ID NO: 1212003 - DNA, 22 bp, Homo sapiens
aggtaagaagttttaaaaagcc

SEQ ID NO: 1212004 - DNA, 13 bp, Homo sapiens
aggtaagtggaat

SEQ ID NO: 1212005 - DNA, 13 bp, Homo sapiens
aggtaagtttttt

SEQ ID NO: 1212006 - DNA, 18 bp, Homo sapiens
aggtaatataaaaagctt

SEQ ID NO: 1212007 - DNA, 20 bp, Homo sapiens
aggtaatatacctggtttac

SEQ ID NO: 1212008 - DNA, 21 bp, Homo sapiens
aggtaatccaagatattttaa

SEQ ID NO: 1212009 - DNA, 18 bp, Homo sapiens
aggtaatgaagctatttg

SEQ ID NO: 1212010 - DNA, 19 bp, Homo sapiens
aggtaatgaccatgaaaga

SEQ ID NO: 1212011 - DNA, 20 bp, Homo sapiens
aggtaatgaccatgaaagac

SEQ ID NO: 1212012 - DNA, 21 bp, Homo sapiens
aggtaatgaccatgaaagact

SEQ ID NO: 1212013 - DNA, 22 bp, Homo sapiens
aggtaattgttttttaaagcaa

SEQ ID NO: 1212014 - DNA, 17 bp, Homo sapiens
aggtaatttttttcacc

SEQ ID NO: 1212015 - DNA, 16 bp, Homo sapiens
aggtacaagaagcatt

SEQ ID NO: 1212016 - DNA, 16 bp, Homo sapiens
aggtacacagctctag

SEQ ID NO: 1212017 - DNA, 14 bp, Homo sapiens
aggtacagaaaaca

SEQ ID NO: 1212018 - DNA, 16 bp, Homo sapiens
aggtacaggagaggca

SEQ ID NO: 1212019 - DNA, 22 bp, Homo sapiens
aggtacaggagaggcagcatgc

SEQ ID NO: 1212020 - DNA, 18 bp, Homo sapiens
aggtaccaaacaaggaag

SEQ ID NO: 1212021 - DNA, 20 bp, Homo sapiens
aggtaccaaacaaggaagcc

SEQ ID NO: 1212022 - DNA, 16 bp, Homo sapiens
aggtaccagctgcgct

SEQ ID NO: 1212023 - DNA, 16 bp, Homo sapiens
aggtaccgtctacatt

SEQ ID NO: 1212024 - DNA, 19 bp, Homo sapiens
aggtacgatgacagtgttc

SEQ ID NO: 1212025 - DNA, 15 bp, Homo sapiens
aggtactaaatacct

SEQ ID NO: 1212026 - DNA, 17 bp, Homo sapiens
aggtagaaatatctgaa

SEQ ID NO: 1212027 - DNA, 14 bp, Homo sapiens
aggtagaatgtaaa

SEQ ID NO: 1212028 - DNA, 20 bp, Homo sapiens
aggtagagtttgaaggaggt

SEQ ID NO: 1212029 - DNA, 21 bp, Homo sapiens
aggtagagtttgaaggaggtg

SEQ ID NO: 1212030 - DNA, 22 bp, Homo sapiens
aggtagatcgcttgagcccagg

SEQ ID NO: 1212031 - DNA, 19 bp, Homo sapiens
aggtagcctgctgtggggt

SEQ ID NO: 1212032 - DNA, 13 bp, Homo sapiens
aggtaggaagagc

SEQ ID NO: 1212033 - DNA, 22 bp, Homo sapiens
aggtaggcccttgtcctgccag

SEQ ID NO: 1212034 - DNA, 23 bp, Homo sapiens
aggtaggcccttgtcctgccagc

SEQ ID NO: 1212035 - DNA, 18 bp, Homo sapiens
aggtaggctgcaaaatta

SEQ ID NO: 1212036 - DNA, 16 bp, Homo sapiens
aggtaggctgtggggt

SEQ ID NO: 1212037 - DNA, 18 bp, Homo sapiens
aggtagtattacaccacc

SEQ ID NO: 1212038 - DNA, 20 bp, Homo sapiens
aggtagttgggtagaaaaat

SEQ ID NO: 1212039 - DNA, 14 bp, Homo sapiens
aggtataaagacaa

SEQ ID NO: 1212040 - DNA, 23 bp, Homo sapiens
aggtataggggtcctgggggcag

SEQ ID NO: 1212041 - DNA, 15 bp, Homo sapiens
aggtatattgtgaac

SEQ ID NO: 1212042 - DNA, 15 bp, Homo sapiens
aggtatctccaggat

SEQ ID NO: 1212043 - DNA, 15 bp, Homo sapiens
aggtatggccatgcc

SEQ ID NO: 1212044 - DNA, 21 bp, Homo sapiens
aggtatggccatgccctagac

SEQ ID NO: 1212045 - DNA, 13 bp, Homo sapiens
aggtatggctctg

SEQ ID NO: 1212046 - DNA, 14 bp, Homo sapiens
aggtatttctccag

SEQ ID NO: 1212047 - DNA, 17 bp, Homo sapiens
aggtattttgaatacca

SEQ ID NO: 1212048 - DNA, 19 bp, Homo sapiens
aggtattttgtagatgtga

SEQ ID NO: 1212049 - DNA, 22 bp, Homo sapiens
aggtatttttttaaatcaagga

SEQ ID NO: 1212050 - DNA, 23 bp, Homo sapiens
aggtatttttttaaatcaaggaa

SEQ ID NO: 1212051 - DNA, 15 bp, Homo sapiens
aggtcaaactcccta

SEQ ID NO: 1212052 - DNA, 16 bp, Homo sapiens
aggtcaaactccctag

SEQ ID NO: 1212053 - DNA, 17 bp, Homo sapiens
aggtcaacagagaaggc

SEQ ID NO: 1212054 - DNA, 19 bp, Homo sapiens
aggtcaacagagaaggcag

SEQ ID NO: 1212055 - DNA, 16 bp, Homo sapiens
agggcccctccctctg

SEQ ID NO: 1212056 - DNA, 17 bp, Homo sapiens
agggcccctccctctgc

SEQ ID NO: 1212057 - DNA, 19 bp, Homo sapiens
agggcccctctgcccagct

SEQ ID NO: 1212058 - DNA, 21 bp, Homo sapiens
agggcccctctgcccagcttg

SEQ ID NO: 1212059 - DNA, 15 bp, Homo sapiens
agggccctcccagcc

SEQ ID NO: 1212060 - DNA, 12 bp, Homo sapiens
agggccctgcag

SEQ ID NO: 1212061 - DNA, 14 bp, Homo sapiens
agggccctgccctg

SEQ ID NO: 1212062 - DNA, 14 bp, Homo sapiens
agggccctgggcag

SEQ ID NO: 1212063 - DNA, 23 bp, Homo sapiens
agggccctgtggagtccagctct

SEQ ID NO: 1212064 - DNA, 23 bp, Homo sapiens
agggcccttcccctcccccactc

SEQ ID NO: 1212065 - DNA, 13 bp, Homo sapiens
agggcccttctct

SEQ ID NO: 1212066 - DNA, 20 bp, Homo sapiens
agggccgcccgctcccttcc

SEQ ID NO: 1212067 - DNA, 20 bp, Homo sapiens
agggccggcggctctgagca

SEQ ID NO: 1212068 - DNA, 20 bp, Homo sapiens
agggcctatatgccagcgcc

SEQ ID NO: 1212069 - DNA, 16 bp, Homo sapiens
agggcctcagagcctg

SEQ ID NO: 1212070 - DNA, 20 bp, Homo sapiens
agggcctcagagcctgacct

SEQ ID NO: 1212071 - DNA, 17 bp, Homo sapiens
agggcctcatctcacct

SEQ ID NO: 1212072 - DNA, 14 bp, Homo sapiens
agggcctccagggc

SEQ ID NO: 1212073 - DNA, 12 bp, Homo sapiens
agggcctccctg

SEQ ID NO: 1212074 - DNA, 15 bp, Homo sapiens
agggcctccctgttc

SEQ ID NO: 1212075 - DNA, 19 bp, Homo sapiens
agggcctctccaaccactg

SEQ ID NO: 1212076 - DNA, 15 bp, Homo sapiens
agggcctgacttgag

SEQ ID NO: 1212077 - DNA, 17 bp, Homo sapiens
agggcctgcctggcccc

SEQ ID NO: 1212078 - DNA, 12 bp, Homo sapiens
agggcctgctgg

SEQ ID NO: 1212079 - DNA, 13 bp, Homo sapiens
agggcctgctgga

SEQ ID NO: 1212080 - DNA, 14 bp, Homo sapiens
agggcctgctggag

SEQ ID NO: 1212081 - DNA, 16 bp, Homo sapiens
agggcctgctggaggc

SEQ ID NO: 1212082 - DNA, 19 bp, Homo sapiens
agggcctgctggaggcctc

SEQ ID NO: 1212083 - DNA, 22 bp, Homo sapiens
agggcctgctggaggcctcagg

SEQ ID NO: 1212084 - DNA, 23 bp, Homo sapiens
agggcctgctggaggcctcaggt

SEQ ID NO: 1212085 - DNA, 13 bp, Homo sapiens
agggcctggagcc

SEQ ID NO: 1212086 - DNA, 15 bp, Homo sapiens
agggcctggccagtc

SEQ ID NO: 1212087 - DNA, 20 bp, Homo sapiens
agggcctggccagtcctggt

SEQ ID NO: 1212088 - DNA, 17 bp, Homo sapiens
agggcctggggcctgag

SEQ ID NO: 1212089 - DNA, 18 bp, Homo sapiens
agggcctggggcctgaga

SEQ ID NO: 1212090 - DNA, 15 bp, Homo sapiens
agggcctgggggcag

SEQ ID NO: 1212091 - DNA, 14 bp, Homo sapiens
agggcctgtctccc

SEQ ID NO: 1212092 - DNA, 15 bp, Homo sapiens
agggcctgtctccct

SEQ ID NO: 1212093 - DNA, 12 bp, Homo sapiens
agggccttgccc

SEQ ID NO: 1212094 - DNA, 18 bp, Homo sapiens
agggccttgcccagagat

SEQ ID NO: 1212095 - DNA, 23 bp, Homo sapiens
agggccttgcccagagatgcctc

SEQ ID NO: 1212096 - DNA, 15 bp, Homo sapiens
agggccttgcttctc

SEQ ID NO: 1212097 - DNA, 16 bp, Homo sapiens
agggccttgcttctct

SEQ ID NO: 1212098 - DNA, 15 bp, Homo sapiens
agggccttggcccag

SEQ ID NO: 1212099 - DNA, 17 bp, Homo sapiens
agggcctttctcctccc

SEQ ID NO: 1212100 - DNA, 20 bp, Homo sapiens
agggcctttctcctccccac

SEQ ID NO: 1212101 - DNA, 21 bp, Homo sapiens
agggccttttctgtgccagac

SEQ ID NO: 1212102 - DNA, 19 bp, Homo sapiens
agggcgagactctgtctca

SEQ ID NO: 1212103 - DNA, 13 bp, Homo sapiens
agggcgaggggag

SEQ ID NO: 1212104 - DNA, 14 bp, Homo sapiens
agggcgccaccacc

SEQ ID NO: 1212105 - DNA, 15 bp, Homo sapiens
agggcgcccctggga

SEQ ID NO: 1212106 - DNA, 22 bp, Homo sapiens
agggcgcccctgggagacaact

SEQ ID NO: 1212107 - DNA, 22 bp, Homo sapiens
agggcgcgcaggcagggagaag

SEQ ID NO: 1212108 - DNA, 18 bp, Homo sapiens
agggcggcaggggcctgg

SEQ ID NO: 1212109 - DNA, 18 bp, Homo sapiens
agggcggccagggacaga

SEQ ID NO: 1212110 - DNA, 19 bp, Homo sapiens
agggcgggcagagggctgg

SEQ ID NO: 1212111 - DNA, 13 bp, Homo sapiens
agggcggggctgg

SEQ ID NO: 1212112 - DNA, 15 bp, Homo sapiens
agggcgtcaggcaga

SEQ ID NO: 1212113 - DNA, 15 bp, Homo sapiens
agggcgtgactcacc

SEQ ID NO: 1212114 - DNA, 16 bp, Homo sapiens
agggcgtgactcaccc

SEQ ID NO: 1212115 - DNA, 22 bp, Homo sapiens
agggcgtgtggtttccctgccc

SEQ ID NO: 1212116 - DNA, 23 bp, Homo sapiens
agggcgttctaggtaggaagagc

SEQ ID NO: 1212117 - DNA, 14 bp, Homo sapiens
agggctaaatgttt

SEQ ID NO: 1212118 - DNA, 21 bp, Homo sapiens
agggctaagagctagcgctgc

SEQ ID NO: 1212119 - DNA, 22 bp, Homo sapiens
agggctaagagctagcgctgcc

SEQ ID NO: 1212120 - DNA, 23 bp, Homo sapiens
agggctaagagctagcgctgccg

SEQ ID NO: 1212121 - DNA, 21 bp, Homo sapiens
agggctaccctgagctgaggc

SEQ ID NO: 1212122 - DNA, 21 bp, Homo sapiens
agggctactgcagctttacat

SEQ ID NO: 1212123 - DNA, 17 bp, Homo sapiens
agggctagccctgagcc

SEQ ID NO: 1212124 - DNA, 20 bp, Homo sapiens
agggctagtagaactggatc

SEQ ID NO: 1212125 - DNA, 11 bp, Homo sapiens
agggctagtga

SEQ ID NO: 1212126 - DNA, 18 bp, Homo sapiens
agggctagtgaagtggcc

SEQ ID NO: 1212127 - DNA, 21 bp, Homo sapiens
agggctagtgaagtggcctct

SEQ ID NO: 1212128 - DNA, 22 bp, Homo sapiens
agggctagtgacttgtgtccca

SEQ ID NO: 1212129 - DNA, 14 bp, Homo sapiens
agggctcacactcc

SEQ ID NO: 1212130 - DNA, 15 bp, Homo sapiens
agggctcacagggca

SEQ ID NO: 1212131 - DNA, 13 bp, Homo sapiens
agggctcactcag

SEQ ID NO: 1212132 - DNA, 14 bp, Homo sapiens
agggctcagaagag

SEQ ID NO: 1212133 - DNA, 18 bp, Homo sapiens
agggctcagaagagcagc

SEQ ID NO: 1212134 - DNA, 22 bp, Homo sapiens
agggctcagagtgaccctcagc

SEQ ID NO: 1212135 - DNA, 14 bp, Homo sapiens
agggctcagcctgg

SEQ ID NO: 1212136 - DNA, 13 bp, Homo sapiens
agggctcagggca

SEQ ID NO: 1212137 - DNA, 20 bp, Homo sapiens
agggctccagcatccagcct

SEQ ID NO: 1212138 - DNA, 22 bp, Homo sapiens
agggctccagcatccagcctgt

SEQ ID NO: 1212139 - DNA, 13 bp, Homo sapiens
agggctcccaggg

SEQ ID NO: 1212140 - DNA, 22 bp, Homo sapiens
agggctcccaggggtctccctg

SEQ ID NO: 1212141 - DNA, 13 bp, Homo sapiens
agggctcctccca

SEQ ID NO: 1212142 - DNA, 17 bp, Homo sapiens
agggctcctcccagctt

SEQ ID NO: 1212143 - DNA, 18 bp, Homo sapiens
agggctcctcccagcttg

SEQ ID NO: 1212144 - DNA, 11 bp, Homo sapiens
agggctcctgc

SEQ ID NO: 1212145 - DNA, 18 bp, Homo sapiens
agggctcgaggggtgggc

SEQ ID NO: 1212146 - DNA, 20 bp, Homo sapiens
agggctcgaggggtgggctg

SEQ ID NO: 1212147 - DNA, 15 bp, Homo sapiens
agggctctaaaaaaa

SEQ ID NO: 1212148 - DNA, 18 bp, Homo sapiens
aggtcaagtaagaagaca

SEQ ID NO: 1212149 - DNA, 19 bp, Homo sapiens
aggtcaagtaagaagacat

SEQ ID NO: 1212150 - DNA, 15 bp, Homo sapiens
aggtcaataaagcag

SEQ ID NO: 1212151 - DNA, 16 bp, Homo sapiens
aggtcaataaagcaga

SEQ ID NO: 1212152 - DNA, 19 bp, Homo sapiens
aggtcaatgtcaagagagg

SEQ ID NO: 1212153 - DNA, 19 bp, Homo sapiens
aggtcacattcaggaagat

SEQ ID NO: 1212154 - DNA, 17 bp, Homo sapiens
aggtcaccagctgctgt

SEQ ID NO: 1212155 - DNA, 19 bp, Homo sapiens
aggtcaccatcctcagagg

SEQ ID NO: 1212156 - DNA, 14 bp, Homo sapiens
aggtcactccacca

SEQ ID NO: 1212157 - DNA, 18 bp, Homo sapiens
aggtcactccaccatccc

SEQ ID NO: 1212158 - DNA, 23 bp, Homo sapiens
aggtcactccaccatccccaccc

SEQ ID NO: 1212159 - DNA, 14 bp, Homo sapiens
aggtcactcttggt

SEQ ID NO: 1212160 - DNA, 14 bp, Homo sapiens
aggtcactggctct

SEQ ID NO: 1212161 - DNA, 19 bp, Homo sapiens
aggtcactggctctccaag

SEQ ID NO: 1212162 - DNA, 20 bp, Homo sapiens
aggtcactggctctccaagt

SEQ ID NO: 1212163 - DNA, 17 bp, Homo sapiens
aggtcactgtcactgcc

SEQ ID NO: 1212164 - DNA, 18 bp, Homo sapiens
aggtcactgtcactgccg

SEQ ID NO: 1212165 - DNA, 14 bp, Homo sapiens
aggtcactgtttcc

SEQ ID NO: 1212166 - DNA, 19 bp, Homo sapiens
aggtcagactaagaaatat

SEQ ID NO: 1212167 - DNA, 18 bp, Homo sapiens
aggtcagaggagggcatg

SEQ ID NO: 1212168 - DNA, 15 bp, Homo sapiens
aggtcagcatgtcta

SEQ ID NO: 1212169 - DNA, 19 bp, Homo sapiens
aggtcagcccgtttcagaa

SEQ ID NO: 1212170 - DNA, 13 bp, Homo sapiens
aggtcagccctgt

SEQ ID NO: 1212171 - DNA, 16 bp, Homo sapiens
aggtcagccctgtgtc

SEQ ID NO: 1212172 - DNA, 17 bp, Homo sapiens
aggtcagccctgtgtct

SEQ ID NO: 1212173 - DNA, 20 bp, Homo sapiens
aggtcagccctgtgtctgtc

SEQ ID NO: 1212174 - DNA, 20 bp, Homo sapiens
aggtcagctgttactttctt

SEQ ID NO: 1212175 - DNA, 22 bp, Homo sapiens
aggtcaggacggctcctcagag

SEQ ID NO: 1212176 - DNA, 17 bp, Homo sapiens
aggtcaggccccactcc

SEQ ID NO: 1212177 - DNA, 20 bp, Homo sapiens
aggtcagggagtgctggctc

SEQ ID NO: 1212178 - DNA, 17 bp, Homo sapiens
aggtcaggggctcccta

SEQ ID NO: 1212179 - DNA, 18 bp, Homo sapiens
aggtcaggggctccctac

SEQ ID NO: 1212180 - DNA, 16 bp, Homo sapiens
aggtcagttgtaataa

SEQ ID NO: 1212181 - DNA, 17 bp, Homo sapiens
aggtcatagctgagatt

SEQ ID NO: 1212182 - DNA, 15 bp, Homo sapiens
aggtcatcaaacatt

SEQ ID NO: 1212183 - DNA, 15 bp, Homo sapiens
aggtcatcagatgcc

SEQ ID NO: 1212184 - DNA, 15 bp, Homo sapiens
aggtcatctgacctt

SEQ ID NO: 1212185 - DNA, 17 bp, Homo sapiens
aggtcatgctggtgggt

SEQ ID NO: 1212186 - DNA, 22 bp, Homo sapiens
aggtcatgtctgtaatcccagc

SEQ ID NO: 1212187 - DNA, 17 bp, Homo sapiens
aggtcattttttttaag

SEQ ID NO: 1212188 - DNA, 20 bp, Homo sapiens
aggtcattttttttaagaaa

SEQ ID NO: 1212189 - DNA, 19 bp, Homo sapiens
aggtccaaacccttcaact

SEQ ID NO: 1212190 - DNA, 21 bp, Homo sapiens
aggtcttcccgcaaggcctct

SEQ ID NO: 1212191 - DNA, 22 bp, Homo sapiens
aggtcttcccgcaaggcctctc

SEQ ID NO: 1212192 - DNA, 15 bp, Homo sapiens
aggtcttgactcatg

SEQ ID NO: 1212193 - DNA, 20 bp, Homo sapiens
aggtcttgactcatggcagc

SEQ ID NO: 1212194 - DNA, 11 bp, Homo sapiens
aggtctttaaa

SEQ ID NO: 1212195 - DNA, 16 bp, Homo sapiens
aggtctttaaaccttt

SEQ ID NO: 1212196 - DNA, 14 bp, Homo sapiens
aggtctttctcctc

SEQ ID NO: 1212197 - DNA, 17 bp, Homo sapiens
aggtctttctcctcagg

SEQ ID NO: 1212198 - DNA, 15 bp, Homo sapiens
aggtctttctctcag

SEQ ID NO: 1212199 - DNA, 17 bp, Homo sapiens
aggtctttgcacatgtg

SEQ ID NO: 1212200 - DNA, 18 bp, Homo sapiens
aggtctttgcacatgtga

SEQ ID NO: 1212201 - DNA, 10 bp, Homo sapiens
aggtctttgt

SEQ ID NO: 1212202 - DNA, 17 bp, Homo sapiens
aggtctttgtaaaatct

SEQ ID NO: 1212203 - DNA, 14 bp, Homo sapiens
aggtcttttgacat

SEQ ID NO: 1212204 - DNA, 16 bp, Homo sapiens
aggtcttttgacatgt

SEQ ID NO: 1212205 - DNA, 14 bp, Homo sapiens
aggtctttttttaa

SEQ ID NO: 1212206 - DNA, 21 bp, Homo sapiens
aggtgaaacgactcaaaatga

SEQ ID NO: 1212207 - DNA, 14 bp, Homo sapiens
aggtgaaatgaatg

SEQ ID NO: 1212208 - DNA, 22 bp, Homo sapiens
aggtgaaatgggagatggtcag

SEQ ID NO: 1212209 - DNA, 15 bp, Homo sapiens
aggtgaacattaaaa

SEQ ID NO: 1212210 - DNA, 17 bp, Homo sapiens
aggtgaaggaatatatg

SEQ ID NO: 1212211 - DNA, 16 bp, Homo sapiens
aggtgaagggatgggg

SEQ ID NO: 1212212 - DNA, 13 bp, Homo sapiens
aggtgaatttcat

SEQ ID NO: 1212213 - DNA, 17 bp, Homo sapiens
aggtgaccgcccagctc

SEQ ID NO: 1212214 - DNA, 21 bp, Homo sapiens
aggtgaccgcccagctctccc

SEQ ID NO: 1212215 - DNA, 21 bp, Homo sapiens
aggtgactgtgctgtgcagct

SEQ ID NO: 1212216 - DNA, 19 bp, Homo sapiens
aggtgacttgagagtggaa

SEQ ID NO: 1212217 - DNA, 15 bp, Homo sapiens
aggtgagaaaaaaac

SEQ ID NO: 1212218 - DNA, 18 bp, Homo sapiens
aggtgagaaaaggggcat

SEQ ID NO: 1212219 - DNA, 13 bp, Homo sapiens
aggtgagaaactg

SEQ ID NO: 1212220 - DNA, 17 bp, Homo sapiens
aggtgagaactcagaag

SEQ ID NO: 1212221 - DNA, 19 bp, Homo sapiens
aggtgagaactcagaagag

SEQ ID NO: 1212222 - DNA, 21 bp, Homo sapiens
aggtgagaactcagaagagaa

SEQ ID NO: 1212223 - DNA, 15 bp, Homo sapiens
agtaaatcctcattt

SEQ ID NO: 1212224 - DNA, 19 bp, Homo sapiens
agtaaatgggggtgcattt

SEQ ID NO: 1212225 - DNA, 21 bp, Homo sapiens
agtaaatgggggtgcatttga

SEQ ID NO: 1212226 - DNA, 19 bp, Homo sapiens
agtaaatgtgtttcttgct

SEQ ID NO: 1212227 - DNA, 10 bp, Homo sapiens
agtaaatgtt

SEQ ID NO: 1212228 - DNA, 23 bp, Homo sapiens
agtaaatgttatcttatactgta

SEQ ID NO: 1212229 - DNA, 13 bp, Homo sapiens
agtaaattatgta

SEQ ID NO: 1212230 - DNA, 15 bp, Homo sapiens
agtaaattattaagc

SEQ ID NO: 1212231 - DNA, 19 bp, Homo sapiens
agtaaattgcctgatttgt

SEQ ID NO: 1212232 - DNA, 14 bp, Homo sapiens
agtaccatttatac

SEQ ID NO: 1212233 - DNA, 21 bp, Homo sapiens
agtaccatttatacaaattag

SEQ ID NO: 1212234 - DNA, 22 bp, Homo sapiens
agtacccatgggaataatagac

SEQ ID NO: 1212235 - DNA, 23 bp, Homo sapiens
agtaccccctcaaaccctgccct

SEQ ID NO: 1212236 - DNA, 19 bp, Homo sapiens
agtaccctccattgggcac

SEQ ID NO: 1212237 - DNA, 19 bp, Homo sapiens
agtaccctctcagctccag

SEQ ID NO: 1212238 - DNA, 17 bp, Homo sapiens
agtaccctttggcctac

SEQ ID NO: 1212239 - DNA, 17 bp, Homo sapiens
agtacctccaagcaagt

SEQ ID NO: 1212240 - DNA, 19 bp, Homo sapiens
agtacctctgtatagaaat

SEQ ID NO: 1212241 - DNA, 20 bp, Homo sapiens
agtacctctgtatagaaatc

SEQ ID NO: 1212242 - DNA, 23 bp, Homo sapiens
agtaccttgaactcttagtgatt

SEQ ID NO: 1212243 - DNA, 15 bp, Homo sapiens
agtacctttgtcaca

SEQ ID NO: 1212244 - DNA, 14 bp, Homo sapiens
agtacgttaaaagc

SEQ ID NO: 1212245 - DNA, 14 bp, Homo sapiens
agtacgttgtgcat

SEQ ID NO: 1212246 - DNA, 11 bp, Homo sapiens
agtactcactt

SEQ ID NO: 1212247 - DNA, 12 bp, Homo sapiens
agtactcacttt

SEQ ID NO: 1212248 - DNA, 22 bp, Homo sapiens
agtactcacttttcacttgtct

SEQ ID NO: 1212249 - DNA, 18 bp, Homo sapiens
agtactcctgcaaaattt

SEQ ID NO: 1212250 - DNA, 21 bp, Homo sapiens
agtactcctgcaaaattttat

SEQ ID NO: 1212251 - DNA, 13 bp, Homo sapiens
agtactctctgct

SEQ ID NO: 1212252 - DNA, 22 bp, Homo sapiens
agtactctctgctctagccagg

SEQ ID NO: 1212253 - DNA, 23 bp, Homo sapiens
agtactctctgctctagccagga

SEQ ID NO: 1212254 - DNA, 12 bp, Homo sapiens
agtactctttaa

SEQ ID NO: 1212255 - DNA, 15 bp, Homo sapiens
agtactctttaacat

SEQ ID NO: 1212256 - DNA, 15 bp, Homo sapiens
agtactggaataaac

SEQ ID NO: 1212257 - DNA, 16 bp, Homo sapiens
agtactggaataaaca

SEQ ID NO: 1212258 - DNA, 17 bp, Homo sapiens
agtactggaataaacag

SEQ ID NO: 1212259 - DNA, 14 bp, Homo sapiens
agtacttcttctgt

SEQ ID NO: 1212260 - DNA, 18 bp, Homo sapiens
agtacttcttctgtaata

SEQ ID NO: 1212261 - DNA, 19 bp, Homo sapiens
agtacttcttctgtaatat

SEQ ID NO: 1212262 - DNA, 23 bp, Homo sapiens
agtacttgggagacctgtaatca

SEQ ID NO: 1212263 - DNA, 15 bp, Homo sapiens
agtacttgtcatatg

SEQ ID NO: 1212264 - DNA, 17 bp, Homo sapiens
agtacttgtcatatgta

SEQ ID NO: 1212265 - DNA, 22 bp, Homo sapiens
agtactttggaggcccctatgt

SEQ ID NO: 1212266 - DNA, 17 bp, Homo sapiens
agtagaaaagttgcaga

SEQ ID NO: 1212267 - DNA, 14 bp, Homo sapiens
agtagaaaatgtga

SEQ ID NO: 1212268 - DNA, 19 bp, Homo sapiens
agtagaaataatatgcatt

SEQ ID NO: 1212269 - DNA, 14 bp, Homo sapiens
agtagaaattttac

SEQ ID NO: 1212270 - DNA, 11 bp, Homo sapiens
agtagaactgt

SEQ ID NO: 1212271 - DNA, 20 bp, Homo sapiens
agtagaagatttgatgctgg

SEQ ID NO: 1212272 - DNA, 15 bp, Homo sapiens
agtagaattgcattg

SEQ ID NO: 1212273 - DNA, 12 bp, Homo sapiens
agtagaatttta

SEQ ID NO: 1212274 - DNA, 15 bp, Homo sapiens
agtagaattttagtc

SEQ ID NO: 1212275 - DNA, 21 bp, Homo sapiens
agtagacacgagcttaatcaa

SEQ ID NO: 1212276 - DNA, 19 bp, Homo sapiens
agtagaccaaatcttgtta

SEQ ID NO: 1212277 - DNA, 22 bp, Homo sapiens
agtagacctctttttcttacca

SEQ ID NO: 1212278 - DNA, 21 bp, Homo sapiens
agtagaccttgttacttctga

SEQ ID NO: 1212279 - DNA, 16 bp, Homo sapiens
agtagacttggtgtga

SEQ ID NO: 1212280 - DNA, 14 bp, Homo sapiens
agtagagaggcccg

SEQ ID NO: 1212281 - DNA, 15 bp, Homo sapiens
agtagagccagcttg

SEQ ID NO: 1212282 - DNA, 19 bp, Homo sapiens
agtagagctagctgccact

SEQ ID NO: 1212283 - DNA, 23 bp, Homo sapiens
agtagagtcatctccatcagctg

SEQ ID NO: 1212284 - DNA, 19 bp, Homo sapiens
agtagatactaaagcaaat

SEQ ID NO: 1212285 - DNA, 20 bp, Homo sapiens
agtagatgtggcctttgaat

SEQ ID NO: 1212286 - DNA, 17 bp, Homo sapiens
agtagattaaaaattat

SEQ ID NO: 1212287 - DNA, 20 bp, Homo sapiens
agtagattgcagaaaattct

SEQ ID NO: 1212288 - DNA, 13 bp, Homo sapiens
agtagatttcatg

SEQ ID NO: 1212289 - DNA, 15 bp, Homo sapiens
agtagatttctatga

SEQ ID NO: 1212290 - DNA, 15 bp, Homo sapiens
agtagatttttaaca

SEQ ID NO: 1212291 - DNA, 19 bp, Homo sapiens
agtagcaaaacaaattcaa

SEQ ID NO: 1212292 - DNA, 22 bp, Homo sapiens
agtagcaaaacaaattcaaata

SEQ ID NO: 1212293 - DNA, 16 bp, Homo sapiens
agtagcaatgtgcctt

SEQ ID NO: 1212294 - DNA, 18 bp, Homo sapiens
agtagcatggactctggg

SEQ ID NO: 1212295 - DNA, 19 bp, Homo sapiens
agtagcatgttgagccagg

SEQ ID NO: 1212296 - DNA, 14 bp, Homo sapiens
agtagccaagttat

SEQ ID NO: 1212297 - DNA, 18 bp, Homo sapiens
agtagccgagagcctgct

SEQ ID NO: 1212298 - DNA, 18 bp, Homo sapiens
agtagcctatgaatgaaa

SEQ ID NO: 1212299 - DNA, 18 bp, Homo sapiens
agtagcgttttttaaatg

SEQ ID NO: 1212300 - DNA, 21 bp, Homo sapiens
agtagcgttttttaaatgtat

SEQ ID NO: 1212301 - DNA, 22 bp, Homo sapiens
agtagcgttttttaaatgtata

SEQ ID NO: 1212302 - DNA, 15 bp, Homo sapiens
agtagctagtagcaa

SEQ ID NO: 1212303 - DNA, 17 bp, Homo sapiens
agtagctggattacagg

SEQ ID NO: 1212304 - DNA, 12 bp, Homo sapiens
agtagctgggat

SEQ ID NO: 1212305 - DNA, 21 bp, Homo sapiens
agtagctgggatgacaggcgc

SEQ ID NO: 1212306 - DNA, 23 bp, Homo sapiens
agtagctgggattacagatctgc

SEQ ID NO: 1212307 - DNA, 18 bp, Homo sapiens
agtagctgggattacagg

SEQ ID NO: 1212308 - DNA, 12 bp, Homo sapiens
agtagctgggcc

SEQ ID NO: 1212309 - DNA, 13 bp, Homo sapiens
agtagctgggcct

SEQ ID NO: 1212310 - DNA, 15 bp, Homo sapiens
agtagctgggcctgt

SEQ ID NO: 1212311 - DNA, 14 bp, Homo sapiens
agtagcttgctccc

SEQ ID NO: 1212312 - DNA, 16 bp, Homo sapiens
agtagcttgctccctg

SEQ ID NO: 1212313 - DNA, 19 bp, Homo sapiens
agtagcttgctccctgtgt

SEQ ID NO: 1212314 - DNA, 23 bp, Homo sapiens
agtaggaaagtcacccaaacact

SEQ ID NO: 1212315 - DNA, 20 bp, Homo sapiens
agtaggaaatacaataaata

SEQ ID NO: 1212316 - DNA, 23 bp, Homo sapiens
agtaggactccttatttggcgtg

SEQ ID NO: 1212317 - DNA, 14 bp, Homo sapiens
agtaggctgggcct

SEQ ID NO: 1212318 - DNA, 18 bp, Homo sapiens
agtaggggaagacatgca

SEQ ID NO: 1212319 - DNA, 18 bp, Homo sapiens
agtagggtagaaggaaag

SEQ ID NO: 1212320 - DNA, 12 bp, Homo sapiens
agtaggtctggg

SEQ ID NO: 1212321 - DNA, 18 bp, Homo sapiens
agtaggtctgggatggac

SEQ ID NO: 1212322 - DNA, 20 bp, Homo sapiens
agtagtacttcttctgtaat

SEQ ID NO: 1212323 - DNA, 14 bp, Homo sapiens
agtagtacttgaaa

SEQ ID NO: 1212324 - DNA, 16 bp, Homo sapiens
agtagtatatttaatt

SEQ ID NO: 1212325 - DNA, 21 bp, Homo sapiens
agtagtatatttaattttgac

SEQ ID NO: 1212326 - DNA, 22 bp, Homo sapiens
agtagtcaaaaacaaagctgat

SEQ ID NO: 1212327 - DNA, 18 bp, Homo sapiens
agtagtcttatgtaaagt

SEQ ID NO: 1212328 - DNA, 17 bp, Homo sapiens
agtagtgatgaaaagta

SEQ ID NO: 1212329 - DNA, 20 bp, Homo sapiens
agtagtgtggcctgtgccag

SEQ ID NO: 1212330 - DNA, 13 bp, Homo sapiens
agtagttaaataa

SEQ ID NO: 1212331 - DNA, 15 bp, Homo sapiens
agtagttaaataact

SEQ ID NO: 1212332 - DNA, 24 bp, Homo sapiens
agtagttggctagtactttgatgc

SEQ ID NO: 1212333 - DNA, 17 bp, Homo sapiens
agtagttggtttgtatg

SEQ ID NO: 1212334 - DNA, 18 bp, Homo sapiens
agtagttggtttgtatga

SEQ ID NO: 1212335 - DNA, 22 bp, Homo sapiens
agtagttggtttgtatgagatg

SEQ ID NO: 1212336 - DNA, 14 bp, Homo sapiens
agtagttgtattct

SEQ ID NO: 1212337 - DNA, 12 bp, Homo sapiens
agtagtttgtat

SEQ ID NO: 1212338 - DNA, 21 bp, Homo sapiens
agtagtttttacagctgtgtt

SEQ ID NO: 1212339 - DNA, 13 bp, Homo sapiens
agtagtttttcag

SEQ ID NO: 1212340 - DNA, 21 bp, Homo sapiens
agtataaaatacaacaaagga

SEQ ID NO: 1212341 - DNA, 22 bp, Homo sapiens
agtataaaatagtatgaaaatg

SEQ ID NO: 1212342 - DNA, 22 bp, Homo sapiens
agtataaacatgaccctgggct

SEQ ID NO: 1212343 - DNA, 13 bp, Homo sapiens
agtataaatctgg

SEQ ID NO: 1212344 - DNA, 16 bp, Homo sapiens
agtataaattatctta

SEQ ID NO: 1212345 - DNA, 12 bp, Homo sapiens
agtataagattt

SEQ ID NO: 1212346 - DNA, 17 bp, Homo sapiens
aggttctcatttctcag

SEQ ID NO: 1212347 - DNA, 22 bp, Homo sapiens
aggttctccgttagctcctgtg

SEQ ID NO: 1212348 - DNA, 14 bp, Homo sapiens
aggttctgggcctc

SEQ ID NO: 1212349 - DNA, 15 bp, Homo sapiens
aggttctgggcctct

SEQ ID NO: 1212350 - DNA, 14 bp, Homo sapiens
aggttctggttcca

SEQ ID NO: 1212351 - DNA, 13 bp, Homo sapiens
aggttcttgcctt

SEQ ID NO: 1212352 - DNA, 18 bp, Homo sapiens
aggttcttgttggtgcac

SEQ ID NO: 1212353 - DNA, 12 bp, Homo sapiens
aggttgaaagac

SEQ ID NO: 1212354 - DNA, 23 bp, Homo sapiens
aggttgaagccaagtggggtgct

SEQ ID NO: 1212355 - DNA, 15 bp, Homo sapiens
aggttgaataatata

SEQ ID NO: 1212356 - DNA, 21 bp, Homo sapiens
aggttgacaataaatgtgctt

SEQ ID NO: 1212357 - DNA, 17 bp, Homo sapiens
aggttgacattcagaaa

SEQ ID NO: 1212358 - DNA, 16 bp, Homo sapiens
aggttgagtgagccgg

SEQ ID NO: 1212359 - DNA, 21 bp, Homo sapiens
aggttgcaaaacggatgagtt

SEQ ID NO: 1212360 - DNA, 18 bp, Homo sapiens
aggttgcagggagccgag

SEQ ID NO: 1212361 - DNA, 15 bp, Homo sapiens
aggttgcagtgagcc

SEQ ID NO: 1212362 - DNA, 16 bp, Homo sapiens
aggttgcagtgagctg

SEQ ID NO: 1212363 - DNA, 16 bp, Homo sapiens
aggttgctgtttcaca

SEQ ID NO: 1212364 - DNA, 20 bp, Homo sapiens
aggttggcaaaaaggcagga

SEQ ID NO: 1212365 - DNA, 16 bp, Homo sapiens
aggttggcaccccagc

SEQ ID NO: 1212366 - DNA, 15 bp, Homo sapiens
aggttggcgggggca

SEQ ID NO: 1212367 - DNA, 20 bp, Homo sapiens
aggttggggagacttggggc

SEQ ID NO: 1212368 - DNA, 17 bp, Homo sapiens
aggttggggataggttt

SEQ ID NO: 1212369 - DNA, 16 bp, Homo sapiens
aggttggggtgtacta

SEQ ID NO: 1212370 - DNA, 16 bp, Homo sapiens
aggttggttccttggg

SEQ ID NO: 1212371 - DNA, 17 bp, Homo sapiens
aggttgtagtaaagaaa

SEQ ID NO: 1212372 - DNA, 20 bp, Homo sapiens
aggttgtctgaagtcactgc

SEQ ID NO: 1212373 - DNA, 14 bp, Homo sapiens
aggttgtgaaataa

SEQ ID NO: 1212374 - DNA, 24 bp, Homo sapiens
aggttgtggatgctccagggcagc

SEQ ID NO: 1212375 - DNA, 13 bp, Homo sapiens
aggttgtgggcct

SEQ ID NO: 1212376 - DNA, 19 bp, Homo sapiens
aggttgtggggaggctgca

SEQ ID NO: 1212377 - DNA, 13 bp, Homo sapiens
aggtttaaaacta

SEQ ID NO: 1212378 - DNA, 23 bp, Homo sapiens
aggtttacaatttacaaagtgtg

SEQ ID NO: 1212379 - DNA, 14 bp, Homo sapiens
aggtttataaagca

SEQ ID NO: 1212380 - DNA, 23 bp, Homo sapiens
aggtttatttatctgagcaataa

SEQ ID NO: 1212381 - DNA, 17 bp, Homo sapiens
aggtttatttttctgtt

SEQ ID NO: 1212382 - DNA, 12 bp, Homo sapiens
aggtttcaatgc

SEQ ID NO: 1212383 - DNA, 13 bp, Homo sapiens
aggtttcaatgca

SEQ ID NO: 1212384 - DNA, 15 bp, Homo sapiens
aggtttcagatgagg

SEQ ID NO: 1212385 - DNA, 19 bp, Homo sapiens
aggtttccttttggaacat

SEQ ID NO: 1212386 - DNA, 17 bp, Homo sapiens
aggtttcgtttctgtat

SEQ ID NO: 1212387 - DNA, 19 bp, Homo sapiens
aggtttctccttgaagcaa

SEQ ID NO: 1212388 - DNA, 15 bp, Homo sapiens
aggtttctggagcag

SEQ ID NO: 1212389 - DNA, 20 bp, Homo sapiens
aggtttctttttttttcctt

SEQ ID NO: 1212390 - DNA, 20 bp, Homo sapiens
aggtttgaaaagctgactgt

SEQ ID NO: 1212391 - DNA, 22 bp, Homo sapiens
aggtttgaaaagctgactgttt

SEQ ID NO: 1212392 - DNA, 19 bp, Homo sapiens
aggtttgcagggagctcaa

SEQ ID NO: 1212393 - DNA, 16 bp, Homo sapiens
aggtttgccagtgaag

SEQ ID NO: 1212394 - DNA, 19 bp, Homo sapiens
aggtttgccagtgaagact

SEQ ID NO: 1212395 - DNA, 17 bp, Homo sapiens
aggtttgcttcctcagt

SEQ ID NO: 1212396 - DNA, 23 bp, Homo sapiens
aggtttggggagggggaagagaa

SEQ ID NO: 1212397 - DNA, 19 bp, Homo sapiens
aggtttggtttttttgtac

SEQ ID NO: 1212398 - DNA, 21 bp, Homo sapiens
aggtttgtcccagtcagaaat

SEQ ID NO: 1212399 - DNA, 18 bp, Homo sapiens
aggtttgttttcagcact

SEQ ID NO: 1212400 - DNA, 21 bp, Homo sapiens
aggttttaaagtgattaaacg

SEQ ID NO: 1212401 - DNA, 10 bp, Homo sapiens
aggttttcag

SEQ ID NO: 1212402 - DNA, 22 bp, Homo sapiens
aggttttcctcttctattttgt

SEQ ID NO: 1212403 - DNA, 14 bp, Homo sapiens
aggttttctccact

SEQ ID NO: 1212404 - DNA, 22 bp, Homo sapiens
aggttttctctaacttctcaag

SEQ ID NO: 1212405 - DNA, 17 bp, Homo sapiens
aggttttcttttaagaa

SEQ ID NO: 1212406 - DNA, 16 bp, Homo sapiens
aggttttgaataaaaa

SEQ ID NO: 1212407 - DNA, 12 bp, Homo sapiens
aggttttgtatt

SEQ ID NO: 1212408 - DNA, 21 bp, Homo sapiens
aggttttgttttttttcagcc

SEQ ID NO: 1212409 - DNA, 19 bp, Homo sapiens
aggtttttaaattgtttca

SEQ ID NO: 1212410 - DNA, 20 bp, Homo sapiens
aggtttttattagtaccata

SEQ ID NO: 1212411 - DNA, 19 bp, Homo sapiens
aggtttttctcatgtatct

SEQ ID NO: 1212412 - DNA, 20 bp, Homo sapiens
aggtttttctcatgtatctt

SEQ ID NO: 1212413 - DNA, 22 bp, Homo sapiens
aggtttttgcttctccagtggt

SEQ ID NO: 1212414 - DNA, 21 bp, Homo sapiens
aggtttttttgtatagtaaag

SEQ ID NO: 1212415 - DNA, 22 bp, Homo sapiens
aggtttttttgtatagtaaagt

SEQ ID NO: 1212416 - DNA, 22 bp, Homo sapiens
aggtttttttgtcaacattgtg

SEQ ID NO: 1212417 - DNA, 16 bp, Homo sapiens
aggttttttttcagtt

SEQ ID NO: 1212418 - DNA, 20 bp, Homo sapiens
aggttttttttttaagtgca

SEQ ID NO: 1212419 - DNA, 21 bp, Homo sapiens
aggttttttttttaagtgcaa

SEQ ID NO: 1212420 - DNA, 18 bp, Homo sapiens
agtaaaaaattaaagccc

SEQ ID NO: 1212421 - DNA, 12 bp, Homo sapiens
agtaaaaacact

SEQ ID NO: 1212422 - DNA, 20 bp, Homo sapiens
agtaaaaattaaaaaatgaa

SEQ ID NO: 1212423 - DNA, 16 bp, Homo sapiens
agtaaaaccttgttct

SEQ ID NO: 1212424 - DNA, 17 bp, Homo sapiens
agtaaaaccttgttcta

SEQ ID NO: 1212425 - DNA, 20 bp, Homo sapiens
agtaaaaccttgttctattt

SEQ ID NO: 1212426 - DNA, 20 bp, Homo sapiens
agtaaaactctcaagcaggt

SEQ ID NO: 1212427 - DNA, 16 bp, Homo sapiens
agtaaaagcaaaaaag

SEQ ID NO: 1212428 - DNA, 22 bp, Homo sapiens
agtaaaagccttattctaaggt

SEQ ID NO: 1212429 - DNA, 18 bp, Homo sapiens
agtaaaagtggtctctgc

SEQ ID NO: 1212430 - DNA, 23 bp, Homo sapiens
agtaaaatgaacattttgtggag

SEQ ID NO: 1212431 - DNA, 16 bp, Homo sapiens
agtaaaattatactgt

SEQ ID NO: 1212432 - DNA, 21 bp, Homo sapiens
agtaaaattatactgtgtgtg

SEQ ID NO: 1212433 - DNA, 15 bp, Homo sapiens
agtaaaattgaagca

SEQ ID NO: 1212434 - DNA, 15 bp, Homo sapiens
agtaaaccactgaaa

SEQ ID NO: 1212435 - DNA, 17 bp, Homo sapiens
agtaaaccactgaaaaa

SEQ ID NO: 1212436 - DNA, 21 bp, Homo sapiens
agtaaaccatgtattccctta

SEQ ID NO: 1212437 - DNA, 14 bp, Homo sapiens
agtaaacgggaaca

SEQ ID NO: 1212438 - DNA, 14 bp, Homo sapiens
agtaaactatttat

SEQ ID NO: 1212439 - DNA, 16 bp, Homo sapiens
agtaaactatttatct

SEQ ID NO: 1212440 - DNA, 12 bp, Homo sapiens
agtaaacttgaa

SEQ ID NO: 1212441 - DNA, 13 bp, Homo sapiens
agtaaacttgaaa

SEQ ID NO: 1212442 - DNA, 14 bp, Homo sapiens
agtaaacttgaaaa

SEQ ID NO: 1212443 - DNA, 13 bp, Homo sapiens
agtaaagaaattt

SEQ ID NO: 1212444 - DNA, 14 bp, Homo sapiens
agtaaagctaaaat

SEQ ID NO: 1212445 - DNA, 22 bp, Homo sapiens
agtaaaggcctcatctccttta

SEQ ID NO: 1212446 - DNA, 18 bp, Homo sapiens
agtaaagtgttctgccag

SEQ ID NO: 1212447 - DNA, 14 bp, Homo sapiens
agtaaataatgaaa

SEQ ID NO: 1212448 - DNA, 17 bp, Homo sapiens
agtaaatacttgcagtt

SEQ ID NO: 1212449 - DNA, 18 bp, Homo sapiens
agtaaatacttgcagttg

SEQ ID NO: 1212450 - DNA, 18 bp, Homo sapiens
agtaaatatatatgtcaa

SEQ ID NO: 1212451 - DNA, 16 bp, Homo sapiens
agtaaatatattatat

SEQ ID NO: 1212452 - DNA, 13 bp, Homo sapiens
agtcctgctccag

SEQ ID NO: 1212453 - DNA, 22 bp, Homo sapiens
agtcctggaagccagctttccc

SEQ ID NO: 1212454 - DNA, 23 bp, Homo sapiens
agtcctggactcctgccaccagc

SEQ ID NO: 1212455 - DNA, 22 bp, Homo sapiens
agtcctggatgatactaataaa

SEQ ID NO: 1212456 - DNA, 18 bp, Homo sapiens
agtcctggatgttgtgtg

SEQ ID NO: 1212457 - DNA, 19 bp, Homo sapiens
agtcctggcagctggacca

SEQ ID NO: 1212458 - DNA, 22 bp, Homo sapiens
agtcctggcagctggaccatct

SEQ ID NO: 1212459 - DNA, 18 bp, Homo sapiens
agtcctggctacatccca

SEQ ID NO: 1212460 - DNA, 19 bp, Homo sapiens
agtcctggctacatcccag

SEQ ID NO: 1212461 - DNA, 21 bp, Homo sapiens
agtcctgggagaacctcaggc

SEQ ID NO: 1212462 - DNA, 12 bp, Homo sapiens
agtcctggtcct

SEQ ID NO: 1212463 - DNA, 14 bp, Homo sapiens
agtcctggtcctgg

SEQ ID NO: 1212464 - DNA, 11 bp, Homo sapiens
agtcctgtcac

SEQ ID NO: 1212465 - DNA, 16 bp, Homo sapiens
agtcctgtctcccact

SEQ ID NO: 1212466 - DNA, 23 bp, Homo sapiens
agtcctgtgaatttcttcactgt

SEQ ID NO: 1212467 - DNA, 13 bp, Homo sapiens
agtccttacctcg

SEQ ID NO: 1212468 - DNA, 14 bp, Homo sapiens
agtccttacctcgg

SEQ ID NO: 1212469 - DNA, 15 bp, Homo sapiens
agtccttacctcggg

SEQ ID NO: 1212470 - DNA, 20 bp, Homo sapiens
agtccttacctcggggagag

SEQ ID NO: 1212471 - DNA, 23 bp, Homo sapiens
agtccttatgttaagccctggca

SEQ ID NO: 1212472 - DNA, 18 bp, Homo sapiens
agtccttattatcccagc

SEQ ID NO: 1212473 - DNA, 15 bp, Homo sapiens
agtccttattcttct

SEQ ID NO: 1212474 - DNA, 14 bp, Homo sapiens
agtccttcctggca

SEQ ID NO: 1212475 - DNA, 16 bp, Homo sapiens
agtccttgaaaatatt

SEQ ID NO: 1212476 - DNA, 21 bp, Homo sapiens
agtcctttctgtgaagctaat

SEQ ID NO: 1212477 - DNA, 15 bp, Homo sapiens
agtcctttttccaat

SEQ ID NO: 1212478 - DNA, 19 bp, Homo sapiens
agtcctttttccaatgttt

SEQ ID NO: 1212479 - DNA, 21 bp, Homo sapiens
agtcctttttccaatgtttta

SEQ ID NO: 1212480 - DNA, 21 bp, Homo sapiens
agtcgagcactctaattagag

SEQ ID NO: 1212481 - DNA, 22 bp, Homo sapiens
agtcgcagaccagagctgtctg

SEQ ID NO: 1212482 - DNA, 18 bp, Homo sapiens
agtcgccagtcactgctg

SEQ ID NO: 1212483 - DNA, 23 bp, Homo sapiens
agtcgccagtcactgctgcaagg

SEQ ID NO: 1212484 - DNA, 24 bp, Homo sapiens
agtcgctggcatgtttcactcctg

SEQ ID NO: 1212485 - DNA, 15 bp, Homo sapiens
agtcggcatgccagg

SEQ ID NO: 1212486 - DNA, 18 bp, Homo sapiens
agtcggcatgccaggacc

SEQ ID NO: 1212487 - DNA, 14 bp, Homo sapiens
agtcggggcctggg

SEQ ID NO: 1212488 - DNA, 16 bp, Homo sapiens
agtcgggggctggcct

SEQ ID NO: 1212489 - DNA, 17 bp, Homo sapiens
agtcgggggctggccta

SEQ ID NO: 1212490 - DNA, 12 bp, Homo sapiens
agtcgtgcctgt

SEQ ID NO: 1212491 - DNA, 18 bp, Homo sapiens
agtcgtggggtgtgctgg

SEQ ID NO: 1212492 - DNA, 20 bp, Homo sapiens
agtcgtggggtgtgctggga

SEQ ID NO: 1212493 - DNA, 21 bp, Homo sapiens
agtcgtggggtgtgctgggag

SEQ ID NO: 1212494 - DNA, 16 bp, Homo sapiens
agtcgttatttctgtt

SEQ ID NO: 1212495 - DNA, 17 bp, Homo sapiens
agtctaaaaagacctgg

SEQ ID NO: 1212496 - DNA, 18 bp, Homo sapiens
agtctaaaaattgataga

SEQ ID NO: 1212497 - DNA, 16 bp, Homo sapiens
agtctaaatatttcct

SEQ ID NO: 1212498 - DNA, 17 bp, Homo sapiens
agtctaaatatttcctt

SEQ ID NO: 1212499 - DNA, 18 bp, Homo sapiens
agtctaaggccatggcat

SEQ ID NO: 1212500 - DNA, 17 bp, Homo sapiens
agtctacagttgtcctg

SEQ ID NO: 1212501 - DNA, 21 bp, Homo sapiens
agtctagatacagaagcccat

SEQ ID NO: 1212502 - DNA, 20 bp, Homo sapiens
agtctaggaatggagtctcc

SEQ ID NO: 1212503 - DNA, 18 bp, Homo sapiens
agtctaggagctgggagg

SEQ ID NO: 1212504 - DNA, 19 bp, Homo sapiens
agtctatctggtattaaat

SEQ ID NO: 1212505 - DNA, 14 bp, Homo sapiens
agtctattagccac

SEQ ID NO: 1212506 - DNA, 17 bp, Homo sapiens
agtctattcattaagta

SEQ ID NO: 1212507 - DNA, 18 bp, Homo sapiens
agtctatttccattcttt

SEQ ID NO: 1212508 - DNA, 11 bp, Homo sapiens
agtctattttt

SEQ ID NO: 1212509 - DNA, 21 bp, Homo sapiens
agtctcaacatgtgtttctga

SEQ ID NO: 1212510 - DNA, 16 bp, Homo sapiens
agtctcaagggtggca

SEQ ID NO: 1212511 - DNA, 16 bp, Homo sapiens
agtctcaatgaaatag

SEQ ID NO: 1212512 - DNA, 20 bp, Homo sapiens
agtctcactgcagtcttatt

SEQ ID NO: 1212513 - DNA, 18 bp, Homo sapiens
agtctcactgcttgaact

SEQ ID NO: 1212514 - DNA, 19 bp, Homo sapiens
agtctcactttgtcgccca

SEQ ID NO: 1212515 - DNA, 19 bp, Homo sapiens
agtctcagaatgtcatttt

SEQ ID NO: 1212516 - DNA, 19 bp, Homo sapiens
agtctcagagaccagcact

SEQ ID NO: 1212517 - DNA, 20 bp, Homo sapiens
agtctcagagaccagcactc

SEQ ID NO: 1212518 - DNA, 21 bp, Homo sapiens
agtctcagagaccagcactca

SEQ ID NO: 1212519 - DNA, 11 bp, Homo sapiens
agtctcagcta

SEQ ID NO: 1212520 - DNA, 17 bp, Homo sapiens
agtctcaggagcatggg

SEQ ID NO: 1212521 - DNA, 13 bp, Homo sapiens
agtctcaggagga

SEQ ID NO: 1212522 - DNA, 16 bp, Homo sapiens
agtctcaggaggaggc

SEQ ID NO: 1212523 - DNA, 18 bp, Homo sapiens
agtctcaggagtctctgg

SEQ ID NO: 1212524 - DNA, 18 bp, Homo sapiens
agtctcagttctcttgct

SEQ ID NO: 1212525 - DNA, 19 bp, Homo sapiens
agtctcataggttaaaaaa

SEQ ID NO: 1212526 - DNA, 20 bp, Homo sapiens
agtctcataggttaaaaaaa

SEQ ID NO: 1212527 - DNA, 23 bp, Homo sapiens
agtctccagggacccttgcctgc

SEQ ID NO: 1212528 - DNA, 19 bp, Homo sapiens
agtctcccaggccccctgc

SEQ ID NO: 1212529 - DNA, 18 bp, Homo sapiens
agtgaaaaaaagaaacga

SEQ ID NO: 1212530 - DNA, 17 bp, Homo sapiens
agtgaaaaaggaggaag

SEQ ID NO: 1212531 - DNA, 23 bp, Homo sapiens
agtgaaaaaggaggaagagaaaa

SEQ ID NO: 1212532 - DNA, 15 bp, Homo sapiens
agtgaaaacaaatct

SEQ ID NO: 1212533 - DNA, 14 bp, Homo sapiens
agtgaaaagatttt

SEQ ID NO: 1212534 - DNA, 17 bp, Homo sapiens
agtgaaaagattttatt

SEQ ID NO: 1212535 - DNA, 23 bp, Homo sapiens
agtgaaaattctgttggtgccac

SEQ ID NO: 1212536 - DNA, 12 bp, Homo sapiens
agtgaaacagag

SEQ ID NO: 1212537 - DNA, 21 bp, Homo sapiens
agtgaaacagagaaagaaaag

SEQ ID NO: 1212538 - DNA, 21 bp, Homo sapiens
agtgaaacctttagggcagct

SEQ ID NO: 1212539 - DNA, 15 bp, Homo sapiens
agtgaaacttttcta

SEQ ID NO: 1212540 - DNA, 19 bp, Homo sapiens
agtgaaagtgaggaaataa

SEQ ID NO: 1212541 - DNA, 20 bp, Homo sapiens
agtgaaattaagcattttga

SEQ ID NO: 1212542 - DNA, 15 bp, Homo sapiens
agtgaacattcccag

SEQ ID NO: 1212543 - DNA, 20 bp, Homo sapiens
agtgaacattcccagcccag

SEQ ID NO: 1212544 - DNA, 23 bp, Homo sapiens
agtgaaccaaagagactggagca

SEQ ID NO: 1212545 - DNA, 21 bp, Homo sapiens
agtgaactcctgccaggcaca

SEQ ID NO: 1212546 - DNA, 23 bp, Homo sapiens
agtgaacttacacttggagcccg

SEQ ID NO: 1212547 - DNA, 16 bp, Homo sapiens
agtgaacttgggccac

SEQ ID NO: 1212548 - DNA, 15 bp, Homo sapiens
agtgaacttttgtaa

SEQ ID NO: 1212549 - DNA, 21 bp, Homo sapiens
agtgaacttttgtaatttgaa

SEQ ID NO: 1212550 - DNA, 22 bp, Homo sapiens
agtgaacttttgtaatttgaat

SEQ ID NO: 1212551 - DNA, 14 bp, Homo sapiens
agtgaagaatactt

SEQ ID NO: 1212552 - DNA, 16 bp, Homo sapiens
agtgaagacttcttgg

SEQ ID NO: 1212553 - DNA, 14 bp, Homo sapiens
agtgaagaggggca

SEQ ID NO: 1212554 - DNA, 21 bp, Homo sapiens
agtgaagaggggcagcccttg

SEQ ID NO: 1212555 - DNA, 16 bp, Homo sapiens
agtgaagcagcactgt

SEQ ID NO: 1212556 - DNA, 12 bp, Homo sapiens
agtgaaggaaat

SEQ ID NO: 1212557 - DNA, 14 bp, Homo sapiens
agtgaaggaaataa

SEQ ID NO: 1212558 - DNA, 20 bp, Homo sapiens
agtgaaggagccacgtgaat

SEQ ID NO: 1212559 - DNA, 15 bp, Homo sapiens
agtgaaggtttacaa

SEQ ID NO: 1212560 - DNA, 18 bp, Homo sapiens
agtgaaggtttacaattt

SEQ ID NO: 1212561 - DNA, 22 bp, Homo sapiens
agtgaagtctagaatcatactt

SEQ ID NO: 1212562 - DNA, 13 bp, Homo sapiens
agtgaagtggcct

SEQ ID NO: 1212563 - DNA, 13 bp, Homo sapiens
agtgaataaatgt

SEQ ID NO: 1212564 - DNA, 14 bp, Homo sapiens
agtgaatattgctt

SEQ ID NO: 1212565 - DNA, 15 bp, Homo sapiens
agtgaatctttctcc

SEQ ID NO: 1212566 - DNA, 16 bp, Homo sapiens
agtgaatgattcagtg

SEQ ID NO: 1212567 - DNA, 17 bp, Homo sapiens
agtgaatgattcagtgt

SEQ ID NO: 1212568 - DNA, 14 bp, Homo sapiens
agtgaatgctggga

SEQ ID NO: 1212569 - DNA, 19 bp, Homo sapiens
agtgaatgctgggactcag

SEQ ID NO: 1212570 - DNA, 23 bp, Homo sapiens
agtgaatggcatttgctggttat

SEQ ID NO: 1212571 - DNA, 19 bp, Homo sapiens
agtgaattagacctttatt

SEQ ID NO: 1212572 - DNA, 12 bp, Homo sapiens
agtgaattgaag

SEQ ID NO: 1212573 - DNA, 23 bp, Homo sapiens
agtgaattgtacctatttctgat

SEQ ID NO: 1212574 - DNA, 21 bp, Homo sapiens
agtgaattgtgaccaagttat

SEQ ID NO: 1212575 - DNA, 14 bp, Homo sapiens
agtgaatttcagta

SEQ ID NO: 1212576 - DNA, 18 bp, Homo sapiens
agtgaatttctaaatgtt

SEQ ID NO: 1212577 - DNA, 13 bp, Homo sapiens
agtgaatttgaat

SEQ ID NO: 1212578 - DNA, 14 bp, Homo sapiens
agtgaatttgaatg

SEQ ID NO: 1212579 - DNA, 22 bp, Homo sapiens
agtgaatttgtccattgtaaat

SEQ ID NO: 1212580 - DNA, 17 bp, Homo sapiens
agtgaatttttctctaa

SEQ ID NO: 1212581 - DNA, 20 bp, Homo sapiens
agtgaatttttctctaactc

SEQ ID NO: 1212582 - DNA, 14 bp, Homo sapiens
agtgacaaaataga

SEQ ID NO: 1212583 - DNA, 21 bp, Homo sapiens
agtgacaaagactcctctggg

SEQ ID NO: 1212584 - DNA, 24 bp, Homo sapiens
agtgacaaataaattaggaccaag

SEQ ID NO: 1212585 - DNA, 15 bp, Homo sapiens
agtgacaaggcccca

SEQ ID NO: 1212586 - DNA, 18 bp, Homo sapiens
agtgacaagtgaagaaca

SEQ ID NO: 1212587 - DNA, 17 bp, Homo sapiens
agtgacaccaataaatg

SEQ ID NO: 1212588 - DNA, 21 bp, Homo sapiens
agtgacaccaataaatgtttg

SEQ ID NO: 1212589 - DNA, 16 bp, Homo sapiens
agtgacacccagaggg

SEQ ID NO: 1212590 - DNA, 17 bp, Homo sapiens
agtgacacccagaggga

SEQ ID NO: 1212591 - DNA, 21 bp, Homo sapiens
agtgacacttcagagagctgg

SEQ ID NO: 1212592 - DNA, 19 bp, Homo sapiens
agtgacagagttcactata

SEQ ID NO: 1212593 - DNA, 20 bp, Homo sapiens
agtgacagtggattgcattt

SEQ ID NO: 1212594 - DNA, 19 bp, Homo sapiens
agtgacagttgcagccctt

SEQ ID NO: 1212595 - DNA, 14 bp, Homo sapiens
agtgacatgcggct

SEQ ID NO: 1212596 - DNA, 15 bp, Homo sapiens
agtgaccagggaagt

SEQ ID NO: 1212597 - DNA, 18 bp, Homo sapiens
agtgaccctcagctgtca

SEQ ID NO: 1212598 - DNA, 22 bp, Homo sapiens
agtgaccctcagctgtcacctg

SEQ ID NO: 1212599 - DNA, 20 bp, Homo sapiens
agtgaccgattatgctttct

SEQ ID NO: 1212600 - DNA, 19 bp, Homo sapiens
agtgacctaaagcattttt

SEQ ID NO: 1212601 - DNA, 14 bp, Homo sapiens
agtgacctgtttat

SEQ ID NO: 1212602 - DNA, 19 bp, Homo sapiens
agtgacgaaaacattgtcc

SEQ ID NO: 1212603 - DNA, 21 bp, Homo sapiens
agtgactcagaacttctgcct

SEQ ID NO: 1212604 - DNA, 18 bp, Homo sapiens
agtgactctatatagctg

SEQ ID NO: 1212605 - DNA, 22 bp, Homo sapiens
agtgactctcctgcctcagcct

SEQ ID NO: 1212606 - DNA, 14 bp, Homo sapiens
agtgactgaccatg

SEQ ID NO: 1212607 - DNA, 18 bp, Homo sapiens
agtgactgaccatgcact

SEQ ID NO: 1212608 - DNA, 17 bp, Homo sapiens
agtgactggcaggtgca

SEQ ID NO: 1212609 - DNA, 22 bp, Homo sapiens
agtgactggcaggtgcagatgg

SEQ ID NO: 1212610 - DNA, 16 bp, Homo sapiens
agtgactgtaattaat

SEQ ID NO: 1212611 - DNA, 17 bp, Homo sapiens
agtgactgtatctgtgt

SEQ ID NO: 1212612 - DNA, 20 bp, Homo sapiens
agtgactgtatctgtgtaga

SEQ ID NO: 1212613 - DNA, 13 bp, Homo sapiens
agtgactgttgta

SEQ ID NO: 1212614 - DNA, 20 bp, Homo sapiens
agtgactgttgtagcatttt

SEQ ID NO: 1212615 - DNA, 19 bp, Homo sapiens
agtgacttattttgtctta

SEQ ID NO: 1212616 - DNA, 12 bp, Homo sapiens
agtgacttctga

SEQ ID NO: 1212617 - DNA, 17 bp, Homo sapiens
agtgacttctgagatct

SEQ ID NO: 1212618 - DNA, 13 bp, Homo sapiens
agtgacttctttt

SEQ ID NO: 1212619 - DNA, 16 bp, Homo sapiens
agtgacttgtgtccca

SEQ ID NO: 1212620 - DNA, 18 bp, Homo sapiens
agtgacttgtgtcccatg

SEQ ID NO: 1212621 - DNA, 17 bp, Homo sapiens
agtgacttgttctgagt

SEQ ID NO: 1212622 - DNA, 19 bp, Homo sapiens
agtgactttaaaagaaaat

SEQ ID NO: 1212623 - DNA, 17 bp, Homo sapiens
agtgactttacaggagg

SEQ ID NO: 1212624 - DNA, 13 bp, Homo sapiens
agtgactttgtat

SEQ ID NO: 1212625 - DNA, 19 bp, Homo sapiens
agtgactttttctgagctt

SEQ ID NO: 1212626 - DNA, 19 bp, Homo sapiens
agtgagaactctctccctg

SEQ ID NO: 1212627 - DNA, 18 bp, Homo sapiens
agtgagaagctgaggcct

SEQ ID NO: 1212628 - DNA, 14 bp, Homo sapiens
agtgagaagggcat

SEQ ID NO: 1212629 - DNA, 13 bp, Homo sapiens
agtgagacagaag

SEQ ID NO: 1212630 - DNA, 21 bp, Homo sapiens
agtgagaccctgtctcaaaaa

SEQ ID NO: 1212631 - DNA, 17 bp, Homo sapiens
agtgagaccctgtctct

SEQ ID NO: 1212632 - DNA, 15 bp, Homo sapiens
agtgagactgcccca

SEQ ID NO: 1212633 - DNA, 15 bp, Homo sapiens
agtgagagaggaggc

SEQ ID NO: 1212634 - DNA, 18 bp, Homo sapiens
agtgagagaggaggcctg

SEQ ID NO: 1212635 - DNA, 12 bp, Homo sapiens
agtgagagccag

SEQ ID NO: 1212636 - DNA, 16 bp, Homo sapiens
agtgagagccagcagc

SEQ ID NO: 1212637 - DNA, 13 bp, Homo sapiens
agtgagagccttt

SEQ ID NO: 1212638 - DNA, 19 bp, Homo sapiens
agtgagaggggagggaggg

SEQ ID NO: 1212639 - DNA, 23 bp, Homo sapiens
agtgagaggggagggctcctggg

SEQ ID NO: 1212640 - DNA, 22 bp, Homo sapiens
agtgagcaaaatatgccccttc

SEQ ID NO: 1212641 - DNA, 14 bp, Homo sapiens
agtgagcaaccagc

SEQ ID NO: 1212642 - DNA, 16 bp, Homo sapiens
agtgagcagaacaggt

SEQ ID NO: 1212643 - DNA, 22 bp, Homo sapiens
agtgagcagagatgtactgcaa

SEQ ID NO: 1212644 - DNA, 14 bp, Homo sapiens
agtgagcagctact

SEQ ID NO: 1212645 - DNA, 15 bp, Homo sapiens
agtgagcagggtggg

SEQ ID NO: 1212646 - DNA, 23 bp, Homo sapiens
agtgagcatatctggtatatgtc

SEQ ID NO: 1212647 - DNA, 21 bp, Homo sapiens
agtgagcatggaacacttcga

SEQ ID NO: 1212648 - DNA, 15 bp, Homo sapiens
agtgagcccccccct

SEQ ID NO: 1212649 - DNA, 18 bp, Homo sapiens
agtgagcccctccccagc

SEQ ID NO: 1212650 - DNA, 20 bp, Homo sapiens
agtgagccgcatcttctcca

SEQ ID NO: 1212651 - DNA, 20 bp, Homo sapiens
agtgccacttaatgtatgtt

SEQ ID NO: 1212652 - DNA, 19 bp, Homo sapiens
agtgccacttgacattcct

SEQ ID NO: 1212653 - DNA, 21 bp, Homo sapiens
agtgccacttgacattccttg

SEQ ID NO: 1212654 - DNA, 23 bp, Homo sapiens
agtgccacttgacattccttgtc

SEQ ID NO: 1212655 - DNA, 18 bp, Homo sapiens
agtgccagaggtgggcag

SEQ ID NO: 1212656 - DNA, 21 bp, Homo sapiens
agtgccagaggtgggcaggtg

SEQ ID NO: 1212657 - DNA, 14 bp, Homo sapiens
agtgccaggaccag

SEQ ID NO: 1212658 - DNA, 18 bp, Homo sapiens
agtgccaggaccagcctg

SEQ ID NO: 1212659 - DNA, 19 bp, Homo sapiens
agtgccaggaccagcctgt

SEQ ID NO: 1212660 - DNA, 13 bp, Homo sapiens
agtgccaggactc

SEQ ID NO: 1212661 - DNA, 23 bp, Homo sapiens
agtgccaggactccccaggccag

SEQ ID NO: 1212662 - DNA, 17 bp, Homo sapiens
agtgccaggtggctcag

SEQ ID NO: 1212663 - DNA, 13 bp, Homo sapiens
agtgccatgcttt

SEQ ID NO: 1212664 - DNA, 15 bp, Homo sapiens
agtgccatgtaaatc

SEQ ID NO: 1212665 - DNA, 17 bp, Homo sapiens
agtgccattactactgt

SEQ ID NO: 1212666 - DNA, 19 bp, Homo sapiens
agtgccattactactgtac

SEQ ID NO: 1212667 - DNA, 22 bp, Homo sapiens
agtgccattccactccactcag

SEQ ID NO: 1212668 - DNA, 14 bp, Homo sapiens
agtgcccaactgtt

SEQ ID NO: 1212669 - DNA, 15 bp, Homo sapiens
agtgcccaactgtta

SEQ ID NO: 1212670 - DNA, 17 bp, Homo sapiens
agtgcccaactgttata

SEQ ID NO: 1212671 - DNA, 17 bp, Homo sapiens
agtgcccacatttgatg

SEQ ID NO: 1212672 - DNA, 20 bp, Homo sapiens
agtgcccaccaacatcccat

SEQ ID NO: 1212673 - DNA, 15 bp, Homo sapiens
agtgcccaccgccct

SEQ ID NO: 1212674 - DNA, 19 bp, Homo sapiens
agtgcccaccgccctcctc

SEQ ID NO: 1212675 - DNA, 22 bp, Homo sapiens
agtgcccaccgccctcctccac

SEQ ID NO: 1212676 - DNA, 15 bp, Homo sapiens
agtgcccagcagagg

SEQ ID NO: 1212677 - DNA, 22 bp, Homo sapiens
agtgccccacctcccgccctca

SEQ ID NO: 1212678 - DNA, 21 bp, Homo sapiens
agtgccccagactgagctctc

SEQ ID NO: 1212679 - DNA, 12 bp, Homo sapiens
agtgcccctgct

SEQ ID NO: 1212680 - DNA, 19 bp, Homo sapiens
agtgcccctgctgcctccc

SEQ ID NO: 1212681 - DNA, 14 bp, Homo sapiens
agtgcccctgtccc

SEQ ID NO: 1212682 - DNA, 20 bp, Homo sapiens
agtgcccctgtcccacctgg

SEQ ID NO: 1212683 - DNA, 21 bp, Homo sapiens
agtgcccctgtcccacctggc

SEQ ID NO: 1212684 - DNA, 16 bp, Homo sapiens
agtgccctccacagcc

SEQ ID NO: 1212685 - DNA, 21 bp, Homo sapiens
agtgccctccacagccgcagc

SEQ ID NO: 1212686 - DNA, 15 bp, Homo sapiens
agtgccctccagccc

SEQ ID NO: 1212687 - DNA, 17 bp, Homo sapiens
agtgccctgcaggcaca

SEQ ID NO: 1212688 - DNA, 18 bp, Homo sapiens
agtgccctgcaggcacag

SEQ ID NO: 1212689 - DNA, 22 bp, Homo sapiens
agtgccctgcaggcacagagga

SEQ ID NO: 1212690 - DNA, 20 bp, Homo sapiens
agtgccgaatgactatgtcc

SEQ ID NO: 1212691 - DNA, 13 bp, Homo sapiens
agtgccgctcctg

SEQ ID NO: 1212692 - DNA, 13 bp, Homo sapiens
agtgccggctgtg

SEQ ID NO: 1212693 - DNA, 14 bp, Homo sapiens
agtgccggctgtgg

SEQ ID NO: 1212694 - DNA, 22 bp, Homo sapiens
agtgccgtagggagtacctgct

SEQ ID NO: 1212695 - DNA, 14 bp, Homo sapiens
agtgcctattgata

SEQ ID NO: 1212696 - DNA, 13 bp, Homo sapiens
agtgcctcctggc

SEQ ID NO: 1212697 - DNA, 14 bp, Homo sapiens
agtgcctcgaggca

SEQ ID NO: 1212698 - DNA, 17 bp, Homo sapiens
agtgcctcgaggcaccg

SEQ ID NO: 1212699 - DNA, 14 bp, Homo sapiens
agtgcctcttccag

SEQ ID NO: 1212700 - DNA, 14 bp, Homo sapiens
agtgcctctttgaa

SEQ ID NO: 1212701 - DNA, 12 bp, Homo sapiens
agtgcctgagct

SEQ ID NO: 1212702 - DNA, 12 bp, Homo sapiens
agtgcctgccac

SEQ ID NO: 1212703 - DNA, 13 bp, Homo sapiens
agtgcctgccact

SEQ ID NO: 1212704 - DNA, 18 bp, Homo sapiens
agtgcctgccactctctg

SEQ ID NO: 1212705 - DNA, 13 bp, Homo sapiens
agtgcctgctttt

SEQ ID NO: 1212706 - DNA, 12 bp, Homo sapiens
agtgcctgggaa

SEQ ID NO: 1212707 - DNA, 15 bp, Homo sapiens
agtgcctgggaagcc

SEQ ID NO: 1212708 - DNA, 18 bp, Homo sapiens
agtgcctgggaatgtatt

SEQ ID NO: 1212709 - DNA, 22 bp, Homo sapiens
agtgcctgggaatgtattattc

SEQ ID NO: 1212710 - DNA, 18 bp, Homo sapiens
agtgcctggtgttctgaa

SEQ ID NO: 1212711 - DNA, 21 bp, Homo sapiens
agtgcctgtacaggaaggtgc

SEQ ID NO: 1212712 - DNA, 19 bp, Homo sapiens
agtgccttacctcctgccc

SEQ ID NO: 1212713 - DNA, 20 bp, Homo sapiens
agtgccttacctcctgccca

SEQ ID NO: 1212714 - DNA, 21 bp, Homo sapiens
agtgccttacctcctgcccag

SEQ ID NO: 1212715 - DNA, 16 bp, Homo sapiens
agtgccttctgggctt

SEQ ID NO: 1212716 - DNA, 20 bp, Homo sapiens
agtgccttctttagaccctc

SEQ ID NO: 1212717 - DNA, 16 bp, Homo sapiens
agtgcctttagagggt

SEQ ID NO: 1212718 - DNA, 18 bp, Homo sapiens
agtgcctttatctcagcc

SEQ ID NO: 1212719 - DNA, 23 bp, Homo sapiens
agtgccttttggtttcaccttcc

SEQ ID NO: 1212720 - DNA, 20 bp, Homo sapiens
agtgcgcagatctgtgcctg

SEQ ID NO: 1212721 - DNA, 22 bp, Homo sapiens
agtgcgcagatctgtgcctggg

SEQ ID NO: 1212722 - DNA, 19 bp, Homo sapiens
agtgcgctcttggtccctg

SEQ ID NO: 1212723 - DNA, 22 bp, Homo sapiens
agtgcggacccttcccagccct

SEQ ID NO: 1212724 - DNA, 19 bp, Homo sapiens
agtgcgggctgaggccaga

SEQ ID NO: 1212725 - DNA, 15 bp, Homo sapiens
agtgcgttctcccag

SEQ ID NO: 1212726 - DNA, 22 bp, Homo sapiens
agtgctaaacaagtaagaaaaa

SEQ ID NO: 1212727 - DNA, 20 bp, Homo sapiens
agtgctaaagttttcttccc

SEQ ID NO: 1212728 - DNA, 13 bp, Homo sapiens
agtgctagaaaat

SEQ ID NO: 1212729 - DNA, 22 bp, Homo sapiens
agtgctatgcggaggaaagcaa

SEQ ID NO: 1212730 - DNA, 15 bp, Homo sapiens
agtgctattctgtgt

SEQ ID NO: 1212731 - DNA, 16 bp, Homo sapiens
agtgctattctgtgtt

SEQ ID NO: 1212732 - DNA, 23 bp, Homo sapiens
agtgctattctgtgttgaacaca

SEQ ID NO: 1212733 - DNA, 15 bp, Homo sapiens
agtgctcaccagccc

SEQ ID NO: 1212734 - DNA, 15 bp, Homo sapiens
agtgctcagtgaagt

SEQ ID NO: 1212735 - DNA, 23 bp, Homo sapiens
agtgctcgagtcacattctgctt

SEQ ID NO: 1212736 - DNA, 14 bp, Homo sapiens
agtgctctcagctg

SEQ ID NO: 1212737 - DNA, 17 bp, Homo sapiens
agtgctctgaccctggg

SEQ ID NO: 1212738 - DNA, 17 bp, Homo sapiens
agtgctctgcctcagac

SEQ ID NO: 1212739 - DNA, 19 bp, Homo sapiens
agtgctcttggctgacccc

SEQ ID NO: 1212740 - DNA, 14 bp, Homo sapiens
agtgctcttttctc

SEQ ID NO: 1212741 - DNA, 17 bp, Homo sapiens
agtgctcttttctcctc

SEQ ID NO: 1212742 - DNA, 18 bp, Homo sapiens
agtgctgaggggcactct

SEQ ID NO: 1212743 - DNA, 15 bp, Homo sapiens
agtgctgatccggct

SEQ ID NO: 1212744 - DNA, 19 bp, Homo sapiens
agtgctgatccggctgctc

SEQ ID NO: 1212745 - DNA, 23 bp, Homo sapiens
agtgctgcagccaaagacagagc

SEQ ID NO: 1212746 - DNA, 12 bp, Homo sapiens
agtgctgcattt

SEQ ID NO: 1212747 - DNA, 13 bp, Homo sapiens
agtgctgcattta

SEQ ID NO: 1212748 - DNA, 16 bp, Homo sapiens
agtgctgcatttaaaa

SEQ ID NO: 1212749 - DNA, 15 bp, Homo sapiens
agtgctgccatgcca

SEQ ID NO: 1212750 - DNA, 16 bp, Homo sapiens
agtgctgccatgccac

SEQ ID NO: 1212751 - DNA, 17 bp, Homo sapiens
agtgctgccatgccact

SEQ ID NO: 1212752 - DNA, 22 bp, Homo sapiens
agtgctgccatgccactgccag

SEQ ID NO: 1212753 - DNA, 23 bp, Homo sapiens
agtgctgccatgccactgccagg

SEQ ID NO: 1212754 - DNA, 12 bp, Homo sapiens
agtgctgcccct

SEQ ID NO: 1212755 - DNA, 15 bp, Homo sapiens
agtgctgccccttgc

SEQ ID NO: 1212756 - DNA, 17 bp, Homo sapiens
agtgctgccccttgcaa

SEQ ID NO: 1212757 - DNA, 20 bp, Homo sapiens
agtgctgccccttgcaagcc

SEQ ID NO: 1212758 - DNA, 24 bp, Homo sapiens
agtgctgccccttgcaagccataa

SEQ ID NO: 1212759 - DNA, 13 bp, Homo sapiens
agtgctgctgtaa

SEQ ID NO: 1212760 - DNA, 15 bp, Homo sapiens
agtgctgcttctctt

SEQ ID NO: 1212761 - DNA, 19 bp, Homo sapiens
agtgctgcttctcttggga

SEQ ID NO: 1212762 - DNA, 18 bp, Homo sapiens
agtgctggaagggaggaa

SEQ ID NO: 1212763 - DNA, 15 bp, Homo sapiens
agtgctggctcacag

SEQ ID NO: 1212764 - DNA, 17 bp, Homo sapiens
agtgctggctcacagta

SEQ ID NO: 1212765 - DNA, 18 bp, Homo sapiens
agtgctggctcacagtac

SEQ ID NO: 1212766 - DNA, 20 bp, Homo sapiens
agtgctgggatgacaggtgt

SEQ ID NO: 1212767 - DNA, 22 bp, Homo sapiens
agtgctgggatggaggggagtg

SEQ ID NO: 1212768 - DNA, 18 bp, Homo sapiens
agtgctgggattacaggc

SEQ ID NO: 1212769 - DNA, 19 bp, Homo sapiens
agtgctgggattacaggct

SEQ ID NO: 1212770 - DNA, 13 bp, Homo sapiens
agtgctgggcact

SEQ ID NO: 1212771 - DNA, 16 bp, Homo sapiens
agtgctgggcactgct

SEQ ID NO: 1212772 - DNA, 19 bp, Homo sapiens
agtgctgggcactgctcca

SEQ ID NO: 1212773 - DNA, 22 bp, Homo sapiens
agtgctggtcagagagacctca

SEQ ID NO: 1212774 - DNA, 23 bp, Homo sapiens
agtgctggtcagagagacctcat

SEQ ID NO: 1212775 - DNA, 17 bp, Homo sapiens
agtgctggtcctaggtc

SEQ ID NO: 1212776 - DNA, 13 bp, Homo sapiens
agtgctgtaatat

SEQ ID NO: 1212777 - DNA, 16 bp, Homo sapiens
agtgctgtacccttcc

SEQ ID NO: 1212778 - DNA, 20 bp, Homo sapiens
agtgctgtcgggaccacatc

SEQ ID NO: 1212779 - DNA, 23 bp, Homo sapiens
agtgctgtcttaaactaaatgtg

SEQ ID NO: 1212780 - DNA, 17 bp, Homo sapiens
agtgctgtggcctgggc

SEQ ID NO: 1212781 - DNA, 19 bp, Homo sapiens
agtgcttaaaaatcattga

SEQ ID NO: 1212782 - DNA, 14 bp, Homo sapiens
agtgcttaacattt

SEQ ID NO: 1212783 - DNA, 13 bp, Homo sapiens
agtgcttcacatt

SEQ ID NO: 1212784 - DNA, 18 bp, Homo sapiens
agtgcttcagagtttgtg

SEQ ID NO: 1212785 - DNA, 14 bp, Homo sapiens
agtgcttgcttttt

SEQ ID NO: 1212786 - DNA, 14 bp, Homo sapiens
agtgcttgggctcc

SEQ ID NO: 1212787 - DNA, 18 bp, Homo sapiens
agtgcttgttagagagaa

SEQ ID NO: 1212788 - DNA, 20 bp, Homo sapiens
agtgcttgttagagagaaag

SEQ ID NO: 1212789 - DNA, 13 bp, Homo sapiens
agtgctttaatgg

SEQ ID NO: 1212790 - DNA, 21 bp, Homo sapiens
agtgctttacctaagtgttga

SEQ ID NO: 1212791 - DNA, 23 bp, Homo sapiens
agtgctttacctaagtgttgatt

SEQ ID NO: 1212792 - DNA, 16 bp, Homo sapiens
agtgctttgcatgtat

SEQ ID NO: 1212793 - DNA, 21 bp, Homo sapiens
agtgcttttcactactttgta

SEQ ID NO: 1212794 - DNA, 19 bp, Homo sapiens
agtggaaaaatagcctgcc

SEQ ID NO: 1212795 - DNA, 13 bp, Homo sapiens
agtggaaaacaaa

SEQ ID NO: 1212796 - DNA, 14 bp, Homo sapiens
agtggaaaacaaag

SEQ ID NO: 1212797 - DNA, 12 bp, Homo sapiens
agtggaaaacat

SEQ ID NO: 1212798 - DNA, 14 bp, Homo sapiens
agtggaaagtcctg

SEQ ID NO: 1212799 - DNA, 21 bp, Homo sapiens
agtggaacagtcacccttctg

SEQ ID NO: 1212800 - DNA, 13 bp, Homo sapiens
agtggaagagcag

SEQ ID NO: 1212801 - DNA, 17 bp, Homo sapiens
agtggaagagcagcctg

SEQ ID NO: 1212802 - DNA, 22 bp, Homo sapiens
agtggaagagcagcctgatggc

SEQ ID NO: 1212803 - DNA, 15 bp, Homo sapiens
agtggaagggaggag

SEQ ID NO: 1212804 - DNA, 21 bp, Homo sapiens
agtggaaggtctattggccaa

SEQ ID NO: 1212805 - DNA, 20 bp, Homo sapiens
agtggaagtatgtatattaa

SEQ ID NO: 1212806 - DNA, 21 bp, Homo sapiens
agtggaagtatgtatattaaa

SEQ ID NO: 1212807 - DNA, 22 bp, Homo sapiens
agtggaagtatgtatattaaaa

SEQ ID NO: 1212808 - DNA, 14 bp, Homo sapiens
agtggaataagaca

SEQ ID NO: 1212809 - DNA, 19 bp, Homo sapiens
agtggaatagtgaatactt

SEQ ID NO: 1212810 - DNA, 22 bp, Homo sapiens
agtggaatagtgaatacttact

SEQ ID NO: 1212811 - DNA, 19 bp, Homo sapiens
agtggaatgcagggaagag

SEQ ID NO: 1212812 - DNA, 20 bp, Homo sapiens
agtggaatgcagggaagagg

SEQ ID NO: 1212813 - DNA, 22 bp, Homo sapiens
agtggaattagagggccttgct

SEQ ID NO: 1212814 - DNA, 24 bp, Homo sapiens
agtggaattccaacttgaaggatt

SEQ ID NO: 1212815 - DNA, 21 bp, Homo sapiens
agtggacaccgctcagtatta

SEQ ID NO: 1212816 - DNA, 17 bp, Homo sapiens
agtggaccctgtggcca

SEQ ID NO: 1212817 - DNA, 17 bp, Homo sapiens
agtggacctagcctgga

SEQ ID NO: 1212818 - DNA, 19 bp, Homo sapiens
agtggaccttaggccttcc

SEQ ID NO: 1212819 - DNA, 17 bp, Homo sapiens
agtggacggaggtcccc

SEQ ID NO: 1212820 - DNA, 14 bp, Homo sapiens
agtggactcagcag

SEQ ID NO: 1212821 - DNA, 19 bp, Homo sapiens
agtggactttccaccccct

SEQ ID NO: 1212822 - DNA, 12 bp, Homo sapiens
agtggagaggga

SEQ ID NO: 1212823 - DNA, 16 bp, Homo sapiens
agtggagcagccagca

SEQ ID NO: 1212824 - DNA, 12 bp, Homo sapiens
agtggagccagg

SEQ ID NO: 1212825 - DNA, 12 bp, Homo sapiens
agtggagctggg

SEQ ID NO: 1212826 - DNA, 13 bp, Homo sapiens
agtggagctggga

SEQ ID NO: 1212827 - DNA, 16 bp, Homo sapiens
agtggagctgggaggt

SEQ ID NO: 1212828 - DNA, 13 bp, Homo sapiens
agtggagctggtc

SEQ ID NO: 1212829 - DNA, 14 bp, Homo sapiens
agtggaggaagccc

SEQ ID NO: 1212830 - DNA, 17 bp, Homo sapiens
agtggaggattatcagt

SEQ ID NO: 1212831 - DNA, 19 bp, Homo sapiens
agtggagggttgagatgta

SEQ ID NO: 1212832 - DNA, 22 bp, Homo sapiens
agtggagggttgagatgtagag

SEQ ID NO: 1212833 - DNA, 23 bp, Homo sapiens
agtggagggttgagatgtagagt

SEQ ID NO: 1212834 - DNA, 23 bp, Homo sapiens
agtggaggtgggctgggccctct

SEQ ID NO: 1212835 - DNA, 21 bp, Homo sapiens
agtggaggttgagtgagccgg

SEQ ID NO: 1212836 - DNA, 19 bp, Homo sapiens
agtggagttgaaactgcta

SEQ ID NO: 1212837 - DNA, 16 bp, Homo sapiens
agtggatcacaaagtg

SEQ ID NO: 1212838 - DNA, 23 bp, Homo sapiens
agttacagcgagaggcagagaaa

SEQ ID NO: 1212839 - DNA, 13 bp, Homo sapiens
agttacagttctg

SEQ ID NO: 1212840 - DNA, 16 bp, Homo sapiens
agttacattaatgtta

SEQ ID NO: 1212841 - DNA, 16 bp, Homo sapiens
agttaccagtgcctta

SEQ ID NO: 1212842 - DNA, 23 bp, Homo sapiens
agttacccaaaatctgattagaa

SEQ ID NO: 1212843 - DNA, 20 bp, Homo sapiens
agttaccctgatctggaccc

SEQ ID NO: 1212844 - DNA, 21 bp, Homo sapiens
agttaccgagacatgaatact

SEQ ID NO: 1212845 - DNA, 17 bp, Homo sapiens
agttaccttatagttac

SEQ ID NO: 1212846 - DNA, 20 bp, Homo sapiens
agttaccttatagttactgt

SEQ ID NO: 1212847 - DNA, 23 bp, Homo sapiens
agttactactgattttaaaatga

SEQ ID NO: 1212848 - DNA, 17 bp, Homo sapiens
agttactaggtaacttc

SEQ ID NO: 1212849 - DNA, 13 bp, Homo sapiens
agttactcagccc

SEQ ID NO: 1212850 - DNA, 14 bp, Homo sapiens
agttactcagccct

SEQ ID NO: 1212851 - DNA, 15 bp, Homo sapiens
agttactcagccctg

SEQ ID NO: 1212852 - DNA, 17 bp, Homo sapiens
agttactcagccctggg

SEQ ID NO: 1212853 - DNA, 18 bp, Homo sapiens
agttactcagccctgggc

SEQ ID NO: 1212854 - DNA, 15 bp, Homo sapiens
agttactctgaaggg

SEQ ID NO: 1212855 - DNA, 21 bp, Homo sapiens
agttactgccggtttgaaaat

SEQ ID NO: 1212856 - DNA, 11 bp, Homo sapiens
agttactgtgt

SEQ ID NO: 1212857 - DNA, 14 bp, Homo sapiens
agttactgtgtaat

SEQ ID NO: 1212858 - DNA, 16 bp, Homo sapiens
agttactgtgtaatta

SEQ ID NO: 1212859 - DNA, 15 bp, Homo sapiens
agttacttagaatgc

SEQ ID NO: 1212860 - DNA, 16 bp, Homo sapiens
agttacttatgattta

SEQ ID NO: 1212861 - DNA, 15 bp, Homo sapiens
agttacttcctatca

SEQ ID NO: 1212862 - DNA, 17 bp, Homo sapiens
agttacttgtctgaggc

SEQ ID NO: 1212863 - DNA, 18 bp, Homo sapiens
agttacttgtctgaggcc

SEQ ID NO: 1212864 - DNA, 13 bp, Homo sapiens
agttactttagat

SEQ ID NO: 1212865 - DNA, 20 bp, Homo sapiens
agttactttatgtttgtctt

SEQ ID NO: 1212866 - DNA, 22 bp, Homo sapiens
agttagattattgaaatattat

SEQ ID NO: 1212867 - DNA, 19 bp, Homo sapiens
agttagcagggatgttcct

SEQ ID NO: 1212868 - DNA, 20 bp, Homo sapiens
agttagcagggatgttcctt

SEQ ID NO: 1212869 - DNA, 14 bp, Homo sapiens
agttagctcaggag

SEQ ID NO: 1212870 - DNA, 22 bp, Homo sapiens
agttagctcaggaggcttggaa

SEQ ID NO: 1212871 - DNA, 17 bp, Homo sapiens
agttaggaaataaaacc

SEQ ID NO: 1212872 - DNA, 20 bp, Homo sapiens
agttaggaaataaaaccttt

SEQ ID NO: 1212873 - DNA, 21 bp, Homo sapiens
agttaggaaataaaacctttc

SEQ ID NO: 1212874 - DNA, 22 bp, Homo sapiens
agttaggaaataaaacctttca

SEQ ID NO: 1212875 - DNA, 18 bp, Homo sapiens
agttaggatagcattttt

SEQ ID NO: 1212876 - DNA, 23 bp, Homo sapiens
agttaggatattgatttaaaatt

SEQ ID NO: 1212877 - DNA, 16 bp, Homo sapiens
agttagggttttgcaa

SEQ ID NO: 1212878 - DNA, 22 bp, Homo sapiens
agttaggttgtctccaggccat

SEQ ID NO: 1212879 - DNA, 17 bp, Homo sapiens
agttagtagcatgttga

SEQ ID NO: 1212880 - DNA, 14 bp, Homo sapiens
agttagtggaaatc

SEQ ID NO: 1212881 - DNA, 20 bp, Homo sapiens
agttagtggattactgccat

SEQ ID NO: 1212882 - DNA, 19 bp, Homo sapiens
agttagttccactgagacc

SEQ ID NO: 1212883 - DNA, 16 bp, Homo sapiens
agttagtttctttggg

SEQ ID NO: 1212884 - DNA, 17 bp, Homo sapiens
agttagtttctttggga

SEQ ID NO: 1212885 - DNA, 19 bp, Homo sapiens
agttataaaactatgtgtt

SEQ ID NO: 1212886 - DNA, 14 bp, Homo sapiens
agttataaaattaa

SEQ ID NO: 1212887 - DNA, 20 bp, Homo sapiens
agttataaaattaaaagttt

SEQ ID NO: 1212888 - DNA, 18 bp, Homo sapiens
agttataagcgtatttag

SEQ ID NO: 1212889 - DNA, 19 bp, Homo sapiens
agttataataactgaactg

SEQ ID NO: 1212890 - DNA, 20 bp, Homo sapiens
agttatacagttataaaatt

SEQ ID NO: 1212891 - DNA, 21 bp, Homo sapiens
agttatacagttataaaatta

SEQ ID NO: 1212892 - DNA, 20 bp, Homo sapiens
agttatacttatttgtatat

SEQ ID NO: 1212893 - DNA, 19 bp, Homo sapiens
agttatagatgtctaggta

SEQ ID NO: 1212894 - DNA, 19 bp, Homo sapiens
agttatagtatatctggac

SEQ ID NO: 1212895 - DNA, 14 bp, Homo sapiens
agttatagtgaata

SEQ ID NO: 1212896 - DNA, 23 bp, Homo sapiens
agttatagtgaatactgctacag

SEQ ID NO: 1212897 - DNA, 17 bp, Homo sapiens
agttatagtgtttaact

SEQ ID NO: 1212898 - DNA, 19 bp, Homo sapiens
agttatagtgtttaactgg

SEQ ID NO: 1212899 - DNA, 13 bp, Homo sapiens
agttatagtttca

SEQ ID NO: 1212900 - DNA, 13 bp, Homo sapiens
agttatatgtaca

SEQ ID NO: 1212901 - DNA, 17 bp, Homo sapiens
agttatatgtacagttt

SEQ ID NO: 1212902 - DNA, 22 bp, Homo sapiens
agttatatttcagatgtaatgt

SEQ ID NO: 1212903 - DNA, 17 bp, Homo sapiens
agttatcaaaaagtatt

SEQ ID NO: 1212904 - DNA, 14 bp, Homo sapiens
agttatcaggtgca

SEQ ID NO: 1212905 - DNA, 18 bp, Homo sapiens
agttatcatctcaccaca

SEQ ID NO: 1212906 - DNA, 15 bp, Homo sapiens
agttatcatgaattt

SEQ ID NO: 1212907 - DNA, 16 bp, Homo sapiens
agttatcatgaatttt

SEQ ID NO: 1212908 - DNA, 20 bp, Homo sapiens
agttatcatgaattttaaag

SEQ ID NO: 1212909 - DNA, 16 bp, Homo sapiens
agttatcctttgtgag

SEQ ID NO: 1212910 - DNA, 22 bp, Homo sapiens
agttatcctttgtgagcctatg

SEQ ID NO: 1212911 - DNA, 15 bp, Homo sapiens
agttatcttctttat

SEQ ID NO: 1212912 - DNA, 21 bp, Homo sapiens
agttatcttctttattattcc

SEQ ID NO: 1212913 - DNA, 14 bp, Homo sapiens
agttatgatgtaat

SEQ ID NO: 1212914 - DNA, 18 bp, Homo sapiens
agttatggtgatgactta

SEQ ID NO: 1212915 - DNA, 13 bp, Homo sapiens
agttatgtgaatg

SEQ ID NO: 1212916 - DNA, 23 bp, Homo sapiens
agttatgtgggtggcttctagtt

SEQ ID NO: 1212917 - DNA, 23 bp, Homo sapiens
agttattaacgggcatgtattat

SEQ ID NO: 1212918 - DNA, 21 bp, Homo sapiens
agttattaagaggtaagactt

SEQ ID NO: 1212919 - DNA, 22 bp, Homo sapiens
agttattaatttttaaggatgt

SEQ ID NO: 1212920 - DNA, 15 bp, Homo sapiens
agttattcaaatgaa

SEQ ID NO: 1212921 - DNA, 20 bp, Homo sapiens
agttattcttggtactgttg

SEQ ID NO: 1212922 - DNA, 17 bp, Homo sapiens
agttattgaatcttaat

SEQ ID NO: 1212923 - DNA, 21 bp, Homo sapiens
agttattgaatcttaattttt

SEQ ID NO: 1212924 - DNA, 18 bp, Homo sapiens
agttattgcagtttatca

SEQ ID NO: 1212925 - DNA, 12 bp, Homo sapiens
agttatttaaat

SEQ ID NO: 1212926 - DNA, 14 bp, Homo sapiens
agttatttactttt

SEQ ID NO: 1212927 - DNA, 14 bp, Homo sapiens
agttatttccaagt

SEQ ID NO: 1212928 - DNA, 17 bp, Homo sapiens
agttattttatttgctt

SEQ ID NO: 1212929 - DNA, 16 bp, Homo sapiens
agttattttcttgttt

SEQ ID NO: 1212930 - DNA, 18 bp, Homo sapiens
agttattttcttgtttaa

SEQ ID NO: 1212931 - DNA, 13 bp, Homo sapiens
agttcaaagtgta

SEQ ID NO: 1212932 - DNA, 14 bp, Homo sapiens
agttcaaagtgtat

SEQ ID NO: 1212933 - DNA, 21 bp, Homo sapiens
agttcaaagtgtatatttatt

SEQ ID NO: 1212934 - DNA, 21 bp, Homo sapiens
agttcaaatgatgaagaccaa

SEQ ID NO: 1212935 - DNA, 20 bp, Homo sapiens
agttcaacctggtggcacca

SEQ ID NO: 1212936 - DNA, 21 bp, Homo sapiens
agttcaacctggtggcaccag

SEQ ID NO: 1212937 - DNA, 22 bp, Homo sapiens
agttcaacctggtggcaccaga

SEQ ID NO: 1212938 - DNA, 16 bp, Homo sapiens
agttcaagcctgtggg

SEQ ID NO: 1212939 - DNA, 22 bp, Homo sapiens
agttcaagcctgtgggagtaga

SEQ ID NO: 1212940 - DNA, 22 bp, Homo sapiens
agttcaatactcttgaaatgta

SEQ ID NO: 1212941 - DNA, 22 bp, Homo sapiens
agttcaatctcccgctgctgct

SEQ ID NO: 1212942 - DNA, 18 bp, Homo sapiens
agttcacattagaattag

SEQ ID NO: 1212943 - DNA, 22 bp, Homo sapiens
agttcactgttgtacacagtct

SEQ ID NO: 1212944 - DNA, 17 bp, Homo sapiens
agttcagaaggtgtgtc

SEQ ID NO: 1212945 - DNA, 13 bp, Homo sapiens
agttcagatctta

SEQ ID NO: 1212946 - DNA, 16 bp, Homo sapiens
agttcagatcttaata

SEQ ID NO: 1212947 - DNA, 15 bp, Homo sapiens
agttcagccaccctg

SEQ ID NO: 1212948 - DNA, 16 bp, Homo sapiens
agttcagctgcttctc

SEQ ID NO: 1212949 - DNA, 16 bp, Homo sapiens
agttcaggagtcccaa

SEQ ID NO: 1212950 - DNA, 19 bp, Homo sapiens
agttcaggagtcccaagga

SEQ ID NO: 1212951 - DNA, 20 bp, Homo sapiens
agttcaggagtcccaaggaa

SEQ ID NO: 1212952 - DNA, 16 bp, Homo sapiens
agttcaggctctgaga

SEQ ID NO: 1212953 - DNA, 13 bp, Homo sapiens
agttcagggaccg

SEQ ID NO: 1212954 - DNA, 16 bp, Homo sapiens
agttcagtagaattac

SEQ ID NO: 1212955 - DNA, 13 bp, Homo sapiens
agttcagtagatt

SEQ ID NO: 1212956 - DNA, 13 bp, Homo sapiens
agttcatatatac

SEQ ID NO: 1212957 - DNA, 18 bp, Homo sapiens
agttcatatgtaccatgt

SEQ ID NO: 1212958 - DNA, 19 bp, Homo sapiens
agttcatattccatattta

SEQ ID NO: 1212959 - DNA, 20 bp, Homo sapiens
agttgttttatcttttaagt

SEQ ID NO: 1212960 - DNA, 19 bp, Homo sapiens
agttgttttcagactcaga

SEQ ID NO: 1212961 - DNA, 13 bp, Homo sapiens
agtttaaaagcca

SEQ ID NO: 1212962 - DNA, 12 bp, Homo sapiens
agtttaaagcaa

SEQ ID NO: 1212963 - DNA, 14 bp, Homo sapiens
agtttaagtctcct

SEQ ID NO: 1212964 - DNA, 15 bp, Homo sapiens
agtttaatacaggaa

SEQ ID NO: 1212965 - DNA, 17 bp, Homo sapiens
agtttaatacaggaaat

SEQ ID NO: 1212966 - DNA, 22 bp, Homo sapiens
agtttaatccttctagtttccc

SEQ ID NO: 1212967 - DNA, 14 bp, Homo sapiens
agtttacaacttga

SEQ ID NO: 1212968 - DNA, 23 bp, Homo sapiens
agtttacaagtgtatatcagaaa

SEQ ID NO: 1212969 - DNA, 15 bp, Homo sapiens
agtttacagatgttt

SEQ ID NO: 1212970 - DNA, 16 bp, Homo sapiens
agtttaccatttgtaa

SEQ ID NO: 1212971 - DNA, 22 bp, Homo sapiens
agtttaccatttgtaataaagt

SEQ ID NO: 1212972 - DNA, 16 bp, Homo sapiens
agtttacctctttaaa

SEQ ID NO: 1212973 - DNA, 20 bp, Homo sapiens
agtttacctctttaaaaaca

SEQ ID NO: 1212974 - DNA, 18 bp, Homo sapiens
agtttacctggcttattt

SEQ ID NO: 1212975 - DNA, 23 bp, Homo sapiens
agtttactttttttctgatgttt

SEQ ID NO: 1212976 - DNA, 14 bp, Homo sapiens
agtttagaggaaaa

SEQ ID NO: 1212977 - DNA, 18 bp, Homo sapiens
agtttagccctgaacatt

SEQ ID NO: 1212978 - DNA, 13 bp, Homo sapiens
agtttaggagaaa

SEQ ID NO: 1212979 - DNA, 23 bp, Homo sapiens
agtttagggaacaatttggcaat

SEQ ID NO: 1212980 - DNA, 24 bp, Homo sapiens
agtttagggaacaatttggcaatt

SEQ ID NO: 1212981 - DNA, 15 bp, Homo sapiens
agtttagttctgttg

SEQ ID NO: 1212982 - DNA, 19 bp, Homo sapiens
agtttagttctgttgacct

SEQ ID NO: 1212983 - DNA, 12 bp, Homo sapiens
agtttatacaga

SEQ ID NO: 1212984 - DNA, 16 bp, Homo sapiens
agtttatattactctc

SEQ ID NO: 1212985 - DNA, 15 bp, Homo sapiens
agtttatattctgaa

SEQ ID NO: 1212986 - DNA, 22 bp, Homo sapiens
agtttatattctgaaaggaaat

SEQ ID NO: 1212987 - DNA, 16 bp, Homo sapiens
agtttatatttaactc

SEQ ID NO: 1212988 - DNA, 18 bp, Homo sapiens
agtttatatttaactctc

SEQ ID NO: 1212989 - DNA, 15 bp, Homo sapiens
agtttatcattcaag

SEQ ID NO: 1212990 - DNA, 16 bp, Homo sapiens
agtttatccaaatctt

SEQ ID NO: 1212991 - DNA, 22 bp, Homo sapiens
agtttatcctgacatattcaag

SEQ ID NO: 1212992 - DNA, 17 bp, Homo sapiens
agtttatggcaaagatt

SEQ ID NO: 1212993 - DNA, 19 bp, Homo sapiens
agtttatggcaaagatttt

SEQ ID NO: 1212994 - DNA, 16 bp, Homo sapiens
agtttattacaatgta

SEQ ID NO: 1212995 - DNA, 13 bp, Homo sapiens
agtttattctaat

SEQ ID NO: 1212996 - DNA, 15 bp, Homo sapiens
agtttattctcattt

SEQ ID NO: 1212997 - DNA, 16 bp, Homo sapiens
agtttattctcatttg

SEQ ID NO: 1212998 - DNA, 17 bp, Homo sapiens
agtttattctgtggttc

SEQ ID NO: 1212999 - DNA, 19 bp, Homo sapiens
agtttattgatattcaata

SEQ ID NO: 1213000 - DNA, 22 bp, Homo sapiens
agtttattgtttgatgttttta

SEQ ID NO: 1213001 - DNA, 21 bp, Homo sapiens
agtttatttccactattttca

SEQ ID NO: 1213002 - DNA, 21 bp, Homo sapiens
agtttatttgagaaaatataa

SEQ ID NO: 1213003 - DNA, 13 bp, Homo sapiens
agtttatttgttg

SEQ ID NO: 1213004 - DNA, 16 bp, Homo sapiens
agtttatttgttgaga

SEQ ID NO: 1213005 - DNA, 17 bp, Homo sapiens
agtttattttttctaca

SEQ ID NO: 1213006 - DNA, 18 bp, Homo sapiens
agtttattttttctacac

SEQ ID NO: 1213007 - DNA, 19 bp, Homo sapiens
agtttattttttctacaca

SEQ ID NO: 1213008 - DNA, 19 bp, Homo sapiens
agtttcaaacttactattt

SEQ ID NO: 1213009 - DNA, 15 bp, Homo sapiens
agtttcaagttttaa

SEQ ID NO: 1213010 - DNA, 19 bp, Homo sapiens
agtttcaatgtagtctgta

SEQ ID NO: 1213011 - DNA, 14 bp, Homo sapiens
agtttcaatgtgat

SEQ ID NO: 1213012 - DNA, 22 bp, Homo sapiens
agtttcaatgtgattctaatgt

SEQ ID NO: 1213013 - DNA, 14 bp, Homo sapiens
agtttcaccactcc

SEQ ID NO: 1213014 - DNA, 20 bp, Homo sapiens
agtttcactgtactgcatgt

SEQ ID NO: 1213015 - DNA, 18 bp, Homo sapiens
agtttcagagaagttctg

SEQ ID NO: 1213016 - DNA, 15 bp, Homo sapiens
agtttcagatatata

SEQ ID NO: 1213017 - DNA, 20 bp, Homo sapiens
agtttcagatttgccattca

SEQ ID NO: 1213018 - DNA, 18 bp, Homo sapiens
agtttcaggtgtttagtt

SEQ ID NO: 1213019 - DNA, 21 bp, Homo sapiens
agtttcagtaaataatgaaaa

SEQ ID NO: 1213020 - DNA, 15 bp, Homo sapiens
agtttcatgtacaag

SEQ ID NO: 1213021 - DNA, 18 bp, Homo sapiens
agtttcatgtacaagatg

SEQ ID NO: 1213022 - DNA, 16 bp, Homo sapiens
agtttcatgtatgtat

SEQ ID NO: 1213023 - DNA, 18 bp, Homo sapiens
agtttccaattatttgac

SEQ ID NO: 1213024 - DNA, 24 bp, Homo sapiens
agtttcctgagggttttctcataa

SEQ ID NO: 1213025 - DNA, 20 bp, Homo sapiens
agtttctaaaattgagttct

SEQ ID NO: 1213026 - DNA, 16 bp, Homo sapiens
agtttctagaggcctc

SEQ ID NO: 1213027 - DNA, 16 bp, Homo sapiens
agtttctagctagaaa

SEQ ID NO: 1213028 - DNA, 17 bp, Homo sapiens
agtttctagtgtcactg

SEQ ID NO: 1213029 - DNA, 21 bp, Homo sapiens
agtttctattctgtcagtgtt

SEQ ID NO: 1213030 - DNA, 13 bp, Homo sapiens
agtttctcagctc

SEQ ID NO: 1213031 - DNA, 14 bp, Homo sapiens
agtttctccttgaa

SEQ ID NO: 1213032 - DNA, 20 bp, Homo sapiens
agtttctctcttgttgtcca

SEQ ID NO: 1213033 - DNA, 23 bp, Homo sapiens
agtttctctgcagaaactactga

SEQ ID NO: 1213034 - DNA, 14 bp, Homo sapiens
agtttctctgcctt

SEQ ID NO: 1213035 - DNA, 17 bp, Homo sapiens
agtttctgggacctcag

SEQ ID NO: 1213036 - DNA, 12 bp, Homo sapiens
agtttctgttga

SEQ ID NO: 1213037 - DNA, 23 bp, Homo sapiens
agtttcttgcttggaagccaggt

SEQ ID NO: 1213038 - DNA, 14 bp, Homo sapiens
agtttcttttgtgt

SEQ ID NO: 1213039 - DNA, 20 bp, Homo sapiens
agtttgaagcacaactccct

SEQ ID NO: 1213040 - DNA, 21 bp, Homo sapiens
agtttgaagcacaactccctt

SEQ ID NO: 1213041 - DNA, 15 bp, Homo sapiens
agtttgaaggaaaca

SEQ ID NO: 1213042 - DNA, 16 bp, Homo sapiens
agtttgaaggaaacag

SEQ ID NO: 1213043 - DNA, 18 bp, Homo sapiens
agtttgaaggaaacagtt

SEQ ID NO: 1213044 - DNA, 21 bp, Homo sapiens
agtttgaaggaggtgagggat

SEQ ID NO: 1213045 - DNA, 14 bp, Homo sapiens
agtttgacacctta

SEQ ID NO: 1213046 - DNA, 22 bp, Homo sapiens
agtttgacctttgtcttctata

SEQ ID NO: 1213047 - DNA, 23 bp, Homo sapiens
agtttgactttttggaattcagc

SEQ ID NO: 1213048 - DNA, 16 bp, Homo sapiens
agtttgagctgccttc

SEQ ID NO: 1213049 - DNA, 23 bp, Homo sapiens
agtttgagctgccttccctagct

SEQ ID NO: 1213050 - DNA, 16 bp, Homo sapiens
agtttgatcagacagc

SEQ ID NO: 1213051 - DNA, 20 bp, Homo sapiens
agtttgatcagacagcttga

SEQ ID NO: 1213052 - DNA, 17 bp, Homo sapiens
agtttgattaaattctt

SEQ ID NO: 1213053 - DNA, 20 bp, Homo sapiens
agtttgattaaattcttgca

SEQ ID NO: 1213054 - DNA, 17 bp, Homo sapiens
agtttgattattatgtt

SEQ ID NO: 1213055 - DNA, 13 bp, Homo sapiens
agtttgatttttg

SEQ ID NO: 1213056 - DNA, 22 bp, Homo sapiens
agtttgatttttgtttttgtaa

SEQ ID NO: 1213057 - DNA, 17 bp, Homo sapiens
agtttgcaaaaaatgtt

SEQ ID NO: 1213058 - DNA, 10 bp, Homo sapiens
agtttgcatg

SEQ ID NO: 1213059 - DNA, 22 bp, Homo sapiens
agtttgccactcccctaaactc

SEQ ID NO: 1213060 - DNA, 15 bp, Homo sapiens
agtttgcctgcagtt

SEQ ID NO: 1213061 - DNA, 18 bp, Homo sapiens
agtttgcctgcagtttct

SEQ ID NO: 1213062 - DNA, 18 bp, Homo sapiens
agtttgcctgctgtattt

SEQ ID NO: 1213063 - DNA, 24 bp, Homo sapiens
agtttgcctgctgtatttatagta

SEQ ID NO: 1213064 - DNA, 18 bp, Homo sapiens
agtttgctaaaagaagag

SEQ ID NO: 1213065 - DNA, 21 bp, Homo sapiens
agtttgtgttttaaaaaaact

SEQ ID NO: 1213066 - DNA, 23 bp, Homo sapiens
agtttgtgttttaaaaaaactga

SEQ ID NO: 1213067 - DNA, 22 bp, Homo sapiens
agtttgttagtatgaggcattt

SEQ ID NO: 1213068 - DNA, 19 bp, Homo sapiens
agttttaacacttctagat

SEQ ID NO: 1213069 - DNA, 13 bp, Homo sapiens
agttttaactgtg

SEQ ID NO: 1213070 - DNA, 16 bp, Homo sapiens
agttttaacttccagt

SEQ ID NO: 1213071 - DNA, 13 bp, Homo sapiens
agttttaataaga

SEQ ID NO: 1213072 - DNA, 21 bp, Homo sapiens
agttttaataagaacagatca

SEQ ID NO: 1213073 - DNA, 21 bp, Homo sapiens
agttttaatgttagaatttag

SEQ ID NO: 1213074 - DNA, 20 bp, Homo sapiens
agttttaattcaacatcaaa

SEQ ID NO: 1213075 - DNA, 15 bp, Homo sapiens
agttttactgcctgt

SEQ ID NO: 1213076 - DNA, 21 bp, Homo sapiens
agttttagttgcagaaacatt

SEQ ID NO: 1213077 - DNA, 14 bp, Homo sapiens
agttttagttttct

SEQ ID NO: 1213078 - DNA, 15 bp, Homo sapiens
agttttagttttctc

SEQ ID NO: 1213079 - DNA, 14 bp, Homo sapiens
agttttataaaact

SEQ ID NO: 1213080 - DNA, 12 bp, Homo sapiens
agttttatcatt

SEQ ID NO: 1213081 - DNA, 21 bp, Homo sapiens
agttttatcctggccttgtac

SEQ ID NO: 1213082 - DNA, 13 bp, Homo sapiens
agttttatttttg

SEQ ID NO: 1213083 - DNA, 15 bp, Homo sapiens
agttttcaaatttgt

SEQ ID NO: 1213084 - DNA, 19 bp, Homo sapiens
agttttcagaaaaagaaat

SEQ ID NO: 1213085 - DNA, 21 bp, Homo sapiens
agttttcagaacctcttcccc

SEQ ID NO: 1213086 - DNA, 17 bp, Homo sapiens
agttttcagtttgtata

SEQ ID NO: 1213087 - DNA, 20 bp, Homo sapiens
agttttcatccataactgaa

SEQ ID NO: 1213088 - DNA, 16 bp, Homo sapiens
agttttccatgaaaac

SEQ ID NO: 1213089 - DNA, 21 bp, Homo sapiens
agttttccctgcactgtgtca

SEQ ID NO: 1213090 - DNA, 18 bp, Homo sapiens
agttttcccttgaggaaa

SEQ ID NO: 1213091 - DNA, 22 bp, Homo sapiens
agttttcctctatacatctctc

SEQ ID NO: 1213092 - DNA, 14 bp, Homo sapiens
agttttccttctgt

SEQ ID NO: 1213093 - DNA, 16 bp, Homo sapiens
agttttccttctgtta

SEQ ID NO: 1213094 - DNA, 18 bp, Homo sapiens
agttttctagcaattttc

SEQ ID NO: 1213095 - DNA, 19 bp, Homo sapiens
agttttctagcaattttct

SEQ ID NO: 1213096 - DNA, 18 bp, Homo sapiens
agttttctggctggagcc

SEQ ID NO: 1213097 - DNA, 18 bp, Homo sapiens
agttttctggtaggaaga

SEQ ID NO: 1213098 - DNA, 17 bp, Homo sapiens
agttttgaaagaaaaat

SEQ ID NO: 1213099 - DNA, 13 bp, Homo sapiens
agttttgaatgtt

SEQ ID NO: 1213100 - DNA, 18 bp, Homo sapiens
agttttgaatgttaagaa

SEQ ID NO: 1213101 - DNA, 21 bp, Homo sapiens
agttttgaatgttaagaattg

SEQ ID NO: 1213102 - DNA, 17 bp, Homo sapiens
agttttgacacttccca

SEQ ID NO: 1213103 - DNA, 17 bp, Homo sapiens
agttttgagtaattcaa

SEQ ID NO: 1213104 - DNA, 18 bp, Homo sapiens
agttttgagtgtactgtg

SEQ ID NO: 1213105 - DNA, 16 bp, Homo sapiens
agttttgagtgtatac

SEQ ID NO: 1213106 - DNA, 18 bp, Homo sapiens
agttttgatataatcttg

SEQ ID NO: 1213107 - DNA, 18 bp, Homo sapiens
agttttgatgtgtgggct

SEQ ID NO: 1213108 - DNA, 19 bp, Homo sapiens
agttttgattttggaaaga

SEQ ID NO: 1213109 - DNA, 14 bp, Homo sapiens
agttttggaatcta

SEQ ID NO: 1213110 - DNA, 21 bp, Homo sapiens
agttttgtaaaaactgaagaa

SEQ ID NO: 1213111 - DNA, 16 bp, Homo sapiens
agttttgtaaaagaaa

SEQ ID NO: 1213112 - DNA, 16 bp, Homo sapiens
agttttgtaagtaaca

SEQ ID NO: 1213113 - DNA, 13 bp, Homo sapiens
agttttgtataaa

SEQ ID NO: 1213114 - DNA, 14 bp, Homo sapiens
agttttgtcttgaa

SEQ ID NO: 1213115 - DNA, 12 bp, Homo sapiens
agttttgtgttt

SEQ ID NO: 1213116 - DNA, 14 bp, Homo sapiens
agttttgttgcccc

SEQ ID NO: 1213117 - DNA, 12 bp, Homo sapiens
agttttgtttaa

SEQ ID NO: 1213118 - DNA, 21 bp, Homo sapiens
agttttgttttccctttaaag

SEQ ID NO: 1213119 - DNA, 21 bp, Homo sapiens
agtttttaaaatatattgctg

SEQ ID NO: 1213120 - DNA, 21 bp, Homo sapiens
agtttttaattaaaaacttta

SEQ ID NO: 1213121 - DNA, 19 bp, Homo sapiens
agtttttacaaaactgctt

SEQ ID NO: 1213122 - DNA, 17 bp, Homo sapiens
agtttttacctaccaca

SEQ ID NO: 1213123 - DNA, 16 bp, Homo sapiens
agtttttactttctgt

SEQ ID NO: 1213124 - DNA, 15 bp, Homo sapiens
agtttttattgcttg

SEQ ID NO: 1213125 - DNA, 9 bp, Homo sapiens
agtttttca

SEQ ID NO: 1213126 - DNA, 13 bp, Homo sapiens
agtttttcacttt

SEQ ID NO: 1213127 - DNA, 23 bp, Homo sapiens
agtttttcaggagcgcaagatag

SEQ ID NO: 1213128 - DNA, 12 bp, Homo sapiens
agtttttcattt

SEQ ID NO: 1213129 - DNA, 21 bp, Homo sapiens
agtttttcatttgttttgctt

SEQ ID NO: 1213130 - DNA, 22 bp, Homo sapiens
agtttttctgttttgtttggca

SEQ ID NO: 1213131 - DNA, 23 bp, Homo sapiens
agtttttctgttttgtttggcaa

SEQ ID NO: 1213132 - DNA, 23 bp, Homo sapiens
agtttttctttaatatgattcta

SEQ ID NO: 1213133 - DNA, 21 bp, Homo sapiens
agtttttgaaaattatgcaaa

SEQ ID NO: 1213134 - DNA, 18 bp, Homo sapiens
agtttttgaggagccagc

SEQ ID NO: 1213135 - DNA, 16 bp, Homo sapiens
agtttttgatagcttt

SEQ ID NO: 1213136 - DNA, 21 bp, Homo sapiens
agtttttggataaagaatact

SEQ ID NO: 1213137 - DNA, 21 bp, Homo sapiens
agtttttgtttgtttcttctt

SEQ ID NO: 1213138 - DNA, 16 bp, Homo sapiens
agtttttgtttttgca

SEQ ID NO: 1213139 - DNA, 17 bp, Homo sapiens
agttttttctcttgggc

SEQ ID NO: 1213140 - DNA, 22 bp, Homo sapiens
agttttttgaaaatgggctcaa

SEQ ID NO: 1213141 - DNA, 21 bp, Homo sapiens
agttttttgaaattatgtgac

SEQ ID NO: 1213142 - DNA, 23 bp, Homo sapiens
agttttttggggggataggaaga

SEQ ID NO: 1213143 - DNA, 16 bp, Homo sapiens
agttttttgttttaca

SEQ ID NO: 1213144 - DNA, 15 bp, Homo sapiens
agtttttttaaatgc

SEQ ID NO: 1213145 - DNA, 14 bp, Homo sapiens
ataatggttgactg

SEQ ID NO: 1213146 - DNA, 19 bp, Homo sapiens
ataatgtactgatttcagt

SEQ ID NO: 1213147 - DNA, 14 bp, Homo sapiens
ataatgtattgtaa

SEQ ID NO: 1213148 - DNA, 14 bp, Homo sapiens
ataatgtatttgaa

SEQ ID NO: 1213149 - DNA, 18 bp, Homo sapiens
ataatgtatttgaaaatt

SEQ ID NO: 1213150 - DNA, 16 bp, Homo sapiens
ataatgtattttcagc

SEQ ID NO: 1213151 - DNA, 14 bp, Homo sapiens
ataatgtccccact

SEQ ID NO: 1213152 - DNA, 16 bp, Homo sapiens
ataatgtccccactcc

SEQ ID NO: 1213153 - DNA, 13 bp, Homo sapiens
ataatgtgaaaat

SEQ ID NO: 1213154 - DNA, 15 bp, Homo sapiens
ataatgtgaaatgta

SEQ ID NO: 1213155 - DNA, 20 bp, Homo sapiens
ataatgtgtctgtgttgctt

SEQ ID NO: 1213156 - DNA, 15 bp, Homo sapiens
ataatgttattcatt

SEQ ID NO: 1213157 - DNA, 16 bp, Homo sapiens
ataatgttctttaatg

SEQ ID NO: 1213158 - DNA, 20 bp, Homo sapiens
ataatgttgtatttaatttt

SEQ ID NO: 1213159 - DNA, 18 bp, Homo sapiens
ataatgtttaaatagcat

SEQ ID NO: 1213160 - DNA, 18 bp, Homo sapiens
ataatgtttaaatcatgt

SEQ ID NO: 1213161 - DNA, 17 bp, Homo sapiens
ataatgtttattaaatg

SEQ ID NO: 1213162 - DNA, 17 bp, Homo sapiens
ataatgtttttaatatt

SEQ ID NO: 1213163 - DNA, 15 bp, Homo sapiens
ataatgtttttcctt

SEQ ID NO: 1213164 - DNA, 16 bp, Homo sapiens
ataattaaagatgcca

SEQ ID NO: 1213165 - DNA, 19 bp, Homo sapiens
ataattaaagcttaaactg

SEQ ID NO: 1213166 - DNA, 22 bp, Homo sapiens
ataattaaagcttaaactgaat

SEQ ID NO: 1213167 - DNA, 16 bp, Homo sapiens
ataattaacttaactg

SEQ ID NO: 1213168 - DNA, 17 bp, Homo sapiens
ataattaacttaactga

SEQ ID NO: 1213169 - DNA, 18 bp, Homo sapiens
ataattaacttaactgaa

SEQ ID NO: 1213170 - DNA, 12 bp, Homo sapiens
ataattacattc

SEQ ID NO: 1213171 - DNA, 23 bp, Homo sapiens
ataattacattcctaactagaat

SEQ ID NO: 1213172 - DNA, 21 bp, Homo sapiens
ataattagatccattaattta

SEQ ID NO: 1213173 - DNA, 21 bp, Homo sapiens
ataattagatgattatatatt

SEQ ID NO: 1213174 - DNA, 16 bp, Homo sapiens
ataattataatatact

SEQ ID NO: 1213175 - DNA, 20 bp, Homo sapiens
ataattatcggaagcagtgc

SEQ ID NO: 1213176 - DNA, 12 bp, Homo sapiens
ataattatgaaa

SEQ ID NO: 1213177 - DNA, 14 bp, Homo sapiens
ataattatgacagt

SEQ ID NO: 1213178 - DNA, 20 bp, Homo sapiens
ataattatgacagttatact

SEQ ID NO: 1213179 - DNA, 22 bp, Homo sapiens
ataattatttattacataattt

SEQ ID NO: 1213180 - DNA, 18 bp, Homo sapiens
ataattcaattttaaaga

SEQ ID NO: 1213181 - DNA, 16 bp, Homo sapiens
ataattcatttgtatt

SEQ ID NO: 1213182 - DNA, 19 bp, Homo sapiens
ataattccctatcttttag

SEQ ID NO: 1213183 - DNA, 15 bp, Homo sapiens
ataattccttggtga

SEQ ID NO: 1213184 - DNA, 14 bp, Homo sapiens
ataattctactttg

SEQ ID NO: 1213185 - DNA, 13 bp, Homo sapiens
ataattctgaaac

SEQ ID NO: 1213186 - DNA, 14 bp, Homo sapiens
ataattctgaaaca

SEQ ID NO: 1213187 - DNA, 21 bp, Homo sapiens
ataattcttagtggaagacaa

SEQ ID NO: 1213188 - DNA, 15 bp, Homo sapiens
ataattcttttctga

SEQ ID NO: 1213189 - DNA, 15 bp, Homo sapiens
ataattgatcaaatt

SEQ ID NO: 1213190 - DNA, 15 bp, Homo sapiens
ataattgattaaaat

SEQ ID NO: 1213191 - DNA, 12 bp, Homo sapiens
ataattggaata

SEQ ID NO: 1213192 - DNA, 18 bp, Homo sapiens
ataattggatttcctaat

SEQ ID NO: 1213193 - DNA, 19 bp, Homo sapiens
ataattgggtcatagaaat

SEQ ID NO: 1213194 - DNA, 17 bp, Homo sapiens
ataattggtgctatttg

SEQ ID NO: 1213195 - DNA, 20 bp, Homo sapiens
ataattggtgctatttgaag

SEQ ID NO: 1213196 - DNA, 22 bp, Homo sapiens
ataattggtgctatttgaagaa

SEQ ID NO: 1213197 - DNA, 20 bp, Homo sapiens
ataattgtgattagacagaa

SEQ ID NO: 1213198 - DNA, 21 bp, Homo sapiens
ataattgtgattagacagaac

SEQ ID NO: 1213199 - DNA, 23 bp, Homo sapiens
ataattgttctcagaatccctta

SEQ ID NO: 1213200 - DNA, 12 bp, Homo sapiens
ataattgttgaa

SEQ ID NO: 1213201 - DNA, 14 bp, Homo sapiens
ataattgttgatat

SEQ ID NO: 1213202 - DNA, 16 bp, Homo sapiens
ataattgttgatattt

SEQ ID NO: 1213203 - DNA, 18 bp, Homo sapiens
ataattgttgttctgtta

SEQ ID NO: 1213204 - DNA, 19 bp, Homo sapiens
ataattgttgttctgttaa

SEQ ID NO: 1213205 - DNA, 21 bp, Homo sapiens
ataattgtttccaacttgtct

SEQ ID NO: 1213206 - DNA, 17 bp, Homo sapiens
ataatttaaaaatatat

SEQ ID NO: 1213207 - DNA, 19 bp, Homo sapiens
ataatttaaaaatatattt

SEQ ID NO: 1213208 - DNA, 12 bp, Homo sapiens
ataatttaaatg

SEQ ID NO: 1213209 - DNA, 19 bp, Homo sapiens
ataatttaataaaaaggaa

SEQ ID NO: 1213210 - DNA, 21 bp, Homo sapiens
ataatttagtggatggaatat

SEQ ID NO: 1213211 - DNA, 12 bp, Homo sapiens
ataatttcaggg

SEQ ID NO: 1213212 - DNA, 11 bp, Homo sapiens
ataatttccca

SEQ ID NO: 1213213 - DNA, 13 bp, Homo sapiens
ataatttcctcac

SEQ ID NO: 1213214 - DNA, 20 bp, Homo sapiens
ataatttgaggtgaaattca

SEQ ID NO: 1213215 - DNA, 21 bp, Homo sapiens
ataatttgagtgtatatatat

SEQ ID NO: 1213216 - DNA, 13 bp, Homo sapiens
ataatttgcactg

SEQ ID NO: 1213217 - DNA, 13 bp, Homo sapiens
ataatttgtaaat

SEQ ID NO: 1213218 - DNA, 22 bp, Homo sapiens
ataatttgtaaatgattttaat

SEQ ID NO: 1213219 - DNA, 20 bp, Homo sapiens
ataatttgtaaattgaataa

SEQ ID NO: 1213220 - DNA, 16 bp, Homo sapiens
ataatttgtacaatgg

SEQ ID NO: 1213221 - DNA, 18 bp, Homo sapiens
ataatttgtacaatggtt

SEQ ID NO: 1213222 - DNA, 19 bp, Homo sapiens
ataatttgtacaatggttt

SEQ ID NO: 1213223 - DNA, 24 bp, Homo sapiens
ataatttgtacaatggtttattcc

SEQ ID NO: 1213224 - DNA, 19 bp, Homo sapiens
ataatttgtacatatgtaa

SEQ ID NO: 1213225 - DNA, 13 bp, Homo sapiens
ataatttgtctta

SEQ ID NO: 1213226 - DNA, 15 bp, Homo sapiens
ataatttgtcttagt

SEQ ID NO: 1213227 - DNA, 16 bp, Homo sapiens
ataatttgtttaaaat

SEQ ID NO: 1213228 - DNA, 19 bp, Homo sapiens
ataatttgtttaaaattct

SEQ ID NO: 1213229 - DNA, 13 bp, Homo sapiens
ataatttgtttcc

SEQ ID NO: 1213230 - DNA, 14 bp, Homo sapiens
ataatttgtttcca

SEQ ID NO: 1213231 - DNA, 22 bp, Homo sapiens
ataattttaaataacctctggc

SEQ ID NO: 1213232 - DNA, 14 bp, Homo sapiens
ataattttctaaga

SEQ ID NO: 1213233 - DNA, 13 bp, Homo sapiens
ataattttcttca

SEQ ID NO: 1213234 - DNA, 22 bp, Homo sapiens
ataattttcttcatgcaatgac

SEQ ID NO: 1213235 - DNA, 21 bp, Homo sapiens
ataattttgcatactgaaaat

SEQ ID NO: 1213236 - DNA, 12 bp, Homo sapiens
ataattttgtaa

SEQ ID NO: 1213237 - DNA, 14 bp, Homo sapiens
ataattttgtgcat

SEQ ID NO: 1213238 - DNA, 18 bp, Homo sapiens
ataatttttaaagtatat

SEQ ID NO: 1213239 - DNA, 21 bp, Homo sapiens
ataatttttaaagtatatatt

SEQ ID NO: 1213240 - DNA, 12 bp, Homo sapiens
ataatttttaac

SEQ ID NO: 1213241 - DNA, 13 bp, Homo sapiens
ataatttttaact

SEQ ID NO: 1213242 - DNA, 14 bp, Homo sapiens
ataatttttaactt

SEQ ID NO: 1213243 - DNA, 15 bp, Homo sapiens
ataatttttgtacat

SEQ ID NO: 1213244 - DNA, 16 bp, Homo sapiens
ataatttttgtacatc

SEQ ID NO: 1213245 - DNA, 15 bp, Homo sapiens
ataattttttattca

SEQ ID NO: 1213246 - DNA, 14 bp, Homo sapiens
ataattttttctta

SEQ ID NO: 1213247 - DNA, 21 bp, Homo sapiens
ataatttttttcaatatttat

SEQ ID NO: 1213248 - DNA, 18 bp, Homo sapiens
atacaaaaacatacttca

SEQ ID NO: 1213249 - DNA, 19 bp, Homo sapiens
atacaaaaattagccgggc

SEQ ID NO: 1213250 - DNA, 17 bp, Homo sapiens
atacaaaatatttaagt

SEQ ID NO: 1213251 - DNA, 16 bp, Homo sapiens
atacaaactctcacca

SEQ ID NO: 1213252 - DNA, 15 bp, Homo sapiens
atacaaagtacagaa

SEQ ID NO: 1213253 - DNA, 16 bp, Homo sapiens
atacaaatagattttt

SEQ ID NO: 1213254 - DNA, 23 bp, Homo sapiens
atacaaattggttggttttgact

SEQ ID NO: 1213255 - DNA, 19 bp, Homo sapiens
atacaaatttggccttaag

SEQ ID NO: 1213256 - DNA, 20 bp, Homo sapiens
atacaacagcaaaccctgat

SEQ ID NO: 1213257 - DNA, 19 bp, Homo sapiens
atacaaccttcatttaaaa

SEQ ID NO: 1213258 - DNA, 14 bp, Homo sapiens
atacaactgcctgg

SEQ ID NO: 1213259 - DNA, 15 bp, Homo sapiens
atacaactgcctggg

SEQ ID NO: 1213260 - DNA, 20 bp, Homo sapiens
atacaactgtaaagcaaata

SEQ ID NO: 1213261 - DNA, 12 bp, Homo sapiens
atacaactttac

SEQ ID NO: 1213262 - DNA, 17 bp, Homo sapiens
atacaagaaaatgtatc

SEQ ID NO: 1213263 - DNA, 12 bp, Homo sapiens
atacaagactgc

SEQ ID NO: 1213264 - DNA, 15 bp, Homo sapiens
atacaagattgaaaa

SEQ ID NO: 1213265 - DNA, 20 bp, Homo sapiens
atacaaggtgagtgtgactt

SEQ ID NO: 1213266 - DNA, 15 bp, Homo sapiens
atacaataaaagagc

SEQ ID NO: 1213267 - DNA, 18 bp, Homo sapiens
atacaataaaagagcttt

SEQ ID NO: 1213268 - DNA, 20 bp, Homo sapiens
atacaataaactattggaaa

SEQ ID NO: 1213269 - DNA, 12 bp, Homo sapiens
atacaataaatt

SEQ ID NO: 1213270 - DNA, 14 bp, Homo sapiens
atacaataaattgc

SEQ ID NO: 1213271 - DNA, 14 bp, Homo sapiens
atacaataacccag

SEQ ID NO: 1213272 - DNA, 16 bp, Homo sapiens
atacaatgaccacata

SEQ ID NO: 1213273 - DNA, 14 bp, Homo sapiens
atacaatgctgtgc

SEQ ID NO: 1213274 - DNA, 17 bp, Homo sapiens
atacaatgctgtgccct

SEQ ID NO: 1213275 - DNA, 23 bp, Homo sapiens
atacaatggtcatttccagacaa

SEQ ID NO: 1213276 - DNA, 14 bp, Homo sapiens
atacaatgtacaat

SEQ ID NO: 1213277 - DNA, 15 bp, Homo sapiens
atacaatgtacaatt

SEQ ID NO: 1213278 - DNA, 21 bp, Homo sapiens
atacaatgtacaattatgtct

SEQ ID NO: 1213279 - DNA, 12 bp, Homo sapiens
atacaatgtatg

SEQ ID NO: 1213280 - DNA, 16 bp, Homo sapiens
atacaatgtatgtaca

SEQ ID NO: 1213281 - DNA, 17 bp, Homo sapiens
atacaatgtatgtacaa

SEQ ID NO: 1213282 - DNA, 21 bp, Homo sapiens
atacaatgtatgtacaataca

SEQ ID NO: 1213283 - DNA, 19 bp, Homo sapiens
atacaatgttatcaaccaa

SEQ ID NO: 1213284 - DNA, 13 bp, Homo sapiens
atacaattaaagg

SEQ ID NO: 1213285 - DNA, 14 bp, Homo sapiens
atacaattaaaggt

SEQ ID NO: 1213286 - DNA, 15 bp, Homo sapiens
atacaattctacatt

SEQ ID NO: 1213287 - DNA, 23 bp, Homo sapiens
atacaatttccatatagtctatt

SEQ ID NO: 1213288 - DNA, 17 bp, Homo sapiens
atacaattttttttatt

SEQ ID NO: 1213289 - DNA, 15 bp, Homo sapiens
atacacaacacacac

SEQ ID NO: 1213290 - DNA, 15 bp, Homo sapiens
atacacaagtaaaca

SEQ ID NO: 1213291 - DNA, 13 bp, Homo sapiens
atacacacaaaaa

SEQ ID NO: 1213292 - DNA, 10 bp, Homo sapiens
atacacacac

SEQ ID NO: 1213293 - DNA, 12 bp, Homo sapiens
atacacacatat

SEQ ID NO: 1213294 - DNA, 15 bp, Homo sapiens
atacacacatataca

SEQ ID NO: 1213295 - DNA, 18 bp, Homo sapiens
atacacacatatacatat

SEQ ID NO: 1213296 - DNA, 21 bp, Homo sapiens
atacacacatatacatatata

SEQ ID NO: 1213297 - DNA, 19 bp, Homo sapiens
atacacactcgaatcattg

SEQ ID NO: 1213298 - DNA, 15 bp, Homo sapiens
atacacagtacttta

SEQ ID NO: 1213299 - DNA, 19 bp, Homo sapiens
atacaccagagataatatg

SEQ ID NO: 1213300 - DNA, 17 bp, Homo sapiens
atacaccagcattcctt

SEQ ID NO: 1213301 - DNA, 14 bp, Homo sapiens
atacaccgggcctg

SEQ ID NO: 1213302 - DNA, 22 bp, Homo sapiens
atacactatttgtgagcaaagg

SEQ ID NO: 1213303 - DNA, 14 bp, Homo sapiens
atacactgcacttt

SEQ ID NO: 1213304 - DNA, 16 bp, Homo sapiens
atacactgcactttgt

SEQ ID NO: 1213305 - DNA, 21 bp, Homo sapiens
atacactgtagtttttgaaaa

SEQ ID NO: 1213306 - DNA, 20 bp, Homo sapiens
atacactgtatgttatagaa

SEQ ID NO: 1213307 - DNA, 17 bp, Homo sapiens
atacagaacagagggcc

SEQ ID NO: 1213308 - DNA, 21 bp, Homo sapiens
atacagaactcacagtaccta

SEQ ID NO: 1213309 - DNA, 15 bp, Homo sapiens
atacagaactctttc

SEQ ID NO: 1213310 - DNA, 20 bp, Homo sapiens
atacagaactctttcaaaac

SEQ ID NO: 1213311 - DNA, 20 bp, Homo sapiens
atacagaagcccatgtcttc

SEQ ID NO: 1213312 - DNA, 22 bp, Homo sapiens
atacagaagcccatgtcttctg

SEQ ID NO: 1213313 - DNA, 16 bp, Homo sapiens
atacagaattgactgc

SEQ ID NO: 1213314 - DNA, 21 bp, Homo sapiens
atacagaattgactgcagttg

SEQ ID NO: 1213315 - DNA, 23 bp, Homo sapiens
atacagacactaagttatagtat

SEQ ID NO: 1213316 - DNA, 12 bp, Homo sapiens
atacagaggaga

SEQ ID NO: 1213317 - DNA, 15 bp, Homo sapiens
atacagaggatgcct

SEQ ID NO: 1213318 - DNA, 13 bp, Homo sapiens
atacagattttac

SEQ ID NO: 1213319 - DNA, 20 bp, Homo sapiens
atacagctgtattgtctgaa

SEQ ID NO: 1213320 - DNA, 15 bp, Homo sapiens
atacaggaaacagtt

SEQ ID NO: 1213321 - DNA, 23 bp, Homo sapiens
atacaggaagaaagagcttgagg

SEQ ID NO: 1213322 - DNA, 21 bp, Homo sapiens
atacagggcatgcattttgca

SEQ ID NO: 1213323 - DNA, 17 bp, Homo sapiens
atacagtaactttatgt

SEQ ID NO: 1213324 - DNA, 19 bp, Homo sapiens
atacagtaagcatagttaa

SEQ ID NO: 1213325 - DNA, 17 bp, Homo sapiens
atacagtccctaaagaa

SEQ ID NO: 1213326 - DNA, 18 bp, Homo sapiens
atacagtccctaaagaaa

SEQ ID NO: 1213327 - DNA, 19 bp, Homo sapiens
atacagtcttccatttgca

SEQ ID NO: 1213328 - DNA, 20 bp, Homo sapiens
atacagtcttccatttgcaa

SEQ ID NO: 1213329 - DNA, 19 bp, Homo sapiens
atacagtgagctctagcaa

SEQ ID NO: 1213330 - DNA, 17 bp, Homo sapiens
atacagtgcagagcctt

SEQ ID NO: 1213331 - DNA, 13 bp, Homo sapiens
atacagtgcccac

SEQ ID NO: 1213332 - DNA, 20 bp, Homo sapiens
atacagttactcagaattct

SEQ ID NO: 1213333 - DNA, 15 bp, Homo sapiens
atacagttataaaat

SEQ ID NO: 1213334 - DNA, 17 bp, Homo sapiens
atacagttataaaatta

SEQ ID NO: 1213335 - DNA, 20 bp, Homo sapiens
atacagttgaaaacttgtaa

SEQ ID NO: 1213336 - DNA, 16 bp, Homo sapiens
atacagttgttggcct

SEQ ID NO: 1213337 - DNA, 14 bp, Homo sapiens
atacataaaaatta

SEQ ID NO: 1213338 - DNA, 20 bp, Homo sapiens
atacataatgtttttccttt

SEQ ID NO: 1213339 - DNA, 23 bp, Homo sapiens
atacatacaccagcattcctttt

SEQ ID NO: 1213340 - DNA, 12 bp, Homo sapiens
atacatacatat

SEQ ID NO: 1213341 - DNA, 15 bp, Homo sapiens
atacatacatatata

SEQ ID NO: 1213342 - DNA, 20 bp, Homo sapiens
atacatacatgtatctggtt

SEQ ID NO: 1213343 - DNA, 20 bp, Homo sapiens
atacatacggtcaggtttaa

SEQ ID NO: 1213344 - DNA, 20 bp, Homo sapiens
atacatacttacatgtgtgt

SEQ ID NO: 1213345 - DNA, 19 bp, Homo sapiens
atacataggcatcatttca

SEQ ID NO: 1213346 - DNA, 11 bp, Homo sapiens
atacatatata

SEQ ID NO: 1213347 - DNA, 20 bp, Homo sapiens
atacatatatatatacacat

SEQ ID NO: 1213348 - DNA, 19 bp, Homo sapiens
atacatatatatctgataa

SEQ ID NO: 1213349 - DNA, 20 bp, Homo sapiens
atacatatatatctgataaa

SEQ ID NO: 1213350 - DNA, 20 bp, Homo sapiens
atacatatatctacacatac

SEQ ID NO: 1213351 - DNA, 23 bp, Homo sapiens
atacatatatgtatatatatgca

SEQ ID NO: 1213352 - DNA, 20 bp, Homo sapiens
atacatatctttattaatca

SEQ ID NO: 1213353 - DNA, 21 bp, Homo sapiens
atacatatctttattaatcac

SEQ ID NO: 1213354 - DNA, 21 bp, Homo sapiens
atacatatgagaatatacctt

SEQ ID NO: 1213355 - DNA, 14 bp, Homo sapiens
atacatattttgta

SEQ ID NO: 1213356 - DNA, 12 bp, Homo sapiens
atacatcactgc

SEQ ID NO: 1213357 - DNA, 15 bp, Homo sapiens
atacatcactgcttg

SEQ ID NO: 1213358 - DNA, 19 bp, Homo sapiens
atacatcactgcttgatga

SEQ ID NO: 1213359 - DNA, 16 bp, Homo sapiens
atacatgatacatttt

SEQ ID NO: 1213360 - DNA, 17 bp, Homo sapiens
atacatgatacattttt

SEQ ID NO: 1213361 - DNA, 22 bp, Homo sapiens
atacatgctaagagaagtagaa

SEQ ID NO: 1213362 - DNA, 20 bp, Homo sapiens
atacatgtacctatagaaat

SEQ ID NO: 1213363 - DNA, 21 bp, Homo sapiens
atacatgtgccgaatgtgcag

SEQ ID NO: 1213364 - DNA, 12 bp, Homo sapiens
atacatgtgtgg

SEQ ID NO: 1213365 - DNA, 17 bp, Homo sapiens
atacattaacggtgcta

SEQ ID NO: 1213366 - DNA, 20 bp, Homo sapiens
atacattcaaatttgtctgg

SEQ ID NO: 1213367 - DNA, 17 bp, Homo sapiens
atacattgtgtgaaaaa

SEQ ID NO: 1213368 - DNA, 16 bp, Homo sapiens
atacatttaaaacatt

SEQ ID NO: 1213369 - DNA, 19 bp, Homo sapiens
atacatttgaggggaaaac

SEQ ID NO: 1213370 - DNA, 17 bp, Homo sapiens
atacattttataatttc

SEQ ID NO: 1213371 - DNA, 14 bp, Homo sapiens
atacattttattct

SEQ ID NO: 1213372 - DNA, 14 bp, Homo sapiens
atacattttctaaa

SEQ ID NO: 1213373 - DNA, 22 bp, Homo sapiens
atacattttctaaataaaaata

SEQ ID NO: 1213374 - DNA, 14 bp, Homo sapiens
atacattttctggt

SEQ ID NO: 1213375 - DNA, 19 bp, Homo sapiens
atacattttgttatagaat

SEQ ID NO: 1213376 - DNA, 14 bp, Homo sapiens
ataccaagtattta

SEQ ID NO: 1213377 - DNA, 18 bp, Homo sapiens
ataccaatcacaaggata

SEQ ID NO: 1213378 - DNA, 20 bp, Homo sapiens
ataccaatgtgttttctgta

SEQ ID NO: 1213379 - DNA, 24 bp, Homo sapiens
ataccacagctatttagaagcatc

SEQ ID NO: 1213380 - DNA, 23 bp, Homo sapiens
ataccacctgtacatacattgta

SEQ ID NO: 1213381 - DNA, 21 bp, Homo sapiens
ataccactctttacctttatt

SEQ ID NO: 1213382 - DNA, 20 bp, Homo sapiens
ataccactttgacacgcttc

SEQ ID NO: 1213383 - DNA, 21 bp, Homo sapiens
ataccactttgacacgcttca

SEQ ID NO: 1213384 - DNA, 19 bp, Homo sapiens
ataccagagacctgaggca

SEQ ID NO: 1213385 - DNA, 17 bp, Homo sapiens
ataccagccagtaaatg

SEQ ID NO: 1213386 - DNA, 19 bp, Homo sapiens
ataccagccagtaaatggg

SEQ ID NO: 1213387 - DNA, 16 bp, Homo sapiens
ataccagcgaggaggc

SEQ ID NO: 1213388 - DNA, 17 bp, Homo sapiens
ataccagcttaatagct

SEQ ID NO: 1213389 - DNA, 18 bp, Homo sapiens
ataccagcttagatttta

SEQ ID NO: 1213390 - DNA, 22 bp, Homo sapiens
ataccagtactcagtatagcat

SEQ ID NO: 1213391 - DNA, 20 bp, Homo sapiens
ataccagtgaaccaaagaga

SEQ ID NO: 1213392 - DNA, 12 bp, Homo sapiens
ataccagtgtgg

SEQ ID NO: 1213393 - DNA, 19 bp, Homo sapiens
ataccattaaaactgcttt

SEQ ID NO: 1213394 - DNA, 15 bp, Homo sapiens
ataccattgaaatca

SEQ ID NO: 1213395 - DNA, 21 bp, Homo sapiens
atacccaaaggaatagaaatc

SEQ ID NO: 1213396 - DNA, 13 bp, Homo sapiens
atacccagtggaa

SEQ ID NO: 1213397 - DNA, 18 bp, Homo sapiens
atacccatagcttccatg

SEQ ID NO: 1213398 - DNA, 15 bp, Homo sapiens
atacccatgaactta

SEQ ID NO: 1213399 - DNA, 17 bp, Homo sapiens
ataccccctgcaaagcc

SEQ ID NO: 1213400 - DNA, 20 bp, Homo sapiens
ataccccctgcaaagcccag

SEQ ID NO: 1213401 - DNA, 22 bp, Homo sapiens
ataccccctgcaaagcccagct

SEQ ID NO: 1213402 - DNA, 18 bp, Homo sapiens
ataccccttattgctgcc

SEQ ID NO: 1213403 - DNA, 18 bp, Homo sapiens
atacccgcctagctgctg

SEQ ID NO: 1213404 - DNA, 22 bp, Homo sapiens
ataccctactgtggggagagat

SEQ ID NO: 1213405 - DNA, 19 bp, Homo sapiens
ataccctagaagaaaaccc

SEQ ID NO: 1213406 - DNA, 12 bp, Homo sapiens
ataccctccccc

SEQ ID NO: 1213407 - DNA, 17 bp, Homo sapiens
ataccgcctcgtgccag

SEQ ID NO: 1213408 - DNA, 22 bp, Homo sapiens
ataccgcctcgtgccagcagcc

SEQ ID NO: 1213409 - DNA, 21 bp, Homo sapiens
atacctaagaagtacattgtt

SEQ ID NO: 1213410 - DNA, 16 bp, Homo sapiens
atacctaattgtggat

SEQ ID NO: 1213411 - DNA, 15 bp, Homo sapiens
atacctcaacctatg

SEQ ID NO: 1213412 - DNA, 15 bp, Homo sapiens
atacctcatcatcca

SEQ ID NO: 1213413 - DNA, 20 bp, Homo sapiens
atacctcttagctgagtgga

SEQ ID NO: 1213414 - DNA, 23 bp, Homo sapiens
atacctgattgatcacacagtgt

SEQ ID NO: 1213415 - DNA, 13 bp, Homo sapiens
atacctgcctttt

SEQ ID NO: 1213416 - DNA, 18 bp, Homo sapiens
atacctggcttttacttt

SEQ ID NO: 1213417 - DNA, 19 bp, Homo sapiens
atacctggcttttacttta

SEQ ID NO: 1213418 - DNA, 20 bp, Homo sapiens
atacctggcttttactttat

SEQ ID NO: 1213419 - DNA, 23 bp, Homo sapiens
atacctggcttttactttattaa

SEQ ID NO: 1213420 - DNA, 16 bp, Homo sapiens
atacctggctttttaa

SEQ ID NO: 1213421 - DNA, 14 bp, Homo sapiens
atacctgtcaatac

SEQ ID NO: 1213422 - DNA, 22 bp, Homo sapiens
atacctgtctaggaaggtgtga

SEQ ID NO: 1213423 - DNA, 15 bp, Homo sapiens
ataccttatttattt

SEQ ID NO: 1213424 - DNA, 19 bp, Homo sapiens
ataccttctgacagcccaa

SEQ ID NO: 1213425 - DNA, 17 bp, Homo sapiens
ataccttgaaaggcagg

SEQ ID NO: 1213426 - DNA, 15 bp, Homo sapiens
atacctttccttttt

SEQ ID NO: 1213427 - DNA, 22 bp, Homo sapiens
atacctttcctttttggggagt

SEQ ID NO: 1213428 - DNA, 22 bp, Homo sapiens
atacctttgcgtggatcaagct

SEQ ID NO: 1213429 - DNA, 14 bp, Homo sapiens
ataccttttttaga

SEQ ID NO: 1213430 - DNA, 16 bp, Homo sapiens
atacgaaaatcccatg

SEQ ID NO: 1213431 - DNA, 18 bp, Homo sapiens
atacgaaataattgttgt

SEQ ID NO: 1213432 - DNA, 19 bp, Homo sapiens
atacgaaataattgttgtt

SEQ ID NO: 1213433 - DNA, 17 bp, Homo sapiens
atacgactttattttct

SEQ ID NO: 1213434 - DNA, 19 bp, Homo sapiens
atacgagagcagaggtctc

SEQ ID NO: 1213435 - DNA, 20 bp, Homo sapiens
atacgagagcagaggtctcc

SEQ ID NO: 1213436 - DNA, 20 bp, Homo sapiens
atacgcaaaaacttccttta

SEQ ID NO: 1213437 - DNA, 17 bp, Homo sapiens
atacgcactacatgtgg

SEQ ID NO: 1213438 - DNA, 21 bp, Homo sapiens
atacgcctttaaaggttttta

SEQ ID NO: 1213439 - DNA, 18 bp, Homo sapiens
atacgggagtgacccagc

SEQ ID NO: 1213440 - DNA, 18 bp, Homo sapiens
atacggtcaggtttaaca

SEQ ID NO: 1213441 - DNA, 13 bp, Homo sapiens
atacgtacacatt

SEQ ID NO: 1213442 - DNA, 15 bp, Homo sapiens
atacgtacacatttt

SEQ ID NO: 1213443 - DNA, 16 bp, Homo sapiens
atacgtattacaaaca

SEQ ID NO: 1213444 - DNA, 20 bp, Homo sapiens
atacgtgccagatataactg

SEQ ID NO: 1213445 - DNA, 21 bp, Homo sapiens
atacgtgccagatataactgt

SEQ ID NO: 1213446 - DNA, 17 bp, Homo sapiens
atacgtgttaggaggct

SEQ ID NO: 1213447 - DNA, 21 bp, Homo sapiens
atacgttttggtgttgctttt

SEQ ID NO: 1213448 - DNA, 15 bp, Homo sapiens
atactaaaactcaga

SEQ ID NO: 1213449 - DNA, 19 bp, Homo sapiens
atactaaccagcagaaatg

SEQ ID NO: 1213450 - DNA, 20 bp, Homo sapiens
atactaaccagcagaaatgc

SEQ ID NO: 1213451 - DNA, 23 bp, Homo sapiens
atactaagaataacaagaagccc

SEQ ID NO: 1213452 - DNA, 23 bp, Homo sapiens
atactaatgatgagcatttagca

SEQ ID NO: 1213453 - DNA, 19 bp, Homo sapiens
atactaatttttgcttaac

SEQ ID NO: 1213454 - DNA, 22 bp, Homo sapiens
atactaatttttgcttaacatt

SEQ ID NO: 1213455 - DNA, 17 bp, Homo sapiens
atactacaacttttgtt

SEQ ID NO: 1213456 - DNA, 16 bp, Homo sapiens
atactaccctttgctg

SEQ ID NO: 1213457 - DNA, 13 bp, Homo sapiens
atactactcctgt

SEQ ID NO: 1213458 - DNA, 14 bp, Homo sapiens
atactactgaaaca

SEQ ID NO: 1213459 - DNA, 21 bp, Homo sapiens
atactagggagccatttgaga

SEQ ID NO: 1213460 - DNA, 14 bp, Homo sapiens
atactatatttatg

SEQ ID NO: 1213461 - DNA, 17 bp, Homo sapiens
atactatccatgtaata

SEQ ID NO: 1213462 - DNA, 12 bp, Homo sapiens
atactattctca

SEQ ID NO: 1213463 - DNA, 18 bp, Homo sapiens
atactatttagattttct

SEQ ID NO: 1213464 - DNA, 19 bp, Homo sapiens
atactcaaatgagtaacat

SEQ ID NO: 1213465 - DNA, 20 bp, Homo sapiens
atactcaaatgagtaacatt

SEQ ID NO: 1213466 - DNA, 14 bp, Homo sapiens
atactcaaatggtg

SEQ ID NO: 1213467 - DNA, 23 bp, Homo sapiens
atactcaaatggtgtcatggctg

SEQ ID NO: 1213468 - DNA, 12 bp, Homo sapiens
atactcaaggtg

SEQ ID NO: 1213469 - DNA, 16 bp, Homo sapiens
atactcacattttgtt

SEQ ID NO: 1213470 - DNA, 17 bp, Homo sapiens
atactcagaactgtccc

SEQ ID NO: 1213471 - DNA, 14 bp, Homo sapiens
atactcatgaatga

SEQ ID NO: 1213472 - DNA, 21 bp, Homo sapiens
atactcatgaccattagaata

SEQ ID NO: 1213473 - DNA, 14 bp, Homo sapiens
atactcatgtgcaa

SEQ ID NO: 1213474 - DNA, 12 bp, Homo sapiens
atactccagaga

SEQ ID NO: 1213475 - DNA, 18 bp, Homo sapiens
atactctagaacatgcac

SEQ ID NO: 1213476 - DNA, 22 bp, Homo sapiens
atactctagaacatgcacattt

SEQ ID NO: 1213477 - DNA, 20 bp, Homo sapiens
atactctgtagtctcagttc

SEQ ID NO: 1213478 - DNA, 21 bp, Homo sapiens
atactcttaggaagagaaacc

SEQ ID NO: 1213479 - DNA, 13 bp, Homo sapiens
atactcttgaaag

SEQ ID NO: 1213480 - DNA, 17 bp, Homo sapiens
atactgaaaatccaata

SEQ ID NO: 1213481 - DNA, 23 bp, Homo sapiens
atactgaaaatccaataatcaga

SEQ ID NO: 1213482 - DNA, 16 bp, Homo sapiens
atactgaaagatctct

SEQ ID NO: 1213483 - DNA, 20 bp, Homo sapiens
atactgaacatctgagtcct

SEQ ID NO: 1213484 - DNA, 13 bp, Homo sapiens
atactgaaggaaa

SEQ ID NO: 1213485 - DNA, 17 bp, Homo sapiens
atactgaagtgtgggat

SEQ ID NO: 1213486 - DNA, 15 bp, Homo sapiens
atactgacagaagtt

SEQ ID NO: 1213487 - DNA, 22 bp, Homo sapiens
atactgagatgctgggctgtct

SEQ ID NO: 1213488 - DNA, 13 bp, Homo sapiens
atactgagcctgc

SEQ ID NO: 1213489 - DNA, 21 bp, Homo sapiens
atactgagcttttgagtgttc

SEQ ID NO: 1213490 - DNA, 22 bp, Homo sapiens
atactgagggaccaactgggcc

SEQ ID NO: 1213491 - DNA, 23 bp, Homo sapiens
atactgaggggttggtgataact

SEQ ID NO: 1213492 - DNA, 22 bp, Homo sapiens
atactgattgggaggtgcgtgt

SEQ ID NO: 1213493 - DNA, 14 bp, Homo sapiens
atactgcaagaaaa

SEQ ID NO: 1213494 - DNA, 19 bp, Homo sapiens
atactgcagtgtgaatttt

SEQ ID NO: 1213495 - DNA, 22 bp, Homo sapiens
atactgccggtcacccaggctc

SEQ ID NO: 1213496 - DNA, 22 bp, Homo sapiens
atactgcgactttctgcctgga

SEQ ID NO: 1213497 - DNA, 22 bp, Homo sapiens
atactgctacagcaatttctaa

SEQ ID NO: 1213498 - DNA, 16 bp, Homo sapiens
atactgctactgtaat

SEQ ID NO: 1213499 - DNA, 19 bp, Homo sapiens
atactgctactgtaatttt

SEQ ID NO: 1213500 - DNA, 13 bp, Homo sapiens
atagacttgggat

SEQ ID NO: 1213501 - DNA, 17 bp, Homo sapiens
atagagaatgttccaga

SEQ ID NO: 1213502 - DNA, 23 bp, Homo sapiens
atagagactgtagattgcttctg

SEQ ID NO: 1213503 - DNA, 11 bp, Homo sapiens
atagagagaga

SEQ ID NO: 1213504 - DNA, 14 bp, Homo sapiens
atagagagagaggt

SEQ ID NO: 1213505 - DNA, 19 bp, Homo sapiens
atagagaggcctgctttgt

SEQ ID NO: 1213506 - DNA, 21 bp, Homo sapiens
atagagagggagaagaagtca

SEQ ID NO: 1213507 - DNA, 17 bp, Homo sapiens
atagagagggggctctc

SEQ ID NO: 1213508 - DNA, 14 bp, Homo sapiens
atagagattgtaca

SEQ ID NO: 1213509 - DNA, 17 bp, Homo sapiens
atagagattgtacattt

SEQ ID NO: 1213510 - DNA, 20 bp, Homo sapiens
atagagcaaaatcaacatga

SEQ ID NO: 1213511 - DNA, 14 bp, Homo sapiens
atagagctgccact

SEQ ID NO: 1213512 - DNA, 17 bp, Homo sapiens
atagagctgggtggcct

SEQ ID NO: 1213513 - DNA, 13 bp, Homo sapiens
atagagctgtatt

SEQ ID NO: 1213514 - DNA, 16 bp, Homo sapiens
atagagcttttaaaaa

SEQ ID NO: 1213515 - DNA, 22 bp, Homo sapiens
atagagctttttaatagcacta

SEQ ID NO: 1213516 - DNA, 14 bp, Homo sapiens
atagaggaagaaat

SEQ ID NO: 1213517 - DNA, 13 bp, Homo sapiens
atagaggcccagg

SEQ ID NO: 1213518 - DNA, 14 bp, Homo sapiens
atagaggttttgta

SEQ ID NO: 1213519 - DNA, 15 bp, Homo sapiens
atagaggttttgtat

SEQ ID NO: 1213520 - DNA, 17 bp, Homo sapiens
atagagtaatgatgtaa

SEQ ID NO: 1213521 - DNA, 16 bp, Homo sapiens
atagagtgtgatgtat

SEQ ID NO: 1213522 - DNA, 15 bp, Homo sapiens
atagagttggagttt

SEQ ID NO: 1213523 - DNA, 18 bp, Homo sapiens
atagagttggagttttat

SEQ ID NO: 1213524 - DNA, 20 bp, Homo sapiens
atagataagagtagaaactg

SEQ ID NO: 1213525 - DNA, 21 bp, Homo sapiens
atagataccctacgctgtcca

SEQ ID NO: 1213526 - DNA, 14 bp, Homo sapiens
atagatataatgaa

SEQ ID NO: 1213527 - DNA, 15 bp, Homo sapiens
atagtcctttttcca

SEQ ID NO: 1213528 - DNA, 19 bp, Homo sapiens
atagtcctttttccaatgt

SEQ ID NO: 1213529 - DNA, 17 bp, Homo sapiens
atagtcgtgaatcttgt

SEQ ID NO: 1213530 - DNA, 14 bp, Homo sapiens
atagtctacagttg

SEQ ID NO: 1213531 - DNA, 20 bp, Homo sapiens
atagtctacagttgtcctga

SEQ ID NO: 1213532 - DNA, 14 bp, Homo sapiens
atagtcttttgctt

SEQ ID NO: 1213533 - DNA, 16 bp, Homo sapiens
atagtcttttgctttt

SEQ ID NO: 1213534 - DNA, 16 bp, Homo sapiens
atagtgaaaaatgtca

SEQ ID NO: 1213535 - DNA, 13 bp, Homo sapiens
atagtgaatactg

SEQ ID NO: 1213536 - DNA, 14 bp, Homo sapiens
atagtgagagagga

SEQ ID NO: 1213537 - DNA, 22 bp, Homo sapiens
atagtgatttccttaatgaaaa

SEQ ID NO: 1213538 - DNA, 19 bp, Homo sapiens
atagtgcaacatctctgaa

SEQ ID NO: 1213539 - DNA, 16 bp, Homo sapiens
atagtgcaatagtgca

SEQ ID NO: 1213540 - DNA, 13 bp, Homo sapiens
atagtgccaggtg

SEQ ID NO: 1213541 - DNA, 18 bp, Homo sapiens
atagtgccaggtggctca

SEQ ID NO: 1213542 - DNA, 17 bp, Homo sapiens
atagtgcctaaaattgt

SEQ ID NO: 1213543 - DNA, 18 bp, Homo sapiens
atagtgcctaaaattgta

SEQ ID NO: 1213544 - DNA, 22 bp, Homo sapiens
atagtgcctaaaattgtatgaa

SEQ ID NO: 1213545 - DNA, 22 bp, Homo sapiens
atagtgctgggatggaggggag

SEQ ID NO: 1213546 - DNA, 20 bp, Homo sapiens
atagtgggcaccccactgca

SEQ ID NO: 1213547 - DNA, 16 bp, Homo sapiens
atagtgggtacatcaa

SEQ ID NO: 1213548 - DNA, 13 bp, Homo sapiens
atagtgtaaaata

SEQ ID NO: 1213549 - DNA, 19 bp, Homo sapiens
atagtgtaagaactgtaca

SEQ ID NO: 1213550 - DNA, 20 bp, Homo sapiens
atagtgtaagaactgtacat

SEQ ID NO: 1213551 - DNA, 19 bp, Homo sapiens
atagtgtagctgaggaggc

SEQ ID NO: 1213552 - DNA, 23 bp, Homo sapiens
atagtgtataccacctgtacata

SEQ ID NO: 1213553 - DNA, 18 bp, Homo sapiens
atagtgtcatataaactc

SEQ ID NO: 1213554 - DNA, 20 bp, Homo sapiens
atagtgtcatataaactcat

SEQ ID NO: 1213555 - DNA, 13 bp, Homo sapiens
atagtgtcctgcc

SEQ ID NO: 1213556 - DNA, 12 bp, Homo sapiens
atagtgtctttg

SEQ ID NO: 1213557 - DNA, 13 bp, Homo sapiens
atagtgtgaggga

SEQ ID NO: 1213558 - DNA, 23 bp, Homo sapiens
atagtgtggaaattaagaagaaa

SEQ ID NO: 1213559 - DNA, 15 bp, Homo sapiens
atagtgtgttctgat

SEQ ID NO: 1213560 - DNA, 21 bp, Homo sapiens
atagtgtgttctgattagaaa

SEQ ID NO: 1213561 - DNA, 23 bp, Homo sapiens
atagtgtgttctgattagaaatg

SEQ ID NO: 1213562 - DNA, 21 bp, Homo sapiens
atagtgtgttgtgctttcaag

SEQ ID NO: 1213563 - DNA, 14 bp, Homo sapiens
atagtgttcacaaa

SEQ ID NO: 1213564 - DNA, 16 bp, Homo sapiens
atagtgttcacaaact

SEQ ID NO: 1213565 - DNA, 17 bp, Homo sapiens
atagtgttcacaaactg

SEQ ID NO: 1213566 - DNA, 16 bp, Homo sapiens
atagtgttctgctcct

SEQ ID NO: 1213567 - DNA, 14 bp, Homo sapiens
atagtgtttaactg

SEQ ID NO: 1213568 - DNA, 22 bp, Homo sapiens
atagtgtttaactggcatggat

SEQ ID NO: 1213569 - DNA, 15 bp, Homo sapiens
atagttaacacacta

SEQ ID NO: 1213570 - DNA, 14 bp, Homo sapiens
atagttaatatagt

SEQ ID NO: 1213571 - DNA, 17 bp, Homo sapiens
atagttactgtgtaatt

SEQ ID NO: 1213572 - DNA, 18 bp, Homo sapiens
atagttatatgtacagtt

SEQ ID NO: 1213573 - DNA, 21 bp, Homo sapiens
atataatttgagtgtatatat

SEQ ID NO: 1213574 - DNA, 23 bp, Homo sapiens
atataatttgagtgtatatatat

SEQ ID NO: 1213575 - DNA, 10 bp, Homo sapiens
atataatttt

SEQ ID NO: 1213576 - DNA, 12 bp, Homo sapiens
atataattttat

SEQ ID NO: 1213577 - DNA, 23 bp, Homo sapiens
atataatttttttatgttttgtt

SEQ ID NO: 1213578 - DNA, 16 bp, Homo sapiens
atatacaaaactttat

SEQ ID NO: 1213579 - DNA, 16 bp, Homo sapiens
atatacaataacataa

SEQ ID NO: 1213580 - DNA, 15 bp, Homo sapiens
atatacacatacata

SEQ ID NO: 1213581 - DNA, 16 bp, Homo sapiens
atatacacatacatac

SEQ ID NO: 1213582 - DNA, 17 bp, Homo sapiens
atatacagtttgacttt

SEQ ID NO: 1213583 - DNA, 18 bp, Homo sapiens
atatacatactgcatctt

SEQ ID NO: 1213584 - DNA, 15 bp, Homo sapiens
atatacatatatata

SEQ ID NO: 1213585 - DNA, 18 bp, Homo sapiens
atatacatatatatatac

SEQ ID NO: 1213586 - DNA, 16 bp, Homo sapiens
atatacatgaagaata

SEQ ID NO: 1213587 - DNA, 11 bp, Homo sapiens
atatacattgt

SEQ ID NO: 1213588 - DNA, 17 bp, Homo sapiens
atatacattgtgtgaaa

SEQ ID NO: 1213589 - DNA, 23 bp, Homo sapiens
atatacattgtgtgaaaaaagaa

SEQ ID NO: 1213590 - DNA, 12 bp, Homo sapiens
atatacatttca

SEQ ID NO: 1213591 - DNA, 13 bp, Homo sapiens
atatacattttct

SEQ ID NO: 1213592 - DNA, 16 bp, Homo sapiens
atatacattttctaaa

SEQ ID NO: 1213593 - DNA, 20 bp, Homo sapiens
atataccactctttaccttt

SEQ ID NO: 1213594 - DNA, 22 bp, Homo sapiens
atataccactctttacctttat

SEQ ID NO: 1213595 - DNA, 18 bp, Homo sapiens
atataccccaaattgtgt

SEQ ID NO: 1213596 - DNA, 21 bp, Homo sapiens
atataccttatttatttttgt

SEQ ID NO: 1213597 - DNA, 22 bp, Homo sapiens
atatactaagatgttcactgtg

SEQ ID NO: 1213598 - DNA, 15 bp, Homo sapiens
atatactcattagaa

SEQ ID NO: 1213599 - DNA, 18 bp, Homo sapiens
atatactgggttcttgtt

SEQ ID NO: 1213600 - DNA, 13 bp, Homo sapiens
atatacttatttt

SEQ ID NO: 1213601 - DNA, 11 bp, Homo sapiens
atatacttttt

SEQ ID NO: 1213602 - DNA, 14 bp, Homo sapiens
atatagaaaacaaa

SEQ ID NO: 1213603 - DNA, 18 bp, Homo sapiens
atatagcacttttgaaga

SEQ ID NO: 1213604 - DNA, 20 bp, Homo sapiens
atatagcattgataatcttc

SEQ ID NO: 1213605 - DNA, 20 bp, Homo sapiens
atatagctgtacaaatataa

SEQ ID NO: 1213606 - DNA, 18 bp, Homo sapiens
atataggaaaacaataat

SEQ ID NO: 1213607 - DNA, 13 bp, Homo sapiens
atataggctattt

SEQ ID NO: 1213608 - DNA, 15 bp, Homo sapiens
atataggttgtgcaa

SEQ ID NO: 1213609 - DNA, 16 bp, Homo sapiens
atataggttgtgcaaa

SEQ ID NO: 1213610 - DNA, 14 bp, Homo sapiens
atatagtaaacact

SEQ ID NO: 1213611 - DNA, 20 bp, Homo sapiens
atatagtaggggttgaagaa

SEQ ID NO: 1213612 - DNA, 21 bp, Homo sapiens
atatagtaggggttgaagaaa

SEQ ID NO: 1213613 - DNA, 19 bp, Homo sapiens
atatagtatatttatactc

SEQ ID NO: 1213614 - DNA, 16 bp, Homo sapiens
atatagtctacagttg

SEQ ID NO: 1213615 - DNA, 21 bp, Homo sapiens
atatagtctattcattaagta

SEQ ID NO: 1213616 - DNA, 13 bp, Homo sapiens
atatagtgaaaaa

SEQ ID NO: 1213617 - DNA, 15 bp, Homo sapiens
atatagtgctgttta

SEQ ID NO: 1213618 - DNA, 20 bp, Homo sapiens
atatagtgctgtttaagcta

SEQ ID NO: 1213619 - DNA, 17 bp, Homo sapiens
atatagttagctaataa

SEQ ID NO: 1213620 - DNA, 19 bp, Homo sapiens
atatagttctgtgtagaga

SEQ ID NO: 1213621 - DNA, 23 bp, Homo sapiens
atatagttttacttttaaactgt

SEQ ID NO: 1213622 - DNA, 21 bp, Homo sapiens
atatagtttttaccttttatg

SEQ ID NO: 1213623 - DNA, 21 bp, Homo sapiens
atatataaaaagaaaagataa

SEQ ID NO: 1213624 - DNA, 21 bp, Homo sapiens
atatataaacctaaaaaagat

SEQ ID NO: 1213625 - DNA, 14 bp, Homo sapiens
atatataaagatat

SEQ ID NO: 1213626 - DNA, 13 bp, Homo sapiens
atatataaatata

SEQ ID NO: 1213627 - DNA, 17 bp, Homo sapiens
atatataacagatacat

SEQ ID NO: 1213628 - DNA, 15 bp, Homo sapiens
atatatttaatatgt

SEQ ID NO: 1213629 - DNA, 23 bp, Homo sapiens
atatatttatggccgggcagggt

SEQ ID NO: 1213630 - DNA, 22 bp, Homo sapiens
atatatttcacgtgttccctct

SEQ ID NO: 1213631 - DNA, 15 bp, Homo sapiens
atatatttcactttt

SEQ ID NO: 1213632 - DNA, 22 bp, Homo sapiens
atatatttcacttttgttctgc

SEQ ID NO: 1213633 - DNA, 13 bp, Homo sapiens
atatatttctatt

SEQ ID NO: 1213634 - DNA, 18 bp, Homo sapiens
atatatttgcagataatt

SEQ ID NO: 1213635 - DNA, 20 bp, Homo sapiens
atatatttgtaaaagatgaa

SEQ ID NO: 1213636 - DNA, 16 bp, Homo sapiens
atatattttacaattt

SEQ ID NO: 1213637 - DNA, 19 bp, Homo sapiens
atatattttacatctggga

SEQ ID NO: 1213638 - DNA, 13 bp, Homo sapiens
atatattttcaag

SEQ ID NO: 1213639 - DNA, 15 bp, Homo sapiens
atatattttctgttt

SEQ ID NO: 1213640 - DNA, 13 bp, Homo sapiens
atatatttttaaa

SEQ ID NO: 1213641 - DNA, 23 bp, Homo sapiens
atatatttttaaaatatttaact

SEQ ID NO: 1213642 - DNA, 14 bp, Homo sapiens
atatatttttatat

SEQ ID NO: 1213643 - DNA, 14 bp, Homo sapiens
atatatttttcaaa

SEQ ID NO: 1213644 - DNA, 16 bp, Homo sapiens
atatatttttcaaata

SEQ ID NO: 1213645 - DNA, 21 bp, Homo sapiens
atatatttttcaaatagattt

SEQ ID NO: 1213646 - DNA, 21 bp, Homo sapiens
atatatttttcacagtttttc

SEQ ID NO: 1213647 - DNA, 20 bp, Homo sapiens
atatatttttctgagatttt

SEQ ID NO: 1213648 - DNA, 22 bp, Homo sapiens
atatattttttaaaataagtct

SEQ ID NO: 1213649 - DNA, 17 bp, Homo sapiens
atatattttttgctttt

SEQ ID NO: 1213650 - DNA, 17 bp, Homo sapiens
atatcaaaaaaccttta

SEQ ID NO: 1213651 - DNA, 14 bp, Homo sapiens
atatcaaaattcta

SEQ ID NO: 1213652 - DNA, 15 bp, Homo sapiens
atatcaaaattctag

SEQ ID NO: 1213653 - DNA, 22 bp, Homo sapiens
atatcaaagagaagatgcctgt

SEQ ID NO: 1213654 - DNA, 21 bp, Homo sapiens
atatcaaagtcattaaagaca

SEQ ID NO: 1213655 - DNA, 14 bp, Homo sapiens
atatcaaataaaat

SEQ ID NO: 1213656 - DNA, 23 bp, Homo sapiens
atatcaaataaaatatcataaag

SEQ ID NO: 1213657 - DNA, 21 bp, Homo sapiens
atatcaacagatagttgtgtt

SEQ ID NO: 1213658 - DNA, 13 bp, Homo sapiens
atatcaactctca

SEQ ID NO: 1213659 - DNA, 20 bp, Homo sapiens
atatcaactctgaagctaat

SEQ ID NO: 1213660 - DNA, 13 bp, Homo sapiens
atatcaacttatt

SEQ ID NO: 1213661 - DNA, 15 bp, Homo sapiens
atatcaatcacatta

SEQ ID NO: 1213662 - DNA, 17 bp, Homo sapiens
atatcacctctcttcag

SEQ ID NO: 1213663 - DNA, 15 bp, Homo sapiens
atatcactaaataaa

SEQ ID NO: 1213664 - DNA, 16 bp, Homo sapiens
atatcactaaataaac

SEQ ID NO: 1213665 - DNA, 19 bp, Homo sapiens
atatcactaatttcttctt

SEQ ID NO: 1213666 - DNA, 20 bp, Homo sapiens
atatcactcaagccagtgtt

SEQ ID NO: 1213667 - DNA, 14 bp, Homo sapiens
atatcactcattaa

SEQ ID NO: 1213668 - DNA, 17 bp, Homo sapiens
atatcactcattaatta

SEQ ID NO: 1213669 - DNA, 14 bp, Homo sapiens
atatcagacaagca

SEQ ID NO: 1213670 - DNA, 16 bp, Homo sapiens
atatcagacaagcact

SEQ ID NO: 1213671 - DNA, 17 bp, Homo sapiens
atatcaggctattattt

SEQ ID NO: 1213672 - DNA, 22 bp, Homo sapiens
atatcaggctattatttattgt

SEQ ID NO: 1213673 - DNA, 14 bp, Homo sapiens
atatcaggtgtata

SEQ ID NO: 1213674 - DNA, 18 bp, Homo sapiens
atatcaggtgtataaatg

SEQ ID NO: 1213675 - DNA, 19 bp, Homo sapiens
atatcaggtgtataaatgt

SEQ ID NO: 1213676 - DNA, 18 bp, Homo sapiens
atatcagtattctgacat

SEQ ID NO: 1213677 - DNA, 17 bp, Homo sapiens
atatcagttactcagcc

SEQ ID NO: 1213678 - DNA, 19 bp, Homo sapiens
atatcagttactcagccct

SEQ ID NO: 1213679 - DNA, 21 bp, Homo sapiens
atatcagttactcagccctgg

SEQ ID NO: 1213680 - DNA, 19 bp, Homo sapiens
atatcatacagttttcatt

SEQ ID NO: 1213681 - DNA, 14 bp, Homo sapiens
atatcatatgtata

SEQ ID NO: 1213682 - DNA, 18 bp, Homo sapiens
atatcatcacgtatgtta

SEQ ID NO: 1213683 - DNA, 18 bp, Homo sapiens
atatcatgaaacacttct

SEQ ID NO: 1213684 - DNA, 21 bp, Homo sapiens
atatcatgaagccttgctgaa

SEQ ID NO: 1213685 - DNA, 18 bp, Homo sapiens
atatcatgtcttgtgcat

SEQ ID NO: 1213686 - DNA, 22 bp, Homo sapiens
atatcatgttaaattagaatga

SEQ ID NO: 1213687 - DNA, 19 bp, Homo sapiens
atatcattctacagaataa

SEQ ID NO: 1213688 - DNA, 20 bp, Homo sapiens
atatcattctacagaataat

SEQ ID NO: 1213689 - DNA, 13 bp, Homo sapiens
atatcatttactc

SEQ ID NO: 1213690 - DNA, 12 bp, Homo sapiens
atatcatttctt

SEQ ID NO: 1213691 - DNA, 12 bp, Homo sapiens
atatcatttgtg

SEQ ID NO: 1213692 - DNA, 13 bp, Homo sapiens
atatcatttgtga

SEQ ID NO: 1213693 - DNA, 18 bp, Homo sapiens
atatggaacttctaatat

SEQ ID NO: 1213694 - DNA, 20 bp, Homo sapiens
atatggaacttctaatatat

SEQ ID NO: 1213695 - DNA, 15 bp, Homo sapiens
atatggaagaaagta

SEQ ID NO: 1213696 - DNA, 16 bp, Homo sapiens
atatggaagaaagtaa

SEQ ID NO: 1213697 - DNA, 16 bp, Homo sapiens
atatggaagcaaccag

SEQ ID NO: 1213698 - DNA, 22 bp, Homo sapiens
atatggagtgagtcacctgctc

SEQ ID NO: 1213699 - DNA, 17 bp, Homo sapiens
atatggcagagttgtaa

SEQ ID NO: 1213700 - DNA, 23 bp, Homo sapiens
atatggcagagttgtaaatatat

SEQ ID NO: 1213701 - DNA, 14 bp, Homo sapiens
atatggcaggactc

SEQ ID NO: 1213702 - DNA, 17 bp, Homo sapiens
atatggcatatttatat

SEQ ID NO: 1213703 - DNA, 15 bp, Homo sapiens
atatggcccagcctt

SEQ ID NO: 1213704 - DNA, 19 bp, Homo sapiens
atatggcggcctgcagtgg

SEQ ID NO: 1213705 - DNA, 14 bp, Homo sapiens
atatggcttcaagt

SEQ ID NO: 1213706 - DNA, 19 bp, Homo sapiens
atatggcttcaagttgtaa

SEQ ID NO: 1213707 - DNA, 14 bp, Homo sapiens
atatgggagaaata

SEQ ID NO: 1213708 - DNA, 17 bp, Homo sapiens
atatgggcattgtagtt

SEQ ID NO: 1213709 - DNA, 18 bp, Homo sapiens
atatggggggccaacacc

SEQ ID NO: 1213710 - DNA, 23 bp, Homo sapiens
atatggggggccaacaccaggga

SEQ ID NO: 1213711 - DNA, 13 bp, Homo sapiens
atatggtggaaaa

SEQ ID NO: 1213712 - DNA, 19 bp, Homo sapiens
atatggttctccaagaaac

SEQ ID NO: 1213713 - DNA, 18 bp, Homo sapiens
atatggttggagagccct

SEQ ID NO: 1213714 - DNA, 16 bp, Homo sapiens
atatgtaaaacattta

SEQ ID NO: 1213715 - DNA, 18 bp, Homo sapiens
atatgtaaaacatttatt

SEQ ID NO: 1213716 - DNA, 15 bp, Homo sapiens
atatgtaaaataaaa

SEQ ID NO: 1213717 - DNA, 20 bp, Homo sapiens
atatgtaaaataaaattatg

SEQ ID NO: 1213718 - DNA, 11 bp, Homo sapiens
atatgtaaatg

SEQ ID NO: 1213719 - DNA, 12 bp, Homo sapiens
atatgtaaatgt

SEQ ID NO: 1213720 - DNA, 13 bp, Homo sapiens
atatgtaaatgtg

SEQ ID NO: 1213721 - DNA, 14 bp, Homo sapiens
atatgtaaatgtgt

SEQ ID NO: 1213722 - DNA, 18 bp, Homo sapiens
atatgtaaatgtgttagc

SEQ ID NO: 1213723 - DNA, 20 bp, Homo sapiens
atatgtaacagtcaaatatc

SEQ ID NO: 1213724 - DNA, 14 bp, Homo sapiens
atatgtaatttcaa

SEQ ID NO: 1213725 - DNA, 20 bp, Homo sapiens
atatgtaatttcaaaataca

SEQ ID NO: 1213726 - DNA, 12 bp, Homo sapiens
atatgtacagtt

SEQ ID NO: 1213727 - DNA, 16 bp, Homo sapiens
atatgtacagttatct

SEQ ID NO: 1213728 - DNA, 14 bp, Homo sapiens
atatgtacatgaga

SEQ ID NO: 1213729 - DNA, 20 bp, Homo sapiens
atatgtacttgtcaaagaag

SEQ ID NO: 1213730 - DNA, 21 bp, Homo sapiens
atatgtacttgtcaaagaagg

SEQ ID NO: 1213731 - DNA, 20 bp, Homo sapiens
atatgtagatattgttttct

SEQ ID NO: 1213732 - DNA, 23 bp, Homo sapiens
atatgtagatgtatgcacacaca

SEQ ID NO: 1213733 - DNA, 14 bp, Homo sapiens
atatgtatacttat

SEQ ID NO: 1213734 - DNA, 13 bp, Homo sapiens
atatgtatatata

SEQ ID NO: 1213735 - DNA, 20 bp, Homo sapiens
atattcagccagcttaaacc

SEQ ID NO: 1213736 - DNA, 19 bp, Homo sapiens
atattcaggagttggaatg

SEQ ID NO: 1213737 - DNA, 22 bp, Homo sapiens
atattcagtgctgtggcctggg

SEQ ID NO: 1213738 - DNA, 22 bp, Homo sapiens
atattcatattaggtggttctc

SEQ ID NO: 1213739 - DNA, 23 bp, Homo sapiens
atattcatctaataaatcagtga

SEQ ID NO: 1213740 - DNA, 19 bp, Homo sapiens
atattcatgaaatgtggaa

SEQ ID NO: 1213741 - DNA, 18 bp, Homo sapiens
atattcatgcttcttcct

SEQ ID NO: 1213742 - DNA, 18 bp, Homo sapiens
atattcatggttgttttt

SEQ ID NO: 1213743 - DNA, 18 bp, Homo sapiens
atattcattggcagctca

SEQ ID NO: 1213744 - DNA, 15 bp, Homo sapiens
atattccaaggaaaa

SEQ ID NO: 1213745 - DNA, 18 bp, Homo sapiens
atattccaccattcacat

SEQ ID NO: 1213746 - DNA, 20 bp, Homo sapiens
atattccaccattcacattt

SEQ ID NO: 1213747 - DNA, 19 bp, Homo sapiens
atattccagcagtgaaact

SEQ ID NO: 1213748 - DNA, 14 bp, Homo sapiens
atattccatgtata

SEQ ID NO: 1213749 - DNA, 16 bp, Homo sapiens
atattccatgtataag

SEQ ID NO: 1213750 - DNA, 17 bp, Homo sapiens
atattccctagaaactt

SEQ ID NO: 1213751 - DNA, 18 bp, Homo sapiens
atattccgtatttaaagt

SEQ ID NO: 1213752 - DNA, 22 bp, Homo sapiens
atattcctggacttacaaaatg

SEQ ID NO: 1213753 - DNA, 12 bp, Homo sapiens
atattcctttga

SEQ ID NO: 1213754 - DNA, 17 bp, Homo sapiens
atattcctttttctatg

SEQ ID NO: 1213755 - DNA, 19 bp, Homo sapiens
atattctacacatgtaaaa

SEQ ID NO: 1213756 - DNA, 22 bp, Homo sapiens
atattctacacatgtaaaatat

SEQ ID NO: 1213757 - DNA, 19 bp, Homo sapiens
atattctactgtacttttt

SEQ ID NO: 1213758 - DNA, 22 bp, Homo sapiens
atattctattacattttcagtg

SEQ ID NO: 1213759 - DNA, 17 bp, Homo sapiens
atattctattgtttact

SEQ ID NO: 1213760 - DNA, 22 bp, Homo sapiens
atattctcacgggcagtagctg

SEQ ID NO: 1213761 - DNA, 13 bp, Homo sapiens
atattctccctga

SEQ ID NO: 1213762 - DNA, 13 bp, Homo sapiens
atattctctctgt

SEQ ID NO: 1213763 - DNA, 22 bp, Homo sapiens
atattctgaaaggaaatacact

SEQ ID NO: 1213764 - DNA, 16 bp, Homo sapiens
atattctgctctatta

SEQ ID NO: 1213765 - DNA, 15 bp, Homo sapiens
atattctggaaaaaa

SEQ ID NO: 1213766 - DNA, 22 bp, Homo sapiens
atattctggaaaaaaaatatat

SEQ ID NO: 1213767 - DNA, 21 bp, Homo sapiens
atattcttattggaaatgtac

SEQ ID NO: 1213768 - DNA, 12 bp, Homo sapiens
atattcttgtca

SEQ ID NO: 1213769 - DNA, 13 bp, Homo sapiens
atattcttgtcaa

SEQ ID NO: 1213770 - DNA, 19 bp, Homo sapiens
atattcttgtccacattct

SEQ ID NO: 1213771 - DNA, 22 bp, Homo sapiens
atattcttgtccacattctact

SEQ ID NO: 1213772 - DNA, 23 bp, Homo sapiens
atattcttgtccacattctactt

SEQ ID NO: 1213773 - DNA, 16 bp, Homo sapiens
atattgaaaaaataga

SEQ ID NO: 1213774 - DNA, 16 bp, Homo sapiens
atattgaaaattgaaa

SEQ ID NO: 1213775 - DNA, 21 bp, Homo sapiens
atattgaaaattgaaaagtac

SEQ ID NO: 1213776 - DNA, 16 bp, Homo sapiens
atattgaaagttgctt

SEQ ID NO: 1213777 - DNA, 20 bp, Homo sapiens
atattgaacttttgtactga

SEQ ID NO: 1213778 - DNA, 13 bp, Homo sapiens
atattgaagttgt

SEQ ID NO: 1213779 - DNA, 18 bp, Homo sapiens
atattgaatataatatat

SEQ ID NO: 1213780 - DNA, 14 bp, Homo sapiens
atattgaatatatc

SEQ ID NO: 1213781 - DNA, 18 bp, Homo sapiens
atattgaatgtttccaac

SEQ ID NO: 1213782 - DNA, 20 bp, Homo sapiens
atattgacatttgtagttga

SEQ ID NO: 1213783 - DNA, 14 bp, Homo sapiens
atattgagaatcag

SEQ ID NO: 1213784 - DNA, 17 bp, Homo sapiens
atattgagaatcaggtt

SEQ ID NO: 1213785 - DNA, 21 bp, Homo sapiens
atattgagaatcccttaaaat

SEQ ID NO: 1213786 - DNA, 13 bp, Homo sapiens
atattgagcagaa

SEQ ID NO: 1213787 - DNA, 19 bp, Homo sapiens
atattgaggccaagaatat

SEQ ID NO: 1213788 - DNA, 22 bp, Homo sapiens
atattgataagctattgtctgt

SEQ ID NO: 1213789 - DNA, 15 bp, Homo sapiens
atattgatatgctta

SEQ ID NO: 1213790 - DNA, 13 bp, Homo sapiens
atattgatgtgtg

SEQ ID NO: 1213791 - DNA, 18 bp, Homo sapiens
atattgattctgaaattt

SEQ ID NO: 1213792 - DNA, 24 bp, Homo sapiens
atattgatttaaaattgttctact

SEQ ID NO: 1213793 - DNA, 15 bp, Homo sapiens
atattgcaaaataca

SEQ ID NO: 1213794 - DNA, 16 bp, Homo sapiens
atattgccaatgctac

SEQ ID NO: 1213795 - DNA, 15 bp, Homo sapiens
atattgccttatttg

SEQ ID NO: 1213796 - DNA, 19 bp, Homo sapiens
atattgccttatttgtctg

SEQ ID NO: 1213797 - DNA, 21 bp, Homo sapiens
atattgccttatttgtctgta

SEQ ID NO: 1213798 - DNA, 11 bp, Homo sapiens
atattgctaaa

SEQ ID NO: 1213799 - DNA, 18 bp, Homo sapiens
atattgctaaaagtgcat

SEQ ID NO: 1213800 - DNA, 21 bp, Homo sapiens
atattgctgaagaatctactt

SEQ ID NO: 1213801 - DNA, 13 bp, Homo sapiens
atattgctttttc

SEQ ID NO: 1213802 - DNA, 21 bp, Homo sapiens
atattgctttttctaatgtgg

SEQ ID NO: 1213803 - DNA, 22 bp, Homo sapiens
atattgctttttctaatgtggt

SEQ ID NO: 1213804 - DNA, 17 bp, Homo sapiens
atattggatgaaaagag

SEQ ID NO: 1213805 - DNA, 19 bp, Homo sapiens
atattggattgcgcctttg

SEQ ID NO: 1213806 - DNA, 20 bp, Homo sapiens
atattgggaaggaaatatat

SEQ ID NO: 1213807 - DNA, 22 bp, Homo sapiens
atattgggaaggaaatatattt

SEQ ID NO: 1213808 - DNA, 15 bp, Homo sapiens
atattgggtgtagat

SEQ ID NO: 1213809 - DNA, 19 bp, Homo sapiens
atattgggtgtagatttct

SEQ ID NO: 1213810 - DNA, 15 bp, Homo sapiens
atattggtcacgtca

SEQ ID NO: 1213811 - DNA, 17 bp, Homo sapiens
atattgtaaaacaggta

SEQ ID NO: 1213812 - DNA, 12 bp, Homo sapiens
atattgtaaaga

SEQ ID NO: 1213813 - DNA, 16 bp, Homo sapiens
atattgtaaatactgg

SEQ ID NO: 1213814 - DNA, 14 bp, Homo sapiens
atattgtaagaaat

SEQ ID NO: 1213815 - DNA, 15 bp, Homo sapiens
atattgtacaaatgt

SEQ ID NO: 1213816 - DNA, 13 bp, Homo sapiens
atattgtacagtt

SEQ ID NO: 1213817 - DNA, 21 bp, Homo sapiens
atattgtacataaaagaattt

SEQ ID NO: 1213818 - DNA, 15 bp, Homo sapiens
atattgtatattctg

SEQ ID NO: 1213819 - DNA, 20 bp, Homo sapiens
atattgtatattctggaaaa

SEQ ID NO: 1213820 - DNA, 14 bp, Homo sapiens
atattgtgattctg

SEQ ID NO: 1213821 - DNA, 17 bp, Homo sapiens
atattgtgattctgcct

SEQ ID NO: 1213822 - DNA, 21 bp, Homo sapiens
atatttaagtataaaatacaa

SEQ ID NO: 1213823 - DNA, 15 bp, Homo sapiens
atatttaagtatata

SEQ ID NO: 1213824 - DNA, 11 bp, Homo sapiens
atatttaagtg

SEQ ID NO: 1213825 - DNA, 15 bp, Homo sapiens
atatttaatatattg

SEQ ID NO: 1213826 - DNA, 17 bp, Homo sapiens
atatttaatatattgaa

SEQ ID NO: 1213827 - DNA, 21 bp, Homo sapiens
atatttaatgcattaaacctg

SEQ ID NO: 1213828 - DNA, 15 bp, Homo sapiens
atatttaatgtttta

SEQ ID NO: 1213829 - DNA, 22 bp, Homo sapiens
atatttaatgttttaaatgtac

SEQ ID NO: 1213830 - DNA, 16 bp, Homo sapiens
atatttaattaaagca

SEQ ID NO: 1213831 - DNA, 16 bp, Homo sapiens
atatttacaatgtatt

SEQ ID NO: 1213832 - DNA, 17 bp, Homo sapiens
atatttacaatgtatta

SEQ ID NO: 1213833 - DNA, 21 bp, Homo sapiens
atatttacatgaattgcattt

SEQ ID NO: 1213834 - DNA, 15 bp, Homo sapiens
atatttaccttgaaa

SEQ ID NO: 1213835 - DNA, 16 bp, Homo sapiens
atatttaccttgaaaa

SEQ ID NO: 1213836 - DNA, 17 bp, Homo sapiens
atatttactctttgcaa

SEQ ID NO: 1213837 - DNA, 19 bp, Homo sapiens
atatttactctttgcaaac

SEQ ID NO: 1213838 - DNA, 15 bp, Homo sapiens
atatttactgctctt

SEQ ID NO: 1213839 - DNA, 15 bp, Homo sapiens
atatttactgttaga

SEQ ID NO: 1213840 - DNA, 22 bp, Homo sapiens
atatttagatgtaattttgtgt

SEQ ID NO: 1213841 - DNA, 18 bp, Homo sapiens
atatttagcatccctgga

SEQ ID NO: 1213842 - DNA, 22 bp, Homo sapiens
atatttagttacgtataatgct

SEQ ID NO: 1213843 - DNA, 17 bp, Homo sapiens
atatttataaatgagca

SEQ ID NO: 1213844 - DNA, 13 bp, Homo sapiens
atatttataactc

SEQ ID NO: 1213845 - DNA, 17 bp, Homo sapiens
atatttataactcatca

SEQ ID NO: 1213846 - DNA, 21 bp, Homo sapiens
atatttataactcatcataaa

SEQ ID NO: 1213847 - DNA, 15 bp, Homo sapiens
atatttatagtcaca

SEQ ID NO: 1213848 - DNA, 15 bp, Homo sapiens
atatttatatatatt

SEQ ID NO: 1213849 - DNA, 12 bp, Homo sapiens
atatttatgctt

SEQ ID NO: 1213850 - DNA, 20 bp, Homo sapiens
atatttatgtagatgtgcat

SEQ ID NO: 1213851 - DNA, 21 bp, Homo sapiens
atatttatgtctatttaagcc

SEQ ID NO: 1213852 - DNA, 14 bp, Homo sapiens
atatttattatgag

SEQ ID NO: 1213853 - DNA, 23 bp, Homo sapiens
atatttattattttcacctgttt

SEQ ID NO: 1213854 - DNA, 19 bp, Homo sapiens
atatttattcattatttgt

SEQ ID NO: 1213855 - DNA, 19 bp, Homo sapiens
atatttattgttagaaaat

SEQ ID NO: 1213856 - DNA, 22 bp, Homo sapiens
atatttattgtttatttatcag

SEQ ID NO: 1213857 - DNA, 13 bp, Homo sapiens
atatttatttcag

SEQ ID NO: 1213858 - DNA, 20 bp, Homo sapiens
atatttattttcagtatact

SEQ ID NO: 1213859 - DNA, 18 bp, Homo sapiens
atatttatttttttaagc

SEQ ID NO: 1213860 - DNA, 15 bp, Homo sapiens
atatttcagatgtaa

SEQ ID NO: 1213861 - DNA, 20 bp, Homo sapiens
atatttcagatgtaatgttt

SEQ ID NO: 1213862 - DNA, 21 bp, Homo sapiens
atatttcagatgtaatgtttt

SEQ ID NO: 1213863 - DNA, 23 bp, Homo sapiens
atatttcattttaacatgatttc

SEQ ID NO: 1213864 - DNA, 16 bp, Homo sapiens
atatttcctaaggcat

SEQ ID NO: 1213865 - DNA, 17 bp, Homo sapiens
atatttcctaaggcatg

SEQ ID NO: 1213866 - DNA, 23 bp, Homo sapiens
atatttcctaaggcatgtggcct

SEQ ID NO: 1213867 - DNA, 13 bp, Homo sapiens
atatttcctgact

SEQ ID NO: 1213868 - DNA, 12 bp, Homo sapiens
atatttccttta

SEQ ID NO: 1213869 - DNA, 20 bp, Homo sapiens
atatttcctttatgtgaatt

SEQ ID NO: 1213870 - DNA, 12 bp, Homo sapiens
atatttcctttt

SEQ ID NO: 1213871 - DNA, 15 bp, Homo sapiens
atatttcgaaagctg

SEQ ID NO: 1213872 - DNA, 15 bp, Homo sapiens
atatttctaactata

SEQ ID NO: 1213873 - DNA, 21 bp, Homo sapiens
atatttctacagagaaaatga

SEQ ID NO: 1213874 - DNA, 15 bp, Homo sapiens
atatttctgatataa

SEQ ID NO: 1213875 - DNA, 17 bp, Homo sapiens
atatttctgtatatttg

SEQ ID NO: 1213876 - DNA, 18 bp, Homo sapiens
atatttctgtatatttgt

SEQ ID NO: 1213877 - DNA, 21 bp, Homo sapiens
atatttctgtatatttgtcat

SEQ ID NO: 1213878 - DNA, 23 bp, Homo sapiens
atatttctgtatatttgtcatga

SEQ ID NO: 1213879 - DNA, 20 bp, Homo sapiens
atatttcttaatttggataa

SEQ ID NO: 1213880 - DNA, 18 bp, Homo sapiens
atatttcttcaaatatct

SEQ ID NO: 1213881 - DNA, 13 bp, Homo sapiens
atatttcttgctt

SEQ ID NO: 1213882 - DNA, 15 bp, Homo sapiens
atatttcttgctttc

SEQ ID NO: 1213883 - DNA, 19 bp, Homo sapiens
atatttgaattgacagggg

SEQ ID NO: 1213884 - DNA, 13 bp, Homo sapiens
atatttgaatttt

SEQ ID NO: 1213885 - DNA, 20 bp, Homo sapiens
atatttgaattttaaatcta

SEQ ID NO: 1213886 - DNA, 12 bp, Homo sapiens
atatttgacatg

SEQ ID NO: 1213887 - DNA, 20 bp, Homo sapiens
atatttgactctttcaaaga

SEQ ID NO: 1213888 - DNA, 15 bp, Homo sapiens
atatttgacttgcat

SEQ ID NO: 1213889 - DNA, 17 bp, Homo sapiens
atatttgaggagtgtta

SEQ ID NO: 1213890 - DNA, 16 bp, Homo sapiens
atatttgatttctaat

SEQ ID NO: 1213891 - DNA, 11 bp, Homo sapiens
atatttgcaaa

SEQ ID NO: 1213892 - DNA, 21 bp, Homo sapiens
atatttgcaaaccctttgtat

SEQ ID NO: 1213893 - DNA, 17 bp, Homo sapiens
atatttgcaaagtgtat

SEQ ID NO: 1213894 - DNA, 20 bp, Homo sapiens
atatttgcaaagtgtattag

SEQ ID NO: 1213895 - DNA, 23 bp, Homo sapiens
atatttgcagtttttcattttaa

SEQ ID NO: 1213896 - DNA, 11 bp, Homo sapiens
atatttgcatt

SEQ ID NO: 1213897 - DNA, 18 bp, Homo sapiens
atatttgcattatgtatt

SEQ ID NO: 1213898 - DNA, 12 bp, Homo sapiens
atatttgctgca

SEQ ID NO: 1213899 - DNA, 14 bp, Homo sapiens
atatttgctgcaaa

SEQ ID NO: 1213900 - DNA, 13 bp, Homo sapiens
atatttggaaaga

SEQ ID NO: 1213901 - DNA, 23 bp, Homo sapiens
atatttggcgatgaggtaattct

SEQ ID NO: 1213902 - DNA, 23 bp, Homo sapiens
atatttggggtccttttttatac

SEQ ID NO: 1213903 - DNA, 13 bp, Homo sapiens
atatttgtacaaa

SEQ ID NO: 1213904 - DNA, 14 bp, Homo sapiens
atatttgtacaaaa

SEQ ID NO: 1213905 - DNA, 15 bp, Homo sapiens
atatttgtcatgaca

SEQ ID NO: 1213906 - DNA, 21 bp, Homo sapiens
atatttgtcatgctgggattt

SEQ ID NO: 1213907 - DNA, 16 bp, Homo sapiens
atatttgtcttccgat

SEQ ID NO: 1213908 - DNA, 17 bp, Homo sapiens
atatttgtctttgaatc

SEQ ID NO: 1213909 - DNA, 21 bp, Homo sapiens
atatttgtgatagcactttct

SEQ ID NO: 1213910 - DNA, 22 bp, Homo sapiens
atatttgtgatagcactttcta

SEQ ID NO: 1213911 - DNA, 17 bp, Homo sapiens
atatttgtgctatagta

SEQ ID NO: 1213912 - DNA, 22 bp, Homo sapiens
atatttgtgctatagtatttga

SEQ ID NO: 1213913 - DNA, 12 bp, Homo sapiens
atatttgtgtat

SEQ ID NO: 1213914 - DNA, 15 bp, Homo sapiens
atatttgttatgtag

SEQ ID NO: 1213915 - DNA, 14 bp, Homo sapiens
atatttgtttagtt

SEQ ID NO: 1213916 - DNA, 16 bp, Homo sapiens
atattttaaaatgaga

SEQ ID NO: 1213917 - DNA, 15 bp, Homo sapiens
atattttaaaatttg

SEQ ID NO: 1213918 - DNA, 17 bp, Homo sapiens
atattttaaaatttgtt

SEQ ID NO: 1213919 - DNA, 18 bp, Homo sapiens
atattttaaaatttgttc

SEQ ID NO: 1213920 - DNA, 13 bp, Homo sapiens
atattttaaatct

SEQ ID NO: 1213921 - DNA, 14 bp, Homo sapiens
atattttaaatctg

SEQ ID NO: 1213922 - DNA, 13 bp, Homo sapiens
atattttaagaaa

SEQ ID NO: 1213923 - DNA, 14 bp, Homo sapiens
atattttaagaaag

SEQ ID NO: 1213924 - DNA, 16 bp, Homo sapiens
atattttaagaaagag

SEQ ID NO: 1213925 - DNA, 17 bp, Homo sapiens
atattttaagaaagaga

SEQ ID NO: 1213926 - DNA, 18 bp, Homo sapiens
atattttaagccttcatt

SEQ ID NO: 1213927 - DNA, 21 bp, Homo sapiens
atattttaagccttcatttgc

SEQ ID NO: 1213928 - DNA, 22 bp, Homo sapiens
atattttagcattttaattctc

SEQ ID NO: 1213929 - DNA, 13 bp, Homo sapiens
atattttagcctt

SEQ ID NO: 1213930 - DNA, 14 bp, Homo sapiens
atattttataattt

SEQ ID NO: 1213931 - DNA, 15 bp, Homo sapiens
atattttatatgttc

SEQ ID NO: 1213932 - DNA, 19 bp, Homo sapiens
atattttatatgttcatat

SEQ ID NO: 1213933 - DNA, 15 bp, Homo sapiens
atattttatcctgta

SEQ ID NO: 1213934 - DNA, 18 bp, Homo sapiens
atattttatgaacattgt

SEQ ID NO: 1213935 - DNA, 20 bp, Homo sapiens
atattttatgaacattgtac

SEQ ID NO: 1213936 - DNA, 19 bp, Homo sapiens
atattttatggttatgttt

SEQ ID NO: 1213937 - DNA, 15 bp, Homo sapiens
atattttatgtgaga

SEQ ID NO: 1213938 - DNA, 15 bp, Homo sapiens
atattttattactgt

SEQ ID NO: 1213939 - DNA, 19 bp, Homo sapiens
atatcattttaaaaacttt

SEQ ID NO: 1213940 - DNA, 22 bp, Homo sapiens
atatcattttaaaaactttatt

SEQ ID NO: 1213941 - DNA, 19 bp, Homo sapiens
atatccaaaagctttttat

SEQ ID NO: 1213942 - DNA, 23 bp, Homo sapiens
atatccaagtaccaatgctgttg

SEQ ID NO: 1213943 - DNA, 16 bp, Homo sapiens
atatccaagtttgaat

SEQ ID NO: 1213944 - DNA, 14 bp, Homo sapiens
atatccaccacctc

SEQ ID NO: 1213945 - DNA, 16 bp, Homo sapiens
atatccaccacctccc

SEQ ID NO: 1213946 - DNA, 18 bp, Homo sapiens
atatccacccagcaggca

SEQ ID NO: 1213947 - DNA, 20 bp, Homo sapiens
atatccacccagcaggcaga

SEQ ID NO: 1213948 - DNA, 15 bp, Homo sapiens
atatccagttcctgc

SEQ ID NO: 1213949 - DNA, 16 bp, Homo sapiens
atatccagttcctgct

SEQ ID NO: 1213950 - DNA, 16 bp, Homo sapiens
atatccatctttttct

SEQ ID NO: 1213951 - DNA, 15 bp, Homo sapiens
atatcccaacattct

SEQ ID NO: 1213952 - DNA, 13 bp, Homo sapiens
atatcccagagaa

SEQ ID NO: 1213953 - DNA, 16 bp, Homo sapiens
atatccctacatgtat

SEQ ID NO: 1213954 - DNA, 17 bp, Homo sapiens
atatccctacatgtatt

SEQ ID NO: 1213955 - DNA, 23 bp, Homo sapiens
atatccctcccctctctccctgg

SEQ ID NO: 1213956 - DNA, 22 bp, Homo sapiens
atatcctaaacatcattcattt

SEQ ID NO: 1213957 - DNA, 20 bp, Homo sapiens
atatcctctccccctcctcc

SEQ ID NO: 1213958 - DNA, 14 bp, Homo sapiens
atatcctgagccat

SEQ ID NO: 1213959 - DNA, 14 bp, Homo sapiens
atatcctgcctcag

SEQ ID NO: 1213960 - DNA, 15 bp, Homo sapiens
atatcctgtaactac

SEQ ID NO: 1213961 - DNA, 10 bp, Homo sapiens
atatcctgtg

SEQ ID NO: 1213962 - DNA, 15 bp, Homo sapiens
atatcgctgacttca

SEQ ID NO: 1213963 - DNA, 15 bp, Homo sapiens
atatctaaagttata

SEQ ID NO: 1213964 - DNA, 17 bp, Homo sapiens
atatctaatatatatga

SEQ ID NO: 1213965 - DNA, 13 bp, Homo sapiens
atatctagaacta

SEQ ID NO: 1213966 - DNA, 14 bp, Homo sapiens
atatctagaactat

SEQ ID NO: 1213967 - DNA, 17 bp, Homo sapiens
atatctatatgtacttg

SEQ ID NO: 1213968 - DNA, 13 bp, Homo sapiens
atatctatctatt

SEQ ID NO: 1213969 - DNA, 16 bp, Homo sapiens
atatctatctatttga

SEQ ID NO: 1213970 - DNA, 18 bp, Homo sapiens
atatctatctatttgagg

SEQ ID NO: 1213971 - DNA, 13 bp, Homo sapiens
atatctattaata

SEQ ID NO: 1213972 - DNA, 22 bp, Homo sapiens
atatctattaatatatgtatta

SEQ ID NO: 1213973 - DNA, 12 bp, Homo sapiens
atatctattatt

SEQ ID NO: 1213974 - DNA, 16 bp, Homo sapiens
atatctcaacagaatt

SEQ ID NO: 1213975 - DNA, 16 bp, Homo sapiens
atatctcaatctgcag

SEQ ID NO: 1213976 - DNA, 13 bp, Homo sapiens
atatctcctgaaa

SEQ ID NO: 1213977 - DNA, 15 bp, Homo sapiens
atatctcctgaaaag

SEQ ID NO: 1213978 - DNA, 22 bp, Homo sapiens
atatctcctgaaaaggtttatg

SEQ ID NO: 1213979 - DNA, 22 bp, Homo sapiens
atatctctatttaattttgaca

SEQ ID NO: 1213980 - DNA, 14 bp, Homo sapiens
atatctctatttga

SEQ ID NO: 1213981 - DNA, 16 bp, Homo sapiens
atatctctatttgaga

SEQ ID NO: 1213982 - DNA, 22 bp, Homo sapiens
atatctgaaaatgtatgtgtaa

SEQ ID NO: 1213983 - DNA, 17 bp, Homo sapiens
atatctgataaaattgt

SEQ ID NO: 1213984 - DNA, 18 bp, Homo sapiens
atatctgataaaattgtg

SEQ ID NO: 1213985 - DNA, 20 bp, Homo sapiens
atatctgataaaattgtgat

SEQ ID NO: 1213986 - DNA, 22 bp, Homo sapiens
atatctgattgttgtcaggcca

SEQ ID NO: 1213987 - DNA, 16 bp, Homo sapiens
atcactaaactttatt

SEQ ID NO: 1213988 - DNA, 22 bp, Homo sapiens
atcactaaactttatttgtaaa

SEQ ID NO: 1213989 - DNA, 14 bp, Homo sapiens
atcactaatttctt

SEQ ID NO: 1213990 - DNA, 14 bp, Homo sapiens
atcactactgtatg

SEQ ID NO: 1213991 - DNA, 17 bp, Homo sapiens
atcactagagtgctctg

SEQ ID NO: 1213992 - DNA, 18 bp, Homo sapiens
atcactaggtaacttatt

SEQ ID NO: 1213993 - DNA, 22 bp, Homo sapiens
atcactaggtaacttattagaa

SEQ ID NO: 1213994 - DNA, 21 bp, Homo sapiens
atcactattcttaagcacttt

SEQ ID NO: 1213995 - DNA, 23 bp, Homo sapiens
atcactattcttaagcactttga

SEQ ID NO: 1213996 - DNA, 15 bp, Homo sapiens
atcactcactcactc

SEQ ID NO: 1213997 - DNA, 18 bp, Homo sapiens
atcactcactcactcccc

SEQ ID NO: 1213998 - DNA, 23 bp, Homo sapiens
atcactcactcactccccactcc

SEQ ID NO: 1213999 - DNA, 12 bp, Homo sapiens
atcactcagccc

SEQ ID NO: 1214000 - DNA, 15 bp, Homo sapiens
atcactcattaatta

SEQ ID NO: 1214001 - DNA, 16 bp, Homo sapiens
atcactccctggatgt

SEQ ID NO: 1214002 - DNA, 21 bp, Homo sapiens
atcactctgctgcttagacat

SEQ ID NO: 1214003 - DNA, 20 bp, Homo sapiens
atcactgaacaaactaaagg

SEQ ID NO: 1214004 - DNA, 20 bp, Homo sapiens
atcactgaatttataaagta

SEQ ID NO: 1214005 - DNA, 20 bp, Homo sapiens
atcactgagccatcatttcc

SEQ ID NO: 1214006 - DNA, 20 bp, Homo sapiens
atcactgccacactctccat

SEQ ID NO: 1214007 - DNA, 12 bp, Homo sapiens
atcactgctccc

SEQ ID NO: 1214008 - DNA, 17 bp, Homo sapiens
atcactggagcaccagg

SEQ ID NO: 1214009 - DNA, 19 bp, Homo sapiens
atcactggagcaccaggca

SEQ ID NO: 1214010 - DNA, 12 bp, Homo sapiens
atcactggagcc

SEQ ID NO: 1214011 - DNA, 16 bp, Homo sapiens
atcactggagcccagg

SEQ ID NO: 1214012 - DNA, 17 bp, Homo sapiens
atcactggagcccagga

SEQ ID NO: 1214013 - DNA, 21 bp, Homo sapiens
atcactggctggcctgagcaa

SEQ ID NO: 1214014 - DNA, 24 bp, Homo sapiens
atcactggggatggtggcacaggc

SEQ ID NO: 1214015 - DNA, 12 bp, Homo sapiens
atcactgtaaag

SEQ ID NO: 1214016 - DNA, 18 bp, Homo sapiens
atcactgtgaaatttcat

SEQ ID NO: 1214017 - DNA, 22 bp, Homo sapiens
atcactgtgcagttgctgttta

SEQ ID NO: 1214018 - DNA, 20 bp, Homo sapiens
atcactgttgagttctgatt

SEQ ID NO: 1214019 - DNA, 10 bp, Homo sapiens
atcactgttt

SEQ ID NO: 1214020 - DNA, 23 bp, Homo sapiens
atcacttaacggaccaaagcaag

SEQ ID NO: 1214021 - DNA, 20 bp, Homo sapiens
atcacttaggaaatggcttt

SEQ ID NO: 1214022 - DNA, 14 bp, Homo sapiens
atcacttctccccg

SEQ ID NO: 1214023 - DNA, 16 bp, Homo sapiens
atcacttctccccgca

SEQ ID NO: 1214024 - DNA, 13 bp, Homo sapiens
atcacttcttcca

SEQ ID NO: 1214025 - DNA, 19 bp, Homo sapiens
atcacttgaggtcaggagt

SEQ ID NO: 1214026 - DNA, 14 bp, Homo sapiens
atcacttgtacaaa

SEQ ID NO: 1214027 - DNA, 17 bp, Homo sapiens
atcacttgtacaaaata

SEQ ID NO: 1214028 - DNA, 15 bp, Homo sapiens
atcactttaagtttt

SEQ ID NO: 1214029 - DNA, 12 bp, Homo sapiens
atcactttcata

SEQ ID NO: 1214030 - DNA, 21 bp, Homo sapiens
atcactttctcagttttcata

SEQ ID NO: 1214031 - DNA, 16 bp, Homo sapiens
atcagaaaagctatta

SEQ ID NO: 1214032 - DNA, 20 bp, Homo sapiens
atcagaaaagctattaaagt

SEQ ID NO: 1214033 - DNA, 23 bp, Homo sapiens
atcagaaaagtaattttgtcaca

SEQ ID NO: 1214034 - DNA, 18 bp, Homo sapiens
atcagaaagtaacaatct

SEQ ID NO: 1214035 - DNA, 14 bp, Homo sapiens
atcagaacagcaga

SEQ ID NO: 1214036 - DNA, 22 bp, Homo sapiens
atcagaagaccacaaaaattga

SEQ ID NO: 1214037 - DNA, 23 bp, Homo sapiens
atcagaagaccacaaaaattgac

SEQ ID NO: 1214038 - DNA, 17 bp, Homo sapiens
atcagaagataacttga

SEQ ID NO: 1214039 - DNA, 17 bp, Homo sapiens
atcagaagtatatctgt

SEQ ID NO: 1214040 - DNA, 19 bp, Homo sapiens
atcagaagtcatcttgcta

SEQ ID NO: 1214041 - DNA, 14 bp, Homo sapiens
atcagaagttgtat

SEQ ID NO: 1214042 - DNA, 17 bp, Homo sapiens
atcagaatcatggagaa

SEQ ID NO: 1214043 - DNA, 13 bp, Homo sapiens
atcagaatctgtg

SEQ ID NO: 1214044 - DNA, 20 bp, Homo sapiens
atcagaatgaaccctcctcc

SEQ ID NO: 1214045 - DNA, 21 bp, Homo sapiens
atcagaatgaaccctcctcct

SEQ ID NO: 1214046 - DNA, 14 bp, Homo sapiens
atcagaatgttaat

SEQ ID NO: 1214047 - DNA, 12 bp, Homo sapiens
atcagaattctc

SEQ ID NO: 1214048 - DNA, 13 bp, Homo sapiens
atcagaatttgtg

SEQ ID NO: 1214049 - DNA, 14 bp, Homo sapiens
atcagacaagtgtt

SEQ ID NO: 1214050 - DNA, 10 bp, Homo sapiens
atcagacagc

SEQ ID NO: 1214051 - DNA, 15 bp, Homo sapiens
atcagacatacagct

SEQ ID NO: 1214052 - DNA, 16 bp, Homo sapiens
atcagaccataatgtt

SEQ ID NO: 1214053 - DNA, 19 bp, Homo sapiens
atcagaccctaccccacca

SEQ ID NO: 1214054 - DNA, 12 bp, Homo sapiens
atcagacctgtc

SEQ ID NO: 1214055 - DNA, 14 bp, Homo sapiens
atcagacctgtctt

SEQ ID NO: 1214056 - DNA, 15 bp, Homo sapiens
atcagacctgtcttc

SEQ ID NO: 1214057 - DNA, 18 bp, Homo sapiens
atcagacttcacactgca

SEQ ID NO: 1214058 - DNA, 22 bp, Homo sapiens
atcagagatgcaccaccaagcc

SEQ ID NO: 1214059 - DNA, 14 bp, Homo sapiens
atcagagcaggacc

SEQ ID NO: 1214060 - DNA, 17 bp, Homo sapiens
atcagagcgcacaggga

SEQ ID NO: 1214061 - DNA, 17 bp, Homo sapiens
atcagagctccagtttg

SEQ ID NO: 1214062 - DNA, 21 bp, Homo sapiens
atcagagctcttaatgttgct

SEQ ID NO: 1214063 - DNA, 16 bp, Homo sapiens
atcagaggagtaaata

SEQ ID NO: 1214064 - DNA, 15 bp, Homo sapiens
atcagagtgtacaaa

SEQ ID NO: 1214065 - DNA, 15 bp, Homo sapiens
atcagataacaactg

SEQ ID NO: 1214066 - DNA, 16 bp, Homo sapiens
atcagataacaactgt

SEQ ID NO: 1214067 - DNA, 18 bp, Homo sapiens
atcagataacaactgtga

SEQ ID NO: 1214068 - DNA, 12 bp, Homo sapiens
atcagatacatc

SEQ ID NO: 1214069 - DNA, 15 bp, Homo sapiens
atcagatacatcact

SEQ ID NO: 1214070 - DNA, 16 bp, Homo sapiens
atcagatacatcactg

SEQ ID NO: 1214071 - DNA, 17 bp, Homo sapiens
atcagatgactctctcc

SEQ ID NO: 1214072 - DNA, 12 bp, Homo sapiens
atcagatgcctg

SEQ ID NO: 1214073 - DNA, 16 bp, Homo sapiens
atcagatgcctgcttg

SEQ ID NO: 1214074 - DNA, 13 bp, Homo sapiens
atcagattgttaa

SEQ ID NO: 1214075 - DNA, 14 bp, Homo sapiens
atcagattgttaag

SEQ ID NO: 1214076 - DNA, 12 bp, Homo sapiens
atcagcaaaaaa

SEQ ID NO: 1214077 - DNA, 19 bp, Homo sapiens
atcagcaaatttaagagaa

SEQ ID NO: 1214078 - DNA, 17 bp, Homo sapiens
atcagcaatttcagaac

SEQ ID NO: 1214079 - DNA, 17 bp, Homo sapiens
atcagcacgatttctgt

SEQ ID NO: 1214080 - DNA, 19 bp, Homo sapiens
atcagcaggctccagttga

SEQ ID NO: 1214081 - DNA, 23 bp, Homo sapiens
atcagcaggctccagttgaacac

SEQ ID NO: 1214082 - DNA, 21 bp, Homo sapiens
atcagcatgacaaaaataaca

SEQ ID NO: 1214083 - DNA, 23 bp, Homo sapiens
atcagcatgacaaaaataacact

SEQ ID NO: 1214084 - DNA, 20 bp, Homo sapiens
atcagcattagagaaatgaa

SEQ ID NO: 1214085 - DNA, 17 bp, Homo sapiens
atcagcattgtgacttg

SEQ ID NO: 1214086 - DNA, 14 bp, Homo sapiens
atcagcattttaga

SEQ ID NO: 1214087 - DNA, 22 bp, Homo sapiens
atcagcattttagaaactacaa

SEQ ID NO: 1214088 - DNA, 19 bp, Homo sapiens
atcagccaagttttataat

SEQ ID NO: 1214089 - DNA, 15 bp, Homo sapiens
atcagccacattcta

SEQ ID NO: 1214090 - DNA, 20 bp, Homo sapiens
atcagccagcccatggcccc

SEQ ID NO: 1214091 - DNA, 23 bp, Homo sapiens
atcagccagcccatggcccccaa

SEQ ID NO: 1214092 - DNA, 14 bp, Homo sapiens
atcagccagccttc

SEQ ID NO: 1214093 - DNA, 15 bp, Homo sapiens
atcagccattaaaat

SEQ ID NO: 1214094 - DNA, 19 bp, Homo sapiens
atcagccattaaaataaaa

SEQ ID NO: 1214095 - DNA, 20 bp, Homo sapiens
atcagccattaaaataaaac

SEQ ID NO: 1214096 - DNA, 15 bp, Homo sapiens
atcagccccaccctg

SEQ ID NO: 1214097 - DNA, 17 bp, Homo sapiens
atcagccccaccctggc

SEQ ID NO: 1214098 - DNA, 19 bp, Homo sapiens
atcagccccgcctgtcaca

SEQ ID NO: 1214099 - DNA, 17 bp, Homo sapiens
atcagcctgagtctcct

SEQ ID NO: 1214100 - DNA, 18 bp, Homo sapiens
atcagcctgagtctcctg

SEQ ID NO: 1214101 - DNA, 19 bp, Homo sapiens
atcagcctgagtctcctgt

SEQ ID NO: 1214102 - DNA, 14 bp, Homo sapiens
atcagctatttact

SEQ ID NO: 1214103 - DNA, 17 bp, Homo sapiens
atcagctattttgtgaa

SEQ ID NO: 1214104 - DNA, 17 bp, Homo sapiens
atcagctcaaaatttgc

SEQ ID NO: 1214105 - DNA, 13 bp, Homo sapiens
atcagctccttcc

SEQ ID NO: 1214106 - DNA, 16 bp, Homo sapiens
atcagctctcctggct

SEQ ID NO: 1214107 - DNA, 13 bp, Homo sapiens
atcagctctctgc

SEQ ID NO: 1214108 - DNA, 15 bp, Homo sapiens
atcagctctctgctg

SEQ ID NO: 1214109 - DNA, 17 bp, Homo sapiens
atcagctctctgctggg

SEQ ID NO: 1214110 - DNA, 12 bp, Homo sapiens
atcagctgctac

SEQ ID NO: 1214111 - DNA, 23 bp, Homo sapiens
atcagctgctactactcctgtag

SEQ ID NO: 1214112 - DNA, 13 bp, Homo sapiens
atcagctgctgac

SEQ ID NO: 1214113 - DNA, 22 bp, Homo sapiens
atcagctggacatactgctgga

SEQ ID NO: 1214114 - DNA, 18 bp, Homo sapiens
atcagcttttgttctaga

SEQ ID NO: 1214115 - DNA, 17 bp, Homo sapiens
atcaggaaccagggcct

SEQ ID NO: 1214116 - DNA, 22 bp, Homo sapiens
atcaggaaggtaaaaacccagc

SEQ ID NO: 1214117 - DNA, 17 bp, Homo sapiens
atcaggaatgagtcaat

SEQ ID NO: 1214118 - DNA, 22 bp, Homo sapiens
atcaggagactgggctctggct

SEQ ID NO: 1214119 - DNA, 13 bp, Homo sapiens
atcaggatgaacc

SEQ ID NO: 1214120 - DNA, 22 bp, Homo sapiens
atcaggcacccggggccagaga

SEQ ID NO: 1214121 - DNA, 23 bp, Homo sapiens
atcaggcacccggggccagagac

SEQ ID NO: 1214122 - DNA, 21 bp, Homo sapiens
atcaggcatgtgtcccttcca

SEQ ID NO: 1214123 - DNA, 15 bp, Homo sapiens
atcaggctatgtatg

SEQ ID NO: 1214124 - DNA, 15 bp, Homo sapiens
atcaggctcctcagc

SEQ ID NO: 1214125 - DNA, 14 bp, Homo sapiens
atcaggctgctgga

SEQ ID NO: 1214126 - DNA, 19 bp, Homo sapiens
atcagggaatccagctccc

SEQ ID NO: 1214127 - DNA, 18 bp, Homo sapiens
atcagggaggtcattttg

SEQ ID NO: 1214128 - DNA, 11 bp, Homo sapiens
atcagggcctg

SEQ ID NO: 1214129 - DNA, 19 bp, Homo sapiens
atcagggcctggggcctga

SEQ ID NO: 1214130 - DNA, 19 bp, Homo sapiens
atcagggcctttctcctcc

SEQ ID NO: 1214131 - DNA, 15 bp, Homo sapiens
atcaggggccagaga

SEQ ID NO: 1214132 - DNA, 14 bp, Homo sapiens
atcagggggaagaa

SEQ ID NO: 1214133 - DNA, 16 bp, Homo sapiens
atcagggggaagaagc

SEQ ID NO: 1214134 - DNA, 20 bp, Homo sapiens
atcaggggtgcattctggcc

SEQ ID NO: 1214135 - DNA, 20 bp, Homo sapiens
atcagggtgggccactctcc

SEQ ID NO: 1214136 - DNA, 14 bp, Homo sapiens
atcaggtaactttc

SEQ ID NO: 1214137 - DNA, 17 bp, Homo sapiens
atcaggtaccaaggaaa

SEQ ID NO: 1214138 - DNA, 18 bp, Homo sapiens
atcaggtaccaaggaaat

SEQ ID NO: 1214139 - DNA, 20 bp, Homo sapiens
atcaggtcctcagagaattt

SEQ ID NO: 1214140 - DNA, 16 bp, Homo sapiens
atcaggtctgggcaag

SEQ ID NO: 1214141 - DNA, 15 bp, Homo sapiens
atcaggttccatccc

SEQ ID NO: 1214142 - DNA, 14 bp, Homo sapiens
atcaggttgcaaaa

SEQ ID NO: 1214143 - DNA, 19 bp, Homo sapiens
atcaggtttccaatcaaca

SEQ ID NO: 1214144 - DNA, 18 bp, Homo sapiens
atcagtaaataactggaa

SEQ ID NO: 1214145 - DNA, 12 bp, Homo sapiens
atcagtaaatag

SEQ ID NO: 1214146 - DNA, 15 bp, Homo sapiens
atcagtagtgtacat

SEQ ID NO: 1214147 - DNA, 23 bp, Homo sapiens
atcagtagttcacatacaaatca

SEQ ID NO: 1214148 - DNA, 12 bp, Homo sapiens
atcagtattctg

SEQ ID NO: 1214149 - DNA, 14 bp, Homo sapiens
atcagtatttcctt

SEQ ID NO: 1214150 - DNA, 19 bp, Homo sapiens
atcagtatttccttccact

SEQ ID NO: 1214151 - DNA, 19 bp, Homo sapiens
atcagtcataactaaataa

SEQ ID NO: 1214152 - DNA, 21 bp, Homo sapiens
atcagtcctctttcaaaggta

SEQ ID NO: 1214153 - DNA, 16 bp, Homo sapiens
atcagtctcagaatgt

SEQ ID NO: 1214154 - DNA, 14 bp, Homo sapiens
atcagtcttccttg

SEQ ID NO: 1214155 - DNA, 19 bp, Homo sapiens
atcagtcttccttgtggaa

SEQ ID NO: 1214156 - DNA, 13 bp, Homo sapiens
atcagtgactgaa

SEQ ID NO: 1214157 - DNA, 19 bp, Homo sapiens
atcagtgatctatgtttgt

SEQ ID NO: 1214158 - DNA, 20 bp, Homo sapiens
atcagtgctcgagacacagt

SEQ ID NO: 1214159 - DNA, 19 bp, Homo sapiens
atcagtgtaccatttgcct

SEQ ID NO: 1214160 - DNA, 17 bp, Homo sapiens
atcagtgtgtaaataat

SEQ ID NO: 1214161 - DNA, 14 bp, Homo sapiens
atcagtgttaaaaa

SEQ ID NO: 1214162 - DNA, 15 bp, Homo sapiens
atcagtgtttggtgt

SEQ ID NO: 1214163 - DNA, 18 bp, Homo sapiens
atcagttaagaaatttca

SEQ ID NO: 1214164 - DNA, 16 bp, Homo sapiens
atcagttactcagccc

SEQ ID NO: 1214165 - DNA, 21 bp, Homo sapiens
atcagttactcagccctgggc

SEQ ID NO: 1214166 - DNA, 13 bp, Homo sapiens
atcagttatatga

SEQ ID NO: 1214167 - DNA, 16 bp, Homo sapiens
atcagttatatgatat

SEQ ID NO: 1214168 - DNA, 15 bp, Homo sapiens
atcagttatcctttg

SEQ ID NO: 1214169 - DNA, 17 bp, Homo sapiens
atcagttatcctttgtg

SEQ ID NO: 1214170 - DNA, 19 bp, Homo sapiens
atcagttcattagaaatat

SEQ ID NO: 1214171 - DNA, 20 bp, Homo sapiens
atcagttcccccagtacctc

SEQ ID NO: 1214172 - DNA, 17 bp, Homo sapiens
atcagttcctttgtgtg

SEQ ID NO: 1214173 - DNA, 23 bp, Homo sapiens
atcagttcttagattcaggggaa

SEQ ID NO: 1214174 - DNA, 15 bp, Homo sapiens
atcagtttatcctga

SEQ ID NO: 1214175 - DNA, 23 bp, Homo sapiens
atcagtttatcctgacatattca

SEQ ID NO: 1214176 - DNA, 22 bp, Homo sapiens
atcagtttgctagcagaaatct

SEQ ID NO: 1214177 - DNA, 22 bp, Homo sapiens
atcagttttggaatctaagctg

SEQ ID NO: 1214178 - DNA, 17 bp, Homo sapiens
atcataaggaagttatt

SEQ ID NO: 1214179 - DNA, 20 bp, Homo sapiens
atcataaggagttggtgtaa

SEQ ID NO: 1214180 - DNA, 16 bp, Homo sapiens
atcataattacattcc

SEQ ID NO: 1214181 - DNA, 13 bp, Homo sapiens
atcataattacca

SEQ ID NO: 1214182 - DNA, 15 bp, Homo sapiens
atcatacaaactctc

SEQ ID NO: 1214183 - DNA, 12 bp, Homo sapiens
atcatacagttt

SEQ ID NO: 1214184 - DNA, 13 bp, Homo sapiens
atcatacagtttt

SEQ ID NO: 1214185 - DNA, 21 bp, Homo sapiens
atcataccctttattctcact

SEQ ID NO: 1214186 - DNA, 15 bp, Homo sapiens
atcatactgcctact

SEQ ID NO: 1214187 - DNA, 21 bp, Homo sapiens
atcatactgttttgaataaat

SEQ ID NO: 1214188 - DNA, 15 bp, Homo sapiens
atcatacttaacatt

SEQ ID NO: 1214189 - DNA, 22 bp, Homo sapiens
atcatagattattataaactat

SEQ ID NO: 1214190 - DNA, 16 bp, Homo sapiens
atcataggtatttcaa

SEQ ID NO: 1214191 - DNA, 17 bp, Homo sapiens
atcataggtatttcaaa

SEQ ID NO: 1214192 - DNA, 19 bp, Homo sapiens
atcatatataataaattaa

SEQ ID NO: 1214193 - DNA, 18 bp, Homo sapiens
atcatatgattctgcttt

SEQ ID NO: 1214194 - DNA, 21 bp, Homo sapiens
atcatatgattctgcttttac

SEQ ID NO: 1214195 - DNA, 21 bp, Homo sapiens
atcatatgcctgaccccttgc

SEQ ID NO: 1214196 - DNA, 15 bp, Homo sapiens
atcatattatacaga

SEQ ID NO: 1214197 - DNA, 16 bp, Homo sapiens
atcatattatacagac

SEQ ID NO: 1214198 - DNA, 14 bp, Homo sapiens
atcatattattatc

SEQ ID NO: 1214199 - DNA, 15 bp, Homo sapiens
atcatattgtatgta

SEQ ID NO: 1214200 - DNA, 19 bp, Homo sapiens
atcatatttaaagatcttt

SEQ ID NO: 1214201 - DNA, 16 bp, Homo sapiens
atcatcaagtaataca

SEQ ID NO: 1214202 - DNA, 15 bp, Homo sapiens
atcatcagggcctgg

SEQ ID NO: 1214203 - DNA, 14 bp, Homo sapiens
atcatccacccgct

SEQ ID NO: 1214204 - DNA, 15 bp, Homo sapiens
atcatccacccgctg

SEQ ID NO: 1214205 - DNA, 21 bp, Homo sapiens
atcatccacccgctgcccctc

SEQ ID NO: 1214206 - DNA, 22 bp, Homo sapiens
atcatccacccgctgcccctcc

SEQ ID NO: 1214207 - DNA, 16 bp, Homo sapiens
atcatccaggcctcag

SEQ ID NO: 1214208 - DNA, 15 bp, Homo sapiens
atcatccctttctcc

SEQ ID NO: 1214209 - DNA, 21 bp, Homo sapiens
atcatccctttctcccagtga

SEQ ID NO: 1214210 - DNA, 20 bp, Homo sapiens
atcatcctcccttttttgta

SEQ ID NO: 1214211 - DNA, 21 bp, Homo sapiens
atcatcctgttttctctgtga

SEQ ID NO: 1214212 - DNA, 16 bp, Homo sapiens
atcatcctttgttctg

SEQ ID NO: 1214213 - DNA, 19 bp, Homo sapiens
atcatcctttgttctgagc

SEQ ID NO: 1214214 - DNA, 20 bp, Homo sapiens
atcatcgccagaggtgcttc

SEQ ID NO: 1214215 - DNA, 15 bp, Homo sapiens
atcatctatagaaag

SEQ ID NO: 1214216 - DNA, 23 bp, Homo sapiens
atcatctccatcatatgcctgac

SEQ ID NO: 1214217 - DNA, 20 bp, Homo sapiens
atcatctcctgccttcctcc

SEQ ID NO: 1214218 - DNA, 23 bp, Homo sapiens
atcatctgaaggggcaaattctt

SEQ ID NO: 1214219 - DNA, 13 bp, Homo sapiens
atcatctgtgtga

SEQ ID NO: 1214220 - DNA, 16 bp, Homo sapiens
atcatctgtgtgaaaa

SEQ ID NO: 1214221 - DNA, 21 bp, Homo sapiens
atcatcttgaacattaatcca

SEQ ID NO: 1214222 - DNA, 18 bp, Homo sapiens
atcatcttggaactgcat

SEQ ID NO: 1214223 - DNA, 18 bp, Homo sapiens
atcatgaaatatgcatct

SEQ ID NO: 1214224 - DNA, 18 bp, Homo sapiens
atcccttatccaaaatgc

SEQ ID NO: 1214225 - DNA, 20 bp, Homo sapiens
atcccttatccaaaatgctt

SEQ ID NO: 1214226 - DNA, 14 bp, Homo sapiens
atcccttcatatca

SEQ ID NO: 1214227 - DNA, 14 bp, Homo sapiens
atcccttcctggaa

SEQ ID NO: 1214228 - DNA, 23 bp, Homo sapiens
atcccttcggagccaacaagacc

SEQ ID NO: 1214229 - DNA, 17 bp, Homo sapiens
atcccttctcctgccct

SEQ ID NO: 1214230 - DNA, 12 bp, Homo sapiens
atccctttagaa

SEQ ID NO: 1214231 - DNA, 14 bp, Homo sapiens
atccctttattacc

SEQ ID NO: 1214232 - DNA, 15 bp, Homo sapiens
atccctttcctggtt

SEQ ID NO: 1214233 - DNA, 18 bp, Homo sapiens
atccctttttgaagtgta

SEQ ID NO: 1214234 - DNA, 16 bp, Homo sapiens
atccctttttttacat

SEQ ID NO: 1214235 - DNA, 14 bp, Homo sapiens
atccgaatctcttt

SEQ ID NO: 1214236 - DNA, 17 bp, Homo sapiens
atccgactgctttggac

SEQ ID NO: 1214237 - DNA, 22 bp, Homo sapiens
atccgagtgtgatttgaattct

SEQ ID NO: 1214238 - DNA, 21 bp, Homo sapiens
atccgcccacctcagcctccc

SEQ ID NO: 1214239 - DNA, 13 bp, Homo sapiens
atccgctctcttc

SEQ ID NO: 1214240 - DNA, 15 bp, Homo sapiens
atccgctctcttcct

SEQ ID NO: 1214241 - DNA, 18 bp, Homo sapiens
atccgctctcttcctgcc

SEQ ID NO: 1214242 - DNA, 20 bp, Homo sapiens
atccgctctcttcctgcccc

SEQ ID NO: 1214243 - DNA, 19 bp, Homo sapiens
atccggctgctcctccagc

SEQ ID NO: 1214244 - DNA, 15 bp, Homo sapiens
atccgggacacctgg

SEQ ID NO: 1214245 - DNA, 18 bp, Homo sapiens
atccgtcattgctgctgc

SEQ ID NO: 1214246 - DNA, 19 bp, Homo sapiens
atccgtcattgctgctgct

SEQ ID NO: 1214247 - DNA, 20 bp, Homo sapiens
atccgtgtatttggctgggc

SEQ ID NO: 1214248 - DNA, 22 bp, Homo sapiens
atccgtgtatttggctgggcta

SEQ ID NO: 1214249 - DNA, 23 bp, Homo sapiens
atccgtgttgcaggttcatggat

SEQ ID NO: 1214250 - DNA, 14 bp, Homo sapiens
atcctaaacatcat

SEQ ID NO: 1214251 - DNA, 16 bp, Homo sapiens
atcctaaactctctag

SEQ ID NO: 1214252 - DNA, 11 bp, Homo sapiens
atccttcctcc

SEQ ID NO: 1214253 - DNA, 11 bp, Homo sapiens
atccttccttc

SEQ ID NO: 1214254 - DNA, 12 bp, Homo sapiens
atccttccttca

SEQ ID NO: 1214255 - DNA, 22 bp, Homo sapiens
atccttccttcccacccatcgc

SEQ ID NO: 1214256 - DNA, 16 bp, Homo sapiens
atccttcgtcctaaca

SEQ ID NO: 1214257 - DNA, 21 bp, Homo sapiens
atccttcgtcctaacataaca

SEQ ID NO: 1214258 - DNA, 19 bp, Homo sapiens
atccttcgtgaacatcccc

SEQ ID NO: 1214259 - DNA, 23 bp, Homo sapiens
atccttcgtgaacatcccctccc

SEQ ID NO: 1214260 - DNA, 22 bp, Homo sapiens
atccttctaagaggatacaaat

SEQ ID NO: 1214261 - DNA, 13 bp, Homo sapiens
atccttctagttt

SEQ ID NO: 1214262 - DNA, 19 bp, Homo sapiens
atccttctagtttcccaca

SEQ ID NO: 1214263 - DNA, 14 bp, Homo sapiens
atccttctcactgc

SEQ ID NO: 1214264 - DNA, 17 bp, Homo sapiens
atccttctcactgccat

SEQ ID NO: 1214265 - DNA, 20 bp, Homo sapiens
atccttctcactgccatgga

SEQ ID NO: 1214266 - DNA, 22 bp, Homo sapiens
atccttgccaatagtgtcatcc

SEQ ID NO: 1214267 - DNA, 15 bp, Homo sapiens
atccttgctgcagct

SEQ ID NO: 1214268 - DNA, 24 bp, Homo sapiens
atccttggaaaccgtgtgtccagc

SEQ ID NO: 1214269 - DNA, 20 bp, Homo sapiens
atccttggctgaattaaaat

SEQ ID NO: 1214270 - DNA, 23 bp, Homo sapiens
atccttggctgaattaaaatggt

SEQ ID NO: 1214271 - DNA, 23 bp, Homo sapiens
atccttgggccataattatgaaa

SEQ ID NO: 1214272 - DNA, 18 bp, Homo sapiens
atccttgggggctcccag

SEQ ID NO: 1214273 - DNA, 12 bp, Homo sapiens
atccttgtaata

SEQ ID NO: 1214274 - DNA, 15 bp, Homo sapiens
atccttgtcttttga

SEQ ID NO: 1214275 - DNA, 21 bp, Homo sapiens
atccttgtcttttgagctatt

SEQ ID NO: 1214276 - DNA, 21 bp, Homo sapiens
atccttgtgacttacaatttg

SEQ ID NO: 1214277 - DNA, 18 bp, Homo sapiens
atcctttaactctgcgga

SEQ ID NO: 1214278 - DNA, 19 bp, Homo sapiens
atcctttagggttctgcct

SEQ ID NO: 1214279 - DNA, 19 bp, Homo sapiens
atcctttattttattgaaa

SEQ ID NO: 1214280 - DNA, 19 bp, Homo sapiens
atcctttcattaggcaaag

SEQ ID NO: 1214281 - DNA, 22 bp, Homo sapiens
atcctttcattaggcaaagtac

SEQ ID NO: 1214282 - DNA, 11 bp, Homo sapiens
atcctttcctc

SEQ ID NO: 1214283 - DNA, 19 bp, Homo sapiens
atcctttcctcattaaatt

SEQ ID NO: 1214284 - DNA, 21 bp, Homo sapiens
atcctttcctctagcttttct

SEQ ID NO: 1214285 - DNA, 15 bp, Homo sapiens
atcctttctaaacaa

SEQ ID NO: 1214286 - DNA, 20 bp, Homo sapiens
atcctttctgccccccaggg

SEQ ID NO: 1214287 - DNA, 23 bp, Homo sapiens
atcctttctgccccccagggcta

SEQ ID NO: 1214288 - DNA, 17 bp, Homo sapiens
atcctttgagaatgtga

SEQ ID NO: 1214289 - DNA, 19 bp, Homo sapiens
atcctttgagaatgtgatt

SEQ ID NO: 1214290 - DNA, 17 bp, Homo sapiens
atcctttgatcccagaa

SEQ ID NO: 1214291 - DNA, 14 bp, Homo sapiens
atcctttgttctga

SEQ ID NO: 1214292 - DNA, 23 bp, Homo sapiens
atcctttgttttctgactaatta

SEQ ID NO: 1214293 - DNA, 15 bp, Homo sapiens
atccttttctgcaga

SEQ ID NO: 1214294 - DNA, 13 bp, Homo sapiens
atccttttttctc

SEQ ID NO: 1214295 - DNA, 17 bp, Homo sapiens
atccttttttctcttct

SEQ ID NO: 1214296 - DNA, 23 bp, Homo sapiens
atccttttttctcttctgtccat

SEQ ID NO: 1214297 - DNA, 20 bp, Homo sapiens
atccttttttgtcattttat

SEQ ID NO: 1214298 - DNA, 15 bp, Homo sapiens
atcgaaccgttttga

SEQ ID NO: 1214299 - DNA, 17 bp, Homo sapiens
atcgaagggtttttaga

SEQ ID NO: 1214300 - DNA, 21 bp, Homo sapiens
atcgaagggtttttagagaat

SEQ ID NO: 1214301 - DNA, 16 bp, Homo sapiens
atcgaatatagttctg

SEQ ID NO: 1214302 - DNA, 21 bp, Homo sapiens
atcgaatatagttctgtgtag

SEQ ID NO: 1214303 - DNA, 21 bp, Homo sapiens
atcgacttcttggttttctct

SEQ ID NO: 1214304 - DNA, 20 bp, Homo sapiens
atcgagtgtagctgtgaaat

SEQ ID NO: 1214305 - DNA, 14 bp, Homo sapiens
atcgatataaattg

SEQ ID NO: 1214306 - DNA, 20 bp, Homo sapiens
atcgatgggggatgcttcat

SEQ ID NO: 1214307 - DNA, 11 bp, Homo sapiens
atcgattggct

SEQ ID NO: 1214308 - DNA, 18 bp, Homo sapiens
atcgcaccattctgactc

SEQ ID NO: 1214309 - DNA, 22 bp, Homo sapiens
atcgcaccttttataccagaga

SEQ ID NO: 1214310 - DNA, 22 bp, Homo sapiens
atcgcatcattgcactctagcc

SEQ ID NO: 1214311 - DNA, 18 bp, Homo sapiens
atcgccatcttcttccct

SEQ ID NO: 1214312 - DNA, 17 bp, Homo sapiens
atcgcccaggctggagc

SEQ ID NO: 1214313 - DNA, 23 bp, Homo sapiens
atcgcccaggctggagctggccc

SEQ ID NO: 1214314 - DNA, 20 bp, Homo sapiens
atcgccccaactccaacctc

SEQ ID NO: 1214315 - DNA, 23 bp, Homo sapiens
atcgccccaactccaacctctcg

SEQ ID NO: 1214316 - DNA, 15 bp, Homo sapiens
atcgccccaccgcag

SEQ ID NO: 1214317 - DNA, 14 bp, Homo sapiens
atcgccccagactc

SEQ ID NO: 1214318 - DNA, 18 bp, Homo sapiens
atcgccctcctttccctt

SEQ ID NO: 1214319 - DNA, 19 bp, Homo sapiens
atcgccctcctttccctta

SEQ ID NO: 1214320 - DNA, 12 bp, Homo sapiens
atcgcctttccc

SEQ ID NO: 1214321 - DNA, 20 bp, Homo sapiens
atcgcggcggagctggcccc

SEQ ID NO: 1214322 - DNA, 23 bp, Homo sapiens
atcgctaaagggaccatctgctg

SEQ ID NO: 1214323 - DNA, 18 bp, Homo sapiens
atcgctaagctggctctg

SEQ ID NO: 1214324 - DNA, 15 bp, Homo sapiens
atcgctgacttcatg

SEQ ID NO: 1214325 - DNA, 23 bp, Homo sapiens
atcgctgtgtgttagttcccaac

SEQ ID NO: 1214326 - DNA, 15 bp, Homo sapiens
atcgcttgagcccag

SEQ ID NO: 1214327 - DNA, 19 bp, Homo sapiens
atcgcttgagcccaggagt

SEQ ID NO: 1214328 - DNA, 18 bp, Homo sapiens
atcggaagcagtgccttc

SEQ ID NO: 1214329 - DNA, 15 bp, Homo sapiens
atcggacaggaggat

SEQ ID NO: 1214330 - DNA, 13 bp, Homo sapiens
atcggactgccaa

SEQ ID NO: 1214331 - DNA, 13 bp, Homo sapiens
atcggagacagtg

SEQ ID NO: 1214332 - DNA, 20 bp, Homo sapiens
atcggaggcttgtcagagct

SEQ ID NO: 1214333 - DNA, 21 bp, Homo sapiens
atcggaggcttgtcagagctg

SEQ ID NO: 1214334 - DNA, 23 bp, Homo sapiens
atcggaggcttgtcagagctggg

SEQ ID NO: 1214335 - DNA, 18 bp, Homo sapiens
atcggagtcagccaggag

SEQ ID NO: 1214336 - DNA, 15 bp, Homo sapiens
atcggcatttgtttc

SEQ ID NO: 1214337 - DNA, 16 bp, Homo sapiens
atcggccacagggcgg

SEQ ID NO: 1214338 - DNA, 15 bp, Homo sapiens
atcggccctgtcccc

SEQ ID NO: 1214339 - DNA, 21 bp, Homo sapiens
atcggccctgtcccctggagt

SEQ ID NO: 1214340 - DNA, 15 bp, Homo sapiens
atcgggaacagtgtt

SEQ ID NO: 1214341 - DNA, 18 bp, Homo sapiens
atcgggagcacccagagc

SEQ ID NO: 1214342 - DNA, 21 bp, Homo sapiens
atcgggctaaggtccctgggg

SEQ ID NO: 1214343 - DNA, 14 bp, Homo sapiens
atcggggggtggac

SEQ ID NO: 1214344 - DNA, 19 bp, Homo sapiens
atcggtgaaactaacagat

SEQ ID NO: 1214345 - DNA, 21 bp, Homo sapiens
atcggtgaaactaacagataa

SEQ ID NO: 1214346 - DNA, 17 bp, Homo sapiens
atcggtgtccatttata

SEQ ID NO: 1214347 - DNA, 23 bp, Homo sapiens
atcggtgtccatttatagaataa

SEQ ID NO: 1214348 - DNA, 16 bp, Homo sapiens
atcgtaaaaaaataga

SEQ ID NO: 1214349 - DNA, 14 bp, Homo sapiens
atcgtagaaaattt

SEQ ID NO: 1214350 - DNA, 17 bp, Homo sapiens
atcgtctcggcccctct

SEQ ID NO: 1214351 - DNA, 19 bp, Homo sapiens
atcgtgacccttcagggcc

SEQ ID NO: 1214352 - DNA, 16 bp, Homo sapiens
atcgtgatcactgagc

SEQ ID NO: 1214353 - DNA, 12 bp, Homo sapiens
atcgtgcatttg

SEQ ID NO: 1214354 - DNA, 19 bp, Homo sapiens
atcgtgccgttactctcca

SEQ ID NO: 1214355 - DNA, 14 bp, Homo sapiens
atcgtgctactgca

SEQ ID NO: 1214356 - DNA, 21 bp, Homo sapiens
atcgtgggtcactacagggag

SEQ ID NO: 1214357 - DNA, 21 bp, Homo sapiens
atcgtgtattgagatttctta

SEQ ID NO: 1214358 - DNA, 13 bp, Homo sapiens
atcgttactggca

SEQ ID NO: 1214359 - DNA, 22 bp, Homo sapiens
atcgttagtatctaacatgtat

SEQ ID NO: 1214360 - DNA, 15 bp, Homo sapiens
atcgttccccacccc

SEQ ID NO: 1214361 - DNA, 20 bp, Homo sapiens
atcgtttctcagaagtactt

SEQ ID NO: 1214362 - DNA, 19 bp, Homo sapiens
atctaaaaatagacttaaa

SEQ ID NO: 1214363 - DNA, 17 bp, Homo sapiens
atctaaagctttatctt

SEQ ID NO: 1214364 - DNA, 20 bp, Homo sapiens
atctaaagctttatctttgt

SEQ ID NO: 1214365 - DNA, 20 bp, Homo sapiens
atctaaagctttggacaagt

SEQ ID NO: 1214366 - DNA, 18 bp, Homo sapiens
atctaaaggatggaaaaa

SEQ ID NO: 1214367 - DNA, 19 bp, Homo sapiens
atctaaaggatggaaaaat

SEQ ID NO: 1214368 - DNA, 17 bp, Homo sapiens
atctaaagtgtgttgtt

SEQ ID NO: 1214369 - DNA, 12 bp, Homo sapiens
atctaaagttat

SEQ ID NO: 1214370 - DNA, 15 bp, Homo sapiens
atctaaagttatatt

SEQ ID NO: 1214371 - DNA, 16 bp, Homo sapiens
atctaaagttatattt

SEQ ID NO: 1214372 - DNA, 22 bp, Homo sapiens
atctaaatatggactgctcagg

SEQ ID NO: 1214373 - DNA, 15 bp, Homo sapiens
atctaaatctattta

SEQ ID NO: 1214374 - DNA, 20 bp, Homo sapiens
atctaaatctatttattaat

SEQ ID NO: 1214375 - DNA, 22 bp, Homo sapiens
atctaaatctatttattaatat

SEQ ID NO: 1214376 - DNA, 14 bp, Homo sapiens
atctaaatgaatga

SEQ ID NO: 1214377 - DNA, 14 bp, Homo sapiens
atctaaattctgat

SEQ ID NO: 1214378 - DNA, 14 bp, Homo sapiens
atctaacattatta

SEQ ID NO: 1214379 - DNA, 18 bp, Homo sapiens
atctaacctcatcttctt

SEQ ID NO: 1214380 - DNA, 21 bp, Homo sapiens
atctaactgatgagtaaactg

SEQ ID NO: 1214381 - DNA, 14 bp, Homo sapiens
atctaactttcctt

SEQ ID NO: 1214382 - DNA, 16 bp, Homo sapiens
atctaagcctttccat

SEQ ID NO: 1214383 - DNA, 18 bp, Homo sapiens
atctaagcctttccataa

SEQ ID NO: 1214384 - DNA, 11 bp, Homo sapiens
atctaaggata

SEQ ID NO: 1214385 - DNA, 18 bp, Homo sapiens
atctaaggatgtcacagg

SEQ ID NO: 1214386 - DNA, 13 bp, Homo sapiens
atctaagtgatat

SEQ ID NO: 1214387 - DNA, 15 bp, Homo sapiens
atctaagtgatataa

SEQ ID NO: 1214388 - DNA, 17 bp, Homo sapiens
atctaagtgatataaat

SEQ ID NO: 1214389 - DNA, 22 bp, Homo sapiens
atctaatagcgggttactttca

SEQ ID NO: 1214390 - DNA, 15 bp, Homo sapiens
atctaatatatatga

SEQ ID NO: 1214391 - DNA, 19 bp, Homo sapiens
atctaatatatatgaataa

SEQ ID NO: 1214392 - DNA, 13 bp, Homo sapiens
atctaatatgaag

SEQ ID NO: 1214393 - DNA, 23 bp, Homo sapiens
atctaatatggccacagtagtct

SEQ ID NO: 1214394 - DNA, 14 bp, Homo sapiens
atctaatattaaaa

SEQ ID NO: 1214395 - DNA, 19 bp, Homo sapiens
atctaatgaaaaacaaaaa

SEQ ID NO: 1214396 - DNA, 16 bp, Homo sapiens
atctaatgtctcttcc

SEQ ID NO: 1214397 - DNA, 21 bp, Homo sapiens
atctaatgtctcttcctctgt

SEQ ID NO: 1214398 - DNA, 15 bp, Homo sapiens
atctaattaaactaa

SEQ ID NO: 1214399 - DNA, 16 bp, Homo sapiens
atctaattaaatggca

SEQ ID NO: 1214400 - DNA, 23 bp, Homo sapiens
atctaattatttccacttgccct

SEQ ID NO: 1214401 - DNA, 14 bp, Homo sapiens
atctaattttacac

SEQ ID NO: 1214402 - DNA, 15 bp, Homo sapiens
atctacaatacatat

SEQ ID NO: 1214403 - DNA, 20 bp, Homo sapiens
atctacaatcagttgacttt

SEQ ID NO: 1214404 - DNA, 16 bp, Homo sapiens
atctacagctcacctc

SEQ ID NO: 1214405 - DNA, 18 bp, Homo sapiens
atctacagtaatgaaatg

SEQ ID NO: 1214406 - DNA, 23 bp, Homo sapiens
atctacagtaatgaaatgtttac

SEQ ID NO: 1214407 - DNA, 21 bp, Homo sapiens
atctacccaaaggatactgta

SEQ ID NO: 1214408 - DNA, 14 bp, Homo sapiens
atctaccccagact

SEQ ID NO: 1214409 - DNA, 16 bp, Homo sapiens
atctaccccagggaga

SEQ ID NO: 1214410 - DNA, 15 bp, Homo sapiens
atctacccgtgcctg

SEQ ID NO: 1214411 - DNA, 13 bp, Homo sapiens
atctacctggagg

SEQ ID NO: 1214412 - DNA, 18 bp, Homo sapiens
atctacctggagggaaga

SEQ ID NO: 1214413 - DNA, 15 bp, Homo sapiens
atctactaattccac

SEQ ID NO: 1214414 - DNA, 19 bp, Homo sapiens
atctactaattccacacct

SEQ ID NO: 1214415 - DNA, 20 bp, Homo sapiens
atctactaccagaagggctt

SEQ ID NO: 1214416 - DNA, 18 bp, Homo sapiens
atctactcccaagtatgg

SEQ ID NO: 1214417 - DNA, 16 bp, Homo sapiens
atctactctaaagaaa

SEQ ID NO: 1214418 - DNA, 17 bp, Homo sapiens
atctactctaaagaaaa

SEQ ID NO: 1214419 - DNA, 22 bp, Homo sapiens
atctactggaaatgtagcactt

SEQ ID NO: 1214420 - DNA, 14 bp, Homo sapiens
atctacttgcctca

SEQ ID NO: 1214421 - DNA, 20 bp, Homo sapiens
atctactttttgtatttagt

SEQ ID NO: 1214422 - DNA, 13 bp, Homo sapiens
atctacttttttt

SEQ ID NO: 1214423 - DNA, 17 bp, Homo sapiens
atctagaaagaaaagac

SEQ ID NO: 1214424 - DNA, 16 bp, Homo sapiens
atctagaaagagatca

SEQ ID NO: 1214425 - DNA, 21 bp, Homo sapiens
atctagaacacaggcaaaatc

SEQ ID NO: 1214426 - DNA, 19 bp, Homo sapiens
atctagaactatcattttt

SEQ ID NO: 1214427 - DNA, 14 bp, Homo sapiens
atctagaagatgtg

SEQ ID NO: 1214428 - DNA, 15 bp, Homo sapiens
atctagaagatgtgt

SEQ ID NO: 1214429 - DNA, 21 bp, Homo sapiens
atctagaatgtgttttctgaa

SEQ ID NO: 1214430 - DNA, 18 bp, Homo sapiens
atctagatactgtatcat

SEQ ID NO: 1214431 - DNA, 16 bp, Homo sapiens
atctagatatcgactt

SEQ ID NO: 1214432 - DNA, 14 bp, Homo sapiens
atctagcaaatgtt

SEQ ID NO: 1214433 - DNA, 18 bp, Homo sapiens
atctagcaaatgttatgc

SEQ ID NO: 1214434 - DNA, 16 bp, Homo sapiens
atctagcactcctcaa

SEQ ID NO: 1214435 - DNA, 22 bp, Homo sapiens
atctagcactcctcaagacttt

SEQ ID NO: 1214436 - DNA, 17 bp, Homo sapiens
atctagcagtaaaagat

SEQ ID NO: 1214437 - DNA, 22 bp, Homo sapiens
atctagccagagcccttcactg

SEQ ID NO: 1214438 - DNA, 23 bp, Homo sapiens
atctagccagagcccttcactgc

SEQ ID NO: 1214439 - DNA, 19 bp, Homo sapiens
atctagccagcccctcttc

SEQ ID NO: 1214440 - DNA, 20 bp, Homo sapiens
atctagcctaaagtatacaa

SEQ ID NO: 1214441 - DNA, 14 bp, Homo sapiens
atctagcttcttca

SEQ ID NO: 1214442 - DNA, 16 bp, Homo sapiens
atctaggaaaattatt

SEQ ID NO: 1214443 - DNA, 15 bp, Homo sapiens
atctagtagttgttc

SEQ ID NO: 1214444 - DNA, 22 bp, Homo sapiens
atctagtgacacctcagtcata

SEQ ID NO: 1214445 - DNA, 13 bp, Homo sapiens
atctagtgcagct

SEQ ID NO: 1214446 - DNA, 17 bp, Homo sapiens
atctagtgcagctgatt

SEQ ID NO: 1214447 - DNA, 20 bp, Homo sapiens
atctagtttacagaaaaatc

SEQ ID NO: 1214448 - DNA, 20 bp, Homo sapiens
atcctggattcactcactca

SEQ ID NO: 1214449 - DNA, 13 bp, Homo sapiens
atcctggcagccc

SEQ ID NO: 1214450 - DNA, 17 bp, Homo sapiens
atcctggccaacatggt

SEQ ID NO: 1214451 - DNA, 13 bp, Homo sapiens
atcctggccctgg

SEQ ID NO: 1214452 - DNA, 15 bp, Homo sapiens
atcctggccctgggg

SEQ ID NO: 1214453 - DNA, 16 bp, Homo sapiens
atcctggccctggggg

SEQ ID NO: 1214454 - DNA, 14 bp, Homo sapiens
atcctggcctcctt

SEQ ID NO: 1214455 - DNA, 18 bp, Homo sapiens
atcctggcctccttttgc

SEQ ID NO: 1214456 - DNA, 17 bp, Homo sapiens
atcctgggatccagtgt

SEQ ID NO: 1214457 - DNA, 12 bp, Homo sapiens
atcctgggctgg

SEQ ID NO: 1214458 - DNA, 20 bp, Homo sapiens
atcctggggctcccttcatc

SEQ ID NO: 1214459 - DNA, 21 bp, Homo sapiens
atcctgtaactacaatgatgg

SEQ ID NO: 1214460 - DNA, 19 bp, Homo sapiens
atcctgtcgattagactgg

SEQ ID NO: 1214461 - DNA, 21 bp, Homo sapiens
atcctgtcgattagactggac

SEQ ID NO: 1214462 - DNA, 18 bp, Homo sapiens
atcctgtctttctgagca

SEQ ID NO: 1214463 - DNA, 21 bp, Homo sapiens
atcctgtgactgtctcactta

SEQ ID NO: 1214464 - DNA, 12 bp, Homo sapiens
atcctgtgtaac

SEQ ID NO: 1214465 - DNA, 14 bp, Homo sapiens
atcctgtgtcccct

SEQ ID NO: 1214466 - DNA, 19 bp, Homo sapiens
atcctgtgtcccctgacct

SEQ ID NO: 1214467 - DNA, 14 bp, Homo sapiens
atcctgtgtttcta

SEQ ID NO: 1214468 - DNA, 13 bp, Homo sapiens
atcctgttttctc

SEQ ID NO: 1214469 - DNA, 15 bp, Homo sapiens
atccttaaatcttaa

SEQ ID NO: 1214470 - DNA, 22 bp, Homo sapiens
atccttaaatcttaatgttcct

SEQ ID NO: 1214471 - DNA, 14 bp, Homo sapiens
atccttaaattatt

SEQ ID NO: 1214472 - DNA, 19 bp, Homo sapiens
atccttagaggtcctctgg

SEQ ID NO: 1214473 - DNA, 15 bp, Homo sapiens
atccttatcagagct

SEQ ID NO: 1214474 - DNA, 14 bp, Homo sapiens
atccttattgttca

SEQ ID NO: 1214475 - DNA, 23 bp, Homo sapiens
atccttcaaggtggcagctgtta

SEQ ID NO: 1214476 - DNA, 21 bp, Homo sapiens
atccttcacaggcagtgcatg

SEQ ID NO: 1214477 - DNA, 23 bp, Homo sapiens
atccttcacaggcagtgcatgtg

SEQ ID NO: 1214478 - DNA, 18 bp, Homo sapiens
atccttcagcacaggaat

SEQ ID NO: 1214479 - DNA, 18 bp, Homo sapiens
atccttccaaaaaattaa

SEQ ID NO: 1214480 - DNA, 19 bp, Homo sapiens
atccttccaaaaaattaaa

SEQ ID NO: 1214481 - DNA, 15 bp, Homo sapiens
atccttccacctcag

SEQ ID NO: 1214482 - DNA, 16 bp, Homo sapiens
atccttccacctcagt

SEQ ID NO: 1214483 - DNA, 22 bp, Homo sapiens
atccttccagtggctcgctccc

SEQ ID NO: 1214484 - DNA, 14 bp, Homo sapiens
atccttccatcttg

SEQ ID NO: 1214485 - DNA, 11 bp, Homo sapiens
atccttcccca

SEQ ID NO: 1214486 - DNA, 18 bp, Homo sapiens
atccttcccctcttttgg

SEQ ID NO: 1214487 - DNA, 19 bp, Homo sapiens
atctcttaatattgagaat

SEQ ID NO: 1214488 - DNA, 21 bp, Homo sapiens
atctcttaatattgagaatca

SEQ ID NO: 1214489 - DNA, 16 bp, Homo sapiens
atctcttacatcagta

SEQ ID NO: 1214490 - DNA, 17 bp, Homo sapiens
atctcttagaagccatg

SEQ ID NO: 1214491 - DNA, 18 bp, Homo sapiens
atctcttatcttacgaaa

SEQ ID NO: 1214492 - DNA, 18 bp, Homo sapiens
atctcttattctaataaa

SEQ ID NO: 1214493 - DNA, 19 bp, Homo sapiens
atctcttattttacaataa

SEQ ID NO: 1214494 - DNA, 17 bp, Homo sapiens
atctcttcactaccctg

SEQ ID NO: 1214495 - DNA, 13 bp, Homo sapiens
atctcttcattat

SEQ ID NO: 1214496 - DNA, 16 bp, Homo sapiens
atctcttccccagaga

SEQ ID NO: 1214497 - DNA, 18 bp, Homo sapiens
atctcttccccagagagg

SEQ ID NO: 1214498 - DNA, 11 bp, Homo sapiens
atctcttcctg

SEQ ID NO: 1214499 - DNA, 14 bp, Homo sapiens
atctcttgaaacct

SEQ ID NO: 1214500 - DNA, 20 bp, Homo sapiens
atctcttgattataaatgtt

SEQ ID NO: 1214501 - DNA, 17 bp, Homo sapiens
atctctttcacattgtt

SEQ ID NO: 1214502 - DNA, 21 bp, Homo sapiens
atctctttgaattttctgtgt

SEQ ID NO: 1214503 - DNA, 12 bp, Homo sapiens
atctcttttata

SEQ ID NO: 1214504 - DNA, 22 bp, Homo sapiens
atctcttttgaatccatgcttg

SEQ ID NO: 1214505 - DNA, 21 bp, Homo sapiens
atctctttttatttaaatgtg

SEQ ID NO: 1214506 - DNA, 19 bp, Homo sapiens
atctgaaaatgtatgtgta

SEQ ID NO: 1214507 - DNA, 13 bp, Homo sapiens
atctgaacattct

SEQ ID NO: 1214508 - DNA, 14 bp, Homo sapiens
atctgaacccagct

SEQ ID NO: 1214509 - DNA, 14 bp, Homo sapiens
atctgaactctcaa

SEQ ID NO: 1214510 - DNA, 23 bp, Homo sapiens
atctgaagagtatccttccttca

SEQ ID NO: 1214511 - DNA, 18 bp, Homo sapiens
atctgaatagtgtcacca

SEQ ID NO: 1214512 - DNA, 19 bp, Homo sapiens
atctgaatttttaaacaag

SEQ ID NO: 1214513 - DNA, 14 bp, Homo sapiens
atctgaccagcagc

SEQ ID NO: 1214514 - DNA, 15 bp, Homo sapiens
atctgaccagcagcg

SEQ ID NO: 1214515 - DNA, 13 bp, Homo sapiens
atctgaccctccc

SEQ ID NO: 1214516 - DNA, 16 bp, Homo sapiens
atctgaccctcccagt

SEQ ID NO: 1214517 - DNA, 12 bp, Homo sapiens
atctgactgcca

SEQ ID NO: 1214518 - DNA, 13 bp, Homo sapiens
atctgactgccaa

SEQ ID NO: 1214519 - DNA, 14 bp, Homo sapiens
atctgactgccaaa

SEQ ID NO: 1214520 - DNA, 17 bp, Homo sapiens
atctgactgccaaataa

SEQ ID NO: 1214521 - DNA, 21 bp, Homo sapiens
atctgagaaactctacatgta

SEQ ID NO: 1214522 - DNA, 13 bp, Homo sapiens
atctgagaatctt

SEQ ID NO: 1214523 - DNA, 22 bp, Homo sapiens
atctgagattgtgtttgttcat

SEQ ID NO: 1214524 - DNA, 22 bp, Homo sapiens
atctgagcaagagctggcaaag

SEQ ID NO: 1214525 - DNA, 17 bp, Homo sapiens
atctgagcaataacttc

SEQ ID NO: 1214526 - DNA, 19 bp, Homo sapiens
atctgagctcccacctccc

SEQ ID NO: 1214527 - DNA, 20 bp, Homo sapiens
atctgagctcccacctccct

SEQ ID NO: 1214528 - DNA, 21 bp, Homo sapiens
atctgagctcccacctccctt

SEQ ID NO: 1214529 - DNA, 15 bp, Homo sapiens
atctgagggaaatgt

SEQ ID NO: 1214530 - DNA, 18 bp, Homo sapiens
atctgagggaaatgtttt

SEQ ID NO: 1214531 - DNA, 19 bp, Homo sapiens
atctgagggaggaggccac

SEQ ID NO: 1214532 - DNA, 20 bp, Homo sapiens
atctgaggttggatttgctc

SEQ ID NO: 1214533 - DNA, 17 bp, Homo sapiens
atctgagtccagctccc

SEQ ID NO: 1214534 - DNA, 13 bp, Homo sapiens
atctgagttgcat

SEQ ID NO: 1214535 - DNA, 16 bp, Homo sapiens
atctgagttgccaaga

SEQ ID NO: 1214536 - DNA, 20 bp, Homo sapiens
atctgagttgccaagacaaa

SEQ ID NO: 1214537 - DNA, 17 bp, Homo sapiens
atctgatacttatttac

SEQ ID NO: 1214538 - DNA, 22 bp, Homo sapiens
atctgatagaatgatgttttaa

SEQ ID NO: 1214539 - DNA, 16 bp, Homo sapiens
atctgatctgtaccat

SEQ ID NO: 1214540 - DNA, 12 bp, Homo sapiens
atctgatctgtg

SEQ ID NO: 1214541 - DNA, 16 bp, Homo sapiens
atctgatctgtgatta

SEQ ID NO: 1214542 - DNA, 16 bp, Homo sapiens
atctgatggtgagctg

SEQ ID NO: 1214543 - DNA, 19 bp, Homo sapiens
atctggacttcctataata

SEQ ID NO: 1214544 - DNA, 20 bp, Homo sapiens
atctggatgcctcattatgt

SEQ ID NO: 1214545 - DNA, 17 bp, Homo sapiens
atctggatgccttcccc

SEQ ID NO: 1214546 - DNA, 15 bp, Homo sapiens
atctggcacactccc

SEQ ID NO: 1214547 - DNA, 16 bp, Homo sapiens
atctggcacactccct

SEQ ID NO: 1214548 - DNA, 19 bp, Homo sapiens
atctggcattctacacctg

SEQ ID NO: 1214549 - DNA, 21 bp, Homo sapiens
atctggcattctacacctgga

SEQ ID NO: 1214550 - DNA, 11 bp, Homo sapiens
atctggccctg

SEQ ID NO: 1214551 - DNA, 12 bp, Homo sapiens
atctggccctga

SEQ ID NO: 1214552 - DNA, 13 bp, Homo sapiens
atctggccctgac

SEQ ID NO: 1214553 - DNA, 14 bp, Homo sapiens
atctggctcagcat

SEQ ID NO: 1214554 - DNA, 18 bp, Homo sapiens
atctggctgcacaggctg

SEQ ID NO: 1214555 - DNA, 21 bp, Homo sapiens
atctggctgcagttttgctat

SEQ ID NO: 1214556 - DNA, 20 bp, Homo sapiens
atctgggaccctttccttcc

SEQ ID NO: 1214557 - DNA, 18 bp, Homo sapiens
atctgggagtcccctttt

SEQ ID NO: 1214558 - DNA, 15 bp, Homo sapiens
atctgggatcatgat

SEQ ID NO: 1214559 - DNA, 21 bp, Homo sapiens
atctgggattattctttgaaa

SEQ ID NO: 1214560 - DNA, 22 bp, Homo sapiens
atctgggcattttcctcctctg

SEQ ID NO: 1214561 - DNA, 14 bp, Homo sapiens
atctggggagctcc

SEQ ID NO: 1214562 - DNA, 15 bp, Homo sapiens
atctggggagctcct

SEQ ID NO: 1214563 - DNA, 17 bp, Homo sapiens
atctggggagctcctgg

SEQ ID NO: 1214564 - DNA, 22 bp, Homo sapiens
atctggggaggcaggcattcct

SEQ ID NO: 1214565 - DNA, 23 bp, Homo sapiens
atctggggaggcaggcattcctg

SEQ ID NO: 1214566 - DNA, 18 bp, Homo sapiens
atctggggggtggggagg

SEQ ID NO: 1214567 - DNA, 17 bp, Homo sapiens
atctgggtagctgtaag

SEQ ID NO: 1214568 - DNA, 18 bp, Homo sapiens
atctgggtagctgtaagg

SEQ ID NO: 1214569 - DNA, 14 bp, Homo sapiens
atctgggtccttgc

SEQ ID NO: 1214570 - DNA, 15 bp, Homo sapiens
atctgggtgccctga

SEQ ID NO: 1214571 - DNA, 17 bp, Homo sapiens
atctggtagatttttaa

SEQ ID NO: 1214572 - DNA, 17 bp, Homo sapiens
atctggtatatgtcatt

SEQ ID NO: 1214573 - DNA, 21 bp, Homo sapiens
atctggtcttgttagaaaaca

SEQ ID NO: 1214574 - DNA, 18 bp, Homo sapiens
atctggtgacaaatattc

SEQ ID NO: 1214575 - DNA, 18 bp, Homo sapiens
atctggtggtcagcccta

SEQ ID NO: 1214576 - DNA, 17 bp, Homo sapiens
atctggtgtaggaagtt

SEQ ID NO: 1214577 - DNA, 13 bp, Homo sapiens
atctgtaaactgt

SEQ ID NO: 1214578 - DNA, 22 bp, Homo sapiens
atctgtaaactgtgtattccaa

SEQ ID NO: 1214579 - DNA, 13 bp, Homo sapiens
atctgtaaagaaa

SEQ ID NO: 1214580 - DNA, 15 bp, Homo sapiens
atctgtaaagaaaac

SEQ ID NO: 1214581 - DNA, 13 bp, Homo sapiens
atctgtaaatatc

SEQ ID NO: 1214582 - DNA, 19 bp, Homo sapiens
atctgtaagtaacttcaca

SEQ ID NO: 1214583 - DNA, 20 bp, Homo sapiens
atctgtaattgtaattccaa

SEQ ID NO: 1214584 - DNA, 17 bp, Homo sapiens
atctgtacttcttcgat

SEQ ID NO: 1214585 - DNA, 18 bp, Homo sapiens
atctgtactttgtgttta

SEQ ID NO: 1214586 - DNA, 21 bp, Homo sapiens
atctgtactttgtgtttagct

SEQ ID NO: 1214587 - DNA, 23 bp, Homo sapiens
atctgtagggaattcttctgtta

SEQ ID NO: 1214588 - DNA, 19 bp, Homo sapiens
atctgtagttccagctata

SEQ ID NO: 1214589 - DNA, 14 bp, Homo sapiens
atctgtataaataa

SEQ ID NO: 1214590 - DNA, 16 bp, Homo sapiens
atctgtataaataaga

SEQ ID NO: 1214591 - DNA, 22 bp, Homo sapiens
atcttttactttttttctgtga

SEQ ID NO: 1214592 - DNA, 14 bp, Homo sapiens
atcttttagaagtg

SEQ ID NO: 1214593 - DNA, 12 bp, Homo sapiens
atcttttcataa

SEQ ID NO: 1214594 - DNA, 22 bp, Homo sapiens
atcttttcattgaacagcaaag

SEQ ID NO: 1214595 - DNA, 21 bp, Homo sapiens
atcttttctaatcacagtgtt

SEQ ID NO: 1214596 - DNA, 13 bp, Homo sapiens
atcttttgaagag

SEQ ID NO: 1214597 - DNA, 17 bp, Homo sapiens
atcttttgaattcttga

SEQ ID NO: 1214598 - DNA, 23 bp, Homo sapiens
atcttttgtttccttttttccca

SEQ ID NO: 1214599 - DNA, 18 bp, Homo sapiens
atctttttaaaaactctt

SEQ ID NO: 1214600 - DNA, 15 bp, Homo sapiens
atctttttacagttg

SEQ ID NO: 1214601 - DNA, 14 bp, Homo sapiens
atctttttgcttct

SEQ ID NO: 1214602 - DNA, 15 bp, Homo sapiens
atctttttgcttcta

SEQ ID NO: 1214603 - DNA, 17 bp, Homo sapiens
atctttttgcttctact

SEQ ID NO: 1214604 - DNA, 16 bp, Homo sapiens
atcttttttagcataa

SEQ ID NO: 1214605 - DNA, 19 bp, Homo sapiens
atcttttttagcataaaat

SEQ ID NO: 1214606 - DNA, 23 bp, Homo sapiens
atcttttttagcataaaattttc

SEQ ID NO: 1214607 - DNA, 17 bp, Homo sapiens
atcttttttttatataa

SEQ ID NO: 1214608 - DNA, 18 bp, Homo sapiens
atgaaaaaaaaaaacaat

SEQ ID NO: 1214609 - DNA, 14 bp, Homo sapiens
atgaaaaacatccc

SEQ ID NO: 1214610 - DNA, 17 bp, Homo sapiens
atgaaaaacatcccaaa

SEQ ID NO: 1214611 - DNA, 20 bp, Homo sapiens
atgaaaaacatcccaaactt

SEQ ID NO: 1214612 - DNA, 21 bp, Homo sapiens
atgaaaaacatcccaaacttt

SEQ ID NO: 1214613 - DNA, 15 bp, Homo sapiens
atgaaaaagaagaat

SEQ ID NO: 1214614 - DNA, 12 bp, Homo sapiens
atgaaaaagatt

SEQ ID NO: 1214615 - DNA, 23 bp, Homo sapiens
atgaaaaagattatttgtgcatt

SEQ ID NO: 1214616 - DNA, 16 bp, Homo sapiens
atgaaaaagctgcttc

SEQ ID NO: 1214617 - DNA, 19 bp, Homo sapiens
atgaaaaatagtgtctttg

SEQ ID NO: 1214618 - DNA, 13 bp, Homo sapiens
atgaaaaatgtaa

SEQ ID NO: 1214619 - DNA, 17 bp, Homo sapiens
atgaaaaatttaagcat

SEQ ID NO: 1214620 - DNA, 19 bp, Homo sapiens
atgaaaaatttaagcattg

SEQ ID NO: 1214621 - DNA, 20 bp, Homo sapiens
atgaaaaatttaagcattgt

SEQ ID NO: 1214622 - DNA, 15 bp, Homo sapiens
atgaaaacattcaga

SEQ ID NO: 1214623 - DNA, 22 bp, Homo sapiens
atgaaaacattttatttttaaa

SEQ ID NO: 1214624 - DNA, 20 bp, Homo sapiens
atgaaaacgttttattgtgt

SEQ ID NO: 1214625 - DNA, 17 bp, Homo sapiens
atgaaaactaaggattt

SEQ ID NO: 1214626 - DNA, 21 bp, Homo sapiens
atgaaaactcatgatcaagat

SEQ ID NO: 1214627 - DNA, 15 bp, Homo sapiens
atgaaaacttttgta

SEQ ID NO: 1214628 - DNA, 17 bp, Homo sapiens
atgaaaagcctctgttt

SEQ ID NO: 1214629 - DNA, 16 bp, Homo sapiens
atgaaaagctgctggt

SEQ ID NO: 1214630 - DNA, 21 bp, Homo sapiens
atgaaaaggatattatctacc

SEQ ID NO: 1214631 - DNA, 16 bp, Homo sapiens
atgaaaataaaacaca

SEQ ID NO: 1214632 - DNA, 17 bp, Homo sapiens
atgaaaataaaacacac

SEQ ID NO: 1214633 - DNA, 20 bp, Homo sapiens
atgaaaataaaacacacctc

SEQ ID NO: 1214634 - DNA, 22 bp, Homo sapiens
atgaaaataactgaatttggag

SEQ ID NO: 1214635 - DNA, 22 bp, Homo sapiens
atgaaaatatagacattctcac

SEQ ID NO: 1214636 - DNA, 22 bp, Homo sapiens
atgaaaatcctatatctgtttg

SEQ ID NO: 1214637 - DNA, 12 bp, Homo sapiens
atgaaaatcctt

SEQ ID NO: 1214638 - DNA, 18 bp, Homo sapiens
atgaaaatccttttaacc

SEQ ID NO: 1214639 - DNA, 20 bp, Homo sapiens
atgaaaatccttttaaccat

SEQ ID NO: 1214640 - DNA, 15 bp, Homo sapiens
atgaaaatgagccct

SEQ ID NO: 1214641 - DNA, 12 bp, Homo sapiens
atgaaaatggaa

SEQ ID NO: 1214642 - DNA, 13 bp, Homo sapiens
atgaaaatgtcag

SEQ ID NO: 1214643 - DNA, 14 bp, Homo sapiens
atgaaaattgtatt

SEQ ID NO: 1214644 - DNA, 20 bp, Homo sapiens
atgaaacaaaaaaaaaatga

SEQ ID NO: 1214645 - DNA, 16 bp, Homo sapiens
atgaaacaaataatca

SEQ ID NO: 1214646 - DNA, 17 bp, Homo sapiens
atgaaacacttctcatc

SEQ ID NO: 1214647 - DNA, 13 bp, Homo sapiens
atgaaacagaaac

SEQ ID NO: 1214648 - DNA, 22 bp, Homo sapiens
atgaaacagaaacaaaaacact

SEQ ID NO: 1214649 - DNA, 17 bp, Homo sapiens
atgaaacagatgataaa

SEQ ID NO: 1214650 - DNA, 13 bp, Homo sapiens
atgaaacatatca

SEQ ID NO: 1214651 - DNA, 23 bp, Homo sapiens
atgaaaccttattttttcccaaa

SEQ ID NO: 1214652 - DNA, 17 bp, Homo sapiens
atgaaactaggcttctg

SEQ ID NO: 1214653 - DNA, 18 bp, Homo sapiens
atgaaactcctgattttg

SEQ ID NO: 1214654 - DNA, 19 bp, Homo sapiens
atgaaactcctgattttgt

SEQ ID NO: 1214655 - DNA, 17 bp, Homo sapiens
atgaaactgtacatact

SEQ ID NO: 1214656 - DNA, 15 bp, Homo sapiens
atgaaacttggccag

SEQ ID NO: 1214657 - DNA, 12 bp, Homo sapiens
atgaaagcatgt

SEQ ID NO: 1214658 - DNA, 16 bp, Homo sapiens
atgaaagccaaaacct

SEQ ID NO: 1214659 - DNA, 22 bp, Homo sapiens
atgaaagctgattactgtcaat

SEQ ID NO: 1214660 - DNA, 21 bp, Homo sapiens
atgaaaggcaggcctatttca

SEQ ID NO: 1214661 - DNA, 20 bp, Homo sapiens
atgaaagggaaagtcagctt

SEQ ID NO: 1214662 - DNA, 14 bp, Homo sapiens
atgaaataaagaaa

SEQ ID NO: 1214663 - DNA, 22 bp, Homo sapiens
atgaaataaagacccaggggga

SEQ ID NO: 1214664 - DNA, 22 bp, Homo sapiens
atgaaataactccttcttgtag

SEQ ID NO: 1214665 - DNA, 19 bp, Homo sapiens
atgaaatacacaagtaaac

SEQ ID NO: 1214666 - DNA, 15 bp, Homo sapiens
atgaaatatgcatct

SEQ ID NO: 1214667 - DNA, 19 bp, Homo sapiens
atgaaatctgctagaaagt

SEQ ID NO: 1214668 - DNA, 19 bp, Homo sapiens
atgaaatgataaagacttt

SEQ ID NO: 1214669 - DNA, 14 bp, Homo sapiens
atgaaatgcactgt

SEQ ID NO: 1214670 - DNA, 23 bp, Homo sapiens
atgaaatgcactgtattgctcct

SEQ ID NO: 1214671 - DNA, 21 bp, Homo sapiens
atgaaatgccctcctaaatgt

SEQ ID NO: 1214672 - DNA, 21 bp, Homo sapiens
atgaaatggagtcatttgagt

SEQ ID NO: 1214673 - DNA, 15 bp, Homo sapiens
atgaaatgttaacaa

SEQ ID NO: 1214674 - DNA, 15 bp, Homo sapiens
atgaaattcctcctt

SEQ ID NO: 1214675 - DNA, 11 bp, Homo sapiens
atgaaattgcc

SEQ ID NO: 1214676 - DNA, 19 bp, Homo sapiens
atgaaattttctagacttt

SEQ ID NO: 1214677 - DNA, 22 bp, Homo sapiens
atgaaattttctagactttctg

SEQ ID NO: 1214678 - DNA, 13 bp, Homo sapiens
atgaacaacagta

SEQ ID NO: 1214679 - DNA, 13 bp, Homo sapiens
atgaacacactgt

SEQ ID NO: 1214680 - DNA, 14 bp, Homo sapiens
atgaacactcccca

SEQ ID NO: 1214681 - DNA, 13 bp, Homo sapiens
atgaacacttata

SEQ ID NO: 1214682 - DNA, 14 bp, Homo sapiens
atgaacagctctga

SEQ ID NO: 1214683 - DNA, 15 bp, Homo sapiens
atgacaactttgcca

SEQ ID NO: 1214684 - DNA, 22 bp, Homo sapiens
atgacaacttttaaagaaaaat

SEQ ID NO: 1214685 - DNA, 13 bp, Homo sapiens
atgacaagcattt

SEQ ID NO: 1214686 - DNA, 20 bp, Homo sapiens
atgacaagccccaggcaggc

SEQ ID NO: 1214687 - DNA, 13 bp, Homo sapiens
atgacaatcttat

SEQ ID NO: 1214688 - DNA, 19 bp, Homo sapiens
atgacaatgcaatgaaaca

SEQ ID NO: 1214689 - DNA, 17 bp, Homo sapiens
atgacacagttatcaaa

SEQ ID NO: 1214690 - DNA, 16 bp, Homo sapiens
atgacaccatctttta

SEQ ID NO: 1214691 - DNA, 22 bp, Homo sapiens
atgacaccatcttttattcttt

SEQ ID NO: 1214692 - DNA, 15 bp, Homo sapiens
atgacacccagacct

SEQ ID NO: 1214693 - DNA, 16 bp, Homo sapiens
atgacacccatgccag

SEQ ID NO: 1214694 - DNA, 20 bp, Homo sapiens
atgacacccatgccagagag

SEQ ID NO: 1214695 - DNA, 21 bp, Homo sapiens
atgacacccatgccagagagg

SEQ ID NO: 1214696 - DNA, 21 bp, Homo sapiens
atgacactagaaaacttgact

SEQ ID NO: 1214697 - DNA, 15 bp, Homo sapiens
atgacagatggtgaa

SEQ ID NO: 1214698 - DNA, 22 bp, Homo sapiens
atgacagattctgacatttata

SEQ ID NO: 1214699 - DNA, 16 bp, Homo sapiens
atgacagctgtccctg

SEQ ID NO: 1214700 - DNA, 20 bp, Homo sapiens
atgacaggcatccaaggaag

SEQ ID NO: 1214701 - DNA, 16 bp, Homo sapiens
atgacagggcagagca

SEQ ID NO: 1214702 - DNA, 18 bp, Homo sapiens
atgacagggcagagcagg

SEQ ID NO: 1214703 - DNA, 16 bp, Homo sapiens
atgacaggtgtgagcc

SEQ ID NO: 1214704 - DNA, 20 bp, Homo sapiens
atgacaggtgtgagccactg

SEQ ID NO: 1214705 - DNA, 20 bp, Homo sapiens
atgacagtccgtcaaaacag

SEQ ID NO: 1214706 - DNA, 11 bp, Homo sapiens
atgacagtgaa

SEQ ID NO: 1214707 - DNA, 20 bp, Homo sapiens
atgacagtgaagcagcactg

SEQ ID NO: 1214708 - DNA, 12 bp, Homo sapiens
atgacagtgaat

SEQ ID NO: 1214709 - DNA, 19 bp, Homo sapiens
atgacagtgcttgcatcct

SEQ ID NO: 1214710 - DNA, 14 bp, Homo sapiens
atgacatagcagtt

SEQ ID NO: 1214711 - DNA, 17 bp, Homo sapiens
atgacataggccaaggc

SEQ ID NO: 1214712 - DNA, 12 bp, Homo sapiens
atgacatcaaaa

SEQ ID NO: 1214713 - DNA, 15 bp, Homo sapiens
atgacatcaaaatga

SEQ ID NO: 1214714 - DNA, 19 bp, Homo sapiens
atgacatcacttgtacaaa

SEQ ID NO: 1214715 - DNA, 19 bp, Homo sapiens
atgacatccagaaagctga

SEQ ID NO: 1214716 - DNA, 24 bp, Homo sapiens
atgacatcttcaaagcttgaagat

SEQ ID NO: 1214717 - DNA, 17 bp, Homo sapiens
atgacattaaatgcaat

SEQ ID NO: 1214718 - DNA, 22 bp, Homo sapiens
atgacatttaaatgtaacttat

SEQ ID NO: 1214719 - DNA, 21 bp, Homo sapiens
atgaccaaagtcccttcctgc

SEQ ID NO: 1214720 - DNA, 22 bp, Homo sapiens
atgaccacacccgaagtcctgt

SEQ ID NO: 1214721 - DNA, 21 bp, Homo sapiens
atgaccactgggcctgctagt

SEQ ID NO: 1214722 - DNA, 21 bp, Homo sapiens
atgaccagcagcagctttcag

SEQ ID NO: 1214723 - DNA, 17 bp, Homo sapiens
atgaccagggatgctgg

SEQ ID NO: 1214724 - DNA, 23 bp, Homo sapiens
atgaccagggatgctgggctggg

SEQ ID NO: 1214725 - DNA, 20 bp, Homo sapiens
atgaccattgagtccctgct

SEQ ID NO: 1214726 - DNA, 13 bp, Homo sapiens
atgacccaaagac

SEQ ID NO: 1214727 - DNA, 19 bp, Homo sapiens
atgacccacactgccagaa

SEQ ID NO: 1214728 - DNA, 20 bp, Homo sapiens
atgacccacactgccagaag

SEQ ID NO: 1214729 - DNA, 19 bp, Homo sapiens
atgacccacccctgtgctc

SEQ ID NO: 1214730 - DNA, 21 bp, Homo sapiens
atgaccccagaaactgaacca

SEQ ID NO: 1214731 - DNA, 15 bp, Homo sapiens
atgaccccttctctc

SEQ ID NO: 1214732 - DNA, 19 bp, Homo sapiens
atgaccctctgtccccagg

SEQ ID NO: 1214733 - DNA, 23 bp, Homo sapiens
atgaccctgcgaaggggccctgg

SEQ ID NO: 1214734 - DNA, 12 bp, Homo sapiens
atgaccctgggc

SEQ ID NO: 1214735 - DNA, 13 bp, Homo sapiens
atgaccctgggct

SEQ ID NO: 1214736 - DNA, 19 bp, Homo sapiens
atgaccgcacgttctctgc

SEQ ID NO: 1214737 - DNA, 12 bp, Homo sapiens
atgacctaccag

SEQ ID NO: 1214738 - DNA, 14 bp, Homo sapiens
atgacctcccctcc

SEQ ID NO: 1214739 - DNA, 19 bp, Homo sapiens
atgacctgtgaccagcact

SEQ ID NO: 1214740 - DNA, 20 bp, Homo sapiens
atgaccttatcagcttcctg

SEQ ID NO: 1214741 - DNA, 17 bp, Homo sapiens
atgaccttggggtacaa

SEQ ID NO: 1214742 - DNA, 20 bp, Homo sapiens
atgacgccagataaaatgtt

SEQ ID NO: 1214743 - DNA, 18 bp, Homo sapiens
atgacgcggctcaaaagg

SEQ ID NO: 1214744 - DNA, 15 bp, Homo sapiens
atgacggaagaacat

SEQ ID NO: 1214745 - DNA, 21 bp, Homo sapiens
atgacggaagaacatagaact

SEQ ID NO: 1214746 - DNA, 18 bp, Homo sapiens
atgacggtaagtgttctc

SEQ ID NO: 1214747 - DNA, 22 bp, Homo sapiens
atgacggtaagtgttctcatga

SEQ ID NO: 1214748 - DNA, 16 bp, Homo sapiens
atgactaaaaatatta

SEQ ID NO: 1214749 - DNA, 23 bp, Homo sapiens
atgactaaaaatattataactta

SEQ ID NO: 1214750 - DNA, 23 bp, Homo sapiens
atgactaaagagagaatgtagat

SEQ ID NO: 1214751 - DNA, 22 bp, Homo sapiens
atgactatgcgtggctggaacc

SEQ ID NO: 1214752 - DNA, 16 bp, Homo sapiens
atgactatgtaaacta

SEQ ID NO: 1214753 - DNA, 13 bp, Homo sapiens
atgactatgtcca

SEQ ID NO: 1214754 - DNA, 17 bp, Homo sapiens
atgactattacttttct

SEQ ID NO: 1214755 - DNA, 23 bp, Homo sapiens
atgactattacttttctgtttag

SEQ ID NO: 1214756 - DNA, 22 bp, Homo sapiens
atgactcataggtccctgacat

SEQ ID NO: 1214757 - DNA, 22 bp, Homo sapiens
atgactcccttaaaatagaaat

SEQ ID NO: 1214758 - DNA, 15 bp, Homo sapiens
atgactcgaaactga

SEQ ID NO: 1214759 - DNA, 22 bp, Homo sapiens
atgactcgaaactgacagtatt

SEQ ID NO: 1214760 - DNA, 13 bp, Homo sapiens
atgactctgagaa

SEQ ID NO: 1214761 - DNA, 12 bp, Homo sapiens
atgactcttgga

SEQ ID NO: 1214762 - DNA, 21 bp, Homo sapiens
atgactctttctgaaggaaga

SEQ ID NO: 1214763 - DNA, 23 bp, Homo sapiens
atgactctttctgaaggaagaga

SEQ ID NO: 1214764 - DNA, 23 bp, Homo sapiens
atgactgaaagaagaacagctgt

SEQ ID NO: 1214765 - DNA, 22 bp, Homo sapiens
atgactgcacccagctccaggg

SEQ ID NO: 1214766 - DNA, 23 bp, Homo sapiens
atgactgctccccagccctggct

SEQ ID NO: 1214767 - DNA, 18 bp, Homo sapiens
atgactgctttgtttgga

SEQ ID NO: 1214768 - DNA, 12 bp, Homo sapiens
atgactggctgt

SEQ ID NO: 1214769 - DNA, 16 bp, Homo sapiens
atgactggctgtctgc

SEQ ID NO: 1214770 - DNA, 19 bp, Homo sapiens
atgactggctgtctgcctg

SEQ ID NO: 1214771 - DNA, 10 bp, Homo sapiens
atgactgggc

SEQ ID NO: 1214772 - DNA, 12 bp, Homo sapiens
atgactgggcct

SEQ ID NO: 1214773 - DNA, 19 bp, Homo sapiens
atgactggtggtgagagac

SEQ ID NO: 1214774 - DNA, 19 bp, Homo sapiens
atgactgtgaactgggcat

SEQ ID NO: 1214775 - DNA, 11 bp, Homo sapiens
atgactgttga

SEQ ID NO: 1214776 - DNA, 13 bp, Homo sapiens
atgactgtttctt

SEQ ID NO: 1214777 - DNA, 18 bp, Homo sapiens
atgactgtttcttttgta

SEQ ID NO: 1214778 - DNA, 17 bp, Homo sapiens
atgactgtttttgtagt

SEQ ID NO: 1214779 - DNA, 14 bp, Homo sapiens
atgacttacctgtt

SEQ ID NO: 1214780 - DNA, 16 bp, Homo sapiens
atgacttactgtacat

SEQ ID NO: 1214781 - DNA, 15 bp, Homo sapiens
atgacttagaaactg

SEQ ID NO: 1214782 - DNA, 18 bp, Homo sapiens
atgacttattatgcataa

SEQ ID NO: 1214783 - DNA, 12 bp, Homo sapiens
atgacttctgct

SEQ ID NO: 1214784 - DNA, 15 bp, Homo sapiens
atgacttctgctgaa

SEQ ID NO: 1214785 - DNA, 14 bp, Homo sapiens
atgacttgctgtcc

SEQ ID NO: 1214786 - DNA, 21 bp, Homo sapiens
atgacttgctgtccaggcagc

SEQ ID NO: 1214787 - DNA, 11 bp, Homo sapiens
atgagaaactg

SEQ ID NO: 1214788 - DNA, 22 bp, Homo sapiens
atgagaaactggcaaagcagaa

SEQ ID NO: 1214789 - DNA, 11 bp, Homo sapiens
atgagaaactt

SEQ ID NO: 1214790 - DNA, 22 bp, Homo sapiens
atgagaaactttgatctctgct

SEQ ID NO: 1214791 - DNA, 22 bp, Homo sapiens
atgagaaattagtcacttaaaa

SEQ ID NO: 1214792 - DNA, 17 bp, Homo sapiens
atgagaacaaagctgtt

SEQ ID NO: 1214793 - DNA, 22 bp, Homo sapiens
atgagaacaaagctgttaaact

SEQ ID NO: 1214794 - DNA, 23 bp, Homo sapiens
atgagaacaaagctgttaaactg

SEQ ID NO: 1214795 - DNA, 15 bp, Homo sapiens
atgagaagagggcct

SEQ ID NO: 1214796 - DNA, 21 bp, Homo sapiens
atgagaagagggcctgtggga

SEQ ID NO: 1214797 - DNA, 14 bp, Homo sapiens
atgagaagccagga

SEQ ID NO: 1214798 - DNA, 16 bp, Homo sapiens
atgagaaggaacttcc

SEQ ID NO: 1214799 - DNA, 19 bp, Homo sapiens
atgagacaggaaaaaccaa

SEQ ID NO: 1214800 - DNA, 14 bp, Homo sapiens
atgagacctggaac

SEQ ID NO: 1214801 - DNA, 15 bp, Homo sapiens
atgagacctggaaca

SEQ ID NO: 1214802 - DNA, 17 bp, Homo sapiens
atgagactctagggtcc

SEQ ID NO: 1214803 - DNA, 18 bp, Homo sapiens
atgagactctagggtcca

SEQ ID NO: 1214804 - DNA, 21 bp, Homo sapiens
atgagactgatccctggccac

SEQ ID NO: 1214805 - DNA, 23 bp, Homo sapiens
atgagacttccaaacctgacaga

SEQ ID NO: 1214806 - DNA, 15 bp, Homo sapiens
atgagacttgctctc

SEQ ID NO: 1214807 - DNA, 21 bp, Homo sapiens
atgagactttaaaagcatttt

SEQ ID NO: 1214808 - DNA, 18 bp, Homo sapiens
atgagagaatcacacaag

SEQ ID NO: 1214809 - DNA, 16 bp, Homo sapiens
atgagagcgacacaga

SEQ ID NO: 1214810 - DNA, 18 bp, Homo sapiens
atgagagcgacacagacg

SEQ ID NO: 1214811 - DNA, 19 bp, Homo sapiens
atgagaggttgaggaaaag

SEQ ID NO: 1214812 - DNA, 17 bp, Homo sapiens
atgagagttccttctca

SEQ ID NO: 1214813 - DNA, 24 bp, Homo sapiens
atgagatgatacatccaaagcaga

SEQ ID NO: 1214814 - DNA, 19 bp, Homo sapiens
atgagatggttaaaaaggc

SEQ ID NO: 1214815 - DNA, 13 bp, Homo sapiens
atgagattgaatt

SEQ ID NO: 1214816 - DNA, 18 bp, Homo sapiens
atgagattgttttatcat

SEQ ID NO: 1214817 - DNA, 22 bp, Homo sapiens
atgagatttactgctctagaaa

SEQ ID NO: 1214818 - DNA, 13 bp, Homo sapiens
atgagcacctcca

SEQ ID NO: 1214819 - DNA, 14 bp, Homo sapiens
atgagcacctccat

SEQ ID NO: 1214820 - DNA, 14 bp, Homo sapiens
atgagcagagggag

SEQ ID NO: 1214821 - DNA, 16 bp, Homo sapiens
atgagcatcagagagt

SEQ ID NO: 1214822 - DNA, 22 bp, Homo sapiens
atgagcatcagagagtgtacat

SEQ ID NO: 1214823 - DNA, 17 bp, Homo sapiens
atgagcatcctgagccc

SEQ ID NO: 1214824 - DNA, 14 bp, Homo sapiens
atgagccaaaatga

SEQ ID NO: 1214825 - DNA, 15 bp, Homo sapiens
atgagccaaaatgac

SEQ ID NO: 1214826 - DNA, 11 bp, Homo sapiens
atgagccctgg

SEQ ID NO: 1214827 - DNA, 21 bp, Homo sapiens
atgagccctggctcccacctg

SEQ ID NO: 1214828 - DNA, 23 bp, Homo sapiens
atgagccgctgtgagcccctggt

SEQ ID NO: 1214829 - DNA, 20 bp, Homo sapiens
atgagccggttattacttct

SEQ ID NO: 1214830 - DNA, 19 bp, Homo sapiens
atgagcctacgctgaagat

SEQ ID NO: 1214831 - DNA, 11 bp, Homo sapiens
atgagcctgcc

SEQ ID NO: 1214832 - DNA, 14 bp, Homo sapiens
atgagcctgcccgc

SEQ ID NO: 1214833 - DNA, 12 bp, Homo sapiens
atgagcctgctg

SEQ ID NO: 1214834 - DNA, 12 bp, Homo sapiens
atgagcctggca

SEQ ID NO: 1214835 - DNA, 22 bp, Homo sapiens
atgagccttgcagatatctgca

SEQ ID NO: 1214836 - DNA, 14 bp, Homo sapiens
atgagcgccacctc

SEQ ID NO: 1214837 - DNA, 15 bp, Homo sapiens
atgagcgccacctct

SEQ ID NO: 1214838 - DNA, 13 bp, Homo sapiens
atgagcgtcactg

SEQ ID NO: 1214839 - DNA, 17 bp, Homo sapiens
atgagcgtcactgccca

SEQ ID NO: 1214840 - DNA, 13 bp, Homo sapiens
atgagctccagac

SEQ ID NO: 1214841 - DNA, 15 bp, Homo sapiens
atgagctccagaccc

SEQ ID NO: 1214842 - DNA, 21 bp, Homo sapiens
atgagctcgcatttgtcaatg

SEQ ID NO: 1214843 - DNA, 20 bp, Homo sapiens
atgagctcggggtccaccag

SEQ ID NO: 1214844 - DNA, 15 bp, Homo sapiens
atgagctctgaacaa

SEQ ID NO: 1214845 - DNA, 20 bp, Homo sapiens
atgagctctgaacaaacact

SEQ ID NO: 1214846 - DNA, 12 bp, Homo sapiens
atgagctgaggg

SEQ ID NO: 1214847 - DNA, 17 bp, Homo sapiens
atgagctgatctgcgga

SEQ ID NO: 1214848 - DNA, 14 bp, Homo sapiens
atgagctgctgtgc

SEQ ID NO: 1214849 - DNA, 14 bp, Homo sapiens
atgagcttcaatat

SEQ ID NO: 1214850 - DNA, 19 bp, Homo sapiens
atgagcttcaatataagaa

SEQ ID NO: 1214851 - DNA, 19 bp, Homo sapiens
atgaggaaactactgaact

SEQ ID NO: 1214852 - DNA, 22 bp, Homo sapiens
atgaggaaagcgtttctgtgta

SEQ ID NO: 1214853 - DNA, 19 bp, Homo sapiens
atgaggaagcaaagagtga

SEQ ID NO: 1214854 - DNA, 23 bp, Homo sapiens
atgaggaataattatttatttaa

SEQ ID NO: 1214855 - DNA, 17 bp, Homo sapiens
atgaggaccagggtgga

SEQ ID NO: 1214856 - DNA, 12 bp, Homo sapiens
atgaggagacag

SEQ ID NO: 1214857 - DNA, 17 bp, Homo sapiens
atgaggagagaaaatat

SEQ ID NO: 1214858 - DNA, 16 bp, Homo sapiens
atgaggagcagctggg

SEQ ID NO: 1214859 - DNA, 12 bp, Homo sapiens
atgaggagggga

SEQ ID NO: 1214860 - DNA, 17 bp, Homo sapiens
atgaggaggggagggta

SEQ ID NO: 1214861 - DNA, 22 bp, Homo sapiens
atgaggagggtgggggagggag

SEQ ID NO: 1214862 - DNA, 14 bp, Homo sapiens
atgaggagttgctg

SEQ ID NO: 1214863 - DNA, 23 bp, Homo sapiens
atgaggatccgaaacggcagcct

SEQ ID NO: 1214864 - DNA, 14 bp, Homo sapiens
atgaggcaaacagc

SEQ ID NO: 1214865 - DNA, 22 bp, Homo sapiens
atgaggcatttgtttgaactga

SEQ ID NO: 1214866 - DNA, 14 bp, Homo sapiens
atgaggccagacca

SEQ ID NO: 1214867 - DNA, 20 bp, Homo sapiens
atgaggccatctcaggagat

SEQ ID NO: 1214868 - DNA, 18 bp, Homo sapiens
atgaggcctcagtggact

SEQ ID NO: 1214869 - DNA, 15 bp, Homo sapiens
atgaggcctcttgga

SEQ ID NO: 1214870 - DNA, 21 bp, Homo sapiens
atgaggcctcttggacctctg

SEQ ID NO: 1214871 - DNA, 14 bp, Homo sapiens
atgagggactggaa

SEQ ID NO: 1214872 - DNA, 20 bp, Homo sapiens
atgagggactggaaccaggg

SEQ ID NO: 1214873 - DNA, 16 bp, Homo sapiens
atgagggatgggcctg

SEQ ID NO: 1214874 - DNA, 18 bp, Homo sapiens
atgagggatgggcctggc

SEQ ID NO: 1214875 - DNA, 14 bp, Homo sapiens
atgaggggagagga

SEQ ID NO: 1214876 - DNA, 22 bp, Homo sapiens
atgaggggccaccccgtgcccc

SEQ ID NO: 1214877 - DNA, 15 bp, Homo sapiens
atgaggggccactga

SEQ ID NO: 1214878 - DNA, 21 bp, Homo sapiens
atgaggggcttcctgggtcct

SEQ ID NO: 1214879 - DNA, 17 bp, Homo sapiens
atgaggtcaacacaggt

SEQ ID NO: 1214880 - DNA, 14 bp, Homo sapiens
atgaggtctgttta

SEQ ID NO: 1214881 - DNA, 15 bp, Homo sapiens
atgaggtctgtttaa

SEQ ID NO: 1214882 - DNA, 15 bp, Homo sapiens
atgaggtcttcccgc

SEQ ID NO: 1214883 - DNA, 13 bp, Homo sapiens
atgaggtgggagg

SEQ ID NO: 1214884 - DNA, 13 bp, Homo sapiens
atgaggtgggggt

SEQ ID NO: 1214885 - DNA, 16 bp, Homo sapiens
atgagtaacatttgct

SEQ ID NO: 1214886 - DNA, 17 bp, Homo sapiens
atgagtatgaacttgag

SEQ ID NO: 1214887 - DNA, 23 bp, Homo sapiens
atgagtatttggtccaaaaaaag

SEQ ID NO: 1214888 - DNA, 13 bp, Homo sapiens
atgagtcaatcag

SEQ ID NO: 1214889 - DNA, 14 bp, Homo sapiens
atgagtcaatcagc

SEQ ID NO: 1214890 - DNA, 17 bp, Homo sapiens
atgagtcaatgtgcagt

SEQ ID NO: 1214891 - DNA, 21 bp, Homo sapiens
atgagtccttgaaaatatttt

SEQ ID NO: 1214892 - DNA, 22 bp, Homo sapiens
atgagtctaagtatagccactg

SEQ ID NO: 1214893 - DNA, 16 bp, Homo sapiens
atgagtgaataaatgt

SEQ ID NO: 1214894 - DNA, 17 bp, Homo sapiens
atgagtgaataaatgtc

SEQ ID NO: 1214895 - DNA, 16 bp, Homo sapiens
atgagtggccagcgcc

SEQ ID NO: 1214896 - DNA, 22 bp, Homo sapiens
atgagtgtctgtgagaggcagc

SEQ ID NO: 1214897 - DNA, 18 bp, Homo sapiens
atgagttacttagaatgc

SEQ ID NO: 1214898 - DNA, 21 bp, Homo sapiens
atgagttattatctatggaaa

SEQ ID NO: 1214899 - DNA, 20 bp, Homo sapiens
atgagttgtcagctttgact

SEQ ID NO: 1214900 - DNA, 20 bp, Homo sapiens
atgagttgtgatgaatcaat

SEQ ID NO: 1214901 - DNA, 13 bp, Homo sapiens
atgagtttcactg

SEQ ID NO: 1214902 - DNA, 23 bp, Homo sapiens
atgagtttcactgtactgcatgt

SEQ ID NO: 1214903 - DNA, 13 bp, Homo sapiens
atgagtttctggg

SEQ ID NO: 1214904 - DNA, 20 bp, Homo sapiens
atgagtttttgatagcttta

SEQ ID NO: 1214905 - DNA, 17 bp, Homo sapiens
atgataaaataaataat

SEQ ID NO: 1214906 - DNA, 16 bp, Homo sapiens
atgataaactcagatc

SEQ ID NO: 1214907 - DNA, 20 bp, Homo sapiens
atgataaactcagatctgat

SEQ ID NO: 1214908 - DNA, 13 bp, Homo sapiens
atgataaagactt

SEQ ID NO: 1214909 - DNA, 13 bp, Homo sapiens
atgataaagttgt

SEQ ID NO: 1214910 - DNA, 12 bp, Homo sapiens
atgataatgaac

SEQ ID NO: 1214911 - DNA, 18 bp, Homo sapiens
atgataccacctttactg

SEQ ID NO: 1214912 - DNA, 16 bp, Homo sapiens
atgatacccaacagtt

SEQ ID NO: 1214913 - DNA, 19 bp, Homo sapiens
atgatacccaacagtttat

SEQ ID NO: 1214914 - DNA, 16 bp, Homo sapiens
atgatactgatgccat

SEQ ID NO: 1214915 - DNA, 15 bp, Homo sapiens
atgatactgtagaac

SEQ ID NO: 1214916 - DNA, 15 bp, Homo sapiens
atgatactgtttctt

SEQ ID NO: 1214917 - DNA, 21 bp, Homo sapiens
atgatactgtttcttgcactg

SEQ ID NO: 1214918 - DNA, 16 bp, Homo sapiens
atgatagacttgttag

SEQ ID NO: 1214919 - DNA, 14 bp, Homo sapiens
atgatagcccagaa

SEQ ID NO: 1214920 - DNA, 18 bp, Homo sapiens
atgatatacaatggttaa

SEQ ID NO: 1214921 - DNA, 13 bp, Homo sapiens
atgatatgtaaac

SEQ ID NO: 1214922 - DNA, 21 bp, Homo sapiens
atgatatgtaaacataattct

SEQ ID NO: 1214923 - DNA, 19 bp, Homo sapiens
atgatattgtttaaaattc

SEQ ID NO: 1214924 - DNA, 21 bp, Homo sapiens
atgatattgtttaaaattcag

SEQ ID NO: 1214925 - DNA, 16 bp, Homo sapiens
atgatcaaaacatgct

SEQ ID NO: 1214926 - DNA, 19 bp, Homo sapiens
atgatcaaaacctgtgcca

SEQ ID NO: 1214927 - DNA, 17 bp, Homo sapiens
atgatcaagatatatgt

SEQ ID NO: 1214928 - DNA, 17 bp, Homo sapiens
atgatcaggtaactttc

SEQ ID NO: 1214929 - DNA, 19 bp, Homo sapiens
atgatcattgaaatacttt

SEQ ID NO: 1214930 - DNA, 22 bp, Homo sapiens
atgatcatttgcccttaaggac

SEQ ID NO: 1214931 - DNA, 21 bp, Homo sapiens
atgatccaactaatgccttac

SEQ ID NO: 1214932 - DNA, 12 bp, Homo sapiens
atgatccagaac

SEQ ID NO: 1214933 - DNA, 16 bp, Homo sapiens
atgatcctaggcattt

SEQ ID NO: 1214934 - DNA, 17 bp, Homo sapiens
atgatccttttttgtca

SEQ ID NO: 1214935 - DNA, 15 bp, Homo sapiens
atgatctactcagaa

SEQ ID NO: 1214936 - DNA, 16 bp, Homo sapiens
atgatctactcagaaa

SEQ ID NO: 1214937 - DNA, 18 bp, Homo sapiens
atgatctactcagaaatt

SEQ ID NO: 1214938 - DNA, 19 bp, Homo sapiens
atgatctcggatgaccaaa

SEQ ID NO: 1214939 - DNA, 15 bp, Homo sapiens
atgatctcggctcac

SEQ ID NO: 1214940 - DNA, 14 bp, Homo sapiens
atgatctctctgaa

SEQ ID NO: 1214941 - DNA, 17 bp, Homo sapiens
atgatctgcctctaaaa

SEQ ID NO: 1214942 - DNA, 18 bp, Homo sapiens
atgatctggacttcctat

SEQ ID NO: 1214943 - DNA, 22 bp, Homo sapiens
atgatctgtatttaatggtttt

SEQ ID NO: 1214944 - DNA, 14 bp, Homo sapiens
atgatcttctttat

SEQ ID NO: 1214945 - DNA, 15 bp, Homo sapiens
atgatcttctttata

SEQ ID NO: 1214946 - DNA, 17 bp, Homo sapiens
atgatgaaatctttctt

SEQ ID NO: 1214947 - DNA, 17 bp, Homo sapiens
atgatgacaaaaaatgt

SEQ ID NO: 1214948 - DNA, 15 bp, Homo sapiens
atgatgatcctaggc

SEQ ID NO: 1214949 - DNA, 14 bp, Homo sapiens
atgatgatgaaaac

SEQ ID NO: 1214950 - DNA, 20 bp, Homo sapiens
atgatgcagctgttgagaaa

SEQ ID NO: 1214951 - DNA, 18 bp, Homo sapiens
atgatgccaacctctgga

SEQ ID NO: 1214952 - DNA, 15 bp, Homo sapiens
atgatgcctttataa

SEQ ID NO: 1214953 - DNA, 15 bp, Homo sapiens
atgatgctaagctga

SEQ ID NO: 1214954 - DNA, 21 bp, Homo sapiens
atgatgcttgtaacaagaaaa

SEQ ID NO: 1214955 - DNA, 21 bp, Homo sapiens
atgatggaaacgcacttacaa

SEQ ID NO: 1214956 - DNA, 17 bp, Homo sapiens
atgatggaagtgttcag

SEQ ID NO: 1214957 - DNA, 18 bp, Homo sapiens
atgatggaagtgttcaga

SEQ ID NO: 1214958 - DNA, 15 bp, Homo sapiens
atgatggatggcaga

SEQ ID NO: 1214959 - DNA, 17 bp, Homo sapiens
atgatggatggcagact

SEQ ID NO: 1214960 - DNA, 19 bp, Homo sapiens
atgatggcaattttgtaac

SEQ ID NO: 1214961 - DNA, 15 bp, Homo sapiens
atgatggcagagcca

SEQ ID NO: 1214962 - DNA, 15 bp, Homo sapiens
atgatgggaaaatat

SEQ ID NO: 1214963 - DNA, 17 bp, Homo sapiens
atgatgggaaaatattt

SEQ ID NO: 1214964 - DNA, 21 bp, Homo sapiens
atgatgggaatagggagacag

SEQ ID NO: 1214965 - DNA, 13 bp, Homo sapiens
atgatgggcttct

SEQ ID NO: 1214966 - DNA, 18 bp, Homo sapiens
atgatgggcttttgttct

SEQ ID NO: 1214967 - DNA, 20 bp, Homo sapiens
atgatgggcttttgttctga

SEQ ID NO: 1214968 - DNA, 17 bp, Homo sapiens
atgatggggaaggagta

SEQ ID NO: 1214969 - DNA, 18 bp, Homo sapiens
atgatggtgttaaagctg

SEQ ID NO: 1214970 - DNA, 23 bp, Homo sapiens
atgatggtgttaaagctgtacac

SEQ ID NO: 1214971 - DNA, 18 bp, Homo sapiens
atgatggttgcaaaagac

SEQ ID NO: 1214972 - DNA, 17 bp, Homo sapiens
atgatggttttaaactt

SEQ ID NO: 1214973 - DNA, 12 bp, Homo sapiens
atgatgtatatt

SEQ ID NO: 1214974 - DNA, 13 bp, Homo sapiens
atgatgtatattt

SEQ ID NO: 1214975 - DNA, 16 bp, Homo sapiens
atgatgtctacagaaa

SEQ ID NO: 1214976 - DNA, 19 bp, Homo sapiens
atgatgtctcttgtagaag

SEQ ID NO: 1214977 - DNA, 19 bp, Homo sapiens
atgatgtggacatatgtat

SEQ ID NO: 1214978 - DNA, 15 bp, Homo sapiens
atgatgtgttgtgat

SEQ ID NO: 1214979 - DNA, 17 bp, Homo sapiens
atgatgttgataatttc

SEQ ID NO: 1214980 - DNA, 15 bp, Homo sapiens
atgatgtttcacata

SEQ ID NO: 1214981 - DNA, 21 bp, Homo sapiens
atgatgtttgcccaaaattta

SEQ ID NO: 1214982 - DNA, 22 bp, Homo sapiens
atgatgttttaaaaaaatttga

SEQ ID NO: 1214983 - DNA, 14 bp, Homo sapiens
atgatgttttccct

SEQ ID NO: 1214984 - DNA, 19 bp, Homo sapiens
atgattactggcctttttc

SEQ ID NO: 1214985 - DNA, 15 bp, Homo sapiens
atgattatattcaca

SEQ ID NO: 1214986 - DNA, 14 bp, Homo sapiens
atgattattttcaa

SEQ ID NO: 1214987 - DNA, 17 bp, Homo sapiens
atgattcaaatgtttta

SEQ ID NO: 1214988 - DNA, 21 bp, Homo sapiens
atgattcaaattgctgcttgg

SEQ ID NO: 1214989 - DNA, 14 bp, Homo sapiens
atgattcaagccat

SEQ ID NO: 1214990 - DNA, 15 bp, Homo sapiens
atgattcaagccatt

SEQ ID NO: 1214991 - DNA, 16 bp, Homo sapiens
atgattcaagccattc

SEQ ID NO: 1214992 - DNA, 16 bp, Homo sapiens
atgattcagtgttaaa

SEQ ID NO: 1214993 - DNA, 11 bp, Homo sapiens
atgattccaaa

SEQ ID NO: 1214994 - DNA, 14 bp, Homo sapiens
atgattccaaataa

SEQ ID NO: 1214995 - DNA, 22 bp, Homo sapiens
atgattcctcttggcaagatgt

SEQ ID NO: 1214996 - DNA, 15 bp, Homo sapiens
atgattctctgtggt

SEQ ID NO: 1214997 - DNA, 13 bp, Homo sapiens
atgattctgaact

SEQ ID NO: 1214998 - DNA, 15 bp, Homo sapiens
atgattctgctttta

SEQ ID NO: 1214999 - DNA, 23 bp, Homo sapiens
atgattctgcttttaccatgccc

SEQ ID NO: 1215000 - DNA, 14 bp, Homo sapiens
atgattcttctctt

SEQ ID NO: 1215001 - DNA, 15 bp, Homo sapiens
atgattggattattc

SEQ ID NO: 1215002 - DNA, 16 bp, Homo sapiens
atgattggattattca

SEQ ID NO: 1215003 - DNA, 18 bp, Homo sapiens
atgattggcttaaagtga

SEQ ID NO: 1215004 - DNA, 19 bp, Homo sapiens
atgattggcttaaagtgaa

SEQ ID NO: 1215005 - DNA, 16 bp, Homo sapiens
atgattggttcagttt

SEQ ID NO: 1215006 - DNA, 18 bp, Homo sapiens
atgattgtttcttcttca

SEQ ID NO: 1215007 - DNA, 14 bp, Homo sapiens
atgatttactcatt

SEQ ID NO: 1215008 - DNA, 15 bp, Homo sapiens
atgatttactcatta

SEQ ID NO: 1215009 - DNA, 14 bp, Homo sapiens
atgatttatagttt

SEQ ID NO: 1215010 - DNA, 15 bp, Homo sapiens
atgatttatagtttg

SEQ ID NO: 1215011 - DNA, 14 bp, Homo sapiens
atgatttatatatg

SEQ ID NO: 1215012 - DNA, 13 bp, Homo sapiens
atgatttcagaag

SEQ ID NO: 1215013 - DNA, 20 bp, Homo sapiens
atgatttcatgctatctctg

SEQ ID NO: 1215014 - DNA, 21 bp, Homo sapiens
atgatttcatgctatctctgt

SEQ ID NO: 1215015 - DNA, 21 bp, Homo sapiens
atgatttcattatcacatgat

SEQ ID NO: 1215016 - DNA, 19 bp, Homo sapiens
atgatttccttcaatgtgc

SEQ ID NO: 1215017 - DNA, 15 bp, Homo sapiens
atgatttccttgaat

SEQ ID NO: 1215018 - DNA, 16 bp, Homo sapiens
atgatttccttgaatg

SEQ ID NO: 1215019 - DNA, 19 bp, Homo sapiens
atgatttccttgaatgtgg

SEQ ID NO: 1215020 - DNA, 14 bp, Homo sapiens
atgatttcttgctt

SEQ ID NO: 1215021 - DNA, 17 bp, Homo sapiens
atgatttcttgctttgg

SEQ ID NO: 1215022 - DNA, 23 bp, Homo sapiens
atgatttgtcccagcctggggct

SEQ ID NO: 1215023 - DNA, 17 bp, Homo sapiens
atgatttgttttgaatt

SEQ ID NO: 1215024 - DNA, 17 bp, Homo sapiens
atgattttaattttata

SEQ ID NO: 1215025 - DNA, 13 bp, Homo sapiens
atgattttattac

SEQ ID NO: 1215026 - DNA, 15 bp, Homo sapiens
atgattttattacag

SEQ ID NO: 1215027 - DNA, 18 bp, Homo sapiens
atgattttcatttcatga

SEQ ID NO: 1215028 - DNA, 20 bp, Homo sapiens
atgattttgtaattcttatg

SEQ ID NO: 1215029 - DNA, 11 bp, Homo sapiens
atgatttttag

SEQ ID NO: 1215030 - DNA, 14 bp, Homo sapiens
atgatttttcattg

SEQ ID NO: 1215031 - DNA, 20 bp, Homo sapiens
atgatttttggtatttatgt

SEQ ID NO: 1215032 - DNA, 22 bp, Homo sapiens
atgatttttggtatttatgtaa

SEQ ID NO: 1215033 - DNA, 17 bp, Homo sapiens
atgatttttttttccaa

SEQ ID NO: 1215034 - DNA, 16 bp, Homo sapiens
atgcaaaaaaaattag

SEQ ID NO: 1215035 - DNA, 11 bp, Homo sapiens
atgcaaaaatc

SEQ ID NO: 1215036 - DNA, 22 bp, Homo sapiens
atgcaaaatcaggaaaggctgt

SEQ ID NO: 1215037 - DNA, 23 bp, Homo sapiens
atgcaaaatcaggaaaggctgta

SEQ ID NO: 1215038 - DNA, 13 bp, Homo sapiens
atgcaaaatgaaa

SEQ ID NO: 1215039 - DNA, 12 bp, Homo sapiens
atgcaaaattgt

SEQ ID NO: 1215040 - DNA, 24 bp, Homo sapiens
atgcaaaattgttttcacttgtat

SEQ ID NO: 1215041 - DNA, 17 bp, Homo sapiens
atgcagttttaagaatt

SEQ ID NO: 1215042 - DNA, 16 bp, Homo sapiens
atgcataaaaaaatga

SEQ ID NO: 1215043 - DNA, 17 bp, Homo sapiens
atgcatacaataaaaga

SEQ ID NO: 1215044 - DNA, 17 bp, Homo sapiens
atgcatacagttttcta

SEQ ID NO: 1215045 - DNA, 20 bp, Homo sapiens
atgcatactgttgatacaaa

SEQ ID NO: 1215046 - DNA, 22 bp, Homo sapiens
atgcatactgttgatacaaacc

SEQ ID NO: 1215047 - DNA, 15 bp, Homo sapiens
atgcatataatgaat

SEQ ID NO: 1215048 - DNA, 18 bp, Homo sapiens
atgcatatcctgagccat

SEQ ID NO: 1215049 - DNA, 16 bp, Homo sapiens
atgcatcagataacaa

SEQ ID NO: 1215050 - DNA, 19 bp, Homo sapiens
atgcatcagataacaactg

SEQ ID NO: 1215051 - DNA, 22 bp, Homo sapiens
atgcatcagataacaactgtga

SEQ ID NO: 1215052 - DNA, 18 bp, Homo sapiens
atgcatccattcctcagg

SEQ ID NO: 1215053 - DNA, 22 bp, Homo sapiens
atgcatccattcctcagggaca

SEQ ID NO: 1215054 - DNA, 22 bp, Homo sapiens
atgcatcgggaaagaagaaact

SEQ ID NO: 1215055 - DNA, 22 bp, Homo sapiens
atgcatctcactggatgcaaag

SEQ ID NO: 1215056 - DNA, 21 bp, Homo sapiens
atgcatgaacaagttttaatg

SEQ ID NO: 1215057 - DNA, 17 bp, Homo sapiens
atgcatgcactgttccc

SEQ ID NO: 1215058 - DNA, 11 bp, Homo sapiens
atgcatgccag

SEQ ID NO: 1215059 - DNA, 17 bp, Homo sapiens
atgcatgcgcaggctca

SEQ ID NO: 1215060 - DNA, 20 bp, Homo sapiens
atgcatggaaacctgaaaaa

SEQ ID NO: 1215061 - DNA, 20 bp, Homo sapiens
atgccccttctccccttcct

SEQ ID NO: 1215062 - DNA, 19 bp, Homo sapiens
atgccccttcttgggcccc

SEQ ID NO: 1215063 - DNA, 23 bp, Homo sapiens
atgccccttcttgggccccagac

SEQ ID NO: 1215064 - DNA, 14 bp, Homo sapiens
atgcccgcctagtt

SEQ ID NO: 1215065 - DNA, 19 bp, Homo sapiens
atgccctagaccctcccca

SEQ ID NO: 1215066 - DNA, 14 bp, Homo sapiens
atgccctcccagga

SEQ ID NO: 1215067 - DNA, 16 bp, Homo sapiens
atgccctcccctcagc

SEQ ID NO: 1215068 - DNA, 13 bp, Homo sapiens
atgccctcccttc

SEQ ID NO: 1215069 - DNA, 19 bp, Homo sapiens
atgccctcccttctccctg

SEQ ID NO: 1215070 - DNA, 17 bp, Homo sapiens
atgccctcctaaatgtc

SEQ ID NO: 1215071 - DNA, 16 bp, Homo sapiens
atgccctcttctcctt

SEQ ID NO: 1215072 - DNA, 14 bp, Homo sapiens
atgccctgcagagc

SEQ ID NO: 1215073 - DNA, 17 bp, Homo sapiens
atgccctgcagagcaat

SEQ ID NO: 1215074 - DNA, 20 bp, Homo sapiens
atgccctgcagagcaataac

SEQ ID NO: 1215075 - DNA, 11 bp, Homo sapiens
atgccctgccc

SEQ ID NO: 1215076 - DNA, 17 bp, Homo sapiens
atgccctgcccttcctc

SEQ ID NO: 1215077 - DNA, 19 bp, Homo sapiens
atgccctgcccttcctcag

SEQ ID NO: 1215078 - DNA, 15 bp, Homo sapiens
atgccctgctggcct

SEQ ID NO: 1215079 - DNA, 13 bp, Homo sapiens
atgccctgtgcaa

SEQ ID NO: 1215080 - DNA, 19 bp, Homo sapiens
atgccgaacattaggaatt

SEQ ID NO: 1215081 - DNA, 15 bp, Homo sapiens
atgccgatttctgta

SEQ ID NO: 1215082 - DNA, 16 bp, Homo sapiens
atgccgatttctgtaa

SEQ ID NO: 1215083 - DNA, 15 bp, Homo sapiens
atgccgcagggaggg

SEQ ID NO: 1215084 - DNA, 18 bp, Homo sapiens
atgccgcagggagggctg

SEQ ID NO: 1215085 - DNA, 16 bp, Homo sapiens
atgccggatgtgcttt

SEQ ID NO: 1215086 - DNA, 15 bp, Homo sapiens
atgccgggcgccagg

SEQ ID NO: 1215087 - DNA, 16 bp, Homo sapiens
atgccgggcgccagga

SEQ ID NO: 1215088 - DNA, 17 bp, Homo sapiens
atgccgggcgccaggac

SEQ ID NO: 1215089 - DNA, 21 bp, Homo sapiens
atgccgggcgccaggacagca

SEQ ID NO: 1215090 - DNA, 15 bp, Homo sapiens
atgccgtcctgctgg

SEQ ID NO: 1215091 - DNA, 23 bp, Homo sapiens
atgcctaaaaattcccttcctgt

SEQ ID NO: 1215092 - DNA, 18 bp, Homo sapiens
atgcctacagccctcact

SEQ ID NO: 1215093 - DNA, 19 bp, Homo sapiens
atgcctagcacaagtacca

SEQ ID NO: 1215094 - DNA, 18 bp, Homo sapiens
atgcctagcagagaactg

SEQ ID NO: 1215095 - DNA, 16 bp, Homo sapiens
atgcctagtccaacat

SEQ ID NO: 1215096 - DNA, 12 bp, Homo sapiens
atgcctattgta

SEQ ID NO: 1215097 - DNA, 16 bp, Homo sapiens
atgcctcaattcacat

SEQ ID NO: 1215098 - DNA, 23 bp, Homo sapiens
atgcctcaccacacccaggtctc

SEQ ID NO: 1215099 - DNA, 15 bp, Homo sapiens
atgcctcactaattt

SEQ ID NO: 1215100 - DNA, 13 bp, Homo sapiens
atgcctcagccct

SEQ ID NO: 1215101 - DNA, 20 bp, Homo sapiens
atgcctcagccctgaccctg

SEQ ID NO: 1215102 - DNA, 19 bp, Homo sapiens
atgcctcagtgtatttgta

SEQ ID NO: 1215103 - DNA, 12 bp, Homo sapiens
atgcctccaccg

SEQ ID NO: 1215104 - DNA, 12 bp, Homo sapiens
atgcctccctgg

SEQ ID NO: 1215105 - DNA, 19 bp, Homo sapiens
atgcctccctgggccacct

SEQ ID NO: 1215106 - DNA, 20 bp, Homo sapiens
atgcctccctgggccacctc

SEQ ID NO: 1215107 - DNA, 13 bp, Homo sapiens
atgcctcctcagg

SEQ ID NO: 1215108 - DNA, 18 bp, Homo sapiens
atgcctcctcaggagccg

SEQ ID NO: 1215109 - DNA, 21 bp, Homo sapiens
atgcctctgacagtccacagg

SEQ ID NO: 1215110 - DNA, 20 bp, Homo sapiens
atgcctctggaggcctctgg

SEQ ID NO: 1215111 - DNA, 20 bp, Homo sapiens
atgcctgactaatttttgta

SEQ ID NO: 1215112 - DNA, 17 bp, Homo sapiens
atgcctgagggtggaga

SEQ ID NO: 1215113 - DNA, 13 bp, Homo sapiens
atgcctgcactgg

SEQ ID NO: 1215114 - DNA, 15 bp, Homo sapiens
atgcctgcactggga

SEQ ID NO: 1215115 - DNA, 23 bp, Homo sapiens
atgcctgcactgggaaggaaaca

SEQ ID NO: 1215116 - DNA, 17 bp, Homo sapiens
atgcctgcgcctgctgc

SEQ ID NO: 1215117 - DNA, 19 bp, Homo sapiens
atgcctgcgcctgctgcct

SEQ ID NO: 1215118 - DNA, 15 bp, Homo sapiens
atgcctggagggtaa

SEQ ID NO: 1215119 - DNA, 15 bp, Homo sapiens
atgcctggtcccaag

SEQ ID NO: 1215120 - DNA, 21 bp, Homo sapiens
atgcctgtcagtttcatggag

SEQ ID NO: 1215121 - DNA, 17 bp, Homo sapiens
atgcctgtccagcctgg

SEQ ID NO: 1215122 - DNA, 22 bp, Homo sapiens
atgcctgtctctagctgttctg

SEQ ID NO: 1215123 - DNA, 13 bp, Homo sapiens
atgcctgtctctg

SEQ ID NO: 1215124 - DNA, 21 bp, Homo sapiens
atgcctgtctctgttcagatg

SEQ ID NO: 1215125 - DNA, 23 bp, Homo sapiens
atgcctgtctctgttcagatgtg

SEQ ID NO: 1215126 - DNA, 19 bp, Homo sapiens
atgcctgtcttaattttct

SEQ ID NO: 1215127 - DNA, 13 bp, Homo sapiens
atgcctgtgaagc

SEQ ID NO: 1215128 - DNA, 12 bp, Homo sapiens
atgcctgtgcca

SEQ ID NO: 1215129 - DNA, 13 bp, Homo sapiens
atgcctgtgccaa

SEQ ID NO: 1215130 - DNA, 19 bp, Homo sapiens
atgcctgtggtgaagtgtg

SEQ ID NO: 1215131 - DNA, 21 bp, Homo sapiens
atgcctgtggtgaagtgtggc

SEQ ID NO: 1215132 - DNA, 22 bp, Homo sapiens
atgcctgtggtgaagtgtggct

SEQ ID NO: 1215133 - DNA, 22 bp, Homo sapiens
atgcctgttaatttataatgta

SEQ ID NO: 1215134 - DNA, 16 bp, Homo sapiens
atgccttaagcagaac

SEQ ID NO: 1215135 - DNA, 16 bp, Homo sapiens
atgccttactcttctt

SEQ ID NO: 1215136 - DNA, 15 bp, Homo sapiens
atgccttagcatgtg

SEQ ID NO: 1215137 - DNA, 17 bp, Homo sapiens
atgccttctagattcac

SEQ ID NO: 1215138 - DNA, 20 bp, Homo sapiens
atgccttcttattgctttta

SEQ ID NO: 1215139 - DNA, 19 bp, Homo sapiens
atgccttgacaacagactg

SEQ ID NO: 1215140 - DNA, 19 bp, Homo sapiens
atgccttgaggtgaaatgg

SEQ ID NO: 1215141 - DNA, 18 bp, Homo sapiens
atgccttgataaatatat

SEQ ID NO: 1215142 - DNA, 21 bp, Homo sapiens
atgccttgataaatatatatg

SEQ ID NO: 1215143 - DNA, 22 bp, Homo sapiens
atgccttgataaatatatatga

SEQ ID NO: 1215144 - DNA, 21 bp, Homo sapiens
atgccttggtgccggtcacac

SEQ ID NO: 1215145 - DNA, 21 bp, Homo sapiens
atgccttgtataatattgaaa

SEQ ID NO: 1215146 - DNA, 17 bp, Homo sapiens
atgcctttaaagtatga

SEQ ID NO: 1215147 - DNA, 20 bp, Homo sapiens
atgcctttaaatctgtgatg

SEQ ID NO: 1215148 - DNA, 13 bp, Homo sapiens
atgccttttctgt

SEQ ID NO: 1215149 - DNA, 13 bp, Homo sapiens
atgcgagactctg

SEQ ID NO: 1215150 - DNA, 15 bp, Homo sapiens
atgcgagactctgat

SEQ ID NO: 1215151 - DNA, 15 bp, Homo sapiens
atgcgagcttggcct

SEQ ID NO: 1215152 - DNA, 14 bp, Homo sapiens
atgcgaggggccag

SEQ ID NO: 1215153 - DNA, 19 bp, Homo sapiens
atgcgaggggccagcagag

SEQ ID NO: 1215154 - DNA, 20 bp, Homo sapiens
atgcgaggggccagcagagg

SEQ ID NO: 1215155 - DNA, 16 bp, Homo sapiens
atgcgcaatgtggcat

SEQ ID NO: 1215156 - DNA, 20 bp, Homo sapiens
atgcgcacagagggaagcca

SEQ ID NO: 1215157 - DNA, 20 bp, Homo sapiens
atgcgcagatgaggggccac

SEQ ID NO: 1215158 - DNA, 22 bp, Homo sapiens
atgcgcagatgaggggccactg

SEQ ID NO: 1215159 - DNA, 14 bp, Homo sapiens
atgcgcagtgcctt

SEQ ID NO: 1215160 - DNA, 16 bp, Homo sapiens
atgcgccaccatgccc

SEQ ID NO: 1215161 - DNA, 20 bp, Homo sapiens
atgcgccttgctgatggctt

SEQ ID NO: 1215162 - DNA, 15 bp, Homo sapiens
atgcgctcagggcca

SEQ ID NO: 1215163 - DNA, 23 bp, Homo sapiens
atgcgctcagggccatgctgagg

SEQ ID NO: 1215164 - DNA, 14 bp, Homo sapiens
atgcgctgtggcca

SEQ ID NO: 1215165 - DNA, 19 bp, Homo sapiens
atgcggccgcattccctga

SEQ ID NO: 1215166 - DNA, 16 bp, Homo sapiens
atgcggctttctctgc

SEQ ID NO: 1215167 - DNA, 15 bp, Homo sapiens
atgcgggctcgccca

SEQ ID NO: 1215168 - DNA, 18 bp, Homo sapiens
atgcggggacaggctgga

SEQ ID NO: 1215169 - DNA, 14 bp, Homo sapiens
atgcggtagccagc

SEQ ID NO: 1215170 - DNA, 18 bp, Homo sapiens
atgcggtgggtgctgcca

SEQ ID NO: 1215171 - DNA, 20 bp, Homo sapiens
atgcggtttccaaggtgcac

SEQ ID NO: 1215172 - DNA, 21 bp, Homo sapiens
atgcggtttccaaggtgcaca

SEQ ID NO: 1215173 - DNA, 17 bp, Homo sapiens
atgcgtaatttaatggg

SEQ ID NO: 1215174 - DNA, 18 bp, Homo sapiens
atgcgtattctgtggccg

SEQ ID NO: 1215175 - DNA, 22 bp, Homo sapiens
atgcgtgagatgggtgtacaaa

SEQ ID NO: 1215176 - DNA, 20 bp, Homo sapiens
atgcgtgcataccacttttg

SEQ ID NO: 1215177 - DNA, 20 bp, Homo sapiens
atgtacaaaaaaaaaaccct

SEQ ID NO: 1215178 - DNA, 21 bp, Homo sapiens
atgtacaaaatcgattggctt

SEQ ID NO: 1215179 - DNA, 21 bp, Homo sapiens
atgtacaaactagtttttata

SEQ ID NO: 1215180 - DNA, 12 bp, Homo sapiens
atgtacaaccct

SEQ ID NO: 1215181 - DNA, 13 bp, Homo sapiens
atgtacaaccctg

SEQ ID NO: 1215182 - DNA, 14 bp, Homo sapiens
atgtacaaccctga

SEQ ID NO: 1215183 - DNA, 15 bp, Homo sapiens
atgtacaagttttgt

SEQ ID NO: 1215184 - DNA, 21 bp, Homo sapiens
atgtacaagttttgtataaat

SEQ ID NO: 1215185 - DNA, 20 bp, Homo sapiens
atgtacaatacaatgtacaa

SEQ ID NO: 1215186 - DNA, 15 bp, Homo sapiens
atgtacaattatgtc

SEQ ID NO: 1215187 - DNA, 15 bp, Homo sapiens
atgtacacaggtcaa

SEQ ID NO: 1215188 - DNA, 18 bp, Homo sapiens
atgtacactggatatgtt

SEQ ID NO: 1215189 - DNA, 18 bp, Homo sapiens
atgtacagacatatttaa

SEQ ID NO: 1215190 - DNA, 15 bp, Homo sapiens
atgtacagtattttg

SEQ ID NO: 1215191 - DNA, 19 bp, Homo sapiens
atgtacagtttattgatat

SEQ ID NO: 1215192 - DNA, 21 bp, Homo sapiens
atgtacatagttatttttctc

SEQ ID NO: 1215193 - DNA, 13 bp, Homo sapiens
atgtacatgtgta

SEQ ID NO: 1215194 - DNA, 14 bp, Homo sapiens
atgtacatgtgtag

SEQ ID NO: 1215195 - DNA, 14 bp, Homo sapiens
atgtacatttaata

SEQ ID NO: 1215196 - DNA, 16 bp, Homo sapiens
atgtacatttaataat

SEQ ID NO: 1215197 - DNA, 17 bp, Homo sapiens
atgtacatttaataata

SEQ ID NO: 1215198 - DNA, 20 bp, Homo sapiens
atgtacatttccaaatgaac

SEQ ID NO: 1215199 - DNA, 18 bp, Homo sapiens
atgtaccatgaaacaaag

SEQ ID NO: 1215200 - DNA, 15 bp, Homo sapiens
atgtaccatttgcat

SEQ ID NO: 1215201 - DNA, 18 bp, Homo sapiens
atgtaccatttgcatggc

SEQ ID NO: 1215202 - DNA, 22 bp, Homo sapiens
atgtaccatttgcatggctcca

SEQ ID NO: 1215203 - DNA, 23 bp, Homo sapiens
atgtaccctccccttttatgcac

SEQ ID NO: 1215204 - DNA, 21 bp, Homo sapiens
atgtacctatagaaatagaac

SEQ ID NO: 1215205 - DNA, 14 bp, Homo sapiens
atgtacctcccctg

SEQ ID NO: 1215206 - DNA, 16 bp, Homo sapiens
atgtacctcccctgcc

SEQ ID NO: 1215207 - DNA, 17 bp, Homo sapiens
atgtacgacttgcatac

SEQ ID NO: 1215208 - DNA, 14 bp, Homo sapiens
atgtacgtttgtat

SEQ ID NO: 1215209 - DNA, 21 bp, Homo sapiens
atgtacgtttgtatgtgtgta

SEQ ID NO: 1215210 - DNA, 15 bp, Homo sapiens
atgtactagtgttct

SEQ ID NO: 1215211 - DNA, 20 bp, Homo sapiens
atgtactagtgttctgtttg

SEQ ID NO: 1215212 - DNA, 14 bp, Homo sapiens
atgtactgagattt

SEQ ID NO: 1215213 - DNA, 18 bp, Homo sapiens
atgtactgcaaagtcgcc

SEQ ID NO: 1215214 - DNA, 17 bp, Homo sapiens
atgtactgtacataaat

SEQ ID NO: 1215215 - DNA, 19 bp, Homo sapiens
atgtactgtatattacaga

SEQ ID NO: 1215216 - DNA, 18 bp, Homo sapiens
atgtacttaagagtggca

SEQ ID NO: 1215217 - DNA, 15 bp, Homo sapiens
atgtacttagctgta

SEQ ID NO: 1215218 - DNA, 16 bp, Homo sapiens
atgtacttgtcaaaga

SEQ ID NO: 1215219 - DNA, 18 bp, Homo sapiens
atgtacttgtcaaagaag

SEQ ID NO: 1215220 - DNA, 23 bp, Homo sapiens
atgtacttgtttgaatatttgtt

SEQ ID NO: 1215221 - DNA, 22 bp, Homo sapiens
atgtactttggcatcttttgga

SEQ ID NO: 1215222 - DNA, 14 bp, Homo sapiens
atgtactttttagt

SEQ ID NO: 1215223 - DNA, 18 bp, Homo sapiens
atgtagaaaagagacttc

SEQ ID NO: 1215224 - DNA, 15 bp, Homo sapiens
atgtagaactcagca

SEQ ID NO: 1215225 - DNA, 18 bp, Homo sapiens
atgtagaactcagcagtt

SEQ ID NO: 1215226 - DNA, 20 bp, Homo sapiens
atgtagaatattcagacaaa

SEQ ID NO: 1215227 - DNA, 15 bp, Homo sapiens
atgtagagaaaagca

SEQ ID NO: 1215228 - DNA, 16 bp, Homo sapiens
atgtagagagaacagg

SEQ ID NO: 1215229 - DNA, 19 bp, Homo sapiens
atgtagataacaagacctc

SEQ ID NO: 1215230 - DNA, 23 bp, Homo sapiens
atgtagatattgtgaagtacata

SEQ ID NO: 1215231 - DNA, 20 bp, Homo sapiens
atgtagcaaaacgcatggag

SEQ ID NO: 1215232 - DNA, 13 bp, Homo sapiens
atgtagcacttac

SEQ ID NO: 1215233 - DNA, 22 bp, Homo sapiens
atgtagcacttacgtaaaacat

SEQ ID NO: 1215234 - DNA, 18 bp, Homo sapiens
atgtagcttccacctcat

SEQ ID NO: 1215235 - DNA, 19 bp, Homo sapiens
atgtaggggaagagatgtt

SEQ ID NO: 1215236 - DNA, 20 bp, Homo sapiens
atgtaggggaagagatgttt

SEQ ID NO: 1215237 - DNA, 23 bp, Homo sapiens
atgtaggggaagagatgtttaca

SEQ ID NO: 1215238 - DNA, 18 bp, Homo sapiens
atgtaggtgagcctgggc

SEQ ID NO: 1215239 - DNA, 15 bp, Homo sapiens
atgtaggtgtctgca

SEQ ID NO: 1215240 - DNA, 21 bp, Homo sapiens
atgtaggtgtctgcacccagg

SEQ ID NO: 1215241 - DNA, 12 bp, Homo sapiens
atgtagtaacac

SEQ ID NO: 1215242 - DNA, 13 bp, Homo sapiens
atgtagtaacact

SEQ ID NO: 1215243 - DNA, 14 bp, Homo sapiens
atgtagtaacacta

SEQ ID NO: 1215244 - DNA, 16 bp, Homo sapiens
atgtagtataaagaaa

SEQ ID NO: 1215245 - DNA, 14 bp, Homo sapiens
atgtagtatctata

SEQ ID NO: 1215246 - DNA, 19 bp, Homo sapiens
atgtagtatctatatgact

SEQ ID NO: 1215247 - DNA, 18 bp, Homo sapiens
atgtagtattcaatgatt

SEQ ID NO: 1215248 - DNA, 23 bp, Homo sapiens
atgtagtattttttgtataattg

SEQ ID NO: 1215249 - DNA, 19 bp, Homo sapiens
atgtagtcagactgacact

SEQ ID NO: 1215250 - DNA, 21 bp, Homo sapiens
atgtagtttttatatgttgta

SEQ ID NO: 1215251 - DNA, 22 bp, Homo sapiens
atgtataaaaattatcaaaaag

SEQ ID NO: 1215252 - DNA, 18 bp, Homo sapiens
atgtataaagattgtact

SEQ ID NO: 1215253 - DNA, 20 bp, Homo sapiens
atgtataaagattgtactta

SEQ ID NO: 1215254 - DNA, 21 bp, Homo sapiens
atgtataaagcaactgttatg

SEQ ID NO: 1215255 - DNA, 22 bp, Homo sapiens
atgtataaagcaactgttatga

SEQ ID NO: 1215256 - DNA, 23 bp, Homo sapiens
atgtataaatgtaaaaatgaagg

SEQ ID NO: 1215257 - DNA, 22 bp, Homo sapiens
atgtataaccaagtgtgctctt

SEQ ID NO: 1215258 - DNA, 18 bp, Homo sapiens
atgtataagtaaatatat

SEQ ID NO: 1215259 - DNA, 19 bp, Homo sapiens
atgtataattaacttaact

SEQ ID NO: 1215260 - DNA, 21 bp, Homo sapiens
atgtataattaacttaactga

SEQ ID NO: 1215261 - DNA, 22 bp, Homo sapiens
atgtataattaacttaactgaa

SEQ ID NO: 1215262 - DNA, 17 bp, Homo sapiens
atgtatacacacatata

SEQ ID NO: 1215263 - DNA, 18 bp, Homo sapiens
atgtatacacacatatac

SEQ ID NO: 1215264 - DNA, 20 bp, Homo sapiens
atgtatacacacatatacat

SEQ ID NO: 1215265 - DNA, 18 bp, Homo sapiens
atgtatacttatcttgct

SEQ ID NO: 1215266 - DNA, 15 bp, Homo sapiens
atgtatagtaaatca

SEQ ID NO: 1215267 - DNA, 14 bp, Homo sapiens
atgtatagtgtcta

SEQ ID NO: 1215268 - DNA, 13 bp, Homo sapiens
atgtatataaaaa

SEQ ID NO: 1215269 - DNA, 17 bp, Homo sapiens
atgtatatatatatagt

SEQ ID NO: 1215270 - DNA, 20 bp, Homo sapiens
atgtatatatctattattca

SEQ ID NO: 1215271 - DNA, 16 bp, Homo sapiens
atgtatatgtatatat

SEQ ID NO: 1215272 - DNA, 17 bp, Homo sapiens
atgtatattaaaaaaga

SEQ ID NO: 1215273 - DNA, 21 bp, Homo sapiens
atgtatattaaaaaagagaca

SEQ ID NO: 1215274 - DNA, 19 bp, Homo sapiens
atgtatatttaattaaagc

SEQ ID NO: 1215275 - DNA, 13 bp, Homo sapiens
atgtatatttgca

SEQ ID NO: 1215276 - DNA, 18 bp, Homo sapiens
atgtatatttgcatattt

SEQ ID NO: 1215277 - DNA, 17 bp, Homo sapiens
atgtatattttaataga

SEQ ID NO: 1215278 - DNA, 18 bp, Homo sapiens
atgtatatttttttaatt

SEQ ID NO: 1215279 - DNA, 11 bp, Homo sapiens
atgtatcacta

SEQ ID NO: 1215280 - DNA, 20 bp, Homo sapiens
atgtatcatttttgtgcaca

SEQ ID NO: 1215281 - DNA, 13 bp, Homo sapiens
atgtatcgctcct

SEQ ID NO: 1215282 - DNA, 17 bp, Homo sapiens
atgtatcgctcctattg

SEQ ID NO: 1215283 - DNA, 17 bp, Homo sapiens
atgtatctacaatacat

SEQ ID NO: 1215284 - DNA, 17 bp, Homo sapiens
atgtatctatttgtaca

SEQ ID NO: 1215285 - DNA, 15 bp, Homo sapiens
atgtatctgagcagg

SEQ ID NO: 1215286 - DNA, 14 bp, Homo sapiens
atgtatctgagttg

SEQ ID NO: 1215287 - DNA, 14 bp, Homo sapiens
atgtatgaaggctt

SEQ ID NO: 1215288 - DNA, 14 bp, Homo sapiens
atgtatgattacat

SEQ ID NO: 1215289 - DNA, 20 bp, Homo sapiens
atgtatggaatacagtgtta

SEQ ID NO: 1215290 - DNA, 12 bp, Homo sapiens
atgtatgtaaaa

SEQ ID NO: 1215291 - DNA, 13 bp, Homo sapiens
atgtatgtaaaaa

SEQ ID NO: 1215292 - DNA, 22 bp, Homo sapiens
atgtatgtacaatacaatgtac

SEQ ID NO: 1215293 - DNA, 17 bp, Homo sapiens
atgtatgtgcactgtca

SEQ ID NO: 1215294 - DNA, 20 bp, Homo sapiens
atgtatgtgcactgtcactt

SEQ ID NO: 1215295 - DNA, 15 bp, Homo sapiens
atgtatgtgtaagta

SEQ ID NO: 1215296 - DNA, 16 bp, Homo sapiens
atgtatgtgtaagtat

SEQ ID NO: 1215297 - DNA, 14 bp, Homo sapiens
atgtatgtgtggct

SEQ ID NO: 1215298 - DNA, 13 bp, Homo sapiens
atgtatgttacca

SEQ ID NO: 1215299 - DNA, 20 bp, Homo sapiens
atgtatgttcagaagaaatt

SEQ ID NO: 1215300 - DNA, 14 bp, Homo sapiens
atgtatgtttacat

SEQ ID NO: 1215301 - DNA, 16 bp, Homo sapiens
atgtatgtttacatat

SEQ ID NO: 1215302 - DNA, 18 bp, Homo sapiens
atgtatgtttacatatca

SEQ ID NO: 1215303 - DNA, 15 bp, Homo sapiens
atgtattaatctgtt

SEQ ID NO: 1215304 - DNA, 13 bp, Homo sapiens
atgtattacatga

SEQ ID NO: 1215305 - DNA, 19 bp, Homo sapiens
atgtattacatgactgttt

SEQ ID NO: 1215306 - DNA, 17 bp, Homo sapiens
atgtattatcacatcaa

SEQ ID NO: 1215307 - DNA, 13 bp, Homo sapiens
atgtattatgaaa

SEQ ID NO: 1215308 - DNA, 12 bp, Homo sapiens
atgtattatgct

SEQ ID NO: 1215309 - DNA, 19 bp, Homo sapiens
atgtattattattaaagaa

SEQ ID NO: 1215310 - DNA, 23 bp, Homo sapiens
atgtattattattaaagaaaaat

SEQ ID NO: 1215311 - DNA, 20 bp, Homo sapiens
atgtattattctgcagcatg

SEQ ID NO: 1215312 - DNA, 20 bp, Homo sapiens
atgtattcaagcaaacatca

SEQ ID NO: 1215313 - DNA, 17 bp, Homo sapiens
atgtattcccttgtatt

SEQ ID NO: 1215314 - DNA, 18 bp, Homo sapiens
atgtattcccttgtattt

SEQ ID NO: 1215315 - DNA, 18 bp, Homo sapiens
atgtattctttctgcctt

SEQ ID NO: 1215316 - DNA, 14 bp, Homo sapiens
atgtattgagatat

SEQ ID NO: 1215317 - DNA, 22 bp, Homo sapiens
atgtattgattacaaataaaca

SEQ ID NO: 1215318 - DNA, 15 bp, Homo sapiens
atgtattggcctgga

SEQ ID NO: 1215319 - DNA, 19 bp, Homo sapiens
atgtattgtaaacatgtgt

SEQ ID NO: 1215320 - DNA, 20 bp, Homo sapiens
atgtattgtaaacatgtgtt

SEQ ID NO: 1215321 - DNA, 21 bp, Homo sapiens
atgtattgtaaacatgtgttt

SEQ ID NO: 1215322 - DNA, 12 bp, Homo sapiens
atgtatttaatt

SEQ ID NO: 1215323 - DNA, 13 bp, Homo sapiens
atgtatttataat

SEQ ID NO: 1215324 - DNA, 21 bp, Homo sapiens
atgtatttcagggacctcagg

SEQ ID NO: 1215325 - DNA, 18 bp, Homo sapiens
atgtatttgaaaattaca

SEQ ID NO: 1215326 - DNA, 22 bp, Homo sapiens
atgtatttgaaaattacatgtt

SEQ ID NO: 1215327 - DNA, 12 bp, Homo sapiens
atgtatttgatt

SEQ ID NO: 1215328 - DNA, 13 bp, Homo sapiens
atgtatttgtagt

SEQ ID NO: 1215329 - DNA, 13 bp, Homo sapiens
atgtattttccta

SEQ ID NO: 1215330 - DNA, 19 bp, Homo sapiens
atgtattttcctaatgtga

SEQ ID NO: 1215331 - DNA, 12 bp, Homo sapiens
atgtattttgaa

SEQ ID NO: 1215332 - DNA, 14 bp, Homo sapiens
atgtattttgaaaa

SEQ ID NO: 1215333 - DNA, 15 bp, Homo sapiens
atgtatttttcttgc

SEQ ID NO: 1215334 - DNA, 19 bp, Homo sapiens
atgtatttttgatgtatat

SEQ ID NO: 1215335 - DNA, 14 bp, Homo sapiens
atgtcaaacaaata

SEQ ID NO: 1215336 - DNA, 23 bp, Homo sapiens
atgtcaaatatttagatgtaatt

SEQ ID NO: 1215337 - DNA, 12 bp, Homo sapiens
atgtcaaatgga

SEQ ID NO: 1215338 - DNA, 18 bp, Homo sapiens
atgtcaacttctggctcc

SEQ ID NO: 1215339 - DNA, 20 bp, Homo sapiens
atgtcaacttttgactaaga

SEQ ID NO: 1215340 - DNA, 22 bp, Homo sapiens
atgtcaacttttgactaagaat

SEQ ID NO: 1215341 - DNA, 14 bp, Homo sapiens
atgtcaagcaatgg

SEQ ID NO: 1215342 - DNA, 16 bp, Homo sapiens
atgtcaagtaccaaaa

SEQ ID NO: 1215343 - DNA, 22 bp, Homo sapiens
atgtcaatgccaggatttctca

SEQ ID NO: 1215344 - DNA, 19 bp, Homo sapiens
atgtcaatttctgtgttgc

SEQ ID NO: 1215345 - DNA, 14 bp, Homo sapiens
atgtcacaaattga

SEQ ID NO: 1215346 - DNA, 18 bp, Homo sapiens
atgtcacatttgaattct

SEQ ID NO: 1215347 - DNA, 19 bp, Homo sapiens
atgtcaccaccttcccagc

SEQ ID NO: 1215348 - DNA, 22 bp, Homo sapiens
atgtcaccgtggaccttcctgc

SEQ ID NO: 1215349 - DNA, 12 bp, Homo sapiens
atgtcacctcag

SEQ ID NO: 1215350 - DNA, 13 bp, Homo sapiens
atgtcacctcagc

SEQ ID NO: 1215351 - DNA, 15 bp, Homo sapiens
atgtcacctcagctg

SEQ ID NO: 1215352 - DNA, 21 bp, Homo sapiens
atgtcacctcagctgatatta

SEQ ID NO: 1215353 - DNA, 19 bp, Homo sapiens
atgtcacgaacttgaaagt

SEQ ID NO: 1215354 - DNA, 14 bp, Homo sapiens
atgtcactgtggtc

SEQ ID NO: 1215355 - DNA, 22 bp, Homo sapiens
atgtcactgtttttattccttc

SEQ ID NO: 1215356 - DNA, 23 bp, Homo sapiens
atgtcactgtttttattccttcc

SEQ ID NO: 1215357 - DNA, 16 bp, Homo sapiens
atgtcagaaacaatga

SEQ ID NO: 1215358 - DNA, 14 bp, Homo sapiens
atgtcagactttgc

SEQ ID NO: 1215359 - DNA, 15 bp, Homo sapiens
atgtcagactttgct

SEQ ID NO: 1215360 - DNA, 21 bp, Homo sapiens
atgtcagactttgctgcattt

SEQ ID NO: 1215361 - DNA, 12 bp, Homo sapiens
atgtcagagcta

SEQ ID NO: 1215362 - DNA, 21 bp, Homo sapiens
atgtcagaggaccccagggtg

SEQ ID NO: 1215363 - DNA, 21 bp, Homo sapiens
atgtcagataagtgtaaatag

SEQ ID NO: 1215364 - DNA, 22 bp, Homo sapiens
atgtcagataagtgtaaataga

SEQ ID NO: 1215365 - DNA, 19 bp, Homo sapiens
atgtcagatttctggttga

SEQ ID NO: 1215366 - DNA, 22 bp, Homo sapiens
atgtcagcaaaaagcaaaatca

SEQ ID NO: 1215367 - DNA, 23 bp, Homo sapiens
atgtcagcaaaaagcaaaatcat

SEQ ID NO: 1215368 - DNA, 23 bp, Homo sapiens
atgtcagccgagccgggcctggg

SEQ ID NO: 1215369 - DNA, 11 bp, Homo sapiens
atgtcagcctt

SEQ ID NO: 1215370 - DNA, 14 bp, Homo sapiens
atgtcagccttgca

SEQ ID NO: 1215371 - DNA, 17 bp, Homo sapiens
atgtcaggaacagaagg

SEQ ID NO: 1215372 - DNA, 12 bp, Homo sapiens
atgtcaggccag

SEQ ID NO: 1215373 - DNA, 16 bp, Homo sapiens
atgtcaggcctgtgtg

SEQ ID NO: 1215374 - DNA, 21 bp, Homo sapiens
atgtcagtctgcttagaaata

SEQ ID NO: 1215375 - DNA, 17 bp, Homo sapiens
atgtcagtgtttgggaa

SEQ ID NO: 1215376 - DNA, 14 bp, Homo sapiens
atgtcataaagtga

SEQ ID NO: 1215377 - DNA, 22 bp, Homo sapiens
atgtcatatcatttcactgtct

SEQ ID NO: 1215378 - DNA, 21 bp, Homo sapiens
atgtcatggccttgaaacagt

SEQ ID NO: 1215379 - DNA, 16 bp, Homo sapiens
atgtcattaaacatga

SEQ ID NO: 1215380 - DNA, 15 bp, Homo sapiens
atgtcattatttatt

SEQ ID NO: 1215381 - DNA, 15 bp, Homo sapiens
atgtcattgctaaaa

SEQ ID NO: 1215382 - DNA, 21 bp, Homo sapiens
atgtcattgctaaaaaataaa

SEQ ID NO: 1215383 - DNA, 17 bp, Homo sapiens
atgtcatttcagaagtt

SEQ ID NO: 1215384 - DNA, 14 bp, Homo sapiens
atgtcatttgagca

SEQ ID NO: 1215385 - DNA, 22 bp, Homo sapiens
atgtcatttttaatgtatctat

SEQ ID NO: 1215386 - DNA, 21 bp, Homo sapiens
atgtccaaagaggctgcccct

SEQ ID NO: 1215387 - DNA, 23 bp, Homo sapiens
atgtccaagtccaacctgcctgt

SEQ ID NO: 1215388 - DNA, 21 bp, Homo sapiens
atgtccagaagaatattcagg

SEQ ID NO: 1215389 - DNA, 18 bp, Homo sapiens
atgtccagtcatcctgcc

SEQ ID NO: 1215390 - DNA, 13 bp, Homo sapiens
atgtccagtgagt

SEQ ID NO: 1215391 - DNA, 13 bp, Homo sapiens
atgtccatacact

SEQ ID NO: 1215392 - DNA, 20 bp, Homo sapiens
atgtcccaacttgtaaaaat

SEQ ID NO: 1215393 - DNA, 14 bp, Homo sapiens
atgtcccacccacc

SEQ ID NO: 1215394 - DNA, 23 bp, Homo sapiens
atgtcccagtgctcaccagccct

SEQ ID NO: 1215395 - DNA, 23 bp, Homo sapiens
atgtccccaaagtaccacactga

SEQ ID NO: 1215396 - DNA, 23 bp, Homo sapiens
atgtcccccactgctaaggctgc

SEQ ID NO: 1215397 - DNA, 14 bp, Homo sapiens
atgtccccttcctg

SEQ ID NO: 1215398 - DNA, 17 bp, Homo sapiens
atgtccctccaacacag

SEQ ID NO: 1215399 - DNA, 14 bp, Homo sapiens
atgtccctgggcca

SEQ ID NO: 1215400 - DNA, 16 bp, Homo sapiens
atgtccctgggccagg

SEQ ID NO: 1215401 - DNA, 17 bp, Homo sapiens
atgtccctgggccaggg

SEQ ID NO: 1215402 - DNA, 21 bp, Homo sapiens
atgtccctgggccagggtctg

SEQ ID NO: 1215403 - DNA, 21 bp, Homo sapiens
atgtcccttgatgcacagaga

SEQ ID NO: 1215404 - DNA, 16 bp, Homo sapiens
atgtccctttcttggc

SEQ ID NO: 1215405 - DNA, 20 bp, Homo sapiens
atgtccctttcttggccagt

SEQ ID NO: 1215406 - DNA, 19 bp, Homo sapiens
atgtcctaattcttctgtc

SEQ ID NO: 1215407 - DNA, 21 bp, Homo sapiens
atgtcctcagcatttcttttc

SEQ ID NO: 1215408 - DNA, 19 bp, Homo sapiens
atgtgggtggcttctagtt

SEQ ID NO: 1215409 - DNA, 18 bp, Homo sapiens
atgtggtggcacaggccc

SEQ ID NO: 1215410 - DNA, 22 bp, Homo sapiens
atgtggtggcacaggccccctt

SEQ ID NO: 1215411 - DNA, 17 bp, Homo sapiens
atgtggtgtggggcgtg

SEQ ID NO: 1215412 - DNA, 15 bp, Homo sapiens
atgtggttacacact

SEQ ID NO: 1215413 - DNA, 23 bp, Homo sapiens
atgtggttacttcctactgtagg

SEQ ID NO: 1215414 - DNA, 23 bp, Homo sapiens
atgtggttcagtgccttcctctc

SEQ ID NO: 1215415 - DNA, 19 bp, Homo sapiens
atgtggtttatagagggcc

SEQ ID NO: 1215416 - DNA, 22 bp, Homo sapiens
atgtgtaataaatatgtttcac

SEQ ID NO: 1215417 - DNA, 20 bp, Homo sapiens
atgtgtacaatgtacacact

SEQ ID NO: 1215418 - DNA, 20 bp, Homo sapiens
atgtgtagggaaagttaaaa

SEQ ID NO: 1215419 - DNA, 13 bp, Homo sapiens
atgtgtataaact

SEQ ID NO: 1215420 - DNA, 15 bp, Homo sapiens
atgttagtcattgtt

SEQ ID NO: 1215421 - DNA, 16 bp, Homo sapiens
atgttagtcattgtta

SEQ ID NO: 1215422 - DNA, 21 bp, Homo sapiens
atgttagttaccttatagtta

SEQ ID NO: 1215423 - DNA, 22 bp, Homo sapiens
atgttatacaaccttcatttaa

SEQ ID NO: 1215424 - DNA, 15 bp, Homo sapiens
atgttatagaacttc

SEQ ID NO: 1215425 - DNA, 18 bp, Homo sapiens
atgttatatcatatgtat

SEQ ID NO: 1215426 - DNA, 19 bp, Homo sapiens
atgttatatcatatgtata

SEQ ID NO: 1215427 - DNA, 23 bp, Homo sapiens
atgttatcacctaagcacttcta

SEQ ID NO: 1215428 - DNA, 11 bp, Homo sapiens
atgttatgaac

SEQ ID NO: 1215429 - DNA, 13 bp, Homo sapiens
atgttatgaacag

SEQ ID NO: 1215430 - DNA, 22 bp, Homo sapiens
atgttatgaggacgtgtctgtt

SEQ ID NO: 1215431 - DNA, 19 bp, Homo sapiens
atgttatgggatgtaaaca

SEQ ID NO: 1215432 - DNA, 12 bp, Homo sapiens
atgttatgttta

SEQ ID NO: 1215433 - DNA, 16 bp, Homo sapiens
atgttattatgctaat

SEQ ID NO: 1215434 - DNA, 14 bp, Homo sapiens
atgttattctagta

SEQ ID NO: 1215435 - DNA, 12 bp, Homo sapiens
atgttattttgt

SEQ ID NO: 1215436 - DNA, 19 bp, Homo sapiens
atgttattttttaattatt

SEQ ID NO: 1215437 - DNA, 17 bp, Homo sapiens
atgttcaaagccacatt

SEQ ID NO: 1215438 - DNA, 20 bp, Homo sapiens
atgttcagaaatgtaaatgt

SEQ ID NO: 1215439 - DNA, 23 bp, Homo sapiens
atgttcagagtggctcactggct

SEQ ID NO: 1215440 - DNA, 16 bp, Homo sapiens
atgttcagattattgg

SEQ ID NO: 1215441 - DNA, 19 bp, Homo sapiens
atgttcatatttattgatt

SEQ ID NO: 1215442 - DNA, 18 bp, Homo sapiens
atgttcatgtaagaagcc

SEQ ID NO: 1215443 - DNA, 14 bp, Homo sapiens
atgttcattgtaat

SEQ ID NO: 1215444 - DNA, 18 bp, Homo sapiens
atgttcatttgtttgttt

SEQ ID NO: 1215445 - DNA, 14 bp, Homo sapiens
atgttcattttctc

SEQ ID NO: 1215446 - DNA, 20 bp, Homo sapiens
atgttcattttctctgtatg

SEQ ID NO: 1215447 - DNA, 17 bp, Homo sapiens
atgttccacctgccaca

SEQ ID NO: 1215448 - DNA, 16 bp, Homo sapiens
atgttcccaatttgaa

SEQ ID NO: 1215449 - DNA, 11 bp, Homo sapiens
atgttccctct

SEQ ID NO: 1215450 - DNA, 12 bp, Homo sapiens
atgttccctgca

SEQ ID NO: 1215451 - DNA, 19 bp, Homo sapiens
atgttccctgcaccctgga

SEQ ID NO: 1215452 - DNA, 15 bp, Homo sapiens
atgttccctttaaaa

SEQ ID NO: 1215453 - DNA, 11 bp, Homo sapiens
atgttccttta

SEQ ID NO: 1215454 - DNA, 15 bp, Homo sapiens
atgttcctttaaggt

SEQ ID NO: 1215455 - DNA, 23 bp, Homo sapiens
atgttcctttatttaggaaacac

SEQ ID NO: 1215456 - DNA, 15 bp, Homo sapiens
atgttccttttgaaa

SEQ ID NO: 1215457 - DNA, 13 bp, Homo sapiens
atgttcctttttt

SEQ ID NO: 1215458 - DNA, 17 bp, Homo sapiens
atgttctaacagatcag

SEQ ID NO: 1215459 - DNA, 23 bp, Homo sapiens
atgttctaggtcagtctaacagt

SEQ ID NO: 1215460 - DNA, 11 bp, Homo sapiens
atgttctatta

SEQ ID NO: 1215461 - DNA, 18 bp, Homo sapiens
atgttctattaatcacct

SEQ ID NO: 1215462 - DNA, 21 bp, Homo sapiens
atgttctcatgaactacccca

SEQ ID NO: 1215463 - DNA, 16 bp, Homo sapiens
atgttctctcttctcc

SEQ ID NO: 1215464 - DNA, 17 bp, Homo sapiens
atgttctctcttctcca

SEQ ID NO: 1215465 - DNA, 19 bp, Homo sapiens
atgttctcttcccaggcct

SEQ ID NO: 1215466 - DNA, 18 bp, Homo sapiens
atgttctgacattaacag

SEQ ID NO: 1215467 - DNA, 14 bp, Homo sapiens
atgttctgcaagaa

SEQ ID NO: 1215468 - DNA, 15 bp, Homo sapiens
atgttctgcaagaat

SEQ ID NO: 1215469 - DNA, 17 bp, Homo sapiens
atgttctgcaagaatta

SEQ ID NO: 1215470 - DNA, 18 bp, Homo sapiens
atgttctgcaagaattaa

SEQ ID NO: 1215471 - DNA, 20 bp, Homo sapiens
atgttctgcaagaattaaaa

SEQ ID NO: 1215472 - DNA, 22 bp, Homo sapiens
atgttctgcaagaattaaaact

SEQ ID NO: 1215473 - DNA, 12 bp, Homo sapiens
atgttctgcccc

SEQ ID NO: 1215474 - DNA, 17 bp, Homo sapiens
atgttctgcccccagcc

SEQ ID NO: 1215475 - DNA, 20 bp, Homo sapiens
atgttctgcccccagcccaa

SEQ ID NO: 1215476 - DNA, 16 bp, Homo sapiens
atgttctgtcttccca

SEQ ID NO: 1215477 - DNA, 18 bp, Homo sapiens
atgttctgtcttcccaaa

SEQ ID NO: 1215478 - DNA, 18 bp, Homo sapiens
atgttctgtgatacagaa

SEQ ID NO: 1215479 - DNA, 21 bp, Homo sapiens
atgttctgtgcctgtaaacat

SEQ ID NO: 1215480 - DNA, 13 bp, Homo sapiens
atgttctgtttgc

SEQ ID NO: 1215481 - DNA, 17 bp, Homo sapiens
atgttctgtttgctgtg

SEQ ID NO: 1215482 - DNA, 14 bp, Homo sapiens
atgttcttaattct

SEQ ID NO: 1215483 - DNA, 15 bp, Homo sapiens
atgttcttaattctt

SEQ ID NO: 1215484 - DNA, 21 bp, Homo sapiens
atgttcttgggtggttcctaa

SEQ ID NO: 1215485 - DNA, 12 bp, Homo sapiens
atgttgaaagat

SEQ ID NO: 1215486 - DNA, 22 bp, Homo sapiens
atgttgaaatatgatgttaaaa

SEQ ID NO: 1215487 - DNA, 14 bp, Homo sapiens
atgttgaaatatgc

SEQ ID NO: 1215488 - DNA, 16 bp, Homo sapiens
atgttgaaatatgcat

SEQ ID NO: 1215489 - DNA, 15 bp, Homo sapiens
atgttgaatactttt

SEQ ID NO: 1215490 - DNA, 22 bp, Homo sapiens
atgttgaatgcccacaggcaaa

SEQ ID NO: 1215491 - DNA, 13 bp, Homo sapiens
atgttgaatgtat

SEQ ID NO: 1215492 - DNA, 14 bp, Homo sapiens
atgttgacctttga

SEQ ID NO: 1215493 - DNA, 16 bp, Homo sapiens
atgttgagaatcccaa

SEQ ID NO: 1215494 - DNA, 18 bp, Homo sapiens
atgttgagccaggcctgg

SEQ ID NO: 1215495 - DNA, 16 bp, Homo sapiens
atgttgataatttcag

SEQ ID NO: 1215496 - DNA, 14 bp, Homo sapiens
atgttgatcagcaa

SEQ ID NO: 1215497 - DNA, 16 bp, Homo sapiens
atgttgatctgcatat

SEQ ID NO: 1215498 - DNA, 17 bp, Homo sapiens
atgttgatctgcatatt

SEQ ID NO: 1215499 - DNA, 22 bp, Homo sapiens
atgttgatctgcatatttctgt

SEQ ID NO: 1215500 - DNA, 23 bp, Homo sapiens
atgttgatctgcatatttctgta

SEQ ID NO: 1215501 - DNA, 22 bp, Homo sapiens
atgttgatgactcgaaactgac

SEQ ID NO: 1215502 - DNA, 15 bp, Homo sapiens
atgttgcaatgtgaa

SEQ ID NO: 1215503 - DNA, 16 bp, Homo sapiens
atgttgcatgcctatg

SEQ ID NO: 1215504 - DNA, 19 bp, Homo sapiens
atgttgccacctgttaaaa

SEQ ID NO: 1215505 - DNA, 12 bp, Homo sapiens
atgttgcccaag

SEQ ID NO: 1215506 - DNA, 22 bp, Homo sapiens
atgttgcccctttctcttttcc

SEQ ID NO: 1215507 - DNA, 19 bp, Homo sapiens
atgttgctagttttttgct

SEQ ID NO: 1215508 - DNA, 18 bp, Homo sapiens
atgttgctattgtaaggt

SEQ ID NO: 1215509 - DNA, 19 bp, Homo sapiens
atgttgctcagtctccctt

SEQ ID NO: 1215510 - DNA, 17 bp, Homo sapiens
atgttgctgaatttgta

SEQ ID NO: 1215511 - DNA, 11 bp, Homo sapiens
atgttgctgcc

SEQ ID NO: 1215512 - DNA, 19 bp, Homo sapiens
atgttgctggactgtcata

SEQ ID NO: 1215513 - DNA, 17 bp, Homo sapiens
atgttgcttaggatgtg

SEQ ID NO: 1215514 - DNA, 19 bp, Homo sapiens
atgttgcttctgaatcact

SEQ ID NO: 1215515 - DNA, 22 bp, Homo sapiens
atgttggataaggaattataga

SEQ ID NO: 1215516 - DNA, 18 bp, Homo sapiens
atgttggatttataaatg

SEQ ID NO: 1215517 - DNA, 21 bp, Homo sapiens
atgttggatttataaatgcta

SEQ ID NO: 1215518 - DNA, 19 bp, Homo sapiens
atgttggcaaatcacttca

SEQ ID NO: 1215519 - DNA, 21 bp, Homo sapiens
atgttggggtttcctttacct

SEQ ID NO: 1215520 - DNA, 20 bp, Homo sapiens
atgttgggttgttacagagt

SEQ ID NO: 1215521 - DNA, 18 bp, Homo sapiens
atgttggtcattttatgt

SEQ ID NO: 1215522 - DNA, 14 bp, Homo sapiens
atgttggtgttcca

SEQ ID NO: 1215523 - DNA, 18 bp, Homo sapiens
atgttggtttcagtggct

SEQ ID NO: 1215524 - DNA, 14 bp, Homo sapiens
atgttgtaaataaa

SEQ ID NO: 1215525 - DNA, 23 bp, Homo sapiens
atgttgtaataaaacttatgcta

SEQ ID NO: 1215526 - DNA, 14 bp, Homo sapiens
atgttgtaatattt

SEQ ID NO: 1215527 - DNA, 19 bp, Homo sapiens
atgttgtaatatttcttca

SEQ ID NO: 1215528 - DNA, 15 bp, Homo sapiens
atgttgtaatgctgc

SEQ ID NO: 1215529 - DNA, 20 bp, Homo sapiens
atgttgtacatactgccgaa

SEQ ID NO: 1215530 - DNA, 15 bp, Homo sapiens
atgttgtcaaagaga

SEQ ID NO: 1215531 - DNA, 19 bp, Homo sapiens
attagaattaccatttgtt

SEQ ID NO: 1215532 - DNA, 14 bp, Homo sapiens
attagaattattta

SEQ ID NO: 1215533 - DNA, 13 bp, Homo sapiens
attagacagaaca

SEQ ID NO: 1215534 - DNA, 15 bp, Homo sapiens
attagactggaactt

SEQ ID NO: 1215535 - DNA, 14 bp, Homo sapiens
attagactggacag

SEQ ID NO: 1215536 - DNA, 15 bp, Homo sapiens
attagactggacagc

SEQ ID NO: 1215537 - DNA, 16 bp, Homo sapiens
attagactggacagct

SEQ ID NO: 1215538 - DNA, 19 bp, Homo sapiens
attagactggacagcttgt

SEQ ID NO: 1215539 - DNA, 19 bp, Homo sapiens
attagactttagaaataaa

SEQ ID NO: 1215540 - DNA, 16 bp, Homo sapiens
attagagaactggagg

SEQ ID NO: 1215541 - DNA, 20 bp, Homo sapiens
attagagcacagcttcttct

SEQ ID NO: 1215542 - DNA, 22 bp, Homo sapiens
attagagcacagcttcttctgc

SEQ ID NO: 1215543 - DNA, 21 bp, Homo sapiens
attagagggaggagaatgagc

SEQ ID NO: 1215544 - DNA, 17 bp, Homo sapiens
attagagtatttccctt

SEQ ID NO: 1215545 - DNA, 23 bp, Homo sapiens
attagagtcaactacacaaagca

SEQ ID NO: 1215546 - DNA, 15 bp, Homo sapiens
attagagtcagcctt

SEQ ID NO: 1215547 - DNA, 13 bp, Homo sapiens
attagataatatt

SEQ ID NO: 1215548 - DNA, 14 bp, Homo sapiens
attagataatattt

SEQ ID NO: 1215549 - DNA, 18 bp, Homo sapiens
attagatcttcaaacaga

SEQ ID NO: 1215550 - DNA, 21 bp, Homo sapiens
attagattgcaaagcaatgaa

SEQ ID NO: 1215551 - DNA, 22 bp, Homo sapiens
attagattttattttactattg

SEQ ID NO: 1215552 - DNA, 18 bp, Homo sapiens
attagcaaagaagcttca

SEQ ID NO: 1215553 - DNA, 21 bp, Homo sapiens
attagcagaatggagaaagta

SEQ ID NO: 1215554 - DNA, 14 bp, Homo sapiens
attagcagttgctc

SEQ ID NO: 1215555 - DNA, 16 bp, Homo sapiens
attagcagttgctcac

SEQ ID NO: 1215556 - DNA, 20 bp, Homo sapiens
attagcagttgctcacatgt

SEQ ID NO: 1215557 - DNA, 14 bp, Homo sapiens
attagcatgcaagc

SEQ ID NO: 1215558 - DNA, 16 bp, Homo sapiens
attagcatgcaagctt

SEQ ID NO: 1215559 - DNA, 15 bp, Homo sapiens
attagcggctcctcg

SEQ ID NO: 1215560 - DNA, 22 bp, Homo sapiens
attagcttacccaatgggaccg

SEQ ID NO: 1215561 - DNA, 23 bp, Homo sapiens
attagctttgggtgcctttgcca

SEQ ID NO: 1215562 - DNA, 21 bp, Homo sapiens
attaggaagtgtaacagctga

SEQ ID NO: 1215563 - DNA, 22 bp, Homo sapiens
attaggaagtgtaacagctgag

SEQ ID NO: 1215564 - DNA, 13 bp, Homo sapiens
attaggaataaat

SEQ ID NO: 1215565 - DNA, 22 bp, Homo sapiens
attaggacaatcagtcccctcc

SEQ ID NO: 1215566 - DNA, 21 bp, Homo sapiens
attaggatctgcaaacaatga

SEQ ID NO: 1215567 - DNA, 22 bp, Homo sapiens
attaggatctgcaaacaatgaa

SEQ ID NO: 1215568 - DNA, 14 bp, Homo sapiens
attaggatttcatg

SEQ ID NO: 1215569 - DNA, 16 bp, Homo sapiens
attaggatttcatgat

SEQ ID NO: 1215570 - DNA, 16 bp, Homo sapiens
attaggcaaagtacaa

SEQ ID NO: 1215571 - DNA, 21 bp, Homo sapiens
attaggcaaggctatgtgatt

SEQ ID NO: 1215572 - DNA, 20 bp, Homo sapiens
attaggcataaattaaaatg

SEQ ID NO: 1215573 - DNA, 21 bp, Homo sapiens
attaggcataaattaaaatgt

SEQ ID NO: 1215574 - DNA, 23 bp, Homo sapiens
attaggctgtaactactttataa

SEQ ID NO: 1215575 - DNA, 17 bp, Homo sapiens
attagggagaaaattca

SEQ ID NO: 1215576 - DNA, 18 bp, Homo sapiens
attagggccctgtgtctg

SEQ ID NO: 1215577 - DNA, 18 bp, Homo sapiens
attaggggattcttcttt

SEQ ID NO: 1215578 - DNA, 15 bp, Homo sapiens
attaggggttgctaa

SEQ ID NO: 1215579 - DNA, 22 bp, Homo sapiens
attaggggttgctaagaagcga

SEQ ID NO: 1215580 - DNA, 14 bp, Homo sapiens
attaggtagacttt

SEQ ID NO: 1215581 - DNA, 21 bp, Homo sapiens
attaggtcgttttccaaagag

SEQ ID NO: 1215582 - DNA, 17 bp, Homo sapiens
attaggtgaagggatgg

SEQ ID NO: 1215583 - DNA, 18 bp, Homo sapiens
attaggtgtgactgaatt

SEQ ID NO: 1215584 - DNA, 21 bp, Homo sapiens
attaggtgtgactgaatttct

SEQ ID NO: 1215585 - DNA, 17 bp, Homo sapiens
attaggttgaaacatat

SEQ ID NO: 1215586 - DNA, 21 bp, Homo sapiens
attagtaagatctctttctaa

SEQ ID NO: 1215587 - DNA, 22 bp, Homo sapiens
attagtaccatagtaccattta

SEQ ID NO: 1215588 - DNA, 19 bp, Homo sapiens
attagtactgctcttgttt

SEQ ID NO: 1215589 - DNA, 12 bp, Homo sapiens
attagtataata

SEQ ID NO: 1215590 - DNA, 19 bp, Homo sapiens
attagtatggttcaagatt

SEQ ID NO: 1215591 - DNA, 22 bp, Homo sapiens
attagtatgtctgtttttgtat

SEQ ID NO: 1215592 - DNA, 14 bp, Homo sapiens
attagtattgttgt

SEQ ID NO: 1215593 - DNA, 18 bp, Homo sapiens
attagtatttatttaatg

SEQ ID NO: 1215594 - DNA, 23 bp, Homo sapiens
attagtatttatttaatgttatg

SEQ ID NO: 1215595 - DNA, 20 bp, Homo sapiens
attagtcactgctgctactg

SEQ ID NO: 1215596 - DNA, 13 bp, Homo sapiens
attatattcacag

SEQ ID NO: 1215597 - DNA, 23 bp, Homo sapiens
attatattggtgcgtttttacag

SEQ ID NO: 1215598 - DNA, 16 bp, Homo sapiens
attatatttgcattat

SEQ ID NO: 1215599 - DNA, 19 bp, Homo sapiens
attatcaatatctaatata

SEQ ID NO: 1215600 - DNA, 13 bp, Homo sapiens
attatcagcaaag

SEQ ID NO: 1215601 - DNA, 16 bp, Homo sapiens
attatcagcaaagaaa

SEQ ID NO: 1215602 - DNA, 21 bp, Homo sapiens
attatcagttaaaatcacatt

SEQ ID NO: 1215603 - DNA, 20 bp, Homo sapiens
attatcatgcgttttatatc

SEQ ID NO: 1215604 - DNA, 14 bp, Homo sapiens
attatccatattga

SEQ ID NO: 1215605 - DNA, 13 bp, Homo sapiens
attatccattacg

SEQ ID NO: 1215606 - DNA, 20 bp, Homo sapiens
attatcctcctgttctgaaa

SEQ ID NO: 1215607 - DNA, 14 bp, Homo sapiens
attatcctttattt

SEQ ID NO: 1215608 - DNA, 18 bp, Homo sapiens
attatcgccttttgacag

SEQ ID NO: 1215609 - DNA, 17 bp, Homo sapiens
attatcggaagcagtgc

SEQ ID NO: 1215610 - DNA, 22 bp, Homo sapiens
attatcgggaacagtgtttccc

SEQ ID NO: 1215611 - DNA, 17 bp, Homo sapiens
attatctaaagtgtgtt

SEQ ID NO: 1215612 - DNA, 23 bp, Homo sapiens
attatctaaagtgtgttgttgct

SEQ ID NO: 1215613 - DNA, 16 bp, Homo sapiens
attatctaaatgaatg

SEQ ID NO: 1215614 - DNA, 17 bp, Homo sapiens
attatctaaatgaatga

SEQ ID NO: 1215615 - DNA, 13 bp, Homo sapiens
attatctaattta

SEQ ID NO: 1215616 - DNA, 20 bp, Homo sapiens
attatctatacatatcttta

SEQ ID NO: 1215617 - DNA, 15 bp, Homo sapiens
attatctatgcagca

SEQ ID NO: 1215618 - DNA, 19 bp, Homo sapiens
attatctatggaaatgtga

SEQ ID NO: 1215619 - DNA, 21 bp, Homo sapiens
attatctctttgatctacttg

SEQ ID NO: 1215620 - DNA, 20 bp, Homo sapiens
attatctgttgccttatttc

SEQ ID NO: 1215621 - DNA, 16 bp, Homo sapiens
attatcttcagcccag

SEQ ID NO: 1215622 - DNA, 12 bp, Homo sapiens
attatcttcata

SEQ ID NO: 1215623 - DNA, 16 bp, Homo sapiens
attatcttgatacatt

SEQ ID NO: 1215624 - DNA, 13 bp, Homo sapiens
attatgaaaacta

SEQ ID NO: 1215625 - DNA, 20 bp, Homo sapiens
attatgatttcattatcaca

SEQ ID NO: 1215626 - DNA, 22 bp, Homo sapiens
attatgatttcattatcacatg

SEQ ID NO: 1215627 - DNA, 21 bp, Homo sapiens
attatgcacttttagaaatgc

SEQ ID NO: 1215628 - DNA, 13 bp, Homo sapiens
attatgcataaag

SEQ ID NO: 1215629 - DNA, 20 bp, Homo sapiens
attatgcttccacaggcaaa

SEQ ID NO: 1215630 - DNA, 16 bp, Homo sapiens
attatgctttgaactt

SEQ ID NO: 1215631 - DNA, 22 bp, Homo sapiens
attatggaaaaataaaactgtc

SEQ ID NO: 1215632 - DNA, 19 bp, Homo sapiens
attatggtgggtgattatt

SEQ ID NO: 1215633 - DNA, 18 bp, Homo sapiens
attatgtaatatattgta

SEQ ID NO: 1215634 - DNA, 15 bp, Homo sapiens
attatgtatgtttac

SEQ ID NO: 1215635 - DNA, 19 bp, Homo sapiens
attatgtatttataattta

SEQ ID NO: 1215636 - DNA, 15 bp, Homo sapiens
attatgtcaaccagg

SEQ ID NO: 1215637 - DNA, 14 bp, Homo sapiens
attatgtcttcttt

SEQ ID NO: 1215638 - DNA, 16 bp, Homo sapiens
attatgtcttcttttg

SEQ ID NO: 1215639 - DNA, 17 bp, Homo sapiens
attatgtcttcttttgt

SEQ ID NO: 1215640 - DNA, 20 bp, Homo sapiens
attatgtgacattttacatt

SEQ ID NO: 1215641 - DNA, 12 bp, Homo sapiens
attatgtttatt

SEQ ID NO: 1215642 - DNA, 23 bp, Homo sapiens
attattaaattgtaaaactccaa

SEQ ID NO: 1215643 - DNA, 23 bp, Homo sapiens
attattaacatacctaagaagta

SEQ ID NO: 1215644 - DNA, 16 bp, Homo sapiens
attattaataatgaag

SEQ ID NO: 1215645 - DNA, 13 bp, Homo sapiens
attattaattgca

SEQ ID NO: 1215646 - DNA, 13 bp, Homo sapiens
attattacaaata

SEQ ID NO: 1215647 - DNA, 15 bp, Homo sapiens
attattacaaatatt

SEQ ID NO: 1215648 - DNA, 17 bp, Homo sapiens
attattacaaatattgt

SEQ ID NO: 1215649 - DNA, 13 bp, Homo sapiens
attattacagtgt

SEQ ID NO: 1215650 - DNA, 21 bp, Homo sapiens
attattaccagcatttgtcct

SEQ ID NO: 1215651 - DNA, 22 bp, Homo sapiens
attattaccagcatttgtcctt

SEQ ID NO: 1215652 - DNA, 14 bp, Homo sapiens
attattactggtat

SEQ ID NO: 1215653 - DNA, 21 bp, Homo sapiens
attattacttatttttgacag

SEQ ID NO: 1215654 - DNA, 14 bp, Homo sapiens
attattataaacta

SEQ ID NO: 1215655 - DNA, 14 bp, Homo sapiens
attattatacttca

SEQ ID NO: 1215656 - DNA, 14 bp, Homo sapiens
attattatattgaa

SEQ ID NO: 1215657 - DNA, 16 bp, Homo sapiens
attattatcgctttat

SEQ ID NO: 1215658 - DNA, 15 bp, Homo sapiens
attattatgtttatt

SEQ ID NO: 1215659 - DNA, 17 bp, Homo sapiens
attattattaaaaatat

SEQ ID NO: 1215660 - DNA, 15 bp, Homo sapiens
attattattcttcat

SEQ ID NO: 1215661 - DNA, 14 bp, Homo sapiens
attattcaaaaaca

SEQ ID NO: 1215662 - DNA, 19 bp, Homo sapiens
attattcaaaccaatttct

SEQ ID NO: 1215663 - DNA, 22 bp, Homo sapiens
attattcaaaccaatttcttcc

SEQ ID NO: 1215664 - DNA, 13 bp, Homo sapiens
attattcaacaca

SEQ ID NO: 1215665 - DNA, 12 bp, Homo sapiens
attattcaagaa

SEQ ID NO: 1215666 - DNA, 18 bp, Homo sapiens
attattcaagaatgaaaa

SEQ ID NO: 1215667 - DNA, 19 bp, Homo sapiens
attattcaagaatgaaaaa

SEQ ID NO: 1215668 - DNA, 13 bp, Homo sapiens
attattcagaact

SEQ ID NO: 1215669 - DNA, 15 bp, Homo sapiens
attcaatcatttatt

SEQ ID NO: 1215670 - DNA, 18 bp, Homo sapiens
attcaatctgtaaactgt

SEQ ID NO: 1215671 - DNA, 22 bp, Homo sapiens
attcaattagtggtcataaaat

SEQ ID NO: 1215672 - DNA, 18 bp, Homo sapiens
attcaattataattgtaa

SEQ ID NO: 1215673 - DNA, 16 bp, Homo sapiens
attcaattcctctggg

SEQ ID NO: 1215674 - DNA, 17 bp, Homo sapiens
attcaattcctctggga

SEQ ID NO: 1215675 - DNA, 19 bp, Homo sapiens
attcaatttattcaagaaa

SEQ ID NO: 1215676 - DNA, 22 bp, Homo sapiens
attcaattttctttaaccagtc

SEQ ID NO: 1215677 - DNA, 21 bp, Homo sapiens
attcacaaagtaatttggaaa

SEQ ID NO: 1215678 - DNA, 17 bp, Homo sapiens
attcacaacctcaccaa

SEQ ID NO: 1215679 - DNA, 21 bp, Homo sapiens
attcacaacctcaccaaacta

SEQ ID NO: 1215680 - DNA, 21 bp, Homo sapiens
attcacaagcctcctgtacct

SEQ ID NO: 1215681 - DNA, 22 bp, Homo sapiens
attcacaagcctcctgtacctc

SEQ ID NO: 1215682 - DNA, 14 bp, Homo sapiens
attcacaattattc

SEQ ID NO: 1215683 - DNA, 21 bp, Homo sapiens
attcacagaaagctagatatg

SEQ ID NO: 1215684 - DNA, 14 bp, Homo sapiens
attcacagactgat

SEQ ID NO: 1215685 - DNA, 20 bp, Homo sapiens
attcacagtgctcttttctc

SEQ ID NO: 1215686 - DNA, 12 bp, Homo sapiens
attcacagtttt

SEQ ID NO: 1215687 - DNA, 15 bp, Homo sapiens
attcacatctcattt

SEQ ID NO: 1215688 - DNA, 16 bp, Homo sapiens
attcacatctcatttt

SEQ ID NO: 1215689 - DNA, 18 bp, Homo sapiens
attcacattgttaagaaa

SEQ ID NO: 1215690 - DNA, 13 bp, Homo sapiens
attcacatttgat

SEQ ID NO: 1215691 - DNA, 21 bp, Homo sapiens
attcaccaaaatagtcttctc

SEQ ID NO: 1215692 - DNA, 16 bp, Homo sapiens
attcaccccctttcct

SEQ ID NO: 1215693 - DNA, 16 bp, Homo sapiens
attcacctcagcctgg

SEQ ID NO: 1215694 - DNA, 17 bp, Homo sapiens
attcacctcagcctgga

SEQ ID NO: 1215695 - DNA, 18 bp, Homo sapiens
attcacctcagtagaaaa

SEQ ID NO: 1215696 - DNA, 13 bp, Homo sapiens
attcacctcttcc

SEQ ID NO: 1215697 - DNA, 13 bp, Homo sapiens
attcacctgtaaa

SEQ ID NO: 1215698 - DNA, 16 bp, Homo sapiens
attcacctgtaaaact

SEQ ID NO: 1215699 - DNA, 17 bp, Homo sapiens
attcacctgtaaaactt

SEQ ID NO: 1215700 - DNA, 16 bp, Homo sapiens
attcactaatcttgaa

SEQ ID NO: 1215701 - DNA, 15 bp, Homo sapiens
attcactgccttcct

SEQ ID NO: 1215702 - DNA, 18 bp, Homo sapiens
attcactggttttacaca

SEQ ID NO: 1215703 - DNA, 15 bp, Homo sapiens
attcactgtaagttt

SEQ ID NO: 1215704 - DNA, 18 bp, Homo sapiens
attcactttcatttttga

SEQ ID NO: 1215705 - DNA, 13 bp, Homo sapiens
attcacttttgtt

SEQ ID NO: 1215706 - DNA, 14 bp, Homo sapiens
attcacttttgtta

SEQ ID NO: 1215707 - DNA, 12 bp, Homo sapiens
attcagaaaaaa

SEQ ID NO: 1215708 - DNA, 13 bp, Homo sapiens
attcagaaaactt

SEQ ID NO: 1215709 - DNA, 18 bp, Homo sapiens
attcagaaaatgttctgt

SEQ ID NO: 1215710 - DNA, 13 bp, Homo sapiens
attcagaaagctt

SEQ ID NO: 1215711 - DNA, 14 bp, Homo sapiens
attcctagtctttc

SEQ ID NO: 1215712 - DNA, 18 bp, Homo sapiens
attcctagtctttccagt

SEQ ID NO: 1215713 - DNA, 20 bp, Homo sapiens
attcctagtggatgactgtt

SEQ ID NO: 1215714 - DNA, 17 bp, Homo sapiens
attcctatatagtttat

SEQ ID NO: 1215715 - DNA, 19 bp, Homo sapiens
attcctatatcctgtgact

SEQ ID NO: 1215716 - DNA, 20 bp, Homo sapiens
attcctatgaagttggcaca

SEQ ID NO: 1215717 - DNA, 17 bp, Homo sapiens
attcctcaacgtattgt

SEQ ID NO: 1215718 - DNA, 17 bp, Homo sapiens
attcctcagctgccaag

SEQ ID NO: 1215719 - DNA, 14 bp, Homo sapiens
attcctcagggaca

SEQ ID NO: 1215720 - DNA, 14 bp, Homo sapiens
attcctccactctg

SEQ ID NO: 1215721 - DNA, 22 bp, Homo sapiens
attcctccactctgtatctatg

SEQ ID NO: 1215722 - DNA, 15 bp, Homo sapiens
attcctccagcctcc

SEQ ID NO: 1215723 - DNA, 18 bp, Homo sapiens
attcctccagcctcccct

SEQ ID NO: 1215724 - DNA, 19 bp, Homo sapiens
attcctccagcctcccctc

SEQ ID NO: 1215725 - DNA, 14 bp, Homo sapiens
attcctcctgctca

SEQ ID NO: 1215726 - DNA, 15 bp, Homo sapiens
attcctccttccccc

SEQ ID NO: 1215727 - DNA, 21 bp, Homo sapiens
attcctccttccccccatctc

SEQ ID NO: 1215728 - DNA, 13 bp, Homo sapiens
attcctctcttaa

SEQ ID NO: 1215729 - DNA, 18 bp, Homo sapiens
attcctcttgcctctctc

SEQ ID NO: 1215730 - DNA, 20 bp, Homo sapiens
attcctcttgcctctctcag

SEQ ID NO: 1215731 - DNA, 13 bp, Homo sapiens
attcctctttgct

SEQ ID NO: 1215732 - DNA, 14 bp, Homo sapiens
attcctctttgctt

SEQ ID NO: 1215733 - DNA, 15 bp, Homo sapiens
attcctctttgcttt

SEQ ID NO: 1215734 - DNA, 18 bp, Homo sapiens
attcctctttgctttgct

SEQ ID NO: 1215735 - DNA, 13 bp, Homo sapiens
attcctgaaagaa

SEQ ID NO: 1215736 - DNA, 16 bp, Homo sapiens
attcctgaagggaact

SEQ ID NO: 1215737 - DNA, 14 bp, Homo sapiens
attcctgacccagg

SEQ ID NO: 1215738 - DNA, 18 bp, Homo sapiens
attcctgacctccgccat

SEQ ID NO: 1215739 - DNA, 22 bp, Homo sapiens
attcctgacctccgccatccac

SEQ ID NO: 1215740 - DNA, 16 bp, Homo sapiens
attcctgagctggcct

SEQ ID NO: 1215741 - DNA, 17 bp, Homo sapiens
attcctgagctggcctg

SEQ ID NO: 1215742 - DNA, 20 bp, Homo sapiens
attcctgctatgacagctgg

SEQ ID NO: 1215743 - DNA, 22 bp, Homo sapiens
attcctgctatgacagctggct

SEQ ID NO: 1215744 - DNA, 20 bp, Homo sapiens
attcctggacatcaccagtc

SEQ ID NO: 1215745 - DNA, 23 bp, Homo sapiens
attcctggagaggtggctgcgcc

SEQ ID NO: 1215746 - DNA, 22 bp, Homo sapiens
attcctggctctaccctgtctg

SEQ ID NO: 1215747 - DNA, 17 bp, Homo sapiens
attcctgggcctgtccc

SEQ ID NO: 1215748 - DNA, 15 bp, Homo sapiens
attcctggtacccag

SEQ ID NO: 1215749 - DNA, 19 bp, Homo sapiens
attcctggtttgactcagt

SEQ ID NO: 1215750 - DNA, 22 bp, Homo sapiens
attcctggtttgactcagttcc

SEQ ID NO: 1215751 - DNA, 18 bp, Homo sapiens
attcctgtaaataagagt

SEQ ID NO: 1215752 - DNA, 16 bp, Homo sapiens
attcctgtatgttgtc

SEQ ID NO: 1215753 - DNA, 13 bp, Homo sapiens
attcctgtgccct

SEQ ID NO: 1215754 - DNA, 20 bp, Homo sapiens
attcctgttgaccttcccac

SEQ ID NO: 1215755 - DNA, 19 bp, Homo sapiens
attcctgttgatgggaaaa

SEQ ID NO: 1215756 - DNA, 16 bp, Homo sapiens
attccttaaacctgaa

SEQ ID NO: 1215757 - DNA, 16 bp, Homo sapiens
attccttacttgcact

SEQ ID NO: 1215758 - DNA, 19 bp, Homo sapiens
attccttagactcttttcc

SEQ ID NO: 1215759 - DNA, 20 bp, Homo sapiens
attccttagcttagacctca

SEQ ID NO: 1215760 - DNA, 22 bp, Homo sapiens
attccttagcttagacctcagc

SEQ ID NO: 1215761 - DNA, 19 bp, Homo sapiens
attccttcaaataaagaaa

SEQ ID NO: 1215762 - DNA, 13 bp, Homo sapiens
attccttcactca

SEQ ID NO: 1215763 - DNA, 23 bp, Homo sapiens
attccttctcccatctcttcctt

SEQ ID NO: 1215764 - DNA, 13 bp, Homo sapiens
attccttctgtag

SEQ ID NO: 1215765 - DNA, 16 bp, Homo sapiens
attccttctgtagtgt

SEQ ID NO: 1215766 - DNA, 15 bp, Homo sapiens
attccttcttctagt

SEQ ID NO: 1215767 - DNA, 16 bp, Homo sapiens
attccttgcgcctcag

SEQ ID NO: 1215768 - DNA, 23 bp, Homo sapiens
attccttgtgttttgtcctgcct

SEQ ID NO: 1215769 - DNA, 16 bp, Homo sapiens
attcctttcccttcct

SEQ ID NO: 1215770 - DNA, 18 bp, Homo sapiens
attcctttcccttcctct

SEQ ID NO: 1215771 - DNA, 20 bp, Homo sapiens
attcctttcccttcctcttc

SEQ ID NO: 1215772 - DNA, 17 bp, Homo sapiens
attccttttgatgggga

SEQ ID NO: 1215773 - DNA, 22 bp, Homo sapiens
attccttttgatggggagaaag

SEQ ID NO: 1215774 - DNA, 18 bp, Homo sapiens
attccttttgtgtacagt

SEQ ID NO: 1215775 - DNA, 12 bp, Homo sapiens
attcctttttct

SEQ ID NO: 1215776 - DNA, 16 bp, Homo sapiens
attcgaatgacactgt

SEQ ID NO: 1215777 - DNA, 22 bp, Homo sapiens
attcgaatggggtagaaacatt

SEQ ID NO: 1215778 - DNA, 16 bp, Homo sapiens
attcgatgccccccta

SEQ ID NO: 1215779 - DNA, 21 bp, Homo sapiens
attcgcccaaagccagacagc

SEQ ID NO: 1215780 - DNA, 15 bp, Homo sapiens
attcgctagtgttta

SEQ ID NO: 1215781 - DNA, 17 bp, Homo sapiens
attcggggcctgctgga

SEQ ID NO: 1215782 - DNA, 16 bp, Homo sapiens
attcgtcctttgacaa

SEQ ID NO: 1215783 - DNA, 19 bp, Homo sapiens
attcgtctgtcccagagct

SEQ ID NO: 1215784 - DNA, 22 bp, Homo sapiens
attcgtgagctggggactcagg

SEQ ID NO: 1215785 - DNA, 20 bp, Homo sapiens
attcgtgcatttttggatca

SEQ ID NO: 1215786 - DNA, 18 bp, Homo sapiens
attcgtggcatgttttga

SEQ ID NO: 1215787 - DNA, 23 bp, Homo sapiens
attcgtggtgatcaattaaatgt

SEQ ID NO: 1215788 - DNA, 16 bp, Homo sapiens
attcgtgtgttttttt

SEQ ID NO: 1215789 - DNA, 16 bp, Homo sapiens
attcgtgttatgaatc

SEQ ID NO: 1215790 - DNA, 23 bp, Homo sapiens
attcgtgttatgaatctgtgctg

SEQ ID NO: 1215791 - DNA, 13 bp, Homo sapiens
attcgttctgtgg

SEQ ID NO: 1215792 - DNA, 20 bp, Homo sapiens
attcgttgtgttttttaaga

SEQ ID NO: 1215793 - DNA, 22 bp, Homo sapiens
attcgttgtgttttttaagata

SEQ ID NO: 1215794 - DNA, 20 bp, Homo sapiens
attctaaaatgattgtagta

SEQ ID NO: 1215795 - DNA, 16 bp, Homo sapiens
attctaaagttttgca

SEQ ID NO: 1215796 - DNA, 21 bp, Homo sapiens
attctaaatccgacttgaata

SEQ ID NO: 1215797 - DNA, 23 bp, Homo sapiens
attctaaatccgacttgaatatt

SEQ ID NO: 1215798 - DNA, 18 bp, Homo sapiens
attctaaatgaatgttta

SEQ ID NO: 1215799 - DNA, 12 bp, Homo sapiens
attctaaatgta

SEQ ID NO: 1215800 - DNA, 14 bp, Homo sapiens
attctaagatttgg

SEQ ID NO: 1215801 - DNA, 22 bp, Homo sapiens
attctaagccagttttcatttt

SEQ ID NO: 1215802 - DNA, 15 bp, Homo sapiens
attctaagtgaaatt

SEQ ID NO: 1215803 - DNA, 19 bp, Homo sapiens
attctaagttagactcttc

SEQ ID NO: 1215804 - DNA, 20 bp, Homo sapiens
attctaataaatatactatg

SEQ ID NO: 1215805 - DNA, 15 bp, Homo sapiens
attctacagaataat

SEQ ID NO: 1215806 - DNA, 20 bp, Homo sapiens
attctacagaataatccagt

SEQ ID NO: 1215807 - DNA, 22 bp, Homo sapiens
attctactagcaggcaatgctg

SEQ ID NO: 1215808 - DNA, 14 bp, Homo sapiens
attctactcttgtc

SEQ ID NO: 1215809 - DNA, 16 bp, Homo sapiens
attctactcttgtcat

SEQ ID NO: 1215810 - DNA, 15 bp, Homo sapiens
attctacttcagctt

SEQ ID NO: 1215811 - DNA, 17 bp, Homo sapiens
attctactttaagcact

SEQ ID NO: 1215812 - DNA, 21 bp, Homo sapiens
attctagatcctgcaccccag

SEQ ID NO: 1215813 - DNA, 15 bp, Homo sapiens
attctagattacttt

SEQ ID NO: 1215814 - DNA, 14 bp, Homo sapiens
attctagcagggaa

SEQ ID NO: 1215815 - DNA, 21 bp, Homo sapiens
attctagctgtatgatttgtt

SEQ ID NO: 1215816 - DNA, 22 bp, Homo sapiens
attctaggtggaggttgtgcat

SEQ ID NO: 1215817 - DNA, 22 bp, Homo sapiens
attctagtactagaaactgaag

SEQ ID NO: 1215818 - DNA, 13 bp, Homo sapiens
attctagtatttt

SEQ ID NO: 1215819 - DNA, 14 bp, Homo sapiens
attctagtatttta

SEQ ID NO: 1215820 - DNA, 12 bp, Homo sapiens
attctagtgctg

SEQ ID NO: 1215821 - DNA, 13 bp, Homo sapiens
attctatatgaat

SEQ ID NO: 1215822 - DNA, 19 bp, Homo sapiens
attctatatgaatttaaat

SEQ ID NO: 1215823 - DNA, 20 bp, Homo sapiens
attctatattattatatata

SEQ ID NO: 1215824 - DNA, 19 bp, Homo sapiens
attctatcggccaggctgg

SEQ ID NO: 1215825 - DNA, 15 bp, Homo sapiens
attctatctactgat

SEQ ID NO: 1215826 - DNA, 21 bp, Homo sapiens
attctatcttttgtttccttt

SEQ ID NO: 1215827 - DNA, 15 bp, Homo sapiens
attctatgagaacaa

SEQ ID NO: 1215828 - DNA, 24 bp, Homo sapiens
attctatgttaaatactgtgcaga

SEQ ID NO: 1215829 - DNA, 18 bp, Homo sapiens
attctattacattttcag

SEQ ID NO: 1215830 - DNA, 13 bp, Homo sapiens
attctattctaat

SEQ ID NO: 1215831 - DNA, 14 bp, Homo sapiens
attctattctaata

SEQ ID NO: 1215832 - DNA, 22 bp, Homo sapiens
attctattgcagttatagaaaa

SEQ ID NO: 1215833 - DNA, 18 bp, Homo sapiens
attctattgtattatttg

SEQ ID NO: 1215834 - DNA, 18 bp, Homo sapiens
attctattttagaataaa

SEQ ID NO: 1215835 - DNA, 21 bp, Homo sapiens
attctcatctgcacccttctt

SEQ ID NO: 1215836 - DNA, 19 bp, Homo sapiens
attctcattaaaagaatat

SEQ ID NO: 1215837 - DNA, 17 bp, Homo sapiens
attctcatttgttctca

SEQ ID NO: 1215838 - DNA, 16 bp, Homo sapiens
attctccacagcaacc

SEQ ID NO: 1215839 - DNA, 21 bp, Homo sapiens
attctccaggggtttacagtg

SEQ ID NO: 1215840 - DNA, 20 bp, Homo sapiens
attctcccaggtaccagctg

SEQ ID NO: 1215841 - DNA, 22 bp, Homo sapiens
attctcccaggtaccagctgcg

SEQ ID NO: 1215842 - DNA, 24 bp, Homo sapiens
attctcccaggtaccagctgcgct

SEQ ID NO: 1215843 - DNA, 14 bp, Homo sapiens
attctccctgacct

SEQ ID NO: 1215844 - DNA, 12 bp, Homo sapiens
attctcctgcca

SEQ ID NO: 1215845 - DNA, 20 bp, Homo sapiens
attctcctgcctcagcctcc

SEQ ID NO: 1215846 - DNA, 23 bp, Homo sapiens
attctcctgcctcagcctcccaa

SEQ ID NO: 1215847 - DNA, 11 bp, Homo sapiens
attctcctgga

SEQ ID NO: 1215848 - DNA, 12 bp, Homo sapiens
attctccttccc

SEQ ID NO: 1215849 - DNA, 16 bp, Homo sapiens
attctccttgtgttac

SEQ ID NO: 1215850 - DNA, 18 bp, Homo sapiens
attctccttgtgttacta

SEQ ID NO: 1215851 - DNA, 19 bp, Homo sapiens
attctccttgtgttactaa

SEQ ID NO: 1215852 - DNA, 18 bp, Homo sapiens
attctccttgttgttggt

SEQ ID NO: 1215853 - DNA, 19 bp, Homo sapiens
attctcgtgagtcatttaa

SEQ ID NO: 1215854 - DNA, 17 bp, Homo sapiens
attctctagtttgatta

SEQ ID NO: 1215855 - DNA, 18 bp, Homo sapiens
attctctagtttgattaa

SEQ ID NO: 1215856 - DNA, 23 bp, Homo sapiens
attctctagtttgattaaattct

SEQ ID NO: 1215857 - DNA, 22 bp, Homo sapiens
attctctatttgaattatttct

SEQ ID NO: 1215858 - DNA, 12 bp, Homo sapiens
attctctctcct

SEQ ID NO: 1215859 - DNA, 17 bp, Homo sapiens
attctctctcctgtcca

SEQ ID NO: 1215860 - DNA, 12 bp, Homo sapiens
attctctcttta

SEQ ID NO: 1215861 - DNA, 13 bp, Homo sapiens
attctctgagctg

SEQ ID NO: 1215862 - DNA, 16 bp, Homo sapiens
attctctgcaatttgt

SEQ ID NO: 1215863 - DNA, 13 bp, Homo sapiens
attctctgtctca

SEQ ID NO: 1215864 - DNA, 14 bp, Homo sapiens
attctctgtctcat

SEQ ID NO: 1215865 - DNA, 11 bp, Homo sapiens
attctctgtgg

SEQ ID NO: 1215866 - DNA, 15 bp, Homo sapiens
attctcttaaataaa

SEQ ID NO: 1215867 - DNA, 21 bp, Homo sapiens
attctcttaatcactactgta

SEQ ID NO: 1215868 - DNA, 14 bp, Homo sapiens
attctcttatccaa

SEQ ID NO: 1215869 - DNA, 21 bp, Homo sapiens
attctctttaaaaaagactga

SEQ ID NO: 1215870 - DNA, 12 bp, Homo sapiens
attctcttttaa

SEQ ID NO: 1215871 - DNA, 17 bp, Homo sapiens
attctgaaaggaaatac

SEQ ID NO: 1215872 - DNA, 18 bp, Homo sapiens
attctgaaaggaaataca

SEQ ID NO: 1215873 - DNA, 22 bp, Homo sapiens
attctgaaatacttttgagtat

SEQ ID NO: 1215874 - DNA, 19 bp, Homo sapiens
attctgaatgcttctaagt

SEQ ID NO: 1215875 - DNA, 22 bp, Homo sapiens
attctgaatgcttctaagtaaa

SEQ ID NO: 1215876 - DNA, 18 bp, Homo sapiens
attctgacatttatattt

SEQ ID NO: 1215877 - DNA, 17 bp, Homo sapiens
attctgacccagggcct

SEQ ID NO: 1215878 - DNA, 12 bp, Homo sapiens
attctgactgtc

SEQ ID NO: 1215879 - DNA, 16 bp, Homo sapiens
attctgacttatgaat

SEQ ID NO: 1215880 - DNA, 22 bp, Homo sapiens
attctgagttttgtgtttgttg

SEQ ID NO: 1215881 - DNA, 13 bp, Homo sapiens
attctgattccac

SEQ ID NO: 1215882 - DNA, 20 bp, Homo sapiens
attctgattcgaatgacact

SEQ ID NO: 1215883 - DNA, 22 bp, Homo sapiens
attctgattcgaatgacactgt

SEQ ID NO: 1215884 - DNA, 14 bp, Homo sapiens
attctgatttcagt

SEQ ID NO: 1215885 - DNA, 19 bp, Homo sapiens
attctgatttcagtttttc

SEQ ID NO: 1215886 - DNA, 20 bp, Homo sapiens
attctgatttcagtttttca

SEQ ID NO: 1215887 - DNA, 23 bp, Homo sapiens
attctgcaagtttctgtttcaaa

SEQ ID NO: 1215888 - DNA, 22 bp, Homo sapiens
attctgcagaactcctccaaag

SEQ ID NO: 1215889 - DNA, 15 bp, Homo sapiens
attctgcagcatgac

SEQ ID NO: 1215890 - DNA, 22 bp, Homo sapiens
attctgcagcatgacctgtgac

SEQ ID NO: 1215891 - DNA, 17 bp, Homo sapiens
attctgcagtaaatctt

SEQ ID NO: 1215892 - DNA, 20 bp, Homo sapiens
attctgcagtaaatctttta

SEQ ID NO: 1215893 - DNA, 21 bp, Homo sapiens
attctgcagtaaatcttttac

SEQ ID NO: 1215894 - DNA, 14 bp, Homo sapiens
attctgcatgtact

SEQ ID NO: 1215895 - DNA, 18 bp, Homo sapiens
attctgcccaaaaatatg

SEQ ID NO: 1215896 - DNA, 19 bp, Homo sapiens
attctgcccaaaaatatgg

SEQ ID NO: 1215897 - DNA, 19 bp, Homo sapiens
attctgccctccttaattt

SEQ ID NO: 1215898 - DNA, 20 bp, Homo sapiens
attctgccgccccctcctga

SEQ ID NO: 1215899 - DNA, 21 bp, Homo sapiens
attctgccgccccctcctgaa

SEQ ID NO: 1215900 - DNA, 22 bp, Homo sapiens
attctgcctacgttctctttaa

SEQ ID NO: 1215901 - DNA, 23 bp, Homo sapiens
attctgcctacgttctctttaaa

SEQ ID NO: 1215902 - DNA, 21 bp, Homo sapiens
attctgcctagagtgtagcct

SEQ ID NO: 1215903 - DNA, 16 bp, Homo sapiens
attctgcctctcctca

SEQ ID NO: 1215904 - DNA, 14 bp, Homo sapiens
attctgcctctctg

SEQ ID NO: 1215905 - DNA, 21 bp, Homo sapiens
attctgcctctctggaaagag

SEQ ID NO: 1215906 - DNA, 14 bp, Homo sapiens
attctgcctgctcc

SEQ ID NO: 1215907 - DNA, 17 bp, Homo sapiens
attctgcctgctccatc

SEQ ID NO: 1215908 - DNA, 21 bp, Homo sapiens
attctgccttggttctggcca

SEQ ID NO: 1215909 - DNA, 22 bp, Homo sapiens
attctgcgtcatgcttgtgtta

SEQ ID NO: 1215910 - DNA, 22 bp, Homo sapiens
attctggaagctgattaaaaca

SEQ ID NO: 1215911 - DNA, 14 bp, Homo sapiens
attctggaaggaat

SEQ ID NO: 1215912 - DNA, 16 bp, Homo sapiens
attctggacagacaga

SEQ ID NO: 1215913 - DNA, 15 bp, Homo sapiens
attctggaccagaga

SEQ ID NO: 1215914 - DNA, 15 bp, Homo sapiens
attctggatctcctg

SEQ ID NO: 1215915 - DNA, 16 bp, Homo sapiens
attctggatctcctgc

SEQ ID NO: 1215916 - DNA, 16 bp, Homo sapiens
attctggatctgaccc

SEQ ID NO: 1215917 - DNA, 19 bp, Homo sapiens
attctggatctgaccctcc

SEQ ID NO: 1215918 - DNA, 23 bp, Homo sapiens
attctggatctgaccctcccagt

SEQ ID NO: 1215919 - DNA, 14 bp, Homo sapiens
attctggcaggacc

SEQ ID NO: 1215920 - DNA, 22 bp, Homo sapiens
attctgggcaccacaaaatata

SEQ ID NO: 1215921 - DNA, 18 bp, Homo sapiens
attctgggcttggggtgt

SEQ ID NO: 1215922 - DNA, 11 bp, Homo sapiens
attctgggtgc

SEQ ID NO: 1215923 - DNA, 15 bp, Homo sapiens
attctggtatacatt

SEQ ID NO: 1215924 - DNA, 19 bp, Homo sapiens
attctggtatacattgaat

SEQ ID NO: 1215925 - DNA, 15 bp, Homo sapiens
attctggtgtttaca

SEQ ID NO: 1215926 - DNA, 19 bp, Homo sapiens
attctggttccagggtccc

SEQ ID NO: 1215927 - DNA, 23 bp, Homo sapiens
attctggttccagggtccctctg

SEQ ID NO: 1215928 - DNA, 12 bp, Homo sapiens
attctgtaaatg

SEQ ID NO: 1215929 - DNA, 18 bp, Homo sapiens
attctgtaattacatatt

SEQ ID NO: 1215930 - DNA, 17 bp, Homo sapiens
attctgtcatagaaagt

SEQ ID NO: 1215931 - DNA, 18 bp, Homo sapiens
attctgtcatagaaagtg

SEQ ID NO: 1215932 - DNA, 22 bp, Homo sapiens
attctgtccatgaagcatacac

SEQ ID NO: 1215933 - DNA, 12 bp, Homo sapiens
attctgtccctg

SEQ ID NO: 1215934 - DNA, 22 bp, Homo sapiens
attctgtccctgtccctgcccc

SEQ ID NO: 1215935 - DNA, 11 bp, Homo sapiens
attctgtcttg

SEQ ID NO: 1215936 - DNA, 21 bp, Homo sapiens
attctgtcttgttcattttga

SEQ ID NO: 1215937 - DNA, 18 bp, Homo sapiens
attctgtgaccaaaatac

SEQ ID NO: 1215938 - DNA, 21 bp, Homo sapiens
attctgtgaccaaaatacctt

SEQ ID NO: 1215939 - DNA, 20 bp, Homo sapiens
attctgtgatcttttaaagt

SEQ ID NO: 1215940 - DNA, 22 bp, Homo sapiens
attctgtgcctccaggaccagg

SEQ ID NO: 1215941 - DNA, 17 bp, Homo sapiens
attctgtggtgggaaca

SEQ ID NO: 1215942 - DNA, 17 bp, Homo sapiens
attctgtggttctataa

SEQ ID NO: 1215943 - DNA, 19 bp, Homo sapiens
attctgtggttctataata

SEQ ID NO: 1215944 - DNA, 14 bp, Homo sapiens
attattcagtgtca

SEQ ID NO: 1215945 - DNA, 18 bp, Homo sapiens
attattcatttaaaatga

SEQ ID NO: 1215946 - DNA, 16 bp, Homo sapiens
attattccaaagttat

SEQ ID NO: 1215947 - DNA, 12 bp, Homo sapiens
attattccctct

SEQ ID NO: 1215948 - DNA, 19 bp, Homo sapiens
attattcctcagattgctg

SEQ ID NO: 1215949 - DNA, 20 bp, Homo sapiens
attattcctcagattgctga

SEQ ID NO: 1215950 - DNA, 13 bp, Homo sapiens
attattcctccag

SEQ ID NO: 1215951 - DNA, 22 bp, Homo sapiens
attattctccactttttcttat

SEQ ID NO: 1215952 - DNA, 22 bp, Homo sapiens
attattctgcctacgttctctt

SEQ ID NO: 1215953 - DNA, 13 bp, Homo sapiens
attattctgtttt

SEQ ID NO: 1215954 - DNA, 15 bp, Homo sapiens
attattgaaatatta

SEQ ID NO: 1215955 - DNA, 21 bp, Homo sapiens
attattgagctctatttcccc

SEQ ID NO: 1215956 - DNA, 12 bp, Homo sapiens
attattgagttc

SEQ ID NO: 1215957 - DNA, 20 bp, Homo sapiens
attattgagttccagttgaa

SEQ ID NO: 1215958 - DNA, 21 bp, Homo sapiens
attattgagttccagttgaag

SEQ ID NO: 1215959 - DNA, 12 bp, Homo sapiens
attattgatgat

SEQ ID NO: 1215960 - DNA, 12 bp, Homo sapiens
attattgcatta

SEQ ID NO: 1215961 - DNA, 20 bp, Homo sapiens
attattggaatataattgtt

SEQ ID NO: 1215962 - DNA, 23 bp, Homo sapiens
attattggttggtgtgaagaaag

SEQ ID NO: 1215963 - DNA, 15 bp, Homo sapiens
attattgtaaacttt

SEQ ID NO: 1215964 - DNA, 17 bp, Homo sapiens
attattgtaaacttttt

SEQ ID NO: 1215965 - DNA, 20 bp, Homo sapiens
attattgtaaactttttcaa

SEQ ID NO: 1215966 - DNA, 22 bp, Homo sapiens
attattgtaaactttttcaatg

SEQ ID NO: 1215967 - DNA, 23 bp, Homo sapiens
attattgtgtgttatttaaatga

SEQ ID NO: 1215968 - DNA, 21 bp, Homo sapiens
attattgttcccctaagtgga

SEQ ID NO: 1215969 - DNA, 22 bp, Homo sapiens
attattgttcccctaagtggat

SEQ ID NO: 1215970 - DNA, 22 bp, Homo sapiens
attatttaaaccgctaaaagaa

SEQ ID NO: 1215971 - DNA, 11 bp, Homo sapiens
attatttaaag

SEQ ID NO: 1215972 - DNA, 16 bp, Homo sapiens
attatttaaataaaat

SEQ ID NO: 1215973 - DNA, 15 bp, Homo sapiens
attatttaattgtcc

SEQ ID NO: 1215974 - DNA, 15 bp, Homo sapiens
attatttaatttgta

SEQ ID NO: 1215975 - DNA, 16 bp, Homo sapiens
attatttaatttgtat

SEQ ID NO: 1215976 - DNA, 14 bp, Homo sapiens
attatttacaagaa

SEQ ID NO: 1215977 - DNA, 16 bp, Homo sapiens
attatttacatcactt

SEQ ID NO: 1215978 - DNA, 12 bp, Homo sapiens
attatttataat

SEQ ID NO: 1215979 - DNA, 22 bp, Homo sapiens
attatttatatggggaatatat

SEQ ID NO: 1215980 - DNA, 23 bp, Homo sapiens
attatttattacttgtgcactta

SEQ ID NO: 1215981 - DNA, 13 bp, Homo sapiens
attatttattatt

SEQ ID NO: 1215982 - DNA, 21 bp, Homo sapiens
attatttattgtattaggaaa

SEQ ID NO: 1215983 - DNA, 20 bp, Homo sapiens
attatttattgttaaattac

SEQ ID NO: 1215984 - DNA, 21 bp, Homo sapiens
attatttcactttagatgctg

SEQ ID NO: 1215985 - DNA, 21 bp, Homo sapiens
attatttctccatcccctccc

SEQ ID NO: 1215986 - DNA, 19 bp, Homo sapiens
attatttctgtatttggct

SEQ ID NO: 1215987 - DNA, 12 bp, Homo sapiens
attatttctgtt

SEQ ID NO: 1215988 - DNA, 21 bp, Homo sapiens
attatttctgttcttacaaat

SEQ ID NO: 1215989 - DNA, 19 bp, Homo sapiens
attgtcagagttctgctct

SEQ ID NO: 1215990 - DNA, 19 bp, Homo sapiens
attgtcagatcgttcattg

SEQ ID NO: 1215991 - DNA, 23 bp, Homo sapiens
attgtcatctttttctagagtta

SEQ ID NO: 1215992 - DNA, 15 bp, Homo sapiens
attgtcattaaaggt

SEQ ID NO: 1215993 - DNA, 14 bp, Homo sapiens
attgtccagctggg

SEQ ID NO: 1215994 - DNA, 19 bp, Homo sapiens
attgtccaggtgaggccca

SEQ ID NO: 1215995 - DNA, 23 bp, Homo sapiens
attgtccagtttgtcttggatat

SEQ ID NO: 1215996 - DNA, 13 bp, Homo sapiens
attgtccttcaga

SEQ ID NO: 1215997 - DNA, 14 bp, Homo sapiens
attgtccttcagag

SEQ ID NO: 1215998 - DNA, 14 bp, Homo sapiens
attgtccttttctc

SEQ ID NO: 1215999 - DNA, 16 bp, Homo sapiens
attgtccttttctccc

SEQ ID NO: 1216000 - DNA, 19 bp, Homo sapiens
attgtcgctatgtgacttg

SEQ ID NO: 1216001 - DNA, 14 bp, Homo sapiens
attgtcgtttttat

SEQ ID NO: 1216002 - DNA, 17 bp, Homo sapiens
attgtctaaaatgtcag

SEQ ID NO: 1216003 - DNA, 20 bp, Homo sapiens
atttaatgcattaaacctgt

SEQ ID NO: 1216004 - DNA, 14 bp, Homo sapiens
atttaatggactgt

SEQ ID NO: 1216005 - DNA, 18 bp, Homo sapiens
atttaatggactgtgaat

SEQ ID NO: 1216006 - DNA, 16 bp, Homo sapiens
atttaatggatatttc

SEQ ID NO: 1216007 - DNA, 18 bp, Homo sapiens
atttaatggatatttctc

SEQ ID NO: 1216008 - DNA, 22 bp, Homo sapiens
atttaatggcagctagtgcctt

SEQ ID NO: 1216009 - DNA, 13 bp, Homo sapiens
atttaatgtatta

SEQ ID NO: 1216010 - DNA, 21 bp, Homo sapiens
atttaatgtattaatctgttt

SEQ ID NO: 1216011 - DNA, 19 bp, Homo sapiens
atttaatgttttaaatgta

SEQ ID NO: 1216012 - DNA, 16 bp, Homo sapiens
atttaatgttttctgc

SEQ ID NO: 1216013 - DNA, 21 bp, Homo sapiens
atttaatgttttctgctgttt

SEQ ID NO: 1216014 - DNA, 14 bp, Homo sapiens
atttaattaaagca

SEQ ID NO: 1216015 - DNA, 15 bp, Homo sapiens
atttaattcatgttt

SEQ ID NO: 1216016 - DNA, 17 bp, Homo sapiens
atttaattcatgtttct

SEQ ID NO: 1216017 - DNA, 18 bp, Homo sapiens
atttaattcctcttttta

SEQ ID NO: 1216018 - DNA, 21 bp, Homo sapiens
atttaattcttcacctttgta

SEQ ID NO: 1216019 - DNA, 14 bp, Homo sapiens
atttaattgctttg

SEQ ID NO: 1216020 - DNA, 15 bp, Homo sapiens
atttaattgctttga

SEQ ID NO: 1216021 - DNA, 16 bp, Homo sapiens
atttaattgctttgaa

SEQ ID NO: 1216022 - DNA, 13 bp, Homo sapiens
atttaatttccag

SEQ ID NO: 1216023 - DNA, 20 bp, Homo sapiens
atttaatttcttcatgtgat

SEQ ID NO: 1216024 - DNA, 12 bp, Homo sapiens
atttaatttgta

SEQ ID NO: 1216025 - DNA, 22 bp, Homo sapiens
atttaatttgtatgctaaatga

SEQ ID NO: 1216026 - DNA, 20 bp, Homo sapiens
atttacaaaaatataaaata

SEQ ID NO: 1216027 - DNA, 15 bp, Homo sapiens
atttacaaactgaag

SEQ ID NO: 1216028 - DNA, 14 bp, Homo sapiens
atttacaaagtgtg

SEQ ID NO: 1216029 - DNA, 14 bp, Homo sapiens
atttgactaatttt

SEQ ID NO: 1216030 - DNA, 15 bp, Homo sapiens
atttgactaatttta

SEQ ID NO: 1216031 - DNA, 19 bp, Homo sapiens
atttgactctttcaaagaa

SEQ ID NO: 1216032 - DNA, 16 bp, Homo sapiens
atttgacttgtggttg

SEQ ID NO: 1216033 - DNA, 18 bp, Homo sapiens
atttgactttaatttatg

SEQ ID NO: 1216034 - DNA, 11 bp, Homo sapiens
atttgagaaaa

SEQ ID NO: 1216035 - DNA, 19 bp, Homo sapiens
atttgagaaaataaagcta

SEQ ID NO: 1216036 - DNA, 14 bp, Homo sapiens
atttgagaaaatat

SEQ ID NO: 1216037 - DNA, 18 bp, Homo sapiens
atttgagaatacataaac

SEQ ID NO: 1216038 - DNA, 20 bp, Homo sapiens
atttgagaatacataaacaa

SEQ ID NO: 1216039 - DNA, 14 bp, Homo sapiens
atttgagaatataa

SEQ ID NO: 1216040 - DNA, 14 bp, Homo sapiens
atttgagactgaaa

SEQ ID NO: 1216041 - DNA, 18 bp, Homo sapiens
atttgagagaaatatgaa

SEQ ID NO: 1216042 - DNA, 16 bp, Homo sapiens
atttgagcaagtaaca

SEQ ID NO: 1216043 - DNA, 15 bp, Homo sapiens
atttgagcatgcaca

SEQ ID NO: 1216044 - DNA, 20 bp, Homo sapiens
atttgaggaagctctccctt

SEQ ID NO: 1216045 - DNA, 12 bp, Homo sapiens
atttgaggagac

SEQ ID NO: 1216046 - DNA, 17 bp, Homo sapiens
atttgagggcccagcca

SEQ ID NO: 1216047 - DNA, 19 bp, Homo sapiens
atttgagggcccagccagg

SEQ ID NO: 1216048 - DNA, 22 bp, Homo sapiens
atttgaggggaaaacaccataa

SEQ ID NO: 1216049 - DNA, 15 bp, Homo sapiens
atttgaggtctgttc

SEQ ID NO: 1216050 - DNA, 17 bp, Homo sapiens
atttgaggtctgttctt

SEQ ID NO: 1216051 - DNA, 22 bp, Homo sapiens
atttgaggtctgttctttccaa

SEQ ID NO: 1216052 - DNA, 13 bp, Homo sapiens
atttgaggtgaaa

SEQ ID NO: 1216053 - DNA, 13 bp, Homo sapiens
atttgagtctctt

SEQ ID NO: 1216054 - DNA, 14 bp, Homo sapiens
atttgataaacatt

SEQ ID NO: 1216055 - DNA, 13 bp, Homo sapiens
atttgatacataa

SEQ ID NO: 1216056 - DNA, 15 bp, Homo sapiens
atttgatattatcta

SEQ ID NO: 1216057 - DNA, 16 bp, Homo sapiens
atttgatatttttcca

SEQ ID NO: 1216058 - DNA, 18 bp, Homo sapiens
atttgatatttttccatt

SEQ ID NO: 1216059 - DNA, 17 bp, Homo sapiens
atttgatcgttccagtt

SEQ ID NO: 1216060 - DNA, 14 bp, Homo sapiens
atttgatctttgtt

SEQ ID NO: 1216061 - DNA, 16 bp, Homo sapiens
atttgatgattttcat

SEQ ID NO: 1216062 - DNA, 17 bp, Homo sapiens
atttgatgctggagagg

SEQ ID NO: 1216063 - DNA, 13 bp, Homo sapiens
atttgatgtacat

SEQ ID NO: 1216064 - DNA, 16 bp, Homo sapiens
atttgattaacatttg

SEQ ID NO: 1216065 - DNA, 17 bp, Homo sapiens
atttgattaacatttgt

SEQ ID NO: 1216066 - DNA, 17 bp, Homo sapiens
atttgattcattttcct

SEQ ID NO: 1216067 - DNA, 16 bp, Homo sapiens
atttgattgatttgaa

SEQ ID NO: 1216068 - DNA, 15 bp, Homo sapiens
atttgattgctttgc

SEQ ID NO: 1216069 - DNA, 20 bp, Homo sapiens
atttgattgctttgctgcac

SEQ ID NO: 1216070 - DNA, 13 bp, Homo sapiens
atttgatttccat

SEQ ID NO: 1216071 - DNA, 17 bp, Homo sapiens
atttgatttccatctta

SEQ ID NO: 1216072 - DNA, 14 bp, Homo sapiens
atttgatttctaat

SEQ ID NO: 1216073 - DNA, 20 bp, Homo sapiens
atttgatttctaattgtaag

SEQ ID NO: 1216074 - DNA, 18 bp, Homo sapiens
atttgatttgaaaagtat

SEQ ID NO: 1216075 - DNA, 18 bp, Homo sapiens
atttgatttttgtctcaa

SEQ ID NO: 1216076 - DNA, 20 bp, Homo sapiens
atttgcaaaccctttgtatt

SEQ ID NO: 1216077 - DNA, 21 bp, Homo sapiens
atttgcaaaccctttgtatta

SEQ ID NO: 1216078 - DNA, 21 bp, Homo sapiens
atttgcaacagtaatcagagt

SEQ ID NO: 1216079 - DNA, 20 bp, Homo sapiens
atttgcaagggaaaagtctc

SEQ ID NO: 1216080 - DNA, 23 bp, Homo sapiens
atttgtccttttatttctccatc

SEQ ID NO: 1216081 - DNA, 14 bp, Homo sapiens
atttgtctcctact

SEQ ID NO: 1216082 - DNA, 14 bp, Homo sapiens
atttgtcttccgat

SEQ ID NO: 1216083 - DNA, 23 bp, Homo sapiens
atttgtcttccgatcaacattta

SEQ ID NO: 1216084 - DNA, 15 bp, Homo sapiens
atttgtctttgtaat

SEQ ID NO: 1216085 - DNA, 22 bp, Homo sapiens
atttgtctttttgttgtaaaac

SEQ ID NO: 1216086 - DNA, 23 bp, Homo sapiens
atttgtgaaatgatggtgaaagt

SEQ ID NO: 1216087 - DNA, 15 bp, Homo sapiens
atttgtgacaaaaaa

SEQ ID NO: 1216088 - DNA, 14 bp, Homo sapiens
atttgtgactcttt

SEQ ID NO: 1216089 - DNA, 17 bp, Homo sapiens
atttgtgatacaatgct

SEQ ID NO: 1216090 - DNA, 14 bp, Homo sapiens
atttgtgccagagg

SEQ ID NO: 1216091 - DNA, 12 bp, Homo sapiens
atttgtggaata

SEQ ID NO: 1216092 - DNA, 22 bp, Homo sapiens
atttgtgggaggagtgacatga

SEQ ID NO: 1216093 - DNA, 23 bp, Homo sapiens
atttgtgggaggagtgacatgaa

SEQ ID NO: 1216094 - DNA, 21 bp, Homo sapiens
atttgtggttagaatcttgtt

SEQ ID NO: 1216095 - DNA, 13 bp, Homo sapiens
atttgtgtaatag

SEQ ID NO: 1216096 - DNA, 15 bp, Homo sapiens
atttgtgtgtgtgca

SEQ ID NO: 1216097 - DNA, 21 bp, Homo sapiens
atttgtgtgttctaatgagta

SEQ ID NO: 1216098 - DNA, 22 bp, Homo sapiens
atttgtgtgtttttagctgtga

SEQ ID NO: 1216099 - DNA, 21 bp, Homo sapiens
atttgttaaaattatcaatat

SEQ ID NO: 1216100 - DNA, 15 bp, Homo sapiens
atttgttaaactagc

SEQ ID NO: 1216101 - DNA, 19 bp, Homo sapiens
atttgttaattcctatgaa

SEQ ID NO: 1216102 - DNA, 14 bp, Homo sapiens
atttgttataatga

SEQ ID NO: 1216103 - DNA, 23 bp, Homo sapiens
atttgttcactgaaggtgattca

SEQ ID NO: 1216104 - DNA, 13 bp, Homo sapiens
atttgttcttaca

SEQ ID NO: 1216105 - DNA, 16 bp, Homo sapiens
atttgttcttgtattt

SEQ ID NO: 1216106 - DNA, 17 bp, Homo sapiens
atttgttcttgtattta

SEQ ID NO: 1216107 - DNA, 18 bp, Homo sapiens
atttgttgaaattatgta

SEQ ID NO: 1216108 - DNA, 20 bp, Homo sapiens
atttgttgaaattatgtatg

SEQ ID NO: 1216109 - DNA, 19 bp, Homo sapiens
atttgttgacaaaattttc

SEQ ID NO: 1216110 - DNA, 19 bp, Homo sapiens
atttgttgacagcaaaatg

SEQ ID NO: 1216111 - DNA, 13 bp, Homo sapiens
atttgttgagagt

SEQ ID NO: 1216112 - DNA, 14 bp, Homo sapiens
atttgttggaatga

SEQ ID NO: 1216113 - DNA, 15 bp, Homo sapiens
atttgtttaaaattc

SEQ ID NO: 1216114 - DNA, 20 bp, Homo sapiens
atttgtttaaagaataaagt

SEQ ID NO: 1216115 - DNA, 20 bp, Homo sapiens
atttgtttcatttctgcaga

SEQ ID NO: 1216116 - DNA, 13 bp, Homo sapiens
atttgtttccccc

SEQ ID NO: 1216117 - DNA, 18 bp, Homo sapiens
atttgtttctttctctga

SEQ ID NO: 1216118 - DNA, 22 bp, Homo sapiens
atttgtttgaactgataaagat

SEQ ID NO: 1216119 - DNA, 22 bp, Homo sapiens
atttgtttgtttgttttattca

SEQ ID NO: 1216120 - DNA, 16 bp, Homo sapiens
atttgttttaggtaga

SEQ ID NO: 1216121 - DNA, 13 bp, Homo sapiens
atttgttttcaca

SEQ ID NO: 1216122 - DNA, 18 bp, Homo sapiens
atttgttttgaattttgt

SEQ ID NO: 1216123 - DNA, 13 bp, Homo sapiens
atttgttttgctt

SEQ ID NO: 1216124 - DNA, 16 bp, Homo sapiens
atttgttttggatata

SEQ ID NO: 1216125 - DNA, 20 bp, Homo sapiens
atttgtttttaaactgtaca

SEQ ID NO: 1216126 - DNA, 15 bp, Homo sapiens
attttggtactttta

SEQ ID NO: 1216127 - DNA, 21 bp, Homo sapiens
attttggtgagaaatgggact

SEQ ID NO: 1216128 - DNA, 22 bp, Homo sapiens
attttggtttttcaacactgaa

SEQ ID NO: 1216129 - DNA, 21 bp, Homo sapiens
attttgtaaaatgtattatgt

SEQ ID NO: 1216130 - DNA, 17 bp, Homo sapiens
attttgtaaactcaaaa

SEQ ID NO: 1216131 - DNA, 20 bp, Homo sapiens
attttgtaaactcaaaatat

SEQ ID NO: 1216132 - DNA, 17 bp, Homo sapiens
attttgtaacaaatgaa

SEQ ID NO: 1216133 - DNA, 19 bp, Homo sapiens
attttgtaataataaagaa

SEQ ID NO: 1216134 - DNA, 15 bp, Homo sapiens
attttgtaatattct

SEQ ID NO: 1216135 - DNA, 23 bp, Homo sapiens
attttgtaatgtatcaaatacat

SEQ ID NO: 1216136 - DNA, 15 bp, Homo sapiens
attttgtacatactg

SEQ ID NO: 1216137 - DNA, 16 bp, Homo sapiens
attttgtacatactgt

SEQ ID NO: 1216138 - DNA, 15 bp, Homo sapiens
attttgtagatgtga

SEQ ID NO: 1216139 - DNA, 14 bp, Homo sapiens
attttgtatattgt

SEQ ID NO: 1216140 - DNA, 16 bp, Homo sapiens
attttgtatatttgta

SEQ ID NO: 1216141 - DNA, 17 bp, Homo sapiens
attttgtatgctgaatt

SEQ ID NO: 1216142 - DNA, 18 bp, Homo sapiens
attttgtatgctgaattt

SEQ ID NO: 1216143 - DNA, 19 bp, Homo sapiens
attttgtattacatctaat

SEQ ID NO: 1216144 - DNA, 13 bp, Homo sapiens
caaacaaaactta

SEQ ID NO: 1216145 - DNA, 21 bp, Homo sapiens
caaacaaaagcagccctctgc

SEQ ID NO: 1216146 - DNA, 10 bp, Homo sapiens
caaacaaaca

SEQ ID NO: 1216147 - DNA, 14 bp, Homo sapiens
caaacaaatatgca

SEQ ID NO: 1216148 - DNA, 17 bp, Homo sapiens
caaacaaatatgcaaaa

SEQ ID NO: 1216149 - DNA, 23 bp, Homo sapiens
caaacaaccattttttgttctgt

SEQ ID NO: 1216150 - DNA, 16 bp, Homo sapiens
caaacaacctgaatct

SEQ ID NO: 1216151 - DNA, 15 bp, Homo sapiens
caaacaacttcagaa

SEQ ID NO: 1216152 - DNA, 18 bp, Homo sapiens
caaacaatcccaatcttt

SEQ ID NO: 1216153 - DNA, 19 bp, Homo sapiens
caaacaatcccaatctttc

SEQ ID NO: 1216154 - DNA, 14 bp, Homo sapiens
caaacaatgcaacc

SEQ ID NO: 1216155 - DNA, 21 bp, Homo sapiens
caaacacagttacacttgtgc

SEQ ID NO: 1216156 - DNA, 15 bp, Homo sapiens
caaacacatggggga

SEQ ID NO: 1216157 - DNA, 14 bp, Homo sapiens
caaacacctcccag

SEQ ID NO: 1216158 - DNA, 15 bp, Homo sapiens
caaacacctcccagg

SEQ ID NO: 1216159 - DNA, 14 bp, Homo sapiens
caaacaccttccag

SEQ ID NO: 1216160 - DNA, 21 bp, Homo sapiens
caaacaccttccagctcctgt

SEQ ID NO: 1216161 - DNA, 19 bp, Homo sapiens
caaacactgcagtttcctg

SEQ ID NO: 1216162 - DNA, 18 bp, Homo sapiens
caaacagaaacacaaacg

SEQ ID NO: 1216163 - DNA, 16 bp, Homo sapiens
caaacagaacagggtc

SEQ ID NO: 1216164 - DNA, 13 bp, Homo sapiens
caaacagccacac

SEQ ID NO: 1216165 - DNA, 15 bp, Homo sapiens
caaacaggaacaatc

SEQ ID NO: 1216166 - DNA, 15 bp, Homo sapiens
caaacagtaacgtgt

SEQ ID NO: 1216167 - DNA, 20 bp, Homo sapiens
caaacataaggcacattgtg

SEQ ID NO: 1216168 - DNA, 16 bp, Homo sapiens
caaacatcaaataaat

SEQ ID NO: 1216169 - DNA, 20 bp, Homo sapiens
caaacatcaaataaatttct

SEQ ID NO: 1216170 - DNA, 22 bp, Homo sapiens
caaacatcaaataaatttctgg

SEQ ID NO: 1216171 - DNA, 17 bp, Homo sapiens
caaacatcactctgctg

SEQ ID NO: 1216172 - DNA, 18 bp, Homo sapiens
caaacatcactctgctgc

SEQ ID NO: 1216173 - DNA, 22 bp, Homo sapiens
caaacatcagacctgtcttcca

SEQ ID NO: 1216174 - DNA, 20 bp, Homo sapiens
caaacatggatacttcctgg

SEQ ID NO: 1216175 - DNA, 22 bp, Homo sapiens
caaacatggatacttcctgggt

SEQ ID NO: 1216176 - DNA, 18 bp, Homo sapiens
caaacattttctggccag

SEQ ID NO: 1216177 - DNA, 23 bp, Homo sapiens
caaacattttctggccagtgttt

SEQ ID NO: 1216178 - DNA, 13 bp, Homo sapiens
caaaccaaagctg

SEQ ID NO: 1216179 - DNA, 16 bp, Homo sapiens
caaaccaaagctgcct

SEQ ID NO: 1216180 - DNA, 20 bp, Homo sapiens
caaaccaaagctgcctgtgc

SEQ ID NO: 1216181 - DNA, 11 bp, Homo sapiens
caaaccaagaa

SEQ ID NO: 1216182 - DNA, 18 bp, Homo sapiens
caaaccaatacagaattg

SEQ ID NO: 1216183 - DNA, 22 bp, Homo sapiens
caaaccaatggtgatcctctat

SEQ ID NO: 1216184 - DNA, 14 bp, Homo sapiens
caaaccacagcagg

SEQ ID NO: 1216185 - DNA, 22 bp, Homo sapiens
caaaccaccaggactgaaagaa

SEQ ID NO: 1216186 - DNA, 12 bp, Homo sapiens
caaaccagcctt

SEQ ID NO: 1216187 - DNA, 14 bp, Homo sapiens
caaaccagcttcat

SEQ ID NO: 1216188 - DNA, 13 bp, Homo sapiens
caaaccaggtcac

SEQ ID NO: 1216189 - DNA, 21 bp, Homo sapiens
caaaccaggtcaccatcctca

SEQ ID NO: 1216190 - DNA, 18 bp, Homo sapiens
caaaccagtttattctgt

SEQ ID NO: 1216191 - DNA, 22 bp, Homo sapiens
caaaccagtttattctgtggtt

SEQ ID NO: 1216192 - DNA, 16 bp, Homo sapiens
caaaccatgagaattt

SEQ ID NO: 1216193 - DNA, 14 bp, Homo sapiens
caaaccattactga

SEQ ID NO: 1216194 - DNA, 14 bp, Homo sapiens
caaaccattgctct

SEQ ID NO: 1216195 - DNA, 23 bp, Homo sapiens
caaaccattgctcttagtcccaa

SEQ ID NO: 1216196 - DNA, 21 bp, Homo sapiens
caaacccacctgctagtgtga

SEQ ID NO: 1216197 - DNA, 23 bp, Homo sapiens
caaacccacgattttctccagct

SEQ ID NO: 1216198 - DNA, 24 bp, Homo sapiens
caaacccacgattttctccagctc

SEQ ID NO: 1216199 - DNA, 19 bp, Homo sapiens
caaacccagacaaccaaaa

SEQ ID NO: 1216200 - DNA, 20 bp, Homo sapiens
caaacccagacaaccaaaac

SEQ ID NO: 1216201 - DNA, 12 bp, Homo sapiens
caaacccagcca

SEQ ID NO: 1216202 - DNA, 17 bp, Homo sapiens
caaacccagccactgcc

SEQ ID NO: 1216203 - DNA, 22 bp, Homo sapiens
caaacccagtctcctctccatt

SEQ ID NO: 1216204 - DNA, 13 bp, Homo sapiens
caaaccccagccc

SEQ ID NO: 1216205 - DNA, 15 bp, Homo sapiens
caaaccctagccttg

SEQ ID NO: 1216206 - DNA, 20 bp, Homo sapiens
caaaccctagccttgcttgt

SEQ ID NO: 1216207 - DNA, 13 bp, Homo sapiens
caaaccctgtggg

SEQ ID NO: 1216208 - DNA, 23 bp, Homo sapiens
caaacccttaactgacatgggcc

SEQ ID NO: 1216209 - DNA, 13 bp, Homo sapiens
caaacccttcaac

SEQ ID NO: 1216210 - DNA, 19 bp, Homo sapiens
caaacccttcaactcctgg

SEQ ID NO: 1216211 - DNA, 21 bp, Homo sapiens
caaacccttcaactcctggct

SEQ ID NO: 1216212 - DNA, 22 bp, Homo sapiens
caaacccttgctttcctgggcc

SEQ ID NO: 1216213 - DNA, 13 bp, Homo sapiens
caaacctactgcc

SEQ ID NO: 1216214 - DNA, 19 bp, Homo sapiens
caaacctactgcccacatt

SEQ ID NO: 1216215 - DNA, 20 bp, Homo sapiens
caaacctactgcccacattt

SEQ ID NO: 1216216 - DNA, 22 bp, Homo sapiens
caaacctactgcccacatttgg

SEQ ID NO: 1216217 - DNA, 16 bp, Homo sapiens
caaacctcactgagag

SEQ ID NO: 1216218 - DNA, 19 bp, Homo sapiens
caaacctgacccctgctca

SEQ ID NO: 1216219 - DNA, 19 bp, Homo sapiens
caaacctgtcttggggcca

SEQ ID NO: 1216220 - DNA, 17 bp, Homo sapiens
caaacctttctggcctg

SEQ ID NO: 1216221 - DNA, 16 bp, Homo sapiens
caaacgacagaggagc

SEQ ID NO: 1216222 - DNA, 17 bp, Homo sapiens
caaacgcctagattgct

SEQ ID NO: 1216223 - DNA, 14 bp, Homo sapiens
caaacgcctcccct

SEQ ID NO: 1216224 - DNA, 21 bp, Homo sapiens
caaacgctaaagagcccttgc

SEQ ID NO: 1216225 - DNA, 13 bp, Homo sapiens
caaacgtgttttt

SEQ ID NO: 1216226 - DNA, 16 bp, Homo sapiens
caaactaaattcaaag

SEQ ID NO: 1216227 - DNA, 16 bp, Homo sapiens
caaactacatgtaatc

SEQ ID NO: 1216228 - DNA, 16 bp, Homo sapiens
caaactactgaatgaa

SEQ ID NO: 1216229 - DNA, 21 bp, Homo sapiens
caaactactgaatgaagcagt

SEQ ID NO: 1216230 - DNA, 23 bp, Homo sapiens
caaactactgaatgaagcagtat

SEQ ID NO: 1216231 - DNA, 16 bp, Homo sapiens
caaactactgtacatt

SEQ ID NO: 1216232 - DNA, 11 bp, Homo sapiens
caaactacttc

SEQ ID NO: 1216233 - DNA, 13 bp, Homo sapiens
caaactagggcca

SEQ ID NO: 1216234 - DNA, 23 bp, Homo sapiens
caaactcaatgctttatttgtaa

SEQ ID NO: 1216235 - DNA, 15 bp, Homo sapiens
caaactcagatcctt

SEQ ID NO: 1216236 - DNA, 16 bp, Homo sapiens
caaactccccttccct

SEQ ID NO: 1216237 - DNA, 19 bp, Homo sapiens
caaactccccttccctggg

SEQ ID NO: 1216238 - DNA, 18 bp, Homo sapiens
caaattagaaaatgttat

SEQ ID NO: 1216239 - DNA, 22 bp, Homo sapiens
caaattagaaaatgttatttaa

SEQ ID NO: 1216240 - DNA, 21 bp, Homo sapiens
caaattagaaacaccattcat

SEQ ID NO: 1216241 - DNA, 18 bp, Homo sapiens
caaattagaagacattta

SEQ ID NO: 1216242 - DNA, 19 bp, Homo sapiens
caaattagaagacatttat

SEQ ID NO: 1216243 - DNA, 23 bp, Homo sapiens
caaattagcaggtgcaccttctg

SEQ ID NO: 1216244 - DNA, 17 bp, Homo sapiens
caaattataagggccct

SEQ ID NO: 1216245 - DNA, 22 bp, Homo sapiens
caaattataagggccctgccct

SEQ ID NO: 1216246 - DNA, 16 bp, Homo sapiens
caaattatatgctaat

SEQ ID NO: 1216247 - DNA, 17 bp, Homo sapiens
caaattatatgctaatt

SEQ ID NO: 1216248 - DNA, 23 bp, Homo sapiens
caaattattaattgtcctgtgtc

SEQ ID NO: 1216249 - DNA, 15 bp, Homo sapiens
caaattatttattac

SEQ ID NO: 1216250 - DNA, 16 bp, Homo sapiens
caaattatttattact

SEQ ID NO: 1216251 - DNA, 17 bp, Homo sapiens
caaattatttattactt

SEQ ID NO: 1216252 - DNA, 16 bp, Homo sapiens
caaattatttgtgtaa

SEQ ID NO: 1216253 - DNA, 23 bp, Homo sapiens
caaattattttaatattttgtat

SEQ ID NO: 1216254 - DNA, 23 bp, Homo sapiens
caaattcaaataatccattccaa

SEQ ID NO: 1216255 - DNA, 21 bp, Homo sapiens
caaattcaagagctagaaaaa

SEQ ID NO: 1216256 - DNA, 14 bp, Homo sapiens
caaattcaaggcct

SEQ ID NO: 1216257 - DNA, 15 bp, Homo sapiens
caaattcaaggcctt

SEQ ID NO: 1216258 - DNA, 15 bp, Homo sapiens
caaattcatataaaa

SEQ ID NO: 1216259 - DNA, 16 bp, Homo sapiens
caaattcatattctgt

SEQ ID NO: 1216260 - DNA, 23 bp, Homo sapiens
caaattcatggcatgcttaaatt

SEQ ID NO: 1216261 - DNA, 20 bp, Homo sapiens
caaattctacaacttttcct

SEQ ID NO: 1216262 - DNA, 15 bp, Homo sapiens
caaattcttctgaac

SEQ ID NO: 1216263 - DNA, 18 bp, Homo sapiens
caaattcttttgaattgt

SEQ ID NO: 1216264 - DNA, 21 bp, Homo sapiens
caaattcttttgaattgttac

SEQ ID NO: 1216265 - DNA, 23 bp, Homo sapiens
caaattcttttgaattgttacat

SEQ ID NO: 1216266 - DNA, 22 bp, Homo sapiens
caaattgtatctagtgcagctg

SEQ ID NO: 1216267 - DNA, 17 bp, Homo sapiens
caaattgtcgtttttat

SEQ ID NO: 1216268 - DNA, 18 bp, Homo sapiens
caaattgtcgtttttatt

SEQ ID NO: 1216269 - DNA, 16 bp, Homo sapiens
caaattgtttgtacag

SEQ ID NO: 1216270 - DNA, 12 bp, Homo sapiens
caaatttaaagg

SEQ ID NO: 1216271 - DNA, 17 bp, Homo sapiens
caaatttatatttttta

SEQ ID NO: 1216272 - DNA, 13 bp, Homo sapiens
caaatttatgcat

SEQ ID NO: 1216273 - DNA, 19 bp, Homo sapiens
caaatttatgcatttcatt

SEQ ID NO: 1216274 - DNA, 17 bp, Homo sapiens
caaatttctataaattt

SEQ ID NO: 1216275 - DNA, 21 bp, Homo sapiens
caaatttggccttaagaactg

SEQ ID NO: 1216276 - DNA, 19 bp, Homo sapiens
caaatttgtacaggactgt

SEQ ID NO: 1216277 - DNA, 20 bp, Homo sapiens
caaatttgtacctctaagta

SEQ ID NO: 1216278 - DNA, 15 bp, Homo sapiens
caaattttaaaacat

SEQ ID NO: 1216279 - DNA, 16 bp, Homo sapiens
caaattttaaaagcca

SEQ ID NO: 1216280 - DNA, 17 bp, Homo sapiens
caaattttaatttttgc

SEQ ID NO: 1216281 - DNA, 18 bp, Homo sapiens
caaattttcaagtttaca

SEQ ID NO: 1216282 - DNA, 21 bp, Homo sapiens
caaattttcaagtttacactt

SEQ ID NO: 1216283 - DNA, 21 bp, Homo sapiens
caaattttcactgctgctcct

SEQ ID NO: 1216284 - DNA, 21 bp, Homo sapiens
caaatttttcaaatcattcct

SEQ ID NO: 1216285 - DNA, 21 bp, Homo sapiens
caaatttttttcttaggagca

SEQ ID NO: 1216286 - DNA, 12 bp, Homo sapiens
caacaaaagaat

SEQ ID NO: 1216287 - DNA, 20 bp, Homo sapiens
caacaaaccctctgtagcta

SEQ ID NO: 1216288 - DNA, 17 bp, Homo sapiens
caacaaagcacagtgtt

SEQ ID NO: 1216289 - DNA, 12 bp, Homo sapiens
caacaaaggaag

SEQ ID NO: 1216290 - DNA, 19 bp, Homo sapiens
caacaacctcaactgccta

SEQ ID NO: 1216291 - DNA, 17 bp, Homo sapiens
caacaactattttttaa

SEQ ID NO: 1216292 - DNA, 14 bp, Homo sapiens
caacaagaagaaat

SEQ ID NO: 1216293 - DNA, 15 bp, Homo sapiens
caacaagaagaaata

SEQ ID NO: 1216294 - DNA, 16 bp, Homo sapiens
caacaagaagaaatat

SEQ ID NO: 1216295 - DNA, 18 bp, Homo sapiens
caacaagaccgccccagg

SEQ ID NO: 1216296 - DNA, 16 bp, Homo sapiens
caacaagactgccagg

SEQ ID NO: 1216297 - DNA, 14 bp, Homo sapiens
caacaagagtttat

SEQ ID NO: 1216298 - DNA, 22 bp, Homo sapiens
caacaagcccgttagccccagg

SEQ ID NO: 1216299 - DNA, 22 bp, Homo sapiens
caacaaggaaaaatgccactcc

SEQ ID NO: 1216300 - DNA, 17 bp, Homo sapiens
caacaaggatcaggctg

SEQ ID NO: 1216301 - DNA, 15 bp, Homo sapiens
caacaataaaatttt

SEQ ID NO: 1216302 - DNA, 23 bp, Homo sapiens
caacaataaacaggaattttatt

SEQ ID NO: 1216303 - DNA, 13 bp, Homo sapiens
caacaataacact

SEQ ID NO: 1216304 - DNA, 15 bp, Homo sapiens
caacaattggagggt

SEQ ID NO: 1216305 - DNA, 15 bp, Homo sapiens
caacaattggtaaaa

SEQ ID NO: 1216306 - DNA, 14 bp, Homo sapiens
caacaatttatgaa

SEQ ID NO: 1216307 - DNA, 13 bp, Homo sapiens
caacaatttcaat

SEQ ID NO: 1216308 - DNA, 12 bp, Homo sapiens
caacacaaagag

SEQ ID NO: 1216309 - DNA, 17 bp, Homo sapiens
caacacaagctggaagc

SEQ ID NO: 1216310 - DNA, 22 bp, Homo sapiens
caacacacagatttgagctcag

SEQ ID NO: 1216311 - DNA, 13 bp, Homo sapiens
caacacagatccg

SEQ ID NO: 1216312 - DNA, 16 bp, Homo sapiens
caacacagttgggacc

SEQ ID NO: 1216313 - DNA, 22 bp, Homo sapiens
caacaccaagcacagcagcctg

SEQ ID NO: 1216314 - DNA, 16 bp, Homo sapiens
caacaccacagacaca

SEQ ID NO: 1216315 - DNA, 14 bp, Homo sapiens
caacaccctgcttc

SEQ ID NO: 1216316 - DNA, 16 bp, Homo sapiens
caacaccctgcttctc

SEQ ID NO: 1216317 - DNA, 16 bp, Homo sapiens
caacacctgcctctga

SEQ ID NO: 1216318 - DNA, 13 bp, Homo sapiens
caacaccttcctc

SEQ ID NO: 1216319 - DNA, 14 bp, Homo sapiens
caacaccttcctcc

SEQ ID NO: 1216320 - DNA, 12 bp, Homo sapiens
caacaccttctt

SEQ ID NO: 1216321 - DNA, 14 bp, Homo sapiens
caacaccttcttgg

SEQ ID NO: 1216322 - DNA, 20 bp, Homo sapiens
caacaccttcttggcttctg

SEQ ID NO: 1216323 - DNA, 19 bp, Homo sapiens
caacacgcacctgcctcag

SEQ ID NO: 1216324 - DNA, 22 bp, Homo sapiens
caacactccggtcagcccctgg

SEQ ID NO: 1216325 - DNA, 14 bp, Homo sapiens
caacactcttcttg

SEQ ID NO: 1216326 - DNA, 20 bp, Homo sapiens
caacactcttcttgagcaga

SEQ ID NO: 1216327 - DNA, 15 bp, Homo sapiens
caacactgattcctg

SEQ ID NO: 1216328 - DNA, 18 bp, Homo sapiens
caacactgtgccctggtg

SEQ ID NO: 1216329 - DNA, 23 bp, Homo sapiens
caacactgtgccctggtggagaa

SEQ ID NO: 1216330 - DNA, 17 bp, Homo sapiens
caacacttaagtctcag

SEQ ID NO: 1216331 - DNA, 14 bp, Homo sapiens
caacagaaaaacaa

SEQ ID NO: 1216332 - DNA, 20 bp, Homo sapiens
caacagaaaaacaatcttat

SEQ ID NO: 1216333 - DNA, 14 bp, Homo sapiens
caacagaaaaatgg

SEQ ID NO: 1216334 - DNA, 22 bp, Homo sapiens
caacagaaacctatcctcactg

SEQ ID NO: 1216335 - DNA, 12 bp, Homo sapiens
caacagaagcag

SEQ ID NO: 1216336 - DNA, 17 bp, Homo sapiens
caacagaagcagacttt

SEQ ID NO: 1216337 - DNA, 19 bp, Homo sapiens
caacagaagcatttgtatt

SEQ ID NO: 1216338 - DNA, 15 bp, Homo sapiens
caacagaagcttcca

SEQ ID NO: 1216339 - DNA, 21 bp, Homo sapiens
caacagaagtatcaagccatg

SEQ ID NO: 1216340 - DNA, 16 bp, Homo sapiens
caacagactctcacag

SEQ ID NO: 1216341 - DNA, 18 bp, Homo sapiens
caacagagaaggcaggaa

SEQ ID NO: 1216342 - DNA, 23 bp, Homo sapiens
caacagagtgagaccctgtctct

SEQ ID NO: 1216343 - DNA, 19 bp, Homo sapiens
caacagatgaccgtgtaca

SEQ ID NO: 1216344 - DNA, 21 bp, Homo sapiens
caacagatgaccgtgtacaat

SEQ ID NO: 1216345 - DNA, 23 bp, Homo sapiens
caacagatgcttttctgtctctg

SEQ ID NO: 1216346 - DNA, 17 bp, Homo sapiens
caacagcaaacaggtgc

SEQ ID NO: 1216347 - DNA, 15 bp, Homo sapiens
caacagcaagaaata

SEQ ID NO: 1216348 - DNA, 22 bp, Homo sapiens
caacagcaagaaataaatcaga

SEQ ID NO: 1216349 - DNA, 12 bp, Homo sapiens
caacagcactgg

SEQ ID NO: 1216350 - DNA, 12 bp, Homo sapiens
caacagccctgc

SEQ ID NO: 1216351 - DNA, 16 bp, Homo sapiens
caacagccctgcctga

SEQ ID NO: 1216352 - DNA, 15 bp, Homo sapiens
caacagcttcagaaa

SEQ ID NO: 1216353 - DNA, 18 bp, Homo sapiens
caacagcttttcccagga

SEQ ID NO: 1216354 - DNA, 19 bp, Homo sapiens
caacagcttttcccaggag

SEQ ID NO: 1216355 - DNA, 22 bp, Homo sapiens
caacaggagaatggggttcctg

SEQ ID NO: 1216356 - DNA, 17 bp, Homo sapiens
caacaggcaggggccca

SEQ ID NO: 1216357 - DNA, 17 bp, Homo sapiens
caacaggggaggaaaaa

SEQ ID NO: 1216358 - DNA, 20 bp, Homo sapiens
caacagggtagatttctctt

SEQ ID NO: 1216359 - DNA, 17 bp, Homo sapiens
caacaggtaaaacaggg

SEQ ID NO: 1216360 - DNA, 18 bp, Homo sapiens
caacaggtggcaggacca

SEQ ID NO: 1216361 - DNA, 13 bp, Homo sapiens
caacaggttttat

SEQ ID NO: 1216362 - DNA, 17 bp, Homo sapiens
caacagtaaaccactga

SEQ ID NO: 1216363 - DNA, 18 bp, Homo sapiens
caacagtcaaaacagaga

SEQ ID NO: 1216364 - DNA, 16 bp, Homo sapiens
caacagtgagagactc

SEQ ID NO: 1216365 - DNA, 22 bp, Homo sapiens
caacagttctgagctgtaattt

SEQ ID NO: 1216366 - DNA, 20 bp, Homo sapiens
caacagtttatttttattat

SEQ ID NO: 1216367 - DNA, 22 bp, Homo sapiens
caacagttttttatgctaatca

SEQ ID NO: 1216368 - DNA, 13 bp, Homo sapiens
caacataaaacaa

SEQ ID NO: 1216369 - DNA, 17 bp, Homo sapiens
caacataaaacaaaacc

SEQ ID NO: 1216370 - DNA, 19 bp, Homo sapiens
caacataaaacaaaaccaa

SEQ ID NO: 1216371 - DNA, 20 bp, Homo sapiens
caacataaaacaaaaccaag

SEQ ID NO: 1216372 - DNA, 16 bp, Homo sapiens
caacataatctagttt

SEQ ID NO: 1216373 - DNA, 22 bp, Homo sapiens
caacatagtgagatcccatttc

SEQ ID NO: 1216374 - DNA, 14 bp, Homo sapiens
caacatatagttga

SEQ ID NO: 1216375 - DNA, 16 bp, Homo sapiens
caacatcaatgttcat

SEQ ID NO: 1216376 - DNA, 18 bp, Homo sapiens
caacatcaatgttcattg

SEQ ID NO: 1216377 - DNA, 14 bp, Homo sapiens
caacatcacagccc

SEQ ID NO: 1216378 - DNA, 19 bp, Homo sapiens
caacatcccattgccctgg

SEQ ID NO: 1216379 - DNA, 14 bp, Homo sapiens
caacatcgtggatg

SEQ ID NO: 1216380 - DNA, 21 bp, Homo sapiens
caacatgacatccagagatga

SEQ ID NO: 1216381 - DNA, 20 bp, Homo sapiens
caacatgcctgcacctgcag

SEQ ID NO: 1216382 - DNA, 15 bp, Homo sapiens
caacatggcaattgc

SEQ ID NO: 1216383 - DNA, 22 bp, Homo sapiens
caacatggctgatcattaatta

SEQ ID NO: 1216384 - DNA, 18 bp, Homo sapiens
caacatgggagggatcag

SEQ ID NO: 1216385 - DNA, 18 bp, Homo sapiens
caacatgtggctcctccc

SEQ ID NO: 1216386 - DNA, 21 bp, Homo sapiens
caacatgtggctcctcccagc

SEQ ID NO: 1216387 - DNA, 23 bp, Homo sapiens
caacatgttatttgtaatagatg

SEQ ID NO: 1216388 - DNA, 22 bp, Homo sapiens
caacatgttgggaaacttggct

SEQ ID NO: 1216389 - DNA, 17 bp, Homo sapiens
caacattaaaactcata

SEQ ID NO: 1216390 - DNA, 21 bp, Homo sapiens
caacattaaaactcataatta

SEQ ID NO: 1216391 - DNA, 20 bp, Homo sapiens
caacattaaggaatttgatg

SEQ ID NO: 1216392 - DNA, 16 bp, Homo sapiens
caacattccagggttg

SEQ ID NO: 1216393 - DNA, 11 bp, Homo sapiens
caacattcctt

SEQ ID NO: 1216394 - DNA, 16 bp, Homo sapiens
caacattgtagcctca

SEQ ID NO: 1216395 - DNA, 14 bp, Homo sapiens
caacatttatgacc

SEQ ID NO: 1216396 - DNA, 18 bp, Homo sapiens
caacatttctgtatactg

SEQ ID NO: 1216397 - DNA, 20 bp, Homo sapiens
caacatttctgtatactgta

SEQ ID NO: 1216398 - DNA, 23 bp, Homo sapiens
caacatttcttaaattattttat

SEQ ID NO: 1216399 - DNA, 17 bp, Homo sapiens
caacattttttcccagt

SEQ ID NO: 1216400 - DNA, 16 bp, Homo sapiens
caacatttttttttct

SEQ ID NO: 1216401 - DNA, 17 bp, Homo sapiens
caaccaaccagcagggt

SEQ ID NO: 1216402 - DNA, 16 bp, Homo sapiens
caaccaactgccccag

SEQ ID NO: 1216403 - DNA, 17 bp, Homo sapiens
caaccaactgccccagg

SEQ ID NO: 1216404 - DNA, 23 bp, Homo sapiens
caaccaagatgcaaatgttttga

SEQ ID NO: 1216405 - DNA, 20 bp, Homo sapiens
caaccaatttacactgccat

SEQ ID NO: 1216406 - DNA, 12 bp, Homo sapiens
caaccacagaga

SEQ ID NO: 1216407 - DNA, 14 bp, Homo sapiens
caaccactggtctg

SEQ ID NO: 1216408 - DNA, 23 bp, Homo sapiens
caaccactggtctgtagggattt

SEQ ID NO: 1216409 - DNA, 17 bp, Homo sapiens
caaccactgtaaaatga

SEQ ID NO: 1216410 - DNA, 19 bp, Homo sapiens
caaccactgtaaaatgaaa

SEQ ID NO: 1216411 - DNA, 14 bp, Homo sapiens
caaccactgtgcca

SEQ ID NO: 1216412 - DNA, 18 bp, Homo sapiens
caaccagaaacacccctc

SEQ ID NO: 1216413 - DNA, 19 bp, Homo sapiens
caactgttgattgcaggaa

SEQ ID NO: 1216414 - DNA, 19 bp, Homo sapiens
caactgttggattcagaaa

SEQ ID NO: 1216415 - DNA, 15 bp, Homo sapiens
caacttaacatgggc

SEQ ID NO: 1216416 - DNA, 22 bp, Homo sapiens
caacttaatactcaaatgagta

SEQ ID NO: 1216417 - DNA, 20 bp, Homo sapiens
caacttagatctctcctgca

SEQ ID NO: 1216418 - DNA, 21 bp, Homo sapiens
caacttagatctctcctgcaa

SEQ ID NO: 1216419 - DNA, 15 bp, Homo sapiens
caacttagctcaggt

SEQ ID NO: 1216420 - DNA, 16 bp, Homo sapiens
caacttagctcaggtg

SEQ ID NO: 1216421 - DNA, 15 bp, Homo sapiens
caacttccagaggac

SEQ ID NO: 1216422 - DNA, 19 bp, Homo sapiens
caacttcctcccttacaga

SEQ ID NO: 1216423 - DNA, 14 bp, Homo sapiens
caacttcctctgcc

SEQ ID NO: 1216424 - DNA, 18 bp, Homo sapiens
caacttctatcctttctt

SEQ ID NO: 1216425 - DNA, 13 bp, Homo sapiens
caacttctcccac

SEQ ID NO: 1216426 - DNA, 15 bp, Homo sapiens
caacttctcttgctt

SEQ ID NO: 1216427 - DNA, 19 bp, Homo sapiens
caacttctcttgctttcta

SEQ ID NO: 1216428 - DNA, 22 bp, Homo sapiens
caacttctgcctcccatgctta

SEQ ID NO: 1216429 - DNA, 14 bp, Homo sapiens
caacttctggctcc

SEQ ID NO: 1216430 - DNA, 20 bp, Homo sapiens
caacttctttttattttctt

SEQ ID NO: 1216431 - DNA, 21 bp, Homo sapiens
caacttgaagattgtagcaat

SEQ ID NO: 1216432 - DNA, 18 bp, Homo sapiens
caacttgaaggattgcat

SEQ ID NO: 1216433 - DNA, 21 bp, Homo sapiens
caacttgaaggattgcatcct

SEQ ID NO: 1216434 - DNA, 22 bp, Homo sapiens
caacttgagcctgtgaccttgg

SEQ ID NO: 1216435 - DNA, 13 bp, Homo sapiens
caacttgagggcc

SEQ ID NO: 1216436 - DNA, 19 bp, Homo sapiens
caacttgagggcccagagc

SEQ ID NO: 1216437 - DNA, 20 bp, Homo sapiens
caacttgagggcccagagca

SEQ ID NO: 1216438 - DNA, 22 bp, Homo sapiens
caacttgagggcccagagcagg

SEQ ID NO: 1216439 - DNA, 15 bp, Homo sapiens
caacttgatgtgaaa

SEQ ID NO: 1216440 - DNA, 13 bp, Homo sapiens
caacttggcagct

SEQ ID NO: 1216441 - DNA, 22 bp, Homo sapiens
caacttgtaaatacaccacctc

SEQ ID NO: 1216442 - DNA, 18 bp, Homo sapiens
caacttgtcacccaaagc

SEQ ID NO: 1216443 - DNA, 22 bp, Homo sapiens
caacttgtctttttctggactg

SEQ ID NO: 1216444 - DNA, 22 bp, Homo sapiens
caacttgtgaactccatcattc

SEQ ID NO: 1216445 - DNA, 16 bp, Homo sapiens
caactttaagaggaca

SEQ ID NO: 1216446 - DNA, 12 bp, Homo sapiens
caactttactgt

SEQ ID NO: 1216447 - DNA, 18 bp, Homo sapiens
caactttagctagtatct

SEQ ID NO: 1216448 - DNA, 19 bp, Homo sapiens
caactttagtatttttact

SEQ ID NO: 1216449 - DNA, 14 bp, Homo sapiens
caagggatttgagg

SEQ ID NO: 1216450 - DNA, 17 bp, Homo sapiens
caagggcacattgccca

SEQ ID NO: 1216451 - DNA, 18 bp, Homo sapiens
caagggcacattgcccat

SEQ ID NO: 1216452 - DNA, 15 bp, Homo sapiens
caagggcatcaggca

SEQ ID NO: 1216453 - DNA, 18 bp, Homo sapiens
caagggcatcaggcactg

SEQ ID NO: 1216454 - DNA, 19 bp, Homo sapiens
caagggcatcaggcactgg

SEQ ID NO: 1216455 - DNA, 23 bp, Homo sapiens
caagggcatcaggcactggtggc

SEQ ID NO: 1216456 - DNA, 15 bp, Homo sapiens
caagggcccagagtg

SEQ ID NO: 1216457 - DNA, 15 bp, Homo sapiens
caagggccccagggg

SEQ ID NO: 1216458 - DNA, 17 bp, Homo sapiens
caagggccccaggggca

SEQ ID NO: 1216459 - DNA, 19 bp, Homo sapiens
caagggccccaggggcagc

SEQ ID NO: 1216460 - DNA, 12 bp, Homo sapiens
caagggcctgga

SEQ ID NO: 1216461 - DNA, 12 bp, Homo sapiens
caagggctccag

SEQ ID NO: 1216462 - DNA, 19 bp, Homo sapiens
caagggctccagcatccag

SEQ ID NO: 1216463 - DNA, 12 bp, Homo sapiens
caagggctccta

SEQ ID NO: 1216464 - DNA, 22 bp, Homo sapiens
caagggctggggcggagctggg

SEQ ID NO: 1216465 - DNA, 19 bp, Homo sapiens
caagggcttctgcaccctc

SEQ ID NO: 1216466 - DNA, 20 bp, Homo sapiens
caagggcttctgcaccctcc

SEQ ID NO: 1216467 - DNA, 23 bp, Homo sapiens
caaggggagtcaccttcccttgc

SEQ ID NO: 1216468 - DNA, 15 bp, Homo sapiens
caagggggactgtct

SEQ ID NO: 1216469 - DNA, 14 bp, Homo sapiens
caagggggtgactg

SEQ ID NO: 1216470 - DNA, 17 bp, Homo sapiens
caagggggtgactggaa

SEQ ID NO: 1216471 - DNA, 21 bp, Homo sapiens
caagggggtgtcatctgagga

SEQ ID NO: 1216472 - DNA, 21 bp, Homo sapiens
caaggggtgggactggtgggg

SEQ ID NO: 1216473 - DNA, 16 bp, Homo sapiens
caagggtctagggaga

SEQ ID NO: 1216474 - DNA, 17 bp, Homo sapiens
caagggtctagggagag

SEQ ID NO: 1216475 - DNA, 14 bp, Homo sapiens
caagggtgcctcag

SEQ ID NO: 1216476 - DNA, 16 bp, Homo sapiens
caagggtgcctcagga

SEQ ID NO: 1216477 - DNA, 17 bp, Homo sapiens
caagggtggcaggtcac

SEQ ID NO: 1216478 - DNA, 16 bp, Homo sapiens
caagggtggcatccca

SEQ ID NO: 1216479 - DNA, 16 bp, Homo sapiens
caagggttaaggcctg

SEQ ID NO: 1216480 - DNA, 15 bp, Homo sapiens
caagggttctttcct

SEQ ID NO: 1216481 - DNA, 16 bp, Homo sapiens
caagggttgagagcca

SEQ ID NO: 1216482 - DNA, 15 bp, Homo sapiens
caagggttgcttctg

SEQ ID NO: 1216483 - DNA, 22 bp, Homo sapiens
caagggtttcgactggtccagc

SEQ ID NO: 1216484 - DNA, 23 bp, Homo sapiens
caaggtaattgttttttaaagca

SEQ ID NO: 1216485 - DNA, 14 bp, Homo sapiens
caaggtaggctgca

SEQ ID NO: 1216486 - DNA, 17 bp, Homo sapiens
caaggtatttctccagt

SEQ ID NO: 1216487 - DNA, 19 bp, Homo sapiens
caaggtcactgtttcctgg

SEQ ID NO: 1216488 - DNA, 13 bp, Homo sapiens
caaggtcattttt

SEQ ID NO: 1216489 - DNA, 22 bp, Homo sapiens
caaggtccactccctgctccac

SEQ ID NO: 1216490 - DNA, 23 bp, Homo sapiens
caaggtccactccctgctccacg

SEQ ID NO: 1216491 - DNA, 13 bp, Homo sapiens
caaggtccagtgg

SEQ ID NO: 1216492 - DNA, 14 bp, Homo sapiens
caaggtccccccac

SEQ ID NO: 1216493 - DNA, 17 bp, Homo sapiens
caaggtcccctccacat

SEQ ID NO: 1216494 - DNA, 15 bp, Homo sapiens
caaggtcctctcagt

SEQ ID NO: 1216495 - DNA, 14 bp, Homo sapiens
caaggtcctgctca

SEQ ID NO: 1216496 - DNA, 22 bp, Homo sapiens
caaggtctccttactctgagcc

SEQ ID NO: 1216497 - DNA, 16 bp, Homo sapiens
caaggtcttcagccat

SEQ ID NO: 1216498 - DNA, 19 bp, Homo sapiens
caaggtgaatagcacaggt

SEQ ID NO: 1216499 - DNA, 19 bp, Homo sapiens
caaggtgagaattaagttt

SEQ ID NO: 1216500 - DNA, 15 bp, Homo sapiens
caaggtgcaaatcaa

SEQ ID NO: 1216501 - DNA, 11 bp, Homo sapiens
caaggtgctaa

SEQ ID NO: 1216502 - DNA, 14 bp, Homo sapiens
caaggtgctaacat

SEQ ID NO: 1216503 - DNA, 13 bp, Homo sapiens
caaggtgctcaca

SEQ ID NO: 1216504 - DNA, 21 bp, Homo sapiens
caaggtgctcttgaacctgtg

SEQ ID NO: 1216505 - DNA, 19 bp, Homo sapiens
caaggtgctggtgggtctg

SEQ ID NO: 1216506 - DNA, 23 bp, Homo sapiens
caaggtgctggtgggtctgagct

SEQ ID NO: 1216507 - DNA, 14 bp, Homo sapiens
caaggtggagggaa

SEQ ID NO: 1216508 - DNA, 21 bp, Homo sapiens
caaggtggcagatgtcttccc

SEQ ID NO: 1216509 - DNA, 20 bp, Homo sapiens
caaggtggcctctgcctggg

SEQ ID NO: 1216510 - DNA, 20 bp, Homo sapiens
caaggtgggctgagccctgg

SEQ ID NO: 1216511 - DNA, 18 bp, Homo sapiens
caaggtgtccagggtcct

SEQ ID NO: 1216512 - DNA, 12 bp, Homo sapiens
caaggtgtggaa

SEQ ID NO: 1216513 - DNA, 21 bp, Homo sapiens
caaggtgtttccatttctcaa

SEQ ID NO: 1216514 - DNA, 19 bp, Homo sapiens
caaggttactcagcagcag

SEQ ID NO: 1216515 - DNA, 22 bp, Homo sapiens
caaggttactcagcagcagaga

SEQ ID NO: 1216516 - DNA, 17 bp, Homo sapiens
caaggttataatttttt

SEQ ID NO: 1216517 - DNA, 21 bp, Homo sapiens
caaggttccagaggccctagg

SEQ ID NO: 1216518 - DNA, 19 bp, Homo sapiens
caaggttccctctgagaat

SEQ ID NO: 1216519 - DNA, 15 bp, Homo sapiens
caaggttctccaaca

SEQ ID NO: 1216520 - DNA, 19 bp, Homo sapiens
caaggttggcaccccagct

SEQ ID NO: 1216521 - DNA, 20 bp, Homo sapiens
caaggtttaggctggtggcc

SEQ ID NO: 1216522 - DNA, 23 bp, Homo sapiens
caaggtttaggctggtggcccag

SEQ ID NO: 1216523 - DNA, 14 bp, Homo sapiens
caaggtttataaag

SEQ ID NO: 1216524 - DNA, 19 bp, Homo sapiens
caaggtttataaagcagat

SEQ ID NO: 1216525 - DNA, 19 bp, Homo sapiens
caaggttttataaggctga

SEQ ID NO: 1216526 - DNA, 15 bp, Homo sapiens
caagtaaaaaggcta

SEQ ID NO: 1216527 - DNA, 13 bp, Homo sapiens
caagtaaacattc

SEQ ID NO: 1216528 - DNA, 23 bp, Homo sapiens
caagtaaccaggccccagcctcc

SEQ ID NO: 1216529 - DNA, 15 bp, Homo sapiens
caagtaagaaataat

SEQ ID NO: 1216530 - DNA, 14 bp, Homo sapiens
caagtaagaagaca

SEQ ID NO: 1216531 - DNA, 16 bp, Homo sapiens
caagtaagaagacatg

SEQ ID NO: 1216532 - DNA, 13 bp, Homo sapiens
caagtaatattat

SEQ ID NO: 1216533 - DNA, 11 bp, Homo sapiens
caagtaattgt

SEQ ID NO: 1216534 - DNA, 18 bp, Homo sapiens
caagtaccaatgctgttg

SEQ ID NO: 1216535 - DNA, 13 bp, Homo sapiens
caagtactgctgt

SEQ ID NO: 1216536 - DNA, 14 bp, Homo sapiens
caagtactgctgta

SEQ ID NO: 1216537 - DNA, 16 bp, Homo sapiens
caagtactgctgtaaa

SEQ ID NO: 1216538 - DNA, 17 bp, Homo sapiens
caagtactgttttgaag

SEQ ID NO: 1216539 - DNA, 15 bp, Homo sapiens
caagtagaaaagcag

SEQ ID NO: 1216540 - DNA, 17 bp, Homo sapiens
caagtagataaatattt

SEQ ID NO: 1216541 - DNA, 17 bp, Homo sapiens
caagtagctttccacat

SEQ ID NO: 1216542 - DNA, 13 bp, Homo sapiens
caagtatagaaaa

SEQ ID NO: 1216543 - DNA, 15 bp, Homo sapiens
caagtatagaaaatc

SEQ ID NO: 1216544 - DNA, 19 bp, Homo sapiens
caagtatatgtgaaaaaaa

SEQ ID NO: 1216545 - DNA, 16 bp, Homo sapiens
caagtatgaataaaga

SEQ ID NO: 1216546 - DNA, 19 bp, Homo sapiens
caagtatgaataaagacac

SEQ ID NO: 1216547 - DNA, 21 bp, Homo sapiens
caagtatgaataaagacacct

SEQ ID NO: 1216548 - DNA, 18 bp, Homo sapiens
caagtatgccttaagcag

SEQ ID NO: 1216549 - DNA, 17 bp, Homo sapiens
caagtatgttttagcat

SEQ ID NO: 1216550 - DNA, 17 bp, Homo sapiens
caagtattactaaattg

SEQ ID NO: 1216551 - DNA, 19 bp, Homo sapiens
caagtattactaaattgac

SEQ ID NO: 1216552 - DNA, 23 bp, Homo sapiens
caagtattactaaattgaccttt

SEQ ID NO: 1216553 - DNA, 13 bp, Homo sapiens
caagtattatacc

SEQ ID NO: 1216554 - DNA, 20 bp, Homo sapiens
caagtatttattattgaaga

SEQ ID NO: 1216555 - DNA, 16 bp, Homo sapiens
caagtatttgttaatt

SEQ ID NO: 1216556 - DNA, 19 bp, Homo sapiens
caagtatttgttaatttag

SEQ ID NO: 1216557 - DNA, 20 bp, Homo sapiens
caagtatttgttaatttaga

SEQ ID NO: 1216558 - DNA, 22 bp, Homo sapiens
caagtatttgttaatttagaaa

SEQ ID NO: 1216559 - DNA, 11 bp, Homo sapiens
caagtattttt

SEQ ID NO: 1216560 - DNA, 17 bp, Homo sapiens
caagtcaacactcttct

SEQ ID NO: 1216561 - DNA, 20 bp, Homo sapiens
caagtcaacactcttcttga

SEQ ID NO: 1216562 - DNA, 13 bp, Homo sapiens
caagtcaagtgaa

SEQ ID NO: 1216563 - DNA, 13 bp, Homo sapiens
caagtcacagctg

SEQ ID NO: 1216564 - DNA, 14 bp, Homo sapiens
caagtcacagctgc

SEQ ID NO: 1216565 - DNA, 18 bp, Homo sapiens
caagtcacagctgcagct

SEQ ID NO: 1216566 - DNA, 20 bp, Homo sapiens
caagtcacagctgcagctgg

SEQ ID NO: 1216567 - DNA, 22 bp, Homo sapiens
caagtcacagctgcagctgggc

SEQ ID NO: 1216568 - DNA, 18 bp, Homo sapiens
caagtcacatgcgtaaac

SEQ ID NO: 1216569 - DNA, 15 bp, Homo sapiens
caagtcagctccagc

SEQ ID NO: 1216570 - DNA, 16 bp, Homo sapiens
caagtcagctccagct

SEQ ID NO: 1216571 - DNA, 19 bp, Homo sapiens
caagtcaggccaggtgggc

SEQ ID NO: 1216572 - DNA, 18 bp, Homo sapiens
caagtcatagccataaat

SEQ ID NO: 1216573 - DNA, 17 bp, Homo sapiens
caagtcatgtgcatttc

SEQ ID NO: 1216574 - DNA, 13 bp, Homo sapiens
caagtcattgttt

SEQ ID NO: 1216575 - DNA, 23 bp, Homo sapiens
caagtcatttccgtcccccccca

SEQ ID NO: 1216576 - DNA, 17 bp, Homo sapiens
caagtcattttaacttt

SEQ ID NO: 1216577 - DNA, 13 bp, Homo sapiens
caagtccaacctg

SEQ ID NO: 1216578 - DNA, 20 bp, Homo sapiens
caagtccaacctgcctgtgc

SEQ ID NO: 1216579 - DNA, 16 bp, Homo sapiens
caagtccactgtcctc

SEQ ID NO: 1216580 - DNA, 22 bp, Homo sapiens
caagtccactgtcctccttggc

SEQ ID NO: 1216581 - DNA, 22 bp, Homo sapiens
caagtccagctgggaagccctt

SEQ ID NO: 1216582 - DNA, 18 bp, Homo sapiens
caagtcccagacaaggag

SEQ ID NO: 1216583 - DNA, 17 bp, Homo sapiens
caagtcccatcatagaa

SEQ ID NO: 1216584 - DNA, 14 bp, Homo sapiens
caagtccccaagat

SEQ ID NO: 1216585 - DNA, 11 bp, Homo sapiens
caagtccctgt

SEQ ID NO: 1216586 - DNA, 20 bp, Homo sapiens
caagtccctgtaattgttgt

SEQ ID NO: 1216587 - DNA, 23 bp, Homo sapiens
caatacagtgaaggtctttgtta

SEQ ID NO: 1216588 - DNA, 13 bp, Homo sapiens
caataccactggt

SEQ ID NO: 1216589 - DNA, 21 bp, Homo sapiens
caataccctagaagaaaaccc

SEQ ID NO: 1216590 - DNA, 16 bp, Homo sapiens
caataccgctcagtat

SEQ ID NO: 1216591 - DNA, 14 bp, Homo sapiens
caatacctgtacta

SEQ ID NO: 1216592 - DNA, 17 bp, Homo sapiens
caataccttttttttca

SEQ ID NO: 1216593 - DNA, 21 bp, Homo sapiens
caatacgggagtgacccagct

SEQ ID NO: 1216594 - DNA, 22 bp, Homo sapiens
caatactaagaataacaagaag

SEQ ID NO: 1216595 - DNA, 18 bp, Homo sapiens
caatactccctttaaaga

SEQ ID NO: 1216596 - DNA, 18 bp, Homo sapiens
caatactcttgaaatgta

SEQ ID NO: 1216597 - DNA, 13 bp, Homo sapiens
caatactgagcca

SEQ ID NO: 1216598 - DNA, 18 bp, Homo sapiens
caatacttgaatatggaa

SEQ ID NO: 1216599 - DNA, 20 bp, Homo sapiens
cacacttcaggctcttctcc

SEQ ID NO: 1216600 - DNA, 15 bp, Homo sapiens
cacacttcccacccc

SEQ ID NO: 1216601 - DNA, 20 bp, Homo sapiens
cacacttcccacccccaggc

SEQ ID NO: 1216602 - DNA, 18 bp, Homo sapiens
cacacttccccatctttg

SEQ ID NO: 1216603 - DNA, 13 bp, Homo sapiens
cacacttcctgtc

SEQ ID NO: 1216604 - DNA, 14 bp, Homo sapiens
cacacttcctgtcc

SEQ ID NO: 1216605 - DNA, 16 bp, Homo sapiens
cacacttcctgtccag

SEQ ID NO: 1216606 - DNA, 20 bp, Homo sapiens
cacacttcctgtccagagag

SEQ ID NO: 1216607 - DNA, 22 bp, Homo sapiens
cacacttgtacccacaggtgag

SEQ ID NO: 1216608 - DNA, 22 bp, Homo sapiens
cacacttgtaggataagtgaaa

SEQ ID NO: 1216609 - DNA, 19 bp, Homo sapiens
cacacttgtgccagcccgg

SEQ ID NO: 1216610 - DNA, 21 bp, Homo sapiens
cacacttgtgtgtgggctgtg

SEQ ID NO: 1216611 - DNA, 16 bp, Homo sapiens
cacacttgttccagct

SEQ ID NO: 1216612 - DNA, 21 bp, Homo sapiens
cacactttctcttcaatgaaa

SEQ ID NO: 1216613 - DNA, 17 bp, Homo sapiens
cacactttttaagaaat

SEQ ID NO: 1216614 - DNA, 16 bp, Homo sapiens
cacagaaaccaatttt

SEQ ID NO: 1216615 - DNA, 19 bp, Homo sapiens
cacagaaatcagaggagag

SEQ ID NO: 1216616 - DNA, 20 bp, Homo sapiens
cacagaaatcagaggagaga

SEQ ID NO: 1216617 - DNA, 14 bp, Homo sapiens
cacagaaatgctgc

SEQ ID NO: 1216618 - DNA, 18 bp, Homo sapiens
cacagaaatgctgctggc

SEQ ID NO: 1216619 - DNA, 20 bp, Homo sapiens
cacagaaatgctgctggcca

SEQ ID NO: 1216620 - DNA, 21 bp, Homo sapiens
cacagaaatgctgctggccaa

SEQ ID NO: 1216621 - DNA, 22 bp, Homo sapiens
cacagaaccttcaacccagtgg

SEQ ID NO: 1216622 - DNA, 18 bp, Homo sapiens
cacagaagccaggagcaa

SEQ ID NO: 1216623 - DNA, 19 bp, Homo sapiens
cacagaatcatatgattct

SEQ ID NO: 1216624 - DNA, 17 bp, Homo sapiens
cacagaatgctcagggt

SEQ ID NO: 1216625 - DNA, 23 bp, Homo sapiens
cacagaatttgtatgtattttca

SEQ ID NO: 1216626 - DNA, 12 bp, Homo sapiens
cacagacacaca

SEQ ID NO: 1216627 - DNA, 20 bp, Homo sapiens
cacagacacacacacgcacg

SEQ ID NO: 1216628 - DNA, 22 bp, Homo sapiens
cacagacactaacgaaatatca

SEQ ID NO: 1216629 - DNA, 19 bp, Homo sapiens
cacagacatactaaccagc

SEQ ID NO: 1216630 - DNA, 15 bp, Homo sapiens
cacagaccaggcctt

SEQ ID NO: 1216631 - DNA, 22 bp, Homo sapiens
cacagaccccgggtctccttgg

SEQ ID NO: 1216632 - DNA, 13 bp, Homo sapiens
cacagacccctcc

SEQ ID NO: 1216633 - DNA, 17 bp, Homo sapiens
cacagacctctgcttgg

SEQ ID NO: 1216634 - DNA, 13 bp, Homo sapiens
cacagacctgcag

SEQ ID NO: 1216635 - DNA, 23 bp, Homo sapiens
cacagacctgcagtgaggggccc

SEQ ID NO: 1216636 - DNA, 14 bp, Homo sapiens
cacagacctgctct

SEQ ID NO: 1216637 - DNA, 19 bp, Homo sapiens
cacagacctgctctggaca

SEQ ID NO: 1216638 - DNA, 21 bp, Homo sapiens
cacagacctggagcccctggg

SEQ ID NO: 1216639 - DNA, 24 bp, Homo sapiens
cacagacctggagcccctgggtgg

SEQ ID NO: 1216640 - DNA, 18 bp, Homo sapiens
cacagacgggcacacaga

SEQ ID NO: 1216641 - DNA, 21 bp, Homo sapiens
cacagacgttaggcatttcct

SEQ ID NO: 1216642 - DNA, 11 bp, Homo sapiens
cacagactccg

SEQ ID NO: 1216643 - DNA, 15 bp, Homo sapiens
cacagactccggcct

SEQ ID NO: 1216644 - DNA, 18 bp, Homo sapiens
cacagactccggcctgta

SEQ ID NO: 1216645 - DNA, 12 bp, Homo sapiens
cacagactgccc

SEQ ID NO: 1216646 - DNA, 19 bp, Homo sapiens
cacagactgccccagccaa

SEQ ID NO: 1216647 - DNA, 14 bp, Homo sapiens
cacagactggcaat

SEQ ID NO: 1216648 - DNA, 20 bp, Homo sapiens
cacagactggcaataaactc

SEQ ID NO: 1216649 - DNA, 18 bp, Homo sapiens
cacagactgggaacccct

SEQ ID NO: 1216650 - DNA, 18 bp, Homo sapiens
cacagacttctggaaggc

SEQ ID NO: 1216651 - DNA, 20 bp, Homo sapiens
cacagacttctggaaggctg

SEQ ID NO: 1216652 - DNA, 23 bp, Homo sapiens
cacagacttctggaaggctggct

SEQ ID NO: 1216653 - DNA, 18 bp, Homo sapiens
cacagagaaatacaaaat

SEQ ID NO: 1216654 - DNA, 20 bp, Homo sapiens
cacagagaagtttgtagcca

SEQ ID NO: 1216655 - DNA, 18 bp, Homo sapiens
cacagagacggtctggaa

SEQ ID NO: 1216656 - DNA, 18 bp, Homo sapiens
cacagagagacagacttg

SEQ ID NO: 1216657 - DNA, 23 bp, Homo sapiens
cacagagagggacacatgcccct

SEQ ID NO: 1216658 - DNA, 23 bp, Homo sapiens
cacagagagggagagcagagaaa

SEQ ID NO: 1216659 - DNA, 15 bp, Homo sapiens
cacagagcacactta

SEQ ID NO: 1216660 - DNA, 19 bp, Homo sapiens
cacagccaacgagacacat

SEQ ID NO: 1216661 - DNA, 12 bp, Homo sapiens
cacagccacccg

SEQ ID NO: 1216662 - DNA, 12 bp, Homo sapiens
cacagccacctc

SEQ ID NO: 1216663 - DNA, 13 bp, Homo sapiens
cacagccacctcc

SEQ ID NO: 1216664 - DNA, 18 bp, Homo sapiens
cacagccacctccgccag

SEQ ID NO: 1216665 - DNA, 22 bp, Homo sapiens
cacagccacctccgccagaccc

SEQ ID NO: 1216666 - DNA, 17 bp, Homo sapiens
cacagccactaaaacac

SEQ ID NO: 1216667 - DNA, 22 bp, Homo sapiens
cacagccagcccaaaccttggg

SEQ ID NO: 1216668 - DNA, 22 bp, Homo sapiens
cacagcccacggggatcacagc

SEQ ID NO: 1216669 - DNA, 14 bp, Homo sapiens
cacagcccagcccg

SEQ ID NO: 1216670 - DNA, 11 bp, Homo sapiens
cacagcccagg

SEQ ID NO: 1216671 - DNA, 12 bp, Homo sapiens
cacagccctggg

SEQ ID NO: 1216672 - DNA, 14 bp, Homo sapiens
cacagccctgtcag

SEQ ID NO: 1216673 - DNA, 18 bp, Homo sapiens
cacagccctgtcagtgca

SEQ ID NO: 1216674 - DNA, 23 bp, Homo sapiens
cacagccctgtcagtgcagcccg

SEQ ID NO: 1216675 - DNA, 23 bp, Homo sapiens
cacagcccttatgcggttaattt

SEQ ID NO: 1216676 - DNA, 22 bp, Homo sapiens
cacagccgcagcctccctctga

SEQ ID NO: 1216677 - DNA, 21 bp, Homo sapiens
cacagccgcctgaaagccaca

SEQ ID NO: 1216678 - DNA, 13 bp, Homo sapiens
cacagcctccagg

SEQ ID NO: 1216679 - DNA, 14 bp, Homo sapiens
cacagcctcccctg

SEQ ID NO: 1216680 - DNA, 19 bp, Homo sapiens
cacagcctcccctgccagg

SEQ ID NO: 1216681 - DNA, 21 bp, Homo sapiens
cacagcctcccctgccagggc

SEQ ID NO: 1216682 - DNA, 23 bp, Homo sapiens
cacagcctcccctgccagggcag

SEQ ID NO: 1216683 - DNA, 14 bp, Homo sapiens
cacagcctccctga

SEQ ID NO: 1216684 - DNA, 14 bp, Homo sapiens
cacagcctcgggga

SEQ ID NO: 1216685 - DNA, 22 bp, Homo sapiens
cacagcctcggggatggggagg

SEQ ID NO: 1216686 - DNA, 21 bp, Homo sapiens
cacagcctgacacagtgctcg

SEQ ID NO: 1216687 - DNA, 18 bp, Homo sapiens
cacagcctgctggcaggg

SEQ ID NO: 1216688 - DNA, 19 bp, Homo sapiens
cacagcctgctggcagggc

SEQ ID NO: 1216689 - DNA, 20 bp, Homo sapiens
cacagcctgctggcagggcc

SEQ ID NO: 1216690 - DNA, 22 bp, Homo sapiens
cacagcctgctggcagggccag

SEQ ID NO: 1216691 - DNA, 16 bp, Homo sapiens
cacagccttccttctg

SEQ ID NO: 1216692 - DNA, 21 bp, Homo sapiens
cacagccttcggacagacata

SEQ ID NO: 1216693 - DNA, 15 bp, Homo sapiens
cacagcgagcctgtg

SEQ ID NO: 1216694 - DNA, 17 bp, Homo sapiens
cacagcgagcctgtgcc

SEQ ID NO: 1216695 - DNA, 18 bp, Homo sapiens
cacagcgagcctgtgcct

SEQ ID NO: 1216696 - DNA, 22 bp, Homo sapiens
cacagcgagcctgtgccttcct

SEQ ID NO: 1216697 - DNA, 23 bp, Homo sapiens
cacagcgagcctgtgccttcctc

SEQ ID NO: 1216698 - DNA, 16 bp, Homo sapiens
cacagcgagggcagct

SEQ ID NO: 1216699 - DNA, 18 bp, Homo sapiens
cacagcgagggcagctgc

SEQ ID NO: 1216700 - DNA, 20 bp, Homo sapiens
cacagcggaggtgtggagcc

SEQ ID NO: 1216701 - DNA, 21 bp, Homo sapiens
cacagcggagtctgtcctgtg

SEQ ID NO: 1216702 - DNA, 15 bp, Homo sapiens
cacagcgtccctggc

SEQ ID NO: 1216703 - DNA, 14 bp, Homo sapiens
cacagcgtgctggc

SEQ ID NO: 1216704 - DNA, 20 bp, Homo sapiens
cacagcgtgctggcgacact

SEQ ID NO: 1216705 - DNA, 16 bp, Homo sapiens
cacagctactctcccc

SEQ ID NO: 1216706 - DNA, 15 bp, Homo sapiens
cacagctcaggaggc

SEQ ID NO: 1216707 - DNA, 15 bp, Homo sapiens
cacagctccaggaca

SEQ ID NO: 1216708 - DNA, 16 bp, Homo sapiens
cacagctccaggacac

SEQ ID NO: 1216709 - DNA, 14 bp, Homo sapiens
cacagctcccaccc

SEQ ID NO: 1216710 - DNA, 16 bp, Homo sapiens
cacagctcccacccca

SEQ ID NO: 1216711 - DNA, 15 bp, Homo sapiens
cacagctcctcccac

SEQ ID NO: 1216712 - DNA, 17 bp, Homo sapiens
cacagctcctgccaggg

SEQ ID NO: 1216713 - DNA, 21 bp, Homo sapiens
cacagctctccggtctctctc

SEQ ID NO: 1216714 - DNA, 14 bp, Homo sapiens
cacagctctgggcc

SEQ ID NO: 1216715 - DNA, 17 bp, Homo sapiens
cacagctctgggcctct

SEQ ID NO: 1216716 - DNA, 14 bp, Homo sapiens
cacagctgagaggc

SEQ ID NO: 1216717 - DNA, 15 bp, Homo sapiens
cacagctgcagctga

SEQ ID NO: 1216718 - DNA, 18 bp, Homo sapiens
cacagctgcagctgggcc

SEQ ID NO: 1216719 - DNA, 19 bp, Homo sapiens
cacagctgcagctgggccc

SEQ ID NO: 1216720 - DNA, 21 bp, Homo sapiens
cacagctgcagctgggcccca

SEQ ID NO: 1216721 - DNA, 12 bp, Homo sapiens
cacagctgccct

SEQ ID NO: 1216722 - DNA, 15 bp, Homo sapiens
cacagctgccctagc

SEQ ID NO: 1216723 - DNA, 22 bp, Homo sapiens
cacagctgccctagctgacccc

SEQ ID NO: 1216724 - DNA, 16 bp, Homo sapiens
cacagctgccctgctg

SEQ ID NO: 1216725 - DNA, 17 bp, Homo sapiens
cacagctgccctgctgc

SEQ ID NO: 1216726 - DNA, 22 bp, Homo sapiens
cacagctgccctgctgccacag

SEQ ID NO: 1216727 - DNA, 23 bp, Homo sapiens
cacagctgccctgctgccacagc

SEQ ID NO: 1216728 - DNA, 14 bp, Homo sapiens
caccacccagccct

SEQ ID NO: 1216729 - DNA, 15 bp, Homo sapiens
caccacccagccctt

SEQ ID NO: 1216730 - DNA, 17 bp, Homo sapiens
caccaccccctgtccca

SEQ ID NO: 1216731 - DNA, 20 bp, Homo sapiens
caccaccccctgtcccattc

SEQ ID NO: 1216732 - DNA, 14 bp, Homo sapiens
caccacccctacca

SEQ ID NO: 1216733 - DNA, 22 bp, Homo sapiens
caccaccctagtcccttcccct

SEQ ID NO: 1216734 - DNA, 16 bp, Homo sapiens
caccaccctcaggtgc

SEQ ID NO: 1216735 - DNA, 20 bp, Homo sapiens
caccaccctcaggtgcctcc

SEQ ID NO: 1216736 - DNA, 19 bp, Homo sapiens
caccacctatatccagaag

SEQ ID NO: 1216737 - DNA, 17 bp, Homo sapiens
caccacctcactcctgt

SEQ ID NO: 1216738 - DNA, 13 bp, Homo sapiens
caccacctccctc

SEQ ID NO: 1216739 - DNA, 16 bp, Homo sapiens
caccacctctgtgggc

SEQ ID NO: 1216740 - DNA, 13 bp, Homo sapiens
caccaccttccca

SEQ ID NO: 1216741 - DNA, 14 bp, Homo sapiens
caccaccttcccag

SEQ ID NO: 1216742 - DNA, 21 bp, Homo sapiens
caccaccttcccagctctccc

SEQ ID NO: 1216743 - DNA, 16 bp, Homo sapiens
caccacgattctccca

SEQ ID NO: 1216744 - DNA, 15 bp, Homo sapiens
caccacgcagccgcc

SEQ ID NO: 1216745 - DNA, 16 bp, Homo sapiens
caccacggcgtttttt

SEQ ID NO: 1216746 - DNA, 14 bp, Homo sapiens
caccacgtcctggt

SEQ ID NO: 1216747 - DNA, 20 bp, Homo sapiens
caccacgtctgccaggccca

SEQ ID NO: 1216748 - DNA, 19 bp, Homo sapiens
caccactaaccatccccaa

SEQ ID NO: 1216749 - DNA, 16 bp, Homo sapiens
caccactacattctgt

SEQ ID NO: 1216750 - DNA, 18 bp, Homo sapiens
caccactaccagccagcc

SEQ ID NO: 1216751 - DNA, 13 bp, Homo sapiens
caccactagagct

SEQ ID NO: 1216752 - DNA, 11 bp, Homo sapiens
caccactcagg

SEQ ID NO: 1216753 - DNA, 12 bp, Homo sapiens
caccactcaggc

SEQ ID NO: 1216754 - DNA, 16 bp, Homo sapiens
caccactcaggccaca

SEQ ID NO: 1216755 - DNA, 14 bp, Homo sapiens
caccactccactcc

SEQ ID NO: 1216756 - DNA, 17 bp, Homo sapiens
caccactcctctccctt

SEQ ID NO: 1216757 - DNA, 13 bp, Homo sapiens
caccactgcactc

SEQ ID NO: 1216758 - DNA, 17 bp, Homo sapiens
caccactgccctgcctg

SEQ ID NO: 1216759 - DNA, 19 bp, Homo sapiens
caccactgccctgcctgcc

SEQ ID NO: 1216760 - DNA, 20 bp, Homo sapiens
caccactgccctgcctgccc

SEQ ID NO: 1216761 - DNA, 22 bp, Homo sapiens
caccactgccctgcctgcccac

SEQ ID NO: 1216762 - DNA, 14 bp, Homo sapiens
caccactgcctgac

SEQ ID NO: 1216763 - DNA, 13 bp, Homo sapiens
caccactgctgag

SEQ ID NO: 1216764 - DNA, 19 bp, Homo sapiens
caccactgctgaggagtct

SEQ ID NO: 1216765 - DNA, 16 bp, Homo sapiens
caccactgttgccttt

SEQ ID NO: 1216766 - DNA, 16 bp, Homo sapiens
caccagaaattccagt

SEQ ID NO: 1216767 - DNA, 22 bp, Homo sapiens
caccagacccacctggagcccg

SEQ ID NO: 1216768 - DNA, 19 bp, Homo sapiens
caccagactgaagtaaaca

SEQ ID NO: 1216769 - DNA, 18 bp, Homo sapiens
caccagagcaacctctca

SEQ ID NO: 1216770 - DNA, 20 bp, Homo sapiens
caccagagcaacctctcact

SEQ ID NO: 1216771 - DNA, 22 bp, Homo sapiens
caccagagcaacctctcactcc

SEQ ID NO: 1216772 - DNA, 15 bp, Homo sapiens
caccagatgcttttg

SEQ ID NO: 1216773 - DNA, 23 bp, Homo sapiens
caccagatgcttttgtgagaaag

SEQ ID NO: 1216774 - DNA, 14 bp, Homo sapiens
caccagcaacatct

SEQ ID NO: 1216775 - DNA, 15 bp, Homo sapiens
caccagcagcacaat

SEQ ID NO: 1216776 - DNA, 17 bp, Homo sapiens
caccagcagcacaattc

SEQ ID NO: 1216777 - DNA, 23 bp, Homo sapiens
caccagcagcacaattctgtccc

SEQ ID NO: 1216778 - DNA, 14 bp, Homo sapiens
caccagcagcctgg

SEQ ID NO: 1216779 - DNA, 15 bp, Homo sapiens
caccagcattccttt

SEQ ID NO: 1216780 - DNA, 13 bp, Homo sapiens
caccagccagccc

SEQ ID NO: 1216781 - DNA, 17 bp, Homo sapiens
caccagccagccctggc

SEQ ID NO: 1216782 - DNA, 18 bp, Homo sapiens
caccagccagccctggcc

SEQ ID NO: 1216783 - DNA, 12 bp, Homo sapiens
caccagccagcg

SEQ ID NO: 1216784 - DNA, 10 bp, Homo sapiens
caccagcccc

SEQ ID NO: 1216785 - DNA, 18 bp, Homo sapiens
caccagccccactgccag

SEQ ID NO: 1216786 - DNA, 20 bp, Homo sapiens
caccagccccactgccagca

SEQ ID NO: 1216787 - DNA, 21 bp, Homo sapiens
caccagccccactgccagcag

SEQ ID NO: 1216788 - DNA, 14 bp, Homo sapiens
caccagccccagca

SEQ ID NO: 1216789 - DNA, 16 bp, Homo sapiens
caccagccccagcaag

SEQ ID NO: 1216790 - DNA, 18 bp, Homo sapiens
caccagcccccgccccag

SEQ ID NO: 1216791 - DNA, 21 bp, Homo sapiens
caccagcccccgccccagagt

SEQ ID NO: 1216792 - DNA, 22 bp, Homo sapiens
caccagcccccgccccagagtg

SEQ ID NO: 1216793 - DNA, 24 bp, Homo sapiens
caccagccccctggatgggcattg

SEQ ID NO: 1216794 - DNA, 19 bp, Homo sapiens
caccagccccggccttgct

SEQ ID NO: 1216795 - DNA, 14 bp, Homo sapiens
caccagccctactc

SEQ ID NO: 1216796 - DNA, 14 bp, Homo sapiens
caccagccctgcag

SEQ ID NO: 1216797 - DNA, 21 bp, Homo sapiens
caccagccgctgcagggctcc

SEQ ID NO: 1216798 - DNA, 15 bp, Homo sapiens
caccagcctgctgac

SEQ ID NO: 1216799 - DNA, 14 bp, Homo sapiens
caccagcgttccct

SEQ ID NO: 1216800 - DNA, 20 bp, Homo sapiens
caccagcgttcccttctccc

SEQ ID NO: 1216801 - DNA, 22 bp, Homo sapiens
caccagcgttcccttctccccc

SEQ ID NO: 1216802 - DNA, 19 bp, Homo sapiens
caccagcgtttgaggggct

SEQ ID NO: 1216803 - DNA, 11 bp, Homo sapiens
caccagctctg

SEQ ID NO: 1216804 - DNA, 13 bp, Homo sapiens
caccagctctgtg

SEQ ID NO: 1216805 - DNA, 18 bp, Homo sapiens
caccagctctgtggcctg

SEQ ID NO: 1216806 - DNA, 17 bp, Homo sapiens
caccagctgcctcttct

SEQ ID NO: 1216807 - DNA, 14 bp, Homo sapiens
caccagctgctctg

SEQ ID NO: 1216808 - DNA, 17 bp, Homo sapiens
caccagctgctctgccc

SEQ ID NO: 1216809 - DNA, 12 bp, Homo sapiens
caccagctgctg

SEQ ID NO: 1216810 - DNA, 15 bp, Homo sapiens
caccagctgctgtgc

SEQ ID NO: 1216811 - DNA, 16 bp, Homo sapiens
caccagctgctgtgcc

SEQ ID NO: 1216812 - DNA, 18 bp, Homo sapiens
cacccgtcctccctcagc

SEQ ID NO: 1216813 - DNA, 20 bp, Homo sapiens
cacccgtcctccctcagcct

SEQ ID NO: 1216814 - DNA, 23 bp, Homo sapiens
cacccgtcctccctcagcctccc

SEQ ID NO: 1216815 - DNA, 17 bp, Homo sapiens
cacccgtctctctgccc

SEQ ID NO: 1216816 - DNA, 14 bp, Homo sapiens
cacccgtcttcaat

SEQ ID NO: 1216817 - DNA, 18 bp, Homo sapiens
cacccgtggggtgctgcc

SEQ ID NO: 1216818 - DNA, 20 bp, Homo sapiens
cacccgtggggtgctgccct

SEQ ID NO: 1216819 - DNA, 17 bp, Homo sapiens
caccctaagggcagccc

SEQ ID NO: 1216820 - DNA, 19 bp, Homo sapiens
caccctaagggcagccctc

SEQ ID NO: 1216821 - DNA, 20 bp, Homo sapiens
caccctacaaacctgtattt

SEQ ID NO: 1216822 - DNA, 14 bp, Homo sapiens
caccctaccagctc

SEQ ID NO: 1216823 - DNA, 15 bp, Homo sapiens
caccctaccagctcc

SEQ ID NO: 1216824 - DNA, 12 bp, Homo sapiens
caccctacctgt

SEQ ID NO: 1216825 - DNA, 14 bp, Homo sapiens
caccctacctgttc

SEQ ID NO: 1216826 - DNA, 16 bp, Homo sapiens
caccctacctgttcag

SEQ ID NO: 1216827 - DNA, 21 bp, Homo sapiens
caccctacgctcatctctgga

SEQ ID NO: 1216828 - DNA, 15 bp, Homo sapiens
caccctactctggat

SEQ ID NO: 1216829 - DNA, 16 bp, Homo sapiens
caccctagtcccttcc

SEQ ID NO: 1216830 - DNA, 17 bp, Homo sapiens
caccctagtcccttccc

SEQ ID NO: 1216831 - DNA, 14 bp, Homo sapiens
caccctatatataa

SEQ ID NO: 1216832 - DNA, 18 bp, Homo sapiens
caccctcaaaccctgtgg

SEQ ID NO: 1216833 - DNA, 18 bp, Homo sapiens
caccctcaaatgtcagag

SEQ ID NO: 1216834 - DNA, 14 bp, Homo sapiens
caccctcacacaca

SEQ ID NO: 1216835 - DNA, 22 bp, Homo sapiens
caccctcacacacacagctggg

SEQ ID NO: 1216836 - DNA, 12 bp, Homo sapiens
caccctcaccca

SEQ ID NO: 1216837 - DNA, 20 bp, Homo sapiens
caccctcacccactctggtg

SEQ ID NO: 1216838 - DNA, 20 bp, Homo sapiens
caccctcactggctctcctg

SEQ ID NO: 1216839 - DNA, 16 bp, Homo sapiens
caccctcagcacccct

SEQ ID NO: 1216840 - DNA, 18 bp, Homo sapiens
caccctcagcaccccttc

SEQ ID NO: 1216841 - DNA, 19 bp, Homo sapiens
caccctcagcaccccttcc

SEQ ID NO: 1216842 - DNA, 13 bp, Homo sapiens
caccctcagggag

SEQ ID NO: 1216843 - DNA, 14 bp, Homo sapiens
caccctcagggagc

SEQ ID NO: 1216844 - DNA, 15 bp, Homo sapiens
caccctcaggtgcct

SEQ ID NO: 1216845 - DNA, 21 bp, Homo sapiens
caccctcaggtgcctccaatt

SEQ ID NO: 1216846 - DNA, 15 bp, Homo sapiens
caccctcatccttta

SEQ ID NO: 1216847 - DNA, 13 bp, Homo sapiens
caccctcatgaaa

SEQ ID NO: 1216848 - DNA, 13 bp, Homo sapiens
caccctccaccct

SEQ ID NO: 1216849 - DNA, 17 bp, Homo sapiens
caccctccaccgagcca

SEQ ID NO: 1216850 - DNA, 13 bp, Homo sapiens
caccctccacctt

SEQ ID NO: 1216851 - DNA, 15 bp, Homo sapiens
caccctccactcagc

SEQ ID NO: 1216852 - DNA, 18 bp, Homo sapiens
caccctccatgctcctca

SEQ ID NO: 1216853 - DNA, 21 bp, Homo sapiens
caccctccatgctcctcacct

SEQ ID NO: 1216854 - DNA, 23 bp, Homo sapiens
caccctcccctctcttgcacccg

SEQ ID NO: 1216855 - DNA, 10 bp, Homo sapiens
caccctcctc

SEQ ID NO: 1216856 - DNA, 14 bp, Homo sapiens
caccctcctctagc

SEQ ID NO: 1216857 - DNA, 21 bp, Homo sapiens
caccctcctctagccatccct

SEQ ID NO: 1216858 - DNA, 22 bp, Homo sapiens
caccctcctctagccatccctt

SEQ ID NO: 1216859 - DNA, 16 bp, Homo sapiens
caccctcctgtaccgt

SEQ ID NO: 1216860 - DNA, 11 bp, Homo sapiens
caccctccttc

SEQ ID NO: 1216861 - DNA, 15 bp, Homo sapiens
caccctctcctgggg

SEQ ID NO: 1216862 - DNA, 23 bp, Homo sapiens
caccctctgcccagggagtcctt

SEQ ID NO: 1216863 - DNA, 13 bp, Homo sapiens
caccctctgggga

SEQ ID NO: 1216864 - DNA, 13 bp, Homo sapiens
caccctctggtcc

SEQ ID NO: 1216865 - DNA, 16 bp, Homo sapiens
caccctctggtccttc

SEQ ID NO: 1216866 - DNA, 15 bp, Homo sapiens
caccctctgtcccca

SEQ ID NO: 1216867 - DNA, 12 bp, Homo sapiens
caccctgagccc

SEQ ID NO: 1216868 - DNA, 13 bp, Homo sapiens
caccctgcacctg

SEQ ID NO: 1216869 - DNA, 12 bp, Homo sapiens
caccctgcagag

SEQ ID NO: 1216870 - DNA, 13 bp, Homo sapiens
caccctgcagagc

SEQ ID NO: 1216871 - DNA, 19 bp, Homo sapiens
caccctgcattttcctctt

SEQ ID NO: 1216872 - DNA, 17 bp, Homo sapiens
cacctagagctccagtt

SEQ ID NO: 1216873 - DNA, 14 bp, Homo sapiens
cacctagcagcacc

SEQ ID NO: 1216874 - DNA, 17 bp, Homo sapiens
cacctagcagcctcaaa

SEQ ID NO: 1216875 - DNA, 15 bp, Homo sapiens
cacctagccagctgt

SEQ ID NO: 1216876 - DNA, 18 bp, Homo sapiens
cacctaggccactcctcc

SEQ ID NO: 1216877 - DNA, 19 bp, Homo sapiens
cacctaggccactcctcca

SEQ ID NO: 1216878 - DNA, 20 bp, Homo sapiens
cacctagtctgtaactcttt

SEQ ID NO: 1216879 - DNA, 21 bp, Homo sapiens
cacctagttctccccgatggg

SEQ ID NO: 1216880 - DNA, 16 bp, Homo sapiens
cacctatatccagaag

SEQ ID NO: 1216881 - DNA, 19 bp, Homo sapiens
cacctatctcagccatagg

SEQ ID NO: 1216882 - DNA, 21 bp, Homo sapiens
cacctatctcgtgggagagcc

SEQ ID NO: 1216883 - DNA, 20 bp, Homo sapiens
cacctatgagatggccatgc

SEQ ID NO: 1216884 - DNA, 21 bp, Homo sapiens
cacctatgagatggccatgct

SEQ ID NO: 1216885 - DNA, 23 bp, Homo sapiens
cacctatgagatggccatgctca

SEQ ID NO: 1216886 - DNA, 15 bp, Homo sapiens
cacctatgttatttt

SEQ ID NO: 1216887 - DNA, 18 bp, Homo sapiens
cacctcaacccagaggct

SEQ ID NO: 1216888 - DNA, 15 bp, Homo sapiens
cacctcaagaccccc

SEQ ID NO: 1216889 - DNA, 14 bp, Homo sapiens
cacctcacgctctg

SEQ ID NO: 1216890 - DNA, 19 bp, Homo sapiens
cacctcacgctctggacat

SEQ ID NO: 1216891 - DNA, 15 bp, Homo sapiens
cacctcactcctgtt

SEQ ID NO: 1216892 - DNA, 17 bp, Homo sapiens
cacctcagaaagtcacc

SEQ ID NO: 1216893 - DNA, 11 bp, Homo sapiens
cacctcagcct

SEQ ID NO: 1216894 - DNA, 14 bp, Homo sapiens
cacctcagcctccc

SEQ ID NO: 1216895 - DNA, 14 bp, Homo sapiens
cacctcagcctgga

SEQ ID NO: 1216896 - DNA, 17 bp, Homo sapiens
cacctcagcctggagag

SEQ ID NO: 1216897 - DNA, 21 bp, Homo sapiens
cacctcagcctggagaggcct

SEQ ID NO: 1216898 - DNA, 11 bp, Homo sapiens
cacctcagggc

SEQ ID NO: 1216899 - DNA, 12 bp, Homo sapiens
cacctcagggca

SEQ ID NO: 1216900 - DNA, 23 bp, Homo sapiens
cacctcagggcacgcaggaccag

SEQ ID NO: 1216901 - DNA, 14 bp, Homo sapiens
cacctcagtgggaa

SEQ ID NO: 1216902 - DNA, 19 bp, Homo sapiens
cacctcagttcccttggcc

SEQ ID NO: 1216903 - DNA, 21 bp, Homo sapiens
cacctcagttcccttggcctc

SEQ ID NO: 1216904 - DNA, 17 bp, Homo sapiens
cacctcatcactggact

SEQ ID NO: 1216905 - DNA, 15 bp, Homo sapiens
cacctcatgcccacc

SEQ ID NO: 1216906 - DNA, 17 bp, Homo sapiens
cacctcatgcccacccc

SEQ ID NO: 1216907 - DNA, 19 bp, Homo sapiens
cacctccaagcatttcatg

SEQ ID NO: 1216908 - DNA, 11 bp, Homo sapiens
cacctccaccc

SEQ ID NO: 1216909 - DNA, 20 bp, Homo sapiens
cacctccacccagcccctgg

SEQ ID NO: 1216910 - DNA, 13 bp, Homo sapiens
cacctccaccccc

SEQ ID NO: 1216911 - DNA, 19 bp, Homo sapiens
cacctccacccccgccacg

SEQ ID NO: 1216912 - DNA, 21 bp, Homo sapiens
cacctccacccccgccacggc

SEQ ID NO: 1216913 - DNA, 24 bp, Homo sapiens
cacctccacccccgccacggccac

SEQ ID NO: 1216914 - DNA, 11 bp, Homo sapiens
cacctccaggc

SEQ ID NO: 1216915 - DNA, 15 bp, Homo sapiens
cacctccaggcaggc

SEQ ID NO: 1216916 - DNA, 19 bp, Homo sapiens
cacctccaggcaggccagg

SEQ ID NO: 1216917 - DNA, 15 bp, Homo sapiens
cacctccaggcctgt

SEQ ID NO: 1216918 - DNA, 22 bp, Homo sapiens
cacctccaggttcaagtgattc

SEQ ID NO: 1216919 - DNA, 11 bp, Homo sapiens
cacctcccagg

SEQ ID NO: 1216920 - DNA, 12 bp, Homo sapiens
cacctccccaaa

SEQ ID NO: 1216921 - DNA, 14 bp, Homo sapiens
cacctccccaaagc

SEQ ID NO: 1216922 - DNA, 14 bp, Homo sapiens
cacctccccacaca

SEQ ID NO: 1216923 - DNA, 21 bp, Homo sapiens
cacctcccccatctcttctgg

SEQ ID NO: 1216924 - DNA, 16 bp, Homo sapiens
cacctccccccactgc

SEQ ID NO: 1216925 - DNA, 22 bp, Homo sapiens
cacctccccccactgcaggccc

SEQ ID NO: 1216926 - DNA, 14 bp, Homo sapiens
cacctccccctacc

SEQ ID NO: 1216927 - DNA, 20 bp, Homo sapiens
cacctccccctttcacactg

SEQ ID NO: 1216928 - DNA, 22 bp, Homo sapiens
cacctccccctttcacactgga

SEQ ID NO: 1216929 - DNA, 15 bp, Homo sapiens
cacctcccctccttg

SEQ ID NO: 1216930 - DNA, 20 bp, Homo sapiens
cacctccctccccagctccg

SEQ ID NO: 1216931 - DNA, 16 bp, Homo sapiens
cacctccctcccggca

SEQ ID NO: 1216932 - DNA, 17 bp, Homo sapiens
cacctccctctgccagt

SEQ ID NO: 1216933 - DNA, 12 bp, Homo sapiens
cacctccctgcc

SEQ ID NO: 1216934 - DNA, 13 bp, Homo sapiens
cacctccctgcgc

SEQ ID NO: 1216935 - DNA, 13 bp, Homo sapiens
cacctcccttccc

SEQ ID NO: 1216936 - DNA, 13 bp, Homo sapiens
cacctccgccaga

SEQ ID NO: 1216937 - DNA, 16 bp, Homo sapiens
cacctccgccagaccc

SEQ ID NO: 1216938 - DNA, 19 bp, Homo sapiens
cacctccggctgcctagcc

SEQ ID NO: 1216939 - DNA, 19 bp, Homo sapiens
cacctcctaccccttcctg

SEQ ID NO: 1216940 - DNA, 20 bp, Homo sapiens
cacctcctccactcactcca

SEQ ID NO: 1216941 - DNA, 22 bp, Homo sapiens
cacctcctccactcactccagc

SEQ ID NO: 1216942 - DNA, 15 bp, Homo sapiens
cacctcctccccctg

SEQ ID NO: 1216943 - DNA, 14 bp, Homo sapiens
cacctgaaacactg

SEQ ID NO: 1216944 - DNA, 15 bp, Homo sapiens
cacctgaaacactgg

SEQ ID NO: 1216945 - DNA, 19 bp, Homo sapiens
cacctgaaacactggacct

SEQ ID NO: 1216946 - DNA, 20 bp, Homo sapiens
cacctgaaacactggacctg

SEQ ID NO: 1216947 - DNA, 22 bp, Homo sapiens
cacctgaaacactggacctggg

SEQ ID NO: 1216948 - DNA, 20 bp, Homo sapiens
cacctgaaattaatttgtga

SEQ ID NO: 1216949 - DNA, 15 bp, Homo sapiens
cacctgaaccccatg

SEQ ID NO: 1216950 - DNA, 23 bp, Homo sapiens
cacctgaaccccatgggcttgga

SEQ ID NO: 1216951 - DNA, 19 bp, Homo sapiens
cacctgaactgaacaccat

SEQ ID NO: 1216952 - DNA, 17 bp, Homo sapiens
cacctgaatcagctgga

SEQ ID NO: 1216953 - DNA, 17 bp, Homo sapiens
cacctgacaatggcagc

SEQ ID NO: 1216954 - DNA, 18 bp, Homo sapiens
cacctgacaatggcagct

SEQ ID NO: 1216955 - DNA, 21 bp, Homo sapiens
cacctgacaatggcagctaga

SEQ ID NO: 1216956 - DNA, 12 bp, Homo sapiens
cacctgacctct

SEQ ID NO: 1216957 - DNA, 22 bp, Homo sapiens
cacctgacctcttgctgccagc

SEQ ID NO: 1216958 - DNA, 18 bp, Homo sapiens
cacctgacggctggggac

SEQ ID NO: 1216959 - DNA, 15 bp, Homo sapiens
cacctgactctgaaa

SEQ ID NO: 1216960 - DNA, 20 bp, Homo sapiens
cacctgactctgaaatctga

SEQ ID NO: 1216961 - DNA, 20 bp, Homo sapiens
cacctgagaccctgggagag

SEQ ID NO: 1216962 - DNA, 23 bp, Homo sapiens
cacctgagcccggatgcttctcc

SEQ ID NO: 1216963 - DNA, 17 bp, Homo sapiens
cacctgagcgctgtgga

SEQ ID NO: 1216964 - DNA, 18 bp, Homo sapiens
cacctgagcgctgtggac

SEQ ID NO: 1216965 - DNA, 19 bp, Homo sapiens
cacctgaggtgggcccagg

SEQ ID NO: 1216966 - DNA, 18 bp, Homo sapiens
cacctgaggttaggagtt

SEQ ID NO: 1216967 - DNA, 13 bp, Homo sapiens
cacctgcaagccc

SEQ ID NO: 1216968 - DNA, 16 bp, Homo sapiens
cacctgcaagccccag

SEQ ID NO: 1216969 - DNA, 17 bp, Homo sapiens
cacctgcaagccccagg

SEQ ID NO: 1216970 - DNA, 18 bp, Homo sapiens
cacctgcaagccccaggg

SEQ ID NO: 1216971 - DNA, 19 bp, Homo sapiens
cacctgcaagccccagggc

SEQ ID NO: 1216972 - DNA, 20 bp, Homo sapiens
cacctgcaagccccagggcc

SEQ ID NO: 1216973 - DNA, 19 bp, Homo sapiens
cacctgcacctccccccac

SEQ ID NO: 1216974 - DNA, 23 bp, Homo sapiens
cacctgcacttaaggcactctgt

SEQ ID NO: 1216975 - DNA, 12 bp, Homo sapiens
cacctgcagaga

SEQ ID NO: 1216976 - DNA, 17 bp, Homo sapiens
cacctgccacccccagg

SEQ ID NO: 1216977 - DNA, 15 bp, Homo sapiens
cacctgccagcctgg

SEQ ID NO: 1216978 - DNA, 17 bp, Homo sapiens
cacctgccagcctggct

SEQ ID NO: 1216979 - DNA, 13 bp, Homo sapiens
cacctgcccaacc

SEQ ID NO: 1216980 - DNA, 16 bp, Homo sapiens
cacctgcccagctccc

SEQ ID NO: 1216981 - DNA, 16 bp, Homo sapiens
cacctgccccaactct

SEQ ID NO: 1216982 - DNA, 15 bp, Homo sapiens
cacctgccccctggt

SEQ ID NO: 1216983 - DNA, 21 bp, Homo sapiens
cacctgccccctggtggacag

SEQ ID NO: 1216984 - DNA, 15 bp, Homo sapiens
cacctgcccccttct

SEQ ID NO: 1216985 - DNA, 22 bp, Homo sapiens
cacctgcccccttctcccacac

SEQ ID NO: 1216986 - DNA, 16 bp, Homo sapiens
cacctgcccctctgtt

SEQ ID NO: 1216987 - DNA, 20 bp, Homo sapiens
cacctgcccctctgttctct

SEQ ID NO: 1216988 - DNA, 12 bp, Homo sapiens
cacctgccctgc

SEQ ID NO: 1216989 - DNA, 13 bp, Homo sapiens
cacctgccgacct

SEQ ID NO: 1216990 - DNA, 21 bp, Homo sapiens
cacctgccgacctcgtcctcc

SEQ ID NO: 1216991 - DNA, 13 bp, Homo sapiens
cacctgcctcagc

SEQ ID NO: 1216992 - DNA, 14 bp, Homo sapiens
cacctgcctcagct

SEQ ID NO: 1216993 - DNA, 13 bp, Homo sapiens
cacctgcctcagg

SEQ ID NO: 1216994 - DNA, 14 bp, Homo sapiens
cacctgcctcagga

SEQ ID NO: 1216995 - DNA, 20 bp, Homo sapiens
cacctgcctcaggactgcga

SEQ ID NO: 1216996 - DNA, 23 bp, Homo sapiens
cacctgcctcggcctcccaaagt

SEQ ID NO: 1216997 - DNA, 21 bp, Homo sapiens
cacctgcctctgaccccagca

SEQ ID NO: 1216998 - DNA, 10 bp, Homo sapiens
cacctgcctg

SEQ ID NO: 1216999 - DNA, 11 bp, Homo sapiens
cacctgcctgc

SEQ ID NO: 1217000 - DNA, 15 bp, Homo sapiens
cacctgcctgccgct

SEQ ID NO: 1217001 - DNA, 21 bp, Homo sapiens
cacctgcctgcgtcttccgcc

SEQ ID NO: 1217002 - DNA, 14 bp, Homo sapiens
cacctgcgcacagg

SEQ ID NO: 1217003 - DNA, 19 bp, Homo sapiens
cacctgcgcttctgctgga

SEQ ID NO: 1217004 - DNA, 21 bp, Homo sapiens
cacctgcgcttctgctggagg

SEQ ID NO: 1217005 - DNA, 22 bp, Homo sapiens
cacctgctcacagggatgctgg

SEQ ID NO: 1217006 - DNA, 12 bp, Homo sapiens
cacctgctccag

SEQ ID NO: 1217007 - DNA, 18 bp, Homo sapiens
cacctgctgagagaccca

SEQ ID NO: 1217008 - DNA, 16 bp, Homo sapiens
cacctgctgcgtcccc

SEQ ID NO: 1217009 - DNA, 22 bp, Homo sapiens
cacctgctgcgtccccactccc

SEQ ID NO: 1217010 - DNA, 10 bp, Homo sapiens
cacctgctgg

SEQ ID NO: 1217011 - DNA, 17 bp, Homo sapiens
cacctgctggcccctca

SEQ ID NO: 1217012 - DNA, 20 bp, Homo sapiens
cacctgcttccacccgtctc

SEQ ID NO: 1217013 - DNA, 22 bp, Homo sapiens
cacctggaagcatttgtttcta

SEQ ID NO: 1217014 - DNA, 20 bp, Homo sapiens
cacctggaatatataaccag

SEQ ID NO: 1217015 - DNA, 16 bp, Homo sapiens
cacctggacacacact

SEQ ID NO: 1217016 - DNA, 22 bp, Homo sapiens
cacctggaccatttgattgttt

SEQ ID NO: 1217017 - DNA, 12 bp, Homo sapiens
cacctggacccc

SEQ ID NO: 1217018 - DNA, 15 bp, Homo sapiens
cacctggaccccctg

SEQ ID NO: 1217019 - DNA, 17 bp, Homo sapiens
cacctggaccccctgcc

SEQ ID NO: 1217020 - DNA, 18 bp, Homo sapiens
cacctggaccccctgccc

SEQ ID NO: 1217021 - DNA, 18 bp, Homo sapiens
cacctggactgaccctgc

SEQ ID NO: 1217022 - DNA, 23 bp, Homo sapiens
cacctggagcccgcttcaagctc

SEQ ID NO: 1217023 - DNA, 22 bp, Homo sapiens
cacctggaggcaagagggaggg

SEQ ID NO: 1217024 - DNA, 12 bp, Homo sapiens
cacctggcacat

SEQ ID NO: 1217025 - DNA, 15 bp, Homo sapiens
cacctggcacattca

SEQ ID NO: 1217026 - DNA, 22 bp, Homo sapiens
cacctggcagggctcacactcc

SEQ ID NO: 1217027 - DNA, 23 bp, Homo sapiens
cacctggcagggctcacactcct

SEQ ID NO: 1217028 - DNA, 11 bp, Homo sapiens
cacctggccac

SEQ ID NO: 1217029 - DNA, 14 bp, Homo sapiens
cacctggccccatg

SEQ ID NO: 1217030 - DNA, 22 bp, Homo sapiens
cacctggccccatgtctctcag

SEQ ID NO: 1217031 - DNA, 15 bp, Homo sapiens
cacctggccctgctt

SEQ ID NO: 1217032 - DNA, 20 bp, Homo sapiens
cacctggccctgcttcctgc

SEQ ID NO: 1217033 - DNA, 16 bp, Homo sapiens
cacctggcctgctggg

SEQ ID NO: 1217034 - DNA, 20 bp, Homo sapiens
cacctggcctgggccacacc

SEQ ID NO: 1217035 - DNA, 22 bp, Homo sapiens
cacctggcctgggccacacctg

SEQ ID NO: 1217036 - DNA, 12 bp, Homo sapiens
cacctggctccc

SEQ ID NO: 1217037 - DNA, 13 bp, Homo sapiens
cacctggctcccc

SEQ ID NO: 1217038 - DNA, 19 bp, Homo sapiens
cacctggctgagcctggct

SEQ ID NO: 1217039 - DNA, 19 bp, Homo sapiens
cacctggctgaggttcctc

SEQ ID NO: 1217040 - DNA, 20 bp, Homo sapiens
cacctggctgaggttcctct

SEQ ID NO: 1217041 - DNA, 21 bp, Homo sapiens
cacctggctgaggttcctctg

SEQ ID NO: 1217042 - DNA, 20 bp, Homo sapiens
cacctgggagaaggtctcca

SEQ ID NO: 1217043 - DNA, 12 bp, Homo sapiens
cacctgggcacc

SEQ ID NO: 1217044 - DNA, 16 bp, Homo sapiens
cacctgggcagctcct

SEQ ID NO: 1217045 - DNA, 18 bp, Homo sapiens
cacctgggcagctcctcc

SEQ ID NO: 1217046 - DNA, 23 bp, Homo sapiens
cacctgggcagctcctccctgtg

SEQ ID NO: 1217047 - DNA, 15 bp, Homo sapiens
cacctgggccgggct

SEQ ID NO: 1217048 - DNA, 15 bp, Homo sapiens
cacctgggcctttcc

SEQ ID NO: 1217049 - DNA, 19 bp, Homo sapiens
cacctgggcctttcctgtg

SEQ ID NO: 1217050 - DNA, 12 bp, Homo sapiens
cacctgggctgg

SEQ ID NO: 1217051 - DNA, 13 bp, Homo sapiens
cacctgggctggg

SEQ ID NO: 1217052 - DNA, 15 bp, Homo sapiens
cacctggggagtggg

SEQ ID NO: 1217053 - DNA, 17 bp, Homo sapiens
cacctggggtctctctc

SEQ ID NO: 1217054 - DNA, 15 bp, Homo sapiens
cacctgtaaaacttt

SEQ ID NO: 1217055 - DNA, 14 bp, Homo sapiens
cacctgtacataca

SEQ ID NO: 1217056 - DNA, 18 bp, Homo sapiens
cacctgtacatacattgt

SEQ ID NO: 1217057 - DNA, 22 bp, Homo sapiens
cacctgtactcaggaggctgag

SEQ ID NO: 1217058 - DNA, 15 bp, Homo sapiens
cacctgtactcttcc

SEQ ID NO: 1217059 - DNA, 17 bp, Homo sapiens
cacctgtactcttccga

SEQ ID NO: 1217060 - DNA, 14 bp, Homo sapiens
cacctgtagtccca

SEQ ID NO: 1217061 - DNA, 16 bp, Homo sapiens
cacctgtagtcccagc

SEQ ID NO: 1217062 - DNA, 20 bp, Homo sapiens
cacctgtccccaccctccac

SEQ ID NO: 1217063 - DNA, 13 bp, Homo sapiens
cacctgtccggcc

SEQ ID NO: 1217064 - DNA, 19 bp, Homo sapiens
cacctgtccggcccagtgc

SEQ ID NO: 1217065 - DNA, 23 bp, Homo sapiens
cacctgtccggcccagtgccagc

SEQ ID NO: 1217066 - DNA, 12 bp, Homo sapiens
cacctgtgacaa

SEQ ID NO: 1217067 - DNA, 20 bp, Homo sapiens
cacctgtgagtttaaagcaa

SEQ ID NO: 1217068 - DNA, 23 bp, Homo sapiens
cacctgtgcagcgaagcttagcg

SEQ ID NO: 1217069 - DNA, 16 bp, Homo sapiens
cacctgtgccctcacc

SEQ ID NO: 1217070 - DNA, 17 bp, Homo sapiens
cacctgtgccctcacca

SEQ ID NO: 1217071 - DNA, 22 bp, Homo sapiens
cacctgtggaacataaaaagga

SEQ ID NO: 1217072 - DNA, 19 bp, Homo sapiens
cacctgttaaaatgtacac

SEQ ID NO: 1217073 - DNA, 19 bp, Homo sapiens
cacctgttcacagaaaaag

SEQ ID NO: 1217074 - DNA, 11 bp, Homo sapiens
cacctgtttcc

SEQ ID NO: 1217075 - DNA, 19 bp, Homo sapiens
cacctgtttctggaagact

SEQ ID NO: 1217076 - DNA, 16 bp, Homo sapiens
cacctgttttctgaaa

SEQ ID NO: 1217077 - DNA, 20 bp, Homo sapiens
cacctgttttctgaaacaca

SEQ ID NO: 1217078 - DNA, 20 bp, Homo sapiens
cacctgtttttaagctgttt

SEQ ID NO: 1217079 - DNA, 15 bp, Homo sapiens
caccttaaattaaac

SEQ ID NO: 1217080 - DNA, 22 bp, Homo sapiens
caccttaaattaaacaatttat

SEQ ID NO: 1217081 - DNA, 17 bp, Homo sapiens
caccttaccaactttct

SEQ ID NO: 1217082 - DNA, 21 bp, Homo sapiens
caccttagggtggctttaatt

SEQ ID NO: 1217083 - DNA, 13 bp, Homo sapiens
caccttagtgcaa

SEQ ID NO: 1217084 - DNA, 20 bp, Homo sapiens
caccttatctggaagatctg

SEQ ID NO: 1217085 - DNA, 20 bp, Homo sapiens
caccttcaagcgctccaggg

SEQ ID NO: 1217086 - DNA, 17 bp, Homo sapiens
caccttcaattcctggg

SEQ ID NO: 1217087 - DNA, 18 bp, Homo sapiens
caccttcaattcctgggc

SEQ ID NO: 1217088 - DNA, 20 bp, Homo sapiens
caccttcagaggctgaggtg

SEQ ID NO: 1217089 - DNA, 13 bp, Homo sapiens
caccttcagggct

SEQ ID NO: 1217090 - DNA, 18 bp, Homo sapiens
caccttcagggctgagtt

SEQ ID NO: 1217091 - DNA, 16 bp, Homo sapiens
caccttccagctcctg

SEQ ID NO: 1217092 - DNA, 16 bp, Homo sapiens
caccttcccacccctt

SEQ ID NO: 1217093 - DNA, 17 bp, Homo sapiens
caccttcccagctctcc

SEQ ID NO: 1217094 - DNA, 14 bp, Homo sapiens
caccttcccatgcc

SEQ ID NO: 1217095 - DNA, 14 bp, Homo sapiens
caccttccccagac

SEQ ID NO: 1217096 - DNA, 21 bp, Homo sapiens
caccttccccagactcagctc

SEQ ID NO: 1217097 - DNA, 11 bp, Homo sapiens
caccttccctc

SEQ ID NO: 1217098 - DNA, 15 bp, Homo sapiens
caccttccctcgact

SEQ ID NO: 1217099 - DNA, 21 bp, Homo sapiens
caccttcccttctacaaggac

SEQ ID NO: 1217100 - DNA, 15 bp, Homo sapiens
caccttcccttgcca

SEQ ID NO: 1217101 - DNA, 18 bp, Homo sapiens
caccttcccttgccactt

SEQ ID NO: 1217102 - DNA, 15 bp, Homo sapiens
caccttccgacatcc

SEQ ID NO: 1217103 - DNA, 16 bp, Homo sapiens
caccttcctcctgcag

SEQ ID NO: 1217104 - DNA, 17 bp, Homo sapiens
caccttcctcctgcaga

SEQ ID NO: 1217105 - DNA, 21 bp, Homo sapiens
caccttcgggcagtcctgtgt

SEQ ID NO: 1217106 - DNA, 21 bp, Homo sapiens
caccttctagtcttggccagc

SEQ ID NO: 1217107 - DNA, 18 bp, Homo sapiens
caccttctgagtattctc

SEQ ID NO: 1217108 - DNA, 19 bp, Homo sapiens
caccttctgtccccagccc

SEQ ID NO: 1217109 - DNA, 15 bp, Homo sapiens
caccttcttggcttc

SEQ ID NO: 1217110 - DNA, 16 bp, Homo sapiens
caccttcttggcttct

SEQ ID NO: 1217111 - DNA, 18 bp, Homo sapiens
caccttcttggcttctgg

SEQ ID NO: 1217112 - DNA, 15 bp, Homo sapiens
caccttctttctgga

SEQ ID NO: 1217113 - DNA, 22 bp, Homo sapiens
caccttgaagaacctctcactt

SEQ ID NO: 1217114 - DNA, 16 bp, Homo sapiens
caccttgcaacacaca

SEQ ID NO: 1217115 - DNA, 18 bp, Homo sapiens
caccttgcaacacacaga

SEQ ID NO: 1217116 - DNA, 21 bp, Homo sapiens
caccttgctaacctaaaagac

SEQ ID NO: 1217117 - DNA, 12 bp, Homo sapiens
caccttgctctt

SEQ ID NO: 1217118 - DNA, 16 bp, Homo sapiens
caccttgctcttcttt

SEQ ID NO: 1217119 - DNA, 19 bp, Homo sapiens
caccttgcttttttactta

SEQ ID NO: 1217120 - DNA, 13 bp, Homo sapiens
caccttggaaggg

SEQ ID NO: 1217121 - DNA, 21 bp, Homo sapiens
caccttggacatcctcctccc

SEQ ID NO: 1217122 - DNA, 12 bp, Homo sapiens
caccttggccca

SEQ ID NO: 1217123 - DNA, 18 bp, Homo sapiens
caccttggcccaggagct

SEQ ID NO: 1217124 - DNA, 23 bp, Homo sapiens
caccttggcccaggagctctgcg

SEQ ID NO: 1217125 - DNA, 21 bp, Homo sapiens
caccttggggtccctccaccc

SEQ ID NO: 1217126 - DNA, 16 bp, Homo sapiens
caccttggtccctctc

SEQ ID NO: 1217127 - DNA, 22 bp, Homo sapiens
caccttgtcatgtaccatcaat

SEQ ID NO: 1217128 - DNA, 15 bp, Homo sapiens
cacctttattaaaat

SEQ ID NO: 1217129 - DNA, 18 bp, Homo sapiens
cacctttattaaaatctt

SEQ ID NO: 1217130 - DNA, 14 bp, Homo sapiens
cacctttcccatct

SEQ ID NO: 1217131 - DNA, 15 bp, Homo sapiens
cacctttctctgaga

SEQ ID NO: 1217132 - DNA, 13 bp, Homo sapiens
cacctttctgggc

SEQ ID NO: 1217133 - DNA, 16 bp, Homo sapiens
cacctttctgggcttt

SEQ ID NO: 1217134 - DNA, 21 bp, Homo sapiens
cacctttctgggctttctcct

SEQ ID NO: 1217135 - DNA, 18 bp, Homo sapiens
cacctttgggatcagcct

SEQ ID NO: 1217136 - DNA, 23 bp, Homo sapiens
cacctttgggatcagcctccgcc

SEQ ID NO: 1217137 - DNA, 16 bp, Homo sapiens
cacctttgtaagacat

SEQ ID NO: 1217138 - DNA, 22 bp, Homo sapiens
cacctttgtctggatgcacact

SEQ ID NO: 1217139 - DNA, 21 bp, Homo sapiens
cacctttgtttagaacactgg

SEQ ID NO: 1217140 - DNA, 17 bp, Homo sapiens
caccttttcatgtacag

SEQ ID NO: 1217141 - DNA, 20 bp, Homo sapiens
caccttttcatgtacagcat

SEQ ID NO: 1217142 - DNA, 12 bp, Homo sapiens
cacccctccctc

SEQ ID NO: 1217143 - DNA, 17 bp, Homo sapiens
cacccctccctccctct

SEQ ID NO: 1217144 - DNA, 23 bp, Homo sapiens
cacccctccctgcttgcacactt

SEQ ID NO: 1217145 - DNA, 17 bp, Homo sapiens
cacccctcgccaccttt

SEQ ID NO: 1217146 - DNA, 12 bp, Homo sapiens
cacccctctctg

SEQ ID NO: 1217147 - DNA, 16 bp, Homo sapiens
cacccctctgccctca

SEQ ID NO: 1217148 - DNA, 13 bp, Homo sapiens
cacccctctgtct

SEQ ID NO: 1217149 - DNA, 12 bp, Homo sapiens
cacccctcttct

SEQ ID NO: 1217150 - DNA, 21 bp, Homo sapiens
cacccctgagttgggcagcca

SEQ ID NO: 1217151 - DNA, 22 bp, Homo sapiens
cacccctgagttgggcagccag

SEQ ID NO: 1217152 - DNA, 13 bp, Homo sapiens
cacccctgccact

SEQ ID NO: 1217153 - DNA, 14 bp, Homo sapiens
cacccctgccactc

SEQ ID NO: 1217154 - DNA, 18 bp, Homo sapiens
cacccctgccactcaccc

SEQ ID NO: 1217155 - DNA, 14 bp, Homo sapiens
cacccctgccccca

SEQ ID NO: 1217156 - DNA, 19 bp, Homo sapiens
cacccctgcccccagcccc

SEQ ID NO: 1217157 - DNA, 24 bp, Homo sapiens
cacccctgctctacccatgagcct

SEQ ID NO: 1217158 - DNA, 12 bp, Homo sapiens
cacccctgggca

SEQ ID NO: 1217159 - DNA, 14 bp, Homo sapiens
cacccctgggcagg

SEQ ID NO: 1217160 - DNA, 13 bp, Homo sapiens
cacccctgggcca

SEQ ID NO: 1217161 - DNA, 22 bp, Homo sapiens
cacccctgggccagcggggctg

SEQ ID NO: 1217162 - DNA, 18 bp, Homo sapiens
cacccctgggggctctca

SEQ ID NO: 1217163 - DNA, 23 bp, Homo sapiens
cacccctgtcccacccacacagc

SEQ ID NO: 1217164 - DNA, 20 bp, Homo sapiens
caccccttatccaggactct

SEQ ID NO: 1217165 - DNA, 23 bp, Homo sapiens
caccccttcataccgcctcgtgc

SEQ ID NO: 1217166 - DNA, 11 bp, Homo sapiens
caccccttcca

SEQ ID NO: 1217167 - DNA, 16 bp, Homo sapiens
caccccttccatgtgg

SEQ ID NO: 1217168 - DNA, 13 bp, Homo sapiens
caccccttcccca

SEQ ID NO: 1217169 - DNA, 12 bp, Homo sapiens
caccccttcctc

SEQ ID NO: 1217170 - DNA, 13 bp, Homo sapiens
caccccttcctcc

SEQ ID NO: 1217171 - DNA, 16 bp, Homo sapiens
caccccttcctgtccc

SEQ ID NO: 1217172 - DNA, 21 bp, Homo sapiens
caccccttcgacatgctgcca

SEQ ID NO: 1217173 - DNA, 18 bp, Homo sapiens
caccccttctctcctccc

SEQ ID NO: 1217174 - DNA, 21 bp, Homo sapiens
caccccttctctcctccccaa

SEQ ID NO: 1217175 - DNA, 12 bp, Homo sapiens
caccccttggcc

SEQ ID NO: 1217176 - DNA, 17 bp, Homo sapiens
cacccctttcctcccca

SEQ ID NO: 1217177 - DNA, 23 bp, Homo sapiens
cacccgatgctgctttcccctgt

SEQ ID NO: 1217178 - DNA, 13 bp, Homo sapiens
cacccgccctgtg

SEQ ID NO: 1217179 - DNA, 13 bp, Homo sapiens
cacccgcctctcc

SEQ ID NO: 1217180 - DNA, 14 bp, Homo sapiens
cacccgctgcccct

SEQ ID NO: 1217181 - DNA, 15 bp, Homo sapiens
cacccgctgcccctc

SEQ ID NO: 1217182 - DNA, 19 bp, Homo sapiens
cacccgctgcccctccccg

SEQ ID NO: 1217183 - DNA, 15 bp, Homo sapiens
cacccgcttcctgtt

SEQ ID NO: 1217184 - DNA, 21 bp, Homo sapiens
cacccggacaggtggggcctc

SEQ ID NO: 1217185 - DNA, 15 bp, Homo sapiens
cacccggctgcagag

SEQ ID NO: 1217186 - DNA, 21 bp, Homo sapiens
cacccggctgcagaggccaga

SEQ ID NO: 1217187 - DNA, 17 bp, Homo sapiens
cacccggctggccggga

SEQ ID NO: 1217188 - DNA, 13 bp, Homo sapiens
cacccgggctgcc

SEQ ID NO: 1217189 - DNA, 23 bp, Homo sapiens
cacccggggcctggacctatgca

SEQ ID NO: 1217190 - DNA, 20 bp, Homo sapiens
cacccgggggagcccagtga

SEQ ID NO: 1217191 - DNA, 17 bp, Homo sapiens
cacccgtaggcagcctc

SEQ ID NO: 1217192 - DNA, 21 bp, Homo sapiens
cacccgtaggcagcctctctg

SEQ ID NO: 1217193 - DNA, 13 bp, Homo sapiens
cactttcctcagt

SEQ ID NO: 1217194 - DNA, 15 bp, Homo sapiens
cactttcctcagttg

SEQ ID NO: 1217195 - DNA, 16 bp, Homo sapiens
cactttctaatgtttc

SEQ ID NO: 1217196 - DNA, 18 bp, Homo sapiens
cactttctaatgtttctg

SEQ ID NO: 1217197 - DNA, 16 bp, Homo sapiens
cactttctatagcaga

SEQ ID NO: 1217198 - DNA, 22 bp, Homo sapiens
cactttgaaaatatttctatgt

SEQ ID NO: 1217199 - DNA, 15 bp, Homo sapiens
cactttgaaatgtgt

SEQ ID NO: 1217200 - DNA, 17 bp, Homo sapiens
cactttgaaatgtgttt

SEQ ID NO: 1217201 - DNA, 16 bp, Homo sapiens
cactttgagaaacacc

SEQ ID NO: 1217202 - DNA, 20 bp, Homo sapiens
cactttgcacgacgccctct

SEQ ID NO: 1217203 - DNA, 21 bp, Homo sapiens
cactttgcacgacgccctctc

SEQ ID NO: 1217204 - DNA, 22 bp, Homo sapiens
cactttgcactgatatatcatg

SEQ ID NO: 1217205 - DNA, 15 bp, Homo sapiens
cactttgctcaaaat

SEQ ID NO: 1217206 - DNA, 20 bp, Homo sapiens
cactttggtacatggccagt

SEQ ID NO: 1217207 - DNA, 12 bp, Homo sapiens
cactttgtaaat

SEQ ID NO: 1217208 - DNA, 13 bp, Homo sapiens
cactttgtaaatt

SEQ ID NO: 1217209 - DNA, 14 bp, Homo sapiens
cactttgtattact

SEQ ID NO: 1217210 - DNA, 14 bp, Homo sapiens
cactttgtctgtac

SEQ ID NO: 1217211 - DNA, 14 bp, Homo sapiens
cactttgttcttta

SEQ ID NO: 1217212 - DNA, 14 bp, Homo sapiens
cactttgttgcaag

SEQ ID NO: 1217213 - DNA, 15 bp, Homo sapiens
cactttgttgcaaga

SEQ ID NO: 1217214 - DNA, 22 bp, Homo sapiens
cactttgttgcaagatgtgaat

SEQ ID NO: 1217215 - DNA, 19 bp, Homo sapiens
cactttgttggcccttcca

SEQ ID NO: 1217216 - DNA, 15 bp, Homo sapiens
cactttgtttagaaa

SEQ ID NO: 1217217 - DNA, 16 bp, Homo sapiens
cactttgtttagaaaa

SEQ ID NO: 1217218 - DNA, 12 bp, Homo sapiens
cactttgtttat

SEQ ID NO: 1217219 - DNA, 17 bp, Homo sapiens
cacttttaaaaaacaaa

SEQ ID NO: 1217220 - DNA, 17 bp, Homo sapiens
cacttttaataaacttt

SEQ ID NO: 1217221 - DNA, 21 bp, Homo sapiens
cacttttagttggcatttgtt

SEQ ID NO: 1217222 - DNA, 18 bp, Homo sapiens
cacttttcaaaagaagac

SEQ ID NO: 1217223 - DNA, 17 bp, Homo sapiens
cacttttcaatttgtca

SEQ ID NO: 1217224 - DNA, 13 bp, Homo sapiens
cacttttcagtga

SEQ ID NO: 1217225 - DNA, 13 bp, Homo sapiens
cacttttcctttt

SEQ ID NO: 1217226 - DNA, 14 bp, Homo sapiens
cacttttccttttc

SEQ ID NO: 1217227 - DNA, 12 bp, Homo sapiens
cacttttctggg

SEQ ID NO: 1217228 - DNA, 22 bp, Homo sapiens
cacttttgttaacagtatttct

SEQ ID NO: 1217229 - DNA, 22 bp, Homo sapiens
cacttttgttcttggtttgtaa

SEQ ID NO: 1217230 - DNA, 18 bp, Homo sapiens
cacttttttataaaagtt

SEQ ID NO: 1217231 - DNA, 19 bp, Homo sapiens
cactttttttttttttccc

SEQ ID NO: 1217232 - DNA, 20 bp, Homo sapiens
cactttttttttttttcccc

SEQ ID NO: 1217233 - DNA, 20 bp, Homo sapiens
cagaaaaaaaaaatgcattt

SEQ ID NO: 1217234 - DNA, 15 bp, Homo sapiens
cagaaaaacaatctt

SEQ ID NO: 1217235 - DNA, 21 bp, Homo sapiens
cagaaaaagcatgatgggaaa

SEQ ID NO: 1217236 - DNA, 22 bp, Homo sapiens
cagaaaaataaatgtcactgcc

SEQ ID NO: 1217237 - DNA, 13 bp, Homo sapiens
cagaaaaatactt

SEQ ID NO: 1217238 - DNA, 19 bp, Homo sapiens
cagaaaacaacaaaagaat

SEQ ID NO: 1217239 - DNA, 23 bp, Homo sapiens
cagaaaacatgtttaaatagcct

SEQ ID NO: 1217240 - DNA, 14 bp, Homo sapiens
cagaaaaccccagc

SEQ ID NO: 1217241 - DNA, 17 bp, Homo sapiens
cagaaaacccttgggcc

SEQ ID NO: 1217242 - DNA, 23 bp, Homo sapiens
cagaaaacccttgggccagaagt

SEQ ID NO: 1217243 - DNA, 21 bp, Homo sapiens
cagaaaacctctcctgacccc

SEQ ID NO: 1217244 - DNA, 23 bp, Homo sapiens
cagaaaagccttttaatctcttt

SEQ ID NO: 1217245 - DNA, 17 bp, Homo sapiens
cagaaaagggaagttgt

SEQ ID NO: 1217246 - DNA, 16 bp, Homo sapiens
cagaaaagtaattttg

SEQ ID NO: 1217247 - DNA, 20 bp, Homo sapiens
cagaaaagtaattttgtcac

SEQ ID NO: 1217248 - DNA, 10 bp, Homo sapiens
cagaaaagtg

SEQ ID NO: 1217249 - DNA, 16 bp, Homo sapiens
cagaaaagtgcctgag

SEQ ID NO: 1217250 - DNA, 23 bp, Homo sapiens
cagaaaatgctggctgagctgaa

SEQ ID NO: 1217251 - DNA, 23 bp, Homo sapiens
cagaaaatgttgagaatcccaaa

SEQ ID NO: 1217252 - DNA, 13 bp, Homo sapiens
cagaaaattctgt

SEQ ID NO: 1217253 - DNA, 14 bp, Homo sapiens
cagaaaattctgtg

SEQ ID NO: 1217254 - DNA, 15 bp, Homo sapiens
cagaaaattctgtgc

SEQ ID NO: 1217255 - DNA, 18 bp, Homo sapiens
cagaaacaaaaacactaa

SEQ ID NO: 1217256 - DNA, 19 bp, Homo sapiens
cagaaacacccctctgtct

SEQ ID NO: 1217257 - DNA, 23 bp, Homo sapiens
cagaaacacccctctgtctagga

SEQ ID NO: 1217258 - DNA, 14 bp, Homo sapiens
cagaaacagcatat

SEQ ID NO: 1217259 - DNA, 21 bp, Homo sapiens
cagaaacagctgcttctcccc

SEQ ID NO: 1217260 - DNA, 22 bp, Homo sapiens
cagaaacagctgcttctccccc

SEQ ID NO: 1217261 - DNA, 14 bp, Homo sapiens
cagaaacagggaca

SEQ ID NO: 1217262 - DNA, 19 bp, Homo sapiens
cagaaacagggacaaagaa

SEQ ID NO: 1217263 - DNA, 15 bp, Homo sapiens
cagaaacagggcagc

SEQ ID NO: 1217264 - DNA, 22 bp, Homo sapiens
cagaaacagggcagcagtgggg

SEQ ID NO: 1217265 - DNA, 17 bp, Homo sapiens
cagaaacatcagttact

SEQ ID NO: 1217266 - DNA, 22 bp, Homo sapiens
cagaaacatcagttactctgaa

SEQ ID NO: 1217267 - DNA, 12 bp, Homo sapiens
cagaaacatctc

SEQ ID NO: 1217268 - DNA, 12 bp, Homo sapiens
cagaaacatgaa

SEQ ID NO: 1217269 - DNA, 14 bp, Homo sapiens
cagaaaccagttat

SEQ ID NO: 1217270 - DNA, 22 bp, Homo sapiens
cagaaaccctcattgtgtttct

SEQ ID NO: 1217271 - DNA, 18 bp, Homo sapiens
cagaaacctatctcaggg

SEQ ID NO: 1217272 - DNA, 19 bp, Homo sapiens
cagaaacctatctcaggga

SEQ ID NO: 1217273 - DNA, 23 bp, Homo sapiens
cagaaacgagatcgggaagcaga

SEQ ID NO: 1217274 - DNA, 19 bp, Homo sapiens
cagaaactggattaaaaca

SEQ ID NO: 1217275 - DNA, 21 bp, Homo sapiens
cagaaagaagcagttctcaca

SEQ ID NO: 1217276 - DNA, 13 bp, Homo sapiens
cagaaagccaaca

SEQ ID NO: 1217277 - DNA, 13 bp, Homo sapiens
cagaaagcctcct

SEQ ID NO: 1217278 - DNA, 22 bp, Homo sapiens
cagaaagcctcctgccccctgc

SEQ ID NO: 1217279 - DNA, 23 bp, Homo sapiens
cagaaagcctcctgccccctgcc

SEQ ID NO: 1217280 - DNA, 17 bp, Homo sapiens
cagaaagcctctctctc

SEQ ID NO: 1217281 - DNA, 22 bp, Homo sapiens
cagaaagcctgggtgacatttg

SEQ ID NO: 1217282 - DNA, 15 bp, Homo sapiens
cagaaagctgccaga

SEQ ID NO: 1217283 - DNA, 15 bp, Homo sapiens
cagaaagcttcaaat

SEQ ID NO: 1217284 - DNA, 17 bp, Homo sapiens
cagaaagcttcaaatta

SEQ ID NO: 1217285 - DNA, 20 bp, Homo sapiens
cagaaaggaaaacctgaaga

SEQ ID NO: 1217286 - DNA, 16 bp, Homo sapiens
cagaaaggatatttaa

SEQ ID NO: 1217287 - DNA, 20 bp, Homo sapiens
cagaaaggcaggtttcattt

SEQ ID NO: 1217288 - DNA, 13 bp, Homo sapiens
cagaaagggtgcc

SEQ ID NO: 1217289 - DNA, 15 bp, Homo sapiens
cagaaagtatatact

SEQ ID NO: 1217290 - DNA, 19 bp, Homo sapiens
cagaaagtcaccaggactt

SEQ ID NO: 1217291 - DNA, 19 bp, Homo sapiens
cagaaagtgcctgacacac

SEQ ID NO: 1217292 - DNA, 23 bp, Homo sapiens
cagaaagtgcctgacacactaac

SEQ ID NO: 1217293 - DNA, 23 bp, Homo sapiens
cagaaagtggccatgccaccctg

SEQ ID NO: 1217294 - DNA, 21 bp, Homo sapiens
cagaaagtgtgtgtgttctgt

SEQ ID NO: 1217295 - DNA, 14 bp, Homo sapiens
cagaaatacaattt

SEQ ID NO: 1217296 - DNA, 13 bp, Homo sapiens
cagaaatacctgt

SEQ ID NO: 1217297 - DNA, 16 bp, Homo sapiens
cagaaatacctgtcta

SEQ ID NO: 1217298 - DNA, 22 bp, Homo sapiens
cagaaatatttgtgacaaaaaa

SEQ ID NO: 1217299 - DNA, 22 bp, Homo sapiens
cagaaatcacagtcaatggatc

SEQ ID NO: 1217300 - DNA, 16 bp, Homo sapiens
cagaaatcacgttgct

SEQ ID NO: 1217301 - DNA, 12 bp, Homo sapiens
cagaaatcactg

SEQ ID NO: 1217302 - DNA, 18 bp, Homo sapiens
cagaaatcagaggagaga

SEQ ID NO: 1217303 - DNA, 14 bp, Homo sapiens
cagaaatgccccca

SEQ ID NO: 1217304 - DNA, 22 bp, Homo sapiens
cagaaatgcccccattctccca

SEQ ID NO: 1217305 - DNA, 14 bp, Homo sapiens
cagaaatgctgcct

SEQ ID NO: 1217306 - DNA, 19 bp, Homo sapiens
cagaaatgctgcctgcctg

SEQ ID NO: 1217307 - DNA, 23 bp, Homo sapiens
cagaaatgctgcctgcctgtctg

SEQ ID NO: 1217308 - DNA, 16 bp, Homo sapiens
cagaaatgctgctggc

SEQ ID NO: 1217309 - DNA, 21 bp, Homo sapiens
cagaaatggacaaagaaaacg

SEQ ID NO: 1217310 - DNA, 21 bp, Homo sapiens
cagaaatgtctaaatgctgaa

SEQ ID NO: 1217311 - DNA, 15 bp, Homo sapiens
cagaaattaaaatat

SEQ ID NO: 1217312 - DNA, 17 bp, Homo sapiens
cagaaattaaaatatta

SEQ ID NO: 1217313 - DNA, 22 bp, Homo sapiens
cagaaattaaaatattatttga

SEQ ID NO: 1217314 - DNA, 15 bp, Homo sapiens
cagaaattccagtaa

SEQ ID NO: 1217315 - DNA, 11 bp, Homo sapiens
cagaaattgga

SEQ ID NO: 1217316 - DNA, 21 bp, Homo sapiens
cagaaattggaacagaatgtt

SEQ ID NO: 1217317 - DNA, 14 bp, Homo sapiens
cagaacccagggct

SEQ ID NO: 1217318 - DNA, 22 bp, Homo sapiens
cagaacccatcggtaggcaaag

SEQ ID NO: 1217319 - DNA, 23 bp, Homo sapiens
cagaacccctacatgaaacagaa

SEQ ID NO: 1217320 - DNA, 14 bp, Homo sapiens
cagaacctcttccc

SEQ ID NO: 1217321 - DNA, 18 bp, Homo sapiens
cagaacctcttccccaga

SEQ ID NO: 1217322 - DNA, 21 bp, Homo sapiens
cagaacctcttccccagaaag

SEQ ID NO: 1217323 - DNA, 12 bp, Homo sapiens
cagaacctgagg

SEQ ID NO: 1217324 - DNA, 22 bp, Homo sapiens
cagaacctgcacacaggacagc

SEQ ID NO: 1217325 - DNA, 21 bp, Homo sapiens
cagaaccttcaacccagtggg

SEQ ID NO: 1217326 - DNA, 15 bp, Homo sapiens
cagaaccttgtccca

SEQ ID NO: 1217327 - DNA, 18 bp, Homo sapiens
cagaaccttgtcccagcc

SEQ ID NO: 1217328 - DNA, 14 bp, Homo sapiens
cagaacgcacccca

SEQ ID NO: 1217329 - DNA, 18 bp, Homo sapiens
cagaacgcaccccactgg

SEQ ID NO: 1217330 - DNA, 19 bp, Homo sapiens
cagaacgtggctctgctgg

SEQ ID NO: 1217331 - DNA, 16 bp, Homo sapiens
cagaactaaatttttc

SEQ ID NO: 1217332 - DNA, 19 bp, Homo sapiens
cagaactaaatttttcata

SEQ ID NO: 1217333 - DNA, 17 bp, Homo sapiens
cagaactaccaggtggc

SEQ ID NO: 1217334 - DNA, 13 bp, Homo sapiens
cagaactacttct

SEQ ID NO: 1217335 - DNA, 19 bp, Homo sapiens
cagaactcctccaaagcat

SEQ ID NO: 1217336 - DNA, 15 bp, Homo sapiens
cagaactcgatgcac

SEQ ID NO: 1217337 - DNA, 19 bp, Homo sapiens
cagaactcgatgcactgac

SEQ ID NO: 1217338 - DNA, 15 bp, Homo sapiens
cagaactctctgtct

SEQ ID NO: 1217339 - DNA, 22 bp, Homo sapiens
cagaactctctgtcttctctcc

SEQ ID NO: 1217340 - DNA, 16 bp, Homo sapiens
cagaactctttcaaaa

SEQ ID NO: 1217341 - DNA, 16 bp, Homo sapiens
cagaactgaagccact

SEQ ID NO: 1217342 - DNA, 18 bp, Homo sapiens
cagaactgaagccacttg

SEQ ID NO: 1217343 - DNA, 13 bp, Homo sapiens
cagaactgagctc

SEQ ID NO: 1217344 - DNA, 16 bp, Homo sapiens
cagaactgagctcctc

SEQ ID NO: 1217345 - DNA, 17 bp, Homo sapiens
cagaactgagctcctct

SEQ ID NO: 1217346 - DNA, 19 bp, Homo sapiens
cagaactgccattattttc

SEQ ID NO: 1217347 - DNA, 12 bp, Homo sapiens
cagaactgcccc

SEQ ID NO: 1217348 - DNA, 17 bp, Homo sapiens
cagaactgcccccactg

SEQ ID NO: 1217349 - DNA, 12 bp, Homo sapiens
cagaactgccct

SEQ ID NO: 1217350 - DNA, 18 bp, Homo sapiens
cagaactgcccttgctgc

SEQ ID NO: 1217351 - DNA, 19 bp, Homo sapiens
cagaactgcccttgctgcc

SEQ ID NO: 1217352 - DNA, 16 bp, Homo sapiens
cagaactggctgggcc

SEQ ID NO: 1217353 - DNA, 19 bp, Homo sapiens
cagaactggctgggcccct

SEQ ID NO: 1217354 - DNA, 18 bp, Homo sapiens
cagaactgtcccatcccc

SEQ ID NO: 1217355 - DNA, 21 bp, Homo sapiens
cagaactgtcccatccccagg

SEQ ID NO: 1217356 - DNA, 22 bp, Homo sapiens
cagaactgtcccatccccaggt

SEQ ID NO: 1217357 - DNA, 16 bp, Homo sapiens
cagaacttgaagggtt

SEQ ID NO: 1217358 - DNA, 14 bp, Homo sapiens
cagaacttgctgct

SEQ ID NO: 1217359 - DNA, 17 bp, Homo sapiens
cagaacttgctgctgtc

SEQ ID NO: 1217360 - DNA, 20 bp, Homo sapiens
cagaacttgctgctgtcttg

SEQ ID NO: 1217361 - DNA, 21 bp, Homo sapiens
cagaagaaaaggaaatgaaca

SEQ ID NO: 1217362 - DNA, 22 bp, Homo sapiens
cagaagaaaatagaattgacat

SEQ ID NO: 1217363 - DNA, 17 bp, Homo sapiens
cagaagaaataaatata

SEQ ID NO: 1217364 - DNA, 14 bp, Homo sapiens
cagaagaagagaag

SEQ ID NO: 1217365 - DNA, 18 bp, Homo sapiens
cagaagaagagaagctgc

SEQ ID NO: 1217366 - DNA, 21 bp, Homo sapiens
cagaagaagagaagctgctga

SEQ ID NO: 1217367 - DNA, 12 bp, Homo sapiens
cagaagaatatt

SEQ ID NO: 1217368 - DNA, 16 bp, Homo sapiens
cagaagaatattcagg

SEQ ID NO: 1217369 - DNA, 17 bp, Homo sapiens
cagaagaatattcagga

SEQ ID NO: 1217370 - DNA, 21 bp, Homo sapiens
cagaagaccacaaaaattgac

SEQ ID NO: 1217371 - DNA, 16 bp, Homo sapiens
cagaagacccctgact

SEQ ID NO: 1217372 - DNA, 18 bp, Homo sapiens
cagaagactagaggccag

SEQ ID NO: 1217373 - DNA, 19 bp, Homo sapiens
cagaagactagaggccagg

SEQ ID NO: 1217374 - DNA, 24 bp, Homo sapiens
cagaagactagaggccagggcagc

SEQ ID NO: 1217375 - DNA, 18 bp, Homo sapiens
cagaagacttcccagctt

SEQ ID NO: 1217376 - DNA, 21 bp, Homo sapiens
cagaagagaaaggactcagtg

SEQ ID NO: 1217377 - DNA, 22 bp, Homo sapiens
cagaagagaaaggactcagtgt

SEQ ID NO: 1217378 - DNA, 16 bp, Homo sapiens
cagaagagaaatacag

SEQ ID NO: 1217379 - DNA, 20 bp, Homo sapiens
cagaagagaaatacagctgg

SEQ ID NO: 1217380 - DNA, 23 bp, Homo sapiens
cagaagagaaatacagctggcta

SEQ ID NO: 1217381 - DNA, 18 bp, Homo sapiens
cagaagagaattcagtat

SEQ ID NO: 1217382 - DNA, 22 bp, Homo sapiens
cagaagagaattcagtattttt

SEQ ID NO: 1217383 - DNA, 16 bp, Homo sapiens
cagaagagactgatcc

SEQ ID NO: 1217384 - DNA, 20 bp, Homo sapiens
cagaagagatgggcttgttt

SEQ ID NO: 1217385 - DNA, 23 bp, Homo sapiens
cagaagagggtgtgtttgaaatc

SEQ ID NO: 1217386 - DNA, 20 bp, Homo sapiens
cagaagatagcttcacccca

SEQ ID NO: 1217387 - DNA, 17 bp, Homo sapiens
cagaagatgccagcttc

SEQ ID NO: 1217388 - DNA, 19 bp, Homo sapiens
cagaagatgccagcttctc

SEQ ID NO: 1217389 - DNA, 21 bp, Homo sapiens
cagaagatgccagcttctctc

SEQ ID NO: 1217390 - DNA, 13 bp, Homo sapiens
cagaagatgccct

SEQ ID NO: 1217391 - DNA, 14 bp, Homo sapiens
cagaagatggtgaa

SEQ ID NO: 1217392 - DNA, 15 bp, Homo sapiens
cagaagatggtgaag

SEQ ID NO: 1217393 - DNA, 22 bp, Homo sapiens
cagaagcaagggggtgatgtag

SEQ ID NO: 1217394 - DNA, 22 bp, Homo sapiens
cagaagcagcccctcgaggcct

SEQ ID NO: 1217395 - DNA, 15 bp, Homo sapiens
cagaagcaggctgga

SEQ ID NO: 1217396 - DNA, 20 bp, Homo sapiens
cagaagcagggtaccctttg

SEQ ID NO: 1217397 - DNA, 13 bp, Homo sapiens
cagaagcatattt

SEQ ID NO: 1217398 - DNA, 22 bp, Homo sapiens
cagaagcatattttgctggttt

SEQ ID NO: 1217399 - DNA, 14 bp, Homo sapiens
cagaagcattaact

SEQ ID NO: 1217400 - DNA, 15 bp, Homo sapiens
cagaagcatttgtat

SEQ ID NO: 1217401 - DNA, 19 bp, Homo sapiens
cagaagcatttgtattttg

SEQ ID NO: 1217402 - DNA, 21 bp, Homo sapiens
cagaagcatttgtattttgtg

SEQ ID NO: 1217403 - DNA, 21 bp, Homo sapiens
cagaagccaagctccctggag

SEQ ID NO: 1217404 - DNA, 22 bp, Homo sapiens
cagaagccaagctccctggagc

SEQ ID NO: 1217405 - DNA, 21 bp, Homo sapiens
cagaagcccatgtcttctgct

SEQ ID NO: 1217406 - DNA, 23 bp, Homo sapiens
cagaagccctgatgtgtcctcag

SEQ ID NO: 1217407 - DNA, 14 bp, Homo sapiens
cagaagcctctggc

SEQ ID NO: 1217408 - DNA, 19 bp, Homo sapiens
cagaagcctgaggctggga

SEQ ID NO: 1217409 - DNA, 18 bp, Homo sapiens
cagaagcctgatgctgac

SEQ ID NO: 1217410 - DNA, 22 bp, Homo sapiens
cagaagcctggactctgcccca

SEQ ID NO: 1217411 - DNA, 20 bp, Homo sapiens
cagaagccttggaaccagcc

SEQ ID NO: 1217412 - DNA, 22 bp, Homo sapiens
cagaagccttggaaccagcccc

SEQ ID NO: 1217413 - DNA, 20 bp, Homo sapiens
cagaagctcttactctttcc

SEQ ID NO: 1217414 - DNA, 19 bp, Homo sapiens
cagaaggaaaaatgtgtaa

SEQ ID NO: 1217415 - DNA, 14 bp, Homo sapiens
cagaaggaaatgat

SEQ ID NO: 1217416 - DNA, 15 bp, Homo sapiens
cagaaggaaggagga

SEQ ID NO: 1217417 - DNA, 16 bp, Homo sapiens
cagaaggagaaggaaa

SEQ ID NO: 1217418 - DNA, 17 bp, Homo sapiens
cagaaggagggcagagc

SEQ ID NO: 1217419 - DNA, 19 bp, Homo sapiens
cagaaggagggcagagcca

SEQ ID NO: 1217420 - DNA, 19 bp, Homo sapiens
cagaccttaagacactgtg

SEQ ID NO: 1217421 - DNA, 13 bp, Homo sapiens
cagacctttactg

SEQ ID NO: 1217422 - DNA, 22 bp, Homo sapiens
cagacgacacctggagactgtc

SEQ ID NO: 1217423 - DNA, 15 bp, Homo sapiens
cagacgaggggcttc

SEQ ID NO: 1217424 - DNA, 15 bp, Homo sapiens
cagacgcagcagctg

SEQ ID NO: 1217425 - DNA, 17 bp, Homo sapiens
cagacgctgctgtcaca

SEQ ID NO: 1217426 - DNA, 16 bp, Homo sapiens
cagacggagctgcgct

SEQ ID NO: 1217427 - DNA, 19 bp, Homo sapiens
cagacggccggccggacct

SEQ ID NO: 1217428 - DNA, 12 bp, Homo sapiens
cagacggcctag

SEQ ID NO: 1217429 - DNA, 14 bp, Homo sapiens
cagacggcctaggg

SEQ ID NO: 1217430 - DNA, 21 bp, Homo sapiens
cagacgggaatgcctaggtcc

SEQ ID NO: 1217431 - DNA, 22 bp, Homo sapiens
cagacgggaatgcctaggtccc

SEQ ID NO: 1217432 - DNA, 23 bp, Homo sapiens
cagacgggaatgcctaggtccct

SEQ ID NO: 1217433 - DNA, 18 bp, Homo sapiens
cagacgggtctgagactg

SEQ ID NO: 1217434 - DNA, 19 bp, Homo sapiens
cagacgggtctgagactga

SEQ ID NO: 1217435 - DNA, 20 bp, Homo sapiens
cagacggtctgtgtgctgtt

SEQ ID NO: 1217436 - DNA, 23 bp, Homo sapiens
cagacgtcgtacccagccatgtg

SEQ ID NO: 1217437 - DNA, 18 bp, Homo sapiens
cagacgttgcctgagaag

SEQ ID NO: 1217438 - DNA, 20 bp, Homo sapiens
cagactaaaggatccagaga

SEQ ID NO: 1217439 - DNA, 20 bp, Homo sapiens
cagactaagaaggaaaagaa

SEQ ID NO: 1217440 - DNA, 21 bp, Homo sapiens
cagactagatggacctgcctg

SEQ ID NO: 1217441 - DNA, 23 bp, Homo sapiens
cagactatcgtaacctggtgcct

SEQ ID NO: 1217442 - DNA, 23 bp, Homo sapiens
cagactcaaatgctcagaccagc

SEQ ID NO: 1217443 - DNA, 17 bp, Homo sapiens
cagactcaagagaaact

SEQ ID NO: 1217444 - DNA, 20 bp, Homo sapiens
cagactcaaggagttggtaa

SEQ ID NO: 1217445 - DNA, 13 bp, Homo sapiens
cagactcactggg

SEQ ID NO: 1217446 - DNA, 18 bp, Homo sapiens
cagactcactgggaagct

SEQ ID NO: 1217447 - DNA, 21 bp, Homo sapiens
cagactcactgggaagctccc

SEQ ID NO: 1217448 - DNA, 13 bp, Homo sapiens
cagactcagctcc

SEQ ID NO: 1217449 - DNA, 15 bp, Homo sapiens
cagactcagctccag

SEQ ID NO: 1217450 - DNA, 16 bp, Homo sapiens
cagactcagctccaga

SEQ ID NO: 1217451 - DNA, 16 bp, Homo sapiens
cagactcagtttgtca

SEQ ID NO: 1217452 - DNA, 13 bp, Homo sapiens
cagactccagccc

SEQ ID NO: 1217453 - DNA, 15 bp, Homo sapiens
cagactccagcccct

SEQ ID NO: 1217454 - DNA, 16 bp, Homo sapiens
cagactccagcccctg

SEQ ID NO: 1217455 - DNA, 17 bp, Homo sapiens
cagactccagcccctgg

SEQ ID NO: 1217456 - DNA, 19 bp, Homo sapiens
cagactccagcccctggac

SEQ ID NO: 1217457 - DNA, 20 bp, Homo sapiens
cagactcctgaggacagctg

SEQ ID NO: 1217458 - DNA, 18 bp, Homo sapiens
cagactctaggttataca

SEQ ID NO: 1217459 - DNA, 19 bp, Homo sapiens
cagactctaggttatacaa

SEQ ID NO: 1217460 - DNA, 14 bp, Homo sapiens
cagactctgagctg

SEQ ID NO: 1217461 - DNA, 16 bp, Homo sapiens
cagactctgcctcctg

SEQ ID NO: 1217462 - DNA, 22 bp, Homo sapiens
cagactgagctctccaggccag

SEQ ID NO: 1217463 - DNA, 15 bp, Homo sapiens
cagactgatgagcac

SEQ ID NO: 1217464 - DNA, 19 bp, Homo sapiens
cagactgatgagcacatct

SEQ ID NO: 1217465 - DNA, 13 bp, Homo sapiens
cagactgcagaca

SEQ ID NO: 1217466 - DNA, 20 bp, Homo sapiens
cagactgctgggactggcca

SEQ ID NO: 1217467 - DNA, 12 bp, Homo sapiens
cagactgcttgg

SEQ ID NO: 1217468 - DNA, 19 bp, Homo sapiens
cagactgcttggccagatg

SEQ ID NO: 1217469 - DNA, 14 bp, Homo sapiens
cagactggcaataa

SEQ ID NO: 1217470 - DNA, 16 bp, Homo sapiens
cagactggcaataaac

SEQ ID NO: 1217471 - DNA, 18 bp, Homo sapiens
cagactgggaacagggcc

SEQ ID NO: 1217472 - DNA, 15 bp, Homo sapiens
cagactgggcccagg

SEQ ID NO: 1217473 - DNA, 17 bp, Homo sapiens
cagactgggcccaggca

SEQ ID NO: 1217474 - DNA, 18 bp, Homo sapiens
cagactgggcccaggcag

SEQ ID NO: 1217475 - DNA, 21 bp, Homo sapiens
cagactggggcatcctgtgcc

SEQ ID NO: 1217476 - DNA, 20 bp, Homo sapiens
cagactgggtttctagccca

SEQ ID NO: 1217477 - DNA, 17 bp, Homo sapiens
cagactgtaagatgttg

SEQ ID NO: 1217478 - DNA, 22 bp, Homo sapiens
cagactgtaagatgttgtttta

SEQ ID NO: 1217479 - DNA, 17 bp, Homo sapiens
cagactgtgaacttgac

SEQ ID NO: 1217480 - DNA, 21 bp, Homo sapiens
cagactgtgaacttgactggg

SEQ ID NO: 1217481 - DNA, 12 bp, Homo sapiens
cagactgtttta

SEQ ID NO: 1217482 - DNA, 14 bp, Homo sapiens
cagacttaccagga

SEQ ID NO: 1217483 - DNA, 14 bp, Homo sapiens
cagacttcacactg

SEQ ID NO: 1217484 - DNA, 14 bp, Homo sapiens
cagacttcccagct

SEQ ID NO: 1217485 - DNA, 24 bp, Homo sapiens
cagacttccttgagacacggagcc

SEQ ID NO: 1217486 - DNA, 20 bp, Homo sapiens
cagacttctccagacccacc

SEQ ID NO: 1217487 - DNA, 14 bp, Homo sapiens
cagacttctggaag

SEQ ID NO: 1217488 - DNA, 21 bp, Homo sapiens
cagacttctggaaggctggct

SEQ ID NO: 1217489 - DNA, 20 bp, Homo sapiens
cagacttgccaggctccctt

SEQ ID NO: 1217490 - DNA, 15 bp, Homo sapiens
cagacttggcctcca

SEQ ID NO: 1217491 - DNA, 19 bp, Homo sapiens
cagacttggcctccagctg

SEQ ID NO: 1217492 - DNA, 15 bp, Homo sapiens
cagactttaaagaat

SEQ ID NO: 1217493 - DNA, 18 bp, Homo sapiens
cagactttcccaaatgta

SEQ ID NO: 1217494 - DNA, 19 bp, Homo sapiens
cagactttcccaaatgtat

SEQ ID NO: 1217495 - DNA, 12 bp, Homo sapiens
cagactttctgt

SEQ ID NO: 1217496 - DNA, 15 bp, Homo sapiens
cagactttgagcctg

SEQ ID NO: 1217497 - DNA, 14 bp, Homo sapiens
cagactttgctgca

SEQ ID NO: 1217498 - DNA, 21 bp, Homo sapiens
cagactttgctgcattttaca

SEQ ID NO: 1217499 - DNA, 20 bp, Homo sapiens
cagactttgcttcccattgt

SEQ ID NO: 1217500 - DNA, 21 bp, Homo sapiens
cagactttggacagtggcctc

SEQ ID NO: 1217501 - DNA, 20 bp, Homo sapiens
cagactttgtgttcatttca

SEQ ID NO: 1217502 - DNA, 16 bp, Homo sapiens
cagacttttcagaaga

SEQ ID NO: 1217503 - DNA, 13 bp, Homo sapiens
cagagaaaatgaa

SEQ ID NO: 1217504 - DNA, 17 bp, Homo sapiens
cagagaaacgcgctcct

SEQ ID NO: 1217505 - DNA, 23 bp, Homo sapiens
cagagaaagaaaaggcaaaagac

SEQ ID NO: 1217506 - DNA, 18 bp, Homo sapiens
cagagaaagaagagacag

SEQ ID NO: 1217507 - DNA, 17 bp, Homo sapiens
cagagaaatacaaaata

SEQ ID NO: 1217508 - DNA, 22 bp, Homo sapiens
cagagaacaatcactattctta

SEQ ID NO: 1217509 - DNA, 11 bp, Homo sapiens
cagagaacagc

SEQ ID NO: 1217510 - DNA, 15 bp, Homo sapiens
cagagaacagtcatg

SEQ ID NO: 1217511 - DNA, 14 bp, Homo sapiens
cagagaaccaggct

SEQ ID NO: 1217512 - DNA, 16 bp, Homo sapiens
cagagaacctttagaa

SEQ ID NO: 1217513 - DNA, 13 bp, Homo sapiens
cagagaagccccg

SEQ ID NO: 1217514 - DNA, 20 bp, Homo sapiens
cagagaagccccgcacgggc

SEQ ID NO: 1217515 - DNA, 23 bp, Homo sapiens
cagagaagccccgcacgggctgt

SEQ ID NO: 1217516 - DNA, 19 bp, Homo sapiens
cagagaagcggatttccag

SEQ ID NO: 1217517 - DNA, 15 bp, Homo sapiens
cagagaagctgggga

SEQ ID NO: 1217518 - DNA, 21 bp, Homo sapiens
cagagaagctggggaggagct

SEQ ID NO: 1217519 - DNA, 15 bp, Homo sapiens
cagagaaggaaaaga

SEQ ID NO: 1217520 - DNA, 20 bp, Homo sapiens
cagagaaggacggtgccaag

SEQ ID NO: 1217521 - DNA, 13 bp, Homo sapiens
cagagaaggcagg

SEQ ID NO: 1217522 - DNA, 14 bp, Homo sapiens
cagagaaggcagga

SEQ ID NO: 1217523 - DNA, 17 bp, Homo sapiens
cagagaaggcaggaatg

SEQ ID NO: 1217524 - DNA, 20 bp, Homo sapiens
cagagaaggcaggaatgtgt

SEQ ID NO: 1217525 - DNA, 13 bp, Homo sapiens
cagagaaggcctc

SEQ ID NO: 1217526 - DNA, 14 bp, Homo sapiens
cagagaaggcctct

SEQ ID NO: 1217527 - DNA, 22 bp, Homo sapiens
cagagaaggcctcttgtgctca

SEQ ID NO: 1217528 - DNA, 20 bp, Homo sapiens
cagagaagggctcctgcagg

SEQ ID NO: 1217529 - DNA, 21 bp, Homo sapiens
cagagaagggctcctgcaggc

SEQ ID NO: 1217530 - DNA, 17 bp, Homo sapiens
cagagaagtttgtagcc

SEQ ID NO: 1217531 - DNA, 20 bp, Homo sapiens
cagagaagtttgtagccagg

SEQ ID NO: 1217532 - DNA, 12 bp, Homo sapiens
cagagaataaaa

SEQ ID NO: 1217533 - DNA, 15 bp, Homo sapiens
cagagaatcaaagat

SEQ ID NO: 1217534 - DNA, 19 bp, Homo sapiens
cagagaatgttagccatga

SEQ ID NO: 1217535 - DNA, 20 bp, Homo sapiens
cagagaatttctaaagtaaa

SEQ ID NO: 1217536 - DNA, 23 bp, Homo sapiens
cagagaatttctaccatttcaga

SEQ ID NO: 1217537 - DNA, 20 bp, Homo sapiens
cagagacaaaatatttccca

SEQ ID NO: 1217538 - DNA, 18 bp, Homo sapiens
cagagacacctgcacctc

SEQ ID NO: 1217539 - DNA, 23 bp, Homo sapiens
cagagacactgttgataaaaact

SEQ ID NO: 1217540 - DNA, 12 bp, Homo sapiens
cagagacagata

SEQ ID NO: 1217541 - DNA, 15 bp, Homo sapiens
cagagacaggaaaat

SEQ ID NO: 1217542 - DNA, 23 bp, Homo sapiens
cagagacaggaaaatcctctggc

SEQ ID NO: 1217543 - DNA, 14 bp, Homo sapiens
cagagacaggccca

SEQ ID NO: 1217544 - DNA, 19 bp, Homo sapiens
cagacctggagcccctggg

SEQ ID NO: 1217545 - DNA, 21 bp, Homo sapiens
cagacctggagcccctgggtg

SEQ ID NO: 1217546 - DNA, 19 bp, Homo sapiens
cagacctgtcaccctgcag

SEQ ID NO: 1217547 - DNA, 20 bp, Homo sapiens
cagacctgtcaccctgcagg

SEQ ID NO: 1217548 - DNA, 16 bp, Homo sapiens
cagacctgtcttccaa

SEQ ID NO: 1217549 - DNA, 23 bp, Homo sapiens
cagacctgtcttccaaggagacc

SEQ ID NO: 1217550 - DNA, 17 bp, Homo sapiens
cagaaggatgaatgagg

SEQ ID NO: 1217551 - DNA, 23 bp, Homo sapiens
cagaaggcaaagtttacagatgt

SEQ ID NO: 1217552 - DNA, 18 bp, Homo sapiens
cagaaggccaagaatcaa

SEQ ID NO: 1217553 - DNA, 18 bp, Homo sapiens
cagaagggaattgctcag

SEQ ID NO: 1217554 - DNA, 15 bp, Homo sapiens
cagaagggagaagga

SEQ ID NO: 1217555 - DNA, 13 bp, Homo sapiens
cagaagggcagtg

SEQ ID NO: 1217556 - DNA, 16 bp, Homo sapiens
cagaaggggagctttt

SEQ ID NO: 1217557 - DNA, 15 bp, Homo sapiens
cagaagggggccatg

SEQ ID NO: 1217558 - DNA, 16 bp, Homo sapiens
cagaaggtatcagtta

SEQ ID NO: 1217559 - DNA, 21 bp, Homo sapiens
cagaaggtatcagttatatga

SEQ ID NO: 1217560 - DNA, 23 bp, Homo sapiens
cagaaggttgctctagattgaga

SEQ ID NO: 1217561 - DNA, 16 bp, Homo sapiens
cagaagtaagcctcat

SEQ ID NO: 1217562 - DNA, 16 bp, Homo sapiens
cagaagtaccagacta

SEQ ID NO: 1217563 - DNA, 22 bp, Homo sapiens
cagaagtacttttctgttcatc

SEQ ID NO: 1217564 - DNA, 17 bp, Homo sapiens
cagaagtcatcttgcta

SEQ ID NO: 1217565 - DNA, 19 bp, Homo sapiens
cagaagtgagcccccccct

SEQ ID NO: 1217566 - DNA, 21 bp, Homo sapiens
cagaagtgagcccccccctta

SEQ ID NO: 1217567 - DNA, 17 bp, Homo sapiens
cagaagtgagctttgct

SEQ ID NO: 1217568 - DNA, 20 bp, Homo sapiens
cagaagtgagctttgctgct

SEQ ID NO: 1217569 - DNA, 15 bp, Homo sapiens
cagaagtgatttagt

SEQ ID NO: 1217570 - DNA, 19 bp, Homo sapiens
cagaagtgtcaccctgtgg

SEQ ID NO: 1217571 - DNA, 18 bp, Homo sapiens
cagaagttagtttgtata

SEQ ID NO: 1217572 - DNA, 15 bp, Homo sapiens
cagaagtttctcagc

SEQ ID NO: 1217573 - DNA, 19 bp, Homo sapiens
cagaagtttctcagctccc

SEQ ID NO: 1217574 - DNA, 16 bp, Homo sapiens
cagaagtttggcaata

SEQ ID NO: 1217575 - DNA, 20 bp, Homo sapiens
cagaataaaagttcctctcc

SEQ ID NO: 1217576 - DNA, 17 bp, Homo sapiens
cagaataaatccttggg

SEQ ID NO: 1217577 - DNA, 19 bp, Homo sapiens
cagaataaattgatccttt

SEQ ID NO: 1217578 - DNA, 15 bp, Homo sapiens
cagaataagttattg

SEQ ID NO: 1217579 - DNA, 18 bp, Homo sapiens
cagaataagttattgcag

SEQ ID NO: 1217580 - DNA, 20 bp, Homo sapiens
cagaataagttattgcagtt

SEQ ID NO: 1217581 - DNA, 17 bp, Homo sapiens
cagaataatctttgggt

SEQ ID NO: 1217582 - DNA, 12 bp, Homo sapiens
cagaataatgga

SEQ ID NO: 1217583 - DNA, 15 bp, Homo sapiens
cagaataatggaaac

SEQ ID NO: 1217584 - DNA, 19 bp, Homo sapiens
cagaataatggaaacatta

SEQ ID NO: 1217585 - DNA, 23 bp, Homo sapiens
cagaatacagtaagctgctctat

SEQ ID NO: 1217586 - DNA, 15 bp, Homo sapiens
cagaataccttcttc

SEQ ID NO: 1217587 - DNA, 21 bp, Homo sapiens
cagaataccttcttcgctgct

SEQ ID NO: 1217588 - DNA, 23 bp, Homo sapiens
cagaataccttcttcgctgctag

SEQ ID NO: 1217589 - DNA, 22 bp, Homo sapiens
cagaatacggaagagcaggtga

SEQ ID NO: 1217590 - DNA, 15 bp, Homo sapiens
cagaatagccacatt

SEQ ID NO: 1217591 - DNA, 20 bp, Homo sapiens
cagaatagctgttttgtgta

SEQ ID NO: 1217592 - DNA, 15 bp, Homo sapiens
cagaatataacatgt

SEQ ID NO: 1217593 - DNA, 12 bp, Homo sapiens
cagaatatctgg

SEQ ID NO: 1217594 - DNA, 22 bp, Homo sapiens
cagaatatttttatatttcctt

SEQ ID NO: 1217595 - DNA, 23 bp, Homo sapiens
cagaatatttttatatttccttt

SEQ ID NO: 1217596 - DNA, 21 bp, Homo sapiens
cagaatcatatgattctgctt

SEQ ID NO: 1217597 - DNA, 15 bp, Homo sapiens
cagaatcattgctta

SEQ ID NO: 1217598 - DNA, 20 bp, Homo sapiens
cagaatccataaatgtgttc

SEQ ID NO: 1217599 - DNA, 21 bp, Homo sapiens
cagaatccataaatgtgttcc

SEQ ID NO: 1217600 - DNA, 18 bp, Homo sapiens
cagaatcccagccggcca

SEQ ID NO: 1217601 - DNA, 19 bp, Homo sapiens
cagaatccccaagtgcctg

SEQ ID NO: 1217602 - DNA, 20 bp, Homo sapiens
cagaatctaaacgtggtcac

SEQ ID NO: 1217603 - DNA, 23 bp, Homo sapiens
cagaatctaaacgtggtcacctt

SEQ ID NO: 1217604 - DNA, 18 bp, Homo sapiens
cagaatctgctgttgcca

SEQ ID NO: 1217605 - DNA, 13 bp, Homo sapiens
cagaatcttctgg

SEQ ID NO: 1217606 - DNA, 16 bp, Homo sapiens
cagaatcttgactttc

SEQ ID NO: 1217607 - DNA, 21 bp, Homo sapiens
cagaatcttgactttctgatt

SEQ ID NO: 1217608 - DNA, 15 bp, Homo sapiens
cagaatctttgttaa

SEQ ID NO: 1217609 - DNA, 20 bp, Homo sapiens
cagaatgaaccctcctcctt

SEQ ID NO: 1217610 - DNA, 15 bp, Homo sapiens
cagaatgcattaaaa

SEQ ID NO: 1217611 - DNA, 18 bp, Homo sapiens
cagaatgcattaaaaaaa

SEQ ID NO: 1217612 - DNA, 17 bp, Homo sapiens
cagaatgctatttcact

SEQ ID NO: 1217613 - DNA, 13 bp, Homo sapiens
cagaatgctcagg

SEQ ID NO: 1217614 - DNA, 15 bp, Homo sapiens
cagaatgctcctgag

SEQ ID NO: 1217615 - DNA, 11 bp, Homo sapiens
cagaatgctgt

SEQ ID NO: 1217616 - DNA, 17 bp, Homo sapiens
cagaatgctgtacatct

SEQ ID NO: 1217617 - DNA, 16 bp, Homo sapiens
cagaatggaggcaggg

SEQ ID NO: 1217618 - DNA, 19 bp, Homo sapiens
cagaatgggccactgtagg

SEQ ID NO: 1217619 - DNA, 17 bp, Homo sapiens
cagaatgggggctttcg

SEQ ID NO: 1217620 - DNA, 21 bp, Homo sapiens
cagaatgtcattttggtactt

SEQ ID NO: 1217621 - DNA, 17 bp, Homo sapiens
cagaatgtgaaaaagga

SEQ ID NO: 1217622 - DNA, 15 bp, Homo sapiens
cagaatgtgttcttt

SEQ ID NO: 1217623 - DNA, 17 bp, Homo sapiens
cagaattaaacttttaa

SEQ ID NO: 1217624 - DNA, 19 bp, Homo sapiens
cagaattaaacttttaatt

SEQ ID NO: 1217625 - DNA, 22 bp, Homo sapiens
cagaattaagaaatactcatgt

SEQ ID NO: 1217626 - DNA, 14 bp, Homo sapiens
cagaattaagcaga

SEQ ID NO: 1217627 - DNA, 21 bp, Homo sapiens
cagaattagatggcttatttt

SEQ ID NO: 1217628 - DNA, 15 bp, Homo sapiens
cagaattatttttaa

SEQ ID NO: 1217629 - DNA, 15 bp, Homo sapiens
cagaattcaaaagtg

SEQ ID NO: 1217630 - DNA, 14 bp, Homo sapiens
cagaattcattcat

SEQ ID NO: 1217631 - DNA, 14 bp, Homo sapiens
cagaattcccttga

SEQ ID NO: 1217632 - DNA, 22 bp, Homo sapiens
cagaattcccttgaattgtgta

SEQ ID NO: 1217633 - DNA, 23 bp, Homo sapiens
cagaattcccttgaattgtgtat

SEQ ID NO: 1217634 - DNA, 15 bp, Homo sapiens
cagaattccttttct

SEQ ID NO: 1217635 - DNA, 17 bp, Homo sapiens
cagaattcggtgtgctg

SEQ ID NO: 1217636 - DNA, 21 bp, Homo sapiens
cagaattcggtgtgctgccaa

SEQ ID NO: 1217637 - DNA, 22 bp, Homo sapiens
cagaattcggtgtgctgccaac

SEQ ID NO: 1217638 - DNA, 15 bp, Homo sapiens
cagaattctctagtt

SEQ ID NO: 1217639 - DNA, 18 bp, Homo sapiens
cagaattctctagtttga

SEQ ID NO: 1217640 - DNA, 14 bp, Homo sapiens
cagaattctgctac

SEQ ID NO: 1217641 - DNA, 21 bp, Homo sapiens
cagaattctgctacctcactg

SEQ ID NO: 1217642 - DNA, 22 bp, Homo sapiens
cagaattgactgcagttgaaca

SEQ ID NO: 1217643 - DNA, 23 bp, Homo sapiens
cagaattggatacatacaccagc

SEQ ID NO: 1217644 - DNA, 18 bp, Homo sapiens
cagaattggcataatttg

SEQ ID NO: 1217645 - DNA, 20 bp, Homo sapiens
cagaattgtatctcatactg

SEQ ID NO: 1217646 - DNA, 19 bp, Homo sapiens
cagaatttattagtttaaa

SEQ ID NO: 1217647 - DNA, 19 bp, Homo sapiens
cagaatttctttgtcattc

SEQ ID NO: 1217648 - DNA, 22 bp, Homo sapiens
cagaatttctttgtcattcaag

SEQ ID NO: 1217649 - DNA, 14 bp, Homo sapiens
cagaatttgagaac

SEQ ID NO: 1217650 - DNA, 16 bp, Homo sapiens
cagaatttgagaacct

SEQ ID NO: 1217651 - DNA, 21 bp, Homo sapiens
cagaatttgtatgtattttca

SEQ ID NO: 1217652 - DNA, 13 bp, Homo sapiens
cagaattttaatg

SEQ ID NO: 1217653 - DNA, 24 bp, Homo sapiens
cagaattttaatgtgaagacattt

SEQ ID NO: 1217654 - DNA, 15 bp, Homo sapiens
cagaattttaggaac

SEQ ID NO: 1217655 - DNA, 21 bp, Homo sapiens
cagaattttaggaacttcaga

SEQ ID NO: 1217656 - DNA, 22 bp, Homo sapiens
cagacaaaaacagcctcacaga

SEQ ID NO: 1217657 - DNA, 20 bp, Homo sapiens
cagacaaaatgaaagaaaat

SEQ ID NO: 1217658 - DNA, 20 bp, Homo sapiens
cagacaaaatggatacataa

SEQ ID NO: 1217659 - DNA, 16 bp, Homo sapiens
cagacaaaatttgaga

SEQ ID NO: 1217660 - DNA, 16 bp, Homo sapiens
cagacaaatttaaagg

SEQ ID NO: 1217661 - DNA, 22 bp, Homo sapiens
cagacaaatttaaaggaaacac

SEQ ID NO: 1217662 - DNA, 20 bp, Homo sapiens
cagacaacaccttcctcctg

SEQ ID NO: 1217663 - DNA, 22 bp, Homo sapiens
cagacaacaccttcctcctgca

SEQ ID NO: 1217664 - DNA, 14 bp, Homo sapiens
cagacaacagaagt

SEQ ID NO: 1217665 - DNA, 13 bp, Homo sapiens
cagacaaccaaaa

SEQ ID NO: 1217666 - DNA, 15 bp, Homo sapiens
cagacaaccaaaaca

SEQ ID NO: 1217667 - DNA, 17 bp, Homo sapiens
cagacaaccaaaacata

SEQ ID NO: 1217668 - DNA, 18 bp, Homo sapiens
cagacaaccttgtcccaa

SEQ ID NO: 1217669 - DNA, 21 bp, Homo sapiens
cagacaaccttgtcccaagga

SEQ ID NO: 1217670 - DNA, 22 bp, Homo sapiens
cagacaacgggcccatggcctt

SEQ ID NO: 1217671 - DNA, 19 bp, Homo sapiens
cagacaactctagaaatgc

SEQ ID NO: 1217672 - DNA, 17 bp, Homo sapiens
cagacaagagctgctgt

SEQ ID NO: 1217673 - DNA, 22 bp, Homo sapiens
cagagacagggaaaggtcagcc

SEQ ID NO: 1217674 - DNA, 16 bp, Homo sapiens
cagagaccacaccact

SEQ ID NO: 1217675 - DNA, 14 bp, Homo sapiens
cagagaccagcact

SEQ ID NO: 1217676 - DNA, 15 bp, Homo sapiens
cagagaccagcactc

SEQ ID NO: 1217677 - DNA, 16 bp, Homo sapiens
cagagaccagcactca

SEQ ID NO: 1217678 - DNA, 15 bp, Homo sapiens
cagagaccaggctgt

SEQ ID NO: 1217679 - DNA, 15 bp, Homo sapiens
cagagaccagggctc

SEQ ID NO: 1217680 - DNA, 21 bp, Homo sapiens
cagagaccagggctccagccc

SEQ ID NO: 1217681 - DNA, 16 bp, Homo sapiens
cagagaccccttcctt

SEQ ID NO: 1217682 - DNA, 13 bp, Homo sapiens
cagagacgcagga

SEQ ID NO: 1217683 - DNA, 15 bp, Homo sapiens
cagagacggtctgga

SEQ ID NO: 1217684 - DNA, 14 bp, Homo sapiens
cagagactctattt

SEQ ID NO: 1217685 - DNA, 18 bp, Homo sapiens
cagagactctattttaat

SEQ ID NO: 1217686 - DNA, 20 bp, Homo sapiens
cagagactctattttaatgt

SEQ ID NO: 1217687 - DNA, 18 bp, Homo sapiens
cagagagaacaacaggca

SEQ ID NO: 1217688 - DNA, 16 bp, Homo sapiens
cagagagaatgagagc

SEQ ID NO: 1217689 - DNA, 14 bp, Homo sapiens
cagagagacagacc

SEQ ID NO: 1217690 - DNA, 15 bp, Homo sapiens
cagagagacagaccg

SEQ ID NO: 1217691 - DNA, 15 bp, Homo sapiens
cagagagaccctgca

SEQ ID NO: 1217692 - DNA, 16 bp, Homo sapiens
cagagagaccctgcaa

SEQ ID NO: 1217693 - DNA, 17 bp, Homo sapiens
cagagagacctcatcct

SEQ ID NO: 1217694 - DNA, 19 bp, Homo sapiens
cagagagagaagtgcccct

SEQ ID NO: 1217695 - DNA, 21 bp, Homo sapiens
cagagagagaagtgcccctgc

SEQ ID NO: 1217696 - DNA, 22 bp, Homo sapiens
cagagagagaagtgcccctgct

SEQ ID NO: 1217697 - DNA, 13 bp, Homo sapiens
cagagagagccag

SEQ ID NO: 1217698 - DNA, 12 bp, Homo sapiens
cagagagagggg

SEQ ID NO: 1217699 - DNA, 12 bp, Homo sapiens
cagagagcaggc

SEQ ID NO: 1217700 - DNA, 14 bp, Homo sapiens
cagagagcaggcag

SEQ ID NO: 1217701 - DNA, 14 bp, Homo sapiens
cagagagcagggga

SEQ ID NO: 1217702 - DNA, 15 bp, Homo sapiens
cagagagcatctttc

SEQ ID NO: 1217703 - DNA, 20 bp, Homo sapiens
cagagagcctagaacatccc

SEQ ID NO: 1217704 - DNA, 19 bp, Homo sapiens
cagagagcctggtgctgct

SEQ ID NO: 1217705 - DNA, 19 bp, Homo sapiens
cagagagctggtagttagt

SEQ ID NO: 1217706 - DNA, 18 bp, Homo sapiens
cagagaggactgtaggga

SEQ ID NO: 1217707 - DNA, 13 bp, Homo sapiens
cagagaggagaaa

SEQ ID NO: 1217708 - DNA, 16 bp, Homo sapiens
cagagaggagaaacac

SEQ ID NO: 1217709 - DNA, 21 bp, Homo sapiens
cagagaggagaaacacatctt

SEQ ID NO: 1217710 - DNA, 17 bp, Homo sapiens
cagagaggagcacctga

SEQ ID NO: 1217711 - DNA, 11 bp, Homo sapiens
cagagaggagt

SEQ ID NO: 1217712 - DNA, 16 bp, Homo sapiens
cagagaggatacattt

SEQ ID NO: 1217713 - DNA, 18 bp, Homo sapiens
cagagaggatacatttaa

SEQ ID NO: 1217714 - DNA, 13 bp, Homo sapiens
cagagaggccttt

SEQ ID NO: 1217715 - DNA, 15 bp, Homo sapiens
cagagagggcccagc

SEQ ID NO: 1217716 - DNA, 18 bp, Homo sapiens
cagagagggtgacaagat

SEQ ID NO: 1217717 - DNA, 17 bp, Homo sapiens
cagagaggtctcaggtt

SEQ ID NO: 1217718 - DNA, 15 bp, Homo sapiens
cagagaggtggccac

SEQ ID NO: 1217719 - DNA, 15 bp, Homo sapiens
cagagagtcctctgg

SEQ ID NO: 1217720 - DNA, 18 bp, Homo sapiens
cagagagtcctctggatg

SEQ ID NO: 1217721 - DNA, 13 bp, Homo sapiens
cagagagtggctc

SEQ ID NO: 1217722 - DNA, 14 bp, Homo sapiens
cagagagtggctcc

SEQ ID NO: 1217723 - DNA, 14 bp, Homo sapiens
cagagagtgtacat

SEQ ID NO: 1217724 - DNA, 15 bp, Homo sapiens
cagagataggcctgt

SEQ ID NO: 1217725 - DNA, 22 bp, Homo sapiens
cagagatagtggggagacttct

SEQ ID NO: 1217726 - DNA, 21 bp, Homo sapiens
cagagatgatcagtccaactg

SEQ ID NO: 1217727 - DNA, 18 bp, Homo sapiens
cagagatgcctccaccgc

SEQ ID NO: 1217728 - DNA, 16 bp, Homo sapiens
cagagatgtactgcaa

SEQ ID NO: 1217729 - DNA, 13 bp, Homo sapiens
cagagattctgga

SEQ ID NO: 1217730 - DNA, 22 bp, Homo sapiens
cagagattctggatctcctgct

SEQ ID NO: 1217731 - DNA, 23 bp, Homo sapiens
cagagattctggatctcctgctg

SEQ ID NO: 1217732 - DNA, 24 bp, Homo sapiens
cagagattctggatctcctgctgc

SEQ ID NO: 1217733 - DNA, 17 bp, Homo sapiens
cagagattgaactccaa

SEQ ID NO: 1217734 - DNA, 15 bp, Homo sapiens
cagagcaaagcgccc

SEQ ID NO: 1217735 - DNA, 22 bp, Homo sapiens
cagagcaaagcgcccacccagg

SEQ ID NO: 1217736 - DNA, 15 bp, Homo sapiens
cagagcaacctctca

SEQ ID NO: 1217737 - DNA, 19 bp, Homo sapiens
cagagccctggctgggttc

SEQ ID NO: 1217738 - DNA, 21 bp, Homo sapiens
cagagcccttcactgccatga

SEQ ID NO: 1217739 - DNA, 18 bp, Homo sapiens
cagagccggcatccttgc

SEQ ID NO: 1217740 - DNA, 15 bp, Homo sapiens
cagagccggccgcct

SEQ ID NO: 1217741 - DNA, 22 bp, Homo sapiens
cagagccgggaggaaaaggccc

SEQ ID NO: 1217742 - DNA, 16 bp, Homo sapiens
cagagcctaccttcac

SEQ ID NO: 1217743 - DNA, 17 bp, Homo sapiens
cagagcctaccttcacc

SEQ ID NO: 1217744 - DNA, 16 bp, Homo sapiens
cagagcctcctgggaa

SEQ ID NO: 1217745 - DNA, 20 bp, Homo sapiens
cagagcctctgagatgatgc

SEQ ID NO: 1217746 - DNA, 14 bp, Homo sapiens
cagagcctgaattt

SEQ ID NO: 1217747 - DNA, 12 bp, Homo sapiens
cagagcctggct

SEQ ID NO: 1217748 - DNA, 12 bp, Homo sapiens
cagagcctgtcc

SEQ ID NO: 1217749 - DNA, 14 bp, Homo sapiens
cagagcctgtcccc

SEQ ID NO: 1217750 - DNA, 22 bp, Homo sapiens
cagagccttccatgacctcccc

SEQ ID NO: 1217751 - DNA, 18 bp, Homo sapiens
cagagccttctcagaagc

SEQ ID NO: 1217752 - DNA, 21 bp, Homo sapiens
cagagccttctcagaagcaca

SEQ ID NO: 1217753 - DNA, 19 bp, Homo sapiens
cagagcctttggatgacca

SEQ ID NO: 1217754 - DNA, 20 bp, Homo sapiens
cagagcctttggatgaccag

SEQ ID NO: 1217755 - DNA, 22 bp, Homo sapiens
cagagcgataatacactattat

SEQ ID NO: 1217756 - DNA, 15 bp, Homo sapiens
cagagcgcacaggga

SEQ ID NO: 1217757 - DNA, 18 bp, Homo sapiens
cagagcgccaggaagcca

SEQ ID NO: 1217758 - DNA, 18 bp, Homo sapiens
cagagcggtatctctggc

SEQ ID NO: 1217759 - DNA, 22 bp, Homo sapiens
cagagcggtatctctggcacca

SEQ ID NO: 1217760 - DNA, 19 bp, Homo sapiens
cagagcgtccttccccctg

SEQ ID NO: 1217761 - DNA, 18 bp, Homo sapiens
cagagctaaactccttcc

SEQ ID NO: 1217762 - DNA, 22 bp, Homo sapiens
cagagctaaactccttcctggc

SEQ ID NO: 1217763 - DNA, 20 bp, Homo sapiens
cagagctagggctgctgctt

SEQ ID NO: 1217764 - DNA, 21 bp, Homo sapiens
cagagctagggctgctgcttc

SEQ ID NO: 1217765 - DNA, 22 bp, Homo sapiens
cagagctagggctgctgcttct

SEQ ID NO: 1217766 - DNA, 20 bp, Homo sapiens
cagagctcatcccccctgct

SEQ ID NO: 1217767 - DNA, 23 bp, Homo sapiens
cagagctcatcccccctgctgcc

SEQ ID NO: 1217768 - DNA, 14 bp, Homo sapiens
cagagctctctgag

SEQ ID NO: 1217769 - DNA, 15 bp, Homo sapiens
cagagctcttatgtg

SEQ ID NO: 1217770 - DNA, 17 bp, Homo sapiens
cagagctcttcaagctg

SEQ ID NO: 1217771 - DNA, 18 bp, Homo sapiens
cagagctcttcaagctgt

SEQ ID NO: 1217772 - DNA, 22 bp, Homo sapiens
cagagctcttcaagctgtcccc

SEQ ID NO: 1217773 - DNA, 21 bp, Homo sapiens
cagagctgaggatttcctgga

SEQ ID NO: 1217774 - DNA, 23 bp, Homo sapiens
cagagctgaggatttcctggagt

SEQ ID NO: 1217775 - DNA, 16 bp, Homo sapiens
cagagctgagggccct

SEQ ID NO: 1217776 - DNA, 13 bp, Homo sapiens
cagagctggaagg

SEQ ID NO: 1217777 - DNA, 18 bp, Homo sapiens
cagagctggaaggcaggg

SEQ ID NO: 1217778 - DNA, 20 bp, Homo sapiens
cagagctggaaggcagggca

SEQ ID NO: 1217779 - DNA, 23 bp, Homo sapiens
cagagctggaaggcagggcagag

SEQ ID NO: 1217780 - DNA, 21 bp, Homo sapiens
cagagctggcatctatctggt

SEQ ID NO: 1217781 - DNA, 15 bp, Homo sapiens
cagagctggcctccc

SEQ ID NO: 1217782 - DNA, 10 bp, Homo sapiens
cagagctggg

SEQ ID NO: 1217783 - DNA, 15 bp, Homo sapiens
cagagctgggaggca

SEQ ID NO: 1217784 - DNA, 20 bp, Homo sapiens
cagagctgggaggcatggcc

SEQ ID NO: 1217785 - DNA, 23 bp, Homo sapiens
cagagctgggaggcatggccctg

SEQ ID NO: 1217786 - DNA, 14 bp, Homo sapiens
cagagctgggaggg

SEQ ID NO: 1217787 - DNA, 22 bp, Homo sapiens
cagagctggggctgccagcctg

SEQ ID NO: 1217788 - DNA, 13 bp, Homo sapiens
cagagctgggtgg

SEQ ID NO: 1217789 - DNA, 12 bp, Homo sapiens
cagagctgtgcc

SEQ ID NO: 1217790 - DNA, 13 bp, Homo sapiens
cagagctgtgcca

SEQ ID NO: 1217791 - DNA, 13 bp, Homo sapiens
cagagctgtgcct

SEQ ID NO: 1217792 - DNA, 14 bp, Homo sapiens
cagatactgtcttt

SEQ ID NO: 1217793 - DNA, 19 bp, Homo sapiens
cagatacttggggggctga

SEQ ID NO: 1217794 - DNA, 21 bp, Homo sapiens
cagatagaaaacagcccccac

SEQ ID NO: 1217795 - DNA, 22 bp, Homo sapiens
cagatagaaaacagcccccact

SEQ ID NO: 1217796 - DNA, 13 bp, Homo sapiens
cagatagagctgg

SEQ ID NO: 1217797 - DNA, 14 bp, Homo sapiens
cagatagagctggg

SEQ ID NO: 1217798 - DNA, 17 bp, Homo sapiens
cagatagagctgggtgg

SEQ ID NO: 1217799 - DNA, 22 bp, Homo sapiens
cagatataaaagactgaccaat

SEQ ID NO: 1217800 - DNA, 18 bp, Homo sapiens
cagatataaatggctggt

SEQ ID NO: 1217801 - DNA, 14 bp, Homo sapiens
cagatataagagaa

SEQ ID NO: 1217802 - DNA, 19 bp, Homo sapiens
cagatatagatcctgagct

SEQ ID NO: 1217803 - DNA, 20 bp, Homo sapiens
cagatatatatcatattggt

SEQ ID NO: 1217804 - DNA, 19 bp, Homo sapiens
cagatatatttttcacagt

SEQ ID NO: 1217805 - DNA, 15 bp, Homo sapiens
cagatatcaaaattc

SEQ ID NO: 1217806 - DNA, 18 bp, Homo sapiens
cagatatccacataaatg

SEQ ID NO: 1217807 - DNA, 20 bp, Homo sapiens
cagatatccacataaatgct

SEQ ID NO: 1217808 - DNA, 15 bp, Homo sapiens
cagatatttgtcatg

SEQ ID NO: 1217809 - DNA, 20 bp, Homo sapiens
cagatattttttcagaaata

SEQ ID NO: 1217810 - DNA, 17 bp, Homo sapiens
cagatcaaaatgccttt

SEQ ID NO: 1217811 - DNA, 21 bp, Homo sapiens
cagatcaccagcccggcctgc

SEQ ID NO: 1217812 - DNA, 14 bp, Homo sapiens
cagatcacgaggtc

SEQ ID NO: 1217813 - DNA, 15 bp, Homo sapiens
cagatcactgccaca

SEQ ID NO: 1217814 - DNA, 16 bp, Homo sapiens
cagatcaggaaccagg

SEQ ID NO: 1217815 - DNA, 18 bp, Homo sapiens
cagatcaggaaccagggc

SEQ ID NO: 1217816 - DNA, 20 bp, Homo sapiens
cagatcaggaaccagggcct

SEQ ID NO: 1217817 - DNA, 21 bp, Homo sapiens
cagatcaggaaccagggcctc

SEQ ID NO: 1217818 - DNA, 18 bp, Homo sapiens
cagatcaggccttctttg

SEQ ID NO: 1217819 - DNA, 17 bp, Homo sapiens
cagatcatccgtctgtg

SEQ ID NO: 1217820 - DNA, 13 bp, Homo sapiens
cagatccaaggcc

SEQ ID NO: 1217821 - DNA, 14 bp, Homo sapiens
cagatccccaagcc

SEQ ID NO: 1217822 - DNA, 23 bp, Homo sapiens
cagatcctgggtactgaaagcct

SEQ ID NO: 1217823 - DNA, 15 bp, Homo sapiens
cagatccttagagaa

SEQ ID NO: 1217824 - DNA, 17 bp, Homo sapiens
cagatcgaaattggact

SEQ ID NO: 1217825 - DNA, 20 bp, Homo sapiens
cagatctatagcagagtcct

SEQ ID NO: 1217826 - DNA, 14 bp, Homo sapiens
cagatctcccactg

SEQ ID NO: 1217827 - DNA, 16 bp, Homo sapiens
cagccagctgcagggc

SEQ ID NO: 1217828 - DNA, 18 bp, Homo sapiens
cagccagctgcagggcac

SEQ ID NO: 1217829 - DNA, 20 bp, Homo sapiens
cagccagctgcagggcacgg

SEQ ID NO: 1217830 - DNA, 13 bp, Homo sapiens
cagccaggacccg

SEQ ID NO: 1217831 - DNA, 20 bp, Homo sapiens
cagccaggacccgcctgctc

SEQ ID NO: 1217832 - DNA, 11 bp, Homo sapiens
cagccaggagg

SEQ ID NO: 1217833 - DNA, 13 bp, Homo sapiens
cagccaggaggga

SEQ ID NO: 1217834 - DNA, 21 bp, Homo sapiens
cagccaggagtgcccccggga

SEQ ID NO: 1217835 - DNA, 16 bp, Homo sapiens
cagccaggccaacagc

SEQ ID NO: 1217836 - DNA, 17 bp, Homo sapiens
cagccaggcccaggcca

SEQ ID NO: 1217837 - DNA, 19 bp, Homo sapiens
cagcagccctcctcacccc

SEQ ID NO: 1217838 - DNA, 19 bp, Homo sapiens
cagcagccctgccccacac

SEQ ID NO: 1217839 - DNA, 15 bp, Homo sapiens
cagcattctggaggg

SEQ ID NO: 1217840 - DNA, 23 bp, Homo sapiens
cagcacaaccggtcccttccatg

SEQ ID NO: 1217841 - DNA, 13 bp, Homo sapiens
cagcacaaggcca

SEQ ID NO: 1217842 - DNA, 18 bp, Homo sapiens
cagcacaaggccttgcct

SEQ ID NO: 1217843 - DNA, 14 bp, Homo sapiens
cagcacaagggcac

SEQ ID NO: 1217844 - DNA, 22 bp, Homo sapiens
cagcacaattctgtccctgtcc

SEQ ID NO: 1217845 - DNA, 20 bp, Homo sapiens
cagcacacacaaacctactg

SEQ ID NO: 1217846 - DNA, 17 bp, Homo sapiens
cagcccctgggaacagg

SEQ ID NO: 1217847 - DNA, 22 bp, Homo sapiens
cagcccctgggaacaggcccca

SEQ ID NO: 1217848 - DNA, 20 bp, Homo sapiens
cagcccctgggcccttgtgc

SEQ ID NO: 1217849 - DNA, 17 bp, Homo sapiens
cagcccctggggcccag

SEQ ID NO: 1217850 - DNA, 20 bp, Homo sapiens
cagcccctgtatggcactgg

SEQ ID NO: 1217851 - DNA, 14 bp, Homo sapiens
cagcccctgtccca

SEQ ID NO: 1217852 - DNA, 21 bp, Homo sapiens
cagcccctgtttactggttct

SEQ ID NO: 1217853 - DNA, 16 bp, Homo sapiens
cagccccttctcagaa

SEQ ID NO: 1217854 - DNA, 13 bp, Homo sapiens
cagccccttctcc

SEQ ID NO: 1217855 - DNA, 17 bp, Homo sapiens
cagccccttctcccagc

SEQ ID NO: 1217856 - DNA, 18 bp, Homo sapiens
cagccccttgagaaacct

SEQ ID NO: 1217857 - DNA, 17 bp, Homo sapiens
cagcccctttgcctctg

SEQ ID NO: 1217858 - DNA, 18 bp, Homo sapiens
cagcccctttgcctctgt

SEQ ID NO: 1217859 - DNA, 21 bp, Homo sapiens
cagccccttttctctgctctt

SEQ ID NO: 1217860 - DNA, 16 bp, Homo sapiens
cagcccgaatgcctgt

SEQ ID NO: 1217861 - DNA, 15 bp, Homo sapiens
cagcccgacagtgcc

SEQ ID NO: 1217862 - DNA, 16 bp, Homo sapiens
cagcccgacagtgcca

SEQ ID NO: 1217863 - DNA, 20 bp, Homo sapiens
cagcccgacagtgccatccc

SEQ ID NO: 1217864 - DNA, 15 bp, Homo sapiens
cagcccgcagcacat

SEQ ID NO: 1217865 - DNA, 13 bp, Homo sapiens
cagcccgcctgcc

SEQ ID NO: 1217866 - DNA, 19 bp, Homo sapiens
cagcccgcctgccgtgcat

SEQ ID NO: 1217867 - DNA, 23 bp, Homo sapiens
cagcccgcctgccgtgcatggct

SEQ ID NO: 1217868 - DNA, 13 bp, Homo sapiens
cagcccgcggcct

SEQ ID NO: 1217869 - DNA, 17 bp, Homo sapiens
cagcccgctaggctcgc

SEQ ID NO: 1217870 - DNA, 16 bp, Homo sapiens
cagcccgctctctggc

SEQ ID NO: 1217871 - DNA, 14 bp, Homo sapiens
cagcccgctgagtg

SEQ ID NO: 1217872 - DNA, 15 bp, Homo sapiens
cagcccggaccttgg

SEQ ID NO: 1217873 - DNA, 14 bp, Homo sapiens
cagcccggcctgct

SEQ ID NO: 1217874 - DNA, 20 bp, Homo sapiens
cagcccggcctgctcccagc

SEQ ID NO: 1217875 - DNA, 21 bp, Homo sapiens
cagcccggcctgctcccagca

SEQ ID NO: 1217876 - DNA, 21 bp, Homo sapiens
cagcccggcgccaccatcctg

SEQ ID NO: 1217877 - DNA, 17 bp, Homo sapiens
cagcccggctgctgctt

SEQ ID NO: 1217878 - DNA, 16 bp, Homo sapiens
cagcccgggagcctag

SEQ ID NO: 1217879 - DNA, 17 bp, Homo sapiens
cagcccgtcctcctcta

SEQ ID NO: 1217880 - DNA, 18 bp, Homo sapiens
cagcccgtgaagcagtgc

SEQ ID NO: 1217881 - DNA, 19 bp, Homo sapiens
cagcccgtgaagcagtgcc

SEQ ID NO: 1217882 - DNA, 21 bp, Homo sapiens
cagcccgtgtggccccttcac

SEQ ID NO: 1217883 - DNA, 21 bp, Homo sapiens
cagccctaaggatctctcagg

SEQ ID NO: 1217884 - DNA, 15 bp, Homo sapiens
cagccctagctgtcc

SEQ ID NO: 1217885 - DNA, 22 bp, Homo sapiens
cagccctagctgtcccatgggg

SEQ ID NO: 1217886 - DNA, 11 bp, Homo sapiens
cagccctagga

SEQ ID NO: 1217887 - DNA, 14 bp, Homo sapiens
cagccctatggatg

SEQ ID NO: 1217888 - DNA, 18 bp, Homo sapiens
cagccctcagttccttca

SEQ ID NO: 1217889 - DNA, 21 bp, Homo sapiens
cagccctccatggtcctgtct

SEQ ID NO: 1217890 - DNA, 13 bp, Homo sapiens
cagccctccctgc

SEQ ID NO: 1217891 - DNA, 15 bp, Homo sapiens
cagccctccctgccc

SEQ ID NO: 1217892 - DNA, 16 bp, Homo sapiens
cagccctccctgcccc

SEQ ID NO: 1217893 - DNA, 15 bp, Homo sapiens
cagccctccctgtcc

SEQ ID NO: 1217894 - DNA, 19 bp, Homo sapiens
cagccctccctgtcctcct

SEQ ID NO: 1217895 - DNA, 22 bp, Homo sapiens
cagccctccctgtcctcctcgg

SEQ ID NO: 1217896 - DNA, 12 bp, Homo sapiens
cagccctcctca

SEQ ID NO: 1217897 - DNA, 17 bp, Homo sapiens
cagccctcctctgcact

SEQ ID NO: 1217898 - DNA, 18 bp, Homo sapiens
cagccctccttcagggga

SEQ ID NO: 1217899 - DNA, 14 bp, Homo sapiens
cagccctctgcctc

SEQ ID NO: 1217900 - DNA, 17 bp, Homo sapiens
cagccctcttgcccgca

SEQ ID NO: 1217901 - DNA, 19 bp, Homo sapiens
cagccctcttgcccgcacc

SEQ ID NO: 1217902 - DNA, 16 bp, Homo sapiens
cagccctgaccctgtg

SEQ ID NO: 1217903 - DNA, 20 bp, Homo sapiens
cagccctgagtggtcactgg

SEQ ID NO: 1217904 - DNA, 23 bp, Homo sapiens
cagccctgcagcccaaaacccag

SEQ ID NO: 1217905 - DNA, 20 bp, Homo sapiens
cagccctgccccacacctcc

SEQ ID NO: 1217906 - DNA, 21 bp, Homo sapiens
cagccctgccccacacctcct

SEQ ID NO: 1217907 - DNA, 23 bp, Homo sapiens
cagccctgccccacacctcctct

SEQ ID NO: 1217908 - DNA, 15 bp, Homo sapiens
cagccctgcctgaga

SEQ ID NO: 1217909 - DNA, 15 bp, Homo sapiens
cagccctgctgggga

SEQ ID NO: 1217910 - DNA, 20 bp, Homo sapiens
cagccctgctggggatcccc

SEQ ID NO: 1217911 - DNA, 13 bp, Homo sapiens
cagccctgctttg

SEQ ID NO: 1217912 - DNA, 19 bp, Homo sapiens
cagccctgctttgggctgc

SEQ ID NO: 1217913 - DNA, 20 bp, Homo sapiens
cagccctgctttgggctgcc

SEQ ID NO: 1217914 - DNA, 12 bp, Homo sapiens
cagccctggccc

SEQ ID NO: 1217915 - DNA, 17 bp, Homo sapiens
cagccctggcccacccc

SEQ ID NO: 1217916 - DNA, 14 bp, Homo sapiens
cagccctggcccct

SEQ ID NO: 1217917 - DNA, 15 bp, Homo sapiens
cagccctggcccctg

SEQ ID NO: 1217918 - DNA, 18 bp, Homo sapiens
cagccctggcccctgtgg

SEQ ID NO: 1217919 - DNA, 19 bp, Homo sapiens
cagccctggcccctgtggg

SEQ ID NO: 1217920 - DNA, 17 bp, Homo sapiens
cagccctggcctggctg

SEQ ID NO: 1217921 - DNA, 18 bp, Homo sapiens
cagccctggcctggctgg

SEQ ID NO: 1217922 - DNA, 15 bp, Homo sapiens
cagccctggctctgc

SEQ ID NO: 1217923 - DNA, 16 bp, Homo sapiens
cagccctggctctgca

SEQ ID NO: 1217924 - DNA, 21 bp, Homo sapiens
cagccctgggccccaccacct

SEQ ID NO: 1217925 - DNA, 12 bp, Homo sapiens
cagccctgggct

SEQ ID NO: 1217926 - DNA, 13 bp, Homo sapiens
cagccctgggctt

SEQ ID NO: 1217927 - DNA, 23 bp, Homo sapiens
cagccctgggcttggctcttggc

SEQ ID NO: 1217928 - DNA, 16 bp, Homo sapiens
cagccctggttctggc

SEQ ID NO: 1217929 - DNA, 18 bp, Homo sapiens
cagccctgtcacgccggg

SEQ ID NO: 1217930 - DNA, 16 bp, Homo sapiens
cagccctgtcctggtt

SEQ ID NO: 1217931 - DNA, 18 bp, Homo sapiens
cagccctgtgtctgtcac

SEQ ID NO: 1217932 - DNA, 20 bp, Homo sapiens
cagccctgtgtctgtcacag

SEQ ID NO: 1217933 - DNA, 17 bp, Homo sapiens
cagcccttagcacagag

SEQ ID NO: 1217934 - DNA, 19 bp, Homo sapiens
cagcccttagcacagagag

SEQ ID NO: 1217935 - DNA, 23 bp, Homo sapiens
cagcccttatgcggttaattttg

SEQ ID NO: 1217936 - DNA, 12 bp, Homo sapiens
cagcccttccct

SEQ ID NO: 1217937 - DNA, 15 bp, Homo sapiens
cagcccttccctggc

SEQ ID NO: 1217938 - DNA, 22 bp, Homo sapiens
cagcccttcctcctgaagcctc

SEQ ID NO: 1217939 - DNA, 23 bp, Homo sapiens
cagcccttcctcctgaagcctct

SEQ ID NO: 1217940 - DNA, 15 bp, Homo sapiens
cagcccttccttggg

SEQ ID NO: 1217941 - DNA, 18 bp, Homo sapiens
cagcccttctgcctttct

SEQ ID NO: 1217942 - DNA, 21 bp, Homo sapiens
cagcccttgcccccatccctc

SEQ ID NO: 1217943 - DNA, 12 bp, Homo sapiens
cagcccttgctt

SEQ ID NO: 1217944 - DNA, 14 bp, Homo sapiens
cagcccttgcttgt

SEQ ID NO: 1217945 - DNA, 14 bp, Homo sapiens
cagcccttgggcag

SEQ ID NO: 1217946 - DNA, 20 bp, Homo sapiens
cagcccttgtgtgtgccctg

SEQ ID NO: 1217947 - DNA, 19 bp, Homo sapiens
cagccctttgggaggctga

SEQ ID NO: 1217948 - DNA, 20 bp, Homo sapiens
cagccctttgggaggctgag

SEQ ID NO: 1217949 - DNA, 15 bp, Homo sapiens
cagccgaccctcctg

SEQ ID NO: 1217950 - DNA, 21 bp, Homo sapiens
cagccgaccctcctggccttc

SEQ ID NO: 1217951 - DNA, 16 bp, Homo sapiens
cagccggagggaggca

SEQ ID NO: 1217952 - DNA, 19 bp, Homo sapiens
cagccggccaatggaaacc

SEQ ID NO: 1217953 - DNA, 14 bp, Homo sapiens
cagccggcctctct

SEQ ID NO: 1217954 - DNA, 23 bp, Homo sapiens
cagccggcctctctggcctccca

SEQ ID NO: 1217955 - DNA, 24 bp, Homo sapiens
cagccggcctctctggcctcccac

SEQ ID NO: 1217956 - DNA, 15 bp, Homo sapiens
cagccgggggctggc

SEQ ID NO: 1217957 - DNA, 14 bp, Homo sapiens
cagccgtattttac

SEQ ID NO: 1217958 - DNA, 16 bp, Homo sapiens
cagccgtcagccatca

SEQ ID NO: 1217959 - DNA, 20 bp, Homo sapiens
cagccgtcagccatcagcca

SEQ ID NO: 1217960 - DNA, 13 bp, Homo sapiens
cagccgtcccagg

SEQ ID NO: 1217961 - DNA, 9 bp, Homo sapiens
cagccgtgc

SEQ ID NO: 1217962 - DNA, 23 bp, Homo sapiens
cagccgtggtccaaccaggagct

SEQ ID NO: 1217963 - DNA, 19 bp, Homo sapiens
cagccgttttcctcatcct

SEQ ID NO: 1217964 - DNA, 16 bp, Homo sapiens
cagcctaatcccgtgc

SEQ ID NO: 1217965 - DNA, 20 bp, Homo sapiens
cagcctactccgctcactga

SEQ ID NO: 1217966 - DNA, 17 bp, Homo sapiens
cagcctagccgacctca

SEQ ID NO: 1217967 - DNA, 21 bp, Homo sapiens
cagcctagccgacctcagcct

SEQ ID NO: 1217968 - DNA, 17 bp, Homo sapiens
cagcctagcctggctct

SEQ ID NO: 1217969 - DNA, 22 bp, Homo sapiens
cagcctaggacgccaacttctc

SEQ ID NO: 1217970 - DNA, 21 bp, Homo sapiens
cagcctagggctgagctgggg

SEQ ID NO: 1217971 - DNA, 23 bp, Homo sapiens
cagcctagttatcaaggggatga

SEQ ID NO: 1217972 - DNA, 22 bp, Homo sapiens
cagcctatgagcatcctgagcc

SEQ ID NO: 1217973 - DNA, 18 bp, Homo sapiens
cagcctcagaaggcccca

SEQ ID NO: 1217974 - DNA, 14 bp, Homo sapiens
cagcctcagagtgg

SEQ ID NO: 1217975 - DNA, 12 bp, Homo sapiens
cagcctcagtgc

SEQ ID NO: 1217976 - DNA, 17 bp, Homo sapiens
cagcctcagtgccactt

SEQ ID NO: 1217977 - DNA, 19 bp, Homo sapiens
cagcctcagtgccacttga

SEQ ID NO: 1217978 - DNA, 17 bp, Homo sapiens
cagcctcatactcctgg

SEQ ID NO: 1217979 - DNA, 19 bp, Homo sapiens
cagcctcatactcctgggc

SEQ ID NO: 1217980 - DNA, 14 bp, Homo sapiens
cagcctccaagctc

SEQ ID NO: 1217981 - DNA, 18 bp, Homo sapiens
cagcctccaccttgctct

SEQ ID NO: 1217982 - DNA, 19 bp, Homo sapiens
cagcctccaccttgctctt

SEQ ID NO: 1217983 - DNA, 20 bp, Homo sapiens
cagcctccaccttgctcttc

SEQ ID NO: 1217984 - DNA, 17 bp, Homo sapiens
cagcctccagagaagcc

SEQ ID NO: 1217985 - DNA, 23 bp, Homo sapiens
cagcctccagagaagccccgcac

SEQ ID NO: 1217986 - DNA, 20 bp, Homo sapiens
cagcctccagagccagcctg

SEQ ID NO: 1217987 - DNA, 22 bp, Homo sapiens
cagcctccagagccagcctggg

SEQ ID NO: 1217988 - DNA, 12 bp, Homo sapiens
cagcctccaggg

SEQ ID NO: 1217989 - DNA, 15 bp, Homo sapiens
cagcctccagggccc

SEQ ID NO: 1217990 - DNA, 15 bp, Homo sapiens
cagcctccatgtttt

SEQ ID NO: 1217991 - DNA, 19 bp, Homo sapiens
cagcctcccaaagtgctgg

SEQ ID NO: 1217992 - DNA, 20 bp, Homo sapiens
cagcctcccaaagtgctggg

SEQ ID NO: 1217993 - DNA, 19 bp, Homo sapiens
cagcctcccaagtagctgg

SEQ ID NO: 1217994 - DNA, 20 bp, Homo sapiens
cagcctcccaagtagctggg

SEQ ID NO: 1217995 - DNA, 13 bp, Homo sapiens
cagcctcccacaa

SEQ ID NO: 1217996 - DNA, 14 bp, Homo sapiens
cagcctcccacccc

SEQ ID NO: 1217997 - DNA, 16 bp, Homo sapiens
cagcctcccaccccca

SEQ ID NO: 1217998 - DNA, 18 bp, Homo sapiens
cagcctcccacccccatc

SEQ ID NO: 1217999 - DNA, 12 bp, Homo sapiens
cagcctcccagg

SEQ ID NO: 1218000 - DNA, 16 bp, Homo sapiens
cagcctcccatccagg

SEQ ID NO: 1218001 - DNA, 17 bp, Homo sapiens
cagcctcccctgccagg

SEQ ID NO: 1218002 - DNA, 18 bp, Homo sapiens
cagcctcccctgccaggg

SEQ ID NO: 1218003 - DNA, 22 bp, Homo sapiens
cagcctcccctgccagggcagg

SEQ ID NO: 1218004 - DNA, 14 bp, Homo sapiens
cagcctccccttct

SEQ ID NO: 1218005 - DNA, 19 bp, Homo sapiens
cagcctccccttcttcccg

SEQ ID NO: 1218006 - DNA, 18 bp, Homo sapiens
cagcctcccgagtagctg

SEQ ID NO: 1218007 - DNA, 20 bp, Homo sapiens
cagcctcccgagtagctggg

SEQ ID NO: 1218008 - DNA, 19 bp, Homo sapiens
cagcctccctagtagctgg

SEQ ID NO: 1218009 - DNA, 21 bp, Homo sapiens
cagcctccctctgacctgcag

SEQ ID NO: 1218010 - DNA, 14 bp, Homo sapiens
cagcctccctgagc

SEQ ID NO: 1218011 - DNA, 18 bp, Homo sapiens
cagcctccctgagcctgc

SEQ ID NO: 1218012 - DNA, 19 bp, Homo sapiens
cagcctccctgtctccagc

SEQ ID NO: 1218013 - DNA, 21 bp, Homo sapiens
cagcctccctgtctccagctg

SEQ ID NO: 1218014 - DNA, 23 bp, Homo sapiens
cagcctccctgtctccagctgcc

SEQ ID NO: 1218015 - DNA, 20 bp, Homo sapiens
cagcctccgagagggagaga

SEQ ID NO: 1218016 - DNA, 17 bp, Homo sapiens
cagcctccgggcgtgtg

SEQ ID NO: 1218017 - DNA, 21 bp, Homo sapiens
cagcctcctctggacggcagg

SEQ ID NO: 1218018 - DNA, 19 bp, Homo sapiens
cagcctcctgagggctcca

SEQ ID NO: 1218019 - DNA, 20 bp, Homo sapiens
cagcctcctgagtagctgga

SEQ ID NO: 1218020 - DNA, 14 bp, Homo sapiens
cagcctcctgctgg

SEQ ID NO: 1218021 - DNA, 14 bp, Homo sapiens
cagcctcctgggta

SEQ ID NO: 1218022 - DNA, 11 bp, Homo sapiens
cagcctccttg

SEQ ID NO: 1218023 - DNA, 14 bp, Homo sapiens
cagcctcgaggctg

SEQ ID NO: 1218024 - DNA, 15 bp, Homo sapiens
cagcctcgaggctgg

SEQ ID NO: 1218025 - DNA, 16 bp, Homo sapiens
cagcctcgaggctggt

SEQ ID NO: 1218026 - DNA, 12 bp, Homo sapiens
cagcctcggcct

SEQ ID NO: 1218027 - DNA, 17 bp, Homo sapiens
cagcctcggcctaggtc

SEQ ID NO: 1218028 - DNA, 19 bp, Homo sapiens
cagcctcggggatggggag

SEQ ID NO: 1218029 - DNA, 23 bp, Homo sapiens
cagcctcgttggaagaggaacag

SEQ ID NO: 1218030 - DNA, 21 bp, Homo sapiens
cagcctctcagtgccctccag

SEQ ID NO: 1218031 - DNA, 12 bp, Homo sapiens
cagcctctcccg

SEQ ID NO: 1218032 - DNA, 15 bp, Homo sapiens
cagcctctcccggct

SEQ ID NO: 1218033 - DNA, 12 bp, Homo sapiens
cagcctctctgc

SEQ ID NO: 1218034 - DNA, 15 bp, Homo sapiens
cagcctctctggctg

SEQ ID NO: 1218035 - DNA, 20 bp, Homo sapiens
cagcctctctggctggtctt

SEQ ID NO: 1218036 - DNA, 17 bp, Homo sapiens
cagcctctgaaaaccaa

SEQ ID NO: 1218037 - DNA, 21 bp, Homo sapiens
cagcctctgcaactgcaagaa

SEQ ID NO: 1218038 - DNA, 15 bp, Homo sapiens
cagcctcttctctgc

SEQ ID NO: 1218039 - DNA, 18 bp, Homo sapiens
cagcctgaacagaagctc

SEQ ID NO: 1218040 - DNA, 21 bp, Homo sapiens
cagcctgaagcctggattcca

SEQ ID NO: 1218041 - DNA, 23 bp, Homo sapiens
cagcctgaagcctggattccagc

SEQ ID NO: 1218042 - DNA, 17 bp, Homo sapiens
cagcctgacctgagact

SEQ ID NO: 1218043 - DNA, 16 bp, Homo sapiens
cagcctgagcaactct

SEQ ID NO: 1218044 - DNA, 21 bp, Homo sapiens
cagcctgagcaactcttgatt

SEQ ID NO: 1218045 - DNA, 12 bp, Homo sapiens
cagcctgaggct

SEQ ID NO: 1218046 - DNA, 15 bp, Homo sapiens
cagcctgaggctgag

SEQ ID NO: 1218047 - DNA, 19 bp, Homo sapiens
cagcctgaggctgagactg

SEQ ID NO: 1218048 - DNA, 14 bp, Homo sapiens
cagcctgagtctcc

SEQ ID NO: 1218049 - DNA, 14 bp, Homo sapiens
cagcctgatggcca

SEQ ID NO: 1218050 - DNA, 12 bp, Homo sapiens
cagcctgcccac

SEQ ID NO: 1218051 - DNA, 16 bp, Homo sapiens
cagcctgcccacctct

SEQ ID NO: 1218052 - DNA, 17 bp, Homo sapiens
cagcctgcccacctctc

SEQ ID NO: 1218053 - DNA, 18 bp, Homo sapiens
cagcctgcccacctctcc

SEQ ID NO: 1218054 - DNA, 19 bp, Homo sapiens
cagcctgcccacctctccc

SEQ ID NO: 1218055 - DNA, 22 bp, Homo sapiens
cagcctgcccacctctccctgc

SEQ ID NO: 1218056 - DNA, 13 bp, Homo sapiens
cagcctgccccct

SEQ ID NO: 1218057 - DNA, 20 bp, Homo sapiens
cagcctgccgccgtctctgt

SEQ ID NO: 1218058 - DNA, 15 bp, Homo sapiens
cagcctgcctggcag

SEQ ID NO: 1218059 - DNA, 19 bp, Homo sapiens
cagcctgcctggcaggctg

SEQ ID NO: 1218060 - DNA, 13 bp, Homo sapiens
cagcctgcctgtc

SEQ ID NO: 1218061 - DNA, 12 bp, Homo sapiens
cagcctgctcca

SEQ ID NO: 1218062 - DNA, 15 bp, Homo sapiens
cagcctgctccagct

SEQ ID NO: 1218063 - DNA, 19 bp, Homo sapiens
cagcctgctccagctgttc

SEQ ID NO: 1218064 - DNA, 13 bp, Homo sapiens
cagcttctctgca

SEQ ID NO: 1218065 - DNA, 14 bp, Homo sapiens
cagcttctctgcag

SEQ ID NO: 1218066 - DNA, 19 bp, Homo sapiens
cagcttctgccacataaaa

SEQ ID NO: 1218067 - DNA, 19 bp, Homo sapiens
cagcttctggtactctcct

SEQ ID NO: 1218068 - DNA, 15 bp, Homo sapiens
cagcttcttcctagg

SEQ ID NO: 1218069 - DNA, 17 bp, Homo sapiens
cagcttcttcctaggtc

SEQ ID NO: 1218070 - DNA, 14 bp, Homo sapiens
cagcttcttgcact

SEQ ID NO: 1218071 - DNA, 14 bp, Homo sapiens
cagcttcttgggct

SEQ ID NO: 1218072 - DNA, 23 bp, Homo sapiens
cagcttcttgggctgagtgcagc

SEQ ID NO: 1218073 - DNA, 18 bp, Homo sapiens
cagcttcttttgccaact

SEQ ID NO: 1218074 - DNA, 12 bp, Homo sapiens
cagcttgaacct

SEQ ID NO: 1218075 - DNA, 18 bp, Homo sapiens
cagcttgaacctgcttcc

SEQ ID NO: 1218076 - DNA, 15 bp, Homo sapiens
cagcttgacctgagg

SEQ ID NO: 1218077 - DNA, 21 bp, Homo sapiens
cagcttgacctgaggctgtgg

SEQ ID NO: 1218078 - DNA, 22 bp, Homo sapiens
cagcttgacctgaggctgtggt

SEQ ID NO: 1218079 - DNA, 23 bp, Homo sapiens
cagcttgacctgaggctgtggtc

SEQ ID NO: 1218080 - DNA, 21 bp, Homo sapiens
cagcttgagccgggcccctgg

SEQ ID NO: 1218081 - DNA, 13 bp, Homo sapiens
cagcttgccccgg

SEQ ID NO: 1218082 - DNA, 15 bp, Homo sapiens
cagcttgctcttcag

SEQ ID NO: 1218083 - DNA, 21 bp, Homo sapiens
cagcttgctgaggggcaggga

SEQ ID NO: 1218084 - DNA, 13 bp, Homo sapiens
cagcttgctgtca

SEQ ID NO: 1218085 - DNA, 21 bp, Homo sapiens
cagcttgctgtcacttcttca

SEQ ID NO: 1218086 - DNA, 14 bp, Homo sapiens
cagcttgggcccag

SEQ ID NO: 1218087 - DNA, 19 bp, Homo sapiens
cagcttgggcccagctggg

SEQ ID NO: 1218088 - DNA, 18 bp, Homo sapiens
cagcttgggcttcttcct

SEQ ID NO: 1218089 - DNA, 20 bp, Homo sapiens
cagcttggggccaccaaagc

SEQ ID NO: 1218090 - DNA, 21 bp, Homo sapiens
cagcttggggccaccaaagct

SEQ ID NO: 1218091 - DNA, 22 bp, Homo sapiens
cagcttggggccaccaaagctg

SEQ ID NO: 1218092 - DNA, 19 bp, Homo sapiens
cagcttgggtcaggttctt

SEQ ID NO: 1218093 - DNA, 16 bp, Homo sapiens
cagcttgtaggagctg

SEQ ID NO: 1218094 - DNA, 22 bp, Homo sapiens
cagcttgtgattcctacccctc

SEQ ID NO: 1218095 - DNA, 21 bp, Homo sapiens
cagcttgtggcaagtgaattt

SEQ ID NO: 1218096 - DNA, 13 bp, Homo sapiens
cagctttaaacaa

SEQ ID NO: 1218097 - DNA, 18 bp, Homo sapiens
cagctttaaactcaggga

SEQ ID NO: 1218098 - DNA, 15 bp, Homo sapiens
cagctttacatgcaa

SEQ ID NO: 1218099 - DNA, 16 bp, Homo sapiens
cagctttactttaaaa

SEQ ID NO: 1218100 - DNA, 15 bp, Homo sapiens
cagctttcagagcca

SEQ ID NO: 1218101 - DNA, 16 bp, Homo sapiens
cagctttcatgattag

SEQ ID NO: 1218102 - DNA, 17 bp, Homo sapiens
cagctttccctgcctct

SEQ ID NO: 1218103 - DNA, 18 bp, Homo sapiens
cagctttctcgcgccctc

SEQ ID NO: 1218104 - DNA, 19 bp, Homo sapiens
cagctttgacgtattatct

SEQ ID NO: 1218105 - DNA, 21 bp, Homo sapiens
cagctttgacgtattatctgt

SEQ ID NO: 1218106 - DNA, 16 bp, Homo sapiens
cagctttgagaagcct

SEQ ID NO: 1218107 - DNA, 14 bp, Homo sapiens
cagctttgcacccc

SEQ ID NO: 1218108 - DNA, 18 bp, Homo sapiens
cagctttgcacccctttc

SEQ ID NO: 1218109 - DNA, 16 bp, Homo sapiens
cagctttgccttccac

SEQ ID NO: 1218110 - DNA, 11 bp, Homo sapiens
cagctttgcta

SEQ ID NO: 1218111 - DNA, 20 bp, Homo sapiens
cagctttgctccgctcccac

SEQ ID NO: 1218112 - DNA, 21 bp, Homo sapiens
cagctttgtttgttgtcagct

SEQ ID NO: 1218113 - DNA, 23 bp, Homo sapiens
cagctttgtttgttgtcagctga

SEQ ID NO: 1218114 - DNA, 14 bp, Homo sapiens
cagcttttactgtt

SEQ ID NO: 1218115 - DNA, 11 bp, Homo sapiens
cagcttttcaa

SEQ ID NO: 1218116 - DNA, 12 bp, Homo sapiens
cagcttttgcaa

SEQ ID NO: 1218117 - DNA, 17 bp, Homo sapiens
cagcttttgttctagac

SEQ ID NO: 1218118 - DNA, 19 bp, Homo sapiens
cagcttttgttctagactt

SEQ ID NO: 1218119 - DNA, 19 bp, Homo sapiens
cagctttttattccctgcc

SEQ ID NO: 1218120 - DNA, 22 bp, Homo sapiens
cagctttttattccctgcccaa

SEQ ID NO: 1218121 - DNA, 21 bp, Homo sapiens
caggaaaaaaaaaaaaaagac

SEQ ID NO: 1218122 - DNA, 19 bp, Homo sapiens
caggaaaaaataaaaagag

SEQ ID NO: 1218123 - DNA, 22 bp, Homo sapiens
caggaaaacaaatcactgtatt

SEQ ID NO: 1218124 - DNA, 23 bp, Homo sapiens
caggaaaacgggaccggccaggc

SEQ ID NO: 1218125 - DNA, 20 bp, Homo sapiens
caggaaaactgacagaggag

SEQ ID NO: 1218126 - DNA, 17 bp, Homo sapiens
caggaaaactgggacat

SEQ ID NO: 1218127 - DNA, 17 bp, Homo sapiens
caggaaaatgtattgat

SEQ ID NO: 1218128 - DNA, 13 bp, Homo sapiens
caggaaaattgaa

SEQ ID NO: 1218129 - DNA, 23 bp, Homo sapiens
caggaaaattgtttgaacccagg

SEQ ID NO: 1218130 - DNA, 18 bp, Homo sapiens
caggaaacaagggaaggg

SEQ ID NO: 1218131 - DNA, 21 bp, Homo sapiens
caggaaacaagggaaggggcc

SEQ ID NO: 1218132 - DNA, 19 bp, Homo sapiens
caggaaaccctggcttgct

SEQ ID NO: 1218133 - DNA, 16 bp, Homo sapiens
caggaaagccacatct

SEQ ID NO: 1218134 - DNA, 18 bp, Homo sapiens
caggaaagccacatcttg

SEQ ID NO: 1218135 - DNA, 19 bp, Homo sapiens
caggaaagccctccccctt

SEQ ID NO: 1218136 - DNA, 23 bp, Homo sapiens
caggaaagccctcccccttcccc

SEQ ID NO: 1218137 - DNA, 19 bp, Homo sapiens
caggaaagcgcctccaacc

SEQ ID NO: 1218138 - DNA, 19 bp, Homo sapiens
caggaaagctcagctactg

SEQ ID NO: 1218139 - DNA, 15 bp, Homo sapiens
caggaaaggaatcat

SEQ ID NO: 1218140 - DNA, 19 bp, Homo sapiens
caggaaaggaatcatttct

SEQ ID NO: 1218141 - DNA, 16 bp, Homo sapiens
caggaaagtggccaag

SEQ ID NO: 1218142 - DNA, 13 bp, Homo sapiens
caggaaatatata

SEQ ID NO: 1218143 - DNA, 17 bp, Homo sapiens
caggaaatatatatgtg

SEQ ID NO: 1218144 - DNA, 23 bp, Homo sapiens
caggaaatatatatgtgtgtgta

SEQ ID NO: 1218145 - DNA, 13 bp, Homo sapiens
caggaaatgaaaa

SEQ ID NO: 1218146 - DNA, 20 bp, Homo sapiens
caggaaatgaaaatgtcttg

SEQ ID NO: 1218147 - DNA, 21 bp, Homo sapiens
caggaaatgaaaatgtcttgt

SEQ ID NO: 1218148 - DNA, 15 bp, Homo sapiens
caggaacaaacaggg

SEQ ID NO: 1218149 - DNA, 22 bp, Homo sapiens
caggaacaaacagggctgcctt

SEQ ID NO: 1218150 - DNA, 19 bp, Homo sapiens
caggaacaagtaatgtatt

SEQ ID NO: 1218151 - DNA, 12 bp, Homo sapiens
caggaacagaag

SEQ ID NO: 1218152 - DNA, 18 bp, Homo sapiens
caggaacagaaggatgaa

SEQ ID NO: 1218153 - DNA, 20 bp, Homo sapiens
caggaacagctatgggagcc

SEQ ID NO: 1218154 - DNA, 18 bp, Homo sapiens
caggaacagtggctgggt

SEQ ID NO: 1218155 - DNA, 20 bp, Homo sapiens
caggaacagtggctgggtgg

SEQ ID NO: 1218156 - DNA, 15 bp, Homo sapiens
caggaacatacagac

SEQ ID NO: 1218157 - DNA, 20 bp, Homo sapiens
caggaacatacagacacatt

SEQ ID NO: 1218158 - DNA, 15 bp, Homo sapiens
caggaaccaaaaaga

SEQ ID NO: 1218159 - DNA, 16 bp, Homo sapiens
caggaaccaaaaagag

SEQ ID NO: 1218160 - DNA, 13 bp, Homo sapiens
caggaaccagggc

SEQ ID NO: 1218161 - DNA, 19 bp, Homo sapiens
caggaaccagggcctccct

SEQ ID NO: 1218162 - DNA, 18 bp, Homo sapiens
caggaaccctcctcctgt

SEQ ID NO: 1218163 - DNA, 12 bp, Homo sapiens
caggaacccttg

SEQ ID NO: 1218164 - DNA, 21 bp, Homo sapiens
caggaacctgtcctaaggaac

SEQ ID NO: 1218165 - DNA, 13 bp, Homo sapiens
caggaacgagcac

SEQ ID NO: 1218166 - DNA, 16 bp, Homo sapiens
caggaacgagcactgg

SEQ ID NO: 1218167 - DNA, 18 bp, Homo sapiens
caggaacgagcactggcc

SEQ ID NO: 1218168 - DNA, 20 bp, Homo sapiens
caggaacgagcactggccag

SEQ ID NO: 1218169 - DNA, 22 bp, Homo sapiens
caggaacgagcactggccagag

SEQ ID NO: 1218170 - DNA, 22 bp, Homo sapiens
caggacacatcccggcctcttc

SEQ ID NO: 1218171 - DNA, 21 bp, Homo sapiens
caggacaccacgattctccca

SEQ ID NO: 1218172 - DNA, 23 bp, Homo sapiens
caggacacgaaggctgcccctgt

SEQ ID NO: 1218173 - DNA, 15 bp, Homo sapiens
caggacacggggcag

SEQ ID NO: 1218174 - DNA, 13 bp, Homo sapiens
caggacagcagca

SEQ ID NO: 1218175 - DNA, 16 bp, Homo sapiens
caggacagccagcagc

SEQ ID NO: 1218176 - DNA, 17 bp, Homo sapiens
caggacagccagcagca

SEQ ID NO: 1218177 - DNA, 14 bp, Homo sapiens
caggacagcgggaa

SEQ ID NO: 1218178 - DNA, 17 bp, Homo sapiens
caggacagcgggaaaaa

SEQ ID NO: 1218179 - DNA, 12 bp, Homo sapiens
caggacaggacc

SEQ ID NO: 1218180 - DNA, 13 bp, Homo sapiens
caggacaggacca

SEQ ID NO: 1218181 - DNA, 13 bp, Homo sapiens
caggacaggagac

SEQ ID NO: 1218182 - DNA, 13 bp, Homo sapiens
caggaccaagcca

SEQ ID NO: 1218183 - DNA, 15 bp, Homo sapiens
caggaccaagccaca

SEQ ID NO: 1218184 - DNA, 12 bp, Homo sapiens
caggaccacaaa

SEQ ID NO: 1218185 - DNA, 14 bp, Homo sapiens
caggaccagcctgt

SEQ ID NO: 1218186 - DNA, 13 bp, Homo sapiens
caggaccagctgg

SEQ ID NO: 1218187 - DNA, 16 bp, Homo sapiens
caggaccagctggggc

SEQ ID NO: 1218188 - DNA, 23 bp, Homo sapiens
caggaccagctggggcgtgggga

SEQ ID NO: 1218189 - DNA, 14 bp, Homo sapiens
caggaccaggacta

SEQ ID NO: 1218190 - DNA, 14 bp, Homo sapiens
caggaccaggggcc

SEQ ID NO: 1218191 - DNA, 13 bp, Homo sapiens
caggaccatggcc

SEQ ID NO: 1218192 - DNA, 13 bp, Homo sapiens
caggacccagagg

SEQ ID NO: 1218193 - DNA, 15 bp, Homo sapiens
caggacccagaggaa

SEQ ID NO: 1218194 - DNA, 13 bp, Homo sapiens
caggacccaggcc

SEQ ID NO: 1218195 - DNA, 18 bp, Homo sapiens
caggacccaggccctcca

SEQ ID NO: 1218196 - DNA, 12 bp, Homo sapiens
caggacccaggg

SEQ ID NO: 1218197 - DNA, 13 bp, Homo sapiens
caggacccagggt

SEQ ID NO: 1218198 - DNA, 18 bp, Homo sapiens
caggacccagggtcccct

SEQ ID NO: 1218199 - DNA, 13 bp, Homo sapiens
caggaccccagct

SEQ ID NO: 1218200 - DNA, 18 bp, Homo sapiens
caggaccccagctctgcg

SEQ ID NO: 1218201 - DNA, 14 bp, Homo sapiens
caggaccccaggtc

SEQ ID NO: 1218202 - DNA, 17 bp, Homo sapiens
caggaccccaggtcagg

SEQ ID NO: 1218203 - DNA, 14 bp, Homo sapiens
caggacccccttcc

SEQ ID NO: 1218204 - DNA, 17 bp, Homo sapiens
caggacccccttcccct

SEQ ID NO: 1218205 - DNA, 18 bp, Homo sapiens
caggacccctgtccagga

SEQ ID NO: 1218206 - DNA, 14 bp, Homo sapiens
caggacccgccagc

SEQ ID NO: 1218207 - DNA, 16 bp, Homo sapiens
caggacccgccagccc

SEQ ID NO: 1218208 - DNA, 15 bp, Homo sapiens
caggacccgcctgct

SEQ ID NO: 1218209 - DNA, 17 bp, Homo sapiens
caggacccgcctgctcc

SEQ ID NO: 1218210 - DNA, 16 bp, Homo sapiens
caggaccctccactca

SEQ ID NO: 1218211 - DNA, 21 bp, Homo sapiens
caggaccctccactcactgct

SEQ ID NO: 1218212 - DNA, 20 bp, Homo sapiens
caggaccctgacctccgccc

SEQ ID NO: 1218213 - DNA, 19 bp, Homo sapiens
caggaccctgtcctgcagt

SEQ ID NO: 1218214 - DNA, 20 bp, Homo sapiens
caggacctcagagtccaggc

SEQ ID NO: 1218215 - DNA, 13 bp, Homo sapiens
caggacctcaggt

SEQ ID NO: 1218216 - DNA, 17 bp, Homo sapiens
caggacctcgtgccacc

SEQ ID NO: 1218217 - DNA, 20 bp, Homo sapiens
caggacctctgtaggcagca

SEQ ID NO: 1218218 - DNA, 22 bp, Homo sapiens
caggacctctgtaggcagcaga

SEQ ID NO: 1218219 - DNA, 21 bp, Homo sapiens
caggacctgcctagcatgggg

SEQ ID NO: 1218220 - DNA, 17 bp, Homo sapiens
caggacctggctgccat

SEQ ID NO: 1218221 - DNA, 18 bp, Homo sapiens
caggacctggctgccata

SEQ ID NO: 1218222 - DNA, 14 bp, Homo sapiens
caggacctgtgctt

SEQ ID NO: 1218223 - DNA, 17 bp, Homo sapiens
caggacctgtggccaag

SEQ ID NO: 1218224 - DNA, 20 bp, Homo sapiens
caggaccttcgggctgtgcc

SEQ ID NO: 1218225 - DNA, 22 bp, Homo sapiens
caggaccttcgggctgtgcccg

SEQ ID NO: 1218226 - DNA, 21 bp, Homo sapiens
caggaccttttggtcttcagc

SEQ ID NO: 1218227 - DNA, 14 bp, Homo sapiens
caggacgaggagga

SEQ ID NO: 1218228 - DNA, 16 bp, Homo sapiens
caggacgccactcatt

SEQ ID NO: 1218229 - DNA, 20 bp, Homo sapiens
caggacgccactcatttcat

SEQ ID NO: 1218230 - DNA, 14 bp, Homo sapiens
caggacgcttctga

SEQ ID NO: 1218231 - DNA, 15 bp, Homo sapiens
caggacgcttctgaa

SEQ ID NO: 1218232 - DNA, 21 bp, Homo sapiens
caggacgcttctgaatgctgc

SEQ ID NO: 1218233 - DNA, 22 bp, Homo sapiens
caggacgcttctgaatgctgct

SEQ ID NO: 1218234 - DNA, 18 bp, Homo sapiens
caggacggctcctcagag

SEQ ID NO: 1218235 - DNA, 20 bp, Homo sapiens
caggactacaataccctacc

SEQ ID NO: 1218236 - DNA, 18 bp, Homo sapiens
caggactaggcatgtcag

SEQ ID NO: 1218237 - DNA, 22 bp, Homo sapiens
caggactcaccctccacaaagc

SEQ ID NO: 1218238 - DNA, 16 bp, Homo sapiens
caggactccccaggcc

SEQ ID NO: 1218239 - DNA, 17 bp, Homo sapiens
caggactccctcctcac

SEQ ID NO: 1218240 - DNA, 22 bp, Homo sapiens
caggactccctcctcacctctg

SEQ ID NO: 1218241 - DNA, 19 bp, Homo sapiens
caggactcctggcagggcc

SEQ ID NO: 1218242 - DNA, 12 bp, Homo sapiens
caggactctgcc

SEQ ID NO: 1218243 - DNA, 15 bp, Homo sapiens
caggactctgcctcc

SEQ ID NO: 1218244 - DNA, 16 bp, Homo sapiens
caggactctgcctcct

SEQ ID NO: 1218245 - DNA, 13 bp, Homo sapiens
caggactctgcgg

SEQ ID NO: 1218246 - DNA, 17 bp, Homo sapiens
caggactctgcgggagg

SEQ ID NO: 1218247 - DNA, 22 bp, Homo sapiens
caggactctgcgggaggctggg

SEQ ID NO: 1218248 - DNA, 16 bp, Homo sapiens
caggactctggcactt

SEQ ID NO: 1218249 - DNA, 19 bp, Homo sapiens
caggactgaattgtcccca

SEQ ID NO: 1218250 - DNA, 19 bp, Homo sapiens
caggactgagccctctcac

SEQ ID NO: 1218251 - DNA, 23 bp, Homo sapiens
caggactgagccctctcactcca

SEQ ID NO: 1218252 - DNA, 22 bp, Homo sapiens
caggactggtactcaagccagc

SEQ ID NO: 1218253 - DNA, 20 bp, Homo sapiens
caggacttgctaaagcactt

SEQ ID NO: 1218254 - DNA, 19 bp, Homo sapiens
caggacttggggtcaggaa

SEQ ID NO: 1218255 - DNA, 15 bp, Homo sapiens
caggagaaagccggg

SEQ ID NO: 1218256 - DNA, 19 bp, Homo sapiens
caggagaaagccgggggag

SEQ ID NO: 1218257 - DNA, 20 bp, Homo sapiens
caggagaaagccgggggagg

SEQ ID NO: 1218258 - DNA, 11 bp, Homo sapiens
caggagaacca

SEQ ID NO: 1218259 - DNA, 14 bp, Homo sapiens
caggagatggcccc

SEQ ID NO: 1218260 - DNA, 17 bp, Homo sapiens
caggagatggccccaac

SEQ ID NO: 1218261 - DNA, 15 bp, Homo sapiens
caggagattggattt

SEQ ID NO: 1218262 - DNA, 18 bp, Homo sapiens
caggagcaaatgtttctg

SEQ ID NO: 1218263 - DNA, 17 bp, Homo sapiens
caggagcacaggcagct

SEQ ID NO: 1218264 - DNA, 13 bp, Homo sapiens
caggagcagcagc

SEQ ID NO: 1218265 - DNA, 19 bp, Homo sapiens
caggagcagcagccagcac

SEQ ID NO: 1218266 - DNA, 15 bp, Homo sapiens
caggagcaggcacgg

SEQ ID NO: 1218267 - DNA, 18 bp, Homo sapiens
caggagcaggcacgggtg

SEQ ID NO: 1218268 - DNA, 19 bp, Homo sapiens
caggagcagggcggctgcc

SEQ ID NO: 1218269 - DNA, 23 bp, Homo sapiens
caggagcatgtatgtctgcaggt

SEQ ID NO: 1218270 - DNA, 17 bp, Homo sapiens
caggagcccccaacaca

SEQ ID NO: 1218271 - DNA, 12 bp, Homo sapiens
caggagcccctg

SEQ ID NO: 1218272 - DNA, 20 bp, Homo sapiens
caggagcccctggggctgta

SEQ ID NO: 1218273 - DNA, 18 bp, Homo sapiens
caggagcctagcggagcc

SEQ ID NO: 1218274 - DNA, 20 bp, Homo sapiens
caggagcctccctgcacggc

SEQ ID NO: 1218275 - DNA, 14 bp, Homo sapiens
caggagcctggtcc

SEQ ID NO: 1218276 - DNA, 15 bp, Homo sapiens
caggagcctggtcct

SEQ ID NO: 1218277 - DNA, 13 bp, Homo sapiens
caggagcgcaaga

SEQ ID NO: 1218278 - DNA, 17 bp, Homo sapiens
caggagctctgcgccag

SEQ ID NO: 1218279 - DNA, 18 bp, Homo sapiens
caggagctctgcgccagg

SEQ ID NO: 1218280 - DNA, 22 bp, Homo sapiens
caggagctctgcgccaggcaga

SEQ ID NO: 1218281 - DNA, 20 bp, Homo sapiens
caggagctgagtcacctcct

SEQ ID NO: 1218282 - DNA, 15 bp, Homo sapiens
caggagctgatggca

SEQ ID NO: 1218283 - DNA, 16 bp, Homo sapiens
caggagctgatggcag

SEQ ID NO: 1218284 - DNA, 17 bp, Homo sapiens
caggagctgatggcagc

SEQ ID NO: 1218285 - DNA, 23 bp, Homo sapiens
caggagcttgggcagtgccccag

SEQ ID NO: 1218286 - DNA, 19 bp, Homo sapiens
caggaggatcacttgagtc

SEQ ID NO: 1218287 - DNA, 17 bp, Homo sapiens
caggaggattccttgtg

SEQ ID NO: 1218288 - DNA, 15 bp, Homo sapiens
caggaggattgcctt

SEQ ID NO: 1218289 - DNA, 22 bp, Homo sapiens
caggaggattgcttgagcccag

SEQ ID NO: 1218290 - DNA, 23 bp, Homo sapiens
caggaggattgcttgagcccagg

SEQ ID NO: 1218291 - DNA, 15 bp, Homo sapiens
caggaggcaggacct

SEQ ID NO: 1218292 - DNA, 20 bp, Homo sapiens
caggaggccctggtcctggc

SEQ ID NO: 1218293 - DNA, 21 bp, Homo sapiens
caggaggccctggtcctggcc

SEQ ID NO: 1218294 - DNA, 21 bp, Homo sapiens
caggaggcccttgtcgtggga

SEQ ID NO: 1218295 - DNA, 16 bp, Homo sapiens
caggaggcctgcacca

SEQ ID NO: 1218296 - DNA, 21 bp, Homo sapiens
caggaggcggcagctcttctg

SEQ ID NO: 1218297 - DNA, 12 bp, Homo sapiens
caggaggctgag

SEQ ID NO: 1218298 - DNA, 16 bp, Homo sapiens
caggaggctgaggcag

SEQ ID NO: 1218299 - DNA, 21 bp, Homo sapiens
caggaggctttaagctccagc

SEQ ID NO: 1218300 - DNA, 15 bp, Homo sapiens
caggagggaggcagg

SEQ ID NO: 1218301 - DNA, 15 bp, Homo sapiens
caggagggaggcggg

SEQ ID NO: 1218302 - DNA, 19 bp, Homo sapiens
caggagggaggcggggagg

SEQ ID NO: 1218303 - DNA, 23 bp, Homo sapiens
caggagggaggtttgtgagagcg

SEQ ID NO: 1218304 - DNA, 22 bp, Homo sapiens
caggagggattggccgcttggc

SEQ ID NO: 1218305 - DNA, 14 bp, Homo sapiens
caggagggcacagc

SEQ ID NO: 1218306 - DNA, 14 bp, Homo sapiens
caggagggcactgg

SEQ ID NO: 1218307 - DNA, 13 bp, Homo sapiens
caggagggccagc

SEQ ID NO: 1218308 - DNA, 23 bp, Homo sapiens
caggagggcccggagaaactgag

SEQ ID NO: 1218309 - DNA, 16 bp, Homo sapiens
caggagggccctacct

SEQ ID NO: 1218310 - DNA, 23 bp, Homo sapiens
caggagggctaattagaaatcaa

SEQ ID NO: 1218311 - DNA, 19 bp, Homo sapiens
caggaggggaaaaaattaa

SEQ ID NO: 1218312 - DNA, 15 bp, Homo sapiens
caggaggggcctggg

SEQ ID NO: 1218313 - DNA, 17 bp, Homo sapiens
caggaggggcctgggca

SEQ ID NO: 1218314 - DNA, 19 bp, Homo sapiens
caggaggggcctgggcagc

SEQ ID NO: 1218315 - DNA, 19 bp, Homo sapiens
caggaggggtgagtcccct

SEQ ID NO: 1218316 - DNA, 20 bp, Homo sapiens
caggagggtcaccctggcct

SEQ ID NO: 1218317 - DNA, 20 bp, Homo sapiens
caggagggtgacgcccagct

SEQ ID NO: 1218318 - DNA, 22 bp, Homo sapiens
caggagggtgacgcccagctcc

SEQ ID NO: 1218319 - DNA, 17 bp, Homo sapiens
caggagggtgaggaggt

SEQ ID NO: 1218320 - DNA, 14 bp, Homo sapiens
caggaggtggaggc

SEQ ID NO: 1218321 - DNA, 22 bp, Homo sapiens
caggaggtggctatggccaccc

SEQ ID NO: 1218322 - DNA, 19 bp, Homo sapiens
caggaggttcccccgacca

SEQ ID NO: 1218323 - DNA, 18 bp, Homo sapiens
caggaggttggtgactga

SEQ ID NO: 1218324 - DNA, 21 bp, Homo sapiens
caggaggttggtgactgaaac

SEQ ID NO: 1218325 - DNA, 23 bp, Homo sapiens
caggaggttgtggatgctccagg

SEQ ID NO: 1218326 - DNA, 18 bp, Homo sapiens
caggagtcccaaggaaag

SEQ ID NO: 1218327 - DNA, 19 bp, Homo sapiens
caggagtcccaaggaaagc

SEQ ID NO: 1218328 - DNA, 24 bp, Homo sapiens
caggagtcccaaggaaagccccag

SEQ ID NO: 1218329 - DNA, 14 bp, Homo sapiens
caggagtccctggt

SEQ ID NO: 1218330 - DNA, 15 bp, Homo sapiens
caggagtctgccact

SEQ ID NO: 1218331 - DNA, 16 bp, Homo sapiens
caggagtctgtgctct

SEQ ID NO: 1218332 - DNA, 17 bp, Homo sapiens
caggagtcttcagaccc

SEQ ID NO: 1218333 - DNA, 18 bp, Homo sapiens
caggagtcttcagaccca

SEQ ID NO: 1218334 - DNA, 20 bp, Homo sapiens
caggagtcttcagacccaga

SEQ ID NO: 1218335 - DNA, 21 bp, Homo sapiens
caggagtcttcagacccagag

SEQ ID NO: 1218336 - DNA, 22 bp, Homo sapiens
caggagtgggaaaacactgcca

SEQ ID NO: 1218337 - DNA, 16 bp, Homo sapiens
caggagtgtcctgccc

SEQ ID NO: 1218338 - DNA, 17 bp, Homo sapiens
caggagttgtgagccct

SEQ ID NO: 1218339 - DNA, 22 bp, Homo sapiens
caggagtttgagacaagccctg

SEQ ID NO: 1218340 - DNA, 23 bp, Homo sapiens
caggagtttgagacaagccctgg

SEQ ID NO: 1218341 - DNA, 21 bp, Homo sapiens
caggagtttgagaccaacctg

SEQ ID NO: 1218342 - DNA, 17 bp, Homo sapiens
caggagttttaagtcca

SEQ ID NO: 1218343 - DNA, 18 bp, Homo sapiens
caggagttttactgcctg

SEQ ID NO: 1218344 - DNA, 14 bp, Homo sapiens
caggataagaaaaa

SEQ ID NO: 1218345 - DNA, 20 bp, Homo sapiens
caggataatatatttgcaga

SEQ ID NO: 1218346 - DNA, 17 bp, Homo sapiens
caggatactggcacaga

SEQ ID NO: 1218347 - DNA, 20 bp, Homo sapiens
caggatactggcacagaggt

SEQ ID NO: 1218348 - DNA, 23 bp, Homo sapiens
caggatatcacattggagtcact

SEQ ID NO: 1218349 - DNA, 20 bp, Homo sapiens
caggatattaaacgtgtaaa

SEQ ID NO: 1218350 - DNA, 22 bp, Homo sapiens
caggatattaaacgtgtaaatt

SEQ ID NO: 1218351 - DNA, 16 bp, Homo sapiens
caggatattagttaat

SEQ ID NO: 1218352 - DNA, 20 bp, Homo sapiens
caggatattagttaatgagc

SEQ ID NO: 1218353 - DNA, 22 bp, Homo sapiens
caggatattagttaatgagcca

SEQ ID NO: 1218354 - DNA, 16 bp, Homo sapiens
caggatccagtgacat

SEQ ID NO: 1218355 - DNA, 20 bp, Homo sapiens
caggatcctattctcaccag

SEQ ID NO: 1218356 - DNA, 21 bp, Homo sapiens
caggatcctattctcaccagg

SEQ ID NO: 1218357 - DNA, 18 bp, Homo sapiens
caggatctcaagccagcc

SEQ ID NO: 1218358 - DNA, 15 bp, Homo sapiens
caggatgaaagttcc

SEQ ID NO: 1218359 - DNA, 21 bp, Homo sapiens
caggcctccaacgcccctgtg

SEQ ID NO: 1218360 - DNA, 24 bp, Homo sapiens
caggcctccaacgcccctgtggcc

SEQ ID NO: 1218361 - DNA, 11 bp, Homo sapiens
caggcctccag

SEQ ID NO: 1218362 - DNA, 13 bp, Homo sapiens
caggcctccagcc

SEQ ID NO: 1218363 - DNA, 17 bp, Homo sapiens
caggcctccagcctctc

SEQ ID NO: 1218364 - DNA, 19 bp, Homo sapiens
caggcctccagcctctccc

SEQ ID NO: 1218365 - DNA, 20 bp, Homo sapiens
caggcctccagcctctcccg

SEQ ID NO: 1218366 - DNA, 10 bp, Homo sapiens
caggcctccc

SEQ ID NO: 1218367 - DNA, 12 bp, Homo sapiens
caggcctccctc

SEQ ID NO: 1218368 - DNA, 15 bp, Homo sapiens
caggcctccctgaaa

SEQ ID NO: 1218369 - DNA, 23 bp, Homo sapiens
caggcctccgtcttcccagcggt

SEQ ID NO: 1218370 - DNA, 19 bp, Homo sapiens
caggcctcctaggggaagg

SEQ ID NO: 1218371 - DNA, 22 bp, Homo sapiens
caggcctcgcacttgcagagga

SEQ ID NO: 1218372 - DNA, 23 bp, Homo sapiens
caggcctcgcacttgcagaggag

SEQ ID NO: 1218373 - DNA, 15 bp, Homo sapiens
caggcctctctctgc

SEQ ID NO: 1218374 - DNA, 17 bp, Homo sapiens
caggcctctctctgctc

SEQ ID NO: 1218375 - DNA, 22 bp, Homo sapiens
caggcctctgtgtccttccctg

SEQ ID NO: 1218376 - DNA, 12 bp, Homo sapiens
caggcctcttgg

SEQ ID NO: 1218377 - DNA, 13 bp, Homo sapiens
caggcctgaccca

SEQ ID NO: 1218378 - DNA, 16 bp, Homo sapiens
caggcctgacccacgg

SEQ ID NO: 1218379 - DNA, 22 bp, Homo sapiens
caggcctgagaatgagtgggaa

SEQ ID NO: 1218380 - DNA, 22 bp, Homo sapiens
caggcctgcagcaggagtggtg

SEQ ID NO: 1218381 - DNA, 17 bp, Homo sapiens
caggcctgcctcccact

SEQ ID NO: 1218382 - DNA, 12 bp, Homo sapiens
caggcctgctgg

SEQ ID NO: 1218383 - DNA, 17 bp, Homo sapiens
caggcctgctggcatca

SEQ ID NO: 1218384 - DNA, 21 bp, Homo sapiens
caggcctggacgggccctcct

SEQ ID NO: 1218385 - DNA, 13 bp, Homo sapiens
caggcctggagcg

SEQ ID NO: 1218386 - DNA, 17 bp, Homo sapiens
caggcctggcaagtggg

SEQ ID NO: 1218387 - DNA, 12 bp, Homo sapiens
caggcctggcct

SEQ ID NO: 1218388 - DNA, 14 bp, Homo sapiens
caggcctggcctcg

SEQ ID NO: 1218389 - DNA, 19 bp, Homo sapiens
caggcctggcctcgcctgc

SEQ ID NO: 1218390 - DNA, 23 bp, Homo sapiens
caggcctggcctcgcctgccttt

SEQ ID NO: 1218391 - DNA, 17 bp, Homo sapiens
caggcctggctccccga

SEQ ID NO: 1218392 - DNA, 17 bp, Homo sapiens
caggcctgggacccagc

SEQ ID NO: 1218393 - DNA, 21 bp, Homo sapiens
caggcctgggacccagctact

SEQ ID NO: 1218394 - DNA, 15 bp, Homo sapiens
caggcctgggcagga

SEQ ID NO: 1218395 - DNA, 19 bp, Homo sapiens
caggcctgggcaggaccct

SEQ ID NO: 1218396 - DNA, 23 bp, Homo sapiens
caggcctgggcaggaccctgctg

SEQ ID NO: 1218397 - DNA, 12 bp, Homo sapiens
caggcctgggtt

SEQ ID NO: 1218398 - DNA, 15 bp, Homo sapiens
caggcctgtccaaca

SEQ ID NO: 1218399 - DNA, 16 bp, Homo sapiens
caggcctgtccaccct

SEQ ID NO: 1218400 - DNA, 18 bp, Homo sapiens
caggcctgtccaccctgc

SEQ ID NO: 1218401 - DNA, 21 bp, Homo sapiens
caggcctgtccaccctgccaa

SEQ ID NO: 1218402 - DNA, 19 bp, Homo sapiens
caggcctgtgtgactccat

SEQ ID NO: 1218403 - DNA, 17 bp, Homo sapiens
caggcctgttcccttgt

SEQ ID NO: 1218404 - DNA, 17 bp, Homo sapiens
caggccttatctccaag

SEQ ID NO: 1218405 - DNA, 10 bp, Homo sapiens
caggccttct

SEQ ID NO: 1218406 - DNA, 15 bp, Homo sapiens
caggccttctgtggg

SEQ ID NO: 1218407 - DNA, 16 bp, Homo sapiens
caggccttctgtgggg

SEQ ID NO: 1218408 - DNA, 17 bp, Homo sapiens
caggccttctgtggggc

SEQ ID NO: 1218409 - DNA, 19 bp, Homo sapiens
caggccttctgtggggctg

SEQ ID NO: 1218410 - DNA, 21 bp, Homo sapiens
caggccttctgtggggctggg

SEQ ID NO: 1218411 - DNA, 20 bp, Homo sapiens
caggccttgctgactctctg

SEQ ID NO: 1218412 - DNA, 23 bp, Homo sapiens
caggccttgctgactctctgagc

SEQ ID NO: 1218413 - DNA, 15 bp, Homo sapiens
caggccttgctgggg

SEQ ID NO: 1218414 - DNA, 17 bp, Homo sapiens
caggcctttggagggga

SEQ ID NO: 1218415 - DNA, 18 bp, Homo sapiens
caggcctttggaggggaa

SEQ ID NO: 1218416 - DNA, 22 bp, Homo sapiens
caggcctttggaggggaaatgg

SEQ ID NO: 1218417 - DNA, 18 bp, Homo sapiens
caggcgagcctgactctg

SEQ ID NO: 1218418 - DNA, 20 bp, Homo sapiens
caggcgatccacctgtctca

SEQ ID NO: 1218419 - DNA, 22 bp, Homo sapiens
caggcgatggggcaagacagaa

SEQ ID NO: 1218420 - DNA, 23 bp, Homo sapiens
caggcgatggggcaagacagaaa

SEQ ID NO: 1218421 - DNA, 19 bp, Homo sapiens
caggcgcagaggtcccagc

SEQ ID NO: 1218422 - DNA, 20 bp, Homo sapiens
caggcgcagaggtcccagcc

SEQ ID NO: 1218423 - DNA, 17 bp, Homo sapiens
caggcgccggcgggcgg

SEQ ID NO: 1218424 - DNA, 15 bp, Homo sapiens
caggcgcctggtgtg

SEQ ID NO: 1218425 - DNA, 16 bp, Homo sapiens
caggcgcggcggctct

SEQ ID NO: 1218426 - DNA, 15 bp, Homo sapiens
caggcggccagggcg

SEQ ID NO: 1218427 - DNA, 20 bp, Homo sapiens
caggcggccagggcggccag

SEQ ID NO: 1218428 - DNA, 15 bp, Homo sapiens
caggcggccctcagt

SEQ ID NO: 1218429 - DNA, 17 bp, Homo sapiens
caggcggccctggggag

SEQ ID NO: 1218430 - DNA, 12 bp, Homo sapiens
caggcggctcct

SEQ ID NO: 1218431 - DNA, 17 bp, Homo sapiens
caggcggctcctcctca

SEQ ID NO: 1218432 - DNA, 19 bp, Homo sapiens
caggcgggagatggacccc

SEQ ID NO: 1218433 - DNA, 23 bp, Homo sapiens
caggcgggagatggacccctccc

SEQ ID NO: 1218434 - DNA, 19 bp, Homo sapiens
cagggagcaagacagagac

SEQ ID NO: 1218435 - DNA, 16 bp, Homo sapiens
cagggagcactgttca

SEQ ID NO: 1218436 - DNA, 14 bp, Homo sapiens
cagggagcagggaa

SEQ ID NO: 1218437 - DNA, 21 bp, Homo sapiens
cagggagcagggaaggcctga

SEQ ID NO: 1218438 - DNA, 19 bp, Homo sapiens
cagggagcggccggccagc

SEQ ID NO: 1218439 - DNA, 23 bp, Homo sapiens
cagggagcggccggccagcccct

SEQ ID NO: 1218440 - DNA, 21 bp, Homo sapiens
cagggagctcgcattctcttg

SEQ ID NO: 1218441 - DNA, 17 bp, Homo sapiens
cagggagctctggggac

SEQ ID NO: 1218442 - DNA, 16 bp, Homo sapiens
cagggagcttcctggc

SEQ ID NO: 1218443 - DNA, 22 bp, Homo sapiens
cagggagcttcctggctctggg

SEQ ID NO: 1218444 - DNA, 23 bp, Homo sapiens
cagggagcttcctggctctgggg

SEQ ID NO: 1218445 - DNA, 22 bp, Homo sapiens
cagggagcttgccacactcttc

SEQ ID NO: 1218446 - DNA, 15 bp, Homo sapiens
cagggaggagaggaa

SEQ ID NO: 1218447 - DNA, 23 bp, Homo sapiens
cagggaggaggtggcagccctgt

SEQ ID NO: 1218448 - DNA, 23 bp, Homo sapiens
caggggcatgtattggcctggag

SEQ ID NO: 1218449 - DNA, 18 bp, Homo sapiens
caggggccagagagcagg

SEQ ID NO: 1218450 - DNA, 14 bp, Homo sapiens
caggggccagagga

SEQ ID NO: 1218451 - DNA, 21 bp, Homo sapiens
caggggccagatgattttcct

SEQ ID NO: 1218452 - DNA, 18 bp, Homo sapiens
caggggccaggggtggga

SEQ ID NO: 1218453 - DNA, 22 bp, Homo sapiens
caggggcccaccctctgcccag

SEQ ID NO: 1218454 - DNA, 24 bp, Homo sapiens
caggggcccaccctctgcccaggg

SEQ ID NO: 1218455 - DNA, 14 bp, Homo sapiens
caggggccccagat

SEQ ID NO: 1218456 - DNA, 17 bp, Homo sapiens
caggggccccagatctg

SEQ ID NO: 1218457 - DNA, 19 bp, Homo sapiens
caggggccccagatctgcc

SEQ ID NO: 1218458 - DNA, 21 bp, Homo sapiens
caggggccccagatctgcctg

SEQ ID NO: 1218459 - DNA, 19 bp, Homo sapiens
caggggcccttgggacagc

SEQ ID NO: 1218460 - DNA, 17 bp, Homo sapiens
caggggccggccagtgg

SEQ ID NO: 1218461 - DNA, 12 bp, Homo sapiens
caggggcctgga

SEQ ID NO: 1218462 - DNA, 13 bp, Homo sapiens
caggggcctggag

SEQ ID NO: 1218463 - DNA, 22 bp, Homo sapiens
caggggcctggagatcctcctg

SEQ ID NO: 1218464 - DNA, 17 bp, Homo sapiens
caggggcctgggccggc

SEQ ID NO: 1218465 - DNA, 20 bp, Homo sapiens
cagtcaagaagaaaaaggtt

SEQ ID NO: 1218466 - DNA, 20 bp, Homo sapiens
cagtcaagctgttgaagtct

SEQ ID NO: 1218467 - DNA, 17 bp, Homo sapiens
cagtcacaacagagtga

SEQ ID NO: 1218468 - DNA, 13 bp, Homo sapiens
cagtcacagccac

SEQ ID NO: 1218469 - DNA, 13 bp, Homo sapiens
cagtcaccaccca

SEQ ID NO: 1218470 - DNA, 15 bp, Homo sapiens
cagtcaccacccagc

SEQ ID NO: 1218471 - DNA, 16 bp, Homo sapiens
cagtcaccacccagcc

SEQ ID NO: 1218472 - DNA, 17 bp, Homo sapiens
cagtcaccacccagccc

SEQ ID NO: 1218473 - DNA, 18 bp, Homo sapiens
cagtcaccacccagccct

SEQ ID NO: 1218474 - DNA, 22 bp, Homo sapiens
cagtcaccacccagcccttcct

SEQ ID NO: 1218475 - DNA, 13 bp, Homo sapiens
cagtcacccccac

SEQ ID NO: 1218476 - DNA, 14 bp, Homo sapiens
cagtcactcctctc

SEQ ID NO: 1218477 - DNA, 12 bp, Homo sapiens
cagtcactgctc

SEQ ID NO: 1218478 - DNA, 16 bp, Homo sapiens
cagtcactgctgcaag

SEQ ID NO: 1218479 - DNA, 22 bp, Homo sapiens
cagtcactgtccctcaaatgac

SEQ ID NO: 1218480 - DNA, 21 bp, Homo sapiens
cagtcacttgggagctgctgg

SEQ ID NO: 1218481 - DNA, 15 bp, Homo sapiens
cagtcaggggctggg

SEQ ID NO: 1218482 - DNA, 22 bp, Homo sapiens
cagtcaggggtcaggtgtcagg

SEQ ID NO: 1218483 - DNA, 15 bp, Homo sapiens
cagtcagtgtttctt

SEQ ID NO: 1218484 - DNA, 15 bp, Homo sapiens
cagtcagttcccgga

SEQ ID NO: 1218485 - DNA, 23 bp, Homo sapiens
cagtcagttcccggagcacagcc

SEQ ID NO: 1218486 - DNA, 16 bp, Homo sapiens
cagtcagttttgctcc

SEQ ID NO: 1218487 - DNA, 12 bp, Homo sapiens
cagtcatatttc

SEQ ID NO: 1218488 - DNA, 15 bp, Homo sapiens
cagtcatcactctca

SEQ ID NO: 1218489 - DNA, 18 bp, Homo sapiens
cagtcatcatcagggcct

SEQ ID NO: 1218490 - DNA, 12 bp, Homo sapiens
cagtcatctccc

SEQ ID NO: 1218491 - DNA, 15 bp, Homo sapiens
cagtcatctcccctc

SEQ ID NO: 1218492 - DNA, 17 bp, Homo sapiens
cagtcatggaatcttgc

SEQ ID NO: 1218493 - DNA, 18 bp, Homo sapiens
cagtcatggaatcttgct

SEQ ID NO: 1218494 - DNA, 17 bp, Homo sapiens
cagtcatggcctgagat

SEQ ID NO: 1218495 - DNA, 13 bp, Homo sapiens
cagtcatggtact

SEQ ID NO: 1218496 - DNA, 14 bp, Homo sapiens
cagtcattctagga

SEQ ID NO: 1218497 - DNA, 23 bp, Homo sapiens
cagtcattctaggatgtggagct

SEQ ID NO: 1218498 - DNA, 11 bp, Homo sapiens
cagtcatttaa

SEQ ID NO: 1218499 - DNA, 12 bp, Homo sapiens
cagtcatttaaa

SEQ ID NO: 1218500 - DNA, 17 bp, Homo sapiens
cagtccaaatgtcctcc

SEQ ID NO: 1218501 - DNA, 18 bp, Homo sapiens
cagtccaaatgtcctcca

SEQ ID NO: 1218502 - DNA, 19 bp, Homo sapiens
cagtccaaccagaaacacc

SEQ ID NO: 1218503 - DNA, 13 bp, Homo sapiens
cagtccacaaaat

SEQ ID NO: 1218504 - DNA, 15 bp, Homo sapiens
cagtccacaggggcc

SEQ ID NO: 1218505 - DNA, 17 bp, Homo sapiens
cagtccacaggggccac

SEQ ID NO: 1218506 - DNA, 22 bp, Homo sapiens
cagtccactgttgagccccagt

SEQ ID NO: 1218507 - DNA, 12 bp, Homo sapiens
cagtccagaccc

SEQ ID NO: 1218508 - DNA, 16 bp, Homo sapiens
cagtccagagcttttc

SEQ ID NO: 1218509 - DNA, 18 bp, Homo sapiens
cagtccagagcttttcag

SEQ ID NO: 1218510 - DNA, 23 bp, Homo sapiens
cagtccaggatgctaacatctaa

SEQ ID NO: 1218511 - DNA, 12 bp, Homo sapiens
cagtcccacact

SEQ ID NO: 1218512 - DNA, 19 bp, Homo sapiens
cagtcccacactgtgcaga

SEQ ID NO: 1218513 - DNA, 18 bp, Homo sapiens
cagtcccacactgtggcc

SEQ ID NO: 1218514 - DNA, 13 bp, Homo sapiens
cagtcccaggggc

SEQ ID NO: 1218515 - DNA, 22 bp, Homo sapiens
cagtcccagtattctcagagca

SEQ ID NO: 1218516 - DNA, 14 bp, Homo sapiens
cagtccccacccct

SEQ ID NO: 1218517 - DNA, 17 bp, Homo sapiens
cagtccccacccctgcc

SEQ ID NO: 1218518 - DNA, 15 bp, Homo sapiens
cagtccccagccctg

SEQ ID NO: 1218519 - DNA, 21 bp, Homo sapiens
cagtccccagccctgggcttg

SEQ ID NO: 1218520 - DNA, 16 bp, Homo sapiens
cagtcccccacccacc

SEQ ID NO: 1218521 - DNA, 20 bp, Homo sapiens
cagtcccccacccacctcct

SEQ ID NO: 1218522 - DNA, 21 bp, Homo sapiens
cagtcccccacccacctcctg

SEQ ID NO: 1218523 - DNA, 16 bp, Homo sapiens
cagtccccctgcccca

SEQ ID NO: 1218524 - DNA, 13 bp, Homo sapiens
cagtcccctccca

SEQ ID NO: 1218525 - DNA, 17 bp, Homo sapiens
cagtcccctcccatctg

SEQ ID NO: 1218526 - DNA, 16 bp, Homo sapiens
cagtcttccacaaaga

SEQ ID NO: 1218527 - DNA, 15 bp, Homo sapiens
cagtcttccatttgc

SEQ ID NO: 1218528 - DNA, 18 bp, Homo sapiens
cagtcttccatttgcaag

SEQ ID NO: 1218529 - DNA, 17 bp, Homo sapiens
cagtcttcctgacactt

SEQ ID NO: 1218530 - DNA, 18 bp, Homo sapiens
cagtcttcctgacacttt

SEQ ID NO: 1218531 - DNA, 21 bp, Homo sapiens
cagtcttcctgacactttaat

SEQ ID NO: 1218532 - DNA, 15 bp, Homo sapiens
cagtcttctgactgt

SEQ ID NO: 1218533 - DNA, 16 bp, Homo sapiens
cagtcttgcctaggcc

SEQ ID NO: 1218534 - DNA, 16 bp, Homo sapiens
cagtcttggctcactg

SEQ ID NO: 1218535 - DNA, 21 bp, Homo sapiens
cagtcttggtaaaacattact

SEQ ID NO: 1218536 - DNA, 18 bp, Homo sapiens
cagtcttgtagctagaac

SEQ ID NO: 1218537 - DNA, 17 bp, Homo sapiens
cagtctttaaaggccca

SEQ ID NO: 1218538 - DNA, 18 bp, Homo sapiens
cagtctttaaaggcccag

SEQ ID NO: 1218539 - DNA, 20 bp, Homo sapiens
cagtctttaaaggcccagcc

SEQ ID NO: 1218540 - DNA, 16 bp, Homo sapiens
cagtctttgctcagtg

SEQ ID NO: 1218541 - DNA, 17 bp, Homo sapiens
cagtctttgctcagtgt

SEQ ID NO: 1218542 - DNA, 12 bp, Homo sapiens
cagtcttttgtc

SEQ ID NO: 1218543 - DNA, 22 bp, Homo sapiens
cagtgaaaaatatgttgagtgt

SEQ ID NO: 1218544 - DNA, 15 bp, Homo sapiens
cagtgaaacttgtgc

SEQ ID NO: 1218545 - DNA, 12 bp, Homo sapiens
cagtgaacattc

SEQ ID NO: 1218546 - DNA, 17 bp, Homo sapiens
cagtgaacattcccagc

SEQ ID NO: 1218547 - DNA, 20 bp, Homo sapiens
cagtgaacattcccagccca

SEQ ID NO: 1218548 - DNA, 21 bp, Homo sapiens
cagtgaacattcccagcccag

SEQ ID NO: 1218549 - DNA, 20 bp, Homo sapiens
cagtgaaccaaagagactgg

SEQ ID NO: 1218550 - DNA, 14 bp, Homo sapiens
cagtgaactcctgc

SEQ ID NO: 1218551 - DNA, 13 bp, Homo sapiens
cagtgaagcagca

SEQ ID NO: 1218552 - DNA, 16 bp, Homo sapiens
cagtgaagggttttgt

SEQ ID NO: 1218553 - DNA, 19 bp, Homo sapiens
cagtgaagtctagaatcat

SEQ ID NO: 1218554 - DNA, 20 bp, Homo sapiens
cagtgaagtctagaatcata

SEQ ID NO: 1218555 - DNA, 18 bp, Homo sapiens
cagtgaatccctgggagc

SEQ ID NO: 1218556 - DNA, 23 bp, Homo sapiens
cagtgaatccctgggagcgcctg

SEQ ID NO: 1218557 - DNA, 18 bp, Homo sapiens
cagtgaatgctagacaga

SEQ ID NO: 1218558 - DNA, 16 bp, Homo sapiens
cagtgaattgtctttt

SEQ ID NO: 1218559 - DNA, 11 bp, Homo sapiens
cagtgaatttg

SEQ ID NO: 1218560 - DNA, 15 bp, Homo sapiens
cagtgaatttgtcca

SEQ ID NO: 1218561 - DNA, 22 bp, Homo sapiens
cagtgaatttgtccattgtaaa

SEQ ID NO: 1218562 - DNA, 21 bp, Homo sapiens
cagtgacaaagactcctctgg

SEQ ID NO: 1218563 - DNA, 22 bp, Homo sapiens
cagtgacaaagactcctctggg

SEQ ID NO: 1218564 - DNA, 18 bp, Homo sapiens
cagtgacacccagaggga

SEQ ID NO: 1218565 - DNA, 21 bp, Homo sapiens
cagtgacactaaaacaagagg

SEQ ID NO: 1218566 - DNA, 16 bp, Homo sapiens
cagtgacacttcagag

SEQ ID NO: 1218567 - DNA, 17 bp, Homo sapiens
cagtgacacttcagaga

SEQ ID NO: 1218568 - DNA, 23 bp, Homo sapiens
cagtgacacttcagagagctggt

SEQ ID NO: 1218569 - DNA, 18 bp, Homo sapiens
cagtgacagacaggctct

SEQ ID NO: 1218570 - DNA, 19 bp, Homo sapiens
cagtgtccagcttccaaag

SEQ ID NO: 1218571 - DNA, 23 bp, Homo sapiens
cagtgtccagcttccaaagccta

SEQ ID NO: 1218572 - DNA, 14 bp, Homo sapiens
cagtgtcccaggca

SEQ ID NO: 1218573 - DNA, 16 bp, Homo sapiens
cagtgtcccctccact

SEQ ID NO: 1218574 - DNA, 20 bp, Homo sapiens
cagtgtccttagaacatttt

SEQ ID NO: 1218575 - DNA, 20 bp, Homo sapiens
cagtgtccttggcaggctga

SEQ ID NO: 1218576 - DNA, 14 bp, Homo sapiens
cagtgtctcggagg

SEQ ID NO: 1218577 - DNA, 13 bp, Homo sapiens
cagtgtctgtgtt

SEQ ID NO: 1218578 - DNA, 23 bp, Homo sapiens
cagtgtctgtgttttgaaagaat

SEQ ID NO: 1218579 - DNA, 13 bp, Homo sapiens
cagtgtcttccat

SEQ ID NO: 1218580 - DNA, 16 bp, Homo sapiens
cagtgtctttctagcc

SEQ ID NO: 1218581 - DNA, 17 bp, Homo sapiens
cagtgtctttttttgta

SEQ ID NO: 1218582 - DNA, 19 bp, Homo sapiens
cagtgtctttttttgtata

SEQ ID NO: 1218583 - DNA, 16 bp, Homo sapiens
cagtgtgaggccaggg

SEQ ID NO: 1218584 - DNA, 19 bp, Homo sapiens
cagtgtgaggccagggcag

SEQ ID NO: 1218585 - DNA, 18 bp, Homo sapiens
cagtgtgatcccaagtgc

SEQ ID NO: 1218586 - DNA, 19 bp, Homo sapiens
cagtgtgatcccaagtgcc

SEQ ID NO: 1218587 - DNA, 18 bp, Homo sapiens
cagtgtgctttgcatttt

SEQ ID NO: 1218588 - DNA, 22 bp, Homo sapiens
cagtgtggagaccctgccacag

SEQ ID NO: 1218589 - DNA, 22 bp, Homo sapiens
cagtgtggagttcaccttggaa

SEQ ID NO: 1218590 - DNA, 15 bp, Homo sapiens
cagtgtggccaggct

SEQ ID NO: 1218591 - DNA, 23 bp, Homo sapiens
cagtgtgggaatgcggcaagaag

SEQ ID NO: 1218592 - DNA, 15 bp, Homo sapiens
cagtgtgtaaataat

SEQ ID NO: 1218593 - DNA, 21 bp, Homo sapiens
cagtgtgtcgagtcaaaatgt

SEQ ID NO: 1218594 - DNA, 20 bp, Homo sapiens
cagtgtgtgaactgctttca

SEQ ID NO: 1218595 - DNA, 20 bp, Homo sapiens
cagtgtgtgtttaacattca

SEQ ID NO: 1218596 - DNA, 15 bp, Homo sapiens
cagtgttaaatgaaa

SEQ ID NO: 1218597 - DNA, 18 bp, Homo sapiens
cagtgttaaatgaaattg

SEQ ID NO: 1218598 - DNA, 15 bp, Homo sapiens
cagtgttaaattcat

SEQ ID NO: 1218599 - DNA, 14 bp, Homo sapiens
cagtgttagagaaa

SEQ ID NO: 1218600 - DNA, 19 bp, Homo sapiens
cagtgttagagaaatcctt

SEQ ID NO: 1218601 - DNA, 14 bp, Homo sapiens
cagtgttagtattc

SEQ ID NO: 1218602 - DNA, 16 bp, Homo sapiens
cagtgttagtgctggt

SEQ ID NO: 1218603 - DNA, 23 bp, Homo sapiens
cagtgttagtgctggtcagagag

SEQ ID NO: 1218604 - DNA, 13 bp, Homo sapiens
cagtgttatccca

SEQ ID NO: 1218605 - DNA, 15 bp, Homo sapiens
cagtgttatcccaag

SEQ ID NO: 1218606 - DNA, 18 bp, Homo sapiens
cagtgttatcccaagacc

SEQ ID NO: 1218607 - DNA, 21 bp, Homo sapiens
cagtgttccccatctgggtcc

SEQ ID NO: 1218608 - DNA, 17 bp, Homo sapiens
cagtgttcctgaagctg

SEQ ID NO: 1218609 - DNA, 18 bp, Homo sapiens
cagtgttcctgaagctgc

SEQ ID NO: 1218610 - DNA, 17 bp, Homo sapiens
cagtgttctatgaacaa

SEQ ID NO: 1218611 - DNA, 18 bp, Homo sapiens
cagtgttctatgaacaac

SEQ ID NO: 1218612 - DNA, 20 bp, Homo sapiens
cagtgttgcatatgagcctg

SEQ ID NO: 1218613 - DNA, 15 bp, Homo sapiens
cagtgttgcctcctc

SEQ ID NO: 1218614 - DNA, 21 bp, Homo sapiens
cagtgttgcctcctcccatcc

SEQ ID NO: 1218615 - DNA, 20 bp, Homo sapiens
cagtgttggctgtgtgacag

SEQ ID NO: 1218616 - DNA, 23 bp, Homo sapiens
cagtgttgtgccccttcactcat

SEQ ID NO: 1218617 - DNA, 22 bp, Homo sapiens
cagtgttgtggatttaacagaa

SEQ ID NO: 1218618 - DNA, 17 bp, Homo sapiens
cagtgttgtgggcttcc

SEQ ID NO: 1218619 - DNA, 19 bp, Homo sapiens
cagtgttgtgggcttcctg

SEQ ID NO: 1218620 - DNA, 17 bp, Homo sapiens
cagtgttgttccctccc

SEQ ID NO: 1218621 - DNA, 23 bp, Homo sapiens
cagtgttgttgctctaggaagac

SEQ ID NO: 1218622 - DNA, 16 bp, Homo sapiens
cagtgttgtttgtaaa

SEQ ID NO: 1218623 - DNA, 17 bp, Homo sapiens
cagtgttgtttgtaaat

SEQ ID NO: 1218624 - DNA, 21 bp, Homo sapiens
cagtgttgtttgtaaataaga

SEQ ID NO: 1218625 - DNA, 22 bp, Homo sapiens
cagtgttgtttgtaaataagag

SEQ ID NO: 1218626 - DNA, 14 bp, Homo sapiens
cagtgtttaaaact

SEQ ID NO: 1218627 - DNA, 11 bp, Homo sapiens
cagtgtttatg

SEQ ID NO: 1218628 - DNA, 22 bp, Homo sapiens
cagtgtttcaattctgtaatta

SEQ ID NO: 1218629 - DNA, 14 bp, Homo sapiens
cagtgtttcccata

SEQ ID NO: 1218630 - DNA, 18 bp, Homo sapiens
cagtgtttcccataattt

SEQ ID NO: 1218631 - DNA, 20 bp, Homo sapiens
cagtgtttcccataattttc

SEQ ID NO: 1218632 - DNA, 17 bp, Homo sapiens
cagtgtttgggaaatta

SEQ ID NO: 1218633 - DNA, 22 bp, Homo sapiens
cagtgttttctgggataagtaa

SEQ ID NO: 1218634 - DNA, 11 bp, Homo sapiens
cagtgttttgg

SEQ ID NO: 1218635 - DNA, 21 bp, Homo sapiens
cagtgtttttagacctgtgtt

SEQ ID NO: 1218636 - DNA, 17 bp, Homo sapiens
cagtgtttttattgctc

SEQ ID NO: 1218637 - DNA, 16 bp, Homo sapiens
cagttaaaaaaaattt

SEQ ID NO: 1218638 - DNA, 12 bp, Homo sapiens
cagttaaaatgt

SEQ ID NO: 1218639 - DNA, 13 bp, Homo sapiens
cagttaaagatta

SEQ ID NO: 1218640 - DNA, 21 bp, Homo sapiens
cagttaactattgcatttata

SEQ ID NO: 1218641 - DNA, 20 bp, Homo sapiens
cagttaagaagccctgcaga

SEQ ID NO: 1218642 - DNA, 17 bp, Homo sapiens
cagttaaggaatataat

SEQ ID NO: 1218643 - DNA, 22 bp, Homo sapiens
cagttaattactcagcagaatg

SEQ ID NO: 1218644 - DNA, 16 bp, Homo sapiens
cagttaatttttccaa

SEQ ID NO: 1218645 - DNA, 17 bp, Homo sapiens
cagttaccacagcaact

SEQ ID NO: 1218646 - DNA, 19 bp, Homo sapiens
cagttactaagaagaaaat

SEQ ID NO: 1218647 - DNA, 14 bp, Homo sapiens
cagttactcagccc

SEQ ID NO: 1218648 - DNA, 15 bp, Homo sapiens
cagttactcagccct

SEQ ID NO: 1218649 - DNA, 16 bp, Homo sapiens
cagttactcaggaggc

SEQ ID NO: 1218650 - DNA, 12 bp, Homo sapiens
cataaaaagcag

SEQ ID NO: 1218651 - DNA, 17 bp, Homo sapiens
cataaaaagcagaattt

SEQ ID NO: 1218652 - DNA, 21 bp, Homo sapiens
cataaaaagcagaattttaat

SEQ ID NO: 1218653 - DNA, 22 bp, Homo sapiens
cataaaaagcagaattttaatg

SEQ ID NO: 1218654 - DNA, 21 bp, Homo sapiens
cataaaaaggacatcagcaaa

SEQ ID NO: 1218655 - DNA, 21 bp, Homo sapiens
cataaaaattagccaagtgtg

SEQ ID NO: 1218656 - DNA, 12 bp, Homo sapiens
cataaaacaaaa

SEQ ID NO: 1218657 - DNA, 15 bp, Homo sapiens
cataaaacaaaacca

SEQ ID NO: 1218658 - DNA, 12 bp, Homo sapiens
cataaaacaggt

SEQ ID NO: 1218659 - DNA, 16 bp, Homo sapiens
cataaaacattaagaa

SEQ ID NO: 1218660 - DNA, 19 bp, Homo sapiens
cataaaacattaagaaaat

SEQ ID NO: 1218661 - DNA, 13 bp, Homo sapiens
cataaaactttaa

SEQ ID NO: 1218662 - DNA, 14 bp, Homo sapiens
cataaaactttaaa

SEQ ID NO: 1218663 - DNA, 20 bp, Homo sapiens
cataaaactttaaaaggcaa

SEQ ID NO: 1218664 - DNA, 20 bp, Homo sapiens
cataaaataaagtatatata

SEQ ID NO: 1218665 - DNA, 23 bp, Homo sapiens
cataaaattgcagtttcatgtat

SEQ ID NO: 1218666 - DNA, 20 bp, Homo sapiens
cataaacaagaccacgtttc

SEQ ID NO: 1218667 - DNA, 15 bp, Homo sapiens
cataaacattctttt

SEQ ID NO: 1218668 - DNA, 19 bp, Homo sapiens
cataaaccaaaaccaaaca

SEQ ID NO: 1218669 - DNA, 21 bp, Homo sapiens
cataaaccatttttgttactc

SEQ ID NO: 1218670 - DNA, 17 bp, Homo sapiens
cataaactgactttatc

SEQ ID NO: 1218671 - DNA, 19 bp, Homo sapiens
cataaagactgtgctgaga

SEQ ID NO: 1218672 - DNA, 20 bp, Homo sapiens
cataaagcaaatagacacag

SEQ ID NO: 1218673 - DNA, 12 bp, Homo sapiens
cataaagccttt

SEQ ID NO: 1218674 - DNA, 14 bp, Homo sapiens
cataaagtaaatac

SEQ ID NO: 1218675 - DNA, 15 bp, Homo sapiens
cataaagtaaataca

SEQ ID NO: 1218676 - DNA, 19 bp, Homo sapiens
cataaagtaatgatgaaat

SEQ ID NO: 1218677 - DNA, 17 bp, Homo sapiens
cataaagtgagaaaact

SEQ ID NO: 1218678 - DNA, 21 bp, Homo sapiens
cataaagttgataaagatttt

SEQ ID NO: 1218679 - DNA, 16 bp, Homo sapiens
cataaataaaactgaa

SEQ ID NO: 1218680 - DNA, 22 bp, Homo sapiens
cataaataaattaaataaaata

SEQ ID NO: 1218681 - DNA, 22 bp, Homo sapiens
cataaatactgtcaaacaataa

SEQ ID NO: 1218682 - DNA, 11 bp, Homo sapiens
cataaatcaac

SEQ ID NO: 1218683 - DNA, 19 bp, Homo sapiens
cataaatcacagaaaattt

SEQ ID NO: 1218684 - DNA, 18 bp, Homo sapiens
cataaatcatgttgttgt

SEQ ID NO: 1218685 - DNA, 21 bp, Homo sapiens
cataaatgctccttgtggcct

SEQ ID NO: 1218686 - DNA, 15 bp, Homo sapiens
cataaattaaaatgt

SEQ ID NO: 1218687 - DNA, 22 bp, Homo sapiens
cataaattatttgattatttaa

SEQ ID NO: 1218688 - DNA, 14 bp, Homo sapiens
cataacaattcctc

SEQ ID NO: 1218689 - DNA, 15 bp, Homo sapiens
cataacaattcctct

SEQ ID NO: 1218690 - DNA, 13 bp, Homo sapiens
cataacatttaaa

SEQ ID NO: 1218691 - DNA, 14 bp, Homo sapiens
cataactgaaaatg

SEQ ID NO: 1218692 - DNA, 21 bp, Homo sapiens
cataactgcttcttggagctt

SEQ ID NO: 1218693 - DNA, 19 bp, Homo sapiens
cataactggattttgaacg

SEQ ID NO: 1218694 - DNA, 10 bp, Homo sapiens
cataactgta

SEQ ID NO: 1218695 - DNA, 13 bp, Homo sapiens
cataacttcctgt

SEQ ID NO: 1218696 - DNA, 23 bp, Homo sapiens
cataacttcctgtacttgaagtc

SEQ ID NO: 1218697 - DNA, 19 bp, Homo sapiens
cataagaaaactaagaaat

SEQ ID NO: 1218698 - DNA, 23 bp, Homo sapiens
cataagaccataacagccaacag

SEQ ID NO: 1218699 - DNA, 16 bp, Homo sapiens
cataagaccctaagcc

SEQ ID NO: 1218700 - DNA, 20 bp, Homo sapiens
cataagaccctaagcctcct

SEQ ID NO: 1218701 - DNA, 15 bp, Homo sapiens
cataagattaaagga

SEQ ID NO: 1218702 - DNA, 14 bp, Homo sapiens
cataagctcagaat

SEQ ID NO: 1218703 - DNA, 22 bp, Homo sapiens
cataaggaatgtagctggtttc

SEQ ID NO: 1218704 - DNA, 15 bp, Homo sapiens
cataaggatgacttt

SEQ ID NO: 1218705 - DNA, 16 bp, Homo sapiens
cataaggcctgccctc

SEQ ID NO: 1218706 - DNA, 18 bp, Homo sapiens
cataaggcctgccctccc

SEQ ID NO: 1218707 - DNA, 19 bp, Homo sapiens
cataaggcctgccctccca

SEQ ID NO: 1218708 - DNA, 21 bp, Homo sapiens
cataaggcctgccctcccatg

SEQ ID NO: 1218709 - DNA, 22 bp, Homo sapiens
cataaggtttcgtttctgtata

SEQ ID NO: 1218710 - DNA, 17 bp, Homo sapiens
cataaggttttattcat

SEQ ID NO: 1218711 - DNA, 23 bp, Homo sapiens
cataagtaacttttaaaatttgt

SEQ ID NO: 1218712 - DNA, 24 bp, Homo sapiens
cataagtaacttttaaaatttgtc

SEQ ID NO: 1218713 - DNA, 19 bp, Homo sapiens
cataagtattatgtctctt

SEQ ID NO: 1218714 - DNA, 22 bp, Homo sapiens
cataagtcctctagtgaatgta

SEQ ID NO: 1218715 - DNA, 14 bp, Homo sapiens
cataagtgacacca

SEQ ID NO: 1218716 - DNA, 19 bp, Homo sapiens
cataagtgacaccaataaa

SEQ ID NO: 1218717 - DNA, 23 bp, Homo sapiens
cataagtgacaccaataaatgtt

SEQ ID NO: 1218718 - DNA, 20 bp, Homo sapiens
cataagttatgcctctgaca

SEQ ID NO: 1218719 - DNA, 19 bp, Homo sapiens
cataagtttaactttaaaa

SEQ ID NO: 1218720 - DNA, 12 bp, Homo sapiens
cataagtttctg

SEQ ID NO: 1218721 - DNA, 17 bp, Homo sapiens
cataataaaaaggcaat

SEQ ID NO: 1218722 - DNA, 22 bp, Homo sapiens
cataataaaaaggcaatcacat

SEQ ID NO: 1218723 - DNA, 18 bp, Homo sapiens
cataataaaaggctttga

SEQ ID NO: 1218724 - DNA, 14 bp, Homo sapiens
cataataaagttgt

SEQ ID NO: 1218725 - DNA, 17 bp, Homo sapiens
cataataaccctgccag

SEQ ID NO: 1218726 - DNA, 18 bp, Homo sapiens
cataataaccctgccagt

SEQ ID NO: 1218727 - DNA, 16 bp, Homo sapiens
cataataagtttcata

SEQ ID NO: 1218728 - DNA, 17 bp, Homo sapiens
cataataataatgggtt

SEQ ID NO: 1218729 - DNA, 20 bp, Homo sapiens
cataataccaccatttaaaa

SEQ ID NO: 1218730 - DNA, 17 bp, Homo sapiens
cataatatgaagccttt

SEQ ID NO: 1218731 - DNA, 18 bp, Homo sapiens
cataatatgaagcctttg

SEQ ID NO: 1218732 - DNA, 19 bp, Homo sapiens
cataatatgaagcctttgg

SEQ ID NO: 1218733 - DNA, 16 bp, Homo sapiens
cataatcactctaatt

SEQ ID NO: 1218734 - DNA, 14 bp, Homo sapiens
cataatcagtaaat

SEQ ID NO: 1218735 - DNA, 23 bp, Homo sapiens
cataatcagtaaatagtgtcata

SEQ ID NO: 1218736 - DNA, 20 bp, Homo sapiens
cataatcatggattatgttg

SEQ ID NO: 1218737 - DNA, 21 bp, Homo sapiens
cataatctggactcctctgtc

SEQ ID NO: 1218738 - DNA, 22 bp, Homo sapiens
cataatctggactcctctgtcc

SEQ ID NO: 1218739 - DNA, 23 bp, Homo sapiens
cataatctggactcctctgtcca

SEQ ID NO: 1218740 - DNA, 18 bp, Homo sapiens
cataatctggtctcttct

SEQ ID NO: 1218741 - DNA, 23 bp, Homo sapiens
cataatctggtctcttcttcttt

SEQ ID NO: 1218742 - DNA, 18 bp, Homo sapiens
cataatctgtacaatgaa

SEQ ID NO: 1218743 - DNA, 22 bp, Homo sapiens
cataatcttctgccttctcatg

SEQ ID NO: 1218744 - DNA, 15 bp, Homo sapiens
cataatgataaaata

SEQ ID NO: 1218745 - DNA, 20 bp, Homo sapiens
cataatgcattcttctctgt

SEQ ID NO: 1218746 - DNA, 22 bp, Homo sapiens
cataatgcattcttctctgttg

SEQ ID NO: 1218747 - DNA, 17 bp, Homo sapiens
cataatgcgtgcatacc

SEQ ID NO: 1218748 - DNA, 22 bp, Homo sapiens
cataatgctaatttaaagagac

SEQ ID NO: 1218749 - DNA, 14 bp, Homo sapiens
cataatgctactgt

SEQ ID NO: 1218750 - DNA, 19 bp, Homo sapiens
cataatgggccactgaaat

SEQ ID NO: 1218751 - DNA, 23 bp, Homo sapiens
cataatgggccactgaaatctgt

SEQ ID NO: 1218752 - DNA, 19 bp, Homo sapiens
cataatggttgtgaaatgt

SEQ ID NO: 1218753 - DNA, 15 bp, Homo sapiens
cataatgtataaaga

SEQ ID NO: 1218754 - DNA, 18 bp, Homo sapiens
cataatgttaagctttat

SEQ ID NO: 1218755 - DNA, 24 bp, Homo sapiens
cataatgttaagctttattgtgat

SEQ ID NO: 1218756 - DNA, 17 bp, Homo sapiens
cataatgttacattatt

SEQ ID NO: 1218757 - DNA, 21 bp, Homo sapiens
cataatgtttctggatttcat

SEQ ID NO: 1218758 - DNA, 13 bp, Homo sapiens
cataattacattc

SEQ ID NO: 1218759 - DNA, 20 bp, Homo sapiens
cataattacattcctaacta

SEQ ID NO: 1218760 - DNA, 16 bp, Homo sapiens
cataattagatccatt

SEQ ID NO: 1218761 - DNA, 18 bp, Homo sapiens
cataattagatccattaa

SEQ ID NO: 1218762 - DNA, 22 bp, Homo sapiens
cataattagatccattaattta

SEQ ID NO: 1218763 - DNA, 21 bp, Homo sapiens
cataattatgaaaactcatga

SEQ ID NO: 1218764 - DNA, 18 bp, Homo sapiens
cataattcctacagcact

SEQ ID NO: 1218765 - DNA, 17 bp, Homo sapiens
cattgtgccaagccttc

SEQ ID NO: 1218766 - DNA, 19 bp, Homo sapiens
cattgtgccaagccttctg

SEQ ID NO: 1218767 - DNA, 22 bp, Homo sapiens
cattgtgccaagccttctgtga

SEQ ID NO: 1218768 - DNA, 16 bp, Homo sapiens
cattgtggctcctatc

SEQ ID NO: 1218769 - DNA, 22 bp, Homo sapiens
cattgtgggatgttcagcactg

SEQ ID NO: 1218770 - DNA, 17 bp, Homo sapiens
cattgtgtggcctggtg

SEQ ID NO: 1218771 - DNA, 15 bp, Homo sapiens
cattgttcaaaagga

SEQ ID NO: 1218772 - DNA, 16 bp, Homo sapiens
cattgttcaaaaggaa

SEQ ID NO: 1218773 - DNA, 18 bp, Homo sapiens
cattgttcaattagaata

SEQ ID NO: 1218774 - DNA, 14 bp, Homo sapiens
cattgttccacaca

SEQ ID NO: 1218775 - DNA, 22 bp, Homo sapiens
cattgttctgaacactttaggt

SEQ ID NO: 1218776 - DNA, 20 bp, Homo sapiens
cattgttgagctattgctgt

SEQ ID NO: 1218777 - DNA, 13 bp, Homo sapiens
cattgttgtcaaa

SEQ ID NO: 1218778 - DNA, 18 bp, Homo sapiens
cattgttgtcttcactta

SEQ ID NO: 1218779 - DNA, 17 bp, Homo sapiens
cattgtttcgtaacaca

SEQ ID NO: 1218780 - DNA, 21 bp, Homo sapiens
cattgtttgaaacaaagaagg

SEQ ID NO: 1218781 - DNA, 22 bp, Homo sapiens
cattgtttgaaacaaagaaggt

SEQ ID NO: 1218782 - DNA, 16 bp, Homo sapiens
cattgtttgctgctat

SEQ ID NO: 1218783 - DNA, 19 bp, Homo sapiens
cattgtttgcttattgttc

SEQ ID NO: 1218784 - DNA, 21 bp, Homo sapiens
cattgtttgcttattgttcca

SEQ ID NO: 1218785 - DNA, 22 bp, Homo sapiens
cattgtttgcttattgttccaa

SEQ ID NO: 1218786 - DNA, 22 bp, Homo sapiens
cattgtttgtctgtcttcatag

SEQ ID NO: 1218787 - DNA, 15 bp, Homo sapiens
cattgtttgtttgta

SEQ ID NO: 1218788 - DNA, 18 bp, Homo sapiens
cattgttttcttttacag

SEQ ID NO: 1218789 - DNA, 12 bp, Homo sapiens
cattgtttttgt

SEQ ID NO: 1218790 - DNA, 13 bp, Homo sapiens
cattgtttttgta

SEQ ID NO: 1218791 - DNA, 21 bp, Homo sapiens
catttaaaaaaaaaatttgtt

SEQ ID NO: 1218792 - DNA, 13 bp, Homo sapiens
catttaaaacaga

SEQ ID NO: 1218793 - DNA, 12 bp, Homo sapiens
catttaaaacat

SEQ ID NO: 1218794 - DNA, 20 bp, Homo sapiens
catttaaaacattaaaatat

SEQ ID NO: 1218795 - DNA, 21 bp, Homo sapiens
catttaaaacattaaaatata

SEQ ID NO: 1218796 - DNA, 15 bp, Homo sapiens
catttaaaagataca

SEQ ID NO: 1218797 - DNA, 16 bp, Homo sapiens
catttaaaagatacag

SEQ ID NO: 1218798 - DNA, 12 bp, Homo sapiens
catttaaaagca

SEQ ID NO: 1218799 - DNA, 13 bp, Homo sapiens
catttaaaatgat

SEQ ID NO: 1218800 - DNA, 16 bp, Homo sapiens
catttaaaatgattag

SEQ ID NO: 1218801 - DNA, 18 bp, Homo sapiens
catttaaaatgattagaa

SEQ ID NO: 1218802 - DNA, 17 bp, Homo sapiens
catttaaaatggaaaat

SEQ ID NO: 1218803 - DNA, 16 bp, Homo sapiens
catttaaaattgctat

SEQ ID NO: 1218804 - DNA, 22 bp, Homo sapiens
catttaaaattgctatgttact

SEQ ID NO: 1218805 - DNA, 16 bp, Homo sapiens
catttaaacatgttta

SEQ ID NO: 1218806 - DNA, 15 bp, Homo sapiens
catttaaactaaatt

SEQ ID NO: 1218807 - DNA, 15 bp, Homo sapiens
catttaaactctgcc

SEQ ID NO: 1218808 - DNA, 16 bp, Homo sapiens
catttaaactctgcca

SEQ ID NO: 1218809 - DNA, 19 bp, Homo sapiens
catttaaactctgccagaa

SEQ ID NO: 1218810 - DNA, 22 bp, Homo sapiens
catttaaactctgccagaaaaa

SEQ ID NO: 1218811 - DNA, 18 bp, Homo sapiens
catttaaatgtaacttat

SEQ ID NO: 1218812 - DNA, 17 bp, Homo sapiens
catttaaatttgatttc

SEQ ID NO: 1218813 - DNA, 18 bp, Homo sapiens
catttaaattttttggca

SEQ ID NO: 1218814 - DNA, 18 bp, Homo sapiens
catttaaatttttttcct

SEQ ID NO: 1218815 - DNA, 13 bp, Homo sapiens
catttaacataat

SEQ ID NO: 1218816 - DNA, 18 bp, Homo sapiens
catttaacattgtttttg

SEQ ID NO: 1218817 - DNA, 23 bp, Homo sapiens
catttaacccccctgtacacaac

SEQ ID NO: 1218818 - DNA, 13 bp, Homo sapiens
catttaaggagat

SEQ ID NO: 1218819 - DNA, 14 bp, Homo sapiens
catttaagggaaaa

SEQ ID NO: 1218820 - DNA, 17 bp, Homo sapiens
catttaagggaaaaata

SEQ ID NO: 1218821 - DNA, 15 bp, Homo sapiens
catttaagtatcttg

SEQ ID NO: 1218822 - DNA, 15 bp, Homo sapiens
catttaataaaactg

SEQ ID NO: 1218823 - DNA, 14 bp, Homo sapiens
catttaataaagat

SEQ ID NO: 1218824 - DNA, 19 bp, Homo sapiens
catttaataaagatgagtt

SEQ ID NO: 1218825 - DNA, 22 bp, Homo sapiens
catttaatggcagctagtgcct

SEQ ID NO: 1218826 - DNA, 16 bp, Homo sapiens
catttacaggagggcc

SEQ ID NO: 1218827 - DNA, 19 bp, Homo sapiens
catttacagtctctttctt

SEQ ID NO: 1218828 - DNA, 11 bp, Homo sapiens
catttaccaaa

SEQ ID NO: 1218829 - DNA, 18 bp, Homo sapiens
catttactctaaaaactg

SEQ ID NO: 1218830 - DNA, 13 bp, Homo sapiens
catttacttaaga

SEQ ID NO: 1218831 - DNA, 15 bp, Homo sapiens
catttacttttaata

SEQ ID NO: 1218832 - DNA, 12 bp, Homo sapiens
catttagaaaat

SEQ ID NO: 1218833 - DNA, 16 bp, Homo sapiens
catttagataatttga

SEQ ID NO: 1218834 - DNA, 20 bp, Homo sapiens
catttagataatttgaaaaa

SEQ ID NO: 1218835 - DNA, 24 bp, Homo sapiens
catttagcacaatttgagactgaa

SEQ ID NO: 1218836 - DNA, 22 bp, Homo sapiens
catttagctaaacggattccaa

SEQ ID NO: 1218837 - DNA, 21 bp, Homo sapiens
catttagcttgttccactgca

SEQ ID NO: 1218838 - DNA, 20 bp, Homo sapiens
catttagcttttttatttta

SEQ ID NO: 1218839 - DNA, 21 bp, Homo sapiens
catttagcttttttattttaa

SEQ ID NO: 1218840 - DNA, 17 bp, Homo sapiens
catttagtgctaaacaa

SEQ ID NO: 1218841 - DNA, 17 bp, Homo sapiens
catttagtgtgaatatt

SEQ ID NO: 1218842 - DNA, 23 bp, Homo sapiens
catttagttacaacctgaaggaa

SEQ ID NO: 1218843 - DNA, 14 bp, Homo sapiens
catttagttctttg

SEQ ID NO: 1218844 - DNA, 17 bp, Homo sapiens
catttagtttgattatt

SEQ ID NO: 1218845 - DNA, 15 bp, Homo sapiens
catttagttttatgg

SEQ ID NO: 1218846 - DNA, 21 bp, Homo sapiens
catttagttttatggcatgat

SEQ ID NO: 1218847 - DNA, 19 bp, Homo sapiens
catttataaccccagcctg

SEQ ID NO: 1218848 - DNA, 20 bp, Homo sapiens
catttataaccccagcctga

SEQ ID NO: 1218849 - DNA, 23 bp, Homo sapiens
catttataaccccagcctgacct

SEQ ID NO: 1218850 - DNA, 12 bp, Homo sapiens
catttatacaaa

SEQ ID NO: 1218851 - DNA, 15 bp, Homo sapiens
catttatacaaatta

SEQ ID NO: 1218852 - DNA, 17 bp, Homo sapiens
catttatacaaattaga

SEQ ID NO: 1218853 - DNA, 19 bp, Homo sapiens
catttatacaaattagaaa

SEQ ID NO: 1218854 - DNA, 22 bp, Homo sapiens
catttatacatcacctttttga

SEQ ID NO: 1218855 - DNA, 16 bp, Homo sapiens
catttatacctttgaa

SEQ ID NO: 1218856 - DNA, 14 bp, Homo sapiens
catttatatatata

SEQ ID NO: 1218857 - DNA, 19 bp, Homo sapiens
catttatatatatatgtat

SEQ ID NO: 1218858 - DNA, 20 bp, Homo sapiens
catttatatatatatgtata

SEQ ID NO: 1218859 - DNA, 21 bp, Homo sapiens
catttatatatatatgtatat

SEQ ID NO: 1218860 - DNA, 22 bp, Homo sapiens
catttatatatatatgtatatg

SEQ ID NO: 1218861 - DNA, 12 bp, Homo sapiens
catttatatatt

SEQ ID NO: 1218862 - DNA, 18 bp, Homo sapiens
catttatgacctaagtca

SEQ ID NO: 1218863 - DNA, 14 bp, Homo sapiens
catttatgcacatt

SEQ ID NO: 1218864 - DNA, 20 bp, Homo sapiens
catttatggtcaacacttaa

SEQ ID NO: 1218865 - DNA, 23 bp, Homo sapiens
catttatgtctcatgtaatttgc

SEQ ID NO: 1218866 - DNA, 21 bp, Homo sapiens
catttatgttcctttatttag

SEQ ID NO: 1218867 - DNA, 20 bp, Homo sapiens
catttatttattactgtccc

SEQ ID NO: 1218868 - DNA, 22 bp, Homo sapiens
catttatttattactgtcccta

SEQ ID NO: 1218869 - DNA, 12 bp, Homo sapiens
catttatttctc

SEQ ID NO: 1218870 - DNA, 13 bp, Homo sapiens
catttattttata

SEQ ID NO: 1218871 - DNA, 14 bp, Homo sapiens
catttattttgaca

SEQ ID NO: 1218872 - DNA, 15 bp, Homo sapiens
catttcaaagccctg

SEQ ID NO: 1218873 - DNA, 21 bp, Homo sapiens
catttcaaagccctgcctctg

SEQ ID NO: 1218874 - DNA, 16 bp, Homo sapiens
catttcaattcctggc

SEQ ID NO: 1218875 - DNA, 17 bp, Homo sapiens
catttcaattcctggcc

SEQ ID NO: 1218876 - DNA, 15 bp, Homo sapiens
catttcaccatggcc

SEQ ID NO: 1218877 - DNA, 16 bp, Homo sapiens
catttcacctgtgaca

SEQ ID NO: 1218878 - DNA, 20 bp, Homo sapiens
catttcagaaggtatcagtt

SEQ ID NO: 1218879 - DNA, 21 bp, Homo sapiens
catttcagaagttagtttgta

SEQ ID NO: 1218880 - DNA, 15 bp, Homo sapiens
catttcagacatatc

SEQ ID NO: 1218881 - DNA, 19 bp, Homo sapiens
catttcagggtcttggctg

SEQ ID NO: 1218882 - DNA, 20 bp, Homo sapiens
catttcataaggcctgccct

SEQ ID NO: 1218883 - DNA, 22 bp, Homo sapiens
catttcataaggcctgccctcc

SEQ ID NO: 1218884 - DNA, 15 bp, Homo sapiens
catttcatacaacag

SEQ ID NO: 1218885 - DNA, 16 bp, Homo sapiens
catttcatacaacaga

SEQ ID NO: 1218886 - DNA, 23 bp, Homo sapiens
catttcatacaacagaaaccaga

SEQ ID NO: 1218887 - DNA, 16 bp, Homo sapiens
catttcatcattgttt

SEQ ID NO: 1218888 - DNA, 21 bp, Homo sapiens
catttcatcattgtttctgca

SEQ ID NO: 1218889 - DNA, 23 bp, Homo sapiens
cattttgttgtgtgtatgctgct

SEQ ID NO: 1218890 - DNA, 9 bp, Homo sapiens
catttttaa

SEQ ID NO: 1218891 - DNA, 17 bp, Homo sapiens
catttttaaacttgaaa

SEQ ID NO: 1218892 - DNA, 18 bp, Homo sapiens
catttttaaacttgaaat

SEQ ID NO: 1218893 - DNA, 20 bp, Homo sapiens
catttttaaacttgaaatat

SEQ ID NO: 1218894 - DNA, 14 bp, Homo sapiens
catttttaaagcct

SEQ ID NO: 1218895 - DNA, 18 bp, Homo sapiens
catttttaaagcctggct

SEQ ID NO: 1218896 - DNA, 17 bp, Homo sapiens
catttttaaatgtgttt

SEQ ID NO: 1218897 - DNA, 15 bp, Homo sapiens
catttttaaccactt

SEQ ID NO: 1218898 - DNA, 15 bp, Homo sapiens
catttttaagactgt

SEQ ID NO: 1218899 - DNA, 15 bp, Homo sapiens
catttttaagtgctg

SEQ ID NO: 1218900 - DNA, 21 bp, Homo sapiens
catttttaagtgctgcattta

SEQ ID NO: 1218901 - DNA, 18 bp, Homo sapiens
catttttaatattactgt

SEQ ID NO: 1218902 - DNA, 21 bp, Homo sapiens
catttttaatattactgtctt

SEQ ID NO: 1218903 - DNA, 23 bp, Homo sapiens
catttttaatattactgtcttta

SEQ ID NO: 1218904 - DNA, 18 bp, Homo sapiens
catttttaatgtatctat

SEQ ID NO: 1218905 - DNA, 20 bp, Homo sapiens
catttttaatgtatctattt

SEQ ID NO: 1218906 - DNA, 22 bp, Homo sapiens
catttttaatgtatctatttgt

SEQ ID NO: 1218907 - DNA, 19 bp, Homo sapiens
catttttacaaataggtag

SEQ ID NO: 1218908 - DNA, 13 bp, Homo sapiens
catttttacacta

SEQ ID NO: 1218909 - DNA, 20 bp, Homo sapiens
catttttactattgttacat

SEQ ID NO: 1218910 - DNA, 16 bp, Homo sapiens
catttttagaaatcac

SEQ ID NO: 1218911 - DNA, 19 bp, Homo sapiens
catttttagattggttctg

SEQ ID NO: 1218912 - DNA, 17 bp, Homo sapiens
catttttataaatttta

SEQ ID NO: 1218913 - DNA, 13 bp, Homo sapiens
catttttatacag

SEQ ID NO: 1218914 - DNA, 14 bp, Homo sapiens
catttttatgcaga

SEQ ID NO: 1218915 - DNA, 15 bp, Homo sapiens
catttttatgcagac

SEQ ID NO: 1218916 - DNA, 14 bp, Homo sapiens
catttttatttctt

SEQ ID NO: 1218917 - DNA, 12 bp, Homo sapiens
catttttcaata

SEQ ID NO: 1218918 - DNA, 14 bp, Homo sapiens
catttttcaatata

SEQ ID NO: 1218919 - DNA, 15 bp, Homo sapiens
catttttccaggact

SEQ ID NO: 1218920 - DNA, 14 bp, Homo sapiens
catttttcctttag

SEQ ID NO: 1218921 - DNA, 15 bp, Homo sapiens
catttttctataaat

SEQ ID NO: 1218922 - DNA, 17 bp, Homo sapiens
catttttctataaatca

SEQ ID NO: 1218923 - DNA, 14 bp, Homo sapiens
catttttcttgttt

SEQ ID NO: 1218924 - DNA, 19 bp, Homo sapiens
catttttgaaactgcattt

SEQ ID NO: 1218925 - DNA, 16 bp, Homo sapiens
catttttgaggaagtt

SEQ ID NO: 1218926 - DNA, 19 bp, Homo sapiens
catttttgctaattatcaa

SEQ ID NO: 1218927 - DNA, 17 bp, Homo sapiens
catttttggggggagag

SEQ ID NO: 1218928 - DNA, 20 bp, Homo sapiens
catttttgtactaactagca

SEQ ID NO: 1218929 - DNA, 12 bp, Homo sapiens
catttttgtata

SEQ ID NO: 1218930 - DNA, 13 bp, Homo sapiens
catttttgtataa

SEQ ID NO: 1218931 - DNA, 14 bp, Homo sapiens
catttttgtataaa

SEQ ID NO: 1218932 - DNA, 17 bp, Homo sapiens
catttttgtataaaaag

SEQ ID NO: 1218933 - DNA, 12 bp, Homo sapiens
catttttgtgca

SEQ ID NO: 1218934 - DNA, 16 bp, Homo sapiens
catttttgtgccatta

SEQ ID NO: 1218935 - DNA, 17 bp, Homo sapiens
catttttgttttgaaag

SEQ ID NO: 1218936 - DNA, 18 bp, Homo sapiens
catttttgttttgaaagt

SEQ ID NO: 1218937 - DNA, 19 bp, Homo sapiens
catttttgttttgaaagtt

SEQ ID NO: 1218938 - DNA, 16 bp, Homo sapiens
cattttttaaaactga

SEQ ID NO: 1218939 - DNA, 22 bp, Homo sapiens
cattttttaggacatcttaaat

SEQ ID NO: 1218940 - DNA, 13 bp, Homo sapiens
cattttttcagtc

SEQ ID NO: 1218941 - DNA, 18 bp, Homo sapiens
cattttttgggcagcaat

SEQ ID NO: 1218942 - DNA, 17 bp, Homo sapiens
catttttttaatttatt

SEQ ID NO: 1218943 - DNA, 20 bp, Homo sapiens
catttttttaatttattatt

SEQ ID NO: 1218944 - DNA, 18 bp, Homo sapiens
catttttttctctctgga

SEQ ID NO: 1218945 - DNA, 22 bp, Homo sapiens
cattttttttaagaaaaaggat

SEQ ID NO: 1218946 - DNA, 21 bp, Homo sapiens
cattttttttatattgcctta

SEQ ID NO: 1218947 - DNA, 15 bp, Homo sapiens
cattttttttcaagt

SEQ ID NO: 1218948 - DNA, 21 bp, Homo sapiens
cattttttttcagcagactat

SEQ ID NO: 1218949 - DNA, 22 bp, Homo sapiens
ccaaaaaaaggaaaaataatca

SEQ ID NO: 1218950 - DNA, 17 bp, Homo sapiens
ccaaaaaacctcactgg

SEQ ID NO: 1218951 - DNA, 15 bp, Homo sapiens
ccaaaaaagcaaaca

SEQ ID NO: 1218952 - DNA, 14 bp, Homo sapiens
ccaaaaaccatgtt

SEQ ID NO: 1218953 - DNA, 13 bp, Homo sapiens
ccaaaaagcacat

SEQ ID NO: 1218954 - DNA, 16 bp, Homo sapiens
ccaaaaataaatatat

SEQ ID NO: 1218955 - DNA, 20 bp, Homo sapiens
ccaaaaatacaacacagacg

SEQ ID NO: 1218956 - DNA, 13 bp, Homo sapiens
ccaaaaatagcta

SEQ ID NO: 1218957 - DNA, 18 bp, Homo sapiens
ccaaaaatatctcctcca

SEQ ID NO: 1218958 - DNA, 14 bp, Homo sapiens
ccaaaacaatgttt

SEQ ID NO: 1218959 - DNA, 16 bp, Homo sapiens
ccaaaacagcatagta

SEQ ID NO: 1218960 - DNA, 22 bp, Homo sapiens
ccaaaacatattcaaagcagca

SEQ ID NO: 1218961 - DNA, 20 bp, Homo sapiens
ccaaaacatccacttaagtt

SEQ ID NO: 1218962 - DNA, 15 bp, Homo sapiens
ccaaaaccacagccc

SEQ ID NO: 1218963 - DNA, 19 bp, Homo sapiens
ccaaaaccacatgggctgg

SEQ ID NO: 1218964 - DNA, 17 bp, Homo sapiens
ccaaaaccatccatccc

SEQ ID NO: 1218965 - DNA, 14 bp, Homo sapiens
ccaaaacttctctt

SEQ ID NO: 1218966 - DNA, 14 bp, Homo sapiens
ccaaaagacaaaaa

SEQ ID NO: 1218967 - DNA, 19 bp, Homo sapiens
ccaaaagattgctgaaatt

SEQ ID NO: 1218968 - DNA, 15 bp, Homo sapiens
ccaaaagcagtaaat

SEQ ID NO: 1218969 - DNA, 14 bp, Homo sapiens
ccaaaagctgctca

SEQ ID NO: 1218970 - DNA, 19 bp, Homo sapiens
ccaaaaggtttaagaaata

SEQ ID NO: 1218971 - DNA, 17 bp, Homo sapiens
ccaaaagtccctccctg

SEQ ID NO: 1218972 - DNA, 22 bp, Homo sapiens
ccaaaagtccctccctgcctga

SEQ ID NO: 1218973 - DNA, 17 bp, Homo sapiens
ccaaaagttttcctgag

SEQ ID NO: 1218974 - DNA, 14 bp, Homo sapiens
ccaaaataagaaaa

SEQ ID NO: 1218975 - DNA, 18 bp, Homo sapiens
ccaaaataagaaaagatg

SEQ ID NO: 1218976 - DNA, 23 bp, Homo sapiens
ccaaaataatctatattaaatga

SEQ ID NO: 1218977 - DNA, 14 bp, Homo sapiens
ccaaaatacaatgt

SEQ ID NO: 1218978 - DNA, 24 bp, Homo sapiens
ccaaaataccaaatgcctgttgta

SEQ ID NO: 1218979 - DNA, 19 bp, Homo sapiens
ccaaaatattaacattctt

SEQ ID NO: 1218980 - DNA, 12 bp, Homo sapiens
ccaaaatcaaga

SEQ ID NO: 1218981 - DNA, 16 bp, Homo sapiens
ccaaaatccaaaaagc

SEQ ID NO: 1218982 - DNA, 21 bp, Homo sapiens
ccaaaatcctgaactttctcc

SEQ ID NO: 1218983 - DNA, 16 bp, Homo sapiens
ccaaaatctcaagaaa

SEQ ID NO: 1218984 - DNA, 22 bp, Homo sapiens
ccaaaatgctctagtgccttct

SEQ ID NO: 1218985 - DNA, 17 bp, Homo sapiens
ccaaaatgttggctgcg

SEQ ID NO: 1218986 - DNA, 21 bp, Homo sapiens
ccaaaatgttggtcattttat

SEQ ID NO: 1218987 - DNA, 21 bp, Homo sapiens
ccaaaatttattttataagaa

SEQ ID NO: 1218988 - DNA, 15 bp, Homo sapiens
ccaaaattttaaaaa

SEQ ID NO: 1218989 - DNA, 16 bp, Homo sapiens
ccaaacaaatatgcaa

SEQ ID NO: 1218990 - DNA, 12 bp, Homo sapiens
ccaaacaaggaa

SEQ ID NO: 1218991 - DNA, 21 bp, Homo sapiens
ccaaacaaggaagccaaagtt

SEQ ID NO: 1218992 - DNA, 17 bp, Homo sapiens
ccaaacacaaaacattc

SEQ ID NO: 1218993 - DNA, 16 bp, Homo sapiens
ccaaacaccagtcacc

SEQ ID NO: 1218994 - DNA, 17 bp, Homo sapiens
ccaaacaccagtcacct

SEQ ID NO: 1218995 - DNA, 20 bp, Homo sapiens
ccaaacaccttccagctcct

SEQ ID NO: 1218996 - DNA, 12 bp, Homo sapiens
ccaaacactcag

SEQ ID NO: 1218997 - DNA, 13 bp, Homo sapiens
ccaaacactcagt

SEQ ID NO: 1218998 - DNA, 17 bp, Homo sapiens
ccaaacacttctgcttt

SEQ ID NO: 1218999 - DNA, 15 bp, Homo sapiens
ccaaacatcagacct

SEQ ID NO: 1219000 - DNA, 20 bp, Homo sapiens
ccaaacatcagacctgtctt

SEQ ID NO: 1219001 - DNA, 13 bp, Homo sapiens
ccaaacatctggc

SEQ ID NO: 1219002 - DNA, 22 bp, Homo sapiens
ccaaacattaatcaccaaagta

SEQ ID NO: 1219003 - DNA, 17 bp, Homo sapiens
ccaaacatttcatccgt

SEQ ID NO: 1219004 - DNA, 16 bp, Homo sapiens
ccaaaccacaagactc

SEQ ID NO: 1219005 - DNA, 13 bp, Homo sapiens
ccaaaccagcctt

SEQ ID NO: 1219006 - DNA, 14 bp, Homo sapiens
ccaaaccagtttat

SEQ ID NO: 1219007 - DNA, 17 bp, Homo sapiens
ccaaaccatcagctgct

SEQ ID NO: 1219008 - DNA, 18 bp, Homo sapiens
ccaaacccaaaagaaact

SEQ ID NO: 1219009 - DNA, 15 bp, Homo sapiens
ccaaacccagacaac

SEQ ID NO: 1219010 - DNA, 12 bp, Homo sapiens
ccaaacccagcc

SEQ ID NO: 1219011 - DNA, 13 bp, Homo sapiens
ccaaacccagcca

SEQ ID NO: 1219012 - DNA, 18 bp, Homo sapiens
ccaaacccagccactgcc

SEQ ID NO: 1219013 - DNA, 17 bp, Homo sapiens
ccaaaccccagccccaa

SEQ ID NO: 1219014 - DNA, 18 bp, Homo sapiens
ccaaacccttaactgaca

SEQ ID NO: 1219015 - DNA, 12 bp, Homo sapiens
ccaaacccttca

SEQ ID NO: 1219016 - DNA, 22 bp, Homo sapiens
ccaaacccttcaactcctggct

SEQ ID NO: 1219017 - DNA, 23 bp, Homo sapiens
ccaaacccttgctttcctgggcc

SEQ ID NO: 1219018 - DNA, 13 bp, Homo sapiens
ccaaacctccagc

SEQ ID NO: 1219019 - DNA, 14 bp, Homo sapiens
ccaaactaattttt

SEQ ID NO: 1219020 - DNA, 16 bp, Homo sapiens
ccaaactactgaatga

SEQ ID NO: 1219021 - DNA, 19 bp, Homo sapiens
ccaaactagtatcatttta

SEQ ID NO: 1219022 - DNA, 13 bp, Homo sapiens
ccaaactctgcca

SEQ ID NO: 1219023 - DNA, 18 bp, Homo sapiens
ccaaactcttccctctct

SEQ ID NO: 1219024 - DNA, 20 bp, Homo sapiens
ccaaactgtagcaagatgca

SEQ ID NO: 1219025 - DNA, 23 bp, Homo sapiens
ccaaactgtagcaagatgcaaat

SEQ ID NO: 1219026 - DNA, 20 bp, Homo sapiens
ccaaactgtctttgtcacca

SEQ ID NO: 1219027 - DNA, 16 bp, Homo sapiens
ccaaacttggattttt

SEQ ID NO: 1219028 - DNA, 12 bp, Homo sapiens
ccaaactttaaa

SEQ ID NO: 1219029 - DNA, 13 bp, Homo sapiens
ccaaactttaaaa

SEQ ID NO: 1219030 - DNA, 21 bp, Homo sapiens
ccaaactttaaaatgcgaaat

SEQ ID NO: 1219031 - DNA, 14 bp, Homo sapiens
ccaaagaaacaagc

SEQ ID NO: 1219032 - DNA, 19 bp, Homo sapiens
ccaaagaaacaagctgtgc

SEQ ID NO: 1219033 - DNA, 12 bp, Homo sapiens
ccaaagaaagtt

SEQ ID NO: 1219034 - DNA, 22 bp, Homo sapiens
ccaaagaaatgggcctgcctgc

SEQ ID NO: 1219035 - DNA, 23 bp, Homo sapiens
ccaaagaaatgggcctgcctgcc

SEQ ID NO: 1219036 - DNA, 14 bp, Homo sapiens
ccaaagaaggcagg

SEQ ID NO: 1219037 - DNA, 16 bp, Homo sapiens
ccaaagaatattttga

SEQ ID NO: 1219038 - DNA, 17 bp, Homo sapiens
ccaaagactatttcaaa

SEQ ID NO: 1219039 - DNA, 21 bp, Homo sapiens
ccaaagactatttcaaaatgt

SEQ ID NO: 1219040 - DNA, 15 bp, Homo sapiens
ccaaagagcctggag

SEQ ID NO: 1219041 - DNA, 17 bp, Homo sapiens
ccaaagagcctggagaa

SEQ ID NO: 1219042 - DNA, 12 bp, Homo sapiens
ccaaagaggctg

SEQ ID NO: 1219043 - DNA, 17 bp, Homo sapiens
ccaaagaggctgcccct

SEQ ID NO: 1219044 - DNA, 20 bp, Homo sapiens
ccaaagaggctgcccctctc

SEQ ID NO: 1219045 - DNA, 21 bp, Homo sapiens
ccaaagaggctgcccctctca

SEQ ID NO: 1219046 - DNA, 16 bp, Homo sapiens
ccaaagagggcttcct

SEQ ID NO: 1219047 - DNA, 21 bp, Homo sapiens
catttgctgagtttcccttcc

SEQ ID NO: 1219048 - DNA, 16 bp, Homo sapiens
catttgctgatttcta

SEQ ID NO: 1219049 - DNA, 19 bp, Homo sapiens
catttgctggttataacag

SEQ ID NO: 1219050 - DNA, 18 bp, Homo sapiens
catttggaaccaaagtct

SEQ ID NO: 1219051 - DNA, 15 bp, Homo sapiens
catttggaatacttt

SEQ ID NO: 1219052 - DNA, 15 bp, Homo sapiens
catttggaattacaa

SEQ ID NO: 1219053 - DNA, 23 bp, Homo sapiens
catttggagtgttccccttccac

SEQ ID NO: 1219054 - DNA, 23 bp, Homo sapiens
catttggcaaaatgtcttaacaa

SEQ ID NO: 1219055 - DNA, 20 bp, Homo sapiens
catttggccccaggggacgt

SEQ ID NO: 1219056 - DNA, 14 bp, Homo sapiens
catttggcttgctg

SEQ ID NO: 1219057 - DNA, 18 bp, Homo sapiens
catttggtctgccagaat

SEQ ID NO: 1219058 - DNA, 22 bp, Homo sapiens
catttggtgagagtcaaagctg

SEQ ID NO: 1219059 - DNA, 23 bp, Homo sapiens
catttggtggtttcagaaatgtg

SEQ ID NO: 1219060 - DNA, 15 bp, Homo sapiens
catttggtgttcctg

SEQ ID NO: 1219061 - DNA, 16 bp, Homo sapiens
catttggttggcacta

SEQ ID NO: 1219062 - DNA, 11 bp, Homo sapiens
catttgtaaaa

SEQ ID NO: 1219063 - DNA, 20 bp, Homo sapiens
catttgtaaaaatgagactt

SEQ ID NO: 1219064 - DNA, 14 bp, Homo sapiens
catttgtaaatgct

SEQ ID NO: 1219065 - DNA, 19 bp, Homo sapiens
catttgtaagtgtaaaaaa

SEQ ID NO: 1219066 - DNA, 22 bp, Homo sapiens
catttgtaagtgtaaaaaatgt

SEQ ID NO: 1219067 - DNA, 20 bp, Homo sapiens
catttgtacaaggtaattgt

SEQ ID NO: 1219068 - DNA, 16 bp, Homo sapiens
catttgtactttattt

SEQ ID NO: 1219069 - DNA, 11 bp, Homo sapiens
catttgtatat

SEQ ID NO: 1219070 - DNA, 12 bp, Homo sapiens
catttgtatatt

SEQ ID NO: 1219071 - DNA, 14 bp, Homo sapiens
catttgtatattgt

SEQ ID NO: 1219072 - DNA, 22 bp, Homo sapiens
catttgtatgtgtgtagactgt

SEQ ID NO: 1219073 - DNA, 13 bp, Homo sapiens
catttgtattgct

SEQ ID NO: 1219074 - DNA, 11 bp, Homo sapiens
catttgtattt

SEQ ID NO: 1219075 - DNA, 14 bp, Homo sapiens
ccaagctccatctc

SEQ ID NO: 1219076 - DNA, 21 bp, Homo sapiens
ccaagctccctgccccaaata

SEQ ID NO: 1219077 - DNA, 18 bp, Homo sapiens
ccaagctccctggagccc

SEQ ID NO: 1219078 - DNA, 20 bp, Homo sapiens
ccaagctccctggagccctg

SEQ ID NO: 1219079 - DNA, 18 bp, Homo sapiens
ccaagctctagtgggaag

SEQ ID NO: 1219080 - DNA, 14 bp, Homo sapiens
ccaagctctctgca

SEQ ID NO: 1219081 - DNA, 16 bp, Homo sapiens
ccaagctgagtttcct

SEQ ID NO: 1219082 - DNA, 18 bp, Homo sapiens
ccaagctgagtttcctat

SEQ ID NO: 1219083 - DNA, 19 bp, Homo sapiens
ccaagctgagtttcctatg

SEQ ID NO: 1219084 - DNA, 11 bp, Homo sapiens
ccaagctgggc

SEQ ID NO: 1219085 - DNA, 19 bp, Homo sapiens
ccaagctgtacccttgaga

SEQ ID NO: 1219086 - DNA, 13 bp, Homo sapiens
ccaagctgtggca

SEQ ID NO: 1219087 - DNA, 21 bp, Homo sapiens
ccaagctgtgttaactgttca

SEQ ID NO: 1219088 - DNA, 17 bp, Homo sapiens
ccaagctgttttcttct

SEQ ID NO: 1219089 - DNA, 19 bp, Homo sapiens
ccaagcttaatagccctcc

SEQ ID NO: 1219090 - DNA, 17 bp, Homo sapiens
ccaagcttcctgtgccc

SEQ ID NO: 1219091 - DNA, 16 bp, Homo sapiens
ccaagcttggcagccg

SEQ ID NO: 1219092 - DNA, 18 bp, Homo sapiens
ccaagctttaaattatgt

SEQ ID NO: 1219093 - DNA, 23 bp, Homo sapiens
ccaagctttgaggctctgtcact

SEQ ID NO: 1219094 - DNA, 19 bp, Homo sapiens
ccaaggaaaattgaaagta

SEQ ID NO: 1219095 - DNA, 17 bp, Homo sapiens
ccaaggaaacgctacct

SEQ ID NO: 1219096 - DNA, 11 bp, Homo sapiens
ccaaggaagct

SEQ ID NO: 1219097 - DNA, 19 bp, Homo sapiens
ccaaggaagctccttcctg

SEQ ID NO: 1219098 - DNA, 20 bp, Homo sapiens
ccaaggaagctccttcctgt

SEQ ID NO: 1219099 - DNA, 12 bp, Homo sapiens
ccaaggaaggag

SEQ ID NO: 1219100 - DNA, 16 bp, Homo sapiens
ccaaggaaggagcccc

SEQ ID NO: 1219101 - DNA, 21 bp, Homo sapiens
ccaaggaaggagcccctgagt

SEQ ID NO: 1219102 - DNA, 22 bp, Homo sapiens
ccaaggaatgtgtccaagacac

SEQ ID NO: 1219103 - DNA, 23 bp, Homo sapiens
ccaaggaatgtgtccaagacaca

SEQ ID NO: 1219104 - DNA, 14 bp, Homo sapiens
ccaaggacccctca

SEQ ID NO: 1219105 - DNA, 22 bp, Homo sapiens
ccaaggaccttggaagagcaag

SEQ ID NO: 1219106 - DNA, 11 bp, Homo sapiens
ccaaggactgc

SEQ ID NO: 1219107 - DNA, 15 bp, Homo sapiens
ccaaggagaaacaga

SEQ ID NO: 1219108 - DNA, 12 bp, Homo sapiens
ccaaggagacca

SEQ ID NO: 1219109 - DNA, 16 bp, Homo sapiens
ccaaggagcagagagg

SEQ ID NO: 1219110 - DNA, 21 bp, Homo sapiens
ccaaggagctgatttccaggc

SEQ ID NO: 1219111 - DNA, 23 bp, Homo sapiens
ccaaggagctgatttccaggccc

SEQ ID NO: 1219112 - DNA, 15 bp, Homo sapiens
ccaaggagctgctat

SEQ ID NO: 1219113 - DNA, 14 bp, Homo sapiens
ccaaggaggcctgg

SEQ ID NO: 1219114 - DNA, 12 bp, Homo sapiens
ccaaggaggggc

SEQ ID NO: 1219115 - DNA, 19 bp, Homo sapiens
ccaaggataggtattttat

SEQ ID NO: 1219116 - DNA, 21 bp, Homo sapiens
ccaaggatcctctccactcca

SEQ ID NO: 1219117 - DNA, 21 bp, Homo sapiens
ccaaggatgccttagcatgtg

SEQ ID NO: 1219118 - DNA, 15 bp, Homo sapiens
ccaaggcaaaaaact

SEQ ID NO: 1219119 - DNA, 13 bp, Homo sapiens
ccaaggcaaggca

SEQ ID NO: 1219120 - DNA, 16 bp, Homo sapiens
ccaaggcaaggcaggt

SEQ ID NO: 1219121 - DNA, 17 bp, Homo sapiens
ccaaggcaaggcaggtg

SEQ ID NO: 1219122 - DNA, 15 bp, Homo sapiens
ccaaggcagcctcca

SEQ ID NO: 1219123 - DNA, 17 bp, Homo sapiens
ccaaggcagcctccaga

SEQ ID NO: 1219124 - DNA, 19 bp, Homo sapiens
ccaaggcagcctccagagc

SEQ ID NO: 1219125 - DNA, 22 bp, Homo sapiens
ccaaggcagcctccagagccag

SEQ ID NO: 1219126 - DNA, 20 bp, Homo sapiens
ccaaggcagctcttctggag

SEQ ID NO: 1219127 - DNA, 12 bp, Homo sapiens
ccaaggcagtgc

SEQ ID NO: 1219128 - DNA, 19 bp, Homo sapiens
ccaaggcagtgcatgcatg

SEQ ID NO: 1219129 - DNA, 20 bp, Homo sapiens
ccaaggcagtgcatgcatgt

SEQ ID NO: 1219130 - DNA, 21 bp, Homo sapiens
ccaaggcagtgcatgcatgtt

SEQ ID NO: 1219131 - DNA, 11 bp, Homo sapiens
ccaaggccacc

SEQ ID NO: 1219132 - DNA, 19 bp, Homo sapiens
ccaaggccagaaggagggg

SEQ ID NO: 1219133 - DNA, 14 bp, Homo sapiens
ccaaggccccaggg

SEQ ID NO: 1219134 - DNA, 22 bp, Homo sapiens
ccaaggccccagggacagaggc

SEQ ID NO: 1219135 - DNA, 23 bp, Homo sapiens
ccaaggccccagggacagaggcc

SEQ ID NO: 1219136 - DNA, 20 bp, Homo sapiens
ccaaggccgaagctctggct

SEQ ID NO: 1219137 - DNA, 22 bp, Homo sapiens
ccaaggccgccagcgtgtggag

SEQ ID NO: 1219138 - DNA, 23 bp, Homo sapiens
ccaaggcctctcaccccacttcc

SEQ ID NO: 1219139 - DNA, 18 bp, Homo sapiens
ccaaggctcactgcagcg

SEQ ID NO: 1219140 - DNA, 16 bp, Homo sapiens
ccaaggctttctctac

SEQ ID NO: 1219141 - DNA, 21 bp, Homo sapiens
ccaagggaaaggggtgctttt

SEQ ID NO: 1219142 - DNA, 16 bp, Homo sapiens
ccaagggaacctgtgt

SEQ ID NO: 1219143 - DNA, 18 bp, Homo sapiens
ccaagggaacctgtgtcc

SEQ ID NO: 1219144 - DNA, 19 bp, Homo sapiens
ccaagggaacctgtgtccg

SEQ ID NO: 1219145 - DNA, 16 bp, Homo sapiens
ccaagggacaggtggg

SEQ ID NO: 1219146 - DNA, 20 bp, Homo sapiens
ccaagggacaggtgggcctg

SEQ ID NO: 1219147 - DNA, 12 bp, Homo sapiens
ccaagggaggga

SEQ ID NO: 1219148 - DNA, 16 bp, Homo sapiens
ccaagggatggcacca

SEQ ID NO: 1219149 - DNA, 18 bp, Homo sapiens
ccaagggatggcaccact

SEQ ID NO: 1219150 - DNA, 13 bp, Homo sapiens
ccaagggccgtgc

SEQ ID NO: 1219151 - DNA, 17 bp, Homo sapiens
ccaagggcctcccacca

SEQ ID NO: 1219152 - DNA, 21 bp, Homo sapiens
ccaagggcttctgcaccctcc

SEQ ID NO: 1219153 - DNA, 15 bp, Homo sapiens
ccaaggggctgcgct

SEQ ID NO: 1219154 - DNA, 17 bp, Homo sapiens
ccaagggggcggggact

SEQ ID NO: 1219155 - DNA, 23 bp, Homo sapiens
ccaagggggcggggactgctggc

SEQ ID NO: 1219156 - DNA, 24 bp, Homo sapiens
ccaagggggcggggactgctggct

SEQ ID NO: 1219157 - DNA, 18 bp, Homo sapiens
ccaaggggtgggccacag

SEQ ID NO: 1219158 - DNA, 20 bp, Homo sapiens
ccaagggtatgggaagccat

SEQ ID NO: 1219159 - DNA, 19 bp, Homo sapiens
ccaagggttgagagccagt

SEQ ID NO: 1219160 - DNA, 20 bp, Homo sapiens
ccaagggttgagagccagtg

SEQ ID NO: 1219161 - DNA, 20 bp, Homo sapiens
ccaagggtttcgactggtcc

SEQ ID NO: 1219162 - DNA, 22 bp, Homo sapiens
ccaagggtttcgactggtccag

SEQ ID NO: 1219163 - DNA, 21 bp, Homo sapiens
ccaaggtattctattctaata

SEQ ID NO: 1219164 - DNA, 15 bp, Homo sapiens
ccaaggtcactcttg

SEQ ID NO: 1219165 - DNA, 14 bp, Homo sapiens
ccaaggtcctgctc

SEQ ID NO: 1219166 - DNA, 13 bp, Homo sapiens
ccaaggtgcacat

SEQ ID NO: 1219167 - DNA, 20 bp, Homo sapiens
ccaaggtgcatatagaaaac

SEQ ID NO: 1219168 - DNA, 22 bp, Homo sapiens
ccaaggtgcatatagaaaacaa

SEQ ID NO: 1219169 - DNA, 23 bp, Homo sapiens
ccaaggtgcatatagaaaacaaa

SEQ ID NO: 1219170 - DNA, 22 bp, Homo sapiens
ccaaggtggcagatgtcttccc

SEQ ID NO: 1219171 - DNA, 13 bp, Homo sapiens
ccaaggtgggagg

SEQ ID NO: 1219172 - DNA, 14 bp, Homo sapiens
ccaaggtgggcgga

SEQ ID NO: 1219173 - DNA, 17 bp, Homo sapiens
ccaaggtgggctgagcc

SEQ ID NO: 1219174 - DNA, 18 bp, Homo sapiens
ccaaggtgggctgagccc

SEQ ID NO: 1219175 - DNA, 17 bp, Homo sapiens
ccaaggttactcagcag

SEQ ID NO: 1219176 - DNA, 22 bp, Homo sapiens
ccaaggttggagcccagggcat

SEQ ID NO: 1219177 - DNA, 14 bp, Homo sapiens
ccaaggtttataaa

SEQ ID NO: 1219178 - DNA, 19 bp, Homo sapiens
ccaaggttttataaggctg

SEQ ID NO: 1219179 - DNA, 14 bp, Homo sapiens
ccaagtaaaatgtt

SEQ ID NO: 1219180 - DNA, 18 bp, Homo sapiens
ccaagtaaagtgatgttt

SEQ ID NO: 1219181 - DNA, 17 bp, Homo sapiens
ccaagtaccaatgctgt

SEQ ID NO: 1219182 - DNA, 18 bp, Homo sapiens
ccaagtaccaatgctgtt

SEQ ID NO: 1219183 - DNA, 20 bp, Homo sapiens
ccaagtagctgggattacag

SEQ ID NO: 1219184 - DNA, 15 bp, Homo sapiens
ccaagtatgccttaa

SEQ ID NO: 1219185 - DNA, 16 bp, Homo sapiens
ccaagtatgccttaag

SEQ ID NO: 1219186 - DNA, 20 bp, Homo sapiens
ccaagtatgccttaagcaga

SEQ ID NO: 1219187 - DNA, 18 bp, Homo sapiens
ccaagtcaacactcttct

SEQ ID NO: 1219188 - DNA, 19 bp, Homo sapiens
ccaagtcaacactcttctt

SEQ ID NO: 1219189 - DNA, 21 bp, Homo sapiens
ccaagtcaacactcttcttga

SEQ ID NO: 1219190 - DNA, 17 bp, Homo sapiens
ccaagtcaggccaggtg

SEQ ID NO: 1219191 - DNA, 13 bp, Homo sapiens
ccaagtcattgtt

SEQ ID NO: 1219192 - DNA, 19 bp, Homo sapiens
ccaagtccaacctgcctgt

SEQ ID NO: 1219193 - DNA, 16 bp, Homo sapiens
ccaagtccactgtcct

SEQ ID NO: 1219194 - DNA, 13 bp, Homo sapiens
ccaagtccagatt

SEQ ID NO: 1219195 - DNA, 15 bp, Homo sapiens
ccaagtcctgaagag

SEQ ID NO: 1219196 - DNA, 16 bp, Homo sapiens
ccaagtctctctgtga

SEQ ID NO: 1219197 - DNA, 18 bp, Homo sapiens
ccaagtctctctgtgaat

SEQ ID NO: 1219198 - DNA, 19 bp, Homo sapiens
ccaagtctttcttcttttt

SEQ ID NO: 1219199 - DNA, 23 bp, Homo sapiens
ccaagtctttcttcttttttaag

SEQ ID NO: 1219200 - DNA, 18 bp, Homo sapiens
ccaagtgaacactagcca

SEQ ID NO: 1219201 - DNA, 13 bp, Homo sapiens
ccaagtgaccagg

SEQ ID NO: 1219202 - DNA, 20 bp, Homo sapiens
ccaagtgcctgcttttgatg

SEQ ID NO: 1219203 - DNA, 23 bp, Homo sapiens
ccaagtggctgggtgccctctca

SEQ ID NO: 1219204 - DNA, 23 bp, Homo sapiens
ccaagtgggctggtattctctct

SEQ ID NO: 1219205 - DNA, 14 bp, Homo sapiens
ccaagtggggtgct

SEQ ID NO: 1219206 - DNA, 20 bp, Homo sapiens
ccaagtggggtgctctggtc

SEQ ID NO: 1219207 - DNA, 22 bp, Homo sapiens
ccaagtggggtgctgggaggag

SEQ ID NO: 1219208 - DNA, 18 bp, Homo sapiens
ccaagtggtcaggagttg

SEQ ID NO: 1219209 - DNA, 22 bp, Homo sapiens
ccaagtgtctagagtcatgtga

SEQ ID NO: 1219210 - DNA, 14 bp, Homo sapiens
ccaagtgtgaacaa

SEQ ID NO: 1219211 - DNA, 21 bp, Homo sapiens
ccaagtgtgctctttttttaa

SEQ ID NO: 1219212 - DNA, 14 bp, Homo sapiens
ccaagtgtgtgtgc

SEQ ID NO: 1219213 - DNA, 20 bp, Homo sapiens
ccaagttataaatcaatgtc

SEQ ID NO: 1219214 - DNA, 22 bp, Homo sapiens
ccaagttataaatcaatgtcac

SEQ ID NO: 1219215 - DNA, 16 bp, Homo sapiens
ccaagttctaggcccc

SEQ ID NO: 1219216 - DNA, 17 bp, Homo sapiens
ccaagttcttcacctct

SEQ ID NO: 1219217 - DNA, 14 bp, Homo sapiens
ccaagttgcagtga

SEQ ID NO: 1219218 - DNA, 19 bp, Homo sapiens
ccaagttgcagtgagcagg

SEQ ID NO: 1219219 - DNA, 17 bp, Homo sapiens
ccaagtttccatagcaa

SEQ ID NO: 1219220 - DNA, 20 bp, Homo sapiens
ccaagtttccatagcaacag

SEQ ID NO: 1219221 - DNA, 20 bp, Homo sapiens
ccaagtttccggaggagccg

SEQ ID NO: 1219222 - DNA, 23 bp, Homo sapiens
ccaataaaaacattttgaagtgt

SEQ ID NO: 1219223 - DNA, 15 bp, Homo sapiens
ccaataaaagtgact

SEQ ID NO: 1219224 - DNA, 12 bp, Homo sapiens
ccaataaactga

SEQ ID NO: 1219225 - DNA, 13 bp, Homo sapiens
ccaataaactgag

SEQ ID NO: 1219226 - DNA, 20 bp, Homo sapiens
ccaataaaggcagctgcctc

SEQ ID NO: 1219227 - DNA, 21 bp, Homo sapiens
ccaataaaggcagctgcctct

SEQ ID NO: 1219228 - DNA, 22 bp, Homo sapiens
ccaataaagtgccttctgggct

SEQ ID NO: 1219229 - DNA, 14 bp, Homo sapiens
ccaataaatgtttg

SEQ ID NO: 1219230 - DNA, 23 bp, Homo sapiens
ccaataacaaggagctcaccctg

SEQ ID NO: 1219231 - DNA, 24 bp, Homo sapiens
ccaataactaatgctaagaaatgc

SEQ ID NO: 1219232 - DNA, 21 bp, Homo sapiens
ccaataataaaaaacaagaaa

SEQ ID NO: 1219233 - DNA, 23 bp, Homo sapiens
ccaataataaatgccctcttctc

SEQ ID NO: 1219234 - DNA, 19 bp, Homo sapiens
ccaataccctagaagaaaa

SEQ ID NO: 1219235 - DNA, 16 bp, Homo sapiens
ccaataggcaaattaa

SEQ ID NO: 1219236 - DNA, 19 bp, Homo sapiens
ccaataggcaaattaatca

SEQ ID NO: 1219237 - DNA, 23 bp, Homo sapiens
ccaatatatagtgggtacatcaa

SEQ ID NO: 1219238 - DNA, 22 bp, Homo sapiens
ccaatatcatgtcttgtgcata

SEQ ID NO: 1219239 - DNA, 15 bp, Homo sapiens
ccaatatgtattgta

SEQ ID NO: 1219240 - DNA, 22 bp, Homo sapiens
ccaatatgtattgtaaacatgt

SEQ ID NO: 1219241 - DNA, 18 bp, Homo sapiens
ccaatattaaatctgctg

SEQ ID NO: 1219242 - DNA, 13 bp, Homo sapiens
ccaatattataat

SEQ ID NO: 1219243 - DNA, 15 bp, Homo sapiens
ccaatattgtacagt

SEQ ID NO: 1219244 - DNA, 20 bp, Homo sapiens
ccaatattttctttaatgct

SEQ ID NO: 1219245 - DNA, 22 bp, Homo sapiens
ccaatattttctttaatgcttt

SEQ ID NO: 1219246 - DNA, 18 bp, Homo sapiens
ccaatcaaagaattacag

SEQ ID NO: 1219247 - DNA, 15 bp, Homo sapiens
ccaatcacaaggata

SEQ ID NO: 1219248 - DNA, 17 bp, Homo sapiens
ccaatcagagagcctag

SEQ ID NO: 1219249 - DNA, 18 bp, Homo sapiens
ccaatcagagagcctaga

SEQ ID NO: 1219250 - DNA, 19 bp, Homo sapiens
ccaatcagagagcctagaa

SEQ ID NO: 1219251 - DNA, 21 bp, Homo sapiens
ccaatcagcttttgttctaga

SEQ ID NO: 1219252 - DNA, 15 bp, Homo sapiens
ccaatccccagccta

SEQ ID NO: 1219253 - DNA, 16 bp, Homo sapiens
ccaatcccctccttgg

SEQ ID NO: 1219254 - DNA, 13 bp, Homo sapiens
ccaatccctgcca

SEQ ID NO: 1219255 - DNA, 23 bp, Homo sapiens
ccaatccctgccactgggctctg

SEQ ID NO: 1219256 - DNA, 17 bp, Homo sapiens
ccaatcctcactgggtg

SEQ ID NO: 1219257 - DNA, 15 bp, Homo sapiens
ccaatcggactgcca

SEQ ID NO: 1219258 - DNA, 23 bp, Homo sapiens
ccaatctctacccctttcttctc

SEQ ID NO: 1219259 - DNA, 19 bp, Homo sapiens
ccaatctctggtgcctaaa

SEQ ID NO: 1219260 - DNA, 19 bp, Homo sapiens
ccaatctgcaatttctact

SEQ ID NO: 1219261 - DNA, 21 bp, Homo sapiens
ccaatctgccctttgcagtgt

SEQ ID NO: 1219262 - DNA, 23 bp, Homo sapiens
ccaatgaaatacacaagtaaaca

SEQ ID NO: 1219263 - DNA, 17 bp, Homo sapiens
ccaatgacacccatgcc

SEQ ID NO: 1219264 - DNA, 23 bp, Homo sapiens
ccaatgacacccatgccagagag

SEQ ID NO: 1219265 - DNA, 23 bp, Homo sapiens
ccaatgagactctagggtccagt

SEQ ID NO: 1219266 - DNA, 15 bp, Homo sapiens
ccaatgatggtcacc

SEQ ID NO: 1219267 - DNA, 21 bp, Homo sapiens
ccaatgcatgcagccactgtg

SEQ ID NO: 1219268 - DNA, 18 bp, Homo sapiens
ccaatgccccactggcag

SEQ ID NO: 1219269 - DNA, 18 bp, Homo sapiens
ccaatgcctataaaatgc

SEQ ID NO: 1219270 - DNA, 16 bp, Homo sapiens
ccaatgcctttttaga

SEQ ID NO: 1219271 - DNA, 18 bp, Homo sapiens
ccaatgcgacaagtagtt

SEQ ID NO: 1219272 - DNA, 18 bp, Homo sapiens
ccaatgctgcctgggagc

SEQ ID NO: 1219273 - DNA, 21 bp, Homo sapiens
ccaatggcattattaggtctt

SEQ ID NO: 1219274 - DNA, 17 bp, Homo sapiens
ccaatgggaccgtgccc

SEQ ID NO: 1219275 - DNA, 16 bp, Homo sapiens
ccaatggtgcttcccc

SEQ ID NO: 1219276 - DNA, 15 bp, Homo sapiens
ccaatgtaggagctg

SEQ ID NO: 1219277 - DNA, 16 bp, Homo sapiens
ccaatgtcctgaaaca

SEQ ID NO: 1219278 - DNA, 13 bp, Homo sapiens
ccaatgtctccca

SEQ ID NO: 1219279 - DNA, 14 bp, Homo sapiens
ccaatgtctcccac

SEQ ID NO: 1219280 - DNA, 22 bp, Homo sapiens
ccaatgtctcccacacccaccc

SEQ ID NO: 1219281 - DNA, 19 bp, Homo sapiens
ccaattaagtcctacttta

SEQ ID NO: 1219282 - DNA, 18 bp, Homo sapiens
ccaattcggggcctgctg

SEQ ID NO: 1219283 - DNA, 19 bp, Homo sapiens
ccaattcggggcctgctgg

SEQ ID NO: 1219284 - DNA, 22 bp, Homo sapiens
ccaattctatcttttgtttcct

SEQ ID NO: 1219285 - DNA, 18 bp, Homo sapiens
ccaattctggacagacag

SEQ ID NO: 1219286 - DNA, 23 bp, Homo sapiens
ccaattgatgttttacgtgcaaa

SEQ ID NO: 1219287 - DNA, 13 bp, Homo sapiens
ccaatttcctctc

SEQ ID NO: 1219288 - DNA, 23 bp, Homo sapiens
ccaatttcctctccactgctgga

SEQ ID NO: 1219289 - DNA, 12 bp, Homo sapiens
ccaatttcttcc

SEQ ID NO: 1219290 - DNA, 13 bp, Homo sapiens
ccaatttcttcct

SEQ ID NO: 1219291 - DNA, 20 bp, Homo sapiens
ccaatttgtaaaaacagcat

SEQ ID NO: 1219292 - DNA, 17 bp, Homo sapiens
ccaatttgtctcctact

SEQ ID NO: 1219293 - DNA, 23 bp, Homo sapiens
ccaatttgtctcctactctgtgt

SEQ ID NO: 1219294 - DNA, 16 bp, Homo sapiens
ccaattttaatttagt

SEQ ID NO: 1219295 - DNA, 18 bp, Homo sapiens
ccaattttgatcttttta

SEQ ID NO: 1219296 - DNA, 13 bp, Homo sapiens
ccacaaaaacaat

SEQ ID NO: 1219297 - DNA, 20 bp, Homo sapiens
ccacaaaagacagacccagt

SEQ ID NO: 1219298 - DNA, 15 bp, Homo sapiens
ccacaaacggagccc

SEQ ID NO: 1219299 - DNA, 18 bp, Homo sapiens
ccacaaacggagcccctg

SEQ ID NO: 1219300 - DNA, 15 bp, Homo sapiens
ccacaaagcaaaggc

SEQ ID NO: 1219301 - DNA, 17 bp, Homo sapiens
ccacaaagcaaaggcag

SEQ ID NO: 1219302 - DNA, 21 bp, Homo sapiens
ccacaaatcaaagcaagggct

SEQ ID NO: 1219303 - DNA, 23 bp, Homo sapiens
ccacaaatgggcgcccccccctc

SEQ ID NO: 1219304 - DNA, 14 bp, Homo sapiens
ccacaacagcctgg

SEQ ID NO: 1219305 - DNA, 21 bp, Homo sapiens
ccacaactgctgtggccccct

SEQ ID NO: 1219306 - DNA, 22 bp, Homo sapiens
ccacaactgctgtggccccctg

SEQ ID NO: 1219307 - DNA, 20 bp, Homo sapiens
ccacaacttgtcacccaaag

SEQ ID NO: 1219308 - DNA, 16 bp, Homo sapiens
ccacaagaaatttgat

SEQ ID NO: 1219309 - DNA, 23 bp, Homo sapiens
ccacaagccattttttgaggaga

SEQ ID NO: 1219310 - DNA, 19 bp, Homo sapiens
ccacaagctgagcaggaca

SEQ ID NO: 1219311 - DNA, 18 bp, Homo sapiens
ccacaagctgcactgtga

SEQ ID NO: 1219312 - DNA, 19 bp, Homo sapiens
ccacaagctgcactgtgaa

SEQ ID NO: 1219313 - DNA, 16 bp, Homo sapiens
ccacaaggaaccctca

SEQ ID NO: 1219314 - DNA, 20 bp, Homo sapiens
ccacaaggaaccctcaggcc

SEQ ID NO: 1219315 - DNA, 22 bp, Homo sapiens
ccacaaggaaccctcaggccac

SEQ ID NO: 1219316 - DNA, 17 bp, Homo sapiens
ccacaaggctggccagc

SEQ ID NO: 1219317 - DNA, 17 bp, Homo sapiens
ccacaaggctgttgcat

SEQ ID NO: 1219318 - DNA, 18 bp, Homo sapiens
ccacaaggggcttttccc

SEQ ID NO: 1219319 - DNA, 23 bp, Homo sapiens
ccacaaggtccactccctgctcc

SEQ ID NO: 1219320 - DNA, 21 bp, Homo sapiens
ccacaagtggtggtaaccctg

SEQ ID NO: 1219321 - DNA, 20 bp, Homo sapiens
ccacaagttaaataaatcat

SEQ ID NO: 1219322 - DNA, 20 bp, Homo sapiens
ccacaatataaaactgtact

SEQ ID NO: 1219323 - DNA, 18 bp, Homo sapiens
ccacaattaaaccgcatg

SEQ ID NO: 1219324 - DNA, 17 bp, Homo sapiens
ccacacaaactatggga

SEQ ID NO: 1219325 - DNA, 12 bp, Homo sapiens
ccacacacagag

SEQ ID NO: 1219326 - DNA, 17 bp, Homo sapiens
ccacacacaggccttct

SEQ ID NO: 1219327 - DNA, 20 bp, Homo sapiens
ccacacacaggccttctgtg

SEQ ID NO: 1219328 - DNA, 22 bp, Homo sapiens
ccacacacgcaggaactcccag

SEQ ID NO: 1219329 - DNA, 23 bp, Homo sapiens
ccacacacgcaggaactcccagc

SEQ ID NO: 1219330 - DNA, 13 bp, Homo sapiens
ccacacagagtgg

SEQ ID NO: 1219331 - DNA, 14 bp, Homo sapiens
ccacacagctgccc

SEQ ID NO: 1219332 - DNA, 17 bp, Homo sapiens
ccacacagctgccctag

SEQ ID NO: 1219333 - DNA, 13 bp, Homo sapiens
ccacacagggcac

SEQ ID NO: 1219334 - DNA, 20 bp, Homo sapiens
ccacacagtcacccctccct

SEQ ID NO: 1219335 - DNA, 22 bp, Homo sapiens
ccacacagtcacccctccctcc

SEQ ID NO: 1219336 - DNA, 18 bp, Homo sapiens
ccacacattccagccagg

SEQ ID NO: 1219337 - DNA, 15 bp, Homo sapiens
ccacacattccaggg

SEQ ID NO: 1219338 - DNA, 14 bp, Homo sapiens
ccacaccaagcagc

SEQ ID NO: 1219339 - DNA, 19 bp, Homo sapiens
ccacaccaatcagagagcc

SEQ ID NO: 1219340 - DNA, 20 bp, Homo sapiens
ccacaccaatcagagagcct

SEQ ID NO: 1219341 - DNA, 13 bp, Homo sapiens
ccacaccacatct

SEQ ID NO: 1219342 - DNA, 12 bp, Homo sapiens
ccacacccagga

SEQ ID NO: 1219343 - DNA, 13 bp, Homo sapiens
ccacaccccagcc

SEQ ID NO: 1219344 - DNA, 15 bp, Homo sapiens
ccacaccccagccca

SEQ ID NO: 1219345 - DNA, 15 bp, Homo sapiens
ccacaccggttccct

SEQ ID NO: 1219346 - DNA, 16 bp, Homo sapiens
ccacaccgtcttcctt

SEQ ID NO: 1219347 - DNA, 22 bp, Homo sapiens
ccacacctcagttcccttggcc

SEQ ID NO: 1219348 - DNA, 14 bp, Homo sapiens
ccacacctccctga

SEQ ID NO: 1219349 - DNA, 16 bp, Homo sapiens
ccacacctccctgaac

SEQ ID NO: 1219350 - DNA, 16 bp, Homo sapiens
ccacacctggccttaa

SEQ ID NO: 1219351 - DNA, 15 bp, Homo sapiens
ccacaccttggcctt

SEQ ID NO: 1219352 - DNA, 14 bp, Homo sapiens
ccacacgcatgggc

SEQ ID NO: 1219353 - DNA, 17 bp, Homo sapiens
ccacacggactcccggg

SEQ ID NO: 1219354 - DNA, 23 bp, Homo sapiens
ccacacggactcccgggccacgc

SEQ ID NO: 1219355 - DNA, 14 bp, Homo sapiens
ccacacggagaggc

SEQ ID NO: 1219356 - DNA, 22 bp, Homo sapiens
ccacactagggactatcaggta

SEQ ID NO: 1219357 - DNA, 17 bp, Homo sapiens
ccacactattaccatga

SEQ ID NO: 1219358 - DNA, 18 bp, Homo sapiens
ccacactattaccatgag

SEQ ID NO: 1219359 - DNA, 19 bp, Homo sapiens
ccacactcaccccagcctc

SEQ ID NO: 1219360 - DNA, 14 bp, Homo sapiens
ccacactcagtccc

SEQ ID NO: 1219361 - DNA, 13 bp, Homo sapiens
ccacactccactc

SEQ ID NO: 1219362 - DNA, 14 bp, Homo sapiens
ccacactccactct

SEQ ID NO: 1219363 - DNA, 14 bp, Homo sapiens
ccacactgaaacca

SEQ ID NO: 1219364 - DNA, 15 bp, Homo sapiens
ccacactgaatctcc

SEQ ID NO: 1219365 - DNA, 13 bp, Homo sapiens
ccacactgagttc

SEQ ID NO: 1219366 - DNA, 14 bp, Homo sapiens
ccacactgatggct

SEQ ID NO: 1219367 - DNA, 13 bp, Homo sapiens
ccacactgccacc

SEQ ID NO: 1219368 - DNA, 13 bp, Homo sapiens
ccacactggactc

SEQ ID NO: 1219369 - DNA, 14 bp, Homo sapiens
ccacactggactcc

SEQ ID NO: 1219370 - DNA, 15 bp, Homo sapiens
ccacactgggcctgg

SEQ ID NO: 1219371 - DNA, 13 bp, Homo sapiens
ccacactggtgac

SEQ ID NO: 1219372 - DNA, 19 bp, Homo sapiens
ccacactgtggccaggcct

SEQ ID NO: 1219373 - DNA, 20 bp, Homo sapiens
ccacacttcaggctcttctc

SEQ ID NO: 1219374 - DNA, 21 bp, Homo sapiens
ccacacttcaggctcttctcc

SEQ ID NO: 1219375 - DNA, 21 bp, Homo sapiens
ccacacttcccacccccaggc

SEQ ID NO: 1219376 - DNA, 13 bp, Homo sapiens
ccacacttcctgt

SEQ ID NO: 1219377 - DNA, 13 bp, Homo sapiens
ccacacttccttt

SEQ ID NO: 1219378 - DNA, 13 bp, Homo sapiens
ccacacttcttga

SEQ ID NO: 1219379 - DNA, 21 bp, Homo sapiens
ccacacttcttgaaacagcct

SEQ ID NO: 1219380 - DNA, 18 bp, Homo sapiens
ccacacttgtgccagccc

SEQ ID NO: 1219381 - DNA, 20 bp, Homo sapiens
ccacacttgttccagctctt

SEQ ID NO: 1219382 - DNA, 21 bp, Homo sapiens
ccacacttgttccagctcttt

SEQ ID NO: 1219383 - DNA, 23 bp, Homo sapiens
ccacagaaccttcaacccagtgg

SEQ ID NO: 1219384 - DNA, 17 bp, Homo sapiens
ccacagaagccaggagc

SEQ ID NO: 1219385 - DNA, 21 bp, Homo sapiens
ccacagaagccaggagcaaat

SEQ ID NO: 1219386 - DNA, 13 bp, Homo sapiens
ccacagacacaca

SEQ ID NO: 1219387 - DNA, 21 bp, Homo sapiens
ccacagacacacacacgcacg

SEQ ID NO: 1219388 - DNA, 17 bp, Homo sapiens
ccacagacctgcagtga

SEQ ID NO: 1219389 - DNA, 18 bp, Homo sapiens
ccacagacctgctctgga

SEQ ID NO: 1219390 - DNA, 11 bp, Homo sapiens
ccacagactga

SEQ ID NO: 1219391 - DNA, 13 bp, Homo sapiens
ccacagactgccc

SEQ ID NO: 1219392 - DNA, 21 bp, Homo sapiens
ccacagactgccccagccaac

SEQ ID NO: 1219393 - DNA, 16 bp, Homo sapiens
ccacagactggttttg

SEQ ID NO: 1219394 - DNA, 18 bp, Homo sapiens
ccacatttgggctcaggg

SEQ ID NO: 1219395 - DNA, 23 bp, Homo sapiens
ccacatttggttctaagaaaccc

SEQ ID NO: 1219396 - DNA, 16 bp, Homo sapiens
ccaccaaactgcacac

SEQ ID NO: 1219397 - DNA, 21 bp, Homo sapiens
ccaccaaactgcacacacagc

SEQ ID NO: 1219398 - DNA, 24 bp, Homo sapiens
ccaccaaactgcacacacagctcc

SEQ ID NO: 1219399 - DNA, 16 bp, Homo sapiens
ccaccaaagctgccca

SEQ ID NO: 1219400 - DNA, 18 bp, Homo sapiens
ccaccaaagctgcccact

SEQ ID NO: 1219401 - DNA, 17 bp, Homo sapiens
ccaccaaatcatcctga

SEQ ID NO: 1219402 - DNA, 15 bp, Homo sapiens
ccaccaacatcccat

SEQ ID NO: 1219403 - DNA, 17 bp, Homo sapiens
ccaccaaccccgcggcc

SEQ ID NO: 1219404 - DNA, 12 bp, Homo sapiens
ccaccaactctg

SEQ ID NO: 1219405 - DNA, 13 bp, Homo sapiens
ccaccaactctgc

SEQ ID NO: 1219406 - DNA, 18 bp, Homo sapiens
ccaccccatccagccaga

SEQ ID NO: 1219407 - DNA, 13 bp, Homo sapiens
ccaccccatgagc

SEQ ID NO: 1219408 - DNA, 17 bp, Homo sapiens
ccaccccatgtgccttt

SEQ ID NO: 1219409 - DNA, 17 bp, Homo sapiens
ccacccccaacccccag

SEQ ID NO: 1219410 - DNA, 15 bp, Homo sapiens
ccacccccaccccca

SEQ ID NO: 1219411 - DNA, 19 bp, Homo sapiens
ccacccccagaggaagtgg

SEQ ID NO: 1219412 - DNA, 17 bp, Homo sapiens
ccacccccagccaggct

SEQ ID NO: 1219413 - DNA, 15 bp, Homo sapiens
ccacccccagccccg

SEQ ID NO: 1219414 - DNA, 16 bp, Homo sapiens
ccacccccagctcaat

SEQ ID NO: 1219415 - DNA, 14 bp, Homo sapiens
ccacccccaggcct

SEQ ID NO: 1219416 - DNA, 17 bp, Homo sapiens
ccacccccaggcctcct

SEQ ID NO: 1219417 - DNA, 13 bp, Homo sapiens
ccacccccaggtc

SEQ ID NO: 1219418 - DNA, 13 bp, Homo sapiens
ccacccccctcct

SEQ ID NO: 1219419 - DNA, 17 bp, Homo sapiens
ccacccccctcctcccc

SEQ ID NO: 1219420 - DNA, 21 bp, Homo sapiens
ccacccccctctctttctctg

SEQ ID NO: 1219421 - DNA, 22 bp, Homo sapiens
ccacccccctctctttctctgg

SEQ ID NO: 1219422 - DNA, 16 bp, Homo sapiens
ccacccccgccacggc

SEQ ID NO: 1219423 - DNA, 21 bp, Homo sapiens
ccacccccgccacggccaccc

SEQ ID NO: 1219424 - DNA, 21 bp, Homo sapiens
ccacccccgccgtggggctcc

SEQ ID NO: 1219425 - DNA, 21 bp, Homo sapiens
ccacccccgggatcctgcccc

SEQ ID NO: 1219426 - DNA, 23 bp, Homo sapiens
ccacccccgggatcctgccccca

SEQ ID NO: 1219427 - DNA, 14 bp, Homo sapiens
ccaccccctcaagc

SEQ ID NO: 1219428 - DNA, 18 bp, Homo sapiens
ccaccccctcctccccca

SEQ ID NO: 1219429 - DNA, 15 bp, Homo sapiens
ccaccccctgggcag

SEQ ID NO: 1219430 - DNA, 15 bp, Homo sapiens
ccaccccctgtccca

SEQ ID NO: 1219431 - DNA, 13 bp, Homo sapiens
ccaccccctgttc

SEQ ID NO: 1219432 - DNA, 17 bp, Homo sapiens
ccacccccttcagtgcc

SEQ ID NO: 1219433 - DNA, 22 bp, Homo sapiens
ccacccccttcagtgcccacca

SEQ ID NO: 1219434 - DNA, 13 bp, Homo sapiens
ccacccccttctc

SEQ ID NO: 1219435 - DNA, 18 bp, Homo sapiens
ccacccccttctctgctc

SEQ ID NO: 1219436 - DNA, 23 bp, Homo sapiens
ccacccccttctctgctccacca

SEQ ID NO: 1219437 - DNA, 20 bp, Homo sapiens
ccaccccgccgttccctgcg

SEQ ID NO: 1219438 - DNA, 17 bp, Homo sapiens
ccaccccgggctctctg

SEQ ID NO: 1219439 - DNA, 20 bp, Homo sapiens
ccaccccgggctctctgctg

SEQ ID NO: 1219440 - DNA, 21 bp, Homo sapiens
ccaccccggggaccctgtgac

SEQ ID NO: 1219441 - DNA, 13 bp, Homo sapiens
ccacccctacccc

SEQ ID NO: 1219442 - DNA, 19 bp, Homo sapiens
ccacccctcaacacctctg

SEQ ID NO: 1219443 - DNA, 15 bp, Homo sapiens
ccacccctcactccc

SEQ ID NO: 1219444 - DNA, 20 bp, Homo sapiens
ccacccctcactccccaggg

SEQ ID NO: 1219445 - DNA, 21 bp, Homo sapiens
ccacccctcactccccaggga

SEQ ID NO: 1219446 - DNA, 23 bp, Homo sapiens
ccacccctcactccccagggagc

SEQ ID NO: 1219447 - DNA, 13 bp, Homo sapiens
ccacccctccaga

SEQ ID NO: 1219448 - DNA, 11 bp, Homo sapiens
ccacccctccc

SEQ ID NO: 1219449 - DNA, 13 bp, Homo sapiens
ccacccctcttct

SEQ ID NO: 1219450 - DNA, 14 bp, Homo sapiens
ccacccctgccact

SEQ ID NO: 1219451 - DNA, 22 bp, Homo sapiens
ccacccctgcccccagccccgg

SEQ ID NO: 1219452 - DNA, 14 bp, Homo sapiens
ccacccctggaaga

SEQ ID NO: 1219453 - DNA, 14 bp, Homo sapiens
ccacccctgtgctc

SEQ ID NO: 1219454 - DNA, 22 bp, Homo sapiens
ccaccccttccccaggcccacc

SEQ ID NO: 1219455 - DNA, 12 bp, Homo sapiens
ccaccccttcct

SEQ ID NO: 1219456 - DNA, 14 bp, Homo sapiens
ccaccccttcctgt

SEQ ID NO: 1219457 - DNA, 17 bp, Homo sapiens
ccaccccttggcccctc

SEQ ID NO: 1219458 - DNA, 14 bp, Homo sapiens
ccacccgatgctgc

SEQ ID NO: 1219459 - DNA, 16 bp, Homo sapiens
ccacccgatgctgctt

SEQ ID NO: 1219460 - DNA, 19 bp, Homo sapiens
ccacccgcagatgacacgc

SEQ ID NO: 1219461 - DNA, 15 bp, Homo sapiens
ccacccgcccgaggg

SEQ ID NO: 1219462 - DNA, 18 bp, Homo sapiens
ccacccgctgcccctccc

SEQ ID NO: 1219463 - DNA, 16 bp, Homo sapiens
ccacccggacaggtgg

SEQ ID NO: 1219464 - DNA, 17 bp, Homo sapiens
ccacccggggcctggac

SEQ ID NO: 1219465 - DNA, 20 bp, Homo sapiens
ccacccgggggagcccagtg

SEQ ID NO: 1219466 - DNA, 21 bp, Homo sapiens
ccacccgggggagcccagtga

SEQ ID NO: 1219467 - DNA, 16 bp, Homo sapiens
ccacccgtaggcagcc

SEQ ID NO: 1219468 - DNA, 15 bp, Homo sapiens
ccacccgtcctccct

SEQ ID NO: 1219469 - DNA, 20 bp, Homo sapiens
ccacccgtcctccctcagcc

SEQ ID NO: 1219470 - DNA, 22 bp, Homo sapiens
ccacccgtcctccctcagcctc

SEQ ID NO: 1219471 - DNA, 15 bp, Homo sapiens
ccacccgtggagatg

SEQ ID NO: 1219472 - DNA, 18 bp, Homo sapiens
ccacccgtggggtgctgc

SEQ ID NO: 1219473 - DNA, 19 bp, Homo sapiens
ccacccgttctgctggcct

SEQ ID NO: 1219474 - DNA, 21 bp, Homo sapiens
ccacccgttctgctggcctgg

SEQ ID NO: 1219475 - DNA, 22 bp, Homo sapiens
ccacccgttctgctggcctgga

SEQ ID NO: 1219476 - DNA, 14 bp, Homo sapiens
ccaccctaccagct

SEQ ID NO: 1219477 - DNA, 22 bp, Homo sapiens
ccaccctacctgttcagtgtcc

SEQ ID NO: 1219478 - DNA, 14 bp, Homo sapiens
ccaccctacgctca

SEQ ID NO: 1219479 - DNA, 21 bp, Homo sapiens
ccaccctagccaatgtctcct

SEQ ID NO: 1219480 - DNA, 22 bp, Homo sapiens
ccaccctcaaatgtcagagcta

SEQ ID NO: 1219481 - DNA, 14 bp, Homo sapiens
ccaccctcacacac

SEQ ID NO: 1219482 - DNA, 15 bp, Homo sapiens
ccaccctcaggtgcc

SEQ ID NO: 1219483 - DNA, 17 bp, Homo sapiens
ccaccctccatgctcct

SEQ ID NO: 1219484 - DNA, 15 bp, Homo sapiens
ccaccctcccctctc

SEQ ID NO: 1219485 - DNA, 19 bp, Homo sapiens
ccaccctccctccactcct

SEQ ID NO: 1219486 - DNA, 18 bp, Homo sapiens
ccaccctcctcttggaat

SEQ ID NO: 1219487 - DNA, 12 bp, Homo sapiens
ccaccctctggg

SEQ ID NO: 1219488 - DNA, 14 bp, Homo sapiens
ccaccctctggtcc

SEQ ID NO: 1219489 - DNA, 16 bp, Homo sapiens
ccaccctgaaagccct

SEQ ID NO: 1219490 - DNA, 15 bp, Homo sapiens
ccaccctgagccggc

SEQ ID NO: 1219491 - DNA, 13 bp, Homo sapiens
ccaccctgcccac

SEQ ID NO: 1219492 - DNA, 21 bp, Homo sapiens
ccaccctgcccacccccggga

SEQ ID NO: 1219493 - DNA, 14 bp, Homo sapiens
ccaccctgcctgca

SEQ ID NO: 1219494 - DNA, 16 bp, Homo sapiens
ccaccctgcgggccag

SEQ ID NO: 1219495 - DNA, 16 bp, Homo sapiens
ccaccctgctgcacta

SEQ ID NO: 1219496 - DNA, 18 bp, Homo sapiens
ccaccctgctgcactagg

SEQ ID NO: 1219497 - DNA, 11 bp, Homo sapiens
ccaccctggaa

SEQ ID NO: 1219498 - DNA, 13 bp, Homo sapiens
ccaccctggcccg

SEQ ID NO: 1219499 - DNA, 13 bp, Homo sapiens
ccaccctgggccc

SEQ ID NO: 1219500 - DNA, 15 bp, Homo sapiens
ccaccctgggccctg

SEQ ID NO: 1219501 - DNA, 16 bp, Homo sapiens
ccaccctgggccctgg

SEQ ID NO: 1219502 - DNA, 16 bp, Homo sapiens
ccaccctgtcccccag

SEQ ID NO: 1219503 - DNA, 16 bp, Homo sapiens
ccacccttccatcagc

SEQ ID NO: 1219504 - DNA, 13 bp, Homo sapiens
ccacccttggcct

SEQ ID NO: 1219505 - DNA, 16 bp, Homo sapiens
ccacccttggcctgtc

SEQ ID NO: 1219506 - DNA, 21 bp, Homo sapiens
ccaccctttcatagagaggcc

SEQ ID NO: 1219507 - DNA, 19 bp, Homo sapiens
ccaccgaccaactgcccta

SEQ ID NO: 1219508 - DNA, 15 bp, Homo sapiens
ccaccgagccacgca

SEQ ID NO: 1219509 - DNA, 22 bp, Homo sapiens
ccaccgaggttcccagggctgg

SEQ ID NO: 1219510 - DNA, 20 bp, Homo sapiens
ccaccgcatatgcatgccag

SEQ ID NO: 1219511 - DNA, 17 bp, Homo sapiens
ccaccgcccctggccgc

SEQ ID NO: 1219512 - DNA, 14 bp, Homo sapiens
ccaccgcctctggc

SEQ ID NO: 1219513 - DNA, 14 bp, Homo sapiens
ccaccgcgggtgtg

SEQ ID NO: 1219514 - DNA, 13 bp, Homo sapiens
ccaccgctgccta

SEQ ID NO: 1219515 - DNA, 23 bp, Homo sapiens
ccaccggcctgtgggtctctgaa

SEQ ID NO: 1219516 - DNA, 13 bp, Homo sapiens
ccaccgggctgca

SEQ ID NO: 1219517 - DNA, 14 bp, Homo sapiens
ccaccgggctgcag

SEQ ID NO: 1219518 - DNA, 15 bp, Homo sapiens
ccaccgggctgcagg

SEQ ID NO: 1219519 - DNA, 16 bp, Homo sapiens
ccaccgggctgcaggt

SEQ ID NO: 1219520 - DNA, 17 bp, Homo sapiens
ccaccgggggtggctct

SEQ ID NO: 1219521 - DNA, 18 bp, Homo sapiens
ccaccgtacaaccccctc

SEQ ID NO: 1219522 - DNA, 13 bp, Homo sapiens
ccaccgtccgccc

SEQ ID NO: 1219523 - DNA, 16 bp, Homo sapiens
ccaccgtccgccctgc

SEQ ID NO: 1219524 - DNA, 14 bp, Homo sapiens
ccaccgtctcggcc

SEQ ID NO: 1219525 - DNA, 23 bp, Homo sapiens
ccaccgtgaaccagagggtgtgg

SEQ ID NO: 1219526 - DNA, 15 bp, Homo sapiens
ccaccgtgcctggct

SEQ ID NO: 1219527 - DNA, 16 bp, Homo sapiens
ccaccgtgcctggcta

SEQ ID NO: 1219528 - DNA, 13 bp, Homo sapiens
ccaccgtggagga

SEQ ID NO: 1219529 - DNA, 14 bp, Homo sapiens
ccaccgtttcttcc

SEQ ID NO: 1219530 - DNA, 16 bp, Homo sapiens
ccacctacacaggagt

SEQ ID NO: 1219531 - DNA, 17 bp, Homo sapiens
ccacctactcctgggtc

SEQ ID NO: 1219532 - DNA, 22 bp, Homo sapiens
ccacctactgcactttccccct

SEQ ID NO: 1219533 - DNA, 17 bp, Homo sapiens
ccacctaggccactcct

SEQ ID NO: 1219534 - DNA, 19 bp, Homo sapiens
ccacctagtgccccagact

SEQ ID NO: 1219535 - DNA, 20 bp, Homo sapiens
ccacctatctcgtgggagag

SEQ ID NO: 1219536 - DNA, 21 bp, Homo sapiens
ccacctatctcgtgggagagc

SEQ ID NO: 1219537 - DNA, 14 bp, Homo sapiens
ccacctatgcctgt

SEQ ID NO: 1219538 - DNA, 19 bp, Homo sapiens
ccacctcacctctttgttc

SEQ ID NO: 1219539 - DNA, 15 bp, Homo sapiens
ccacctcactcctgt

SEQ ID NO: 1219540 - DNA, 16 bp, Homo sapiens
ccacctcagccttgga

SEQ ID NO: 1219541 - DNA, 16 bp, Homo sapiens
ccacctcagggcacgc

SEQ ID NO: 1219542 - DNA, 20 bp, Homo sapiens
ccacctcagggcacgcagga

SEQ ID NO: 1219543 - DNA, 16 bp, Homo sapiens
ccacctcatcactgga

SEQ ID NO: 1219544 - DNA, 19 bp, Homo sapiens
ccacctcatcactggactg

SEQ ID NO: 1219545 - DNA, 23 bp, Homo sapiens
ccacctcatggattgccacagct

SEQ ID NO: 1219546 - DNA, 14 bp, Homo sapiens
ccacctccacccag

SEQ ID NO: 1219547 - DNA, 21 bp, Homo sapiens
ccacctccacccagcccctgg

SEQ ID NO: 1219548 - DNA, 14 bp, Homo sapiens
ccacctccaccccc

SEQ ID NO: 1219549 - DNA, 22 bp, Homo sapiens
ccacctccacccccgccacggc

SEQ ID NO: 1219550 - DNA, 13 bp, Homo sapiens
ccacctccagaaa

SEQ ID NO: 1219551 - DNA, 18 bp, Homo sapiens
ccacctccagcccgggag

SEQ ID NO: 1219552 - DNA, 19 bp, Homo sapiens
ccacctccagcccgggagc

SEQ ID NO: 1219553 - DNA, 20 bp, Homo sapiens
ccacctccagcccgggagcc

SEQ ID NO: 1219554 - DNA, 22 bp, Homo sapiens
ccacctccagcccgggagccta

SEQ ID NO: 1219555 - DNA, 23 bp, Homo sapiens
ccacctccagcccgggagcctag

SEQ ID NO: 1219556 - DNA, 21 bp, Homo sapiens
ccacctccccacacacaggcc

SEQ ID NO: 1219557 - DNA, 22 bp, Homo sapiens
ccacctccccacacacaggcct

SEQ ID NO: 1219558 - DNA, 20 bp, Homo sapiens
ccacctccccctcccccttc

SEQ ID NO: 1219559 - DNA, 23 bp, Homo sapiens
ccacctccctaccaaaaattgcc

SEQ ID NO: 1219560 - DNA, 13 bp, Homo sapiens
ccacctccctctg

SEQ ID NO: 1219561 - DNA, 16 bp, Homo sapiens
ccacctccctgcctcc

SEQ ID NO: 1219562 - DNA, 16 bp, Homo sapiens
ccacctcccttcccac

SEQ ID NO: 1219563 - DNA, 22 bp, Homo sapiens
ccacctccgccagaccccgtgg

SEQ ID NO: 1219564 - DNA, 18 bp, Homo sapiens
ccacctcctagaggtggg

SEQ ID NO: 1219565 - DNA, 12 bp, Homo sapiens
ccacctcctccc

SEQ ID NO: 1219566 - DNA, 15 bp, Homo sapiens
ccacctcctgcggct

SEQ ID NO: 1219567 - DNA, 20 bp, Homo sapiens
ccacctccttccagcactga

SEQ ID NO: 1219568 - DNA, 16 bp, Homo sapiens
ccacctcgctcccctc

SEQ ID NO: 1219569 - DNA, 23 bp, Homo sapiens
ccacctcgctcccctctggaatc

SEQ ID NO: 1219570 - DNA, 17 bp, Homo sapiens
ccacctcggcacacact

SEQ ID NO: 1219571 - DNA, 16 bp, Homo sapiens
ccacctcggcctccca

SEQ ID NO: 1219572 - DNA, 14 bp, Homo sapiens
ccacctcggtcact

SEQ ID NO: 1219573 - DNA, 19 bp, Homo sapiens
ccacctctcacgggccctg

SEQ ID NO: 1219574 - DNA, 13 bp, Homo sapiens
ccacctctccctc

SEQ ID NO: 1219575 - DNA, 16 bp, Homo sapiens
ccacctctccctgacc

SEQ ID NO: 1219576 - DNA, 14 bp, Homo sapiens
ccacctctctcctt

SEQ ID NO: 1219577 - DNA, 19 bp, Homo sapiens
ccacctctctcctttgctg

SEQ ID NO: 1219578 - DNA, 23 bp, Homo sapiens
ccacctctcttttcctctctgtc

SEQ ID NO: 1219579 - DNA, 23 bp, Homo sapiens
ccacctctgacgcaccactgcca

SEQ ID NO: 1219580 - DNA, 22 bp, Homo sapiens
ccacctctgggtccttggctcc

SEQ ID NO: 1219581 - DNA, 14 bp, Homo sapiens
ccacctctggtggc

SEQ ID NO: 1219582 - DNA, 15 bp, Homo sapiens
ccacctctggtggct

SEQ ID NO: 1219583 - DNA, 19 bp, Homo sapiens
ccacctgacaatggcagct

SEQ ID NO: 1219584 - DNA, 20 bp, Homo sapiens
ccacctgacacaccaggcgc

SEQ ID NO: 1219585 - DNA, 22 bp, Homo sapiens
ccacctgacctcttgctgccag

SEQ ID NO: 1219586 - DNA, 20 bp, Homo sapiens
ccacctgaggaactgtctcg

SEQ ID NO: 1219587 - DNA, 22 bp, Homo sapiens
ccacctgaggtgggctggggct

SEQ ID NO: 1219588 - DNA, 21 bp, Homo sapiens
ccacctgccacccccaggtct

SEQ ID NO: 1219589 - DNA, 12 bp, Homo sapiens
ccacctgccccc

SEQ ID NO: 1219590 - DNA, 20 bp, Homo sapiens
ccacctgcccccttctccca

SEQ ID NO: 1219591 - DNA, 16 bp, Homo sapiens
ccacctgcctgcgtct

SEQ ID NO: 1219592 - DNA, 15 bp, Homo sapiens
ccacctgccttggcc

SEQ ID NO: 1219593 - DNA, 22 bp, Homo sapiens
ccacctgcgcttctgctggagg

SEQ ID NO: 1219594 - DNA, 22 bp, Homo sapiens
ccacctgctagtgtgaattaaa

SEQ ID NO: 1219595 - DNA, 22 bp, Homo sapiens
ccacctgctgagagacccaagg

SEQ ID NO: 1219596 - DNA, 22 bp, Homo sapiens
ccacctggacacacactcacca

SEQ ID NO: 1219597 - DNA, 13 bp, Homo sapiens
ccacctggccacc

SEQ ID NO: 1219598 - DNA, 22 bp, Homo sapiens
ccacctggccccatgtctctca

SEQ ID NO: 1219599 - DNA, 18 bp, Homo sapiens
ccacctggggtctctctc

SEQ ID NO: 1219600 - DNA, 13 bp, Homo sapiens
ccacctgtacata

SEQ ID NO: 1219601 - DNA, 12 bp, Homo sapiens
ccacctgtagct

SEQ ID NO: 1219602 - DNA, 21 bp, Homo sapiens
ccacctgtccggcccagtgcc

SEQ ID NO: 1219603 - DNA, 16 bp, Homo sapiens
ccacctgtctcagcct

SEQ ID NO: 1219604 - DNA, 21 bp, Homo sapiens
ccacctgtgccctcaccacca

SEQ ID NO: 1219605 - DNA, 12 bp, Homo sapiens
ccacctgtgctg

SEQ ID NO: 1219606 - DNA, 15 bp, Homo sapiens
ccacctgtgctgctg

SEQ ID NO: 1219607 - DNA, 11 bp, Homo sapiens
ccacctgtggg

SEQ ID NO: 1219608 - DNA, 22 bp, Homo sapiens
ccacctgttaaaatgtacactg

SEQ ID NO: 1219609 - DNA, 14 bp, Homo sapiens
ccaccttaaattaa

SEQ ID NO: 1219610 - DNA, 18 bp, Homo sapiens
ccaccttaaattaaacaa

SEQ ID NO: 1219611 - DNA, 17 bp, Homo sapiens
ccaccttcaattcctgg

SEQ ID NO: 1219612 - DNA, 20 bp, Homo sapiens
ccaccttcaattcctgggcc

SEQ ID NO: 1219613 - DNA, 11 bp, Homo sapiens
ccaccttccca

SEQ ID NO: 1219614 - DNA, 12 bp, Homo sapiens
ccaccttcccag

SEQ ID NO: 1219615 - DNA, 12 bp, Homo sapiens
ccaccttcccca

SEQ ID NO: 1219616 - DNA, 16 bp, Homo sapiens
ccaccttccccagact

SEQ ID NO: 1219617 - DNA, 18 bp, Homo sapiens
ccaccttctgtccccagc

SEQ ID NO: 1219618 - DNA, 22 bp, Homo sapiens
ccaccttctgtccccagccctg

SEQ ID NO: 1219619 - DNA, 15 bp, Homo sapiens
ccaccttgccagggc

SEQ ID NO: 1219620 - DNA, 18 bp, Homo sapiens
ccaccttgccagggcagg

SEQ ID NO: 1219621 - DNA, 17 bp, Homo sapiens
ccaccttgcttgaggga

SEQ ID NO: 1219622 - DNA, 17 bp, Homo sapiens
ccaccttggaccctggt

SEQ ID NO: 1219623 - DNA, 18 bp, Homo sapiens
ccaccttggactcctccc

SEQ ID NO: 1219624 - DNA, 14 bp, Homo sapiens
ccaccttggaggag

SEQ ID NO: 1219625 - DNA, 15 bp, Homo sapiens
ccaccttgtcctggc

SEQ ID NO: 1219626 - DNA, 19 bp, Homo sapiens
ccaccttgttggagcctgc

SEQ ID NO: 1219627 - DNA, 20 bp, Homo sapiens
ccaccttgttggagcctgca

SEQ ID NO: 1219628 - DNA, 22 bp, Homo sapiens
ccaccttgttggagcctgcagg

SEQ ID NO: 1219629 - DNA, 20 bp, Homo sapiens
ccacctttattaaaatctta

SEQ ID NO: 1219630 - DNA, 22 bp, Homo sapiens
ccacctttgggatcagcctccg

SEQ ID NO: 1219631 - DNA, 16 bp, Homo sapiens
ccacctttgtgcagct

SEQ ID NO: 1219632 - DNA, 17 bp, Homo sapiens
ccacgaaactgccctgg

SEQ ID NO: 1219633 - DNA, 16 bp, Homo sapiens
ccacgaacgctcttag

SEQ ID NO: 1219634 - DNA, 15 bp, Homo sapiens
ccacgaatttgctgg

SEQ ID NO: 1219635 - DNA, 19 bp, Homo sapiens
ccacgaatttgctggggaa

SEQ ID NO: 1219636 - DNA, 15 bp, Homo sapiens
ccacgactggccagg

SEQ ID NO: 1219637 - DNA, 15 bp, Homo sapiens
ccacgaggctgcccc

SEQ ID NO: 1219638 - DNA, 16 bp, Homo sapiens
ccacgaggctgccccc

SEQ ID NO: 1219639 - DNA, 17 bp, Homo sapiens
ccacgaggctgccccca

SEQ ID NO: 1219640 - DNA, 14 bp, Homo sapiens
ccacgagggctggc

SEQ ID NO: 1219641 - DNA, 23 bp, Homo sapiens
ccacgaggggacccatgggggct

SEQ ID NO: 1219642 - DNA, 23 bp, Homo sapiens
ccacgaggttaaagaagctgcat

SEQ ID NO: 1219643 - DNA, 18 bp, Homo sapiens
ccacgatgtggccctggc

SEQ ID NO: 1219644 - DNA, 13 bp, Homo sapiens
ccacgattctccc

SEQ ID NO: 1219645 - DNA, 13 bp, Homo sapiens
ccacgatttgtct

SEQ ID NO: 1219646 - DNA, 16 bp, Homo sapiens
ccacgattttctccag

SEQ ID NO: 1219647 - DNA, 22 bp, Homo sapiens
ccacgcagccgccgccgcccac

SEQ ID NO: 1219648 - DNA, 15 bp, Homo sapiens
ccactccagcccgca

SEQ ID NO: 1219649 - DNA, 16 bp, Homo sapiens
ccactccagcccgcag

SEQ ID NO: 1219650 - DNA, 14 bp, Homo sapiens
ccactccagctctg

SEQ ID NO: 1219651 - DNA, 15 bp, Homo sapiens
ccactccccagcccc

SEQ ID NO: 1219652 - DNA, 15 bp, Homo sapiens
ccactcccccacctg

SEQ ID NO: 1219653 - DNA, 20 bp, Homo sapiens
ccactcccccttcccttgga

SEQ ID NO: 1219654 - DNA, 19 bp, Homo sapiens
ccactcccctaaactccag

SEQ ID NO: 1219655 - DNA, 14 bp, Homo sapiens
ccactcccctcaca

SEQ ID NO: 1219656 - DNA, 16 bp, Homo sapiens
ccactccctcccagaa

SEQ ID NO: 1219657 - DNA, 18 bp, Homo sapiens
ccactccctgagctttgg

SEQ ID NO: 1219658 - DNA, 21 bp, Homo sapiens
ccactcctctcaactgcctca

SEQ ID NO: 1219659 - DNA, 23 bp, Homo sapiens
ccactcctctcaactgcctcagc

SEQ ID NO: 1219660 - DNA, 18 bp, Homo sapiens
ccactcctctcccttgag

SEQ ID NO: 1219661 - DNA, 13 bp, Homo sapiens
ccactcctctgac

SEQ ID NO: 1219662 - DNA, 14 bp, Homo sapiens
ccactcctctgact

SEQ ID NO: 1219663 - DNA, 14 bp, Homo sapiens
ccactcctctgctg

SEQ ID NO: 1219664 - DNA, 22 bp, Homo sapiens
ccactcctctgctgacctgctg

SEQ ID NO: 1219665 - DNA, 14 bp, Homo sapiens
ccactccttccttt

SEQ ID NO: 1219666 - DNA, 16 bp, Homo sapiens
ccactcgatgatgctt

SEQ ID NO: 1219667 - DNA, 14 bp, Homo sapiens
ccactcgcagtcgc

SEQ ID NO: 1219668 - DNA, 18 bp, Homo sapiens
ccactcgcagtcgcagga

SEQ ID NO: 1219669 - DNA, 22 bp, Homo sapiens
ccactcggagggtgccctctgc

SEQ ID NO: 1219670 - DNA, 18 bp, Homo sapiens
ccactcgtgcatccctga

SEQ ID NO: 1219671 - DNA, 20 bp, Homo sapiens
ccactctaccctcccacccc

SEQ ID NO: 1219672 - DNA, 16 bp, Homo sapiens
ccactctagttctaga

SEQ ID NO: 1219673 - DNA, 17 bp, Homo sapiens
ccactctagttctagat

SEQ ID NO: 1219674 - DNA, 19 bp, Homo sapiens
ccactctagttctagatga

SEQ ID NO: 1219675 - DNA, 16 bp, Homo sapiens
ccactctcattcccca

SEQ ID NO: 1219676 - DNA, 14 bp, Homo sapiens
ccactctccccaca

SEQ ID NO: 1219677 - DNA, 15 bp, Homo sapiens
ccactctcccctccc

SEQ ID NO: 1219678 - DNA, 18 bp, Homo sapiens
ccactctcccctccctct

SEQ ID NO: 1219679 - DNA, 11 bp, Homo sapiens
ccactctcctt

SEQ ID NO: 1219680 - DNA, 18 bp, Homo sapiens
ccactctcggggcccttg

SEQ ID NO: 1219681 - DNA, 20 bp, Homo sapiens
ccactctgattcacctcttc

SEQ ID NO: 1219682 - DNA, 22 bp, Homo sapiens
ccactctgattcacctcttcct

SEQ ID NO: 1219683 - DNA, 23 bp, Homo sapiens
ccactctgattcacctcttcctc

SEQ ID NO: 1219684 - DNA, 14 bp, Homo sapiens
ccactctgcctgcc

SEQ ID NO: 1219685 - DNA, 13 bp, Homo sapiens
ccactctgcttct

SEQ ID NO: 1219686 - DNA, 20 bp, Homo sapiens
ccactctgcttctctgactt

SEQ ID NO: 1219687 - DNA, 11 bp, Homo sapiens
ccactctggat

SEQ ID NO: 1219688 - DNA, 21 bp, Homo sapiens
ccactctggattcagccttct

SEQ ID NO: 1219689 - DNA, 11 bp, Homo sapiens
ccactctgtaa

SEQ ID NO: 1219690 - DNA, 19 bp, Homo sapiens
ccactcttctttaagccat

SEQ ID NO: 1219691 - DNA, 20 bp, Homo sapiens
ccactcttctttaagccata

SEQ ID NO: 1219692 - DNA, 20 bp, Homo sapiens
ccactgaaatgaccaagaca

SEQ ID NO: 1219693 - DNA, 21 bp, Homo sapiens
ccactgaaatgaccaagacag

SEQ ID NO: 1219694 - DNA, 14 bp, Homo sapiens
ccactgaagctggg

SEQ ID NO: 1219695 - DNA, 16 bp, Homo sapiens
ccactgaagctgggat

SEQ ID NO: 1219696 - DNA, 23 bp, Homo sapiens
ccactgaattgacatgaccctct

SEQ ID NO: 1219697 - DNA, 19 bp, Homo sapiens
ccactgacagcctcccacc

SEQ ID NO: 1219698 - DNA, 13 bp, Homo sapiens
ccactgacagcta

SEQ ID NO: 1219699 - DNA, 15 bp, Homo sapiens
ccactgacccacctg

SEQ ID NO: 1219700 - DNA, 23 bp, Homo sapiens
ccactgaccgggatccagttcca

SEQ ID NO: 1219701 - DNA, 15 bp, Homo sapiens
ccactgacttgctgt

SEQ ID NO: 1219702 - DNA, 17 bp, Homo sapiens
ccactgacttgctgtgt

SEQ ID NO: 1219703 - DNA, 19 bp, Homo sapiens
ccactgcaaataaagcctt

SEQ ID NO: 1219704 - DNA, 23 bp, Homo sapiens
ccactgcatcgtttcatcttcca

SEQ ID NO: 1219705 - DNA, 19 bp, Homo sapiens
ccactgccaagcttcctgt

SEQ ID NO: 1219706 - DNA, 21 bp, Homo sapiens
ccactgccaagcttcctgtgc

SEQ ID NO: 1219707 - DNA, 13 bp, Homo sapiens
ccactgccagcag

SEQ ID NO: 1219708 - DNA, 14 bp, Homo sapiens
ccactgccagcagc

SEQ ID NO: 1219709 - DNA, 23 bp, Homo sapiens
ccactgccaggcacctggcctgc

SEQ ID NO: 1219710 - DNA, 16 bp, Homo sapiens
ccactgccataaaaca

SEQ ID NO: 1219711 - DNA, 19 bp, Homo sapiens
ccactgccccctgctgcca

SEQ ID NO: 1219712 - DNA, 22 bp, Homo sapiens
ccactgccccgtgtgaatgtag

SEQ ID NO: 1219713 - DNA, 20 bp, Homo sapiens
ccactgcccgagctggtgca

SEQ ID NO: 1219714 - DNA, 13 bp, Homo sapiens
ccactgccctgcc

SEQ ID NO: 1219715 - DNA, 17 bp, Homo sapiens
ccactgccctgcctgcc

SEQ ID NO: 1219716 - DNA, 18 bp, Homo sapiens
ccactgccctgcctgccc

SEQ ID NO: 1219717 - DNA, 16 bp, Homo sapiens
ccactgccctggcagc

SEQ ID NO: 1219718 - DNA, 19 bp, Homo sapiens
ccactgccctggcagcagc

SEQ ID NO: 1219719 - DNA, 19 bp, Homo sapiens
ccactgcctcctgcctggg

SEQ ID NO: 1219720 - DNA, 11 bp, Homo sapiens
ccactgcctct

SEQ ID NO: 1219721 - DNA, 16 bp, Homo sapiens
ccactgcctctccctc

SEQ ID NO: 1219722 - DNA, 11 bp, Homo sapiens
ccactgcctgc

SEQ ID NO: 1219723 - DNA, 23 bp, Homo sapiens
ccactgcctgcccacccgtggag

SEQ ID NO: 1219724 - DNA, 23 bp, Homo sapiens
ccactgccttcgcttcttgcctc

SEQ ID NO: 1219725 - DNA, 17 bp, Homo sapiens
ccactgcctttcagaag

SEQ ID NO: 1219726 - DNA, 19 bp, Homo sapiens
ccactgcgccactgccatc

SEQ ID NO: 1219727 - DNA, 19 bp, Homo sapiens
ccactgcgcttactcctct

SEQ ID NO: 1219728 - DNA, 18 bp, Homo sapiens
ccactgcggggagacaga

SEQ ID NO: 1219729 - DNA, 15 bp, Homo sapiens
ccactgctaaggctg

SEQ ID NO: 1219730 - DNA, 16 bp, Homo sapiens
ccactgctaaggctgc

SEQ ID NO: 1219731 - DNA, 13 bp, Homo sapiens
ccactgctgagga

SEQ ID NO: 1219732 - DNA, 16 bp, Homo sapiens
ccactgctgaggagtc

SEQ ID NO: 1219733 - DNA, 18 bp, Homo sapiens
ccactgctgaggagtctg

SEQ ID NO: 1219734 - DNA, 19 bp, Homo sapiens
ccactgctgatattttctc

SEQ ID NO: 1219735 - DNA, 18 bp, Homo sapiens
ccactgctgcagtagggg

SEQ ID NO: 1219736 - DNA, 11 bp, Homo sapiens
ccactgctgga

SEQ ID NO: 1219737 - DNA, 14 bp, Homo sapiens
ccactgcttttccc

SEQ ID NO: 1219738 - DNA, 14 bp, Homo sapiens
ccactggaagatcc

SEQ ID NO: 1219739 - DNA, 15 bp, Homo sapiens
ccactggaagggcag

SEQ ID NO: 1219740 - DNA, 16 bp, Homo sapiens
ccactggacaacactg

SEQ ID NO: 1219741 - DNA, 22 bp, Homo sapiens
ccactggacttgagcttggcag

SEQ ID NO: 1219742 - DNA, 22 bp, Homo sapiens
ccactggcatcgcagcttcctg

SEQ ID NO: 1219743 - DNA, 12 bp, Homo sapiens
ccactggccacc

SEQ ID NO: 1219744 - DNA, 14 bp, Homo sapiens
ccactggccaccag

SEQ ID NO: 1219745 - DNA, 14 bp, Homo sapiens
ccactggccgctga

SEQ ID NO: 1219746 - DNA, 19 bp, Homo sapiens
ccactggccgctgagcgcc

SEQ ID NO: 1219747 - DNA, 14 bp, Homo sapiens
ccactggctgagaa

SEQ ID NO: 1219748 - DNA, 15 bp, Homo sapiens
ccactggctggagga

SEQ ID NO: 1219749 - DNA, 20 bp, Homo sapiens
ccactggcttttgcctgtaa

SEQ ID NO: 1219750 - DNA, 17 bp, Homo sapiens
ccactgggaccaaccct

SEQ ID NO: 1219751 - DNA, 13 bp, Homo sapiens
ccactgggactcc

SEQ ID NO: 1219752 - DNA, 19 bp, Homo sapiens
ccactgggactcccagcag

SEQ ID NO: 1219753 - DNA, 23 bp, Homo sapiens
ccactgggactcccagcagagcc

SEQ ID NO: 1219754 - DNA, 14 bp, Homo sapiens
ccactgggcacctg

SEQ ID NO: 1219755 - DNA, 17 bp, Homo sapiens
ccactgggccagccctg

SEQ ID NO: 1219756 - DNA, 11 bp, Homo sapiens
ccactgggccc

SEQ ID NO: 1219757 - DNA, 18 bp, Homo sapiens
ccactgggcccctgtccc

SEQ ID NO: 1219758 - DNA, 19 bp, Homo sapiens
ccactgggcccctgtcccc

SEQ ID NO: 1219759 - DNA, 14 bp, Homo sapiens
ccactgggcctgct

SEQ ID NO: 1219760 - DNA, 15 bp, Homo sapiens
ccactgggcctgcta

SEQ ID NO: 1219761 - DNA, 13 bp, Homo sapiens
ccactgggctctg

SEQ ID NO: 1219762 - DNA, 14 bp, Homo sapiens
ccactgggctctgg

SEQ ID NO: 1219763 - DNA, 15 bp, Homo sapiens
ccactgggctctgga

SEQ ID NO: 1219764 - DNA, 16 bp, Homo sapiens
ccactgggctctggac

SEQ ID NO: 1219765 - DNA, 23 bp, Homo sapiens
ccactgggctctggacctcagga

SEQ ID NO: 1219766 - DNA, 18 bp, Homo sapiens
ccactggggaatgctccc

SEQ ID NO: 1219767 - DNA, 20 bp, Homo sapiens
ccactggggaatgctcccag

SEQ ID NO: 1219768 - DNA, 19 bp, Homo sapiens
ccagagcggaggctgtgtg

SEQ ID NO: 1219769 - DNA, 18 bp, Homo sapiens
ccagagcggtatctctgg

SEQ ID NO: 1219770 - DNA, 20 bp, Homo sapiens
ccagagctagggctgctgct

SEQ ID NO: 1219771 - DNA, 21 bp, Homo sapiens
ccagagctcatcccccctgct

SEQ ID NO: 1219772 - DNA, 15 bp, Homo sapiens
ccagagctggaaggc

SEQ ID NO: 1219773 - DNA, 17 bp, Homo sapiens
ccagagctggaaggcag

SEQ ID NO: 1219774 - DNA, 22 bp, Homo sapiens
ccagagctggaaggcagggcag

SEQ ID NO: 1219775 - DNA, 15 bp, Homo sapiens
ccagagctggcctcc

SEQ ID NO: 1219776 - DNA, 21 bp, Homo sapiens
ccagagctgggaggcatggcc

SEQ ID NO: 1219777 - DNA, 23 bp, Homo sapiens
ccagagctgtctgaactcacgtg

SEQ ID NO: 1219778 - DNA, 12 bp, Homo sapiens
ccagagctgtgc

SEQ ID NO: 1219779 - DNA, 13 bp, Homo sapiens
ccagagctgtgcc

SEQ ID NO: 1219780 - DNA, 14 bp, Homo sapiens
ccagagctgtgcca

SEQ ID NO: 1219781 - DNA, 15 bp, Homo sapiens
ccagagctgtgccag

SEQ ID NO: 1219782 - DNA, 17 bp, Homo sapiens
ccagagctgtgccagca

SEQ ID NO: 1219783 - DNA, 18 bp, Homo sapiens
ccagagctgtgcctgctc

SEQ ID NO: 1219784 - DNA, 24 bp, Homo sapiens
ccagagctgtttatggcctcagct

SEQ ID NO: 1219785 - DNA, 18 bp, Homo sapiens
ccagagcttattggccac

SEQ ID NO: 1219786 - DNA, 22 bp, Homo sapiens
ccagagcttattggccactggg

SEQ ID NO: 1219787 - DNA, 21 bp, Homo sapiens
ccagaggaactgtccagagag

SEQ ID NO: 1219788 - DNA, 19 bp, Homo sapiens
ccagaggaaggggccagag

SEQ ID NO: 1219789 - DNA, 19 bp, Homo sapiens
ccagaggaatcctggcagc

SEQ ID NO: 1219790 - DNA, 17 bp, Homo sapiens
ccagaggaatgatgggc

SEQ ID NO: 1219791 - DNA, 16 bp, Homo sapiens
ccagaggacacaggca

SEQ ID NO: 1219792 - DNA, 15 bp, Homo sapiens
ccagaggaccgagag

SEQ ID NO: 1219793 - DNA, 12 bp, Homo sapiens
ccagaggacctg

SEQ ID NO: 1219794 - DNA, 15 bp, Homo sapiens
ccagaggactcccaa

SEQ ID NO: 1219795 - DNA, 14 bp, Homo sapiens
ccagaggagcagct

SEQ ID NO: 1219796 - DNA, 16 bp, Homo sapiens
ccagaggagccaccag

SEQ ID NO: 1219797 - DNA, 12 bp, Homo sapiens
ccagaggcaggc

SEQ ID NO: 1219798 - DNA, 19 bp, Homo sapiens
ccagaggcccccagcccag

SEQ ID NO: 1219799 - DNA, 22 bp, Homo sapiens
ccagaggcccccagcccagggc

SEQ ID NO: 1219800 - DNA, 22 bp, Homo sapiens
ccagaggccctaggcgggatgg

SEQ ID NO: 1219801 - DNA, 18 bp, Homo sapiens
ccagaggccctgaagcct

SEQ ID NO: 1219802 - DNA, 16 bp, Homo sapiens
ccagaggctcccaatc

SEQ ID NO: 1219803 - DNA, 18 bp, Homo sapiens
ccagaggctgggagtccc

SEQ ID NO: 1219804 - DNA, 16 bp, Homo sapiens
ccagaggctgggttca

SEQ ID NO: 1219805 - DNA, 15 bp, Homo sapiens
ccagagggccagcag

SEQ ID NO: 1219806 - DNA, 22 bp, Homo sapiens
ccagagggccagcaggctcctg

SEQ ID NO: 1219807 - DNA, 23 bp, Homo sapiens
ccagaggggctgctccagtgggc

SEQ ID NO: 1219808 - DNA, 17 bp, Homo sapiens
ccagagggtagggcaca

SEQ ID NO: 1219809 - DNA, 15 bp, Homo sapiens
ccagagggtgtggct

SEQ ID NO: 1219810 - DNA, 20 bp, Homo sapiens
ccagagggtgtggctttcca

SEQ ID NO: 1219811 - DNA, 15 bp, Homo sapiens
ccagaggtccagccc

SEQ ID NO: 1219812 - DNA, 16 bp, Homo sapiens
ccagaggtccagccca

SEQ ID NO: 1219813 - DNA, 17 bp, Homo sapiens
ccagaggtccagcccat

SEQ ID NO: 1219814 - DNA, 15 bp, Homo sapiens
ccagaggtcctccgt

SEQ ID NO: 1219815 - DNA, 19 bp, Homo sapiens
ccagaggtctagattaata

SEQ ID NO: 1219816 - DNA, 14 bp, Homo sapiens
ccagaggtggatgt

SEQ ID NO: 1219817 - DNA, 20 bp, Homo sapiens
ccagaggtggcccttgttta

SEQ ID NO: 1219818 - DNA, 19 bp, Homo sapiens
ccagaggtgggatcctccc

SEQ ID NO: 1219819 - DNA, 22 bp, Homo sapiens
ccagaggtgggatcctccctca

SEQ ID NO: 1219820 - DNA, 14 bp, Homo sapiens
ccagaggtgggcag

SEQ ID NO: 1219821 - DNA, 16 bp, Homo sapiens
ccagaggtgggcaggt

SEQ ID NO: 1219822 - DNA, 22 bp, Homo sapiens
ccagaggtgggcaggtggtggc

SEQ ID NO: 1219823 - DNA, 23 bp, Homo sapiens
ccagaggttatctgcctggcctg

SEQ ID NO: 1219824 - DNA, 14 bp, Homo sapiens
ccagagtcccaggc

SEQ ID NO: 1219825 - DNA, 17 bp, Homo sapiens
ccagagtcccaggcccc

SEQ ID NO: 1219826 - DNA, 17 bp, Homo sapiens
ccagagtccggaggcag

SEQ ID NO: 1219827 - DNA, 19 bp, Homo sapiens
ccagatttacactgggaga

SEQ ID NO: 1219828 - DNA, 12 bp, Homo sapiens
ccagatttgtct

SEQ ID NO: 1219829 - DNA, 22 bp, Homo sapiens
ccagattttttaaaatttatat

SEQ ID NO: 1219830 - DNA, 17 bp, Homo sapiens
ccagcaaccctcctatc

SEQ ID NO: 1219831 - DNA, 18 bp, Homo sapiens
ccagcaaccctcctatca

SEQ ID NO: 1219832 - DNA, 16 bp, Homo sapiens
ccagcaactgcccttc

SEQ ID NO: 1219833 - DNA, 17 bp, Homo sapiens
ccagcaagagaaccccg

SEQ ID NO: 1219834 - DNA, 18 bp, Homo sapiens
ccagcaagagcacaagag

SEQ ID NO: 1219835 - DNA, 23 bp, Homo sapiens
ccagcaaggcaggttggatggga

SEQ ID NO: 1219836 - DNA, 14 bp, Homo sapiens
ccagcaataagaaa

SEQ ID NO: 1219837 - DNA, 20 bp, Homo sapiens
ccagcaataagaaatgaaca

SEQ ID NO: 1219838 - DNA, 21 bp, Homo sapiens
ccagcaataagaaatgaacaa

SEQ ID NO: 1219839 - DNA, 22 bp, Homo sapiens
ccagcaataagaaatgaacaaa

SEQ ID NO: 1219840 - DNA, 21 bp, Homo sapiens
ccagcaatgacatctcagggg

SEQ ID NO: 1219841 - DNA, 23 bp, Homo sapiens
ccagcaatgacatctcaggggcc

SEQ ID NO: 1219842 - DNA, 18 bp, Homo sapiens
ccagcaatgatgtccaga

SEQ ID NO: 1219843 - DNA, 15 bp, Homo sapiens
ccagcaattatgaaa

SEQ ID NO: 1219844 - DNA, 14 bp, Homo sapiens
ccagcacaccaagt

SEQ ID NO: 1219845 - DNA, 20 bp, Homo sapiens
ccagcacactatttacaaga

SEQ ID NO: 1219846 - DNA, 15 bp, Homo sapiens
ccagcacagccacct

SEQ ID NO: 1219847 - DNA, 16 bp, Homo sapiens
ccagcacagccacctc

SEQ ID NO: 1219848 - DNA, 17 bp, Homo sapiens
ccagcacagccacctcc

SEQ ID NO: 1219849 - DNA, 22 bp, Homo sapiens
ccagcacagccacctccgccag

SEQ ID NO: 1219850 - DNA, 17 bp, Homo sapiens
ccagcacagcttgacct

SEQ ID NO: 1219851 - DNA, 12 bp, Homo sapiens
ccagcacagggg

SEQ ID NO: 1219852 - DNA, 22 bp, Homo sapiens
ccagcacaggggccccagatct

SEQ ID NO: 1219853 - DNA, 24 bp, Homo sapiens
ccagcacaggggccccagatctgc

SEQ ID NO: 1219854 - DNA, 23 bp, Homo sapiens
ccagcacatggccatagaggccc

SEQ ID NO: 1219855 - DNA, 15 bp, Homo sapiens
ccagccagcccttcc

SEQ ID NO: 1219856 - DNA, 16 bp, Homo sapiens
ccagccagcgcctccc

SEQ ID NO: 1219857 - DNA, 13 bp, Homo sapiens
ccagccaggcaga

SEQ ID NO: 1219858 - DNA, 16 bp, Homo sapiens
ccagccaggccaacag

SEQ ID NO: 1219859 - DNA, 12 bp, Homo sapiens
ccagccaggccc

SEQ ID NO: 1219860 - DNA, 12 bp, Homo sapiens
ccagccaggcgg

SEQ ID NO: 1219861 - DNA, 22 bp, Homo sapiens
ccagccaggctatggttgccac

SEQ ID NO: 1219862 - DNA, 19 bp, Homo sapiens
ccagccagggagcttgcca

SEQ ID NO: 1219863 - DNA, 16 bp, Homo sapiens
ccagccatcaaaatgc

SEQ ID NO: 1219864 - DNA, 18 bp, Homo sapiens
ccagccatcaaaatgctt

SEQ ID NO: 1219865 - DNA, 19 bp, Homo sapiens
ccagccatctgcccagggg

SEQ ID NO: 1219866 - DNA, 20 bp, Homo sapiens
ccagccatctgcccaggggt

SEQ ID NO: 1219867 - DNA, 14 bp, Homo sapiens
ccagccatgtctgc

SEQ ID NO: 1219868 - DNA, 17 bp, Homo sapiens
ccagccatgtctgcatt

SEQ ID NO: 1219869 - DNA, 17 bp, Homo sapiens
ccagcccaaaccttggg

SEQ ID NO: 1219870 - DNA, 18 bp, Homo sapiens
ccagcccaaaccttgggc

SEQ ID NO: 1219871 - DNA, 19 bp, Homo sapiens
ccagcccaaaccttgggcc

SEQ ID NO: 1219872 - DNA, 15 bp, Homo sapiens
ccagcccacagagcc

SEQ ID NO: 1219873 - DNA, 18 bp, Homo sapiens
ccagcccacagagcctga

SEQ ID NO: 1219874 - DNA, 12 bp, Homo sapiens
ccagcccacatt

SEQ ID NO: 1219875 - DNA, 15 bp, Homo sapiens
ccagcccaccctgct

SEQ ID NO: 1219876 - DNA, 21 bp, Homo sapiens
ccagcccaccctgctcctcct

SEQ ID NO: 1219877 - DNA, 20 bp, Homo sapiens
ccagcccacctcaacccaga

SEQ ID NO: 1219878 - DNA, 14 bp, Homo sapiens
ccagcccactgcct

SEQ ID NO: 1219879 - DNA, 20 bp, Homo sapiens
ccagcccagagccacctgga

SEQ ID NO: 1219880 - DNA, 14 bp, Homo sapiens
ccagcccagccagg

SEQ ID NO: 1219881 - DNA, 14 bp, Homo sapiens
ccagcccagcctgc

SEQ ID NO: 1219882 - DNA, 15 bp, Homo sapiens
ccagcccagcctgcc

SEQ ID NO: 1219883 - DNA, 16 bp, Homo sapiens
ccagcccagcctgccc

SEQ ID NO: 1219884 - DNA, 13 bp, Homo sapiens
ccagcccagctgg

SEQ ID NO: 1219885 - DNA, 17 bp, Homo sapiens
ccagcccagggctcctg

SEQ ID NO: 1219886 - DNA, 21 bp, Homo sapiens
ccagcccagggttcccccagc

SEQ ID NO: 1219887 - DNA, 18 bp, Homo sapiens
ccagcccatggcccccaa

SEQ ID NO: 1219888 - DNA, 21 bp, Homo sapiens
ccagcccatggcccccaataa

SEQ ID NO: 1219889 - DNA, 22 bp, Homo sapiens
ccagcccatggcccccaataaa

SEQ ID NO: 1219890 - DNA, 20 bp, Homo sapiens
ccagcccattggccgagctc

SEQ ID NO: 1219891 - DNA, 16 bp, Homo sapiens
ccagccccaagctggg

SEQ ID NO: 1219892 - DNA, 20 bp, Homo sapiens
ccagccccacccccagccag

SEQ ID NO: 1219893 - DNA, 22 bp, Homo sapiens
ccagccccacccccagccaggc

SEQ ID NO: 1219894 - DNA, 13 bp, Homo sapiens
ccagccccactgc

SEQ ID NO: 1219895 - DNA, 22 bp, Homo sapiens
ccagccccagacaacagcccag

SEQ ID NO: 1219896 - DNA, 12 bp, Homo sapiens
ccagccccaggc

SEQ ID NO: 1219897 - DNA, 19 bp, Homo sapiens
ccagccccaggcctggcct

SEQ ID NO: 1219898 - DNA, 23 bp, Homo sapiens
ccagccccatcagaacctgagct

SEQ ID NO: 1219899 - DNA, 14 bp, Homo sapiens
ccagcccccagtgc

SEQ ID NO: 1219900 - DNA, 23 bp, Homo sapiens
ccagcccccgccccagagtggcc

SEQ ID NO: 1219901 - DNA, 18 bp, Homo sapiens
ccagccccctccagctca

SEQ ID NO: 1219902 - DNA, 13 bp, Homo sapiens
ccagccccctgga

SEQ ID NO: 1219903 - DNA, 15 bp, Homo sapiens
ccagccccctggatg

SEQ ID NO: 1219904 - DNA, 23 bp, Homo sapiens
ccagccccctggatgggcattgg

SEQ ID NO: 1219905 - DNA, 15 bp, Homo sapiens
ccagccccgactcca

SEQ ID NO: 1219906 - DNA, 17 bp, Homo sapiens
ccagccccgactccagc

SEQ ID NO: 1219907 - DNA, 20 bp, Homo sapiens
ccagccccgactccagccag

SEQ ID NO: 1219908 - DNA, 16 bp, Homo sapiens
ccagccccgctcaggc

SEQ ID NO: 1219909 - DNA, 15 bp, Homo sapiens
ccagccccgctccca

SEQ ID NO: 1219910 - DNA, 17 bp, Homo sapiens
ccagccccggcaagcca

SEQ ID NO: 1219911 - DNA, 17 bp, Homo sapiens
ccagccccggggtgagt

SEQ ID NO: 1219912 - DNA, 14 bp, Homo sapiens
ccagcccctactgc

SEQ ID NO: 1219913 - DNA, 12 bp, Homo sapiens
ccagcccctaga

SEQ ID NO: 1219914 - DNA, 15 bp, Homo sapiens
ccagcccctagaaac

SEQ ID NO: 1219915 - DNA, 11 bp, Homo sapiens
ccagcccctcc

SEQ ID NO: 1219916 - DNA, 20 bp, Homo sapiens
ccagcccctcccaccacagc

SEQ ID NO: 1219917 - DNA, 23 bp, Homo sapiens
ccagcccctctcccctctctgct

SEQ ID NO: 1219918 - DNA, 17 bp, Homo sapiens
ccagcccctctggtcgc

SEQ ID NO: 1219919 - DNA, 22 bp, Homo sapiens
ccagcccctctggtcgctcctg

SEQ ID NO: 1219920 - DNA, 23 bp, Homo sapiens
ccagcccctctggtcgctcctgc

SEQ ID NO: 1219921 - DNA, 23 bp, Homo sapiens
ccagcccctggccccaggacctg

SEQ ID NO: 1219922 - DNA, 12 bp, Homo sapiens
ccagcccctgta

SEQ ID NO: 1219923 - DNA, 17 bp, Homo sapiens
ccagcccctgtcccacc

SEQ ID NO: 1219924 - DNA, 17 bp, Homo sapiens
ccagccccttctcccag

SEQ ID NO: 1219925 - DNA, 14 bp, Homo sapiens
ccagccccttgaga

SEQ ID NO: 1219926 - DNA, 16 bp, Homo sapiens
ccagccccttgcttca

SEQ ID NO: 1219927 - DNA, 22 bp, Homo sapiens
ccagcccctttgcctctgtcct

SEQ ID NO: 1219928 - DNA, 17 bp, Homo sapiens
ccagccccttttctctg

SEQ ID NO: 1219929 - DNA, 18 bp, Homo sapiens
ccagccccttttctctgc

SEQ ID NO: 1219930 - DNA, 20 bp, Homo sapiens
ccagccccttttctctgctc

SEQ ID NO: 1219931 - DNA, 21 bp, Homo sapiens
ccagccccttttctctgctct

SEQ ID NO: 1219932 - DNA, 16 bp, Homo sapiens
ccagcccgcggcctgg

SEQ ID NO: 1219933 - DNA, 13 bp, Homo sapiens
ccagcccggcctg

SEQ ID NO: 1219934 - DNA, 14 bp, Homo sapiens
ccagcccggcctgc

SEQ ID NO: 1219935 - DNA, 19 bp, Homo sapiens
ccagcccggcctgctccca

SEQ ID NO: 1219936 - DNA, 20 bp, Homo sapiens
ccagcccggcctgctcccag

SEQ ID NO: 1219937 - DNA, 13 bp, Homo sapiens
ccagcccgggagc

SEQ ID NO: 1219938 - DNA, 16 bp, Homo sapiens
ccagcccgggagccta

SEQ ID NO: 1219939 - DNA, 16 bp, Homo sapiens
ccagccctatggatgt

SEQ ID NO: 1219940 - DNA, 13 bp, Homo sapiens
ccagccctccctg

SEQ ID NO: 1219941 - DNA, 17 bp, Homo sapiens
ccagccctccctgtcct

SEQ ID NO: 1219942 - DNA, 12 bp, Homo sapiens
ccagccctccta

SEQ ID NO: 1219943 - DNA, 12 bp, Homo sapiens
ccagccctcctt

SEQ ID NO: 1219944 - DNA, 21 bp, Homo sapiens
ccagccctccttatcaaagga

SEQ ID NO: 1219945 - DNA, 13 bp, Homo sapiens
ccagccctgcagc

SEQ ID NO: 1219946 - DNA, 12 bp, Homo sapiens
ccagccctgctg

SEQ ID NO: 1219947 - DNA, 14 bp, Homo sapiens
ccagccctggccca

SEQ ID NO: 1219948 - DNA, 16 bp, Homo sapiens
ccagccctggcccacc

SEQ ID NO: 1219949 - DNA, 13 bp, Homo sapiens
ccagccctgggct

SEQ ID NO: 1219950 - DNA, 14 bp, Homo sapiens
ccagccctgggctt

SEQ ID NO: 1219951 - DNA, 17 bp, Homo sapiens
ccagccctgggcttggc

SEQ ID NO: 1219952 - DNA, 17 bp, Homo sapiens
ccagcccttagcacaga

SEQ ID NO: 1219953 - DNA, 13 bp, Homo sapiens
ccagcccttcctt

SEQ ID NO: 1219954 - DNA, 18 bp, Homo sapiens
ccagcccttccttgggcg

SEQ ID NO: 1219955 - DNA, 15 bp, Homo sapiens
ccagcccttctgcct

SEQ ID NO: 1219956 - DNA, 21 bp, Homo sapiens
ccagcccttttgttgagccag

SEQ ID NO: 1219957 - DNA, 17 bp, Homo sapiens
ccagccgaccctcctgg

SEQ ID NO: 1219958 - DNA, 22 bp, Homo sapiens
ccagccgaccctcctggccttc

SEQ ID NO: 1219959 - DNA, 18 bp, Homo sapiens
ccagccgcaggaaggcag

SEQ ID NO: 1219960 - DNA, 23 bp, Homo sapiens
ccagccgccattgccaccaggag

SEQ ID NO: 1219961 - DNA, 17 bp, Homo sapiens
ccagccgccccagcccc

SEQ ID NO: 1219962 - DNA, 15 bp, Homo sapiens
ccagccgccctgggc

SEQ ID NO: 1219963 - DNA, 16 bp, Homo sapiens
ccagccgccctgggct

SEQ ID NO: 1219964 - DNA, 21 bp, Homo sapiens
ccagccgctgcagggctccca

SEQ ID NO: 1219965 - DNA, 16 bp, Homo sapiens
ccagccggccaatgga

SEQ ID NO: 1219966 - DNA, 20 bp, Homo sapiens
ccagccggcctctctggcct

SEQ ID NO: 1219967 - DNA, 22 bp, Homo sapiens
ccagccggcctctctggcctcc

SEQ ID NO: 1219968 - DNA, 13 bp, Homo sapiens
ccagccggggcct

SEQ ID NO: 1219969 - DNA, 14 bp, Homo sapiens
ccagccgtatttta

SEQ ID NO: 1219970 - DNA, 20 bp, Homo sapiens
ccagccgtgatgctcaggct

SEQ ID NO: 1219971 - DNA, 23 bp, Homo sapiens
ccagccgtgatgctcaggcttga

SEQ ID NO: 1219972 - DNA, 17 bp, Homo sapiens
ccagcctaagatgaaga

SEQ ID NO: 1219973 - DNA, 19 bp, Homo sapiens
ccagcctacccttcctgca

SEQ ID NO: 1219974 - DNA, 20 bp, Homo sapiens
ccagcctagcctggctctgc

SEQ ID NO: 1219975 - DNA, 19 bp, Homo sapiens
ccagcctatgagcatcctg

SEQ ID NO: 1219976 - DNA, 20 bp, Homo sapiens
ccagcctatgagcatcctga

SEQ ID NO: 1219977 - DNA, 21 bp, Homo sapiens
ccagcctatgagcatcctgag

SEQ ID NO: 1219978 - DNA, 18 bp, Homo sapiens
ccagcctcaatgtcactt

SEQ ID NO: 1219979 - DNA, 16 bp, Homo sapiens
ccagcctcagactgga

SEQ ID NO: 1219980 - DNA, 22 bp, Homo sapiens
ccaggcaggggtgggggtggag

SEQ ID NO: 1219981 - DNA, 14 bp, Homo sapiens
ccaggcaggtctgc

SEQ ID NO: 1219982 - DNA, 21 bp, Homo sapiens
ccaggcaggtctgcaagggcc

SEQ ID NO: 1219983 - DNA, 20 bp, Homo sapiens
ccaggcagtaccattcagga

SEQ ID NO: 1219984 - DNA, 21 bp, Homo sapiens
ccaggcatatgtttccccatc

SEQ ID NO: 1219985 - DNA, 21 bp, Homo sapiens
ccaggcatctgttagcagagt

SEQ ID NO: 1219986 - DNA, 22 bp, Homo sapiens
ccaggcatctgttagcagagtc

SEQ ID NO: 1219987 - DNA, 18 bp, Homo sapiens
ccaggcatgcagctgcct

SEQ ID NO: 1219988 - DNA, 20 bp, Homo sapiens
ccaggcatttagccctcaca

SEQ ID NO: 1219989 - DNA, 16 bp, Homo sapiens
ccaggccaaagcccca

SEQ ID NO: 1219990 - DNA, 18 bp, Homo sapiens
ccaggccaaagccccatg

SEQ ID NO: 1219991 - DNA, 13 bp, Homo sapiens
ccaggccaacagc

SEQ ID NO: 1219992 - DNA, 17 bp, Homo sapiens
ccaggccaacagcacct

SEQ ID NO: 1219993 - DNA, 12 bp, Homo sapiens
ccaggccaccag

SEQ ID NO: 1219994 - DNA, 16 bp, Homo sapiens
ccaggccacctcccca

SEQ ID NO: 1219995 - DNA, 19 bp, Homo sapiens
ccaggccactgtggccaga

SEQ ID NO: 1219996 - DNA, 21 bp, Homo sapiens
ccaggccagcccccccaccca

SEQ ID NO: 1219997 - DNA, 14 bp, Homo sapiens
ccaggccagcctcc

SEQ ID NO: 1219998 - DNA, 12 bp, Homo sapiens
ccaggccaggcc

SEQ ID NO: 1219999 - DNA, 18 bp, Homo sapiens
ccaggccaggccaccagg

SEQ ID NO: 1220000 - DNA, 13 bp, Homo sapiens
ccaggccaggtgg

SEQ ID NO: 1220001 - DNA, 17 bp, Homo sapiens
ccaggccatgtggcctg

SEQ ID NO: 1220002 - DNA, 20 bp, Homo sapiens
ccaggccatgtggcctgccc

SEQ ID NO: 1220003 - DNA, 21 bp, Homo sapiens
ccaggccatgtggcctgccca

SEQ ID NO: 1220004 - DNA, 17 bp, Homo sapiens
ccaggccattctgccgc

SEQ ID NO: 1220005 - DNA, 17 bp, Homo sapiens
ccaggcccaaggctccc

SEQ ID NO: 1220006 - DNA, 12 bp, Homo sapiens
ccaggcccacca

SEQ ID NO: 1220007 - DNA, 20 bp, Homo sapiens
ccaggcccacgaggagcagc

SEQ ID NO: 1220008 - DNA, 14 bp, Homo sapiens
ccaggcccagccct

SEQ ID NO: 1220009 - DNA, 16 bp, Homo sapiens
ccaggcccagccctcc

SEQ ID NO: 1220010 - DNA, 12 bp, Homo sapiens
ccaggcccaggc

SEQ ID NO: 1220011 - DNA, 16 bp, Homo sapiens
ccaggcccaggccagc

SEQ ID NO: 1220012 - DNA, 20 bp, Homo sapiens
ccaggccccaaaaccacagc

SEQ ID NO: 1220013 - DNA, 16 bp, Homo sapiens
ccaggccccagcctcc

SEQ ID NO: 1220014 - DNA, 18 bp, Homo sapiens
ccaggccccagcctccag

SEQ ID NO: 1220015 - DNA, 20 bp, Homo sapiens
ccaggccccagcctccaggc

SEQ ID NO: 1220016 - DNA, 14 bp, Homo sapiens
ccaggcccctgagg

SEQ ID NO: 1220017 - DNA, 18 bp, Homo sapiens
ccaggcccctgaggactg

SEQ ID NO: 1220018 - DNA, 16 bp, Homo sapiens
ccaggcccggggctgg

SEQ ID NO: 1220019 - DNA, 16 bp, Homo sapiens
ccaggccctccagtgg

SEQ ID NO: 1220020 - DNA, 14 bp, Homo sapiens
ccaggccctccatg

SEQ ID NO: 1220021 - DNA, 18 bp, Homo sapiens
ccaggccctccatgggct

SEQ ID NO: 1220022 - DNA, 19 bp, Homo sapiens
ccaggccctccatgggcta

SEQ ID NO: 1220023 - DNA, 14 bp, Homo sapiens
ccaggccctcccac

SEQ ID NO: 1220024 - DNA, 15 bp, Homo sapiens
ccaggccctcccacc

SEQ ID NO: 1220025 - DNA, 14 bp, Homo sapiens
ccaggccctccctg

SEQ ID NO: 1220026 - DNA, 17 bp, Homo sapiens
ccaggccctccctgact

SEQ ID NO: 1220027 - DNA, 18 bp, Homo sapiens
ccaggccctcctctccca

SEQ ID NO: 1220028 - DNA, 19 bp, Homo sapiens
ccaggcccttggctgcagg

SEQ ID NO: 1220029 - DNA, 19 bp, Homo sapiens
ccaggccgcagctcttgcc

SEQ ID NO: 1220030 - DNA, 15 bp, Homo sapiens
ccaggccggagccca

SEQ ID NO: 1220031 - DNA, 14 bp, Homo sapiens
ccaggccggcccag

SEQ ID NO: 1220032 - DNA, 22 bp, Homo sapiens
ccaggccggcccagatgtgtcc

SEQ ID NO: 1220033 - DNA, 22 bp, Homo sapiens
ccaggccggtgtgggctgtgtc

SEQ ID NO: 1220034 - DNA, 19 bp, Homo sapiens
ccaggccgtcctcccgggc

SEQ ID NO: 1220035 - DNA, 22 bp, Homo sapiens
ccaggccgttccccttggcttc

SEQ ID NO: 1220036 - DNA, 18 bp, Homo sapiens
ccaggcctccagcctctc

SEQ ID NO: 1220037 - DNA, 14 bp, Homo sapiens
ccaggcctcctagg

SEQ ID NO: 1220038 - DNA, 19 bp, Homo sapiens
ccaggcctctctctgctcc

SEQ ID NO: 1220039 - DNA, 20 bp, Homo sapiens
ccaggcctctctctgctcca

SEQ ID NO: 1220040 - DNA, 16 bp, Homo sapiens
ccaggcctctgtgtcc

SEQ ID NO: 1220041 - DNA, 16 bp, Homo sapiens
ccaggcctcttggcag

SEQ ID NO: 1220042 - DNA, 19 bp, Homo sapiens
ccaggcctcttggcagtca

SEQ ID NO: 1220043 - DNA, 19 bp, Homo sapiens
ccaggcctgatcttgcctg

SEQ ID NO: 1220044 - DNA, 16 bp, Homo sapiens
ccaggcctgcctccca

SEQ ID NO: 1220045 - DNA, 13 bp, Homo sapiens
ccaggcctgctgg

SEQ ID NO: 1220046 - DNA, 19 bp, Homo sapiens
ccaggcctgctggcatcag

SEQ ID NO: 1220047 - DNA, 17 bp, Homo sapiens
ccaggcctggacgggcc

SEQ ID NO: 1220048 - DNA, 14 bp, Homo sapiens
ccaggcctggagcg

SEQ ID NO: 1220049 - DNA, 16 bp, Homo sapiens
ccaggcctggagggca

SEQ ID NO: 1220050 - DNA, 17 bp, Homo sapiens
ccaggcctggccatgtg

SEQ ID NO: 1220051 - DNA, 13 bp, Homo sapiens
ccaggcctggcct

SEQ ID NO: 1220052 - DNA, 15 bp, Homo sapiens
ccaggcctggctccc

SEQ ID NO: 1220053 - DNA, 20 bp, Homo sapiens
ccaggcctgggtctgtgtct

SEQ ID NO: 1220054 - DNA, 16 bp, Homo sapiens
ccaggcctgtccaccc

SEQ ID NO: 1220055 - DNA, 21 bp, Homo sapiens
ccaggcctgtccaccctgcca

SEQ ID NO: 1220056 - DNA, 20 bp, Homo sapiens
ccaggccttacatctggctg

SEQ ID NO: 1220057 - DNA, 21 bp, Homo sapiens
ccaggccttgctgactctctg

SEQ ID NO: 1220058 - DNA, 13 bp, Homo sapiens
ccaggcctttgga

SEQ ID NO: 1220059 - DNA, 14 bp, Homo sapiens
ccaggcctttggag

SEQ ID NO: 1220060 - DNA, 14 bp, Homo sapiens
ccaggcgcatgtct

SEQ ID NO: 1220061 - DNA, 15 bp, Homo sapiens
ccaggcgcatgtctg

SEQ ID NO: 1220062 - DNA, 13 bp, Homo sapiens
ccaggcggccctg

SEQ ID NO: 1220063 - DNA, 15 bp, Homo sapiens
ccaggcggccctggg

SEQ ID NO: 1220064 - DNA, 19 bp, Homo sapiens
ccaggcggccctggggagg

SEQ ID NO: 1220065 - DNA, 18 bp, Homo sapiens
ccaggcgggctcaaggaa

SEQ ID NO: 1220066 - DNA, 16 bp, Homo sapiens
ccaggcgttggtgcca

SEQ ID NO: 1220067 - DNA, 20 bp, Homo sapiens
ccaggcgttggtgccacttc

SEQ ID NO: 1220068 - DNA, 18 bp, Homo sapiens
ccaggctatggttgccac

SEQ ID NO: 1220069 - DNA, 22 bp, Homo sapiens
ccaggctcacctttagaacagg

SEQ ID NO: 1220070 - DNA, 23 bp, Homo sapiens
ccaggctccgcccttagtccccc

SEQ ID NO: 1220071 - DNA, 23 bp, Homo sapiens
ccaggctcgtggactgagtggga

SEQ ID NO: 1220072 - DNA, 15 bp, Homo sapiens
ccaggctctgggcac

SEQ ID NO: 1220073 - DNA, 16 bp, Homo sapiens
ccaggctctgggcaca

SEQ ID NO: 1220074 - DNA, 17 bp, Homo sapiens
ccaggctctgggcacag

SEQ ID NO: 1220075 - DNA, 20 bp, Homo sapiens
ccaggctctgggcacagtgc

SEQ ID NO: 1220076 - DNA, 17 bp, Homo sapiens
ccaggctcttcctggac

SEQ ID NO: 1220077 - DNA, 23 bp, Homo sapiens
ccaggctctttggggtcagccag

SEQ ID NO: 1220078 - DNA, 13 bp, Homo sapiens
ccaggctgaagca

SEQ ID NO: 1220079 - DNA, 20 bp, Homo sapiens
ccaggctgaagcaggttccc

SEQ ID NO: 1220080 - DNA, 16 bp, Homo sapiens
ccaggctgaattacag

SEQ ID NO: 1220081 - DNA, 19 bp, Homo sapiens
ccaggctgaattacagtga

SEQ ID NO: 1220082 - DNA, 17 bp, Homo sapiens
ccaggctgaccacagca

SEQ ID NO: 1220083 - DNA, 18 bp, Homo sapiens
ccaggctgaccacagcac

SEQ ID NO: 1220084 - DNA, 23 bp, Homo sapiens
ccaggctgaccacagcacagcca

SEQ ID NO: 1220085 - DNA, 13 bp, Homo sapiens
ccaggctgagcct

SEQ ID NO: 1220086 - DNA, 15 bp, Homo sapiens
ccaggctgcactgca

SEQ ID NO: 1220087 - DNA, 18 bp, Homo sapiens
ccaggctgcactgcagtg

SEQ ID NO: 1220088 - DNA, 19 bp, Homo sapiens
ccaggctgcactgcagtga

SEQ ID NO: 1220089 - DNA, 19 bp, Homo sapiens
ccaggctgccaaggccaga

SEQ ID NO: 1220090 - DNA, 23 bp, Homo sapiens
ccaggctgcctcccttgtggcag

SEQ ID NO: 1220091 - DNA, 21 bp, Homo sapiens
ccaggctgcctcggactccat

SEQ ID NO: 1220092 - DNA, 15 bp, Homo sapiens
ccaggctgctggagt

SEQ ID NO: 1220093 - DNA, 22 bp, Homo sapiens
ccaggctggagataacagcctc

SEQ ID NO: 1220094 - DNA, 23 bp, Homo sapiens
ccaggctggagataacagcctct

SEQ ID NO: 1220095 - DNA, 12 bp, Homo sapiens
ccaggctggagc

SEQ ID NO: 1220096 - DNA, 12 bp, Homo sapiens
ccaggctggagt

SEQ ID NO: 1220097 - DNA, 16 bp, Homo sapiens
ccaggctggagtgcag

SEQ ID NO: 1220098 - DNA, 18 bp, Homo sapiens
ccaggctggagtgcagtg

SEQ ID NO: 1220099 - DNA, 22 bp, Homo sapiens
ccaggctggcgcagccaaggcc

SEQ ID NO: 1220100 - DNA, 23 bp, Homo sapiens
ccaggctggcgcagccaaggccg

SEQ ID NO: 1220101 - DNA, 12 bp, Homo sapiens
ccaggctgggca

SEQ ID NO: 1220102 - DNA, 13 bp, Homo sapiens
ccaggctgggccg

SEQ ID NO: 1220103 - DNA, 19 bp, Homo sapiens
ccaggctgggctctgcctg

SEQ ID NO: 1220104 - DNA, 14 bp, Homo sapiens
ccaggctggtctca

SEQ ID NO: 1220105 - DNA, 15 bp, Homo sapiens
ccaggggctcctggg

SEQ ID NO: 1220106 - DNA, 21 bp, Homo sapiens
ccaggggctcctgggttggag

SEQ ID NO: 1220107 - DNA, 20 bp, Homo sapiens
ccaggggctgcttcctcctg

SEQ ID NO: 1220108 - DNA, 22 bp, Homo sapiens
ccagggggatatgggtcctctg

SEQ ID NO: 1220109 - DNA, 17 bp, Homo sapiens
ccagtccccgtgccccg

SEQ ID NO: 1220110 - DNA, 22 bp, Homo sapiens
ccagtccccgtgccccgcctcc

SEQ ID NO: 1220111 - DNA, 13 bp, Homo sapiens
ccagtccctgggg

SEQ ID NO: 1220112 - DNA, 18 bp, Homo sapiens
ccagtcctccagaccacc

SEQ ID NO: 1220113 - DNA, 19 bp, Homo sapiens
ccagtcctccagaccacca

SEQ ID NO: 1220114 - DNA, 17 bp, Homo sapiens
ccagtcctcctgggagc

SEQ ID NO: 1220115 - DNA, 11 bp, Homo sapiens
ccagtcctgct

SEQ ID NO: 1220116 - DNA, 21 bp, Homo sapiens
ccagtcctgctacctcccttg

SEQ ID NO: 1220117 - DNA, 12 bp, Homo sapiens
ccagtcctgggt

SEQ ID NO: 1220118 - DNA, 13 bp, Homo sapiens
ccagtcctgggtt

SEQ ID NO: 1220119 - DNA, 13 bp, Homo sapiens
ccagtcctggtcc

SEQ ID NO: 1220120 - DNA, 14 bp, Homo sapiens
ccagtcctggtcct

SEQ ID NO: 1220121 - DNA, 15 bp, Homo sapiens
ccagtcctggtcctg

SEQ ID NO: 1220122 - DNA, 17 bp, Homo sapiens
ccagtccttccacctcg

SEQ ID NO: 1220123 - DNA, 17 bp, Homo sapiens
ccagtcggccccatctc

SEQ ID NO: 1220124 - DNA, 15 bp, Homo sapiens
ccagtcgttatttct

SEQ ID NO: 1220125 - DNA, 15 bp, Homo sapiens
ccagtctcagagacc

SEQ ID NO: 1220126 - DNA, 16 bp, Homo sapiens
ccagtctcagagacca

SEQ ID NO: 1220127 - DNA, 15 bp, Homo sapiens
ccagtctcatctcct

SEQ ID NO: 1220128 - DNA, 13 bp, Homo sapiens
ccagtctccaggg

SEQ ID NO: 1220129 - DNA, 19 bp, Homo sapiens
ccagtctcccaggccccct

SEQ ID NO: 1220130 - DNA, 21 bp, Homo sapiens
ccagtctcccaggccccctgc

SEQ ID NO: 1220131 - DNA, 12 bp, Homo sapiens
ccagtctcccca

SEQ ID NO: 1220132 - DNA, 17 bp, Homo sapiens
ccagtctccccactcca

SEQ ID NO: 1220133 - DNA, 15 bp, Homo sapiens
ccagtctcctcactc

SEQ ID NO: 1220134 - DNA, 16 bp, Homo sapiens
ccagtctcctcactct

SEQ ID NO: 1220135 - DNA, 17 bp, Homo sapiens
ccagtctcctcactctg

SEQ ID NO: 1220136 - DNA, 15 bp, Homo sapiens
ccagtctcctctcca

SEQ ID NO: 1220137 - DNA, 14 bp, Homo sapiens
ccagtctctgtcgt

SEQ ID NO: 1220138 - DNA, 23 bp, Homo sapiens
ccagtctctgtcgtggagccatt

SEQ ID NO: 1220139 - DNA, 12 bp, Homo sapiens
ccagtctgaagt

SEQ ID NO: 1220140 - DNA, 21 bp, Homo sapiens
ccagtctgaagtgcctactgg

SEQ ID NO: 1220141 - DNA, 14 bp, Homo sapiens
ccagtctgaagttt

SEQ ID NO: 1220142 - DNA, 21 bp, Homo sapiens
ccagtctgaagtttcatttat

SEQ ID NO: 1220143 - DNA, 12 bp, Homo sapiens
ccagtctgaccc

SEQ ID NO: 1220144 - DNA, 12 bp, Homo sapiens
ccagtctgatta

SEQ ID NO: 1220145 - DNA, 18 bp, Homo sapiens
ccagtctgtaaaatacat

SEQ ID NO: 1220146 - DNA, 17 bp, Homo sapiens
ccagtctgtctactgtg

SEQ ID NO: 1220147 - DNA, 21 bp, Homo sapiens
ccagtctgtggatcagagatg

SEQ ID NO: 1220148 - DNA, 12 bp, Homo sapiens
ccagtcttcctt

SEQ ID NO: 1220149 - DNA, 16 bp, Homo sapiens
ccagtcttccttgtct

SEQ ID NO: 1220150 - DNA, 19 bp, Homo sapiens
ccagtcttccttgtctctg

SEQ ID NO: 1220151 - DNA, 12 bp, Homo sapiens
ccagtcttgcct

SEQ ID NO: 1220152 - DNA, 19 bp, Homo sapiens
ccagtctttaaaggcccag

SEQ ID NO: 1220153 - DNA, 22 bp, Homo sapiens
ccagtctttaaaggcccagccc

SEQ ID NO: 1220154 - DNA, 23 bp, Homo sapiens
ccagtctttaaaggcccagcccc

SEQ ID NO: 1220155 - DNA, 17 bp, Homo sapiens
ccagtgaacattcccag

SEQ ID NO: 1220156 - DNA, 18 bp, Homo sapiens
ccagtgaactcctgccag

SEQ ID NO: 1220157 - DNA, 22 bp, Homo sapiens
ccagtgaacttacacttggagc

SEQ ID NO: 1220158 - DNA, 12 bp, Homo sapiens
ccagtgaagact

SEQ ID NO: 1220159 - DNA, 15 bp, Homo sapiens
ccagtgaagcctctg

SEQ ID NO: 1220160 - DNA, 17 bp, Homo sapiens
ccagtgaaggagccacg

SEQ ID NO: 1220161 - DNA, 19 bp, Homo sapiens
ccagtgaagggttttgtgt

SEQ ID NO: 1220162 - DNA, 22 bp, Homo sapiens
ccagtgaagggttttgtgtgtt

SEQ ID NO: 1220163 - DNA, 13 bp, Homo sapiens
ccagtgaagtcct

SEQ ID NO: 1220164 - DNA, 15 bp, Homo sapiens
ccagtgaatctgttt

SEQ ID NO: 1220165 - DNA, 16 bp, Homo sapiens
ccagtgacacttcaga

SEQ ID NO: 1220166 - DNA, 20 bp, Homo sapiens
ccagtgacacttcagagagc

SEQ ID NO: 1220167 - DNA, 23 bp, Homo sapiens
ccagtgacacttcagagagctgg

SEQ ID NO: 1220168 - DNA, 15 bp, Homo sapiens
ccagtgacagacagg

SEQ ID NO: 1220169 - DNA, 18 bp, Homo sapiens
ccagtgacagacaggctc

SEQ ID NO: 1220170 - DNA, 21 bp, Homo sapiens
ccagtgacagacaggctctta

SEQ ID NO: 1220171 - DNA, 11 bp, Homo sapiens
ccagtgacatg

SEQ ID NO: 1220172 - DNA, 19 bp, Homo sapiens
ccagtgacttgttctgagt

SEQ ID NO: 1220173 - DNA, 21 bp, Homo sapiens
ccagtgacttgttctgagtaa

SEQ ID NO: 1220174 - DNA, 18 bp, Homo sapiens
ccagtgagaagctgaggc

SEQ ID NO: 1220175 - DNA, 20 bp, Homo sapiens
ccagtgagcgcttgggcgcc

SEQ ID NO: 1220176 - DNA, 12 bp, Homo sapiens
ccagtgaggaac

SEQ ID NO: 1220177 - DNA, 16 bp, Homo sapiens
ccagtgaggatgacag

SEQ ID NO: 1220178 - DNA, 16 bp, Homo sapiens
ccagtgagggctgggc

SEQ ID NO: 1220179 - DNA, 20 bp, Homo sapiens
ccagtgagggctgggcccac

SEQ ID NO: 1220180 - DNA, 13 bp, Homo sapiens
ccagtgagtgtaa

SEQ ID NO: 1220181 - DNA, 15 bp, Homo sapiens
ccagtgatgatgttt

SEQ ID NO: 1220182 - DNA, 18 bp, Homo sapiens
ccagtgatgatgttttga

SEQ ID NO: 1220183 - DNA, 19 bp, Homo sapiens
ccagtgatgatgttttgat

SEQ ID NO: 1220184 - DNA, 20 bp, Homo sapiens
ccagtgatgatgttttgata

SEQ ID NO: 1220185 - DNA, 15 bp, Homo sapiens
ccagtgcagccactg

SEQ ID NO: 1220186 - DNA, 17 bp, Homo sapiens
ccagtgcagccactggc

SEQ ID NO: 1220187 - DNA, 20 bp, Homo sapiens
ccagtgcagtttctaagcat

SEQ ID NO: 1220188 - DNA, 19 bp, Homo sapiens
ccagtgcatatgcaatgta

SEQ ID NO: 1220189 - DNA, 17 bp, Homo sapiens
ccagtgccactgccccc

SEQ ID NO: 1220190 - DNA, 21 bp, Homo sapiens
ccagtgccattccactccact

SEQ ID NO: 1220191 - DNA, 24 bp, Homo sapiens
ccagtgccattccactccactcag

SEQ ID NO: 1220192 - DNA, 19 bp, Homo sapiens
ccagtgcccaaagtctgtg

SEQ ID NO: 1220193 - DNA, 22 bp, Homo sapiens
ccagtgcccaaagtctgtgtga

SEQ ID NO: 1220194 - DNA, 15 bp, Homo sapiens
ccagtgcctcctagc

SEQ ID NO: 1220195 - DNA, 15 bp, Homo sapiens
ccagtgcctgccact

SEQ ID NO: 1220196 - DNA, 20 bp, Homo sapiens
ccagtgccttacctcctgcc

SEQ ID NO: 1220197 - DNA, 21 bp, Homo sapiens
ccagtgcggttcctcatctga

SEQ ID NO: 1220198 - DNA, 20 bp, Homo sapiens
ccagtgctcaccagccctgc

SEQ ID NO: 1220199 - DNA, 21 bp, Homo sapiens
ccagtgctccagtttcccggt

SEQ ID NO: 1220200 - DNA, 20 bp, Homo sapiens
ccagtgctctgcctcagacg

SEQ ID NO: 1220201 - DNA, 12 bp, Homo sapiens
ccagtgctgcca

SEQ ID NO: 1220202 - DNA, 15 bp, Homo sapiens
ccagtgctgccatgc

SEQ ID NO: 1220203 - DNA, 16 bp, Homo sapiens
ccagtgctgccatgcc

SEQ ID NO: 1220204 - DNA, 18 bp, Homo sapiens
ccagtgctgccatgccac

SEQ ID NO: 1220205 - DNA, 19 bp, Homo sapiens
ccagtgctgccatgccact

SEQ ID NO: 1220206 - DNA, 23 bp, Homo sapiens
ccagtgctgccatgccactgcca

SEQ ID NO: 1220207 - DNA, 18 bp, Homo sapiens
ccagtgctgctgtaaata

SEQ ID NO: 1220208 - DNA, 21 bp, Homo sapiens
ccagtgcttctccaacactga

SEQ ID NO: 1220209 - DNA, 15 bp, Homo sapiens
ccagtggaaaacaaa

SEQ ID NO: 1220210 - DNA, 20 bp, Homo sapiens
ccagtggaacagtcaccctt

SEQ ID NO: 1220211 - DNA, 22 bp, Homo sapiens
ccagtggaagttcttcaagagg

SEQ ID NO: 1220212 - DNA, 14 bp, Homo sapiens
ccagtggaattcca

SEQ ID NO: 1220213 - DNA, 16 bp, Homo sapiens
ccagtggacctagcct

SEQ ID NO: 1220214 - DNA, 21 bp, Homo sapiens
ccagtggatgccacagcccag

SEQ ID NO: 1220215 - DNA, 15 bp, Homo sapiens
ccagtggcacaggag

SEQ ID NO: 1220216 - DNA, 16 bp, Homo sapiens
ccagtggcctcaaccc

SEQ ID NO: 1220217 - DNA, 23 bp, Homo sapiens
ccagtggcctcaaccctccctca

SEQ ID NO: 1220218 - DNA, 17 bp, Homo sapiens
ccagtggccttccccag

SEQ ID NO: 1220219 - DNA, 12 bp, Homo sapiens
ccagtggccttt

SEQ ID NO: 1220220 - DNA, 15 bp, Homo sapiens
ccagtgggaactgtg

SEQ ID NO: 1220221 - DNA, 23 bp, Homo sapiens
ccaggggggacaatatgtgccaa

SEQ ID NO: 1220222 - DNA, 19 bp, Homo sapiens
ccaggggtaacctggccac

SEQ ID NO: 1220223 - DNA, 14 bp, Homo sapiens
ccaggggtcccagc

SEQ ID NO: 1220224 - DNA, 16 bp, Homo sapiens
ccaggggtctccctgg

SEQ ID NO: 1220225 - DNA, 18 bp, Homo sapiens
ccaggggtctccctggag

SEQ ID NO: 1220226 - DNA, 15 bp, Homo sapiens
ccaggggtctgtctg

SEQ ID NO: 1220227 - DNA, 16 bp, Homo sapiens
ccaggggtctgtctgc

SEQ ID NO: 1220228 - DNA, 13 bp, Homo sapiens
ccagggtcccacc

SEQ ID NO: 1220229 - DNA, 18 bp, Homo sapiens
ccagggtcccacccccaa

SEQ ID NO: 1220230 - DNA, 13 bp, Homo sapiens
ccagggtcccagg

SEQ ID NO: 1220231 - DNA, 15 bp, Homo sapiens
ccagggtcccaggaa

SEQ ID NO: 1220232 - DNA, 16 bp, Homo sapiens
ccagggtcccaggaag

SEQ ID NO: 1220233 - DNA, 14 bp, Homo sapiens
ccagggtcccctcc

SEQ ID NO: 1220234 - DNA, 15 bp, Homo sapiens
ccagggtcccctgcc

SEQ ID NO: 1220235 - DNA, 21 bp, Homo sapiens
ccagggtcccctgccaccgac

SEQ ID NO: 1220236 - DNA, 13 bp, Homo sapiens
ccagggtccctgg

SEQ ID NO: 1220237 - DNA, 21 bp, Homo sapiens
ccagggtccgcaccagctgct

SEQ ID NO: 1220238 - DNA, 22 bp, Homo sapiens
ccagggtccgcaccagctgctc

SEQ ID NO: 1220239 - DNA, 18 bp, Homo sapiens
ccagggtcctctagccca

SEQ ID NO: 1220240 - DNA, 14 bp, Homo sapiens
ccagggtcctgtgc

SEQ ID NO: 1220241 - DNA, 21 bp, Homo sapiens
ccagggtcgtctttgtgtatg

SEQ ID NO: 1220242 - DNA, 17 bp, Homo sapiens
ccagggtcttgggctac

SEQ ID NO: 1220243 - DNA, 22 bp, Homo sapiens
ccagggtcttgggctactggca

SEQ ID NO: 1220244 - DNA, 17 bp, Homo sapiens
ccagggtgagagctgct

SEQ ID NO: 1220245 - DNA, 22 bp, Homo sapiens
ccagggtgagagctgctctgga

SEQ ID NO: 1220246 - DNA, 20 bp, Homo sapiens
ccagggtggaccaggcctgg

SEQ ID NO: 1220247 - DNA, 22 bp, Homo sapiens
ccagggtggaccaggcctggag

SEQ ID NO: 1220248 - DNA, 12 bp, Homo sapiens
ccagggtggaga

SEQ ID NO: 1220249 - DNA, 16 bp, Homo sapiens
ccagggtggcagcaac

SEQ ID NO: 1220250 - DNA, 16 bp, Homo sapiens
ccagggtggctgccag

SEQ ID NO: 1220251 - DNA, 17 bp, Homo sapiens
ccagggtggctgccagc

SEQ ID NO: 1220252 - DNA, 23 bp, Homo sapiens
ccagggtgtgactcgggagctgc

SEQ ID NO: 1220253 - DNA, 15 bp, Homo sapiens
ccagggttcccccag

SEQ ID NO: 1220254 - DNA, 21 bp, Homo sapiens
ccagggttcccccagccctgt

SEQ ID NO: 1220255 - DNA, 15 bp, Homo sapiens
ccagggtttctctgc

SEQ ID NO: 1220256 - DNA, 21 bp, Homo sapiens
ccagggttttgccccaagtcc

SEQ ID NO: 1220257 - DNA, 16 bp, Homo sapiens
ccaggtaatgagggac

SEQ ID NO: 1220258 - DNA, 13 bp, Homo sapiens
ccaggtacaggag

SEQ ID NO: 1220259 - DNA, 20 bp, Homo sapiens
ccaggtacaggagaggcagc

SEQ ID NO: 1220260 - DNA, 20 bp, Homo sapiens
ccaggtaccacccttcagac

SEQ ID NO: 1220261 - DNA, 22 bp, Homo sapiens
ccaggtaccacccttcagaccc

SEQ ID NO: 1220262 - DNA, 22 bp, Homo sapiens
ccaggtatccaaaaatgtgtaa

SEQ ID NO: 1220263 - DNA, 15 bp, Homo sapiens
ccaggtatctccagg

SEQ ID NO: 1220264 - DNA, 20 bp, Homo sapiens
ccaggtcaccaagcagtggc

SEQ ID NO: 1220265 - DNA, 18 bp, Homo sapiens
ccaggtcaccatcctcag

SEQ ID NO: 1220266 - DNA, 19 bp, Homo sapiens
ccaggtcaccatcctcaga

SEQ ID NO: 1220267 - DNA, 16 bp, Homo sapiens
ccaggtcagccctgtg

SEQ ID NO: 1220268 - DNA, 19 bp, Homo sapiens
ccaggtcagccctgtgtct

SEQ ID NO: 1220269 - DNA, 22 bp, Homo sapiens
ccaggtcagctgttactttctt

SEQ ID NO: 1220270 - DNA, 20 bp, Homo sapiens
ccaggtccaaacccttcaac

SEQ ID NO: 1220271 - DNA, 13 bp, Homo sapiens
ccaggtccagctc

SEQ ID NO: 1220272 - DNA, 17 bp, Homo sapiens
ccaggtccagctctgga

SEQ ID NO: 1220273 - DNA, 12 bp, Homo sapiens
ccaggtccccaa

SEQ ID NO: 1220274 - DNA, 19 bp, Homo sapiens
ccaggtcccccgactgcct

SEQ ID NO: 1220275 - DNA, 14 bp, Homo sapiens
ccaggtcctctgat

SEQ ID NO: 1220276 - DNA, 14 bp, Homo sapiens
ccaggtcctgtctc

SEQ ID NO: 1220277 - DNA, 21 bp, Homo sapiens
ccaggtctcaaggttctcatt

SEQ ID NO: 1220278 - DNA, 16 bp, Homo sapiens
ccaggtctcacgggca

SEQ ID NO: 1220279 - DNA, 15 bp, Homo sapiens
ccaggtcttcctgct

SEQ ID NO: 1220280 - DNA, 17 bp, Homo sapiens
ccaggtcttcctgcttt

SEQ ID NO: 1220281 - DNA, 15 bp, Homo sapiens
ccaggtcttgactca

SEQ ID NO: 1220282 - DNA, 21 bp, Homo sapiens
ccaggtcttgactcatggcag

SEQ ID NO: 1220283 - DNA, 20 bp, Homo sapiens
ccaggtcttggagctgagcc

SEQ ID NO: 1220284 - DNA, 21 bp, Homo sapiens
ccaggtgaggcccaagagccc

SEQ ID NO: 1220285 - DNA, 14 bp, Homo sapiens
ccaggtgaggtcca

SEQ ID NO: 1220286 - DNA, 22 bp, Homo sapiens
ccaggtgaggtccaccggcccc

SEQ ID NO: 1220287 - DNA, 20 bp, Homo sapiens
ccaggtgagtgtgagggcag

SEQ ID NO: 1220288 - DNA, 15 bp, Homo sapiens
ccaggtgatttcctc

SEQ ID NO: 1220289 - DNA, 14 bp, Homo sapiens
ccaggtgcagacct

SEQ ID NO: 1220290 - DNA, 18 bp, Homo sapiens
ccaggtgcagaccttggg

SEQ ID NO: 1220291 - DNA, 14 bp, Homo sapiens
ccaggtgcagtggc

SEQ ID NO: 1220292 - DNA, 22 bp, Homo sapiens
ccaggtgcagtggctcacgcct

SEQ ID NO: 1220293 - DNA, 13 bp, Homo sapiens
ccaggtgcggcct

SEQ ID NO: 1220294 - DNA, 14 bp, Homo sapiens
ccaggtgcggcctg

SEQ ID NO: 1220295 - DNA, 19 bp, Homo sapiens
ccaggtgcgtgtgtctctg

SEQ ID NO: 1220296 - DNA, 12 bp, Homo sapiens
ccaggtggctca

SEQ ID NO: 1220297 - DNA, 18 bp, Homo sapiens
ccaggtgggaacggctga

SEQ ID NO: 1220298 - DNA, 14 bp, Homo sapiens
ccaggtgggactta

SEQ ID NO: 1220299 - DNA, 13 bp, Homo sapiens
ccaggtgggagcg

SEQ ID NO: 1220300 - DNA, 13 bp, Homo sapiens
ccaggtgtgcctg

SEQ ID NO: 1220301 - DNA, 21 bp, Homo sapiens
ccaggtgttactgtaattcct

SEQ ID NO: 1220302 - DNA, 14 bp, Homo sapiens
ccaggttaaaattt

SEQ ID NO: 1220303 - DNA, 23 bp, Homo sapiens
ccaggttaggaaggcagcattcc

SEQ ID NO: 1220304 - DNA, 15 bp, Homo sapiens
ccaggttccacagag

SEQ ID NO: 1220305 - DNA, 13 bp, Homo sapiens
ccaggttgaaaga

SEQ ID NO: 1220306 - DNA, 13 bp, Homo sapiens
ccaggttggggag

SEQ ID NO: 1220307 - DNA, 14 bp, Homo sapiens
ccaggttggggaga

SEQ ID NO: 1220308 - DNA, 13 bp, Homo sapiens
ccaggtttaagct

SEQ ID NO: 1220309 - DNA, 13 bp, Homo sapiens
ccagtaacttttt

SEQ ID NO: 1220310 - DNA, 19 bp, Homo sapiens
ccagtaacttttttgtgta

SEQ ID NO: 1220311 - DNA, 20 bp, Homo sapiens
ccagtaacttttttgtgtat

SEQ ID NO: 1220312 - DNA, 22 bp, Homo sapiens
ccagtaacttttttgtgtatgt

SEQ ID NO: 1220313 - DNA, 17 bp, Homo sapiens
ccagtacctttgtcaca

SEQ ID NO: 1220314 - DNA, 19 bp, Homo sapiens
ccagtacgtcccgctgctg

SEQ ID NO: 1220315 - DNA, 16 bp, Homo sapiens
ccagtacgtgctaaca

SEQ ID NO: 1220316 - DNA, 14 bp, Homo sapiens
ccagtagctgggat

SEQ ID NO: 1220317 - DNA, 20 bp, Homo sapiens
ccagtaggactcaaggtgga

SEQ ID NO: 1220318 - DNA, 20 bp, Homo sapiens
ccagtaggagaaatctcagc

SEQ ID NO: 1220319 - DNA, 22 bp, Homo sapiens
ccagtagtgggatcatccagag

SEQ ID NO: 1220320 - DNA, 18 bp, Homo sapiens
ccagtataagatttttga

SEQ ID NO: 1220321 - DNA, 17 bp, Homo sapiens
ccagtattactgctgct

SEQ ID NO: 1220322 - DNA, 20 bp, Homo sapiens
ccagtattactgctgctgtg

SEQ ID NO: 1220323 - DNA, 22 bp, Homo sapiens
ccagtattactgctgctgtgct

SEQ ID NO: 1220324 - DNA, 13 bp, Homo sapiens
ccagtattctcag

SEQ ID NO: 1220325 - DNA, 21 bp, Homo sapiens
ccagtattctcagagcatgtg

SEQ ID NO: 1220326 - DNA, 14 bp, Homo sapiens
ccagtattcttgtc

SEQ ID NO: 1220327 - DNA, 17 bp, Homo sapiens
ccagtatttttgctgct

SEQ ID NO: 1220328 - DNA, 14 bp, Homo sapiens
ccagtcaacctggg

SEQ ID NO: 1220329 - DNA, 19 bp, Homo sapiens
ccagtcaccttctgggcaa

SEQ ID NO: 1220330 - DNA, 16 bp, Homo sapiens
ccagtcactcctctct

SEQ ID NO: 1220331 - DNA, 15 bp, Homo sapiens
ccagtcaggcccagg

SEQ ID NO: 1220332 - DNA, 15 bp, Homo sapiens
ccagtcatctgtaag

SEQ ID NO: 1220333 - DNA, 16 bp, Homo sapiens
ccagtcatctgtaaga

SEQ ID NO: 1220334 - DNA, 12 bp, Homo sapiens
ccagtcatggta

SEQ ID NO: 1220335 - DNA, 19 bp, Homo sapiens
ccagtcatggtactacccc

SEQ ID NO: 1220336 - DNA, 20 bp, Homo sapiens
ccagtcatggtactacccca

SEQ ID NO: 1220337 - DNA, 21 bp, Homo sapiens
ccagtccaaatgtcctccaga

SEQ ID NO: 1220338 - DNA, 13 bp, Homo sapiens
ccagtcccacact

SEQ ID NO: 1220339 - DNA, 19 bp, Homo sapiens
ccatgaagacaggacagtg

SEQ ID NO: 1220340 - DNA, 15 bp, Homo sapiens
ccatgaagacaggat

SEQ ID NO: 1220341 - DNA, 17 bp, Homo sapiens
ccatgaatcaaagacat

SEQ ID NO: 1220342 - DNA, 15 bp, Homo sapiens
ccatgacagaggctg

SEQ ID NO: 1220343 - DNA, 17 bp, Homo sapiens
ccatgacagaggctgca

SEQ ID NO: 1220344 - DNA, 15 bp, Homo sapiens
ccatgacatttcatc

SEQ ID NO: 1220345 - DNA, 16 bp, Homo sapiens
ccatgaccagaaacag

SEQ ID NO: 1220346 - DNA, 16 bp, Homo sapiens
ccatgacccacccctg

SEQ ID NO: 1220347 - DNA, 20 bp, Homo sapiens
ccatgacccacccctgtgct

SEQ ID NO: 1220348 - DNA, 23 bp, Homo sapiens
ccatgaccccttctctctccaga

SEQ ID NO: 1220349 - DNA, 13 bp, Homo sapiens
ccatgacctcccc

SEQ ID NO: 1220350 - DNA, 19 bp, Homo sapiens
ccatgacctcccctcccca

SEQ ID NO: 1220351 - DNA, 19 bp, Homo sapiens
ccatgaccttggggtacaa

SEQ ID NO: 1220352 - DNA, 14 bp, Homo sapiens
ccatgactcttgga

SEQ ID NO: 1220353 - DNA, 16 bp, Homo sapiens
ccatgactcttggagc

SEQ ID NO: 1220354 - DNA, 19 bp, Homo sapiens
ccatgactcttggagcctc

SEQ ID NO: 1220355 - DNA, 13 bp, Homo sapiens
ccatgactgcacc

SEQ ID NO: 1220356 - DNA, 14 bp, Homo sapiens
ccatgactgcaccc

SEQ ID NO: 1220357 - DNA, 17 bp, Homo sapiens
ccatgactgcacccagc

SEQ ID NO: 1220358 - DNA, 15 bp, Homo sapiens
ccatgactgcatttt

SEQ ID NO: 1220359 - DNA, 21 bp, Homo sapiens
ccatgactgtgaccaccttct

SEQ ID NO: 1220360 - DNA, 20 bp, Homo sapiens
ccatgagatagcattagctg

SEQ ID NO: 1220361 - DNA, 12 bp, Homo sapiens
ccatgagcctgc

SEQ ID NO: 1220362 - DNA, 15 bp, Homo sapiens
ccatgagctccagac

SEQ ID NO: 1220363 - DNA, 16 bp, Homo sapiens
ccatgagctccagacc

SEQ ID NO: 1220364 - DNA, 17 bp, Homo sapiens
ccatgagctcggggtcc

SEQ ID NO: 1220365 - DNA, 15 bp, Homo sapiens
ccatgagctgctcat

SEQ ID NO: 1220366 - DNA, 18 bp, Homo sapiens
ccatgaggagttgctgtt

SEQ ID NO: 1220367 - DNA, 24 bp, Homo sapiens
ccatggcccccaataaaggcagct

SEQ ID NO: 1220368 - DNA, 15 bp, Homo sapiens
ccatggccccccact

SEQ ID NO: 1220369 - DNA, 23 bp, Homo sapiens
ccatggccgaagccccttggaga

SEQ ID NO: 1220370 - DNA, 14 bp, Homo sapiens
ccatggccttatga

SEQ ID NO: 1220371 - DNA, 13 bp, Homo sapiens
ccatggctcaggc

SEQ ID NO: 1220372 - DNA, 17 bp, Homo sapiens
ccatggctgaagctgga

SEQ ID NO: 1220373 - DNA, 23 bp, Homo sapiens
ccatggctgaagctggagcagcg

SEQ ID NO: 1220374 - DNA, 21 bp, Homo sapiens
ccatggctgggcgtgctagag

SEQ ID NO: 1220375 - DNA, 14 bp, Homo sapiens
ccatggcttcctcc

SEQ ID NO: 1220376 - DNA, 16 bp, Homo sapiens
ccatgggaataataga

SEQ ID NO: 1220377 - DNA, 19 bp, Homo sapiens
ccatgggaggtggggcctc

SEQ ID NO: 1220378 - DNA, 13 bp, Homo sapiens
ccatgggcccgct

SEQ ID NO: 1220379 - DNA, 11 bp, Homo sapiens
ccatgggcctg

SEQ ID NO: 1220380 - DNA, 12 bp, Homo sapiens
ccatgggcctgg

SEQ ID NO: 1220381 - DNA, 18 bp, Homo sapiens
ccatgggcctgggcctgc

SEQ ID NO: 1220382 - DNA, 15 bp, Homo sapiens
ccatgggctgtgtcc

SEQ ID NO: 1220383 - DNA, 21 bp, Homo sapiens
ccatgggcttggacttcctgg

SEQ ID NO: 1220384 - DNA, 12 bp, Homo sapiens
ccatggggagga

SEQ ID NO: 1220385 - DNA, 17 bp, Homo sapiens
ccatggggaggagacct

SEQ ID NO: 1220386 - DNA, 15 bp, Homo sapiens
ccatggggtccatcc

SEQ ID NO: 1220387 - DNA, 18 bp, Homo sapiens
ccatggggtcggctcctg

SEQ ID NO: 1220388 - DNA, 23 bp, Homo sapiens
ccatgggtatgacataggccaag

SEQ ID NO: 1220389 - DNA, 16 bp, Homo sapiens
ccatgggtctggcctg

SEQ ID NO: 1220390 - DNA, 20 bp, Homo sapiens
ccatggtactgtagcagggg

SEQ ID NO: 1220391 - DNA, 22 bp, Homo sapiens
ccatggtactgtagcaggggaa

SEQ ID NO: 1220392 - DNA, 15 bp, Homo sapiens
ccatggtcctgtctg

SEQ ID NO: 1220393 - DNA, 20 bp, Homo sapiens
ccatggtcggaaaacatgct

SEQ ID NO: 1220394 - DNA, 17 bp, Homo sapiens
ccatggtgaaagggttt

SEQ ID NO: 1220395 - DNA, 17 bp, Homo sapiens
ccatggtgctaggaaga

SEQ ID NO: 1220396 - DNA, 22 bp, Homo sapiens
ccatggtgctaggaagaggagt

SEQ ID NO: 1220397 - DNA, 14 bp, Homo sapiens
ccatggtgcttgtt

SEQ ID NO: 1220398 - DNA, 16 bp, Homo sapiens
ccatggtggagggcac

SEQ ID NO: 1220399 - DNA, 18 bp, Homo sapiens
ccatgtaaataagatgat

SEQ ID NO: 1220400 - DNA, 23 bp, Homo sapiens
ccatgtaaatccccactgggacc

SEQ ID NO: 1220401 - DNA, 14 bp, Homo sapiens
ccatgtacctcccc

SEQ ID NO: 1220402 - DNA, 15 bp, Homo sapiens
ccatgtactgtagtt

SEQ ID NO: 1220403 - DNA, 16 bp, Homo sapiens
ccattggttcttcctt

SEQ ID NO: 1220404 - DNA, 18 bp, Homo sapiens
ccattggttcttcctttc

SEQ ID NO: 1220405 - DNA, 22 bp, Homo sapiens
ccattggttggaagctaccaga

SEQ ID NO: 1220406 - DNA, 14 bp, Homo sapiens
ccattgtattttgt

SEQ ID NO: 1220407 - DNA, 22 bp, Homo sapiens
ccattgtccctctgccccatcc

SEQ ID NO: 1220408 - DNA, 19 bp, Homo sapiens
ccattgtgaaccaatgcaa

SEQ ID NO: 1220409 - DNA, 19 bp, Homo sapiens
ccattgtgaagcacctact

SEQ ID NO: 1220410 - DNA, 17 bp, Homo sapiens
ccattgtgacagcgatg

SEQ ID NO: 1220411 - DNA, 15 bp, Homo sapiens
ccattgtgtggcctg

SEQ ID NO: 1220412 - DNA, 17 bp, Homo sapiens
ccattgttgtcaaggaa

SEQ ID NO: 1220413 - DNA, 21 bp, Homo sapiens
ccattgtttgaaacaaagaag

SEQ ID NO: 1220414 - DNA, 14 bp, Homo sapiens
ccatttaaaaagtt

SEQ ID NO: 1220415 - DNA, 15 bp, Homo sapiens
ccatttaaagaaaga

SEQ ID NO: 1220416 - DNA, 20 bp, Homo sapiens
ccatttaataaagaaatatt

SEQ ID NO: 1220417 - DNA, 20 bp, Homo sapiens
ccatttaatggggaggacaa

SEQ ID NO: 1220418 - DNA, 22 bp, Homo sapiens
ccatttacagtctctttcttcc

SEQ ID NO: 1220419 - DNA, 17 bp, Homo sapiens
ccatttacatgttttaa

SEQ ID NO: 1220420 - DNA, 22 bp, Homo sapiens
ccatttacatgttttaaagaaa

SEQ ID NO: 1220421 - DNA, 17 bp, Homo sapiens
ccatttacttaagactt

SEQ ID NO: 1220422 - DNA, 20 bp, Homo sapiens
ccatttagaggatgtggctg

SEQ ID NO: 1220423 - DNA, 18 bp, Homo sapiens
ccatttagtgtgaatatt

SEQ ID NO: 1220424 - DNA, 17 bp, Homo sapiens
ccatttcaggaatttaa

SEQ ID NO: 1220425 - DNA, 16 bp, Homo sapiens
ccatttcagtggcttc

SEQ ID NO: 1220426 - DNA, 16 bp, Homo sapiens
ccatttcatctatttc

SEQ ID NO: 1220427 - DNA, 16 bp, Homo sapiens
ccatttcccatctgca

SEQ ID NO: 1220428 - DNA, 18 bp, Homo sapiens
ccatttcccatctgcacc

SEQ ID NO: 1220429 - DNA, 10 bp, Homo sapiens
ccatttcctg

SEQ ID NO: 1220430 - DNA, 13 bp, Homo sapiens
ccatttcctgatc

SEQ ID NO: 1220431 - DNA, 16 bp, Homo sapiens
ccatttcctgatctag

SEQ ID NO: 1220432 - DNA, 17 bp, Homo sapiens
ccatttctaaataagga

SEQ ID NO: 1220433 - DNA, 14 bp, Homo sapiens
ccatttctatttat

SEQ ID NO: 1220434 - DNA, 23 bp, Homo sapiens
ccatttctcaatcagtgcagtga

SEQ ID NO: 1220435 - DNA, 16 bp, Homo sapiens
ccatttctcactgaga

SEQ ID NO: 1220436 - DNA, 14 bp, Homo sapiens
ccatttctctacac

SEQ ID NO: 1220437 - DNA, 13 bp, Homo sapiens
ccatttctctgct

SEQ ID NO: 1220438 - DNA, 12 bp, Homo sapiens
ccatttctgatg

SEQ ID NO: 1220439 - DNA, 22 bp, Homo sapiens
ccatttctgttgctggaggggc

SEQ ID NO: 1220440 - DNA, 16 bp, Homo sapiens
ccatttcttcagaggg

SEQ ID NO: 1220441 - DNA, 18 bp, Homo sapiens
ccatttcttctctctgtt

SEQ ID NO: 1220442 - DNA, 17 bp, Homo sapiens
ccatttgattgttttat

SEQ ID NO: 1220443 - DNA, 17 bp, Homo sapiens
ccatttgatttttctaa

SEQ ID NO: 1220444 - DNA, 18 bp, Homo sapiens
ccatttgcaataacagct

SEQ ID NO: 1220445 - DNA, 21 bp, Homo sapiens
ccatttgcaataacagctgca

SEQ ID NO: 1220446 - DNA, 20 bp, Homo sapiens
ccatttgcagagtcctgcac

SEQ ID NO: 1220447 - DNA, 21 bp, Homo sapiens
ccatttgctagttctgctgcc

SEQ ID NO: 1220448 - DNA, 22 bp, Homo sapiens
ccatttgctagttctgctgccc

SEQ ID NO: 1220449 - DNA, 20 bp, Homo sapiens
ccatttgctgagtttccctt

SEQ ID NO: 1220450 - DNA, 13 bp, Homo sapiens
ccatttgtaataa

SEQ ID NO: 1220451 - DNA, 18 bp, Homo sapiens
ccatttgtaataaagtat

SEQ ID NO: 1220452 - DNA, 15 bp, Homo sapiens
ccatttgtgcaaaat

SEQ ID NO: 1220453 - DNA, 15 bp, Homo sapiens
ccatttgtgccagag

SEQ ID NO: 1220454 - DNA, 16 bp, Homo sapiens
ccatttgtgccagagg

SEQ ID NO: 1220455 - DNA, 15 bp, Homo sapiens
ccattttaaatttta

SEQ ID NO: 1220456 - DNA, 18 bp, Homo sapiens
ccattttattttttgggc

SEQ ID NO: 1220457 - DNA, 20 bp, Homo sapiens
ccattttattttttgggcca

SEQ ID NO: 1220458 - DNA, 17 bp, Homo sapiens
ccattttctatcatgga

SEQ ID NO: 1220459 - DNA, 12 bp, Homo sapiens
ccattttctgtg

SEQ ID NO: 1220460 - DNA, 13 bp, Homo sapiens
ccattttctgtgg

SEQ ID NO: 1220461 - DNA, 23 bp, Homo sapiens
ccattttcttattgcgctgctac

SEQ ID NO: 1220462 - DNA, 21 bp, Homo sapiens
ccattttcttctctgtgaagt

SEQ ID NO: 1220463 - DNA, 14 bp, Homo sapiens
ccattttgcaaaat

SEQ ID NO: 1220464 - DNA, 17 bp, Homo sapiens
ccattttgcaaaatttc

SEQ ID NO: 1220465 - DNA, 16 bp, Homo sapiens
ccattttgcccttcca

SEQ ID NO: 1220466 - DNA, 18 bp, Homo sapiens
ccattttgttaaaatcta

SEQ ID NO: 1220467 - DNA, 22 bp, Homo sapiens
ccattttgttattgactaacag

SEQ ID NO: 1220468 - DNA, 15 bp, Homo sapiens
ccatttttcctctgt

SEQ ID NO: 1220469 - DNA, 14 bp, Homo sapiens
ccatttttctcttg

SEQ ID NO: 1220470 - DNA, 19 bp, Homo sapiens
ccattttttaaggaaacaa

SEQ ID NO: 1220471 - DNA, 17 bp, Homo sapiens
ccattttttcttccctt

SEQ ID NO: 1220472 - DNA, 15 bp, Homo sapiens
cccaaaacccagggc

SEQ ID NO: 1220473 - DNA, 22 bp, Homo sapiens
cccaaaagtcaaaaggtgcctg

SEQ ID NO: 1220474 - DNA, 18 bp, Homo sapiens
cccaaaatttattttata

SEQ ID NO: 1220475 - DNA, 19 bp, Homo sapiens
cccaaacaccttccagctc

SEQ ID NO: 1220476 - DNA, 21 bp, Homo sapiens
cccaaacaccttccagctcct

SEQ ID NO: 1220477 - DNA, 21 bp, Homo sapiens
cccaaaccattactgagggga

SEQ ID NO: 1220478 - DNA, 12 bp, Homo sapiens
cccaaaccccag

SEQ ID NO: 1220479 - DNA, 14 bp, Homo sapiens
cccaaaccccagcc

SEQ ID NO: 1220480 - DNA, 15 bp, Homo sapiens
cccaaaccccagccc

SEQ ID NO: 1220481 - DNA, 13 bp, Homo sapiens
cccaaaccctagg

SEQ ID NO: 1220482 - DNA, 21 bp, Homo sapiens
cccaccagacgtcaggccctg

SEQ ID NO: 1220483 - DNA, 15 bp, Homo sapiens
cccaccagagccggg

SEQ ID NO: 1220484 - DNA, 12 bp, Homo sapiens
cccaccagcagc

SEQ ID NO: 1220485 - DNA, 13 bp, Homo sapiens
cccaccagcagca

SEQ ID NO: 1220486 - DNA, 13 bp, Homo sapiens
cccaccagccccg

SEQ ID NO: 1220487 - DNA, 13 bp, Homo sapiens
cccaccagctcca

SEQ ID NO: 1220488 - DNA, 13 bp, Homo sapiens
cccaccagggtcc

SEQ ID NO: 1220489 - DNA, 23 bp, Homo sapiens
cccaccagtgtagcatcttcctc

SEQ ID NO: 1220490 - DNA, 22 bp, Homo sapiens
cccaccatcaccaccgcctctg

SEQ ID NO: 1220491 - DNA, 13 bp, Homo sapiens
cccaccatgcagc

SEQ ID NO: 1220492 - DNA, 19 bp, Homo sapiens
cccaccatgcagcccctgg

SEQ ID NO: 1220493 - DNA, 21 bp, Homo sapiens
cccaccatgcagcccctgggc

SEQ ID NO: 1220494 - DNA, 17 bp, Homo sapiens
cccaccatggaccagcc

SEQ ID NO: 1220495 - DNA, 16 bp, Homo sapiens
cccacccaagcttggc

SEQ ID NO: 1220496 - DNA, 22 bp, Homo sapiens
cccacccaagcttggcagccga

SEQ ID NO: 1220497 - DNA, 14 bp, Homo sapiens
cccacccacacagc

SEQ ID NO: 1220498 - DNA, 13 bp, Homo sapiens
cccacccaccccc

SEQ ID NO: 1220499 - DNA, 14 bp, Homo sapiens
cccacccaccccca

SEQ ID NO: 1220500 - DNA, 17 bp, Homo sapiens
cccacccagattctgaa

SEQ ID NO: 1220501 - DNA, 12 bp, Homo sapiens
cccacccagccc

SEQ ID NO: 1220502 - DNA, 12 bp, Homo sapiens
cccacccagctc

SEQ ID NO: 1220503 - DNA, 16 bp, Homo sapiens
cccacccagctccagg

SEQ ID NO: 1220504 - DNA, 13 bp, Homo sapiens
cccacccaggagg

SEQ ID NO: 1220505 - DNA, 13 bp, Homo sapiens
cccacccatcttc

SEQ ID NO: 1220506 - DNA, 14 bp, Homo sapiens
cccacccatcttcc

SEQ ID NO: 1220507 - DNA, 13 bp, Homo sapiens
cccaccccaactc

SEQ ID NO: 1220508 - DNA, 17 bp, Homo sapiens
cccaccccaactctccc

SEQ ID NO: 1220509 - DNA, 14 bp, Homo sapiens
cccaccccacctct

SEQ ID NO: 1220510 - DNA, 17 bp, Homo sapiens
cccaccccacctcttgt

SEQ ID NO: 1220511 - DNA, 16 bp, Homo sapiens
cccaccccagaaatca

SEQ ID NO: 1220512 - DNA, 12 bp, Homo sapiens
cccaccccagca

SEQ ID NO: 1220513 - DNA, 14 bp, Homo sapiens
cccacccccaaccc

SEQ ID NO: 1220514 - DNA, 13 bp, Homo sapiens
cccacccccagcc

SEQ ID NO: 1220515 - DNA, 14 bp, Homo sapiens
cccacccccagcca

SEQ ID NO: 1220516 - DNA, 15 bp, Homo sapiens
cccacccccagccag

SEQ ID NO: 1220517 - DNA, 16 bp, Homo sapiens
cccacccccagccagg

SEQ ID NO: 1220518 - DNA, 13 bp, Homo sapiens
cccacccccagct

SEQ ID NO: 1220519 - DNA, 19 bp, Homo sapiens
cccacccccaggcctccta

SEQ ID NO: 1220520 - DNA, 20 bp, Homo sapiens
cccacccccaggcctcctag

SEQ ID NO: 1220521 - DNA, 22 bp, Homo sapiens
cccacccccaggcctcctaggg

SEQ ID NO: 1220522 - DNA, 17 bp, Homo sapiens
cccaccccccagcctcc

SEQ ID NO: 1220523 - DNA, 14 bp, Homo sapiens
cccacccccctcat

SEQ ID NO: 1220524 - DNA, 13 bp, Homo sapiens
cccaccccctcct

SEQ ID NO: 1220525 - DNA, 14 bp, Homo sapiens
cccaccccctgccc

SEQ ID NO: 1220526 - DNA, 19 bp, Homo sapiens
cccaccccctgccctgcac

SEQ ID NO: 1220527 - DNA, 19 bp, Homo sapiens
cccacccccttcagtgccc

SEQ ID NO: 1220528 - DNA, 22 bp, Homo sapiens
cccacccccttctctgctccac

SEQ ID NO: 1220529 - DNA, 16 bp, Homo sapiens
cccaccccgccgttcc

SEQ ID NO: 1220530 - DNA, 14 bp, Homo sapiens
cccaccccggggac

SEQ ID NO: 1220531 - DNA, 20 bp, Homo sapiens
cccaccccggggaccctgtg

SEQ ID NO: 1220532 - DNA, 23 bp, Homo sapiens
cccacccctaccgatggtcccag

SEQ ID NO: 1220533 - DNA, 11 bp, Homo sapiens
cccacccctca

SEQ ID NO: 1220534 - DNA, 15 bp, Homo sapiens
cccacccctcactcc

SEQ ID NO: 1220535 - DNA, 21 bp, Homo sapiens
cccacccctcactccccaggg

SEQ ID NO: 1220536 - DNA, 21 bp, Homo sapiens
cccacccctgcctcccatgcc

SEQ ID NO: 1220537 - DNA, 22 bp, Homo sapiens
cccacccctgggggctctcatg

SEQ ID NO: 1220538 - DNA, 12 bp, Homo sapiens
cccacccctgtg

SEQ ID NO: 1220539 - DNA, 21 bp, Homo sapiens
cccacccctgtgctccgtgcc

SEQ ID NO: 1220540 - DNA, 13 bp, Homo sapiens
cccaccccttccc

SEQ ID NO: 1220541 - DNA, 13 bp, Homo sapiens
cccaccccttggc

SEQ ID NO: 1220542 - DNA, 14 bp, Homo sapiens
cccaccccttggcc

SEQ ID NO: 1220543 - DNA, 15 bp, Homo sapiens
cccacccgatgctgc

SEQ ID NO: 1220544 - DNA, 22 bp, Homo sapiens
cccacccgtcttcaatctctgt

SEQ ID NO: 1220545 - DNA, 13 bp, Homo sapiens
cccaccctaaggg

SEQ ID NO: 1220546 - DNA, 16 bp, Homo sapiens
cccaccctcagcaccc

SEQ ID NO: 1220547 - DNA, 13 bp, Homo sapiens
cccaccctccact

SEQ ID NO: 1220548 - DNA, 13 bp, Homo sapiens
cccaccctcctgt

SEQ ID NO: 1220549 - DNA, 21 bp, Homo sapiens
cccaccctctggtccttctga

SEQ ID NO: 1220550 - DNA, 21 bp, Homo sapiens
cccaccctgcgggccagggtc

SEQ ID NO: 1220551 - DNA, 13 bp, Homo sapiens
cccaccctggcct

SEQ ID NO: 1220552 - DNA, 14 bp, Homo sapiens
cccaccctgggccc

SEQ ID NO: 1220553 - DNA, 17 bp, Homo sapiens
cccaccgaggttcccag

SEQ ID NO: 1220554 - DNA, 18 bp, Homo sapiens
cccaccgaggttcccagg

SEQ ID NO: 1220555 - DNA, 19 bp, Homo sapiens
ccccaagatgagctgcagc

SEQ ID NO: 1220556 - DNA, 13 bp, Homo sapiens
ccccaagcagcca

SEQ ID NO: 1220557 - DNA, 19 bp, Homo sapiens
ccccaagcagccagccagt

SEQ ID NO: 1220558 - DNA, 12 bp, Homo sapiens
ccccaaggccag

SEQ ID NO: 1220559 - DNA, 16 bp, Homo sapiens
ccccaaggccccaggg

SEQ ID NO: 1220560 - DNA, 18 bp, Homo sapiens
ccccaaggccccagggac

SEQ ID NO: 1220561 - DNA, 19 bp, Homo sapiens
ccccaaggccccagggaca

SEQ ID NO: 1220562 - DNA, 20 bp, Homo sapiens
ccccaaggccccagggacag

SEQ ID NO: 1220563 - DNA, 18 bp, Homo sapiens
ccccaaggttccagaggc

SEQ ID NO: 1220564 - DNA, 18 bp, Homo sapiens
ccccaaggttctggttcc

SEQ ID NO: 1220565 - DNA, 13 bp, Homo sapiens
ccccaagtgcctg

SEQ ID NO: 1220566 - DNA, 14 bp, Homo sapiens
ccccaataaaggca

SEQ ID NO: 1220567 - DNA, 15 bp, Homo sapiens
ccccaataaaggcag

SEQ ID NO: 1220568 - DNA, 18 bp, Homo sapiens
ccccaataaaggcagctg

SEQ ID NO: 1220569 - DNA, 23 bp, Homo sapiens
ccccaataaaggcagctgcctct

SEQ ID NO: 1220570 - DNA, 21 bp, Homo sapiens
ccccaatcacgagatcttcct

SEQ ID NO: 1220571 - DNA, 13 bp, Homo sapiens
ccccaatccctgc

SEQ ID NO: 1220572 - DNA, 17 bp, Homo sapiens
ccccaatcggactgcca

SEQ ID NO: 1220573 - DNA, 19 bp, Homo sapiens
ccccaatcggactgccaaa

SEQ ID NO: 1220574 - DNA, 19 bp, Homo sapiens
ccccaatcgggtccagaga

SEQ ID NO: 1220575 - DNA, 18 bp, Homo sapiens
ccccaattactattccct

SEQ ID NO: 1220576 - DNA, 20 bp, Homo sapiens
ccccacaaggaaccctcagg

SEQ ID NO: 1220577 - DNA, 21 bp, Homo sapiens
ccccacacacaggccttctgt

SEQ ID NO: 1220578 - DNA, 14 bp, Homo sapiens
ccccacaccaggcc

SEQ ID NO: 1220579 - DNA, 12 bp, Homo sapiens
ccccacacccag

SEQ ID NO: 1220580 - DNA, 15 bp, Homo sapiens
ccccacaccccagcc

SEQ ID NO: 1220581 - DNA, 16 bp, Homo sapiens
ccccacacctcagttc

SEQ ID NO: 1220582 - DNA, 15 bp, Homo sapiens
ccccacactccactc

SEQ ID NO: 1220583 - DNA, 22 bp, Homo sapiens
ccccacacttgttccagctctt

SEQ ID NO: 1220584 - DNA, 21 bp, Homo sapiens
ccccacagactccggcctgta

SEQ ID NO: 1220585 - DNA, 18 bp, Homo sapiens
ccccacagcgtccctggc

SEQ ID NO: 1220586 - DNA, 15 bp, Homo sapiens
ccccacagctccagg

SEQ ID NO: 1220587 - DNA, 12 bp, Homo sapiens
ccccacagtccc

SEQ ID NO: 1220588 - DNA, 13 bp, Homo sapiens
ccccacataccat

SEQ ID NO: 1220589 - DNA, 16 bp, Homo sapiens
ccccacatccttctca

SEQ ID NO: 1220590 - DNA, 20 bp, Homo sapiens
ccccacatccttctcactgc

SEQ ID NO: 1220591 - DNA, 23 bp, Homo sapiens
ccccaccacgtctggctccctgc

SEQ ID NO: 1220592 - DNA, 13 bp, Homo sapiens
ccccaccagcagc

SEQ ID NO: 1220593 - DNA, 14 bp, Homo sapiens
ccccaccagcagca

SEQ ID NO: 1220594 - DNA, 18 bp, Homo sapiens
ccccaccagcagcacaat

SEQ ID NO: 1220595 - DNA, 18 bp, Homo sapiens
ccccacccaagcttggca

SEQ ID NO: 1220596 - DNA, 19 bp, Homo sapiens
ccccacccaagcttggcag

SEQ ID NO: 1220597 - DNA, 12 bp, Homo sapiens
ccccacccaccc

SEQ ID NO: 1220598 - DNA, 17 bp, Homo sapiens
ccccacccacccccagg

SEQ ID NO: 1220599 - DNA, 23 bp, Homo sapiens
ccccacccacccccaggcctcct

SEQ ID NO: 1220600 - DNA, 23 bp, Homo sapiens
ccccacccacctccacccagccc

SEQ ID NO: 1220601 - DNA, 12 bp, Homo sapiens
ccccacccagga

SEQ ID NO: 1220602 - DNA, 13 bp, Homo sapiens
ccccacccatggg

SEQ ID NO: 1220603 - DNA, 19 bp, Homo sapiens
ccccacccccagccaggct

SEQ ID NO: 1220604 - DNA, 17 bp, Homo sapiens
ccccacccccagctcaa

SEQ ID NO: 1220605 - DNA, 20 bp, Homo sapiens
ccccacccccagctcaatgg

SEQ ID NO: 1220606 - DNA, 17 bp, Homo sapiens
ccccacccccctcctcc

SEQ ID NO: 1220607 - DNA, 12 bp, Homo sapiens
ccccaccccctt

SEQ ID NO: 1220608 - DNA, 22 bp, Homo sapiens
ccccaccccggggaccctgtga

SEQ ID NO: 1220609 - DNA, 14 bp, Homo sapiens
ccccacccctgccc

SEQ ID NO: 1220610 - DNA, 13 bp, Homo sapiens
ccccaccccttcc

SEQ ID NO: 1220611 - DNA, 15 bp, Homo sapiens
ccccaccccttcccc

SEQ ID NO: 1220612 - DNA, 22 bp, Homo sapiens
ccccaccccttccccactgcct

SEQ ID NO: 1220613 - DNA, 14 bp, Homo sapiens
ccccaccccttcga

SEQ ID NO: 1220614 - DNA, 22 bp, Homo sapiens
ccccaccctcaaaccctgtggg

SEQ ID NO: 1220615 - DNA, 13 bp, Homo sapiens
ccccaccctccat

SEQ ID NO: 1220616 - DNA, 14 bp, Homo sapiens
ccccaccctggcct

SEQ ID NO: 1220617 - DNA, 16 bp, Homo sapiens
ccccaccgctcagtgt

SEQ ID NO: 1220618 - DNA, 21 bp, Homo sapiens
ccccaccgctcagtgtcagcg

SEQ ID NO: 1220619 - DNA, 21 bp, Homo sapiens
ccccaccggtccagctggcct

SEQ ID NO: 1220620 - DNA, 13 bp, Homo sapiens
ccccacctcccat

SEQ ID NO: 1220621 - DNA, 17 bp, Homo sapiens
ccccacctcccatttct

SEQ ID NO: 1220622 - DNA, 14 bp, Homo sapiens
ccccacctccccac

SEQ ID NO: 1220623 - DNA, 15 bp, Homo sapiens
ccccacctccctgcg

SEQ ID NO: 1220624 - DNA, 23 bp, Homo sapiens
ccccacctgacaatggcagctag

SEQ ID NO: 1220625 - DNA, 12 bp, Homo sapiens
ccccacctgccg

SEQ ID NO: 1220626 - DNA, 12 bp, Homo sapiens
ccccacctggac

SEQ ID NO: 1220627 - DNA, 23 bp, Homo sapiens
ccccacctggacacacactcacc

SEQ ID NO: 1220628 - DNA, 13 bp, Homo sapiens
ccccacgagggct

SEQ ID NO: 1220629 - DNA, 14 bp, Homo sapiens
ccccacgagggctg

SEQ ID NO: 1220630 - DNA, 15 bp, Homo sapiens
ccccacgagggctgg

SEQ ID NO: 1220631 - DNA, 16 bp, Homo sapiens
ccccacgagggctggc

SEQ ID NO: 1220632 - DNA, 17 bp, Homo sapiens
ccccacgagggctggct

SEQ ID NO: 1220633 - DNA, 21 bp, Homo sapiens
ccccacgagggctggctggcc

SEQ ID NO: 1220634 - DNA, 20 bp, Homo sapiens
ccccacgagtcacctgcaag

SEQ ID NO: 1220635 - DNA, 18 bp, Homo sapiens
ccccacgccctctcctcc

SEQ ID NO: 1220636 - DNA, 16 bp, Homo sapiens
ccccacgctgaccatg

SEQ ID NO: 1220637 - DNA, 20 bp, Homo sapiens
ccccacgctgtggccctgga

SEQ ID NO: 1220638 - DNA, 14 bp, Homo sapiens
ccccactactgcag

SEQ ID NO: 1220639 - DNA, 23 bp, Homo sapiens
ccccactactgcagcacctccag

SEQ ID NO: 1220640 - DNA, 19 bp, Homo sapiens
ccccactcaggggacccca

SEQ ID NO: 1220641 - DNA, 22 bp, Homo sapiens
ccccactcagtgcctccacatg

SEQ ID NO: 1220642 - DNA, 12 bp, Homo sapiens
ccccactccagc

SEQ ID NO: 1220643 - DNA, 22 bp, Homo sapiens
ccccactccagtccactcctga

SEQ ID NO: 1220644 - DNA, 14 bp, Homo sapiens
ccccactcccctca

SEQ ID NO: 1220645 - DNA, 16 bp, Homo sapiens
ccccactcccctcaca

SEQ ID NO: 1220646 - DNA, 17 bp, Homo sapiens
ccccactcccctcacac

SEQ ID NO: 1220647 - DNA, 16 bp, Homo sapiens
ccccactccctggcca

SEQ ID NO: 1220648 - DNA, 23 bp, Homo sapiens
ccccactccctggctctcagaag

SEQ ID NO: 1220649 - DNA, 21 bp, Homo sapiens
ccccactcctctgctgacctg

SEQ ID NO: 1220650 - DNA, 14 bp, Homo sapiens
ccccactctctcac

SEQ ID NO: 1220651 - DNA, 11 bp, Homo sapiens
ccccactctgc

SEQ ID NO: 1220652 - DNA, 18 bp, Homo sapiens
ccccactgcaggccccgc

SEQ ID NO: 1220653 - DNA, 16 bp, Homo sapiens
ccccactgccagcagc

SEQ ID NO: 1220654 - DNA, 19 bp, Homo sapiens
ccccactgccagcagcagc

SEQ ID NO: 1220655 - DNA, 12 bp, Homo sapiens
ccccactgcctg

SEQ ID NO: 1220656 - DNA, 16 bp, Homo sapiens
ccccactgctgagctg

SEQ ID NO: 1220657 - DNA, 21 bp, Homo sapiens
ccccactgctgagctggccct

SEQ ID NO: 1220658 - DNA, 11 bp, Homo sapiens
ccccactggac

SEQ ID NO: 1220659 - DNA, 13 bp, Homo sapiens
ccccactgggaga

SEQ ID NO: 1220660 - DNA, 15 bp, Homo sapiens
ccccactgggagagc

SEQ ID NO: 1220661 - DNA, 14 bp, Homo sapiens
ccccactgggccag

SEQ ID NO: 1220662 - DNA, 20 bp, Homo sapiens
ccccacttatgctgctgtga

SEQ ID NO: 1220663 - DNA, 13 bp, Homo sapiens
ccccacttcccac

SEQ ID NO: 1220664 - DNA, 15 bp, Homo sapiens
ccccacttgcctctt

SEQ ID NO: 1220665 - DNA, 13 bp, Homo sapiens
ccccactttgaag

SEQ ID NO: 1220666 - DNA, 17 bp, Homo sapiens
ccccagaaagcctcctg

SEQ ID NO: 1220667 - DNA, 14 bp, Homo sapiens
ccccagaaatcact

SEQ ID NO: 1220668 - DNA, 16 bp, Homo sapiens
ccccagaaatcactgt

SEQ ID NO: 1220669 - DNA, 18 bp, Homo sapiens
ccccagaaatcactgtga

SEQ ID NO: 1220670 - DNA, 18 bp, Homo sapiens
ccccagaactggctgggc

SEQ ID NO: 1220671 - DNA, 17 bp, Homo sapiens
ccccagacaacagccca

SEQ ID NO: 1220672 - DNA, 24 bp, Homo sapiens
ccccagacaacagcccaggcatct

SEQ ID NO: 1220673 - DNA, 15 bp, Homo sapiens
ccccctcctgctcct

SEQ ID NO: 1220674 - DNA, 12 bp, Homo sapiens
ccccctcctggc

SEQ ID NO: 1220675 - DNA, 14 bp, Homo sapiens
ccccctcggagcct

SEQ ID NO: 1220676 - DNA, 12 bp, Homo sapiens
ccccctctcctc

SEQ ID NO: 1220677 - DNA, 16 bp, Homo sapiens
ccccctctcctcccag

SEQ ID NO: 1220678 - DNA, 19 bp, Homo sapiens
ccccctctcctcccagctg

SEQ ID NO: 1220679 - DNA, 20 bp, Homo sapiens
ccccctctcctcccagctgc

SEQ ID NO: 1220680 - DNA, 22 bp, Homo sapiens
ccccctctgccggtcgggcagc

SEQ ID NO: 1220681 - DNA, 12 bp, Homo sapiens
ccccctctggct

SEQ ID NO: 1220682 - DNA, 12 bp, Homo sapiens
ccccctctggtt

SEQ ID NO: 1220683 - DNA, 18 bp, Homo sapiens
ccccctgcaaagcccagc

SEQ ID NO: 1220684 - DNA, 16 bp, Homo sapiens
ccccctgccagtgcct

SEQ ID NO: 1220685 - DNA, 16 bp, Homo sapiens
ccccctgccccccagc

SEQ ID NO: 1220686 - DNA, 16 bp, Homo sapiens
ccccctgccctcgtgg

SEQ ID NO: 1220687 - DNA, 18 bp, Homo sapiens
ccccctgctccaccagca

SEQ ID NO: 1220688 - DNA, 18 bp, Homo sapiens
ccccctggatgtcccctg

SEQ ID NO: 1220689 - DNA, 20 bp, Homo sapiens
ccccctggatgtcccctgtc

SEQ ID NO: 1220690 - DNA, 20 bp, Homo sapiens
ccccctggtggacagtcctg

SEQ ID NO: 1220691 - DNA, 20 bp, Homo sapiens
ccccctgtacacaactcact

SEQ ID NO: 1220692 - DNA, 18 bp, Homo sapiens
ccccctgtagactagtgc

SEQ ID NO: 1220693 - DNA, 12 bp, Homo sapiens
ccccctgtccca

SEQ ID NO: 1220694 - DNA, 19 bp, Homo sapiens
ccccctgtcccattctaga

SEQ ID NO: 1220695 - DNA, 17 bp, Homo sapiens
ccccctgtccccaagac

SEQ ID NO: 1220696 - DNA, 14 bp, Homo sapiens
ccccctgtggcggc

SEQ ID NO: 1220697 - DNA, 12 bp, Homo sapiens
cccccttcagct

SEQ ID NO: 1220698 - DNA, 16 bp, Homo sapiens
cccccttcagctcctg

SEQ ID NO: 1220699 - DNA, 14 bp, Homo sapiens
cccccttcagtgcc

SEQ ID NO: 1220700 - DNA, 15 bp, Homo sapiens
cccccttccccagcc

SEQ ID NO: 1220701 - DNA, 14 bp, Homo sapiens
cccccttcgctcct

SEQ ID NO: 1220702 - DNA, 15 bp, Homo sapiens
cccccttctcccaca

SEQ ID NO: 1220703 - DNA, 17 bp, Homo sapiens
cccccttctcccacact

SEQ ID NO: 1220704 - DNA, 15 bp, Homo sapiens
cccccttgaagcaat

SEQ ID NO: 1220705 - DNA, 18 bp, Homo sapiens
cccccttgaatctgcagg

SEQ ID NO: 1220706 - DNA, 20 bp, Homo sapiens
cccccttgaatctgcaggga

SEQ ID NO: 1220707 - DNA, 23 bp, Homo sapiens
cccccttgaggattgtggaaaac

SEQ ID NO: 1220708 - DNA, 18 bp, Homo sapiens
cccccttgccagacatgt

SEQ ID NO: 1220709 - DNA, 14 bp, Homo sapiens
cccccttgtcttcc

SEQ ID NO: 1220710 - DNA, 19 bp, Homo sapiens
cccccttgtcttcccccct

SEQ ID NO: 1220711 - DNA, 21 bp, Homo sapiens
ccccctttacctagctgtgcc

SEQ ID NO: 1220712 - DNA, 18 bp, Homo sapiens
ccccctttcacactggat

SEQ ID NO: 1220713 - DNA, 18 bp, Homo sapiens
ccccctttcagatgtctt

SEQ ID NO: 1220714 - DNA, 15 bp, Homo sapiens
ccccctttcccgggc

SEQ ID NO: 1220715 - DNA, 18 bp, Homo sapiens
ccccctttggcactggat

SEQ ID NO: 1220716 - DNA, 21 bp, Homo sapiens
ccccctttggcactggatgga

SEQ ID NO: 1220717 - DNA, 11 bp, Homo sapiens
ccccgaagagt

SEQ ID NO: 1220718 - DNA, 12 bp, Homo sapiens
ccccgacacacg

SEQ ID NO: 1220719 - DNA, 16 bp, Homo sapiens
ccccgacactgctgca

SEQ ID NO: 1220720 - DNA, 19 bp, Homo sapiens
ccccgaccaatccccagcc

SEQ ID NO: 1220721 - DNA, 15 bp, Homo sapiens
ccccgacggctgtga

SEQ ID NO: 1220722 - DNA, 14 bp, Homo sapiens
ccccgactccagcc

SEQ ID NO: 1220723 - DNA, 17 bp, Homo sapiens
ccccgactccagccagc

SEQ ID NO: 1220724 - DNA, 14 bp, Homo sapiens
ccccgactgcctgt

SEQ ID NO: 1220725 - DNA, 14 bp, Homo sapiens
ccccgacttcctga

SEQ ID NO: 1220726 - DNA, 12 bp, Homo sapiens
ccccgagctggg

SEQ ID NO: 1220727 - DNA, 13 bp, Homo sapiens
ccccgagctgggg

SEQ ID NO: 1220728 - DNA, 17 bp, Homo sapiens
ccccgaggagctgggcc

SEQ ID NO: 1220729 - DNA, 15 bp, Homo sapiens
ccccgaggctgcccc

SEQ ID NO: 1220730 - DNA, 22 bp, Homo sapiens
ccccgaggctgccccaggccgg

SEQ ID NO: 1220731 - DNA, 23 bp, Homo sapiens
ccccgaggctgccccaggccgga

SEQ ID NO: 1220732 - DNA, 13 bp, Homo sapiens
ccccgaggctgct

SEQ ID NO: 1220733 - DNA, 19 bp, Homo sapiens
ccccgagggctgagcctgg

SEQ ID NO: 1220734 - DNA, 15 bp, Homo sapiens
ccccgagtcctcagg

SEQ ID NO: 1220735 - DNA, 14 bp, Homo sapiens
ccccgatgtcccct

SEQ ID NO: 1220736 - DNA, 17 bp, Homo sapiens
ccccgatgtcccctgcg

SEQ ID NO: 1220737 - DNA, 15 bp, Homo sapiens
ccccgcacagccacc

SEQ ID NO: 1220738 - DNA, 16 bp, Homo sapiens
ccccgcacagccaccc

SEQ ID NO: 1220739 - DNA, 19 bp, Homo sapiens
ccccgcacagccacccgtg

SEQ ID NO: 1220740 - DNA, 15 bp, Homo sapiens
ccccgcacccccgcc

SEQ ID NO: 1220741 - DNA, 17 bp, Homo sapiens
ccccgcacccccgccag

SEQ ID NO: 1220742 - DNA, 14 bp, Homo sapiens
ccccgcacgggctg

SEQ ID NO: 1220743 - DNA, 20 bp, Homo sapiens
ccccgcacgggctgtctggg

SEQ ID NO: 1220744 - DNA, 14 bp, Homo sapiens
ccccgcactgcaga

SEQ ID NO: 1220745 - DNA, 21 bp, Homo sapiens
ccccgcagacggtctgtgtgc

SEQ ID NO: 1220746 - DNA, 21 bp, Homo sapiens
ccccgcagtccccagcccttc

SEQ ID NO: 1220747 - DNA, 17 bp, Homo sapiens
ccccgccacctcagggc

SEQ ID NO: 1220748 - DNA, 14 bp, Homo sapiens
ccccgccacggcca

SEQ ID NO: 1220749 - DNA, 13 bp, Homo sapiens
ccccgccagggct

SEQ ID NO: 1220750 - DNA, 14 bp, Homo sapiens
ccccgccagggctg

SEQ ID NO: 1220751 - DNA, 14 bp, Homo sapiens
ccccgcccacccac

SEQ ID NO: 1220752 - DNA, 17 bp, Homo sapiens
ccccgccccacattccg

SEQ ID NO: 1220753 - DNA, 12 bp, Homo sapiens
ccccgccccagg

SEQ ID NO: 1220754 - DNA, 12 bp, Homo sapiens
ccccgcccccag

SEQ ID NO: 1220755 - DNA, 20 bp, Homo sapiens
ccccgccccccagagccagg

SEQ ID NO: 1220756 - DNA, 14 bp, Homo sapiens
ccccgcccccgccc

SEQ ID NO: 1220757 - DNA, 21 bp, Homo sapiens
ccccgccccctgccctcccct

SEQ ID NO: 1220758 - DNA, 15 bp, Homo sapiens
ccccgcccctgtggc

SEQ ID NO: 1220759 - DNA, 13 bp, Homo sapiens
ccccgcctgccac

SEQ ID NO: 1220760 - DNA, 14 bp, Homo sapiens
ccccgcctgccacc

SEQ ID NO: 1220761 - DNA, 14 bp, Homo sapiens
ccccgcctggccag

SEQ ID NO: 1220762 - DNA, 13 bp, Homo sapiens
ccccgccttccct

SEQ ID NO: 1220763 - DNA, 17 bp, Homo sapiens
ccccgcggtgctctggc

SEQ ID NO: 1220764 - DNA, 13 bp, Homo sapiens
ccccgctcccacc

SEQ ID NO: 1220765 - DNA, 12 bp, Homo sapiens
ccccgctccgtc

SEQ ID NO: 1220766 - DNA, 12 bp, Homo sapiens
ccccgctctgga

SEQ ID NO: 1220767 - DNA, 15 bp, Homo sapiens
ccccggacctacctc

SEQ ID NO: 1220768 - DNA, 13 bp, Homo sapiens
ccccggaggaagc

SEQ ID NO: 1220769 - DNA, 14 bp, Homo sapiens
ccccggaggaagct

SEQ ID NO: 1220770 - DNA, 16 bp, Homo sapiens
ccccggaggaagcttg

SEQ ID NO: 1220771 - DNA, 21 bp, Homo sapiens
ccccggaggcgtggaggagag

SEQ ID NO: 1220772 - DNA, 13 bp, Homo sapiens
ccccggcaggcct

SEQ ID NO: 1220773 - DNA, 15 bp, Homo sapiens
ccccggcccccctct

SEQ ID NO: 1220774 - DNA, 18 bp, Homo sapiens
ccccggccctaccagcgc

SEQ ID NO: 1220775 - DNA, 12 bp, Homo sapiens
ccccggctgggc

SEQ ID NO: 1220776 - DNA, 15 bp, Homo sapiens
ccccgggatattata

SEQ ID NO: 1220777 - DNA, 16 bp, Homo sapiens
ccccgggatcctgccc

SEQ ID NO: 1220778 - DNA, 21 bp, Homo sapiens
ccccgggcccgggcccccgcc

SEQ ID NO: 1220779 - DNA, 16 bp, Homo sapiens
ccccgggctctggcca

SEQ ID NO: 1220780 - DNA, 16 bp, Homo sapiens
ccccgggctggccctg

SEQ ID NO: 1220781 - DNA, 21 bp, Homo sapiens
ccccggggcatggacagggcc

SEQ ID NO: 1220782 - DNA, 12 bp, Homo sapiens
ccccggggctgg

SEQ ID NO: 1220783 - DNA, 13 bp, Homo sapiens
ccccggggctggc

SEQ ID NO: 1220784 - DNA, 13 bp, Homo sapiens
cccctctcccctt

SEQ ID NO: 1220785 - DNA, 15 bp, Homo sapiens
cccctctccccttgg

SEQ ID NO: 1220786 - DNA, 13 bp, Homo sapiens
cccctctccctgg

SEQ ID NO: 1220787 - DNA, 21 bp, Homo sapiens
cccctctcgggctctctcacc

SEQ ID NO: 1220788 - DNA, 13 bp, Homo sapiens
cccctctctctgg

SEQ ID NO: 1220789 - DNA, 21 bp, Homo sapiens
cccctctcttcgtcctgatcc

SEQ ID NO: 1220790 - DNA, 13 bp, Homo sapiens
cccctctctttct

SEQ ID NO: 1220791 - DNA, 19 bp, Homo sapiens
cccctctgattgttcccga

SEQ ID NO: 1220792 - DNA, 12 bp, Homo sapiens
cccctctgccca

SEQ ID NO: 1220793 - DNA, 17 bp, Homo sapiens
cccctctgcccagcttg

SEQ ID NO: 1220794 - DNA, 16 bp, Homo sapiens
cccctctgctgctgtc

SEQ ID NO: 1220795 - DNA, 13 bp, Homo sapiens
cccctctggccag

SEQ ID NO: 1220796 - DNA, 18 bp, Homo sapiens
cccctctggctccagctg

SEQ ID NO: 1220797 - DNA, 23 bp, Homo sapiens
cccctctggtcgctcctgcccac

SEQ ID NO: 1220798 - DNA, 17 bp, Homo sapiens
cccctctgtggagcgcc

SEQ ID NO: 1220799 - DNA, 13 bp, Homo sapiens
cccctctgttctc

SEQ ID NO: 1220800 - DNA, 19 bp, Homo sapiens
cccctcttcaaagcagagt

SEQ ID NO: 1220801 - DNA, 13 bp, Homo sapiens
cccctcttccagc

SEQ ID NO: 1220802 - DNA, 14 bp, Homo sapiens
cccctcttcctctt

SEQ ID NO: 1220803 - DNA, 19 bp, Homo sapiens
cccctcttcctcttgaccc

SEQ ID NO: 1220804 - DNA, 22 bp, Homo sapiens
cccctcttcctcttgaccctgc

SEQ ID NO: 1220805 - DNA, 14 bp, Homo sapiens
cccctcttctgctc

SEQ ID NO: 1220806 - DNA, 12 bp, Homo sapiens
cccctcttgccc

SEQ ID NO: 1220807 - DNA, 14 bp, Homo sapiens
cccctcttggagaa

SEQ ID NO: 1220808 - DNA, 18 bp, Homo sapiens
cccctcttgtctcccctg

SEQ ID NO: 1220809 - DNA, 13 bp, Homo sapiens
cccctctttctct

SEQ ID NO: 1220810 - DNA, 14 bp, Homo sapiens
cccctctttctctt

SEQ ID NO: 1220811 - DNA, 16 bp, Homo sapiens
cccctctttctctttc

SEQ ID NO: 1220812 - DNA, 22 bp, Homo sapiens
cccctctttctctttcttcctt

SEQ ID NO: 1220813 - DNA, 18 bp, Homo sapiens
cccctgagaccaccccca

SEQ ID NO: 1220814 - DNA, 21 bp, Homo sapiens
cccctgagagtttcctcagaa

SEQ ID NO: 1220815 - DNA, 22 bp, Homo sapiens
cccctgagagtttcctcagaac

SEQ ID NO: 1220816 - DNA, 20 bp, Homo sapiens
cccctgagatcccctgagcc

SEQ ID NO: 1220817 - DNA, 18 bp, Homo sapiens
cccctgagcaatgtctgt

SEQ ID NO: 1220818 - DNA, 19 bp, Homo sapiens
cccctgagcaatgtctgtg

SEQ ID NO: 1220819 - DNA, 15 bp, Homo sapiens
cccctgagcccagag

SEQ ID NO: 1220820 - DNA, 15 bp, Homo sapiens
cccctgaggactgga

SEQ ID NO: 1220821 - DNA, 14 bp, Homo sapiens
cccctgagtccgcc

SEQ ID NO: 1220822 - DNA, 20 bp, Homo sapiens
cccctgatgcagcctgtggc

SEQ ID NO: 1220823 - DNA, 15 bp, Homo sapiens
cccctgcaaagccca

SEQ ID NO: 1220824 - DNA, 20 bp, Homo sapiens
cccctgcaaagcccagcttg

SEQ ID NO: 1220825 - DNA, 21 bp, Homo sapiens
cccctgcaacttccgctgagg

SEQ ID NO: 1220826 - DNA, 15 bp, Homo sapiens
cccctgcagcctggg

SEQ ID NO: 1220827 - DNA, 18 bp, Homo sapiens
cccctgcagcctgggtct

SEQ ID NO: 1220828 - DNA, 21 bp, Homo sapiens
cccctgcagcctgggtctgga

SEQ ID NO: 1220829 - DNA, 22 bp, Homo sapiens
cccctgcagtttggccctggag

SEQ ID NO: 1220830 - DNA, 14 bp, Homo sapiens
cccctgccacactg

SEQ ID NO: 1220831 - DNA, 16 bp, Homo sapiens
cccctgccacactgat

SEQ ID NO: 1220832 - DNA, 21 bp, Homo sapiens
cccctgccaccgactgcccag

SEQ ID NO: 1220833 - DNA, 22 bp, Homo sapiens
cccctgccaccgactgcccagc

SEQ ID NO: 1220834 - DNA, 18 bp, Homo sapiens
cccctgccacctccctga

SEQ ID NO: 1220835 - DNA, 16 bp, Homo sapiens
cccctgccactcaccc

SEQ ID NO: 1220836 - DNA, 17 bp, Homo sapiens
cccctgccactcaccct

SEQ ID NO: 1220837 - DNA, 14 bp, Homo sapiens
cccctgccagggca

SEQ ID NO: 1220838 - DNA, 14 bp, Homo sapiens
cccctgccagtgcc

SEQ ID NO: 1220839 - DNA, 16 bp, Homo sapiens
cccctgccagtgcctt

SEQ ID NO: 1220840 - DNA, 12 bp, Homo sapiens
cccctgccccca

SEQ ID NO: 1220841 - DNA, 14 bp, Homo sapiens
cccctgccccgtca

SEQ ID NO: 1220842 - DNA, 15 bp, Homo sapiens
cccctgccccgtcac

SEQ ID NO: 1220843 - DNA, 23 bp, Homo sapiens
cccctgccctcccctctctgcac

SEQ ID NO: 1220844 - DNA, 21 bp, Homo sapiens
cccctgccctcgtggccagcc

SEQ ID NO: 1220845 - DNA, 12 bp, Homo sapiens
cccctgccctgc

SEQ ID NO: 1220846 - DNA, 20 bp, Homo sapiens
cccctgccctgtgccgcact

SEQ ID NO: 1220847 - DNA, 14 bp, Homo sapiens
cccctgcctcgagg

SEQ ID NO: 1220848 - DNA, 15 bp, Homo sapiens
cccctgcctcgaggg

SEQ ID NO: 1220849 - DNA, 19 bp, Homo sapiens
cccctgcctcgagggccgc

SEQ ID NO: 1220850 - DNA, 21 bp, Homo sapiens
cccctgcctcgagggccgcct

SEQ ID NO: 1220851 - DNA, 15 bp, Homo sapiens
cccctgcctgacagc

SEQ ID NO: 1220852 - DNA, 16 bp, Homo sapiens
cccctgcctgccatgt

SEQ ID NO: 1220853 - DNA, 14 bp, Homo sapiens
cccctgcctggaac

SEQ ID NO: 1220854 - DNA, 15 bp, Homo sapiens
cccctgcctggaact

SEQ ID NO: 1220855 - DNA, 11 bp, Homo sapiens
cccctgccttc

SEQ ID NO: 1220856 - DNA, 12 bp, Homo sapiens
cccctgccttcc

SEQ ID NO: 1220857 - DNA, 14 bp, Homo sapiens
cccctgccttcctc

SEQ ID NO: 1220858 - DNA, 22 bp, Homo sapiens
cccctgcgggcgcgggcagcca

SEQ ID NO: 1220859 - DNA, 19 bp, Homo sapiens
cccctgctccaccagcagc

SEQ ID NO: 1220860 - DNA, 20 bp, Homo sapiens
cccctgctccaccagcagca

SEQ ID NO: 1220861 - DNA, 21 bp, Homo sapiens
cccctgctcccattcctccct

SEQ ID NO: 1220862 - DNA, 14 bp, Homo sapiens
cccctgctgacctt

SEQ ID NO: 1220863 - DNA, 14 bp, Homo sapiens
cccctgctgcctcc

SEQ ID NO: 1220864 - DNA, 18 bp, Homo sapiens
cccctgctgcctccccaa

SEQ ID NO: 1220865 - DNA, 16 bp, Homo sapiens
cccctgctgcttggga

SEQ ID NO: 1220866 - DNA, 14 bp, Homo sapiens
cccctgctgtctct

SEQ ID NO: 1220867 - DNA, 18 bp, Homo sapiens
cccctgctgtctctctgg

SEQ ID NO: 1220868 - DNA, 15 bp, Homo sapiens
cccctgctgtgctgc

SEQ ID NO: 1220869 - DNA, 22 bp, Homo sapiens
cccctggaagagcccagtctgt

SEQ ID NO: 1220870 - DNA, 20 bp, Homo sapiens
cccctggaccaccagcccca

SEQ ID NO: 1220871 - DNA, 15 bp, Homo sapiens
cccctggacctggga

SEQ ID NO: 1220872 - DNA, 15 bp, Homo sapiens
cccctggactgggag

SEQ ID NO: 1220873 - DNA, 20 bp, Homo sapiens
cccctggagtgtgtcagagc

SEQ ID NO: 1220874 - DNA, 22 bp, Homo sapiens
cccctggatgggcattgggctg

SEQ ID NO: 1220875 - DNA, 23 bp, Homo sapiens
cccctggcaatcccaccaaatca

SEQ ID NO: 1220876 - DNA, 19 bp, Homo sapiens
cccctggcagcacagccca

SEQ ID NO: 1220877 - DNA, 15 bp, Homo sapiens
cccctggcagctgcc

SEQ ID NO: 1220878 - DNA, 19 bp, Homo sapiens
cccctggcagctgcccctc

SEQ ID NO: 1220879 - DNA, 22 bp, Homo sapiens
cccctggcagctgcccctcctg

SEQ ID NO: 1220880 - DNA, 11 bp, Homo sapiens
cccctggcctc

SEQ ID NO: 1220881 - DNA, 14 bp, Homo sapiens
cccctggcctctgt

SEQ ID NO: 1220882 - DNA, 11 bp, Homo sapiens
cccctggctct

SEQ ID NO: 1220883 - DNA, 17 bp, Homo sapiens
cccctggctctgggccg

SEQ ID NO: 1220884 - DNA, 23 bp, Homo sapiens
cccctggcttttcactgctggct

SEQ ID NO: 1220885 - DNA, 13 bp, Homo sapiens
cccctgggcagat

SEQ ID NO: 1220886 - DNA, 20 bp, Homo sapiens
cccctgggcatcttctggct

SEQ ID NO: 1220887 - DNA, 12 bp, Homo sapiens
cccctgggccct

SEQ ID NO: 1220888 - DNA, 21 bp, Homo sapiens
cccctgggctctgccccagct

SEQ ID NO: 1220889 - DNA, 19 bp, Homo sapiens
cccctgggcttggcctgct

SEQ ID NO: 1220890 - DNA, 21 bp, Homo sapiens
cccctgggcttggcctgctgt

SEQ ID NO: 1220891 - DNA, 23 bp, Homo sapiens
cccctgggcttggcctgctgtga

SEQ ID NO: 1220892 - DNA, 14 bp, Homo sapiens
cccctggggacaga

SEQ ID NO: 1220893 - DNA, 14 bp, Homo sapiens
cccctggggcccag

SEQ ID NO: 1220894 - DNA, 13 bp, Homo sapiens
cccctggggtggc

SEQ ID NO: 1220895 - DNA, 19 bp, Homo sapiens
cccctggggtggccagggc

SEQ ID NO: 1220896 - DNA, 15 bp, Homo sapiens
cccctggtggacagt

SEQ ID NO: 1220897 - DNA, 22 bp, Homo sapiens
cccctggtggacagtcctggga

SEQ ID NO: 1220898 - DNA, 23 bp, Homo sapiens
cccctggtggacagtcctgggag

SEQ ID NO: 1220899 - DNA, 18 bp, Homo sapiens
cccctgtacatttgtgct

SEQ ID NO: 1220900 - DNA, 20 bp, Homo sapiens
cccctgtagactagtgccgt

SEQ ID NO: 1220901 - DNA, 15 bp, Homo sapiens
cccctgtaggcctca

SEQ ID NO: 1220902 - DNA, 23 bp, Homo sapiens
cccctgtagggaaaccttggaga

SEQ ID NO: 1220903 - DNA, 13 bp, Homo sapiens
cccctgtcagttt

SEQ ID NO: 1220904 - DNA, 17 bp, Homo sapiens
cccctgtcccaccaact

SEQ ID NO: 1220905 - DNA, 20 bp, Homo sapiens
cccctgtcccaccaactctg

SEQ ID NO: 1220906 - DNA, 16 bp, Homo sapiens
cccctgtcccacctgg

SEQ ID NO: 1220907 - DNA, 17 bp, Homo sapiens
ccccttccccagccctt

SEQ ID NO: 1220908 - DNA, 15 bp, Homo sapiens
ccccttccccgtccc

SEQ ID NO: 1220909 - DNA, 14 bp, Homo sapiens
ccccttcccctgct

SEQ ID NO: 1220910 - DNA, 15 bp, Homo sapiens
ccccttcccctgctg

SEQ ID NO: 1220911 - DNA, 16 bp, Homo sapiens
ccccttcccctgctga

SEQ ID NO: 1220912 - DNA, 17 bp, Homo sapiens
ccccttcccgccttcca

SEQ ID NO: 1220913 - DNA, 13 bp, Homo sapiens
ccccttccctggg

SEQ ID NO: 1220914 - DNA, 19 bp, Homo sapiens
ccccttccctggggagccc

SEQ ID NO: 1220915 - DNA, 21 bp, Homo sapiens
ccccttcctaattccacagct

SEQ ID NO: 1220916 - DNA, 18 bp, Homo sapiens
ccccttcctggacacact

SEQ ID NO: 1220917 - DNA, 20 bp, Homo sapiens
ccccttcctggacacactct

SEQ ID NO: 1220918 - DNA, 15 bp, Homo sapiens
ccccttcctgtcctg

SEQ ID NO: 1220919 - DNA, 19 bp, Homo sapiens
ccccttcctgtcctgcctc

SEQ ID NO: 1220920 - DNA, 20 bp, Homo sapiens
ccccttcctgtcctgcctcc

SEQ ID NO: 1220921 - DNA, 23 bp, Homo sapiens
ccccttcctgtcctgcctcctca

SEQ ID NO: 1220922 - DNA, 15 bp, Homo sapiens
ccccttcctgtttca

SEQ ID NO: 1220923 - DNA, 17 bp, Homo sapiens
ccccttcctgtttcaga

SEQ ID NO: 1220924 - DNA, 20 bp, Homo sapiens
ccccttcctgtttcagaccc

SEQ ID NO: 1220925 - DNA, 21 bp, Homo sapiens
ccccttcctttcctctgcagc

SEQ ID NO: 1220926 - DNA, 23 bp, Homo sapiens
ccccttcctttcctctgcagcac

SEQ ID NO: 1220927 - DNA, 14 bp, Homo sapiens
ccccttctcccctt

SEQ ID NO: 1220928 - DNA, 13 bp, Homo sapiens
ccccttctctctc

SEQ ID NO: 1220929 - DNA, 13 bp, Homo sapiens
ccccttctctgct

SEQ ID NO: 1220930 - DNA, 19 bp, Homo sapiens
ccccttctgctcagctctg

SEQ ID NO: 1220931 - DNA, 21 bp, Homo sapiens
ccccttctgctcagctctggg

SEQ ID NO: 1220932 - DNA, 13 bp, Homo sapiens
ccccttcttcccg

SEQ ID NO: 1220933 - DNA, 19 bp, Homo sapiens
ccccttcttcctcccctca

SEQ ID NO: 1220934 - DNA, 12 bp, Homo sapiens
ccccttgaagca

SEQ ID NO: 1220935 - DNA, 19 bp, Homo sapiens
ccccttgaagcaataactc

SEQ ID NO: 1220936 - DNA, 20 bp, Homo sapiens
ccccttgaggattgtggaaa

SEQ ID NO: 1220937 - DNA, 21 bp, Homo sapiens
ccccttgatttaaacacacag

SEQ ID NO: 1220938 - DNA, 15 bp, Homo sapiens
ccccttgcagcctgg

SEQ ID NO: 1220939 - DNA, 18 bp, Homo sapiens
ccccttgcagcctggtca

SEQ ID NO: 1220940 - DNA, 20 bp, Homo sapiens
ccccttgcccagggctcagc

SEQ ID NO: 1220941 - DNA, 17 bp, Homo sapiens
ccccttgccctccgcct

SEQ ID NO: 1220942 - DNA, 21 bp, Homo sapiens
ccccttgcccttgccctgacc

SEQ ID NO: 1220943 - DNA, 14 bp, Homo sapiens
ccccttggacctcc

SEQ ID NO: 1220944 - DNA, 13 bp, Homo sapiens
ccccttggagaga

SEQ ID NO: 1220945 - DNA, 16 bp, Homo sapiens
ccccttgggcatccac

SEQ ID NO: 1220946 - DNA, 15 bp, Homo sapiens
ccccttgggcggctg

SEQ ID NO: 1220947 - DNA, 15 bp, Homo sapiens
ccccttgtcctttcc

SEQ ID NO: 1220948 - DNA, 13 bp, Homo sapiens
ccccttgtctccc

SEQ ID NO: 1220949 - DNA, 22 bp, Homo sapiens
ccccttgtgggcaaaggcaggg

SEQ ID NO: 1220950 - DNA, 17 bp, Homo sapiens
ccccttgttgcactgcc

SEQ ID NO: 1220951 - DNA, 19 bp, Homo sapiens
ccccttgttgcactgcccc

SEQ ID NO: 1220952 - DNA, 19 bp, Homo sapiens
cccctttaaatcaccatag

SEQ ID NO: 1220953 - DNA, 13 bp, Homo sapiens
cccctttcctaaa

SEQ ID NO: 1220954 - DNA, 19 bp, Homo sapiens
cccctttcctccccataca

SEQ ID NO: 1220955 - DNA, 13 bp, Homo sapiens
cccctttcctgtc

SEQ ID NO: 1220956 - DNA, 21 bp, Homo sapiens
cccctttccttcactgcccca

SEQ ID NO: 1220957 - DNA, 15 bp, Homo sapiens
cccctttgaccttcc

SEQ ID NO: 1220958 - DNA, 20 bp, Homo sapiens
cccctttgatgattaattca

SEQ ID NO: 1220959 - DNA, 15 bp, Homo sapiens
cccctttgcctctgt

SEQ ID NO: 1220960 - DNA, 15 bp, Homo sapiens
cccctttgtcctgcg

SEQ ID NO: 1220961 - DNA, 18 bp, Homo sapiens
ccccttttacttttttat

SEQ ID NO: 1220962 - DNA, 18 bp, Homo sapiens
ccccttttctctgctctt

SEQ ID NO: 1220963 - DNA, 14 bp, Homo sapiens
ccccttttctgcat

SEQ ID NO: 1220964 - DNA, 23 bp, Homo sapiens
ccccttttcttttctaccctagc

SEQ ID NO: 1220965 - DNA, 16 bp, Homo sapiens
ccccttttgcctggct

SEQ ID NO: 1220966 - DNA, 18 bp, Homo sapiens
ccccttttgcctggctgt

SEQ ID NO: 1220967 - DNA, 23 bp, Homo sapiens
ccccttttgtgggtttctctgtg

SEQ ID NO: 1220968 - DNA, 20 bp, Homo sapiens
ccccttttttgtcccccaac

SEQ ID NO: 1220969 - DNA, 13 bp, Homo sapiens
cccgaaagcatca

SEQ ID NO: 1220970 - DNA, 20 bp, Homo sapiens
cccgaaagcatcactgcctt

SEQ ID NO: 1220971 - DNA, 20 bp, Homo sapiens
cccgaaatcagcccccagcc

SEQ ID NO: 1220972 - DNA, 17 bp, Homo sapiens
cccgaagccatcacttc

SEQ ID NO: 1220973 - DNA, 18 bp, Homo sapiens
cccgaagccatcacttct

SEQ ID NO: 1220974 - DNA, 21 bp, Homo sapiens
cccgaagccatcacttctccc

SEQ ID NO: 1220975 - DNA, 14 bp, Homo sapiens
cccgaagtcctgtc

SEQ ID NO: 1220976 - DNA, 16 bp, Homo sapiens
cccgaagtcctgtcac

SEQ ID NO: 1220977 - DNA, 23 bp, Homo sapiens
cccgaagtcctgtcactgagcac

SEQ ID NO: 1220978 - DNA, 23 bp, Homo sapiens
cccgaattctatttttgtccttg

SEQ ID NO: 1220979 - DNA, 17 bp, Homo sapiens
cccgaatttagtcacac

SEQ ID NO: 1220980 - DNA, 14 bp, Homo sapiens
cccgacagcctggc

SEQ ID NO: 1220981 - DNA, 13 bp, Homo sapiens
cccgacaggtggg

SEQ ID NO: 1220982 - DNA, 17 bp, Homo sapiens
cccgacagtgccatccc

SEQ ID NO: 1220983 - DNA, 20 bp, Homo sapiens
cccgacatggacccggagct

SEQ ID NO: 1220984 - DNA, 16 bp, Homo sapiens
cccgaccaatccccag

SEQ ID NO: 1220985 - DNA, 11 bp, Homo sapiens
cccgaccaggt

SEQ ID NO: 1220986 - DNA, 21 bp, Homo sapiens
cccgacccagccagctgcagg

SEQ ID NO: 1220987 - DNA, 22 bp, Homo sapiens
cccgaccgtatacttaaaatga

SEQ ID NO: 1220988 - DNA, 14 bp, Homo sapiens
cccgacggcctcca

SEQ ID NO: 1220989 - DNA, 15 bp, Homo sapiens
cccgacggcctccag

SEQ ID NO: 1220990 - DNA, 13 bp, Homo sapiens
cccgactgcctgt

SEQ ID NO: 1220991 - DNA, 21 bp, Homo sapiens
cccgacttcttttgaaatgtg

SEQ ID NO: 1220992 - DNA, 21 bp, Homo sapiens
cccgagcccagctacattcct

SEQ ID NO: 1220993 - DNA, 17 bp, Homo sapiens
cccgagcccaggcagct

SEQ ID NO: 1220994 - DNA, 11 bp, Homo sapiens
cccgagccctg

SEQ ID NO: 1220995 - DNA, 22 bp, Homo sapiens
cccgagctgggggccatgagct

SEQ ID NO: 1220996 - DNA, 12 bp, Homo sapiens
cccgagctggtg

SEQ ID NO: 1220997 - DNA, 14 bp, Homo sapiens
cccgagctgtcccc

SEQ ID NO: 1220998 - DNA, 18 bp, Homo sapiens
cccgaggaagcacagctt

SEQ ID NO: 1220999 - DNA, 22 bp, Homo sapiens
cccgaggaagcacagcttgggt

SEQ ID NO: 1221000 - DNA, 13 bp, Homo sapiens
cccgaggcccaga

SEQ ID NO: 1221001 - DNA, 13 bp, Homo sapiens
cccgaggctgccc

SEQ ID NO: 1221002 - DNA, 20 bp, Homo sapiens
cccgaggctgccccaggccg

SEQ ID NO: 1221003 - DNA, 15 bp, Homo sapiens
cccgagggagctgct

SEQ ID NO: 1221004 - DNA, 12 bp, Homo sapiens
cccgagggctga

SEQ ID NO: 1221005 - DNA, 17 bp, Homo sapiens
cccgagggctgaggagc

SEQ ID NO: 1221006 - DNA, 15 bp, Homo sapiens
cccgaggggagggca

SEQ ID NO: 1221007 - DNA, 18 bp, Homo sapiens
cccgaggttgtggggagg

SEQ ID NO: 1221008 - DNA, 14 bp, Homo sapiens
cccgagtacctcca

SEQ ID NO: 1221009 - DNA, 20 bp, Homo sapiens
cccgatccccgacagtggct

SEQ ID NO: 1221010 - DNA, 20 bp, Homo sapiens
cccgatgctgctttcccctg

SEQ ID NO: 1221011 - DNA, 20 bp, Homo sapiens
cccgatgtcgacatgttttt

SEQ ID NO: 1221012 - DNA, 12 bp, Homo sapiens
cccgcacacctg

SEQ ID NO: 1221013 - DNA, 12 bp, Homo sapiens
cccgcaccccag

SEQ ID NO: 1221014 - DNA, 13 bp, Homo sapiens
cccgcactgcaga

SEQ ID NO: 1221015 - DNA, 15 bp, Homo sapiens
cccgcactgcagacg

SEQ ID NO: 1221016 - DNA, 12 bp, Homo sapiens
cccgcagaggca

SEQ ID NO: 1221017 - DNA, 21 bp, Homo sapiens
cccgcagcccgcctgccgtgc

SEQ ID NO: 1221018 - DNA, 22 bp, Homo sapiens
cccgcagcccgtgaagcagtgc

SEQ ID NO: 1221019 - DNA, 20 bp, Homo sapiens
cccgcagcctggcatctgtg

SEQ ID NO: 1221020 - DNA, 18 bp, Homo sapiens
cccgcaggaactgggctg

SEQ ID NO: 1221021 - DNA, 18 bp, Homo sapiens
cccgcagggccatgcaga

SEQ ID NO: 1221022 - DNA, 19 bp, Homo sapiens
cccgcagtccccagccctt

SEQ ID NO: 1221023 - DNA, 14 bp, Homo sapiens
cccgccaaccctgc

SEQ ID NO: 1221024 - DNA, 23 bp, Homo sapiens
cccgccacatggtgtggccatca

SEQ ID NO: 1221025 - DNA, 12 bp, Homo sapiens
cccgccagcccc

SEQ ID NO: 1221026 - DNA, 12 bp, Homo sapiens
cccgccagggct

SEQ ID NO: 1221027 - DNA, 16 bp, Homo sapiens
cccgccagggctgggg

SEQ ID NO: 1221028 - DNA, 12 bp, Homo sapiens
cccgcccactgt

SEQ ID NO: 1221029 - DNA, 13 bp, Homo sapiens
cccgccccacagg

SEQ ID NO: 1221030 - DNA, 15 bp, Homo sapiens
cccgccccacattcc

SEQ ID NO: 1221031 - DNA, 14 bp, Homo sapiens
cccgccccacctcc

SEQ ID NO: 1221032 - DNA, 15 bp, Homo sapiens
ccctaggttccctgt

SEQ ID NO: 1221033 - DNA, 16 bp, Homo sapiens
ccctagtcccttcccc

SEQ ID NO: 1221034 - DNA, 22 bp, Homo sapiens
ccctagtcccttcccctccctg

SEQ ID NO: 1221035 - DNA, 16 bp, Homo sapiens
ccctatacactagaca

SEQ ID NO: 1221036 - DNA, 18 bp, Homo sapiens
ccctatagcactgagctc

SEQ ID NO: 1221037 - DNA, 23 bp, Homo sapiens
ccctatagtttcaccactcctct

SEQ ID NO: 1221038 - DNA, 18 bp, Homo sapiens
ccctatccacccagccca

SEQ ID NO: 1221039 - DNA, 19 bp, Homo sapiens
ccctatccacccagcccat

SEQ ID NO: 1221040 - DNA, 22 bp, Homo sapiens
ccctatcccattctccctctca

SEQ ID NO: 1221041 - DNA, 14 bp, Homo sapiens
ccctatcctctgag

SEQ ID NO: 1221042 - DNA, 23 bp, Homo sapiens
ccctatctaaccctcccatggca

SEQ ID NO: 1221043 - DNA, 20 bp, Homo sapiens
ccctatctattaaagtgact

SEQ ID NO: 1221044 - DNA, 22 bp, Homo sapiens
ccctatctattaaagtgacttt

SEQ ID NO: 1221045 - DNA, 15 bp, Homo sapiens
ccctatctcctgaca

SEQ ID NO: 1221046 - DNA, 17 bp, Homo sapiens
ccctatcttgtcctgga

SEQ ID NO: 1221047 - DNA, 18 bp, Homo sapiens
ccctatggctgagccttg

SEQ ID NO: 1221048 - DNA, 19 bp, Homo sapiens
ccctatggggaggccctgc

SEQ ID NO: 1221049 - DNA, 15 bp, Homo sapiens
ccctattccctaact

SEQ ID NO: 1221050 - DNA, 15 bp, Homo sapiens
ccctatttattgact

SEQ ID NO: 1221051 - DNA, 17 bp, Homo sapiens
ccctatttattgacttt

SEQ ID NO: 1221052 - DNA, 18 bp, Homo sapiens
ccctatttattgactttg

SEQ ID NO: 1221053 - DNA, 21 bp, Homo sapiens
ccctcaaacctcctcttctga

SEQ ID NO: 1221054 - DNA, 19 bp, Homo sapiens
ccctcaaatgacccaaaga

SEQ ID NO: 1221055 - DNA, 15 bp, Homo sapiens
ccctcaaatgtcaga

SEQ ID NO: 1221056 - DNA, 18 bp, Homo sapiens
ccctcaaatgtcagagct

SEQ ID NO: 1221057 - DNA, 16 bp, Homo sapiens
ccctcaacctcttctg

SEQ ID NO: 1221058 - DNA, 17 bp, Homo sapiens
ccctcaagaggaagtga

SEQ ID NO: 1221059 - DNA, 16 bp, Homo sapiens
ccctcaaggggcaggg

SEQ ID NO: 1221060 - DNA, 17 bp, Homo sapiens
ccctcacacacacagct

SEQ ID NO: 1221061 - DNA, 22 bp, Homo sapiens
ccctcacacacacagctgggca

SEQ ID NO: 1221062 - DNA, 20 bp, Homo sapiens
ccctcacacacaccccccca

SEQ ID NO: 1221063 - DNA, 21 bp, Homo sapiens
ccctcacacacacccccccac

SEQ ID NO: 1221064 - DNA, 14 bp, Homo sapiens
ccctcacatcctct

SEQ ID NO: 1221065 - DNA, 15 bp, Homo sapiens
ccctcacatcctctc

SEQ ID NO: 1221066 - DNA, 19 bp, Homo sapiens
ccctcacatcctctccagg

SEQ ID NO: 1221067 - DNA, 20 bp, Homo sapiens
ccctcacatcctctccagga

SEQ ID NO: 1221068 - DNA, 12 bp, Homo sapiens
ccctcacccact

SEQ ID NO: 1221069 - DNA, 15 bp, Homo sapiens
ccctcacccactctg

SEQ ID NO: 1221070 - DNA, 13 bp, Homo sapiens
ccctcaccccaag

SEQ ID NO: 1221071 - DNA, 17 bp, Homo sapiens
ccctcaccccagctccg

SEQ ID NO: 1221072 - DNA, 14 bp, Homo sapiens
ccctcacctcctct

SEQ ID NO: 1221073 - DNA, 12 bp, Homo sapiens
ccctcacctctg

SEQ ID NO: 1221074 - DNA, 13 bp, Homo sapiens
ccctcacctctga

SEQ ID NO: 1221075 - DNA, 13 bp, Homo sapiens
ccctcacctgcag

SEQ ID NO: 1221076 - DNA, 17 bp, Homo sapiens
ccctcacctgcagagaa

SEQ ID NO: 1221077 - DNA, 14 bp, Homo sapiens
ccctcacctgggca

SEQ ID NO: 1221078 - DNA, 15 bp, Homo sapiens
ccctcacctgggcac

SEQ ID NO: 1221079 - DNA, 19 bp, Homo sapiens
ccctcacctgggcctttcc

SEQ ID NO: 1221080 - DNA, 18 bp, Homo sapiens
ccctcaccttgcaacaca

SEQ ID NO: 1221081 - DNA, 17 bp, Homo sapiens
ccctcacgtttcttccc

SEQ ID NO: 1221082 - DNA, 16 bp, Homo sapiens
ccctcactccccaggg

SEQ ID NO: 1221083 - DNA, 17 bp, Homo sapiens
ccctcactgctggggag

SEQ ID NO: 1221084 - DNA, 19 bp, Homo sapiens
ccctcactggctctcctgg

SEQ ID NO: 1221085 - DNA, 22 bp, Homo sapiens
ccctcagatgatctctccacgg

SEQ ID NO: 1221086 - DNA, 23 bp, Homo sapiens
ccctcagatgcgttcgcctctgg

SEQ ID NO: 1221087 - DNA, 14 bp, Homo sapiens
ccctcagatgtccc

SEQ ID NO: 1221088 - DNA, 21 bp, Homo sapiens
ccctcagcaccccttccatgt

SEQ ID NO: 1221089 - DNA, 16 bp, Homo sapiens
ccctcagccctggcct

SEQ ID NO: 1221090 - DNA, 15 bp, Homo sapiens
ccctcagcctgccca

SEQ ID NO: 1221091 - DNA, 20 bp, Homo sapiens
ccctcagcctgcccacctct

SEQ ID NO: 1221092 - DNA, 21 bp, Homo sapiens
ccctcagcctgcccacctctc

SEQ ID NO: 1221093 - DNA, 18 bp, Homo sapiens
ccctcaggcataggcctg

SEQ ID NO: 1221094 - DNA, 22 bp, Homo sapiens
ccctcaggcataggcctgggtg

SEQ ID NO: 1221095 - DNA, 12 bp, Homo sapiens
ccctcaggccac

SEQ ID NO: 1221096 - DNA, 17 bp, Homo sapiens
ccctcagggactgcacc

SEQ ID NO: 1221097 - DNA, 20 bp, Homo sapiens
ccctcagggactgcaccctg

SEQ ID NO: 1221098 - DNA, 15 bp, Homo sapiens
ccctcaggggcaggt

SEQ ID NO: 1221099 - DNA, 19 bp, Homo sapiens
ccctcagggggccagctgg

SEQ ID NO: 1221100 - DNA, 15 bp, Homo sapiens
ccctcaggttccttt

SEQ ID NO: 1221101 - DNA, 13 bp, Homo sapiens
ccctcagtcaccc

SEQ ID NO: 1221102 - DNA, 19 bp, Homo sapiens
ccctcagtcacccccactt

SEQ ID NO: 1221103 - DNA, 18 bp, Homo sapiens
ccctcatcccacttcctt

SEQ ID NO: 1221104 - DNA, 13 bp, Homo sapiens
ccctcatctctcc

SEQ ID NO: 1221105 - DNA, 16 bp, Homo sapiens
ccctcatggcccctct

SEQ ID NO: 1221106 - DNA, 17 bp, Homo sapiens
ccctcattactgggcct

SEQ ID NO: 1221107 - DNA, 13 bp, Homo sapiens
ccctcattcagag

SEQ ID NO: 1221108 - DNA, 18 bp, Homo sapiens
ccctcattcagagactgc

SEQ ID NO: 1221109 - DNA, 20 bp, Homo sapiens
ccctcattcagagactgccc

SEQ ID NO: 1221110 - DNA, 16 bp, Homo sapiens
ccctcattcaggaaaa

SEQ ID NO: 1221111 - DNA, 16 bp, Homo sapiens
ccctcattcatcttgc

SEQ ID NO: 1221112 - DNA, 17 bp, Homo sapiens
ccctcattgctgtcttg

SEQ ID NO: 1221113 - DNA, 21 bp, Homo sapiens
ccctcattgctgtcttgcccc

SEQ ID NO: 1221114 - DNA, 23 bp, Homo sapiens
ccctcattgctgtcttgccccag

SEQ ID NO: 1221115 - DNA, 16 bp, Homo sapiens
ccctcatttttccttt

SEQ ID NO: 1221116 - DNA, 15 bp, Homo sapiens
ccctccaaacctcca

SEQ ID NO: 1221117 - DNA, 23 bp, Homo sapiens
ccctccaaacctccagcctccct

SEQ ID NO: 1221118 - DNA, 11 bp, Homo sapiens
ccctccaaaga

SEQ ID NO: 1221119 - DNA, 14 bp, Homo sapiens
ccctccaagcctgg

SEQ ID NO: 1221120 - DNA, 18 bp, Homo sapiens
ccctccaagcctggcacc

SEQ ID NO: 1221121 - DNA, 19 bp, Homo sapiens
ccctccaagcctggcaccc

SEQ ID NO: 1221122 - DNA, 15 bp, Homo sapiens
ccctccacagctgca

SEQ ID NO: 1221123 - DNA, 13 bp, Homo sapiens
ccctccacatccc

SEQ ID NO: 1221124 - DNA, 15 bp, Homo sapiens
ccctccaccagcctg

SEQ ID NO: 1221125 - DNA, 16 bp, Homo sapiens
ccctccaccagcctgc

SEQ ID NO: 1221126 - DNA, 19 bp, Homo sapiens
ccctccaccagcctgctga

SEQ ID NO: 1221127 - DNA, 20 bp, Homo sapiens
ccctccaccagcctgctgac

SEQ ID NO: 1221128 - DNA, 16 bp, Homo sapiens
ccctccaccccacaga

SEQ ID NO: 1221129 - DNA, 13 bp, Homo sapiens
ccctccaccccag

SEQ ID NO: 1221130 - DNA, 22 bp, Homo sapiens
ccctccaccccccactcagtgc

SEQ ID NO: 1221131 - DNA, 22 bp, Homo sapiens
ccctccaccctgtcccccagct

SEQ ID NO: 1221132 - DNA, 23 bp, Homo sapiens
ccctccacggtccgcggcctgca

SEQ ID NO: 1221133 - DNA, 15 bp, Homo sapiens
ccctccagaccctgc

SEQ ID NO: 1221134 - DNA, 18 bp, Homo sapiens
ccctccagaccctgcctg

SEQ ID NO: 1221135 - DNA, 13 bp, Homo sapiens
ccctccagagaca

SEQ ID NO: 1221136 - DNA, 16 bp, Homo sapiens
ccctccataagtttaa

SEQ ID NO: 1221137 - DNA, 15 bp, Homo sapiens
ccctccatccccatc

SEQ ID NO: 1221138 - DNA, 15 bp, Homo sapiens
ccctccatcccgaca

SEQ ID NO: 1221139 - DNA, 22 bp, Homo sapiens
ccctccattgggcacagtccag

SEQ ID NO: 1221140 - DNA, 23 bp, Homo sapiens
ccctccattgggcacagtccaga

SEQ ID NO: 1221141 - DNA, 13 bp, Homo sapiens
ccctcccaacagc

SEQ ID NO: 1221142 - DNA, 12 bp, Homo sapiens
ccctcccaacct

SEQ ID NO: 1221143 - DNA, 18 bp, Homo sapiens
ccctcccaacctcaatgc

SEQ ID NO: 1221144 - DNA, 17 bp, Homo sapiens
ccctcccaccacagcag

SEQ ID NO: 1221145 - DNA, 15 bp, Homo sapiens
ccctcccaccacccc

SEQ ID NO: 1221146 - DNA, 12 bp, Homo sapiens
ccctcccacccc

SEQ ID NO: 1221147 - DNA, 15 bp, Homo sapiens
ccctcccacccccag

SEQ ID NO: 1221148 - DNA, 16 bp, Homo sapiens
ccctcccacccccagc

SEQ ID NO: 1221149 - DNA, 17 bp, Homo sapiens
ccctcccacccccagcc

SEQ ID NO: 1221150 - DNA, 10 bp, Homo sapiens
ccctcccact

SEQ ID NO: 1221151 - DNA, 15 bp, Homo sapiens
ccctcccactttgct

SEQ ID NO: 1221152 - DNA, 13 bp, Homo sapiens
ccctcccagacag

SEQ ID NO: 1221153 - DNA, 18 bp, Homo sapiens
ccctcccagacaggccct

SEQ ID NO: 1221154 - DNA, 15 bp, Homo sapiens
ccctcccagctgcac

SEQ ID NO: 1221155 - DNA, 14 bp, Homo sapiens
ccctcccaggggag

SEQ ID NO: 1221156 - DNA, 16 bp, Homo sapiens
ccctcccatcctccag

SEQ ID NO: 1221157 - DNA, 11 bp, Homo sapiens
ccctcctctgc

SEQ ID NO: 1221158 - DNA, 13 bp, Homo sapiens
ccctcctctgcca

SEQ ID NO: 1221159 - DNA, 22 bp, Homo sapiens
ccctcctcttcccttagcctct

SEQ ID NO: 1221160 - DNA, 13 bp, Homo sapiens
ccctcctcttgga

SEQ ID NO: 1221161 - DNA, 22 bp, Homo sapiens
ccctcctgaaccgcacagctca

SEQ ID NO: 1221162 - DNA, 23 bp, Homo sapiens
ccctcctgaaccgcacagctcag

SEQ ID NO: 1221163 - DNA, 20 bp, Homo sapiens
ccctcctgcacacagggcag

SEQ ID NO: 1221164 - DNA, 15 bp, Homo sapiens
ccctcctgcccagga

SEQ ID NO: 1221165 - DNA, 20 bp, Homo sapiens
ccctcctgccgactcctggg

SEQ ID NO: 1221166 - DNA, 12 bp, Homo sapiens
ccctcctgctcc

SEQ ID NO: 1221167 - DNA, 13 bp, Homo sapiens
ccctcctgctcct

SEQ ID NO: 1221168 - DNA, 14 bp, Homo sapiens
ccctcctgctcctc

SEQ ID NO: 1221169 - DNA, 17 bp, Homo sapiens
ccctcctgctcctccct

SEQ ID NO: 1221170 - DNA, 15 bp, Homo sapiens
ccctcctgctgggcg

SEQ ID NO: 1221171 - DNA, 20 bp, Homo sapiens
ccctcctggagctctgtggg

SEQ ID NO: 1221172 - DNA, 11 bp, Homo sapiens
ccctcctggca

SEQ ID NO: 1221173 - DNA, 15 bp, Homo sapiens
ccctcctggccttcc

SEQ ID NO: 1221174 - DNA, 17 bp, Homo sapiens
ccctcctggccttcctc

SEQ ID NO: 1221175 - DNA, 19 bp, Homo sapiens
ccctcctggccttcctcgt

SEQ ID NO: 1221176 - DNA, 16 bp, Homo sapiens
ccctcctggtcctgga

SEQ ID NO: 1221177 - DNA, 18 bp, Homo sapiens
ccctcctggtcctggaca

SEQ ID NO: 1221178 - DNA, 16 bp, Homo sapiens
ccctccttccctcctg

SEQ ID NO: 1221179 - DNA, 14 bp, Homo sapiens
ccctccttctcctt

SEQ ID NO: 1221180 - DNA, 18 bp, Homo sapiens
ccctccttgcaaccaggc

SEQ ID NO: 1221181 - DNA, 20 bp, Homo sapiens
ccctccttgcaaccaggcag

SEQ ID NO: 1221182 - DNA, 14 bp, Homo sapiens
ccctccttgggcac

SEQ ID NO: 1221183 - DNA, 16 bp, Homo sapiens
ccctccttgggcactt

SEQ ID NO: 1221184 - DNA, 18 bp, Homo sapiens
ccctccttgtgccttctt

SEQ ID NO: 1221185 - DNA, 15 bp, Homo sapiens
ccctcctttccctta

SEQ ID NO: 1221186 - DNA, 18 bp, Homo sapiens
ccctcctttcccttattg

SEQ ID NO: 1221187 - DNA, 22 bp, Homo sapiens
ccctcctttcccttattgcctc

SEQ ID NO: 1221188 - DNA, 22 bp, Homo sapiens
ccctcgaaccaaggcagcctcc

SEQ ID NO: 1221189 - DNA, 17 bp, Homo sapiens
ccctcgactcagcacca

SEQ ID NO: 1221190 - DNA, 22 bp, Homo sapiens
ccctcgacttgaccctttcctc

SEQ ID NO: 1221191 - DNA, 13 bp, Homo sapiens
ccctcgaggccta

SEQ ID NO: 1221192 - DNA, 21 bp, Homo sapiens
ccctcgaggcctacagaggag

SEQ ID NO: 1221193 - DNA, 21 bp, Homo sapiens
ccctcgatcatatttcccctt

SEQ ID NO: 1221194 - DNA, 18 bp, Homo sapiens
ccctcgcacacagggctc

SEQ ID NO: 1221195 - DNA, 21 bp, Homo sapiens
ccctcgcacacagggctcaca

SEQ ID NO: 1221196 - DNA, 23 bp, Homo sapiens
ccctcgcacacagggctcacagg

SEQ ID NO: 1221197 - DNA, 22 bp, Homo sapiens
ccctcgcagacctaagccctgc

SEQ ID NO: 1221198 - DNA, 16 bp, Homo sapiens
ccctcgccacctttca

SEQ ID NO: 1221199 - DNA, 13 bp, Homo sapiens
ccctcgccagctt

SEQ ID NO: 1221200 - DNA, 13 bp, Homo sapiens
ccctcgctgctgc

SEQ ID NO: 1221201 - DNA, 14 bp, Homo sapiens
ccctcgctgctgct

SEQ ID NO: 1221202 - DNA, 14 bp, Homo sapiens
ccctcgctgcttct

SEQ ID NO: 1221203 - DNA, 17 bp, Homo sapiens
ccctcggaagccgtctg

SEQ ID NO: 1221204 - DNA, 22 bp, Homo sapiens
ccctcggaagccgtctgactcc

SEQ ID NO: 1221205 - DNA, 17 bp, Homo sapiens
ccctcggagcctgtgtt

SEQ ID NO: 1221206 - DNA, 15 bp, Homo sapiens
ccctcggagctggct

SEQ ID NO: 1221207 - DNA, 20 bp, Homo sapiens
ccctcggagctggctgtgcc

SEQ ID NO: 1221208 - DNA, 21 bp, Homo sapiens
ccctcggagctggctgtgcct

SEQ ID NO: 1221209 - DNA, 22 bp, Homo sapiens
ccctcggcctccgaggctcccc

SEQ ID NO: 1221210 - DNA, 20 bp, Homo sapiens
ccctcgggaccccactcgga

SEQ ID NO: 1221211 - DNA, 18 bp, Homo sapiens
ccctcgggcccacctggc

SEQ ID NO: 1221212 - DNA, 20 bp, Homo sapiens
ccctcgggcccacctggcca

SEQ ID NO: 1221213 - DNA, 16 bp, Homo sapiens
ccctcgggggcctgtg

SEQ ID NO: 1221214 - DNA, 18 bp, Homo sapiens
ccctcggtggctgcacag

SEQ ID NO: 1221215 - DNA, 21 bp, Homo sapiens
ccctcggtggctgcacagaag

SEQ ID NO: 1221216 - DNA, 13 bp, Homo sapiens
ccctcgtccacag

SEQ ID NO: 1221217 - DNA, 19 bp, Homo sapiens
ccctcgtccacaggggcag

SEQ ID NO: 1221218 - DNA, 17 bp, Homo sapiens
ccctcgtcccatccagc

SEQ ID NO: 1221219 - DNA, 20 bp, Homo sapiens
ccctcgtcccatccagctac

SEQ ID NO: 1221220 - DNA, 19 bp, Homo sapiens
ccctcgtccgtctgtctcg

SEQ ID NO: 1221221 - DNA, 15 bp, Homo sapiens
ccctcgtctccctgg

SEQ ID NO: 1221222 - DNA, 13 bp, Homo sapiens
ccctcgtggccag

SEQ ID NO: 1221223 - DNA, 20 bp, Homo sapiens
ccctcgtggccagcccggct

SEQ ID NO: 1221224 - DNA, 22 bp, Homo sapiens
ccctcgtgtcagctcaggcagc

SEQ ID NO: 1221225 - DNA, 21 bp, Homo sapiens
ccctctacagagcttccctga

SEQ ID NO: 1221226 - DNA, 19 bp, Homo sapiens
ccctctagaaatttttcag

SEQ ID NO: 1221227 - DNA, 10 bp, Homo sapiens
ccctctaggg

SEQ ID NO: 1221228 - DNA, 16 bp, Homo sapiens
ccctctagggcagggt

SEQ ID NO: 1221229 - DNA, 15 bp, Homo sapiens
ccctctcacgccacc

SEQ ID NO: 1221230 - DNA, 14 bp, Homo sapiens
ccctctcactccag

SEQ ID NO: 1221231 - DNA, 15 bp, Homo sapiens
ccctctcactccagc

SEQ ID NO: 1221232 - DNA, 21 bp, Homo sapiens
ccctctcactccagccaaaga

SEQ ID NO: 1221233 - DNA, 14 bp, Homo sapiens
ccctctcagaacat

SEQ ID NO: 1221234 - DNA, 20 bp, Homo sapiens
ccctctcagaggcctgctgc

SEQ ID NO: 1221235 - DNA, 14 bp, Homo sapiens
ccctctcaggagag

SEQ ID NO: 1221236 - DNA, 15 bp, Homo sapiens
ccctctcaggagagt

SEQ ID NO: 1221237 - DNA, 20 bp, Homo sapiens
ccctctcatgtccctccagg

SEQ ID NO: 1221238 - DNA, 15 bp, Homo sapiens
ccctctcccagggat

SEQ ID NO: 1221239 - DNA, 20 bp, Homo sapiens
ccctctccccacccctaccc

SEQ ID NO: 1221240 - DNA, 11 bp, Homo sapiens
ccctctccctg

SEQ ID NO: 1221241 - DNA, 14 bp, Homo sapiens
ccctctccctgtgt

SEQ ID NO: 1221242 - DNA, 18 bp, Homo sapiens
ccctctcccttccctcct

SEQ ID NO: 1221243 - DNA, 15 bp, Homo sapiens
ccctctcctcccagc

SEQ ID NO: 1221244 - DNA, 18 bp, Homo sapiens
ccctctcctcccagctgc

SEQ ID NO: 1221245 - DNA, 19 bp, Homo sapiens
ccctctcctcccagctgct

SEQ ID NO: 1221246 - DNA, 22 bp, Homo sapiens
ccctctcctcccagctgcttta

SEQ ID NO: 1221247 - DNA, 12 bp, Homo sapiens
ccctctcctgcc

SEQ ID NO: 1221248 - DNA, 13 bp, Homo sapiens
ccctctcctgccc

SEQ ID NO: 1221249 - DNA, 13 bp, Homo sapiens
ccctctcctgcct

SEQ ID NO: 1221250 - DNA, 12 bp, Homo sapiens
ccctctcctggg

SEQ ID NO: 1221251 - DNA, 12 bp, Homo sapiens
ccctctcctgtc

SEQ ID NO: 1221252 - DNA, 16 bp, Homo sapiens
ccctctcggccaggca

SEQ ID NO: 1221253 - DNA, 19 bp, Homo sapiens
ccctctctcccatttcagg

SEQ ID NO: 1221254 - DNA, 15 bp, Homo sapiens
ccctctctcttctgc

SEQ ID NO: 1221255 - DNA, 10 bp, Homo sapiens
ccctctctgc

SEQ ID NO: 1221256 - DNA, 20 bp, Homo sapiens
ccctctctgcagacttccca

SEQ ID NO: 1221257 - DNA, 18 bp, Homo sapiens
ccctctctgcatctgacc

SEQ ID NO: 1221258 - DNA, 16 bp, Homo sapiens
ccctctctgctccaga

SEQ ID NO: 1221259 - DNA, 15 bp, Homo sapiens
ccctctctgctctgc

SEQ ID NO: 1221260 - DNA, 19 bp, Homo sapiens
ccctctcttcgtcctgatc

SEQ ID NO: 1221261 - DNA, 12 bp, Homo sapiens
ccctctctttct

SEQ ID NO: 1221262 - DNA, 22 bp, Homo sapiens
ccctctgaagagaccttggctg

SEQ ID NO: 1221263 - DNA, 17 bp, Homo sapiens
ccctctgacctgcactg

SEQ ID NO: 1221264 - DNA, 21 bp, Homo sapiens
ccctctgagaattccaaggag

SEQ ID NO: 1221265 - DNA, 16 bp, Homo sapiens
ccctctgcacccagaa

SEQ ID NO: 1221266 - DNA, 21 bp, Homo sapiens
ccctctgccccaagcagccag

SEQ ID NO: 1221267 - DNA, 18 bp, Homo sapiens
ccctctgccccatcctcc

SEQ ID NO: 1221268 - DNA, 20 bp, Homo sapiens
ccctctgccggtcgggcagc

SEQ ID NO: 1221269 - DNA, 22 bp, Homo sapiens
ccctctgccggtcgggcagcca

SEQ ID NO: 1221270 - DNA, 10 bp, Homo sapiens
ccctctgcct

SEQ ID NO: 1221271 - DNA, 13 bp, Homo sapiens
ccctctgcctcct

SEQ ID NO: 1221272 - DNA, 14 bp, Homo sapiens
ccctctgcctcctc

SEQ ID NO: 1221273 - DNA, 12 bp, Homo sapiens
ccctctgcctgc

SEQ ID NO: 1221274 - DNA, 19 bp, Homo sapiens
ccctctgcctgcactccct

SEQ ID NO: 1221275 - DNA, 23 bp, Homo sapiens
ccctctgcctgcactccctggcc

SEQ ID NO: 1221276 - DNA, 16 bp, Homo sapiens
ccctctgcctgtccct

SEQ ID NO: 1221277 - DNA, 23 bp, Homo sapiens
ccctctgcctgtccctctcaggc

SEQ ID NO: 1221278 - DNA, 16 bp, Homo sapiens
ccctctgccttcaggc

SEQ ID NO: 1221279 - DNA, 23 bp, Homo sapiens
ccctctgctgctgcccggggtgg

SEQ ID NO: 1221280 - DNA, 14 bp, Homo sapiens
ccctgcctgcctct

SEQ ID NO: 1221281 - DNA, 13 bp, Homo sapiens
ccctgcctggaac

SEQ ID NO: 1221282 - DNA, 14 bp, Homo sapiens
ccctgcctgggcct

SEQ ID NO: 1221283 - DNA, 23 bp, Homo sapiens
ccctgcctgtgcccgcatgtgtg

SEQ ID NO: 1221284 - DNA, 22 bp, Homo sapiens
ccctgccttatcttgcacccca

SEQ ID NO: 1221285 - DNA, 13 bp, Homo sapiens
ccctgccttcctc

SEQ ID NO: 1221286 - DNA, 15 bp, Homo sapiens
ccctgccttcctctg

SEQ ID NO: 1221287 - DNA, 20 bp, Homo sapiens
ccctgccttcctctgaggac

SEQ ID NO: 1221288 - DNA, 22 bp, Homo sapiens
ccctgccttcctctgaggacag

SEQ ID NO: 1221289 - DNA, 13 bp, Homo sapiens
ccctgccttgccg

SEQ ID NO: 1221290 - DNA, 15 bp, Homo sapiens
ccctgccttgccgct

SEQ ID NO: 1221291 - DNA, 21 bp, Homo sapiens
ccctgccttgccgctcccctt

SEQ ID NO: 1221292 - DNA, 23 bp, Homo sapiens
ccctgccttgccgctccccttgg

SEQ ID NO: 1221293 - DNA, 17 bp, Homo sapiens
ccctgcgaaggggccct

SEQ ID NO: 1221294 - DNA, 20 bp, Homo sapiens
ccctgcgaaggggccctggt

SEQ ID NO: 1221295 - DNA, 15 bp, Homo sapiens
ccctgcgcctccaga

SEQ ID NO: 1221296 - DNA, 22 bp, Homo sapiens
ccctgcgcctgtgatgctgggc

SEQ ID NO: 1221297 - DNA, 22 bp, Homo sapiens
ccctgcgctctctttgcaactg

SEQ ID NO: 1221298 - DNA, 20 bp, Homo sapiens
ccctgcggcctccacacctg

SEQ ID NO: 1221299 - DNA, 24 bp, Homo sapiens
ccctgcgggcgcgggcagccaccc

SEQ ID NO: 1221300 - DNA, 17 bp, Homo sapiens
ccctgcgttggagccac

SEQ ID NO: 1221301 - DNA, 23 bp, Homo sapiens
ccctgctaaatgccatgtttatc

SEQ ID NO: 1221302 - DNA, 18 bp, Homo sapiens
ccctgctactcctgtgct

SEQ ID NO: 1221303 - DNA, 16 bp, Homo sapiens
ccctgctcagtaaagc

SEQ ID NO: 1221304 - DNA, 12 bp, Homo sapiens
ccctgctcagtg

SEQ ID NO: 1221305 - DNA, 14 bp, Homo sapiens
ccctgctccaccag

SEQ ID NO: 1221306 - DNA, 17 bp, Homo sapiens
ccctgctccaccagcag

SEQ ID NO: 1221307 - DNA, 19 bp, Homo sapiens
ccctgctccagaagatagc

SEQ ID NO: 1221308 - DNA, 17 bp, Homo sapiens
ccctgctcccacagaac

SEQ ID NO: 1221309 - DNA, 12 bp, Homo sapiens
ccctgctcctca

SEQ ID NO: 1221310 - DNA, 13 bp, Homo sapiens
ccctgctcctcat

SEQ ID NO: 1221311 - DNA, 15 bp, Homo sapiens
ccctgctcctcatgg

SEQ ID NO: 1221312 - DNA, 19 bp, Homo sapiens
ccctgctcctccctggctg

SEQ ID NO: 1221313 - DNA, 20 bp, Homo sapiens
ccctgctcctccctggctgc

SEQ ID NO: 1221314 - DNA, 21 bp, Homo sapiens
ccctgctcctccctggctgcc

SEQ ID NO: 1221315 - DNA, 12 bp, Homo sapiens
ccctgctcctgc

SEQ ID NO: 1221316 - DNA, 15 bp, Homo sapiens
ccctgctcctgcagc

SEQ ID NO: 1221317 - DNA, 16 bp, Homo sapiens
ccctgctcctgcagca

SEQ ID NO: 1221318 - DNA, 15 bp, Homo sapiens
ccctgctctacccat

SEQ ID NO: 1221319 - DNA, 13 bp, Homo sapiens
ccctgctgacctt

SEQ ID NO: 1221320 - DNA, 14 bp, Homo sapiens
ccctgctgaccttg

SEQ ID NO: 1221321 - DNA, 18 bp, Homo sapiens
ccctgctgagtcatctgt

SEQ ID NO: 1221322 - DNA, 10 bp, Homo sapiens
ccctgctgca

SEQ ID NO: 1221323 - DNA, 19 bp, Homo sapiens
ccctgctgccgcctcccag

SEQ ID NO: 1221324 - DNA, 20 bp, Homo sapiens
ccctgctgctgccagggctt

SEQ ID NO: 1221325 - DNA, 11 bp, Homo sapiens
ccctgctggcc

SEQ ID NO: 1221326 - DNA, 13 bp, Homo sapiens
ccctgctggcctg

SEQ ID NO: 1221327 - DNA, 13 bp, Homo sapiens
ccctgctgtctct

SEQ ID NO: 1221328 - DNA, 18 bp, Homo sapiens
ccctgctgtctctctggg

SEQ ID NO: 1221329 - DNA, 17 bp, Homo sapiens
ccctgctgtgccatgct

SEQ ID NO: 1221330 - DNA, 12 bp, Homo sapiens
ccctgcttcacc

SEQ ID NO: 1221331 - DNA, 19 bp, Homo sapiens
ccctgcttgcacacttccc

SEQ ID NO: 1221332 - DNA, 18 bp, Homo sapiens
ccctgctttgggctgccc

SEQ ID NO: 1221333 - DNA, 23 bp, Homo sapiens
ccctgctttgggctgccctggtg

SEQ ID NO: 1221334 - DNA, 10 bp, Homo sapiens
ccctgctttt

SEQ ID NO: 1221335 - DNA, 16 bp, Homo sapiens
ccctggaagagcccag

SEQ ID NO: 1221336 - DNA, 12 bp, Homo sapiens
ccctggaagccg

SEQ ID NO: 1221337 - DNA, 21 bp, Homo sapiens
ccctggacagatggcccaagg

SEQ ID NO: 1221338 - DNA, 14 bp, Homo sapiens
ccctggacaggcag

SEQ ID NO: 1221339 - DNA, 15 bp, Homo sapiens
ccctggacaggcagc

SEQ ID NO: 1221340 - DNA, 14 bp, Homo sapiens
ccgtggtcctttgg

SEQ ID NO: 1221341 - DNA, 22 bp, Homo sapiens
ccgtggtggcggtggctgcccc

SEQ ID NO: 1221342 - DNA, 20 bp, Homo sapiens
ccgtggtgttatttaaagaa

SEQ ID NO: 1221343 - DNA, 16 bp, Homo sapiens
ccgtgtaaaccaaagc

SEQ ID NO: 1221344 - DNA, 23 bp, Homo sapiens
ccgtgtcaagctgctctgagcca

SEQ ID NO: 1221345 - DNA, 11 bp, Homo sapiens
ccgtgtcccaa

SEQ ID NO: 1221346 - DNA, 16 bp, Homo sapiens
ccgtgtcccaaggagc

SEQ ID NO: 1221347 - DNA, 12 bp, Homo sapiens
ccgtgtcctcct

SEQ ID NO: 1221348 - DNA, 17 bp, Homo sapiens
ccgtgtctcagcctctg

SEQ ID NO: 1221349 - DNA, 21 bp, Homo sapiens
ccgtgtctcgcgcgactgaga

SEQ ID NO: 1221350 - DNA, 17 bp, Homo sapiens
ccgtgtctgtctggcac

SEQ ID NO: 1221351 - DNA, 12 bp, Homo sapiens
ccgtgtgaatgt

SEQ ID NO: 1221352 - DNA, 20 bp, Homo sapiens
ccgtgtgagtgtgacagggc

SEQ ID NO: 1221353 - DNA, 21 bp, Homo sapiens
ccgtgtgagtgtgacagggcc

SEQ ID NO: 1221354 - DNA, 14 bp, Homo sapiens
ccgtgtggcccctt

SEQ ID NO: 1221355 - DNA, 16 bp, Homo sapiens
ccgtgtgtccagcatt

SEQ ID NO: 1221356 - DNA, 19 bp, Homo sapiens
ccgtgtgtggttggaaaac

SEQ ID NO: 1221357 - DNA, 14 bp, Homo sapiens
ccgtgttcctcggt

SEQ ID NO: 1221358 - DNA, 22 bp, Homo sapiens
ccgtgttgcatgaaggagcagc

SEQ ID NO: 1221359 - DNA, 14 bp, Homo sapiens
ccgttaaataattc

SEQ ID NO: 1221360 - DNA, 13 bp, Homo sapiens
ccgttactctcca

SEQ ID NO: 1221361 - DNA, 13 bp, Homo sapiens
ccgttagctcctg

SEQ ID NO: 1221362 - DNA, 18 bp, Homo sapiens
ccgttagctcctgtggcc

SEQ ID NO: 1221363 - DNA, 12 bp, Homo sapiens
ccgttattaaaa

SEQ ID NO: 1221364 - DNA, 14 bp, Homo sapiens
ccgttccccttggc

SEQ ID NO: 1221365 - DNA, 15 bp, Homo sapiens
ccgttctgctggcct

SEQ ID NO: 1221366 - DNA, 16 bp, Homo sapiens
ccgttgaatctgggag

SEQ ID NO: 1221367 - DNA, 19 bp, Homo sapiens
ccgttgaatctgggaggga

SEQ ID NO: 1221368 - DNA, 23 bp, Homo sapiens
ccgttggaaacataaccattaca

SEQ ID NO: 1221369 - DNA, 13 bp, Homo sapiens
ccgttgtgagctg

SEQ ID NO: 1221370 - DNA, 15 bp, Homo sapiens
ccgtttatgggcctt

SEQ ID NO: 1221371 - DNA, 17 bp, Homo sapiens
ccgtttcagtggaccct

SEQ ID NO: 1221372 - DNA, 15 bp, Homo sapiens
ccgtttcttccctgt

SEQ ID NO: 1221373 - DNA, 20 bp, Homo sapiens
ccgttttcatcctggcctcc

SEQ ID NO: 1221374 - DNA, 13 bp, Homo sapiens
ccgttttcctcat

SEQ ID NO: 1221375 - DNA, 15 bp, Homo sapiens
ccgttttcctcatcc

SEQ ID NO: 1221376 - DNA, 13 bp, Homo sapiens
ccgttttcttaca

SEQ ID NO: 1221377 - DNA, 19 bp, Homo sapiens
cctaaaaagattgccaatt

SEQ ID NO: 1221378 - DNA, 20 bp, Homo sapiens
cctaaaaataggggccgttt

SEQ ID NO: 1221379 - DNA, 15 bp, Homo sapiens
cctaaaactggcctg

SEQ ID NO: 1221380 - DNA, 20 bp, Homo sapiens
cctaaaactggcctgacttg

SEQ ID NO: 1221381 - DNA, 22 bp, Homo sapiens
cctaaaagtgggcttgattctg

SEQ ID NO: 1221382 - DNA, 18 bp, Homo sapiens
cctaaaattactattctt

SEQ ID NO: 1221383 - DNA, 23 bp, Homo sapiens
cctaaacagatataaatggctgg

SEQ ID NO: 1221384 - DNA, 16 bp, Homo sapiens
cctaaacataattgtg

SEQ ID NO: 1221385 - DNA, 17 bp, Homo sapiens
cctaaacataattgtgg

SEQ ID NO: 1221386 - DNA, 21 bp, Homo sapiens
cctaaaccaaaaactgaaagt

SEQ ID NO: 1221387 - DNA, 14 bp, Homo sapiens
cctaaactccaggg

SEQ ID NO: 1221388 - DNA, 15 bp, Homo sapiens
cctaaactgcagcct

SEQ ID NO: 1221389 - DNA, 20 bp, Homo sapiens
cctaaactgcagcctctctg

SEQ ID NO: 1221390 - DNA, 17 bp, Homo sapiens
cctaaagacgtctcttt

SEQ ID NO: 1221391 - DNA, 18 bp, Homo sapiens
cctaaagagttattcaaa

SEQ ID NO: 1221392 - DNA, 17 bp, Homo sapiens
cctaaagatgggaggag

SEQ ID NO: 1221393 - DNA, 13 bp, Homo sapiens
cctaaagcctcaa

SEQ ID NO: 1221394 - DNA, 13 bp, Homo sapiens
cctaaagggagaa

SEQ ID NO: 1221395 - DNA, 23 bp, Homo sapiens
cctaaagggagaaggaagggcag

SEQ ID NO: 1221396 - DNA, 14 bp, Homo sapiens
cctaaagggcaggg

SEQ ID NO: 1221397 - DNA, 16 bp, Homo sapiens
cctaaagggcagggcc

SEQ ID NO: 1221398 - DNA, 20 bp, Homo sapiens
cctaaagtatacaactgcct

SEQ ID NO: 1221399 - DNA, 18 bp, Homo sapiens
cctaaagtgcttgctttt

SEQ ID NO: 1221400 - DNA, 18 bp, Homo sapiens
cctaaataaagtcttact

SEQ ID NO: 1221401 - DNA, 21 bp, Homo sapiens
cctaaatatccaaagactgta

SEQ ID NO: 1221402 - DNA, 17 bp, Homo sapiens
cctaaatattttcaaga

SEQ ID NO: 1221403 - DNA, 13 bp, Homo sapiens
cctaaatcccaag

SEQ ID NO: 1221404 - DNA, 14 bp, Homo sapiens
cctaaatgcaaagc

SEQ ID NO: 1221405 - DNA, 15 bp, Homo sapiens
cctaaattatttact

SEQ ID NO: 1221406 - DNA, 13 bp, Homo sapiens
cctaaatttaatg

SEQ ID NO: 1221407 - DNA, 18 bp, Homo sapiens
cctaaatttaatgctgcc

SEQ ID NO: 1221408 - DNA, 21 bp, Homo sapiens
cctaacaacattgtagcctca

SEQ ID NO: 1221409 - DNA, 13 bp, Homo sapiens
cctaacaccagcg

SEQ ID NO: 1221410 - DNA, 23 bp, Homo sapiens
cctaacatggtttaaaagaaaaa

SEQ ID NO: 1221411 - DNA, 14 bp, Homo sapiens
cctaaccccttcca

SEQ ID NO: 1221412 - DNA, 17 bp, Homo sapiens
cctaactagaattagta

SEQ ID NO: 1221413 - DNA, 18 bp, Homo sapiens
cctaactctgcccaccct

SEQ ID NO: 1221414 - DNA, 19 bp, Homo sapiens
cctaactctgcccaccctc

SEQ ID NO: 1221415 - DNA, 18 bp, Homo sapiens
cctaactgcaatgtggat

SEQ ID NO: 1221416 - DNA, 18 bp, Homo sapiens
cctaagaagttattttct

SEQ ID NO: 1221417 - DNA, 17 bp, Homo sapiens
cctaagaatctttagag

SEQ ID NO: 1221418 - DNA, 20 bp, Homo sapiens
cctaagaggtttttcctctt

SEQ ID NO: 1221419 - DNA, 16 bp, Homo sapiens
cctaagagtggaggag

SEQ ID NO: 1221420 - DNA, 13 bp, Homo sapiens
cctaagccagcct

SEQ ID NO: 1221421 - DNA, 15 bp, Homo sapiens
cctaagccagcctgg

SEQ ID NO: 1221422 - DNA, 16 bp, Homo sapiens
cctaagccagcctggt

SEQ ID NO: 1221423 - DNA, 17 bp, Homo sapiens
cctaagcccccagggcc

SEQ ID NO: 1221424 - DNA, 19 bp, Homo sapiens
cctaagcccccagggcctc

SEQ ID NO: 1221425 - DNA, 15 bp, Homo sapiens
cctaagcctgtcccc

SEQ ID NO: 1221426 - DNA, 19 bp, Homo sapiens
cctaagcctgtccccagac

SEQ ID NO: 1221427 - DNA, 13 bp, Homo sapiens
cctaaggaacctt

SEQ ID NO: 1221428 - DNA, 14 bp, Homo sapiens
cctaaggacacact

SEQ ID NO: 1221429 - DNA, 15 bp, Homo sapiens
cctaaggacacacta

SEQ ID NO: 1221430 - DNA, 17 bp, Homo sapiens
cctaaggacacactaat

SEQ ID NO: 1221431 - DNA, 24 bp, Homo sapiens
cctaaggatctctcaggagcacag

SEQ ID NO: 1221432 - DNA, 11 bp, Homo sapiens
cctaaggcatg

SEQ ID NO: 1221433 - DNA, 12 bp, Homo sapiens
cctaaggcccat

SEQ ID NO: 1221434 - DNA, 18 bp, Homo sapiens
cctaaggctccccacccc

SEQ ID NO: 1221435 - DNA, 22 bp, Homo sapiens
cctaaggctgcaaggtttaggc

SEQ ID NO: 1221436 - DNA, 17 bp, Homo sapiens
cctaagggcagccctcc

SEQ ID NO: 1221437 - DNA, 20 bp, Homo sapiens
cctaaggtccaacaagaatg

SEQ ID NO: 1221438 - DNA, 14 bp, Homo sapiens
cctaagtcaggtaa

SEQ ID NO: 1221439 - DNA, 15 bp, Homo sapiens
cctaagtcccttcct

SEQ ID NO: 1221440 - DNA, 16 bp, Homo sapiens
cctaagtcccttccta

SEQ ID NO: 1221441 - DNA, 23 bp, Homo sapiens
cctaagtcccttcctattctcct

SEQ ID NO: 1221442 - DNA, 18 bp, Homo sapiens
cctaagtcctttatgtgg

SEQ ID NO: 1221443 - DNA, 19 bp, Homo sapiens
cctaagtgatttccacagg

SEQ ID NO: 1221444 - DNA, 15 bp, Homo sapiens
cctaagtggctgctg

SEQ ID NO: 1221445 - DNA, 21 bp, Homo sapiens
cctaataaagttctgtactca

SEQ ID NO: 1221446 - DNA, 17 bp, Homo sapiens
cctaatatcaaatgcag

SEQ ID NO: 1221447 - DNA, 15 bp, Homo sapiens
cctaatcactctgag

SEQ ID NO: 1221448 - DNA, 13 bp, Homo sapiens
cctaatctctgta

SEQ ID NO: 1221449 - DNA, 19 bp, Homo sapiens
cctaatggagaagacccac

SEQ ID NO: 1221450 - DNA, 12 bp, Homo sapiens
cctaatggcttt

SEQ ID NO: 1221451 - DNA, 17 bp, Homo sapiens
cctaatgtgatcatatg

SEQ ID NO: 1221452 - DNA, 21 bp, Homo sapiens
cctaattaatatattaaaatt

SEQ ID NO: 1221453 - DNA, 16 bp, Homo sapiens
cctaattcaattcaaa

SEQ ID NO: 1221454 - DNA, 20 bp, Homo sapiens
cctaattcaattcaaagctg

SEQ ID NO: 1221455 - DNA, 15 bp, Homo sapiens
cctaattccacagct

SEQ ID NO: 1221456 - DNA, 14 bp, Homo sapiens
cctagagccagacc

SEQ ID NO: 1221457 - DNA, 16 bp, Homo sapiens
cctagagccagaccaa

SEQ ID NO: 1221458 - DNA, 18 bp, Homo sapiens
cctagaggtgggcagctg

SEQ ID NO: 1221459 - DNA, 19 bp, Homo sapiens
cctagaggtgggcagctgg

SEQ ID NO: 1221460 - DNA, 20 bp, Homo sapiens
cctagaggtgggcagctggg

SEQ ID NO: 1221461 - DNA, 23 bp, Homo sapiens
cctagaggtgggcagctgggccc

SEQ ID NO: 1221462 - DNA, 17 bp, Homo sapiens
cctagataaaaagatgg

SEQ ID NO: 1221463 - DNA, 20 bp, Homo sapiens
cctagatccacacacagagg

SEQ ID NO: 1221464 - DNA, 21 bp, Homo sapiens
cctagatgcacgtggggccca

SEQ ID NO: 1221465 - DNA, 20 bp, Homo sapiens
cctagattaggtagactttg

SEQ ID NO: 1221466 - DNA, 21 bp, Homo sapiens
cctagcaacatatctctgccg

SEQ ID NO: 1221467 - DNA, 13 bp, Homo sapiens
cctagcagcctca

SEQ ID NO: 1221468 - DNA, 13 bp, Homo sapiens
cctagcatggggt

SEQ ID NO: 1221469 - DNA, 19 bp, Homo sapiens
cctagcatggggtcagccc

SEQ ID NO: 1221470 - DNA, 21 bp, Homo sapiens
cctagcatggggtcagcccca

SEQ ID NO: 1221471 - DNA, 14 bp, Homo sapiens
cctagccattcctg

SEQ ID NO: 1221472 - DNA, 15 bp, Homo sapiens
cctagcccagactct

SEQ ID NO: 1221473 - DNA, 12 bp, Homo sapiens
cctagcccagtg

SEQ ID NO: 1221474 - DNA, 17 bp, Homo sapiens
cctagcccagtgcttct

SEQ ID NO: 1221475 - DNA, 12 bp, Homo sapiens
cctagcccctct

SEQ ID NO: 1221476 - DNA, 17 bp, Homo sapiens
cctagcccctctctcac

SEQ ID NO: 1221477 - DNA, 13 bp, Homo sapiens
cctagcccttcca

SEQ ID NO: 1221478 - DNA, 19 bp, Homo sapiens
cctagcccttccagcctgg

SEQ ID NO: 1221479 - DNA, 14 bp, Homo sapiens
cctagcccttccct

SEQ ID NO: 1221480 - DNA, 14 bp, Homo sapiens
cctagccgacctca

SEQ ID NO: 1221481 - DNA, 15 bp, Homo sapiens
cctagccgacctcag

SEQ ID NO: 1221482 - DNA, 17 bp, Homo sapiens
cctagccgacctcagcc

SEQ ID NO: 1221483 - DNA, 20 bp, Homo sapiens
cctagccgacctcagccttc

SEQ ID NO: 1221484 - DNA, 11 bp, Homo sapiens
cctagcctgga

SEQ ID NO: 1221485 - DNA, 12 bp, Homo sapiens
cctagcctggat

SEQ ID NO: 1221486 - DNA, 16 bp, Homo sapiens
cctagcctggctctgc

SEQ ID NO: 1221487 - DNA, 14 bp, Homo sapiens
cctagccttgcttg

SEQ ID NO: 1221488 - DNA, 19 bp, Homo sapiens
cctagcgatctctcctggc

SEQ ID NO: 1221489 - DNA, 19 bp, Homo sapiens
cctagcggagcccagcctg

SEQ ID NO: 1221490 - DNA, 20 bp, Homo sapiens
cctagcggagcccagcctgg

SEQ ID NO: 1221491 - DNA, 15 bp, Homo sapiens
cctagctacactgag

SEQ ID NO: 1221492 - DNA, 18 bp, Homo sapiens
cctagctacactgagcag

SEQ ID NO: 1221493 - DNA, 24 bp, Homo sapiens
cctagctctttgggcctctcctgc

SEQ ID NO: 1221494 - DNA, 13 bp, Homo sapiens
cctagctggctct

SEQ ID NO: 1221495 - DNA, 15 bp, Homo sapiens
cctagctggctctgt

SEQ ID NO: 1221496 - DNA, 12 bp, Homo sapiens
cctagctgtccc

SEQ ID NO: 1221497 - DNA, 13 bp, Homo sapiens
cctagctgtccca

SEQ ID NO: 1221498 - DNA, 23 bp, Homo sapiens
cctagctgtgccccctctggtta

SEQ ID NO: 1221499 - DNA, 13 bp, Homo sapiens
cctagctgtgtca

SEQ ID NO: 1221500 - DNA, 21 bp, Homo sapiens
cctagctttagaccctgggtg

SEQ ID NO: 1221501 - DNA, 22 bp, Homo sapiens
cctagctttagaccctgggtgg

SEQ ID NO: 1221502 - DNA, 23 bp, Homo sapiens
cctagctttagaccctgggtggg

SEQ ID NO: 1221503 - DNA, 23 bp, Homo sapiens
cctagctttatatatggacatgg

SEQ ID NO: 1221504 - DNA, 13 bp, Homo sapiens
cctagcttttaaa

SEQ ID NO: 1221505 - DNA, 16 bp, Homo sapiens
cctagcttttaaaaaa

SEQ ID NO: 1221506 - DNA, 20 bp, Homo sapiens
cctaggaaaccagctcgtgg

SEQ ID NO: 1221507 - DNA, 16 bp, Homo sapiens
cctaggaccactcagc

SEQ ID NO: 1221508 - DNA, 19 bp, Homo sapiens
cctaggaccactcagcccc

SEQ ID NO: 1221509 - DNA, 17 bp, Homo sapiens
cctaggagatatctgag

SEQ ID NO: 1221510 - DNA, 19 bp, Homo sapiens
cctaggagatatctgaggg

SEQ ID NO: 1221511 - DNA, 22 bp, Homo sapiens
cctaggagatatctgagggagg

SEQ ID NO: 1221512 - DNA, 16 bp, Homo sapiens
cctaggatgctgcagc

SEQ ID NO: 1221513 - DNA, 21 bp, Homo sapiens
cctaggatgctgcagcagagt

SEQ ID NO: 1221514 - DNA, 20 bp, Homo sapiens
cctaggattccccctgccct

SEQ ID NO: 1221515 - DNA, 23 bp, Homo sapiens
cctaggattccccctgccctgtg

SEQ ID NO: 1221516 - DNA, 22 bp, Homo sapiens
cctaggcattgcaggaccttgg

SEQ ID NO: 1221517 - DNA, 22 bp, Homo sapiens
cctaggccaaatgcacaagctc

SEQ ID NO: 1221518 - DNA, 19 bp, Homo sapiens
cctaggccactcctccaaa

SEQ ID NO: 1221519 - DNA, 14 bp, Homo sapiens
cctaggcccaggcc

SEQ ID NO: 1221520 - DNA, 15 bp, Homo sapiens
cctaggcccaggcct

SEQ ID NO: 1221521 - DNA, 16 bp, Homo sapiens
cctaggcccaggcctg

SEQ ID NO: 1221522 - DNA, 19 bp, Homo sapiens
cctaggcctcagccagaga

SEQ ID NO: 1221523 - DNA, 18 bp, Homo sapiens
cctaggctccaccccatc

SEQ ID NO: 1221524 - DNA, 18 bp, Homo sapiens
cctagggaacagaaattg

SEQ ID NO: 1221525 - DNA, 15 bp, Homo sapiens
cctagggaattcctg

SEQ ID NO: 1221526 - DNA, 22 bp, Homo sapiens
cctagggcattgtatctgtctt

SEQ ID NO: 1221527 - DNA, 16 bp, Homo sapiens
cctagggcctggtcca

SEQ ID NO: 1221528 - DNA, 14 bp, Homo sapiens
cctaggggaagggg

SEQ ID NO: 1221529 - DNA, 17 bp, Homo sapiens
cctaggggacacttccc

SEQ ID NO: 1221530 - DNA, 15 bp, Homo sapiens
cctagggtggcctga

SEQ ID NO: 1221531 - DNA, 14 bp, Homo sapiens
cctaggtcccttcc

SEQ ID NO: 1221532 - DNA, 16 bp, Homo sapiens
cctaggtcccttcccg

SEQ ID NO: 1221533 - DNA, 15 bp, Homo sapiens
cctaggtcctctgag

SEQ ID NO: 1221534 - DNA, 20 bp, Homo sapiens
cctaggtgcagctcctcagc

SEQ ID NO: 1221535 - DNA, 21 bp, Homo sapiens
cctaggtgcagctcctcagcg

SEQ ID NO: 1221536 - DNA, 19 bp, Homo sapiens
cctaggttatgggtacggc

SEQ ID NO: 1221537 - DNA, 16 bp, Homo sapiens
cctaggttcccggtcc

SEQ ID NO: 1221538 - DNA, 18 bp, Homo sapiens
cctaggttcccggtcccg

SEQ ID NO: 1221539 - DNA, 20 bp, Homo sapiens
cctaggttcccggtcccgag

SEQ ID NO: 1221540 - DNA, 21 bp, Homo sapiens
cctaggttccctgttcttcct

SEQ ID NO: 1221541 - DNA, 18 bp, Homo sapiens
cctaggttggtttcccct

SEQ ID NO: 1221542 - DNA, 21 bp, Homo sapiens
cctaggttggtttcccctgca

SEQ ID NO: 1221543 - DNA, 16 bp, Homo sapiens
cctagtaaaaccttgt

SEQ ID NO: 1221544 - DNA, 21 bp, Homo sapiens
cctagtaattgcctagaaata

SEQ ID NO: 1221545 - DNA, 15 bp, Homo sapiens
cctagtactctctgc

SEQ ID NO: 1221546 - DNA, 20 bp, Homo sapiens
cctagtactctctgctctag

SEQ ID NO: 1221547 - DNA, 21 bp, Homo sapiens
cctagtactctctgctctagc

SEQ ID NO: 1221548 - DNA, 23 bp, Homo sapiens
cctagtactctctgctctagcca

SEQ ID NO: 1221549 - DNA, 13 bp, Homo sapiens
cctagtactgccc

SEQ ID NO: 1221550 - DNA, 20 bp, Homo sapiens
cctagtagctgggattacag

SEQ ID NO: 1221551 - DNA, 18 bp, Homo sapiens
cctagtcccctttcctct

SEQ ID NO: 1221552 - DNA, 16 bp, Homo sapiens
cctagtcgggcagggc

SEQ ID NO: 1221553 - DNA, 21 bp, Homo sapiens
cctagtcgggcagggcccctg

SEQ ID NO: 1221554 - DNA, 19 bp, Homo sapiens
cctagtgaaacttttctag

SEQ ID NO: 1221555 - DNA, 12 bp, Homo sapiens
cctagtgcccca

SEQ ID NO: 1221556 - DNA, 18 bp, Homo sapiens
cctagtgctattctgtgt

SEQ ID NO: 1221557 - DNA, 23 bp, Homo sapiens
cctagtgctattctgtgttgaac

SEQ ID NO: 1221558 - DNA, 20 bp, Homo sapiens
cctagtggatgactgttgat

SEQ ID NO: 1221559 - DNA, 20 bp, Homo sapiens
cctagttaaagaaaggaaaa

SEQ ID NO: 1221560 - DNA, 14 bp, Homo sapiens
cctagtttccctga

SEQ ID NO: 1221561 - DNA, 14 bp, Homo sapiens
cctagtttcctctc

SEQ ID NO: 1221562 - DNA, 15 bp, Homo sapiens
cctagttttccatgc

SEQ ID NO: 1221563 - DNA, 18 bp, Homo sapiens
cctagttttctcctccca

SEQ ID NO: 1221564 - DNA, 12 bp, Homo sapiens
cctcacctctga

SEQ ID NO: 1221565 - DNA, 13 bp, Homo sapiens
cctcacctctgga

SEQ ID NO: 1221566 - DNA, 19 bp, Homo sapiens
cctcacctgcccctctgtt

SEQ ID NO: 1221567 - DNA, 21 bp, Homo sapiens
cctcacctgcccctctgttct

SEQ ID NO: 1221568 - DNA, 18 bp, Homo sapiens
cctcacctgggcacctgg

SEQ ID NO: 1221569 - DNA, 22 bp, Homo sapiens
cctcacctgggcacctggggag

SEQ ID NO: 1221570 - DNA, 17 bp, Homo sapiens
cctcacctgggcctttc

SEQ ID NO: 1221571 - DNA, 22 bp, Homo sapiens
cctcacctgggcctttcctgtg

SEQ ID NO: 1221572 - DNA, 12 bp, Homo sapiens
cctcaccttcct

SEQ ID NO: 1221573 - DNA, 15 bp, Homo sapiens
cctcaccttcctgtg

SEQ ID NO: 1221574 - DNA, 19 bp, Homo sapiens
cctcaccttgcaacacaca

SEQ ID NO: 1221575 - DNA, 13 bp, Homo sapiens
cctcacgccccct

SEQ ID NO: 1221576 - DNA, 16 bp, Homo sapiens
cctcacgctctggaca

SEQ ID NO: 1221577 - DNA, 21 bp, Homo sapiens
cctcacgggaccgtcagcatg

SEQ ID NO: 1221578 - DNA, 22 bp, Homo sapiens
cctcacggggttggctgttcca

SEQ ID NO: 1221579 - DNA, 21 bp, Homo sapiens
cctcacggtgccttttttcac

SEQ ID NO: 1221580 - DNA, 13 bp, Homo sapiens
cctcacgtgcagg

SEQ ID NO: 1221581 - DNA, 22 bp, Homo sapiens
cctcacgtgcaggacagctctt

SEQ ID NO: 1221582 - DNA, 23 bp, Homo sapiens
cctcacgtgcaggacagctcttg

SEQ ID NO: 1221583 - DNA, 22 bp, Homo sapiens
cctcactatggtatgctggcca

SEQ ID NO: 1221584 - DNA, 16 bp, Homo sapiens
cctcactccccaggga

SEQ ID NO: 1221585 - DNA, 18 bp, Homo sapiens
cctcactccctctgcaga

SEQ ID NO: 1221586 - DNA, 16 bp, Homo sapiens
cctcactctgtcagcc

SEQ ID NO: 1221587 - DNA, 18 bp, Homo sapiens
cctcactctgtcagccag

SEQ ID NO: 1221588 - DNA, 22 bp, Homo sapiens
cctcactctgtcagccagccgc

SEQ ID NO: 1221589 - DNA, 20 bp, Homo sapiens
cctcactgagaggcctggag

SEQ ID NO: 1221590 - DNA, 13 bp, Homo sapiens
cctcactgagcct

SEQ ID NO: 1221591 - DNA, 21 bp, Homo sapiens
cctcactggaggagcagcttc

SEQ ID NO: 1221592 - DNA, 13 bp, Homo sapiens
cctcactggctca

SEQ ID NO: 1221593 - DNA, 18 bp, Homo sapiens
cctcactggctcatgccc

SEQ ID NO: 1221594 - DNA, 19 bp, Homo sapiens
cctcactggctctcctggc

SEQ ID NO: 1221595 - DNA, 14 bp, Homo sapiens
cctcactggctggg

SEQ ID NO: 1221596 - DNA, 23 bp, Homo sapiens
cctcactggctggggcagagggg

SEQ ID NO: 1221597 - DNA, 19 bp, Homo sapiens
cctcactggggtcctgggg

SEQ ID NO: 1221598 - DNA, 12 bp, Homo sapiens
cctcactgggtg

SEQ ID NO: 1221599 - DNA, 20 bp, Homo sapiens
cctcactgtatccaggttcc

SEQ ID NO: 1221600 - DNA, 16 bp, Homo sapiens
cctcactgttgaattt

SEQ ID NO: 1221601 - DNA, 19 bp, Homo sapiens
cctcacttccatacagctc

SEQ ID NO: 1221602 - DNA, 21 bp, Homo sapiens
cctcacttccatacagctcta

SEQ ID NO: 1221603 - DNA, 18 bp, Homo sapiens
cctcacttgattcatctc

SEQ ID NO: 1221604 - DNA, 23 bp, Homo sapiens
cctcacttgattcatctctggtt

SEQ ID NO: 1221605 - DNA, 22 bp, Homo sapiens
cctcacttttaatgaacaaatg

SEQ ID NO: 1221606 - DNA, 16 bp, Homo sapiens
cctcagaaggccccag

SEQ ID NO: 1221607 - DNA, 17 bp, Homo sapiens
cctcagacatctccagt

SEQ ID NO: 1221608 - DNA, 20 bp, Homo sapiens
cctcagacatctccagtgtg

SEQ ID NO: 1221609 - DNA, 13 bp, Homo sapiens
cctcagacattta

SEQ ID NO: 1221610 - DNA, 17 bp, Homo sapiens
cctcagacgttgcctga

SEQ ID NO: 1221611 - DNA, 19 bp, Homo sapiens
cctcagacgttgcctgaga

SEQ ID NO: 1221612 - DNA, 20 bp, Homo sapiens
cctcagacgttgcctgagaa

SEQ ID NO: 1221613 - DNA, 22 bp, Homo sapiens
cctcagacttaccaggaagcag

SEQ ID NO: 1221614 - DNA, 14 bp, Homo sapiens
cctcagagaccagg

SEQ ID NO: 1221615 - DNA, 16 bp, Homo sapiens
cctcagagaccagggc

SEQ ID NO: 1221616 - DNA, 19 bp, Homo sapiens
cctcagagaccagggctcc

SEQ ID NO: 1221617 - DNA, 21 bp, Homo sapiens
cctcagagaccagggctccag

SEQ ID NO: 1221618 - DNA, 16 bp, Homo sapiens
cctcagagagttgtct

SEQ ID NO: 1221619 - DNA, 13 bp, Homo sapiens
cctcagagatgat

SEQ ID NO: 1221620 - DNA, 12 bp, Homo sapiens
cctcagagccca

SEQ ID NO: 1221621 - DNA, 15 bp, Homo sapiens
cctcagagcccatgg

SEQ ID NO: 1221622 - DNA, 15 bp, Homo sapiens
cctcagagcgccagg

SEQ ID NO: 1221623 - DNA, 15 bp, Homo sapiens
cctcagaggctgagc

SEQ ID NO: 1221624 - DNA, 14 bp, Homo sapiens
cctcagagtgcaag

SEQ ID NO: 1221625 - DNA, 15 bp, Homo sapiens
cctcagatctctctc

SEQ ID NO: 1221626 - DNA, 17 bp, Homo sapiens
cctcagatctgaacaca

SEQ ID NO: 1221627 - DNA, 21 bp, Homo sapiens
cctcagatgatctctccacgg

SEQ ID NO: 1221628 - DNA, 16 bp, Homo sapiens
cctcagattgctgaat

SEQ ID NO: 1221629 - DNA, 14 bp, Homo sapiens
cctcagcaagccct

SEQ ID NO: 1221630 - DNA, 22 bp, Homo sapiens
cctcagcacccctagcatgaac

SEQ ID NO: 1221631 - DNA, 16 bp, Homo sapiens
cctcagcaccccttcc

SEQ ID NO: 1221632 - DNA, 20 bp, Homo sapiens
cctcagcaccccttccatgt

SEQ ID NO: 1221633 - DNA, 18 bp, Homo sapiens
cctcagccacttgcctgt

SEQ ID NO: 1221634 - DNA, 11 bp, Homo sapiens
cctcagccaga

SEQ ID NO: 1221635 - DNA, 19 bp, Homo sapiens
cctcagccagtggcacagg

SEQ ID NO: 1221636 - DNA, 21 bp, Homo sapiens
cctcagccatgaggagttgct

SEQ ID NO: 1221637 - DNA, 20 bp, Homo sapiens
cctcagccatgggaacctca

SEQ ID NO: 1221638 - DNA, 23 bp, Homo sapiens
cctcagccatgggaacctcatat

SEQ ID NO: 1221639 - DNA, 14 bp, Homo sapiens
cctcagctgccaag

SEQ ID NO: 1221640 - DNA, 15 bp, Homo sapiens
cctcagctgccaagc

SEQ ID NO: 1221641 - DNA, 17 bp, Homo sapiens
cctcagctgccaagcac

SEQ ID NO: 1221642 - DNA, 18 bp, Homo sapiens
cctcagctgcctcacttc

SEQ ID NO: 1221643 - DNA, 14 bp, Homo sapiens
cctcagctgtcacc

SEQ ID NO: 1221644 - DNA, 20 bp, Homo sapiens
cctcagctgtcacctgctca

SEQ ID NO: 1221645 - DNA, 22 bp, Homo sapiens
cctcagctgtcacctgctcaca

SEQ ID NO: 1221646 - DNA, 11 bp, Homo sapiens
cctcaggacaa

SEQ ID NO: 1221647 - DNA, 13 bp, Homo sapiens
cctcaggaccctc

SEQ ID NO: 1221648 - DNA, 17 bp, Homo sapiens
cctcaggaccctcagcc

SEQ ID NO: 1221649 - DNA, 22 bp, Homo sapiens
cctcaggagccgaagcccaggg

SEQ ID NO: 1221650 - DNA, 15 bp, Homo sapiens
cctcaggcacacagc

SEQ ID NO: 1221651 - DNA, 16 bp, Homo sapiens
cctcaggcacacagct

SEQ ID NO: 1221652 - DNA, 13 bp, Homo sapiens
cctcaggcagctc

SEQ ID NO: 1221653 - DNA, 13 bp, Homo sapiens
cctcaggcaggaa

SEQ ID NO: 1221654 - DNA, 19 bp, Homo sapiens
cctcaggcaggaagggcag

SEQ ID NO: 1221655 - DNA, 18 bp, Homo sapiens
cctcaggcataggcctgg

SEQ ID NO: 1221656 - DNA, 13 bp, Homo sapiens
cctcaggccaccc

SEQ ID NO: 1221657 - DNA, 15 bp, Homo sapiens
cctcaggccagggct

SEQ ID NO: 1221658 - DNA, 16 bp, Homo sapiens
cctcaggccagggctc

SEQ ID NO: 1221659 - DNA, 21 bp, Homo sapiens
cctcaggccaggtgcagtggc

SEQ ID NO: 1221660 - DNA, 14 bp, Homo sapiens
cctcaggctcccca

SEQ ID NO: 1221661 - DNA, 16 bp, Homo sapiens
cctcaggctccccaga

SEQ ID NO: 1221662 - DNA, 16 bp, Homo sapiens
cctcaggcttccttgg

SEQ ID NO: 1221663 - DNA, 15 bp, Homo sapiens
cctcaggcttgaggg

SEQ ID NO: 1221664 - DNA, 11 bp, Homo sapiens
cctcagggaca

SEQ ID NO: 1221665 - DNA, 20 bp, Homo sapiens
cctcagggagcagggaaggc

SEQ ID NO: 1221666 - DNA, 21 bp, Homo sapiens
cctcagggagcagggaaggcc

SEQ ID NO: 1221667 - DNA, 11 bp, Homo sapiens
cctcaggggca

SEQ ID NO: 1221668 - DNA, 12 bp, Homo sapiens
cctcaggggcac

SEQ ID NO: 1221669 - DNA, 16 bp, Homo sapiens
cctcaggggcacctcc

SEQ ID NO: 1221670 - DNA, 16 bp, Homo sapiens
cctcaggggcaggtgg

SEQ ID NO: 1221671 - DNA, 14 bp, Homo sapiens
cctcagggggccag

SEQ ID NO: 1221672 - DNA, 16 bp, Homo sapiens
cctcagggggccagct

SEQ ID NO: 1221673 - DNA, 22 bp, Homo sapiens
cctcagggggccagctggggag

SEQ ID NO: 1221674 - DNA, 21 bp, Homo sapiens
cctcagggggtaggagagcac

SEQ ID NO: 1221675 - DNA, 16 bp, Homo sapiens
cctcagggtcctgccc

SEQ ID NO: 1221676 - DNA, 21 bp, Homo sapiens
cctcagggtctaaggagcgct

SEQ ID NO: 1221677 - DNA, 13 bp, Homo sapiens
cctcagggtgggg

SEQ ID NO: 1221678 - DNA, 14 bp, Homo sapiens
cctcagggtggggg

SEQ ID NO: 1221679 - DNA, 19 bp, Homo sapiens
cctcaggtacagcgggctg

SEQ ID NO: 1221680 - DNA, 19 bp, Homo sapiens
cctcaggtagtactgggaa

SEQ ID NO: 1221681 - DNA, 17 bp, Homo sapiens
cctcaggtcagctggga

SEQ ID NO: 1221682 - DNA, 20 bp, Homo sapiens
cctcaggtgagaagcagagg

SEQ ID NO: 1221683 - DNA, 15 bp, Homo sapiens
cctcaggtgcctcca

SEQ ID NO: 1221684 - DNA, 18 bp, Homo sapiens
cctcaggtgcctccaatt

SEQ ID NO: 1221685 - DNA, 16 bp, Homo sapiens
cctcaggtgctgtcca

SEQ ID NO: 1221686 - DNA, 23 bp, Homo sapiens
cctcaggtggccagcctggatct

SEQ ID NO: 1221687 - DNA, 15 bp, Homo sapiens
cctcaggtggccatg

SEQ ID NO: 1221688 - DNA, 18 bp, Homo sapiens
cctcaggtggccatgcct

SEQ ID NO: 1221689 - DNA, 21 bp, Homo sapiens
cctcaggtgtgcctgttgctt

SEQ ID NO: 1221690 - DNA, 14 bp, Homo sapiens
cctcaggttccttt

SEQ ID NO: 1221691 - DNA, 17 bp, Homo sapiens
cctcagtaacatttctg

SEQ ID NO: 1221692 - DNA, 21 bp, Homo sapiens
cctcagtagaaaaggatctaa

SEQ ID NO: 1221693 - DNA, 23 bp, Homo sapiens
cctcagtagatactaaagcaaat

SEQ ID NO: 1221694 - DNA, 21 bp, Homo sapiens
cctcagtagtccctgcacagt

SEQ ID NO: 1221695 - DNA, 23 bp, Homo sapiens
cctcagtagtccctgcacagtga

SEQ ID NO: 1221696 - DNA, 16 bp, Homo sapiens
cctcagtatatttaaa

SEQ ID NO: 1221697 - DNA, 18 bp, Homo sapiens
cctcagtatttatgtaat

SEQ ID NO: 1221698 - DNA, 13 bp, Homo sapiens
cctcagtcacccc

SEQ ID NO: 1221699 - DNA, 15 bp, Homo sapiens
cctcagtcaccccca

SEQ ID NO: 1221700 - DNA, 20 bp, Homo sapiens
cctcagtcagttcccggagc

SEQ ID NO: 1221701 - DNA, 17 bp, Homo sapiens
cctcattcaggaaaact

SEQ ID NO: 1221702 - DNA, 22 bp, Homo sapiens
cctcattcaggaaaactgacag

SEQ ID NO: 1221703 - DNA, 13 bp, Homo sapiens
cctcattcccctc

SEQ ID NO: 1221704 - DNA, 12 bp, Homo sapiens
cctcattctgaa

SEQ ID NO: 1221705 - DNA, 18 bp, Homo sapiens
cctcattctgaggcctga

SEQ ID NO: 1221706 - DNA, 15 bp, Homo sapiens
cctcattgcctcctg

SEQ ID NO: 1221707 - DNA, 17 bp, Homo sapiens
cctcattgcctcctgtt

SEQ ID NO: 1221708 - DNA, 21 bp, Homo sapiens
cctcattgcctcctgttctgc

SEQ ID NO: 1221709 - DNA, 21 bp, Homo sapiens
cctcattgtgccaagccttct

SEQ ID NO: 1221710 - DNA, 13 bp, Homo sapiens
cctcatttaaaag

SEQ ID NO: 1221711 - DNA, 18 bp, Homo sapiens
cctcatttcttcctctgc

SEQ ID NO: 1221712 - DNA, 20 bp, Homo sapiens
cctcatttcttcctctgcat

SEQ ID NO: 1221713 - DNA, 16 bp, Homo sapiens
cctcatttttccttta

SEQ ID NO: 1221714 - DNA, 15 bp, Homo sapiens
cctccaaaagcactt

SEQ ID NO: 1221715 - DNA, 17 bp, Homo sapiens
cctccaaacctccagcc

SEQ ID NO: 1221716 - DNA, 20 bp, Homo sapiens
cctccaaacctccagcctcc

SEQ ID NO: 1221717 - DNA, 19 bp, Homo sapiens
cctccaaatggagaagctg

SEQ ID NO: 1221718 - DNA, 20 bp, Homo sapiens
cctccaaatggagaagctgc

SEQ ID NO: 1221719 - DNA, 21 bp, Homo sapiens
cctccaaatggagaagctgca

SEQ ID NO: 1221720 - DNA, 23 bp, Homo sapiens
cctccaaatggagaagctgcagg

SEQ ID NO: 1221721 - DNA, 21 bp, Homo sapiens
cctccaaccaaataagacttc

SEQ ID NO: 1221722 - DNA, 18 bp, Homo sapiens
cctccaaccctagcaaaa

SEQ ID NO: 1221723 - DNA, 19 bp, Homo sapiens
cctccaaccctagcaaaag

SEQ ID NO: 1221724 - DNA, 14 bp, Homo sapiens
cctccaaccctgcc

SEQ ID NO: 1221725 - DNA, 15 bp, Homo sapiens
cctccaaccctgccg

SEQ ID NO: 1221726 - DNA, 21 bp, Homo sapiens
cctccaagcacagagcctggc

SEQ ID NO: 1221727 - DNA, 14 bp, Homo sapiens
cctccaagcatttc

SEQ ID NO: 1221728 - DNA, 16 bp, Homo sapiens
cctccaagcctgcctc

SEQ ID NO: 1221729 - DNA, 17 bp, Homo sapiens
cctccaagcggccctgt

SEQ ID NO: 1221730 - DNA, 21 bp, Homo sapiens
cctccaaggaggggctgtaaa

SEQ ID NO: 1221731 - DNA, 21 bp, Homo sapiens
cctccaagggtttcgactggt

SEQ ID NO: 1221732 - DNA, 22 bp, Homo sapiens
cctccaagggtttcgactggtc

SEQ ID NO: 1221733 - DNA, 14 bp, Homo sapiens
cctccaatgtcctg

SEQ ID NO: 1221734 - DNA, 18 bp, Homo sapiens
cctccaatgtcctgaaac

SEQ ID NO: 1221735 - DNA, 22 bp, Homo sapiens
cctccaattggtgcttcagccc

SEQ ID NO: 1221736 - DNA, 19 bp, Homo sapiens
cctccacaaagcaaaggca

SEQ ID NO: 1221737 - DNA, 18 bp, Homo sapiens
cctccacaccagtggcct

SEQ ID NO: 1221738 - DNA, 22 bp, Homo sapiens
cctccacaccagtggcctcgtg

SEQ ID NO: 1221739 - DNA, 16 bp, Homo sapiens
cctccacacctgaact

SEQ ID NO: 1221740 - DNA, 14 bp, Homo sapiens
cctccacagagagg

SEQ ID NO: 1221741 - DNA, 17 bp, Homo sapiens
cctccacagccgcagcc

SEQ ID NO: 1221742 - DNA, 14 bp, Homo sapiens
cctccacagcgagg

SEQ ID NO: 1221743 - DNA, 20 bp, Homo sapiens
cctccacagcgagggcagct

SEQ ID NO: 1221744 - DNA, 21 bp, Homo sapiens
cctccacagcgagggcagctg

SEQ ID NO: 1221745 - DNA, 14 bp, Homo sapiens
cctccacagctgca

SEQ ID NO: 1221746 - DNA, 21 bp, Homo sapiens
cctccacagtcccccacccac

SEQ ID NO: 1221747 - DNA, 17 bp, Homo sapiens
cctccacagtgctgctt

SEQ ID NO: 1221748 - DNA, 12 bp, Homo sapiens
cctccacatcct

SEQ ID NO: 1221749 - DNA, 15 bp, Homo sapiens
cctccacatcctcca

SEQ ID NO: 1221750 - DNA, 16 bp, Homo sapiens
cctccacatcctttct

SEQ ID NO: 1221751 - DNA, 18 bp, Homo sapiens
cctccacatgctgcctgg

SEQ ID NO: 1221752 - DNA, 19 bp, Homo sapiens
cctccacatgctgcctggc

SEQ ID NO: 1221753 - DNA, 21 bp, Homo sapiens
cctccacattaagtggctttt

SEQ ID NO: 1221754 - DNA, 14 bp, Homo sapiens
cctccaccaccact

SEQ ID NO: 1221755 - DNA, 20 bp, Homo sapiens
cctccaccaccactggccac

SEQ ID NO: 1221756 - DNA, 15 bp, Homo sapiens
cctctggagtggcca

SEQ ID NO: 1221757 - DNA, 16 bp, Homo sapiens
cctctggagtggccac

SEQ ID NO: 1221758 - DNA, 21 bp, Homo sapiens
cctctggcattagaattattt

SEQ ID NO: 1221759 - DNA, 18 bp, Homo sapiens
cctctggccaaatatgca

SEQ ID NO: 1221760 - DNA, 12 bp, Homo sapiens
cctctggccagg

SEQ ID NO: 1221761 - DNA, 15 bp, Homo sapiens
cctctggccaggatg

SEQ ID NO: 1221762 - DNA, 10 bp, Homo sapiens
cctctggccc

SEQ ID NO: 1221763 - DNA, 15 bp, Homo sapiens
cctctggcccctcac

SEQ ID NO: 1221764 - DNA, 19 bp, Homo sapiens
cctctggcccctcacccac

SEQ ID NO: 1221765 - DNA, 20 bp, Homo sapiens
cctctggcccctcacccacc

SEQ ID NO: 1221766 - DNA, 11 bp, Homo sapiens
cctctggccct

SEQ ID NO: 1221767 - DNA, 13 bp, Homo sapiens
cctctggccctgc

SEQ ID NO: 1221768 - DNA, 14 bp, Homo sapiens
cctctggcccttgg

SEQ ID NO: 1221769 - DNA, 15 bp, Homo sapiens
cctctggccgccacc

SEQ ID NO: 1221770 - DNA, 16 bp, Homo sapiens
cctctggctccagctg

SEQ ID NO: 1221771 - DNA, 10 bp, Homo sapiens
cctctggctt

SEQ ID NO: 1221772 - DNA, 13 bp, Homo sapiens
cctctggcttccc

SEQ ID NO: 1221773 - DNA, 15 bp, Homo sapiens
cctctggcttcccat

SEQ ID NO: 1221774 - DNA, 23 bp, Homo sapiens
cctctggcttccctaaactgcag

SEQ ID NO: 1221775 - DNA, 16 bp, Homo sapiens
cctgctcctccctggc

SEQ ID NO: 1221776 - DNA, 13 bp, Homo sapiens
cctgctcctcctg

SEQ ID NO: 1221777 - DNA, 21 bp, Homo sapiens
cctgctcctcctgccctgtcc

SEQ ID NO: 1221778 - DNA, 22 bp, Homo sapiens
cctgctcctcctgccctgtccc

SEQ ID NO: 1221779 - DNA, 17 bp, Homo sapiens
cctgctcctgcagcatg

SEQ ID NO: 1221780 - DNA, 17 bp, Homo sapiens
cctgctctacccatgag

SEQ ID NO: 1221781 - DNA, 22 bp, Homo sapiens
cctgctctacccatgagcctgc

SEQ ID NO: 1221782 - DNA, 18 bp, Homo sapiens
cctgctctagtgggacag

SEQ ID NO: 1221783 - DNA, 19 bp, Homo sapiens
cctgctctcctcttgccac

SEQ ID NO: 1221784 - DNA, 21 bp, Homo sapiens
cctgctctcctcttgccactg

SEQ ID NO: 1221785 - DNA, 13 bp, Homo sapiens
cctgctctctgct

SEQ ID NO: 1221786 - DNA, 14 bp, Homo sapiens
cctgctctctggag

SEQ ID NO: 1221787 - DNA, 24 bp, Homo sapiens
cctgctctttctacatgactgggc

SEQ ID NO: 1221788 - DNA, 21 bp, Homo sapiens
cctgctgaaagtcctgctttc

SEQ ID NO: 1221789 - DNA, 21 bp, Homo sapiens
cctgctgaacacagtgtctgt

SEQ ID NO: 1221790 - DNA, 21 bp, Homo sapiens
cctgctgaaggtggggattgc

SEQ ID NO: 1221791 - DNA, 23 bp, Homo sapiens
cctgctgaatgatttccaaagag

SEQ ID NO: 1221792 - DNA, 14 bp, Homo sapiens
cctgctgacagaca

SEQ ID NO: 1221793 - DNA, 13 bp, Homo sapiens
cctgctgacctgt

SEQ ID NO: 1221794 - DNA, 15 bp, Homo sapiens
cctgctgacctgtgc

SEQ ID NO: 1221795 - DNA, 17 bp, Homo sapiens
cctgctgagagacccaa

SEQ ID NO: 1221796 - DNA, 22 bp, Homo sapiens
cctgctgaggaggggcctgggc

SEQ ID NO: 1221797 - DNA, 14 bp, Homo sapiens
cctgctgaggcagt

SEQ ID NO: 1221798 - DNA, 20 bp, Homo sapiens
cctgctgcaccctgcgcctc

SEQ ID NO: 1221799 - DNA, 20 bp, Homo sapiens
cctgctgcactaggacttgg

SEQ ID NO: 1221800 - DNA, 12 bp, Homo sapiens
cctgctgccaca

SEQ ID NO: 1221801 - DNA, 14 bp, Homo sapiens
cctgctgccacagc

SEQ ID NO: 1221802 - DNA, 19 bp, Homo sapiens
cctgctgccacagcaagga

SEQ ID NO: 1221803 - DNA, 15 bp, Homo sapiens
cctgctgccagtgca

SEQ ID NO: 1221804 - DNA, 16 bp, Homo sapiens
cctgctgccagtgcag

SEQ ID NO: 1221805 - DNA, 20 bp, Homo sapiens
cctgctgccagtgcagccac

SEQ ID NO: 1221806 - DNA, 22 bp, Homo sapiens
cctgctgccagtgcagccactg

SEQ ID NO: 1221807 - DNA, 22 bp, Homo sapiens
cctgctgccatgtggactggtg

SEQ ID NO: 1221808 - DNA, 15 bp, Homo sapiens
cctgctgcccaggct

SEQ ID NO: 1221809 - DNA, 16 bp, Homo sapiens
cctgctgcccagtgca

SEQ ID NO: 1221810 - DNA, 13 bp, Homo sapiens
cctgctgccccag

SEQ ID NO: 1221811 - DNA, 17 bp, Homo sapiens
cctgctgccccagctga

SEQ ID NO: 1221812 - DNA, 22 bp, Homo sapiens
cctgctgccgcctcccagcctg

SEQ ID NO: 1221813 - DNA, 13 bp, Homo sapiens
cctgctgcctccc

SEQ ID NO: 1221814 - DNA, 15 bp, Homo sapiens
cctgctgcctcccca

SEQ ID NO: 1221815 - DNA, 16 bp, Homo sapiens
cctgctgcctccccaa

SEQ ID NO: 1221816 - DNA, 17 bp, Homo sapiens
cctgctgcctccccaac

SEQ ID NO: 1221817 - DNA, 19 bp, Homo sapiens
cctgctgccttttctggag

SEQ ID NO: 1221818 - DNA, 15 bp, Homo sapiens
cctgctgctcctgtt

SEQ ID NO: 1221819 - DNA, 20 bp, Homo sapiens
cctgctgctgccagggcttc

SEQ ID NO: 1221820 - DNA, 11 bp, Homo sapiens
cctgctgctgt

SEQ ID NO: 1221821 - DNA, 20 bp, Homo sapiens
cctgctgctgtgtttttgct

SEQ ID NO: 1221822 - DNA, 14 bp, Homo sapiens
cctgctgcttggga

SEQ ID NO: 1221823 - DNA, 12 bp, Homo sapiens
cctgctggaagc

SEQ ID NO: 1221824 - DNA, 14 bp, Homo sapiens
cctgctggaggcct

SEQ ID NO: 1221825 - DNA, 17 bp, Homo sapiens
cctgctggaggcctcag

SEQ ID NO: 1221826 - DNA, 18 bp, Homo sapiens
cctgctggaggcctcagg

SEQ ID NO: 1221827 - DNA, 9 bp, Homo sapiens
cctgctggc

SEQ ID NO: 1221828 - DNA, 12 bp, Homo sapiens
cctgctggcagg

SEQ ID NO: 1221829 - DNA, 14 bp, Homo sapiens
cctgctggcagggc

SEQ ID NO: 1221830 - DNA, 16 bp, Homo sapiens
cctgctggcagggcca

SEQ ID NO: 1221831 - DNA, 23 bp, Homo sapiens
cctgctggcagggccagggcaat

SEQ ID NO: 1221832 - DNA, 19 bp, Homo sapiens
cctgctggcatcaggtctg

SEQ ID NO: 1221833 - DNA, 12 bp, Homo sapiens
cctgctggcccc

SEQ ID NO: 1221834 - DNA, 18 bp, Homo sapiens
cctgctggcccctcacct

SEQ ID NO: 1221835 - DNA, 21 bp, Homo sapiens
cctgctggcccctcacctggg

SEQ ID NO: 1221836 - DNA, 21 bp, Homo sapiens
cctgctgggaaccccgcagcc

SEQ ID NO: 1221837 - DNA, 22 bp, Homo sapiens
cctgctgggaaccccgcagccc

SEQ ID NO: 1221838 - DNA, 19 bp, Homo sapiens
cctgctgggaagagctccc

SEQ ID NO: 1221839 - DNA, 13 bp, Homo sapiens
cctgctgggactg

SEQ ID NO: 1221840 - DNA, 16 bp, Homo sapiens
cctgctgggcgtgtgt

SEQ ID NO: 1221841 - DNA, 21 bp, Homo sapiens
cctgctgggctctccacctca

SEQ ID NO: 1221842 - DNA, 22 bp, Homo sapiens
cctgctgggctctccacctcag

SEQ ID NO: 1221843 - DNA, 17 bp, Homo sapiens
cctgctggggctgaaca

SEQ ID NO: 1221844 - DNA, 16 bp, Homo sapiens
cctgctgtccctgtca

SEQ ID NO: 1221845 - DNA, 15 bp, Homo sapiens
cctgctgtctctctg

SEQ ID NO: 1221846 - DNA, 20 bp, Homo sapiens
cctgctgtgattccactaca

SEQ ID NO: 1221847 - DNA, 12 bp, Homo sapiens
cctgctgtgcct

SEQ ID NO: 1221848 - DNA, 13 bp, Homo sapiens
cctgctgtggggc

SEQ ID NO: 1221849 - DNA, 22 bp, Homo sapiens
cctgctgtgtccttcctccaca

SEQ ID NO: 1221850 - DNA, 19 bp, Homo sapiens
cctgctgtgttaagaggac

SEQ ID NO: 1221851 - DNA, 18 bp, Homo sapiens
cctgcttaaacttgaccc

SEQ ID NO: 1221852 - DNA, 17 bp, Homo sapiens
cctgcttcatgctcagc

SEQ ID NO: 1221853 - DNA, 13 bp, Homo sapiens
cctgcttcccctc

SEQ ID NO: 1221854 - DNA, 13 bp, Homo sapiens
cctgcttcccctt

SEQ ID NO: 1221855 - DNA, 14 bp, Homo sapiens
cctgcttcctggct

SEQ ID NO: 1221856 - DNA, 12 bp, Homo sapiens
cctgcttcctgt

SEQ ID NO: 1221857 - DNA, 13 bp, Homo sapiens
cctgcttccttca

SEQ ID NO: 1221858 - DNA, 16 bp, Homo sapiens
cctgcttccttcagtt

SEQ ID NO: 1221859 - DNA, 19 bp, Homo sapiens
cctgcttcttctctccaca

SEQ ID NO: 1221860 - DNA, 15 bp, Homo sapiens
cctgcttgcacactt

SEQ ID NO: 1221861 - DNA, 17 bp, Homo sapiens
cctgcttgccaaggcag

SEQ ID NO: 1221862 - DNA, 23 bp, Homo sapiens
cctgcttgccaaggcagaggcct

SEQ ID NO: 1221863 - DNA, 15 bp, Homo sapiens
cctgcttgcccgctc

SEQ ID NO: 1221864 - DNA, 22 bp, Homo sapiens
cctgcttgtactaagccaggag

SEQ ID NO: 1221865 - DNA, 13 bp, Homo sapiens
cctgcttgttggg

SEQ ID NO: 1221866 - DNA, 20 bp, Homo sapiens
cctgctttgaataaatgtgt

SEQ ID NO: 1221867 - DNA, 13 bp, Homo sapiens
cctgctttggcct

SEQ ID NO: 1221868 - DNA, 16 bp, Homo sapiens
cctgctttggcctttc

SEQ ID NO: 1221869 - DNA, 18 bp, Homo sapiens
cctgcttttccaggatcc

SEQ ID NO: 1221870 - DNA, 19 bp, Homo sapiens
cctgcttttccaggatcct

SEQ ID NO: 1221871 - DNA, 23 bp, Homo sapiens
cctgcttttccaggatcctgcag

SEQ ID NO: 1221872 - DNA, 19 bp, Homo sapiens
cctgcttttgatgatgtct

SEQ ID NO: 1221873 - DNA, 20 bp, Homo sapiens
cctgctttttggaaagtcag

SEQ ID NO: 1221874 - DNA, 15 bp, Homo sapiens
cctgctttttttctt

SEQ ID NO: 1221875 - DNA, 17 bp, Homo sapiens
cctgctttttttcttaa

SEQ ID NO: 1221876 - DNA, 14 bp, Homo sapiens
cctggaaacagacc

SEQ ID NO: 1221877 - DNA, 16 bp, Homo sapiens
cctggaaacagcatga

SEQ ID NO: 1221878 - DNA, 19 bp, Homo sapiens
cctggaaagcaggatgtag

SEQ ID NO: 1221879 - DNA, 23 bp, Homo sapiens
cctggaaaggctcagtctcagga

SEQ ID NO: 1221880 - DNA, 14 bp, Homo sapiens
cctggaaccaatcc

SEQ ID NO: 1221881 - DNA, 18 bp, Homo sapiens
cctggaaccagagccaca

SEQ ID NO: 1221882 - DNA, 15 bp, Homo sapiens
cctggaaccagggag

SEQ ID NO: 1221883 - DNA, 18 bp, Homo sapiens
cctggaaccttgctgtcc

SEQ ID NO: 1221884 - DNA, 20 bp, Homo sapiens
cctggaaccttgctgtcctg

SEQ ID NO: 1221885 - DNA, 12 bp, Homo sapiens
cctggaagacaa

SEQ ID NO: 1221886 - DNA, 18 bp, Homo sapiens
cctggaagacaacccagg

SEQ ID NO: 1221887 - DNA, 19 bp, Homo sapiens
cctggaagacaacccaggc

SEQ ID NO: 1221888 - DNA, 18 bp, Homo sapiens
cctggaagagcccagtct

SEQ ID NO: 1221889 - DNA, 11 bp, Homo sapiens
cctggaagcca

SEQ ID NO: 1221890 - DNA, 20 bp, Homo sapiens
cctggaagctgtgtccttgc

SEQ ID NO: 1221891 - DNA, 20 bp, Homo sapiens
cctggaaggacatccatgtt

SEQ ID NO: 1221892 - DNA, 15 bp, Homo sapiens
cctgctcccctttgg

SEQ ID NO: 1221893 - DNA, 17 bp, Homo sapiens
cctgctccgtggactgc

SEQ ID NO: 1221894 - DNA, 14 bp, Homo sapiens
cctgctcctcactg

SEQ ID NO: 1221895 - DNA, 19 bp, Homo sapiens
cctgctcctccctgccccc

SEQ ID NO: 1221896 - DNA, 15 bp, Homo sapiens
cctgctcctccctgg

SEQ ID NO: 1221897 - DNA, 15 bp, Homo sapiens
cctggcagctgctgt

SEQ ID NO: 1221898 - DNA, 16 bp, Homo sapiens
cctggcagctgctgtg

SEQ ID NO: 1221899 - DNA, 22 bp, Homo sapiens
cctggcagctgctgtgggtggg

SEQ ID NO: 1221900 - DNA, 21 bp, Homo sapiens
cctggcaggctgtctggccag

SEQ ID NO: 1221901 - DNA, 21 bp, Homo sapiens
cctggcagggccacctgcagg

SEQ ID NO: 1221902 - DNA, 23 bp, Homo sapiens
cctggcagttgaacagagggaga

SEQ ID NO: 1221903 - DNA, 15 bp, Homo sapiens
cctggcatctgtgcg

SEQ ID NO: 1221904 - DNA, 15 bp, Homo sapiens
cctggcatctgtgtg

SEQ ID NO: 1221905 - DNA, 16 bp, Homo sapiens
cctggcatctgtgtgt

SEQ ID NO: 1221906 - DNA, 19 bp, Homo sapiens
cctggcattatgtccactg

SEQ ID NO: 1221907 - DNA, 20 bp, Homo sapiens
cctggcattcttgtacagtg

SEQ ID NO: 1221908 - DNA, 21 bp, Homo sapiens
cctggccaagctttgaggctc

SEQ ID NO: 1221909 - DNA, 16 bp, Homo sapiens
cctggccaccagccat

SEQ ID NO: 1221910 - DNA, 12 bp, Homo sapiens
cctggccacctg

SEQ ID NO: 1221911 - DNA, 19 bp, Homo sapiens
cctggccaccttgtcctgg

SEQ ID NO: 1221912 - DNA, 16 bp, Homo sapiens
cctggccactaaagct

SEQ ID NO: 1221913 - DNA, 17 bp, Homo sapiens
cctggccactgtccctg

SEQ ID NO: 1221914 - DNA, 19 bp, Homo sapiens
cctggccactgtccctgtc

SEQ ID NO: 1221915 - DNA, 22 bp, Homo sapiens
cctggccactgtccctgtcctt

SEQ ID NO: 1221916 - DNA, 12 bp, Homo sapiens
cctggccagaca

SEQ ID NO: 1221917 - DNA, 12 bp, Homo sapiens
cctggccagatt

SEQ ID NO: 1221918 - DNA, 16 bp, Homo sapiens
cctggccagctctgag

SEQ ID NO: 1221919 - DNA, 17 bp, Homo sapiens
cctggccagctctgagg

SEQ ID NO: 1221920 - DNA, 12 bp, Homo sapiens
cctggccaggag

SEQ ID NO: 1221921 - DNA, 16 bp, Homo sapiens
cctggccaggagcagg

SEQ ID NO: 1221922 - DNA, 14 bp, Homo sapiens
cctggccaggagct

SEQ ID NO: 1221923 - DNA, 15 bp, Homo sapiens
cctggccaggagctc

SEQ ID NO: 1221924 - DNA, 22 bp, Homo sapiens
cctggccaggagctcttcaggc

SEQ ID NO: 1221925 - DNA, 21 bp, Homo sapiens
cctggccaggcaccccctgga

SEQ ID NO: 1221926 - DNA, 14 bp, Homo sapiens
cctggccaggcaga

SEQ ID NO: 1221927 - DNA, 16 bp, Homo sapiens
cctggccagtcctggt

SEQ ID NO: 1221928 - DNA, 19 bp, Homo sapiens
cctggccatcccacaagtg

SEQ ID NO: 1221929 - DNA, 18 bp, Homo sapiens
cctggccatgctgtccct

SEQ ID NO: 1221930 - DNA, 16 bp, Homo sapiens
cctggcccacccccca

SEQ ID NO: 1221931 - DNA, 17 bp, Homo sapiens
cctggcccaccccccag

SEQ ID NO: 1221932 - DNA, 20 bp, Homo sapiens
cctggcccaccccccagcct

SEQ ID NO: 1221933 - DNA, 18 bp, Homo sapiens
cctggcccactctgtaat

SEQ ID NO: 1221934 - DNA, 20 bp, Homo sapiens
cctggcccagcggcccctcc

SEQ ID NO: 1221935 - DNA, 14 bp, Homo sapiens
cctggcccaggcct

SEQ ID NO: 1221936 - DNA, 22 bp, Homo sapiens
cctggcccaggccttgctgact

SEQ ID NO: 1221937 - DNA, 16 bp, Homo sapiens
cctggcccatctcagc

SEQ ID NO: 1221938 - DNA, 18 bp, Homo sapiens
cctggcccatctcagcct

SEQ ID NO: 1221939 - DNA, 15 bp, Homo sapiens
cctggccccagcctg

SEQ ID NO: 1221940 - DNA, 18 bp, Homo sapiens
cctggccccagcctgggc

SEQ ID NO: 1221941 - DNA, 13 bp, Homo sapiens
cctggccccagga

SEQ ID NO: 1221942 - DNA, 13 bp, Homo sapiens
cctggccccaggc

SEQ ID NO: 1221943 - DNA, 21 bp, Homo sapiens
cctggccccaggccccagaca

SEQ ID NO: 1221944 - DNA, 12 bp, Homo sapiens
cctggccccatg

SEQ ID NO: 1221945 - DNA, 17 bp, Homo sapiens
cctggccccatgtctct

SEQ ID NO: 1221946 - DNA, 20 bp, Homo sapiens
cctggcccccaacctcaggg

SEQ ID NO: 1221947 - DNA, 23 bp, Homo sapiens
cctggcccccaacctcagggctc

SEQ ID NO: 1221948 - DNA, 17 bp, Homo sapiens
cctggccccctcattca

SEQ ID NO: 1221949 - DNA, 24 bp, Homo sapiens
cctggccccctcattcagagactg

SEQ ID NO: 1221950 - DNA, 23 bp, Homo sapiens
cctggccccgggctctggccacc

SEQ ID NO: 1221951 - DNA, 22 bp, Homo sapiens
cctggcccctccagaccctgcc

SEQ ID NO: 1221952 - DNA, 15 bp, Homo sapiens
cctggcccctgtggg

SEQ ID NO: 1221953 - DNA, 19 bp, Homo sapiens
cctggcccctgtggggaac

SEQ ID NO: 1221954 - DNA, 23 bp, Homo sapiens
cctggccctgcttcctgcttgcc

SEQ ID NO: 1221955 - DNA, 14 bp, Homo sapiens
cctggccctggggg

SEQ ID NO: 1221956 - DNA, 15 bp, Homo sapiens
cctggcccttcagtc

SEQ ID NO: 1221957 - DNA, 18 bp, Homo sapiens
cctggccgagtccaagct

SEQ ID NO: 1221958 - DNA, 19 bp, Homo sapiens
cctggccgagtccaagctg

SEQ ID NO: 1221959 - DNA, 22 bp, Homo sapiens
cctggccgccccctgcccccca

SEQ ID NO: 1221960 - DNA, 17 bp, Homo sapiens
cctggccgcgctccggg

SEQ ID NO: 1221961 - DNA, 20 bp, Homo sapiens
cctggccggggcccctcacc

SEQ ID NO: 1221962 - DNA, 18 bp, Homo sapiens
cctggccgggtcaccctg

SEQ ID NO: 1221963 - DNA, 13 bp, Homo sapiens
cctggcctcactg

SEQ ID NO: 1221964 - DNA, 15 bp, Homo sapiens
cctggcctcactggc

SEQ ID NO: 1221965 - DNA, 17 bp, Homo sapiens
cctggcctcactggctg

SEQ ID NO: 1221966 - DNA, 18 bp, Homo sapiens
cctggcctcactggctgg

SEQ ID NO: 1221967 - DNA, 21 bp, Homo sapiens
cctggcctcagttcccagctc

SEQ ID NO: 1221968 - DNA, 15 bp, Homo sapiens
cctggcctcccctgc

SEQ ID NO: 1221969 - DNA, 17 bp, Homo sapiens
cctggcctcccctgcca

SEQ ID NO: 1221970 - DNA, 11 bp, Homo sapiens
cctggcctcct

SEQ ID NO: 1221971 - DNA, 13 bp, Homo sapiens
cctggcctctgct

SEQ ID NO: 1221972 - DNA, 14 bp, Homo sapiens
cctggcctctgtgc

SEQ ID NO: 1221973 - DNA, 13 bp, Homo sapiens
cctggcctgagct

SEQ ID NO: 1221974 - DNA, 14 bp, Homo sapiens
cctggcctgagctg

SEQ ID NO: 1221975 - DNA, 19 bp, Homo sapiens
cctggcctgagctggggcc

SEQ ID NO: 1221976 - DNA, 22 bp, Homo sapiens
cctggcctgagctggggccaca

SEQ ID NO: 1221977 - DNA, 17 bp, Homo sapiens
cctggcctgccggacac

SEQ ID NO: 1221978 - DNA, 13 bp, Homo sapiens
cctggcctgctgg

SEQ ID NO: 1221979 - DNA, 16 bp, Homo sapiens
cctggcctggctcccc

SEQ ID NO: 1221980 - DNA, 14 bp, Homo sapiens
cctggcctgggcca

SEQ ID NO: 1221981 - DNA, 16 bp, Homo sapiens
cctggccttctgaact

SEQ ID NO: 1221982 - DNA, 21 bp, Homo sapiens
cctggccttgtgtcactggct

SEQ ID NO: 1221983 - DNA, 18 bp, Homo sapiens
cctggcgacaagagtgag

SEQ ID NO: 1221984 - DNA, 22 bp, Homo sapiens
cctggcgcaggtgggctggact

SEQ ID NO: 1221985 - DNA, 18 bp, Homo sapiens
cctggcggccccaactcg

SEQ ID NO: 1221986 - DNA, 15 bp, Homo sapiens
cctggcggcctgtgg

SEQ ID NO: 1221987 - DNA, 15 bp, Homo sapiens
cctggcgggggtggg

SEQ ID NO: 1221988 - DNA, 16 bp, Homo sapiens
cctggcgtcggccaga

SEQ ID NO: 1221989 - DNA, 19 bp, Homo sapiens
cctggcgtgctcagaccca

SEQ ID NO: 1221990 - DNA, 22 bp, Homo sapiens
cctggctaataaggctttagtg

SEQ ID NO: 1221991 - DNA, 19 bp, Homo sapiens
cctggctacatcccagcct

SEQ ID NO: 1221992 - DNA, 14 bp, Homo sapiens
cctggctcccacct

SEQ ID NO: 1221993 - DNA, 16 bp, Homo sapiens
cctggctccccacgag

SEQ ID NO: 1221994 - DNA, 21 bp, Homo sapiens
cctggctccccacgagtcacc

SEQ ID NO: 1221995 - DNA, 13 bp, Homo sapiens
cctggctccccct

SEQ ID NO: 1221996 - DNA, 18 bp, Homo sapiens
cctggctccccgagggct

SEQ ID NO: 1221997 - DNA, 22 bp, Homo sapiens
cctggctccccgagggctcaga

SEQ ID NO: 1221998 - DNA, 23 bp, Homo sapiens
cctggctccctcctccaggcctg

SEQ ID NO: 1221999 - DNA, 21 bp, Homo sapiens
cctggctccttcactgaacat

SEQ ID NO: 1222000 - DNA, 22 bp, Homo sapiens
cctggctccttgcagcagggct

SEQ ID NO: 1222001 - DNA, 19 bp, Homo sapiens
cctggctctaccctgtctg

SEQ ID NO: 1222002 - DNA, 20 bp, Homo sapiens
cctggctctaccctgtctgt

SEQ ID NO: 1222003 - DNA, 16 bp, Homo sapiens
cctggctctcagaagg

SEQ ID NO: 1222004 - DNA, 22 bp, Homo sapiens
cctggctctgcaatgggcactg

SEQ ID NO: 1222005 - DNA, 14 bp, Homo sapiens
cctggctctgcccc

SEQ ID NO: 1222006 - DNA, 18 bp, Homo sapiens
cctggctctgcccctcag

SEQ ID NO: 1222007 - DNA, 20 bp, Homo sapiens
cctggctctgcccctcaggg

SEQ ID NO: 1222008 - DNA, 18 bp, Homo sapiens
cctgggccgtggcacagc

SEQ ID NO: 1222009 - DNA, 21 bp, Homo sapiens
cctgggccgtggcacagctgg

SEQ ID NO: 1222010 - DNA, 22 bp, Homo sapiens
cctgggccgtggcacagctggg

SEQ ID NO: 1222011 - DNA, 14 bp, Homo sapiens
cctgggcctcagtt

SEQ ID NO: 1222012 - DNA, 13 bp, Homo sapiens
cctgggcctgccc

SEQ ID NO: 1222013 - DNA, 13 bp, Homo sapiens
cctgggcctgctt

SEQ ID NO: 1222014 - DNA, 20 bp, Homo sapiens
cctgggcctgcttttccagg

SEQ ID NO: 1222015 - DNA, 23 bp, Homo sapiens
cctgggcctgcttttccaggatc

SEQ ID NO: 1222016 - DNA, 13 bp, Homo sapiens
cctgggcctgtgc

SEQ ID NO: 1222017 - DNA, 14 bp, Homo sapiens
cctgggcctgtgca

SEQ ID NO: 1222018 - DNA, 18 bp, Homo sapiens
cctgggcctgtgcagcag

SEQ ID NO: 1222019 - DNA, 19 bp, Homo sapiens
cctgggcctgtgcagcagc

SEQ ID NO: 1222020 - DNA, 20 bp, Homo sapiens
cctgggcctgtgcagcagcc

SEQ ID NO: 1222021 - DNA, 21 bp, Homo sapiens
cctgggcctgtgcagcagccc

SEQ ID NO: 1222022 - DNA, 22 bp, Homo sapiens
cctgggcctgtgcagcagccca

SEQ ID NO: 1222023 - DNA, 13 bp, Homo sapiens
cctgggcgccctg

SEQ ID NO: 1222024 - DNA, 12 bp, Homo sapiens
cctggtgccctg

SEQ ID NO: 1222025 - DNA, 13 bp, Homo sapiens
cctggtgccctga

SEQ ID NO: 1222026 - DNA, 20 bp, Homo sapiens
cctggtgccctggatgccca

SEQ ID NO: 1222027 - DNA, 22 bp, Homo sapiens
cctggtgccctggatgcccagg

SEQ ID NO: 1222028 - DNA, 17 bp, Homo sapiens
cctggtgctacttgctt

SEQ ID NO: 1222029 - DNA, 22 bp, Homo sapiens
cctggtgctcctgcccagccac

SEQ ID NO: 1222030 - DNA, 15 bp, Homo sapiens
cctggtgctgccaca

SEQ ID NO: 1222031 - DNA, 20 bp, Homo sapiens
cctggtgctgcctctacctg

SEQ ID NO: 1222032 - DNA, 13 bp, Homo sapiens
cctggtgctgctg

SEQ ID NO: 1222033 - DNA, 15 bp, Homo sapiens
cctggtgcttccaaa

SEQ ID NO: 1222034 - DNA, 14 bp, Homo sapiens
cctggtggacagtc

SEQ ID NO: 1222035 - DNA, 20 bp, Homo sapiens
cctggtggacagtcctggga

SEQ ID NO: 1222036 - DNA, 14 bp, Homo sapiens
cctggtggcaccag

SEQ ID NO: 1222037 - DNA, 17 bp, Homo sapiens
cctggtggcaccagatg

SEQ ID NO: 1222038 - DNA, 14 bp, Homo sapiens
cctggtgggcctcc

SEQ ID NO: 1222039 - DNA, 12 bp, Homo sapiens
cctggtgggctg

SEQ ID NO: 1222040 - DNA, 14 bp, Homo sapiens
cctggtgggtcagg

SEQ ID NO: 1222041 - DNA, 18 bp, Homo sapiens
cctggtggtattttcaat

SEQ ID NO: 1222042 - DNA, 21 bp, Homo sapiens
cctggtggtattttcaatagc

SEQ ID NO: 1222043 - DNA, 21 bp, Homo sapiens
cctggtggttgctgttttcct

SEQ ID NO: 1222044 - DNA, 14 bp, Homo sapiens
cctggtgtcaggca

SEQ ID NO: 1222045 - DNA, 16 bp, Homo sapiens
cctggtgtcaggcagg

SEQ ID NO: 1222046 - DNA, 19 bp, Homo sapiens
cctggtgtgcggaggcagg

SEQ ID NO: 1222047 - DNA, 15 bp, Homo sapiens
cctggtgttctgaag

SEQ ID NO: 1222048 - DNA, 18 bp, Homo sapiens
cctggttcagaataaatt

SEQ ID NO: 1222049 - DNA, 13 bp, Homo sapiens
cctggttcccgtt

SEQ ID NO: 1222050 - DNA, 22 bp, Homo sapiens
cctggttccttcctatgcccag

SEQ ID NO: 1222051 - DNA, 23 bp, Homo sapiens
cctggttgcctctcttgcccctt

SEQ ID NO: 1222052 - DNA, 20 bp, Homo sapiens
cctggtttcctttctcattt

SEQ ID NO: 1222053 - DNA, 15 bp, Homo sapiens
cctggtttgactcag

SEQ ID NO: 1222054 - DNA, 19 bp, Homo sapiens
cctggtttgcaaagaccac

SEQ ID NO: 1222055 - DNA, 20 bp, Homo sapiens
cctggtttgcaaagaccacc

SEQ ID NO: 1222056 - DNA, 21 bp, Homo sapiens
cctggtttgcaaagaccacct

SEQ ID NO: 1222057 - DNA, 22 bp, Homo sapiens
cctggtttttggattaaattag

SEQ ID NO: 1222058 - DNA, 22 bp, Homo sapiens
cctggtttttgtagccttcctc

SEQ ID NO: 1222059 - DNA, 17 bp, Homo sapiens
cctggtttttttcctgt

SEQ ID NO: 1222060 - DNA, 20 bp, Homo sapiens
cctgtaaaactttattttat

SEQ ID NO: 1222061 - DNA, 12 bp, Homo sapiens
cctgtaaacttt

SEQ ID NO: 1222062 - DNA, 18 bp, Homo sapiens
cctgtaaataagagttgc

SEQ ID NO: 1222063 - DNA, 16 bp, Homo sapiens
cctgtaacaagccaga

SEQ ID NO: 1222064 - DNA, 23 bp, Homo sapiens
cctgtaacacaagccacagaagc

SEQ ID NO: 1222065 - DNA, 16 bp, Homo sapiens
cctgtaactacaatga

SEQ ID NO: 1222066 - DNA, 18 bp, Homo sapiens
cctgtaactacaatgatg

SEQ ID NO: 1222067 - DNA, 18 bp, Homo sapiens
cctgtaaggtttcaatgc

SEQ ID NO: 1222068 - DNA, 20 bp, Homo sapiens
cctgtaatcagctctcctgg

SEQ ID NO: 1222069 - DNA, 23 bp, Homo sapiens
cctgtaatcagctctcctggctc

SEQ ID NO: 1222070 - DNA, 15 bp, Homo sapiens
cctgtaatcccagca

SEQ ID NO: 1222071 - DNA, 16 bp, Homo sapiens
cctgtaatcccagcac

SEQ ID NO: 1222072 - DNA, 15 bp, Homo sapiens
cctgtaatcccagct

SEQ ID NO: 1222073 - DNA, 14 bp, Homo sapiens
cctgtaatcttttt

SEQ ID NO: 1222074 - DNA, 16 bp, Homo sapiens
cctgtaatctttttct

SEQ ID NO: 1222075 - DNA, 23 bp, Homo sapiens
cctgtaattcctacctccctgca

SEQ ID NO: 1222076 - DNA, 23 bp, Homo sapiens
cctgtacaggaaggtgcctggcc

SEQ ID NO: 1222077 - DNA, 21 bp, Homo sapiens
cctgtacagtagattttccaa

SEQ ID NO: 1222078 - DNA, 16 bp, Homo sapiens
cctgtacattgtggga

SEQ ID NO: 1222079 - DNA, 16 bp, Homo sapiens
cctgtacccaccccag

SEQ ID NO: 1222080 - DNA, 21 bp, Homo sapiens
cctgtacccaccccagcacag

SEQ ID NO: 1222081 - DNA, 14 bp, Homo sapiens
cctgtacccagctc

SEQ ID NO: 1222082 - DNA, 17 bp, Homo sapiens
cctgtacccagctcctt

SEQ ID NO: 1222083 - DNA, 17 bp, Homo sapiens
cctgtaccccagcactt

SEQ ID NO: 1222084 - DNA, 15 bp, Homo sapiens
cctgtaccttgctgt

SEQ ID NO: 1222085 - DNA, 22 bp, Homo sapiens
cctgtaccttttgaggagcccc

SEQ ID NO: 1222086 - DNA, 23 bp, Homo sapiens
cctgtaccttttgaggagcccca

SEQ ID NO: 1222087 - DNA, 13 bp, Homo sapiens
cctgtactcagga

SEQ ID NO: 1222088 - DNA, 15 bp, Homo sapiens
cctgtactcaggagg

SEQ ID NO: 1222089 - DNA, 23 bp, Homo sapiens
cctgtactgaagaaaaggggagc

SEQ ID NO: 1222090 - DNA, 17 bp, Homo sapiens
cctgtactgttctgtgt

SEQ ID NO: 1222091 - DNA, 13 bp, Homo sapiens
cctgtagacctag

SEQ ID NO: 1222092 - DNA, 16 bp, Homo sapiens
cctgtagagttgctga

SEQ ID NO: 1222093 - DNA, 17 bp, Homo sapiens
cctgtagagttgctgag

SEQ ID NO: 1222094 - DNA, 19 bp, Homo sapiens
cctgtagcaatggccagag

SEQ ID NO: 1222095 - DNA, 15 bp, Homo sapiens
cctgtagcacttact

SEQ ID NO: 1222096 - DNA, 13 bp, Homo sapiens
cctgtagcatctt

SEQ ID NO: 1222097 - DNA, 15 bp, Homo sapiens
cctgtagcatcttct

SEQ ID NO: 1222098 - DNA, 21 bp, Homo sapiens
cctgtagcatcttctggagtc

SEQ ID NO: 1222099 - DNA, 20 bp, Homo sapiens
cctgtagccccagtgacagc

SEQ ID NO: 1222100 - DNA, 12 bp, Homo sapiens
cctgtagctcag

SEQ ID NO: 1222101 - DNA, 13 bp, Homo sapiens
cctgtagctcagt

SEQ ID NO: 1222102 - DNA, 15 bp, Homo sapiens
cctgtagctcagtca

SEQ ID NO: 1222103 - DNA, 13 bp, Homo sapiens
cctgtagctctgc

SEQ ID NO: 1222104 - DNA, 20 bp, Homo sapiens
cctgtagctctgcctccctc

SEQ ID NO: 1222105 - DNA, 22 bp, Homo sapiens
cctgtagggaaaccttggagag

SEQ ID NO: 1222106 - DNA, 23 bp, Homo sapiens
cctgtagggaaaccttggagagg

SEQ ID NO: 1222107 - DNA, 22 bp, Homo sapiens
cctgtagggcacccaaaactca

SEQ ID NO: 1222108 - DNA, 14 bp, Homo sapiens
cctgtagggctagc

SEQ ID NO: 1222109 - DNA, 14 bp, Homo sapiens
cctgtagtgagaaa

SEQ ID NO: 1222110 - DNA, 14 bp, Homo sapiens
cctgtagttaggaa

SEQ ID NO: 1222111 - DNA, 21 bp, Homo sapiens
cctgtagttgacaattctgca

SEQ ID NO: 1222112 - DNA, 23 bp, Homo sapiens
cctgtagttgacaattctgcatg

SEQ ID NO: 1222113 - DNA, 16 bp, Homo sapiens
cctgtataagtggagg

SEQ ID NO: 1222114 - DNA, 16 bp, Homo sapiens
cctgtatatagcccag

SEQ ID NO: 1222115 - DNA, 21 bp, Homo sapiens
cctgtatatagcccagccagg

SEQ ID NO: 1222116 - DNA, 14 bp, Homo sapiens
cctgtatcttgtct

SEQ ID NO: 1222117 - DNA, 19 bp, Homo sapiens
cctgtatgtggtgtggggc

SEQ ID NO: 1222118 - DNA, 13 bp, Homo sapiens
cctgtatgttgtc

SEQ ID NO: 1222119 - DNA, 17 bp, Homo sapiens
cctgtattttctttctc

SEQ ID NO: 1222120 - DNA, 19 bp, Homo sapiens
cctgtcaagttaacaagga

SEQ ID NO: 1222121 - DNA, 13 bp, Homo sapiens
cctgtcacacact

SEQ ID NO: 1222122 - DNA, 16 bp, Homo sapiens
cctgtcacacactgga

SEQ ID NO: 1222123 - DNA, 17 bp, Homo sapiens
cctgtcacacactggac

SEQ ID NO: 1222124 - DNA, 22 bp, Homo sapiens
cctgtcacacactggaccccac

SEQ ID NO: 1222125 - DNA, 15 bp, Homo sapiens
cctgtcacctgggag

SEQ ID NO: 1222126 - DNA, 23 bp, Homo sapiens
cctgtcccaccaactctgcactc

SEQ ID NO: 1222127 - DNA, 21 bp, Homo sapiens
cctgtcccacccacacagctg

SEQ ID NO: 1222128 - DNA, 23 bp, Homo sapiens
cctgtcccacccacacagctgcc

SEQ ID NO: 1222129 - DNA, 17 bp, Homo sapiens
cctgtcccacccccacc

SEQ ID NO: 1222130 - DNA, 22 bp, Homo sapiens
cctgtcccacccccttccccca

SEQ ID NO: 1222131 - DNA, 14 bp, Homo sapiens
cctgtcccacctct

SEQ ID NO: 1222132 - DNA, 14 bp, Homo sapiens
cctgtcccacctgg

SEQ ID NO: 1222133 - DNA, 14 bp, Homo sapiens
cctgtcccagaggt

SEQ ID NO: 1222134 - DNA, 22 bp, Homo sapiens
cctgtcccaggactcaccctcc

SEQ ID NO: 1222135 - DNA, 20 bp, Homo sapiens
cctgtcccaggccggcccag

SEQ ID NO: 1222136 - DNA, 19 bp, Homo sapiens
cctgtcccatgcaggccct

SEQ ID NO: 1222137 - DNA, 13 bp, Homo sapiens
cctgtcccattct

SEQ ID NO: 1222138 - DNA, 14 bp, Homo sapiens
cctgtccccaccct

SEQ ID NO: 1222139 - DNA, 17 bp, Homo sapiens
cctgtccccaccctcca

SEQ ID NO: 1222140 - DNA, 13 bp, Homo sapiens
cctgtccccagac

SEQ ID NO: 1222141 - DNA, 20 bp, Homo sapiens
cctgtccccagaccaaccct

SEQ ID NO: 1222142 - DNA, 18 bp, Homo sapiens
cctgtccccaggcccagc

SEQ ID NO: 1222143 - DNA, 22 bp, Homo sapiens
cctgtccccaggcccagccctc

SEQ ID NO: 1222144 - DNA, 21 bp, Homo sapiens
cctgtccccagtccccagccc

SEQ ID NO: 1222145 - DNA, 19 bp, Homo sapiens
cctgtcccccactctctca

SEQ ID NO: 1222146 - DNA, 14 bp, Homo sapiens
cctgtcccccagca

SEQ ID NO: 1222147 - DNA, 16 bp, Homo sapiens
cctgtcccccagctct

SEQ ID NO: 1222148 - DNA, 17 bp, Homo sapiens
cctgtcccccagctctg

SEQ ID NO: 1222149 - DNA, 17 bp, Homo sapiens
cctgtccccctcccctc

SEQ ID NO: 1222150 - DNA, 18 bp, Homo sapiens
cctgtccccgccttccct

SEQ ID NO: 1222151 - DNA, 22 bp, Homo sapiens
cctgtccccgccttccctcact

SEQ ID NO: 1222152 - DNA, 16 bp, Homo sapiens
cctgtcccgccttcct

SEQ ID NO: 1222153 - DNA, 13 bp, Homo sapiens
cctgtccctgtag

SEQ ID NO: 1222154 - DNA, 21 bp, Homo sapiens
cctgtccctgtagctcagtca

SEQ ID NO: 1222155 - DNA, 21 bp, Homo sapiens
cctgtcccttcgagtccagga

SEQ ID NO: 1222156 - DNA, 15 bp, Homo sapiens
cctgtccggcccagt

SEQ ID NO: 1222157 - DNA, 16 bp, Homo sapiens
cctgtccggcccagtg

SEQ ID NO: 1222158 - DNA, 17 bp, Homo sapiens
cctgtccggcccagtgc

SEQ ID NO: 1222159 - DNA, 18 bp, Homo sapiens
cctgtccggcccagtgcc

SEQ ID NO: 1222160 - DNA, 18 bp, Homo sapiens
cctgtcctaaggaacctt

SEQ ID NO: 1222161 - DNA, 10 bp, Homo sapiens
cctgtcctca

SEQ ID NO: 1222162 - DNA, 21 bp, Homo sapiens
cctgtcctccaacaccaagca

SEQ ID NO: 1222163 - DNA, 15 bp, Homo sapiens
cctgtcctcctcgga

SEQ ID NO: 1222164 - DNA, 13 bp, Homo sapiens
cctgtcctgatgg

SEQ ID NO: 1222165 - DNA, 12 bp, Homo sapiens
cctgtcctgcag

SEQ ID NO: 1222166 - DNA, 13 bp, Homo sapiens
cctgtcctgcagt

SEQ ID NO: 1222167 - DNA, 14 bp, Homo sapiens
cctgtcctgcagtc

SEQ ID NO: 1222168 - DNA, 21 bp, Homo sapiens
cctgtcctggtacagcagggt

SEQ ID NO: 1222169 - DNA, 14 bp, Homo sapiens
cctgtcctggttcc

SEQ ID NO: 1222170 - DNA, 18 bp, Homo sapiens
cctgtccttccctgttct

SEQ ID NO: 1222171 - DNA, 16 bp, Homo sapiens
cctgtcgattagactg

SEQ ID NO: 1222172 - DNA, 19 bp, Homo sapiens
cctgtcggtggctgccttt

SEQ ID NO: 1222173 - DNA, 16 bp, Homo sapiens
cctgtcgtgccagtcc

SEQ ID NO: 1222174 - DNA, 11 bp, Homo sapiens
cctgtctaaag

SEQ ID NO: 1222175 - DNA, 14 bp, Homo sapiens
cctgtctaggtctc

SEQ ID NO: 1222176 - DNA, 20 bp, Homo sapiens
cctgtctaggtctcctcagg

SEQ ID NO: 1222177 - DNA, 22 bp, Homo sapiens
cctgtctaggtctcctcagggt

SEQ ID NO: 1222178 - DNA, 14 bp, Homo sapiens
cctgtctcagcctc

SEQ ID NO: 1222179 - DNA, 18 bp, Homo sapiens
cctgtctcatccccaggg

SEQ ID NO: 1222180 - DNA, 20 bp, Homo sapiens
cctgtctcatccccaggggt

SEQ ID NO: 1222181 - DNA, 12 bp, Homo sapiens
cctgtctccagc

SEQ ID NO: 1222182 - DNA, 13 bp, Homo sapiens
cctgtctccagct

SEQ ID NO: 1222183 - DNA, 21 bp, Homo sapiens
cctgtctccagggcccccacc

SEQ ID NO: 1222184 - DNA, 21 bp, Homo sapiens
cctgtctcccggctcccctcc

SEQ ID NO: 1222185 - DNA, 14 bp, Homo sapiens
cctgtctcccttct

SEQ ID NO: 1222186 - DNA, 22 bp, Homo sapiens
cctgtctcctactttgaaaact

SEQ ID NO: 1222187 - DNA, 22 bp, Homo sapiens
cctgtctctattagctgggttc

SEQ ID NO: 1222188 - DNA, 18 bp, Homo sapiens
cctgtctctgttcagatg

SEQ ID NO: 1222189 - DNA, 17 bp, Homo sapiens
cctgtctgactactttg

SEQ ID NO: 1222190 - DNA, 17 bp, Homo sapiens
cctgtctgccagccagc

SEQ ID NO: 1222191 - DNA, 20 bp, Homo sapiens
cctgtctgccccagcccaga

SEQ ID NO: 1222192 - DNA, 23 bp, Homo sapiens
cctgtctggaagacgtggctctg

SEQ ID NO: 1222193 - DNA, 16 bp, Homo sapiens
cctgtctggattgttt

SEQ ID NO: 1222194 - DNA, 19 bp, Homo sapiens
cctgtctggcttctagaga

SEQ ID NO: 1222195 - DNA, 17 bp, Homo sapiens
cctgtctgtcccttttc

SEQ ID NO: 1222196 - DNA, 21 bp, Homo sapiens
cctgtctgtcccttttctttg

SEQ ID NO: 1222197 - DNA, 22 bp, Homo sapiens
cctgtctgtcccttttctttga

SEQ ID NO: 1222198 - DNA, 16 bp, Homo sapiens
cctgtctgtccttctg

SEQ ID NO: 1222199 - DNA, 17 bp, Homo sapiens
cctgtctgtctctccat

SEQ ID NO: 1222200 - DNA, 18 bp, Homo sapiens
cctgtctgtctctccatc

SEQ ID NO: 1222201 - DNA, 17 bp, Homo sapiens
cctgtctgttacactgg

SEQ ID NO: 1222202 - DNA, 22 bp, Homo sapiens
cctgtcttatggtccagaaact

SEQ ID NO: 1222203 - DNA, 15 bp, Homo sapiens
cctgtcttctgggca

SEQ ID NO: 1222204 - DNA, 15 bp, Homo sapiens
cctgtcttgagtaga

SEQ ID NO: 1222205 - DNA, 21 bp, Homo sapiens
cctgtcttgctcctggggaga

SEQ ID NO: 1222206 - DNA, 17 bp, Homo sapiens
cctgtcttggggccact

SEQ ID NO: 1222207 - DNA, 20 bp, Homo sapiens
cctgtcttggggccactttc

SEQ ID NO: 1222208 - DNA, 17 bp, Homo sapiens
cctgtctttaaggaaaa

SEQ ID NO: 1222209 - DNA, 16 bp, Homo sapiens
cctgtgaagcagtcag

SEQ ID NO: 1222210 - DNA, 19 bp, Homo sapiens
cctgtgaatgccactgcct

SEQ ID NO: 1222211 - DNA, 16 bp, Homo sapiens
cctgtgaatggaggca

SEQ ID NO: 1222212 - DNA, 22 bp, Homo sapiens
cctgtgacatggtgcctgagag

SEQ ID NO: 1222213 - DNA, 17 bp, Homo sapiens
cctgtgacccgtgaatg

SEQ ID NO: 1222214 - DNA, 18 bp, Homo sapiens
cctgtgaccctctcactt

SEQ ID NO: 1222215 - DNA, 20 bp, Homo sapiens
cctgtgaccctctcactttg

SEQ ID NO: 1222216 - DNA, 13 bp, Homo sapiens
cctgtgaccttgg

SEQ ID NO: 1222217 - DNA, 17 bp, Homo sapiens
cctgtgagcccagctgg

SEQ ID NO: 1222218 - DNA, 13 bp, Homo sapiens
cctgtgagtaggc

SEQ ID NO: 1222219 - DNA, 22 bp, Homo sapiens
cctgtgatatggcggcctgcag

SEQ ID NO: 1222220 - DNA, 21 bp, Homo sapiens
cctgtgatctgtgtacaattt

SEQ ID NO: 1222221 - DNA, 23 bp, Homo sapiens
cctgtgcacaccccactcccaca

SEQ ID NO: 1222222 - DNA, 18 bp, Homo sapiens
cctgtgcactgggcaggt

SEQ ID NO: 1222223 - DNA, 15 bp, Homo sapiens
cctgtgcagatgctg

SEQ ID NO: 1222224 - DNA, 21 bp, Homo sapiens
cctgtgcagatgctgctgaag

SEQ ID NO: 1222225 - DNA, 22 bp, Homo sapiens
ccttagtcccccaactctgagc

SEQ ID NO: 1222226 - DNA, 14 bp, Homo sapiens
ccttagtctcagtt

SEQ ID NO: 1222227 - DNA, 22 bp, Homo sapiens
ccttagtgccaggagggcacag

SEQ ID NO: 1222228 - DNA, 17 bp, Homo sapiens
ccttagttggctggaaa

SEQ ID NO: 1222229 - DNA, 14 bp, Homo sapiens
ccttatagttactg

SEQ ID NO: 1222230 - DNA, 20 bp, Homo sapiens
ccttatatatgcacttaatt

SEQ ID NO: 1222231 - DNA, 13 bp, Homo sapiens
ccttatcaaagga

SEQ ID NO: 1222232 - DNA, 13 bp, Homo sapiens
ccttatcaaggat

SEQ ID NO: 1222233 - DNA, 12 bp, Homo sapiens
ccttatcaagtg

SEQ ID NO: 1222234 - DNA, 19 bp, Homo sapiens
ccttatcacagaaataaaa

SEQ ID NO: 1222235 - DNA, 13 bp, Homo sapiens
ccttatcaccagc

SEQ ID NO: 1222236 - DNA, 13 bp, Homo sapiens
ccttatcagagct

SEQ ID NO: 1222237 - DNA, 14 bp, Homo sapiens
ccttatcagagcta

SEQ ID NO: 1222238 - DNA, 13 bp, Homo sapiens
ccttatccaaaat

SEQ ID NO: 1222239 - DNA, 15 bp, Homo sapiens
ccttatcctctgatc

SEQ ID NO: 1222240 - DNA, 16 bp, Homo sapiens
ccttatcctctgatct

SEQ ID NO: 1222241 - DNA, 19 bp, Homo sapiens
ccttatgaccagtgagaac

SEQ ID NO: 1222242 - DNA, 19 bp, Homo sapiens
ccttatgacttgctacttt

SEQ ID NO: 1222243 - DNA, 20 bp, Homo sapiens
ccttatgagcgtcactgccc

SEQ ID NO: 1222244 - DNA, 19 bp, Homo sapiens
ccttatgggatcatttttc

SEQ ID NO: 1222245 - DNA, 19 bp, Homo sapiens
ccttatgtgttacattatt

SEQ ID NO: 1222246 - DNA, 17 bp, Homo sapiens
ccttattatcccagctt

SEQ ID NO: 1222247 - DNA, 14 bp, Homo sapiens
ccttattgcctccc

SEQ ID NO: 1222248 - DNA, 19 bp, Homo sapiens
ccttattgctgccaaaacc

SEQ ID NO: 1222249 - DNA, 20 bp, Homo sapiens
ccttattggaaggtattttt

SEQ ID NO: 1222250 - DNA, 15 bp, Homo sapiens
ccttattgtacctct

SEQ ID NO: 1222251 - DNA, 16 bp, Homo sapiens
ccttattgtacctctc

SEQ ID NO: 1222252 - DNA, 16 bp, Homo sapiens
ccttatttatttttgt

SEQ ID NO: 1222253 - DNA, 12 bp, Homo sapiens
ccttatttctca

SEQ ID NO: 1222254 - DNA, 13 bp, Homo sapiens
ccttatttctcat

SEQ ID NO: 1222255 - DNA, 22 bp, Homo sapiens
ccttatttctctctcctggtgt

SEQ ID NO: 1222256 - DNA, 11 bp, Homo sapiens
ccttatttgtc

SEQ ID NO: 1222257 - DNA, 19 bp, Homo sapiens
ccttatttgtctgtaaaaa

SEQ ID NO: 1222258 - DNA, 14 bp, Homo sapiens
ccttattttgagta

SEQ ID NO: 1222259 - DNA, 17 bp, Homo sapiens
ccttgcccagggctcag

SEQ ID NO: 1222260 - DNA, 15 bp, Homo sapiens
ccttgccccactcct

SEQ ID NO: 1222261 - DNA, 19 bp, Homo sapiens
ccttgccccaggccaggta

SEQ ID NO: 1222262 - DNA, 21 bp, Homo sapiens
ccttgccccaggccaggtagc

SEQ ID NO: 1222263 - DNA, 20 bp, Homo sapiens
ccttgccccccgccctcatg

SEQ ID NO: 1222264 - DNA, 16 bp, Homo sapiens
ccttgcccgccagcct

SEQ ID NO: 1222265 - DNA, 19 bp, Homo sapiens
ccttgcccgccagcctcag

SEQ ID NO: 1222266 - DNA, 20 bp, Homo sapiens
ccttgcccgccagcctcagt

SEQ ID NO: 1222267 - DNA, 19 bp, Homo sapiens
ccttgccctccgcctggga

SEQ ID NO: 1222268 - DNA, 16 bp, Homo sapiens
ccttgccctgacctcc

SEQ ID NO: 1222269 - DNA, 16 bp, Homo sapiens
ccttgcccttgccctg

SEQ ID NO: 1222270 - DNA, 15 bp, Homo sapiens
ccttgcccttggagc

SEQ ID NO: 1222271 - DNA, 20 bp, Homo sapiens
ccttgcctcaatgccagtaa

SEQ ID NO: 1222272 - DNA, 14 bp, Homo sapiens
ccttgcctccccat

SEQ ID NO: 1222273 - DNA, 22 bp, Homo sapiens
ccttgcctccccatttcccatc

SEQ ID NO: 1222274 - DNA, 23 bp, Homo sapiens
ccttgcctccccatttcccatct

SEQ ID NO: 1222275 - DNA, 21 bp, Homo sapiens
ccttgcctgaacatccttcct

SEQ ID NO: 1222276 - DNA, 13 bp, Homo sapiens
ccttgcctggcct

SEQ ID NO: 1222277 - DNA, 12 bp, Homo sapiens
ccttgcctggta

SEQ ID NO: 1222278 - DNA, 17 bp, Homo sapiens
ccttgcctggtacagta

SEQ ID NO: 1222279 - DNA, 18 bp, Homo sapiens
ccttgccttaataaatat

SEQ ID NO: 1222280 - DNA, 20 bp, Homo sapiens
ccttgcgcctcagccctcag

SEQ ID NO: 1222281 - DNA, 16 bp, Homo sapiens
ccttgcgctgtcccag

SEQ ID NO: 1222282 - DNA, 20 bp, Homo sapiens
ccttgcgtcccatgaggtct

SEQ ID NO: 1222283 - DNA, 22 bp, Homo sapiens
ccttgctcactcactcactcca

SEQ ID NO: 1222284 - DNA, 15 bp, Homo sapiens
ccttgctcagtgcct

SEQ ID NO: 1222285 - DNA, 19 bp, Homo sapiens
ccttgctcagtgcctcctg

SEQ ID NO: 1222286 - DNA, 14 bp, Homo sapiens
ccttgctcattctt

SEQ ID NO: 1222287 - DNA, 18 bp, Homo sapiens
ccttgctcctagcagaca

SEQ ID NO: 1222288 - DNA, 20 bp, Homo sapiens
ccttgctctcccctgccctg

SEQ ID NO: 1222289 - DNA, 15 bp, Homo sapiens
ccttgctctccctct

SEQ ID NO: 1222290 - DNA, 19 bp, Homo sapiens
ccttgctctccctcttctc

SEQ ID NO: 1222291 - DNA, 12 bp, Homo sapiens
ccttgctctgag

SEQ ID NO: 1222292 - DNA, 22 bp, Homo sapiens
ccttgctgaccccaggtcagcc

SEQ ID NO: 1222293 - DNA, 13 bp, Homo sapiens
ccttgctgactct

SEQ ID NO: 1222294 - DNA, 19 bp, Homo sapiens
ccttgctgactctctgagc

SEQ ID NO: 1222295 - DNA, 16 bp, Homo sapiens
ccttgctgatggcttg

SEQ ID NO: 1222296 - DNA, 13 bp, Homo sapiens
ccttgctgcagct

SEQ ID NO: 1222297 - DNA, 12 bp, Homo sapiens
ccttgctgcccg

SEQ ID NO: 1222298 - DNA, 13 bp, Homo sapiens
ccttgctgcccgc

SEQ ID NO: 1222299 - DNA, 17 bp, Homo sapiens
ccttgctggaaaaccca

SEQ ID NO: 1222300 - DNA, 12 bp, Homo sapiens
ccttgctggccc

SEQ ID NO: 1222301 - DNA, 22 bp, Homo sapiens
ccttgctggccccagccctgct

SEQ ID NO: 1222302 - DNA, 13 bp, Homo sapiens
ccttgctgggcca

SEQ ID NO: 1222303 - DNA, 14 bp, Homo sapiens
ccttgctgggccag

SEQ ID NO: 1222304 - DNA, 17 bp, Homo sapiens
ccttgctgggccaggga

SEQ ID NO: 1222305 - DNA, 18 bp, Homo sapiens
ccttgctggggtccaggg

SEQ ID NO: 1222306 - DNA, 20 bp, Homo sapiens
ccttgctggggtccagggct

SEQ ID NO: 1222307 - DNA, 17 bp, Homo sapiens
ccttgctgtcctgatct

SEQ ID NO: 1222308 - DNA, 13 bp, Homo sapiens
ccttgctgtgtga

SEQ ID NO: 1222309 - DNA, 23 bp, Homo sapiens
ccttgctgttcttgaagctgggc

SEQ ID NO: 1222310 - DNA, 14 bp, Homo sapiens
ccttgcttctcttc

SEQ ID NO: 1222311 - DNA, 13 bp, Homo sapiens
ccttgctttcctg

SEQ ID NO: 1222312 - DNA, 22 bp, Homo sapiens
ccttgctttgggctttgcaggc

SEQ ID NO: 1222313 - DNA, 21 bp, Homo sapiens
ccttgctttgttttaataaac

SEQ ID NO: 1222314 - DNA, 19 bp, Homo sapiens
ccttgcttttccctctttt

SEQ ID NO: 1222315 - DNA, 13 bp, Homo sapiens
ccttgcttttgct

SEQ ID NO: 1222316 - DNA, 15 bp, Homo sapiens
ccttgcttttgcttc

SEQ ID NO: 1222317 - DNA, 18 bp, Homo sapiens
ccttggaaacctgccctg

SEQ ID NO: 1222318 - DNA, 23 bp, Homo sapiens
ccttggaaacctgccctgcctga

SEQ ID NO: 1222319 - DNA, 18 bp, Homo sapiens
ccttggaaatagaaagaa

SEQ ID NO: 1222320 - DNA, 17 bp, Homo sapiens
ccttggaaatgtctgct

SEQ ID NO: 1222321 - DNA, 18 bp, Homo sapiens
ccttggaaatgtctgctg

SEQ ID NO: 1222322 - DNA, 21 bp, Homo sapiens
ccttggaatctaacgggcatt

SEQ ID NO: 1222323 - DNA, 23 bp, Homo sapiens
ccttggagaactcggtttggtag

SEQ ID NO: 1222324 - DNA, 14 bp, Homo sapiens
ccttggagagcagc

SEQ ID NO: 1222325 - DNA, 15 bp, Homo sapiens
ccttggagagcagct

SEQ ID NO: 1222326 - DNA, 17 bp, Homo sapiens
ccttggagagcagctgg

SEQ ID NO: 1222327 - DNA, 13 bp, Homo sapiens
ccttggagctgcc

SEQ ID NO: 1222328 - DNA, 22 bp, Homo sapiens
ccttggagggagaggtggcagg

SEQ ID NO: 1222329 - DNA, 18 bp, Homo sapiens
ccttggatgtagtctgag

SEQ ID NO: 1222330 - DNA, 14 bp, Homo sapiens
ccttggcaccacca

SEQ ID NO: 1222331 - DNA, 19 bp, Homo sapiens
ccttggcaccaccagggtg

SEQ ID NO: 1222332 - DNA, 19 bp, Homo sapiens
ccttggcacccccatgctg

SEQ ID NO: 1222333 - DNA, 16 bp, Homo sapiens
ccttggcagtgtccca

SEQ ID NO: 1222334 - DNA, 22 bp, Homo sapiens
ccttggcagtgtcccagggccc

SEQ ID NO: 1222335 - DNA, 16 bp, Homo sapiens
ccttggcatagacatg

SEQ ID NO: 1222336 - DNA, 17 bp, Homo sapiens
ccttggcatgggcgcag

SEQ ID NO: 1222337 - DNA, 22 bp, Homo sapiens
ccttggcatgggcgcaggccca

SEQ ID NO: 1222338 - DNA, 14 bp, Homo sapiens
ccttggcatttctt

SEQ ID NO: 1222339 - DNA, 15 bp, Homo sapiens
ccttggccacagact

SEQ ID NO: 1222340 - DNA, 14 bp, Homo sapiens
ccttggcccaggag

SEQ ID NO: 1222341 - DNA, 15 bp, Homo sapiens
ccttggcccaggagc

SEQ ID NO: 1222342 - DNA, 16 bp, Homo sapiens
ccttggcccaggagct

SEQ ID NO: 1222343 - DNA, 17 bp, Homo sapiens
ccttggccccagaggac

SEQ ID NO: 1222344 - DNA, 23 bp, Homo sapiens
ccttggccccccaaagtgctggg

SEQ ID NO: 1222345 - DNA, 14 bp, Homo sapiens
ccttggcctcagaa

SEQ ID NO: 1222346 - DNA, 16 bp, Homo sapiens
ccttggcctctttcct

SEQ ID NO: 1222347 - DNA, 22 bp, Homo sapiens
ccttggcctgtctcatccccag

SEQ ID NO: 1222348 - DNA, 20 bp, Homo sapiens
ccttggcgctctcagctttc

SEQ ID NO: 1222349 - DNA, 18 bp, Homo sapiens
ccttggctcaatcctcta

SEQ ID NO: 1222350 - DNA, 22 bp, Homo sapiens
ccttggctcaatcctctaagct

SEQ ID NO: 1222351 - DNA, 13 bp, Homo sapiens
ccttggctgcagc

SEQ ID NO: 1222352 - DNA, 16 bp, Homo sapiens
ccttggctgcagccat

SEQ ID NO: 1222353 - DNA, 12 bp, Homo sapiens
ccttggctgggc

SEQ ID NO: 1222354 - DNA, 17 bp, Homo sapiens
ccttggcttacctgacc

SEQ ID NO: 1222355 - DNA, 18 bp, Homo sapiens
ccttggcttacctgacct

SEQ ID NO: 1222356 - DNA, 13 bp, Homo sapiens
ccttggcttcctc

SEQ ID NO: 1222357 - DNA, 11 bp, Homo sapiens
ccttggcttct

SEQ ID NO: 1222358 - DNA, 17 bp, Homo sapiens
ccttggcttctgcttca

SEQ ID NO: 1222359 - DNA, 18 bp, Homo sapiens
ccttggcttgcctggtgg

SEQ ID NO: 1222360 - DNA, 19 bp, Homo sapiens
ccttggcttgcctggtggg

SEQ ID NO: 1222361 - DNA, 18 bp, Homo sapiens
ccttggctttcagagcca

SEQ ID NO: 1222362 - DNA, 14 bp, Homo sapiens
ccttggctttctcc

SEQ ID NO: 1222363 - DNA, 17 bp, Homo sapiens
ccttggctttctccctc

SEQ ID NO: 1222364 - DNA, 19 bp, Homo sapiens
ccttgggaaggacacagca

SEQ ID NO: 1222365 - DNA, 20 bp, Homo sapiens
ccttgggaaggacacagcag

SEQ ID NO: 1222366 - DNA, 12 bp, Homo sapiens
ccttgggacccc

SEQ ID NO: 1222367 - DNA, 20 bp, Homo sapiens
ccttgggatcagatcaagag

SEQ ID NO: 1222368 - DNA, 15 bp, Homo sapiens
ccttgggcacatctg

SEQ ID NO: 1222369 - DNA, 11 bp, Homo sapiens
ccttgggcagt

SEQ ID NO: 1222370 - DNA, 16 bp, Homo sapiens
ccttgggcatccaccc

SEQ ID NO: 1222371 - DNA, 24 bp, Homo sapiens
ccttgggcatccacccagtgctgc

SEQ ID NO: 1222372 - DNA, 22 bp, Homo sapiens
ccttgggccagaagtaccagac

SEQ ID NO: 1222373 - DNA, 23 bp, Homo sapiens
ccttgggccagaagtaccagact

SEQ ID NO: 1222374 - DNA, 13 bp, Homo sapiens
ccttgggcctttc

SEQ ID NO: 1222375 - DNA, 16 bp, Homo sapiens
ccttgggcctttcagt

SEQ ID NO: 1222376 - DNA, 17 bp, Homo sapiens
ccttgggcggctgagag

SEQ ID NO: 1222377 - DNA, 16 bp, Homo sapiens
ccttgggctcctggct

SEQ ID NO: 1222378 - DNA, 19 bp, Homo sapiens
ccttgggctcctggctgcc

SEQ ID NO: 1222379 - DNA, 21 bp, Homo sapiens
ccttgggctcctggctgccag

SEQ ID NO: 1222380 - DNA, 15 bp, Homo sapiens
ccttggggcctggct

SEQ ID NO: 1222381 - DNA, 16 bp, Homo sapiens
ccttggggcctggctt

SEQ ID NO: 1222382 - DNA, 17 bp, Homo sapiens
ccttggggcctggcttg

SEQ ID NO: 1222383 - DNA, 23 bp, Homo sapiens
ccttggggctggggaagaggact

SEQ ID NO: 1222384 - DNA, 22 bp, Homo sapiens
ccttgggggggctgcctttgtg

SEQ ID NO: 1222385 - DNA, 23 bp, Homo sapiens
ccttgggggttcagggaactgct

SEQ ID NO: 1222386 - DNA, 23 bp, Homo sapiens
ccttggggtaagccagagcctgg

SEQ ID NO: 1222387 - DNA, 21 bp, Homo sapiens
ccttgggtgagtggcctgcta

SEQ ID NO: 1222388 - DNA, 18 bp, Homo sapiens
ccttggtagcagcctggg

SEQ ID NO: 1222389 - DNA, 11 bp, Homo sapiens
ccttggtgccg

SEQ ID NO: 1222390 - DNA, 12 bp, Homo sapiens
ccttggtgctct

SEQ ID NO: 1222391 - DNA, 18 bp, Homo sapiens
ccttggtggagcagccag

SEQ ID NO: 1222392 - DNA, 24 bp, Homo sapiens
ccttggtggagcagccagagctgt

SEQ ID NO: 1222393 - DNA, 12 bp, Homo sapiens
ccttggtgggga

SEQ ID NO: 1222394 - DNA, 16 bp, Homo sapiens
ccttggtgtccacctg

SEQ ID NO: 1222395 - DNA, 21 bp, Homo sapiens
ccttggtgtccacctggcccc

SEQ ID NO: 1222396 - DNA, 15 bp, Homo sapiens
ccttggtgtttccct

SEQ ID NO: 1222397 - DNA, 18 bp, Homo sapiens
ccttggtgtttcccttcc

SEQ ID NO: 1222398 - DNA, 18 bp, Homo sapiens
ccttggttcatcagtgtt

SEQ ID NO: 1222399 - DNA, 13 bp, Homo sapiens
ccttggttcctaa

SEQ ID NO: 1222400 - DNA, 16 bp, Homo sapiens
ccttggttctggccac

SEQ ID NO: 1222401 - DNA, 19 bp, Homo sapiens
ccttggttctggccacccc

SEQ ID NO: 1222402 - DNA, 11 bp, Homo sapiens
ccttgtaaaaa

SEQ ID NO: 1222403 - DNA, 15 bp, Homo sapiens
ccttgtaaaaaaagc

SEQ ID NO: 1222404 - DNA, 17 bp, Homo sapiens
ccttgtaaaaaaagcaa

SEQ ID NO: 1222405 - DNA, 21 bp, Homo sapiens
ccttgtaaagacagagtgaat

SEQ ID NO: 1222406 - DNA, 15 bp, Homo sapiens
ccttgtaatacctga

SEQ ID NO: 1222407 - DNA, 24 bp, Homo sapiens
ccttgtatagtgtccccatgggct

SEQ ID NO: 1222408 - DNA, 14 bp, Homo sapiens
ccttgtatttaaat

SEQ ID NO: 1222409 - DNA, 16 bp, Homo sapiens
ccttgtatttaaatat

SEQ ID NO: 1222410 - DNA, 21 bp, Homo sapiens
ccttgtatttaaatattaaat

SEQ ID NO: 1222411 - DNA, 16 bp, Homo sapiens
ccttgtattttgttaa

SEQ ID NO: 1222412 - DNA, 20 bp, Homo sapiens
ccttgtattttgttaaagct

SEQ ID NO: 1222413 - DNA, 14 bp, Homo sapiens
ccttgtcaccagca

SEQ ID NO: 1222414 - DNA, 20 bp, Homo sapiens
ccttgtcaccagcaacatct

SEQ ID NO: 1222415 - DNA, 18 bp, Homo sapiens
ccttgtcatcctcccttg

SEQ ID NO: 1222416 - DNA, 14 bp, Homo sapiens
ccttgtcattgcct

SEQ ID NO: 1222417 - DNA, 15 bp, Homo sapiens
ccttgtccaggaact

SEQ ID NO: 1222418 - DNA, 23 bp, Homo sapiens
ccttgtccaggaactgcctgggc

SEQ ID NO: 1222419 - DNA, 16 bp, Homo sapiens
ccttgtcctgaagccc

SEQ ID NO: 1222420 - DNA, 19 bp, Homo sapiens
ccttgtcctgaagcccagc

SEQ ID NO: 1222421 - DNA, 22 bp, Homo sapiens
ccttgtcctgaagcccagcgac

SEQ ID NO: 1222422 - DNA, 13 bp, Homo sapiens
ccttgtcctgcca

SEQ ID NO: 1222423 - DNA, 15 bp, Homo sapiens
ccttgtcctgccagc

SEQ ID NO: 1222424 - DNA, 16 bp, Homo sapiens
ccttgtcctgccagct

SEQ ID NO: 1222425 - DNA, 17 bp, Homo sapiens
ccttgtcctgccagctg

SEQ ID NO: 1222426 - DNA, 18 bp, Homo sapiens
ccttgtcctgccagctgc

SEQ ID NO: 1222427 - DNA, 19 bp, Homo sapiens
ccttgtcctgccagctgcc

SEQ ID NO: 1222428 - DNA, 21 bp, Homo sapiens
ccttgtcctgccagctgcctt

SEQ ID NO: 1222429 - DNA, 16 bp, Homo sapiens
ccttgtcctgggtctg

SEQ ID NO: 1222430 - DNA, 13 bp, Homo sapiens
ccttgtcgtggga

SEQ ID NO: 1222431 - DNA, 18 bp, Homo sapiens
ccttgtctccctggttgc

SEQ ID NO: 1222432 - DNA, 21 bp, Homo sapiens
ccttgtcttcccccctctcct

SEQ ID NO: 1222433 - DNA, 23 bp, Homo sapiens
ccttgtcttttcaagtaattttc

SEQ ID NO: 1222434 - DNA, 16 bp, Homo sapiens
ccttgtcttttgagct

SEQ ID NO: 1222435 - DNA, 16 bp, Homo sapiens
ccttgtgagagcccat

SEQ ID NO: 1222436 - DNA, 12 bp, Homo sapiens
ccttgtgcttgg

SEQ ID NO: 1222437 - DNA, 21 bp, Homo sapiens
ccttgtgcttggtggggctcg

SEQ ID NO: 1222438 - DNA, 22 bp, Homo sapiens
ccttgtggatgctagtgctgta

SEQ ID NO: 1222439 - DNA, 23 bp, Homo sapiens
ccttgtggccttttttataacta

SEQ ID NO: 1222440 - DNA, 17 bp, Homo sapiens
ccttgtggcttgggaca

SEQ ID NO: 1222441 - DNA, 22 bp, Homo sapiens
ccttgtgggcaaaggcagggcc

SEQ ID NO: 1222442 - DNA, 15 bp, Homo sapiens
ccttgtgtcactggc

SEQ ID NO: 1222443 - DNA, 14 bp, Homo sapiens
ccttgtgtgtcagg

SEQ ID NO: 1222444 - DNA, 18 bp, Homo sapiens
ccttgtgtgtgccctggg

SEQ ID NO: 1222445 - DNA, 23 bp, Homo sapiens
ccttgtgttcagctctttccaaa

SEQ ID NO: 1222446 - DNA, 18 bp, Homo sapiens
ccttgtgttttgtcctgc

SEQ ID NO: 1222447 - DNA, 20 bp, Homo sapiens
ccttgtgttttgtcctgcct

SEQ ID NO: 1222448 - DNA, 16 bp, Homo sapiens
ccttgttacttctgag

SEQ ID NO: 1222449 - DNA, 19 bp, Homo sapiens
ccttgttacttctgaggta

SEQ ID NO: 1222450 - DNA, 13 bp, Homo sapiens
ccttgttcatgga

SEQ ID NO: 1222451 - DNA, 17 bp, Homo sapiens
ccttgttcatggagagc

SEQ ID NO: 1222452 - DNA, 13 bp, Homo sapiens
ccttgttctattt

SEQ ID NO: 1222453 - DNA, 14 bp, Homo sapiens
ccttgttctatttt

SEQ ID NO: 1222454 - DNA, 22 bp, Homo sapiens
ccttgttctatttttcaatcat

SEQ ID NO: 1222455 - DNA, 15 bp, Homo sapiens
ccttgttgcactgcc

SEQ ID NO: 1222456 - DNA, 16 bp, Homo sapiens
ccttgttggagcctgc

SEQ ID NO: 1222457 - DNA, 16 bp, Homo sapiens
ccttgttggtcagagg

SEQ ID NO: 1222458 - DNA, 17 bp, Homo sapiens
ccttgttgtttcttgcc

SEQ ID NO: 1222459 - DNA, 20 bp, Homo sapiens
ccttgtttatcagatacatc

SEQ ID NO: 1222460 - DNA, 23 bp, Homo sapiens
ccttgtttgagtttttcctccca

SEQ ID NO: 1222461 - DNA, 15 bp, Homo sapiens
cctttaaaaaagaaa

SEQ ID NO: 1222462 - DNA, 14 bp, Homo sapiens
cctttaaagccttt

SEQ ID NO: 1222463 - DNA, 23 bp, Homo sapiens
cctttaaagtatgaatctatgcc

SEQ ID NO: 1222464 - DNA, 16 bp, Homo sapiens
cctttaaatgaaacaa

SEQ ID NO: 1222465 - DNA, 16 bp, Homo sapiens
cctttaaccctgattc

SEQ ID NO: 1222466 - DNA, 16 bp, Homo sapiens
cctttaactcatgagg

SEQ ID NO: 1222467 - DNA, 19 bp, Homo sapiens
cctttaactgacaagccat

SEQ ID NO: 1222468 - DNA, 22 bp, Homo sapiens
cctttaactgtatccttaacca

SEQ ID NO: 1222469 - DNA, 19 bp, Homo sapiens
cctttaagcctgcattctt

SEQ ID NO: 1222470 - DNA, 21 bp, Homo sapiens
cctttaagcctgcattcttaa

SEQ ID NO: 1222471 - DNA, 18 bp, Homo sapiens
cctttaaggtactgaagc

SEQ ID NO: 1222472 - DNA, 11 bp, Homo sapiens
cctttaatatt

SEQ ID NO: 1222473 - DNA, 16 bp, Homo sapiens
cctttaatattttgta

SEQ ID NO: 1222474 - DNA, 21 bp, Homo sapiens
cctttaatattttgtaatatt

SEQ ID NO: 1222475 - DNA, 13 bp, Homo sapiens
cctttaatgcatc

SEQ ID NO: 1222476 - DNA, 18 bp, Homo sapiens
cctttaattgtaaagtaa

SEQ ID NO: 1222477 - DNA, 16 bp, Homo sapiens
cctttaattttcttgt

SEQ ID NO: 1222478 - DNA, 18 bp, Homo sapiens
cctttacaccaactccta

SEQ ID NO: 1222479 - DNA, 12 bp, Homo sapiens
cctttacatgag

SEQ ID NO: 1222480 - DNA, 18 bp, Homo sapiens
cctttaccttttctataa

SEQ ID NO: 1222481 - DNA, 15 bp, Homo sapiens
cctttacgtgtttaa

SEQ ID NO: 1222482 - DNA, 19 bp, Homo sapiens
cctttacgtgtttaaaaaa

SEQ ID NO: 1222483 - DNA, 18 bp, Homo sapiens
cctttactatcattctca

SEQ ID NO: 1222484 - DNA, 21 bp, Homo sapiens
cctttactatcattctcagtg

SEQ ID NO: 1222485 - DNA, 15 bp, Homo sapiens
cctttacttgacctc

SEQ ID NO: 1222486 - DNA, 14 bp, Homo sapiens
cctttactttccct

SEQ ID NO: 1222487 - DNA, 20 bp, Homo sapiens
cctttactttcccttgcttt

SEQ ID NO: 1222488 - DNA, 14 bp, Homo sapiens
cctttagaaaatat

SEQ ID NO: 1222489 - DNA, 16 bp, Homo sapiens
cctttagaaaatataa

SEQ ID NO: 1222490 - DNA, 14 bp, Homo sapiens
cctttagaacagga

SEQ ID NO: 1222491 - DNA, 19 bp, Homo sapiens
cctttagccaaacccttgt

SEQ ID NO: 1222492 - DNA, 18 bp, Homo sapiens
cctttaggcagcctgccg

SEQ ID NO: 1222493 - DNA, 15 bp, Homo sapiens
cctttagggcagctt

SEQ ID NO: 1222494 - DNA, 20 bp, Homo sapiens
cctttagggcagcttgcccc

SEQ ID NO: 1222495 - DNA, 18 bp, Homo sapiens
cctttagggctgttgcta

SEQ ID NO: 1222496 - DNA, 19 bp, Homo sapiens
cctttagggttctgcctct

SEQ ID NO: 1222497 - DNA, 19 bp, Homo sapiens
cctttaggtcaaactccct

SEQ ID NO: 1222498 - DNA, 16 bp, Homo sapiens
cctttaggtctggttg

SEQ ID NO: 1222499 - DNA, 22 bp, Homo sapiens
cctttatcaaaaaaagactcag

SEQ ID NO: 1222500 - DNA, 16 bp, Homo sapiens
cctttatcacctcatt

SEQ ID NO: 1222501 - DNA, 18 bp, Homo sapiens
cctttatcttgaagtcag

SEQ ID NO: 1222502 - DNA, 19 bp, Homo sapiens
cctttatcttgaagtcagc

SEQ ID NO: 1222503 - DNA, 20 bp, Homo sapiens
cctttatcttgaagtcagcc

SEQ ID NO: 1222504 - DNA, 14 bp, Homo sapiens
cctttatgatgcta

SEQ ID NO: 1222505 - DNA, 22 bp, Homo sapiens
cctttatgatgctaagctgata

SEQ ID NO: 1222506 - DNA, 12 bp, Homo sapiens
cctttatgtgaa

SEQ ID NO: 1222507 - DNA, 13 bp, Homo sapiens
cctttatgtgaat

SEQ ID NO: 1222508 - DNA, 20 bp, Homo sapiens
ctaatgagctagtgtcttat

SEQ ID NO: 1222509 - DNA, 23 bp, Homo sapiens
ctaatgaggagagaaaatatatg

SEQ ID NO: 1222510 - DNA, 19 bp, Homo sapiens
ctaatgatcaaaacatgct

SEQ ID NO: 1222511 - DNA, 14 bp, Homo sapiens
ctaatgcaaattaa

SEQ ID NO: 1222512 - DNA, 15 bp, Homo sapiens
ctaatgctaagaaat

SEQ ID NO: 1222513 - DNA, 21 bp, Homo sapiens
ctaatgctggcctgactggtt

SEQ ID NO: 1222514 - DNA, 16 bp, Homo sapiens
ctaatgcttgtttatg

SEQ ID NO: 1222515 - DNA, 17 bp, Homo sapiens
ctaatgcttgtttatga

SEQ ID NO: 1222516 - DNA, 19 bp, Homo sapiens
ctaatggggaaatgtagct

SEQ ID NO: 1222517 - DNA, 20 bp, Homo sapiens
ctaatggggaaatgtagcta

SEQ ID NO: 1222518 - DNA, 19 bp, Homo sapiens
ctaatgggtatttaaacaa

SEQ ID NO: 1222519 - DNA, 19 bp, Homo sapiens
ctaatgtaaactttgtcat

SEQ ID NO: 1222520 - DNA, 19 bp, Homo sapiens
ctaatgtcacaattatgtg

SEQ ID NO: 1222521 - DNA, 15 bp, Homo sapiens
ctaatgtctcactgt

SEQ ID NO: 1222522 - DNA, 16 bp, Homo sapiens
ctaatgtctcactgtt

SEQ ID NO: 1222523 - DNA, 19 bp, Homo sapiens
ctaatgtctcactgttctg

SEQ ID NO: 1222524 - DNA, 22 bp, Homo sapiens
ctaatgtctcactgttctgcaa

SEQ ID NO: 1222525 - DNA, 23 bp, Homo sapiens
ctaatgtggaccttagaatacag

SEQ ID NO: 1222526 - DNA, 19 bp, Homo sapiens
ctaatgtggttatttctct

SEQ ID NO: 1222527 - DNA, 17 bp, Homo sapiens
ctaatgttgatcagcaa

SEQ ID NO: 1222528 - DNA, 18 bp, Homo sapiens
ctaatgttgctggatcag

SEQ ID NO: 1222529 - DNA, 15 bp, Homo sapiens
ctaatgttggacaga

SEQ ID NO: 1222530 - DNA, 15 bp, Homo sapiens
ctaatgtttgaacaa

SEQ ID NO: 1222531 - DNA, 18 bp, Homo sapiens
ctaatgtttgtattttta

SEQ ID NO: 1222532 - DNA, 23 bp, Homo sapiens
ctaatgtttgtatttttagtaga

SEQ ID NO: 1222533 - DNA, 18 bp, Homo sapiens
ctaattaaaatctggaaa

SEQ ID NO: 1222534 - DNA, 19 bp, Homo sapiens
ctaattaaaatctggaaat

SEQ ID NO: 1222535 - DNA, 18 bp, Homo sapiens
ctaattaaccttactaat

SEQ ID NO: 1222536 - DNA, 17 bp, Homo sapiens
ctaattaactgaaacat

SEQ ID NO: 1222537 - DNA, 18 bp, Homo sapiens
ctaattaatatattaaaa

SEQ ID NO: 1222538 - DNA, 23 bp, Homo sapiens
ctaattagtctatcaaatgaaac

SEQ ID NO: 1222539 - DNA, 15 bp, Homo sapiens
ctaattataattcag

SEQ ID NO: 1222540 - DNA, 19 bp, Homo sapiens
ctaattatcaatgggatat

SEQ ID NO: 1222541 - DNA, 20 bp, Homo sapiens
ctaattcaaggaatttctta

SEQ ID NO: 1222542 - DNA, 22 bp, Homo sapiens
ctaattcacacaaagactcctt

SEQ ID NO: 1222543 - DNA, 22 bp, Homo sapiens
ctaattcagacagagactttaa

SEQ ID NO: 1222544 - DNA, 21 bp, Homo sapiens
ctaattcccaacatttcttaa

SEQ ID NO: 1222545 - DNA, 21 bp, Homo sapiens
ctaattcccattttgcaaaat

SEQ ID NO: 1222546 - DNA, 15 bp, Homo sapiens
ctaattcctttctat

SEQ ID NO: 1222547 - DNA, 16 bp, Homo sapiens
ctaattcgatgaaggc

SEQ ID NO: 1222548 - DNA, 13 bp, Homo sapiens
ctaattctgggaa

SEQ ID NO: 1222549 - DNA, 18 bp, Homo sapiens
ctaattcttctgtcctga

SEQ ID NO: 1222550 - DNA, 19 bp, Homo sapiens
ctaattggaagaaattcct

SEQ ID NO: 1222551 - DNA, 19 bp, Homo sapiens
ctaattggcctctttaaga

SEQ ID NO: 1222552 - DNA, 23 bp, Homo sapiens
ctaattgggagtccaggcacagg

SEQ ID NO: 1222553 - DNA, 20 bp, Homo sapiens
ctaattgtaagtgaaattaa

SEQ ID NO: 1222554 - DNA, 12 bp, Homo sapiens
ctaattgtggat

SEQ ID NO: 1222555 - DNA, 12 bp, Homo sapiens
ctaatttaaaaa

SEQ ID NO: 1222556 - DNA, 14 bp, Homo sapiens
ctaatttaaaaaat

SEQ ID NO: 1222557 - DNA, 11 bp, Homo sapiens
ctaatttaaca

SEQ ID NO: 1222558 - DNA, 13 bp, Homo sapiens
ctaatttataaaa

SEQ ID NO: 1222559 - DNA, 19 bp, Homo sapiens
ctaatttatactttaaagt

SEQ ID NO: 1222560 - DNA, 15 bp, Homo sapiens
ctaatttatattatc

SEQ ID NO: 1222561 - DNA, 16 bp, Homo sapiens
ctaatttatattatcc

SEQ ID NO: 1222562 - DNA, 14 bp, Homo sapiens
ctaatttattaatc

SEQ ID NO: 1222563 - DNA, 20 bp, Homo sapiens
ctaatttctcctcccttcct

SEQ ID NO: 1222564 - DNA, 21 bp, Homo sapiens
ctaatttgcactaatgtgtta

SEQ ID NO: 1222565 - DNA, 22 bp, Homo sapiens
ctaatttgtaggaaaaagcaag

SEQ ID NO: 1222566 - DNA, 19 bp, Homo sapiens
ctaatttgttttggatata

SEQ ID NO: 1222567 - DNA, 15 bp, Homo sapiens
ctaattttaaataat

SEQ ID NO: 1222568 - DNA, 19 bp, Homo sapiens
ctaattttaaataatttct

SEQ ID NO: 1222569 - DNA, 20 bp, Homo sapiens
ctaattttacacattagatt

SEQ ID NO: 1222570 - DNA, 19 bp, Homo sapiens
ctaattttacatgtttata

SEQ ID NO: 1222571 - DNA, 12 bp, Homo sapiens
ctaattttctat

SEQ ID NO: 1222572 - DNA, 17 bp, Homo sapiens
ctaattttctatcagaa

SEQ ID NO: 1222573 - DNA, 15 bp, Homo sapiens
ctaattttgtacata

SEQ ID NO: 1222574 - DNA, 22 bp, Homo sapiens
ctaattttgtacatactgtatt

SEQ ID NO: 1222575 - DNA, 17 bp, Homo sapiens
ctaattttgttgaaaat

SEQ ID NO: 1222576 - DNA, 17 bp, Homo sapiens
ctaatttttaagcaaaa

SEQ ID NO: 1222577 - DNA, 12 bp, Homo sapiens
ctaatttttgta

SEQ ID NO: 1222578 - DNA, 14 bp, Homo sapiens
ctaatttttgtaat

SEQ ID NO: 1222579 - DNA, 20 bp, Homo sapiens
ctaatttttgtaattttagt

SEQ ID NO: 1222580 - DNA, 14 bp, Homo sapiens
ctaatttttgtatg

SEQ ID NO: 1222581 - DNA, 23 bp, Homo sapiens
ctaatttttgtatgtttagtaga

SEQ ID NO: 1222582 - DNA, 14 bp, Homo sapiens
ctaatttttgtatt

SEQ ID NO: 1222583 - DNA, 18 bp, Homo sapiens
ctaatttttgtattattt

SEQ ID NO: 1222584 - DNA, 21 bp, Homo sapiens
ctaatttttttgtattttagc

SEQ ID NO: 1222585 - DNA, 20 bp, Homo sapiens
ctacaaaacctgatgttaaa

SEQ ID NO: 1222586 - DNA, 18 bp, Homo sapiens
ctacaaagctttgctaca

SEQ ID NO: 1222587 - DNA, 17 bp, Homo sapiens
ctacaaagtaaaatgaa

SEQ ID NO: 1222588 - DNA, 13 bp, Homo sapiens
ctacaaatttatg

SEQ ID NO: 1222589 - DNA, 16 bp, Homo sapiens
ctacaaatttatgcat

SEQ ID NO: 1222590 - DNA, 19 bp, Homo sapiens
ctacaaatttatgcatttc

SEQ ID NO: 1222591 - DNA, 18 bp, Homo sapiens
ctacaaccaagctctctg

SEQ ID NO: 1222592 - DNA, 18 bp, Homo sapiens
ctacaactaaaaataaat

SEQ ID NO: 1222593 - DNA, 17 bp, Homo sapiens
ctacaacttaatggaaa

SEQ ID NO: 1222594 - DNA, 16 bp, Homo sapiens
ctacaacttcagcagt

SEQ ID NO: 1222595 - DNA, 18 bp, Homo sapiens
ctacaacttttgttttct

SEQ ID NO: 1222596 - DNA, 19 bp, Homo sapiens
ctacaacttttgttttctg

SEQ ID NO: 1222597 - DNA, 20 bp, Homo sapiens
ctacaacttttgttttctga

SEQ ID NO: 1222598 - DNA, 15 bp, Homo sapiens
ctacaagacacagtg

SEQ ID NO: 1222599 - DNA, 15 bp, Homo sapiens
ctacaagagcagcct

SEQ ID NO: 1222600 - DNA, 19 bp, Homo sapiens
ctacaagagcagcctgtgg

SEQ ID NO: 1222601 - DNA, 20 bp, Homo sapiens
ctacaagagcagcctgtggc

SEQ ID NO: 1222602 - DNA, 23 bp, Homo sapiens
ctacaagagcagcctgtggcatc

SEQ ID NO: 1222603 - DNA, 13 bp, Homo sapiens
ctacaagatttcc

SEQ ID NO: 1222604 - DNA, 18 bp, Homo sapiens
ctacaagtgtaggccacc

SEQ ID NO: 1222605 - DNA, 21 bp, Homo sapiens
ctacaatcagttgactttaag

SEQ ID NO: 1222606 - DNA, 23 bp, Homo sapiens
ctacaatcatggtcaagttccca

SEQ ID NO: 1222607 - DNA, 20 bp, Homo sapiens
ctacaattttctcccaggaa

SEQ ID NO: 1222608 - DNA, 13 bp, Homo sapiens
ctacacactgcat

SEQ ID NO: 1222609 - DNA, 22 bp, Homo sapiens
ctacacactgtcatgcttcatc

SEQ ID NO: 1222610 - DNA, 15 bp, Homo sapiens
ctacacagacattaa

SEQ ID NO: 1222611 - DNA, 13 bp, Homo sapiens
ctacacagcacac

SEQ ID NO: 1222612 - DNA, 18 bp, Homo sapiens
ctacacatgtaaaatatg

SEQ ID NO: 1222613 - DNA, 14 bp, Homo sapiens
ctacacccaagcct

SEQ ID NO: 1222614 - DNA, 16 bp, Homo sapiens
ctacacccagcaatag

SEQ ID NO: 1222615 - DNA, 16 bp, Homo sapiens
ctacacccctgtgctc

SEQ ID NO: 1222616 - DNA, 22 bp, Homo sapiens
ctacacccctgtgctcccctgc

SEQ ID NO: 1222617 - DNA, 11 bp, Homo sapiens
ctacacctgga

SEQ ID NO: 1222618 - DNA, 13 bp, Homo sapiens
ctacacctggctg

SEQ ID NO: 1222619 - DNA, 15 bp, Homo sapiens
ctacacctggctgag

SEQ ID NO: 1222620 - DNA, 13 bp, Homo sapiens
ctacaccttgagg

SEQ ID NO: 1222621 - DNA, 22 bp, Homo sapiens
ctacacggactgaggtgcctgc

SEQ ID NO: 1222622 - DNA, 23 bp, Homo sapiens
ctacacggactgaggtgcctgct

SEQ ID NO: 1222623 - DNA, 23 bp, Homo sapiens
ctacactcttgtaataaaatgtc

SEQ ID NO: 1222624 - DNA, 11 bp, Homo sapiens
ctacactgaaa

SEQ ID NO: 1222625 - DNA, 12 bp, Homo sapiens
ctacactgaaac

SEQ ID NO: 1222626 - DNA, 22 bp, Homo sapiens
ctacactgtattacataaataa

SEQ ID NO: 1222627 - DNA, 20 bp, Homo sapiens
ctacactgtgaacttgggga

SEQ ID NO: 1222628 - DNA, 18 bp, Homo sapiens
ctacagaaataacagctg

SEQ ID NO: 1222629 - DNA, 17 bp, Homo sapiens
ctacagaaatactgctc

SEQ ID NO: 1222630 - DNA, 13 bp, Homo sapiens
ctacagaaattct

SEQ ID NO: 1222631 - DNA, 21 bp, Homo sapiens
ctacagaaattctgcaagttt

SEQ ID NO: 1222632 - DNA, 18 bp, Homo sapiens
ctaatgaagggaaaggat

SEQ ID NO: 1222633 - DNA, 12 bp, Homo sapiens
ctaccctcaccc

SEQ ID NO: 1222634 - DNA, 14 bp, Homo sapiens
ctaccctccagagt

SEQ ID NO: 1222635 - DNA, 15 bp, Homo sapiens
ctaccctcccaccag

SEQ ID NO: 1222636 - DNA, 14 bp, Homo sapiens
ctaccctcccaccc

SEQ ID NO: 1222637 - DNA, 19 bp, Homo sapiens
ctaccctcccacccccttc

SEQ ID NO: 1222638 - DNA, 14 bp, Homo sapiens
ctaccctcccccag

SEQ ID NO: 1222639 - DNA, 15 bp, Homo sapiens
ctaccctcgggccca

SEQ ID NO: 1222640 - DNA, 22 bp, Homo sapiens
ctaccctcgggcccacctggcc

SEQ ID NO: 1222641 - DNA, 13 bp, Homo sapiens
ctactgaaacaga

SEQ ID NO: 1222642 - DNA, 16 bp, Homo sapiens
ctactgaacacatgtg

SEQ ID NO: 1222643 - DNA, 16 bp, Homo sapiens
ctactgaaccagccac

SEQ ID NO: 1222644 - DNA, 21 bp, Homo sapiens
ctactgaatgacctctctact

SEQ ID NO: 1222645 - DNA, 16 bp, Homo sapiens
ctactgacagggagca

SEQ ID NO: 1222646 - DNA, 14 bp, Homo sapiens
ctactgacatgtgg

SEQ ID NO: 1222647 - DNA, 17 bp, Homo sapiens
ctactgacctttgtcct

SEQ ID NO: 1222648 - DNA, 17 bp, Homo sapiens
ctactgataaagaaaga

SEQ ID NO: 1222649 - DNA, 16 bp, Homo sapiens
ctactgatgaaatctg

SEQ ID NO: 1222650 - DNA, 14 bp, Homo sapiens
ctactgattccgca

SEQ ID NO: 1222651 - DNA, 17 bp, Homo sapiens
ctactgattgtttcatt

SEQ ID NO: 1222652 - DNA, 16 bp, Homo sapiens
ctactgatttcctttg

SEQ ID NO: 1222653 - DNA, 19 bp, Homo sapiens
ctactgattttaaaatgaa

SEQ ID NO: 1222654 - DNA, 20 bp, Homo sapiens
ctagaattagtatgtctgtt

SEQ ID NO: 1222655 - DNA, 21 bp, Homo sapiens
ctagaattgagtgtttaaagt

SEQ ID NO: 1222656 - DNA, 13 bp, Homo sapiens
ctagaatttattc

SEQ ID NO: 1222657 - DNA, 23 bp, Homo sapiens
ctagaatttattcaattcctctg

SEQ ID NO: 1222658 - DNA, 21 bp, Homo sapiens
ctagacaaacaagggagaaga

SEQ ID NO: 1222659 - DNA, 16 bp, Homo sapiens
ctagacaaccctgcaa

SEQ ID NO: 1222660 - DNA, 15 bp, Homo sapiens
ctagacaacctttct

SEQ ID NO: 1222661 - DNA, 17 bp, Homo sapiens
ctagacaacctttctgt

SEQ ID NO: 1222662 - DNA, 21 bp, Homo sapiens
ctagacaacctttctgtagcc

SEQ ID NO: 1222663 - DNA, 23 bp, Homo sapiens
ctagacacatgaaggtaaataaa

SEQ ID NO: 1222664 - DNA, 16 bp, Homo sapiens
ctagacaggaaccctt

SEQ ID NO: 1222665 - DNA, 15 bp, Homo sapiens
ctagacagtattgcc

SEQ ID NO: 1222666 - DNA, 16 bp, Homo sapiens
ctagacagtattgcca

SEQ ID NO: 1222667 - DNA, 17 bp, Homo sapiens
ctagacagtattgccac

SEQ ID NO: 1222668 - DNA, 22 bp, Homo sapiens
ctagacatctacctatacttaa

SEQ ID NO: 1222669 - DNA, 12 bp, Homo sapiens
ctagaccaataa

SEQ ID NO: 1222670 - DNA, 20 bp, Homo sapiens
ctagaccagcagacagagcc

SEQ ID NO: 1222671 - DNA, 21 bp, Homo sapiens
ctagaccagcagacagagcca

SEQ ID NO: 1222672 - DNA, 23 bp, Homo sapiens
ctagaccagcagacagagccagg

SEQ ID NO: 1222673 - DNA, 13 bp, Homo sapiens
ctagaccagtttg

SEQ ID NO: 1222674 - DNA, 17 bp, Homo sapiens
ctagacgcccctcccaa

SEQ ID NO: 1222675 - DNA, 20 bp, Homo sapiens
ctagactaattaaaatctgg

SEQ ID NO: 1222676 - DNA, 19 bp, Homo sapiens
ctagactagcaatctcttc

SEQ ID NO: 1222677 - DNA, 17 bp, Homo sapiens
ctagactcaaaacctgg

SEQ ID NO: 1222678 - DNA, 21 bp, Homo sapiens
ctagactcaaaacctggagat

SEQ ID NO: 1222679 - DNA, 13 bp, Homo sapiens
ctagacttcccca

SEQ ID NO: 1222680 - DNA, 21 bp, Homo sapiens
ctagacttccccatcccgaag

SEQ ID NO: 1222681 - DNA, 13 bp, Homo sapiens
ctagactttctgt

SEQ ID NO: 1222682 - DNA, 16 bp, Homo sapiens
ctagagaacaggtggt

SEQ ID NO: 1222683 - DNA, 15 bp, Homo sapiens
ctagagacaaatctt

SEQ ID NO: 1222684 - DNA, 16 bp, Homo sapiens
ctagagacaaatcttt

SEQ ID NO: 1222685 - DNA, 22 bp, Homo sapiens
ctagagacagaagcaggctgga

SEQ ID NO: 1222686 - DNA, 16 bp, Homo sapiens
ctagagagagggagaa

SEQ ID NO: 1222687 - DNA, 22 bp, Homo sapiens
ctagagagggaggcaagccctg

SEQ ID NO: 1222688 - DNA, 23 bp, Homo sapiens
ctagagagggaggcaagccctgt

SEQ ID NO: 1222689 - DNA, 14 bp, Homo sapiens
ctagagatattctt

SEQ ID NO: 1222690 - DNA, 15 bp, Homo sapiens
ctagagatattttgt

SEQ ID NO: 1222691 - DNA, 16 bp, Homo sapiens
ctagagcaacccctgt

SEQ ID NO: 1222692 - DNA, 19 bp, Homo sapiens
ctagagcactctcacccca

SEQ ID NO: 1222693 - DNA, 14 bp, Homo sapiens
ctagagcagacagg

SEQ ID NO: 1222694 - DNA, 15 bp, Homo sapiens
ctagagcagggatta

SEQ ID NO: 1222695 - DNA, 14 bp, Homo sapiens
ctagagccagacca

SEQ ID NO: 1222696 - DNA, 16 bp, Homo sapiens
ctagagccttcagcct

SEQ ID NO: 1222697 - DNA, 18 bp, Homo sapiens
ctagaggccaaattcttt

SEQ ID NO: 1222698 - DNA, 19 bp, Homo sapiens
ctagaggccagccccaccc

SEQ ID NO: 1222699 - DNA, 22 bp, Homo sapiens
ctagaggccagccccacccagg

SEQ ID NO: 1222700 - DNA, 11 bp, Homo sapiens
ctagaggcctc

SEQ ID NO: 1222701 - DNA, 14 bp, Homo sapiens
ctagagggacctct

SEQ ID NO: 1222702 - DNA, 17 bp, Homo sapiens
ctagagggacctctccc

SEQ ID NO: 1222703 - DNA, 18 bp, Homo sapiens
ctagagggacctctccca

SEQ ID NO: 1222704 - DNA, 19 bp, Homo sapiens
ctagagggacctctcccag

SEQ ID NO: 1222705 - DNA, 20 bp, Homo sapiens
ctagagggacctctcccagg

SEQ ID NO: 1222706 - DNA, 19 bp, Homo sapiens
ctagagggaggggcctagg

SEQ ID NO: 1222707 - DNA, 22 bp, Homo sapiens
ctagagggaggggcctaggcct

SEQ ID NO: 1222708 - DNA, 22 bp, Homo sapiens
ctagagggatacactgaagtta

SEQ ID NO: 1222709 - DNA, 20 bp, Homo sapiens
ctagagggcccatcaggcag

SEQ ID NO: 1222710 - DNA, 22 bp, Homo sapiens
ctagagggttgctgcctttcaa

SEQ ID NO: 1222711 - DNA, 17 bp, Homo sapiens
ctagaggtgagaaattt

SEQ ID NO: 1222712 - DNA, 21 bp, Homo sapiens
ctagaggtgggcagctgggcc

SEQ ID NO: 1222713 - DNA, 19 bp, Homo sapiens
ctagaggtgttacagagga

SEQ ID NO: 1222714 - DNA, 20 bp, Homo sapiens
ctagaggtgttacagaggac

SEQ ID NO: 1222715 - DNA, 17 bp, Homo sapiens
ctagaggttcaaagata

SEQ ID NO: 1222716 - DNA, 21 bp, Homo sapiens
ctagaggttcaaagatatttt

SEQ ID NO: 1222717 - DNA, 20 bp, Homo sapiens
ctagagtcatgtgagcctcg

SEQ ID NO: 1222718 - DNA, 22 bp, Homo sapiens
ctagagtctcagaaactcccct

SEQ ID NO: 1222719 - DNA, 16 bp, Homo sapiens
ctagagtctgaacagc

SEQ ID NO: 1222720 - DNA, 23 bp, Homo sapiens
ctagagtgtagcctaaagggcag

SEQ ID NO: 1222721 - DNA, 13 bp, Homo sapiens
ctagagttatctt

SEQ ID NO: 1222722 - DNA, 20 bp, Homo sapiens
ctagagttatcttctttatt

SEQ ID NO: 1222723 - DNA, 20 bp, Homo sapiens
ctagagttcggtctgacagt

SEQ ID NO: 1222724 - DNA, 23 bp, Homo sapiens
ctagagttcggtctgacagtcct

SEQ ID NO: 1222725 - DNA, 16 bp, Homo sapiens
ctagagttttatcaac

SEQ ID NO: 1222726 - DNA, 23 bp, Homo sapiens
ctagataaaaagatggcctttgc

SEQ ID NO: 1222727 - DNA, 15 bp, Homo sapiens
ctagatacaataaat

SEQ ID NO: 1222728 - DNA, 23 bp, Homo sapiens
ctagatacaataaattgctaatg

SEQ ID NO: 1222729 - DNA, 24 bp, Homo sapiens
ctagatactgtatcatgacaaaga

SEQ ID NO: 1222730 - DNA, 17 bp, Homo sapiens
ctagatagctattaaga

SEQ ID NO: 1222731 - DNA, 14 bp, Homo sapiens
ctagatatgcctta

SEQ ID NO: 1222732 - DNA, 13 bp, Homo sapiens
ctagatccacaca

SEQ ID NO: 1222733 - DNA, 17 bp, Homo sapiens
ctagatccacacacaga

SEQ ID NO: 1222734 - DNA, 22 bp, Homo sapiens
ctagatccacgtgtggcctccg

SEQ ID NO: 1222735 - DNA, 14 bp, Homo sapiens
ctagatcctgcacc

SEQ ID NO: 1222736 - DNA, 17 bp, Homo sapiens
ctagatcctgcacccca

SEQ ID NO: 1222737 - DNA, 20 bp, Homo sapiens
ctagatcctgcaccccagca

SEQ ID NO: 1222738 - DNA, 17 bp, Homo sapiens
ctagatgattttttgaa

SEQ ID NO: 1222739 - DNA, 18 bp, Homo sapiens
ctagatgcatcactgggt

SEQ ID NO: 1222740 - DNA, 21 bp, Homo sapiens
ctagatgctttcctaaatcag

SEQ ID NO: 1222741 - DNA, 16 bp, Homo sapiens
ctagatgtttaacaaa

SEQ ID NO: 1222742 - DNA, 13 bp, Homo sapiens
ctagattaccatg

SEQ ID NO: 1222743 - DNA, 17 bp, Homo sapiens
ctagattttaatttatt

SEQ ID NO: 1222744 - DNA, 22 bp, Homo sapiens
ctagattttaatttatttgttt

SEQ ID NO: 1222745 - DNA, 16 bp, Homo sapiens
ctagcaaaagtgcaag

SEQ ID NO: 1222746 - DNA, 14 bp, Homo sapiens
ctagcaaaggaaaa

SEQ ID NO: 1222747 - DNA, 15 bp, Homo sapiens
ctagcaaaggaaaat

SEQ ID NO: 1222748 - DNA, 18 bp, Homo sapiens
ctagcaacatatctctgc

SEQ ID NO: 1222749 - DNA, 20 bp, Homo sapiens
ctagcaatcacaacactggc

SEQ ID NO: 1222750 - DNA, 19 bp, Homo sapiens
ctagcacaaggagtgcccg

SEQ ID NO: 1222751 - DNA, 17 bp, Homo sapiens
ctagcacaatttgcact

SEQ ID NO: 1222752 - DNA, 15 bp, Homo sapiens
ctagcacagcagctt

SEQ ID NO: 1222753 - DNA, 23 bp, Homo sapiens
ctagcacagtaaaagtaaagact

SEQ ID NO: 1222754 - DNA, 14 bp, Homo sapiens
ctagcacctccccc

SEQ ID NO: 1222755 - DNA, 14 bp, Homo sapiens
ctagcactcctcaa

SEQ ID NO: 1222756 - DNA, 19 bp, Homo sapiens
ctagcactcctcaagactt

SEQ ID NO: 1222757 - DNA, 12 bp, Homo sapiens
ctagcattcctc

SEQ ID NO: 1222758 - DNA, 16 bp, Homo sapiens
ctagccaaaccaggac

SEQ ID NO: 1222759 - DNA, 20 bp, Homo sapiens
ctagccaaaccaggaccctg

SEQ ID NO: 1222760 - DNA, 22 bp, Homo sapiens
ctagccaatattaaaagagacc

SEQ ID NO: 1222761 - DNA, 15 bp, Homo sapiens
ctagccactccctcc

SEQ ID NO: 1222762 - DNA, 17 bp, Homo sapiens
ctagccactccctccca

SEQ ID NO: 1222763 - DNA, 21 bp, Homo sapiens
ctagccagacaaaatttgaga

SEQ ID NO: 1222764 - DNA, 22 bp, Homo sapiens
ctagccagacactctgctctgc

SEQ ID NO: 1222765 - DNA, 20 bp, Homo sapiens
ctagccagagaatagatcag

SEQ ID NO: 1222766 - DNA, 18 bp, Homo sapiens
ctagccagcccctcttcc

SEQ ID NO: 1222767 - DNA, 22 bp, Homo sapiens
ctagccaggaagtacttccacc

SEQ ID NO: 1222768 - DNA, 23 bp, Homo sapiens
ctagccaggaagtacttccacct

SEQ ID NO: 1222769 - DNA, 19 bp, Homo sapiens
ctagccaggagtctgtgct

SEQ ID NO: 1222770 - DNA, 14 bp, Homo sapiens
ctagccattcctgg

SEQ ID NO: 1222771 - DNA, 20 bp, Homo sapiens
ctagccattcctggtaccca

SEQ ID NO: 1222772 - DNA, 18 bp, Homo sapiens
ctagcccaatgaaatgaa

SEQ ID NO: 1222773 - DNA, 17 bp, Homo sapiens
ctagcccactccctgcc

SEQ ID NO: 1222774 - DNA, 14 bp, Homo sapiens
ctagcccagactct

SEQ ID NO: 1222775 - DNA, 15 bp, Homo sapiens
ctagcccagtgcttc

SEQ ID NO: 1222776 - DNA, 13 bp, Homo sapiens
ctagcccctctct

SEQ ID NO: 1222777 - DNA, 17 bp, Homo sapiens
ctagccctcctttttcc

SEQ ID NO: 1222778 - DNA, 19 bp, Homo sapiens
ctagccctcctttttccaa

SEQ ID NO: 1222779 - DNA, 10 bp, Homo sapiens
ctagccctga

SEQ ID NO: 1222780 - DNA, 16 bp, Homo sapiens
ctagccctgagcccgg

SEQ ID NO: 1222781 - DNA, 13 bp, Homo sapiens
ctagccctgggac

SEQ ID NO: 1222782 - DNA, 12 bp, Homo sapiens
ctagcccttcca

SEQ ID NO: 1222783 - DNA, 20 bp, Homo sapiens
ctagcccttccagcctggga

SEQ ID NO: 1222784 - DNA, 12 bp, Homo sapiens
ctagcccttccc

SEQ ID NO: 1222785 - DNA, 15 bp, Homo sapiens
ctagcccttccctga

SEQ ID NO: 1222786 - DNA, 17 bp, Homo sapiens
ctagcccttccctgagt

SEQ ID NO: 1222787 - DNA, 13 bp, Homo sapiens
ctagccgacctca

SEQ ID NO: 1222788 - DNA, 15 bp, Homo sapiens
ctagccgacctcagc

SEQ ID NO: 1222789 - DNA, 13 bp, Homo sapiens
ctagcctctccag

SEQ ID NO: 1222790 - DNA, 14 bp, Homo sapiens
ctagcctctgagat

SEQ ID NO: 1222791 - DNA, 21 bp, Homo sapiens
ctagcctgtgcctctgggact

SEQ ID NO: 1222792 - DNA, 22 bp, Homo sapiens
ctagcctgtgcctctgggactg

SEQ ID NO: 1222793 - DNA, 19 bp, Homo sapiens
ctagccttatcctctgatc

SEQ ID NO: 1222794 - DNA, 22 bp, Homo sapiens
ctagccttggcctctttcctca

SEQ ID NO: 1222795 - DNA, 21 bp, Homo sapiens
ctagcgaacgtatttctccag

SEQ ID NO: 1222796 - DNA, 22 bp, Homo sapiens
ctagcgcagttttttttttctt

SEQ ID NO: 1222797 - DNA, 12 bp, Homo sapiens
ctagcgctgccg

SEQ ID NO: 1222798 - DNA, 16 bp, Homo sapiens
ctagcgctgccgcacc

SEQ ID NO: 1222799 - DNA, 15 bp, Homo sapiens
ctagcggagcccagc

SEQ ID NO: 1222800 - DNA, 16 bp, Homo sapiens
ctagcggagcccagcc

SEQ ID NO: 1222801 - DNA, 13 bp, Homo sapiens
ctagctaaataaa

SEQ ID NO: 1222802 - DNA, 15 bp, Homo sapiens
ctagctaattattta

SEQ ID NO: 1222803 - DNA, 14 bp, Homo sapiens
ctagctagaaatat

SEQ ID NO: 1222804 - DNA, 16 bp, Homo sapiens
ctagctagaaatatga

SEQ ID NO: 1222805 - DNA, 21 bp, Homo sapiens
ctagctagaaatatgatttta

SEQ ID NO: 1222806 - DNA, 16 bp, Homo sapiens
ctagctagccagccaa

SEQ ID NO: 1222807 - DNA, 15 bp, Homo sapiens
ctagctctcccagtg

SEQ ID NO: 1222808 - DNA, 22 bp, Homo sapiens
ctagctctcccagtgaactcct

SEQ ID NO: 1222809 - DNA, 21 bp, Homo sapiens
ctagctctctaggcctctcca

SEQ ID NO: 1222810 - DNA, 22 bp, Homo sapiens
ctagctctctaggcctctccag

SEQ ID NO: 1222811 - DNA, 10 bp, Homo sapiens
ctagctctgg

SEQ ID NO: 1222812 - DNA, 22 bp, Homo sapiens
ctagctctttgggcctctcctg

SEQ ID NO: 1222813 - DNA, 20 bp, Homo sapiens
ctagctgaccccgagaagtg

SEQ ID NO: 1222814 - DNA, 12 bp, Homo sapiens
ctagctggcagg

SEQ ID NO: 1222815 - DNA, 21 bp, Homo sapiens
ctagctgggggtgggccaggc

SEQ ID NO: 1222816 - DNA, 15 bp, Homo sapiens
ctagctgtctgtgaa

SEQ ID NO: 1222817 - DNA, 19 bp, Homo sapiens
ctagctgtgccccctctgg

SEQ ID NO: 1222818 - DNA, 15 bp, Homo sapiens
ctagctgttcttttt

SEQ ID NO: 1222819 - DNA, 15 bp, Homo sapiens
ctagcttctgctttt

SEQ ID NO: 1222820 - DNA, 16 bp, Homo sapiens
ctagcttctgcttttc

SEQ ID NO: 1222821 - DNA, 23 bp, Homo sapiens
ctagcttctgcttttctgccctg

SEQ ID NO: 1222822 - DNA, 23 bp, Homo sapiens
ctagctttacgctcatcacctaa

SEQ ID NO: 1222823 - DNA, 18 bp, Homo sapiens
ctagctttagaccctggg

SEQ ID NO: 1222824 - DNA, 19 bp, Homo sapiens
ctagctttagaccctgggt

SEQ ID NO: 1222825 - DNA, 20 bp, Homo sapiens
ctagctttatatatggacat

SEQ ID NO: 1222826 - DNA, 21 bp, Homo sapiens
ctagctttatatatggacatg

SEQ ID NO: 1222827 - DNA, 14 bp, Homo sapiens
ctagcttttaaaaa

SEQ ID NO: 1222828 - DNA, 16 bp, Homo sapiens
ctagcttttaaaaaat

SEQ ID NO: 1222829 - DNA, 18 bp, Homo sapiens
ctagcttttaaaaaatat

SEQ ID NO: 1222830 - DNA, 12 bp, Homo sapiens
ctagcttttcta

SEQ ID NO: 1222831 - DNA, 17 bp, Homo sapiens
ctaggaaaaaaggaata

SEQ ID NO: 1222832 - DNA, 16 bp, Homo sapiens
ctaggaagcttggctt

SEQ ID NO: 1222833 - DNA, 17 bp, Homo sapiens
ctaggaatgaaatcctg

SEQ ID NO: 1222834 - DNA, 19 bp, Homo sapiens
ctaggaatggagtctccca

SEQ ID NO: 1222835 - DNA, 15 bp, Homo sapiens
ctaggaattcccagc

SEQ ID NO: 1222836 - DNA, 17 bp, Homo sapiens
ctaggaattctttgcat

SEQ ID NO: 1222837 - DNA, 14 bp, Homo sapiens
ctaggacactgaca

SEQ ID NO: 1222838 - DNA, 20 bp, Homo sapiens
ctaggaccactcagccccta

SEQ ID NO: 1222839 - DNA, 12 bp, Homo sapiens
ctaggactcaga

SEQ ID NO: 1222840 - DNA, 14 bp, Homo sapiens
ctaggactctgagg

SEQ ID NO: 1222841 - DNA, 22 bp, Homo sapiens
ctaggactctgaggctctttct

SEQ ID NO: 1222842 - DNA, 12 bp, Homo sapiens
ctaggactgagg

SEQ ID NO: 1222843 - DNA, 13 bp, Homo sapiens
ctaggactgagga

SEQ ID NO: 1222844 - DNA, 23 bp, Homo sapiens
ctaggagaaccaaatctggaagc

SEQ ID NO: 1222845 - DNA, 13 bp, Homo sapiens
ctaggagagccaa

SEQ ID NO: 1222846 - DNA, 23 bp, Homo sapiens
ctaggagatatctgagggaggag

SEQ ID NO: 1222847 - DNA, 19 bp, Homo sapiens
ctaggagctgggaggaaaa

SEQ ID NO: 1222848 - DNA, 15 bp, Homo sapiens
ctaggaggctggcca

SEQ ID NO: 1222849 - DNA, 13 bp, Homo sapiens
ctaggagggagac

SEQ ID NO: 1222850 - DNA, 23 bp, Homo sapiens
ctaggagttgagtacagtgagga

SEQ ID NO: 1222851 - DNA, 22 bp, Homo sapiens
ctaggataaaaagccagggctg

SEQ ID NO: 1222852 - DNA, 17 bp, Homo sapiens
ctaggataacttgcttt

SEQ ID NO: 1222853 - DNA, 14 bp, Homo sapiens
ctaggatatgtata

SEQ ID NO: 1222854 - DNA, 18 bp, Homo sapiens
ctaggatatgtatatttt

SEQ ID NO: 1222855 - DNA, 22 bp, Homo sapiens
ctaggatatgtatattttaata

SEQ ID NO: 1222856 - DNA, 18 bp, Homo sapiens
ctaggatgcggaaatccc

SEQ ID NO: 1222857 - DNA, 16 bp, Homo sapiens
ctaggatgctgcagca

SEQ ID NO: 1222858 - DNA, 13 bp, Homo sapiens
ctaggatttcatg

SEQ ID NO: 1222859 - DNA, 16 bp, Homo sapiens
ctaggcaggacctgtg

SEQ ID NO: 1222860 - DNA, 15 bp, Homo sapiens
ctaggcatcaccccc

SEQ ID NO: 1222861 - DNA, 18 bp, Homo sapiens
ctaggcatcccaggggac

SEQ ID NO: 1222862 - DNA, 18 bp, Homo sapiens
ctaggcatgtcagaggac

SEQ ID NO: 1222863 - DNA, 14 bp, Homo sapiens
ctaggcatttcatt

SEQ ID NO: 1222864 - DNA, 21 bp, Homo sapiens
ctaggcatttgctgaatacag

SEQ ID NO: 1222865 - DNA, 14 bp, Homo sapiens
ctaggccactcctc

SEQ ID NO: 1222866 - DNA, 15 bp, Homo sapiens
ctaggccactcctcc

SEQ ID NO: 1222867 - DNA, 19 bp, Homo sapiens
ctaggccactcctccaaag

SEQ ID NO: 1222868 - DNA, 18 bp, Homo sapiens
ctaggcccaggcctgggt

SEQ ID NO: 1222869 - DNA, 19 bp, Homo sapiens
ctaggcccaggcctgggtt

SEQ ID NO: 1222870 - DNA, 23 bp, Homo sapiens
ctaggcccattgtcctccttttc

SEQ ID NO: 1222871 - DNA, 13 bp, Homo sapiens
ctaggcccccact

SEQ ID NO: 1222872 - DNA, 16 bp, Homo sapiens
ctaggcccccacttgc

SEQ ID NO: 1222873 - DNA, 20 bp, Homo sapiens
ctaggcccccacttgcctct

SEQ ID NO: 1222874 - DNA, 13 bp, Homo sapiens
ctaggccccccag

SEQ ID NO: 1222875 - DNA, 15 bp, Homo sapiens
ctaggcgagtgccag

SEQ ID NO: 1222876 - DNA, 17 bp, Homo sapiens
ctaggcgagtgccagga

SEQ ID NO: 1222877 - DNA, 19 bp, Homo sapiens
ctaggcgagtgccaggact

SEQ ID NO: 1222878 - DNA, 18 bp, Homo sapiens
ctaggctacaattttctc

SEQ ID NO: 1222879 - DNA, 23 bp, Homo sapiens
ctaggctggaagccatggtcccg

SEQ ID NO: 1222880 - DNA, 23 bp, Homo sapiens
ctaggcttcagcatatttatagc

SEQ ID NO: 1222881 - DNA, 17 bp, Homo sapiens
ctaggcttctgtaatca

SEQ ID NO: 1222882 - DNA, 21 bp, Homo sapiens
ctagggaaaaaccagcgtgtg

SEQ ID NO: 1222883 - DNA, 17 bp, Homo sapiens
ctagggaatctggatta

SEQ ID NO: 1222884 - DNA, 19 bp, Homo sapiens
ctagggactgccaggctgt

SEQ ID NO: 1222885 - DNA, 17 bp, Homo sapiens
ctagggagccatttgag

SEQ ID NO: 1222886 - DNA, 17 bp, Homo sapiens
ctagggatataaaaaca

SEQ ID NO: 1222887 - DNA, 18 bp, Homo sapiens
ctagggattcaggctgct

SEQ ID NO: 1222888 - DNA, 14 bp, Homo sapiens
ctagggcagaagac

SEQ ID NO: 1222889 - DNA, 21 bp, Homo sapiens
ctagggcagggtgggagccgg

SEQ ID NO: 1222890 - DNA, 23 bp, Homo sapiens
ctagggcagggtgggagccggga

SEQ ID NO: 1222891 - DNA, 16 bp, Homo sapiens
ctagggccaagcccag

SEQ ID NO: 1222892 - DNA, 17 bp, Homo sapiens
ctagggccaagcccagc

SEQ ID NO: 1222893 - DNA, 21 bp, Homo sapiens
ctagggcgacgtcttcagagt

SEQ ID NO: 1222894 - DNA, 14 bp, Homo sapiens
ctagggctagtctt

SEQ ID NO: 1222895 - DNA, 14 bp, Homo sapiens
ctagggctgctgct

SEQ ID NO: 1222896 - DNA, 16 bp, Homo sapiens
ctagggctgctgcttc

SEQ ID NO: 1222897 - DNA, 19 bp, Homo sapiens
ctagggctgctgcttctgc

SEQ ID NO: 1222898 - DNA, 23 bp, Homo sapiens
ctagggctgctgcttctgctcca

SEQ ID NO: 1222899 - DNA, 14 bp, Homo sapiens
ctaggggatgaggg

SEQ ID NO: 1222900 - DNA, 23 bp, Homo sapiens
ctagggggagccccttctgctca

SEQ ID NO: 1222901 - DNA, 14 bp, Homo sapiens
ctagggggtgtcag

SEQ ID NO: 1222902 - DNA, 19 bp, Homo sapiens
ctagggggtgtcagaagct

SEQ ID NO: 1222903 - DNA, 21 bp, Homo sapiens
ctaggggtcagggaccaagga

SEQ ID NO: 1222904 - DNA, 18 bp, Homo sapiens
ctagggtacatgtccaca

SEQ ID NO: 1222905 - DNA, 15 bp, Homo sapiens
ctaggtaaaatttgt

SEQ ID NO: 1222906 - DNA, 14 bp, Homo sapiens
ctaggtacgatgac

SEQ ID NO: 1222907 - DNA, 19 bp, Homo sapiens
ctaggtacgatgacagtgt

SEQ ID NO: 1222908 - DNA, 23 bp, Homo sapiens
ctaggtaggcaccacagagaaga

SEQ ID NO: 1222909 - DNA, 11 bp, Homo sapiens
ctaggtatcat

SEQ ID NO: 1222910 - DNA, 22 bp, Homo sapiens
ctaggtatcattcaactctcca

SEQ ID NO: 1222911 - DNA, 14 bp, Homo sapiens
ctaggtattgtcta

SEQ ID NO: 1222912 - DNA, 22 bp, Homo sapiens
ctaggtattgtctactctgaag

SEQ ID NO: 1222913 - DNA, 19 bp, Homo sapiens
ctaggtcacgttggccctc

SEQ ID NO: 1222914 - DNA, 15 bp, Homo sapiens
ctaggtcagtctaac

SEQ ID NO: 1222915 - DNA, 16 bp, Homo sapiens
ctaggtcagtctaaca

SEQ ID NO: 1222916 - DNA, 14 bp, Homo sapiens
ctaggtcccttccc

SEQ ID NO: 1222917 - DNA, 22 bp, Homo sapiens
ctaggtcccttcccgacccagc

SEQ ID NO: 1222918 - DNA, 18 bp, Homo sapiens
ctaggtcctctgaggcac

SEQ ID NO: 1222919 - DNA, 12 bp, Homo sapiens
ctaggtctccag

SEQ ID NO: 1222920 - DNA, 16 bp, Homo sapiens
ctaggtctcctcaggg

SEQ ID NO: 1222921 - DNA, 17 bp, Homo sapiens
ctaggtctcctcagggt

SEQ ID NO: 1222922 - DNA, 16 bp, Homo sapiens
ctaggtgacatgtcta

SEQ ID NO: 1222923 - DNA, 21 bp, Homo sapiens
ctaggtgacatgtctactttt

SEQ ID NO: 1222924 - DNA, 13 bp, Homo sapiens
ctaggtgcagctc

SEQ ID NO: 1222925 - DNA, 18 bp, Homo sapiens
ctaggtgcagctcctcag

SEQ ID NO: 1222926 - DNA, 18 bp, Homo sapiens
ctaggtgggccagcccct

SEQ ID NO: 1222927 - DNA, 21 bp, Homo sapiens
ctaggtgggccagcccctccc

SEQ ID NO: 1222928 - DNA, 23 bp, Homo sapiens
ctaggtgggttgaaagccaagga

SEQ ID NO: 1222929 - DNA, 14 bp, Homo sapiens
ctaggtgtggctgt

SEQ ID NO: 1222930 - DNA, 19 bp, Homo sapiens
ctaggtgttgtcagcaggc

SEQ ID NO: 1222931 - DNA, 14 bp, Homo sapiens
ctaggttaaagcta

SEQ ID NO: 1222932 - DNA, 15 bp, Homo sapiens
ctaggttatacaata

SEQ ID NO: 1222933 - DNA, 17 bp, Homo sapiens
ctaggttatacaataac

SEQ ID NO: 1222934 - DNA, 14 bp, Homo sapiens
ctaggttggacagc

SEQ ID NO: 1222935 - DNA, 21 bp, Homo sapiens
ctaggttggacagcccccttc

SEQ ID NO: 1222936 - DNA, 22 bp, Homo sapiens
ctaggttttggagagtttgcct

SEQ ID NO: 1222937 - DNA, 13 bp, Homo sapiens
ctagtaaaacctt

SEQ ID NO: 1222938 - DNA, 18 bp, Homo sapiens
ctagtaaaaccttgttct

SEQ ID NO: 1222939 - DNA, 20 bp, Homo sapiens
ctagtaaaaccttgttctat

SEQ ID NO: 1222940 - DNA, 18 bp, Homo sapiens
ctagtaagcatctacttc

SEQ ID NO: 1222941 - DNA, 14 bp, Homo sapiens
ctagtaattgccta

SEQ ID NO: 1222942 - DNA, 20 bp, Homo sapiens
ctagtacataattgattaaa

SEQ ID NO: 1222943 - DNA, 16 bp, Homo sapiens
ctagtactctctgctc

SEQ ID NO: 1222944 - DNA, 23 bp, Homo sapiens
ctagtactggggagaaataattg

SEQ ID NO: 1222945 - DNA, 11 bp, Homo sapiens
ctagtactgta

SEQ ID NO: 1222946 - DNA, 17 bp, Homo sapiens
ctagtagatttctatga

SEQ ID NO: 1222947 - DNA, 18 bp, Homo sapiens
ctagtagcaatgtgcctt

SEQ ID NO: 1222948 - DNA, 17 bp, Homo sapiens
ctagtagttcctgctac

SEQ ID NO: 1222949 - DNA, 16 bp, Homo sapiens
ctagtatcagaacaaa

SEQ ID NO: 1222950 - DNA, 17 bp, Homo sapiens
ctagtatttttttctta

SEQ ID NO: 1222951 - DNA, 15 bp, Homo sapiens
ctagtcaagctcctc

SEQ ID NO: 1222952 - DNA, 22 bp, Homo sapiens
ctagtcaagctcctcctccctg

SEQ ID NO: 1222953 - DNA, 19 bp, Homo sapiens
ctagtcaccgacagcggcc

SEQ ID NO: 1222954 - DNA, 23 bp, Homo sapiens
ctagtcaccgacagcggccttga

SEQ ID NO: 1222955 - DNA, 17 bp, Homo sapiens
ctagtcacgcatgcagt

SEQ ID NO: 1222956 - DNA, 22 bp, Homo sapiens
ctagtcagtaaagatatttgaa

SEQ ID NO: 1222957 - DNA, 22 bp, Homo sapiens
ctagtccaacattttttcccag

SEQ ID NO: 1222958 - DNA, 17 bp, Homo sapiens
ctagtccccctgttttc

SEQ ID NO: 1222959 - DNA, 21 bp, Homo sapiens
ctagtccccctgttttctgtt

SEQ ID NO: 1222960 - DNA, 14 bp, Homo sapiens
ctagtcccttcccc

SEQ ID NO: 1222961 - DNA, 15 bp, Homo sapiens
ctagtcccttcccct

SEQ ID NO: 1222962 - DNA, 18 bp, Homo sapiens
ctagtcctatggaaaaaa

SEQ ID NO: 1222963 - DNA, 14 bp, Homo sapiens
ctagtcgggcaggg

SEQ ID NO: 1222964 - DNA, 15 bp, Homo sapiens
ctagtctagtttcct

SEQ ID NO: 1222965 - DNA, 19 bp, Homo sapiens
ctagtctcctttgcactga

SEQ ID NO: 1222966 - DNA, 16 bp, Homo sapiens
ctagtctgtcttcctg

SEQ ID NO: 1222967 - DNA, 23 bp, Homo sapiens
ctagtctgtgtaactttaaacat

SEQ ID NO: 1222968 - DNA, 20 bp, Homo sapiens
ctagtcttcccttacctcaa

SEQ ID NO: 1222969 - DNA, 14 bp, Homo sapiens
ctagtcttctggtt

SEQ ID NO: 1222970 - DNA, 16 bp, Homo sapiens
ctagtcttttgctttt

SEQ ID NO: 1222971 - DNA, 16 bp, Homo sapiens
ctagtgacacctcagt

SEQ ID NO: 1222972 - DNA, 23 bp, Homo sapiens
ctagtgacacctcagtcatattt

SEQ ID NO: 1222973 - DNA, 18 bp, Homo sapiens
ctagtgacttcctggtga

SEQ ID NO: 1222974 - DNA, 18 bp, Homo sapiens
ctagtgacttgtgtccca

SEQ ID NO: 1222975 - DNA, 15 bp, Homo sapiens
ctagtgatggtcaga

SEQ ID NO: 1222976 - DNA, 14 bp, Homo sapiens
ctagtgcagctgat

SEQ ID NO: 1222977 - DNA, 20 bp, Homo sapiens
ctagtgcagctgattttaac

SEQ ID NO: 1222978 - DNA, 21 bp, Homo sapiens
ctagtgcagctgattttaaca

SEQ ID NO: 1222979 - DNA, 13 bp, Homo sapiens
ctagtgcatttca

SEQ ID NO: 1222980 - DNA, 23 bp, Homo sapiens
ctagtgcatttcaaggaatggaa

SEQ ID NO: 1222981 - DNA, 17 bp, Homo sapiens
ctagtgcatttggcact

SEQ ID NO: 1222982 - DNA, 17 bp, Homo sapiens
ctagtgccaaataattg

SEQ ID NO: 1222983 - DNA, 22 bp, Homo sapiens
ctagtgccgaatgactatgtcc

SEQ ID NO: 1222984 - DNA, 13 bp, Homo sapiens
ctagtgccttgcc

SEQ ID NO: 1222985 - DNA, 14 bp, Homo sapiens
ctagtgccttgccc

SEQ ID NO: 1222986 - DNA, 15 bp, Homo sapiens
ctagtgccttgccca

SEQ ID NO: 1222987 - DNA, 16 bp, Homo sapiens
ctagtgccttgcccac

SEQ ID NO: 1222988 - DNA, 19 bp, Homo sapiens
ctagtgctattctgtgttg

SEQ ID NO: 1222989 - DNA, 22 bp, Homo sapiens
ctagtgctgtaatattgtaaat

SEQ ID NO: 1222990 - DNA, 14 bp, Homo sapiens
ctagtgctgtgaaa

SEQ ID NO: 1222991 - DNA, 22 bp, Homo sapiens
ctagtgctgtgaaaaaaaaaat

SEQ ID NO: 1222992 - DNA, 15 bp, Homo sapiens
ctagtggatgactgt

SEQ ID NO: 1222993 - DNA, 13 bp, Homo sapiens
ctagtggctgttc

SEQ ID NO: 1222994 - DNA, 15 bp, Homo sapiens
ctagtggcttcaaaa

SEQ ID NO: 1222995 - DNA, 13 bp, Homo sapiens
ctagtgggacagc

SEQ ID NO: 1222996 - DNA, 22 bp, Homo sapiens
ctagtgggacagcccagagcct

SEQ ID NO: 1222997 - DNA, 19 bp, Homo sapiens
ctagtggggtctccctctc

SEQ ID NO: 1222998 - DNA, 17 bp, Homo sapiens
ctagtggtctcacctgg

SEQ ID NO: 1222999 - DNA, 19 bp, Homo sapiens
ctagtgtccataaataaag

SEQ ID NO: 1223000 - DNA, 12 bp, Homo sapiens
ctagtgtcttat

SEQ ID NO: 1223001 - DNA, 19 bp, Homo sapiens
ctagtgtgagtggcagcca

SEQ ID NO: 1223002 - DNA, 21 bp, Homo sapiens
ctagtgtgagtggcagccatg

SEQ ID NO: 1223003 - DNA, 14 bp, Homo sapiens
ctagtgttgcttgg

SEQ ID NO: 1223004 - DNA, 13 bp, Homo sapiens
ctagtgtttctag

SEQ ID NO: 1223005 - DNA, 20 bp, Homo sapiens
ctagttaacctagaagtatt

SEQ ID NO: 1223006 - DNA, 13 bp, Homo sapiens
ctagaagccaagg

SEQ ID NO: 1223007 - DNA, 12 bp, Homo sapiens
ctagaagcccct

SEQ ID NO: 1223008 - DNA, 13 bp, Homo sapiens
ctagaaggccaca

SEQ ID NO: 1223009 - DNA, 22 bp, Homo sapiens
ctagaaggcttctctccacagt

SEQ ID NO: 1223010 - DNA, 19 bp, Homo sapiens
ctagaagtgggccaggaca

SEQ ID NO: 1223011 - DNA, 20 bp, Homo sapiens
ctagaagtgggccaggacag

SEQ ID NO: 1223012 - DNA, 21 bp, Homo sapiens
ctagaagtgggccaggacagg

SEQ ID NO: 1223013 - DNA, 20 bp, Homo sapiens
ctagaagtgtgaagtgcaga

SEQ ID NO: 1223014 - DNA, 16 bp, Homo sapiens
ctagaataatctcatc

SEQ ID NO: 1223015 - DNA, 22 bp, Homo sapiens
ctagaataatctcatcccccca

SEQ ID NO: 1223016 - DNA, 14 bp, Homo sapiens
ctagaatcatactt

SEQ ID NO: 1223017 - DNA, 22 bp, Homo sapiens
ctagaatgtcagatttctggtt

SEQ ID NO: 1223018 - DNA, 22 bp, Homo sapiens
ctagaatgtctgaagtacaaac

SEQ ID NO: 1223019 - DNA, 21 bp, Homo sapiens
ctagaatgtgaatataacttt

SEQ ID NO: 1223020 - DNA, 17 bp, Homo sapiens
ctagaatgtttcatttg

SEQ ID NO: 1223021 - DNA, 18 bp, Homo sapiens
ctagaattagtatgtctg

SEQ ID NO: 1223022 - DNA, 15 bp, Homo sapiens
ctatattgatttaaa

SEQ ID NO: 1223023 - DNA, 19 bp, Homo sapiens
ctatattgatttaaaagtg

SEQ ID NO: 1223024 - DNA, 16 bp, Homo sapiens
ctatatttaacaagat

SEQ ID NO: 1223025 - DNA, 23 bp, Homo sapiens
ctatatttattttcagtatactg

SEQ ID NO: 1223026 - DNA, 14 bp, Homo sapiens
ctatatttcagtga

SEQ ID NO: 1223027 - DNA, 23 bp, Homo sapiens
ctatatttgctagactctagaca

SEQ ID NO: 1223028 - DNA, 20 bp, Homo sapiens
ctatcaaccccagacactgg

SEQ ID NO: 1223029 - DNA, 16 bp, Homo sapiens
ctatcacatgtgaaaa

SEQ ID NO: 1223030 - DNA, 19 bp, Homo sapiens
ctatcacctagcagcctca

SEQ ID NO: 1223031 - DNA, 16 bp, Homo sapiens
ctatcacctatttcca

SEQ ID NO: 1223032 - DNA, 17 bp, Homo sapiens
ctatcacctatttccat

SEQ ID NO: 1223033 - DNA, 15 bp, Homo sapiens
ctatcacctcccctc

SEQ ID NO: 1223034 - DNA, 16 bp, Homo sapiens
ctatcacctcccctcc

SEQ ID NO: 1223035 - DNA, 19 bp, Homo sapiens
ctatcacctcgagaagtaa

SEQ ID NO: 1223036 - DNA, 15 bp, Homo sapiens
ctatcacgagccttt

SEQ ID NO: 1223037 - DNA, 18 bp, Homo sapiens
ctatcagcattgtttcaa

SEQ ID NO: 1223038 - DNA, 17 bp, Homo sapiens
ctatcagttatcctttg

SEQ ID NO: 1223039 - DNA, 16 bp, Homo sapiens
ctatcatctcttaaat

SEQ ID NO: 1223040 - DNA, 14 bp, Homo sapiens
ctatcatggtgaaa

SEQ ID NO: 1223041 - DNA, 13 bp, Homo sapiens
ctatcattccaat

SEQ ID NO: 1223042 - DNA, 13 bp, Homo sapiens
ctatcattctcag

SEQ ID NO: 1223043 - DNA, 15 bp, Homo sapiens
ctatcattctcagtg

SEQ ID NO: 1223044 - DNA, 18 bp, Homo sapiens
ctatccaaagaacttgat

SEQ ID NO: 1223045 - DNA, 20 bp, Homo sapiens
ctatccaaagaacttgattt

SEQ ID NO: 1223046 - DNA, 14 bp, Homo sapiens
ctatccaagtgtta

SEQ ID NO: 1223047 - DNA, 13 bp, Homo sapiens
ctatccacccagc

SEQ ID NO: 1223048 - DNA, 23 bp, Homo sapiens
ctatccagtgacttgttctgagt

SEQ ID NO: 1223049 - DNA, 23 bp, Homo sapiens
ctatcccaatcaaagaattacag

SEQ ID NO: 1223050 - DNA, 13 bp, Homo sapiens
ctatcccacttca

SEQ ID NO: 1223051 - DNA, 15 bp, Homo sapiens
ctatccccaagctgg

SEQ ID NO: 1223052 - DNA, 19 bp, Homo sapiens
ctatccccatctccctgcc

SEQ ID NO: 1223053 - DNA, 21 bp, Homo sapiens
ctatccccatctccctgcctg

SEQ ID NO: 1223054 - DNA, 22 bp, Homo sapiens
ctatccccatctccctgcctgg

SEQ ID NO: 1223055 - DNA, 12 bp, Homo sapiens
ctatccccctta

SEQ ID NO: 1223056 - DNA, 13 bp, Homo sapiens
ctatcccccttaa

SEQ ID NO: 1223057 - DNA, 17 bp, Homo sapiens
ctatcccccttaaagaa

SEQ ID NO: 1223058 - DNA, 19 bp, Homo sapiens
ctatcccccttaaagaaaa

SEQ ID NO: 1223059 - DNA, 15 bp, Homo sapiens
ctatccctgtacaga

SEQ ID NO: 1223060 - DNA, 15 bp, Homo sapiens
ctatccgtgttgcag

SEQ ID NO: 1223061 - DNA, 11 bp, Homo sapiens
ctatcctcccc

SEQ ID NO: 1223062 - DNA, 15 bp, Homo sapiens
ctatcctctcttcct

SEQ ID NO: 1223063 - DNA, 16 bp, Homo sapiens
ctatcctctcttcctc

SEQ ID NO: 1223064 - DNA, 11 bp, Homo sapiens
ctatcctgatt

SEQ ID NO: 1223065 - DNA, 15 bp, Homo sapiens
ctatcctgattccaa

SEQ ID NO: 1223066 - DNA, 16 bp, Homo sapiens
ctatcctgattccaaa

SEQ ID NO: 1223067 - DNA, 17 bp, Homo sapiens
ctatcctgattccaaat

SEQ ID NO: 1223068 - DNA, 17 bp, Homo sapiens
ctatcctgcgggtttta

SEQ ID NO: 1223069 - DNA, 13 bp, Homo sapiens
ctatccttcgtga

SEQ ID NO: 1223070 - DNA, 21 bp, Homo sapiens
ctatccttggagagcagctgg

SEQ ID NO: 1223071 - DNA, 21 bp, Homo sapiens
ctatccttttgcctgcaggtc

SEQ ID NO: 1223072 - DNA, 20 bp, Homo sapiens
ctatcgagtttgcaatgtca

SEQ ID NO: 1223073 - DNA, 19 bp, Homo sapiens
ctatcgtaacctggtgcct

SEQ ID NO: 1223074 - DNA, 12 bp, Homo sapiens
ctatctacaaaa

SEQ ID NO: 1223075 - DNA, 21 bp, Homo sapiens
ctatctactaccagaagggct

SEQ ID NO: 1223076 - DNA, 20 bp, Homo sapiens
ctatctagcagtaaaagata

SEQ ID NO: 1223077 - DNA, 20 bp, Homo sapiens
ctatctaggtggagttgaaa

SEQ ID NO: 1223078 - DNA, 16 bp, Homo sapiens
ctatctattaaagtga

SEQ ID NO: 1223079 - DNA, 18 bp, Homo sapiens
ctatctcaatcctaattt

SEQ ID NO: 1223080 - DNA, 14 bp, Homo sapiens
ctatctcagccata

SEQ ID NO: 1223081 - DNA, 21 bp, Homo sapiens
ctatctcatctatctcaatcc

SEQ ID NO: 1223082 - DNA, 18 bp, Homo sapiens
ctatctgcactctaaact

SEQ ID NO: 1223083 - DNA, 21 bp, Homo sapiens
ctatctgcactctaaactgca

SEQ ID NO: 1223084 - DNA, 16 bp, Homo sapiens
ctatctgggaagctat

SEQ ID NO: 1223085 - DNA, 18 bp, Homo sapiens
ctatctggggagctcctg

SEQ ID NO: 1223086 - DNA, 22 bp, Homo sapiens
ctatctggggagctcctggcca

SEQ ID NO: 1223087 - DNA, 17 bp, Homo sapiens
ctatctggtattaaatg

SEQ ID NO: 1223088 - DNA, 16 bp, Homo sapiens
ctatctggtgatttct

SEQ ID NO: 1223089 - DNA, 21 bp, Homo sapiens
ctatctgtcatctctctgggg

SEQ ID NO: 1223090 - DNA, 14 bp, Homo sapiens
ctatctgtctggtg

SEQ ID NO: 1223091 - DNA, 18 bp, Homo sapiens
ctatctgtctggtggccc

SEQ ID NO: 1223092 - DNA, 14 bp, Homo sapiens
ctatctgtgattcc

SEQ ID NO: 1223093 - DNA, 14 bp, Homo sapiens
ctatctgtgttttg

SEQ ID NO: 1223094 - DNA, 15 bp, Homo sapiens
ctatctgttgaaaag

SEQ ID NO: 1223095 - DNA, 18 bp, Homo sapiens
ctatcttactatttcaca

SEQ ID NO: 1223096 - DNA, 14 bp, Homo sapiens
ctatcttccaaatg

SEQ ID NO: 1223097 - DNA, 19 bp, Homo sapiens
ctatcttttgtttcctttt

SEQ ID NO: 1223098 - DNA, 21 bp, Homo sapiens
ctatgaaaagctagaattgag

SEQ ID NO: 1223099 - DNA, 22 bp, Homo sapiens
ctatgaaaatgagccctggctc

SEQ ID NO: 1223100 - DNA, 17 bp, Homo sapiens
ctatgaaataatgtgaa

SEQ ID NO: 1223101 - DNA, 13 bp, Homo sapiens
ctatgaacactgt

SEQ ID NO: 1223102 - DNA, 13 bp, Homo sapiens
ctatgaactacaa

SEQ ID NO: 1223103 - DNA, 20 bp, Homo sapiens
ctatgaagttgctgtttatt

SEQ ID NO: 1223104 - DNA, 17 bp, Homo sapiens
ctatgaattctaagtga

SEQ ID NO: 1223105 - DNA, 15 bp, Homo sapiens
ctatgacaaattcaa

SEQ ID NO: 1223106 - DNA, 15 bp, Homo sapiens
ctatgacagctggct

SEQ ID NO: 1223107 - DNA, 15 bp, Homo sapiens
ctatgactgctcccc

SEQ ID NO: 1223108 - DNA, 17 bp, Homo sapiens
ctatgactgctccccag

SEQ ID NO: 1223109 - DNA, 16 bp, Homo sapiens
ctatgagaaaagaggc

SEQ ID NO: 1223110 - DNA, 18 bp, Homo sapiens
ctatgagatggccatgct

SEQ ID NO: 1223111 - DNA, 19 bp, Homo sapiens
ctatgagatggccatgctc

SEQ ID NO: 1223112 - DNA, 22 bp, Homo sapiens
ctatgagcatcctgagccccgc

SEQ ID NO: 1223113 - DNA, 13 bp, Homo sapiens
ctatgaggaaagg

SEQ ID NO: 1223114 - DNA, 22 bp, Homo sapiens
ctatgaggaataattatttatt

SEQ ID NO: 1223115 - DNA, 23 bp, Homo sapiens
ctatgaggaataattatttattt

SEQ ID NO: 1223116 - DNA, 13 bp, Homo sapiens
ctatgataaagtt

SEQ ID NO: 1223117 - DNA, 14 bp, Homo sapiens
ctatgataaagttg

SEQ ID NO: 1223118 - DNA, 19 bp, Homo sapiens
ctatgataaagttgtaaat

SEQ ID NO: 1223119 - DNA, 20 bp, Homo sapiens
ctatgatatggtaaaagtta

SEQ ID NO: 1223120 - DNA, 16 bp, Homo sapiens
ctatgatcacagtgac

SEQ ID NO: 1223121 - DNA, 18 bp, Homo sapiens
ctatgatgagaggccagc

SEQ ID NO: 1223122 - DNA, 19 bp, Homo sapiens
ctatgatgagaggccagca

SEQ ID NO: 1223123 - DNA, 20 bp, Homo sapiens
ctatgatgagaggccagcac

SEQ ID NO: 1223124 - DNA, 16 bp, Homo sapiens
ctatgatggaagtgtt

SEQ ID NO: 1223125 - DNA, 17 bp, Homo sapiens
ctatgatggatggcaga

SEQ ID NO: 1223126 - DNA, 22 bp, Homo sapiens
ctatgatggatggcagactctt

SEQ ID NO: 1223127 - DNA, 20 bp, Homo sapiens
ctatgatttaatttgaaata

SEQ ID NO: 1223128 - DNA, 18 bp, Homo sapiens
ctatgatttttttttcca

SEQ ID NO: 1223129 - DNA, 22 bp, Homo sapiens
ctatgcaaagcactctctgcag

SEQ ID NO: 1223130 - DNA, 20 bp, Homo sapiens
ctatgcagaggtccacaaca

SEQ ID NO: 1223131 - DNA, 14 bp, Homo sapiens
ctatgcagggaggc

SEQ ID NO: 1223132 - DNA, 16 bp, Homo sapiens
ctatgcattttcttca

SEQ ID NO: 1223133 - DNA, 18 bp, Homo sapiens
ctatgcattttcttcaca

SEQ ID NO: 1223134 - DNA, 19 bp, Homo sapiens
ctatgccagctcagtccca

SEQ ID NO: 1223135 - DNA, 21 bp, Homo sapiens
ctatgccatttcttctctctg

SEQ ID NO: 1223136 - DNA, 16 bp, Homo sapiens
ctatgcccacataccc

SEQ ID NO: 1223137 - DNA, 16 bp, Homo sapiens
ctatgccctgcagagc

SEQ ID NO: 1223138 - DNA, 19 bp, Homo sapiens
ctatgccctgcagagcaat

SEQ ID NO: 1223139 - DNA, 21 bp, Homo sapiens
ctatgccctgcagagcaataa

SEQ ID NO: 1223140 - DNA, 15 bp, Homo sapiens
ctatgccctgccctt

SEQ ID NO: 1223141 - DNA, 19 bp, Homo sapiens
ctatgcctgcactgggaag

SEQ ID NO: 1223142 - DNA, 16 bp, Homo sapiens
ctatgcctgtggtgaa

SEQ ID NO: 1223143 - DNA, 19 bp, Homo sapiens
ctatgccttgcacacaggt

SEQ ID NO: 1223144 - DNA, 21 bp, Homo sapiens
ctatgctaaacctcctgcctc

SEQ ID NO: 1223145 - DNA, 21 bp, Homo sapiens
ctatgctattgacaataaaat

SEQ ID NO: 1223146 - DNA, 18 bp, Homo sapiens
ctatgcttaataaaagaa

SEQ ID NO: 1223147 - DNA, 19 bp, Homo sapiens
ctatgcttaataaaagaac

SEQ ID NO: 1223148 - DNA, 22 bp, Homo sapiens
ctatgcttaataaaagaacatg

SEQ ID NO: 1223149 - DNA, 15 bp, Homo sapiens
ctatggaaacatttt

SEQ ID NO: 1223150 - DNA, 23 bp, Homo sapiens
ctatggaaacattttatactgta

SEQ ID NO: 1223151 - DNA, 15 bp, Homo sapiens
ctatggaaatgtgag

SEQ ID NO: 1223152 - DNA, 15 bp, Homo sapiens
ctatggacacagggt

SEQ ID NO: 1223153 - DNA, 17 bp, Homo sapiens
ctatggagactttgctg

SEQ ID NO: 1223154 - DNA, 18 bp, Homo sapiens
ctatggagactttgctgt

SEQ ID NO: 1223155 - DNA, 19 bp, Homo sapiens
ctatggagactttgctgtt

SEQ ID NO: 1223156 - DNA, 23 bp, Homo sapiens
ctatggagactttgctgttactg

SEQ ID NO: 1223157 - DNA, 19 bp, Homo sapiens
ctatggagggtcctcctcc

SEQ ID NO: 1223158 - DNA, 19 bp, Homo sapiens
ctatggagtgcaccaaaga

SEQ ID NO: 1223159 - DNA, 15 bp, Homo sapiens
ctatggatggcttct

SEQ ID NO: 1223160 - DNA, 18 bp, Homo sapiens
ctatggccctgcaaaaat

SEQ ID NO: 1223161 - DNA, 21 bp, Homo sapiens
ctatggcttatttctatgaca

SEQ ID NO: 1223162 - DNA, 22 bp, Homo sapiens
ctatggctttaaataaattaag

SEQ ID NO: 1223163 - DNA, 15 bp, Homo sapiens
ctatggggaggccct

SEQ ID NO: 1223164 - DNA, 16 bp, Homo sapiens
ctatggggaggccctg

SEQ ID NO: 1223165 - DNA, 18 bp, Homo sapiens
ctatggggaggccctgcc

SEQ ID NO: 1223166 - DNA, 18 bp, Homo sapiens
ctatggggatggtccact

SEQ ID NO: 1223167 - DNA, 19 bp, Homo sapiens
ctatgggggcactgaggac

SEQ ID NO: 1223168 - DNA, 22 bp, Homo sapiens
ctatgggttatttttattaaat

SEQ ID NO: 1223169 - DNA, 19 bp, Homo sapiens
ctatggtatgctggccagc

SEQ ID NO: 1223170 - DNA, 20 bp, Homo sapiens
ctatggtatgctggccagca

SEQ ID NO: 1223171 - DNA, 22 bp, Homo sapiens
ctatggtatgctggccagcacc

SEQ ID NO: 1223172 - DNA, 21 bp, Homo sapiens
ctatggtcgggagacagcatc

SEQ ID NO: 1223173 - DNA, 14 bp, Homo sapiens
ctatggtgaggtgt

SEQ ID NO: 1223174 - DNA, 15 bp, Homo sapiens
ctatggtgaggtgtg

SEQ ID NO: 1223175 - DNA, 15 bp, Homo sapiens
ctatggttgccaccc

SEQ ID NO: 1223176 - DNA, 11 bp, Homo sapiens
ctatgtaaatt

SEQ ID NO: 1223177 - DNA, 18 bp, Homo sapiens
ctatgtaacaaacctgca

SEQ ID NO: 1223178 - DNA, 15 bp, Homo sapiens
ctatgtaagggtctt

SEQ ID NO: 1223179 - DNA, 22 bp, Homo sapiens
ctatgtagctgaaaataaaatg

SEQ ID NO: 1223180 - DNA, 13 bp, Homo sapiens
ctatgtatcaatg

SEQ ID NO: 1223181 - DNA, 13 bp, Homo sapiens
ctatgtatttgca

SEQ ID NO: 1223182 - DNA, 22 bp, Homo sapiens
ctatgtatttgcagttcacctg

SEQ ID NO: 1223183 - DNA, 18 bp, Homo sapiens
ctatgtattttcctaatg

SEQ ID NO: 1223184 - DNA, 13 bp, Homo sapiens
ctatgtcattttt

SEQ ID NO: 1223185 - DNA, 18 bp, Homo sapiens
ctatgtcatttttaatgt

SEQ ID NO: 1223186 - DNA, 20 bp, Homo sapiens
ctatgtcatttttaatgtat

SEQ ID NO: 1223187 - DNA, 14 bp, Homo sapiens
ctatgtcccaagag

SEQ ID NO: 1223188 - DNA, 19 bp, Homo sapiens
ctatgtcccaagagccata

SEQ ID NO: 1223189 - DNA, 20 bp, Homo sapiens
ctatgtcctaaggacacact

SEQ ID NO: 1223190 - DNA, 23 bp, Homo sapiens
ctatgtcctaaggacacactaat

SEQ ID NO: 1223191 - DNA, 16 bp, Homo sapiens
ctatgtcctaataata

SEQ ID NO: 1223192 - DNA, 16 bp, Homo sapiens
ctatgtcgagagctgg

SEQ ID NO: 1223193 - DNA, 13 bp, Homo sapiens
ctatgtcttgttt

SEQ ID NO: 1223194 - DNA, 18 bp, Homo sapiens
ctatgtgccagttcctgt

SEQ ID NO: 1223195 - DNA, 19 bp, Homo sapiens
ctatgtgccagttcctgta

SEQ ID NO: 1223196 - DNA, 15 bp, Homo sapiens
ctatgtgtatgcaag

SEQ ID NO: 1223197 - DNA, 22 bp, Homo sapiens
ctatgtgtttctgtaacaaatt

SEQ ID NO: 1223198 - DNA, 17 bp, Homo sapiens
ctatgtgtttttctcat

SEQ ID NO: 1223199 - DNA, 23 bp, Homo sapiens
ctatgttaaatactgtgcagaat

SEQ ID NO: 1223200 - DNA, 13 bp, Homo sapiens
ctatgttgcccaa

SEQ ID NO: 1223201 - DNA, 18 bp, Homo sapiens
ctatgttgcccaagctgg

SEQ ID NO: 1223202 - DNA, 16 bp, Homo sapiens
ctatgtttattctagt

SEQ ID NO: 1223203 - DNA, 13 bp, Homo sapiens
ctatgtttgtatt

SEQ ID NO: 1223204 - DNA, 23 bp, Homo sapiens
ctatgtttgtatttggaatattt

SEQ ID NO: 1223205 - DNA, 17 bp, Homo sapiens
ctatgtttgtgtgattt

SEQ ID NO: 1223206 - DNA, 23 bp, Homo sapiens
ctattaaaaaagtctacaacata

SEQ ID NO: 1223207 - DNA, 18 bp, Homo sapiens
ctattaaaatattttgga

SEQ ID NO: 1223208 - DNA, 17 bp, Homo sapiens
ctattaaagtgactttc

SEQ ID NO: 1223209 - DNA, 19 bp, Homo sapiens
ctattaacaattaattgtc

SEQ ID NO: 1223210 - DNA, 16 bp, Homo sapiens
ctattaaccttttttg

SEQ ID NO: 1223211 - DNA, 16 bp, Homo sapiens
ctattaagatttccaa

SEQ ID NO: 1223212 - DNA, 17 bp, Homo sapiens
ctattaagatttccaag

SEQ ID NO: 1223213 - DNA, 20 bp, Homo sapiens
ctattaagcagtaaaaactg

SEQ ID NO: 1223214 - DNA, 21 bp, Homo sapiens
ctattaagcagtaaaaactgt

SEQ ID NO: 1223215 - DNA, 18 bp, Homo sapiens
ctattaatcaagagaaac

SEQ ID NO: 1223216 - DNA, 20 bp, Homo sapiens
ctattacttttctgtttagt

SEQ ID NO: 1223217 - DNA, 18 bp, Homo sapiens
ctattagactttagaaat

SEQ ID NO: 1223218 - DNA, 15 bp, Homo sapiens
ctattagagaagaga

SEQ ID NO: 1223219 - DNA, 18 bp, Homo sapiens
ctattagagtatttccct

SEQ ID NO: 1223220 - DNA, 17 bp, Homo sapiens
ctattagcggctcctcg

SEQ ID NO: 1223221 - DNA, 17 bp, Homo sapiens
ctattataatttaatgc

SEQ ID NO: 1223222 - DNA, 16 bp, Homo sapiens
ctattatggaaaactg

SEQ ID NO: 1223223 - DNA, 22 bp, Homo sapiens
ctattatttattgtattaggaa

SEQ ID NO: 1223224 - DNA, 13 bp, Homo sapiens
ctattatttggag

SEQ ID NO: 1223225 - DNA, 22 bp, Homo sapiens
ctattcaagaggaaatgtcaca

SEQ ID NO: 1223226 - DNA, 22 bp, Homo sapiens
ctattcaaggtggccaaattat

SEQ ID NO: 1223227 - DNA, 22 bp, Homo sapiens
ctattcaataaatcgtgctggg

SEQ ID NO: 1223228 - DNA, 11 bp, Homo sapiens
ctattcacaac

SEQ ID NO: 1223229 - DNA, 16 bp, Homo sapiens
ctattcacaattattc

SEQ ID NO: 1223230 - DNA, 15 bp, Homo sapiens
ctattcaccctccac

SEQ ID NO: 1223231 - DNA, 19 bp, Homo sapiens
ctattcaccctccacttcc

SEQ ID NO: 1223232 - DNA, 13 bp, Homo sapiens
ctattcagacaag

SEQ ID NO: 1223233 - DNA, 14 bp, Homo sapiens
ctattcagacaagc

SEQ ID NO: 1223234 - DNA, 23 bp, Homo sapiens
ctattcagtaataactctaccct

SEQ ID NO: 1223235 - DNA, 19 bp, Homo sapiens
ctattcagtggcgagaaat

SEQ ID NO: 1223236 - DNA, 15 bp, Homo sapiens
ctattccaaaaaggt

SEQ ID NO: 1223237 - DNA, 12 bp, Homo sapiens
ctattccaggaa

SEQ ID NO: 1223238 - DNA, 20 bp, Homo sapiens
ctattgtaaggtctttgtaa

SEQ ID NO: 1223239 - DNA, 19 bp, Homo sapiens
ctattgtaatcgtgtgcca

SEQ ID NO: 1223240 - DNA, 16 bp, Homo sapiens
ctattgtagcatttct

SEQ ID NO: 1223241 - DNA, 20 bp, Homo sapiens
ctattgtgtggatgaccaca

SEQ ID NO: 1223242 - DNA, 22 bp, Homo sapiens
ctattgtttattctttttaaag

SEQ ID NO: 1223243 - DNA, 15 bp, Homo sapiens
ctattgtttgtaaaa

SEQ ID NO: 1223244 - DNA, 17 bp, Homo sapiens
ctatttaaaacttgtaa

SEQ ID NO: 1223245 - DNA, 14 bp, Homo sapiens
ctatttaaaataaa

SEQ ID NO: 1223246 - DNA, 22 bp, Homo sapiens
ctatttaatatctggcactgtt

SEQ ID NO: 1223247 - DNA, 12 bp, Homo sapiens
ctatttaatgga

SEQ ID NO: 1223248 - DNA, 12 bp, Homo sapiens
ctatttaatttt

SEQ ID NO: 1223249 - DNA, 17 bp, Homo sapiens
ctatttactttattaac

SEQ ID NO: 1223250 - DNA, 20 bp, Homo sapiens
ctatttactttattaactta

SEQ ID NO: 1223251 - DNA, 23 bp, Homo sapiens
ctatttagtttttgtaatttatt

SEQ ID NO: 1223252 - DNA, 21 bp, Homo sapiens
ctatttataatacagaatctt

SEQ ID NO: 1223253 - DNA, 18 bp, Homo sapiens
ctatttatccctttcctg

SEQ ID NO: 1223254 - DNA, 19 bp, Homo sapiens
ctatttatccctttcctgg

SEQ ID NO: 1223255 - DNA, 23 bp, Homo sapiens
ctatttatccctttcctggtttc

SEQ ID NO: 1223256 - DNA, 21 bp, Homo sapiens
ctatttatctgtagtaaacta

SEQ ID NO: 1223257 - DNA, 19 bp, Homo sapiens
ctatttatctgtgtttttg

SEQ ID NO: 1223258 - DNA, 13 bp, Homo sapiens
ctatttattaata

SEQ ID NO: 1223259 - DNA, 15 bp, Homo sapiens
ctatttattgacttt

SEQ ID NO: 1223260 - DNA, 17 bp, Homo sapiens
ctatttattgtgctggg

SEQ ID NO: 1223261 - DNA, 17 bp, Homo sapiens
ctatttattttcctaaa

SEQ ID NO: 1223262 - DNA, 18 bp, Homo sapiens
ctatttattttcctaaag

SEQ ID NO: 1223263 - DNA, 19 bp, Homo sapiens
ctatttattttcctaaaga

SEQ ID NO: 1223264 - DNA, 15 bp, Homo sapiens
ctatttcaaaatgtc

SEQ ID NO: 1223265 - DNA, 13 bp, Homo sapiens
ctatttcaataac

SEQ ID NO: 1223266 - DNA, 19 bp, Homo sapiens
ctatttcagtgttacctgt

SEQ ID NO: 1223267 - DNA, 15 bp, Homo sapiens
ctatttcatgttttt

SEQ ID NO: 1223268 - DNA, 18 bp, Homo sapiens
ctatttccactgaacaaa

SEQ ID NO: 1223269 - DNA, 22 bp, Homo sapiens
ctatttccccaggggaaaatga

SEQ ID NO: 1223270 - DNA, 19 bp, Homo sapiens
ctatttcccctcttctgct

SEQ ID NO: 1223271 - DNA, 21 bp, Homo sapiens
ctatttccctctactgagtaa

SEQ ID NO: 1223272 - DNA, 18 bp, Homo sapiens
ctatttctatgtcatttt

SEQ ID NO: 1223273 - DNA, 12 bp, Homo sapiens
ctatttctattc

SEQ ID NO: 1223274 - DNA, 17 bp, Homo sapiens
ctatttctattccttat

SEQ ID NO: 1223275 - DNA, 16 bp, Homo sapiens
ctatttctctccccac

SEQ ID NO: 1223276 - DNA, 23 bp, Homo sapiens
ctatttctgagaaggtccttaat

SEQ ID NO: 1223277 - DNA, 14 bp, Homo sapiens
ctatttcttgaaga

SEQ ID NO: 1223278 - DNA, 16 bp, Homo sapiens
ctatttcttgaagaat

SEQ ID NO: 1223279 - DNA, 13 bp, Homo sapiens
ctatttgaagaaa

SEQ ID NO: 1223280 - DNA, 23 bp, Homo sapiens
ctatttgaagaaaaaaatgtaca

SEQ ID NO: 1223281 - DNA, 20 bp, Homo sapiens
ctatttgagcatgcacagct

SEQ ID NO: 1223282 - DNA, 18 bp, Homo sapiens
ctatttgtaaatctgcca

SEQ ID NO: 1223283 - DNA, 21 bp, Homo sapiens
ctatttgtaaatctgccacaa

SEQ ID NO: 1223284 - DNA, 14 bp, Homo sapiens
ctatttgtacaatt

SEQ ID NO: 1223285 - DNA, 23 bp, Homo sapiens
ctatttgtatttctcttgtcctt

SEQ ID NO: 1223286 - DNA, 17 bp, Homo sapiens
ctatttgtctttcagga

SEQ ID NO: 1223287 - DNA, 14 bp, Homo sapiens
ctattttaaaataa

SEQ ID NO: 1223288 - DNA, 22 bp, Homo sapiens
ctattttaatgtatatttgctg

SEQ ID NO: 1223289 - DNA, 15 bp, Homo sapiens
ctattttagaataaa

SEQ ID NO: 1223290 - DNA, 19 bp, Homo sapiens
ctattttagatatctagac

SEQ ID NO: 1223291 - DNA, 16 bp, Homo sapiens
ctattttatttgtatt

SEQ ID NO: 1223292 - DNA, 13 bp, Homo sapiens
ctattttcaaaga

SEQ ID NO: 1223293 - DNA, 12 bp, Homo sapiens
ctattttcataa

SEQ ID NO: 1223294 - DNA, 15 bp, Homo sapiens
ctattttcatttgta

SEQ ID NO: 1223295 - DNA, 12 bp, Homo sapiens
ctattttcctct

SEQ ID NO: 1223296 - DNA, 19 bp, Homo sapiens
ctattttgacagttatttt

SEQ ID NO: 1223297 - DNA, 12 bp, Homo sapiens
ctattttgtaaa

SEQ ID NO: 1223298 - DNA, 17 bp, Homo sapiens
ctatttttaaataattt

SEQ ID NO: 1223299 - DNA, 19 bp, Homo sapiens
ctatttttaatgtttgtac

SEQ ID NO: 1223300 - DNA, 12 bp, Homo sapiens
ctatttttatca

SEQ ID NO: 1223301 - DNA, 19 bp, Homo sapiens
ctatttttatcatgaattc

SEQ ID NO: 1223302 - DNA, 16 bp, Homo sapiens
ctatttttatttatat

SEQ ID NO: 1223303 - DNA, 21 bp, Homo sapiens
ctatttttgactgtagccaca

SEQ ID NO: 1223304 - DNA, 17 bp, Homo sapiens
ctatttttgattgtgtt

SEQ ID NO: 1223305 - DNA, 18 bp, Homo sapiens
ctatttttggcagtctga

SEQ ID NO: 1223306 - DNA, 21 bp, Homo sapiens
ctatttttggcagtctgaatt

SEQ ID NO: 1223307 - DNA, 14 bp, Homo sapiens
ctattttttaagaa

SEQ ID NO: 1223308 - DNA, 20 bp, Homo sapiens
ctattttttattttactttt

SEQ ID NO: 1223309 - DNA, 17 bp, Homo sapiens
ctatttttttaactgaa

SEQ ID NO: 1223310 - DNA, 20 bp, Homo sapiens
ctatttttttaactgaaaat

SEQ ID NO: 1223311 - DNA, 23 bp, Homo sapiens
ctatttttttaagctatcagcaa

SEQ ID NO: 1223312 - DNA, 13 bp, Homo sapiens
ctatttttttaga

SEQ ID NO: 1223313 - DNA, 23 bp, Homo sapiens
ctatttttttcttaaagcaaact

SEQ ID NO: 1223314 - DNA, 23 bp, Homo sapiens
ctatttttttttctttttaaagt

SEQ ID NO: 1223315 - DNA, 20 bp, Homo sapiens
ctcaaaacacttccagtctg

SEQ ID NO: 1223316 - DNA, 20 bp, Homo sapiens
ctcaaaacttaacatattta

SEQ ID NO: 1223317 - DNA, 18 bp, Homo sapiens
ctcaaaagctgggcaggt

SEQ ID NO: 1223318 - DNA, 14 bp, Homo sapiens
ctcaaaaggaaacc

SEQ ID NO: 1223319 - DNA, 18 bp, Homo sapiens
ctcaaaaggaaaccaagt

SEQ ID NO: 1223320 - DNA, 23 bp, Homo sapiens
ctcaaaaggaaaccaagtggtca

SEQ ID NO: 1223321 - DNA, 15 bp, Homo sapiens
ctcaaaatgacagtt

SEQ ID NO: 1223322 - DNA, 17 bp, Homo sapiens
ctcaaaatgacagtttc

SEQ ID NO: 1223323 - DNA, 20 bp, Homo sapiens
ctcaaactaaattcaaagaa

SEQ ID NO: 1223324 - DNA, 13 bp, Homo sapiens
ctcaaactgcaca

SEQ ID NO: 1223325 - DNA, 16 bp, Homo sapiens
ctcaaacttgtggcct

SEQ ID NO: 1223326 - DNA, 23 bp, Homo sapiens
ctcaaagaaatctactatatccc

SEQ ID NO: 1223327 - DNA, 23 bp, Homo sapiens
ctcacgcttacctcaaccatcct

SEQ ID NO: 1223328 - DNA, 22 bp, Homo sapiens
ctcacggaccactcgaggcctg

SEQ ID NO: 1223329 - DNA, 19 bp, Homo sapiens
ctcacgggcagtagctgtg

SEQ ID NO: 1223330 - DNA, 17 bp, Homo sapiens
ctcacgggccctgcccc

SEQ ID NO: 1223331 - DNA, 21 bp, Homo sapiens
ctcacggggttggctgttcca

SEQ ID NO: 1223332 - DNA, 14 bp, Homo sapiens
ctcacgtcaaatgc

SEQ ID NO: 1223333 - DNA, 20 bp, Homo sapiens
ctcacgtgcaggacagctct

SEQ ID NO: 1223334 - DNA, 21 bp, Homo sapiens
ctcacgtgtcagaagcctcca

SEQ ID NO: 1223335 - DNA, 16 bp, Homo sapiens
ctcacgtttcttcccc

SEQ ID NO: 1223336 - DNA, 11 bp, Homo sapiens
ctcactactga

SEQ ID NO: 1223337 - DNA, 22 bp, Homo sapiens
ctcactaggcccccacttgcct

SEQ ID NO: 1223338 - DNA, 14 bp, Homo sapiens
ctcactagtgccaa

SEQ ID NO: 1223339 - DNA, 21 bp, Homo sapiens
ctcactatggtatgctggcca

SEQ ID NO: 1223340 - DNA, 19 bp, Homo sapiens
ctcactattcttggaccat

SEQ ID NO: 1223341 - DNA, 22 bp, Homo sapiens
ctcactattcttggaccatgcc

SEQ ID NO: 1223342 - DNA, 16 bp, Homo sapiens
ctcactcactcattcc

SEQ ID NO: 1223343 - DNA, 15 bp, Homo sapiens
ctcactcactccaag

SEQ ID NO: 1223344 - DNA, 12 bp, Homo sapiens
ctcactcagcca

SEQ ID NO: 1223345 - DNA, 16 bp, Homo sapiens
ctcactccaagaccac

SEQ ID NO: 1223346 - DNA, 20 bp, Homo sapiens
ctcactccaagaccaccagg

SEQ ID NO: 1223347 - DNA, 22 bp, Homo sapiens
ctcactccaagaccaccagggt

SEQ ID NO: 1223348 - DNA, 23 bp, Homo sapiens
ctcactccaagaccaccagggtc

SEQ ID NO: 1223349 - DNA, 18 bp, Homo sapiens
ctcactccacagagtgag

SEQ ID NO: 1223350 - DNA, 12 bp, Homo sapiens
ctcactccacca

SEQ ID NO: 1223351 - DNA, 13 bp, Homo sapiens
ctcactccagcca

SEQ ID NO: 1223352 - DNA, 20 bp, Homo sapiens
ctcactcccaagggacagca

SEQ ID NO: 1223353 - DNA, 13 bp, Homo sapiens
ctcactccccact

SEQ ID NO: 1223354 - DNA, 16 bp, Homo sapiens
ctcactccccactccc

SEQ ID NO: 1223355 - DNA, 14 bp, Homo sapiens
ctcactccccaggg

SEQ ID NO: 1223356 - DNA, 19 bp, Homo sapiens
ctcactccccatgccacgt

SEQ ID NO: 1223357 - DNA, 13 bp, Homo sapiens
ctcactcctacct

SEQ ID NO: 1223358 - DNA, 15 bp, Homo sapiens
ctcactcctacctgg

SEQ ID NO: 1223359 - DNA, 23 bp, Homo sapiens
ctcactcctgaattcagttgctt

SEQ ID NO: 1223360 - DNA, 12 bp, Homo sapiens
ctcactcctgtt

SEQ ID NO: 1223361 - DNA, 15 bp, Homo sapiens
ctcactccttttaaa

SEQ ID NO: 1223362 - DNA, 18 bp, Homo sapiens
ctcactccttttaaagaa

SEQ ID NO: 1223363 - DNA, 11 bp, Homo sapiens
ctcactctggg

SEQ ID NO: 1223364 - DNA, 11 bp, Homo sapiens
ctcactctgtc

SEQ ID NO: 1223365 - DNA, 14 bp, Homo sapiens
ctcactctgtcagc

SEQ ID NO: 1223366 - DNA, 19 bp, Homo sapiens
ctcactctgtcagccagcc

SEQ ID NO: 1223367 - DNA, 21 bp, Homo sapiens
ctcactctgtcgctcaggctg

SEQ ID NO: 1223368 - DNA, 19 bp, Homo sapiens
ctcactcttcctcatcctg

SEQ ID NO: 1223369 - DNA, 23 bp, Homo sapiens
ctcactgaaacatggctgtgttt

SEQ ID NO: 1223370 - DNA, 14 bp, Homo sapiens
ctcactgaaaggca

SEQ ID NO: 1223371 - DNA, 13 bp, Homo sapiens
ctcactgaactcc

SEQ ID NO: 1223372 - DNA, 16 bp, Homo sapiens
ctcactgaagcctgcg

SEQ ID NO: 1223373 - DNA, 23 bp, Homo sapiens
ctcactgaagcctgcgttggtcc

SEQ ID NO: 1223374 - DNA, 13 bp, Homo sapiens
ctcactgaggcca

SEQ ID NO: 1223375 - DNA, 19 bp, Homo sapiens
ctcactgaggccatcaggg

SEQ ID NO: 1223376 - DNA, 15 bp, Homo sapiens
ctcactgattctcta

SEQ ID NO: 1223377 - DNA, 21 bp, Homo sapiens
ctcactgcaaccttcacctcc

SEQ ID NO: 1223378 - DNA, 15 bp, Homo sapiens
ctcactgcagcctca

SEQ ID NO: 1223379 - DNA, 16 bp, Homo sapiens
ctcactgcagcctcaa

SEQ ID NO: 1223380 - DNA, 18 bp, Homo sapiens
ctcactgcagtcttattt

SEQ ID NO: 1223381 - DNA, 15 bp, Homo sapiens
ctcactgccaggcca

SEQ ID NO: 1223382 - DNA, 19 bp, Homo sapiens
ctcactgccaggccagcct

SEQ ID NO: 1223383 - DNA, 21 bp, Homo sapiens
ctcactgccaggccagcctcc

SEQ ID NO: 1223384 - DNA, 19 bp, Homo sapiens
ctcactgcctaggaggctg

SEQ ID NO: 1223385 - DNA, 21 bp, Homo sapiens
ctcactgcctggtaaaattaa

SEQ ID NO: 1223386 - DNA, 12 bp, Homo sapiens
ctcactgctcaa

SEQ ID NO: 1223387 - DNA, 14 bp, Homo sapiens
ctcactgctcaaga

SEQ ID NO: 1223388 - DNA, 19 bp, Homo sapiens
ctcactgctggggagtccc

SEQ ID NO: 1223389 - DNA, 20 bp, Homo sapiens
ctcactggaggagcagcttc

SEQ ID NO: 1223390 - DNA, 22 bp, Homo sapiens
ctcactggaggagcagcttcct

SEQ ID NO: 1223391 - DNA, 15 bp, Homo sapiens
ctcactggctctcct

SEQ ID NO: 1223392 - DNA, 12 bp, Homo sapiens
ctcactggctgg

SEQ ID NO: 1223393 - DNA, 15 bp, Homo sapiens
ctcactggctgggag

SEQ ID NO: 1223394 - DNA, 15 bp, Homo sapiens
ctcactggctggggc

SEQ ID NO: 1223395 - DNA, 17 bp, Homo sapiens
ctcactggctggggcag

SEQ ID NO: 1223396 - DNA, 13 bp, Homo sapiens
ctcactggggcct

SEQ ID NO: 1223397 - DNA, 16 bp, Homo sapiens
ctcactggggcctaca

SEQ ID NO: 1223398 - DNA, 18 bp, Homo sapiens
ctcactggggcctacagc

SEQ ID NO: 1223399 - DNA, 17 bp, Homo sapiens
ctcactggggtcctggg

SEQ ID NO: 1223400 - DNA, 20 bp, Homo sapiens
ctcactggggtcctggggcc

SEQ ID NO: 1223401 - DNA, 22 bp, Homo sapiens
ctcactgtgatcaatattttta

SEQ ID NO: 1223402 - DNA, 20 bp, Homo sapiens
ctcactgtggtgtctgtgtt

SEQ ID NO: 1223403 - DNA, 12 bp, Homo sapiens
ctcactgttccc

SEQ ID NO: 1223404 - DNA, 19 bp, Homo sapiens
ctcactgtttgtttttatt

SEQ ID NO: 1223405 - DNA, 21 bp, Homo sapiens
ctcacttatcccaagagaatg

SEQ ID NO: 1223406 - DNA, 14 bp, Homo sapiens
ctcacttattatta

SEQ ID NO: 1223407 - DNA, 14 bp, Homo sapiens
ctcacttcaatgtg

SEQ ID NO: 1223408 - DNA, 13 bp, Homo sapiens
ctcacttccagat

SEQ ID NO: 1223409 - DNA, 22 bp, Homo sapiens
ctcacttccagatatccacata

SEQ ID NO: 1223410 - DNA, 20 bp, Homo sapiens
ctcacttccatacagctcta

SEQ ID NO: 1223411 - DNA, 20 bp, Homo sapiens
ctcacttctgggcttcatct

SEQ ID NO: 1223412 - DNA, 23 bp, Homo sapiens
ctcacttgccattgccaggagat

SEQ ID NO: 1223413 - DNA, 14 bp, Homo sapiens
ctcacttgccttag

SEQ ID NO: 1223414 - DNA, 11 bp, Homo sapiens
ctcactttcca

SEQ ID NO: 1223415 - DNA, 16 bp, Homo sapiens
ctcactttccaccaag

SEQ ID NO: 1223416 - DNA, 13 bp, Homo sapiens
ctcactttttcca

SEQ ID NO: 1223417 - DNA, 19 bp, Homo sapiens
ctcagaaactcccctgggg

SEQ ID NO: 1223418 - DNA, 17 bp, Homo sapiens
ctcagaaagccaacatg

SEQ ID NO: 1223419 - DNA, 14 bp, Homo sapiens
ctcagaaagggatt

SEQ ID NO: 1223420 - DNA, 18 bp, Homo sapiens
ctcagaaagtcaccagga

SEQ ID NO: 1223421 - DNA, 18 bp, Homo sapiens
ctcagaaagtgcctgaca

SEQ ID NO: 1223422 - DNA, 19 bp, Homo sapiens
ctcagaaatggacaaagaa

SEQ ID NO: 1223423 - DNA, 21 bp, Homo sapiens
ctcagaaatttttatttttct

SEQ ID NO: 1223424 - DNA, 14 bp, Homo sapiens
ctcagaacagctga

SEQ ID NO: 1223425 - DNA, 13 bp, Homo sapiens
ctcagaacataaa

SEQ ID NO: 1223426 - DNA, 21 bp, Homo sapiens
ctcagaacccacagtgagagg

SEQ ID NO: 1223427 - DNA, 14 bp, Homo sapiens
ctcagaacccaggg

SEQ ID NO: 1223428 - DNA, 17 bp, Homo sapiens
ctcagaacccagggctc

SEQ ID NO: 1223429 - DNA, 17 bp, Homo sapiens
ctcagaaccttgtccca

SEQ ID NO: 1223430 - DNA, 18 bp, Homo sapiens
ctcagaaccttgtcccag

SEQ ID NO: 1223431 - DNA, 21 bp, Homo sapiens
ctcagaaccttgtcccagcca

SEQ ID NO: 1223432 - DNA, 23 bp, Homo sapiens
ctcagaaccttgtcccagccagt

SEQ ID NO: 1223433 - DNA, 14 bp, Homo sapiens
ctcagaactgtccc

SEQ ID NO: 1223434 - DNA, 21 bp, Homo sapiens
ctcagaactgtcccatcccca

SEQ ID NO: 1223435 - DNA, 23 bp, Homo sapiens
ctcagaactgtcccatccccagg

SEQ ID NO: 1223436 - DNA, 17 bp, Homo sapiens
ctcagaacttgctgctg

SEQ ID NO: 1223437 - DNA, 19 bp, Homo sapiens
ctcagaagagaaatacagc

SEQ ID NO: 1223438 - DNA, 17 bp, Homo sapiens
ctcagaagagcagcttc

SEQ ID NO: 1223439 - DNA, 15 bp, Homo sapiens
ctcagaagcctgagg

SEQ ID NO: 1223440 - DNA, 17 bp, Homo sapiens
ctcagaagcctgaggct

SEQ ID NO: 1223441 - DNA, 20 bp, Homo sapiens
ctcagaaggccccagagaga

SEQ ID NO: 1223442 - DNA, 16 bp, Homo sapiens
ctcagaaggtattcct

SEQ ID NO: 1223443 - DNA, 23 bp, Homo sapiens
ctcagaatccaagtgaacactag

SEQ ID NO: 1223444 - DNA, 11 bp, Homo sapiens
ctcagaatcta

SEQ ID NO: 1223445 - DNA, 20 bp, Homo sapiens
ctcagaatctacccaaagga

SEQ ID NO: 1223446 - DNA, 18 bp, Homo sapiens
ctcagaatgatttgtaaa

SEQ ID NO: 1223447 - DNA, 21 bp, Homo sapiens
ctcagaatgatttgtaaatag

SEQ ID NO: 1223448 - DNA, 17 bp, Homo sapiens
ctcagaatgggggcttt

SEQ ID NO: 1223449 - DNA, 21 bp, Homo sapiens
ctcagcctcctgagcctgtgg

SEQ ID NO: 1223450 - DNA, 16 bp, Homo sapiens
ctcagcctctcgaagt

SEQ ID NO: 1223451 - DNA, 16 bp, Homo sapiens
ctcagcctctgcaact

SEQ ID NO: 1223452 - DNA, 21 bp, Homo sapiens
ctcagcctctgcaactgcaag

SEQ ID NO: 1223453 - DNA, 14 bp, Homo sapiens
ctcagcctcttctc

SEQ ID NO: 1223454 - DNA, 19 bp, Homo sapiens
ctcagcctgcccacctctc

SEQ ID NO: 1223455 - DNA, 17 bp, Homo sapiens
ctcagcctgctgcccag

SEQ ID NO: 1223456 - DNA, 11 bp, Homo sapiens
ctcagcctgga

SEQ ID NO: 1223457 - DNA, 13 bp, Homo sapiens
ctcagcctggaga

SEQ ID NO: 1223458 - DNA, 14 bp, Homo sapiens
ctcagcctggagag

SEQ ID NO: 1223459 - DNA, 17 bp, Homo sapiens
ctcagcctggagaggcc

SEQ ID NO: 1223460 - DNA, 19 bp, Homo sapiens
ctcagcctggagaggcctg

SEQ ID NO: 1223461 - DNA, 22 bp, Homo sapiens
ctcagcctggagaggcctgggg

SEQ ID NO: 1223462 - DNA, 23 bp, Homo sapiens
ctcagcctggagaggcctggggt

SEQ ID NO: 1223463 - DNA, 14 bp, Homo sapiens
ctcagcctggggct

SEQ ID NO: 1223464 - DNA, 16 bp, Homo sapiens
ctcagcctggggctct

SEQ ID NO: 1223465 - DNA, 17 bp, Homo sapiens
ctcagcctggggctctc

SEQ ID NO: 1223466 - DNA, 18 bp, Homo sapiens
ctcagcctgtctcgggct

SEQ ID NO: 1223467 - DNA, 14 bp, Homo sapiens
ctcagcctgttgcc

SEQ ID NO: 1223468 - DNA, 16 bp, Homo sapiens
ctcagccttcagacag

SEQ ID NO: 1223469 - DNA, 17 bp, Homo sapiens
ctcagccttcagacaga

SEQ ID NO: 1223470 - DNA, 20 bp, Homo sapiens
ctcagccttccaactagctg

SEQ ID NO: 1223471 - DNA, 16 bp, Homo sapiens
ctcagccttctgagta

SEQ ID NO: 1223472 - DNA, 12 bp, Homo sapiens
ctcagccttgca

SEQ ID NO: 1223473 - DNA, 14 bp, Homo sapiens
ctcagccttgcaca

SEQ ID NO: 1223474 - DNA, 15 bp, Homo sapiens
ctcagccttgcacac

SEQ ID NO: 1223475 - DNA, 21 bp, Homo sapiens
ctcagccttgcacacccactg

SEQ ID NO: 1223476 - DNA, 22 bp, Homo sapiens
ctcagccttgcacacccactgc

SEQ ID NO: 1223477 - DNA, 23 bp, Homo sapiens
ctcagccttgcacacccactgcc

SEQ ID NO: 1223478 - DNA, 14 bp, Homo sapiens
ctcagcgaatgaat

SEQ ID NO: 1223479 - DNA, 15 bp, Homo sapiens
ctcagcgagaggcag

SEQ ID NO: 1223480 - DNA, 12 bp, Homo sapiens
ctcagcgcaggc

SEQ ID NO: 1223481 - DNA, 13 bp, Homo sapiens
ctcagcgcaggct

SEQ ID NO: 1223482 - DNA, 14 bp, Homo sapiens
ctcagcggaggggt

SEQ ID NO: 1223483 - DNA, 23 bp, Homo sapiens
ctcagcgtttttttgtttttaat

SEQ ID NO: 1223484 - DNA, 16 bp, Homo sapiens
ctcagctcagcgccag

SEQ ID NO: 1223485 - DNA, 14 bp, Homo sapiens
ctcagctctctggg

SEQ ID NO: 1223486 - DNA, 23 bp, Homo sapiens
ctcagctctgacattctgattcg

SEQ ID NO: 1223487 - DNA, 12 bp, Homo sapiens
ctcagctctggg

SEQ ID NO: 1223488 - DNA, 18 bp, Homo sapiens
ctcagctctgggagagga

SEQ ID NO: 1223489 - DNA, 16 bp, Homo sapiens
ctcagctcttccatga

SEQ ID NO: 1223490 - DNA, 17 bp, Homo sapiens
ctcagctcttggctcca

SEQ ID NO: 1223491 - DNA, 23 bp, Homo sapiens
ctcagctgaatgcctcctgtggg

SEQ ID NO: 1223492 - DNA, 21 bp, Homo sapiens
ctcagctgcacattcctggcc

SEQ ID NO: 1223493 - DNA, 22 bp, Homo sapiens
ctcagctgcacattcctggccc

SEQ ID NO: 1223494 - DNA, 22 bp, Homo sapiens
ctcagctgcatggagcctggaa

SEQ ID NO: 1223495 - DNA, 12 bp, Homo sapiens
ctcagctgccaa

SEQ ID NO: 1223496 - DNA, 23 bp, Homo sapiens
ctcagggagcgatccaggggaag

SEQ ID NO: 1223497 - DNA, 11 bp, Homo sapiens
ctcagggaggg

SEQ ID NO: 1223498 - DNA, 12 bp, Homo sapiens
ctcagggaggga

SEQ ID NO: 1223499 - DNA, 19 bp, Homo sapiens
ctcagggcacgcaggacca

SEQ ID NO: 1223500 - DNA, 10 bp, Homo sapiens
ctcagggcag

SEQ ID NO: 1223501 - DNA, 17 bp, Homo sapiens
ctcagggcagctgcctg

SEQ ID NO: 1223502 - DNA, 19 bp, Homo sapiens
ctcagggcagctgcctggc

SEQ ID NO: 1223503 - DNA, 21 bp, Homo sapiens
ctcagggcagctgcctggcca

SEQ ID NO: 1223504 - DNA, 17 bp, Homo sapiens
ctcagggcagctgtgct

SEQ ID NO: 1223505 - DNA, 13 bp, Homo sapiens
ctcagggccatgc

SEQ ID NO: 1223506 - DNA, 18 bp, Homo sapiens
ctcagggccatgctgagg

SEQ ID NO: 1223507 - DNA, 20 bp, Homo sapiens
ctcagggccatgctgaggcc

SEQ ID NO: 1223508 - DNA, 14 bp, Homo sapiens
ctcagggccccagc

SEQ ID NO: 1223509 - DNA, 13 bp, Homo sapiens
ctcagggctccca

SEQ ID NO: 1223510 - DNA, 15 bp, Homo sapiens
ctcagggctcccagg

SEQ ID NO: 1223511 - DNA, 16 bp, Homo sapiens
ctcagggctcccaggg

SEQ ID NO: 1223512 - DNA, 13 bp, Homo sapiens
ctcagggctcctg

SEQ ID NO: 1223513 - DNA, 20 bp, Homo sapiens
ctcagggctggagcctgggg

SEQ ID NO: 1223514 - DNA, 19 bp, Homo sapiens
ctcaggggacactggcccc

SEQ ID NO: 1223515 - DNA, 22 bp, Homo sapiens
ctcaggggaccccactcccctc

SEQ ID NO: 1223516 - DNA, 20 bp, Homo sapiens
ctcaggggatgtttacctgg

SEQ ID NO: 1223517 - DNA, 11 bp, Homo sapiens
ctcaggggcaa

SEQ ID NO: 1223518 - DNA, 14 bp, Homo sapiens
ctcaggggcaggtg

SEQ ID NO: 1223519 - DNA, 20 bp, Homo sapiens
ctcaggggccagaggaactg

SEQ ID NO: 1223520 - DNA, 14 bp, Homo sapiens
ctcaggggcctctc

SEQ ID NO: 1223521 - DNA, 18 bp, Homo sapiens
ctcaggggcctctctcct

SEQ ID NO: 1223522 - DNA, 16 bp, Homo sapiens
ctcaggggctgtttga

SEQ ID NO: 1223523 - DNA, 16 bp, Homo sapiens
ctcagggggccagctg

SEQ ID NO: 1223524 - DNA, 18 bp, Homo sapiens
ctcagggggccagctggg

SEQ ID NO: 1223525 - DNA, 21 bp, Homo sapiens
ctcagggggccagctggggag

SEQ ID NO: 1223526 - DNA, 21 bp, Homo sapiens
ctcagggggtaggagagcact

SEQ ID NO: 1223527 - DNA, 22 bp, Homo sapiens
ctcagggggtaggagagcactg

SEQ ID NO: 1223528 - DNA, 19 bp, Homo sapiens
ctcagggggtcagcagagt

SEQ ID NO: 1223529 - DNA, 16 bp, Homo sapiens
ctcaggggtggagaag

SEQ ID NO: 1223530 - DNA, 18 bp, Homo sapiens
ctcagggtcaaagacaga

SEQ ID NO: 1223531 - DNA, 17 bp, Homo sapiens
ctcagggtcactgtcct

SEQ ID NO: 1223532 - DNA, 14 bp, Homo sapiens
ctcagggtgggggg

SEQ ID NO: 1223533 - DNA, 18 bp, Homo sapiens
ctcagggtggggggtgac

SEQ ID NO: 1223534 - DNA, 18 bp, Homo sapiens
ctcaggtaatcattttaa

SEQ ID NO: 1223535 - DNA, 18 bp, Homo sapiens
ctcaggtacagcgggctg

SEQ ID NO: 1223536 - DNA, 21 bp, Homo sapiens
ctcaggtacagcgggctgtgc

SEQ ID NO: 1223537 - DNA, 17 bp, Homo sapiens
ctcaggtagaaggttga

SEQ ID NO: 1223538 - DNA, 23 bp, Homo sapiens
ctcaggtagaaggttgacacagt

SEQ ID NO: 1223539 - DNA, 15 bp, Homo sapiens
ctcaggtagtactgg

SEQ ID NO: 1223540 - DNA, 16 bp, Homo sapiens
ctcaggtagtactggg

SEQ ID NO: 1223541 - DNA, 18 bp, Homo sapiens
ctcaggtcagctgggagc

SEQ ID NO: 1223542 - DNA, 21 bp, Homo sapiens
ctcaggtcagctgggagccag

SEQ ID NO: 1223543 - DNA, 16 bp, Homo sapiens
ctcaggtctgtaactg

SEQ ID NO: 1223544 - DNA, 20 bp, Homo sapiens
ctcaggtctgtaactgccca

SEQ ID NO: 1223545 - DNA, 23 bp, Homo sapiens
ctcaggtgcacacatcaccaggt

SEQ ID NO: 1223546 - DNA, 16 bp, Homo sapiens
ctcaggtgccactccc

SEQ ID NO: 1223547 - DNA, 19 bp, Homo sapiens
ctcaggtgccactccctga

SEQ ID NO: 1223548 - DNA, 20 bp, Homo sapiens
ctcaggtgccactccctgag

SEQ ID NO: 1223549 - DNA, 22 bp, Homo sapiens
ctcaggtgccactccctgagct

SEQ ID NO: 1223550 - DNA, 23 bp, Homo sapiens
ctcaggtgccactccctgagctt

SEQ ID NO: 1223551 - DNA, 21 bp, Homo sapiens
ctcaggtgctatgtcccaaga

SEQ ID NO: 1223552 - DNA, 22 bp, Homo sapiens
ctcaggtgctatgtcccaagag

SEQ ID NO: 1223553 - DNA, 12 bp, Homo sapiens
ctcaggtggcca

SEQ ID NO: 1223554 - DNA, 20 bp, Homo sapiens
ctcaggtggccagcctggat

SEQ ID NO: 1223555 - DNA, 21 bp, Homo sapiens
ctcaggtggccagcctggatc

SEQ ID NO: 1223556 - DNA, 20 bp, Homo sapiens
ctcaggtgtgcctgttgctt

SEQ ID NO: 1223557 - DNA, 15 bp, Homo sapiens
ctcaggttccagaac

SEQ ID NO: 1223558 - DNA, 16 bp, Homo sapiens
ctcaggttccagaaca

SEQ ID NO: 1223559 - DNA, 18 bp, Homo sapiens
ctcaggttccagaacagc

SEQ ID NO: 1223560 - DNA, 18 bp, Homo sapiens
ctcaggttcttcagggcc

SEQ ID NO: 1223561 - DNA, 22 bp, Homo sapiens
ctcaggttgtagtaaagaaatt

SEQ ID NO: 1223562 - DNA, 16 bp, Homo sapiens
ctcagtaaagcacttg

SEQ ID NO: 1223563 - DNA, 22 bp, Homo sapiens
ctcagtaacataactgcttctt

SEQ ID NO: 1223564 - DNA, 13 bp, Homo sapiens
ctcagtaccccat

SEQ ID NO: 1223565 - DNA, 12 bp, Homo sapiens
ctcagtactttg

SEQ ID NO: 1223566 - DNA, 12 bp, Homo sapiens
ctcagtagaaaa

SEQ ID NO: 1223567 - DNA, 14 bp, Homo sapiens
ctcagtatagcatt

SEQ ID NO: 1223568 - DNA, 17 bp, Homo sapiens
ctcagtatgaattattc

SEQ ID NO: 1223569 - DNA, 21 bp, Homo sapiens
ctcagtatgctttccctgagg

SEQ ID NO: 1223570 - DNA, 23 bp, Homo sapiens
ctcagtatgctttccctgaggaa

SEQ ID NO: 1223571 - DNA, 20 bp, Homo sapiens
ctcagtattactttctgccg

SEQ ID NO: 1223572 - DNA, 13 bp, Homo sapiens
ctcagtatttatg

SEQ ID NO: 1223573 - DNA, 18 bp, Homo sapiens
ctcagtatttatgtaatt

SEQ ID NO: 1223574 - DNA, 21 bp, Homo sapiens
ctcagtcacccccacttccca

SEQ ID NO: 1223575 - DNA, 13 bp, Homo sapiens
ctcagtccactgt

SEQ ID NO: 1223576 - DNA, 15 bp, Homo sapiens
ctcagtccactgttg

SEQ ID NO: 1223577 - DNA, 17 bp, Homo sapiens
ctcagtcccccaacaga

SEQ ID NO: 1223578 - DNA, 16 bp, Homo sapiens
ctcagtcccccaccac

SEQ ID NO: 1223579 - DNA, 15 bp, Homo sapiens
ctcagtctccctccc

SEQ ID NO: 1223580 - DNA, 15 bp, Homo sapiens
ctcagtctcttccac

SEQ ID NO: 1223581 - DNA, 18 bp, Homo sapiens
ctcagtctgttcactgca

SEQ ID NO: 1223582 - DNA, 19 bp, Homo sapiens
ctcagtctgttcactgcat

SEQ ID NO: 1223583 - DNA, 20 bp, Homo sapiens
ctcagtgaaggtggtggggc

SEQ ID NO: 1223584 - DNA, 17 bp, Homo sapiens
ctcagtgactcagaact

SEQ ID NO: 1223585 - DNA, 14 bp, Homo sapiens
ctcagtgagctggg

SEQ ID NO: 1223586 - DNA, 14 bp, Homo sapiens
ctcagtgcagcaat

SEQ ID NO: 1223587 - DNA, 17 bp, Homo sapiens
ctcagtgcatttgtgct

SEQ ID NO: 1223588 - DNA, 22 bp, Homo sapiens
ctcagtgcatttgtgctagaaa

SEQ ID NO: 1223589 - DNA, 20 bp, Homo sapiens
ctcagtgccacttgacattc

SEQ ID NO: 1223590 - DNA, 14 bp, Homo sapiens
ctcagtgcctcctg

SEQ ID NO: 1223591 - DNA, 13 bp, Homo sapiens
ctcagtgcctttt

SEQ ID NO: 1223592 - DNA, 16 bp, Homo sapiens
ctcagtggatcttcag

SEQ ID NO: 1223593 - DNA, 17 bp, Homo sapiens
ctcagtggatcttcaga

SEQ ID NO: 1223594 - DNA, 17 bp, Homo sapiens
ctcagtgtatttgtatt

SEQ ID NO: 1223595 - DNA, 15 bp, Homo sapiens
ctcagtgtccagctt

SEQ ID NO: 1223596 - DNA, 17 bp, Homo sapiens
ctcagtgttttggactc

SEQ ID NO: 1223597 - DNA, 16 bp, Homo sapiens
ctcagttaaaatgtga

SEQ ID NO: 1223598 - DNA, 17 bp, Homo sapiens
ctcagttatgtagtttc

SEQ ID NO: 1223599 - DNA, 23 bp, Homo sapiens
ctcagttattacatgtaatttga

SEQ ID NO: 1223600 - DNA, 21 bp, Homo sapiens
ctcagttcaacctggtggcac

SEQ ID NO: 1223601 - DNA, 22 bp, Homo sapiens
ctcagttcaacctggtggcacc

SEQ ID NO: 1223602 - DNA, 23 bp, Homo sapiens
ctcagttcaacctggtggcacca

SEQ ID NO: 1223603 - DNA, 18 bp, Homo sapiens
ctcagttcccttggcctc

SEQ ID NO: 1223604 - DNA, 19 bp, Homo sapiens
ctcagttcccttggcctca

SEQ ID NO: 1223605 - DNA, 20 bp, Homo sapiens
ctcagttcccttggcctcag

SEQ ID NO: 1223606 - DNA, 18 bp, Homo sapiens
ctcagttcgtgtttgatt

SEQ ID NO: 1223607 - DNA, 15 bp, Homo sapiens
ctcagttctagtctc

SEQ ID NO: 1223608 - DNA, 21 bp, Homo sapiens
ctcagttctagtctctctggg

SEQ ID NO: 1223609 - DNA, 18 bp, Homo sapiens
ctcagttgtttgcttctt

SEQ ID NO: 1223610 - DNA, 15 bp, Homo sapiens
ctcagtttaatcctt

SEQ ID NO: 1223611 - DNA, 21 bp, Homo sapiens
ctcagtttaatccttctagtt

SEQ ID NO: 1223612 - DNA, 14 bp, Homo sapiens
ctcagtttacatct

SEQ ID NO: 1223613 - DNA, 19 bp, Homo sapiens
ctcagtttctccatcagct

SEQ ID NO: 1223614 - DNA, 17 bp, Homo sapiens
ctcagttttatcatttt

SEQ ID NO: 1223615 - DNA, 12 bp, Homo sapiens
ctcagttttcct

SEQ ID NO: 1223616 - DNA, 22 bp, Homo sapiens
ctcatcctggcacgccctactc

SEQ ID NO: 1223617 - DNA, 17 bp, Homo sapiens
ctcatcgggcccaggga

SEQ ID NO: 1223618 - DNA, 18 bp, Homo sapiens
ctcatctatctcaatcct

SEQ ID NO: 1223619 - DNA, 19 bp, Homo sapiens
ctcatctatgaggaaaggt

SEQ ID NO: 1223620 - DNA, 18 bp, Homo sapiens
ctcatctcagtgaagaat

SEQ ID NO: 1223621 - DNA, 21 bp, Homo sapiens
ctcatctccaaggatcctctc

SEQ ID NO: 1223622 - DNA, 22 bp, Homo sapiens
ctcatctccttcctgaggagcc

SEQ ID NO: 1223623 - DNA, 12 bp, Homo sapiens
ctcatctctgga

SEQ ID NO: 1223624 - DNA, 20 bp, Homo sapiens
ctcatctctggaaggggcag

SEQ ID NO: 1223625 - DNA, 20 bp, Homo sapiens
ctcatctgagaggctctccg

SEQ ID NO: 1223626 - DNA, 24 bp, Homo sapiens
ctcatctgagaggctctccgtgca

SEQ ID NO: 1223627 - DNA, 18 bp, Homo sapiens
ctcatctgatcacttcat

SEQ ID NO: 1223628 - DNA, 14 bp, Homo sapiens
ctcatctgcaccct

SEQ ID NO: 1223629 - DNA, 14 bp, Homo sapiens
ctcatctgctggtc

SEQ ID NO: 1223630 - DNA, 13 bp, Homo sapiens
ctcatctgtccct

SEQ ID NO: 1223631 - DNA, 16 bp, Homo sapiens
ctcatctgtggagctg

SEQ ID NO: 1223632 - DNA, 13 bp, Homo sapiens
ctcatcttactgt

SEQ ID NO: 1223633 - DNA, 18 bp, Homo sapiens
ctcatcttagtgcctgag

SEQ ID NO: 1223634 - DNA, 17 bp, Homo sapiens
ctcatctttctccttca

SEQ ID NO: 1223635 - DNA, 14 bp, Homo sapiens
ctcatgaactaccc

SEQ ID NO: 1223636 - DNA, 16 bp, Homo sapiens
ctcatgaagcaggagg

SEQ ID NO: 1223637 - DNA, 15 bp, Homo sapiens
ctcatgaatgaaaat

SEQ ID NO: 1223638 - DNA, 15 bp, Homo sapiens
ctcatgaggggagag

SEQ ID NO: 1223639 - DNA, 19 bp, Homo sapiens
ctcatgaggggagaggaga

SEQ ID NO: 1223640 - DNA, 22 bp, Homo sapiens
ctcatgataccacctttactgt

SEQ ID NO: 1223641 - DNA, 19 bp, Homo sapiens
ctcatgatcttgtgacata

SEQ ID NO: 1223642 - DNA, 17 bp, Homo sapiens
ctcatgcaaactgcttt

SEQ ID NO: 1223643 - DNA, 19 bp, Homo sapiens
ctcatgcaaactgctttat

SEQ ID NO: 1223644 - DNA, 21 bp, Homo sapiens
ctcatgcaaactgctttattt

SEQ ID NO: 1223645 - DNA, 18 bp, Homo sapiens
ctcatgcatagtcccagc

SEQ ID NO: 1223646 - DNA, 19 bp, Homo sapiens
ctcatgcatagtcccagct

SEQ ID NO: 1223647 - DNA, 16 bp, Homo sapiens
ctcatgcatttcaagc

SEQ ID NO: 1223648 - DNA, 17 bp, Homo sapiens
ctcatgccacaccttct

SEQ ID NO: 1223649 - DNA, 21 bp, Homo sapiens
ctcatgccatggtctttgcta

SEQ ID NO: 1223650 - DNA, 22 bp, Homo sapiens
ctcatgcccaccccctgccctg

SEQ ID NO: 1223651 - DNA, 23 bp, Homo sapiens
ctcatgcccaccccctgccctgc

SEQ ID NO: 1223652 - DNA, 14 bp, Homo sapiens
ctcatgcccagctc

SEQ ID NO: 1223653 - DNA, 16 bp, Homo sapiens
ctcatgcccagctctc

SEQ ID NO: 1223654 - DNA, 19 bp, Homo sapiens
ctcatgcccagctctctga

SEQ ID NO: 1223655 - DNA, 17 bp, Homo sapiens
ctcatgccccctttcag

SEQ ID NO: 1223656 - DNA, 17 bp, Homo sapiens
ctcatgcccctggctgg

SEQ ID NO: 1223657 - DNA, 16 bp, Homo sapiens
ctcatgccccttgggg

SEQ ID NO: 1223658 - DNA, 14 bp, Homo sapiens
ctcatgccctgcca

SEQ ID NO: 1223659 - DNA, 15 bp, Homo sapiens
ctcatgccctgccaa

SEQ ID NO: 1223660 - DNA, 14 bp, Homo sapiens
ctcatgctgttgct

SEQ ID NO: 1223661 - DNA, 17 bp, Homo sapiens
ctcatggattgccacag

SEQ ID NO: 1223662 - DNA, 14 bp, Homo sapiens
ctcatggcagctgt

SEQ ID NO: 1223663 - DNA, 19 bp, Homo sapiens
ctcatggcccctctgacct

SEQ ID NO: 1223664 - DNA, 20 bp, Homo sapiens
ctcatgggaagatgtctcag

SEQ ID NO: 1223665 - DNA, 21 bp, Homo sapiens
ctcatgggaagatgtctcaga

SEQ ID NO: 1223666 - DNA, 16 bp, Homo sapiens
ctcatgggaaggggag

SEQ ID NO: 1223667 - DNA, 22 bp, Homo sapiens
ctcatgggtcctagcccttccc

SEQ ID NO: 1223668 - DNA, 15 bp, Homo sapiens
ctcatgggtggcact

SEQ ID NO: 1223669 - DNA, 14 bp, Homo sapiens
ctcatgggtggctg

SEQ ID NO: 1223670 - DNA, 17 bp, Homo sapiens
ctcatgtaggtgagcct

SEQ ID NO: 1223671 - DNA, 20 bp, Homo sapiens
ctcatgtaggtgagcctggg

SEQ ID NO: 1223672 - DNA, 20 bp, Homo sapiens
ctcatgtccccttcctgttc

SEQ ID NO: 1223673 - DNA, 22 bp, Homo sapiens
ctcatgtccccttcctgttctt

SEQ ID NO: 1223674 - DNA, 13 bp, Homo sapiens
ctcatgtggctgg

SEQ ID NO: 1223675 - DNA, 16 bp, Homo sapiens
ctcatgtgtgcaacag

SEQ ID NO: 1223676 - DNA, 17 bp, Homo sapiens
ctcatgttactcagtgt

SEQ ID NO: 1223677 - DNA, 17 bp, Homo sapiens
ctcatgttccttttgaa

SEQ ID NO: 1223678 - DNA, 18 bp, Homo sapiens
ctcatgttctcttcccag

SEQ ID NO: 1223679 - DNA, 20 bp, Homo sapiens
ctcatgttctcttcccaggc

SEQ ID NO: 1223680 - DNA, 16 bp, Homo sapiens
ctcatgttgctgaatt

SEQ ID NO: 1223681 - DNA, 16 bp, Homo sapiens
ctcatgttttcaactg

SEQ ID NO: 1223682 - DNA, 13 bp, Homo sapiens
ctcatgttttcca

SEQ ID NO: 1223683 - DNA, 11 bp, Homo sapiens
ctcattaaaat

SEQ ID NO: 1223684 - DNA, 15 bp, Homo sapiens
ctcattaaaatccag

SEQ ID NO: 1223685 - DNA, 15 bp, Homo sapiens
ctcattaaacttttt

SEQ ID NO: 1223686 - DNA, 11 bp, Homo sapiens
ctcattaaatt

SEQ ID NO: 1223687 - DNA, 22 bp, Homo sapiens
ctcattaacaactcattctgat

SEQ ID NO: 1223688 - DNA, 15 bp, Homo sapiens
ctcattaatagctgc

SEQ ID NO: 1223689 - DNA, 15 bp, Homo sapiens
ctcattacagttctt

SEQ ID NO: 1223690 - DNA, 19 bp, Homo sapiens
ctcattacagttctttcct

SEQ ID NO: 1223691 - DNA, 13 bp, Homo sapiens
ctcattagactgg

SEQ ID NO: 1223692 - DNA, 17 bp, Homo sapiens
ctcattaggttttgctt

SEQ ID NO: 1223693 - DNA, 14 bp, Homo sapiens
ctcattagtggtac

SEQ ID NO: 1223694 - DNA, 17 bp, Homo sapiens
ctcattatgttgatact

SEQ ID NO: 1223695 - DNA, 22 bp, Homo sapiens
ctcattcaggaaaactgacaga

SEQ ID NO: 1223696 - DNA, 17 bp, Homo sapiens
ctcattcagtattaaag

SEQ ID NO: 1223697 - DNA, 22 bp, Homo sapiens
ctcattcatcttgcaagcaaat

SEQ ID NO: 1223698 - DNA, 18 bp, Homo sapiens
ctcattccaacagtgagt

SEQ ID NO: 1223699 - DNA, 17 bp, Homo sapiens
ctcattccactgttggt

SEQ ID NO: 1223700 - DNA, 14 bp, Homo sapiens
ctcattcccctcgt

SEQ ID NO: 1223701 - DNA, 21 bp, Homo sapiens
ctcattccggccacatcattc

SEQ ID NO: 1223702 - DNA, 21 bp, Homo sapiens
ctcattctactaatgtgatgc

SEQ ID NO: 1223703 - DNA, 17 bp, Homo sapiens
ctcattgacaagaactg

SEQ ID NO: 1223704 - DNA, 15 bp, Homo sapiens
ctcattgacatgata

SEQ ID NO: 1223705 - DNA, 18 bp, Homo sapiens
ctcattgctgagcctctg

SEQ ID NO: 1223706 - DNA, 19 bp, Homo sapiens
ctcattgctgagcctctgc

SEQ ID NO: 1223707 - DNA, 19 bp, Homo sapiens
ctcattgctgtcttgcccc

SEQ ID NO: 1223708 - DNA, 20 bp, Homo sapiens
ctcattgctgtcttgcccca

SEQ ID NO: 1223709 - DNA, 19 bp, Homo sapiens
ctcattgcttacaagccta

SEQ ID NO: 1223710 - DNA, 19 bp, Homo sapiens
ctcattgtgccaagccttc

SEQ ID NO: 1223711 - DNA, 20 bp, Homo sapiens
ctcattgtgccaagccttct

SEQ ID NO: 1223712 - DNA, 23 bp, Homo sapiens
ctcatttaaacccaatcagatgc

SEQ ID NO: 1223713 - DNA, 16 bp, Homo sapiens
ctcatttaagggaaaa

SEQ ID NO: 1223714 - DNA, 18 bp, Homo sapiens
ctcatttaagggaaaaat

SEQ ID NO: 1223715 - DNA, 15 bp, Homo sapiens
ctcatttagaaacaa

SEQ ID NO: 1223716 - DNA, 17 bp, Homo sapiens
ctcatttcacagccttt

SEQ ID NO: 1223717 - DNA, 15 bp, Homo sapiens
ctcatttcatctcat

SEQ ID NO: 1223718 - DNA, 19 bp, Homo sapiens
ctcatttccaaaccatcag

SEQ ID NO: 1223719 - DNA, 17 bp, Homo sapiens
ctcatttctttgtcttt

SEQ ID NO: 1223720 - DNA, 22 bp, Homo sapiens
ctcatttctttgtctttttcct

SEQ ID NO: 1223721 - DNA, 19 bp, Homo sapiens
ctcatttggtctgccagaa

SEQ ID NO: 1223722 - DNA, 23 bp, Homo sapiens
ctcattttctacgtcatgtattt

SEQ ID NO: 1223723 - DNA, 13 bp, Homo sapiens
ctcattttctggt

SEQ ID NO: 1223724 - DNA, 14 bp, Homo sapiens
ctcattttctggtt

SEQ ID NO: 1223725 - DNA, 20 bp, Homo sapiens
ctcattttgacaaagtgcct

SEQ ID NO: 1223726 - DNA, 12 bp, Homo sapiens
ctcatttttcct

SEQ ID NO: 1223727 - DNA, 13 bp, Homo sapiens
ctcattttttaaa

SEQ ID NO: 1223728 - DNA, 18 bp, Homo sapiens
ctcatttttttaatttat

SEQ ID NO: 1223729 - DNA, 21 bp, Homo sapiens
ctccaaaaaaaaaaaaaatac

SEQ ID NO: 1223730 - DNA, 17 bp, Homo sapiens
ctccaaaacccatgtgg

SEQ ID NO: 1223731 - DNA, 18 bp, Homo sapiens
ctccaaaataaaactttt

SEQ ID NO: 1223732 - DNA, 14 bp, Homo sapiens
ctccaaacctccag

SEQ ID NO: 1223733 - DNA, 15 bp, Homo sapiens
ctccaaacctccagc

SEQ ID NO: 1223734 - DNA, 23 bp, Homo sapiens
ctccaaactgaagcagcctctcc

SEQ ID NO: 1223735 - DNA, 14 bp, Homo sapiens
ctccaaaggggctg

SEQ ID NO: 1223736 - DNA, 18 bp, Homo sapiens
ctccaaaggggctgctgg

SEQ ID NO: 1223737 - DNA, 20 bp, Homo sapiens
ctccaaaggggctgctgggg

SEQ ID NO: 1223738 - DNA, 15 bp, Homo sapiens
ctccaaatctccagt

SEQ ID NO: 1223739 - DNA, 18 bp, Homo sapiens
ctccaaatctgatttcat

SEQ ID NO: 1223740 - DNA, 15 bp, Homo sapiens
ctccagtctgctgcc

SEQ ID NO: 1223741 - DNA, 13 bp, Homo sapiens
ctccagtgccgct

SEQ ID NO: 1223742 - DNA, 19 bp, Homo sapiens
ctccagtgccgctcctgct

SEQ ID NO: 1223743 - DNA, 21 bp, Homo sapiens
ctccagtgccgctcctgcttc

SEQ ID NO: 1223744 - DNA, 15 bp, Homo sapiens
ctccagtgggcaggg

SEQ ID NO: 1223745 - DNA, 16 bp, Homo sapiens
ctccagtgggcagggg

SEQ ID NO: 1223746 - DNA, 22 bp, Homo sapiens
ctccagtgtgggcttgaccagg

SEQ ID NO: 1223747 - DNA, 12 bp, Homo sapiens
ctccagtgttgc

SEQ ID NO: 1223748 - DNA, 19 bp, Homo sapiens
ctccagtgttgcctcctcc

SEQ ID NO: 1223749 - DNA, 17 bp, Homo sapiens
ctccagttgggactcag

SEQ ID NO: 1223750 - DNA, 18 bp, Homo sapiens
ctccagttgggactcagg

SEQ ID NO: 1223751 - DNA, 17 bp, Homo sapiens
ctccagtttgcacctgt

SEQ ID NO: 1223752 - DNA, 18 bp, Homo sapiens
ctccagtttgcacctgtc

SEQ ID NO: 1223753 - DNA, 20 bp, Homo sapiens
ctccagtttttgtttttgca

SEQ ID NO: 1223754 - DNA, 19 bp, Homo sapiens
ctccataaagtacaaatga

SEQ ID NO: 1223755 - DNA, 20 bp, Homo sapiens
ctccataaagtacaaatgaa

SEQ ID NO: 1223756 - DNA, 18 bp, Homo sapiens
ctccataagtttaacttt

SEQ ID NO: 1223757 - DNA, 12 bp, Homo sapiens
ctccatacagcc

SEQ ID NO: 1223758 - DNA, 13 bp, Homo sapiens
ctccatacagcct

SEQ ID NO: 1223759 - DNA, 15 bp, Homo sapiens
ctccatactcaagct

SEQ ID NO: 1223760 - DNA, 14 bp, Homo sapiens
ctccatactcagga

SEQ ID NO: 1223761 - DNA, 20 bp, Homo sapiens
ctccatatctccatggccct

SEQ ID NO: 1223762 - DNA, 16 bp, Homo sapiens
ctccatcatatgcctg

SEQ ID NO: 1223763 - DNA, 18 bp, Homo sapiens
ctccatcatatgcctgac

SEQ ID NO: 1223764 - DNA, 21 bp, Homo sapiens
ctccatcatatgcctgacccc

SEQ ID NO: 1223765 - DNA, 21 bp, Homo sapiens
ctccatccacctcatcactgg

SEQ ID NO: 1223766 - DNA, 21 bp, Homo sapiens
ctccatccacgtggcctctct

SEQ ID NO: 1223767 - DNA, 21 bp, Homo sapiens
ctccatccatctgtccgtcca

SEQ ID NO: 1223768 - DNA, 16 bp, Homo sapiens
ctccatccccatcggc

SEQ ID NO: 1223769 - DNA, 11 bp, Homo sapiens
ctccatcccct

SEQ ID NO: 1223770 - DNA, 17 bp, Homo sapiens
ctccatcccctccctgc

SEQ ID NO: 1223771 - DNA, 23 bp, Homo sapiens
ctccatcccctccctgcctgctc

SEQ ID NO: 1223772 - DNA, 15 bp, Homo sapiens
ctccatccctctaat

SEQ ID NO: 1223773 - DNA, 16 bp, Homo sapiens
ctccatccctgctctg

SEQ ID NO: 1223774 - DNA, 21 bp, Homo sapiens
ctccatcctgtttgtatgaaa

SEQ ID NO: 1223775 - DNA, 19 bp, Homo sapiens
ctccatcgccatcttcttc

SEQ ID NO: 1223776 - DNA, 23 bp, Homo sapiens
ctccatcgtctcatcctcctttc

SEQ ID NO: 1223777 - DNA, 20 bp, Homo sapiens
ctccatctctcatcctccag

SEQ ID NO: 1223778 - DNA, 16 bp, Homo sapiens
ctccatcttccaggat

SEQ ID NO: 1223779 - DNA, 17 bp, Homo sapiens
ctccatcttccaggatg

SEQ ID NO: 1223780 - DNA, 20 bp, Homo sapiens
ctccatcttggtagttctgt

SEQ ID NO: 1223781 - DNA, 16 bp, Homo sapiens
ctccatctttctacag

SEQ ID NO: 1223782 - DNA, 15 bp, Homo sapiens
ctccatgactggctg

SEQ ID NO: 1223783 - DNA, 21 bp, Homo sapiens
ctccatgaggtactggtccct

SEQ ID NO: 1223784 - DNA, 17 bp, Homo sapiens
ctccatgagttttttct

SEQ ID NO: 1223785 - DNA, 20 bp, Homo sapiens
ctccatgccccagctctgga

SEQ ID NO: 1223786 - DNA, 21 bp, Homo sapiens
ctccatgccccagctctggat

SEQ ID NO: 1223787 - DNA, 15 bp, Homo sapiens
ctccatgcctctgga

SEQ ID NO: 1223788 - DNA, 23 bp, Homo sapiens
ctccatgcctctggaggcctctg

SEQ ID NO: 1223789 - DNA, 23 bp, Homo sapiens
ctccatgcgcagatgaggggcca

SEQ ID NO: 1223790 - DNA, 18 bp, Homo sapiens
ctccatgctgcaaaggag

SEQ ID NO: 1223791 - DNA, 14 bp, Homo sapiens
ctccatgctgcctc

SEQ ID NO: 1223792 - DNA, 18 bp, Homo sapiens
ctccatggccctgtccca

SEQ ID NO: 1223793 - DNA, 19 bp, Homo sapiens
ctccatggccctgtcccag

SEQ ID NO: 1223794 - DNA, 17 bp, Homo sapiens
ctccatgggctagtgtg

SEQ ID NO: 1223795 - DNA, 22 bp, Homo sapiens
ctccatggggttcgagactcca

SEQ ID NO: 1223796 - DNA, 15 bp, Homo sapiens
ctccatggtcctgtc

SEQ ID NO: 1223797 - DNA, 21 bp, Homo sapiens
ctccatggtcctgtctgtcct

SEQ ID NO: 1223798 - DNA, 22 bp, Homo sapiens
ctccatggtcctgtctgtcctt

SEQ ID NO: 1223799 - DNA, 15 bp, Homo sapiens
ctccatgtgcatata

SEQ ID NO: 1223800 - DNA, 17 bp, Homo sapiens
ctccatgtgcatataaa

SEQ ID NO: 1223801 - DNA, 22 bp, Homo sapiens
ctccatgtttttggggacactg

SEQ ID NO: 1223802 - DNA, 13 bp, Homo sapiens
ctccattctattt

SEQ ID NO: 1223803 - DNA, 14 bp, Homo sapiens
ctccattctgacca

SEQ ID NO: 1223804 - DNA, 20 bp, Homo sapiens
ctccattctgaccatttcag

SEQ ID NO: 1223805 - DNA, 20 bp, Homo sapiens
ctccattgtgtgatccagcc

SEQ ID NO: 1223806 - DNA, 16 bp, Homo sapiens
ctccatttaagacaca

SEQ ID NO: 1223807 - DNA, 20 bp, Homo sapiens
ctccatttaagacacattga

SEQ ID NO: 1223808 - DNA, 15 bp, Homo sapiens
ctccatttagttctt

SEQ ID NO: 1223809 - DNA, 21 bp, Homo sapiens
ctccatttcccaaagtcctct

SEQ ID NO: 1223810 - DNA, 17 bp, Homo sapiens
ctccatttctttcttcc

SEQ ID NO: 1223811 - DNA, 17 bp, Homo sapiens
ctccatttggtcctttc

SEQ ID NO: 1223812 - DNA, 21 bp, Homo sapiens
ctccatttggtcctttctcca

SEQ ID NO: 1223813 - DNA, 20 bp, Homo sapiens
ctccatttgtcatcgttccc

SEQ ID NO: 1223814 - DNA, 23 bp, Homo sapiens
ctccatttgtcatcgttccccac

SEQ ID NO: 1223815 - DNA, 21 bp, Homo sapiens
ctcccagggagtgagcagcta

SEQ ID NO: 1223816 - DNA, 23 bp, Homo sapiens
ctcccagggagtgagcagctact

SEQ ID NO: 1223817 - DNA, 16 bp, Homo sapiens
ctcccaggggagccag

SEQ ID NO: 1223818 - DNA, 13 bp, Homo sapiens
ctcccaggggtct

SEQ ID NO: 1223819 - DNA, 16 bp, Homo sapiens
ctcccaggtaccagct

SEQ ID NO: 1223820 - DNA, 17 bp, Homo sapiens
ctcccaggtaccagctg

SEQ ID NO: 1223821 - DNA, 21 bp, Homo sapiens
ctcccaggtaccagctgcgct

SEQ ID NO: 1223822 - DNA, 22 bp, Homo sapiens
ctcccaggtaccagctgcgctt

SEQ ID NO: 1223823 - DNA, 24 bp, Homo sapiens
ctcccaggtaccagctgcgcttgc

SEQ ID NO: 1223824 - DNA, 20 bp, Homo sapiens
ctcccaggtggattttgtgg

SEQ ID NO: 1223825 - DNA, 14 bp, Homo sapiens
ctcccagtccattt

SEQ ID NO: 1223826 - DNA, 15 bp, Homo sapiens
ctcccagtccatttc

SEQ ID NO: 1223827 - DNA, 15 bp, Homo sapiens
ctcccagtcctccag

SEQ ID NO: 1223828 - DNA, 17 bp, Homo sapiens
ctcccagtctcatctcc

SEQ ID NO: 1223829 - DNA, 16 bp, Homo sapiens
ctcccatcacttccct

SEQ ID NO: 1223830 - DNA, 15 bp, Homo sapiens
ctcccatccagggcc

SEQ ID NO: 1223831 - DNA, 16 bp, Homo sapiens
ctcccatccccctgcc

SEQ ID NO: 1223832 - DNA, 19 bp, Homo sapiens
ctcccatccccctgccctc

SEQ ID NO: 1223833 - DNA, 15 bp, Homo sapiens
ctcccatcccctcaa

SEQ ID NO: 1223834 - DNA, 14 bp, Homo sapiens
ctcccatcccgctt

SEQ ID NO: 1223835 - DNA, 17 bp, Homo sapiens
ctcccatcctccagccc

SEQ ID NO: 1223836 - DNA, 19 bp, Homo sapiens
ctcccatcctccagccctg

SEQ ID NO: 1223837 - DNA, 11 bp, Homo sapiens
ctcccatcctg

SEQ ID NO: 1223838 - DNA, 15 bp, Homo sapiens
ctcccatcctggggc

SEQ ID NO: 1223839 - DNA, 21 bp, Homo sapiens
ctcccatcctggggcagcact

SEQ ID NO: 1223840 - DNA, 22 bp, Homo sapiens
ctcccatctccttacctctgga

SEQ ID NO: 1223841 - DNA, 17 bp, Homo sapiens
ctcccatctctacccca

SEQ ID NO: 1223842 - DNA, 11 bp, Homo sapiens
ctcccatctgg

SEQ ID NO: 1223843 - DNA, 15 bp, Homo sapiens
ctcccatctgggagt

SEQ ID NO: 1223844 - DNA, 21 bp, Homo sapiens
ctcccatgaccatactgaggg

SEQ ID NO: 1223845 - DNA, 23 bp, Homo sapiens
ctcccatgcgggtgcacacgaag

SEQ ID NO: 1223846 - DNA, 14 bp, Homo sapiens
ctcccatggcacct

SEQ ID NO: 1223847 - DNA, 14 bp, Homo sapiens
ctcccatgtatgga

SEQ ID NO: 1223848 - DNA, 19 bp, Homo sapiens
ctcccattaggacaatcag

SEQ ID NO: 1223849 - DNA, 22 bp, Homo sapiens
ctcccattgtccctctgcccca

SEQ ID NO: 1223850 - DNA, 16 bp, Homo sapiens
ctcccatttcctgatc

SEQ ID NO: 1223851 - DNA, 23 bp, Homo sapiens
ctccccaaagtgctgggattaca

SEQ ID NO: 1223852 - DNA, 15 bp, Homo sapiens
ctccccaaatggctg

SEQ ID NO: 1223853 - DNA, 20 bp, Homo sapiens
ctccccaacaattggagggt

SEQ ID NO: 1223854 - DNA, 12 bp, Homo sapiens
ctccccaaccct

SEQ ID NO: 1223855 - DNA, 19 bp, Homo sapiens
ctccccaaccctaggttcc

SEQ ID NO: 1223856 - DNA, 19 bp, Homo sapiens
ctccccaaccctgcccctg

SEQ ID NO: 1223857 - DNA, 15 bp, Homo sapiens
ctccccaatccaggc

SEQ ID NO: 1223858 - DNA, 16 bp, Homo sapiens
ctccccaatccaggcc

SEQ ID NO: 1223859 - DNA, 19 bp, Homo sapiens
ctccccacacacaggcctt

SEQ ID NO: 1223860 - DNA, 21 bp, Homo sapiens
ctccccacacacaggccttct

SEQ ID NO: 1223861 - DNA, 15 bp, Homo sapiens
ctccccacagcgtcc

SEQ ID NO: 1223862 - DNA, 19 bp, Homo sapiens
ctccccacagcgtccctgg

SEQ ID NO: 1223863 - DNA, 20 bp, Homo sapiens
ctccccacagcgtccctggc

SEQ ID NO: 1223864 - DNA, 13 bp, Homo sapiens
ctccccacccaag

SEQ ID NO: 1223865 - DNA, 19 bp, Homo sapiens
ctccccacccaagagagga

SEQ ID NO: 1223866 - DNA, 15 bp, Homo sapiens
ctccccaccccgaaa

SEQ ID NO: 1223867 - DNA, 14 bp, Homo sapiens
ctccccacccgccc

SEQ ID NO: 1223868 - DNA, 18 bp, Homo sapiens
ctccccacctggacacac

SEQ ID NO: 1223869 - DNA, 12 bp, Homo sapiens
ctccccacctgt

SEQ ID NO: 1223870 - DNA, 13 bp, Homo sapiens
ctccccacctgta

SEQ ID NO: 1223871 - DNA, 16 bp, Homo sapiens
ctccccacctgtagct

SEQ ID NO: 1223872 - DNA, 15 bp, Homo sapiens
ctccccaccttcccc

SEQ ID NO: 1223873 - DNA, 16 bp, Homo sapiens
ctccccacgagtcacc

SEQ ID NO: 1223874 - DNA, 20 bp, Homo sapiens
ctccccacgagtcacctgca

SEQ ID NO: 1223875 - DNA, 21 bp, Homo sapiens
ctccccacgagtcacctgcaa

SEQ ID NO: 1223876 - DNA, 11 bp, Homo sapiens
ctccccactcc

SEQ ID NO: 1223877 - DNA, 12 bp, Homo sapiens
ctccccactccc

SEQ ID NO: 1223878 - DNA, 12 bp, Homo sapiens
ctccccactcta

SEQ ID NO: 1223879 - DNA, 13 bp, Homo sapiens
ctccccactctag

SEQ ID NO: 1223880 - DNA, 14 bp, Homo sapiens
ctccccagaaacag

SEQ ID NO: 1223881 - DNA, 21 bp, Homo sapiens
ctccccagaactggctgggcc

SEQ ID NO: 1223882 - DNA, 15 bp, Homo sapiens
ctccccagagcactg

SEQ ID NO: 1223883 - DNA, 13 bp, Homo sapiens
ctccccagagctg

SEQ ID NO: 1223884 - DNA, 16 bp, Homo sapiens
ctccccagatctccca

SEQ ID NO: 1223885 - DNA, 19 bp, Homo sapiens
ctccccagcattccagccc

SEQ ID NO: 1223886 - DNA, 22 bp, Homo sapiens
ctccccagcattccagcccctc

SEQ ID NO: 1223887 - DNA, 21 bp, Homo sapiens
ctccccagccagcccttccct

SEQ ID NO: 1223888 - DNA, 14 bp, Homo sapiens
ctccccagcccaat

SEQ ID NO: 1223889 - DNA, 15 bp, Homo sapiens
ctccccagccccagc

SEQ ID NO: 1223890 - DNA, 13 bp, Homo sapiens
ctccccagcctgg

SEQ ID NO: 1223891 - DNA, 14 bp, Homo sapiens
ctccccagcctggg

SEQ ID NO: 1223892 - DNA, 16 bp, Homo sapiens
ctccccagcctgggcc

SEQ ID NO: 1223893 - DNA, 13 bp, Homo sapiens
ctccccagctccc

SEQ ID NO: 1223894 - DNA, 23 bp, Homo sapiens
ctccccaggacccctgtccagga

SEQ ID NO: 1223895 - DNA, 12 bp, Homo sapiens
ctccccaggcct

SEQ ID NO: 1223896 - DNA, 13 bp, Homo sapiens
ctccccaggcctc

SEQ ID NO: 1223897 - DNA, 14 bp, Homo sapiens
ctccccaggcctcc

SEQ ID NO: 1223898 - DNA, 17 bp, Homo sapiens
ctccccaggcctccagc

SEQ ID NO: 1223899 - DNA, 11 bp, Homo sapiens
ctccccaggga

SEQ ID NO: 1223900 - DNA, 14 bp, Homo sapiens
ctccccagggagct

SEQ ID NO: 1223901 - DNA, 19 bp, Homo sapiens
ctccccagggagctctggg

SEQ ID NO: 1223902 - DNA, 21 bp, Homo sapiens
ctccccaggggagagggtctg

SEQ ID NO: 1223903 - DNA, 17 bp, Homo sapiens
ctccccaggtccagctc

SEQ ID NO: 1223904 - DNA, 22 bp, Homo sapiens
ctccccagtagctgggattaca

SEQ ID NO: 1223905 - DNA, 22 bp, Homo sapiens
ctccccagtctctcttaaagtt

SEQ ID NO: 1223906 - DNA, 11 bp, Homo sapiens
ctccccagtgc

SEQ ID NO: 1223907 - DNA, 13 bp, Homo sapiens
ctccccagtgcct

SEQ ID NO: 1223908 - DNA, 14 bp, Homo sapiens
ctccccagtgcctg

SEQ ID NO: 1223909 - DNA, 18 bp, Homo sapiens
ctccccagtgcctgccac

SEQ ID NO: 1223910 - DNA, 11 bp, Homo sapiens
ctccccagttc

SEQ ID NO: 1223911 - DNA, 13 bp, Homo sapiens
ctccccatacaca

SEQ ID NO: 1223912 - DNA, 16 bp, Homo sapiens
ctccccatacacacac

SEQ ID NO: 1223913 - DNA, 15 bp, Homo sapiens
ctccccatgcaggtg

SEQ ID NO: 1223914 - DNA, 20 bp, Homo sapiens
ctccccatgcaggtggtgtc

SEQ ID NO: 1223915 - DNA, 15 bp, Homo sapiens
ctccccatgccacgt

SEQ ID NO: 1223916 - DNA, 20 bp, Homo sapiens
ctccccatgtgtcctggttc

SEQ ID NO: 1223917 - DNA, 21 bp, Homo sapiens
ctccccatgtgtcctggttcc

SEQ ID NO: 1223918 - DNA, 23 bp, Homo sapiens
ctcccccaacccccaccccacac

SEQ ID NO: 1223919 - DNA, 16 bp, Homo sapiens
ctcccccacccatggg

SEQ ID NO: 1223920 - DNA, 12 bp, Homo sapiens
ctcccccagagt

SEQ ID NO: 1223921 - DNA, 22 bp, Homo sapiens
ctcccccagccatgccagctgg

SEQ ID NO: 1223922 - DNA, 16 bp, Homo sapiens
ctcccccagcgtcagt

SEQ ID NO: 1223923 - DNA, 17 bp, Homo sapiens
ctcccccatagcaccct

SEQ ID NO: 1223924 - DNA, 13 bp, Homo sapiens
ctccccccatccc

SEQ ID NO: 1223925 - DNA, 15 bp, Homo sapiens
ctccccccatcccag

SEQ ID NO: 1223926 - DNA, 19 bp, Homo sapiens
ctccccccatcccagggtc

SEQ ID NO: 1223927 - DNA, 19 bp, Homo sapiens
ctcccccgacactgctgca

SEQ ID NO: 1223928 - DNA, 22 bp, Homo sapiens
ctcccccgacactgctgcacca

SEQ ID NO: 1223929 - DNA, 18 bp, Homo sapiens
ctcccccgcagtccccag

SEQ ID NO: 1223930 - DNA, 12 bp, Homo sapiens
ctcccccgccac

SEQ ID NO: 1223931 - DNA, 22 bp, Homo sapiens
ctcccccgccagccccaagctg

SEQ ID NO: 1223932 - DNA, 22 bp, Homo sapiens
ctccccctaaacccctgtccca

SEQ ID NO: 1223933 - DNA, 14 bp, Homo sapiens
ctccccctacccat

SEQ ID NO: 1223934 - DNA, 15 bp, Homo sapiens
ctccccctacccata

SEQ ID NO: 1223935 - DNA, 19 bp, Homo sapiens
ctccccctcaacctcacca

SEQ ID NO: 1223936 - DNA, 13 bp, Homo sapiens
ctccccctcactt

SEQ ID NO: 1223937 - DNA, 12 bp, Homo sapiens
ctccccctcaga

SEQ ID NO: 1223938 - DNA, 14 bp, Homo sapiens
ctccccctccccag

SEQ ID NO: 1223939 - DNA, 15 bp, Homo sapiens
ctccccctcctccag

SEQ ID NO: 1223940 - DNA, 16 bp, Homo sapiens
ctccccctccttgtgc

SEQ ID NO: 1223941 - DNA, 18 bp, Homo sapiens
ctccatttttaaccactt

SEQ ID NO: 1223942 - DNA, 17 bp, Homo sapiens
ctcccaaagctcagact

SEQ ID NO: 1223943 - DNA, 16 bp, Homo sapiens
ctcccaaagtgctagg

SEQ ID NO: 1223944 - DNA, 15 bp, Homo sapiens
ctcccaaagtgctga

SEQ ID NO: 1223945 - DNA, 17 bp, Homo sapiens
ctcccaaagtgctggga

SEQ ID NO: 1223946 - DNA, 19 bp, Homo sapiens
ctcccaaagtgctgggatt

SEQ ID NO: 1223947 - DNA, 22 bp, Homo sapiens
ctcccaaagtgctgggattata

SEQ ID NO: 1223948 - DNA, 15 bp, Homo sapiens
ctcccaacagcgctt

SEQ ID NO: 1223949 - DNA, 19 bp, Homo sapiens
ctcccaacatgggagggat

SEQ ID NO: 1223950 - DNA, 19 bp, Homo sapiens
ctcccaacccccctcctgc

SEQ ID NO: 1223951 - DNA, 23 bp, Homo sapiens
ctcccaacccccctcctgctcct

SEQ ID NO: 1223952 - DNA, 12 bp, Homo sapiens
ctcccaaccctg

SEQ ID NO: 1223953 - DNA, 16 bp, Homo sapiens
ctcccaaccctggctt

SEQ ID NO: 1223954 - DNA, 12 bp, Homo sapiens
ctcccaacctca

SEQ ID NO: 1223955 - DNA, 22 bp, Homo sapiens
ctcccaacctcaatgccctgcc

SEQ ID NO: 1223956 - DNA, 19 bp, Homo sapiens
ctcccaacgagcctcctca

SEQ ID NO: 1223957 - DNA, 21 bp, Homo sapiens
ctcccaagggtgccctttggg

SEQ ID NO: 1223958 - DNA, 18 bp, Homo sapiens
ctcccaagtagctgggat

SEQ ID NO: 1223959 - DNA, 22 bp, Homo sapiens
ctcccaagtagctgggattaca

SEQ ID NO: 1223960 - DNA, 20 bp, Homo sapiens
ctcccaagttttaggacaaa

SEQ ID NO: 1223961 - DNA, 15 bp, Homo sapiens
ctcccaatcagcttt

SEQ ID NO: 1223962 - DNA, 14 bp, Homo sapiens
ctcccacacccacc

SEQ ID NO: 1223963 - DNA, 15 bp, Homo sapiens
ctcccacactcccaa

SEQ ID NO: 1223964 - DNA, 20 bp, Homo sapiens
ctcccacactgaaaccaaaa

SEQ ID NO: 1223965 - DNA, 22 bp, Homo sapiens
ctcccacacttcccacccccag

SEQ ID NO: 1223966 - DNA, 15 bp, Homo sapiens
ctcccacacttgctg

SEQ ID NO: 1223967 - DNA, 20 bp, Homo sapiens
ctcccacacttgtgccagcc

SEQ ID NO: 1223968 - DNA, 21 bp, Homo sapiens
ctcccacacttgtgccagccc

SEQ ID NO: 1223969 - DNA, 13 bp, Homo sapiens
ctcccacagacct

SEQ ID NO: 1223970 - DNA, 16 bp, Homo sapiens
ctcccacagacctgca

SEQ ID NO: 1223971 - DNA, 17 bp, Homo sapiens
ctcccacagacctgcag

SEQ ID NO: 1223972 - DNA, 18 bp, Homo sapiens
ctcccacagacctgcagt

SEQ ID NO: 1223973 - DNA, 18 bp, Homo sapiens
ctcccacagagtgctgga

SEQ ID NO: 1223974 - DNA, 14 bp, Homo sapiens
ctcccacaggccct

SEQ ID NO: 1223975 - DNA, 16 bp, Homo sapiens
ctcccacaggcccttc

SEQ ID NO: 1223976 - DNA, 18 bp, Homo sapiens
ctcccacatcccactgga

SEQ ID NO: 1223977 - DNA, 13 bp, Homo sapiens
ctcccaccacccc

SEQ ID NO: 1223978 - DNA, 13 bp, Homo sapiens
ctcccaccagagc

SEQ ID NO: 1223979 - DNA, 14 bp, Homo sapiens
ctcccacccacctg

SEQ ID NO: 1223980 - DNA, 19 bp, Homo sapiens
ctcccaccccacccccttc

SEQ ID NO: 1223981 - DNA, 17 bp, Homo sapiens
ctcccaccccactcagg

SEQ ID NO: 1223982 - DNA, 22 bp, Homo sapiens
ctcccaccccactcaggggacc

SEQ ID NO: 1223983 - DNA, 22 bp, Homo sapiens
ctcccaccccagaaatcactgt

SEQ ID NO: 1223984 - DNA, 23 bp, Homo sapiens
ctcccaccccagaaatcactgtg

SEQ ID NO: 1223985 - DNA, 18 bp, Homo sapiens
ctccctcagcccccagga

SEQ ID NO: 1223986 - DNA, 22 bp, Homo sapiens
ctccctcagcccccaggatctg

SEQ ID NO: 1223987 - DNA, 16 bp, Homo sapiens
ctccctcagcccctct

SEQ ID NO: 1223988 - DNA, 14 bp, Homo sapiens
ctccctcagcctcc

SEQ ID NO: 1223989 - DNA, 18 bp, Homo sapiens
ctccctcagctctctggg

SEQ ID NO: 1223990 - DNA, 13 bp, Homo sapiens
ctccctccaagcc

SEQ ID NO: 1223991 - DNA, 15 bp, Homo sapiens
ctccctccaagcctg

SEQ ID NO: 1223992 - DNA, 20 bp, Homo sapiens
ctccctccaagcctggcacc

SEQ ID NO: 1223993 - DNA, 21 bp, Homo sapiens
ctccctccaagcctggcaccc

SEQ ID NO: 1223994 - DNA, 12 bp, Homo sapiens
ctccctccaccc

SEQ ID NO: 1223995 - DNA, 15 bp, Homo sapiens
ctccctccaccccag

SEQ ID NO: 1223996 - DNA, 15 bp, Homo sapiens
ctccctccactcctc

SEQ ID NO: 1223997 - DNA, 13 bp, Homo sapiens
ctccctcccacac

SEQ ID NO: 1223998 - DNA, 23 bp, Homo sapiens
ctccctcccagaaaaactggctc

SEQ ID NO: 1223999 - DNA, 18 bp, Homo sapiens
ctccctcccagcgctctg

SEQ ID NO: 1224000 - DNA, 13 bp, Homo sapiens
ctccctcccagct

SEQ ID NO: 1224001 - DNA, 14 bp, Homo sapiens
ctccctcccagctg

SEQ ID NO: 1224002 - DNA, 16 bp, Homo sapiens
ctccctgggacacaga

SEQ ID NO: 1224003 - DNA, 10 bp, Homo sapiens
ctccctgggc

SEQ ID NO: 1224004 - DNA, 12 bp, Homo sapiens
ctccctgggcct

SEQ ID NO: 1224005 - DNA, 21 bp, Homo sapiens
ctccctggtgcctctgtgcac

SEQ ID NO: 1224006 - DNA, 22 bp, Homo sapiens
ctccctggtgcctctgtgcaca

SEQ ID NO: 1224007 - DNA, 16 bp, Homo sapiens
ctccctggttgcctct

SEQ ID NO: 1224008 - DNA, 18 bp, Homo sapiens
ctccctgtagctctgcct

SEQ ID NO: 1224009 - DNA, 20 bp, Homo sapiens
ctccctgtagctctgcctcc

SEQ ID NO: 1224010 - DNA, 18 bp, Homo sapiens
ctccctgtcacacactgg

SEQ ID NO: 1224011 - DNA, 20 bp, Homo sapiens
ctccctgtcacacactggac

SEQ ID NO: 1224012 - DNA, 21 bp, Homo sapiens
ctccctgtcacacactggacc

SEQ ID NO: 1224013 - DNA, 22 bp, Homo sapiens
ctccctgtcacacactggaccc

SEQ ID NO: 1224014 - DNA, 15 bp, Homo sapiens
ctccctgtcccaggg

SEQ ID NO: 1224015 - DNA, 17 bp, Homo sapiens
ctccctgtcccagggcc

SEQ ID NO: 1224016 - DNA, 18 bp, Homo sapiens
ctccctgtcccagggccc

SEQ ID NO: 1224017 - DNA, 18 bp, Homo sapiens
ctccctgtcccttccttt

SEQ ID NO: 1224018 - DNA, 20 bp, Homo sapiens
ctccctgtcccttcctttct

SEQ ID NO: 1224019 - DNA, 11 bp, Homo sapiens
ctccctgtcct

SEQ ID NO: 1224020 - DNA, 20 bp, Homo sapiens
ctccctgtctccagctgcct

SEQ ID NO: 1224021 - DNA, 16 bp, Homo sapiens
ctccctgtctccaggg

SEQ ID NO: 1224022 - DNA, 14 bp, Homo sapiens
ctccctgtgccccc

SEQ ID NO: 1224023 - DNA, 15 bp, Homo sapiens
ctccctgtgccccca

SEQ ID NO: 1224024 - DNA, 19 bp, Homo sapiens
ctccctgtgcccccagcct

SEQ ID NO: 1224025 - DNA, 20 bp, Homo sapiens
ctccctgtgcccccagcctc

SEQ ID NO: 1224026 - DNA, 22 bp, Homo sapiens
ctccctgtgcccccagcctcag

SEQ ID NO: 1224027 - DNA, 22 bp, Homo sapiens
ctccctgtgggggtggccatcc

SEQ ID NO: 1224028 - DNA, 17 bp, Homo sapiens
ctccctgtgttacccag

SEQ ID NO: 1224029 - DNA, 16 bp, Homo sapiens
ctccctgtgttctggg

SEQ ID NO: 1224030 - DNA, 19 bp, Homo sapiens
ctccctgtgttctgggctg

SEQ ID NO: 1224031 - DNA, 21 bp, Homo sapiens
ctccctgtgttctgggctggg

SEQ ID NO: 1224032 - DNA, 22 bp, Homo sapiens
ctccctgtgttctgggctgggg

SEQ ID NO: 1224033 - DNA, 19 bp, Homo sapiens
ctccctgttatctgctaga

SEQ ID NO: 1224034 - DNA, 23 bp, Homo sapiens
ctccctgttcacggtgacacagg

SEQ ID NO: 1224035 - DNA, 22 bp, Homo sapiens
ctcccttaccctcctctgctgg

SEQ ID NO: 1224036 - DNA, 20 bp, Homo sapiens
ctcccttcaaccattcccca

SEQ ID NO: 1224037 - DNA, 23 bp, Homo sapiens
ctcccttcaaccattccccatgg

SEQ ID NO: 1224038 - DNA, 14 bp, Homo sapiens
ctcccttcccacct

SEQ ID NO: 1224039 - DNA, 14 bp, Homo sapiens
ctcccttcccagtg

SEQ ID NO: 1224040 - DNA, 11 bp, Homo sapiens
ctcccttccct

SEQ ID NO: 1224041 - DNA, 19 bp, Homo sapiens
ctcccttccctccatagcc

SEQ ID NO: 1224042 - DNA, 15 bp, Homo sapiens
ctcccttcccttccc

SEQ ID NO: 1224043 - DNA, 19 bp, Homo sapiens
ctcccttccgaccctctgg

SEQ ID NO: 1224044 - DNA, 22 bp, Homo sapiens
ctcccttccgaccctctgggaa

SEQ ID NO: 1224045 - DNA, 23 bp, Homo sapiens
ctcccttccgaccctctgggaac

SEQ ID NO: 1224046 - DNA, 19 bp, Homo sapiens
ctcccttccgtccatcccc

SEQ ID NO: 1224047 - DNA, 15 bp, Homo sapiens
ctcccttcctgccac

SEQ ID NO: 1224048 - DNA, 14 bp, Homo sapiens
ctcccttcctggcc

SEQ ID NO: 1224049 - DNA, 16 bp, Homo sapiens
ctcccttcctggcctc

SEQ ID NO: 1224050 - DNA, 17 bp, Homo sapiens
ctcccttcctggcctca

SEQ ID NO: 1224051 - DNA, 22 bp, Homo sapiens
ctcccttccttgggcagaatga

SEQ ID NO: 1224052 - DNA, 19 bp, Homo sapiens
ctcccttccttttccctgc

SEQ ID NO: 1224053 - DNA, 14 bp, Homo sapiens
ctcccttctccctg

SEQ ID NO: 1224054 - DNA, 17 bp, Homo sapiens
ctcccttctccctggat

SEQ ID NO: 1224055 - DNA, 19 bp, Homo sapiens
ctcccttctcgtgtttgct

SEQ ID NO: 1224056 - DNA, 21 bp, Homo sapiens
ctcccttcttgggtctgccct

SEQ ID NO: 1224057 - DNA, 17 bp, Homo sapiens
ctcccttcttttatcct

SEQ ID NO: 1224058 - DNA, 18 bp, Homo sapiens
ctcccttgatggggtcca

SEQ ID NO: 1224059 - DNA, 17 bp, Homo sapiens
ctcccttgccccaggcc

SEQ ID NO: 1224060 - DNA, 18 bp, Homo sapiens
ctcccttgccccaggcca

SEQ ID NO: 1224061 - DNA, 21 bp, Homo sapiens
ctcccttgccccaggccaggt

SEQ ID NO: 1224062 - DNA, 21 bp, Homo sapiens
ctcccttgcctttcgaggcct

SEQ ID NO: 1224063 - DNA, 15 bp, Homo sapiens
ctcccttgctggccc

SEQ ID NO: 1224064 - DNA, 17 bp, Homo sapiens
ctcccttgctggcccca

SEQ ID NO: 1224065 - DNA, 23 bp, Homo sapiens
ctcccttgctggccccagccctg

SEQ ID NO: 1224066 - DNA, 18 bp, Homo sapiens
ctcccttggaaacctgcc

SEQ ID NO: 1224067 - DNA, 21 bp, Homo sapiens
ctcccttggtggcaagagccc

SEQ ID NO: 1224068 - DNA, 19 bp, Homo sapiens
ctcccttgtcctgcttggg

SEQ ID NO: 1224069 - DNA, 23 bp, Homo sapiens
ctcccttgtttactctgttacca

SEQ ID NO: 1224070 - DNA, 20 bp, Homo sapiens
ctccctttagtggagccagg

SEQ ID NO: 1224071 - DNA, 14 bp, Homo sapiens
ctccctttcccttc

SEQ ID NO: 1224072 - DNA, 17 bp, Homo sapiens
ctccctttctcaggagc

SEQ ID NO: 1224073 - DNA, 20 bp, Homo sapiens
ctccctttctctctcctctc

SEQ ID NO: 1224074 - DNA, 22 bp, Homo sapiens
ctccctttctctctcctctctg

SEQ ID NO: 1224075 - DNA, 16 bp, Homo sapiens
ctccctttctcttctt

SEQ ID NO: 1224076 - DNA, 19 bp, Homo sapiens
ctcccttttacattctgtg

SEQ ID NO: 1224077 - DNA, 17 bp, Homo sapiens
ctcccttttgtccttcc

SEQ ID NO: 1224078 - DNA, 14 bp, Homo sapiens
ctccctttttatat

SEQ ID NO: 1224079 - DNA, 19 bp, Homo sapiens
ctccgaaattccaaggccc

SEQ ID NO: 1224080 - DNA, 13 bp, Homo sapiens
ctccgaagaaaag

SEQ ID NO: 1224081 - DNA, 14 bp, Homo sapiens
ctccgacctctctc

SEQ ID NO: 1224082 - DNA, 19 bp, Homo sapiens
ctccgacctctctcagccc

SEQ ID NO: 1224083 - DNA, 16 bp, Homo sapiens
ctccgacttcccctgg

SEQ ID NO: 1224084 - DNA, 17 bp, Homo sapiens
ctccgacttcccctggg

SEQ ID NO: 1224085 - DNA, 14 bp, Homo sapiens
ctccgagagcagtg

SEQ ID NO: 1224086 - DNA, 20 bp, Homo sapiens
ctccgagagcagtgggcagg

SEQ ID NO: 1224087 - DNA, 15 bp, Homo sapiens
ctccgagaggtgggc

SEQ ID NO: 1224088 - DNA, 17 bp, Homo sapiens
ctccgagaggtgggcca

SEQ ID NO: 1224089 - DNA, 18 bp, Homo sapiens
ctccgagaggtgggccag

SEQ ID NO: 1224090 - DNA, 22 bp, Homo sapiens
ctccgagaggtgggccagtctg

SEQ ID NO: 1224091 - DNA, 17 bp, Homo sapiens
ctccgaggactggactg

SEQ ID NO: 1224092 - DNA, 13 bp, Homo sapiens
ctccgaggccagt

SEQ ID NO: 1224093 - DNA, 14 bp, Homo sapiens
ctccgaggctcccc

SEQ ID NO: 1224094 - DNA, 18 bp, Homo sapiens
ctccgaggctccccgcct

SEQ ID NO: 1224095 - DNA, 23 bp, Homo sapiens
ctccgaggctccccgcctccact

SEQ ID NO: 1224096 - DNA, 19 bp, Homo sapiens
ctccgagggcggccaggga

SEQ ID NO: 1224097 - DNA, 20 bp, Homo sapiens
ctccgagggcggccagggac

SEQ ID NO: 1224098 - DNA, 21 bp, Homo sapiens
ctccgagggcggccagggaca

SEQ ID NO: 1224099 - DNA, 14 bp, Homo sapiens
ctccgatgcctggc

SEQ ID NO: 1224100 - DNA, 15 bp, Homo sapiens
ctccgcagttcctgt

SEQ ID NO: 1224101 - DNA, 14 bp, Homo sapiens
ctccgcatcacctc

SEQ ID NO: 1224102 - DNA, 21 bp, Homo sapiens
ctccgcatcacctcaccaagg

SEQ ID NO: 1224103 - DNA, 19 bp, Homo sapiens
ctccgccagaccccgtggc

SEQ ID NO: 1224104 - DNA, 23 bp, Homo sapiens
ctccgccagaccccgtggctctg

SEQ ID NO: 1224105 - DNA, 14 bp, Homo sapiens
ctccgccagcctcc

SEQ ID NO: 1224106 - DNA, 15 bp, Homo sapiens
ctccgccagcctcct

SEQ ID NO: 1224107 - DNA, 18 bp, Homo sapiens
ctccgccagcctcctctg

SEQ ID NO: 1224108 - DNA, 14 bp, Homo sapiens
ctccgccattccaa

SEQ ID NO: 1224109 - DNA, 16 bp, Homo sapiens
ctccgcccagcctctc

SEQ ID NO: 1224110 - DNA, 17 bp, Homo sapiens
ctccgcccccagcctat

SEQ ID NO: 1224111 - DNA, 13 bp, Homo sapiens
ctccgccctgcca

SEQ ID NO: 1224112 - DNA, 14 bp, Homo sapiens
ctccgccctgccac

SEQ ID NO: 1224113 - DNA, 16 bp, Homo sapiens
ctccgccctgccactc

SEQ ID NO: 1224114 - DNA, 17 bp, Homo sapiens
ctccgccctgccactca

SEQ ID NO: 1224115 - DNA, 16 bp, Homo sapiens
ctccgcgccgatgcca

SEQ ID NO: 1224116 - DNA, 19 bp, Homo sapiens
ctccgcgggagaccccttg

SEQ ID NO: 1224117 - DNA, 21 bp, Homo sapiens
ctccgcgggagaccccttgtt

SEQ ID NO: 1224118 - DNA, 14 bp, Homo sapiens
ctccgctcccaccg

SEQ ID NO: 1224119 - DNA, 17 bp, Homo sapiens
ctccgctcccaccgccc

SEQ ID NO: 1224120 - DNA, 17 bp, Homo sapiens
ctccgcttgccagaggc

SEQ ID NO: 1224121 - DNA, 22 bp, Homo sapiens
ctccgcttgccagaggccctcg

SEQ ID NO: 1224122 - DNA, 13 bp, Homo sapiens
ctccggagcctca

SEQ ID NO: 1224123 - DNA, 21 bp, Homo sapiens
ctccggagcctcatgttctct

SEQ ID NO: 1224124 - DNA, 17 bp, Homo sapiens
ctccggaggactcacca

SEQ ID NO: 1224125 - DNA, 13 bp, Homo sapiens
ctccggaggactg

SEQ ID NO: 1224126 - DNA, 14 bp, Homo sapiens
ctcctgaggacagc

SEQ ID NO: 1224127 - DNA, 17 bp, Homo sapiens
ctcctgaggacagctgt

SEQ ID NO: 1224128 - DNA, 21 bp, Homo sapiens
ctcctgaggacagctgtcctc

SEQ ID NO: 1224129 - DNA, 16 bp, Homo sapiens
ctcctgaggctttgga

SEQ ID NO: 1224130 - DNA, 23 bp, Homo sapiens
ctcctgagggaggacctggggca

SEQ ID NO: 1224131 - DNA, 13 bp, Homo sapiens
ctcctgagggctc

SEQ ID NO: 1224132 - DNA, 14 bp, Homo sapiens
ctcctgagggctcc

SEQ ID NO: 1224133 - DNA, 17 bp, Homo sapiens
ctcctgagggctccatg

SEQ ID NO: 1224134 - DNA, 16 bp, Homo sapiens
ctcctgaggggcatct

SEQ ID NO: 1224135 - DNA, 23 bp, Homo sapiens
ctcctgaggggcatctgcccctc

SEQ ID NO: 1224136 - DNA, 14 bp, Homo sapiens
ctcctgagtagctg

SEQ ID NO: 1224137 - DNA, 15 bp, Homo sapiens
ctcctgagtagctgg

SEQ ID NO: 1224138 - DNA, 17 bp, Homo sapiens
ctcctgagtagctgggc

SEQ ID NO: 1224139 - DNA, 22 bp, Homo sapiens
ctcctgagtgccccacttctgg

SEQ ID NO: 1224140 - DNA, 23 bp, Homo sapiens
ctcctgagtgccccacttctggc

SEQ ID NO: 1224141 - DNA, 17 bp, Homo sapiens
ctcctgatggccaagag

SEQ ID NO: 1224142 - DNA, 20 bp, Homo sapiens
ctcctgatggccaagagcat

SEQ ID NO: 1224143 - DNA, 23 bp, Homo sapiens
ctcctgatggtgtcattctgcct

SEQ ID NO: 1224144 - DNA, 19 bp, Homo sapiens
ctcctgatgtagcttgaga

SEQ ID NO: 1224145 - DNA, 15 bp, Homo sapiens
ctcctgattatttat

SEQ ID NO: 1224146 - DNA, 17 bp, Homo sapiens
ctcctgatttctctgaa

SEQ ID NO: 1224147 - DNA, 14 bp, Homo sapiens
ctcctgattttgta

SEQ ID NO: 1224148 - DNA, 15 bp, Homo sapiens
ctcctgattttgtag

SEQ ID NO: 1224149 - DNA, 14 bp, Homo sapiens
ctcctgcacacaga

SEQ ID NO: 1224150 - DNA, 22 bp, Homo sapiens
ctcctgcacacagaatgctcag

SEQ ID NO: 1224151 - DNA, 15 bp, Homo sapiens
ctcctgcacacaggg

SEQ ID NO: 1224152 - DNA, 15 bp, Homo sapiens
ctcctgcacttactt

SEQ ID NO: 1224153 - DNA, 22 bp, Homo sapiens
ctcctgcacttacttgcttatt

SEQ ID NO: 1224154 - DNA, 16 bp, Homo sapiens
ctcctgcagacacctg

SEQ ID NO: 1224155 - DNA, 14 bp, Homo sapiens
ctcctgcagtttgg

SEQ ID NO: 1224156 - DNA, 22 bp, Homo sapiens
ctcctgccacatggagccccct

SEQ ID NO: 1224157 - DNA, 15 bp, Homo sapiens
ctcctgccaccagca

SEQ ID NO: 1224158 - DNA, 18 bp, Homo sapiens
ctcctgccaccccttcct

SEQ ID NO: 1224159 - DNA, 20 bp, Homo sapiens
ctcctgccaccccttcctcc

SEQ ID NO: 1224160 - DNA, 21 bp, Homo sapiens
ctcctgccaccccttcctccc

SEQ ID NO: 1224161 - DNA, 11 bp, Homo sapiens
ctcctgccagg

SEQ ID NO: 1224162 - DNA, 15 bp, Homo sapiens
ctcctgccaggcaca

SEQ ID NO: 1224163 - DNA, 22 bp, Homo sapiens
ctcctgccaggcacacacagcc

SEQ ID NO: 1224164 - DNA, 13 bp, Homo sapiens
ctcctgcccacgg

SEQ ID NO: 1224165 - DNA, 12 bp, Homo sapiens
ctcctgcccagc

SEQ ID NO: 1224166 - DNA, 18 bp, Homo sapiens
ctcctgcccagctcctca

SEQ ID NO: 1224167 - DNA, 20 bp, Homo sapiens
ctcctgcccagctcctcaca

SEQ ID NO: 1224168 - DNA, 13 bp, Homo sapiens
ctcctgcccagga

SEQ ID NO: 1224169 - DNA, 14 bp, Homo sapiens
ctcctgcccaggac

SEQ ID NO: 1224170 - DNA, 20 bp, Homo sapiens
ctcctgcccaggactgcatt

SEQ ID NO: 1224171 - DNA, 15 bp, Homo sapiens
ctcctgcccaggaga

SEQ ID NO: 1224172 - DNA, 16 bp, Homo sapiens
ctcctgcccaggagag

SEQ ID NO: 1224173 - DNA, 22 bp, Homo sapiens
ctcctgcccaggagagccagcc

SEQ ID NO: 1224174 - DNA, 13 bp, Homo sapiens
ctcctgccccctg

SEQ ID NO: 1224175 - DNA, 16 bp, Homo sapiens
ctcctgccccctgcca

SEQ ID NO: 1224176 - DNA, 14 bp, Homo sapiens
ctcctgccctcgtc

SEQ ID NO: 1224177 - DNA, 22 bp, Homo sapiens
ctcctgccctcgtctccctggc

SEQ ID NO: 1224178 - DNA, 12 bp, Homo sapiens
ctcctgccctct

SEQ ID NO: 1224179 - DNA, 19 bp, Homo sapiens
ctcctgccctctgctctgc

SEQ ID NO: 1224180 - DNA, 24 bp, Homo sapiens
ctcctgccctctgctctgcctgga

SEQ ID NO: 1224181 - DNA, 12 bp, Homo sapiens
ctcctgccctgt

SEQ ID NO: 1224182 - DNA, 13 bp, Homo sapiens
ctcctgccctgtt

SEQ ID NO: 1224183 - DNA, 15 bp, Homo sapiens
ctcctgccgactcct

SEQ ID NO: 1224184 - DNA, 14 bp, Homo sapiens
ctcctgcctactca

SEQ ID NO: 1224185 - DNA, 15 bp, Homo sapiens
ctcctgcctcagcct

SEQ ID NO: 1224186 - DNA, 16 bp, Homo sapiens
ctcctgcctcagcctc

SEQ ID NO: 1224187 - DNA, 16 bp, Homo sapiens
ctcctgcctcagcctt

SEQ ID NO: 1224188 - DNA, 12 bp, Homo sapiens
ctcctgcctgag

SEQ ID NO: 1224189 - DNA, 15 bp, Homo sapiens
ctcctgcctgccctg

SEQ ID NO: 1224190 - DNA, 16 bp, Homo sapiens
ctcctgcctgccctgc

SEQ ID NO: 1224191 - DNA, 22 bp, Homo sapiens
ctcctgcctgccctgcctcagc

SEQ ID NO: 1224192 - DNA, 18 bp, Homo sapiens
ctcctgcctgtagcagtg

SEQ ID NO: 1224193 - DNA, 19 bp, Homo sapiens
ctcctgcctgtagcagtga

SEQ ID NO: 1224194 - DNA, 19 bp, Homo sapiens
ctcctgccttcctcctggg

SEQ ID NO: 1224195 - DNA, 14 bp, Homo sapiens
ctcctgcggctcag

SEQ ID NO: 1224196 - DNA, 19 bp, Homo sapiens
ctcctgcggctcagccttg

SEQ ID NO: 1224197 - DNA, 16 bp, Homo sapiens
ctcctgcggctgcctg

SEQ ID NO: 1224198 - DNA, 13 bp, Homo sapiens
ctcctgctcctcc

SEQ ID NO: 1224199 - DNA, 14 bp, Homo sapiens
ctcctgctcctccc

SEQ ID NO: 1224200 - DNA, 16 bp, Homo sapiens
ctcctgctcctccctg

SEQ ID NO: 1224201 - DNA, 21 bp, Homo sapiens
ctcctgctcctccctgccccc

SEQ ID NO: 1224202 - DNA, 14 bp, Homo sapiens
ctcctgctctcata

SEQ ID NO: 1224203 - DNA, 16 bp, Homo sapiens
ctcctgctgaccttct

SEQ ID NO: 1224204 - DNA, 14 bp, Homo sapiens
ctcctgctgggcgt

SEQ ID NO: 1224205 - DNA, 21 bp, Homo sapiens
ctcctgcttcccctccctacc

SEQ ID NO: 1224206 - DNA, 19 bp, Homo sapiens
ctcctgcttctctcagcca

SEQ ID NO: 1224207 - DNA, 23 bp, Homo sapiens
ctcctgcttgtactaagccagga

SEQ ID NO: 1224208 - DNA, 18 bp, Homo sapiens
ctcctgcttttctgtcct

SEQ ID NO: 1224209 - DNA, 19 bp, Homo sapiens
ctcctgcttttctgtcctg

SEQ ID NO: 1224210 - DNA, 20 bp, Homo sapiens
ctcctgcttttctgtcctgg

SEQ ID NO: 1224211 - DNA, 17 bp, Homo sapiens
ctcctggaaaggctcag

SEQ ID NO: 1224212 - DNA, 20 bp, Homo sapiens
ctcctggaaaggctcagtct

SEQ ID NO: 1224213 - DNA, 23 bp, Homo sapiens
ctcctggaaaggctcagtctcag

SEQ ID NO: 1224214 - DNA, 16 bp, Homo sapiens
ctcctggaaccaatcc

SEQ ID NO: 1224215 - DNA, 17 bp, Homo sapiens
ctcctggaaccttgctg

SEQ ID NO: 1224216 - DNA, 19 bp, Homo sapiens
ctcctggaaccttgctgtc

SEQ ID NO: 1224217 - DNA, 17 bp, Homo sapiens
ctcctggaagctgtgtc

SEQ ID NO: 1224218 - DNA, 21 bp, Homo sapiens
ctcctggaatcagtatttcct

SEQ ID NO: 1224219 - DNA, 18 bp, Homo sapiens
ctcctggacattttttca

SEQ ID NO: 1224220 - DNA, 11 bp, Homo sapiens
ctcctggacct

SEQ ID NO: 1224221 - DNA, 21 bp, Homo sapiens
ctcctggaccttgacagagca

SEQ ID NO: 1224222 - DNA, 13 bp, Homo sapiens
ctcctggactccg

SEQ ID NO: 1224223 - DNA, 22 bp, Homo sapiens
ctcctggactccggaggactga

SEQ ID NO: 1224224 - DNA, 23 bp, Homo sapiens
ctcctggactccggaggactgag

SEQ ID NO: 1224225 - DNA, 17 bp, Homo sapiens
ctcctggagatagctgg

SEQ ID NO: 1224226 - DNA, 19 bp, Homo sapiens
ctcctggagatagctgggg

SEQ ID NO: 1224227 - DNA, 17 bp, Homo sapiens
ctcctggagcagaaagt

SEQ ID NO: 1224228 - DNA, 16 bp, Homo sapiens
ctcctggagcatccca

SEQ ID NO: 1224229 - DNA, 17 bp, Homo sapiens
ctcctggagctctgtgg

SEQ ID NO: 1224230 - DNA, 18 bp, Homo sapiens
ctcctggaggcaggggct

SEQ ID NO: 1224231 - DNA, 10 bp, Homo sapiens
ctcctggcag

SEQ ID NO: 1224232 - DNA, 23 bp, Homo sapiens
ctcctggccagacgctgccgctg

SEQ ID NO: 1224233 - DNA, 17 bp, Homo sapiens
ctcctggcccgccctca

SEQ ID NO: 1224234 - DNA, 18 bp, Homo sapiens
ctcctggcccgccctcac

SEQ ID NO: 1224235 - DNA, 20 bp, Homo sapiens
ctcctggccggggcccctca

SEQ ID NO: 1224236 - DNA, 18 bp, Homo sapiens
ctcctggcctatccgctg

SEQ ID NO: 1224237 - DNA, 23 bp, Homo sapiens
ctcctggcctggccatctccctc

SEQ ID NO: 1224238 - DNA, 15 bp, Homo sapiens
ctcctggccttcctc

SEQ ID NO: 1224239 - DNA, 16 bp, Homo sapiens
ctcctggccttcctcg

SEQ ID NO: 1224240 - DNA, 18 bp, Homo sapiens
ctcctggcgagttctctt

SEQ ID NO: 1224241 - DNA, 20 bp, Homo sapiens
ctcctggctcaagccctgaa

SEQ ID NO: 1224242 - DNA, 22 bp, Homo sapiens
ctcctggctcttgatacccccc

SEQ ID NO: 1224243 - DNA, 12 bp, Homo sapiens
ctcctggctgcc

SEQ ID NO: 1224244 - DNA, 14 bp, Homo sapiens
ctcctggctgccag

SEQ ID NO: 1224245 - DNA, 17 bp, Homo sapiens
ctcctggctgccaggcg

SEQ ID NO: 1224246 - DNA, 18 bp, Homo sapiens
ctcctggctgccaggcgt

SEQ ID NO: 1224247 - DNA, 19 bp, Homo sapiens
ctcctggctgtctgaggct

SEQ ID NO: 1224248 - DNA, 16 bp, Homo sapiens
ctcctggctgtgccca

SEQ ID NO: 1224249 - DNA, 18 bp, Homo sapiens
ctcctggctgtgcccagc

SEQ ID NO: 1224250 - DNA, 21 bp, Homo sapiens
ctcctggctgtgcccagcagg

SEQ ID NO: 1224251 - DNA, 23 bp, Homo sapiens
ctcctgacccagtccccgtgccc

SEQ ID NO: 1224252 - DNA, 18 bp, Homo sapiens
ctcctgacccctccctgc

SEQ ID NO: 1224253 - DNA, 20 bp, Homo sapiens
ctcctgacccctccctgcag

SEQ ID NO: 1224254 - DNA, 13 bp, Homo sapiens
ctcctgaccctcc

SEQ ID NO: 1224255 - DNA, 12 bp, Homo sapiens
ctcctgacctca

SEQ ID NO: 1224256 - DNA, 19 bp, Homo sapiens
ctcctgacctcaagtgatc

SEQ ID NO: 1224257 - DNA, 16 bp, Homo sapiens
ctcctgacctgtcacc

SEQ ID NO: 1224258 - DNA, 16 bp, Homo sapiens
ctcctgagaaatgtta

SEQ ID NO: 1224259 - DNA, 22 bp, Homo sapiens
ctcctgagaaggcgaggagagt

SEQ ID NO: 1224260 - DNA, 14 bp, Homo sapiens
ctcctgagcctgtg

SEQ ID NO: 1224261 - DNA, 19 bp, Homo sapiens
ctcctgagcctgtgggtcc

SEQ ID NO: 1224262 - DNA, 12 bp, Homo sapiens
ctccttcccctg

SEQ ID NO: 1224263 - DNA, 22 bp, Homo sapiens
ctccttcccctgcacctggcct

SEQ ID NO: 1224264 - DNA, 14 bp, Homo sapiens
ctccttccctcctg

SEQ ID NO: 1224265 - DNA, 19 bp, Homo sapiens
ctccttccctcctgtgccc

SEQ ID NO: 1224266 - DNA, 16 bp, Homo sapiens
ctccttcctcagcctc

SEQ ID NO: 1224267 - DNA, 12 bp, Homo sapiens
ctccttcctggg

SEQ ID NO: 1224268 - DNA, 13 bp, Homo sapiens
ctccttcctggga

SEQ ID NO: 1224269 - DNA, 11 bp, Homo sapiens
ctccttcctgt

SEQ ID NO: 1224270 - DNA, 15 bp, Homo sapiens
ctccttccttcagga

SEQ ID NO: 1224271 - DNA, 19 bp, Homo sapiens
ctccttccttcaggactct

SEQ ID NO: 1224272 - DNA, 22 bp, Homo sapiens
ctccttccttgctgtcctaggc

SEQ ID NO: 1224273 - DNA, 18 bp, Homo sapiens
ctccttcgtatcccgagt

SEQ ID NO: 1224274 - DNA, 13 bp, Homo sapiens
ctccttctcccca

SEQ ID NO: 1224275 - DNA, 13 bp, Homo sapiens
ctccttctccctt

SEQ ID NO: 1224276 - DNA, 12 bp, Homo sapiens
ctccttctcctt

SEQ ID NO: 1224277 - DNA, 13 bp, Homo sapiens
ctccttcttgctt

SEQ ID NO: 1224278 - DNA, 18 bp, Homo sapiens
ctccttgaagcaaatgtg

SEQ ID NO: 1224279 - DNA, 20 bp, Homo sapiens
ctccttgcaaccaggcagct

SEQ ID NO: 1224280 - DNA, 22 bp, Homo sapiens
ctccttgcaaccaggcagctga

SEQ ID NO: 1224281 - DNA, 22 bp, Homo sapiens
ctccttgccccccgccctcatg

SEQ ID NO: 1224282 - DNA, 20 bp, Homo sapiens
ctccttgccttgcttctccc

SEQ ID NO: 1224283 - DNA, 14 bp, Homo sapiens
ctccttgctgaccc

SEQ ID NO: 1224284 - DNA, 15 bp, Homo sapiens
ctccttgctgacccc

SEQ ID NO: 1224285 - DNA, 17 bp, Homo sapiens
ctccttgctgaccccag

SEQ ID NO: 1224286 - DNA, 18 bp, Homo sapiens
ctccttgctgaccccagg

SEQ ID NO: 1224287 - DNA, 22 bp, Homo sapiens
ctccttgctgaccccaggtcag

SEQ ID NO: 1224288 - DNA, 16 bp, Homo sapiens
ctccttgctgcattga

SEQ ID NO: 1224289 - DNA, 18 bp, Homo sapiens
ctccttggcacccccatg

SEQ ID NO: 1224290 - DNA, 14 bp, Homo sapiens
ctccttggccacag

SEQ ID NO: 1224291 - DNA, 22 bp, Homo sapiens
ctccttggcggcaaaagcccat

SEQ ID NO: 1224292 - DNA, 23 bp, Homo sapiens
ctccttggcggcaaaagcccatt

SEQ ID NO: 1224293 - DNA, 17 bp, Homo sapiens
ctccttggctgcagcca

SEQ ID NO: 1224294 - DNA, 22 bp, Homo sapiens
ctccttggctgtctgtgggccg

SEQ ID NO: 1224295 - DNA, 13 bp, Homo sapiens
ctccttgggccct

SEQ ID NO: 1224296 - DNA, 19 bp, Homo sapiens
ctccttgggccctttgagt

SEQ ID NO: 1224297 - DNA, 13 bp, Homo sapiens
ctccttgggctcc

SEQ ID NO: 1224298 - DNA, 15 bp, Homo sapiens
ctccttgggctcctg

SEQ ID NO: 1224299 - DNA, 16 bp, Homo sapiens
ctccttgggctcctgg

SEQ ID NO: 1224300 - DNA, 22 bp, Homo sapiens
ctccttgggctcctggctgcca

SEQ ID NO: 1224301 - DNA, 16 bp, Homo sapiens
ctccttggtttgctag

SEQ ID NO: 1224302 - DNA, 22 bp, Homo sapiens
ctccttggtttgctagtatctt

SEQ ID NO: 1224303 - DNA, 16 bp, Homo sapiens
ctccttgtaaagactg

SEQ ID NO: 1224304 - DNA, 20 bp, Homo sapiens
ctccttgtggactggctgtg

SEQ ID NO: 1224305 - DNA, 15 bp, Homo sapiens
ctccttgtggccttt

SEQ ID NO: 1224306 - DNA, 16 bp, Homo sapiens
ctccttgtggcctttt

SEQ ID NO: 1224307 - DNA, 15 bp, Homo sapiens
ctcctttaattgtaa

SEQ ID NO: 1224308 - DNA, 23 bp, Homo sapiens
ctcctttatctgtaattgtaatt

SEQ ID NO: 1224309 - DNA, 13 bp, Homo sapiens
ctcctttcacaac

SEQ ID NO: 1224310 - DNA, 20 bp, Homo sapiens
ctcctttcacaaccttctgt

SEQ ID NO: 1224311 - DNA, 18 bp, Homo sapiens
ctcctttcatcacactgg

SEQ ID NO: 1224312 - DNA, 21 bp, Homo sapiens
ctcctttcccttattgcctcc

SEQ ID NO: 1224313 - DNA, 13 bp, Homo sapiens
ctcctttcctctg

SEQ ID NO: 1224314 - DNA, 14 bp, Homo sapiens
ctcctttcctctga

SEQ ID NO: 1224315 - DNA, 14 bp, Homo sapiens
ctcctttctccagc

SEQ ID NO: 1224316 - DNA, 19 bp, Homo sapiens
ctcctttctccagccagca

SEQ ID NO: 1224317 - DNA, 14 bp, Homo sapiens
ctcctttctccctg

SEQ ID NO: 1224318 - DNA, 14 bp, Homo sapiens
ctcctttctcctgt

SEQ ID NO: 1224319 - DNA, 17 bp, Homo sapiens
ctcctttctcctgtgaa

SEQ ID NO: 1224320 - DNA, 19 bp, Homo sapiens
ctcctttctcctgtgaatg

SEQ ID NO: 1224321 - DNA, 15 bp, Homo sapiens
ctcctttctgactgt

SEQ ID NO: 1224322 - DNA, 16 bp, Homo sapiens
ctcctttctgtgccct

SEQ ID NO: 1224323 - DNA, 13 bp, Homo sapiens
ctcctttcttttt

SEQ ID NO: 1224324 - DNA, 19 bp, Homo sapiens
ctcctttctttttcttctt

SEQ ID NO: 1224325 - DNA, 20 bp, Homo sapiens
ctcctttctttttcttcttc

SEQ ID NO: 1224326 - DNA, 20 bp, Homo sapiens
ctcctttgcactgagggcca

SEQ ID NO: 1224327 - DNA, 23 bp, Homo sapiens
ctcctttgcatggcagggcctca

SEQ ID NO: 1224328 - DNA, 23 bp, Homo sapiens
ctcctttgctgaggcctccagct

SEQ ID NO: 1224329 - DNA, 16 bp, Homo sapiens
ctccttttatctggtg

SEQ ID NO: 1224330 - DNA, 16 bp, Homo sapiens
ctccttttccttacca

SEQ ID NO: 1224331 - DNA, 20 bp, Homo sapiens
ctccttttcttcaccctccc

SEQ ID NO: 1224332 - DNA, 22 bp, Homo sapiens
ctccttttgcgcttatttggaa

SEQ ID NO: 1224333 - DNA, 15 bp, Homo sapiens
ctccttttgctgtct

SEQ ID NO: 1224334 - DNA, 16 bp, Homo sapiens
ctccttttgctgtctt

SEQ ID NO: 1224335 - DNA, 18 bp, Homo sapiens
ctccttttgtatcttcct

SEQ ID NO: 1224336 - DNA, 19 bp, Homo sapiens
ctccttttgtatcttcctt

SEQ ID NO: 1224337 - DNA, 15 bp, Homo sapiens
ctccttttgtcccca

SEQ ID NO: 1224338 - DNA, 21 bp, Homo sapiens
ctccttttgtccccagggccc

SEQ ID NO: 1224339 - DNA, 13 bp, Homo sapiens
ctcctttttccat

SEQ ID NO: 1224340 - DNA, 21 bp, Homo sapiens
ctcctttttctccctctggat

SEQ ID NO: 1224341 - DNA, 12 bp, Homo sapiens
ctcgaaactgac

SEQ ID NO: 1224342 - DNA, 20 bp, Homo sapiens
ctcgaaactgacagtattaa

SEQ ID NO: 1224343 - DNA, 21 bp, Homo sapiens
ctcgaactattttcaaagact

SEQ ID NO: 1224344 - DNA, 13 bp, Homo sapiens
ctcgaactcctga

SEQ ID NO: 1224345 - DNA, 14 bp, Homo sapiens
ctcgaatgtaattg

SEQ ID NO: 1224346 - DNA, 18 bp, Homo sapiens
ctcgaatgtaattggaat

SEQ ID NO: 1224347 - DNA, 22 bp, Homo sapiens
ctcgacacgtgggctcccctct

SEQ ID NO: 1224348 - DNA, 13 bp, Homo sapiens
ctcgacccagaat

SEQ ID NO: 1224349 - DNA, 19 bp, Homo sapiens
ctcgacccagaatggagcc

SEQ ID NO: 1224350 - DNA, 21 bp, Homo sapiens
ctcgacccagaatggagcctg

SEQ ID NO: 1224351 - DNA, 23 bp, Homo sapiens
ctcgacgtttacaagccccccct

SEQ ID NO: 1224352 - DNA, 14 bp, Homo sapiens
ctcgactcagcacc

SEQ ID NO: 1224353 - DNA, 22 bp, Homo sapiens
ctcgactgagctttagacagca

SEQ ID NO: 1224354 - DNA, 12 bp, Homo sapiens
ctcgactgcttt

SEQ ID NO: 1224355 - DNA, 21 bp, Homo sapiens
ctcgagacacagtgaagcaaa

SEQ ID NO: 1224356 - DNA, 21 bp, Homo sapiens
ctcgagaccatcctggcccct

SEQ ID NO: 1224357 - DNA, 22 bp, Homo sapiens
ctcgagcctgggtgacagggca

SEQ ID NO: 1224358 - DNA, 22 bp, Homo sapiens
ctcgaggcaccggcgctgcagg

SEQ ID NO: 1224359 - DNA, 11 bp, Homo sapiens
ctcgaggccta

SEQ ID NO: 1224360 - DNA, 15 bp, Homo sapiens
ctcgagggccgcctg

SEQ ID NO: 1224361 - DNA, 18 bp, Homo sapiens
ctcgagggccgcctgcct

SEQ ID NO: 1224362 - DNA, 17 bp, Homo sapiens
ctcgagtcacattctgc

SEQ ID NO: 1224363 - DNA, 18 bp, Homo sapiens
ctcgagtcacattctgct

SEQ ID NO: 1224364 - DNA, 19 bp, Homo sapiens
ctcgagtcacattctgctt

SEQ ID NO: 1224365 - DNA, 12 bp, Homo sapiens
ctcgagtgaatt

SEQ ID NO: 1224366 - DNA, 22 bp, Homo sapiens
ctcgagtgaatttctaaatgtt

SEQ ID NO: 1224367 - DNA, 23 bp, Homo sapiens
ctcgagtgcccctgtcccacctg

SEQ ID NO: 1224368 - DNA, 21 bp, Homo sapiens
ctcgatcatatttccccttgg

SEQ ID NO: 1224369 - DNA, 15 bp, Homo sapiens
ctcgatgcactgacc

SEQ ID NO: 1224370 - DNA, 17 bp, Homo sapiens
ctcgattcatattgaat

SEQ ID NO: 1224371 - DNA, 15 bp, Homo sapiens
ctcgattttgtatct

SEQ ID NO: 1224372 - DNA, 18 bp, Homo sapiens
ctcgattttgtatctgca

SEQ ID NO: 1224373 - DNA, 19 bp, Homo sapiens
ctcgattttgtatctgcag

SEQ ID NO: 1224374 - DNA, 20 bp, Homo sapiens
ctcgattttgtatctgcagg

SEQ ID NO: 1224375 - DNA, 23 bp, Homo sapiens
ctcgcaaaaacgtatctcctaat

SEQ ID NO: 1224376 - DNA, 14 bp, Homo sapiens
ctcgcaaccctgcc

SEQ ID NO: 1224377 - DNA, 21 bp, Homo sapiens
ctcgcaagagggtctctttgt

SEQ ID NO: 1224378 - DNA, 12 bp, Homo sapiens
ctcgcacacagg

SEQ ID NO: 1224379 - DNA, 23 bp, Homo sapiens
ctcgcacacagggctcacagggc

SEQ ID NO: 1224380 - DNA, 16 bp, Homo sapiens
ctcgcacaggccctag

SEQ ID NO: 1224381 - DNA, 15 bp, Homo sapiens
ctcgcacctttccaa

SEQ ID NO: 1224382 - DNA, 15 bp, Homo sapiens
ctcgcagacctaagc

SEQ ID NO: 1224383 - DNA, 19 bp, Homo sapiens
ctcgcagcacccacagcac

SEQ ID NO: 1224384 - DNA, 17 bp, Homo sapiens
ctcgcagcccccgcgcc

SEQ ID NO: 1224385 - DNA, 21 bp, Homo sapiens
ctcgcagcccccgcgccctcc

SEQ ID NO: 1224386 - DNA, 18 bp, Homo sapiens
ctcgcagcctctcagtgc

SEQ ID NO: 1224387 - DNA, 12 bp, Homo sapiens
ctcgcagcctga

SEQ ID NO: 1224388 - DNA, 18 bp, Homo sapiens
ctcgcagcctgaagcctg

SEQ ID NO: 1224389 - DNA, 20 bp, Homo sapiens
ctcgcagcctgaagcctgga

SEQ ID NO: 1224390 - DNA, 19 bp, Homo sapiens
ctcgcagggaatgcagcag

SEQ ID NO: 1224391 - DNA, 13 bp, Homo sapiens
ctcgccatgccgg

SEQ ID NO: 1224392 - DNA, 14 bp, Homo sapiens
ctcgcccagacacc

SEQ ID NO: 1224393 - DNA, 13 bp, Homo sapiens
ctcgccccatccc

SEQ ID NO: 1224394 - DNA, 17 bp, Homo sapiens
ctcgcccctccagtgtt

SEQ ID NO: 1224395 - DNA, 17 bp, Homo sapiens
ctcgcccctcccctcag

SEQ ID NO: 1224396 - DNA, 22 bp, Homo sapiens
ctcgcccctcccctcagcctgc

SEQ ID NO: 1224397 - DNA, 19 bp, Homo sapiens
ctcgcccctgttttttgta

SEQ ID NO: 1224398 - DNA, 22 bp, Homo sapiens
ctcgcccgcccactgtcctggg

SEQ ID NO: 1224399 - DNA, 17 bp, Homo sapiens
ctcgccctcctttctgt

SEQ ID NO: 1224400 - DNA, 20 bp, Homo sapiens
ctcgccctgcggtagatggg

SEQ ID NO: 1224401 - DNA, 15 bp, Homo sapiens
ctcgccctgggtcta

SEQ ID NO: 1224402 - DNA, 21 bp, Homo sapiens
ctcgccgtgtctcagcctctg

SEQ ID NO: 1224403 - DNA, 21 bp, Homo sapiens
ctcgcctcactttccaccaag

SEQ ID NO: 1224404 - DNA, 13 bp, Homo sapiens
ctcgccttccctc

SEQ ID NO: 1224405 - DNA, 17 bp, Homo sapiens
ctcgccttccctcctgc

SEQ ID NO: 1224406 - DNA, 20 bp, Homo sapiens
ctcgccttccctcctgcttt

SEQ ID NO: 1224407 - DNA, 15 bp, Homo sapiens
ctcgcgcgactgaga

SEQ ID NO: 1224408 - DNA, 15 bp, Homo sapiens
ctcgctcccctctgg

SEQ ID NO: 1224409 - DNA, 16 bp, Homo sapiens
ctcgctcccctctgga

SEQ ID NO: 1224410 - DNA, 17 bp, Homo sapiens
ctcgctcccctctggaa

SEQ ID NO: 1224411 - DNA, 18 bp, Homo sapiens
ctcgctcccctctggaat

SEQ ID NO: 1224412 - DNA, 21 bp, Homo sapiens
ctcgctccctgtagctctgcc

SEQ ID NO: 1224413 - DNA, 17 bp, Homo sapiens
ctcgctcctccttccca

SEQ ID NO: 1224414 - DNA, 20 bp, Homo sapiens
ctcgctcctccttcccaggg

SEQ ID NO: 1224415 - DNA, 16 bp, Homo sapiens
ctcgctggactctcag

SEQ ID NO: 1224416 - DNA, 20 bp, Homo sapiens
ctcgcttaggtagaaactat

SEQ ID NO: 1224417 - DNA, 17 bp, Homo sapiens
ctcgcttcctcagcctc

SEQ ID NO: 1224418 - DNA, 19 bp, Homo sapiens
ctcgcttcctcagcctcca

SEQ ID NO: 1224419 - DNA, 21 bp, Homo sapiens
ctcggaaccgctcacctagag

SEQ ID NO: 1224420 - DNA, 17 bp, Homo sapiens
ctcggaagccgtctgac

SEQ ID NO: 1224421 - DNA, 15 bp, Homo sapiens
ctcggacccacccca

SEQ ID NO: 1224422 - DNA, 18 bp, Homo sapiens
ctcggagactatggcctc

SEQ ID NO: 1224423 - DNA, 16 bp, Homo sapiens
ctcggagagcagcagc

SEQ ID NO: 1224424 - DNA, 15 bp, Homo sapiens
ctcggagccctcaga

SEQ ID NO: 1224425 - DNA, 12 bp, Homo sapiens
ctcggagcctca

SEQ ID NO: 1224426 - DNA, 22 bp, Homo sapiens
ctcggagcctcatccgaggcag

SEQ ID NO: 1224427 - DNA, 13 bp, Homo sapiens
ctcggagctggct

SEQ ID NO: 1224428 - DNA, 18 bp, Homo sapiens
ctcggagctggctgtgcc

SEQ ID NO: 1224429 - DNA, 19 bp, Homo sapiens
ctcggagctggctgtgcct

SEQ ID NO: 1224430 - DNA, 13 bp, Homo sapiens
ctcggaggaagcc

SEQ ID NO: 1224431 - DNA, 21 bp, Homo sapiens
ctcggagggatggagaaagaa

SEQ ID NO: 1224432 - DNA, 23 bp, Homo sapiens
ctcggagggatggagaaagaagt

SEQ ID NO: 1224433 - DNA, 20 bp, Homo sapiens
ctcggatgacaccctggcct

SEQ ID NO: 1224434 - DNA, 17 bp, Homo sapiens
ctcggatgaccaaacca

SEQ ID NO: 1224435 - DNA, 23 bp, Homo sapiens
ctcggatgaccaaaccagccttc

SEQ ID NO: 1224436 - DNA, 22 bp, Homo sapiens
ctcggatggaccaacctgctct

SEQ ID NO: 1224437 - DNA, 13 bp, Homo sapiens
ctcggcacacact

SEQ ID NO: 1224438 - DNA, 22 bp, Homo sapiens
ctcggcacacactgtgccccac

SEQ ID NO: 1224439 - DNA, 18 bp, Homo sapiens
ctcggcagaactctctgt

SEQ ID NO: 1224440 - DNA, 23 bp, Homo sapiens
ctcggcagcccttccaaactctt

SEQ ID NO: 1224441 - DNA, 18 bp, Homo sapiens
ctcggccactgtgtctct

SEQ ID NO: 1224442 - DNA, 16 bp, Homo sapiens
ctcggccaggcattgg

SEQ ID NO: 1224443 - DNA, 16 bp, Homo sapiens
ctcggccccacccacc

SEQ ID NO: 1224444 - DNA, 15 bp, Homo sapiens
ctcggccccatcgcc

SEQ ID NO: 1224445 - DNA, 22 bp, Homo sapiens
ctcggccccatcgccccaccgc

SEQ ID NO: 1224446 - DNA, 22 bp, Homo sapiens
ctcggcccggagcagcaggaag

SEQ ID NO: 1224447 - DNA, 12 bp, Homo sapiens
ctcggccctgaa

SEQ ID NO: 1224448 - DNA, 19 bp, Homo sapiens
ctcggcctcccaaagtgct

SEQ ID NO: 1224449 - DNA, 15 bp, Homo sapiens
ctcggctcagcctcc

SEQ ID NO: 1224450 - DNA, 22 bp, Homo sapiens
ctcggctccccatgtgtcctgg

SEQ ID NO: 1224451 - DNA, 13 bp, Homo sapiens
ctcggctctgcag

SEQ ID NO: 1224452 - DNA, 13 bp, Homo sapiens
ctcggctggaaga

SEQ ID NO: 1224453 - DNA, 21 bp, Homo sapiens
ctcggctggaagaacatcaag

SEQ ID NO: 1224454 - DNA, 19 bp, Homo sapiens
ctcggcttcttggaccttg

SEQ ID NO: 1224455 - DNA, 20 bp, Homo sapiens
ctcggcttgtgggctggtgc

SEQ ID NO: 1224456 - DNA, 16 bp, Homo sapiens
ctcgggaagggagggg

SEQ ID NO: 1224457 - DNA, 17 bp, Homo sapiens
ctcgggaagggagggga

SEQ ID NO: 1224458 - DNA, 15 bp, Homo sapiens
ctcgggacacctgcc

SEQ ID NO: 1224459 - DNA, 20 bp, Homo sapiens
ctcgggacacctgccctgcc

SEQ ID NO: 1224460 - DNA, 16 bp, Homo sapiens
ctcgggaccccactcg

SEQ ID NO: 1224461 - DNA, 21 bp, Homo sapiens
ctcgggacctcgtttgggagt

SEQ ID NO: 1224462 - DNA, 15 bp, Homo sapiens
ctcgggagctgcaca

SEQ ID NO: 1224463 - DNA, 15 bp, Homo sapiens
ctcgggaggctgaga

SEQ ID NO: 1224464 - DNA, 13 bp, Homo sapiens
ctcgggcccacct

SEQ ID NO: 1224465 - DNA, 18 bp, Homo sapiens
ctcgggcttgagtgagaa

SEQ ID NO: 1224466 - DNA, 17 bp, Homo sapiens
ctcggggagagggggag

SEQ ID NO: 1224467 - DNA, 20 bp, Homo sapiens
ctcggggcccttggggcctg

SEQ ID NO: 1224468 - DNA, 22 bp, Homo sapiens
ctcggggcccttggggcctggc

SEQ ID NO: 1224469 - DNA, 24 bp, Homo sapiens
ctcggggcccttggggcctggctt

SEQ ID NO: 1224470 - DNA, 14 bp, Homo sapiens
ctcgggggcctgtg

SEQ ID NO: 1224471 - DNA, 18 bp, Homo sapiens
ctcgggggcgcctggagg

SEQ ID NO: 1224472 - DNA, 23 bp, Homo sapiens
ctcgggggcgcctggagggatgc

SEQ ID NO: 1224473 - DNA, 17 bp, Homo sapiens
ctcgggggtgctggggc

SEQ ID NO: 1224474 - DNA, 23 bp, Homo sapiens
ctcgggggtgctggggccagggc

SEQ ID NO: 1224475 - DNA, 17 bp, Homo sapiens
ctcggggtccagtgcat

SEQ ID NO: 1224476 - DNA, 15 bp, Homo sapiens
ctcgggtctgggcag

SEQ ID NO: 1224477 - DNA, 20 bp, Homo sapiens
ctcggtgaccactcttcttt

SEQ ID NO: 1224478 - DNA, 14 bp, Homo sapiens
ctcggtgagccggg

SEQ ID NO: 1224479 - DNA, 18 bp, Homo sapiens
ctcggtggacccagggat

SEQ ID NO: 1224480 - DNA, 15 bp, Homo sapiens
ctcggtggctctggg

SEQ ID NO: 1224481 - DNA, 17 bp, Homo sapiens
ctcggtgtggagaagcg

SEQ ID NO: 1224482 - DNA, 21 bp, Homo sapiens
ctcggttcaaggtcactgttt

SEQ ID NO: 1224483 - DNA, 16 bp, Homo sapiens
ctcggtttgccaaaat

SEQ ID NO: 1224484 - DNA, 14 bp, Homo sapiens
ctcgtagccatctc

SEQ ID NO: 1224485 - DNA, 18 bp, Homo sapiens
ctcgtatatgtctcaggt

SEQ ID NO: 1224486 - DNA, 22 bp, Homo sapiens
ctcgtatccaacccaaggacct

SEQ ID NO: 1224487 - DNA, 18 bp, Homo sapiens
ctcgtatttctttttcct

SEQ ID NO: 1224488 - DNA, 18 bp, Homo sapiens
ctcgtcagccacctggga

SEQ ID NO: 1224489 - DNA, 17 bp, Homo sapiens
ctcgtccacaggggcag

SEQ ID NO: 1224490 - DNA, 20 bp, Homo sapiens
ctcgtccacaggggcaggcc

SEQ ID NO: 1224491 - DNA, 15 bp, Homo sapiens
ctcgtcccatccagc

SEQ ID NO: 1224492 - DNA, 21 bp, Homo sapiens
ctcgtcccatccagctaccac

SEQ ID NO: 1224493 - DNA, 12 bp, Homo sapiens
ctcgtccccctc

SEQ ID NO: 1224494 - DNA, 13 bp, Homo sapiens
ctcgtccccctcc

SEQ ID NO: 1224495 - DNA, 15 bp, Homo sapiens
ctcgtccgtctgtct

SEQ ID NO: 1224496 - DNA, 16 bp, Homo sapiens
ctcgtccgtctgtctc

SEQ ID NO: 1224497 - DNA, 12 bp, Homo sapiens
ctcgtcctcccc

SEQ ID NO: 1224498 - DNA, 24 bp, Homo sapiens
ctcgtcctccccctgccagtgcct

SEQ ID NO: 1224499 - DNA, 20 bp, Homo sapiens
ctcgtctccctggtgcctct

SEQ ID NO: 1224500 - DNA, 19 bp, Homo sapiens
ctcgtctcttgtgactcag

SEQ ID NO: 1224501 - DNA, 22 bp, Homo sapiens
ctcgtctggcaagtcggggcct

SEQ ID NO: 1224502 - DNA, 19 bp, Homo sapiens
ctcgtcttccgtctccccc

SEQ ID NO: 1224503 - DNA, 15 bp, Homo sapiens
ctcgtgagtcattta

SEQ ID NO: 1224504 - DNA, 14 bp, Homo sapiens
ctcgtgcagagctg

SEQ ID NO: 1224505 - DNA, 18 bp, Homo sapiens
ctcgtgcagagctggggc

SEQ ID NO: 1224506 - DNA, 17 bp, Homo sapiens
ctcgtgcatccctgaga

SEQ ID NO: 1224507 - DNA, 21 bp, Homo sapiens
ctcgtgccaccccgagggctg

SEQ ID NO: 1224508 - DNA, 14 bp, Homo sapiens
ctcgtgccagcagc

SEQ ID NO: 1224509 - DNA, 17 bp, Homo sapiens
ctcgtgccatgatctgt

SEQ ID NO: 1224510 - DNA, 18 bp, Homo sapiens
ctcgtgcgcatctcagaa

SEQ ID NO: 1224511 - DNA, 21 bp, Homo sapiens
ctcgtggcgcgggagctggga

SEQ ID NO: 1224512 - DNA, 15 bp, Homo sapiens
ctcgtgggagagcca

SEQ ID NO: 1224513 - DNA, 20 bp, Homo sapiens
ctcgtggtagaagccagtac

SEQ ID NO: 1224514 - DNA, 14 bp, Homo sapiens
ctcgtggtatgtat

SEQ ID NO: 1224515 - DNA, 23 bp, Homo sapiens
ctcgtggttattagcaaggctgg

SEQ ID NO: 1224516 - DNA, 21 bp, Homo sapiens
ctcgtgtacagctcccttccc

SEQ ID NO: 1224517 - DNA, 15 bp, Homo sapiens
ctcgtgtatcctggg

SEQ ID NO: 1224518 - DNA, 21 bp, Homo sapiens
ctcgtgtcagtaatttatatg

SEQ ID NO: 1224519 - DNA, 16 bp, Homo sapiens
ctcgtgtcatctccgg

SEQ ID NO: 1224520 - DNA, 12 bp, Homo sapiens
ctcgtgtgattt

SEQ ID NO: 1224521 - DNA, 14 bp, Homo sapiens
ctcgtgtgatttcc

SEQ ID NO: 1224522 - DNA, 20 bp, Homo sapiens
ctcgtgtttgcttaaaatat

SEQ ID NO: 1224523 - DNA, 13 bp, Homo sapiens
ctcgttccggtcc

SEQ ID NO: 1224524 - DNA, 14 bp, Homo sapiens
ctcgttctccttcc

SEQ ID NO: 1224525 - DNA, 14 bp, Homo sapiens
ctcgtttgggagtg

SEQ ID NO: 1224526 - DNA, 16 bp, Homo sapiens
ctcgttttgggccaga

SEQ ID NO: 1224527 - DNA, 20 bp, Homo sapiens
ctctaaaagatcctttttaa

SEQ ID NO: 1224528 - DNA, 23 bp, Homo sapiens
ctctaaaagcgttggatgtagca

SEQ ID NO: 1224529 - DNA, 23 bp, Homo sapiens
ctctaaaataggtaaatgtattt

SEQ ID NO: 1224530 - DNA, 18 bp, Homo sapiens
ctctaaaatggacatttt

SEQ ID NO: 1224531 - DNA, 17 bp, Homo sapiens
ctctaaaattataaatg

SEQ ID NO: 1224532 - DNA, 14 bp, Homo sapiens
ctctaaactgcaaa

SEQ ID NO: 1224533 - DNA, 14 bp, Homo sapiens
ctctaaagaaaaat

SEQ ID NO: 1224534 - DNA, 15 bp, Homo sapiens
ctctaaagaaacttg

SEQ ID NO: 1224535 - DNA, 20 bp, Homo sapiens
ctctaaagaaacttggctgg

SEQ ID NO: 1224536 - DNA, 20 bp, Homo sapiens
ctctagctgggggtgggcca

SEQ ID NO: 1224537 - DNA, 18 bp, Homo sapiens
ctctagctgttctggact

SEQ ID NO: 1224538 - DNA, 21 bp, Homo sapiens
ctctagctgttcttttttgta

SEQ ID NO: 1224539 - DNA, 23 bp, Homo sapiens
ctctagcttaagtgtaaatgaag

SEQ ID NO: 1224540 - DNA, 17 bp, Homo sapiens
ctctagcttttctattt

SEQ ID NO: 1224541 - DNA, 22 bp, Homo sapiens
ctctaggatgtatattttatat

SEQ ID NO: 1224542 - DNA, 21 bp, Homo sapiens
ctctagggactgccaggctgt

SEQ ID NO: 1224543 - DNA, 16 bp, Homo sapiens
ctctaggggcagcctc

SEQ ID NO: 1224544 - DNA, 17 bp, Homo sapiens
ctctaggggtcaggctc

SEQ ID NO: 1224545 - DNA, 20 bp, Homo sapiens
ctctaggggtcaggctccat

SEQ ID NO: 1224546 - DNA, 12 bp, Homo sapiens
ctctagggtcca

SEQ ID NO: 1224547 - DNA, 16 bp, Homo sapiens
ctctaggttatacaat

SEQ ID NO: 1224548 - DNA, 19 bp, Homo sapiens
ctctaggttatacaataac

SEQ ID NO: 1224549 - DNA, 20 bp, Homo sapiens
ctctagtagggagaggctct

SEQ ID NO: 1224550 - DNA, 20 bp, Homo sapiens
ctctagtgaatgtaggctgg

SEQ ID NO: 1224551 - DNA, 19 bp, Homo sapiens
ctctagtgacttcctggtg

SEQ ID NO: 1224552 - DNA, 16 bp, Homo sapiens
ctctagtgccttctaa

SEQ ID NO: 1224553 - DNA, 17 bp, Homo sapiens
ctctagtgcggtttact

SEQ ID NO: 1224554 - DNA, 16 bp, Homo sapiens
ctctagtgctgtgaaa

SEQ ID NO: 1224555 - DNA, 18 bp, Homo sapiens
ctctagtgctgtgaaaaa

SEQ ID NO: 1224556 - DNA, 15 bp, Homo sapiens
ctctagttctagatg

SEQ ID NO: 1224557 - DNA, 14 bp, Homo sapiens
ctctagttctgttg

SEQ ID NO: 1224558 - DNA, 16 bp, Homo sapiens
ctctagttctgttgtt

SEQ ID NO: 1224559 - DNA, 20 bp, Homo sapiens
ctctagttctgttgttttgt

SEQ ID NO: 1224560 - DNA, 23 bp, Homo sapiens
ctctagttctgttgttttgtgta

SEQ ID NO: 1224561 - DNA, 13 bp, Homo sapiens
ctctagttctttg

SEQ ID NO: 1224562 - DNA, 16 bp, Homo sapiens
ctctagttgagtttct

SEQ ID NO: 1224563 - DNA, 12 bp, Homo sapiens
ctctagtttttg

SEQ ID NO: 1224564 - DNA, 15 bp, Homo sapiens
ctctataaaaaatat

SEQ ID NO: 1224565 - DNA, 22 bp, Homo sapiens
ctctataatctgcagtgatgca

SEQ ID NO: 1224566 - DNA, 22 bp, Homo sapiens
ctctatacttctcctttggaca

SEQ ID NO: 1224567 - DNA, 21 bp, Homo sapiens
ctctatataccaaagcacatt

SEQ ID NO: 1224568 - DNA, 19 bp, Homo sapiens
ctctatatgtagtgcattt

SEQ ID NO: 1224569 - DNA, 21 bp, Homo sapiens
ctctatcatggtgaaaagctc

SEQ ID NO: 1224570 - DNA, 22 bp, Homo sapiens
ctctatccaaagaacttgattt

SEQ ID NO: 1224571 - DNA, 23 bp, Homo sapiens
ctctatccaaagaacttgatttg

SEQ ID NO: 1224572 - DNA, 15 bp, Homo sapiens
ctctatcctctctct

SEQ ID NO: 1224573 - DNA, 20 bp, Homo sapiens
ctctatcctctctctctcta

SEQ ID NO: 1224574 - DNA, 19 bp, Homo sapiens
ctctatgcaaaatgtctgt

SEQ ID NO: 1224575 - DNA, 15 bp, Homo sapiens
ctctatgccctgcag

SEQ ID NO: 1224576 - DNA, 20 bp, Homo sapiens
ctctatgccctgcagagcaa

SEQ ID NO: 1224577 - DNA, 14 bp, Homo sapiens
ctctatgcctgcac

SEQ ID NO: 1224578 - DNA, 13 bp, Homo sapiens
ctctatgctggct

SEQ ID NO: 1224579 - DNA, 15 bp, Homo sapiens
ctctatgtttattct

SEQ ID NO: 1224580 - DNA, 14 bp, Homo sapiens
ctctattaaaatgc

SEQ ID NO: 1224581 - DNA, 24 bp, Homo sapiens
ctctattagactttagaaataaat

SEQ ID NO: 1224582 - DNA, 21 bp, Homo sapiens
ctctattatgttatcatcctc

SEQ ID NO: 1224583 - DNA, 18 bp, Homo sapiens
ctctattcttgggaaaca

SEQ ID NO: 1224584 - DNA, 19 bp, Homo sapiens
ctctattcttgggaaacac

SEQ ID NO: 1224585 - DNA, 20 bp, Homo sapiens
ctctattcttgggaaacacc

SEQ ID NO: 1224586 - DNA, 21 bp, Homo sapiens
ctctatttaagatatatacat

SEQ ID NO: 1224587 - DNA, 14 bp, Homo sapiens
ctctatttgagaat

SEQ ID NO: 1224588 - DNA, 14 bp, Homo sapiens
ctctattttaaagt

SEQ ID NO: 1224589 - DNA, 13 bp, Homo sapiens
ctctattttaatt

SEQ ID NO: 1224590 - DNA, 13 bp, Homo sapiens
ctctattttgtga

SEQ ID NO: 1224591 - DNA, 15 bp, Homo sapiens
ctctatttttaatca

SEQ ID NO: 1224592 - DNA, 16 bp, Homo sapiens
ctctcaaatccctctc

SEQ ID NO: 1224593 - DNA, 15 bp, Homo sapiens
ctctcaagctagcca

SEQ ID NO: 1224594 - DNA, 16 bp, Homo sapiens
ctctcaatatgcttac

SEQ ID NO: 1224595 - DNA, 13 bp, Homo sapiens
ctctcctggtgtg

SEQ ID NO: 1224596 - DNA, 13 bp, Homo sapiens
ctctcctgtacct

SEQ ID NO: 1224597 - DNA, 15 bp, Homo sapiens
ctctcctgtacctct

SEQ ID NO: 1224598 - DNA, 17 bp, Homo sapiens
ctctcctgtacctcttg

SEQ ID NO: 1224599 - DNA, 18 bp, Homo sapiens
ctctcctgtacctcttga

SEQ ID NO: 1224600 - DNA, 18 bp, Homo sapiens
ctctcctgtactttttcc

SEQ ID NO: 1224601 - DNA, 21 bp, Homo sapiens
ctctcctgtccaacctaaccc

SEQ ID NO: 1224602 - DNA, 20 bp, Homo sapiens
ctctcctgtccccgccgggc

SEQ ID NO: 1224603 - DNA, 15 bp, Homo sapiens
ctctcctgtctgaac

SEQ ID NO: 1224604 - DNA, 18 bp, Homo sapiens
ctctcctgtctgaacctg

SEQ ID NO: 1224605 - DNA, 13 bp, Homo sapiens
ctctcctgtgtgc

SEQ ID NO: 1224606 - DNA, 17 bp, Homo sapiens
ctctcctgtgtgcttgt

SEQ ID NO: 1224607 - DNA, 16 bp, Homo sapiens
ctctcctgtttggaac

SEQ ID NO: 1224608 - DNA, 12 bp, Homo sapiens
ctctccttccca

SEQ ID NO: 1224609 - DNA, 16 bp, Homo sapiens
ctctccttctcctagc

SEQ ID NO: 1224610 - DNA, 15 bp, Homo sapiens
ctctccttgcccccc

SEQ ID NO: 1224611 - DNA, 18 bp, Homo sapiens
ctctccttggccacagac

SEQ ID NO: 1224612 - DNA, 15 bp, Homo sapiens
ctctccttgggctcc

SEQ ID NO: 1224613 - DNA, 19 bp, Homo sapiens
ctctccttgggctcctggc

SEQ ID NO: 1224614 - DNA, 22 bp, Homo sapiens
ctctccttgggctcctggctgc

SEQ ID NO: 1224615 - DNA, 16 bp, Homo sapiens
ctctcctttctccctg

SEQ ID NO: 1224616 - DNA, 17 bp, Homo sapiens
ctctcctttctccctgc

SEQ ID NO: 1224617 - DNA, 18 bp, Homo sapiens
ctctcctttctccctgca

SEQ ID NO: 1224618 - DNA, 12 bp, Homo sapiens
ctctcgagccca

SEQ ID NO: 1224619 - DNA, 16 bp, Homo sapiens
ctctcgccccatccct

SEQ ID NO: 1224620 - DNA, 18 bp, Homo sapiens
ctctcgccccatccctgc

SEQ ID NO: 1224621 - DNA, 21 bp, Homo sapiens
ctctcgccccatccctgcttg

SEQ ID NO: 1224622 - DNA, 16 bp, Homo sapiens
ctctcggaaggctggc

SEQ ID NO: 1224623 - DNA, 14 bp, Homo sapiens
ctctcggccaggca

SEQ ID NO: 1224624 - DNA, 15 bp, Homo sapiens
ctctcggccccatcg

SEQ ID NO: 1224625 - DNA, 14 bp, Homo sapiens
ctctcggctcccca

SEQ ID NO: 1224626 - DNA, 15 bp, Homo sapiens
ctctcggctggaaga

SEQ ID NO: 1224627 - DNA, 16 bp, Homo sapiens
ctctcgggactagctg

SEQ ID NO: 1224628 - DNA, 19 bp, Homo sapiens
ctctcgggactagctgcct

SEQ ID NO: 1224629 - DNA, 16 bp, Homo sapiens
ctctcgggctctctca

SEQ ID NO: 1224630 - DNA, 19 bp, Homo sapiens
ctctcgggctctctcaccc

SEQ ID NO: 1224631 - DNA, 23 bp, Homo sapiens
ctctcggggcccttggggcctgg

SEQ ID NO: 1224632 - DNA, 21 bp, Homo sapiens
ctctcggttccacgtccccct

SEQ ID NO: 1224633 - DNA, 15 bp, Homo sapiens
ctctcgttctccttc

SEQ ID NO: 1224634 - DNA, 16 bp, Homo sapiens
ctctcgttctccttcc

SEQ ID NO: 1224635 - DNA, 20 bp, Homo sapiens
ctctctaaactggtacaatt

SEQ ID NO: 1224636 - DNA, 15 bp, Homo sapiens
ctctctaagccacag

SEQ ID NO: 1224637 - DNA, 17 bp, Homo sapiens
ctctctaagccacagct

SEQ ID NO: 1224638 - DNA, 23 bp, Homo sapiens
ctctctaagccacagcttcttca

SEQ ID NO: 1224639 - DNA, 18 bp, Homo sapiens
ctctctacccggcccaga

SEQ ID NO: 1224640 - DNA, 20 bp, Homo sapiens
ctctctacccggcccagaga

SEQ ID NO: 1224641 - DNA, 14 bp, Homo sapiens
ctctctacctccac

SEQ ID NO: 1224642 - DNA, 15 bp, Homo sapiens
ctctctacttcccct

SEQ ID NO: 1224643 - DNA, 22 bp, Homo sapiens
ctctctagcacaatttgcacta

SEQ ID NO: 1224644 - DNA, 22 bp, Homo sapiens
ctctctaggagggagccttgtg

SEQ ID NO: 1224645 - DNA, 24 bp, Homo sapiens
ctctctatcctctcttcctcttcc

SEQ ID NO: 1224646 - DNA, 21 bp, Homo sapiens
ctctctatgcaaaatgtctgt

SEQ ID NO: 1224647 - DNA, 13 bp, Homo sapiens
ctctctcacccac

SEQ ID NO: 1224648 - DNA, 18 bp, Homo sapiens
ctctctcacccaccagct

SEQ ID NO: 1224649 - DNA, 21 bp, Homo sapiens
ctctctcacccaccagctcca

SEQ ID NO: 1224650 - DNA, 13 bp, Homo sapiens
ctctctcacccag

SEQ ID NO: 1224651 - DNA, 13 bp, Homo sapiens
ctctctcaggagc

SEQ ID NO: 1224652 - DNA, 12 bp, Homo sapiens
ctctctccagat

SEQ ID NO: 1224653 - DNA, 13 bp, Homo sapiens
ctctctccagggt

SEQ ID NO: 1224654 - DNA, 24 bp, Homo sapiens
ctctctccagggtgcttagttggc

SEQ ID NO: 1224655 - DNA, 23 bp, Homo sapiens
ctctctcccctactacaagtccc

SEQ ID NO: 1224656 - DNA, 15 bp, Homo sapiens
ctctctccctacctc

SEQ ID NO: 1224657 - DNA, 20 bp, Homo sapiens
ctctctccctacctccctcc

SEQ ID NO: 1224658 - DNA, 13 bp, Homo sapiens
ctctctccctctg

SEQ ID NO: 1224659 - DNA, 17 bp, Homo sapiens
ctctctccctgccttta

SEQ ID NO: 1224660 - DNA, 15 bp, Homo sapiens
ctctctccctgtcac

SEQ ID NO: 1224661 - DNA, 22 bp, Homo sapiens
ctctctccctgtcacacactgg

SEQ ID NO: 1224662 - DNA, 13 bp, Homo sapiens
ctctctcctcagg

SEQ ID NO: 1224663 - DNA, 14 bp, Homo sapiens
ctctctcctctctc

SEQ ID NO: 1224664 - DNA, 15 bp, Homo sapiens
ctctctcctggtgtg

SEQ ID NO: 1224665 - DNA, 19 bp, Homo sapiens
ctctctcggagccctcaga

SEQ ID NO: 1224666 - DNA, 15 bp, Homo sapiens
ctctctctctcctca

SEQ ID NO: 1224667 - DNA, 15 bp, Homo sapiens
ctctctctctctcct

SEQ ID NO: 1224668 - DNA, 13 bp, Homo sapiens
ctctctctgctcc

SEQ ID NO: 1224669 - DNA, 12 bp, Homo sapiens
ctctctctgggt

SEQ ID NO: 1224670 - DNA, 15 bp, Homo sapiens
ctctctcttcccagc

SEQ ID NO: 1224671 - DNA, 21 bp, Homo sapiens
ctctctcttctgctccaccct

SEQ ID NO: 1224672 - DNA, 18 bp, Homo sapiens
ctctctctttctagaggt

SEQ ID NO: 1224673 - DNA, 16 bp, Homo sapiens
ctctctgaacccctcc

SEQ ID NO: 1224674 - DNA, 21 bp, Homo sapiens
ctctctgaagcgactctcctg

SEQ ID NO: 1224675 - DNA, 15 bp, Homo sapiens
ctctctgacatatgc

SEQ ID NO: 1224676 - DNA, 21 bp, Homo sapiens
ctctctgacgcttgtgacagt

SEQ ID NO: 1224677 - DNA, 23 bp, Homo sapiens
ctctctgacgcttgtgacagtgc

SEQ ID NO: 1224678 - DNA, 17 bp, Homo sapiens
ctctctgagctggggag

SEQ ID NO: 1224679 - DNA, 12 bp, Homo sapiens
ctctctgcagcc

SEQ ID NO: 1224680 - DNA, 20 bp, Homo sapiens
ctctcttgtgacgtgcactg

SEQ ID NO: 1224681 - DNA, 17 bp, Homo sapiens
ctctcttgttgtccagg

SEQ ID NO: 1224682 - DNA, 17 bp, Homo sapiens
ctctctttaaccctccc

SEQ ID NO: 1224683 - DNA, 17 bp, Homo sapiens
ctctctttatgcttgct

SEQ ID NO: 1224684 - DNA, 14 bp, Homo sapiens
ctctctttccttga

SEQ ID NO: 1224685 - DNA, 21 bp, Homo sapiens
ctctctttctcaaagaggggg

SEQ ID NO: 1224686 - DNA, 18 bp, Homo sapiens
ctctctttgcatggattt

SEQ ID NO: 1224687 - DNA, 15 bp, Homo sapiens
ctctctttgggaatg

SEQ ID NO: 1224688 - DNA, 12 bp, Homo sapiens
ctctcttttaaa

SEQ ID NO: 1224689 - DNA, 13 bp, Homo sapiens
ctctcttttaaag

SEQ ID NO: 1224690 - DNA, 18 bp, Homo sapiens
ctctcttttcctctctgt

SEQ ID NO: 1224691 - DNA, 23 bp, Homo sapiens
ctctgaaaagcaattgccctgta

SEQ ID NO: 1224692 - DNA, 16 bp, Homo sapiens
ctctgaaaattctgga

SEQ ID NO: 1224693 - DNA, 16 bp, Homo sapiens
ctctgaaatctgaaga

SEQ ID NO: 1224694 - DNA, 14 bp, Homo sapiens
ctctgaaattaaag

SEQ ID NO: 1224695 - DNA, 23 bp, Homo sapiens
ctctgaacacacacgccagctcc

SEQ ID NO: 1224696 - DNA, 13 bp, Homo sapiens
ctctgaacacatt

SEQ ID NO: 1224697 - DNA, 15 bp, Homo sapiens
ctctgaactgcaaca

SEQ ID NO: 1224698 - DNA, 23 bp, Homo sapiens
ctctgaacttccaagctccaaat

SEQ ID NO: 1224699 - DNA, 15 bp, Homo sapiens
ctctgaagagacctt

SEQ ID NO: 1224700 - DNA, 13 bp, Homo sapiens
ctctgaagagtgg

SEQ ID NO: 1224701 - DNA, 23 bp, Homo sapiens
ctctgaagagtgggtttcacaag

SEQ ID NO: 1224702 - DNA, 18 bp, Homo sapiens
ctctgaagatgatcattt

SEQ ID NO: 1224703 - DNA, 14 bp, Homo sapiens
ctctgaagcaagag

SEQ ID NO: 1224704 - DNA, 11 bp, Homo sapiens
ctctgaagcat

SEQ ID NO: 1224705 - DNA, 14 bp, Homo sapiens
ctctgaagcatgtt

SEQ ID NO: 1224706 - DNA, 17 bp, Homo sapiens
ctctgaagcatgtttca

SEQ ID NO: 1224707 - DNA, 21 bp, Homo sapiens
ctctgaagccacaaagaccca

SEQ ID NO: 1224708 - DNA, 19 bp, Homo sapiens
ctctgaagcgactctcctg

SEQ ID NO: 1224709 - DNA, 12 bp, Homo sapiens
ctctgaagctaa

SEQ ID NO: 1224710 - DNA, 15 bp, Homo sapiens
ctctgaagggacccc

SEQ ID NO: 1224711 - DNA, 22 bp, Homo sapiens
ctctgaagggcatcatgcatct

SEQ ID NO: 1224712 - DNA, 16 bp, Homo sapiens
ctctgaagttggacag

SEQ ID NO: 1224713 - DNA, 16 bp, Homo sapiens
ctctgaatacacagta

SEQ ID NO: 1224714 - DNA, 15 bp, Homo sapiens
ctctgaatattttgt

SEQ ID NO: 1224715 - DNA, 11 bp, Homo sapiens
ctctgaatctg

SEQ ID NO: 1224716 - DNA, 18 bp, Homo sapiens
ctctgaatgggagccaga

SEQ ID NO: 1224717 - DNA, 15 bp, Homo sapiens
ctctgaattttcaga

SEQ ID NO: 1224718 - DNA, 18 bp, Homo sapiens
ctctgacagcagcctgtg

SEQ ID NO: 1224719 - DNA, 14 bp, Homo sapiens
ctctgacagtccac

SEQ ID NO: 1224720 - DNA, 18 bp, Homo sapiens
ctctgacagtccacaggg

SEQ ID NO: 1224721 - DNA, 19 bp, Homo sapiens
ctctgacatcccttcctgg

SEQ ID NO: 1224722 - DNA, 21 bp, Homo sapiens
ctctgacccggttgcagtcac

SEQ ID NO: 1224723 - DNA, 15 bp, Homo sapiens
ctctgaccctccttc

SEQ ID NO: 1224724 - DNA, 16 bp, Homo sapiens
ctctgaccctccttct

SEQ ID NO: 1224725 - DNA, 17 bp, Homo sapiens
ctctgaccctccttcta

SEQ ID NO: 1224726 - DNA, 12 bp, Homo sapiens
ctctgaccctgg

SEQ ID NO: 1224727 - DNA, 12 bp, Homo sapiens
ctctgacctgca

SEQ ID NO: 1224728 - DNA, 15 bp, Homo sapiens
ctctgacctgcaggc

SEQ ID NO: 1224729 - DNA, 21 bp, Homo sapiens
ctctgacgcaccactgccaat

SEQ ID NO: 1224730 - DNA, 21 bp, Homo sapiens
ctctgacgtcaacccaagctc

SEQ ID NO: 1224731 - DNA, 23 bp, Homo sapiens
ctctgactagtagatttctatga

SEQ ID NO: 1224732 - DNA, 23 bp, Homo sapiens
ctctgactcatccccacagctgg

SEQ ID NO: 1224733 - DNA, 13 bp, Homo sapiens
ctctgactctgag

SEQ ID NO: 1224734 - DNA, 16 bp, Homo sapiens
ctctgactctgagtcc

SEQ ID NO: 1224735 - DNA, 13 bp, Homo sapiens
ctctgacttctgc

SEQ ID NO: 1224736 - DNA, 15 bp, Homo sapiens
ctctgacttctgcct

SEQ ID NO: 1224737 - DNA, 18 bp, Homo sapiens
ctctgagaattccaagga

SEQ ID NO: 1224738 - DNA, 15 bp, Homo sapiens
ctctgagacacaccc

SEQ ID NO: 1224739 - DNA, 20 bp, Homo sapiens
ctctgagacccttttctcag

SEQ ID NO: 1224740 - DNA, 22 bp, Homo sapiens
ctctgagatctaaggatgtcac

SEQ ID NO: 1224741 - DNA, 13 bp, Homo sapiens
ctctgagcacagg

SEQ ID NO: 1224742 - DNA, 23 bp, Homo sapiens
ctctgagcacatagtgtcctgcc

SEQ ID NO: 1224743 - DNA, 16 bp, Homo sapiens
ctctgagcaggggcag

SEQ ID NO: 1224744 - DNA, 16 bp, Homo sapiens
ctctgagcatcaagaa

SEQ ID NO: 1224745 - DNA, 18 bp, Homo sapiens
ctctgagccaagggaggg

SEQ ID NO: 1224746 - DNA, 19 bp, Homo sapiens
ctctgagccaagggaggga

SEQ ID NO: 1224747 - DNA, 18 bp, Homo sapiens
ctctgagccacagtggga

SEQ ID NO: 1224748 - DNA, 12 bp, Homo sapiens
ctctgagcccag

SEQ ID NO: 1224749 - DNA, 13 bp, Homo sapiens
ctctgagcccagg

SEQ ID NO: 1224750 - DNA, 16 bp, Homo sapiens
ctctgagcccaggccg

SEQ ID NO: 1224751 - DNA, 13 bp, Homo sapiens
ctctgagcccata

SEQ ID NO: 1224752 - DNA, 15 bp, Homo sapiens
ctctgagctggggag

SEQ ID NO: 1224753 - DNA, 18 bp, Homo sapiens
ctctgaggaagcagttgg

SEQ ID NO: 1224754 - DNA, 12 bp, Homo sapiens
ctctgaggacaa

SEQ ID NO: 1224755 - DNA, 20 bp, Homo sapiens
ctctgaggacagaggccggg

SEQ ID NO: 1224756 - DNA, 20 bp, Homo sapiens
ctctgaggacaggctctaga

SEQ ID NO: 1224757 - DNA, 22 bp, Homo sapiens
ctctgaggacaggctctagaga

SEQ ID NO: 1224758 - DNA, 20 bp, Homo sapiens
ctctgaggctctttctgggc

SEQ ID NO: 1224759 - DNA, 21 bp, Homo sapiens
ctctgaggctggatcctagcc

SEQ ID NO: 1224760 - DNA, 21 bp, Homo sapiens
ctctgaggggaggcacctcca

SEQ ID NO: 1224761 - DNA, 23 bp, Homo sapiens
ctctgaggggaggcacctccagg

SEQ ID NO: 1224762 - DNA, 16 bp, Homo sapiens
ctctgaggtcaataaa

SEQ ID NO: 1224763 - DNA, 21 bp, Homo sapiens
ctctgaggtcaataaagcaga

SEQ ID NO: 1224764 - DNA, 22 bp, Homo sapiens
ctctgaggtcaataaagcagag

SEQ ID NO: 1224765 - DNA, 14 bp, Homo sapiens
ctctgaggtccctt

SEQ ID NO: 1224766 - DNA, 19 bp, Homo sapiens
ctctgaggtgcctgtccca

SEQ ID NO: 1224767 - DNA, 19 bp, Homo sapiens
ctctgagtcacaggtgtgg

SEQ ID NO: 1224768 - DNA, 17 bp, Homo sapiens
ctctgagtccactgctc

SEQ ID NO: 1224769 - DNA, 13 bp, Homo sapiens
ctctgcacaagct

SEQ ID NO: 1224770 - DNA, 14 bp, Homo sapiens
ctctgcacaagctg

SEQ ID NO: 1224771 - DNA, 18 bp, Homo sapiens
ctctgcacaagctgcacc

SEQ ID NO: 1224772 - DNA, 19 bp, Homo sapiens
ctctgcacaagctgcaccc

SEQ ID NO: 1224773 - DNA, 21 bp, Homo sapiens
ctctgcacaagctgcaccctc

SEQ ID NO: 1224774 - DNA, 22 bp, Homo sapiens
ctctgcacaccctccagagaca

SEQ ID NO: 1224775 - DNA, 16 bp, Homo sapiens
ctctgcacccagaaca

SEQ ID NO: 1224776 - DNA, 15 bp, Homo sapiens
ctctgcacccctctg

SEQ ID NO: 1224777 - DNA, 18 bp, Homo sapiens
ctctgcactactgacatg

SEQ ID NO: 1224778 - DNA, 17 bp, Homo sapiens
ctctgcactccatggcc

SEQ ID NO: 1224779 - DNA, 22 bp, Homo sapiens
ctctgcactccatggccacccc

SEQ ID NO: 1224780 - DNA, 19 bp, Homo sapiens
ctctgcactcccacctgac

SEQ ID NO: 1224781 - DNA, 18 bp, Homo sapiens
ctctgcagaaactactga

SEQ ID NO: 1224782 - DNA, 19 bp, Homo sapiens
ctctgcagacttcccagct

SEQ ID NO: 1224783 - DNA, 22 bp, Homo sapiens
ctctgcagacttcccagctagg

SEQ ID NO: 1224784 - DNA, 14 bp, Homo sapiens
ctctgcagagtcac

SEQ ID NO: 1224785 - DNA, 13 bp, Homo sapiens
ctctgcagcaata

SEQ ID NO: 1224786 - DNA, 15 bp, Homo sapiens
ctctgcagcccagcc

SEQ ID NO: 1224787 - DNA, 11 bp, Homo sapiens
ctctgcagctg

SEQ ID NO: 1224788 - DNA, 12 bp, Homo sapiens
ctctgcagctga

SEQ ID NO: 1224789 - DNA, 18 bp, Homo sapiens
ctctgcagctgacctctg

SEQ ID NO: 1224790 - DNA, 13 bp, Homo sapiens
ctctgcagctgcc

SEQ ID NO: 1224791 - DNA, 14 bp, Homo sapiens
ctctgcagctgccg

SEQ ID NO: 1224792 - DNA, 16 bp, Homo sapiens
ctctgcaggctgggga

SEQ ID NO: 1224793 - DNA, 18 bp, Homo sapiens
ctctgcagtaaaacacat

SEQ ID NO: 1224794 - DNA, 14 bp, Homo sapiens
ctctgcagtgcctt

SEQ ID NO: 1224795 - DNA, 16 bp, Homo sapiens
ctctgcagtgccttgg

SEQ ID NO: 1224796 - DNA, 12 bp, Homo sapiens
ctctgcagtttt

SEQ ID NO: 1224797 - DNA, 19 bp, Homo sapiens
ctctgcagtttttcccaag

SEQ ID NO: 1224798 - DNA, 15 bp, Homo sapiens
ctctgcattctagta

SEQ ID NO: 1224799 - DNA, 17 bp, Homo sapiens
ctctgcatttaaaaaaa

SEQ ID NO: 1224800 - DNA, 20 bp, Homo sapiens
ctctgccaatgtgggctgcc

SEQ ID NO: 1224801 - DNA, 13 bp, Homo sapiens
ctctgccacccac

SEQ ID NO: 1224802 - DNA, 20 bp, Homo sapiens
ctctgccaccctacctgttc

SEQ ID NO: 1224803 - DNA, 19 bp, Homo sapiens
ctctgccagtcgggagagc

SEQ ID NO: 1224804 - DNA, 22 bp, Homo sapiens
ctctgccagtcgggagagccag

SEQ ID NO: 1224805 - DNA, 23 bp, Homo sapiens
ctctgccagtcgggagagccagg

SEQ ID NO: 1224806 - DNA, 15 bp, Homo sapiens
ctctgccagtgacag

SEQ ID NO: 1224807 - DNA, 22 bp, Homo sapiens
ctctgccatgtttttcccctgc

SEQ ID NO: 1224808 - DNA, 23 bp, Homo sapiens
ctctgcccaaccaggttgcagta

SEQ ID NO: 1224809 - DNA, 14 bp, Homo sapiens
ctctgcccaccctc

SEQ ID NO: 1224810 - DNA, 17 bp, Homo sapiens
ctctgcccacctctctt

SEQ ID NO: 1224811 - DNA, 14 bp, Homo sapiens
ctctgcccacctgg

SEQ ID NO: 1224812 - DNA, 17 bp, Homo sapiens
ctctgcccacctggggt

SEQ ID NO: 1224813 - DNA, 11 bp, Homo sapiens
ctctgcccact

SEQ ID NO: 1224814 - DNA, 20 bp, Homo sapiens
ctctgcccagccggagggac

SEQ ID NO: 1224815 - DNA, 15 bp, Homo sapiens
ctctgcccagcttgg

SEQ ID NO: 1224816 - DNA, 18 bp, Homo sapiens
ctctgcccagcttgggcc

SEQ ID NO: 1224817 - DNA, 16 bp, Homo sapiens
ctctgccccaagcagc

SEQ ID NO: 1224818 - DNA, 18 bp, Homo sapiens
ctctgccccaagcagcca

SEQ ID NO: 1224819 - DNA, 20 bp, Homo sapiens
ctctgccccaagcagccagc

SEQ ID NO: 1224820 - DNA, 22 bp, Homo sapiens
ctctgccccaagcagccagcca

SEQ ID NO: 1224821 - DNA, 18 bp, Homo sapiens
ctctgccccaagccccca

SEQ ID NO: 1224822 - DNA, 22 bp, Homo sapiens
ctctgccccaatcgggtccaga

SEQ ID NO: 1224823 - DNA, 23 bp, Homo sapiens
ctctgccccaatcgggtccagag

SEQ ID NO: 1224824 - DNA, 13 bp, Homo sapiens
ctctgccccagct

SEQ ID NO: 1224825 - DNA, 16 bp, Homo sapiens
ctctgccccagctctg

SEQ ID NO: 1224826 - DNA, 18 bp, Homo sapiens
ctctgccccagctctggc

SEQ ID NO: 1224827 - DNA, 21 bp, Homo sapiens
ctctgccccagctctggcttc

SEQ ID NO: 1224828 - DNA, 12 bp, Homo sapiens
ctctgccccagt

SEQ ID NO: 1224829 - DNA, 15 bp, Homo sapiens
ctctgccccatcctc

SEQ ID NO: 1224830 - DNA, 17 bp, Homo sapiens
ctctgccccatcctcca

SEQ ID NO: 1224831 - DNA, 24 bp, Homo sapiens
ctctgccccatcctccagcaggga

SEQ ID NO: 1224832 - DNA, 21 bp, Homo sapiens
ctctgcccccgcgggttctag

SEQ ID NO: 1224833 - DNA, 22 bp, Homo sapiens
ctctgcccccgcgggttctaga

SEQ ID NO: 1224834 - DNA, 15 bp, Homo sapiens
ctctgcccctaagct

SEQ ID NO: 1224835 - DNA, 20 bp, Homo sapiens
ctctgcccctcagggggcca

SEQ ID NO: 1224836 - DNA, 23 bp, Homo sapiens
ctctgcccctcagggggccagct

SEQ ID NO: 1224837 - DNA, 19 bp, Homo sapiens
ctctgcccctcccccagcc

SEQ ID NO: 1224838 - DNA, 15 bp, Homo sapiens
ctctgcccctggacc

SEQ ID NO: 1224839 - DNA, 12 bp, Homo sapiens
ctctgcccgggc

SEQ ID NO: 1224840 - DNA, 16 bp, Homo sapiens
ctctgcccgggcccct

SEQ ID NO: 1224841 - DNA, 22 bp, Homo sapiens
ctctgccctcattactgggcct

SEQ ID NO: 1224842 - DNA, 16 bp, Homo sapiens
ctctgccctctagagc

SEQ ID NO: 1224843 - DNA, 18 bp, Homo sapiens
ctctgccctctccctgtg

SEQ ID NO: 1224844 - DNA, 13 bp, Homo sapiens
ctctgccctctgc

SEQ ID NO: 1224845 - DNA, 14 bp, Homo sapiens
ctctgccctctgct

SEQ ID NO: 1224846 - DNA, 23 bp, Homo sapiens
ctctgccctgcctccctttctgg

SEQ ID NO: 1224847 - DNA, 21 bp, Homo sapiens
ctctgcccttgatcagcccca

SEQ ID NO: 1224848 - DNA, 21 bp, Homo sapiens
ctctgcccttgttccctaggg

SEQ ID NO: 1224849 - DNA, 21 bp, Homo sapiens
ctctgccgatctaattacagc

SEQ ID NO: 1224850 - DNA, 18 bp, Homo sapiens
ctctgccgcaatacagga

SEQ ID NO: 1224851 - DNA, 14 bp, Homo sapiens
ctctgccgctgtgt

SEQ ID NO: 1224852 - DNA, 17 bp, Homo sapiens
ctctgccgctgtgtagg

SEQ ID NO: 1224853 - DNA, 14 bp, Homo sapiens
ctctgccggctctt

SEQ ID NO: 1224854 - DNA, 18 bp, Homo sapiens
ctctgccggctctttcct

SEQ ID NO: 1224855 - DNA, 15 bp, Homo sapiens
ctctgccgtctctcc

SEQ ID NO: 1224856 - DNA, 23 bp, Homo sapiens
ctctgccgtctctcctgctctca

SEQ ID NO: 1224857 - DNA, 15 bp, Homo sapiens
ctctgccgtctctgg

SEQ ID NO: 1224858 - DNA, 17 bp, Homo sapiens
ctctgccgtctctggag

SEQ ID NO: 1224859 - DNA, 15 bp, Homo sapiens
ctctgcctcccaggt

SEQ ID NO: 1224860 - DNA, 16 bp, Homo sapiens
ctctgcctcccaggtt

SEQ ID NO: 1224861 - DNA, 17 bp, Homo sapiens
ctctgcctccctctcca

SEQ ID NO: 1224862 - DNA, 13 bp, Homo sapiens
ctctgcctcctca

SEQ ID NO: 1224863 - DNA, 14 bp, Homo sapiens
ctctgcctcctctt

SEQ ID NO: 1224864 - DNA, 15 bp, Homo sapiens
ctctgcctcctcttc

SEQ ID NO: 1224865 - DNA, 16 bp, Homo sapiens
ctctgcctctcccagg

SEQ ID NO: 1224866 - DNA, 19 bp, Homo sapiens
ctctgcctctcttcttccc

SEQ ID NO: 1224867 - DNA, 13 bp, Homo sapiens
ctctgcctctggg

SEQ ID NO: 1224868 - DNA, 12 bp, Homo sapiens
ctctgcctgcac

SEQ ID NO: 1224869 - DNA, 14 bp, Homo sapiens
ctctgcctgcactc

SEQ ID NO: 1224870 - DNA, 22 bp, Homo sapiens
ctctgcctgcactccctggcct

SEQ ID NO: 1224871 - DNA, 11 bp, Homo sapiens
ctctgcctgcc

SEQ ID NO: 1224872 - DNA, 11 bp, Homo sapiens
ctctgcctggg

SEQ ID NO: 1224873 - DNA, 21 bp, Homo sapiens
ctctgcctggggcctccagaa

SEQ ID NO: 1224874 - DNA, 16 bp, Homo sapiens
ctctgcctgtccctct

SEQ ID NO: 1224875 - DNA, 18 bp, Homo sapiens
ctctgcctgtccctctca

SEQ ID NO: 1224876 - DNA, 13 bp, Homo sapiens
ctctgcctgtctg

SEQ ID NO: 1224877 - DNA, 13 bp, Homo sapiens
ctctgccttggac

SEQ ID NO: 1224878 - DNA, 22 bp, Homo sapiens
ctctgccttttttcacagcccg

SEQ ID NO: 1224879 - DNA, 14 bp, Homo sapiens
ctctgcgccaggca

SEQ ID NO: 1224880 - DNA, 16 bp, Homo sapiens
ctctgcgccaggcaga

SEQ ID NO: 1224881 - DNA, 20 bp, Homo sapiens
ctctgcgccaggcagagctg

SEQ ID NO: 1224882 - DNA, 17 bp, Homo sapiens
ctctgcgggaggctggg

SEQ ID NO: 1224883 - DNA, 19 bp, Homo sapiens
ctctgctacgttcctattg

SEQ ID NO: 1224884 - DNA, 21 bp, Homo sapiens
ctctgctcaccgcccatcagg

SEQ ID NO: 1224885 - DNA, 13 bp, Homo sapiens
ctctgctcaggcc

SEQ ID NO: 1224886 - DNA, 21 bp, Homo sapiens
ctctgctcaggcctccctagc

SEQ ID NO: 1224887 - DNA, 23 bp, Homo sapiens
ctctgctcaggcctccctagcac

SEQ ID NO: 1224888 - DNA, 13 bp, Homo sapiens
ctctgctcatggg

SEQ ID NO: 1224889 - DNA, 20 bp, Homo sapiens
ctctgctcatgggtggctgt

SEQ ID NO: 1224890 - DNA, 13 bp, Homo sapiens
ctctgctccacca

SEQ ID NO: 1224891 - DNA, 14 bp, Homo sapiens
ctctgctccaccac

SEQ ID NO: 1224892 - DNA, 15 bp, Homo sapiens
ctctgctccaccaca

SEQ ID NO: 1224893 - DNA, 19 bp, Homo sapiens
ctctgctcctacatccagc

SEQ ID NO: 1224894 - DNA, 22 bp, Homo sapiens
ctctgctcctacatccagctcc

SEQ ID NO: 1224895 - DNA, 17 bp, Homo sapiens
ctctgctcctggagcct

SEQ ID NO: 1224896 - DNA, 17 bp, Homo sapiens
ctctgctcgccctcctt

SEQ ID NO: 1224897 - DNA, 15 bp, Homo sapiens
ctctgctctagccag

SEQ ID NO: 1224898 - DNA, 19 bp, Homo sapiens
ctctgctctagccaggagt

SEQ ID NO: 1224899 - DNA, 23 bp, Homo sapiens
ctctgctctagccaggagtctgt

SEQ ID NO: 1224900 - DNA, 11 bp, Homo sapiens
ctctgctctgc

SEQ ID NO: 1224901 - DNA, 14 bp, Homo sapiens
ctctgctctgccct

SEQ ID NO: 1224902 - DNA, 15 bp, Homo sapiens
ctctgctctgcctgg

SEQ ID NO: 1224903 - DNA, 16 bp, Homo sapiens
ctctgctctgcctgga

SEQ ID NO: 1224904 - DNA, 13 bp, Homo sapiens
ctctgctctgcgt

SEQ ID NO: 1224905 - DNA, 14 bp, Homo sapiens
ctctgctctgtcct

SEQ ID NO: 1224906 - DNA, 20 bp, Homo sapiens
ctctgctcttgtttcactcc

SEQ ID NO: 1224907 - DNA, 22 bp, Homo sapiens
ctctgctcttgtttcactccac

SEQ ID NO: 1224908 - DNA, 13 bp, Homo sapiens
ctctgctgacctg

SEQ ID NO: 1224909 - DNA, 16 bp, Homo sapiens
ctctgctgagctgggc

SEQ ID NO: 1224910 - DNA, 20 bp, Homo sapiens
ctctgctgagctgggcccag

SEQ ID NO: 1224911 - DNA, 19 bp, Homo sapiens
ctctgctgagtgctgggca

SEQ ID NO: 1224912 - DNA, 13 bp, Homo sapiens
ctctgctgccatg

SEQ ID NO: 1224913 - DNA, 15 bp, Homo sapiens
ctctgctgccccctt

SEQ ID NO: 1224914 - DNA, 22 bp, Homo sapiens
ctctgctgcccccttccccagc

SEQ ID NO: 1224915 - DNA, 12 bp, Homo sapiens
ctctgctgcctc

SEQ ID NO: 1224916 - DNA, 14 bp, Homo sapiens
ctctgctgcctctg

SEQ ID NO: 1224917 - DNA, 19 bp, Homo sapiens
ctctgctgcctctgtggaa

SEQ ID NO: 1224918 - DNA, 14 bp, Homo sapiens
ctctgctgctgccc

SEQ ID NO: 1224919 - DNA, 15 bp, Homo sapiens
ctctgctgctgcccg

SEQ ID NO: 1224920 - DNA, 16 bp, Homo sapiens
ctctgctgctgtccct

SEQ ID NO: 1224921 - DNA, 21 bp, Homo sapiens
ctctgctgctgtccctccccc

SEQ ID NO: 1224922 - DNA, 15 bp, Homo sapiens
ctctgctgggtctcc

SEQ ID NO: 1224923 - DNA, 16 bp, Homo sapiens
ctctgctggtcttcaa

SEQ ID NO: 1224924 - DNA, 18 bp, Homo sapiens
ctctgctggtcttcaatt

SEQ ID NO: 1224925 - DNA, 13 bp, Homo sapiens
ctctgctgtagct

SEQ ID NO: 1224926 - DNA, 15 bp, Homo sapiens
ctctgcttaaacaaa

SEQ ID NO: 1224927 - DNA, 17 bp, Homo sapiens
ctctgcttaaacaaagc

SEQ ID NO: 1224928 - DNA, 18 bp, Homo sapiens
ctctgcttaaacaaagca

SEQ ID NO: 1224929 - DNA, 22 bp, Homo sapiens
ctctgcttaccgttcaagaggc

SEQ ID NO: 1224930 - DNA, 21 bp, Homo sapiens
ctctgcttactaatgtgcccc

SEQ ID NO: 1224931 - DNA, 22 bp, Homo sapiens
ctctgcttactaatgtgcccca

SEQ ID NO: 1224932 - DNA, 15 bp, Homo sapiens
ctctgcttacttttt

SEQ ID NO: 1224933 - DNA, 18 bp, Homo sapiens
ctctgcttactttttata

SEQ ID NO: 1224934 - DNA, 15 bp, Homo sapiens
ctctgcttctctgac

SEQ ID NO: 1224935 - DNA, 21 bp, Homo sapiens
ctctgcttctctgacttctgc

SEQ ID NO: 1224936 - DNA, 18 bp, Homo sapiens
ctctgctttccttttctc

SEQ ID NO: 1224937 - DNA, 12 bp, Homo sapiens
ctctggaaaaat

SEQ ID NO: 1224938 - DNA, 18 bp, Homo sapiens
ctctggaaaactcaggat

SEQ ID NO: 1224939 - DNA, 13 bp, Homo sapiens
ctctggaaagaaa

SEQ ID NO: 1224940 - DNA, 16 bp, Homo sapiens
ctctggaaccccccag

SEQ ID NO: 1224941 - DNA, 21 bp, Homo sapiens
ctctggaagagaggaatgcct

SEQ ID NO: 1224942 - DNA, 19 bp, Homo sapiens
ctctggaagccctggagac

SEQ ID NO: 1224943 - DNA, 16 bp, Homo sapiens
ctctggaagcctggac

SEQ ID NO: 1224944 - DNA, 16 bp, Homo sapiens
ctctggaaggggcagc

SEQ ID NO: 1224945 - DNA, 19 bp, Homo sapiens
ctctggaaggggcagccct

SEQ ID NO: 1224946 - DNA, 21 bp, Homo sapiens
ctctggaataaagttgcagat

SEQ ID NO: 1224947 - DNA, 15 bp, Homo sapiens
ctctggaatgttttt

SEQ ID NO: 1224948 - DNA, 20 bp, Homo sapiens
ctctggacagatggacgcag

SEQ ID NO: 1224949 - DNA, 22 bp, Homo sapiens
ctctggacagcagaagcctcca

SEQ ID NO: 1224950 - DNA, 23 bp, Homo sapiens
ctctggacatgatttagggaagc

SEQ ID NO: 1224951 - DNA, 16 bp, Homo sapiens
ctctggaccaaccctg

SEQ ID NO: 1224952 - DNA, 13 bp, Homo sapiens
ctctggaccagcc

SEQ ID NO: 1224953 - DNA, 17 bp, Homo sapiens
ctctggacggcaggctc

SEQ ID NO: 1224954 - DNA, 18 bp, Homo sapiens
ctctggacgttgtgagaa

SEQ ID NO: 1224955 - DNA, 15 bp, Homo sapiens
ctctggactggctag

SEQ ID NO: 1224956 - DNA, 16 bp, Homo sapiens
ctctggactggctaga

SEQ ID NO: 1224957 - DNA, 13 bp, Homo sapiens
ctctggactttct

SEQ ID NO: 1224958 - DNA, 21 bp, Homo sapiens
ctctggactttctctaataat

SEQ ID NO: 1224959 - DNA, 23 bp, Homo sapiens
ctctggactttctctaataataa

SEQ ID NO: 1224960 - DNA, 12 bp, Homo sapiens
ctctggagcagc

SEQ ID NO: 1224961 - DNA, 14 bp, Homo sapiens
ctctggagccagag

SEQ ID NO: 1224962 - DNA, 16 bp, Homo sapiens
ctctggagccagagag

SEQ ID NO: 1224963 - DNA, 22 bp, Homo sapiens
ctctggagccagagagaacaac

SEQ ID NO: 1224964 - DNA, 20 bp, Homo sapiens
ctctggaggaagttctccag

SEQ ID NO: 1224965 - DNA, 23 bp, Homo sapiens
ctctggaggaagttctccagctt

SEQ ID NO: 1224966 - DNA, 21 bp, Homo sapiens
ctctggaggcctctggccctc

SEQ ID NO: 1224967 - DNA, 19 bp, Homo sapiens
ctctggaggctgcagagct

SEQ ID NO: 1224968 - DNA, 19 bp, Homo sapiens
ctctggaggtgctgctcta

SEQ ID NO: 1224969 - DNA, 20 bp, Homo sapiens
ctctggagtgatggtgtcct

SEQ ID NO: 1224970 - DNA, 20 bp, Homo sapiens
ctctggagtggccactaagc

SEQ ID NO: 1224971 - DNA, 22 bp, Homo sapiens
ctctggatctgttccttggcag

SEQ ID NO: 1224972 - DNA, 17 bp, Homo sapiens
ctctggatgaaggcaaa

SEQ ID NO: 1224973 - DNA, 19 bp, Homo sapiens
ctctggatgaaggcaaaaa

SEQ ID NO: 1224974 - DNA, 15 bp, Homo sapiens
ctctggatggcacca

SEQ ID NO: 1224975 - DNA, 19 bp, Homo sapiens
ctctggatggcaccagagg

SEQ ID NO: 1224976 - DNA, 17 bp, Homo sapiens
ctctggattcagccttc

SEQ ID NO: 1224977 - DNA, 16 bp, Homo sapiens
ctctggcacagtgatg

SEQ ID NO: 1224978 - DNA, 19 bp, Homo sapiens
ctctggcagttctggaatg

SEQ ID NO: 1224979 - DNA, 18 bp, Homo sapiens
ctctggcattagaattat

SEQ ID NO: 1224980 - DNA, 19 bp, Homo sapiens
ctctggcattagaattatt

SEQ ID NO: 1224981 - DNA, 20 bp, Homo sapiens
ctctggcattagaattattt

SEQ ID NO: 1224982 - DNA, 13 bp, Homo sapiens
ctctggcatttgt

SEQ ID NO: 1224983 - DNA, 21 bp, Homo sapiens
ctctggccaaatatgcacttt

SEQ ID NO: 1224984 - DNA, 22 bp, Homo sapiens
ctctggccaaatatgcactttc

SEQ ID NO: 1224985 - DNA, 12 bp, Homo sapiens
ctctggccaccc

SEQ ID NO: 1224986 - DNA, 13 bp, Homo sapiens
ctctggccaccct

SEQ ID NO: 1224987 - DNA, 14 bp, Homo sapiens
ctctggccaccctg

SEQ ID NO: 1224988 - DNA, 19 bp, Homo sapiens
ctctggccaccctggcccg

SEQ ID NO: 1224989 - DNA, 22 bp, Homo sapiens
ctctggccaccctggcccgccc

SEQ ID NO: 1224990 - DNA, 19 bp, Homo sapiens
ctctggccaggatggaggg

SEQ ID NO: 1224991 - DNA, 18 bp, Homo sapiens
ctctggcccagaaagcct

SEQ ID NO: 1224992 - DNA, 21 bp, Homo sapiens
ctctggcccagaaagcctctc

SEQ ID NO: 1224993 - DNA, 15 bp, Homo sapiens
ctctggcccctcacc

SEQ ID NO: 1224994 - DNA, 22 bp, Homo sapiens
ctctggcccctcacccaccatg

SEQ ID NO: 1224995 - DNA, 20 bp, Homo sapiens
ctctggccctcggtggctgc

SEQ ID NO: 1224996 - DNA, 15 bp, Homo sapiens
ctctggccctgcctt

SEQ ID NO: 1224997 - DNA, 12 bp, Homo sapiens
ctctggcccttg

SEQ ID NO: 1224998 - DNA, 15 bp, Homo sapiens
ctctggcccttggaa

SEQ ID NO: 1224999 - DNA, 19 bp, Homo sapiens
ctctggccgccacccccat

SEQ ID NO: 1225000 - DNA, 21 bp, Homo sapiens
ctctggctagaggccagcccc

SEQ ID NO: 1225001 - DNA, 13 bp, Homo sapiens
ctctggctcagcc

SEQ ID NO: 1225002 - DNA, 15 bp, Homo sapiens
ctctggctcagcctg

SEQ ID NO: 1225003 - DNA, 17 bp, Homo sapiens
ctctggctccagaggac

SEQ ID NO: 1225004 - DNA, 20 bp, Homo sapiens
ctctggctccagaggacctg

SEQ ID NO: 1225005 - DNA, 11 bp, Homo sapiens
ctctggctctg

SEQ ID NO: 1225006 - DNA, 17 bp, Homo sapiens
ctctggctgaaccctgt

SEQ ID NO: 1225007 - DNA, 20 bp, Homo sapiens
ctctggctgaaccctgtgct

SEQ ID NO: 1225008 - DNA, 21 bp, Homo sapiens
ctctggctgaaccctgtgctg

SEQ ID NO: 1225009 - DNA, 13 bp, Homo sapiens
ctctggctggcta

SEQ ID NO: 1225010 - DNA, 15 bp, Homo sapiens
ctctggctggtcttc

SEQ ID NO: 1225011 - DNA, 12 bp, Homo sapiens
ctctggcttccc

SEQ ID NO: 1225012 - DNA, 21 bp, Homo sapiens
ctctggcttgccccaggactc

SEQ ID NO: 1225013 - DNA, 20 bp, Homo sapiens
ctctggctttattactcccc

SEQ ID NO: 1225014 - DNA, 18 bp, Homo sapiens
ctctggctttcccaggag

SEQ ID NO: 1225015 - DNA, 15 bp, Homo sapiens
ctctggcttttggaa

SEQ ID NO: 1225016 - DNA, 16 bp, Homo sapiens
ctctggcttttggaag

SEQ ID NO: 1225017 - DNA, 20 bp, Homo sapiens
ctctgggacctagggggacg

SEQ ID NO: 1225018 - DNA, 17 bp, Homo sapiens
ctctgggactctcctcc

SEQ ID NO: 1225019 - DNA, 20 bp, Homo sapiens
ctctgggactctcctcctcc

SEQ ID NO: 1225020 - DNA, 18 bp, Homo sapiens
ctctgggagaaaatcatc

SEQ ID NO: 1225021 - DNA, 12 bp, Homo sapiens
ctctgggagagc

SEQ ID NO: 1225022 - DNA, 20 bp, Homo sapiens
ctctgggagtccccatccca

SEQ ID NO: 1225023 - DNA, 15 bp, Homo sapiens
ctctgggcacagtgc

SEQ ID NO: 1225024 - DNA, 16 bp, Homo sapiens
ctctgggcagcctgct

SEQ ID NO: 1225025 - DNA, 23 bp, Homo sapiens
ctctgggcaggacctcagagtcc

SEQ ID NO: 1225026 - DNA, 14 bp, Homo sapiens
ctctgggcccaggg

SEQ ID NO: 1225027 - DNA, 22 bp, Homo sapiens
ctctgggcccaggggctgtggc

SEQ ID NO: 1225028 - DNA, 20 bp, Homo sapiens
ctctgggccgggcctggggc

SEQ ID NO: 1225029 - DNA, 21 bp, Homo sapiens
ctctgggccgggcctggggct

SEQ ID NO: 1225030 - DNA, 14 bp, Homo sapiens
ctctgggcctgggg

SEQ ID NO: 1225031 - DNA, 13 bp, Homo sapiens
ctctgggcctgtg

SEQ ID NO: 1225032 - DNA, 18 bp, Homo sapiens
ctctgggcctgtgtgtgg

SEQ ID NO: 1225033 - DNA, 18 bp, Homo sapiens
ctctgggctatggacaca

SEQ ID NO: 1225034 - DNA, 16 bp, Homo sapiens
ctctgggctcagggct

SEQ ID NO: 1225035 - DNA, 17 bp, Homo sapiens
ctctgggctcagggctg

SEQ ID NO: 1225036 - DNA, 22 bp, Homo sapiens
ctctgggctcagggctggagtg

SEQ ID NO: 1225037 - DNA, 10 bp, Homo sapiens
ctctggggac

SEQ ID NO: 1225038 - DNA, 17 bp, Homo sapiens
ctctggggatttctggg

SEQ ID NO: 1225039 - DNA, 15 bp, Homo sapiens
ctctggggcagatcc

SEQ ID NO: 1225040 - DNA, 16 bp, Homo sapiens
ctctggggcagatccc

SEQ ID NO: 1225041 - DNA, 20 bp, Homo sapiens
ctctggggccacacagaaac

SEQ ID NO: 1225042 - DNA, 15 bp, Homo sapiens
ctctggggccctggg

SEQ ID NO: 1225043 - DNA, 18 bp, Homo sapiens
ctctggggccctgggcct

SEQ ID NO: 1225044 - DNA, 21 bp, Homo sapiens
ctctggggccctgggcctcag

SEQ ID NO: 1225045 - DNA, 22 bp, Homo sapiens
ctctggggccctgggcctcagt

SEQ ID NO: 1225046 - DNA, 16 bp, Homo sapiens
ctctggggcttgtcct

SEQ ID NO: 1225047 - DNA, 19 bp, Homo sapiens
ctctggggcttgtcctgtg

SEQ ID NO: 1225048 - DNA, 17 bp, Homo sapiens
ctctgggggacccaggt

SEQ ID NO: 1225049 - DNA, 17 bp, Homo sapiens
ctctgggggaggcaggg

SEQ ID NO: 1225050 - DNA, 16 bp, Homo sapiens
ctctgggtcccggggt

SEQ ID NO: 1225051 - DNA, 22 bp, Homo sapiens
ctctgggtccttggctcccggg

SEQ ID NO: 1225052 - DNA, 17 bp, Homo sapiens
ctctggtaatattgact

SEQ ID NO: 1225053 - DNA, 16 bp, Homo sapiens
ctctggtcccctctct

SEQ ID NO: 1225054 - DNA, 17 bp, Homo sapiens
ctctggtcccctctctt

SEQ ID NO: 1225055 - DNA, 16 bp, Homo sapiens
ctctggtcgctcctgc

SEQ ID NO: 1225056 - DNA, 23 bp, Homo sapiens
ctctggtgagtcaccacttcagg

SEQ ID NO: 1225057 - DNA, 21 bp, Homo sapiens
ctctggtgagtcttggcggca

SEQ ID NO: 1225058 - DNA, 23 bp, Homo sapiens
ctctggtgagtcttggcggcagc

SEQ ID NO: 1225059 - DNA, 22 bp, Homo sapiens
ctctggtgataaaaataaagct

SEQ ID NO: 1225060 - DNA, 17 bp, Homo sapiens
ctctggtggcacaggag

SEQ ID NO: 1225061 - DNA, 15 bp, Homo sapiens
ctctggtggctcctc

SEQ ID NO: 1225062 - DNA, 17 bp, Homo sapiens
ctctggtggctcctcct

SEQ ID NO: 1225063 - DNA, 19 bp, Homo sapiens
ctctggtggctcctcctag

SEQ ID NO: 1225064 - DNA, 20 bp, Homo sapiens
ctctggtggctcctcctagg

SEQ ID NO: 1225065 - DNA, 20 bp, Homo sapiens
ctctggtggtcttccttcta

SEQ ID NO: 1225066 - DNA, 23 bp, Homo sapiens
ctctggtgtgtggtgaggggctt

SEQ ID NO: 1225067 - DNA, 20 bp, Homo sapiens
ctctggttatttttctcttg

SEQ ID NO: 1225068 - DNA, 22 bp, Homo sapiens
ctctggttatttttctcttgta

SEQ ID NO: 1225069 - DNA, 15 bp, Homo sapiens
ctctggttctgacac

SEQ ID NO: 1225070 - DNA, 14 bp, Homo sapiens
ctctggttgcctcc

SEQ ID NO: 1225071 - DNA, 23 bp, Homo sapiens
ctctggttgtttctgttccaaat

SEQ ID NO: 1225072 - DNA, 18 bp, Homo sapiens
ctctggttttcctctgct

SEQ ID NO: 1225073 - DNA, 18 bp, Homo sapiens
ctctgtaattgaatatta

SEQ ID NO: 1225074 - DNA, 15 bp, Homo sapiens
ctctgtaattgcaaa

SEQ ID NO: 1225075 - DNA, 16 bp, Homo sapiens
ctctgtaattgcaaaa

SEQ ID NO: 1225076 - DNA, 22 bp, Homo sapiens
ctctgtacttttcattctcttt

SEQ ID NO: 1225077 - DNA, 16 bp, Homo sapiens
ctctgtaggatcgtaa

SEQ ID NO: 1225078 - DNA, 18 bp, Homo sapiens
ctctgtaggcacagagct

SEQ ID NO: 1225079 - DNA, 17 bp, Homo sapiens
ctctgtaggcagcagag

SEQ ID NO: 1225080 - DNA, 22 bp, Homo sapiens
ctctgtagggaactctggggtc

SEQ ID NO: 1225081 - DNA, 15 bp, Homo sapiens
ctctgtatagaaatc

SEQ ID NO: 1225082 - DNA, 18 bp, Homo sapiens
ctctgtatagaaatctaa

SEQ ID NO: 1225083 - DNA, 20 bp, Homo sapiens
ctctgtatagaaatctaaaa

SEQ ID NO: 1225084 - DNA, 22 bp, Homo sapiens
ctctgtatcaggacccagagga

SEQ ID NO: 1225085 - DNA, 13 bp, Homo sapiens
ctctgtcacatcc

SEQ ID NO: 1225086 - DNA, 15 bp, Homo sapiens
ctctgtcactccagg

SEQ ID NO: 1225087 - DNA, 14 bp, Homo sapiens
ctctgtcagccagc

SEQ ID NO: 1225088 - DNA, 17 bp, Homo sapiens
ctctgtcagccagccgc

SEQ ID NO: 1225089 - DNA, 21 bp, Homo sapiens
ctctgtcagccagccgccctg

SEQ ID NO: 1225090 - DNA, 20 bp, Homo sapiens
ctctgtcatcactccctgga

SEQ ID NO: 1225091 - DNA, 21 bp, Homo sapiens
ctctgtcatcactccctggat

SEQ ID NO: 1225092 - DNA, 14 bp, Homo sapiens
ctctgtccaggcca

SEQ ID NO: 1225093 - DNA, 21 bp, Homo sapiens
ctctgtccaggccactgtggc

SEQ ID NO: 1225094 - DNA, 14 bp, Homo sapiens
ctctgtccagggcc

SEQ ID NO: 1225095 - DNA, 21 bp, Homo sapiens
ctctgtccagggccctgagct

SEQ ID NO: 1225096 - DNA, 16 bp, Homo sapiens
ctctgtccccacgagg

SEQ ID NO: 1225097 - DNA, 20 bp, Homo sapiens
ctctgtccccacgaggggac

SEQ ID NO: 1225098 - DNA, 18 bp, Homo sapiens
ctcttccagggcagcggc

SEQ ID NO: 1225099 - DNA, 13 bp, Homo sapiens
ctcttcccaggcc

SEQ ID NO: 1225100 - DNA, 12 bp, Homo sapiens
ctcttcccatga

SEQ ID NO: 1225101 - DNA, 13 bp, Homo sapiens
ctcttcccatgac

SEQ ID NO: 1225102 - DNA, 12 bp, Homo sapiens
ctcttccccaga

SEQ ID NO: 1225103 - DNA, 19 bp, Homo sapiens
ctcttccccagagaggcac

SEQ ID NO: 1225104 - DNA, 14 bp, Homo sapiens
ctcttcccctagac

SEQ ID NO: 1225105 - DNA, 13 bp, Homo sapiens
ctcttccccttcc

SEQ ID NO: 1225106 - DNA, 15 bp, Homo sapiens
ctcttccccttcctg

SEQ ID NO: 1225107 - DNA, 16 bp, Homo sapiens
ctcttccccttgccct

SEQ ID NO: 1225108 - DNA, 19 bp, Homo sapiens
ctcttccccttgcccttgc

SEQ ID NO: 1225109 - DNA, 15 bp, Homo sapiens
ctcttccctgacctc

SEQ ID NO: 1225110 - DNA, 22 bp, Homo sapiens
ctcttcccttagcctctcccac

SEQ ID NO: 1225111 - DNA, 23 bp, Homo sapiens
ctcttccgaaaaatcctcttcct

SEQ ID NO: 1225112 - DNA, 22 bp, Homo sapiens
ctcttccgaatgggttttctat

SEQ ID NO: 1225113 - DNA, 13 bp, Homo sapiens
ctcttccgagctg

SEQ ID NO: 1225114 - DNA, 14 bp, Homo sapiens
ctgagcccctaccc

SEQ ID NO: 1225115 - DNA, 19 bp, Homo sapiens
ctgagcccctaccccacac

SEQ ID NO: 1225116 - DNA, 22 bp, Homo sapiens
ctgagcccctaccccacaccag

SEQ ID NO: 1225117 - DNA, 15 bp, Homo sapiens
ctgagcccctggtct

SEQ ID NO: 1225118 - DNA, 21 bp, Homo sapiens
ctgagcccctggtcttctcta

SEQ ID NO: 1225119 - DNA, 13 bp, Homo sapiens
ctgagcccctgtc

SEQ ID NO: 1225120 - DNA, 19 bp, Homo sapiens
ctgagccccttccttgctc

SEQ ID NO: 1225121 - DNA, 23 bp, Homo sapiens
ctgagcccggccctcccccagct

SEQ ID NO: 1225122 - DNA, 19 bp, Homo sapiens
ctgagcccgggctgcctgg

SEQ ID NO: 1225123 - DNA, 21 bp, Homo sapiens
ctgagcccgggctgcctgggc

SEQ ID NO: 1225124 - DNA, 20 bp, Homo sapiens
ctgagcccggtaagagcaaa

SEQ ID NO: 1225125 - DNA, 23 bp, Homo sapiens
ctgagcccggtaagagcaaaaga

SEQ ID NO: 1225126 - DNA, 18 bp, Homo sapiens
ctgagccctactccctgc

SEQ ID NO: 1225127 - DNA, 14 bp, Homo sapiens
ctgagccctggcag

SEQ ID NO: 1225128 - DNA, 15 bp, Homo sapiens
ctgagccctgtaccc

SEQ ID NO: 1225129 - DNA, 16 bp, Homo sapiens
ctgagcctcacagcag

SEQ ID NO: 1225130 - DNA, 12 bp, Homo sapiens
ctgagcctctgc

SEQ ID NO: 1225131 - DNA, 18 bp, Homo sapiens
ctgagcctctgctcccca

SEQ ID NO: 1225132 - DNA, 21 bp, Homo sapiens
ctgagcctgccaaagtgcctg

SEQ ID NO: 1225133 - DNA, 12 bp, Homo sapiens
ctgagcctgtgg

SEQ ID NO: 1225134 - DNA, 12 bp, Homo sapiens
ctgagccttcag

SEQ ID NO: 1225135 - DNA, 15 bp, Homo sapiens
ctgagccttgtaatt

SEQ ID NO: 1225136 - DNA, 16 bp, Homo sapiens
ctgagccttgtaattc

SEQ ID NO: 1225137 - DNA, 15 bp, Homo sapiens
ctgagcgccaggatg

SEQ ID NO: 1225138 - DNA, 18 bp, Homo sapiens
ctgagcgcccccgagccc

SEQ ID NO: 1225139 - DNA, 20 bp, Homo sapiens
ctgagcgcccccgagccctg

SEQ ID NO: 1225140 - DNA, 21 bp, Homo sapiens
ctgagcgcccccgagccctga

SEQ ID NO: 1225141 - DNA, 15 bp, Homo sapiens
ctgagcgctgtggac

SEQ ID NO: 1225142 - DNA, 14 bp, Homo sapiens
ctgagcggaggctc

SEQ ID NO: 1225143 - DNA, 13 bp, Homo sapiens
ctgagcgggaggc

SEQ ID NO: 1225144 - DNA, 14 bp, Homo sapiens
ctgagcgggaggca

SEQ ID NO: 1225145 - DNA, 15 bp, Homo sapiens
ctgagcgtggaaggg

SEQ ID NO: 1225146 - DNA, 14 bp, Homo sapiens
ctgagctagcctcc

SEQ ID NO: 1225147 - DNA, 20 bp, Homo sapiens
ctgagctagctagcgcaccg

SEQ ID NO: 1225148 - DNA, 20 bp, Homo sapiens
ctgagctattttcctctggc

SEQ ID NO: 1225149 - DNA, 15 bp, Homo sapiens
ctgagctcacatggg

SEQ ID NO: 1225150 - DNA, 18 bp, Homo sapiens
ctgagctccacctctggt

SEQ ID NO: 1225151 - DNA, 20 bp, Homo sapiens
ctgagctccacctctggtgg

SEQ ID NO: 1225152 - DNA, 22 bp, Homo sapiens
ctgagctccatgtgccccctct

SEQ ID NO: 1225153 - DNA, 16 bp, Homo sapiens
ctgagctcccacctcc

SEQ ID NO: 1225154 - DNA, 14 bp, Homo sapiens
ctgagctccccatc

SEQ ID NO: 1225155 - DNA, 16 bp, Homo sapiens
ctgagctccccatcac

SEQ ID NO: 1225156 - DNA, 18 bp, Homo sapiens
ctgagctcctctgggcag

SEQ ID NO: 1225157 - DNA, 20 bp, Homo sapiens
ctgagctcctctgggcagga

SEQ ID NO: 1225158 - DNA, 16 bp, Homo sapiens
ctgagctcgcagcccc

SEQ ID NO: 1225159 - DNA, 22 bp, Homo sapiens
ctgagctcgcagcccccgcgcc

SEQ ID NO: 1225160 - DNA, 22 bp, Homo sapiens
ctgagtaatcgcttaaagatgt

SEQ ID NO: 1225161 - DNA, 13 bp, Homo sapiens
ctgagtactggaa

SEQ ID NO: 1225162 - DNA, 16 bp, Homo sapiens
ctgagtactggaataa

SEQ ID NO: 1225163 - DNA, 14 bp, Homo sapiens
ctgagtagctggga

SEQ ID NO: 1225164 - DNA, 20 bp, Homo sapiens
ctgagtagctgggactacag

SEQ ID NO: 1225165 - DNA, 20 bp, Homo sapiens
ctgagtagctgggattacag

SEQ ID NO: 1225166 - DNA, 19 bp, Homo sapiens
ctgagtagctgggcctgtg

SEQ ID NO: 1225167 - DNA, 16 bp, Homo sapiens
ctgagtcaagttgttc

SEQ ID NO: 1225168 - DNA, 14 bp, Homo sapiens
ctgagtcaccagga

SEQ ID NO: 1225169 - DNA, 19 bp, Homo sapiens
ctgagtcacctcctccact

SEQ ID NO: 1225170 - DNA, 23 bp, Homo sapiens
ctgagtcacctcctccactcact

SEQ ID NO: 1225171 - DNA, 13 bp, Homo sapiens
ctgagtcagtgct

SEQ ID NO: 1225172 - DNA, 18 bp, Homo sapiens
ctgagtcagtgctctcag

SEQ ID NO: 1225173 - DNA, 21 bp, Homo sapiens
ctgagtcagtgctctcagctg

SEQ ID NO: 1225174 - DNA, 17 bp, Homo sapiens
ctgagtcatctgttagg

SEQ ID NO: 1225175 - DNA, 19 bp, Homo sapiens
ctgagtcatgatctccctg

SEQ ID NO: 1225176 - DNA, 20 bp, Homo sapiens
ctgagtcatgatctccctgc

SEQ ID NO: 1225177 - DNA, 22 bp, Homo sapiens
ctgagtcatgatctccctgccg

SEQ ID NO: 1225178 - DNA, 17 bp, Homo sapiens
ctgagtccactgctcca

SEQ ID NO: 1225179 - DNA, 16 bp, Homo sapiens
ctgagtccagagcttg

SEQ ID NO: 1225180 - DNA, 17 bp, Homo sapiens
ctgagtccagagcttgt

SEQ ID NO: 1225181 - DNA, 16 bp, Homo sapiens
ctgagtccagctcccc

SEQ ID NO: 1225182 - DNA, 16 bp, Homo sapiens
ctgagtccatgaaaat

SEQ ID NO: 1225183 - DNA, 21 bp, Homo sapiens
ctgataagactgtttttaagt

SEQ ID NO: 1225184 - DNA, 14 bp, Homo sapiens
ctgataagcttcaa

SEQ ID NO: 1225185 - DNA, 18 bp, Homo sapiens
ctgataaggaaactttat

SEQ ID NO: 1225186 - DNA, 14 bp, Homo sapiens
ctgataataattga

SEQ ID NO: 1225187 - DNA, 18 bp, Homo sapiens
ctgataattttaaattct

SEQ ID NO: 1225188 - DNA, 14 bp, Homo sapiens
ctgatacccagagc

SEQ ID NO: 1225189 - DNA, 12 bp, Homo sapiens
ctgatacctcaa

SEQ ID NO: 1225190 - DNA, 22 bp, Homo sapiens
ctgatagaaatggtttcctctg

SEQ ID NO: 1225191 - DNA, 17 bp, Homo sapiens
ctgatagactttgtgaa

SEQ ID NO: 1225192 - DNA, 21 bp, Homo sapiens
ctgatagctgtttcaaatgtg

SEQ ID NO: 1225193 - DNA, 22 bp, Homo sapiens
ctgatagctgtttcaaatgtgc

SEQ ID NO: 1225194 - DNA, 15 bp, Homo sapiens
ctgataggagggggc

SEQ ID NO: 1225195 - DNA, 18 bp, Homo sapiens
ctgataggagggggcggc

SEQ ID NO: 1225196 - DNA, 20 bp, Homo sapiens
ctgataggagggggcggcag

SEQ ID NO: 1225197 - DNA, 14 bp, Homo sapiens
ctgatatactgtgt

SEQ ID NO: 1225198 - DNA, 21 bp, Homo sapiens
ctgatatcatggggagtaata

SEQ ID NO: 1225199 - DNA, 14 bp, Homo sapiens
ctgatattaatcaa

SEQ ID NO: 1225200 - DNA, 15 bp, Homo sapiens
ctgatattaatcaaa

SEQ ID NO: 1225201 - DNA, 18 bp, Homo sapiens
ctgatattccatgaatgt

SEQ ID NO: 1225202 - DNA, 15 bp, Homo sapiens
ctgatattttctcta

SEQ ID NO: 1225203 - DNA, 16 bp, Homo sapiens
ctgatattttctctag

SEQ ID NO: 1225204 - DNA, 22 bp, Homo sapiens
ctgatcaagagtccggatttct

SEQ ID NO: 1225205 - DNA, 21 bp, Homo sapiens
ctgatcacccaatgcatcacg

SEQ ID NO: 1225206 - DNA, 17 bp, Homo sapiens
ctgatcagaccacggct

SEQ ID NO: 1225207 - DNA, 20 bp, Homo sapiens
ctgatcagagccgtggtcct

SEQ ID NO: 1225208 - DNA, 16 bp, Homo sapiens
ctgatcatccaggcct

SEQ ID NO: 1225209 - DNA, 19 bp, Homo sapiens
ctgatcatccaggcctcag

SEQ ID NO: 1225210 - DNA, 19 bp, Homo sapiens
ctgatcatcgccagaggtg

SEQ ID NO: 1225211 - DNA, 17 bp, Homo sapiens
ctgatcatgcattgttg

SEQ ID NO: 1225212 - DNA, 12 bp, Homo sapiens
ctgatccctcca

SEQ ID NO: 1225213 - DNA, 13 bp, Homo sapiens
ctgatccctccac

SEQ ID NO: 1225214 - DNA, 19 bp, Homo sapiens
ctgatccctccacccccat

SEQ ID NO: 1225215 - DNA, 22 bp, Homo sapiens
ctgatccctgaacccctggcca

SEQ ID NO: 1225216 - DNA, 17 bp, Homo sapiens
ctgatccctggccactg

SEQ ID NO: 1225217 - DNA, 18 bp, Homo sapiens
ctgatccctggccactga

SEQ ID NO: 1225218 - DNA, 19 bp, Homo sapiens
ctgatccggctgctcctcc

SEQ ID NO: 1225219 - DNA, 20 bp, Homo sapiens
ctgatccggctgctcctcca

SEQ ID NO: 1225220 - DNA, 20 bp, Homo sapiens
ctgatccgtccgaggctgct

SEQ ID NO: 1225221 - DNA, 20 bp, Homo sapiens
ctgatcctcagcccctccag

SEQ ID NO: 1225222 - DNA, 12 bp, Homo sapiens
ctgatccttttc

SEQ ID NO: 1225223 - DNA, 20 bp, Homo sapiens
ctgatcgtctcggcccctct

SEQ ID NO: 1225224 - DNA, 22 bp, Homo sapiens
ctgatcgtctcggcccctctga

SEQ ID NO: 1225225 - DNA, 21 bp, Homo sapiens
ctgatcgtgctaaattttcag

SEQ ID NO: 1225226 - DNA, 14 bp, Homo sapiens
ctgatctccatggc

SEQ ID NO: 1225227 - DNA, 22 bp, Homo sapiens
ctgatctccatggcttcctcct

SEQ ID NO: 1225228 - DNA, 18 bp, Homo sapiens
ctgatctctcagccccaa

SEQ ID NO: 1225229 - DNA, 13 bp, Homo sapiens
ctgatctctgacc

SEQ ID NO: 1225230 - DNA, 19 bp, Homo sapiens
ctgatctgcggatctcagc

SEQ ID NO: 1225231 - DNA, 12 bp, Homo sapiens
ctgatctggacc

SEQ ID NO: 1225232 - DNA, 13 bp, Homo sapiens
ctgatctggaccc

SEQ ID NO: 1225233 - DNA, 20 bp, Homo sapiens
ctgatctttttatacacaat

SEQ ID NO: 1225234 - DNA, 12 bp, Homo sapiens
ctgatgaaaaca

SEQ ID NO: 1225235 - DNA, 19 bp, Homo sapiens
ctgatgaaaaggtcagact

SEQ ID NO: 1225236 - DNA, 16 bp, Homo sapiens
ctgatgacagagcgag

SEQ ID NO: 1225237 - DNA, 20 bp, Homo sapiens
ctgatgagtaaactgaggcc

SEQ ID NO: 1225238 - DNA, 20 bp, Homo sapiens
ctgatgatgtcggtcttgca

SEQ ID NO: 1225239 - DNA, 13 bp, Homo sapiens
ctgatgatgtctc

SEQ ID NO: 1225240 - DNA, 20 bp, Homo sapiens
ctgatgcagcctgtggcttg

SEQ ID NO: 1225241 - DNA, 18 bp, Homo sapiens
ctgatgccataaatacaa

SEQ ID NO: 1225242 - DNA, 14 bp, Homo sapiens
ctgatgccccttct

SEQ ID NO: 1225243 - DNA, 15 bp, Homo sapiens
ctgatgccccttctc

SEQ ID NO: 1225244 - DNA, 17 bp, Homo sapiens
ctgatgccctcttctcc

SEQ ID NO: 1225245 - DNA, 20 bp, Homo sapiens
ctgatgccctcttctccttg

SEQ ID NO: 1225246 - DNA, 21 bp, Homo sapiens
ctgatgccctcttctccttgc

SEQ ID NO: 1225247 - DNA, 12 bp, Homo sapiens
ctgatgctccct

SEQ ID NO: 1225248 - DNA, 21 bp, Homo sapiens
ctgatgctccctcccctgccc

SEQ ID NO: 1225249 - DNA, 14 bp, Homo sapiens
ctgatgctgggacc

SEQ ID NO: 1225250 - DNA, 20 bp, Homo sapiens
ctgcaaatcaggcttttgtt

SEQ ID NO: 1225251 - DNA, 16 bp, Homo sapiens
ctgcaaattaatgtat

SEQ ID NO: 1225252 - DNA, 12 bp, Homo sapiens
ctgcaacactgg

SEQ ID NO: 1225253 - DNA, 13 bp, Homo sapiens
ctgcaacactgga

SEQ ID NO: 1225254 - DNA, 14 bp, Homo sapiens
ctgcaacctccgcc

SEQ ID NO: 1225255 - DNA, 15 bp, Homo sapiens
ctgcaacctgttgat

SEQ ID NO: 1225256 - DNA, 20 bp, Homo sapiens
ctgcaaccttgtttattaaa

SEQ ID NO: 1225257 - DNA, 15 bp, Homo sapiens
ctgcaactcaaggac

SEQ ID NO: 1225258 - DNA, 17 bp, Homo sapiens
ctgcaactgctcagctc

SEQ ID NO: 1225259 - DNA, 17 bp, Homo sapiens
ctgcaacttccgctgag

SEQ ID NO: 1225260 - DNA, 18 bp, Homo sapiens
ctgcaacttccgctgagg

SEQ ID NO: 1225261 - DNA, 13 bp, Homo sapiens
ctgcaacttctat

SEQ ID NO: 1225262 - DNA, 22 bp, Homo sapiens
ctgcaagaacactggacctttg

SEQ ID NO: 1225263 - DNA, 19 bp, Homo sapiens
ctgcaagaagcgccgactc

SEQ ID NO: 1225264 - DNA, 17 bp, Homo sapiens
ctgcaagaattaaaact

SEQ ID NO: 1225265 - DNA, 20 bp, Homo sapiens
ctgcaagaattaaaactgag

SEQ ID NO: 1225266 - DNA, 20 bp, Homo sapiens
ctgcaagaattgaagcagga

SEQ ID NO: 1225267 - DNA, 13 bp, Homo sapiens
ctgcaagaccacg

SEQ ID NO: 1225268 - DNA, 19 bp, Homo sapiens
ctgcaagaccacggaggga

SEQ ID NO: 1225269 - DNA, 13 bp, Homo sapiens
ctgcaagagcctt

SEQ ID NO: 1225270 - DNA, 15 bp, Homo sapiens
ctgcaagagccttgg

SEQ ID NO: 1225271 - DNA, 17 bp, Homo sapiens
ctgcaagagccttggtg

SEQ ID NO: 1225272 - DNA, 23 bp, Homo sapiens
ctgcaagagccttggtgtccacc

SEQ ID NO: 1225273 - DNA, 21 bp, Homo sapiens
ctgcaagcacctgttaataaa

SEQ ID NO: 1225274 - DNA, 14 bp, Homo sapiens
ctgcaagccccagg

SEQ ID NO: 1225275 - DNA, 16 bp, Homo sapiens
ctgcaagccccagggc

SEQ ID NO: 1225276 - DNA, 17 bp, Homo sapiens
ctgcaagccccagggcc

SEQ ID NO: 1225277 - DNA, 19 bp, Homo sapiens
ctgcaagccccagggcctg

SEQ ID NO: 1225278 - DNA, 22 bp, Homo sapiens
ctgcaagccccagggcctgggg

SEQ ID NO: 1225279 - DNA, 16 bp, Homo sapiens
ctgcaaggtactctgg

SEQ ID NO: 1225280 - DNA, 19 bp, Homo sapiens
ctgcaaggtactctggtga

SEQ ID NO: 1225281 - DNA, 22 bp, Homo sapiens
ctgcaaggtgaaacgactcaaa

SEQ ID NO: 1225282 - DNA, 19 bp, Homo sapiens
ctgcaaggtggcctctgcc

SEQ ID NO: 1225283 - DNA, 21 bp, Homo sapiens
ctgcaaggtggcctctgcctg

SEQ ID NO: 1225284 - DNA, 19 bp, Homo sapiens
ctgcaagtcagtccaggat

SEQ ID NO: 1225285 - DNA, 19 bp, Homo sapiens
ctgcaagtgaggtgtgtca

SEQ ID NO: 1225286 - DNA, 22 bp, Homo sapiens
ctgcaagtgaggtgtgtcacaa

SEQ ID NO: 1225287 - DNA, 21 bp, Homo sapiens
ctgcaataatatcaaaacaag

SEQ ID NO: 1225288 - DNA, 14 bp, Homo sapiens
ctgcaatagagact

SEQ ID NO: 1225289 - DNA, 20 bp, Homo sapiens
ctgcaatagagactgtagat

SEQ ID NO: 1225290 - DNA, 12 bp, Homo sapiens
ctgcaatatttg

SEQ ID NO: 1225291 - DNA, 18 bp, Homo sapiens
ctgcaatatttgaatttt

SEQ ID NO: 1225292 - DNA, 18 bp, Homo sapiens
ctgcaatcactttttgga

SEQ ID NO: 1225293 - DNA, 20 bp, Homo sapiens
ctgcaatcactttttggaat

SEQ ID NO: 1225294 - DNA, 13 bp, Homo sapiens
ctgcaatgaaagg

SEQ ID NO: 1225295 - DNA, 22 bp, Homo sapiens
ctgcaatgcctagacttcccaa

SEQ ID NO: 1225296 - DNA, 21 bp, Homo sapiens
ctgcaatggcagcattcccac

SEQ ID NO: 1225297 - DNA, 21 bp, Homo sapiens
ctgcaatgggcactgggatga

SEQ ID NO: 1225298 - DNA, 20 bp, Homo sapiens
ctgcaattcccctctgctgc

SEQ ID NO: 1225299 - DNA, 19 bp, Homo sapiens
ctgcaattccctggataga

SEQ ID NO: 1225300 - DNA, 18 bp, Homo sapiens
ctgcacaaagcccttcca

SEQ ID NO: 1225301 - DNA, 20 bp, Homo sapiens
ctgcacaaagcccttccatg

SEQ ID NO: 1225302 - DNA, 14 bp, Homo sapiens
ctgcacaacagccc

SEQ ID NO: 1225303 - DNA, 14 bp, Homo sapiens
ctgcacaagctgca

SEQ ID NO: 1225304 - DNA, 15 bp, Homo sapiens
ctgcacaagctgcac

SEQ ID NO: 1225305 - DNA, 18 bp, Homo sapiens
ctgcacaagctgcaccct

SEQ ID NO: 1225306 - DNA, 15 bp, Homo sapiens
ctgcacaataaaaat

SEQ ID NO: 1225307 - DNA, 13 bp, Homo sapiens
ctgcacaatcagt

SEQ ID NO: 1225308 - DNA, 17 bp, Homo sapiens
ctgcacacacagctcct

SEQ ID NO: 1225309 - DNA, 19 bp, Homo sapiens
ctgcacacacctcagaggc

SEQ ID NO: 1225310 - DNA, 13 bp, Homo sapiens
ctgcacacagacg

SEQ ID NO: 1225311 - DNA, 17 bp, Homo sapiens
ctgcacacagacggcct

SEQ ID NO: 1225312 - DNA, 23 bp, Homo sapiens
ctgcacacagacggcctaggggt

SEQ ID NO: 1225313 - DNA, 14 bp, Homo sapiens
ctgcacacagcacg

SEQ ID NO: 1225314 - DNA, 14 bp, Homo sapiens
ctgcacacaggaca

SEQ ID NO: 1225315 - DNA, 20 bp, Homo sapiens
ctgcacacaggacagcggga

SEQ ID NO: 1225316 - DNA, 13 bp, Homo sapiens
ctgcacacagggc

SEQ ID NO: 1225317 - DNA, 14 bp, Homo sapiens
ctgcacacagggca

SEQ ID NO: 1225318 - DNA, 17 bp, Homo sapiens
ctgcacagaaacttgaa

SEQ ID NO: 1225319 - DNA, 14 bp, Homo sapiens
ctgcacagaagaca

SEQ ID NO: 1225320 - DNA, 12 bp, Homo sapiens
ctgcacagaagg

SEQ ID NO: 1225321 - DNA, 23 bp, Homo sapiens
ctgcacagagggtcccattgtgc

SEQ ID NO: 1225322 - DNA, 17 bp, Homo sapiens
ctgcacagatacctcat

SEQ ID NO: 1225323 - DNA, 18 bp, Homo sapiens
ctgcacagatacctcatc

SEQ ID NO: 1225324 - DNA, 23 bp, Homo sapiens
ctgcacagatacctcatcatcca

SEQ ID NO: 1225325 - DNA, 23 bp, Homo sapiens
ctgcacagatggatttgcctgtg

SEQ ID NO: 1225326 - DNA, 23 bp, Homo sapiens
ctgcacagattctttttttctgt

SEQ ID NO: 1225327 - DNA, 16 bp, Homo sapiens
ctgcacagcaggacct

SEQ ID NO: 1225328 - DNA, 21 bp, Homo sapiens
ctgcacaggcacacagggccc

SEQ ID NO: 1225329 - DNA, 14 bp, Homo sapiens
ctgcacaggtgaca

SEQ ID NO: 1225330 - DNA, 22 bp, Homo sapiens
ctgcacagtgacttctgagatc

SEQ ID NO: 1225331 - DNA, 21 bp, Homo sapiens
ctgcacagtgcatctcagccc

SEQ ID NO: 1225332 - DNA, 22 bp, Homo sapiens
ctgcacagtgcatctcagccca

SEQ ID NO: 1225333 - DNA, 15 bp, Homo sapiens
ctgcacagttgaagg

SEQ ID NO: 1225334 - DNA, 16 bp, Homo sapiens
ctgcacagtttagaac

SEQ ID NO: 1225335 - DNA, 18 bp, Homo sapiens
ctgcacagttttctggct

SEQ ID NO: 1225336 - DNA, 21 bp, Homo sapiens
ctgcacatgaaagttttgcaa

SEQ ID NO: 1225337 - DNA, 15 bp, Homo sapiens
ctgcacattcctggc

SEQ ID NO: 1225338 - DNA, 22 bp, Homo sapiens
ctgcacattgcctgttctgctt

SEQ ID NO: 1225339 - DNA, 20 bp, Homo sapiens
ctgcaccaacctcactgccc

SEQ ID NO: 1225340 - DNA, 22 bp, Homo sapiens
ctgcaccaacctcactgccctc

SEQ ID NO: 1225341 - DNA, 14 bp, Homo sapiens
ctgcaccaccatgc

SEQ ID NO: 1225342 - DNA, 19 bp, Homo sapiens
ctgcaccaccatgcccagc

SEQ ID NO: 1225343 - DNA, 19 bp, Homo sapiens
ctgcaccagcgcccccaga

SEQ ID NO: 1225344 - DNA, 19 bp, Homo sapiens
ctgcacccagcagtgtcac

SEQ ID NO: 1225345 - DNA, 12 bp, Homo sapiens
ctgcaccccagc

SEQ ID NO: 1225346 - DNA, 17 bp, Homo sapiens
ctgcaccccagcattcc

SEQ ID NO: 1225347 - DNA, 18 bp, Homo sapiens
ctgcaccccagcattcca

SEQ ID NO: 1225348 - DNA, 21 bp, Homo sapiens
ctgcaccccagcattccagct

SEQ ID NO: 1225349 - DNA, 23 bp, Homo sapiens
ctgcaccccagcattccagctct

SEQ ID NO: 1225350 - DNA, 16 bp, Homo sapiens
ctgcaccccagcgtca

SEQ ID NO: 1225351 - DNA, 23 bp, Homo sapiens
ctgcaccccagcgtcaggcctac

SEQ ID NO: 1225352 - DNA, 15 bp, Homo sapiens
ctgcacccctgggcc

SEQ ID NO: 1225353 - DNA, 21 bp, Homo sapiens
ctgcaccccttctctcctccc

SEQ ID NO: 1225354 - DNA, 14 bp, Homo sapiens
ctgcaccctcaggc

SEQ ID NO: 1225355 - DNA, 16 bp, Homo sapiens
ctgcaccctcaggcag

SEQ ID NO: 1225356 - DNA, 18 bp, Homo sapiens
ctgcaccctcaggcaggt

SEQ ID NO: 1225357 - DNA, 17 bp, Homo sapiens
ctgcaccctccaccctg

SEQ ID NO: 1225358 - DNA, 18 bp, Homo sapiens
ctgcaccctccaccctgt

SEQ ID NO: 1225359 - DNA, 14 bp, Homo sapiens
ctgcaccctgcgcc

SEQ ID NO: 1225360 - DNA, 15 bp, Homo sapiens
ctgcaccctgcgcct

SEQ ID NO: 1225361 - DNA, 21 bp, Homo sapiens
ctgcaccctgcgcctccagag

SEQ ID NO: 1225362 - DNA, 12 bp, Homo sapiens
ctgcaccctgga

SEQ ID NO: 1225363 - DNA, 22 bp, Homo sapiens
ctgcaccctggggcctggacct

SEQ ID NO: 1225364 - DNA, 14 bp, Homo sapiens
ctgcacccttcttt

SEQ ID NO: 1225365 - DNA, 22 bp, Homo sapiens
ctgcacccttcttttctcatgt

SEQ ID NO: 1225366 - DNA, 19 bp, Homo sapiens
ctgcaccgaccccgggccg

SEQ ID NO: 1225367 - DNA, 20 bp, Homo sapiens
ctgcaccgacccgaggccca

SEQ ID NO: 1225368 - DNA, 21 bp, Homo sapiens
ctgcaccgacccgaggcccag

SEQ ID NO: 1225369 - DNA, 19 bp, Homo sapiens
ctgcaccgccgcagaagca

SEQ ID NO: 1225370 - DNA, 13 bp, Homo sapiens
ctggctctctcca

SEQ ID NO: 1225371 - DNA, 14 bp, Homo sapiens
ctggctctctccag

SEQ ID NO: 1225372 - DNA, 20 bp, Homo sapiens
ctggctctgagcgcctccat

SEQ ID NO: 1225373 - DNA, 21 bp, Homo sapiens
ctggctctgagcgcctccatc

SEQ ID NO: 1225374 - DNA, 18 bp, Homo sapiens
ctggctctgccccctccc

SEQ ID NO: 1225375 - DNA, 20 bp, Homo sapiens
ctggctctgccccctccccc

SEQ ID NO: 1225376 - DNA, 16 bp, Homo sapiens
ctggctctgcccctca

SEQ ID NO: 1225377 - DNA, 22 bp, Homo sapiens
ctggctctgggggacccaggtg

SEQ ID NO: 1225378 - DNA, 21 bp, Homo sapiens
ctggctctgttcggcctttgg

SEQ ID NO: 1225379 - DNA, 16 bp, Homo sapiens
ctggctctgtttgatg

SEQ ID NO: 1225380 - DNA, 23 bp, Homo sapiens
ctggctcttgatacccccctctg

SEQ ID NO: 1225381 - DNA, 19 bp, Homo sapiens
ctggctgaacttggagagg

SEQ ID NO: 1225382 - DNA, 23 bp, Homo sapiens
ctggctgaacttggagagggggc

SEQ ID NO: 1225383 - DNA, 22 bp, Homo sapiens
ctggctgaccccaaagagcctg

SEQ ID NO: 1225384 - DNA, 23 bp, Homo sapiens
ctggctgaccccaaagagcctgg

SEQ ID NO: 1225385 - DNA, 13 bp, Homo sapiens
ctggctgacctgg

SEQ ID NO: 1225386 - DNA, 17 bp, Homo sapiens
ctggctgagcctggctg

SEQ ID NO: 1225387 - DNA, 13 bp, Homo sapiens
ctggctgagctga

SEQ ID NO: 1225388 - DNA, 17 bp, Homo sapiens
ctggctgaggttcctct

SEQ ID NO: 1225389 - DNA, 20 bp, Homo sapiens
ctggctgaggttcctctgcc

SEQ ID NO: 1225390 - DNA, 23 bp, Homo sapiens
ctggctgagtggaatgcagggaa

SEQ ID NO: 1225391 - DNA, 19 bp, Homo sapiens
ctggctgatgatccagaac

SEQ ID NO: 1225392 - DNA, 14 bp, Homo sapiens
ctggctgcacaggc

SEQ ID NO: 1225393 - DNA, 17 bp, Homo sapiens
ctggctgcacaggctga

SEQ ID NO: 1225394 - DNA, 13 bp, Homo sapiens
ctggctgcagtga

SEQ ID NO: 1225395 - DNA, 13 bp, Homo sapiens
ctggctgccaggc

SEQ ID NO: 1225396 - DNA, 13 bp, Homo sapiens
ctggctgcccaga

SEQ ID NO: 1225397 - DNA, 16 bp, Homo sapiens
ctggctgccccaacct

SEQ ID NO: 1225398 - DNA, 21 bp, Homo sapiens
ctggctgccccaacctgctga

SEQ ID NO: 1225399 - DNA, 18 bp, Homo sapiens
ctggctgccctggccctg

SEQ ID NO: 1225400 - DNA, 20 bp, Homo sapiens
ctggctgccctggccctgag

SEQ ID NO: 1225401 - DNA, 14 bp, Homo sapiens
ctggctgccttaga

SEQ ID NO: 1225402 - DNA, 18 bp, Homo sapiens
ctggctgctaggccagag

SEQ ID NO: 1225403 - DNA, 13 bp, Homo sapiens
ctggctgctgccc

SEQ ID NO: 1225404 - DNA, 14 bp, Homo sapiens
ctggctgctgcccc

SEQ ID NO: 1225405 - DNA, 17 bp, Homo sapiens
ctggctgctgcccccac

SEQ ID NO: 1225406 - DNA, 16 bp, Homo sapiens
ctggctgcttgcagcc

SEQ ID NO: 1225407 - DNA, 19 bp, Homo sapiens
ctggctgcttgcagccagg

SEQ ID NO: 1225408 - DNA, 18 bp, Homo sapiens
ctggctggaaagcagagc

SEQ ID NO: 1225409 - DNA, 17 bp, Homo sapiens
ctggctggaggagcagc

SEQ ID NO: 1225410 - DNA, 13 bp, Homo sapiens
ctggctggcctca

SEQ ID NO: 1225411 - DNA, 15 bp, Homo sapiens
ctggctggctgcagt

SEQ ID NO: 1225412 - DNA, 12 bp, Homo sapiens
ctggctgggacg

SEQ ID NO: 1225413 - DNA, 14 bp, Homo sapiens
ctggctgggcccct

SEQ ID NO: 1225414 - DNA, 19 bp, Homo sapiens
ctggctgggcccctgggga

SEQ ID NO: 1225415 - DNA, 20 bp, Homo sapiens
ctggctgggcccctggggac

SEQ ID NO: 1225416 - DNA, 13 bp, Homo sapiens
ctggctggggcag

SEQ ID NO: 1225417 - DNA, 14 bp, Homo sapiens
ctggctggggcaga

SEQ ID NO: 1225418 - DNA, 16 bp, Homo sapiens
ctggctggggcagagg

SEQ ID NO: 1225419 - DNA, 18 bp, Homo sapiens
ctggctggggcagagggg

SEQ ID NO: 1225420 - DNA, 12 bp, Homo sapiens
ctggctgggtgg

SEQ ID NO: 1225421 - DNA, 19 bp, Homo sapiens
ctggctgggttcaggtccc

SEQ ID NO: 1225422 - DNA, 18 bp, Homo sapiens
ctggctggtgggccccca

SEQ ID NO: 1225423 - DNA, 19 bp, Homo sapiens
ctggctggtgggcccccaa

SEQ ID NO: 1225424 - DNA, 21 bp, Homo sapiens
ctggctggtgggcccccaatg

SEQ ID NO: 1225425 - DNA, 15 bp, Homo sapiens
ctggctgtacctgtt

SEQ ID NO: 1225426 - DNA, 18 bp, Homo sapiens
ctggctgtacctgttcct

SEQ ID NO: 1225427 - DNA, 21 bp, Homo sapiens
ctggctgtacctgttcctccc

SEQ ID NO: 1225428 - DNA, 15 bp, Homo sapiens
ctggctgtctagaat

SEQ ID NO: 1225429 - DNA, 16 bp, Homo sapiens
ctggctgtctagaatg

SEQ ID NO: 1225430 - DNA, 21 bp, Homo sapiens
ctggctgtctgtctgcagtgc

SEQ ID NO: 1225431 - DNA, 12 bp, Homo sapiens
ctggctgtgccc

SEQ ID NO: 1225432 - DNA, 17 bp, Homo sapiens
ctggctgtgcccagcag

SEQ ID NO: 1225433 - DNA, 19 bp, Homo sapiens
ctggctgtgcccagcaggc

SEQ ID NO: 1225434 - DNA, 13 bp, Homo sapiens
ctggctgtgcccc

SEQ ID NO: 1225435 - DNA, 16 bp, Homo sapiens
ctggctgtgcccctga

SEQ ID NO: 1225436 - DNA, 18 bp, Homo sapiens
ctggctgtgcccctgatg

SEQ ID NO: 1225437 - DNA, 19 bp, Homo sapiens
ctggctgtgcccctgatgc

SEQ ID NO: 1225438 - DNA, 14 bp, Homo sapiens
ctggctgtgcctgc

SEQ ID NO: 1225439 - DNA, 15 bp, Homo sapiens
ctggctgtggaggcc

SEQ ID NO: 1225440 - DNA, 21 bp, Homo sapiens
ctggctgtggaggcctgatgc

SEQ ID NO: 1225441 - DNA, 20 bp, Homo sapiens
ctggctgtggatagcccata

SEQ ID NO: 1225442 - DNA, 20 bp, Homo sapiens
ctggctgtgtaaccttgggt

SEQ ID NO: 1225443 - DNA, 14 bp, Homo sapiens
ctggctgtgtggcc

SEQ ID NO: 1225444 - DNA, 15 bp, Homo sapiens
ctggcttcactctcc

SEQ ID NO: 1225445 - DNA, 20 bp, Homo sapiens
ctggcttcagggagggttag

SEQ ID NO: 1225446 - DNA, 16 bp, Homo sapiens
ctggcttccaggtatc

SEQ ID NO: 1225447 - DNA, 22 bp, Homo sapiens
ctggcttccaggtatctccagg

SEQ ID NO: 1225448 - DNA, 22 bp, Homo sapiens
ctggcttcccatagtggggcct

SEQ ID NO: 1225449 - DNA, 14 bp, Homo sapiens
ctggcttctggagc

SEQ ID NO: 1225450 - DNA, 21 bp, Homo sapiens
ctggcttgaaggactgcagac

SEQ ID NO: 1225451 - DNA, 13 bp, Homo sapiens
ctgggaatggagg

SEQ ID NO: 1225452 - DNA, 20 bp, Homo sapiens
ctgggaatggaggggcagag

SEQ ID NO: 1225453 - DNA, 23 bp, Homo sapiens
ctgggaatggaggggcagagcca

SEQ ID NO: 1225454 - DNA, 15 bp, Homo sapiens
ctgggaatgggagag

SEQ ID NO: 1225455 - DNA, 18 bp, Homo sapiens
ctgggaatgggagagggg

SEQ ID NO: 1225456 - DNA, 18 bp, Homo sapiens
ctgggaatggggacacgg

SEQ ID NO: 1225457 - DNA, 18 bp, Homo sapiens
ctgggaatgggggagaga

SEQ ID NO: 1225458 - DNA, 22 bp, Homo sapiens
ctgggaatgtattattctgcag

SEQ ID NO: 1225459 - DNA, 18 bp, Homo sapiens
ctgggacacagacccagg

SEQ ID NO: 1225460 - DNA, 22 bp, Homo sapiens
ctgggacaccattaccaaaata

SEQ ID NO: 1225461 - DNA, 19 bp, Homo sapiens
ctgggacacttaacagatg

SEQ ID NO: 1225462 - DNA, 19 bp, Homo sapiens
ctgggacacttccctgggc

SEQ ID NO: 1225463 - DNA, 13 bp, Homo sapiens
ctgggacaggctt

SEQ ID NO: 1225464 - DNA, 21 bp, Homo sapiens
ctgggacatcaggagactggg

SEQ ID NO: 1225465 - DNA, 20 bp, Homo sapiens
ctgggaccacaggcatgcac

SEQ ID NO: 1225466 - DNA, 13 bp, Homo sapiens
ctgggacccagct

SEQ ID NO: 1225467 - DNA, 17 bp, Homo sapiens
ctgggacccagctactc

SEQ ID NO: 1225468 - DNA, 21 bp, Homo sapiens
ctgggacccagctactctgtc

SEQ ID NO: 1225469 - DNA, 15 bp, Homo sapiens
ctgggaccccctcgc

SEQ ID NO: 1225470 - DNA, 19 bp, Homo sapiens
ctgggaccccctcgccagc

SEQ ID NO: 1225471 - DNA, 24 bp, Homo sapiens
ctgggaccccctcgccagcttggc

SEQ ID NO: 1225472 - DNA, 21 bp, Homo sapiens
ctgggacccttgttggggagt

SEQ ID NO: 1225473 - DNA, 19 bp, Homo sapiens
ctgggaccctttccttcct

SEQ ID NO: 1225474 - DNA, 17 bp, Homo sapiens
ctgggaccgtgcgagct

SEQ ID NO: 1225475 - DNA, 18 bp, Homo sapiens
ctgggaccgtgcgagctg

SEQ ID NO: 1225476 - DNA, 19 bp, Homo sapiens
ctgggaccgtgcgagctgc

SEQ ID NO: 1225477 - DNA, 16 bp, Homo sapiens
ctgggacctaatgctg

SEQ ID NO: 1225478 - DNA, 18 bp, Homo sapiens
ctgggacctaatgctggc

SEQ ID NO: 1225479 - DNA, 22 bp, Homo sapiens
ctgggacctaatgctggcctga

SEQ ID NO: 1225480 - DNA, 23 bp, Homo sapiens
ctgggacctaatgctggcctgac

SEQ ID NO: 1225481 - DNA, 13 bp, Homo sapiens
ctgggacctaggg

SEQ ID NO: 1225482 - DNA, 19 bp, Homo sapiens
ctgggacctatacagaaca

SEQ ID NO: 1225483 - DNA, 15 bp, Homo sapiens
ctgggacctcccctg

SEQ ID NO: 1225484 - DNA, 14 bp, Homo sapiens
ctgggacctcctta

SEQ ID NO: 1225485 - DNA, 18 bp, Homo sapiens
ctgggacctgccaggcag

SEQ ID NO: 1225486 - DNA, 20 bp, Homo sapiens
ctgggacctgccaggcaggg

SEQ ID NO: 1225487 - DNA, 15 bp, Homo sapiens
ctgggacctgtgttc

SEQ ID NO: 1225488 - DNA, 16 bp, Homo sapiens
ctgggacggaccagca

SEQ ID NO: 1225489 - DNA, 20 bp, Homo sapiens
ctgggacgtggctcagccag

SEQ ID NO: 1225490 - DNA, 23 bp, Homo sapiens
ctgggacgtggctcagccagcac

SEQ ID NO: 1225491 - DNA, 13 bp, Homo sapiens
ctgggactcagcc

SEQ ID NO: 1225492 - DNA, 18 bp, Homo sapiens
ctgggactcagccttcag

SEQ ID NO: 1225493 - DNA, 17 bp, Homo sapiens
ctgggactcccagcaga

SEQ ID NO: 1225494 - DNA, 20 bp, Homo sapiens
ctgggactcccagcagagcc

SEQ ID NO: 1225495 - DNA, 23 bp, Homo sapiens
ctgggactcggagactatggcct

SEQ ID NO: 1225496 - DNA, 13 bp, Homo sapiens
ctgggactctcct

SEQ ID NO: 1225497 - DNA, 23 bp, Homo sapiens
ctgggactctcctcctcccctcc

SEQ ID NO: 1225498 - DNA, 19 bp, Homo sapiens
ctgggactgagaaggctca

SEQ ID NO: 1225499 - DNA, 16 bp, Homo sapiens
ctgggactgagccagt

SEQ ID NO: 1225500 - DNA, 14 bp, Homo sapiens
ctgggacttccttg

SEQ ID NO: 1225501 - DNA, 16 bp, Homo sapiens
ctgggacttccttgct

SEQ ID NO: 1225502 - DNA, 12 bp, Homo sapiens
ctgggagaaaat

SEQ ID NO: 1225503 - DNA, 15 bp, Homo sapiens
ctgggagaaaatcat

SEQ ID NO: 1225504 - DNA, 18 bp, Homo sapiens
ctgggagaaaatcatcaa

SEQ ID NO: 1225505 - DNA, 19 bp, Homo sapiens
ctgggagaaaatcatcaag

SEQ ID NO: 1225506 - DNA, 23 bp, Homo sapiens
ctgggagaaagaccatgcattta

SEQ ID NO: 1225507 - DNA, 16 bp, Homo sapiens
ctgggagaacctcagg

SEQ ID NO: 1225508 - DNA, 17 bp, Homo sapiens
ctgggagaacctcaggc

SEQ ID NO: 1225509 - DNA, 18 bp, Homo sapiens
ctgggagaacctcaggct

SEQ ID NO: 1225510 - DNA, 12 bp, Homo sapiens
ctgggagagaag

SEQ ID NO: 1225511 - DNA, 18 bp, Homo sapiens
ctgggagagaagaggact

SEQ ID NO: 1225512 - DNA, 15 bp, Homo sapiens
ctgggagagccagct

SEQ ID NO: 1225513 - DNA, 16 bp, Homo sapiens
ctgggagagcctggca

SEQ ID NO: 1225514 - DNA, 17 bp, Homo sapiens
ctgggagagcctggcaa

SEQ ID NO: 1225515 - DNA, 20 bp, Homo sapiens
ctgggagagcctggcaaggc

SEQ ID NO: 1225516 - DNA, 12 bp, Homo sapiens
ctgggagaggat

SEQ ID NO: 1225517 - DNA, 22 bp, Homo sapiens
ctgggcttatatctggcctctg

SEQ ID NO: 1225518 - DNA, 16 bp, Homo sapiens
ctgggcttggcctgga

SEQ ID NO: 1225519 - DNA, 18 bp, Homo sapiens
ctgggcttggcctggaga

SEQ ID NO: 1225520 - DNA, 20 bp, Homo sapiens
ctgggcttggcctggagagg

SEQ ID NO: 1225521 - DNA, 15 bp, Homo sapiens
ctgggcttggctctt

SEQ ID NO: 1225522 - DNA, 21 bp, Homo sapiens
ctgggcttggctcttggcttc

SEQ ID NO: 1225523 - DNA, 20 bp, Homo sapiens
ctgggcttggggcttcctaa

SEQ ID NO: 1225524 - DNA, 23 bp, Homo sapiens
ctgggcttggggtgtggggtggg

SEQ ID NO: 1225525 - DNA, 19 bp, Homo sapiens
ctgggcttggtaagtgaat

SEQ ID NO: 1225526 - DNA, 19 bp, Homo sapiens
ctgggctttctcctggaga

SEQ ID NO: 1225527 - DNA, 16 bp, Homo sapiens
ctggggaaaaaaaaga

SEQ ID NO: 1225528 - DNA, 12 bp, Homo sapiens
ctggggaaggag

SEQ ID NO: 1225529 - DNA, 16 bp, Homo sapiens
ctggggaaggagccag

SEQ ID NO: 1225530 - DNA, 15 bp, Homo sapiens
ctggggacagagcca

SEQ ID NO: 1225531 - DNA, 18 bp, Homo sapiens
ctggggacagcttcctca

SEQ ID NO: 1225532 - DNA, 17 bp, Homo sapiens
ctggggacaggcccgct

SEQ ID NO: 1225533 - DNA, 17 bp, Homo sapiens
ctggggtatgtgtgtgt

SEQ ID NO: 1225534 - DNA, 15 bp, Homo sapiens
ctggggtccagggag

SEQ ID NO: 1225535 - DNA, 16 bp, Homo sapiens
ctggggtccagggagc

SEQ ID NO: 1225536 - DNA, 14 bp, Homo sapiens
ctggggtccagggc

SEQ ID NO: 1225537 - DNA, 19 bp, Homo sapiens
ctggggtctgggcagtgcc

SEQ ID NO: 1225538 - DNA, 20 bp, Homo sapiens
ctggggtgaatacttatttt

SEQ ID NO: 1225539 - DNA, 15 bp, Homo sapiens
ctggggtgagcctga

SEQ ID NO: 1225540 - DNA, 24 bp, Homo sapiens
ctggggtgagcctgactgccagga

SEQ ID NO: 1225541 - DNA, 16 bp, Homo sapiens
ctggggtggccaccag

SEQ ID NO: 1225542 - DNA, 13 bp, Homo sapiens
ctggggtggccag

SEQ ID NO: 1225543 - DNA, 13 bp, Homo sapiens
ctggggtgggaca

SEQ ID NO: 1225544 - DNA, 14 bp, Homo sapiens
ctggggtgggacag

SEQ ID NO: 1225545 - DNA, 17 bp, Homo sapiens
ctggggtgggacaggga

SEQ ID NO: 1225546 - DNA, 21 bp, Homo sapiens
ctggggttcagcccctcctct

SEQ ID NO: 1225547 - DNA, 23 bp, Homo sapiens
ctggggttcagcccctcctctgc

SEQ ID NO: 1225548 - DNA, 17 bp, Homo sapiens
ctggggttcccgaggga

SEQ ID NO: 1225549 - DNA, 14 bp, Homo sapiens
ctggggttgagggc

SEQ ID NO: 1225550 - DNA, 19 bp, Homo sapiens
ctggggttgcgtctgaggc

SEQ ID NO: 1225551 - DNA, 17 bp, Homo sapiens
ctggggttgtccccgct

SEQ ID NO: 1225552 - DNA, 17 bp, Homo sapiens
ctggggtttgaagctga

SEQ ID NO: 1225553 - DNA, 20 bp, Homo sapiens
ctgggtaactagggaagata

SEQ ID NO: 1225554 - DNA, 13 bp, Homo sapiens
ctgggtagctgta

SEQ ID NO: 1225555 - DNA, 14 bp, Homo sapiens
ctgggtaggaaaga

SEQ ID NO: 1225556 - DNA, 19 bp, Homo sapiens
ctgggtatcccctgcctcc

SEQ ID NO: 1225557 - DNA, 22 bp, Homo sapiens
ctgggtatcccctgcctcctgc

SEQ ID NO: 1225558 - DNA, 17 bp, Homo sapiens
ctgggtcaaaagagccc

SEQ ID NO: 1225559 - DNA, 19 bp, Homo sapiens
ctgggtcaaaagagccctg

SEQ ID NO: 1225560 - DNA, 23 bp, Homo sapiens
ctgggtcaaaagagccctggctc

SEQ ID NO: 1225561 - DNA, 22 bp, Homo sapiens
ctgggtcaaagtggtacaggaa

SEQ ID NO: 1225562 - DNA, 11 bp, Homo sapiens
ctgggtcaggg

SEQ ID NO: 1225563 - DNA, 20 bp, Homo sapiens
ctgggtcatgcactgaggtc

SEQ ID NO: 1225564 - DNA, 15 bp, Homo sapiens
ctgggtcccagcctg

SEQ ID NO: 1225565 - DNA, 15 bp, Homo sapiens
ctgggtccctgctcc

SEQ ID NO: 1225566 - DNA, 17 bp, Homo sapiens
ctgggtccttggctccc

SEQ ID NO: 1225567 - DNA, 19 bp, Homo sapiens
ctgggtccttggctcccgg

SEQ ID NO: 1225568 - DNA, 17 bp, Homo sapiens
ctgggtcggccctgccc

SEQ ID NO: 1225569 - DNA, 17 bp, Homo sapiens
ctgggtctaccaggaac

SEQ ID NO: 1225570 - DNA, 22 bp, Homo sapiens
ctgggtctccctttccatggca

SEQ ID NO: 1225571 - DNA, 22 bp, Homo sapiens
ctgggtctgattttctcactga

SEQ ID NO: 1225572 - DNA, 18 bp, Homo sapiens
ctgggtctggatgggagg

SEQ ID NO: 1225573 - DNA, 15 bp, Homo sapiens
ctgggtcttggccat

SEQ ID NO: 1225574 - DNA, 18 bp, Homo sapiens
ctgggtcttggccatgat

SEQ ID NO: 1225575 - DNA, 17 bp, Homo sapiens
ctgggtcttttgctact

SEQ ID NO: 1225576 - DNA, 17 bp, Homo sapiens
ctgggtgacagagcgag

SEQ ID NO: 1225577 - DNA, 20 bp, Homo sapiens
ctgggtgaccgactacccca

SEQ ID NO: 1225578 - DNA, 20 bp, Homo sapiens
ctgggtgagaatcctgcctc

SEQ ID NO: 1225579 - DNA, 22 bp, Homo sapiens
ctgggtgagaatcctgcctctc

SEQ ID NO: 1225580 - DNA, 14 bp, Homo sapiens
ctgggtgagaccca

SEQ ID NO: 1225581 - DNA, 18 bp, Homo sapiens
ctgggtgagctcttccag

SEQ ID NO: 1225582 - DNA, 18 bp, Homo sapiens
ctgggtgcagctgggctt

SEQ ID NO: 1225583 - DNA, 15 bp, Homo sapiens
ctgggtgccattccc

SEQ ID NO: 1225584 - DNA, 16 bp, Homo sapiens
ctgggtgccctctcag

SEQ ID NO: 1225585 - DNA, 14 bp, Homo sapiens
ctgggtgcctccca

SEQ ID NO: 1225586 - DNA, 17 bp, Homo sapiens
ctgggtgcctcccacac

SEQ ID NO: 1225587 - DNA, 11 bp, Homo sapiens
ctgggtgcctg

SEQ ID NO: 1225588 - DNA, 18 bp, Homo sapiens
ctgggtgcctgcagcgcc

SEQ ID NO: 1225589 - DNA, 19 bp, Homo sapiens
ctgggtgcctgcagcgcct

SEQ ID NO: 1225590 - DNA, 22 bp, Homo sapiens
ctgggtgcctgcagcgcctccc

SEQ ID NO: 1225591 - DNA, 19 bp, Homo sapiens
ctgggtgcgtctccagtca

SEQ ID NO: 1225592 - DNA, 15 bp, Homo sapiens
ctgggtgctggctgc

SEQ ID NO: 1225593 - DNA, 13 bp, Homo sapiens
ctgggtgctggga

SEQ ID NO: 1225594 - DNA, 19 bp, Homo sapiens
ctgggtggcccctgtctcg

SEQ ID NO: 1225595 - DNA, 13 bp, Homo sapiens
ctgggtgggccca

SEQ ID NO: 1225596 - DNA, 14 bp, Homo sapiens
ctgggtgggcccag

SEQ ID NO: 1225597 - DNA, 17 bp, Homo sapiens
ctgggtgggcccagaac

SEQ ID NO: 1225598 - DNA, 19 bp, Homo sapiens
ctgggtgggcccagaactg

SEQ ID NO: 1225599 - DNA, 14 bp, Homo sapiens
ctgggtggggacag

SEQ ID NO: 1225600 - DNA, 22 bp, Homo sapiens
ctgggtggggctgctcctccag

SEQ ID NO: 1225601 - DNA, 12 bp, Homo sapiens
ctgggtgggtgg

SEQ ID NO: 1225602 - DNA, 15 bp, Homo sapiens
ctgggtgggtggtgg

SEQ ID NO: 1225603 - DNA, 17 bp, Homo sapiens
ctgggtgggtggtgggg

SEQ ID NO: 1225604 - DNA, 17 bp, Homo sapiens
ctgggtggtggcctggt

SEQ ID NO: 1225605 - DNA, 21 bp, Homo sapiens
ctgggttaggtggccgctcct

SEQ ID NO: 1225606 - DNA, 22 bp, Homo sapiens
ctgggttcaagcaatcctccta

SEQ ID NO: 1225607 - DNA, 21 bp, Homo sapiens
ctgggttcagaaatgctgcct

SEQ ID NO: 1225608 - DNA, 14 bp, Homo sapiens
ctgggttccctttc

SEQ ID NO: 1225609 - DNA, 15 bp, Homo sapiens
ctgggttccgggagg

SEQ ID NO: 1225610 - DNA, 18 bp, Homo sapiens
ctgggttccttcctctga

SEQ ID NO: 1225611 - DNA, 23 bp, Homo sapiens
ctgggttccttcctctgagcctt

SEQ ID NO: 1225612 - DNA, 15 bp, Homo sapiens
ctgggttctggggca

SEQ ID NO: 1225613 - DNA, 20 bp, Homo sapiens
ctgggttgcgggacagagta

SEQ ID NO: 1225614 - DNA, 15 bp, Homo sapiens
ctgggttggagggaa

SEQ ID NO: 1225615 - DNA, 23 bp, Homo sapiens
ctgggttggagggaaccaccagc

SEQ ID NO: 1225616 - DNA, 13 bp, Homo sapiens
ctgggttggtgca

SEQ ID NO: 1225617 - DNA, 14 bp, Homo sapiens
ctgggttggtgcac

SEQ ID NO: 1225618 - DNA, 23 bp, Homo sapiens
ctgggtttattacatggcagtgt

SEQ ID NO: 1225619 - DNA, 16 bp, Homo sapiens
ctgggtttgcccagtc

SEQ ID NO: 1225620 - DNA, 18 bp, Homo sapiens
ctgggtttgcccagtcct

SEQ ID NO: 1225621 - DNA, 18 bp, Homo sapiens
ctgggtttggaccccagc

SEQ ID NO: 1225622 - DNA, 22 bp, Homo sapiens
ctgggtttggaccccagctggg

SEQ ID NO: 1225623 - DNA, 23 bp, Homo sapiens
ctgggtttggaccccagctggga

SEQ ID NO: 1225624 - DNA, 19 bp, Homo sapiens
ctgggtttgttcctggggc

SEQ ID NO: 1225625 - DNA, 13 bp, Homo sapiens
ctggtaaaccaag

SEQ ID NO: 1225626 - DNA, 18 bp, Homo sapiens
ctggtaacagttcatgtt

SEQ ID NO: 1225627 - DNA, 22 bp, Homo sapiens
ctggtaactggaaggccttcca

SEQ ID NO: 1225628 - DNA, 17 bp, Homo sapiens
ctggtaagattgttatt

SEQ ID NO: 1225629 - DNA, 14 bp, Homo sapiens
ctggtaagcagagg

SEQ ID NO: 1225630 - DNA, 15 bp, Homo sapiens
ctggtaagcagaggc

SEQ ID NO: 1225631 - DNA, 16 bp, Homo sapiens
ctggtaagcagaggct

SEQ ID NO: 1225632 - DNA, 14 bp, Homo sapiens
ctggtacagcaggg

SEQ ID NO: 1225633 - DNA, 17 bp, Homo sapiens
ctggtacagcagggtct

SEQ ID NO: 1225634 - DNA, 22 bp, Homo sapiens
ctggtacagcagggtcttgctg

SEQ ID NO: 1225635 - DNA, 23 bp, Homo sapiens
ctggtacagcagggtcttgctgt

SEQ ID NO: 1225636 - DNA, 18 bp, Homo sapiens
ctggtacccagccatctg

SEQ ID NO: 1225637 - DNA, 14 bp, Homo sapiens
ctggtactcaagcc

SEQ ID NO: 1225638 - DNA, 13 bp, Homo sapiens
ctggtactctcct

SEQ ID NO: 1225639 - DNA, 16 bp, Homo sapiens
ctggtactctggcaaa

SEQ ID NO: 1225640 - DNA, 18 bp, Homo sapiens
ctggtagagacccccagg

SEQ ID NO: 1225641 - DNA, 13 bp, Homo sapiens
ctggtagcagcag

SEQ ID NO: 1225642 - DNA, 16 bp, Homo sapiens
ctggtagcagcaggct

SEQ ID NO: 1225643 - DNA, 18 bp, Homo sapiens
ctggtagcagcaggctca

SEQ ID NO: 1225644 - DNA, 19 bp, Homo sapiens
ctggtagcagcaggctcag

SEQ ID NO: 1225645 - DNA, 21 bp, Homo sapiens
ctggtagcataaataaaactg

SEQ ID NO: 1225646 - DNA, 17 bp, Homo sapiens
ctggtagcctgcagaag

SEQ ID NO: 1225647 - DNA, 14 bp, Homo sapiens
ctggtagctgaggg

SEQ ID NO: 1225648 - DNA, 15 bp, Homo sapiens
ctggtagctgagggg

SEQ ID NO: 1225649 - DNA, 21 bp, Homo sapiens
ctggtagctgaggggacgggc

SEQ ID NO: 1225650 - DNA, 19 bp, Homo sapiens
ctggtagggatatggcagg

SEQ ID NO: 1225651 - DNA, 16 bp, Homo sapiens
ctggtaggttgggaca

SEQ ID NO: 1225652 - DNA, 16 bp, Homo sapiens
ctggtagtgtagctgt

SEQ ID NO: 1225653 - DNA, 19 bp, Homo sapiens
ctggtatatccaaaagctt

SEQ ID NO: 1225654 - DNA, 22 bp, Homo sapiens
ctggtatcctcatcatgatgga

SEQ ID NO: 1225655 - DNA, 15 bp, Homo sapiens
ctggtatctcagaaa

SEQ ID NO: 1225656 - DNA, 19 bp, Homo sapiens
ctggtatctggcgttcttt

SEQ ID NO: 1225657 - DNA, 15 bp, Homo sapiens
ctggtggcacaggag

SEQ ID NO: 1225658 - DNA, 18 bp, Homo sapiens
ctggtggcaccagatgca

SEQ ID NO: 1225659 - DNA, 20 bp, Homo sapiens
ctggtggcatcgtagaagag

SEQ ID NO: 1225660 - DNA, 12 bp, Homo sapiens
ctggtggcccag

SEQ ID NO: 1225661 - DNA, 13 bp, Homo sapiens
ctggtggcccagg

SEQ ID NO: 1225662 - DNA, 22 bp, Homo sapiens
ctggtggccccgtttctggtgg

SEQ ID NO: 1225663 - DNA, 22 bp, Homo sapiens
ctggtggcccgacagcctggca

SEQ ID NO: 1225664 - DNA, 15 bp, Homo sapiens
ctggtggcctctgca

SEQ ID NO: 1225665 - DNA, 13 bp, Homo sapiens
ctggtggccttgg

SEQ ID NO: 1225666 - DNA, 15 bp, Homo sapiens
ctggtggccttgggc

SEQ ID NO: 1225667 - DNA, 17 bp, Homo sapiens
ctggtggcttaagtgag

SEQ ID NO: 1225668 - DNA, 17 bp, Homo sapiens
ctggtgggcagctgagg

SEQ ID NO: 1225669 - DNA, 14 bp, Homo sapiens
ctggtgggccccca

SEQ ID NO: 1225670 - DNA, 20 bp, Homo sapiens
ctggtgggccttaacatccc

SEQ ID NO: 1225671 - DNA, 20 bp, Homo sapiens
ctggtgggggttctggcagg

SEQ ID NO: 1225672 - DNA, 21 bp, Homo sapiens
ctggtgggggttctggcagga

SEQ ID NO: 1225673 - DNA, 22 bp, Homo sapiens
ctggtgggggttctggcaggac

SEQ ID NO: 1225674 - DNA, 15 bp, Homo sapiens
ctggtgggtcagggg

SEQ ID NO: 1225675 - DNA, 19 bp, Homo sapiens
ctggtgggtctgagctgga

SEQ ID NO: 1225676 - DNA, 21 bp, Homo sapiens
ctggtgggttagctaaaccaa

SEQ ID NO: 1225677 - DNA, 16 bp, Homo sapiens
ctggtggtattttcaa

SEQ ID NO: 1225678 - DNA, 12 bp, Homo sapiens
ctggtggtcagc

SEQ ID NO: 1225679 - DNA, 18 bp, Homo sapiens
ctggtggtctgttggcag

SEQ ID NO: 1225680 - DNA, 20 bp, Homo sapiens
ctggtggtctgttggcaggc

SEQ ID NO: 1225681 - DNA, 23 bp, Homo sapiens
ctggtggtctgttggcaggctgg

SEQ ID NO: 1225682 - DNA, 15 bp, Homo sapiens
ctggtggtggcctgt

SEQ ID NO: 1225683 - DNA, 20 bp, Homo sapiens
ctggtggttgctgttttcct

SEQ ID NO: 1225684 - DNA, 17 bp, Homo sapiens
ctggtggttgtgccttt

SEQ ID NO: 1225685 - DNA, 21 bp, Homo sapiens
ctggtggtttgatcatttctg

SEQ ID NO: 1225686 - DNA, 14 bp, Homo sapiens
ctggtgtcaggcag

SEQ ID NO: 1225687 - DNA, 11 bp, Homo sapiens
ctggtgtcccc

SEQ ID NO: 1225688 - DNA, 16 bp, Homo sapiens
ctggtgtccccttccc

SEQ ID NO: 1225689 - DNA, 23 bp, Homo sapiens
ctggtgtccccttcccctgctga

SEQ ID NO: 1225690 - DNA, 12 bp, Homo sapiens
ctggtgtcctga

SEQ ID NO: 1225691 - DNA, 14 bp, Homo sapiens
ctggtgtgtccctc

SEQ ID NO: 1225692 - DNA, 23 bp, Homo sapiens
ctggtgtgtccctctgccttttt

SEQ ID NO: 1225693 - DNA, 18 bp, Homo sapiens
ctggtgtgtggtgagggg

SEQ ID NO: 1225694 - DNA, 13 bp, Homo sapiens
ctggtgttctgaa

SEQ ID NO: 1225695 - DNA, 15 bp, Homo sapiens
ctggtgtttacacaa

SEQ ID NO: 1225696 - DNA, 19 bp, Homo sapiens
ctggttaaaaaacaaatgt

SEQ ID NO: 1225697 - DNA, 16 bp, Homo sapiens
ctggttacctgttcca

SEQ ID NO: 1225698 - DNA, 14 bp, Homo sapiens
ctggttagaaatgc

SEQ ID NO: 1225699 - DNA, 23 bp, Homo sapiens
ctggttagaaatgcagaatccta

SEQ ID NO: 1225700 - DNA, 20 bp, Homo sapiens
ctggttagttaaaagcccat

SEQ ID NO: 1225701 - DNA, 22 bp, Homo sapiens
ctggttatcctgtatgctgtaa

SEQ ID NO: 1225702 - DNA, 22 bp, Homo sapiens
ctggttccaaaccagtttattc

SEQ ID NO: 1225703 - DNA, 14 bp, Homo sapiens
ctggttccagggtc

SEQ ID NO: 1225704 - DNA, 15 bp, Homo sapiens
ctggttccagggtcc

SEQ ID NO: 1225705 - DNA, 16 bp, Homo sapiens
ctggttccatggcctc

SEQ ID NO: 1225706 - DNA, 20 bp, Homo sapiens
ctggttccatttttcctctg

SEQ ID NO: 1225707 - DNA, 18 bp, Homo sapiens
ctggttcccgtttctcca

SEQ ID NO: 1225708 - DNA, 17 bp, Homo sapiens
ctggttcctctctccca

SEQ ID NO: 1225709 - DNA, 14 bp, Homo sapiens
ctggttcctttcat

SEQ ID NO: 1225710 - DNA, 15 bp, Homo sapiens
ctggttctcaatgaa

SEQ ID NO: 1225711 - DNA, 17 bp, Homo sapiens
ctggttctcaatgaaaa

SEQ ID NO: 1225712 - DNA, 21 bp, Homo sapiens
ctggttgatttgtaacacagt

SEQ ID NO: 1225713 - DNA, 22 bp, Homo sapiens
ctggttgcatggaaatcagcca

SEQ ID NO: 1225714 - DNA, 13 bp, Homo sapiens
ctggttgcctccc

SEQ ID NO: 1225715 - DNA, 19 bp, Homo sapiens
ctggttgcctcccccgcct

SEQ ID NO: 1225716 - DNA, 12 bp, Homo sapiens
ctggttgcctct

SEQ ID NO: 1225717 - DNA, 13 bp, Homo sapiens
ctggttgcctctc

SEQ ID NO: 1225718 - DNA, 19 bp, Homo sapiens
ctggttgctccatttgaga

SEQ ID NO: 1225719 - DNA, 19 bp, Homo sapiens
ctggttgcttcagacctga

SEQ ID NO: 1225720 - DNA, 13 bp, Homo sapiens
ctggttgggcagc

SEQ ID NO: 1225721 - DNA, 17 bp, Homo sapiens
ctggttgggcagccaga

SEQ ID NO: 1225722 - DNA, 13 bp, Homo sapiens
ctggttggttttg

SEQ ID NO: 1225723 - DNA, 13 bp, Homo sapiens
ctggttgtatttc

SEQ ID NO: 1225724 - DNA, 13 bp, Homo sapiens
ctggttgtcagaa

SEQ ID NO: 1225725 - DNA, 20 bp, Homo sapiens
ctggttgtcagaatggaatc

SEQ ID NO: 1225726 - DNA, 15 bp, Homo sapiens
ctggttgtcattttt

SEQ ID NO: 1225727 - DNA, 21 bp, Homo sapiens
ctggttgttgcaccatctgct

SEQ ID NO: 1225728 - DNA, 21 bp, Homo sapiens
ctggttgtttctgttccaaat

SEQ ID NO: 1225729 - DNA, 19 bp, Homo sapiens
ctggttgtttttgttcttt

SEQ ID NO: 1225730 - DNA, 16 bp, Homo sapiens
ctggtttacaggccct

SEQ ID NO: 1225731 - DNA, 20 bp, Homo sapiens
ctggtttccccagggaagga

SEQ ID NO: 1225732 - DNA, 14 bp, Homo sapiens
ctggtttcctttct

SEQ ID NO: 1225733 - DNA, 15 bp, Homo sapiens
ctggtttcctttctc

SEQ ID NO: 1225734 - DNA, 16 bp, Homo sapiens
ctggtttcctttctca

SEQ ID NO: 1225735 - DNA, 12 bp, Homo sapiens
ctggtttctgag

SEQ ID NO: 1225736 - DNA, 12 bp, Homo sapiens
ctggtttcttcc

SEQ ID NO: 1225737 - DNA, 21 bp, Homo sapiens
ctggtttgatttttttaaagt

SEQ ID NO: 1225738 - DNA, 23 bp, Homo sapiens
ctggtttgcaaagaccacctcca

SEQ ID NO: 1225739 - DNA, 20 bp, Homo sapiens
ctggtttgtttgcttaattt

SEQ ID NO: 1225740 - DNA, 19 bp, Homo sapiens
ctggttttacacagagaaa

SEQ ID NO: 1225741 - DNA, 22 bp, Homo sapiens
ctggttttcttgccaccctctg

SEQ ID NO: 1225742 - DNA, 23 bp, Homo sapiens
ctggttttcttgccaccctctgg

SEQ ID NO: 1225743 - DNA, 13 bp, Homo sapiens
ctggttttgtaag

SEQ ID NO: 1225744 - DNA, 19 bp, Homo sapiens
ctggttttgtaagatgctg

SEQ ID NO: 1225745 - DNA, 22 bp, Homo sapiens
ctggttttgtaagatgctgggt

SEQ ID NO: 1225746 - DNA, 16 bp, Homo sapiens
ctggtttttcagtttt

SEQ ID NO: 1225747 - DNA, 13 bp, Homo sapiens
ctggtttttctca

SEQ ID NO: 1225748 - DNA, 17 bp, Homo sapiens
ctgtaaaaaatggagct

SEQ ID NO: 1225749 - DNA, 19 bp, Homo sapiens
ctgtaaaaacactgaaaaa

SEQ ID NO: 1225750 - DNA, 14 bp, Homo sapiens
ctgtaaaactttat

SEQ ID NO: 1225751 - DNA, 20 bp, Homo sapiens
ctgtaaaactttattttata

SEQ ID NO: 1225752 - DNA, 19 bp, Homo sapiens
ctgtaaaagttataataac

SEQ ID NO: 1225753 - DNA, 15 bp, Homo sapiens
ctgtaaacacagaca

SEQ ID NO: 1225754 - DNA, 12 bp, Homo sapiens
ctgtaaacagaa

SEQ ID NO: 1225755 - DNA, 19 bp, Homo sapiens
ctgtaaactcaaaacttaa

SEQ ID NO: 1225756 - DNA, 12 bp, Homo sapiens
ctgtaaactgtg

SEQ ID NO: 1225757 - DNA, 13 bp, Homo sapiens
ctgtaaactgtgt

SEQ ID NO: 1225758 - DNA, 14 bp, Homo sapiens
ctgtaaactgtgta

SEQ ID NO: 1225759 - DNA, 20 bp, Homo sapiens
ctgtaaacttggaatcaagg

SEQ ID NO: 1225760 - DNA, 13 bp, Homo sapiens
ctgtaaagaaaac

SEQ ID NO: 1225761 - DNA, 16 bp, Homo sapiens
ctgtaaagatgtttat

SEQ ID NO: 1225762 - DNA, 22 bp, Homo sapiens
ctgtaaagatgtttatttcagg

SEQ ID NO: 1225763 - DNA, 13 bp, Homo sapiens
ctgtaaagcaaat

SEQ ID NO: 1225764 - DNA, 17 bp, Homo sapiens
ctgtaaataagagttgc

SEQ ID NO: 1225765 - DNA, 16 bp, Homo sapiens
ctgtaaatatcccaga

SEQ ID NO: 1225766 - DNA, 21 bp, Homo sapiens
ctgtaaatatccctcccctct

SEQ ID NO: 1225767 - DNA, 17 bp, Homo sapiens
ctgtaaatatgtttgtg

SEQ ID NO: 1225768 - DNA, 19 bp, Homo sapiens
ctgtaaatatgtttgtgcc

SEQ ID NO: 1225769 - DNA, 21 bp, Homo sapiens
ctgtaaatatgtttgtgcctt

SEQ ID NO: 1225770 - DNA, 23 bp, Homo sapiens
ctgtaaatatgtttgtgccttaa

SEQ ID NO: 1225771 - DNA, 11 bp, Homo sapiens
ctgtaaatcat

SEQ ID NO: 1225772 - DNA, 18 bp, Homo sapiens
ctgtaaatcctagacttg

SEQ ID NO: 1225773 - DNA, 21 bp, Homo sapiens
ctgtacttgtggttctctttt

SEQ ID NO: 1225774 - DNA, 18 bp, Homo sapiens
ctgtactttgccattttt

SEQ ID NO: 1225775 - DNA, 19 bp, Homo sapiens
ctgtactttgccatttttc

SEQ ID NO: 1225776 - DNA, 18 bp, Homo sapiens
ctgtacttttcattctct

SEQ ID NO: 1225777 - DNA, 22 bp, Homo sapiens
ctgtagaaaagaaaacatttaa

SEQ ID NO: 1225778 - DNA, 19 bp, Homo sapiens
ctgtagaaggtgagaggcg

SEQ ID NO: 1225779 - DNA, 21 bp, Homo sapiens
ctgtagactctaagatacact

SEQ ID NO: 1225780 - DNA, 23 bp, Homo sapiens
ctgtagagttgctgagagggctc

SEQ ID NO: 1225781 - DNA, 19 bp, Homo sapiens
ctgtagagttggaactgca

SEQ ID NO: 1225782 - DNA, 18 bp, Homo sapiens
ctgtagatggtgacctgg

SEQ ID NO: 1225783 - DNA, 19 bp, Homo sapiens
ctgtagattgcttctgtag

SEQ ID NO: 1225784 - DNA, 21 bp, Homo sapiens
ctgtagattgcttctgtagta

SEQ ID NO: 1225785 - DNA, 20 bp, Homo sapiens
ctgtagcaatggccagagcc

SEQ ID NO: 1225786 - DNA, 21 bp, Homo sapiens
ctgtagcaatggccagagcct

SEQ ID NO: 1225787 - DNA, 22 bp, Homo sapiens
ctgtagcaatggccagagcctc

SEQ ID NO: 1225788 - DNA, 18 bp, Homo sapiens
ctgtagcacgctgcctgc

SEQ ID NO: 1225789 - DNA, 16 bp, Homo sapiens
ctgtagcacttactgg

SEQ ID NO: 1225790 - DNA, 21 bp, Homo sapiens
ctgtagcagtgagaaaaagct

SEQ ID NO: 1225791 - DNA, 12 bp, Homo sapiens
ctgtagcatctt

SEQ ID NO: 1225792 - DNA, 15 bp, Homo sapiens
ctgtagcatcttctg

SEQ ID NO: 1225793 - DNA, 19 bp, Homo sapiens
ctgtagcatcttctggagt

SEQ ID NO: 1225794 - DNA, 20 bp, Homo sapiens
ctgtagcatcttctggagtc

SEQ ID NO: 1225795 - DNA, 18 bp, Homo sapiens
ctgtagcattacagtggg

SEQ ID NO: 1225796 - DNA, 14 bp, Homo sapiens
ctgtagccacagct

SEQ ID NO: 1225797 - DNA, 23 bp, Homo sapiens
ctgtattgtaagtggaaaatgca

SEQ ID NO: 1225798 - DNA, 13 bp, Homo sapiens
ctgtattgtctga

SEQ ID NO: 1225799 - DNA, 17 bp, Homo sapiens
ctgtattgtctgaactt

SEQ ID NO: 1225800 - DNA, 20 bp, Homo sapiens
ctgtatttaatggtttttat

SEQ ID NO: 1225801 - DNA, 13 bp, Homo sapiens
ctgtatttcagta

SEQ ID NO: 1225802 - DNA, 19 bp, Homo sapiens
ctgtatttcagtattttcc

SEQ ID NO: 1225803 - DNA, 20 bp, Homo sapiens
ctgtatttcagtattttcca

SEQ ID NO: 1225804 - DNA, 17 bp, Homo sapiens
ctgtatttcatgtggct

SEQ ID NO: 1225805 - DNA, 16 bp, Homo sapiens
ctgtatttgagaatat

SEQ ID NO: 1225806 - DNA, 18 bp, Homo sapiens
ctgtattttggctttctc

SEQ ID NO: 1225807 - DNA, 12 bp, Homo sapiens
ctgtatttttac

SEQ ID NO: 1225808 - DNA, 14 bp, Homo sapiens
ctgtcaaaacactg

SEQ ID NO: 1225809 - DNA, 17 bp, Homo sapiens
ctgtcaaaacactgtgg

SEQ ID NO: 1225810 - DNA, 19 bp, Homo sapiens
ctgtcaaaacactgtggaa

SEQ ID NO: 1225811 - DNA, 20 bp, Homo sapiens
ctgtcaaaacactgtggaac

SEQ ID NO: 1225812 - DNA, 14 bp, Homo sapiens
ctgtcaaaactact

SEQ ID NO: 1225813 - DNA, 14 bp, Homo sapiens
ctgtcaaatgatgt

SEQ ID NO: 1225814 - DNA, 17 bp, Homo sapiens
ctgtcaaattttcaaat

SEQ ID NO: 1225815 - DNA, 22 bp, Homo sapiens
ctgtcaacttcccatctggctc

SEQ ID NO: 1225816 - DNA, 13 bp, Homo sapiens
ctgtcaagcatat

SEQ ID NO: 1225817 - DNA, 12 bp, Homo sapiens
ctgtcaaggccg

SEQ ID NO: 1225818 - DNA, 13 bp, Homo sapiens
ctgtcaaggccga

SEQ ID NO: 1225819 - DNA, 20 bp, Homo sapiens
ctgtcaaggccgagggccag

SEQ ID NO: 1225820 - DNA, 13 bp, Homo sapiens
ctgtcaataaaca

SEQ ID NO: 1225821 - DNA, 13 bp, Homo sapiens
ctgtcaataaatg

SEQ ID NO: 1225822 - DNA, 20 bp, Homo sapiens
ctgtcaataaatgacaccca

SEQ ID NO: 1225823 - DNA, 22 bp, Homo sapiens
ctgtcaataaatgacacccaga

SEQ ID NO: 1225824 - DNA, 13 bp, Homo sapiens
ctgtcaatcacag

SEQ ID NO: 1225825 - DNA, 14 bp, Homo sapiens
ctgtcaatcacagt

SEQ ID NO: 1225826 - DNA, 15 bp, Homo sapiens
ctgtcaatcacagtc

SEQ ID NO: 1225827 - DNA, 16 bp, Homo sapiens
ctgtcaatgagagcat

SEQ ID NO: 1225828 - DNA, 15 bp, Homo sapiens
ctgtcacaaccaaga

SEQ ID NO: 1225829 - DNA, 11 bp, Homo sapiens
ctgtcacaata

SEQ ID NO: 1225830 - DNA, 13 bp, Homo sapiens
ctgtcacaataaa

SEQ ID NO: 1225831 - DNA, 15 bp, Homo sapiens
ctgtcacaataaatg

SEQ ID NO: 1225832 - DNA, 22 bp, Homo sapiens
ctgtcacaataaatggccagtg

SEQ ID NO: 1225833 - DNA, 24 bp, Homo sapiens
ctgtcacaataaatggccagtgct

SEQ ID NO: 1225834 - DNA, 14 bp, Homo sapiens
ctgtcacacactgg

SEQ ID NO: 1225835 - DNA, 18 bp, Homo sapiens
ctgtcacacactggaccc

SEQ ID NO: 1225836 - DNA, 16 bp, Homo sapiens
ctgtcacactggtgct

SEQ ID NO: 1225837 - DNA, 18 bp, Homo sapiens
ctgtcacactggtgctga

SEQ ID NO: 1225838 - DNA, 14 bp, Homo sapiens
ctgtcacaggctgg

SEQ ID NO: 1225839 - DNA, 19 bp, Homo sapiens
ctgtcacaggctgggtcaa

SEQ ID NO: 1225840 - DNA, 16 bp, Homo sapiens
ctgtcacatccaactg

SEQ ID NO: 1225841 - DNA, 13 bp, Homo sapiens
ctgtcaccaaatt

SEQ ID NO: 1225842 - DNA, 16 bp, Homo sapiens
ctgtcacccagctcct

SEQ ID NO: 1225843 - DNA, 14 bp, Homo sapiens
ctgtcaccctccac

SEQ ID NO: 1225844 - DNA, 16 bp, Homo sapiens
ctgtcaccctccacct

SEQ ID NO: 1225845 - DNA, 15 bp, Homo sapiens
ctgtcaccctgcagg

SEQ ID NO: 1225846 - DNA, 18 bp, Homo sapiens
ctgtcaccctgcaggact

SEQ ID NO: 1225847 - DNA, 21 bp, Homo sapiens
ctgtcacggggttccctccta

SEQ ID NO: 1225848 - DNA, 22 bp, Homo sapiens
ctgtcacggggttccctcctag

SEQ ID NO: 1225849 - DNA, 19 bp, Homo sapiens
ctgtcacgtgaaatattta

SEQ ID NO: 1225850 - DNA, 14 bp, Homo sapiens
ctgtcactcactga

SEQ ID NO: 1225851 - DNA, 17 bp, Homo sapiens
ctgtcactcactgaggc

SEQ ID NO: 1225852 - DNA, 19 bp, Homo sapiens
ctgtcactcactgaggcca

SEQ ID NO: 1225853 - DNA, 16 bp, Homo sapiens
ctgtcactgatggaag

SEQ ID NO: 1225854 - DNA, 17 bp, Homo sapiens
ctgtcactgatggaagg

SEQ ID NO: 1225855 - DNA, 12 bp, Homo sapiens
ctgtcactgccg

SEQ ID NO: 1225856 - DNA, 15 bp, Homo sapiens
ctgtcactggcagag

SEQ ID NO: 1225857 - DNA, 17 bp, Homo sapiens
ctgtcactggcagagca

SEQ ID NO: 1225858 - DNA, 23 bp, Homo sapiens
ctgtcactggcagagcacagccc

SEQ ID NO: 1225859 - DNA, 19 bp, Homo sapiens
ctgtcactgtttctctgct

SEQ ID NO: 1225860 - DNA, 15 bp, Homo sapiens
ctgtcacttgtcggg

SEQ ID NO: 1225861 - DNA, 14 bp, Homo sapiens
ctgtcactttgctc

SEQ ID NO: 1225862 - DNA, 22 bp, Homo sapiens
ctgtcagatgagaacaaagctg

SEQ ID NO: 1225863 - DNA, 18 bp, Homo sapiens
ctgtcagcatctggctgt

SEQ ID NO: 1225864 - DNA, 17 bp, Homo sapiens
ctgtcagccagccgccc

SEQ ID NO: 1225865 - DNA, 18 bp, Homo sapiens
ctgtcagccagccgccct

SEQ ID NO: 1225866 - DNA, 20 bp, Homo sapiens
ctgtcagccagccgccctgg

SEQ ID NO: 1225867 - DNA, 22 bp, Homo sapiens
ctgtcagccagccgccctgggc

SEQ ID NO: 1225868 - DNA, 17 bp, Homo sapiens
ctgtcagccgggccctg

SEQ ID NO: 1225869 - DNA, 22 bp, Homo sapiens
ctgtcagccgggccctgagtaa

SEQ ID NO: 1225870 - DNA, 23 bp, Homo sapiens
ctgtcagccgggccctgagtaat

SEQ ID NO: 1225871 - DNA, 22 bp, Homo sapiens
ctgtcagctaaagaagtttgaa

SEQ ID NO: 1225872 - DNA, 17 bp, Homo sapiens
ctgtcaggaagaaatca

SEQ ID NO: 1225873 - DNA, 13 bp, Homo sapiens
ctgtcaggaatgg

SEQ ID NO: 1225874 - DNA, 17 bp, Homo sapiens
ctgtcaggacacatgga

SEQ ID NO: 1225875 - DNA, 16 bp, Homo sapiens
ctgtcaggctgggaca

SEQ ID NO: 1225876 - DNA, 14 bp, Homo sapiens
ctgtcagggagggc

SEQ ID NO: 1225877 - DNA, 15 bp, Homo sapiens
ctgtcagggagggcc

SEQ ID NO: 1225878 - DNA, 17 bp, Homo sapiens
ctgtcagggagggccag

SEQ ID NO: 1225879 - DNA, 22 bp, Homo sapiens
ctgtcagtagtggacattgtaa

SEQ ID NO: 1225880 - DNA, 18 bp, Homo sapiens
ctgtcagtcacagccacc

SEQ ID NO: 1225881 - DNA, 20 bp, Homo sapiens
ctgtcagtgtacacgtctgg

SEQ ID NO: 1225882 - DNA, 19 bp, Homo sapiens
ctgtcataagaatgaataa

SEQ ID NO: 1225883 - DNA, 15 bp, Homo sapiens
ctgtcataggactct

SEQ ID NO: 1225884 - DNA, 22 bp, Homo sapiens
ctgtcatagggattgtccctgt

SEQ ID NO: 1225885 - DNA, 18 bp, Homo sapiens
ctgtcatcactccctgga

SEQ ID NO: 1225886 - DNA, 19 bp, Homo sapiens
ctgtcatcactccctggat

SEQ ID NO: 1225887 - DNA, 21 bp, Homo sapiens
ctgtcatcactccctggatgt

SEQ ID NO: 1225888 - DNA, 20 bp, Homo sapiens
ctgtcatcctcaaagaaagt

SEQ ID NO: 1225889 - DNA, 14 bp, Homo sapiens
ctgtcatctctctg

SEQ ID NO: 1225890 - DNA, 16 bp, Homo sapiens
ctgtcatctctctggg

SEQ ID NO: 1225891 - DNA, 18 bp, Homo sapiens
ctgtcatgaaatcagcaa

SEQ ID NO: 1225892 - DNA, 20 bp, Homo sapiens
ctgtcatgaaatcagcaaga

SEQ ID NO: 1225893 - DNA, 15 bp, Homo sapiens
ctgtcatgaacatgt

SEQ ID NO: 1225894 - DNA, 14 bp, Homo sapiens
ctgtcatgcttcat

SEQ ID NO: 1225895 - DNA, 14 bp, Homo sapiens
ctgtcatgtgcgga

SEQ ID NO: 1225896 - DNA, 16 bp, Homo sapiens
ctgtcattcagaaaaa

SEQ ID NO: 1225897 - DNA, 13 bp, Homo sapiens
ctgtcattcctct

SEQ ID NO: 1225898 - DNA, 15 bp, Homo sapiens
ctgtcattgtattca

SEQ ID NO: 1225899 - DNA, 13 bp, Homo sapiens
ctgtcatttttaa

SEQ ID NO: 1225900 - DNA, 17 bp, Homo sapiens
ctgtcatttttaacagc

SEQ ID NO: 1225901 - DNA, 19 bp, Homo sapiens
ctgtccaaaagcgccctca

SEQ ID NO: 1225902 - DNA, 21 bp, Homo sapiens
ctgtccaaaagcgccctcact

SEQ ID NO: 1225903 - DNA, 17 bp, Homo sapiens
ctgtccaaaggaggctg

SEQ ID NO: 1225904 - DNA, 18 bp, Homo sapiens
ctgtccaaaggaggctgg

SEQ ID NO: 1225905 - DNA, 22 bp, Homo sapiens
ctgtccaaaggaggctggcagg

SEQ ID NO: 1225906 - DNA, 23 bp, Homo sapiens
ctgtccaacctaacccctttcct

SEQ ID NO: 1225907 - DNA, 15 bp, Homo sapiens
ctgtccacacccagc

SEQ ID NO: 1225908 - DNA, 15 bp, Homo sapiens
ctgtccacatcccca

SEQ ID NO: 1225909 - DNA, 20 bp, Homo sapiens
ctgtccacatccccagagcc

SEQ ID NO: 1225910 - DNA, 17 bp, Homo sapiens
ctgtccacatctgcctc

SEQ ID NO: 1225911 - DNA, 14 bp, Homo sapiens
ctgtccccagacca

SEQ ID NO: 1225912 - DNA, 20 bp, Homo sapiens
ctgtccccagccctgtcctg

SEQ ID NO: 1225913 - DNA, 19 bp, Homo sapiens
ctgtccccaggcccagccc

SEQ ID NO: 1225914 - DNA, 23 bp, Homo sapiens
ctgtccccaggcccagccctcct

SEQ ID NO: 1225915 - DNA, 14 bp, Homo sapiens
ctgtccccaggcct

SEQ ID NO: 1225916 - DNA, 18 bp, Homo sapiens
ctgtccccaggcctggct

SEQ ID NO: 1225917 - DNA, 15 bp, Homo sapiens
ctgtccccaggtcct

SEQ ID NO: 1225918 - DNA, 17 bp, Homo sapiens
ctgtccccagtccccag

SEQ ID NO: 1225919 - DNA, 18 bp, Homo sapiens
ctgtccccagtccccagc

SEQ ID NO: 1225920 - DNA, 20 bp, Homo sapiens
ctgtccccagtccccagccc

SEQ ID NO: 1225921 - DNA, 13 bp, Homo sapiens
ctgtcccccactc

SEQ ID NO: 1225922 - DNA, 13 bp, Homo sapiens
ctgtcccccagct

SEQ ID NO: 1225923 - DNA, 14 bp, Homo sapiens
ctgtcccccagctc

SEQ ID NO: 1225924 - DNA, 13 bp, Homo sapiens
ctgtcccccaggc

SEQ ID NO: 1225925 - DNA, 16 bp, Homo sapiens
ctgtcccccaggctgg

SEQ ID NO: 1225926 - DNA, 19 bp, Homo sapiens
ctgtccccgccttccctca

SEQ ID NO: 1225927 - DNA, 18 bp, Homo sapiens
ctgtcccctctgtcatca

SEQ ID NO: 1225928 - DNA, 18 bp, Homo sapiens
ctgtcccctggagtgtgt

SEQ ID NO: 1225929 - DNA, 18 bp, Homo sapiens
ctgtcccggttcaccttg

SEQ ID NO: 1225930 - DNA, 18 bp, Homo sapiens
ctgtccctatacactaga

SEQ ID NO: 1225931 - DNA, 22 bp, Homo sapiens
ctgtccctatctattaaagtga

SEQ ID NO: 1225932 - DNA, 15 bp, Homo sapiens
ctgtccctcaaatga

SEQ ID NO: 1225933 - DNA, 12 bp, Homo sapiens
ctgtccctgagg

SEQ ID NO: 1225934 - DNA, 14 bp, Homo sapiens
ctgtccctgcactg

SEQ ID NO: 1225935 - DNA, 18 bp, Homo sapiens
ctgtccctgcactgtgcc

SEQ ID NO: 1225936 - DNA, 23 bp, Homo sapiens
ctgtccctgccccgccccccaga

SEQ ID NO: 1225937 - DNA, 13 bp, Homo sapiens
ctgtccctgtcag

SEQ ID NO: 1225938 - DNA, 16 bp, Homo sapiens
ctgtccctgtccctgc

SEQ ID NO: 1225939 - DNA, 14 bp, Homo sapiens
ctgtccctgtcctt

SEQ ID NO: 1225940 - DNA, 18 bp, Homo sapiens
ctgtccctgtccttctac

SEQ ID NO: 1225941 - DNA, 12 bp, Homo sapiens
ctgtccctgtgg

SEQ ID NO: 1225942 - DNA, 18 bp, Homo sapiens
ctgtcccttccccttcac

SEQ ID NO: 1225943 - DNA, 15 bp, Homo sapiens
ctgtcccttcctttc

SEQ ID NO: 1225944 - DNA, 16 bp, Homo sapiens
ctgtcccttcctttct

SEQ ID NO: 1225945 - DNA, 19 bp, Homo sapiens
ctgtcccttcctttctccc

SEQ ID NO: 1225946 - DNA, 20 bp, Homo sapiens
ctgtcccttgcctcaatgcc

SEQ ID NO: 1225947 - DNA, 18 bp, Homo sapiens
ctgtcccttgctgtatgc

SEQ ID NO: 1225948 - DNA, 15 bp, Homo sapiens
ctgtcccttttcttt

SEQ ID NO: 1225949 - DNA, 22 bp, Homo sapiens
ctgtcccttttctttgaccaga

SEQ ID NO: 1225950 - DNA, 14 bp, Homo sapiens
ctgtccgcctctgc

SEQ ID NO: 1225951 - DNA, 19 bp, Homo sapiens
ctgtccgcctctgcccgca

SEQ ID NO: 1225952 - DNA, 21 bp, Homo sapiens
ctgtccggcccagtgccagct

SEQ ID NO: 1225953 - DNA, 22 bp, Homo sapiens
ctgtccgtagtatcagagatgt

SEQ ID NO: 1225954 - DNA, 21 bp, Homo sapiens
ctgtccgttcacatgtgtggt

SEQ ID NO: 1225955 - DNA, 18 bp, Homo sapiens
ctgtcctacttctgactt

SEQ ID NO: 1225956 - DNA, 19 bp, Homo sapiens
ctgtcctcaccctgtggga

SEQ ID NO: 1225957 - DNA, 22 bp, Homo sapiens
ctgtcctcaccctgtgggaccg

SEQ ID NO: 1225958 - DNA, 14 bp, Homo sapiens
ctgtcctcagagca

SEQ ID NO: 1225959 - DNA, 17 bp, Homo sapiens
ctgtcctcaggtggcca

SEQ ID NO: 1225960 - DNA, 18 bp, Homo sapiens
ctgtcctcaggtggccat

SEQ ID NO: 1225961 - DNA, 23 bp, Homo sapiens
ctgtcctccaacaccaagcacag

SEQ ID NO: 1225962 - DNA, 12 bp, Homo sapiens
ctgtcctccaag

SEQ ID NO: 1225963 - DNA, 15 bp, Homo sapiens
ctgtcctccaagcca

SEQ ID NO: 1225964 - DNA, 21 bp, Homo sapiens
ctgtcctcccacagacctgca

SEQ ID NO: 1225965 - DNA, 16 bp, Homo sapiens
ctgtcctcctggaagg

SEQ ID NO: 1225966 - DNA, 14 bp, Homo sapiens
ctgtcctccttcct

SEQ ID NO: 1225967 - DNA, 12 bp, Homo sapiens
ctgtcctctccc

SEQ ID NO: 1225968 - DNA, 16 bp, Homo sapiens
ctgtcctctccccctt

SEQ ID NO: 1225969 - DNA, 21 bp, Homo sapiens
ctgtcctctcccccttcagct

SEQ ID NO: 1225970 - DNA, 22 bp, Homo sapiens
ctgtcctctcccccttcagctc

SEQ ID NO: 1225971 - DNA, 13 bp, Homo sapiens
ctgtcctctcgag

SEQ ID NO: 1225972 - DNA, 18 bp, Homo sapiens
ctgtcctctcgagcccag

SEQ ID NO: 1225973 - DNA, 14 bp, Homo sapiens
ctgtcctctgtagt

SEQ ID NO: 1225974 - DNA, 12 bp, Homo sapiens
ctgtcctctttg

SEQ ID NO: 1225975 - DNA, 18 bp, Homo sapiens
ctgtcctgaaccgactga

SEQ ID NO: 1225976 - DNA, 22 bp, Homo sapiens
ctgtcctgaaccgactgaccct

SEQ ID NO: 1225977 - DNA, 17 bp, Homo sapiens
ctgtcctgatctgtgat

SEQ ID NO: 1225978 - DNA, 19 bp, Homo sapiens
ctgtcctgatggtcagctc

SEQ ID NO: 1225979 - DNA, 12 bp, Homo sapiens
ctgtcctgcagt

SEQ ID NO: 1225980 - DNA, 14 bp, Homo sapiens
ctgtctggggcctt

SEQ ID NO: 1225981 - DNA, 20 bp, Homo sapiens
ctgtctggtgaggtggccca

SEQ ID NO: 1225982 - DNA, 15 bp, Homo sapiens
ctgtctggtggcccc

SEQ ID NO: 1225983 - DNA, 17 bp, Homo sapiens
ctgtctgtcccttttct

SEQ ID NO: 1225984 - DNA, 13 bp, Homo sapiens
ctgtctgtcctac

SEQ ID NO: 1225985 - DNA, 20 bp, Homo sapiens
ctgtctgtccttctgaagtg

SEQ ID NO: 1225986 - DNA, 13 bp, Homo sapiens
ctgtctgtctcca

SEQ ID NO: 1225987 - DNA, 14 bp, Homo sapiens
ctgtctgtctctcc

SEQ ID NO: 1225988 - DNA, 16 bp, Homo sapiens
ctgtctgtctgtgggc

SEQ ID NO: 1225989 - DNA, 16 bp, Homo sapiens
ctgtctgtcttctcct

SEQ ID NO: 1225990 - DNA, 12 bp, Homo sapiens
ctgtctgtgaat

SEQ ID NO: 1225991 - DNA, 22 bp, Homo sapiens
ctgtctgtgccatggcccccca

SEQ ID NO: 1225992 - DNA, 15 bp, Homo sapiens
ctgtctgtgggcttc

SEQ ID NO: 1225993 - DNA, 18 bp, Homo sapiens
ctgtctgttacactggag

SEQ ID NO: 1225994 - DNA, 17 bp, Homo sapiens
ctgtctgttatgatttc

SEQ ID NO: 1225995 - DNA, 14 bp, Homo sapiens
ctgtctgtttatat

SEQ ID NO: 1225996 - DNA, 19 bp, Homo sapiens
ctgtcttatggtccagaaa

SEQ ID NO: 1225997 - DNA, 14 bp, Homo sapiens
ctgtcttcaagggc

SEQ ID NO: 1225998 - DNA, 15 bp, Homo sapiens
ctgtcttcaagggct

SEQ ID NO: 1225999 - DNA, 18 bp, Homo sapiens
ctgtcttcagtaagccgt

SEQ ID NO: 1226000 - DNA, 19 bp, Homo sapiens
ctgtcttcatagcagattt

SEQ ID NO: 1226001 - DNA, 22 bp, Homo sapiens
ctgtcttcatagcagattttaa

SEQ ID NO: 1226002 - DNA, 18 bp, Homo sapiens
ctgtcttccacagccgcc

SEQ ID NO: 1226003 - DNA, 13 bp, Homo sapiens
ctgtcttctccta

SEQ ID NO: 1226004 - DNA, 15 bp, Homo sapiens
ctgtcttctcctaat

SEQ ID NO: 1226005 - DNA, 14 bp, Homo sapiens
ctgtcttctctcca

SEQ ID NO: 1226006 - DNA, 16 bp, Homo sapiens
ctgtcttctgggcaca

SEQ ID NO: 1226007 - DNA, 18 bp, Homo sapiens
ctgtcttgctcctgggga

SEQ ID NO: 1226008 - DNA, 19 bp, Homo sapiens
ctgtcttgctcctggggag

SEQ ID NO: 1226009 - DNA, 22 bp, Homo sapiens
ctgtcttggcattaaaccacat

SEQ ID NO: 1226010 - DNA, 13 bp, Homo sapiens
ctgtctttaagaa

SEQ ID NO: 1226011 - DNA, 16 bp, Homo sapiens
ctgtctttcagataca

SEQ ID NO: 1226012 - DNA, 20 bp, Homo sapiens
ctgtctttcagatacatggt

SEQ ID NO: 1226013 - DNA, 17 bp, Homo sapiens
ctgtctttccactctgg

SEQ ID NO: 1226014 - DNA, 18 bp, Homo sapiens
ctgtctttcctgaaccat

SEQ ID NO: 1226015 - DNA, 23 bp, Homo sapiens
ctgtctttctctaaatatgatta

SEQ ID NO: 1226016 - DNA, 17 bp, Homo sapiens
ctgtctttgcagggcac

SEQ ID NO: 1226017 - DNA, 18 bp, Homo sapiens
ctgtcttttgttctctga

SEQ ID NO: 1226018 - DNA, 12 bp, Homo sapiens
ctgtgaaaatag

SEQ ID NO: 1226019 - DNA, 16 bp, Homo sapiens
ctgtgaaaatagtgta

SEQ ID NO: 1226020 - DNA, 15 bp, Homo sapiens
ctgtgaaagaaaata

SEQ ID NO: 1226021 - DNA, 18 bp, Homo sapiens
ctgtgaaagaaaataatg

SEQ ID NO: 1226022 - DNA, 11 bp, Homo sapiens
ctgtgaaatac

SEQ ID NO: 1226023 - DNA, 12 bp, Homo sapiens
ctgtgaaatagt

SEQ ID NO: 1226024 - DNA, 15 bp, Homo sapiens
ctgtgaaatattctt

SEQ ID NO: 1226025 - DNA, 13 bp, Homo sapiens
ctgtgaaatttca

SEQ ID NO: 1226026 - DNA, 21 bp, Homo sapiens
ctgtgaaatttcatgattggc

SEQ ID NO: 1226027 - DNA, 20 bp, Homo sapiens
ctgtgaacaagcttcagtaa

SEQ ID NO: 1226028 - DNA, 18 bp, Homo sapiens
ctgtgaacagcttgctgt

SEQ ID NO: 1226029 - DNA, 19 bp, Homo sapiens
ctgtgaaccctggggcctg

SEQ ID NO: 1226030 - DNA, 14 bp, Homo sapiens
ctgtgaacctggag

SEQ ID NO: 1226031 - DNA, 19 bp, Homo sapiens
ctgtgaacctgggcactcc

SEQ ID NO: 1226032 - DNA, 20 bp, Homo sapiens
ctgtgaactcaatctccagg

SEQ ID NO: 1226033 - DNA, 23 bp, Homo sapiens
ctgtgaactcaatctccagggct

SEQ ID NO: 1226034 - DNA, 15 bp, Homo sapiens
ctgtgaacttgggga

SEQ ID NO: 1226035 - DNA, 16 bp, Homo sapiens
ctgtgaacttggggaa

SEQ ID NO: 1226036 - DNA, 13 bp, Homo sapiens
ctgtgaagctaat

SEQ ID NO: 1226037 - DNA, 20 bp, Homo sapiens
ctgtgaaggcttcactctta

SEQ ID NO: 1226038 - DNA, 18 bp, Homo sapiens
ctgtgaagtccttcacct

SEQ ID NO: 1226039 - DNA, 22 bp, Homo sapiens
ctgtgaatacaattaaaggtcc

SEQ ID NO: 1226040 - DNA, 15 bp, Homo sapiens
ctgtgaatcaatcct

SEQ ID NO: 1226041 - DNA, 16 bp, Homo sapiens
ctgtgaatcctggcaa

SEQ ID NO: 1226042 - DNA, 21 bp, Homo sapiens
ctgtgaatcctggcaagaaag

SEQ ID NO: 1226043 - DNA, 15 bp, Homo sapiens
ctgtgaatgccactg

SEQ ID NO: 1226044 - DNA, 21 bp, Homo sapiens
ctgtgaatgccactgccttcg

SEQ ID NO: 1226045 - DNA, 19 bp, Homo sapiens
ctgtgaattgagctgcaga

SEQ ID NO: 1226046 - DNA, 21 bp, Homo sapiens
ctgtgaattgagctgcagaaa

SEQ ID NO: 1226047 - DNA, 12 bp, Homo sapiens
ctgtgaatttca

SEQ ID NO: 1226048 - DNA, 14 bp, Homo sapiens
ctgtgaatttcaaa

SEQ ID NO: 1226049 - DNA, 21 bp, Homo sapiens
ctgtgacaaaggatgaagaac

SEQ ID NO: 1226050 - DNA, 20 bp, Homo sapiens
ctgtgacaataagtttgaac

SEQ ID NO: 1226051 - DNA, 22 bp, Homo sapiens
ctgtgacagactttggacagtg

SEQ ID NO: 1226052 - DNA, 16 bp, Homo sapiens
ctgtgacatggtgcct

SEQ ID NO: 1226053 - DNA, 17 bp, Homo sapiens
ctgtgacatggtgcctg

SEQ ID NO: 1226054 - DNA, 22 bp, Homo sapiens
ctgtgacatggtgcctgagagg

SEQ ID NO: 1226055 - DNA, 13 bp, Homo sapiens
ctgtgacatgtaa

SEQ ID NO: 1226056 - DNA, 15 bp, Homo sapiens
ctgtgacattgctgg

SEQ ID NO: 1226057 - DNA, 16 bp, Homo sapiens
ctgtgacatttttccg

SEQ ID NO: 1226058 - DNA, 19 bp, Homo sapiens
ctgtgagtgcgcctcacca

SEQ ID NO: 1226059 - DNA, 16 bp, Homo sapiens
ctgtgagttctccctg

SEQ ID NO: 1226060 - DNA, 22 bp, Homo sapiens
ctgtgagttctccctgtacagt

SEQ ID NO: 1226061 - DNA, 17 bp, Homo sapiens
ctgtgataactctgcaa

SEQ ID NO: 1226062 - DNA, 16 bp, Homo sapiens
ctgtgatgagctgatc

SEQ ID NO: 1226063 - DNA, 17 bp, Homo sapiens
ctgtgatgatcctcata

SEQ ID NO: 1226064 - DNA, 14 bp, Homo sapiens
ctgtgatgccacac

SEQ ID NO: 1226065 - DNA, 19 bp, Homo sapiens
ctgtgatgccgtcctgctg

SEQ ID NO: 1226066 - DNA, 24 bp, Homo sapiens
ctgtgatgccgtcctgctggagtg

SEQ ID NO: 1226067 - DNA, 16 bp, Homo sapiens
ctgtgatgctgtgtgc

SEQ ID NO: 1226068 - DNA, 19 bp, Homo sapiens
ctgtgatgctgtgtgccca

SEQ ID NO: 1226069 - DNA, 13 bp, Homo sapiens
ctgtgattaactt

SEQ ID NO: 1226070 - DNA, 19 bp, Homo sapiens
ctgtgattaacttgcttag

SEQ ID NO: 1226071 - DNA, 15 bp, Homo sapiens
ctgtgattacataga

SEQ ID NO: 1226072 - DNA, 16 bp, Homo sapiens
ctgtgattacatagat

SEQ ID NO: 1226073 - DNA, 21 bp, Homo sapiens
ctgtgattacatagatcagcc

SEQ ID NO: 1226074 - DNA, 12 bp, Homo sapiens
ctgtgattagat

SEQ ID NO: 1226075 - DNA, 16 bp, Homo sapiens
ctgtgattcagaaaat

SEQ ID NO: 1226076 - DNA, 22 bp, Homo sapiens
ctgtgattccactacacctggc

SEQ ID NO: 1226077 - DNA, 19 bp, Homo sapiens
ctgtgattgggtgggattt

SEQ ID NO: 1226078 - DNA, 19 bp, Homo sapiens
ctgtgatttcttctccctc

SEQ ID NO: 1226079 - DNA, 16 bp, Homo sapiens
ctgtgcaaaaaaatta

SEQ ID NO: 1226080 - DNA, 15 bp, Homo sapiens
ctgtgcaaagggctg

SEQ ID NO: 1226081 - DNA, 16 bp, Homo sapiens
ctgtgcaaagggctgc

SEQ ID NO: 1226082 - DNA, 16 bp, Homo sapiens
ctgtgcaaatccttga

SEQ ID NO: 1226083 - DNA, 16 bp, Homo sapiens
ctgtgcaactttttaa

SEQ ID NO: 1226084 - DNA, 20 bp, Homo sapiens
ctgtgcacaaaacccagacc

SEQ ID NO: 1226085 - DNA, 22 bp, Homo sapiens
ctgtgcacaaaacccagacctg

SEQ ID NO: 1226086 - DNA, 21 bp, Homo sapiens
ctgtgcacaccccactcccac

SEQ ID NO: 1226087 - DNA, 14 bp, Homo sapiens
ctgtgcacagtggc

SEQ ID NO: 1226088 - DNA, 18 bp, Homo sapiens
ctgtgcacagtggcttct

SEQ ID NO: 1226089 - DNA, 19 bp, Homo sapiens
ctgtgcacctaccccttgg

SEQ ID NO: 1226090 - DNA, 22 bp, Homo sapiens
ctgtgcacctaccccttggaaa

SEQ ID NO: 1226091 - DNA, 17 bp, Homo sapiens
ctgtgcactagcctgtg

SEQ ID NO: 1226092 - DNA, 14 bp, Homo sapiens
ctgtgcactgggca

SEQ ID NO: 1226093 - DNA, 14 bp, Homo sapiens
ctgtgcagaataat

SEQ ID NO: 1226094 - DNA, 15 bp, Homo sapiens
ctgtgcagacccagt

SEQ ID NO: 1226095 - DNA, 14 bp, Homo sapiens
ctgtgcagcagccc

SEQ ID NO: 1226096 - DNA, 19 bp, Homo sapiens
ctgtgcagcagcccagctt

SEQ ID NO: 1226097 - DNA, 22 bp, Homo sapiens
ctgtgcagcagcccagcttcct

SEQ ID NO: 1226098 - DNA, 24 bp, Homo sapiens
ctgtgcagcagcccagcttcctgg

SEQ ID NO: 1226099 - DNA, 17 bp, Homo sapiens
ctgtgcagccgctgagc

SEQ ID NO: 1226100 - DNA, 13 bp, Homo sapiens
ctgtgcagctctc

SEQ ID NO: 1226101 - DNA, 13 bp, Homo sapiens
ctgtgcagggagg

SEQ ID NO: 1226102 - DNA, 16 bp, Homo sapiens
ctgtgcagtcactgga

SEQ ID NO: 1226103 - DNA, 14 bp, Homo sapiens
ctgtgcatgggtga

SEQ ID NO: 1226104 - DNA, 17 bp, Homo sapiens
ctgtgcatttctggttg

SEQ ID NO: 1226105 - DNA, 12 bp, Homo sapiens
ctgtgccaacct

SEQ ID NO: 1226106 - DNA, 18 bp, Homo sapiens
ctgtgccaacctgatgcc

SEQ ID NO: 1226107 - DNA, 17 bp, Homo sapiens
ctgtgccaataaaagtt

SEQ ID NO: 1226108 - DNA, 13 bp, Homo sapiens
ctgtgccacaggc

SEQ ID NO: 1226109 - DNA, 18 bp, Homo sapiens
ctgtgccacccaccaggg

SEQ ID NO: 1226110 - DNA, 20 bp, Homo sapiens
ctgtgccactgacttgctgt

SEQ ID NO: 1226111 - DNA, 22 bp, Homo sapiens
ctgtgccactgacttgctgtgt

SEQ ID NO: 1226112 - DNA, 23 bp, Homo sapiens
ctgtgccactgacttgctgtgtg

SEQ ID NO: 1226113 - DNA, 23 bp, Homo sapiens
ctgtgccagaaacagtgggagcc

SEQ ID NO: 1226114 - DNA, 13 bp, Homo sapiens
ctgtgccagcagg

SEQ ID NO: 1226115 - DNA, 14 bp, Homo sapiens
ctgtgccatgccca

SEQ ID NO: 1226116 - DNA, 15 bp, Homo sapiens
ctgtgccatgctggg

SEQ ID NO: 1226117 - DNA, 23 bp, Homo sapiens
ctgtgccatggccccccactccc

SEQ ID NO: 1226118 - DNA, 18 bp, Homo sapiens
ctgtgcccacatcccagg

SEQ ID NO: 1226119 - DNA, 23 bp, Homo sapiens
ctgtgcccacatcccaggcttca

SEQ ID NO: 1226120 - DNA, 20 bp, Homo sapiens
ctgtgcccacggtctgagct

SEQ ID NO: 1226121 - DNA, 24 bp, Homo sapiens
ctgtgcccacggtctgagctagct

SEQ ID NO: 1226122 - DNA, 15 bp, Homo sapiens
ctgtgcccagcaggc

SEQ ID NO: 1226123 - DNA, 21 bp, Homo sapiens
ctgtgcccagcaggcccagca

SEQ ID NO: 1226124 - DNA, 22 bp, Homo sapiens
ctgtgcccagggtggctgccag

SEQ ID NO: 1226125 - DNA, 14 bp, Homo sapiens
ctgtgccccagctg

SEQ ID NO: 1226126 - DNA, 15 bp, Homo sapiens
ctgtgccccagctgc

SEQ ID NO: 1226127 - DNA, 17 bp, Homo sapiens
ctgtgcccccagcctca

SEQ ID NO: 1226128 - DNA, 18 bp, Homo sapiens
ctgtgcccccagcctcag

SEQ ID NO: 1226129 - DNA, 21 bp, Homo sapiens
ctgtgccccctcccaccctgc

SEQ ID NO: 1226130 - DNA, 17 bp, Homo sapiens
ctgtgccccgcgggctt

SEQ ID NO: 1226131 - DNA, 20 bp, Homo sapiens
ctgtgcccctgatgcagcct

SEQ ID NO: 1226132 - DNA, 17 bp, Homo sapiens
ctgtgccctcaccacca

SEQ ID NO: 1226133 - DNA, 16 bp, Homo sapiens
ctgtgccctccaaaga

SEQ ID NO: 1226134 - DNA, 17 bp, Homo sapiens
ctgtgccctccaaagag

SEQ ID NO: 1226135 - DNA, 15 bp, Homo sapiens
ctgtgccctggtgga

SEQ ID NO: 1226136 - DNA, 16 bp, Homo sapiens
ctgtgccgcactctgg

SEQ ID NO: 1226137 - DNA, 19 bp, Homo sapiens
ctgtgcctcagagaccagg

SEQ ID NO: 1226138 - DNA, 14 bp, Homo sapiens
ctgtgcctcccaaa

SEQ ID NO: 1226139 - DNA, 13 bp, Homo sapiens
ctgtgcctccccc

SEQ ID NO: 1226140 - DNA, 16 bp, Homo sapiens
ctgtgcctcctcaccc

SEQ ID NO: 1226141 - DNA, 16 bp, Homo sapiens
ctgtgcctctgggact

SEQ ID NO: 1226142 - DNA, 14 bp, Homo sapiens
ctgtgcctgctaga

SEQ ID NO: 1226143 - DNA, 16 bp, Homo sapiens
ctgtgcctgctagagc

SEQ ID NO: 1226144 - DNA, 18 bp, Homo sapiens
ctgtgcctgctagagcaa

SEQ ID NO: 1226145 - DNA, 18 bp, Homo sapiens
ctgtgcctgctcagcagc

SEQ ID NO: 1226146 - DNA, 20 bp, Homo sapiens
ctgtgcctgctcagcagcca

SEQ ID NO: 1226147 - DNA, 12 bp, Homo sapiens
ctgtgcctgctt

SEQ ID NO: 1226148 - DNA, 15 bp, Homo sapiens
ctgtgcctgcttctg

SEQ ID NO: 1226149 - DNA, 16 bp, Homo sapiens
ctgtgcctgcttctgt

SEQ ID NO: 1226150 - DNA, 14 bp, Homo sapiens
ctgtgcctggcccc

SEQ ID NO: 1226151 - DNA, 16 bp, Homo sapiens
ctgtgcctggccccag

SEQ ID NO: 1226152 - DNA, 12 bp, Homo sapiens
ctgtgcctggga

SEQ ID NO: 1226153 - DNA, 13 bp, Homo sapiens
ctgtgcctgggcc

SEQ ID NO: 1226154 - DNA, 15 bp, Homo sapiens
ctgtgcctgggccct

SEQ ID NO: 1226155 - DNA, 15 bp, Homo sapiens
ctgtgcctggtttga

SEQ ID NO: 1226156 - DNA, 19 bp, Homo sapiens
ctgtgccttcttttgatta

SEQ ID NO: 1226157 - DNA, 17 bp, Homo sapiens
ctgtgcctttcctatca

SEQ ID NO: 1226158 - DNA, 16 bp, Homo sapiens
ctgtgccttttcccca

SEQ ID NO: 1226159 - DNA, 15 bp, Homo sapiens
ctgtgcgccttgtag

SEQ ID NO: 1226160 - DNA, 19 bp, Homo sapiens
ctgtgcgcgtggcgtggcc

SEQ ID NO: 1226161 - DNA, 14 bp, Homo sapiens
ctgtgcgctgacaa

SEQ ID NO: 1226162 - DNA, 19 bp, Homo sapiens
ctgtgcgtgtggcgtggcc

SEQ ID NO: 1226163 - DNA, 22 bp, Homo sapiens
ctgtgctagggaaacttcccgt

SEQ ID NO: 1226164 - DNA, 13 bp, Homo sapiens
ctgtgctcagaga

SEQ ID NO: 1226165 - DNA, 17 bp, Homo sapiens
ctgtgctcccctgccac

SEQ ID NO: 1226166 - DNA, 15 bp, Homo sapiens
ctgtgctccgtgcct

SEQ ID NO: 1226167 - DNA, 19 bp, Homo sapiens
ctgtgctccgtgcctccac

SEQ ID NO: 1226168 - DNA, 20 bp, Homo sapiens
ctgtgctccgtgcctccacc

SEQ ID NO: 1226169 - DNA, 21 bp, Homo sapiens
ctgtgctccgtgcctccacca

SEQ ID NO: 1226170 - DNA, 18 bp, Homo sapiens
ctgtgctctggggatttc

SEQ ID NO: 1226171 - DNA, 23 bp, Homo sapiens
ctgtgctctggggatttctggga

SEQ ID NO: 1226172 - DNA, 22 bp, Homo sapiens
ctgtgctcttttggtggggagc

SEQ ID NO: 1226173 - DNA, 16 bp, Homo sapiens
ctgtgctgagaagcag

SEQ ID NO: 1226174 - DNA, 16 bp, Homo sapiens
ctgtgctgaggcctta

SEQ ID NO: 1226175 - DNA, 13 bp, Homo sapiens
ctgtgctgctgca

SEQ ID NO: 1226176 - DNA, 21 bp, Homo sapiens
ctgtgctggaccagctggcct

SEQ ID NO: 1226177 - DNA, 17 bp, Homo sapiens
ctgtgctggggcacggc

SEQ ID NO: 1226178 - DNA, 13 bp, Homo sapiens
ctgtgctggggga

SEQ ID NO: 1226179 - DNA, 23 bp, Homo sapiens
ctgtgctgggggaatgagcccag

SEQ ID NO: 1226180 - DNA, 17 bp, Homo sapiens
cttcccctagacctccc

SEQ ID NO: 1226181 - DNA, 22 bp, Homo sapiens
cttcccctcccccactcctcta

SEQ ID NO: 1226182 - DNA, 17 bp, Homo sapiens
cttcccctccctaccct

SEQ ID NO: 1226183 - DNA, 13 bp, Homo sapiens
cttcccctccctg

SEQ ID NO: 1226184 - DNA, 17 bp, Homo sapiens
cttcctcctacctgggg

SEQ ID NO: 1226185 - DNA, 23 bp, Homo sapiens
cttcctcctacctggggactcct

SEQ ID NO: 1226186 - DNA, 16 bp, Homo sapiens
cttcctcctccacagt

SEQ ID NO: 1226187 - DNA, 18 bp, Homo sapiens
cttcctcctccacagtgc

SEQ ID NO: 1226188 - DNA, 14 bp, Homo sapiens
cttcctcctccatc

SEQ ID NO: 1226189 - DNA, 17 bp, Homo sapiens
cttcctcctccccactt

SEQ ID NO: 1226190 - DNA, 18 bp, Homo sapiens
cttcctcctccctcctgc

SEQ ID NO: 1226191 - DNA, 15 bp, Homo sapiens
cttcctcctgaagcc

SEQ ID NO: 1226192 - DNA, 17 bp, Homo sapiens
cttcctcctgaagcctc

SEQ ID NO: 1226193 - DNA, 18 bp, Homo sapiens
cttcctcctgaagcctct

SEQ ID NO: 1226194 - DNA, 13 bp, Homo sapiens
cttcctcctgatg

SEQ ID NO: 1226195 - DNA, 15 bp, Homo sapiens
cttcctcctgatggc

SEQ ID NO: 1226196 - DNA, 21 bp, Homo sapiens
cttcctcctgatggccaagag

SEQ ID NO: 1226197 - DNA, 12 bp, Homo sapiens
cttcctcctgga

SEQ ID NO: 1226198 - DNA, 22 bp, Homo sapiens
cttcctcctgggccctctctgc

SEQ ID NO: 1226199 - DNA, 18 bp, Homo sapiens
cttcctcggtggctctgg

SEQ ID NO: 1226200 - DNA, 18 bp, Homo sapiens
cttcctcgtgcagagctg

SEQ ID NO: 1226201 - DNA, 13 bp, Homo sapiens
cttcctctccact

SEQ ID NO: 1226202 - DNA, 13 bp, Homo sapiens
cttcctctccttc

SEQ ID NO: 1226203 - DNA, 21 bp, Homo sapiens
cttcctctcgcggccctcagt

SEQ ID NO: 1226204 - DNA, 22 bp, Homo sapiens
cttcctctcggctggaagaaca

SEQ ID NO: 1226205 - DNA, 15 bp, Homo sapiens
cttcctctctcctta

SEQ ID NO: 1226206 - DNA, 21 bp, Homo sapiens
cttcctctctctaccagtcta

SEQ ID NO: 1226207 - DNA, 13 bp, Homo sapiens
cttcctctctgga

SEQ ID NO: 1226208 - DNA, 15 bp, Homo sapiens
cttcctctgaggctg

SEQ ID NO: 1226209 - DNA, 20 bp, Homo sapiens
cttcctctgcagctgacctc

SEQ ID NO: 1226210 - DNA, 14 bp, Homo sapiens
cttcctctgggcag

SEQ ID NO: 1226211 - DNA, 17 bp, Homo sapiens
cttcctctgggcagcgc

SEQ ID NO: 1226212 - DNA, 19 bp, Homo sapiens
cttcctctggttcctttca

SEQ ID NO: 1226213 - DNA, 18 bp, Homo sapiens
cttcctcttcctgccctt

SEQ ID NO: 1226214 - DNA, 20 bp, Homo sapiens
cttcctcttcggccctcaga

SEQ ID NO: 1226215 - DNA, 20 bp, Homo sapiens
cttcctctttggtggcatgg

SEQ ID NO: 1226216 - DNA, 15 bp, Homo sapiens
cttcctgaaggggga

SEQ ID NO: 1226217 - DNA, 23 bp, Homo sapiens
cttcctgaagggggacactccat

SEQ ID NO: 1226218 - DNA, 18 bp, Homo sapiens
cttcctgacgaaactggc

SEQ ID NO: 1226219 - DNA, 19 bp, Homo sapiens
cttcctgactctcacctgt

SEQ ID NO: 1226220 - DNA, 21 bp, Homo sapiens
cttcctgagaaagcccacctg

SEQ ID NO: 1226221 - DNA, 19 bp, Homo sapiens
cttcctgattaccagtctg

SEQ ID NO: 1226222 - DNA, 22 bp, Homo sapiens
cttcctgattaccagtctgatt

SEQ ID NO: 1226223 - DNA, 13 bp, Homo sapiens
cttcctgcaagga

SEQ ID NO: 1226224 - DNA, 21 bp, Homo sapiens
cttcctgcaggcaggaacaaa

SEQ ID NO: 1226225 - DNA, 14 bp, Homo sapiens
cttcctgcatttct

SEQ ID NO: 1226226 - DNA, 20 bp, Homo sapiens
cttcctgcatttctcttctc

SEQ ID NO: 1226227 - DNA, 15 bp, Homo sapiens
cttcctgccaccagt

SEQ ID NO: 1226228 - DNA, 12 bp, Homo sapiens
cttcctgccagc

SEQ ID NO: 1226229 - DNA, 13 bp, Homo sapiens
cttcctgcccttc

SEQ ID NO: 1226230 - DNA, 17 bp, Homo sapiens
cttcctgcccttccctc

SEQ ID NO: 1226231 - DNA, 10 bp, Homo sapiens
cttcctgctg

SEQ ID NO: 1226232 - DNA, 15 bp, Homo sapiens
cttcctgctgcaccc

SEQ ID NO: 1226233 - DNA, 16 bp, Homo sapiens
cttcctgctgcaccct

SEQ ID NO: 1226234 - DNA, 12 bp, Homo sapiens
cttcctgctgct

SEQ ID NO: 1226235 - DNA, 16 bp, Homo sapiens
cttcctgctgggactg

SEQ ID NO: 1226236 - DNA, 18 bp, Homo sapiens
cttcctgcttaaacttga

SEQ ID NO: 1226237 - DNA, 16 bp, Homo sapiens
cttcctgcttgccaag

SEQ ID NO: 1226238 - DNA, 18 bp, Homo sapiens
cttcctggaaacagcatg

SEQ ID NO: 1226239 - DNA, 19 bp, Homo sapiens
cttcctggaaacagcatga

SEQ ID NO: 1226240 - DNA, 20 bp, Homo sapiens
cttcctggaaacagcatgaa

SEQ ID NO: 1226241 - DNA, 12 bp, Homo sapiens
cttcctggacac

SEQ ID NO: 1226242 - DNA, 16 bp, Homo sapiens
cttcctggacctgagt

SEQ ID NO: 1226243 - DNA, 17 bp, Homo sapiens
cttcctggacctgagtc

SEQ ID NO: 1226244 - DNA, 13 bp, Homo sapiens
cttcctggcccag

SEQ ID NO: 1226245 - DNA, 14 bp, Homo sapiens
cttcctggcccagg

SEQ ID NO: 1226246 - DNA, 15 bp, Homo sapiens
cttcctggcccaggc

SEQ ID NO: 1226247 - DNA, 17 bp, Homo sapiens
cttcctggcccaggcct

SEQ ID NO: 1226248 - DNA, 18 bp, Homo sapiens
cttcctggcctcactggc

SEQ ID NO: 1226249 - DNA, 20 bp, Homo sapiens
cttcctggcctcactggctg

SEQ ID NO: 1226250 - DNA, 19 bp, Homo sapiens
cttcctggcctcttctggg

SEQ ID NO: 1226251 - DNA, 21 bp, Homo sapiens
cttcctggcctcttctgggct

SEQ ID NO: 1226252 - DNA, 12 bp, Homo sapiens
cttcctggcctg

SEQ ID NO: 1226253 - DNA, 10 bp, Homo sapiens
cttcctggga

SEQ ID NO: 1226254 - DNA, 12 bp, Homo sapiens
cttcctgggacc

SEQ ID NO: 1226255 - DNA, 18 bp, Homo sapiens
cttcctgggaggacaggc

SEQ ID NO: 1226256 - DNA, 22 bp, Homo sapiens
cttcctgggaggacaggcaggc

SEQ ID NO: 1226257 - DNA, 23 bp, Homo sapiens
cttcctgggtcaagtgctaacct

SEQ ID NO: 1226258 - DNA, 23 bp, Homo sapiens
cttcctgtaacacaagccacaga

SEQ ID NO: 1226259 - DNA, 23 bp, Homo sapiens
cttcctgtccactctcggggccc

SEQ ID NO: 1226260 - DNA, 16 bp, Homo sapiens
cttcctgtccagagag

SEQ ID NO: 1226261 - DNA, 21 bp, Homo sapiens
cttcctgtcccacctcttctc

SEQ ID NO: 1226262 - DNA, 14 bp, Homo sapiens
cttcctgtccctga

SEQ ID NO: 1226263 - DNA, 15 bp, Homo sapiens
cttcctgtctgttta

SEQ ID NO: 1226264 - DNA, 17 bp, Homo sapiens
cttcctgtctgtttata

SEQ ID NO: 1226265 - DNA, 16 bp, Homo sapiens
cttcctgtgatccacc

SEQ ID NO: 1226266 - DNA, 18 bp, Homo sapiens
cttcctgtgccctcaccc

SEQ ID NO: 1226267 - DNA, 15 bp, Homo sapiens
cttcctgtgcctttc

SEQ ID NO: 1226268 - DNA, 15 bp, Homo sapiens
cttcctgttccctcc

SEQ ID NO: 1226269 - DNA, 17 bp, Homo sapiens
cttcctgttccctcctg

SEQ ID NO: 1226270 - DNA, 21 bp, Homo sapiens
cttcctgttccctcctggtcc

SEQ ID NO: 1226271 - DNA, 15 bp, Homo sapiens
cttcctgttcttcct

SEQ ID NO: 1226272 - DNA, 16 bp, Homo sapiens
cttcctgttcttcctt

SEQ ID NO: 1226273 - DNA, 20 bp, Homo sapiens
cttcctgttcttccttccta

SEQ ID NO: 1226274 - DNA, 22 bp, Homo sapiens
cttcctgttcttccttcctaga

SEQ ID NO: 1226275 - DNA, 20 bp, Homo sapiens
cttcctgtttcttcccatac

SEQ ID NO: 1226276 - DNA, 22 bp, Homo sapiens
cttcctgtttgttttgttttct

SEQ ID NO: 1226277 - DNA, 23 bp, Homo sapiens
cttcctgtttttcacattttcct

SEQ ID NO: 1226278 - DNA, 19 bp, Homo sapiens
cttccttagaacttctaca

SEQ ID NO: 1226279 - DNA, 14 bp, Homo sapiens
cttccttcagggtt

SEQ ID NO: 1226280 - DNA, 22 bp, Homo sapiens
cttccttcagggtttaatagac

SEQ ID NO: 1226281 - DNA, 23 bp, Homo sapiens
cttccttcagggtttaatagact

SEQ ID NO: 1226282 - DNA, 14 bp, Homo sapiens
cttccttccatttt

SEQ ID NO: 1226283 - DNA, 12 bp, Homo sapiens
cttccttccccc

SEQ ID NO: 1226284 - DNA, 15 bp, Homo sapiens
cttccttccctggct

SEQ ID NO: 1226285 - DNA, 17 bp, Homo sapiens
cttccttccctggcttg

SEQ ID NO: 1226286 - DNA, 17 bp, Homo sapiens
cttccttccgctctgag

SEQ ID NO: 1226287 - DNA, 14 bp, Homo sapiens
cttccttcctagaa

SEQ ID NO: 1226288 - DNA, 22 bp, Homo sapiens
cttccttctaccccaaggccag

SEQ ID NO: 1226289 - DNA, 16 bp, Homo sapiens
cttccttctgctccca

SEQ ID NO: 1226290 - DNA, 18 bp, Homo sapiens
cttccttctgctcccacc

SEQ ID NO: 1226291 - DNA, 20 bp, Homo sapiens
cttccttctgctcccacccc

SEQ ID NO: 1226292 - DNA, 14 bp, Homo sapiens
cttccttctgggac

SEQ ID NO: 1226293 - DNA, 22 bp, Homo sapiens
cttccttgaagaactgcaggcc

SEQ ID NO: 1226294 - DNA, 16 bp, Homo sapiens
cttccttgactgtcta

SEQ ID NO: 1226295 - DNA, 18 bp, Homo sapiens
cttccttgagacacggag

SEQ ID NO: 1226296 - DNA, 17 bp, Homo sapiens
cttccttgctctgcacc

SEQ ID NO: 1226297 - DNA, 20 bp, Homo sapiens
cttccttgctgtcctaggcc

SEQ ID NO: 1226298 - DNA, 14 bp, Homo sapiens
cttccttgggcaga

SEQ ID NO: 1226299 - DNA, 20 bp, Homo sapiens
cttccttgggcgtctccccc

SEQ ID NO: 1226300 - DNA, 22 bp, Homo sapiens
cttccttgggcgtctcccccag

SEQ ID NO: 1226301 - DNA, 23 bp, Homo sapiens
cttccttgggcgtctcccccaga

SEQ ID NO: 1226302 - DNA, 20 bp, Homo sapiens
cttcctttactttcccttgc

SEQ ID NO: 1226303 - DNA, 15 bp, Homo sapiens
cttcctttccctgga

SEQ ID NO: 1226304 - DNA, 11 bp, Homo sapiens
cttcctttcta

SEQ ID NO: 1226305 - DNA, 14 bp, Homo sapiens
cttcctttctcccc

SEQ ID NO: 1226306 - DNA, 15 bp, Homo sapiens
cttcctttctcccct

SEQ ID NO: 1226307 - DNA, 18 bp, Homo sapiens
cttcctttctctcctggc

SEQ ID NO: 1226308 - DNA, 12 bp, Homo sapiens
cttcctttgctc

SEQ ID NO: 1226309 - DNA, 21 bp, Homo sapiens
cttctcactgccatgccagct

SEQ ID NO: 1226310 - DNA, 17 bp, Homo sapiens
cttctcactgccatgga

SEQ ID NO: 1226311 - DNA, 22 bp, Homo sapiens
cttctcagaagcacagaatatt

SEQ ID NO: 1226312 - DNA, 14 bp, Homo sapiens
cttctcagatttct

SEQ ID NO: 1226313 - DNA, 22 bp, Homo sapiens
cttctcagatttctgaggaaat

SEQ ID NO: 1226314 - DNA, 19 bp, Homo sapiens
cttctcagatttttctgaa

SEQ ID NO: 1226315 - DNA, 14 bp, Homo sapiens
cttctcagcccctt

SEQ ID NO: 1226316 - DNA, 22 bp, Homo sapiens
cttctcatagcattaactaatc

SEQ ID NO: 1226317 - DNA, 21 bp, Homo sapiens
cttctcatcatattgtatgta

SEQ ID NO: 1226318 - DNA, 12 bp, Homo sapiens
cttctcatctgt

SEQ ID NO: 1226319 - DNA, 20 bp, Homo sapiens
cttctcattccaacagtgag

SEQ ID NO: 1226320 - DNA, 20 bp, Homo sapiens
cttctcattttttaaaaaag

SEQ ID NO: 1226321 - DNA, 15 bp, Homo sapiens
cttctccaagcatca

SEQ ID NO: 1226322 - DNA, 14 bp, Homo sapiens
cttctccaccagcc

SEQ ID NO: 1226323 - DNA, 14 bp, Homo sapiens
cttctccacgtctt

SEQ ID NO: 1226324 - DNA, 20 bp, Homo sapiens
cttctccacgtctttcctgc

SEQ ID NO: 1226325 - DNA, 19 bp, Homo sapiens
cttctccagtttttgagga

SEQ ID NO: 1226326 - DNA, 15 bp, Homo sapiens
cttctccatgctgca

SEQ ID NO: 1226327 - DNA, 12 bp, Homo sapiens
cttctcccaccc

SEQ ID NO: 1226328 - DNA, 15 bp, Homo sapiens
cttctcccagcacac

SEQ ID NO: 1226329 - DNA, 17 bp, Homo sapiens
cttctcccatctcttcc

SEQ ID NO: 1226330 - DNA, 18 bp, Homo sapiens
cttctcccatctcttcct

SEQ ID NO: 1226331 - DNA, 13 bp, Homo sapiens
cttctcccatttc

SEQ ID NO: 1226332 - DNA, 16 bp, Homo sapiens
cttctcccatttcctg

SEQ ID NO: 1226333 - DNA, 19 bp, Homo sapiens
cttctcccatttcctgatc

SEQ ID NO: 1226334 - DNA, 22 bp, Homo sapiens
cttctccccaacaattggaggg

SEQ ID NO: 1226335 - DNA, 17 bp, Homo sapiens
cttctccccccatccca

SEQ ID NO: 1226336 - DNA, 14 bp, Homo sapiens
cttctcccccgccc

SEQ ID NO: 1226337 - DNA, 17 bp, Homo sapiens
cttctcccccgccctgc

SEQ ID NO: 1226338 - DNA, 20 bp, Homo sapiens
cttctcccccgccctgcccc

SEQ ID NO: 1226339 - DNA, 14 bp, Homo sapiens
cttctcccccttgt

SEQ ID NO: 1226340 - DNA, 15 bp, Homo sapiens
cttctccccgcagcc

SEQ ID NO: 1226341 - DNA, 11 bp, Homo sapiens
cttctcccctc

SEQ ID NO: 1226342 - DNA, 16 bp, Homo sapiens
cttctcccctctccca

SEQ ID NO: 1226343 - DNA, 18 bp, Homo sapiens
cttctcccctctcccagg

SEQ ID NO: 1226344 - DNA, 21 bp, Homo sapiens
cttctcccctctcccagggat

SEQ ID NO: 1226345 - DNA, 15 bp, Homo sapiens
cttctccccttcctg

SEQ ID NO: 1226346 - DNA, 18 bp, Homo sapiens
cttctccccttcctggac

SEQ ID NO: 1226347 - DNA, 15 bp, Homo sapiens
cttctcccggccctc

SEQ ID NO: 1226348 - DNA, 18 bp, Homo sapiens
cttctccctattccctct

SEQ ID NO: 1226349 - DNA, 17 bp, Homo sapiens
cttctcccttcttgggt

SEQ ID NO: 1226350 - DNA, 16 bp, Homo sapiens
cttctccgaggggctg

SEQ ID NO: 1226351 - DNA, 14 bp, Homo sapiens
cttctccgccagcc

SEQ ID NO: 1226352 - DNA, 16 bp, Homo sapiens
cttctccgccagcctc

SEQ ID NO: 1226353 - DNA, 17 bp, Homo sapiens
cttctccgccagcctcc

SEQ ID NO: 1226354 - DNA, 19 bp, Homo sapiens
cttctccgccagcctcctc

SEQ ID NO: 1226355 - DNA, 24 bp, Homo sapiens
cttctccgccagcctcctctggac

SEQ ID NO: 1226356 - DNA, 15 bp, Homo sapiens
cttctcctctctggg

SEQ ID NO: 1226357 - DNA, 17 bp, Homo sapiens
cttctcctctctgggcc

SEQ ID NO: 1226358 - DNA, 15 bp, Homo sapiens
cttctcctcttgtaa

SEQ ID NO: 1226359 - DNA, 20 bp, Homo sapiens
cttctcctgaagttcagcca

SEQ ID NO: 1226360 - DNA, 19 bp, Homo sapiens
cttctcctgacccagtccc

SEQ ID NO: 1226361 - DNA, 13 bp, Homo sapiens
cttctcctgtgac

SEQ ID NO: 1226362 - DNA, 22 bp, Homo sapiens
cttctccttgccttgcttctcc

SEQ ID NO: 1226363 - DNA, 17 bp, Homo sapiens
cttctcctttcacaacc

SEQ ID NO: 1226364 - DNA, 15 bp, Homo sapiens
cttctcggagaccca

SEQ ID NO: 1226365 - DNA, 13 bp, Homo sapiens
cttctcggccagc

SEQ ID NO: 1226366 - DNA, 18 bp, Homo sapiens
cttctcggccagcccgtc

SEQ ID NO: 1226367 - DNA, 21 bp, Homo sapiens
cttctcggcttggatcctggg

SEQ ID NO: 1226368 - DNA, 17 bp, Homo sapiens
cttctcgtgtttgctta

SEQ ID NO: 1226369 - DNA, 20 bp, Homo sapiens
cttctctaaatgaggggcct

SEQ ID NO: 1226370 - DNA, 13 bp, Homo sapiens
cttctctatcctc

SEQ ID NO: 1226371 - DNA, 19 bp, Homo sapiens
cttctctcatctgatcact

SEQ ID NO: 1226372 - DNA, 19 bp, Homo sapiens
cttctctccacagtgttgt

SEQ ID NO: 1226373 - DNA, 13 bp, Homo sapiens
cttctctcctccc

SEQ ID NO: 1226374 - DNA, 15 bp, Homo sapiens
cttctctcctcccca

SEQ ID NO: 1226375 - DNA, 20 bp, Homo sapiens
cttctctcctttctccctgc

SEQ ID NO: 1226376 - DNA, 13 bp, Homo sapiens
cttctctctgtgg

SEQ ID NO: 1226377 - DNA, 13 bp, Homo sapiens
cttctctctgttc

SEQ ID NO: 1226378 - DNA, 14 bp, Homo sapiens
cttctctcttcaat

SEQ ID NO: 1226379 - DNA, 19 bp, Homo sapiens
cttctctgaatcagaaaag

SEQ ID NO: 1226380 - DNA, 14 bp, Homo sapiens
cttctctgacttct

SEQ ID NO: 1226381 - DNA, 20 bp, Homo sapiens
cttctctgacttctgcctgg

SEQ ID NO: 1226382 - DNA, 12 bp, Homo sapiens
cttctctgcagt

SEQ ID NO: 1226383 - DNA, 21 bp, Homo sapiens
cttctctgcagtaaaacacat

SEQ ID NO: 1226384 - DNA, 12 bp, Homo sapiens
cttctctgctcc

SEQ ID NO: 1226385 - DNA, 13 bp, Homo sapiens
cttctctgctcca

SEQ ID NO: 1226386 - DNA, 15 bp, Homo sapiens
cttctctgctccacc

SEQ ID NO: 1226387 - DNA, 21 bp, Homo sapiens
cttctctgctccaccacatcc

SEQ ID NO: 1226388 - DNA, 15 bp, Homo sapiens
cttctctgctgcctc

SEQ ID NO: 1226389 - DNA, 20 bp, Homo sapiens
cttctctggagccaagtcca

SEQ ID NO: 1226390 - DNA, 22 bp, Homo sapiens
cttctctggagccaagtccaga

SEQ ID NO: 1226391 - DNA, 21 bp, Homo sapiens
cttctctgtgaacgatttaga

SEQ ID NO: 1226392 - DNA, 12 bp, Homo sapiens
cttctcttaatt

SEQ ID NO: 1226393 - DNA, 13 bp, Homo sapiens
cttctcttcctgt

SEQ ID NO: 1226394 - DNA, 14 bp, Homo sapiens
cttctcttctttcc

SEQ ID NO: 1226395 - DNA, 18 bp, Homo sapiens
cttctcttgacagtctga

SEQ ID NO: 1226396 - DNA, 15 bp, Homo sapiens
cttctcttgctttct

SEQ ID NO: 1226397 - DNA, 16 bp, Homo sapiens
cttctcttgctttcta

SEQ ID NO: 1226398 - DNA, 16 bp, Homo sapiens
cttctcttgttaggta

SEQ ID NO: 1226399 - DNA, 15 bp, Homo sapiens
cttctctttgactta

SEQ ID NO: 1226400 - DNA, 17 bp, Homo sapiens
cttctcttttcctcgca

SEQ ID NO: 1226401 - DNA, 18 bp, Homo sapiens
cttctgaaccgcaaggag

SEQ ID NO: 1226402 - DNA, 18 bp, Homo sapiens
cttctgaactcaaactga

SEQ ID NO: 1226403 - DNA, 16 bp, Homo sapiens
cttctgaactccatac

SEQ ID NO: 1226404 - DNA, 14 bp, Homo sapiens
cttctgaatcactg

SEQ ID NO: 1226405 - DNA, 18 bp, Homo sapiens
cttctgaccacacttcct

SEQ ID NO: 1226406 - DNA, 23 bp, Homo sapiens
cttctgaccacacttcctgtcca

SEQ ID NO: 1226407 - DNA, 22 bp, Homo sapiens
cttctgaccccacttatgctgc

SEQ ID NO: 1226408 - DNA, 19 bp, Homo sapiens
cttctgacgtgccttttgc

SEQ ID NO: 1226409 - DNA, 19 bp, Homo sapiens
cttctgactagattattat

SEQ ID NO: 1226410 - DNA, 15 bp, Homo sapiens
cttctgactttactt

SEQ ID NO: 1226411 - DNA, 16 bp, Homo sapiens
cttctgagctccacct

SEQ ID NO: 1226412 - DNA, 19 bp, Homo sapiens
cttctgagctccacctctg

SEQ ID NO: 1226413 - DNA, 20 bp, Homo sapiens
cttctgatgaaatgttaaca

SEQ ID NO: 1226414 - DNA, 13 bp, Homo sapiens
cttctgcaccctc

SEQ ID NO: 1226415 - DNA, 17 bp, Homo sapiens
cttctgcaccctccacc

SEQ ID NO: 1226416 - DNA, 19 bp, Homo sapiens
cttctgcaccctccaccct

SEQ ID NO: 1226417 - DNA, 20 bp, Homo sapiens
cttctgcaccctccaccctg

SEQ ID NO: 1226418 - DNA, 22 bp, Homo sapiens
cttctgcaccctccaccctgtc

SEQ ID NO: 1226419 - DNA, 17 bp, Homo sapiens
cttctgcagcctcggcc

SEQ ID NO: 1226420 - DNA, 20 bp, Homo sapiens
cttctgcagcctcggcctag

SEQ ID NO: 1226421 - DNA, 16 bp, Homo sapiens
cttctgccctttccta

SEQ ID NO: 1226422 - DNA, 15 bp, Homo sapiens
cttgccaaaatgttg

SEQ ID NO: 1226423 - DNA, 19 bp, Homo sapiens
cttgccaagggtccctgtg

SEQ ID NO: 1226424 - DNA, 21 bp, Homo sapiens
cttgccaagggtccctgtgtg

SEQ ID NO: 1226425 - DNA, 19 bp, Homo sapiens
cttgccacaccccccaccc

SEQ ID NO: 1226426 - DNA, 23 bp, Homo sapiens
cttgccacaccccccacccctag

SEQ ID NO: 1226427 - DNA, 21 bp, Homo sapiens
cttgccacatggtgtctccca

SEQ ID NO: 1226428 - DNA, 21 bp, Homo sapiens
cttgccagaaccaaattaact

SEQ ID NO: 1226429 - DNA, 18 bp, Homo sapiens
cttgccagaggccctcgg

SEQ ID NO: 1226430 - DNA, 12 bp, Homo sapiens
cttgccagcctc

SEQ ID NO: 1226431 - DNA, 14 bp, Homo sapiens
cttgccagcctcct

SEQ ID NO: 1226432 - DNA, 20 bp, Homo sapiens
cttgccagcctccttgctga

SEQ ID NO: 1226433 - DNA, 15 bp, Homo sapiens
cttgccagggcaggg

SEQ ID NO: 1226434 - DNA, 17 bp, Homo sapiens
cttgccagggcagggtc

SEQ ID NO: 1226435 - DNA, 18 bp, Homo sapiens
cttgccagggcagggtct

SEQ ID NO: 1226436 - DNA, 13 bp, Homo sapiens
cttgccatcctga

SEQ ID NO: 1226437 - DNA, 18 bp, Homo sapiens
cttgccatcctgatggac

SEQ ID NO: 1226438 - DNA, 13 bp, Homo sapiens
cttgccatgcagg

SEQ ID NO: 1226439 - DNA, 14 bp, Homo sapiens
cttgccatgcagga

SEQ ID NO: 1226440 - DNA, 16 bp, Homo sapiens
cttgccatgcaggaag

SEQ ID NO: 1226441 - DNA, 18 bp, Homo sapiens
cttgccattgccaggaga

SEQ ID NO: 1226442 - DNA, 16 bp, Homo sapiens
cttgccatttgtagct

SEQ ID NO: 1226443 - DNA, 15 bp, Homo sapiens
cttgcccaagtccca

SEQ ID NO: 1226444 - DNA, 15 bp, Homo sapiens
cttgcccacaggtgc

SEQ ID NO: 1226445 - DNA, 21 bp, Homo sapiens
cttgcccacaggtgcgggacc

SEQ ID NO: 1226446 - DNA, 13 bp, Homo sapiens
cttgcccagagat

SEQ ID NO: 1226447 - DNA, 21 bp, Homo sapiens
cttgcccagagatgcctccac

SEQ ID NO: 1226448 - DNA, 15 bp, Homo sapiens
cttgcccagggctca

SEQ ID NO: 1226449 - DNA, 23 bp, Homo sapiens
cttgcccaggtcaccaagcagtg

SEQ ID NO: 1226450 - DNA, 13 bp, Homo sapiens
cttgccccactcc

SEQ ID NO: 1226451 - DNA, 17 bp, Homo sapiens
cttgccccactcctctc

SEQ ID NO: 1226452 - DNA, 21 bp, Homo sapiens
cttgccccactcctctccacc

SEQ ID NO: 1226453 - DNA, 21 bp, Homo sapiens
cttgccccactctgcctgcct

SEQ ID NO: 1226454 - DNA, 22 bp, Homo sapiens
cttgccccactctgcctgcctg

SEQ ID NO: 1226455 - DNA, 15 bp, Homo sapiens
cttgccccaggccag

SEQ ID NO: 1226456 - DNA, 16 bp, Homo sapiens
cttgccccaggccagg

SEQ ID NO: 1226457 - DNA, 15 bp, Homo sapiens
cttgcccccatccct

SEQ ID NO: 1226458 - DNA, 22 bp, Homo sapiens
cttgcccccatccctcggaccc

SEQ ID NO: 1226459 - DNA, 23 bp, Homo sapiens
cttgcccccatttcacccatggg

SEQ ID NO: 1226460 - DNA, 13 bp, Homo sapiens
cttgccccccacc

SEQ ID NO: 1226461 - DNA, 16 bp, Homo sapiens
cttgccccccacccca

SEQ ID NO: 1226462 - DNA, 18 bp, Homo sapiens
cttgccccccgccctcat

SEQ ID NO: 1226463 - DNA, 21 bp, Homo sapiens
cttgcccccgcttagccccgc

SEQ ID NO: 1226464 - DNA, 18 bp, Homo sapiens
cttgccccggccccggcc

SEQ ID NO: 1226465 - DNA, 22 bp, Homo sapiens
cttgccccttgtcctgaagccc

SEQ ID NO: 1226466 - DNA, 16 bp, Homo sapiens
cttgcccgccagcctc

SEQ ID NO: 1226467 - DNA, 23 bp, Homo sapiens
cttgcccgccagcctcagtgcca

SEQ ID NO: 1226468 - DNA, 13 bp, Homo sapiens
cttgccctgacct

SEQ ID NO: 1226469 - DNA, 18 bp, Homo sapiens
cttgccctgacctcccag

SEQ ID NO: 1226470 - DNA, 12 bp, Homo sapiens
cttgcccttccc

SEQ ID NO: 1226471 - DNA, 14 bp, Homo sapiens
cttgcccttccctg

SEQ ID NO: 1226472 - DNA, 23 bp, Homo sapiens
cttgcccttccctgtccctctaa

SEQ ID NO: 1226473 - DNA, 18 bp, Homo sapiens
cttgcccttgggtgctat

SEQ ID NO: 1226474 - DNA, 13 bp, Homo sapiens
cttgccgagagag

SEQ ID NO: 1226475 - DNA, 19 bp, Homo sapiens
cttgccgagcctaatgaaa

SEQ ID NO: 1226476 - DNA, 21 bp, Homo sapiens
cttgccgcgtcgccctcccag

SEQ ID NO: 1226477 - DNA, 21 bp, Homo sapiens
cttgcctaaatcccaagaaat

SEQ ID NO: 1226478 - DNA, 17 bp, Homo sapiens
cttgcctaaatttaatg

SEQ ID NO: 1226479 - DNA, 14 bp, Homo sapiens
cttgcctagggcct

SEQ ID NO: 1226480 - DNA, 18 bp, Homo sapiens
cttgcctagggcctggtc

SEQ ID NO: 1226481 - DNA, 17 bp, Homo sapiens
cttgcctcaatgccagt

SEQ ID NO: 1226482 - DNA, 17 bp, Homo sapiens
cttgcctcatttcccta

SEQ ID NO: 1226483 - DNA, 11 bp, Homo sapiens
cttgcctcctg

SEQ ID NO: 1226484 - DNA, 17 bp, Homo sapiens
cttgcctcctggaagaa

SEQ ID NO: 1226485 - DNA, 14 bp, Homo sapiens
cttgcctctgcaca

SEQ ID NO: 1226486 - DNA, 24 bp, Homo sapiens
cttgcctctgcacaccctccagag

SEQ ID NO: 1226487 - DNA, 19 bp, Homo sapiens
cttgcctctgtgctgtgtg

SEQ ID NO: 1226488 - DNA, 20 bp, Homo sapiens
cttgcctctgtgctgtgtgt

SEQ ID NO: 1226489 - DNA, 17 bp, Homo sapiens
cttgcctgaacatcctt

SEQ ID NO: 1226490 - DNA, 18 bp, Homo sapiens
cttgcctgaactccagag

SEQ ID NO: 1226491 - DNA, 19 bp, Homo sapiens
cttgcctgaactccagagg

SEQ ID NO: 1226492 - DNA, 13 bp, Homo sapiens
cttgcctgcctcc

SEQ ID NO: 1226493 - DNA, 15 bp, Homo sapiens
cttgcctgggctggg

SEQ ID NO: 1226494 - DNA, 16 bp, Homo sapiens
cttgcctgggctgggc

SEQ ID NO: 1226495 - DNA, 22 bp, Homo sapiens
cttgcctgggctgggcagcctt

SEQ ID NO: 1226496 - DNA, 13 bp, Homo sapiens
cttgcctggggtc

SEQ ID NO: 1226497 - DNA, 16 bp, Homo sapiens
cttgcctgtctaaagc

SEQ ID NO: 1226498 - DNA, 19 bp, Homo sapiens
cttgccttaataaatatgt

SEQ ID NO: 1226499 - DNA, 21 bp, Homo sapiens
cttgccttattagagtgtctt

SEQ ID NO: 1226500 - DNA, 20 bp, Homo sapiens
cttgccttcttcacccagct

SEQ ID NO: 1226501 - DNA, 12 bp, Homo sapiens
cttgccttgctt

SEQ ID NO: 1226502 - DNA, 18 bp, Homo sapiens
cttgcctttcgaggcctg

SEQ ID NO: 1226503 - DNA, 20 bp, Homo sapiens
cttgcctttcgaggcctgaa

SEQ ID NO: 1226504 - DNA, 19 bp, Homo sapiens
cttgcgaatccaagctccc

SEQ ID NO: 1226505 - DNA, 15 bp, Homo sapiens
cttgcgagtccaagg

SEQ ID NO: 1226506 - DNA, 16 bp, Homo sapiens
cttgcgagtccaaggc

SEQ ID NO: 1226507 - DNA, 22 bp, Homo sapiens
cttgcgccgagaccgcagaggg

SEQ ID NO: 1226508 - DNA, 14 bp, Homo sapiens
cttgcgctgtccca

SEQ ID NO: 1226509 - DNA, 17 bp, Homo sapiens
cttgcgctgtcccaggc

SEQ ID NO: 1226510 - DNA, 20 bp, Homo sapiens
cttgcgctgtcccaggcatg

SEQ ID NO: 1226511 - DNA, 17 bp, Homo sapiens
cttgcggaagccatagg

SEQ ID NO: 1226512 - DNA, 18 bp, Homo sapiens
cttgcggaagccataggg

SEQ ID NO: 1226513 - DNA, 22 bp, Homo sapiens
cttgcggaagccatagggggct

SEQ ID NO: 1226514 - DNA, 20 bp, Homo sapiens
cttgcggaatcactctgtcc

SEQ ID NO: 1226515 - DNA, 18 bp, Homo sapiens
cttgcgtcctgcagagga

SEQ ID NO: 1226516 - DNA, 23 bp, Homo sapiens
cttgctaaagcactttgcactta

SEQ ID NO: 1226517 - DNA, 17 bp, Homo sapiens
cttgctaccagtattta

SEQ ID NO: 1226518 - DNA, 18 bp, Homo sapiens
cttgctaccagtatttag

SEQ ID NO: 1226519 - DNA, 16 bp, Homo sapiens
cttgctacttatcatt

SEQ ID NO: 1226520 - DNA, 12 bp, Homo sapiens
cttgctagctag

SEQ ID NO: 1226521 - DNA, 14 bp, Homo sapiens
cttgctagctagcc

SEQ ID NO: 1226522 - DNA, 18 bp, Homo sapiens
cttgctagctagccagcc

SEQ ID NO: 1226523 - DNA, 22 bp, Homo sapiens
cttgctcactcactcactccaa

SEQ ID NO: 1226524 - DNA, 23 bp, Homo sapiens
cttgctcactcactcactccaag

SEQ ID NO: 1226525 - DNA, 17 bp, Homo sapiens
cttgctcagatagatct

SEQ ID NO: 1226526 - DNA, 15 bp, Homo sapiens
cttgctcagtgcctc

SEQ ID NO: 1226527 - DNA, 22 bp, Homo sapiens
cttgctcagtgcctcctggccg

SEQ ID NO: 1226528 - DNA, 15 bp, Homo sapiens
cttgctcattcttga

SEQ ID NO: 1226529 - DNA, 21 bp, Homo sapiens
cttgctcattcttgaggagca

SEQ ID NO: 1226530 - DNA, 19 bp, Homo sapiens
cttgctccagattctgatg

SEQ ID NO: 1226531 - DNA, 20 bp, Homo sapiens
cttgctccagattctgatgc

SEQ ID NO: 1226532 - DNA, 12 bp, Homo sapiens
cttgctccaggg

SEQ ID NO: 1226533 - DNA, 15 bp, Homo sapiens
cttgctccagggtct

SEQ ID NO: 1226534 - DNA, 17 bp, Homo sapiens
cttgctccagggtcttg

SEQ ID NO: 1226535 - DNA, 20 bp, Homo sapiens
cttgctccagggtcttgggc

SEQ ID NO: 1226536 - DNA, 16 bp, Homo sapiens
cttgctcctggggaga

SEQ ID NO: 1226537 - DNA, 20 bp, Homo sapiens
cttgctctcccctgccctgc

SEQ ID NO: 1226538 - DNA, 15 bp, Homo sapiens
cttgctctccctctt

SEQ ID NO: 1226539 - DNA, 17 bp, Homo sapiens
cttgctctccctcttct

SEQ ID NO: 1226540 - DNA, 14 bp, Homo sapiens
cttgctctcttgtg

SEQ ID NO: 1226541 - DNA, 16 bp, Homo sapiens
cttgctctgagcacag

SEQ ID NO: 1226542 - DNA, 13 bp, Homo sapiens
cttgctctgtccc

SEQ ID NO: 1226543 - DNA, 17 bp, Homo sapiens
cttgctctgtcccccag

SEQ ID NO: 1226544 - DNA, 19 bp, Homo sapiens
cttgctctgtcccccaggc

SEQ ID NO: 1226545 - DNA, 20 bp, Homo sapiens
cttgctctgtcccccaggct

SEQ ID NO: 1226546 - DNA, 17 bp, Homo sapiens
cttggtttcagccaagg

SEQ ID NO: 1226547 - DNA, 20 bp, Homo sapiens
cttggtttctctctacagtg

SEQ ID NO: 1226548 - DNA, 14 bp, Homo sapiens
cttggtttgctagt

SEQ ID NO: 1226549 - DNA, 15 bp, Homo sapiens
cttggtttggggaga

SEQ ID NO: 1226550 - DNA, 16 bp, Homo sapiens
cttggtttggggagaa

SEQ ID NO: 1226551 - DNA, 18 bp, Homo sapiens
cttggtttggggagaaat

SEQ ID NO: 1226552 - DNA, 23 bp, Homo sapiens
cttggtttgtggcgtctccctcg

SEQ ID NO: 1226553 - DNA, 21 bp, Homo sapiens
cttggtttgttatatcaggga

SEQ ID NO: 1226554 - DNA, 22 bp, Homo sapiens
cttggtttgttatatcagggaa

SEQ ID NO: 1226555 - DNA, 18 bp, Homo sapiens
cttggttttctctctgga

SEQ ID NO: 1226556 - DNA, 19 bp, Homo sapiens
cttggttttctctctggat

SEQ ID NO: 1226557 - DNA, 22 bp, Homo sapiens
cttggtttttactgctctgaga

SEQ ID NO: 1226558 - DNA, 16 bp, Homo sapiens
cttggtttttggctct

SEQ ID NO: 1226559 - DNA, 17 bp, Homo sapiens
cttgtaaaaaaagcaaa

SEQ ID NO: 1226560 - DNA, 19 bp, Homo sapiens
cttgtaaaaaaagcaaaaa

SEQ ID NO: 1226561 - DNA, 22 bp, Homo sapiens
cttgtaaaaagggggctgcatt

SEQ ID NO: 1226562 - DNA, 17 bp, Homo sapiens
cttgtaaacagaagcaa

SEQ ID NO: 1226563 - DNA, 13 bp, Homo sapiens
cttgtaaagactg

SEQ ID NO: 1226564 - DNA, 15 bp, Homo sapiens
cttgtaaataaagcc

SEQ ID NO: 1226565 - DNA, 17 bp, Homo sapiens
cttgtaaataaagccct

SEQ ID NO: 1226566 - DNA, 19 bp, Homo sapiens
cttgtaaataaagccctgg

SEQ ID NO: 1226567 - DNA, 21 bp, Homo sapiens
cttgtaaataaccacaaggtc

SEQ ID NO: 1226568 - DNA, 13 bp, Homo sapiens
cttgtaaatcttt

SEQ ID NO: 1226569 - DNA, 18 bp, Homo sapiens
cttgtaaatctttttgct

SEQ ID NO: 1226570 - DNA, 22 bp, Homo sapiens
cttgtaatgatatagccagaaa

SEQ ID NO: 1226571 - DNA, 23 bp, Homo sapiens
cttgtaatttaaacaggcccagc

SEQ ID NO: 1226572 - DNA, 12 bp, Homo sapiens
cttgtacaaaat

SEQ ID NO: 1226573 - DNA, 12 bp, Homo sapiens
cttgtacataat

SEQ ID NO: 1226574 - DNA, 17 bp, Homo sapiens
cttgtacatagtaggca

SEQ ID NO: 1226575 - DNA, 17 bp, Homo sapiens
cttgtaccatagaaaaa

SEQ ID NO: 1226576 - DNA, 18 bp, Homo sapiens
cttgtaccatagaaaaat

SEQ ID NO: 1226577 - DNA, 20 bp, Homo sapiens
cttgtaccatagaaaaatgt

SEQ ID NO: 1226578 - DNA, 17 bp, Homo sapiens
cttgtactaagccagga

SEQ ID NO: 1226579 - DNA, 17 bp, Homo sapiens
cttgtacttctgtgttc

SEQ ID NO: 1226580 - DNA, 13 bp, Homo sapiens
cttgtacttgctt

SEQ ID NO: 1226581 - DNA, 23 bp, Homo sapiens
cttgtactttatttttctgatag

SEQ ID NO: 1226582 - DNA, 13 bp, Homo sapiens
cttgtagcagtgt

SEQ ID NO: 1226583 - DNA, 18 bp, Homo sapiens
cttgtagcagtgtgcttt

SEQ ID NO: 1226584 - DNA, 16 bp, Homo sapiens
cttgtagccatggctg

SEQ ID NO: 1226585 - DNA, 21 bp, Homo sapiens
cttgtaggaatctgccttcca

SEQ ID NO: 1226586 - DNA, 21 bp, Homo sapiens
cttgtagtttacctctttaaa

SEQ ID NO: 1226587 - DNA, 16 bp, Homo sapiens
cttgtatagtgtaaaa

SEQ ID NO: 1226588 - DNA, 13 bp, Homo sapiens
cttgtatattcca

SEQ ID NO: 1226589 - DNA, 11 bp, Homo sapiens
cttgtatattt

SEQ ID NO: 1226590 - DNA, 12 bp, Homo sapiens
cttgtatatttg

SEQ ID NO: 1226591 - DNA, 14 bp, Homo sapiens
cttgtatatttgta

SEQ ID NO: 1226592 - DNA, 19 bp, Homo sapiens
cttgtatatttgtacaaaa

SEQ ID NO: 1226593 - DNA, 14 bp, Homo sapiens
cttgtatcaaatgt

SEQ ID NO: 1226594 - DNA, 19 bp, Homo sapiens
cttgtatctggattcaaat

SEQ ID NO: 1226595 - DNA, 21 bp, Homo sapiens
cttgtatgaataaaaggctgg

SEQ ID NO: 1226596 - DNA, 17 bp, Homo sapiens
cttgtattaagttgtta

SEQ ID NO: 1226597 - DNA, 13 bp, Homo sapiens
cttgtattgactt

SEQ ID NO: 1226598 - DNA, 14 bp, Homo sapiens
cttgtattgacttt

SEQ ID NO: 1226599 - DNA, 19 bp, Homo sapiens
cttgttgcactgccccctg

SEQ ID NO: 1226600 - DNA, 20 bp, Homo sapiens
cttgttgctcaaaaaatgag

SEQ ID NO: 1226601 - DNA, 22 bp, Homo sapiens
cttgttgctgttgatgttttgt

SEQ ID NO: 1226602 - DNA, 20 bp, Homo sapiens
cttgttgggattcctgaccc

SEQ ID NO: 1226603 - DNA, 19 bp, Homo sapiens
cttgttggtagcatgtact

SEQ ID NO: 1226604 - DNA, 19 bp, Homo sapiens
cttgtttaacatatatatt

SEQ ID NO: 1226605 - DNA, 22 bp, Homo sapiens
cttgtttacagcactactctgt

SEQ ID NO: 1226606 - DNA, 17 bp, Homo sapiens
cttgtttcactccacca

SEQ ID NO: 1226607 - DNA, 18 bp, Homo sapiens
cttgtttccttttgggct

SEQ ID NO: 1226608 - DNA, 17 bp, Homo sapiens
cttgtttgaatatttgt

SEQ ID NO: 1226609 - DNA, 22 bp, Homo sapiens
cttgtttgctttgaaaatattt

SEQ ID NO: 1226610 - DNA, 19 bp, Homo sapiens
cttgtttggtagttagcca

SEQ ID NO: 1226611 - DNA, 18 bp, Homo sapiens
cttgttttcaatgtgttg

SEQ ID NO: 1226612 - DNA, 11 bp, Homo sapiens
cttgttttcca

SEQ ID NO: 1226613 - DNA, 12 bp, Homo sapiens
cttgttttccaa

SEQ ID NO: 1226614 - DNA, 13 bp, Homo sapiens
cttgttttccaaa

SEQ ID NO: 1226615 - DNA, 20 bp, Homo sapiens
cttgtttttaatctcctgtt

SEQ ID NO: 1226616 - DNA, 20 bp, Homo sapiens
cttgtttttattaatttata

SEQ ID NO: 1226617 - DNA, 12 bp, Homo sapiens
cttgtttttgca

SEQ ID NO: 1226618 - DNA, 16 bp, Homo sapiens
cttgtttttgcacatg

SEQ ID NO: 1226619 - DNA, 23 bp, Homo sapiens
ctttaaaaaagaaaagtgcatat

SEQ ID NO: 1226620 - DNA, 13 bp, Homo sapiens
ctttaaaaactgt

SEQ ID NO: 1226621 - DNA, 13 bp, Homo sapiens
ctttaaaaaggaa

SEQ ID NO: 1226622 - DNA, 12 bp, Homo sapiens
ctttaaaacaag

SEQ ID NO: 1226623 - DNA, 17 bp, Homo sapiens
ctttaaaaccacagctg

SEQ ID NO: 1226624 - DNA, 11 bp, Homo sapiens
ctttaaaagaa

SEQ ID NO: 1226625 - DNA, 15 bp, Homo sapiens
ctttaaaagaaaata

SEQ ID NO: 1226626 - DNA, 15 bp, Homo sapiens
ctttaaaagagagag

SEQ ID NO: 1226627 - DNA, 15 bp, Homo sapiens
ctttaaaagcatttt

SEQ ID NO: 1226628 - DNA, 18 bp, Homo sapiens
ctttaaaaggaaagaaaa

SEQ ID NO: 1226629 - DNA, 14 bp, Homo sapiens
ctttaaaagtatct

SEQ ID NO: 1226630 - DNA, 18 bp, Homo sapiens
ctttaaaagtatctttaa

SEQ ID NO: 1226631 - DNA, 21 bp, Homo sapiens
ctttaaaagtcattattcctg

SEQ ID NO: 1226632 - DNA, 19 bp, Homo sapiens
ctttaaaatatatgtctat

SEQ ID NO: 1226633 - DNA, 16 bp, Homo sapiens
ctttaaaatgcgaaat

SEQ ID NO: 1226634 - DNA, 23 bp, Homo sapiens
ctttaaaatgcgaaattattggt

SEQ ID NO: 1226635 - DNA, 14 bp, Homo sapiens
ctttaaaattcaag

SEQ ID NO: 1226636 - DNA, 17 bp, Homo sapiens
ctttaaacagtatttca

SEQ ID NO: 1226637 - DNA, 18 bp, Homo sapiens
ctttaaacagtatttcat

SEQ ID NO: 1226638 - DNA, 16 bp, Homo sapiens
ctttaaactcagggac

SEQ ID NO: 1226639 - DNA, 23 bp, Homo sapiens
ctttaaagaggctgtgtggccaa

SEQ ID NO: 1226640 - DNA, 19 bp, Homo sapiens
ctttaaagccgtgctcttt

SEQ ID NO: 1226641 - DNA, 13 bp, Homo sapiens
ctttaaagccttt

SEQ ID NO: 1226642 - DNA, 15 bp, Homo sapiens
ctttaaagctcagga

SEQ ID NO: 1226643 - DNA, 18 bp, Homo sapiens
ctttaaagctcaggaggg

SEQ ID NO: 1226644 - DNA, 13 bp, Homo sapiens
ctttaaaggaaaa

SEQ ID NO: 1226645 - DNA, 14 bp, Homo sapiens
ctttaaaggaaaaa

SEQ ID NO: 1226646 - DNA, 19 bp, Homo sapiens
ctttaaaggaaaaaatgtt

SEQ ID NO: 1226647 - DNA, 19 bp, Homo sapiens
ctttaaaggcccagcccct

SEQ ID NO: 1226648 - DNA, 18 bp, Homo sapiens
ctttaaagtacctgtagt

SEQ ID NO: 1226649 - DNA, 23 bp, Homo sapiens
ctttaaagtacctgtagtgagaa

SEQ ID NO: 1226650 - DNA, 15 bp, Homo sapiens
ctttaaagtatttct

SEQ ID NO: 1226651 - DNA, 17 bp, Homo sapiens
ctttaaataaattaaga

SEQ ID NO: 1226652 - DNA, 22 bp, Homo sapiens
ctttaaatcatttttatattat

SEQ ID NO: 1226653 - DNA, 13 bp, Homo sapiens
ctttaaatgaata

SEQ ID NO: 1226654 - DNA, 14 bp, Homo sapiens
ctttaaatggaaac

SEQ ID NO: 1226655 - DNA, 18 bp, Homo sapiens
ctttaacaattgtcttaa

SEQ ID NO: 1226656 - DNA, 23 bp, Homo sapiens
ctttaacacattctttataaaat

SEQ ID NO: 1226657 - DNA, 18 bp, Homo sapiens
ctttaacagaaactttca

SEQ ID NO: 1226658 - DNA, 16 bp, Homo sapiens
ctttaacagtctaaaa

SEQ ID NO: 1226659 - DNA, 17 bp, Homo sapiens
ctttaaccagtctgaag

SEQ ID NO: 1226660 - DNA, 18 bp, Homo sapiens
ctttaaccctctcttccc

SEQ ID NO: 1226661 - DNA, 15 bp, Homo sapiens
ctttaactcaggagg

SEQ ID NO: 1226662 - DNA, 21 bp, Homo sapiens
ctttaactcccattaccatgt

SEQ ID NO: 1226663 - DNA, 23 bp, Homo sapiens
ctttaactgtgtgaccagcggaa

SEQ ID NO: 1226664 - DNA, 12 bp, Homo sapiens
ctttaagaaaaa

SEQ ID NO: 1226665 - DNA, 18 bp, Homo sapiens
ctttaagaaccttaatga

SEQ ID NO: 1226666 - DNA, 21 bp, Homo sapiens
ctttaagaatgtcctcttgga

SEQ ID NO: 1226667 - DNA, 14 bp, Homo sapiens
ctttaagacatact

SEQ ID NO: 1226668 - DNA, 14 bp, Homo sapiens
ctttaagaggacat

SEQ ID NO: 1226669 - DNA, 20 bp, Homo sapiens
ctttaagatatccatctttt

SEQ ID NO: 1226670 - DNA, 20 bp, Homo sapiens
ctttaagcactacataaact

SEQ ID NO: 1226671 - DNA, 18 bp, Homo sapiens
ctttaagccaaagaaaca

SEQ ID NO: 1226672 - DNA, 12 bp, Homo sapiens
ctttaagccata

SEQ ID NO: 1226673 - DNA, 23 bp, Homo sapiens
ctttaagccatagaccctgaggc

SEQ ID NO: 1226674 - DNA, 19 bp, Homo sapiens
ctttaagcctgcattctta

SEQ ID NO: 1226675 - DNA, 20 bp, Homo sapiens
ctttaagcctgcattcttaa

SEQ ID NO: 1226676 - DNA, 19 bp, Homo sapiens
ctttaaggggaagataaga

SEQ ID NO: 1226677 - DNA, 20 bp, Homo sapiens
ctttaccttttcagggctgg

SEQ ID NO: 1226678 - DNA, 17 bp, Homo sapiens
ctttaccttttctataa

SEQ ID NO: 1226679 - DNA, 18 bp, Homo sapiens
ctttacgctcatcaccta

SEQ ID NO: 1226680 - DNA, 20 bp, Homo sapiens
ctttacgtactgtaactgct

SEQ ID NO: 1226681 - DNA, 21 bp, Homo sapiens
ctttacgtgtttaaaaaaaag

SEQ ID NO: 1226682 - DNA, 20 bp, Homo sapiens
ctttacgttcatcacctgct

SEQ ID NO: 1226683 - DNA, 13 bp, Homo sapiens
ctttactatggcc

SEQ ID NO: 1226684 - DNA, 16 bp, Homo sapiens
ctttactattaaaata

SEQ ID NO: 1226685 - DNA, 14 bp, Homo sapiens
ctttactcctggct

SEQ ID NO: 1226686 - DNA, 23 bp, Homo sapiens
ctttactcctggctcaagccctg

SEQ ID NO: 1226687 - DNA, 18 bp, Homo sapiens
ctttactgcctgaataaa

SEQ ID NO: 1226688 - DNA, 19 bp, Homo sapiens
ctttactgcctgaataaag

SEQ ID NO: 1226689 - DNA, 10 bp, Homo sapiens
ctttactgta

SEQ ID NO: 1226690 - DNA, 21 bp, Homo sapiens
ctttactgtaatataaagtat

SEQ ID NO: 1226691 - DNA, 13 bp, Homo sapiens
ctttactgtttct

SEQ ID NO: 1226692 - DNA, 17 bp, Homo sapiens
ctttacttcccagtata

SEQ ID NO: 1226693 - DNA, 23 bp, Homo sapiens
ctttacttgtggtgtgaccatgt

SEQ ID NO: 1226694 - DNA, 14 bp, Homo sapiens
ctttactttccctt

SEQ ID NO: 1226695 - DNA, 18 bp, Homo sapiens
ctttactttcccttgctt

SEQ ID NO: 1226696 - DNA, 22 bp, Homo sapiens
ctttactttcccttgcttttcc

SEQ ID NO: 1226697 - DNA, 23 bp, Homo sapiens
ctttactttcccttgcttttccc

SEQ ID NO: 1226698 - DNA, 13 bp, Homo sapiens
ctttagaaaacat

SEQ ID NO: 1226699 - DNA, 19 bp, Homo sapiens
ctttagaaagctgacattg

SEQ ID NO: 1226700 - DNA, 23 bp, Homo sapiens
ctttagaaataaaccttaatatt

SEQ ID NO: 1226701 - DNA, 15 bp, Homo sapiens
ctttagaaataaatg

SEQ ID NO: 1226702 - DNA, 17 bp, Homo sapiens
ctttagaacaggagact

SEQ ID NO: 1226703 - DNA, 15 bp, Homo sapiens
ctttagaagcctgca

SEQ ID NO: 1226704 - DNA, 19 bp, Homo sapiens
ctttagaatttttacccaa

SEQ ID NO: 1226705 - DNA, 20 bp, Homo sapiens
ctttagaccctcgggcccca

SEQ ID NO: 1226706 - DNA, 16 bp, Homo sapiens
ctttagaccctgggtg

SEQ ID NO: 1226707 - DNA, 23 bp, Homo sapiens
ctttagaccctgggtgggctctg

SEQ ID NO: 1226708 - DNA, 13 bp, Homo sapiens
ctttagagattat

SEQ ID NO: 1226709 - DNA, 21 bp, Homo sapiens
ctttagaggctttcaaatgta

SEQ ID NO: 1226710 - DNA, 13 bp, Homo sapiens
ctttagagtagca

SEQ ID NO: 1226711 - DNA, 12 bp, Homo sapiens
ctttagatgcca

SEQ ID NO: 1226712 - DNA, 14 bp, Homo sapiens
ctttagatgctgat

SEQ ID NO: 1226713 - DNA, 17 bp, Homo sapiens
ctttagatgctgatgat

SEQ ID NO: 1226714 - DNA, 19 bp, Homo sapiens
ctttagcataaaagaatat

SEQ ID NO: 1226715 - DNA, 17 bp, Homo sapiens
ctttagccatcataact

SEQ ID NO: 1226716 - DNA, 16 bp, Homo sapiens
ctttagcttcatttta

SEQ ID NO: 1226717 - DNA, 14 bp, Homo sapiens
ctttaggaataata

SEQ ID NO: 1226718 - DNA, 15 bp, Homo sapiens
ctttaggatgtaaag

SEQ ID NO: 1226719 - DNA, 14 bp, Homo sapiens
ctttaggcagcctg

SEQ ID NO: 1226720 - DNA, 16 bp, Homo sapiens
ctttaggcagcctgcc

SEQ ID NO: 1226721 - DNA, 20 bp, Homo sapiens
ctttaggcagcctgccgccg

SEQ ID NO: 1226722 - DNA, 17 bp, Homo sapiens
ctttagggctgttgcta

SEQ ID NO: 1226723 - DNA, 21 bp, Homo sapiens
ctttaggtcaaactccctagt

SEQ ID NO: 1226724 - DNA, 14 bp, Homo sapiens
ctttaggtctggtt

SEQ ID NO: 1226725 - DNA, 13 bp, Homo sapiens
ctttaggtttttt

SEQ ID NO: 1226726 - DNA, 20 bp, Homo sapiens
ctttaggtttttttaatgat

SEQ ID NO: 1226727 - DNA, 19 bp, Homo sapiens
ctttagtacctgaaaagta

SEQ ID NO: 1226728 - DNA, 17 bp, Homo sapiens
ctttagtatgctggctt

SEQ ID NO: 1226729 - DNA, 15 bp, Homo sapiens
ctttagtctgcaaaa

SEQ ID NO: 1226730 - DNA, 23 bp, Homo sapiens
ctttagtgttctgtttgaaacta

SEQ ID NO: 1226731 - DNA, 13 bp, Homo sapiens
ctttagtttttgt

SEQ ID NO: 1226732 - DNA, 15 bp, Homo sapiens
ctttagtttttgtga

SEQ ID NO: 1226733 - DNA, 12 bp, Homo sapiens
ctttataaactt

SEQ ID NO: 1226734 - DNA, 19 bp, Homo sapiens
ctttataattctactttga

SEQ ID NO: 1226735 - DNA, 18 bp, Homo sapiens
ctttatacaacgattgta

SEQ ID NO: 1226736 - DNA, 18 bp, Homo sapiens
ctttatacagttgaattt

SEQ ID NO: 1226737 - DNA, 22 bp, Homo sapiens
ctttatagaaggaatttgtact

SEQ ID NO: 1226738 - DNA, 13 bp, Homo sapiens
ctttatagatgta

SEQ ID NO: 1226739 - DNA, 22 bp, Homo sapiens
ctttatatgaagaaaatcactt

SEQ ID NO: 1226740 - DNA, 12 bp, Homo sapiens
ctttatatttag

SEQ ID NO: 1226741 - DNA, 20 bp, Homo sapiens
ctttatcaccaggatgtcac

SEQ ID NO: 1226742 - DNA, 22 bp, Homo sapiens
ctttatcagggaaactaagatt

SEQ ID NO: 1226743 - DNA, 21 bp, Homo sapiens
ctttatcatgaatgcttttag

SEQ ID NO: 1226744 - DNA, 14 bp, Homo sapiens
ctttatcttgacat

SEQ ID NO: 1226745 - DNA, 23 bp, Homo sapiens
ctttatctttccatgggagccag

SEQ ID NO: 1226746 - DNA, 19 bp, Homo sapiens
ctttatgctgtattttaac

SEQ ID NO: 1226747 - DNA, 20 bp, Homo sapiens
ctttatgcttgcttggggaa

SEQ ID NO: 1226748 - DNA, 13 bp, Homo sapiens
ctttatgtatctc

SEQ ID NO: 1226749 - DNA, 21 bp, Homo sapiens
ctttatgtctgtggatttttt

SEQ ID NO: 1226750 - DNA, 12 bp, Homo sapiens
ctttatgtcttt

SEQ ID NO: 1226751 - DNA, 12 bp, Homo sapiens
ctttatgtgaat

SEQ ID NO: 1226752 - DNA, 20 bp, Homo sapiens
ctttatgtttttgaggcttt

SEQ ID NO: 1226753 - DNA, 20 bp, Homo sapiens
ctttattaaccctctgagtt

SEQ ID NO: 1226754 - DNA, 15 bp, Homo sapiens
ctttattaatcacta

SEQ ID NO: 1226755 - DNA, 20 bp, Homo sapiens
ctttattaatcactattgtt

SEQ ID NO: 1226756 - DNA, 23 bp, Homo sapiens
ctttattccagaatgctgtacat

SEQ ID NO: 1226757 - DNA, 14 bp, Homo sapiens
ctttattcttgctg

SEQ ID NO: 1226758 - DNA, 17 bp, Homo sapiens
ctttattgaattagaaa

SEQ ID NO: 1226759 - DNA, 15 bp, Homo sapiens
ctttattgagaaaga

SEQ ID NO: 1226760 - DNA, 16 bp, Homo sapiens
ctttattgcactagga

SEQ ID NO: 1226761 - DNA, 16 bp, Homo sapiens
ctttattggctgagat

SEQ ID NO: 1226762 - DNA, 18 bp, Homo sapiens
ctttattggctgagatat

SEQ ID NO: 1226763 - DNA, 21 bp, Homo sapiens
ctttattggtaaattctggta

SEQ ID NO: 1226764 - DNA, 13 bp, Homo sapiens
ctttattgtacag

SEQ ID NO: 1226765 - DNA, 20 bp, Homo sapiens
ctttattgtacagactgttt

SEQ ID NO: 1226766 - DNA, 24 bp, Homo sapiens
ctttattgtacagactgttttact

SEQ ID NO: 1226767 - DNA, 23 bp, Homo sapiens
ctttattgtgggccatgaaccaa

SEQ ID NO: 1226768 - DNA, 13 bp, Homo sapiens
ctttatttaaatg

SEQ ID NO: 1226769 - DNA, 18 bp, Homo sapiens
ctttatttaaatgcatgt

SEQ ID NO: 1226770 - DNA, 22 bp, Homo sapiens
ctttatttaaatgcatgtctta

SEQ ID NO: 1226771 - DNA, 23 bp, Homo sapiens
ctttatttaaatgcatgtcttaa

SEQ ID NO: 1226772 - DNA, 16 bp, Homo sapiens
ctttatttaggaaaca

SEQ ID NO: 1226773 - DNA, 17 bp, Homo sapiens
ctttatttaggaaacac

SEQ ID NO: 1226774 - DNA, 14 bp, Homo sapiens
ctttatttatttct

SEQ ID NO: 1226775 - DNA, 18 bp, Homo sapiens
ctttatttgcatatttat

SEQ ID NO: 1226776 - DNA, 22 bp, Homo sapiens
ctttatttgtaaaccattgtaa

SEQ ID NO: 1226777 - DNA, 14 bp, Homo sapiens
ctttatttgtaaat

SEQ ID NO: 1226778 - DNA, 17 bp, Homo sapiens
ctttatttgtaaattta

SEQ ID NO: 1226779 - DNA, 16 bp, Homo sapiens
ctttattttatataat

SEQ ID NO: 1226780 - DNA, 12 bp, Homo sapiens
ctttattttatt

SEQ ID NO: 1226781 - DNA, 11 bp, Homo sapiens
ctttattttct

SEQ ID NO: 1226782 - DNA, 16 bp, Homo sapiens
ctttatttttctaagt

SEQ ID NO: 1226783 - DNA, 20 bp, Homo sapiens
ctttatttttcttttcctgg

SEQ ID NO: 1226784 - DNA, 21 bp, Homo sapiens
ctttattttttaagtatttat

SEQ ID NO: 1226785 - DNA, 15 bp, Homo sapiens
ctttcaaaagggaag

SEQ ID NO: 1226786 - DNA, 18 bp, Homo sapiens
ctttcaaagaaggaattc

SEQ ID NO: 1226787 - DNA, 16 bp, Homo sapiens
ctttcaaatcctccct

SEQ ID NO: 1226788 - DNA, 13 bp, Homo sapiens
ctttcaaattata

SEQ ID NO: 1226789 - DNA, 19 bp, Homo sapiens
ctttcaaattatatgctaa

SEQ ID NO: 1226790 - DNA, 11 bp, Homo sapiens
ctttcaaattt

SEQ ID NO: 1226791 - DNA, 14 bp, Homo sapiens
ctttcaaatttaga

SEQ ID NO: 1226792 - DNA, 22 bp, Homo sapiens
ctttcctctaactcactgccta

SEQ ID NO: 1226793 - DNA, 16 bp, Homo sapiens
ctttcctctccctcag

SEQ ID NO: 1226794 - DNA, 19 bp, Homo sapiens
ctttcctcttccccttgcc

SEQ ID NO: 1226795 - DNA, 14 bp, Homo sapiens
ctttcctctttctg

SEQ ID NO: 1226796 - DNA, 16 bp, Homo sapiens
ctttcctctttctgct

SEQ ID NO: 1226797 - DNA, 22 bp, Homo sapiens
ctttcctctttctgctctgcca

SEQ ID NO: 1226798 - DNA, 15 bp, Homo sapiens
ctttcctgaatccaa

SEQ ID NO: 1226799 - DNA, 22 bp, Homo sapiens
ctttcctgaatccaaactaatc

SEQ ID NO: 1226800 - DNA, 13 bp, Homo sapiens
ctttcctgcatct

SEQ ID NO: 1226801 - DNA, 14 bp, Homo sapiens
ctttcctgccccag

SEQ ID NO: 1226802 - DNA, 18 bp, Homo sapiens
ctttcctgccccaggcct

SEQ ID NO: 1226803 - DNA, 22 bp, Homo sapiens
ctttcctgccctgtccaaaagc

SEQ ID NO: 1226804 - DNA, 13 bp, Homo sapiens
ctttcctggtttc

SEQ ID NO: 1226805 - DNA, 18 bp, Homo sapiens
ctttcctggtttccgaaa

SEQ ID NO: 1226806 - DNA, 9 bp, Homo sapiens
ctttcctgt

SEQ ID NO: 1226807 - DNA, 12 bp, Homo sapiens
ctttccttccct

SEQ ID NO: 1226808 - DNA, 16 bp, Homo sapiens
ctttccttctccagga

SEQ ID NO: 1226809 - DNA, 16 bp, Homo sapiens
ctttccttctctgaaa

SEQ ID NO: 1226810 - DNA, 13 bp, Homo sapiens
ctttccttttctc

SEQ ID NO: 1226811 - DNA, 14 bp, Homo sapiens
ctttccttttctct

SEQ ID NO: 1226812 - DNA, 20 bp, Homo sapiens
ctttcgacttgcatttttgc

SEQ ID NO: 1226813 - DNA, 22 bp, Homo sapiens
ctttcgtgtaaattatgtaatg

SEQ ID NO: 1226814 - DNA, 14 bp, Homo sapiens
ctttcgttctgctg

SEQ ID NO: 1226815 - DNA, 23 bp, Homo sapiens
ctttcgttctgctgaccaaatgg

SEQ ID NO: 1226816 - DNA, 18 bp, Homo sapiens
ctttctaaacaagatttt

SEQ ID NO: 1226817 - DNA, 17 bp, Homo sapiens
ctttctaactgtagcta

SEQ ID NO: 1226818 - DNA, 14 bp, Homo sapiens
ctttctaagaaatc

SEQ ID NO: 1226819 - DNA, 16 bp, Homo sapiens
ctttctaatagagaga

SEQ ID NO: 1226820 - DNA, 20 bp, Homo sapiens
ctttctacaatgtgaacttt

SEQ ID NO: 1226821 - DNA, 20 bp, Homo sapiens
ctttctacatgactgggcct

SEQ ID NO: 1226822 - DNA, 22 bp, Homo sapiens
ctttctacatgactgggcctcc

SEQ ID NO: 1226823 - DNA, 17 bp, Homo sapiens
ctttctagaccaataaa

SEQ ID NO: 1226824 - DNA, 21 bp, Homo sapiens
ctttctagagcagttggccaa

SEQ ID NO: 1226825 - DNA, 16 bp, Homo sapiens
ctttctagcctggcta

SEQ ID NO: 1226826 - DNA, 13 bp, Homo sapiens
ctttctagcctta

SEQ ID NO: 1226827 - DNA, 22 bp, Homo sapiens
ctttctagccttagacaaatga

SEQ ID NO: 1226828 - DNA, 18 bp, Homo sapiens
ctttctagggacatgaaa

SEQ ID NO: 1226829 - DNA, 20 bp, Homo sapiens
ctttctagtcctattctatt

SEQ ID NO: 1226830 - DNA, 17 bp, Homo sapiens
ctttctagttcaatgcc

SEQ ID NO: 1226831 - DNA, 18 bp, Homo sapiens
ctttctagttgaaaataa

SEQ ID NO: 1226832 - DNA, 15 bp, Homo sapiens
ctttctatagaaata

SEQ ID NO: 1226833 - DNA, 19 bp, Homo sapiens
ctttctatagaaatattgt

SEQ ID NO: 1226834 - DNA, 16 bp, Homo sapiens
ctttctatcctctgta

SEQ ID NO: 1226835 - DNA, 18 bp, Homo sapiens
ctttctatttgacttgtg

SEQ ID NO: 1226836 - DNA, 20 bp, Homo sapiens
ctttctcaaagagggggctc

SEQ ID NO: 1226837 - DNA, 21 bp, Homo sapiens
ctttctcaaagagggggctct

SEQ ID NO: 1226838 - DNA, 14 bp, Homo sapiens
ctttctcaatgtct

SEQ ID NO: 1226839 - DNA, 17 bp, Homo sapiens
ctttctcacccaggcaa

SEQ ID NO: 1226840 - DNA, 21 bp, Homo sapiens
ctttctcaggagcttgggcag

SEQ ID NO: 1226841 - DNA, 17 bp, Homo sapiens
ctttctcagttttcata

SEQ ID NO: 1226842 - DNA, 22 bp, Homo sapiens
ctttctcataaaactgtgacta

SEQ ID NO: 1226843 - DNA, 13 bp, Homo sapiens
ctttctccagcca

SEQ ID NO: 1226844 - DNA, 14 bp, Homo sapiens
ctttctccaggacc

SEQ ID NO: 1226845 - DNA, 15 bp, Homo sapiens
ctttctccaggacca

SEQ ID NO: 1226846 - DNA, 22 bp, Homo sapiens
ctttctccctcaactgaagggg

SEQ ID NO: 1226847 - DNA, 15 bp, Homo sapiens
ctttctccctcaccc

SEQ ID NO: 1226848 - DNA, 15 bp, Homo sapiens
ctttctccctgcagc

SEQ ID NO: 1226849 - DNA, 22 bp, Homo sapiens
ctttctccctgtcccttccttt

SEQ ID NO: 1226850 - DNA, 23 bp, Homo sapiens
ctttctccctgtcccttcctttc

SEQ ID NO: 1226851 - DNA, 14 bp, Homo sapiens
ctttctccggggtc

SEQ ID NO: 1226852 - DNA, 20 bp, Homo sapiens
ctttctccggggtctgtgct

SEQ ID NO: 1226853 - DNA, 12 bp, Homo sapiens
ctttctcctcag

SEQ ID NO: 1226854 - DNA, 14 bp, Homo sapiens
ctttctcctcagga

SEQ ID NO: 1226855 - DNA, 21 bp, Homo sapiens
ctttctcctcatccatttctt

SEQ ID NO: 1226856 - DNA, 13 bp, Homo sapiens
ctttctcctcccc

SEQ ID NO: 1226857 - DNA, 17 bp, Homo sapiens
ctttctcctccccacct

SEQ ID NO: 1226858 - DNA, 12 bp, Homo sapiens
ctttctcctgga

SEQ ID NO: 1226859 - DNA, 13 bp, Homo sapiens
ctttctcctggag

SEQ ID NO: 1226860 - DNA, 15 bp, Homo sapiens
ctttctcctggtgac

SEQ ID NO: 1226861 - DNA, 11 bp, Homo sapiens
ctttctcctgt

SEQ ID NO: 1226862 - DNA, 15 bp, Homo sapiens
ctttctccttagtct

SEQ ID NO: 1226863 - DNA, 21 bp, Homo sapiens
ctttctcgtggtagaagccag

SEQ ID NO: 1226864 - DNA, 19 bp, Homo sapiens
ctttctctaaatatgatta

SEQ ID NO: 1226865 - DNA, 14 bp, Homo sapiens
ctttctctaataat

SEQ ID NO: 1226866 - DNA, 19 bp, Homo sapiens
ctttctctaataataaata

SEQ ID NO: 1226867 - DNA, 20 bp, Homo sapiens
ctttctctaataataaatag

SEQ ID NO: 1226868 - DNA, 18 bp, Homo sapiens
ctttctctcagaaatgct

SEQ ID NO: 1226869 - DNA, 20 bp, Homo sapiens
ctttctctcctcagtttaca

SEQ ID NO: 1226870 - DNA, 17 bp, Homo sapiens
ctttctctcctggctcg

SEQ ID NO: 1226871 - DNA, 15 bp, Homo sapiens
ctttctctcctttct

SEQ ID NO: 1226872 - DNA, 20 bp, Homo sapiens
ctttctctctcctctctgct

SEQ ID NO: 1226873 - DNA, 15 bp, Homo sapiens
ctttctctgaggaca

SEQ ID NO: 1226874 - DNA, 13 bp, Homo sapiens
ctttctctgccag

SEQ ID NO: 1226875 - DNA, 14 bp, Homo sapiens
ctttctctgccagt

SEQ ID NO: 1226876 - DNA, 16 bp, Homo sapiens
ctttctctgccagtga

SEQ ID NO: 1226877 - DNA, 15 bp, Homo sapiens
ctttctctgcctctg

SEQ ID NO: 1226878 - DNA, 17 bp, Homo sapiens
ctttctctgcctctggg

SEQ ID NO: 1226879 - DNA, 19 bp, Homo sapiens
ctttctctgcctctgggca

SEQ ID NO: 1226880 - DNA, 13 bp, Homo sapiens
ctttctctttctc

SEQ ID NO: 1226881 - DNA, 16 bp, Homo sapiens
ctttctctttcttcct

SEQ ID NO: 1226882 - DNA, 23 bp, Homo sapiens
ctttctcttttcccctttcctgt

SEQ ID NO: 1226883 - DNA, 13 bp, Homo sapiens
ctttctgaaaaca

SEQ ID NO: 1226884 - DNA, 18 bp, Homo sapiens
ctttctgaagatcaattt

SEQ ID NO: 1226885 - DNA, 14 bp, Homo sapiens
ctttctgaattgca

SEQ ID NO: 1226886 - DNA, 15 bp, Homo sapiens
ctttctgactgtccc

SEQ ID NO: 1226887 - DNA, 19 bp, Homo sapiens
ctttctgagtgagttttac

SEQ ID NO: 1226888 - DNA, 23 bp, Homo sapiens
ctttctgagtgagttttactctt

SEQ ID NO: 1226889 - DNA, 20 bp, Homo sapiens
ctttctgatgacgcctgtct

SEQ ID NO: 1226890 - DNA, 21 bp, Homo sapiens
ctttctgatgacgcctgtctg

SEQ ID NO: 1226891 - DNA, 19 bp, Homo sapiens
ctttctgcacacaaatatt

SEQ ID NO: 1226892 - DNA, 12 bp, Homo sapiens
ctttgattcata

SEQ ID NO: 1226893 - DNA, 21 bp, Homo sapiens
ctttgattcatagtaacttct

SEQ ID NO: 1226894 - DNA, 16 bp, Homo sapiens
ctttgattgaagtatt

SEQ ID NO: 1226895 - DNA, 14 bp, Homo sapiens
ctttgatttgtacc

SEQ ID NO: 1226896 - DNA, 16 bp, Homo sapiens
ctttgatttgtaccat

SEQ ID NO: 1226897 - DNA, 17 bp, Homo sapiens
ctttgatttgtaccatt

SEQ ID NO: 1226898 - DNA, 12 bp, Homo sapiens
ctttgcaaagac

SEQ ID NO: 1226899 - DNA, 15 bp, Homo sapiens
ctttgcaaaggagct

SEQ ID NO: 1226900 - DNA, 16 bp, Homo sapiens
ctttgcaaaggagctc

SEQ ID NO: 1226901 - DNA, 21 bp, Homo sapiens
ctttgcaaagtattgtaaatt

SEQ ID NO: 1226902 - DNA, 20 bp, Homo sapiens
ctttgcaaattatttattac

SEQ ID NO: 1226903 - DNA, 16 bp, Homo sapiens
ctttgcaattgctctt

SEQ ID NO: 1226904 - DNA, 21 bp, Homo sapiens
ctttgcaattgctcttctcca

SEQ ID NO: 1226905 - DNA, 23 bp, Homo sapiens
ctttgcaattgctcttctccacg

SEQ ID NO: 1226906 - DNA, 13 bp, Homo sapiens
ctttgcacatgtg

SEQ ID NO: 1226907 - DNA, 23 bp, Homo sapiens
ctttgcacccctttcctccccat

SEQ ID NO: 1226908 - DNA, 14 bp, Homo sapiens
ctttgcacctgaga

SEQ ID NO: 1226909 - DNA, 16 bp, Homo sapiens
ctttgcacctgagacc

SEQ ID NO: 1226910 - DNA, 21 bp, Homo sapiens
ctttgcacgacgccctctccc

SEQ ID NO: 1226911 - DNA, 22 bp, Homo sapiens
ctttgcacgacgccctctcccc

SEQ ID NO: 1226912 - DNA, 14 bp, Homo sapiens
ctttgcactgaggg

SEQ ID NO: 1226913 - DNA, 16 bp, Homo sapiens
ctttgcaggcggccct

SEQ ID NO: 1226914 - DNA, 20 bp, Homo sapiens
ctttgcaggcggccctcagt

SEQ ID NO: 1226915 - DNA, 13 bp, Homo sapiens
ctttgcaggctct

SEQ ID NO: 1226916 - DNA, 12 bp, Homo sapiens
ctttgcagggct

SEQ ID NO: 1226917 - DNA, 22 bp, Homo sapiens
ctttgcagttggactctcaggg

SEQ ID NO: 1226918 - DNA, 23 bp, Homo sapiens
ctttgcagttggactctcaggga

SEQ ID NO: 1226919 - DNA, 13 bp, Homo sapiens
ctttgcatattat

SEQ ID NO: 1226920 - DNA, 15 bp, Homo sapiens
ctttgcatattataa

SEQ ID NO: 1226921 - DNA, 23 bp, Homo sapiens
ctttgcatggcagggcctcatct

SEQ ID NO: 1226922 - DNA, 14 bp, Homo sapiens
ctttgcatgtatta

SEQ ID NO: 1226923 - DNA, 15 bp, Homo sapiens
ctttgcatgtattag

SEQ ID NO: 1226924 - DNA, 14 bp, Homo sapiens
ctttgcattttctg

SEQ ID NO: 1226925 - DNA, 21 bp, Homo sapiens
ctttgcattttctgatgtatt

SEQ ID NO: 1226926 - DNA, 22 bp, Homo sapiens
ctttgccaaaaatacaacacag

SEQ ID NO: 1226927 - DNA, 17 bp, Homo sapiens
ctttgccaacttgccat

SEQ ID NO: 1226928 - DNA, 22 bp, Homo sapiens
ctttgccacaagacctagccta

SEQ ID NO: 1226929 - DNA, 12 bp, Homo sapiens
ctttgccagagc

SEQ ID NO: 1226930 - DNA, 21 bp, Homo sapiens
ctttgccatcaatgatcatat

SEQ ID NO: 1226931 - DNA, 22 bp, Homo sapiens
ctttgcccacccctcactcccc

SEQ ID NO: 1226932 - DNA, 23 bp, Homo sapiens
ctttgcccagggtcctgtgcctg

SEQ ID NO: 1226933 - DNA, 20 bp, Homo sapiens
ctttgcccccttgcccatca

SEQ ID NO: 1226934 - DNA, 18 bp, Homo sapiens
ctttgccttgggctgctc

SEQ ID NO: 1226935 - DNA, 23 bp, Homo sapiens
ctttgcctttaggggtgtgtatt

SEQ ID NO: 1226936 - DNA, 21 bp, Homo sapiens
ctttgcctttcttctgccctt

SEQ ID NO: 1226937 - DNA, 15 bp, Homo sapiens
ctttgcgcctgtgac

SEQ ID NO: 1226938 - DNA, 18 bp, Homo sapiens
ctttgcgtggatcaagct

SEQ ID NO: 1226939 - DNA, 16 bp, Homo sapiens
ctttgctacaaattta

SEQ ID NO: 1226940 - DNA, 18 bp, Homo sapiens
ctttgctcagtgtccagc

SEQ ID NO: 1226941 - DNA, 20 bp, Homo sapiens
ctttgctcagtgtccagctt

SEQ ID NO: 1226942 - DNA, 21 bp, Homo sapiens
ctttgctccgctcccaccgcc

SEQ ID NO: 1226943 - DNA, 14 bp, Homo sapiens
ctttgctctattaa

SEQ ID NO: 1226944 - DNA, 22 bp, Homo sapiens
ctttgctctcaattaaagtcta

SEQ ID NO: 1226945 - DNA, 13 bp, Homo sapiens
ctttgctctgagg

SEQ ID NO: 1226946 - DNA, 14 bp, Homo sapiens
ctttgctctgaggt

SEQ ID NO: 1226947 - DNA, 18 bp, Homo sapiens
ctttgctgcacagcagga

SEQ ID NO: 1226948 - DNA, 22 bp, Homo sapiens
ctttgctgcacagcaggacctg

SEQ ID NO: 1226949 - DNA, 12 bp, Homo sapiens
ctttgctgcaga

SEQ ID NO: 1226950 - DNA, 15 bp, Homo sapiens
ctttgctgcatttta

SEQ ID NO: 1226951 - DNA, 11 bp, Homo sapiens
ctttgctgcca

SEQ ID NO: 1226952 - DNA, 16 bp, Homo sapiens
ctttgctgcccctgtc

SEQ ID NO: 1226953 - DNA, 22 bp, Homo sapiens
ctttgctgcccctgtctggaag

SEQ ID NO: 1226954 - DNA, 10 bp, Homo sapiens
ctttgctgct

SEQ ID NO: 1226955 - DNA, 11 bp, Homo sapiens
ctttgctgcta

SEQ ID NO: 1226956 - DNA, 13 bp, Homo sapiens
ctttgctgctaca

SEQ ID NO: 1226957 - DNA, 14 bp, Homo sapiens
ctttgctgctgctt

SEQ ID NO: 1226958 - DNA, 12 bp, Homo sapiens
ctttgctggttc

SEQ ID NO: 1226959 - DNA, 14 bp, Homo sapiens
ctttgctgtactct

SEQ ID NO: 1226960 - DNA, 22 bp, Homo sapiens
ctttgctgtgaggctgtcctgt

SEQ ID NO: 1226961 - DNA, 21 bp, Homo sapiens
ctttgctgttactgcttctct

SEQ ID NO: 1226962 - DNA, 23 bp, Homo sapiens
ctttgctgttactgcttctcttt

SEQ ID NO: 1226963 - DNA, 22 bp, Homo sapiens
ctttgctgtttagcttcctcca

SEQ ID NO: 1226964 - DNA, 23 bp, Homo sapiens
ctttgcttatgaatatttataac

SEQ ID NO: 1226965 - DNA, 17 bp, Homo sapiens
ctttggaaacaggacca

SEQ ID NO: 1226966 - DNA, 16 bp, Homo sapiens
ctttggaaatagcatg

SEQ ID NO: 1226967 - DNA, 16 bp, Homo sapiens
ctttggaacaagacag

SEQ ID NO: 1226968 - DNA, 14 bp, Homo sapiens
ctttggaacagata

SEQ ID NO: 1226969 - DNA, 16 bp, Homo sapiens
ctttggaacagatatt

SEQ ID NO: 1226970 - DNA, 15 bp, Homo sapiens
ctttggaaccagact

SEQ ID NO: 1226971 - DNA, 15 bp, Homo sapiens
ctttggaagaaaaaa

SEQ ID NO: 1226972 - DNA, 20 bp, Homo sapiens
ctttgggtcctgggcaggtg

SEQ ID NO: 1226973 - DNA, 19 bp, Homo sapiens
ctttgggtctacaagtata

SEQ ID NO: 1226974 - DNA, 22 bp, Homo sapiens
ctttgggtggctcactactgaa

SEQ ID NO: 1226975 - DNA, 15 bp, Homo sapiens
ctttggtacacagtt

SEQ ID NO: 1226976 - DNA, 22 bp, Homo sapiens
ctttggtacatggccagtgtga

SEQ ID NO: 1226977 - DNA, 18 bp, Homo sapiens
ctttggtactgctgtctt

SEQ ID NO: 1226978 - DNA, 22 bp, Homo sapiens
ctttggtgcagaggtttcttga

SEQ ID NO: 1226979 - DNA, 21 bp, Homo sapiens
ctttggtgcgggcacaataaa

SEQ ID NO: 1226980 - DNA, 14 bp, Homo sapiens
ctttggttaataca

SEQ ID NO: 1226981 - DNA, 21 bp, Homo sapiens
ctttggttattggaaggcaag

SEQ ID NO: 1226982 - DNA, 14 bp, Homo sapiens
ctttggttcagcta

SEQ ID NO: 1226983 - DNA, 16 bp, Homo sapiens
ctttggttccttctct

SEQ ID NO: 1226984 - DNA, 18 bp, Homo sapiens
ctttggttccttctctgg

SEQ ID NO: 1226985 - DNA, 17 bp, Homo sapiens
ctttggttggaacttta

SEQ ID NO: 1226986 - DNA, 18 bp, Homo sapiens
ctttgtaaccacaacttt

SEQ ID NO: 1226987 - DNA, 17 bp, Homo sapiens
ctttgtaagacatttgt

SEQ ID NO: 1226988 - DNA, 22 bp, Homo sapiens
ctttgtaatgtcaccaccttcc

SEQ ID NO: 1226989 - DNA, 14 bp, Homo sapiens
ctttgtacttgtgt

SEQ ID NO: 1226990 - DNA, 14 bp, Homo sapiens
ctttgtagaataaa

SEQ ID NO: 1226991 - DNA, 22 bp, Homo sapiens
ctttgtagccatcctgttaaat

SEQ ID NO: 1226992 - DNA, 16 bp, Homo sapiens
ctttgtatacaagtac

SEQ ID NO: 1226993 - DNA, 17 bp, Homo sapiens
ctttgtatacaagtact

SEQ ID NO: 1226994 - DNA, 20 bp, Homo sapiens
ctttgtatgacagtgaagca

SEQ ID NO: 1226995 - DNA, 13 bp, Homo sapiens
ctttgtattactt

SEQ ID NO: 1226996 - DNA, 13 bp, Homo sapiens
ctttgtattataa

SEQ ID NO: 1226997 - DNA, 15 bp, Homo sapiens
ctttgtattataaaa

SEQ ID NO: 1226998 - DNA, 16 bp, Homo sapiens
ctttgtattataattg

SEQ ID NO: 1226999 - DNA, 18 bp, Homo sapiens
ctttgtattataattgtt

SEQ ID NO: 1227000 - DNA, 23 bp, Homo sapiens
ctttgtattataattgttgatat

SEQ ID NO: 1227001 - DNA, 20 bp, Homo sapiens
ctttgtcaccacgtggggct

SEQ ID NO: 1227002 - DNA, 18 bp, Homo sapiens
ctttgtcacttgccacat

SEQ ID NO: 1227003 - DNA, 15 bp, Homo sapiens
ctttgtcattatgat

SEQ ID NO: 1227004 - DNA, 21 bp, Homo sapiens
ctttgtccccacacagcctct

SEQ ID NO: 1227005 - DNA, 11 bp, Homo sapiens
ctttgtcctgc

SEQ ID NO: 1227006 - DNA, 18 bp, Homo sapiens
ctttgtctcgttcctgtt

SEQ ID NO: 1227007 - DNA, 14 bp, Homo sapiens
ctttgtctggccac

SEQ ID NO: 1227008 - DNA, 14 bp, Homo sapiens
ctttgtctggcctc

SEQ ID NO: 1227009 - DNA, 15 bp, Homo sapiens
ctttgtctggcctca

SEQ ID NO: 1227010 - DNA, 14 bp, Homo sapiens
ctttgtctgtacat

SEQ ID NO: 1227011 - DNA, 15 bp, Homo sapiens
ctttgtctgtacata

SEQ ID NO: 1227012 - DNA, 15 bp, Homo sapiens
ctttgtcttgtactt

SEQ ID NO: 1227013 - DNA, 13 bp, Homo sapiens
ctttgtctttttc

SEQ ID NO: 1227014 - DNA, 15 bp, Homo sapiens
ctttgtctttttcct

SEQ ID NO: 1227015 - DNA, 16 bp, Homo sapiens
ctttgtctttttccta

SEQ ID NO: 1227016 - DNA, 17 bp, Homo sapiens
ctttgtcttttttttca

SEQ ID NO: 1227017 - DNA, 23 bp, Homo sapiens
ctttgtgaatctgaactgctcta

SEQ ID NO: 1227018 - DNA, 19 bp, Homo sapiens
ctttgtgagagtgagctgt

SEQ ID NO: 1227019 - DNA, 12 bp, Homo sapiens
ctttgtgatttt

SEQ ID NO: 1227020 - DNA, 18 bp, Homo sapiens
ctttgtgatttttgtaat

SEQ ID NO: 1227021 - DNA, 18 bp, Homo sapiens
ctttgtgcacatttattt

SEQ ID NO: 1227022 - DNA, 18 bp, Homo sapiens
ctttgtgcagcttcgagg

SEQ ID NO: 1227023 - DNA, 13 bp, Homo sapiens
ctttgtgcattct

SEQ ID NO: 1227024 - DNA, 16 bp, Homo sapiens
ctttgtgctgcgcctg

SEQ ID NO: 1227025 - DNA, 22 bp, Homo sapiens
ctttgtgcttggggctatttgt

SEQ ID NO: 1227026 - DNA, 13 bp, Homo sapiens
ctttgtggccaag

SEQ ID NO: 1227027 - DNA, 15 bp, Homo sapiens
ctttgtggccaagga

SEQ ID NO: 1227028 - DNA, 23 bp, Homo sapiens
ctttgtgggaaacagagtccaat

SEQ ID NO: 1227029 - DNA, 21 bp, Homo sapiens
ctttgtgggagggtaagacaa

SEQ ID NO: 1227030 - DNA, 21 bp, Homo sapiens
ctttgtgggttggccaggagg

SEQ ID NO: 1227031 - DNA, 19 bp, Homo sapiens
ctttgtggtctaaagtgtt

SEQ ID NO: 1227032 - DNA, 15 bp, Homo sapiens
ctttgtggtgggcgc

SEQ ID NO: 1227033 - DNA, 16 bp, Homo sapiens
ctttgtgtagctttgc

SEQ ID NO: 1227034 - DNA, 19 bp, Homo sapiens
ctttgtgtatgggggaagg

SEQ ID NO: 1227035 - DNA, 20 bp, Homo sapiens
ctttgtgtcagaaaaaggaa

SEQ ID NO: 1227036 - DNA, 14 bp, Homo sapiens
ctttgtgtggctcc

SEQ ID NO: 1227037 - DNA, 15 bp, Homo sapiens
ctttgtgtggctcct

SEQ ID NO: 1227038 - DNA, 16 bp, Homo sapiens
ctttgtgtggctcctg

SEQ ID NO: 1227039 - DNA, 18 bp, Homo sapiens
ctttgtgtggctcctggt

SEQ ID NO: 1227040 - DNA, 16 bp, Homo sapiens
ctttgtgtggctgccc

SEQ ID NO: 1227041 - DNA, 23 bp, Homo sapiens
cttttttaaattaagacaaaaag

SEQ ID NO: 1227042 - DNA, 15 bp, Homo sapiens
cttttttaaattaat

SEQ ID NO: 1227043 - DNA, 21 bp, Homo sapiens
cttttttaacatgtgttaaac

SEQ ID NO: 1227044 - DNA, 19 bp, Homo sapiens
cttttttaattcagtacaa

SEQ ID NO: 1227045 - DNA, 23 bp, Homo sapiens
cttttttatgtgccgtgttattg

SEQ ID NO: 1227046 - DNA, 16 bp, Homo sapiens
cttttttcaaaagaaa

SEQ ID NO: 1227047 - DNA, 16 bp, Homo sapiens
cttttttctcttctgt

SEQ ID NO: 1227048 - DNA, 16 bp, Homo sapiens
cttttttctttaagat

SEQ ID NO: 1227049 - DNA, 20 bp, Homo sapiens
cttttttgaaataataaatc

SEQ ID NO: 1227050 - DNA, 22 bp, Homo sapiens
cttttttgtcccccaacttgag

SEQ ID NO: 1227051 - DNA, 16 bp, Homo sapiens
cttttttgtctatgaa

SEQ ID NO: 1227052 - DNA, 12 bp, Homo sapiens
cttttttgtgta

SEQ ID NO: 1227053 - DNA, 24 bp, Homo sapiens
cttttttgtgtatgtacttagctg

SEQ ID NO: 1227054 - DNA, 15 bp, Homo sapiens
cttttttgtttgttt

SEQ ID NO: 1227055 - DNA, 22 bp, Homo sapiens
cttttttgtttgtttctttgtg

SEQ ID NO: 1227056 - DNA, 22 bp, Homo sapiens
cttttttgttttttcaaaatag

SEQ ID NO: 1227057 - DNA, 16 bp, Homo sapiens
ctttttttaaaattat

SEQ ID NO: 1227058 - DNA, 22 bp, Homo sapiens
ctttttttctctgcatttaaaa

SEQ ID NO: 1227059 - DNA, 16 bp, Homo sapiens
ctttttttctgtacca

SEQ ID NO: 1227060 - DNA, 19 bp, Homo sapiens
ctttttttctgtaccagtt

SEQ ID NO: 1227061 - DNA, 15 bp, Homo sapiens
ctttttttctttggt

SEQ ID NO: 1227062 - DNA, 22 bp, Homo sapiens
ctttttttgagcgacatctctg

SEQ ID NO: 1227063 - DNA, 23 bp, Homo sapiens
ctttttttggtaaatttttgaaa

SEQ ID NO: 1227064 - DNA, 16 bp, Homo sapiens
ctttttttgtatagtt

SEQ ID NO: 1227065 - DNA, 21 bp, Homo sapiens
ctttttttgtatagttaacac

SEQ ID NO: 1227066 - DNA, 22 bp, Homo sapiens
cttttttttatggcgtttttct

SEQ ID NO: 1227067 - DNA, 15 bp, Homo sapiens
cttttttttctgatt

SEQ ID NO: 1227068 - DNA, 15 bp, Homo sapiens
cttttttttgtatgt

SEQ ID NO: 1227069 - DNA, 12 bp, Homo sapiens
ctttttttttcc

SEQ ID NO: 1227070 - DNA, 13 bp, Homo sapiens
ctttttttttcct

SEQ ID NO: 1227071 - DNA, 15 bp, Homo sapiens
cttttttttttccaa

SEQ ID NO: 1227072 - DNA, 16 bp, Homo sapiens
cttttttttttccaaa

SEQ ID NO: 1227073 - DNA, 18 bp, Homo sapiens
cttttttttttttaacat

SEQ ID NO: 1227074 - DNA, 17 bp, Homo sapiens
ctttttttttttttccc

SEQ ID NO: 1227075 - DNA, 18 bp, Homo sapiens
cttttttttttttttaca

SEQ ID NO: 1227076 - DNA, 18 bp, Homo sapiens
ctttttttttttttttga

SEQ ID NO: 1227077 - DNA, 19 bp, Homo sapiens
ctttttttttttttttgaa

SEQ ID NO: 1227078 - DNA, 15 bp, Homo sapiens
gaaaaaaaaaaagaa

SEQ ID NO: 1227079 - DNA, 17 bp, Homo sapiens
gaaaaaaaaaacacttg

SEQ ID NO: 1227080 - DNA, 17 bp, Homo sapiens
gaaaaaaaaacagccac

SEQ ID NO: 1227081 - DNA, 14 bp, Homo sapiens
gaaaaagcatgatg

SEQ ID NO: 1227082 - DNA, 19 bp, Homo sapiens
gaaaaagcatgatgggaaa

SEQ ID NO: 1227083 - DNA, 15 bp, Homo sapiens
gaaaaaggaggaaga

SEQ ID NO: 1227084 - DNA, 12 bp, Homo sapiens
gaaaaaggcagt

SEQ ID NO: 1227085 - DNA, 15 bp, Homo sapiens
gaaaaaggctgtgct

SEQ ID NO: 1227086 - DNA, 19 bp, Homo sapiens
gaaaaagttaaacattgaa

SEQ ID NO: 1227087 - DNA, 21 bp, Homo sapiens
gaaaaataaacaataagacat

SEQ ID NO: 1227088 - DNA, 13 bp, Homo sapiens
gaaaaataatcaa

SEQ ID NO: 1227089 - DNA, 12 bp, Homo sapiens
gaaaaatagtaa

SEQ ID NO: 1227090 - DNA, 21 bp, Homo sapiens
gaaaaatatgttgagtgttca

SEQ ID NO: 1227091 - DNA, 20 bp, Homo sapiens
gaaaaatattcaagtaacac

SEQ ID NO: 1227092 - DNA, 21 bp, Homo sapiens
gaaaaatattcaagtaacact

SEQ ID NO: 1227093 - DNA, 16 bp, Homo sapiens
gaaaaatattgctaaa

SEQ ID NO: 1227094 - DNA, 20 bp, Homo sapiens
gaaaaatattgctaaaagtg

SEQ ID NO: 1227095 - DNA, 17 bp, Homo sapiens
gaaaaatcatgggccag

SEQ ID NO: 1227096 - DNA, 18 bp, Homo sapiens
gaaaaatccagaaagaaa

SEQ ID NO: 1227097 - DNA, 18 bp, Homo sapiens
gaaaaatcctcttcctct

SEQ ID NO: 1227098 - DNA, 20 bp, Homo sapiens
gaaaaatcctcttcctctga

SEQ ID NO: 1227099 - DNA, 13 bp, Homo sapiens
gaaaaatcttaag

SEQ ID NO: 1227100 - DNA, 23 bp, Homo sapiens
gaaaaatgaaaagcaatacaact

SEQ ID NO: 1227101 - DNA, 22 bp, Homo sapiens
gaaaaatgccactccctaccca

SEQ ID NO: 1227102 - DNA, 16 bp, Homo sapiens
gaaaaatgctccccac

SEQ ID NO: 1227103 - DNA, 11 bp, Homo sapiens
gaaaaatggag

SEQ ID NO: 1227104 - DNA, 16 bp, Homo sapiens
gaaaaatggttgatgg

SEQ ID NO: 1227105 - DNA, 15 bp, Homo sapiens
gaaaaatgtataaaa

SEQ ID NO: 1227106 - DNA, 13 bp, Homo sapiens
gaaaaatgtcact

SEQ ID NO: 1227107 - DNA, 14 bp, Homo sapiens
gaaaaatgtgtaat

SEQ ID NO: 1227108 - DNA, 20 bp, Homo sapiens
gaaaaattcagcaaaccatt

SEQ ID NO: 1227109 - DNA, 16 bp, Homo sapiens
gaaaaattgacaaaaa

SEQ ID NO: 1227110 - DNA, 17 bp, Homo sapiens
gaaaaattgacaaaaaa

SEQ ID NO: 1227111 - DNA, 19 bp, Homo sapiens
gaaaaattggggaggaggg

SEQ ID NO: 1227112 - DNA, 17 bp, Homo sapiens
gaaaaatttaagcattg

SEQ ID NO: 1227113 - DNA, 15 bp, Homo sapiens
gaaaacaaaggagca

SEQ ID NO: 1227114 - DNA, 14 bp, Homo sapiens
gaaaacaaatctat

SEQ ID NO: 1227115 - DNA, 23 bp, Homo sapiens
gaaaacaaccgtcctgctgtccc

SEQ ID NO: 1227116 - DNA, 18 bp, Homo sapiens
gaaaacaattcaagctga

SEQ ID NO: 1227117 - DNA, 18 bp, Homo sapiens
gaaaacactatttccaaa

SEQ ID NO: 1227118 - DNA, 21 bp, Homo sapiens
gaaaacagaacatcattagaa

SEQ ID NO: 1227119 - DNA, 15 bp, Homo sapiens
gaaaacagaatcagt

SEQ ID NO: 1227120 - DNA, 19 bp, Homo sapiens
gaaaacagagtatttctgg

SEQ ID NO: 1227121 - DNA, 19 bp, Homo sapiens
gaaaacaggaaaaaaactt

SEQ ID NO: 1227122 - DNA, 21 bp, Homo sapiens
gaaaacaggaaaaaaactttt

SEQ ID NO: 1227123 - DNA, 15 bp, Homo sapiens
gaaaacatgctacac

SEQ ID NO: 1227124 - DNA, 16 bp, Homo sapiens
gaaaacatgctacaca

SEQ ID NO: 1227125 - DNA, 16 bp, Homo sapiens
gaaaacatgtttaaat

SEQ ID NO: 1227126 - DNA, 16 bp, Homo sapiens
gaaaacattgcttttg

SEQ ID NO: 1227127 - DNA, 14 bp, Homo sapiens
gaaaacatttaaca

SEQ ID NO: 1227128 - DNA, 14 bp, Homo sapiens
gaaaacattttatt

SEQ ID NO: 1227129 - DNA, 19 bp, Homo sapiens
gaaaacattttatttttaa

SEQ ID NO: 1227130 - DNA, 18 bp, Homo sapiens
gaaaaccaagccgtggct

SEQ ID NO: 1227131 - DNA, 19 bp, Homo sapiens
gaaaaccaagccgtggctt

SEQ ID NO: 1227132 - DNA, 21 bp, Homo sapiens
gaaaaccaagccgtggcttcc

SEQ ID NO: 1227133 - DNA, 18 bp, Homo sapiens
gaaaaccataatgtcttt

SEQ ID NO: 1227134 - DNA, 16 bp, Homo sapiens
gaaaacccaaggccag

SEQ ID NO: 1227135 - DNA, 12 bp, Homo sapiens
gaaaacccagag

SEQ ID NO: 1227136 - DNA, 13 bp, Homo sapiens
gaaaacccagaga

SEQ ID NO: 1227137 - DNA, 14 bp, Homo sapiens
gaaaacccagagag

SEQ ID NO: 1227138 - DNA, 13 bp, Homo sapiens
gaaaacccctccc

SEQ ID NO: 1227139 - DNA, 21 bp, Homo sapiens
gaaaacccttgggccagaagt

SEQ ID NO: 1227140 - DNA, 22 bp, Homo sapiens
gaaaacccttgggccagaagta

SEQ ID NO: 1227141 - DNA, 13 bp, Homo sapiens
gaaaaccgagaat

SEQ ID NO: 1227142 - DNA, 13 bp, Homo sapiens
gaaaacctctcct

SEQ ID NO: 1227143 - DNA, 17 bp, Homo sapiens
gaaaacctgggggatgg

SEQ ID NO: 1227144 - DNA, 16 bp, Homo sapiens
gaaaacgccagtgtgt

SEQ ID NO: 1227145 - DNA, 19 bp, Homo sapiens
gaaaacgttttattgtgtt

SEQ ID NO: 1227146 - DNA, 18 bp, Homo sapiens
gaaaactaaggatttttc

SEQ ID NO: 1227147 - DNA, 17 bp, Homo sapiens
gaaaactaatgtactgt

SEQ ID NO: 1227148 - DNA, 20 bp, Homo sapiens
gaaaactaatgtactgtaca

SEQ ID NO: 1227149 - DNA, 19 bp, Homo sapiens
gaaaactactttttggtca

SEQ ID NO: 1227150 - DNA, 20 bp, Homo sapiens
gaaaactattgagccttgca

SEQ ID NO: 1227151 - DNA, 14 bp, Homo sapiens
gaaaactccagggt

SEQ ID NO: 1227152 - DNA, 13 bp, Homo sapiens
gaaaactcccaat

SEQ ID NO: 1227153 - DNA, 16 bp, Homo sapiens
gaaaactctttgctgc

SEQ ID NO: 1227154 - DNA, 19 bp, Homo sapiens
gaaaactgtgcaacttttt

SEQ ID NO: 1227155 - DNA, 21 bp, Homo sapiens
gaaaactgtgcaactttttaa

SEQ ID NO: 1227156 - DNA, 13 bp, Homo sapiens
gaaaacttagcca

SEQ ID NO: 1227157 - DNA, 17 bp, Homo sapiens
gaaaacttagccagagt

SEQ ID NO: 1227158 - DNA, 23 bp, Homo sapiens
gaaaacttatgacctcttccttt

SEQ ID NO: 1227159 - DNA, 14 bp, Homo sapiens
gaaaacttcaaagc

SEQ ID NO: 1227160 - DNA, 16 bp, Homo sapiens
gaaaacttttgtaaat

SEQ ID NO: 1227161 - DNA, 23 bp, Homo sapiens
gaaaacttttgtaaattattgat

SEQ ID NO: 1227162 - DNA, 9 bp, Homo sapiens
gaaaagaaa

SEQ ID NO: 1227163 - DNA, 17 bp, Homo sapiens
gaaaagaaaaaaaaaga

SEQ ID NO: 1227164 - DNA, 19 bp, Homo sapiens
gaaaagaaaacatttaaca

SEQ ID NO: 1227165 - DNA, 15 bp, Homo sapiens
gaaaagaaagaagtt

SEQ ID NO: 1227166 - DNA, 21 bp, Homo sapiens
gaaaagaaagaagttattttc

SEQ ID NO: 1227167 - DNA, 14 bp, Homo sapiens
gaaaagaatttttt

SEQ ID NO: 1227168 - DNA, 16 bp, Homo sapiens
gaaaagaccagggctt

SEQ ID NO: 1227169 - DNA, 14 bp, Homo sapiens
gaaaagaccctgag

SEQ ID NO: 1227170 - DNA, 16 bp, Homo sapiens
gaaaagaccctgagac

SEQ ID NO: 1227171 - DNA, 18 bp, Homo sapiens
gaaaagactcctcctggg

SEQ ID NO: 1227172 - DNA, 16 bp, Homo sapiens
gaaaagactgtgggtg

SEQ ID NO: 1227173 - DNA, 17 bp, Homo sapiens
gaaaagactgtgggtgg

SEQ ID NO: 1227174 - DNA, 18 bp, Homo sapiens
gaaaagagacttctctgt

SEQ ID NO: 1227175 - DNA, 11 bp, Homo sapiens
gaaaagagaga

SEQ ID NO: 1227176 - DNA, 19 bp, Homo sapiens
gaaaagagatattttaaaa

SEQ ID NO: 1227177 - DNA, 12 bp, Homo sapiens
gaaaagaggagt

SEQ ID NO: 1227178 - DNA, 21 bp, Homo sapiens
gaaaagaggagtttcgaggta

SEQ ID NO: 1227179 - DNA, 20 bp, Homo sapiens
gaaaagataaagaccagaaa

SEQ ID NO: 1227180 - DNA, 19 bp, Homo sapiens
gaaaagatacgactttatt

SEQ ID NO: 1227181 - DNA, 20 bp, Homo sapiens
gaaaagatacgactttattt

SEQ ID NO: 1227182 - DNA, 15 bp, Homo sapiens
gaaaagatccccaag

SEQ ID NO: 1227183 - DNA, 17 bp, Homo sapiens
gaaaagatgtagattta

SEQ ID NO: 1227184 - DNA, 21 bp, Homo sapiens
gaaaagatgtagatttatttc

SEQ ID NO: 1227185 - DNA, 23 bp, Homo sapiens
gaaaagattttaatcaagttgaa

SEQ ID NO: 1227186 - DNA, 12 bp, Homo sapiens
gaaaagcaatac

SEQ ID NO: 1227187 - DNA, 12 bp, Homo sapiens
gaaaagcacaga

SEQ ID NO: 1227188 - DNA, 14 bp, Homo sapiens
gaaaagcacctgcc

SEQ ID NO: 1227189 - DNA, 17 bp, Homo sapiens
gaaaagcacctgccgac

SEQ ID NO: 1227190 - DNA, 16 bp, Homo sapiens
gaaaagcagacatttt

SEQ ID NO: 1227191 - DNA, 22 bp, Homo sapiens
gaaaagccctcatcttctcttt

SEQ ID NO: 1227192 - DNA, 19 bp, Homo sapiens
gaaaagcctctgttttgat

SEQ ID NO: 1227193 - DNA, 20 bp, Homo sapiens
gaaaagccttggagaactcg

SEQ ID NO: 1227194 - DNA, 18 bp, Homo sapiens
gaaaagcggacatcagct

SEQ ID NO: 1227195 - DNA, 20 bp, Homo sapiens
gaaaagcggacatcagctgg

SEQ ID NO: 1227196 - DNA, 14 bp, Homo sapiens
gaaaagctcagagt

SEQ ID NO: 1227197 - DNA, 22 bp, Homo sapiens
gaaaagctgccatttcccttct

SEQ ID NO: 1227198 - DNA, 15 bp, Homo sapiens
gaaaagctttcctga

SEQ ID NO: 1227199 - DNA, 20 bp, Homo sapiens
gaaaaggaagactagaggct

SEQ ID NO: 1227200 - DNA, 22 bp, Homo sapiens
gaaaaggaagtttccagaaaag

SEQ ID NO: 1227201 - DNA, 12 bp, Homo sapiens
gaaaaggaatca

SEQ ID NO: 1227202 - DNA, 23 bp, Homo sapiens
gaaaaggaatcacgttagaggaa

SEQ ID NO: 1227203 - DNA, 21 bp, Homo sapiens
gaaaaggatattatctacctg

SEQ ID NO: 1227204 - DNA, 19 bp, Homo sapiens
gaaaaggatcgaggcatgg

SEQ ID NO: 1227205 - DNA, 17 bp, Homo sapiens
gaaaagggaaaaaagaa

SEQ ID NO: 1227206 - DNA, 18 bp, Homo sapiens
gaaaagggaaaaaagaaa

SEQ ID NO: 1227207 - DNA, 18 bp, Homo sapiens
gaaaagggaactgaacat

SEQ ID NO: 1227208 - DNA, 14 bp, Homo sapiens
gaaaagggtcttct

SEQ ID NO: 1227209 - DNA, 23 bp, Homo sapiens
gaaaaggtagaggagtcacgtta

SEQ ID NO: 1227210 - DNA, 20 bp, Homo sapiens
gaaaaggtccttgcctcctg

SEQ ID NO: 1227211 - DNA, 13 bp, Homo sapiens
gaaaaggttgaat

SEQ ID NO: 1227212 - DNA, 21 bp, Homo sapiens
gaaaagtaaggtgcagttccc

SEQ ID NO: 1227213 - DNA, 17 bp, Homo sapiens
gaaaagtaattttgtca

SEQ ID NO: 1227214 - DNA, 23 bp, Homo sapiens
gaaaagtaattttgtcacattat

SEQ ID NO: 1227215 - DNA, 14 bp, Homo sapiens
gaaaagtacattta

SEQ ID NO: 1227216 - DNA, 20 bp, Homo sapiens
gaaaagtatattgataacct

SEQ ID NO: 1227217 - DNA, 21 bp, Homo sapiens
gaaaagtgaaggggaaacaca

SEQ ID NO: 1227218 - DNA, 22 bp, Homo sapiens
gaaaagtgaaggggaaacacac

SEQ ID NO: 1227219 - DNA, 16 bp, Homo sapiens
gaaaagtgatgtattt

SEQ ID NO: 1227220 - DNA, 17 bp, Homo sapiens
gaaaagtgatgtatttt

SEQ ID NO: 1227221 - DNA, 16 bp, Homo sapiens
gaaaagtgcaagtcca

SEQ ID NO: 1227222 - DNA, 14 bp, Homo sapiens
gaaaagtgcctgag

SEQ ID NO: 1227223 - DNA, 12 bp, Homo sapiens
gaaaagtgggct

SEQ ID NO: 1227224 - DNA, 17 bp, Homo sapiens
gaaaagttaaactaaaa

SEQ ID NO: 1227225 - DNA, 13 bp, Homo sapiens
gaaaagttaacat

SEQ ID NO: 1227226 - DNA, 10 bp, Homo sapiens
gaaaagttat

SEQ ID NO: 1227227 - DNA, 10 bp, Homo sapiens
gaaaagttca

SEQ ID NO: 1227228 - DNA, 16 bp, Homo sapiens
gaaaagttggaaggat

SEQ ID NO: 1227229 - DNA, 20 bp, Homo sapiens
gaaaagttggaaggatctgc

SEQ ID NO: 1227230 - DNA, 21 bp, Homo sapiens
gaaaataaaaaaaagaaaaaa

SEQ ID NO: 1227231 - DNA, 16 bp, Homo sapiens
gaaaataaaaatgcta

SEQ ID NO: 1227232 - DNA, 14 bp, Homo sapiens
gaaaataaacacca

SEQ ID NO: 1227233 - DNA, 17 bp, Homo sapiens
gaaaataaacatcagtt

SEQ ID NO: 1227234 - DNA, 20 bp, Homo sapiens
gaaaataaacatcagtttct

SEQ ID NO: 1227235 - DNA, 21 bp, Homo sapiens
gaaaataaactcataaaactc

SEQ ID NO: 1227236 - DNA, 13 bp, Homo sapiens
gaaaataaagcta

SEQ ID NO: 1227237 - DNA, 22 bp, Homo sapiens
gaaaataaatcttagtgttcaa

SEQ ID NO: 1227238 - DNA, 13 bp, Homo sapiens
gaaaataaggcac

SEQ ID NO: 1227239 - DNA, 22 bp, Homo sapiens
gaaaataatggagaatcacttt

SEQ ID NO: 1227240 - DNA, 18 bp, Homo sapiens
gaaaataatgtaattgta

SEQ ID NO: 1227241 - DNA, 19 bp, Homo sapiens
gaaaataatgtaattgtaa

SEQ ID NO: 1227242 - DNA, 19 bp, Homo sapiens
gaaaataattttccaagta

SEQ ID NO: 1227243 - DNA, 17 bp, Homo sapiens
gaaaatagaattgacat

SEQ ID NO: 1227244 - DNA, 20 bp, Homo sapiens
gaaaatagtaaatgctttgt

SEQ ID NO: 1227245 - DNA, 17 bp, Homo sapiens
gaaaatagtgtaagaac

SEQ ID NO: 1227246 - DNA, 18 bp, Homo sapiens
gaaaatagtttaggagaa

SEQ ID NO: 1227247 - DNA, 18 bp, Homo sapiens
gaaaatataagtggtgct

SEQ ID NO: 1227248 - DNA, 19 bp, Homo sapiens
gaaaatataatatttactg

SEQ ID NO: 1227249 - DNA, 22 bp, Homo sapiens
gaaaatataatatttactgtta

SEQ ID NO: 1227250 - DNA, 16 bp, Homo sapiens
gaaaatatatgatggc

SEQ ID NO: 1227251 - DNA, 16 bp, Homo sapiens
gaaaatatatgtattt

SEQ ID NO: 1227252 - DNA, 20 bp, Homo sapiens
gaaaatattctctatttgaa

SEQ ID NO: 1227253 - DNA, 15 bp, Homo sapiens
gaaaatattgtttta

SEQ ID NO: 1227254 - DNA, 22 bp, Homo sapiens
gaaaatatttcctgacttgagt

SEQ ID NO: 1227255 - DNA, 21 bp, Homo sapiens
gaaaatatttctatgtaaatt

SEQ ID NO: 1227256 - DNA, 14 bp, Homo sapiens
gaaaatcaaagtaa

SEQ ID NO: 1227257 - DNA, 15 bp, Homo sapiens
gaaaatcaaatggta

SEQ ID NO: 1227258 - DNA, 16 bp, Homo sapiens
gaaaatcagcctgctc

SEQ ID NO: 1227259 - DNA, 20 bp, Homo sapiens
gaaaatcagcctgctccagc

SEQ ID NO: 1227260 - DNA, 14 bp, Homo sapiens
gaaaatcatattgc

SEQ ID NO: 1227261 - DNA, 23 bp, Homo sapiens
gaaaatcctatatctgtttgtat

SEQ ID NO: 1227262 - DNA, 14 bp, Homo sapiens
gaaaatcctctggc

SEQ ID NO: 1227263 - DNA, 20 bp, Homo sapiens
gaaaatcctgaataaaccag

SEQ ID NO: 1227264 - DNA, 19 bp, Homo sapiens
gaaaatcgagttggcaaaa

SEQ ID NO: 1227265 - DNA, 14 bp, Homo sapiens
gaaaatctaatatt

SEQ ID NO: 1227266 - DNA, 20 bp, Homo sapiens
gaaaatctaatattaaaaat

SEQ ID NO: 1227267 - DNA, 23 bp, Homo sapiens
gaaaatctaatattaaaaatatg

SEQ ID NO: 1227268 - DNA, 21 bp, Homo sapiens
gaaaatctagaggaaaagaaa

SEQ ID NO: 1227269 - DNA, 22 bp, Homo sapiens
gaaaatctagaggaaaagaaag

SEQ ID NO: 1227270 - DNA, 22 bp, Homo sapiens
gaaaatcttagtatagtagaaa

SEQ ID NO: 1227271 - DNA, 16 bp, Homo sapiens
gaaaatctttgttgaa

SEQ ID NO: 1227272 - DNA, 16 bp, Homo sapiens
gaaaattattctataa

SEQ ID NO: 1227273 - DNA, 13 bp, Homo sapiens
gaaaattatttaa

SEQ ID NO: 1227274 - DNA, 16 bp, Homo sapiens
gaaaattatttgcata

SEQ ID NO: 1227275 - DNA, 20 bp, Homo sapiens
gaaaattcaaaaagtgttta

SEQ ID NO: 1227276 - DNA, 22 bp, Homo sapiens
gaaaattcaaaaagtgtttatt

SEQ ID NO: 1227277 - DNA, 13 bp, Homo sapiens
gaaaattcatttt

SEQ ID NO: 1227278 - DNA, 18 bp, Homo sapiens
gaaaattcctataaggaa

SEQ ID NO: 1227279 - DNA, 18 bp, Homo sapiens
gaaaattgaaagtattca

SEQ ID NO: 1227280 - DNA, 19 bp, Homo sapiens
gaaaattgaaataaagcta

SEQ ID NO: 1227281 - DNA, 13 bp, Homo sapiens
gaaaatttaacag

SEQ ID NO: 1227282 - DNA, 18 bp, Homo sapiens
gaaaatttacaaaattta

SEQ ID NO: 1227283 - DNA, 23 bp, Homo sapiens
gaaaatttacaaaatttattctc

SEQ ID NO: 1227284 - DNA, 20 bp, Homo sapiens
gaaaatttagccctttaaaa

SEQ ID NO: 1227285 - DNA, 15 bp, Homo sapiens
gaaaatttgctttaa

SEQ ID NO: 1227286 - DNA, 19 bp, Homo sapiens
gaaaattttaaaaatacat

SEQ ID NO: 1227287 - DNA, 21 bp, Homo sapiens
gaaaattttaaaaatacatat

SEQ ID NO: 1227288 - DNA, 16 bp, Homo sapiens
gaaaatttttgtagta

SEQ ID NO: 1227289 - DNA, 18 bp, Homo sapiens
gaaacaaaaaaaaaatga

SEQ ID NO: 1227290 - DNA, 23 bp, Homo sapiens
gaaacaaaaacactaaaaataaa

SEQ ID NO: 1227291 - DNA, 18 bp, Homo sapiens
gaaacaaaaagagctttc

SEQ ID NO: 1227292 - DNA, 14 bp, Homo sapiens
gaaacaaagaaggt

SEQ ID NO: 1227293 - DNA, 17 bp, Homo sapiens
gaaacaaagtactcttt

SEQ ID NO: 1227294 - DNA, 19 bp, Homo sapiens
gaaacaaataatcacattg

SEQ ID NO: 1227295 - DNA, 19 bp, Homo sapiens
gaaacaacacccaagatga

SEQ ID NO: 1227296 - DNA, 21 bp, Homo sapiens
gaaacaacagctttaaaagaa

SEQ ID NO: 1227297 - DNA, 18 bp, Homo sapiens
gaaacaacatttatatgt

SEQ ID NO: 1227298 - DNA, 17 bp, Homo sapiens
gaaacaactctttgaga

SEQ ID NO: 1227299 - DNA, 20 bp, Homo sapiens
gaaacaactctttgagaaac

SEQ ID NO: 1227300 - DNA, 13 bp, Homo sapiens
gaaacaagctgtg

SEQ ID NO: 1227301 - DNA, 14 bp, Homo sapiens
gaaacaagctgtgc

SEQ ID NO: 1227302 - DNA, 15 bp, Homo sapiens
gaaacacaatatttt

SEQ ID NO: 1227303 - DNA, 11 bp, Homo sapiens
gaaacacacga

SEQ ID NO: 1227304 - DNA, 14 bp, Homo sapiens
gaaacacacgtgct

SEQ ID NO: 1227305 - DNA, 13 bp, Homo sapiens
gaaacacagaaac

SEQ ID NO: 1227306 - DNA, 14 bp, Homo sapiens
gaaacacagggttt

SEQ ID NO: 1227307 - DNA, 17 bp, Homo sapiens
gaaacacatgccagttt

SEQ ID NO: 1227308 - DNA, 17 bp, Homo sapiens
gaaacacgaaacttgtt

SEQ ID NO: 1227309 - DNA, 22 bp, Homo sapiens
gaaacacgaaacttgttattgt

SEQ ID NO: 1227310 - DNA, 19 bp, Homo sapiens
gaaacacgcggatctgaac

SEQ ID NO: 1227311 - DNA, 19 bp, Homo sapiens
gaaacactaaggctgcttc

SEQ ID NO: 1227312 - DNA, 11 bp, Homo sapiens
gaaacactgga

SEQ ID NO: 1227313 - DNA, 15 bp, Homo sapiens
gaaacactggacctg

SEQ ID NO: 1227314 - DNA, 16 bp, Homo sapiens
gaaacactggacctgg

SEQ ID NO: 1227315 - DNA, 14 bp, Homo sapiens
gaaacactttctct

SEQ ID NO: 1227316 - DNA, 14 bp, Homo sapiens
gaaacagaaacaaa

SEQ ID NO: 1227317 - DNA, 13 bp, Homo sapiens
gaaacagaaatag

SEQ ID NO: 1227318 - DNA, 13 bp, Homo sapiens
gaaacagagaaag

SEQ ID NO: 1227319 - DNA, 22 bp, Homo sapiens
gaaacagagaaagaaaaggcaa

SEQ ID NO: 1227320 - DNA, 16 bp, Homo sapiens
gaaacagagacaggcc

SEQ ID NO: 1227321 - DNA, 17 bp, Homo sapiens
gaaacagagacaggccc

SEQ ID NO: 1227322 - DNA, 12 bp, Homo sapiens
gaaacagaggct

SEQ ID NO: 1227323 - DNA, 17 bp, Homo sapiens
gaaacagagtggcctcc

SEQ ID NO: 1227324 - DNA, 20 bp, Homo sapiens
gaaacagagtggcctccctg

SEQ ID NO: 1227325 - DNA, 15 bp, Homo sapiens
gaaacagatgataaa

SEQ ID NO: 1227326 - DNA, 21 bp, Homo sapiens
gaaacagatgataaatattta

SEQ ID NO: 1227327 - DNA, 21 bp, Homo sapiens
gaaacagattcaggccagccc

SEQ ID NO: 1227328 - DNA, 16 bp, Homo sapiens
gaaacagcagtcccag

SEQ ID NO: 1227329 - DNA, 11 bp, Homo sapiens
gaaacagcatg

SEQ ID NO: 1227330 - DNA, 13 bp, Homo sapiens
gaaacagcatgaa

SEQ ID NO: 1227331 - DNA, 14 bp, Homo sapiens
gaaacagcatgaat

SEQ ID NO: 1227332 - DNA, 15 bp, Homo sapiens
gaaacagccagcaag

SEQ ID NO: 1227333 - DNA, 18 bp, Homo sapiens
gaaacagccatgtccaag

SEQ ID NO: 1227334 - DNA, 13 bp, Homo sapiens
gaaacagctgctt

SEQ ID NO: 1227335 - DNA, 14 bp, Homo sapiens
gaaacaggccctct

SEQ ID NO: 1227336 - DNA, 17 bp, Homo sapiens
gaaacaggccctctgtg

SEQ ID NO: 1227337 - DNA, 14 bp, Homo sapiens
gaaacagggcagca

SEQ ID NO: 1227338 - DNA, 16 bp, Homo sapiens
gaaacaggtctgtttt

SEQ ID NO: 1227339 - DNA, 18 bp, Homo sapiens
gaaacagtgggagccctg

SEQ ID NO: 1227340 - DNA, 17 bp, Homo sapiens
gaaacagttccatttat

SEQ ID NO: 1227341 - DNA, 15 bp, Homo sapiens
gaaacagttctcact

SEQ ID NO: 1227342 - DNA, 18 bp, Homo sapiens
gaaacagttctcactggg

SEQ ID NO: 1227343 - DNA, 21 bp, Homo sapiens
gaaacagttctcactgggaag

SEQ ID NO: 1227344 - DNA, 17 bp, Homo sapiens
gaaacagttgctgtgaa

SEQ ID NO: 1227345 - DNA, 18 bp, Homo sapiens
gaaacagttggtaacttt

SEQ ID NO: 1227346 - DNA, 19 bp, Homo sapiens
gaaacagttggtaactttt

SEQ ID NO: 1227347 - DNA, 12 bp, Homo sapiens
gaaacatatcat

SEQ ID NO: 1227348 - DNA, 20 bp, Homo sapiens
gaaacatcagttactctgaa

SEQ ID NO: 1227349 - DNA, 13 bp, Homo sapiens
gaaacatctctgg

SEQ ID NO: 1227350 - DNA, 17 bp, Homo sapiens
gaaacatgaagcataat

SEQ ID NO: 1227351 - DNA, 19 bp, Homo sapiens
gaaacattagtgaaaattc

SEQ ID NO: 1227352 - DNA, 19 bp, Homo sapiens
gaaacattccgaagaggga

SEQ ID NO: 1227353 - DNA, 20 bp, Homo sapiens
gaaacatttcagaaggtatc

SEQ ID NO: 1227354 - DNA, 23 bp, Homo sapiens
gaaacatttcagaaggtatcagt

SEQ ID NO: 1227355 - DNA, 12 bp, Homo sapiens
gaaacatttcct

SEQ ID NO: 1227356 - DNA, 20 bp, Homo sapiens
gaaacattttatcattaaaa

SEQ ID NO: 1227357 - DNA, 13 bp, Homo sapiens
gaaaccaaaacat

SEQ ID NO: 1227358 - DNA, 16 bp, Homo sapiens
gaaaccaaagaagaaa

SEQ ID NO: 1227359 - DNA, 22 bp, Homo sapiens
gaaaccaagtcaggccaggtgg

SEQ ID NO: 1227360 - DNA, 18 bp, Homo sapiens
gaaaccaagtgggctggt

SEQ ID NO: 1227361 - DNA, 17 bp, Homo sapiens
gaaaccacacttcttga

SEQ ID NO: 1227362 - DNA, 21 bp, Homo sapiens
gaaaccacacttcttgaaaca

SEQ ID NO: 1227363 - DNA, 19 bp, Homo sapiens
gaaaccaccgtgaaccaga

SEQ ID NO: 1227364 - DNA, 16 bp, Homo sapiens
gaaaccagaaaagcaa

SEQ ID NO: 1227365 - DNA, 22 bp, Homo sapiens
gaaaccagcttttactgttttt

SEQ ID NO: 1227366 - DNA, 17 bp, Homo sapiens
gaaacccaaagccctgg

SEQ ID NO: 1227367 - DNA, 20 bp, Homo sapiens
gaaacccaaagccctggtaa

SEQ ID NO: 1227368 - DNA, 17 bp, Homo sapiens
gaaacccaagctcctcc

SEQ ID NO: 1227369 - DNA, 23 bp, Homo sapiens
gaaacccacagatgtctctgggg

SEQ ID NO: 1227370 - DNA, 17 bp, Homo sapiens
gaaaccccgtctctact

SEQ ID NO: 1227371 - DNA, 15 bp, Homo sapiens
gaaacccgccctcag

SEQ ID NO: 1227372 - DNA, 16 bp, Homo sapiens
gaaacccggcttcctg

SEQ ID NO: 1227373 - DNA, 22 bp, Homo sapiens
gaaacccgtctctactaaaaat

SEQ ID NO: 1227374 - DNA, 15 bp, Homo sapiens
gaaaccctatttccc

SEQ ID NO: 1227375 - DNA, 14 bp, Homo sapiens
gaaaccgcttttgg

SEQ ID NO: 1227376 - DNA, 14 bp, Homo sapiens
gaaaccgggagaag

SEQ ID NO: 1227377 - DNA, 15 bp, Homo sapiens
gaaacctaactgcaa

SEQ ID NO: 1227378 - DNA, 17 bp, Homo sapiens
gaaacctacaagatttc

SEQ ID NO: 1227379 - DNA, 18 bp, Homo sapiens
gaaacctacaagatttcc

SEQ ID NO: 1227380 - DNA, 18 bp, Homo sapiens
gaaacctagtactgcccc

SEQ ID NO: 1227381 - DNA, 19 bp, Homo sapiens
gaaacctatctcagggagg

SEQ ID NO: 1227382 - DNA, 19 bp, Homo sapiens
gaaacctcacccttgcacc

SEQ ID NO: 1227383 - DNA, 21 bp, Homo sapiens
gaaacctcagggctgtcccag

SEQ ID NO: 1227384 - DNA, 12 bp, Homo sapiens
gaaacctgagat

SEQ ID NO: 1227385 - DNA, 18 bp, Homo sapiens
gaaacctgccctgcctga

SEQ ID NO: 1227386 - DNA, 20 bp, Homo sapiens
gaaacctgcctttgtatgtg

SEQ ID NO: 1227387 - DNA, 18 bp, Homo sapiens
gaaacctgtcattgtatt

SEQ ID NO: 1227388 - DNA, 19 bp, Homo sapiens
gaaaccttagtttcaagag

SEQ ID NO: 1227389 - DNA, 19 bp, Homo sapiens
gaaagccacacggagaggc

SEQ ID NO: 1227390 - DNA, 13 bp, Homo sapiens
gaaagccacatct

SEQ ID NO: 1227391 - DNA, 14 bp, Homo sapiens
gaaagccacatctt

SEQ ID NO: 1227392 - DNA, 15 bp, Homo sapiens
gaaagccacctctcc

SEQ ID NO: 1227393 - DNA, 15 bp, Homo sapiens
gaaagccaccttgtt

SEQ ID NO: 1227394 - DNA, 15 bp, Homo sapiens
gaaagccagacaact

SEQ ID NO: 1227395 - DNA, 15 bp, Homo sapiens
gaaagccatattcca

SEQ ID NO: 1227396 - DNA, 13 bp, Homo sapiens
gaaagcccacctg

SEQ ID NO: 1227397 - DNA, 15 bp, Homo sapiens
gaaagcccacctggg

SEQ ID NO: 1227398 - DNA, 19 bp, Homo sapiens
gaaagcccacctgggctgg

SEQ ID NO: 1227399 - DNA, 14 bp, Homo sapiens
gaaagccctccccc

SEQ ID NO: 1227400 - DNA, 21 bp, Homo sapiens
gaaagccctgagctttctgct

SEQ ID NO: 1227401 - DNA, 15 bp, Homo sapiens
gaaagcctcctgccc

SEQ ID NO: 1227402 - DNA, 21 bp, Homo sapiens
gaaagcctcctgccccctgcc

SEQ ID NO: 1227403 - DNA, 16 bp, Homo sapiens
gaaagcctctgctgcc

SEQ ID NO: 1227404 - DNA, 15 bp, Homo sapiens
gaaagcctgtctctt

SEQ ID NO: 1227405 - DNA, 16 bp, Homo sapiens
gaaagccttagggaag

SEQ ID NO: 1227406 - DNA, 22 bp, Homo sapiens
gaaagcctttcctcggtctccc

SEQ ID NO: 1227407 - DNA, 20 bp, Homo sapiens
gaaagcgcccctcactcctg

SEQ ID NO: 1227408 - DNA, 17 bp, Homo sapiens
gaaagcggagttcctaa

SEQ ID NO: 1227409 - DNA, 14 bp, Homo sapiens
gaaagcgggcagcc

SEQ ID NO: 1227410 - DNA, 22 bp, Homo sapiens
gaccaggggtgatttcagagag

SEQ ID NO: 1227411 - DNA, 23 bp, Homo sapiens
gaccaggtcttggagctgagcct

SEQ ID NO: 1227412 - DNA, 14 bp, Homo sapiens
gaccagtactggga

SEQ ID NO: 1227413 - DNA, 15 bp, Homo sapiens
gaccagtactgggaa

SEQ ID NO: 1227414 - DNA, 15 bp, Homo sapiens
gaccagtgggatggg

SEQ ID NO: 1227415 - DNA, 16 bp, Homo sapiens
gaccagtgggatgggc

SEQ ID NO: 1227416 - DNA, 14 bp, Homo sapiens
gaccagttgggagc

SEQ ID NO: 1227417 - DNA, 15 bp, Homo sapiens
gaccagttgggagca

SEQ ID NO: 1227418 - DNA, 13 bp, Homo sapiens
gaccagtttgcag

SEQ ID NO: 1227419 - DNA, 22 bp, Homo sapiens
gaccataaagggtgtaggggcc

SEQ ID NO: 1227420 - DNA, 16 bp, Homo sapiens
gaccataacagccaac

SEQ ID NO: 1227421 - DNA, 21 bp, Homo sapiens
gaccatccactctaccctccc

SEQ ID NO: 1227422 - DNA, 21 bp, Homo sapiens
gaccatccagaggaataaaaa

SEQ ID NO: 1227423 - DNA, 12 bp, Homo sapiens
gaccatccctga

SEQ ID NO: 1227424 - DNA, 15 bp, Homo sapiens
gaccatcctggcccc

SEQ ID NO: 1227425 - DNA, 14 bp, Homo sapiens
gaccatcgtccagc

SEQ ID NO: 1227426 - DNA, 15 bp, Homo sapiens
gaccatcgtccagcc

SEQ ID NO: 1227427 - DNA, 16 bp, Homo sapiens
gaccatcgtccagccc

SEQ ID NO: 1227428 - DNA, 17 bp, Homo sapiens
gaccatcgtccagccct

SEQ ID NO: 1227429 - DNA, 20 bp, Homo sapiens
gaccatcgtccagccctcct

SEQ ID NO: 1227430 - DNA, 14 bp, Homo sapiens
gaccatgccagatt

SEQ ID NO: 1227431 - DNA, 18 bp, Homo sapiens
gaccatgcgtcaggggcc

SEQ ID NO: 1227432 - DNA, 21 bp, Homo sapiens
gaccatgctcatctgctggtc

SEQ ID NO: 1227433 - DNA, 22 bp, Homo sapiens
gaccatgctcatctgctggtcc

SEQ ID NO: 1227434 - DNA, 16 bp, Homo sapiens
gaccatggacactaca

SEQ ID NO: 1227435 - DNA, 22 bp, Homo sapiens
gaccatggttttggctctccca

SEQ ID NO: 1227436 - DNA, 12 bp, Homo sapiens
gaccatgtggcc

SEQ ID NO: 1227437 - DNA, 14 bp, Homo sapiens
gaccatgttcatta

SEQ ID NO: 1227438 - DNA, 23 bp, Homo sapiens
gaccatgttcattataatctcaa

SEQ ID NO: 1227439 - DNA, 15 bp, Homo sapiens
gaccattcctgtccc

SEQ ID NO: 1227440 - DNA, 16 bp, Homo sapiens
gaccattgacctcagc

SEQ ID NO: 1227441 - DNA, 16 bp, Homo sapiens
gaccattggctgcgct

SEQ ID NO: 1227442 - DNA, 17 bp, Homo sapiens
gaccattttagttttaa

SEQ ID NO: 1227443 - DNA, 12 bp, Homo sapiens
gacccaaagacc

SEQ ID NO: 1227444 - DNA, 21 bp, Homo sapiens
gacccaaattataagggccct

SEQ ID NO: 1227445 - DNA, 22 bp, Homo sapiens
gacccaaattataagggccctg

SEQ ID NO: 1227446 - DNA, 13 bp, Homo sapiens
gacccaaggagga

SEQ ID NO: 1227447 - DNA, 17 bp, Homo sapiens
gacccaagtcaaagatg

SEQ ID NO: 1227448 - DNA, 16 bp, Homo sapiens
gacccacagctctggg

SEQ ID NO: 1227449 - DNA, 14 bp, Homo sapiens
gacccaccccaact

SEQ ID NO: 1227450 - DNA, 15 bp, Homo sapiens
gacccaccccaactc

SEQ ID NO: 1227451 - DNA, 14 bp, Homo sapiens
gacccacccctgtg

SEQ ID NO: 1227452 - DNA, 16 bp, Homo sapiens
gacccacccctgtgct

SEQ ID NO: 1227453 - DNA, 18 bp, Homo sapiens
gacccacccctgtgctcc

SEQ ID NO: 1227454 - DNA, 15 bp, Homo sapiens
gacccacctggagcc

SEQ ID NO: 1227455 - DNA, 20 bp, Homo sapiens
gacccacgaaactgccctgg

SEQ ID NO: 1227456 - DNA, 22 bp, Homo sapiens
gacccacgaaactgccctggct

SEQ ID NO: 1227457 - DNA, 16 bp, Homo sapiens
gacccactctgcggcc

SEQ ID NO: 1227458 - DNA, 20 bp, Homo sapiens
gacccagaatggagcctgct

SEQ ID NO: 1227459 - DNA, 22 bp, Homo sapiens
gacccagagaaggacggtgcca

SEQ ID NO: 1227460 - DNA, 14 bp, Homo sapiens
gacccagaggccct

SEQ ID NO: 1227461 - DNA, 18 bp, Homo sapiens
gacccagagtggagtctg

SEQ ID NO: 1227462 - DNA, 16 bp, Homo sapiens
gacccagatcctcaca

SEQ ID NO: 1227463 - DNA, 15 bp, Homo sapiens
gacccagcatctccc

SEQ ID NO: 1227464 - DNA, 11 bp, Homo sapiens
gacccagccag

SEQ ID NO: 1227465 - DNA, 12 bp, Homo sapiens
gacccagccagc

SEQ ID NO: 1227466 - DNA, 19 bp, Homo sapiens
gacccagccagctgcaggg

SEQ ID NO: 1227467 - DNA, 21 bp, Homo sapiens
gacccagccagctgcagggca

SEQ ID NO: 1227468 - DNA, 23 bp, Homo sapiens
gacccagccagctgcagggcacg

SEQ ID NO: 1227469 - DNA, 23 bp, Homo sapiens
gacccagccccttgagaaacctt

SEQ ID NO: 1227470 - DNA, 16 bp, Homo sapiens
gacccagccctcatcc

SEQ ID NO: 1227471 - DNA, 18 bp, Homo sapiens
gacccagctactctgtcc

SEQ ID NO: 1227472 - DNA, 21 bp, Homo sapiens
gacccagctactctgtccagg

SEQ ID NO: 1227473 - DNA, 23 bp, Homo sapiens
gacccagctactctgtccaggcc

SEQ ID NO: 1227474 - DNA, 23 bp, Homo sapiens
gacccagctactgaaccagccac

SEQ ID NO: 1227475 - DNA, 11 bp, Homo sapiens
gacccagctcc

SEQ ID NO: 1227476 - DNA, 16 bp, Homo sapiens
gacccagctcctctga

SEQ ID NO: 1227477 - DNA, 20 bp, Homo sapiens
gacccagctcctctgagcca

SEQ ID NO: 1227478 - DNA, 18 bp, Homo sapiens
gacccagcttagagttct

SEQ ID NO: 1227479 - DNA, 19 bp, Homo sapiens
gacccagcttagagttctt

SEQ ID NO: 1227480 - DNA, 21 bp, Homo sapiens
gacccaggaaaggcaggattg

SEQ ID NO: 1227481 - DNA, 22 bp, Homo sapiens
gacccaggaatagtggacatgg

SEQ ID NO: 1227482 - DNA, 18 bp, Homo sapiens
gacccaggacccccgagg

SEQ ID NO: 1227483 - DNA, 11 bp, Homo sapiens
gacccaggccc

SEQ ID NO: 1227484 - DNA, 15 bp, Homo sapiens
gacccaggccctcca

SEQ ID NO: 1227485 - DNA, 18 bp, Homo sapiens
gacccaggccctccatgg

SEQ ID NO: 1227486 - DNA, 22 bp, Homo sapiens
gacccaggccgcagctcttgcc

SEQ ID NO: 1227487 - DNA, 18 bp, Homo sapiens
gacccaggctccgccctt

SEQ ID NO: 1227488 - DNA, 13 bp, Homo sapiens
gacccagggccta

SEQ ID NO: 1227489 - DNA, 14 bp, Homo sapiens
gacccagggcctga

SEQ ID NO: 1227490 - DNA, 17 bp, Homo sapiens
gacccagggcctgactt

SEQ ID NO: 1227491 - DNA, 21 bp, Homo sapiens
gacccagggcctgacttgagc

SEQ ID NO: 1227492 - DNA, 23 bp, Homo sapiens
gacccagggcctgacttgagcca

SEQ ID NO: 1227493 - DNA, 16 bp, Homo sapiens
gacccagggtcccctc

SEQ ID NO: 1227494 - DNA, 17 bp, Homo sapiens
gacccagggtcccctcc

SEQ ID NO: 1227495 - DNA, 20 bp, Homo sapiens
gacccagtcccacactgtgg

SEQ ID NO: 1227496 - DNA, 14 bp, Homo sapiens
gacccagtccctgg

SEQ ID NO: 1227497 - DNA, 17 bp, Homo sapiens
gacccagtgcactccgg

SEQ ID NO: 1227498 - DNA, 23 bp, Homo sapiens
gacccatcccttttcctttctgg

SEQ ID NO: 1227499 - DNA, 23 bp, Homo sapiens
gacccatgagttggggtctggca

SEQ ID NO: 1227500 - DNA, 18 bp, Homo sapiens
gacccatgggggctgtct

SEQ ID NO: 1227501 - DNA, 22 bp, Homo sapiens
gacccatgggggctgtctttgc

SEQ ID NO: 1227502 - DNA, 16 bp, Homo sapiens
gaccccaaagagcctg

SEQ ID NO: 1227503 - DNA, 18 bp, Homo sapiens
gaccccaaagagcctgga

SEQ ID NO: 1227504 - DNA, 23 bp, Homo sapiens
gaccccaaagagcctggagaagc

SEQ ID NO: 1227505 - DNA, 14 bp, Homo sapiens
gaccccacccaagc

SEQ ID NO: 1227506 - DNA, 20 bp, Homo sapiens
gaccccacccaagcttggca

SEQ ID NO: 1227507 - DNA, 17 bp, Homo sapiens
gaccccactggctgaga

SEQ ID NO: 1227508 - DNA, 12 bp, Homo sapiens
gaccccagactg

SEQ ID NO: 1227509 - DNA, 15 bp, Homo sapiens
gaccccagccatcca

SEQ ID NO: 1227510 - DNA, 19 bp, Homo sapiens
gaccccagcggctgagtca

SEQ ID NO: 1227511 - DNA, 12 bp, Homo sapiens
gaccccagctct

SEQ ID NO: 1227512 - DNA, 13 bp, Homo sapiens
gaccccagctggg

SEQ ID NO: 1227513 - DNA, 14 bp, Homo sapiens
gaccccagctggga

SEQ ID NO: 1227514 - DNA, 15 bp, Homo sapiens
gaccccagctgggag

SEQ ID NO: 1227515 - DNA, 16 bp, Homo sapiens
gaccccagctgggagg

SEQ ID NO: 1227516 - DNA, 19 bp, Homo sapiens
gaccccagggcctgtctcc

SEQ ID NO: 1227517 - DNA, 13 bp, Homo sapiens
gaccccagggtgg

SEQ ID NO: 1227518 - DNA, 22 bp, Homo sapiens
gaccccagtcgtgatgtggagg

SEQ ID NO: 1227519 - DNA, 12 bp, Homo sapiens
gacccccaacca

SEQ ID NO: 1227520 - DNA, 21 bp, Homo sapiens
gacccccaaccaagtggctcc

SEQ ID NO: 1227521 - DNA, 15 bp, Homo sapiens
gacccccacacctca

SEQ ID NO: 1227522 - DNA, 15 bp, Homo sapiens
gacccccaccccttc

SEQ ID NO: 1227523 - DNA, 17 bp, Homo sapiens
gacccccaccccttccc

SEQ ID NO: 1227524 - DNA, 22 bp, Homo sapiens
gacccccaccccttccccactg

SEQ ID NO: 1227525 - DNA, 17 bp, Homo sapiens
gacccccaggcagaggg

SEQ ID NO: 1227526 - DNA, 14 bp, Homo sapiens
gacccccaggcctg

SEQ ID NO: 1227527 - DNA, 22 bp, Homo sapiens
gacccccaggcctgtccaccct

SEQ ID NO: 1227528 - DNA, 21 bp, Homo sapiens
gacccccccccaatcggactg

SEQ ID NO: 1227529 - DNA, 16 bp, Homo sapiens
gacccccgcagaggca

SEQ ID NO: 1227530 - DNA, 17 bp, Homo sapiens
gacccccgcagaggcag

SEQ ID NO: 1227531 - DNA, 14 bp, Homo sapiens
gacccccgtcagct

SEQ ID NO: 1227532 - DNA, 14 bp, Homo sapiens
gaccccctcccctg

SEQ ID NO: 1227533 - DNA, 16 bp, Homo sapiens
gaccccctcgccagct

SEQ ID NO: 1227534 - DNA, 14 bp, Homo sapiens
gacccccttcccct

SEQ ID NO: 1227535 - DNA, 18 bp, Homo sapiens
gaccccgagaagtgctct

SEQ ID NO: 1227536 - DNA, 14 bp, Homo sapiens
gaccccgagggctg

SEQ ID NO: 1227537 - DNA, 22 bp, Homo sapiens
gaccccgagggctgaggagcag

SEQ ID NO: 1227538 - DNA, 15 bp, Homo sapiens
gaccccgcactgcag

SEQ ID NO: 1227539 - DNA, 13 bp, Homo sapiens
gaccccgcccctg

SEQ ID NO: 1227540 - DNA, 23 bp, Homo sapiens
gaccccggaggcgtggaggagag

SEQ ID NO: 1227541 - DNA, 18 bp, Homo sapiens
gaccccggggggctggga

SEQ ID NO: 1227542 - DNA, 17 bp, Homo sapiens
gaccccgtggctctggg

SEQ ID NO: 1227543 - DNA, 21 bp, Homo sapiens
gaccccgtggctctgggagag

SEQ ID NO: 1227544 - DNA, 15 bp, Homo sapiens
gacccctcaccaccc

SEQ ID NO: 1227545 - DNA, 16 bp, Homo sapiens
gacccctcaccacccc

SEQ ID NO: 1227546 - DNA, 14 bp, Homo sapiens
gacccctcaccttg

SEQ ID NO: 1227547 - DNA, 19 bp, Homo sapiens
gacccctccctgcaggggc

SEQ ID NO: 1227548 - DNA, 17 bp, Homo sapiens
gacccctcgcaaccctg

SEQ ID NO: 1227549 - DNA, 13 bp, Homo sapiens
gacccctctggcc

SEQ ID NO: 1227550 - DNA, 20 bp, Homo sapiens
gacccctctggccaggatgg

SEQ ID NO: 1227551 - DNA, 11 bp, Homo sapiens
gacccctgcct

SEQ ID NO: 1227552 - DNA, 14 bp, Homo sapiens
gacccctgccttcc

SEQ ID NO: 1227553 - DNA, 17 bp, Homo sapiens
gacccctgccttcctct

SEQ ID NO: 1227554 - DNA, 23 bp, Homo sapiens
gacccctgctcagtaaagcactt

SEQ ID NO: 1227555 - DNA, 19 bp, Homo sapiens
gacccctgctcccagcctg

SEQ ID NO: 1227556 - DNA, 20 bp, Homo sapiens
gacccctgctcccagcctgc

SEQ ID NO: 1227557 - DNA, 21 bp, Homo sapiens
gacccctgctcccagcctgct

SEQ ID NO: 1227558 - DNA, 16 bp, Homo sapiens
gacccctggctctggg

SEQ ID NO: 1227559 - DNA, 13 bp, Homo sapiens
gacccctggcttt

SEQ ID NO: 1227560 - DNA, 22 bp, Homo sapiens
gacccctggggtggccagggct

SEQ ID NO: 1227561 - DNA, 15 bp, Homo sapiens
gaccccttgctccct

SEQ ID NO: 1227562 - DNA, 17 bp, Homo sapiens
gaccccttgttgcactg

SEQ ID NO: 1227563 - DNA, 18 bp, Homo sapiens
gaccccttgttgcactgc

SEQ ID NO: 1227564 - DNA, 20 bp, Homo sapiens
gacccctttgagagacgcca

SEQ ID NO: 1227565 - DNA, 21 bp, Homo sapiens
gacccctttgagagacgccac

SEQ ID NO: 1227566 - DNA, 13 bp, Homo sapiens
gacccgccagccc

SEQ ID NO: 1227567 - DNA, 14 bp, Homo sapiens
gacccgccagcccc

SEQ ID NO: 1227568 - DNA, 15 bp, Homo sapiens
gacccgccagccccg

SEQ ID NO: 1227569 - DNA, 23 bp, Homo sapiens
gacccggagctaacactggcccc

SEQ ID NO: 1227570 - DNA, 23 bp, Homo sapiens
gacccggccgccgccaggactgt

SEQ ID NO: 1227571 - DNA, 15 bp, Homo sapiens
gacccggggtctcct

SEQ ID NO: 1227572 - DNA, 21 bp, Homo sapiens
gacccggttattcgcccaccc

SEQ ID NO: 1227573 - DNA, 14 bp, Homo sapiens
gaccctacaggaga

SEQ ID NO: 1227574 - DNA, 11 bp, Homo sapiens
gaccctacccc

SEQ ID NO: 1227575 - DNA, 20 bp, Homo sapiens
gaccctactgaagtggctgg

SEQ ID NO: 1227576 - DNA, 18 bp, Homo sapiens
gaccctatgggtctagga

SEQ ID NO: 1227577 - DNA, 20 bp, Homo sapiens
gaccctatgggtctaggaca

SEQ ID NO: 1227578 - DNA, 16 bp, Homo sapiens
gaccctcagctgtcac

SEQ ID NO: 1227579 - DNA, 23 bp, Homo sapiens
gaccctcaggtgtagctgagctg

SEQ ID NO: 1227580 - DNA, 14 bp, Homo sapiens
gaccctccactcac

SEQ ID NO: 1227581 - DNA, 13 bp, Homo sapiens
gaccctccagagg

SEQ ID NO: 1227582 - DNA, 21 bp, Homo sapiens
gaccctcccactcccatctcc

SEQ ID NO: 1227583 - DNA, 22 bp, Homo sapiens
gaccctcccactcccatctcct

SEQ ID NO: 1227584 - DNA, 21 bp, Homo sapiens
gaccctcccagtctcatctcc

SEQ ID NO: 1227585 - DNA, 23 bp, Homo sapiens
gaccctcccagtctcatctcctg

SEQ ID NO: 1227586 - DNA, 11 bp, Homo sapiens
gaccctcccca

SEQ ID NO: 1227587 - DNA, 24 bp, Homo sapiens
gaccctccccaaggatgaccacac

SEQ ID NO: 1227588 - DNA, 19 bp, Homo sapiens
gaccctcctggccttcctc

SEQ ID NO: 1227589 - DNA, 14 bp, Homo sapiens
gaccctcgcagacc

SEQ ID NO: 1227590 - DNA, 16 bp, Homo sapiens
gaccctcgggccccat

SEQ ID NO: 1227591 - DNA, 20 bp, Homo sapiens
gaccctctgaatggtccagg

SEQ ID NO: 1227592 - DNA, 23 bp, Homo sapiens
gaccctctgaatggtccagggtt

SEQ ID NO: 1227593 - DNA, 20 bp, Homo sapiens
gaccctctgaccctagctct

SEQ ID NO: 1227594 - DNA, 12 bp, Homo sapiens
gaccctctgtcc

SEQ ID NO: 1227595 - DNA, 16 bp, Homo sapiens
gaccctctgtccccag

SEQ ID NO: 1227596 - DNA, 19 bp, Homo sapiens
gaccctctgtccccaggcc

SEQ ID NO: 1227597 - DNA, 23 bp, Homo sapiens
gaccctctgtccccaggcctggc

SEQ ID NO: 1227598 - DNA, 13 bp, Homo sapiens
gaccctcttgccc

SEQ ID NO: 1227599 - DNA, 21 bp, Homo sapiens
gaccctgaaaggaacactggc

SEQ ID NO: 1227600 - DNA, 16 bp, Homo sapiens
gaccctgacctccgcc

SEQ ID NO: 1227601 - DNA, 20 bp, Homo sapiens
gaccctgacctccgcccctg

SEQ ID NO: 1227602 - DNA, 22 bp, Homo sapiens
gaccctgacctccgcccctgcc

SEQ ID NO: 1227603 - DNA, 13 bp, Homo sapiens
gaccctgagactc

SEQ ID NO: 1227604 - DNA, 17 bp, Homo sapiens
gaccctgagactccaga

SEQ ID NO: 1227605 - DNA, 15 bp, Homo sapiens
gaccctgaggaggcc

SEQ ID NO: 1227606 - DNA, 20 bp, Homo sapiens
gaccctgaggccctgggctg

SEQ ID NO: 1227607 - DNA, 23 bp, Homo sapiens
gaccctgaggccctgggctgggt

SEQ ID NO: 1227608 - DNA, 18 bp, Homo sapiens
gaccctgcaaacagaaca

SEQ ID NO: 1227609 - DNA, 21 bp, Homo sapiens
gaccctgcaagaccacggagg

SEQ ID NO: 1227610 - DNA, 14 bp, Homo sapiens
gaccctgcaccctc

SEQ ID NO: 1227611 - DNA, 16 bp, Homo sapiens
gaccctgcaccctcct

SEQ ID NO: 1227612 - DNA, 13 bp, Homo sapiens
gaccctgccacag

SEQ ID NO: 1227613 - DNA, 15 bp, Homo sapiens
gaccctgccacagcc

SEQ ID NO: 1227614 - DNA, 17 bp, Homo sapiens
gaccctgccacagccag

SEQ ID NO: 1227615 - DNA, 18 bp, Homo sapiens
gaccctgccacagccaga

SEQ ID NO: 1227616 - DNA, 17 bp, Homo sapiens
gaccctgccgagggggc

SEQ ID NO: 1227617 - DNA, 21 bp, Homo sapiens
gaccctgcctgagcccaggag

SEQ ID NO: 1227618 - DNA, 23 bp, Homo sapiens
gaccctgcctgagcccaggagct

SEQ ID NO: 1227619 - DNA, 20 bp, Homo sapiens
gaccctgcgaaggggccctg

SEQ ID NO: 1227620 - DNA, 13 bp, Homo sapiens
gacctcgtcctcc

SEQ ID NO: 1227621 - DNA, 15 bp, Homo sapiens
gacctcgtcctcccc

SEQ ID NO: 1227622 - DNA, 17 bp, Homo sapiens
gacctcgtcctccccct

SEQ ID NO: 1227623 - DNA, 22 bp, Homo sapiens
gacctcgtcctccccctgccag

SEQ ID NO: 1227624 - DNA, 18 bp, Homo sapiens
gacctcgtgccaccccga

SEQ ID NO: 1227625 - DNA, 17 bp, Homo sapiens
gacctcgtttgggagtg

SEQ ID NO: 1227626 - DNA, 17 bp, Homo sapiens
gacctctctgcctctct

SEQ ID NO: 1227627 - DNA, 16 bp, Homo sapiens
gacctctgcagcaata

SEQ ID NO: 1227628 - DNA, 11 bp, Homo sapiens
gacctctgctg

SEQ ID NO: 1227629 - DNA, 23 bp, Homo sapiens
gacctctgctgagtgctgggcac

SEQ ID NO: 1227630 - DNA, 22 bp, Homo sapiens
gacctctgtaggcagcagagag

SEQ ID NO: 1227631 - DNA, 14 bp, Homo sapiens
gacctcttgctgtc

SEQ ID NO: 1227632 - DNA, 18 bp, Homo sapiens
gacctcttgctgtctctg

SEQ ID NO: 1227633 - DNA, 20 bp, Homo sapiens
gacctcttgctgtctctgct

SEQ ID NO: 1227634 - DNA, 23 bp, Homo sapiens
gacctgaagagcgctcctctgcc

SEQ ID NO: 1227635 - DNA, 19 bp, Homo sapiens
gacggcctccaggaggggc

SEQ ID NO: 1227636 - DNA, 15 bp, Homo sapiens
gacggccttcttggt

SEQ ID NO: 1227637 - DNA, 13 bp, Homo sapiens
gacggctcctcag

SEQ ID NO: 1227638 - DNA, 15 bp, Homo sapiens
gacggctcctcagag

SEQ ID NO: 1227639 - DNA, 23 bp, Homo sapiens
gacggctcctcagagcgccagga

SEQ ID NO: 1227640 - DNA, 13 bp, Homo sapiens
gacggctggggac

SEQ ID NO: 1227641 - DNA, 14 bp, Homo sapiens
gacggctggggacc

SEQ ID NO: 1227642 - DNA, 23 bp, Homo sapiens
gacggctgggtgtttcagtttga

SEQ ID NO: 1227643 - DNA, 20 bp, Homo sapiens
gacgggagcattggcccctg

SEQ ID NO: 1227644 - DNA, 13 bp, Homo sapiens
gacgggccgcagg

SEQ ID NO: 1227645 - DNA, 13 bp, Homo sapiens
gacgggggtggga

SEQ ID NO: 1227646 - DNA, 14 bp, Homo sapiens
gacgggggtgggag

SEQ ID NO: 1227647 - DNA, 19 bp, Homo sapiens
gacggggtctccctgtgtt

SEQ ID NO: 1227648 - DNA, 17 bp, Homo sapiens
gacggggtttcaccatg

SEQ ID NO: 1227649 - DNA, 17 bp, Homo sapiens
gacggggtttctccatg

SEQ ID NO: 1227650 - DNA, 21 bp, Homo sapiens
gacggtcctttaggcagcctg

SEQ ID NO: 1227651 - DNA, 24 bp, Homo sapiens
gacggtgacaaagatggctcagag

SEQ ID NO: 1227652 - DNA, 16 bp, Homo sapiens
gacggtgcagtctggg

SEQ ID NO: 1227653 - DNA, 18 bp, Homo sapiens
gacggtgccaagggcccc

SEQ ID NO: 1227654 - DNA, 16 bp, Homo sapiens
gacggtgcccaagcca

SEQ ID NO: 1227655 - DNA, 18 bp, Homo sapiens
gacggttaacttgtatat

SEQ ID NO: 1227656 - DNA, 20 bp, Homo sapiens
gacgtaggaacggtaaattt

SEQ ID NO: 1227657 - DNA, 14 bp, Homo sapiens
gacgtattatctgt

SEQ ID NO: 1227658 - DNA, 19 bp, Homo sapiens
gacgtcacgctccctgact

SEQ ID NO: 1227659 - DNA, 14 bp, Homo sapiens
gacgtcaggccctg

SEQ ID NO: 1227660 - DNA, 23 bp, Homo sapiens
gacgtcatcggaggctgggcccc

SEQ ID NO: 1227661 - DNA, 22 bp, Homo sapiens
gacgtgaacgttttaataattt

SEQ ID NO: 1227662 - DNA, 22 bp, Homo sapiens
gacgtgaccggacttttctgca

SEQ ID NO: 1227663 - DNA, 16 bp, Homo sapiens
gacgtgattttgctgt

SEQ ID NO: 1227664 - DNA, 17 bp, Homo sapiens
gacgtgattttgctgta

SEQ ID NO: 1227665 - DNA, 15 bp, Homo sapiens
gacgtggactcctct

SEQ ID NO: 1227666 - DNA, 12 bp, Homo sapiens
gacgtggctcag

SEQ ID NO: 1227667 - DNA, 16 bp, Homo sapiens
gacgtggctcagccag

SEQ ID NO: 1227668 - DNA, 18 bp, Homo sapiens
gacgtgggaatttcaatg

SEQ ID NO: 1227669 - DNA, 13 bp, Homo sapiens
gacgtgggccctg

SEQ ID NO: 1227670 - DNA, 20 bp, Homo sapiens
gacgtgttacccactgccat

SEQ ID NO: 1227671 - DNA, 21 bp, Homo sapiens
gacgttcggggcatgctgggg

SEQ ID NO: 1227672 - DNA, 17 bp, Homo sapiens
gacgttggttctgcact

SEQ ID NO: 1227673 - DNA, 13 bp, Homo sapiens
gacgtttccatca

SEQ ID NO: 1227674 - DNA, 23 bp, Homo sapiens
gacgtttctcatttgtttttctc

SEQ ID NO: 1227675 - DNA, 17 bp, Homo sapiens
gacgtttttgtgctgtg

SEQ ID NO: 1227676 - DNA, 19 bp, Homo sapiens
gacgtttttgtgctgtggg

SEQ ID NO: 1227677 - DNA, 21 bp, Homo sapiens
gacgtttttgtgctgtgggca

SEQ ID NO: 1227678 - DNA, 23 bp, Homo sapiens
gactaaaacattttgactaagtt

SEQ ID NO: 1227679 - DNA, 18 bp, Homo sapiens
gactaaactttttttctg

SEQ ID NO: 1227680 - DNA, 16 bp, Homo sapiens
gactaaagctatgtta

SEQ ID NO: 1227681 - DNA, 20 bp, Homo sapiens
gactaaaggatccagagagc

SEQ ID NO: 1227682 - DNA, 23 bp, Homo sapiens
gactaaaggatccagagagcagc

SEQ ID NO: 1227683 - DNA, 16 bp, Homo sapiens
gactaaattttctttt

SEQ ID NO: 1227684 - DNA, 20 bp, Homo sapiens
gactaacataaaatctgtga

SEQ ID NO: 1227685 - DNA, 18 bp, Homo sapiens
gactaaccttgagtcaga

SEQ ID NO: 1227686 - DNA, 14 bp, Homo sapiens
gactaacttgaaaa

SEQ ID NO: 1227687 - DNA, 23 bp, Homo sapiens
gactaagagaagttgtaaagtat

SEQ ID NO: 1227688 - DNA, 22 bp, Homo sapiens
gactaagatgaaatgcactgta

SEQ ID NO: 1227689 - DNA, 23 bp, Homo sapiens
gactaagccctgtcgagacactt

SEQ ID NO: 1227690 - DNA, 22 bp, Homo sapiens
gactaatcttattcattttctc

SEQ ID NO: 1227691 - DNA, 16 bp, Homo sapiens
gactaattaaaatctg

SEQ ID NO: 1227692 - DNA, 21 bp, Homo sapiens
gactaattaaaatctggaaat

SEQ ID NO: 1227693 - DNA, 18 bp, Homo sapiens
gactaatttaaaaaataa

SEQ ID NO: 1227694 - DNA, 12 bp, Homo sapiens
gactaatttcaa

SEQ ID NO: 1227695 - DNA, 22 bp, Homo sapiens
gactaatttcaaaatgcttttt

SEQ ID NO: 1227696 - DNA, 23 bp, Homo sapiens
gactaattttacatgtttataaa

SEQ ID NO: 1227697 - DNA, 13 bp, Homo sapiens
gactacagggctt

SEQ ID NO: 1227698 - DNA, 17 bp, Homo sapiens
gactacaggtgtgcacc

SEQ ID NO: 1227699 - DNA, 18 bp, Homo sapiens
gactacagtcaggaaagg

SEQ ID NO: 1227700 - DNA, 19 bp, Homo sapiens
gactaccccagtcccaggg

SEQ ID NO: 1227701 - DNA, 23 bp, Homo sapiens
gactaccctctcactagtgccaa

SEQ ID NO: 1227702 - DNA, 17 bp, Homo sapiens
gactaccgcaggcccgg

SEQ ID NO: 1227703 - DNA, 19 bp, Homo sapiens
gactaccgcaggcccggac

SEQ ID NO: 1227704 - DNA, 18 bp, Homo sapiens
gactactaacaaatgtaa

SEQ ID NO: 1227705 - DNA, 17 bp, Homo sapiens
gactactactctgccaa

SEQ ID NO: 1227706 - DNA, 17 bp, Homo sapiens
gactactgctcctgtgg

SEQ ID NO: 1227707 - DNA, 19 bp, Homo sapiens
gactacttggaactaggct

SEQ ID NO: 1227708 - DNA, 18 bp, Homo sapiens
gactagactactcaatat

SEQ ID NO: 1227709 - DNA, 20 bp, Homo sapiens
gactagaggcagggagggga

SEQ ID NO: 1227710 - DNA, 22 bp, Homo sapiens
gactagaggcagggaggggact

SEQ ID NO: 1227711 - DNA, 20 bp, Homo sapiens
gactagaggccagggcagca

SEQ ID NO: 1227712 - DNA, 16 bp, Homo sapiens
gactagatgatggatg

SEQ ID NO: 1227713 - DNA, 17 bp, Homo sapiens
gactagatggacctgcc

SEQ ID NO: 1227714 - DNA, 17 bp, Homo sapiens
gactagatgtagtattt

SEQ ID NO: 1227715 - DNA, 16 bp, Homo sapiens
gactagcaggcatgcc

SEQ ID NO: 1227716 - DNA, 24 bp, Homo sapiens
gactaggacctgagcctggtcctg

SEQ ID NO: 1227717 - DNA, 19 bp, Homo sapiens
gactaggcatgtcagagga

SEQ ID NO: 1227718 - DNA, 19 bp, Homo sapiens
gactagggattcaggctgc

SEQ ID NO: 1227719 - DNA, 20 bp, Homo sapiens
gactagggattcaggctgct

SEQ ID NO: 1227720 - DNA, 16 bp, Homo sapiens
gactaggtattgtcta

SEQ ID NO: 1227721 - DNA, 20 bp, Homo sapiens
gactagttctcttgtcctgt

SEQ ID NO: 1227722 - DNA, 16 bp, Homo sapiens
gactatatagagatgt

SEQ ID NO: 1227723 - DNA, 22 bp, Homo sapiens
gactatctaaatgttgaaagat

SEQ ID NO: 1227724 - DNA, 15 bp, Homo sapiens
gactatctacaaaaa

SEQ ID NO: 1227725 - DNA, 19 bp, Homo sapiens
gactatgaacttctctcag

SEQ ID NO: 1227726 - DNA, 20 bp, Homo sapiens
gactatgatgagaggccagc

SEQ ID NO: 1227727 - DNA, 17 bp, Homo sapiens
gactatgcagaggcctg

SEQ ID NO: 1227728 - DNA, 20 bp, Homo sapiens
gactgacagcatgtgccctc

SEQ ID NO: 1227729 - DNA, 21 bp, Homo sapiens
gactgacagcatgtgccctcc

SEQ ID NO: 1227730 - DNA, 23 bp, Homo sapiens
gactgacagcatgtgccctcctg

SEQ ID NO: 1227731 - DNA, 21 bp, Homo sapiens
gactgacccccatctgagctg

SEQ ID NO: 1227732 - DNA, 15 bp, Homo sapiens
gactgaccctgagga

SEQ ID NO: 1227733 - DNA, 19 bp, Homo sapiens
gactgaccctgaggaggcc

SEQ ID NO: 1227734 - DNA, 14 bp, Homo sapiens
gactgactgagcag

SEQ ID NO: 1227735 - DNA, 21 bp, Homo sapiens
gactgacttgtttgtcttcca

SEQ ID NO: 1227736 - DNA, 15 bp, Homo sapiens
gactgagaacttttt

SEQ ID NO: 1227737 - DNA, 16 bp, Homo sapiens
gactgagactggcact

SEQ ID NO: 1227738 - DNA, 22 bp, Homo sapiens
gactgagactggcacttagccc

SEQ ID NO: 1227739 - DNA, 20 bp, Homo sapiens
gactgagagcccactgcagt

SEQ ID NO: 1227740 - DNA, 18 bp, Homo sapiens
gactgagcaagaccctgt

SEQ ID NO: 1227741 - DNA, 18 bp, Homo sapiens
gactgagcaccctctgga

SEQ ID NO: 1227742 - DNA, 12 bp, Homo sapiens
gactgagcagcc

SEQ ID NO: 1227743 - DNA, 16 bp, Homo sapiens
gactgagcagccgcca

SEQ ID NO: 1227744 - DNA, 21 bp, Homo sapiens
gactgagcagccgccagctgg

SEQ ID NO: 1227745 - DNA, 14 bp, Homo sapiens
gactgagccagtcc

SEQ ID NO: 1227746 - DNA, 17 bp, Homo sapiens
gactgagcccccaccgg

SEQ ID NO: 1227747 - DNA, 22 bp, Homo sapiens
gactgagccctctcactccagc

SEQ ID NO: 1227748 - DNA, 19 bp, Homo sapiens
gactgagctctccaggcca

SEQ ID NO: 1227749 - DNA, 20 bp, Homo sapiens
gactgagctctccaggccag

SEQ ID NO: 1227750 - DNA, 13 bp, Homo sapiens
gactgagggcagt

SEQ ID NO: 1227751 - DNA, 15 bp, Homo sapiens
gactgaggtgcctgc

SEQ ID NO: 1227752 - DNA, 22 bp, Homo sapiens
gactgagtcctcgtagccatct

SEQ ID NO: 1227753 - DNA, 19 bp, Homo sapiens
gactgatccctggccactg

SEQ ID NO: 1227754 - DNA, 12 bp, Homo sapiens
gactgatgagca

SEQ ID NO: 1227755 - DNA, 21 bp, Homo sapiens
gactgatgttgagggaacaga

SEQ ID NO: 1227756 - DNA, 21 bp, Homo sapiens
gactgcaaacttttttatatc

SEQ ID NO: 1227757 - DNA, 21 bp, Homo sapiens
gactgcacccagctccagggg

SEQ ID NO: 1227758 - DNA, 22 bp, Homo sapiens
gactgcagacaggctctgaggg

SEQ ID NO: 1227759 - DNA, 13 bp, Homo sapiens
gactgcagctgct

SEQ ID NO: 1227760 - DNA, 19 bp, Homo sapiens
gactgcaggggccactcca

SEQ ID NO: 1227761 - DNA, 16 bp, Homo sapiens
gactgcagtcggcatg

SEQ ID NO: 1227762 - DNA, 19 bp, Homo sapiens
gactgcagtcggcatgcca

SEQ ID NO: 1227763 - DNA, 20 bp, Homo sapiens
gactgcatggggaggcagca

SEQ ID NO: 1227764 - DNA, 22 bp, Homo sapiens
gactgccaggataaagcttccg

SEQ ID NO: 1227765 - DNA, 10 bp, Homo sapiens
gactgcccag

SEQ ID NO: 1227766 - DNA, 18 bp, Homo sapiens
gactgcccagccactcca

SEQ ID NO: 1227767 - DNA, 18 bp, Homo sapiens
gactgccccaactcctgg

SEQ ID NO: 1227768 - DNA, 13 bp, Homo sapiens
gactgccccagcc

SEQ ID NO: 1227769 - DNA, 16 bp, Homo sapiens
gactgccccagccaac

SEQ ID NO: 1227770 - DNA, 22 bp, Homo sapiens
gactgcccccagaaagcctcct

SEQ ID NO: 1227771 - DNA, 15 bp, Homo sapiens
gactgcccggcaggg

SEQ ID NO: 1227772 - DNA, 13 bp, Homo sapiens
gactgcccttctc

SEQ ID NO: 1227773 - DNA, 14 bp, Homo sapiens
gactgcccttctca

SEQ ID NO: 1227774 - DNA, 15 bp, Homo sapiens
gactgcctgtctcca

SEQ ID NO: 1227775 - DNA, 15 bp, Homo sapiens
gactgcggaggaagg

SEQ ID NO: 1227776 - DNA, 21 bp, Homo sapiens
gactgcgggatggtcctgggg

SEQ ID NO: 1227777 - DNA, 17 bp, Homo sapiens
gactgctaaataaaatt

SEQ ID NO: 1227778 - DNA, 18 bp, Homo sapiens
gactgctaaataaaattt

SEQ ID NO: 1227779 - DNA, 15 bp, Homo sapiens
gactgctccccagcc

SEQ ID NO: 1227780 - DNA, 24 bp, Homo sapiens
gactgctccccagccctggctctg

SEQ ID NO: 1227781 - DNA, 15 bp, Homo sapiens
gactgctgctcccca

SEQ ID NO: 1227782 - DNA, 14 bp, Homo sapiens
gactgctgctgcct

SEQ ID NO: 1227783 - DNA, 21 bp, Homo sapiens
gactgctgctgcctggccact

SEQ ID NO: 1227784 - DNA, 22 bp, Homo sapiens
gactgctgctgcctggccactg

SEQ ID NO: 1227785 - DNA, 19 bp, Homo sapiens
gactgctggacataaatca

SEQ ID NO: 1227786 - DNA, 19 bp, Homo sapiens
gactgctgggactggccag

SEQ ID NO: 1227787 - DNA, 12 bp, Homo sapiens
gactgcttccca

SEQ ID NO: 1227788 - DNA, 15 bp, Homo sapiens
gactgcttcccatcc

SEQ ID NO: 1227789 - DNA, 16 bp, Homo sapiens
gactgcttggccagat

SEQ ID NO: 1227790 - DNA, 19 bp, Homo sapiens
gactggaagacacttcaga

SEQ ID NO: 1227791 - DNA, 21 bp, Homo sapiens
gactggaaggtccttgcctga

SEQ ID NO: 1227792 - DNA, 13 bp, Homo sapiens
gactggacagctt

SEQ ID NO: 1227793 - DNA, 14 bp, Homo sapiens
gactggacccccag

SEQ ID NO: 1227794 - DNA, 17 bp, Homo sapiens
gactggacctggtggct

SEQ ID NO: 1227795 - DNA, 15 bp, Homo sapiens
gactggaggcccctg

SEQ ID NO: 1227796 - DNA, 21 bp, Homo sapiens
gactggagtgaggcttccagg

SEQ ID NO: 1227797 - DNA, 23 bp, Homo sapiens
gactggagtgaggcttccaggct

SEQ ID NO: 1227798 - DNA, 12 bp, Homo sapiens
gactggatgctc

SEQ ID NO: 1227799 - DNA, 20 bp, Homo sapiens
gactggatgctcgccatcaa

SEQ ID NO: 1227800 - DNA, 17 bp, Homo sapiens
gactggatgtaccacca

SEQ ID NO: 1227801 - DNA, 22 bp, Homo sapiens
gactgtagattgcttctgtagt

SEQ ID NO: 1227802 - DNA, 17 bp, Homo sapiens
gactgtagccacagctg

SEQ ID NO: 1227803 - DNA, 20 bp, Homo sapiens
gactgtagccacagctgctg

SEQ ID NO: 1227804 - DNA, 20 bp, Homo sapiens
gactgtataggtagatccag

SEQ ID NO: 1227805 - DNA, 14 bp, Homo sapiens
gactgtatctgtgt

SEQ ID NO: 1227806 - DNA, 15 bp, Homo sapiens
gactgtcaaatgaac

SEQ ID NO: 1227807 - DNA, 16 bp, Homo sapiens
gactgtcaaatgaact

SEQ ID NO: 1227808 - DNA, 15 bp, Homo sapiens
gactgtcacactggt

SEQ ID NO: 1227809 - DNA, 16 bp, Homo sapiens
gactgtcagggagggc

SEQ ID NO: 1227810 - DNA, 17 bp, Homo sapiens
gactgtcagggagggcc

SEQ ID NO: 1227811 - DNA, 22 bp, Homo sapiens
gactgtcagggagggccaggga

SEQ ID NO: 1227812 - DNA, 13 bp, Homo sapiens
gactgtcagttct

SEQ ID NO: 1227813 - DNA, 15 bp, Homo sapiens
gactgtcatagaaat

SEQ ID NO: 1227814 - DNA, 16 bp, Homo sapiens
gactgtccaggagcta

SEQ ID NO: 1227815 - DNA, 19 bp, Homo sapiens
gactgtcccaccgggagcc

SEQ ID NO: 1227816 - DNA, 23 bp, Homo sapiens
gactgtcccaccgggagcctccc

SEQ ID NO: 1227817 - DNA, 22 bp, Homo sapiens
gactgtcctcccacagacctgc

SEQ ID NO: 1227818 - DNA, 23 bp, Homo sapiens
gactgtcggagaggctgtctggg

SEQ ID NO: 1227819 - DNA, 24 bp, Homo sapiens
gactgtctagccactccctcccag

SEQ ID NO: 1227820 - DNA, 22 bp, Homo sapiens
gactgtctatatcataactata

SEQ ID NO: 1227821 - DNA, 21 bp, Homo sapiens
gactgtctcaagagggcactg

SEQ ID NO: 1227822 - DNA, 13 bp, Homo sapiens
gactgtctttcag

SEQ ID NO: 1227823 - DNA, 18 bp, Homo sapiens
gactgtgaacagcttgct

SEQ ID NO: 1227824 - DNA, 19 bp, Homo sapiens
gactgtgatgccacacaga

SEQ ID NO: 1227825 - DNA, 15 bp, Homo sapiens
gactgtgattcagaa

SEQ ID NO: 1227826 - DNA, 19 bp, Homo sapiens
gactgtgcctcaggccagg

SEQ ID NO: 1227827 - DNA, 23 bp, Homo sapiens
gactgtgcctcaggccagggctc

SEQ ID NO: 1227828 - DNA, 14 bp, Homo sapiens
gactgtgctgagaa

SEQ ID NO: 1227829 - DNA, 15 bp, Homo sapiens
gactgtgctggtgca

SEQ ID NO: 1227830 - DNA, 12 bp, Homo sapiens
gactgtgctgtg

SEQ ID NO: 1227831 - DNA, 17 bp, Homo sapiens
gactgtggaaatgccaa

SEQ ID NO: 1227832 - DNA, 13 bp, Homo sapiens
gactgtgggtggg

SEQ ID NO: 1227833 - DNA, 15 bp, Homo sapiens
gactgtgggtgggga

SEQ ID NO: 1227834 - DNA, 22 bp, Homo sapiens
gactgtgtattctagttttgtc

SEQ ID NO: 1227835 - DNA, 13 bp, Homo sapiens
gactgttccaggc

SEQ ID NO: 1227836 - DNA, 22 bp, Homo sapiens
gactgttccaggccctccagtg

SEQ ID NO: 1227837 - DNA, 13 bp, Homo sapiens
gactgttgtagca

SEQ ID NO: 1227838 - DNA, 15 bp, Homo sapiens
gactgtttcacattg

SEQ ID NO: 1227839 - DNA, 17 bp, Homo sapiens
gactgtttcattcactg

SEQ ID NO: 1227840 - DNA, 19 bp, Homo sapiens
gactgtttcttttgtaaag

SEQ ID NO: 1227841 - DNA, 13 bp, Homo sapiens
gactgtttggctt

SEQ ID NO: 1227842 - DNA, 14 bp, Homo sapiens
gactgttttactgt

SEQ ID NO: 1227843 - DNA, 13 bp, Homo sapiens
gactgttttcaat

SEQ ID NO: 1227844 - DNA, 19 bp, Homo sapiens
gactgttttctctcggctc

SEQ ID NO: 1227845 - DNA, 22 bp, Homo sapiens
gactgtttttaagtaacttaag

SEQ ID NO: 1227846 - DNA, 14 bp, Homo sapiens
gactgttttttcct

SEQ ID NO: 1227847 - DNA, 20 bp, Homo sapiens
gacttaaaattagtcttttg

SEQ ID NO: 1227848 - DNA, 20 bp, Homo sapiens
gacttaaaggacaggaggag

SEQ ID NO: 1227849 - DNA, 23 bp, Homo sapiens
gacttaatgtgattactgctcta

SEQ ID NO: 1227850 - DNA, 16 bp, Homo sapiens
gacttactgtacatga

SEQ ID NO: 1227851 - DNA, 13 bp, Homo sapiens
gacttagaaactg

SEQ ID NO: 1227852 - DNA, 23 bp, Homo sapiens
gacttagatattaaaatttggtg

SEQ ID NO: 1227853 - DNA, 16 bp, Homo sapiens
gacttagggcaccagg

SEQ ID NO: 1227854 - DNA, 15 bp, Homo sapiens
gacttaggtttttag

SEQ ID NO: 1227855 - DNA, 17 bp, Homo sapiens
gacttagtatattttct

SEQ ID NO: 1227856 - DNA, 22 bp, Homo sapiens
gacttagttgcgttacaccctt

SEQ ID NO: 1227857 - DNA, 17 bp, Homo sapiens
gacttatagtacatgat

SEQ ID NO: 1227858 - DNA, 17 bp, Homo sapiens
gacttatttctgctctg

SEQ ID NO: 1227859 - DNA, 18 bp, Homo sapiens
gacttatttctgctctgg

SEQ ID NO: 1227860 - DNA, 12 bp, Homo sapiens
gacttatttctt

SEQ ID NO: 1227861 - DNA, 15 bp, Homo sapiens
gacttatttcttaaa

SEQ ID NO: 1227862 - DNA, 17 bp, Homo sapiens
gacttcaaaatattgag

SEQ ID NO: 1227863 - DNA, 19 bp, Homo sapiens
gacttcaaaatattgagca

SEQ ID NO: 1227864 - DNA, 21 bp, Homo sapiens
gacttcaagcatggctatttt

SEQ ID NO: 1227865 - DNA, 13 bp, Homo sapiens
gacttcacactgc

SEQ ID NO: 1227866 - DNA, 14 bp, Homo sapiens
gacttcacactgca

SEQ ID NO: 1227867 - DNA, 16 bp, Homo sapiens
gacttcacactgcaag

SEQ ID NO: 1227868 - DNA, 20 bp, Homo sapiens
gagctgagcagcctctggac

SEQ ID NO: 1227869 - DNA, 23 bp, Homo sapiens
gagctgagggagggagccatgga

SEQ ID NO: 1227870 - DNA, 14 bp, Homo sapiens
gagctgagggccct

SEQ ID NO: 1227871 - DNA, 16 bp, Homo sapiens
gagctgagggccctgt

SEQ ID NO: 1227872 - DNA, 14 bp, Homo sapiens
gagctgagtcacct

SEQ ID NO: 1227873 - DNA, 16 bp, Homo sapiens
gagctgagtcacctcc

SEQ ID NO: 1227874 - DNA, 19 bp, Homo sapiens
gagctgatgccccttctcc

SEQ ID NO: 1227875 - DNA, 15 bp, Homo sapiens
gagctgatggcagct

SEQ ID NO: 1227876 - DNA, 16 bp, Homo sapiens
gagctgatggcagctg

SEQ ID NO: 1227877 - DNA, 18 bp, Homo sapiens
gagctgatggcagctggg

SEQ ID NO: 1227878 - DNA, 16 bp, Homo sapiens
gagctgatttccaggc

SEQ ID NO: 1227879 - DNA, 18 bp, Homo sapiens
gagctgatttccaggccc

SEQ ID NO: 1227880 - DNA, 12 bp, Homo sapiens
gagctgcacaca

SEQ ID NO: 1227881 - DNA, 13 bp, Homo sapiens
gagctgcacagca

SEQ ID NO: 1227882 - DNA, 22 bp, Homo sapiens
gagctgcactgatcacccaatg

SEQ ID NO: 1227883 - DNA, 12 bp, Homo sapiens
gagctgcagagc

SEQ ID NO: 1227884 - DNA, 16 bp, Homo sapiens
gagctgcagcccccca

SEQ ID NO: 1227885 - DNA, 16 bp, Homo sapiens
gagctgccacagagaa

SEQ ID NO: 1227886 - DNA, 20 bp, Homo sapiens
gagctgccactgggcacctg

SEQ ID NO: 1227887 - DNA, 21 bp, Homo sapiens
gagctgccactgggcacctgc

SEQ ID NO: 1227888 - DNA, 22 bp, Homo sapiens
gagctgccactgggcacctgcg

SEQ ID NO: 1227889 - DNA, 14 bp, Homo sapiens
gagctgccagccgg

SEQ ID NO: 1227890 - DNA, 16 bp, Homo sapiens
gagctgcccggcgcct

SEQ ID NO: 1227891 - DNA, 19 bp, Homo sapiens
gagctgcccggcgcctgcc

SEQ ID NO: 1227892 - DNA, 14 bp, Homo sapiens
gagctgcctgcagc

SEQ ID NO: 1227893 - DNA, 15 bp, Homo sapiens
gagctgcctgcagca

SEQ ID NO: 1227894 - DNA, 13 bp, Homo sapiens
gagctgccttccc

SEQ ID NO: 1227895 - DNA, 14 bp, Homo sapiens
gagctgccttccct

SEQ ID NO: 1227896 - DNA, 19 bp, Homo sapiens
gagctgccttccctagctt

SEQ ID NO: 1227897 - DNA, 15 bp, Homo sapiens
gagctgcgccggaca

SEQ ID NO: 1227898 - DNA, 18 bp, Homo sapiens
gagctgcgccggacagag

SEQ ID NO: 1227899 - DNA, 18 bp, Homo sapiens
gagctgctatagcctggg

SEQ ID NO: 1227900 - DNA, 20 bp, Homo sapiens
gagctgctatagcctggggt

SEQ ID NO: 1227901 - DNA, 16 bp, Homo sapiens
gagctgctctggaaaa

SEQ ID NO: 1227902 - DNA, 13 bp, Homo sapiens
gagctgctgggct

SEQ ID NO: 1227903 - DNA, 15 bp, Homo sapiens
gagctgctgtgccca

SEQ ID NO: 1227904 - DNA, 15 bp, Homo sapiens
gagctggaaggcagg

SEQ ID NO: 1227905 - DNA, 20 bp, Homo sapiens
gagctggagatgaggccaga

SEQ ID NO: 1227906 - DNA, 21 bp, Homo sapiens
gagctggagatgaggccagac

SEQ ID NO: 1227907 - DNA, 23 bp, Homo sapiens
gagctggagatgaggccagacca

SEQ ID NO: 1227908 - DNA, 18 bp, Homo sapiens
gagctggatagacttggg

SEQ ID NO: 1227909 - DNA, 13 bp, Homo sapiens
gagctggccccgc

SEQ ID NO: 1227910 - DNA, 14 bp, Homo sapiens
gagctggccccgcc

SEQ ID NO: 1227911 - DNA, 23 bp, Homo sapiens
gagctggccccgcttggtggcct

SEQ ID NO: 1227912 - DNA, 17 bp, Homo sapiens
gagctggcccttgggga

SEQ ID NO: 1227913 - DNA, 11 bp, Homo sapiens
gagctggcctc

SEQ ID NO: 1227914 - DNA, 12 bp, Homo sapiens
gagctggctctg

SEQ ID NO: 1227915 - DNA, 18 bp, Homo sapiens
gagctggctgtgcctgct

SEQ ID NO: 1227916 - DNA, 16 bp, Homo sapiens
gagctgggagccaggc

SEQ ID NO: 1227917 - DNA, 15 bp, Homo sapiens
gagctgggaggtctc

SEQ ID NO: 1227918 - DNA, 16 bp, Homo sapiens
gagctgggcaggaagg

SEQ ID NO: 1227919 - DNA, 11 bp, Homo sapiens
gagctgggccc

SEQ ID NO: 1227920 - DNA, 15 bp, Homo sapiens
gagctgggcccagcc

SEQ ID NO: 1227921 - DNA, 12 bp, Homo sapiens
gagctgggcccc

SEQ ID NO: 1227922 - DNA, 23 bp, Homo sapiens
gagctggggaggtgggaggccag

SEQ ID NO: 1227923 - DNA, 13 bp, Homo sapiens
gagctggggccac

SEQ ID NO: 1227924 - DNA, 24 bp, Homo sapiens
gagctggggctgccagcctgagcg

SEQ ID NO: 1227925 - DNA, 18 bp, Homo sapiens
gagctgggggccatgagc

SEQ ID NO: 1227926 - DNA, 17 bp, Homo sapiens
gagctggggtctgggca

SEQ ID NO: 1227927 - DNA, 20 bp, Homo sapiens
gagctggggtctgggcagtg

SEQ ID NO: 1227928 - DNA, 12 bp, Homo sapiens
gagctgggtggc

SEQ ID NO: 1227929 - DNA, 16 bp, Homo sapiens
gagctgggtggcctgt

SEQ ID NO: 1227930 - DNA, 21 bp, Homo sapiens
gagctggtagttagtagcatg

SEQ ID NO: 1227931 - DNA, 23 bp, Homo sapiens
gagctggtgactttggggacagg

SEQ ID NO: 1227932 - DNA, 17 bp, Homo sapiens
gagctggtgcccggaga

SEQ ID NO: 1227933 - DNA, 22 bp, Homo sapiens
gagctggttcctctctcccacc

SEQ ID NO: 1227934 - DNA, 21 bp, Homo sapiens
gagctgtaatttcgccttaaa

SEQ ID NO: 1227935 - DNA, 23 bp, Homo sapiens
gagctgtaatttcgccttaaact

SEQ ID NO: 1227936 - DNA, 18 bp, Homo sapiens
gagctgtattaagccact

SEQ ID NO: 1227937 - DNA, 16 bp, Homo sapiens
gagctgtcaccaagga

SEQ ID NO: 1227938 - DNA, 15 bp, Homo sapiens
gagctgtctgactgc

SEQ ID NO: 1227939 - DNA, 16 bp, Homo sapiens
gagctgtcttcccctg

SEQ ID NO: 1227940 - DNA, 15 bp, Homo sapiens
gagctgtgacattgc

SEQ ID NO: 1227941 - DNA, 21 bp, Homo sapiens
gagctgtgacattgctggtca

SEQ ID NO: 1227942 - DNA, 21 bp, Homo sapiens
gagctgtgagttctccctgta

SEQ ID NO: 1227943 - DNA, 12 bp, Homo sapiens
gagctgtgccag

SEQ ID NO: 1227944 - DNA, 14 bp, Homo sapiens
gagctgtgcctgct

SEQ ID NO: 1227945 - DNA, 16 bp, Homo sapiens
gagctgtgcctgctca

SEQ ID NO: 1227946 - DNA, 22 bp, Homo sapiens
gagctgtgcctgctcagcagcc

SEQ ID NO: 1227947 - DNA, 19 bp, Homo sapiens
gagctgtgcgctgctctgc

SEQ ID NO: 1227948 - DNA, 14 bp, Homo sapiens
gagctgttcgctcc

SEQ ID NO: 1227949 - DNA, 17 bp, Homo sapiens
gagctgttcgctcctcc

SEQ ID NO: 1227950 - DNA, 17 bp, Homo sapiens
gagctgtttactaggga

SEQ ID NO: 1227951 - DNA, 15 bp, Homo sapiens
gagcttaaaatacaa

SEQ ID NO: 1227952 - DNA, 15 bp, Homo sapiens
gagcttaacagtgtg

SEQ ID NO: 1227953 - DNA, 22 bp, Homo sapiens
gagcttaatctttgaaaggtta

SEQ ID NO: 1227954 - DNA, 14 bp, Homo sapiens
gagcttagccttgt

SEQ ID NO: 1227955 - DNA, 20 bp, Homo sapiens
gagcttagccttgtgccctg

SEQ ID NO: 1227956 - DNA, 14 bp, Homo sapiens
gagcttagggatga

SEQ ID NO: 1227957 - DNA, 22 bp, Homo sapiens
gagcttataaaatttaacttct

SEQ ID NO: 1227958 - DNA, 19 bp, Homo sapiens
gagcttattacagaaaaac

SEQ ID NO: 1227959 - DNA, 16 bp, Homo sapiens
gagcttattggccact

SEQ ID NO: 1227960 - DNA, 16 bp, Homo sapiens
gagcttcaatataaga

SEQ ID NO: 1227961 - DNA, 20 bp, Homo sapiens
gagcttcaatataagaagca

SEQ ID NO: 1227962 - DNA, 12 bp, Homo sapiens
gagcttccaaat

SEQ ID NO: 1227963 - DNA, 21 bp, Homo sapiens
gagcttccaaatgtgtcagaa

SEQ ID NO: 1227964 - DNA, 17 bp, Homo sapiens
gagcttccctgactcat

SEQ ID NO: 1227965 - DNA, 14 bp, Homo sapiens
gagcttcctggctc

SEQ ID NO: 1227966 - DNA, 15 bp, Homo sapiens
gagcttcctggctct

SEQ ID NO: 1227967 - DNA, 16 bp, Homo sapiens
gagcttcctggctctg

SEQ ID NO: 1227968 - DNA, 17 bp, Homo sapiens
gagcttgccacactctt

SEQ ID NO: 1227969 - DNA, 18 bp, Homo sapiens
gagcttgctccagattct

SEQ ID NO: 1227970 - DNA, 22 bp, Homo sapiens
gagcttgctccagattctgatg

SEQ ID NO: 1227971 - DNA, 19 bp, Homo sapiens
gagcttgctttgatttaca

SEQ ID NO: 1227972 - DNA, 12 bp, Homo sapiens
gagcttggcctt

SEQ ID NO: 1227973 - DNA, 21 bp, Homo sapiens
gagcttgggactcaggtctgt

SEQ ID NO: 1227974 - DNA, 17 bp, Homo sapiens
gagcttgggcagtgccc

SEQ ID NO: 1227975 - DNA, 20 bp, Homo sapiens
gagcttgggcagtgccccag

SEQ ID NO: 1227976 - DNA, 22 bp, Homo sapiens
gagcttgggcagtgccccaggg

SEQ ID NO: 1227977 - DNA, 14 bp, Homo sapiens
gagcttgtgtcctg

SEQ ID NO: 1227978 - DNA, 18 bp, Homo sapiens
gagctttccatgttgctg

SEQ ID NO: 1227979 - DNA, 22 bp, Homo sapiens
gagctttctcaatgtcttccca

SEQ ID NO: 1227980 - DNA, 21 bp, Homo sapiens
gagctttctgtccttttggca

SEQ ID NO: 1227981 - DNA, 23 bp, Homo sapiens
gagctttctgtccttttggcact

SEQ ID NO: 1227982 - DNA, 12 bp, Homo sapiens
gagctttctttt

SEQ ID NO: 1227983 - DNA, 19 bp, Homo sapiens
gagctttcttttgtattaa

SEQ ID NO: 1227984 - DNA, 12 bp, Homo sapiens
gagctttgctgc

SEQ ID NO: 1227985 - DNA, 17 bp, Homo sapiens
gagctttgtcacttgcc

SEQ ID NO: 1227986 - DNA, 13 bp, Homo sapiens
gagctttgtgctt

SEQ ID NO: 1227987 - DNA, 15 bp, Homo sapiens
gagcttttctaggct

SEQ ID NO: 1227988 - DNA, 24 bp, Homo sapiens
gagctttttcagaaacagggcagc

SEQ ID NO: 1227989 - DNA, 18 bp, Homo sapiens
gagcttttttctttaaga

SEQ ID NO: 1227990 - DNA, 21 bp, Homo sapiens
gagcttttttgtaccctgaag

SEQ ID NO: 1227991 - DNA, 13 bp, Homo sapiens
gaggaaaaaagaa

SEQ ID NO: 1227992 - DNA, 20 bp, Homo sapiens
gaggaaaacacagcctccct

SEQ ID NO: 1227993 - DNA, 22 bp, Homo sapiens
gaggaaaacactatttccaaaa

SEQ ID NO: 1227994 - DNA, 20 bp, Homo sapiens
gaggaaaaccaagccgtggc

SEQ ID NO: 1227995 - DNA, 21 bp, Homo sapiens
gaggaaaaccaagccgtggct

SEQ ID NO: 1227996 - DNA, 15 bp, Homo sapiens
gaggaaaaggaaaaa

SEQ ID NO: 1227997 - DNA, 16 bp, Homo sapiens
gaggaaaatgagtatt

SEQ ID NO: 1227998 - DNA, 20 bp, Homo sapiens
gaggaaacgggttaaaaatt

SEQ ID NO: 1227999 - DNA, 22 bp, Homo sapiens
gaggaaactcacctgctggccc

SEQ ID NO: 1228000 - DNA, 15 bp, Homo sapiens
gaggaaagcaagtgt

SEQ ID NO: 1228001 - DNA, 14 bp, Homo sapiens
gaggaaaggatttt

SEQ ID NO: 1228002 - DNA, 18 bp, Homo sapiens
gaggaaaggcgcccccgc

SEQ ID NO: 1228003 - DNA, 18 bp, Homo sapiens
gaggaaagggcctggcca

SEQ ID NO: 1228004 - DNA, 18 bp, Homo sapiens
gaggaaataactaagaga

SEQ ID NO: 1228005 - DNA, 20 bp, Homo sapiens
gaggaaccacatataacact

SEQ ID NO: 1228006 - DNA, 15 bp, Homo sapiens
gaggaaccagagcca

SEQ ID NO: 1228007 - DNA, 18 bp, Homo sapiens
gaggaaccagagccatgg

SEQ ID NO: 1228008 - DNA, 15 bp, Homo sapiens
gaggaacgggcagcc

SEQ ID NO: 1228009 - DNA, 17 bp, Homo sapiens
gaggaacgggcagccac

SEQ ID NO: 1228010 - DNA, 20 bp, Homo sapiens
gaggaacgggcagccacagg

SEQ ID NO: 1228011 - DNA, 15 bp, Homo sapiens
gaggaactgtccaga

SEQ ID NO: 1228012 - DNA, 19 bp, Homo sapiens
gaggaactgtccagagagc

SEQ ID NO: 1228013 - DNA, 21 bp, Homo sapiens
gaggaactgtccagagagcaa

SEQ ID NO: 1228014 - DNA, 17 bp, Homo sapiens
gaggaagagaaaaaata

SEQ ID NO: 1228015 - DNA, 18 bp, Homo sapiens
gaggaagagagagaccct

SEQ ID NO: 1228016 - DNA, 13 bp, Homo sapiens
gaggaagagcagg

SEQ ID NO: 1228017 - DNA, 13 bp, Homo sapiens
gaggaagagccac

SEQ ID NO: 1228018 - DNA, 22 bp, Homo sapiens
gaggaagccaggtccacggtct

SEQ ID NO: 1228019 - DNA, 16 bp, Homo sapiens
gaggaagccagtggag

SEQ ID NO: 1228020 - DNA, 20 bp, Homo sapiens
gaggaagcccaggctcggag

SEQ ID NO: 1228021 - DNA, 22 bp, Homo sapiens
gaggaagcccaggctcggagga

SEQ ID NO: 1228022 - DNA, 10 bp, Homo sapiens
gaggaagccg

SEQ ID NO: 1228023 - DNA, 19 bp, Homo sapiens
gaggaagccggtgtccctg

SEQ ID NO: 1228024 - DNA, 22 bp, Homo sapiens
gaggaagctggacagcggcagt

SEQ ID NO: 1228025 - DNA, 22 bp, Homo sapiens
gaggaaggaaaaggaggaaatt

SEQ ID NO: 1228026 - DNA, 21 bp, Homo sapiens
gaggaaggaggacccaggaca

SEQ ID NO: 1228027 - DNA, 13 bp, Homo sapiens
gaggaaggcaaga

SEQ ID NO: 1228028 - DNA, 21 bp, Homo sapiens
gaggaaggcaagagggggtgg

SEQ ID NO: 1228029 - DNA, 18 bp, Homo sapiens
gaggaaggcctttcttct

SEQ ID NO: 1228030 - DNA, 20 bp, Homo sapiens
gaggaagtggggtctggcct

SEQ ID NO: 1228031 - DNA, 18 bp, Homo sapiens
gaggaagtggtctgtctg

SEQ ID NO: 1228032 - DNA, 13 bp, Homo sapiens
gaggaagttcaga

SEQ ID NO: 1228033 - DNA, 14 bp, Homo sapiens
gaggaagttcagat

SEQ ID NO: 1228034 - DNA, 21 bp, Homo sapiens
gaggaagttggctgagccatt

SEQ ID NO: 1228035 - DNA, 17 bp, Homo sapiens
gaggaatactgaacatc

SEQ ID NO: 1228036 - DNA, 21 bp, Homo sapiens
gaggaatcatgtcaggcctgt

SEQ ID NO: 1228037 - DNA, 19 bp, Homo sapiens
gaggaatctgtttctctgc

SEQ ID NO: 1228038 - DNA, 21 bp, Homo sapiens
gaggaatgctcccccatcctc

SEQ ID NO: 1228039 - DNA, 15 bp, Homo sapiens
gaggaatgctctgtg

SEQ ID NO: 1228040 - DNA, 17 bp, Homo sapiens
gaggaatgtagggcctg

SEQ ID NO: 1228041 - DNA, 19 bp, Homo sapiens
gaggaattatcatgggaaa

SEQ ID NO: 1228042 - DNA, 22 bp, Homo sapiens
gaggaattcttctgttctctgg

SEQ ID NO: 1228043 - DNA, 16 bp, Homo sapiens
gaggacacagcacaag

SEQ ID NO: 1228044 - DNA, 13 bp, Homo sapiens
gaggacacaggca

SEQ ID NO: 1228045 - DNA, 10 bp, Homo sapiens
gaggacagag

SEQ ID NO: 1228046 - DNA, 13 bp, Homo sapiens
gaggacagctctg

SEQ ID NO: 1228047 - DNA, 15 bp, Homo sapiens
gaggacagctctggg

SEQ ID NO: 1228048 - DNA, 15 bp, Homo sapiens
gaggacagcttgagc

SEQ ID NO: 1228049 - DNA, 20 bp, Homo sapiens
gaggacaggcgggaggaggt

SEQ ID NO: 1228050 - DNA, 20 bp, Homo sapiens
gaggacataatggggtcctg

SEQ ID NO: 1228051 - DNA, 23 bp, Homo sapiens
gaggaccacagtgggtggcacct

SEQ ID NO: 1228052 - DNA, 22 bp, Homo sapiens
gaggaccactcctgtacactga

SEQ ID NO: 1228053 - DNA, 14 bp, Homo sapiens
gaggaccagggtgg

SEQ ID NO: 1228054 - DNA, 19 bp, Homo sapiens
gaggaccagggtggagctg

SEQ ID NO: 1228055 - DNA, 12 bp, Homo sapiens
gaggacccagga

SEQ ID NO: 1228056 - DNA, 14 bp, Homo sapiens
gaggacccaggaca

SEQ ID NO: 1228057 - DNA, 15 bp, Homo sapiens
gaggaccccgagggc

SEQ ID NO: 1228058 - DNA, 20 bp, Homo sapiens
gaggacccctgccttcctct

SEQ ID NO: 1228059 - DNA, 21 bp, Homo sapiens
gaggaccccttaatcttgctt

SEQ ID NO: 1228060 - DNA, 16 bp, Homo sapiens
gaggaccgctgataag

SEQ ID NO: 1228061 - DNA, 22 bp, Homo sapiens
gaggacctgagtttgggagagt

SEQ ID NO: 1228062 - DNA, 19 bp, Homo sapiens
gaggacgcacgctcgctgc

SEQ ID NO: 1228063 - DNA, 21 bp, Homo sapiens
gaggacgcacgctcgctgcca

SEQ ID NO: 1228064 - DNA, 23 bp, Homo sapiens
gaggacgcacgctcgctgccatc

SEQ ID NO: 1228065 - DNA, 17 bp, Homo sapiens
gaggactcccaaccctg

SEQ ID NO: 1228066 - DNA, 18 bp, Homo sapiens
gaggactcccaaccctgg

SEQ ID NO: 1228067 - DNA, 16 bp, Homo sapiens
gaggactccgggacca

SEQ ID NO: 1228068 - DNA, 23 bp, Homo sapiens
gaggactccgggaccattgacct

SEQ ID NO: 1228069 - DNA, 22 bp, Homo sapiens
gaggactctgcttaaacaaagc

SEQ ID NO: 1228070 - DNA, 15 bp, Homo sapiens
gaggactgagactgg

SEQ ID NO: 1228071 - DNA, 17 bp, Homo sapiens
gaggactgagcccccac

SEQ ID NO: 1228072 - DNA, 19 bp, Homo sapiens
gaggactgagcccccaccg

SEQ ID NO: 1228073 - DNA, 16 bp, Homo sapiens
gaggactggactgttt

SEQ ID NO: 1228074 - DNA, 18 bp, Homo sapiens
gaggacttggagggtctg

SEQ ID NO: 1228075 - DNA, 23 bp, Homo sapiens
gaggactttgattgcacattgtt

SEQ ID NO: 1228076 - DNA, 17 bp, Homo sapiens
gaggactttgcccagga

SEQ ID NO: 1228077 - DNA, 19 bp, Homo sapiens
gaggagaaatgcaataact

SEQ ID NO: 1228078 - DNA, 14 bp, Homo sapiens
gaggagaagacaac

SEQ ID NO: 1228079 - DNA, 14 bp, Homo sapiens
gaggagacctttga

SEQ ID NO: 1228080 - DNA, 21 bp, Homo sapiens
gaggagagaagaatgagccta

SEQ ID NO: 1228081 - DNA, 15 bp, Homo sapiens
gaggagagccactgg

SEQ ID NO: 1228082 - DNA, 16 bp, Homo sapiens
gaggagagccactggg

SEQ ID NO: 1228083 - DNA, 20 bp, Homo sapiens
gaggagagccactgggcccc

SEQ ID NO: 1228084 - DNA, 17 bp, Homo sapiens
gaggagagtcccagagc

SEQ ID NO: 1228085 - DNA, 16 bp, Homo sapiens
gaggagcacctgaacc

SEQ ID NO: 1228086 - DNA, 17 bp, Homo sapiens
gaggagcacctgaaccc

SEQ ID NO: 1228087 - DNA, 11 bp, Homo sapiens
gaggagcagca

SEQ ID NO: 1228088 - DNA, 16 bp, Homo sapiens
gaggcgtgcccccctc

SEQ ID NO: 1228089 - DNA, 20 bp, Homo sapiens
gaggcgtgcccccctcctcc

SEQ ID NO: 1228090 - DNA, 20 bp, Homo sapiens
gaggcgtggaggagaggaga

SEQ ID NO: 1228091 - DNA, 19 bp, Homo sapiens
gaggctaagatgagatttg

SEQ ID NO: 1228092 - DNA, 18 bp, Homo sapiens
gaggctaagttgggatct

SEQ ID NO: 1228093 - DNA, 16 bp, Homo sapiens
gaggctacctcacctg

SEQ ID NO: 1228094 - DNA, 22 bp, Homo sapiens
gaggctccccgcctccactcta

SEQ ID NO: 1228095 - DNA, 23 bp, Homo sapiens
gaggctctggacagcagaagcct

SEQ ID NO: 1228096 - DNA, 15 bp, Homo sapiens
gaggctgagccctgt

SEQ ID NO: 1228097 - DNA, 16 bp, Homo sapiens
gaggctgaggcagaag

SEQ ID NO: 1228098 - DNA, 16 bp, Homo sapiens
gaggctgaggcctgga

SEQ ID NO: 1228099 - DNA, 12 bp, Homo sapiens
gaggctgaggcg

SEQ ID NO: 1228100 - DNA, 16 bp, Homo sapiens
gaggctgagggacagg

SEQ ID NO: 1228101 - DNA, 18 bp, Homo sapiens
gaggctgcactggagcca

SEQ ID NO: 1228102 - DNA, 20 bp, Homo sapiens
gaggctgcactggagccaca

SEQ ID NO: 1228103 - DNA, 23 bp, Homo sapiens
gaggctgcactggagccacaggc

SEQ ID NO: 1228104 - DNA, 18 bp, Homo sapiens
gaggctgcagcaggtgct

SEQ ID NO: 1228105 - DNA, 16 bp, Homo sapiens
gaggctgcagcgagct

SEQ ID NO: 1228106 - DNA, 16 bp, Homo sapiens
gaggctgcatgctctg

SEQ ID NO: 1228107 - DNA, 17 bp, Homo sapiens
gaggctgcatgctctgg

SEQ ID NO: 1228108 - DNA, 22 bp, Homo sapiens
gaggctgcatgctctggaagcc

SEQ ID NO: 1228109 - DNA, 14 bp, Homo sapiens
gaggctgccccagg

SEQ ID NO: 1228110 - DNA, 19 bp, Homo sapiens
gaggctgcccctctcacca

SEQ ID NO: 1228111 - DNA, 14 bp, Homo sapiens
gaggctgcctcagc

SEQ ID NO: 1228112 - DNA, 11 bp, Homo sapiens
gaggctgctag

SEQ ID NO: 1228113 - DNA, 23 bp, Homo sapiens
gaggctgcttcccagaggagcag

SEQ ID NO: 1228114 - DNA, 14 bp, Homo sapiens
gaggctggaggcag

SEQ ID NO: 1228115 - DNA, 23 bp, Homo sapiens
gaggctggatcctagccttatcc

SEQ ID NO: 1228116 - DNA, 13 bp, Homo sapiens
gaggctggcactg

SEQ ID NO: 1228117 - DNA, 12 bp, Homo sapiens
gaggctggcagg

SEQ ID NO: 1228118 - DNA, 12 bp, Homo sapiens
gaggctggccaa

SEQ ID NO: 1228119 - DNA, 23 bp, Homo sapiens
gaggctgggaatggaggggcaga

SEQ ID NO: 1228120 - DNA, 20 bp, Homo sapiens
gaggctgggaggttgggagg

SEQ ID NO: 1228121 - DNA, 14 bp, Homo sapiens
gaggctgggcccct

SEQ ID NO: 1228122 - DNA, 17 bp, Homo sapiens
gaggctgggcccctggg

SEQ ID NO: 1228123 - DNA, 22 bp, Homo sapiens
gaggctggtggttttcagagca

SEQ ID NO: 1228124 - DNA, 20 bp, Homo sapiens
gaggctggtgtatgcactgc

SEQ ID NO: 1228125 - DNA, 12 bp, Homo sapiens
gaggctgtcctg

SEQ ID NO: 1228126 - DNA, 15 bp, Homo sapiens
gaggctgtctggggc

SEQ ID NO: 1228127 - DNA, 15 bp, Homo sapiens
gaggctgtggctggt

SEQ ID NO: 1228128 - DNA, 18 bp, Homo sapiens
gaggctgtggctggtgag

SEQ ID NO: 1228129 - DNA, 16 bp, Homo sapiens
gagggcagagccatgg

SEQ ID NO: 1228130 - DNA, 17 bp, Homo sapiens
gagggcagagccatggg

SEQ ID NO: 1228131 - DNA, 21 bp, Homo sapiens
gagggcagagccatgggcctg

SEQ ID NO: 1228132 - DNA, 14 bp, Homo sapiens
gagggcagaggctg

SEQ ID NO: 1228133 - DNA, 15 bp, Homo sapiens
gagggcagaggctgg

SEQ ID NO: 1228134 - DNA, 12 bp, Homo sapiens
gagggcagcagg

SEQ ID NO: 1228135 - DNA, 14 bp, Homo sapiens
gagggcagcagggc

SEQ ID NO: 1228136 - DNA, 13 bp, Homo sapiens
gagggcagctgct

SEQ ID NO: 1228137 - DNA, 19 bp, Homo sapiens
gagggcaggcttggggaaa

SEQ ID NO: 1228138 - DNA, 16 bp, Homo sapiens
gagggcagtaccctcc

SEQ ID NO: 1228139 - DNA, 16 bp, Homo sapiens
gagggcagtacctggg

SEQ ID NO: 1228140 - DNA, 17 bp, Homo sapiens
gagggcagtacctggga

SEQ ID NO: 1228141 - DNA, 13 bp, Homo sapiens
gagggcagtgccc

SEQ ID NO: 1228142 - DNA, 15 bp, Homo sapiens
gagggcagtgccctt

SEQ ID NO: 1228143 - DNA, 18 bp, Homo sapiens
gagggcatgggttggcag

SEQ ID NO: 1228144 - DNA, 21 bp, Homo sapiens
gagggccagcaggctcctggc

SEQ ID NO: 1228145 - DNA, 12 bp, Homo sapiens
gagggccaggca

SEQ ID NO: 1228146 - DNA, 14 bp, Homo sapiens
gagggccagggagg

SEQ ID NO: 1228147 - DNA, 19 bp, Homo sapiens
gagggccagggaggcagag

SEQ ID NO: 1228148 - DNA, 20 bp, Homo sapiens
gagggccagggaggcagagc

SEQ ID NO: 1228149 - DNA, 16 bp, Homo sapiens
gagggccagtgatgat

SEQ ID NO: 1228150 - DNA, 22 bp, Homo sapiens
gagggcccagagcaggaagcat

SEQ ID NO: 1228151 - DNA, 14 bp, Homo sapiens
gagggcccagccag

SEQ ID NO: 1228152 - DNA, 13 bp, Homo sapiens
gagggcccagccc

SEQ ID NO: 1228153 - DNA, 21 bp, Homo sapiens
gagggcccagcccagagccac

SEQ ID NO: 1228154 - DNA, 22 bp, Homo sapiens
gagggcccagctgtagccatgg

SEQ ID NO: 1228155 - DNA, 15 bp, Homo sapiens
gagggcccctctgcc

SEQ ID NO: 1228156 - DNA, 16 bp, Homo sapiens
gagggcccctctgccc

SEQ ID NO: 1228157 - DNA, 18 bp, Homo sapiens
gagggcccctctgcccag

SEQ ID NO: 1228158 - DNA, 20 bp, Homo sapiens
gagggcccctctgcccagct

SEQ ID NO: 1228159 - DNA, 19 bp, Homo sapiens
gagggcccctgcgtggggg

SEQ ID NO: 1228160 - DNA, 15 bp, Homo sapiens
gagggccctacctga

SEQ ID NO: 1228161 - DNA, 16 bp, Homo sapiens
gagggccgcagggccc

SEQ ID NO: 1228162 - DNA, 14 bp, Homo sapiens
gagggccgcctgcc

SEQ ID NO: 1228163 - DNA, 15 bp, Homo sapiens
gagggccgcctgcct

SEQ ID NO: 1228164 - DNA, 17 bp, Homo sapiens
gagggccgcctgcctta

SEQ ID NO: 1228165 - DNA, 19 bp, Homo sapiens
gagggccggcggctctgag

SEQ ID NO: 1228166 - DNA, 17 bp, Homo sapiens
gagggccgtaccccacc

SEQ ID NO: 1228167 - DNA, 21 bp, Homo sapiens
gagggccgtaccccaccctca

SEQ ID NO: 1228168 - DNA, 14 bp, Homo sapiens
gagggcctggacct

SEQ ID NO: 1228169 - DNA, 19 bp, Homo sapiens
gagggcctgtgggagcctg

SEQ ID NO: 1228170 - DNA, 17 bp, Homo sapiens
gagggccttgcttctct

SEQ ID NO: 1228171 - DNA, 18 bp, Homo sapiens
gagggcgcccattcgtct

SEQ ID NO: 1228172 - DNA, 12 bp, Homo sapiens
gagggcggccag

SEQ ID NO: 1228173 - DNA, 18 bp, Homo sapiens
gagggctagccctgagcc

SEQ ID NO: 1228174 - DNA, 17 bp, Homo sapiens
gagtctggacctccatc

SEQ ID NO: 1228175 - DNA, 22 bp, Homo sapiens
gagtctggacctccatccctgc

SEQ ID NO: 1228176 - DNA, 11 bp, Homo sapiens
gagtctgggac

SEQ ID NO: 1228177 - DNA, 16 bp, Homo sapiens
gagtctgggcctctga

SEQ ID NO: 1228178 - DNA, 12 bp, Homo sapiens
gagtctgtctca

SEQ ID NO: 1228179 - DNA, 23 bp, Homo sapiens
gagtcttaactgtatttcagtat

SEQ ID NO: 1228180 - DNA, 20 bp, Homo sapiens
gagtcttacaatcaaatctc

SEQ ID NO: 1228181 - DNA, 20 bp, Homo sapiens
gagtcttactctgccgccca

SEQ ID NO: 1228182 - DNA, 18 bp, Homo sapiens
gagtcttcagacccagag

SEQ ID NO: 1228183 - DNA, 21 bp, Homo sapiens
gagtcttcagacccagagaag

SEQ ID NO: 1228184 - DNA, 20 bp, Homo sapiens
gagtcttgctctgtcaccca

SEQ ID NO: 1228185 - DNA, 14 bp, Homo sapiens
gagtcttgggtggc

SEQ ID NO: 1228186 - DNA, 23 bp, Homo sapiens
gagtcttggttctaaaggtacca

SEQ ID NO: 1228187 - DNA, 19 bp, Homo sapiens
gagtcttggtttctctcta

SEQ ID NO: 1228188 - DNA, 19 bp, Homo sapiens
gagtgaaacagagaaagaa

SEQ ID NO: 1228189 - DNA, 21 bp, Homo sapiens
gagtgaaacctttagggcagc

SEQ ID NO: 1228190 - DNA, 12 bp, Homo sapiens
gagtgaaccaga

SEQ ID NO: 1228191 - DNA, 15 bp, Homo sapiens
gagtgaaccatcatt

SEQ ID NO: 1228192 - DNA, 19 bp, Homo sapiens
gagtgaaccccacgccctg

SEQ ID NO: 1228193 - DNA, 16 bp, Homo sapiens
gagtgaacctaccttc

SEQ ID NO: 1228194 - DNA, 14 bp, Homo sapiens
gagtgaagaatctt

SEQ ID NO: 1228195 - DNA, 16 bp, Homo sapiens
gagtgaagaggggcag

SEQ ID NO: 1228196 - DNA, 20 bp, Homo sapiens
gagtgaagaggggcagccct

SEQ ID NO: 1228197 - DNA, 21 bp, Homo sapiens
gagtgaagaggggcagccctt

SEQ ID NO: 1228198 - DNA, 14 bp, Homo sapiens
gagtgaataaatgt

SEQ ID NO: 1228199 - DNA, 15 bp, Homo sapiens
gagtgaataaatgtc

SEQ ID NO: 1228200 - DNA, 11 bp, Homo sapiens
gagtgaatttc

SEQ ID NO: 1228201 - DNA, 17 bp, Homo sapiens
gagtgacagctttctgg

SEQ ID NO: 1228202 - DNA, 21 bp, Homo sapiens
gagtgacagctttctgggatg

SEQ ID NO: 1228203 - DNA, 22 bp, Homo sapiens
gagtgacagctttctgggatgt

SEQ ID NO: 1228204 - DNA, 16 bp, Homo sapiens
gagtgacatgaagcat

SEQ ID NO: 1228205 - DNA, 19 bp, Homo sapiens
gagtgaccctcagctgtca

SEQ ID NO: 1228206 - DNA, 17 bp, Homo sapiens
gagtgaccgggcactgg

SEQ ID NO: 1228207 - DNA, 16 bp, Homo sapiens
gagtgacctaaagcat

SEQ ID NO: 1228208 - DNA, 18 bp, Homo sapiens
gagtgacggtcccacact

SEQ ID NO: 1228209 - DNA, 20 bp, Homo sapiens
gagtgacggtcccacactgg

SEQ ID NO: 1228210 - DNA, 23 bp, Homo sapiens
gagtgactcaagaagtgaagaat

SEQ ID NO: 1228211 - DNA, 18 bp, Homo sapiens
gagtgacttattttgtct

SEQ ID NO: 1228212 - DNA, 22 bp, Homo sapiens
gagtgagacccagccctcatcc

SEQ ID NO: 1228213 - DNA, 13 bp, Homo sapiens
gagtgagaccctg

SEQ ID NO: 1228214 - DNA, 19 bp, Homo sapiens
gagtgagactccacctcaa

SEQ ID NO: 1228215 - DNA, 19 bp, Homo sapiens
gagtgagatgtagaaagtt

SEQ ID NO: 1228216 - DNA, 12 bp, Homo sapiens
gagtgagcagct

SEQ ID NO: 1228217 - DNA, 21 bp, Homo sapiens
gagtgagcagctactgtaact

SEQ ID NO: 1228218 - DNA, 19 bp, Homo sapiens
gagtgaggcttccaggctc

SEQ ID NO: 1228219 - DNA, 20 bp, Homo sapiens
gagtgaggcttccaggctct

SEQ ID NO: 1228220 - DNA, 22 bp, Homo sapiens
gagtgagggcctcagagcctga

SEQ ID NO: 1228221 - DNA, 13 bp, Homo sapiens
gagtgagtgtatg

SEQ ID NO: 1228222 - DNA, 19 bp, Homo sapiens
gagtgagtgtggctcccct

SEQ ID NO: 1228223 - DNA, 21 bp, Homo sapiens
gagtgataatattgtttccct

SEQ ID NO: 1228224 - DNA, 22 bp, Homo sapiens
gagtgatacaacttcaagtgca

SEQ ID NO: 1228225 - DNA, 22 bp, Homo sapiens
gagtgatagggatcctggtggg

SEQ ID NO: 1228226 - DNA, 20 bp, Homo sapiens
gagtgatcacctcttgggga

SEQ ID NO: 1228227 - DNA, 22 bp, Homo sapiens
gagtgatcacctcttggggacc

SEQ ID NO: 1228228 - DNA, 15 bp, Homo sapiens
gagtgatggtgtcct

SEQ ID NO: 1228229 - DNA, 18 bp, Homo sapiens
gagtgatggtgtccttcc

SEQ ID NO: 1228230 - DNA, 13 bp, Homo sapiens
gagtgattaagaa

SEQ ID NO: 1228231 - DNA, 20 bp, Homo sapiens
gagtgattgcagctttatgt

SEQ ID NO: 1228232 - DNA, 16 bp, Homo sapiens
gagtgcagccttctcc

SEQ ID NO: 1228233 - DNA, 18 bp, Homo sapiens
gagtgcaggtttctattg

SEQ ID NO: 1228234 - DNA, 14 bp, Homo sapiens
gagtgcagtcctga

SEQ ID NO: 1228235 - DNA, 14 bp, Homo sapiens
gagtgccaggacca

SEQ ID NO: 1228236 - DNA, 13 bp, Homo sapiens
gagtgcccagcag

SEQ ID NO: 1228237 - DNA, 13 bp, Homo sapiens
gagtgccccactt

SEQ ID NO: 1228238 - DNA, 20 bp, Homo sapiens
gagtgcccctgtcccacctg

SEQ ID NO: 1228239 - DNA, 14 bp, Homo sapiens
gagtgcgggctgag

SEQ ID NO: 1228240 - DNA, 16 bp, Homo sapiens
gagtgcgggctgaggc

SEQ ID NO: 1228241 - DNA, 20 bp, Homo sapiens
gagtgcgggctgaggccaga

SEQ ID NO: 1228242 - DNA, 19 bp, Homo sapiens
gagtgctgaaggaatggaa

SEQ ID NO: 1228243 - DNA, 17 bp, Homo sapiens
gagtgctgattcaaacc

SEQ ID NO: 1228244 - DNA, 14 bp, Homo sapiens
gagtgctggactgt

SEQ ID NO: 1228245 - DNA, 21 bp, Homo sapiens
gagtgctggactgttccaggc

SEQ ID NO: 1228246 - DNA, 15 bp, Homo sapiens
gagtgctgggcactg

SEQ ID NO: 1228247 - DNA, 19 bp, Homo sapiens
gagtgctgggcactgctcc

SEQ ID NO: 1228248 - DNA, 20 bp, Homo sapiens
gagtgctgggcactgctcca

SEQ ID NO: 1228249 - DNA, 17 bp, Homo sapiens
gagtgctgtcgggacca

SEQ ID NO: 1228250 - DNA, 15 bp, Homo sapiens
gagtggaagggagga

SEQ ID NO: 1228251 - DNA, 13 bp, Homo sapiens
gagtggaggagga

SEQ ID NO: 1228252 - DNA, 22 bp, Homo sapiens
gagtggatctccaaggaccagg

SEQ ID NO: 1228253 - DNA, 18 bp, Homo sapiens
gagtggcacttctgcctt

SEQ ID NO: 1228254 - DNA, 11 bp, Homo sapiens
gagtggcagcc

SEQ ID NO: 1228255 - DNA, 13 bp, Homo sapiens
gagtggcagccat

SEQ ID NO: 1228256 - DNA, 20 bp, Homo sapiens
gagtggcagctgtcccctct

SEQ ID NO: 1228257 - DNA, 14 bp, Homo sapiens
gagtggcaggggac

SEQ ID NO: 1228258 - DNA, 11 bp, Homo sapiens
gagtggccact

SEQ ID NO: 1228259 - DNA, 11 bp, Homo sapiens
gagtggccagc

SEQ ID NO: 1228260 - DNA, 10 bp, Homo sapiens
gagtggccca

SEQ ID NO: 1228261 - DNA, 11 bp, Homo sapiens
gagtggcccac

SEQ ID NO: 1228262 - DNA, 23 bp, Homo sapiens
gagtggcccctcacctgggcctt

SEQ ID NO: 1228263 - DNA, 15 bp, Homo sapiens
gagtggcctagagca

SEQ ID NO: 1228264 - DNA, 11 bp, Homo sapiens
gagtggcctcc

SEQ ID NO: 1228265 - DNA, 18 bp, Homo sapiens
gagtggcctggccaggag

SEQ ID NO: 1228266 - DNA, 21 bp, Homo sapiens
gagtggctcactggctgggag

SEQ ID NO: 1228267 - DNA, 17 bp, Homo sapiens
gagtgggaaggacttgg

SEQ ID NO: 1228268 - DNA, 16 bp, Homo sapiens
gagtgggcacctcaga

SEQ ID NO: 1228269 - DNA, 13 bp, Homo sapiens
gagtgggccctgc

SEQ ID NO: 1228270 - DNA, 14 bp, Homo sapiens
gagtgggccctgcc

SEQ ID NO: 1228271 - DNA, 23 bp, Homo sapiens
gagtgggccctgcccggggagct

SEQ ID NO: 1228272 - DNA, 17 bp, Homo sapiens
gagtgggcgcagtggct

SEQ ID NO: 1228273 - DNA, 23 bp, Homo sapiens
gagtgggggatcacagcctctga

SEQ ID NO: 1228274 - DNA, 15 bp, Homo sapiens
gagtgggtgacaaga

SEQ ID NO: 1228275 - DNA, 19 bp, Homo sapiens
gagtgggtgacaagagcct

SEQ ID NO: 1228276 - DNA, 17 bp, Homo sapiens
gagtggtcactggtcag

SEQ ID NO: 1228277 - DNA, 23 bp, Homo sapiens
gagtggtcactggtcagggcagt

SEQ ID NO: 1228278 - DNA, 14 bp, Homo sapiens
gagtggtgccctgg

SEQ ID NO: 1228279 - DNA, 14 bp, Homo sapiens
gagtggttcctgtg

SEQ ID NO: 1228280 - DNA, 19 bp, Homo sapiens
gagtggtttcggaaaaaaa

SEQ ID NO: 1228281 - DNA, 22 bp, Homo sapiens
gagtgtaaaatgtatattttta

SEQ ID NO: 1228282 - DNA, 15 bp, Homo sapiens
gagtgtaaataattt

SEQ ID NO: 1228283 - DNA, 20 bp, Homo sapiens
gagtgtaagtgtgagtaaga

SEQ ID NO: 1228284 - DNA, 15 bp, Homo sapiens
gagtgtacagagtgg

SEQ ID NO: 1228285 - DNA, 12 bp, Homo sapiens
gagtgtactgtg

SEQ ID NO: 1228286 - DNA, 13 bp, Homo sapiens
gagtgtactgtgc

SEQ ID NO: 1228287 - DNA, 23 bp, Homo sapiens
gagtgtagcctaaagggcagggc

SEQ ID NO: 1228288 - DNA, 19 bp, Homo sapiens
gagtgtagggggccttgcg

SEQ ID NO: 1228289 - DNA, 16 bp, Homo sapiens
gagtgtaggtgaaatg

SEQ ID NO: 1228290 - DNA, 17 bp, Homo sapiens
gagtgtatacatgtgtg

SEQ ID NO: 1228291 - DNA, 17 bp, Homo sapiens
gagtgtctggaattgtg

SEQ ID NO: 1228292 - DNA, 16 bp, Homo sapiens
gagtgtctgtgagagg

SEQ ID NO: 1228293 - DNA, 11 bp, Homo sapiens
gagtgtgacag

SEQ ID NO: 1228294 - DNA, 16 bp, Homo sapiens
gagtgtgacagggcca

SEQ ID NO: 1228295 - DNA, 18 bp, Homo sapiens
gagtgtgagggcagcact

SEQ ID NO: 1228296 - DNA, 18 bp, Homo sapiens
gagtgtgcaactggccag

SEQ ID NO: 1228297 - DNA, 14 bp, Homo sapiens
gagtgtgcagacag

SEQ ID NO: 1228298 - DNA, 16 bp, Homo sapiens
gagtgtgcagacagcc

SEQ ID NO: 1228299 - DNA, 13 bp, Homo sapiens
gagtgtgcatgga

SEQ ID NO: 1228300 - DNA, 15 bp, Homo sapiens
gagtgtgcatggagg

SEQ ID NO: 1228301 - DNA, 20 bp, Homo sapiens
gagtgtgcatggaggccctc

SEQ ID NO: 1228302 - DNA, 21 bp, Homo sapiens
gagtgtgcgaatcaaacctga

SEQ ID NO: 1228303 - DNA, 13 bp, Homo sapiens
gagtgtgctgcta

SEQ ID NO: 1228304 - DNA, 16 bp, Homo sapiens
gagtgtgctgtatggc

SEQ ID NO: 1228305 - DNA, 23 bp, Homo sapiens
gagtgtgctgtatggcccaggca

SEQ ID NO: 1228306 - DNA, 18 bp, Homo sapiens
gagtgtgggaagggagag

SEQ ID NO: 1228307 - DNA, 17 bp, Homo sapiens
gagtgtgtgataaatca

SEQ ID NO: 1228308 - DNA, 10 bp, Homo sapiens
gagtgtgtgt

SEQ ID NO: 1228309 - DNA, 15 bp, Homo sapiens
gagtgtgtgtgtgca

SEQ ID NO: 1228310 - DNA, 17 bp, Homo sapiens
gagtgtgtttgtcaccg

SEQ ID NO: 1228311 - DNA, 14 bp, Homo sapiens
gagtgttatgtatt

SEQ ID NO: 1228312 - DNA, 15 bp, Homo sapiens
gagtgttatgtattt

SEQ ID NO: 1228313 - DNA, 17 bp, Homo sapiens
gagtgtttgggggacgt

SEQ ID NO: 1228314 - DNA, 23 bp, Homo sapiens
gagtgtttgggggacgtttctca

SEQ ID NO: 1228315 - DNA, 22 bp, Homo sapiens
gagttaaatagagtatatgcac

SEQ ID NO: 1228316 - DNA, 17 bp, Homo sapiens
gagttacagttctgtgg

SEQ ID NO: 1228317 - DNA, 22 bp, Homo sapiens
gagttacttagaatgccataaa

SEQ ID NO: 1228318 - DNA, 18 bp, Homo sapiens
gagttacttgtctgaggc

SEQ ID NO: 1228319 - DNA, 19 bp, Homo sapiens
gagttaggttaataaatca

SEQ ID NO: 1228320 - DNA, 18 bp, Homo sapiens
gagttagtttctttggga

SEQ ID NO: 1228321 - DNA, 18 bp, Homo sapiens
gagttatcatgaatttta

SEQ ID NO: 1228322 - DNA, 19 bp, Homo sapiens
gagttatcatgaattttaa

SEQ ID NO: 1228323 - DNA, 17 bp, Homo sapiens
gagttattcaaatgaag

SEQ ID NO: 1228324 - DNA, 18 bp, Homo sapiens
gagttcaagcctgtggga

SEQ ID NO: 1228325 - DNA, 17 bp, Homo sapiens
gagttcaccttggaagg

SEQ ID NO: 1228326 - DNA, 15 bp, Homo sapiens
gagttccagaaagta

SEQ ID NO: 1228327 - DNA, 16 bp, Homo sapiens
gagttccagaaagtaa

SEQ ID NO: 1228328 - DNA, 19 bp, Homo sapiens
gagttccagaccccctgag

SEQ ID NO: 1228329 - DNA, 17 bp, Homo sapiens
gagttccatgaagacca

SEQ ID NO: 1228330 - DNA, 18 bp, Homo sapiens
gagttccggcctgggcac

SEQ ID NO: 1228331 - DNA, 13 bp, Homo sapiens
gagttcctctgca

SEQ ID NO: 1228332 - DNA, 14 bp, Homo sapiens
gagttcctctgggt

SEQ ID NO: 1228333 - DNA, 21 bp, Homo sapiens
gagttccttgatctgtatata

SEQ ID NO: 1228334 - DNA, 17 bp, Homo sapiens
gagttcgagaccaacct

SEQ ID NO: 1228335 - DNA, 19 bp, Homo sapiens
gagttcgaggctgcagtca

SEQ ID NO: 1228336 - DNA, 23 bp, Homo sapiens
gagttctatggagactttgctgt

SEQ ID NO: 1228337 - DNA, 16 bp, Homo sapiens
gagttctccctgtaca

SEQ ID NO: 1228338 - DNA, 17 bp, Homo sapiens
gagttctctgatgcaga

SEQ ID NO: 1228339 - DNA, 18 bp, Homo sapiens
gagttctctgatgcagaa

SEQ ID NO: 1228340 - DNA, 13 bp, Homo sapiens
gagttctcttccg

SEQ ID NO: 1228341 - DNA, 17 bp, Homo sapiens
gagttctgggtttctag

SEQ ID NO: 1228342 - DNA, 23 bp, Homo sapiens
gagttctgggtttctagaggtca

SEQ ID NO: 1228343 - DNA, 15 bp, Homo sapiens
gagttcttcctgtaa

SEQ ID NO: 1228344 - DNA, 19 bp, Homo sapiens
gagttctttgctgcccctg

SEQ ID NO: 1228345 - DNA, 22 bp, Homo sapiens
gagttgaccgttttcatcctgg

SEQ ID NO: 1228346 - DNA, 22 bp, Homo sapiens
gagttgatactacagtttgtta

SEQ ID NO: 1228347 - DNA, 16 bp, Homo sapiens
gagttgattcagctct

SEQ ID NO: 1228348 - DNA, 17 bp, Homo sapiens
gagttgccaagacaaat

SEQ ID NO: 1228349 - DNA, 14 bp, Homo sapiens
gagttgctgtgccg

SEQ ID NO: 1228350 - DNA, 22 bp, Homo sapiens
gagttggagtactatatttaca

SEQ ID NO: 1228351 - DNA, 23 bp, Homo sapiens
gagttggattaaattctgggtga

SEQ ID NO: 1228352 - DNA, 16 bp, Homo sapiens
gagttggctcaggcag

SEQ ID NO: 1228353 - DNA, 16 bp, Homo sapiens
gagttggggaaggcaa

SEQ ID NO: 1228354 - DNA, 14 bp, Homo sapiens
gagttggggctgcc

SEQ ID NO: 1228355 - DNA, 23 bp, Homo sapiens
gagttgggggagggaagaccaga

SEQ ID NO: 1228356 - DNA, 12 bp, Homo sapiens
gagttgtaaata

SEQ ID NO: 1228357 - DNA, 15 bp, Homo sapiens
gagttgtaaatatat

SEQ ID NO: 1228358 - DNA, 18 bp, Homo sapiens
gagttgtgagccctctag

SEQ ID NO: 1228359 - DNA, 15 bp, Homo sapiens
gagttgtgatgaatc

SEQ ID NO: 1228360 - DNA, 18 bp, Homo sapiens
gagtttaaagagaaaagg

SEQ ID NO: 1228361 - DNA, 20 bp, Homo sapiens
gagtttaaagagaaaaggga

SEQ ID NO: 1228362 - DNA, 18 bp, Homo sapiens
gagtttaatacaggaaat

SEQ ID NO: 1228363 - DNA, 17 bp, Homo sapiens
gagtttacagtttgtgt

SEQ ID NO: 1228364 - DNA, 17 bp, Homo sapiens
gagtttaccatttgtaa

SEQ ID NO: 1228365 - DNA, 20 bp, Homo sapiens
gagtttaccatttgtaataa

SEQ ID NO: 1228366 - DNA, 22 bp, Homo sapiens
gagtttattacaatgtatcttt

SEQ ID NO: 1228367 - DNA, 15 bp, Homo sapiens
gagtttcatgtacaa

SEQ ID NO: 1228368 - DNA, 17 bp, Homo sapiens
gagtttcctatgggaac

SEQ ID NO: 1228369 - DNA, 12 bp, Homo sapiens
gagtttctctgt

SEQ ID NO: 1228370 - DNA, 22 bp, Homo sapiens
gagtttgagacaagccctggca

SEQ ID NO: 1228371 - DNA, 17 bp, Homo sapiens
gagtttgagctgccttc

SEQ ID NO: 1228372 - DNA, 14 bp, Homo sapiens
gagtttgccttcct

SEQ ID NO: 1228373 - DNA, 18 bp, Homo sapiens
gagtttgctattagagca

SEQ ID NO: 1228374 - DNA, 13 bp, Homo sapiens
gagtttggtctgg

SEQ ID NO: 1228375 - DNA, 17 bp, Homo sapiens
gagtttggtctggactg

SEQ ID NO: 1228376 - DNA, 15 bp, Homo sapiens
gagtttgtattatta

SEQ ID NO: 1228377 - DNA, 14 bp, Homo sapiens
gagtttgtattttg

SEQ ID NO: 1228378 - DNA, 13 bp, Homo sapiens
gagtttgtgtctg

SEQ ID NO: 1228379 - DNA, 18 bp, Homo sapiens
gagtttgtgtgttgtctt

SEQ ID NO: 1228380 - DNA, 16 bp, Homo sapiens
gagtttgttctgttct

SEQ ID NO: 1228381 - DNA, 21 bp, Homo sapiens
gagtttgttctgttctggggg

SEQ ID NO: 1228382 - DNA, 22 bp, Homo sapiens
gagtttgttctgttctggggga

SEQ ID NO: 1228383 - DNA, 16 bp, Homo sapiens
gagttttaacaatcca

SEQ ID NO: 1228384 - DNA, 12 bp, Homo sapiens
gagttttaacac

SEQ ID NO: 1228385 - DNA, 23 bp, Homo sapiens
gagttttcctctatacatctctc

SEQ ID NO: 1228386 - DNA, 18 bp, Homo sapiens
gagttttgtgtttgttgt

SEQ ID NO: 1228387 - DNA, 19 bp, Homo sapiens
gagttttgttttaaaatta

SEQ ID NO: 1228388 - DNA, 20 bp, Homo sapiens
gagttttgttttttgtttct

SEQ ID NO: 1228389 - DNA, 13 bp, Homo sapiens
gagtttttcctcc

SEQ ID NO: 1228390 - DNA, 21 bp, Homo sapiens
gagtttttgtttgtttcttct

SEQ ID NO: 1228391 - DNA, 17 bp, Homo sapiens
gagttttttattccagt

SEQ ID NO: 1228392 - DNA, 22 bp, Homo sapiens
gataaaaacccaaaatacagct

SEQ ID NO: 1228393 - DNA, 14 bp, Homo sapiens
gataaaaagatggc

SEQ ID NO: 1228394 - DNA, 18 bp, Homo sapiens
gataaaaagccagggctg

SEQ ID NO: 1228395 - DNA, 17 bp, Homo sapiens
gataaaaaggaaggaga

SEQ ID NO: 1228396 - DNA, 20 bp, Homo sapiens
gataaaaataataataaagt

SEQ ID NO: 1228397 - DNA, 15 bp, Homo sapiens
gataaaactgtgtaa

SEQ ID NO: 1228398 - DNA, 13 bp, Homo sapiens
gataaaagatggc

SEQ ID NO: 1228399 - DNA, 16 bp, Homo sapiens
gataaaagatggccat

SEQ ID NO: 1228400 - DNA, 18 bp, Homo sapiens
gataaaataaataatttt

SEQ ID NO: 1228401 - DNA, 17 bp, Homo sapiens
gataaaatatcctcagg

SEQ ID NO: 1228402 - DNA, 18 bp, Homo sapiens
gataaaatgaggttcaac

SEQ ID NO: 1228403 - DNA, 15 bp, Homo sapiens
gataaaatgttcagt

SEQ ID NO: 1228404 - DNA, 19 bp, Homo sapiens
gataaaattgtgatgtttt

SEQ ID NO: 1228405 - DNA, 18 bp, Homo sapiens
gataaacaacaaggtggt

SEQ ID NO: 1228406 - DNA, 13 bp, Homo sapiens
gataaacattaaa

SEQ ID NO: 1228407 - DNA, 22 bp, Homo sapiens
gataaactgagcctcacttgcc

SEQ ID NO: 1228408 - DNA, 13 bp, Homo sapiens
gataaagaaaaga

SEQ ID NO: 1228409 - DNA, 16 bp, Homo sapiens
gataaagaaaagacat

SEQ ID NO: 1228410 - DNA, 11 bp, Homo sapiens
gataaagatga

SEQ ID NO: 1228411 - DNA, 13 bp, Homo sapiens
gataaagatttct

SEQ ID NO: 1228412 - DNA, 19 bp, Homo sapiens
gataaagatttctagtagg

SEQ ID NO: 1228413 - DNA, 16 bp, Homo sapiens
gataaagatttcttga

SEQ ID NO: 1228414 - DNA, 15 bp, Homo sapiens
gataaagcacagctg

SEQ ID NO: 1228415 - DNA, 18 bp, Homo sapiens
gataaataatcggcccac

SEQ ID NO: 1228416 - DNA, 21 bp, Homo sapiens
gataaatattgagcagatcta

SEQ ID NO: 1228417 - DNA, 14 bp, Homo sapiens
gataaatatttgac

SEQ ID NO: 1228418 - DNA, 18 bp, Homo sapiens
gataaatcagtggttatt

SEQ ID NO: 1228419 - DNA, 16 bp, Homo sapiens
gataaatcatttcagt

SEQ ID NO: 1228420 - DNA, 15 bp, Homo sapiens
gataaatttgttgaa

SEQ ID NO: 1228421 - DNA, 14 bp, Homo sapiens
gataacacttaaaa

SEQ ID NO: 1228422 - DNA, 15 bp, Homo sapiens
gataacacttaaaat

SEQ ID NO: 1228423 - DNA, 15 bp, Homo sapiens
gataacagcctcttg

SEQ ID NO: 1228424 - DNA, 19 bp, Homo sapiens
gagtaataggaccagagcg

SEQ ID NO: 1228425 - DNA, 16 bp, Homo sapiens
gagtaatatgcctgct

SEQ ID NO: 1228426 - DNA, 14 bp, Homo sapiens
gagtaatgatgtaa

SEQ ID NO: 1228427 - DNA, 14 bp, Homo sapiens
gagtaatggtgtag

SEQ ID NO: 1228428 - DNA, 17 bp, Homo sapiens
gagtaatggtgtagaac

SEQ ID NO: 1228429 - DNA, 22 bp, Homo sapiens
gagtaatggtgtagaacactaa

SEQ ID NO: 1228430 - DNA, 17 bp, Homo sapiens
gagtaattttggatttt

SEQ ID NO: 1228431 - DNA, 22 bp, Homo sapiens
gagtacctccagtcacactccc

SEQ ID NO: 1228432 - DNA, 18 bp, Homo sapiens
gagtacctgctgccccag

SEQ ID NO: 1228433 - DNA, 18 bp, Homo sapiens
gagtacgttgtgcatttg

SEQ ID NO: 1228434 - DNA, 19 bp, Homo sapiens
gagtactcacttttcactt

SEQ ID NO: 1228435 - DNA, 14 bp, Homo sapiens
gagtactggaataa

SEQ ID NO: 1228436 - DNA, 23 bp, Homo sapiens
gagtagaaaatgtgaccctccaa

SEQ ID NO: 1228437 - DNA, 13 bp, Homo sapiens
gagtagagaggcc

SEQ ID NO: 1228438 - DNA, 22 bp, Homo sapiens
gagtagcaagttctagagaaga

SEQ ID NO: 1228439 - DNA, 21 bp, Homo sapiens
gagtagcctaaaattactatt

SEQ ID NO: 1228440 - DNA, 17 bp, Homo sapiens
gagtagctagtttgctt

SEQ ID NO: 1228441 - DNA, 12 bp, Homo sapiens
gagtagctggat

SEQ ID NO: 1228442 - DNA, 19 bp, Homo sapiens
gagtagctgggactacagg

SEQ ID NO: 1228443 - DNA, 12 bp, Homo sapiens
gagtagctgggc

SEQ ID NO: 1228444 - DNA, 21 bp, Homo sapiens
gagtaggcggcgatttttgta

SEQ ID NO: 1228445 - DNA, 17 bp, Homo sapiens
gagtagggtagaaggaa

SEQ ID NO: 1228446 - DNA, 23 bp, Homo sapiens
gagtagttatataattgttgaac

SEQ ID NO: 1228447 - DNA, 14 bp, Homo sapiens
gagtatatgcactt

SEQ ID NO: 1228448 - DNA, 11 bp, Homo sapiens
gagtatatgtc

SEQ ID NO: 1228449 - DNA, 21 bp, Homo sapiens
gagtatatttttgtctgcagc

SEQ ID NO: 1228450 - DNA, 11 bp, Homo sapiens
gagtatcactt

SEQ ID NO: 1228451 - DNA, 14 bp, Homo sapiens
gagtatcactttaa

SEQ ID NO: 1228452 - DNA, 14 bp, Homo sapiens
gagtatccttcctt

SEQ ID NO: 1228453 - DNA, 16 bp, Homo sapiens
gagtatgtagtggctt

SEQ ID NO: 1228454 - DNA, 18 bp, Homo sapiens
gagtattgaatggtggtg

SEQ ID NO: 1228455 - DNA, 17 bp, Homo sapiens
gagtattggaagacttg

SEQ ID NO: 1228456 - DNA, 14 bp, Homo sapiens
gagtatttcccttc

SEQ ID NO: 1228457 - DNA, 20 bp, Homo sapiens
gagtcaaaagcctgggtgag

SEQ ID NO: 1228458 - DNA, 14 bp, Homo sapiens
gagtcaaagctgac

SEQ ID NO: 1228459 - DNA, 21 bp, Homo sapiens
gagtcaaagctgaccatggat

SEQ ID NO: 1228460 - DNA, 19 bp, Homo sapiens
gagtcaaatggtaggcatt

SEQ ID NO: 1228461 - DNA, 12 bp, Homo sapiens
gagtcaatttgc

SEQ ID NO: 1228462 - DNA, 18 bp, Homo sapiens
gagtcacaggtgtgggat

SEQ ID NO: 1228463 - DNA, 22 bp, Homo sapiens
gagtcacaggtgtgggatggag

SEQ ID NO: 1228464 - DNA, 15 bp, Homo sapiens
gagtcacattctgct

SEQ ID NO: 1228465 - DNA, 22 bp, Homo sapiens
gagtcacattctgcttaaagtt

SEQ ID NO: 1228466 - DNA, 17 bp, Homo sapiens
gagtcacccagttggtg

SEQ ID NO: 1228467 - DNA, 20 bp, Homo sapiens
gagtcacccagttggtgact

SEQ ID NO: 1228468 - DNA, 19 bp, Homo sapiens
gagtcaccctcctcacaga

SEQ ID NO: 1228469 - DNA, 12 bp, Homo sapiens
gagtcacctcct

SEQ ID NO: 1228470 - DNA, 11 bp, Homo sapiens
gagtcacctgc

SEQ ID NO: 1228471 - DNA, 14 bp, Homo sapiens
gagtcacctgcaag

SEQ ID NO: 1228472 - DNA, 21 bp, Homo sapiens
gagtcacctgcaagccccagg

SEQ ID NO: 1228473 - DNA, 15 bp, Homo sapiens
gagtcacctgctcca

SEQ ID NO: 1228474 - DNA, 12 bp, Homo sapiens
gagtcagagccc

SEQ ID NO: 1228475 - DNA, 14 bp, Homo sapiens
gagtcagagccctg

SEQ ID NO: 1228476 - DNA, 20 bp, Homo sapiens
gagtcagagccctggctggg

SEQ ID NO: 1228477 - DNA, 20 bp, Homo sapiens
gagtcagcaccttggcccag

SEQ ID NO: 1228478 - DNA, 21 bp, Homo sapiens
gagtcagcaccttggcccagg

SEQ ID NO: 1228479 - DNA, 22 bp, Homo sapiens
gagtcagcaccttggcccagga

SEQ ID NO: 1228480 - DNA, 16 bp, Homo sapiens
gagtcagccaggagct

SEQ ID NO: 1228481 - DNA, 21 bp, Homo sapiens
gagtcaggcaattgattgtga

SEQ ID NO: 1228482 - DNA, 12 bp, Homo sapiens
gagtcaggcctg

SEQ ID NO: 1228483 - DNA, 16 bp, Homo sapiens
gagtcaggggctctgt

SEQ ID NO: 1228484 - DNA, 22 bp, Homo sapiens
gagtcagggtgaactgcaaagc

SEQ ID NO: 1228485 - DNA, 22 bp, Homo sapiens
gagtcaggtgaggcatctttac

SEQ ID NO: 1228486 - DNA, 18 bp, Homo sapiens
gagtcaggtttggggttc

SEQ ID NO: 1228487 - DNA, 20 bp, Homo sapiens
gagtcagtgaagtctagaat

SEQ ID NO: 1228488 - DNA, 23 bp, Homo sapiens
gagtcagtgaagtctagaatcat

SEQ ID NO: 1228489 - DNA, 13 bp, Homo sapiens
gagtcatctccat

SEQ ID NO: 1228490 - DNA, 22 bp, Homo sapiens
gagggctagccctgagcccggc

SEQ ID NO: 1228491 - DNA, 17 bp, Homo sapiens
gagggctcactcagcca

SEQ ID NO: 1228492 - DNA, 11 bp, Homo sapiens
gagggctcaga

SEQ ID NO: 1228493 - DNA, 19 bp, Homo sapiens
gagggctcagaagagcagc

SEQ ID NO: 1228494 - DNA, 19 bp, Homo sapiens
gagggctcgaggggtgggc

SEQ ID NO: 1228495 - DNA, 14 bp, Homo sapiens
gagggctctgtttg

SEQ ID NO: 1228496 - DNA, 17 bp, Homo sapiens
gagggctgaggagcagc

SEQ ID NO: 1228497 - DNA, 20 bp, Homo sapiens
gagggctgaggagcagccag

SEQ ID NO: 1228498 - DNA, 22 bp, Homo sapiens
gagggctgatggaggaaaaagg

SEQ ID NO: 1228499 - DNA, 19 bp, Homo sapiens
gagggctggaggcccaggc

SEQ ID NO: 1228500 - DNA, 13 bp, Homo sapiens
gagggctgggccc

SEQ ID NO: 1228501 - DNA, 16 bp, Homo sapiens
gagggcttggcccagc

SEQ ID NO: 1228502 - DNA, 16 bp, Homo sapiens
gagggcttggggctgc

SEQ ID NO: 1228503 - DNA, 16 bp, Homo sapiens
gaggggaaacaatgaa

SEQ ID NO: 1228504 - DNA, 20 bp, Homo sapiens
gaggggaaacaatgaaaaca

SEQ ID NO: 1228505 - DNA, 14 bp, Homo sapiens
gaggggaaatgtaa

SEQ ID NO: 1228506 - DNA, 20 bp, Homo sapiens
gaggggaaatgtaatactgg

SEQ ID NO: 1228507 - DNA, 15 bp, Homo sapiens
gaggggaagaattta

SEQ ID NO: 1228508 - DNA, 12 bp, Homo sapiens
gaggggaagctg

SEQ ID NO: 1228509 - DNA, 17 bp, Homo sapiens
gaggggaagctgggccc

SEQ ID NO: 1228510 - DNA, 14 bp, Homo sapiens
gaggggacagagct

SEQ ID NO: 1228511 - DNA, 19 bp, Homo sapiens
gaggggacagagctgagga

SEQ ID NO: 1228512 - DNA, 13 bp, Homo sapiens
gaggggacccagc

SEQ ID NO: 1228513 - DNA, 23 bp, Homo sapiens
gaggggacccagctcctctgagc

SEQ ID NO: 1228514 - DNA, 15 bp, Homo sapiens
gaggggacgggcaag

SEQ ID NO: 1228515 - DNA, 13 bp, Homo sapiens
gaggggactctgg

SEQ ID NO: 1228516 - DNA, 12 bp, Homo sapiens
gaggggagcagc

SEQ ID NO: 1228517 - DNA, 11 bp, Homo sapiens
gaggggaggag

SEQ ID NO: 1228518 - DNA, 21 bp, Homo sapiens
gaggggaggatcactggagcc

SEQ ID NO: 1228519 - DNA, 13 bp, Homo sapiens
gaggggaggcaga

SEQ ID NO: 1228520 - DNA, 14 bp, Homo sapiens
gaggggagggaggg

SEQ ID NO: 1228521 - DNA, 13 bp, Homo sapiens
gaggggagggctc

SEQ ID NO: 1228522 - DNA, 15 bp, Homo sapiens
gaggggattctctac

SEQ ID NO: 1228523 - DNA, 18 bp, Homo sapiens
gaggggattctctactgc

SEQ ID NO: 1228524 - DNA, 19 bp, Homo sapiens
gaggggattctctactgcc

SEQ ID NO: 1228525 - DNA, 20 bp, Homo sapiens
gaggggattctctactgcca

SEQ ID NO: 1228526 - DNA, 18 bp, Homo sapiens
gaggggcagaacagccgc

SEQ ID NO: 1228527 - DNA, 16 bp, Homo sapiens
gaggggcagagccagg

SEQ ID NO: 1228528 - DNA, 13 bp, Homo sapiens
gaggggcagccgc

SEQ ID NO: 1228529 - DNA, 14 bp, Homo sapiens
gaggggcaggacct

SEQ ID NO: 1228530 - DNA, 12 bp, Homo sapiens
gaggggcaggga

SEQ ID NO: 1228531 - DNA, 14 bp, Homo sapiens
gaggggcagggaga

SEQ ID NO: 1228532 - DNA, 16 bp, Homo sapiens
gaggggcagggagagc

SEQ ID NO: 1228533 - DNA, 15 bp, Homo sapiens
gaggggcaggtaaac

SEQ ID NO: 1228534 - DNA, 22 bp, Homo sapiens
gaggggcatctgcccctccccc

SEQ ID NO: 1228535 - DNA, 20 bp, Homo sapiens
gaggggccaccccgtgcccc

SEQ ID NO: 1228536 - DNA, 19 bp, Homo sapiens
gaggggccctggccaggac

SEQ ID NO: 1228537 - DNA, 17 bp, Homo sapiens
gaggggcctagggagcc

SEQ ID NO: 1228538 - DNA, 22 bp, Homo sapiens
gaggggcctcccccagcacaga

SEQ ID NO: 1228539 - DNA, 16 bp, Homo sapiens
gaggggcctgatgaga

SEQ ID NO: 1228540 - DNA, 17 bp, Homo sapiens
gaggggcctgcgcccag

SEQ ID NO: 1228541 - DNA, 14 bp, Homo sapiens
gaggggcgctggcc

SEQ ID NO: 1228542 - DNA, 15 bp, Homo sapiens
gaggggcgctggccc

SEQ ID NO: 1228543 - DNA, 18 bp, Homo sapiens
gaggggcgctggcccagc

SEQ ID NO: 1228544 - DNA, 16 bp, Homo sapiens
gaggggcgggctcaga

SEQ ID NO: 1228545 - DNA, 19 bp, Homo sapiens
gaggggcgggctcagagct

SEQ ID NO: 1228546 - DNA, 13 bp, Homo sapiens
gaggggctcctgg

SEQ ID NO: 1228547 - DNA, 15 bp, Homo sapiens
gaggggctcctggaa

SEQ ID NO: 1228548 - DNA, 16 bp, Homo sapiens
gaggggctgggctggg

SEQ ID NO: 1228549 - DNA, 14 bp, Homo sapiens
gaggggctggggag

SEQ ID NO: 1228550 - DNA, 16 bp, Homo sapiens
gaggggctggggaggg

SEQ ID NO: 1228551 - DNA, 20 bp, Homo sapiens
gaggggctggggcaggctct

SEQ ID NO: 1228552 - DNA, 16 bp, Homo sapiens
gaggggctgtcctcct

SEQ ID NO: 1228553 - DNA, 19 bp, Homo sapiens
gaggggctgtcctccttcc

SEQ ID NO: 1228554 - DNA, 17 bp, Homo sapiens
gaggggctttctggaga

SEQ ID NO: 1228555 - DNA, 20 bp, Homo sapiens
gagggggactaaactcaacc

SEQ ID NO: 1228556 - DNA, 14 bp, Homo sapiens
gagggggagtagcc

SEQ ID NO: 1228557 - DNA, 15 bp, Homo sapiens
gagggggagtagcca

SEQ ID NO: 1228558 - DNA, 14 bp, Homo sapiens
gagggggccgggcg

SEQ ID NO: 1228559 - DNA, 23 bp, Homo sapiens
gagggggccggggggaggggaca

SEQ ID NO: 1228560 - DNA, 16 bp, Homo sapiens
gagggggcgctcagga

SEQ ID NO: 1228561 - DNA, 20 bp, Homo sapiens
gagggggcgctcaggaccca

SEQ ID NO: 1228562 - DNA, 12 bp, Homo sapiens
gagggggctctc

SEQ ID NO: 1228563 - DNA, 14 bp, Homo sapiens
gagggggctctgcc

SEQ ID NO: 1228564 - DNA, 21 bp, Homo sapiens
gagggggcttgaagccaaaga

SEQ ID NO: 1228565 - DNA, 17 bp, Homo sapiens
gaggggggagggggaag

SEQ ID NO: 1228566 - DNA, 18 bp, Homo sapiens
gagggggtacctcatgag

SEQ ID NO: 1228567 - DNA, 16 bp, Homo sapiens
gagggggtcctcctcg

SEQ ID NO: 1228568 - DNA, 12 bp, Homo sapiens
gatcacaagatg

SEQ ID NO: 1228569 - DNA, 20 bp, Homo sapiens
gatcacacctcagtgggaag

SEQ ID NO: 1228570 - DNA, 13 bp, Homo sapiens
gatcacagcctcc

SEQ ID NO: 1228571 - DNA, 17 bp, Homo sapiens
gatcacagcctccaggg

SEQ ID NO: 1228572 - DNA, 19 bp, Homo sapiens
gatcacagcctccagggcc

SEQ ID NO: 1228573 - DNA, 13 bp, Homo sapiens
gatcacagctgct

SEQ ID NO: 1228574 - DNA, 17 bp, Homo sapiens
gatcacagctgctttct

SEQ ID NO: 1228575 - DNA, 20 bp, Homo sapiens
gatcacagctgctttctgtt

SEQ ID NO: 1228576 - DNA, 11 bp, Homo sapiens
gatcacaggag

SEQ ID NO: 1228577 - DNA, 17 bp, Homo sapiens
gatcacatcttaaattc

SEQ ID NO: 1228578 - DNA, 23 bp, Homo sapiens
gatcacatcttaaattcatttct

SEQ ID NO: 1228579 - DNA, 21 bp, Homo sapiens
gatcaccaaacaacttcagaa

SEQ ID NO: 1228580 - DNA, 18 bp, Homo sapiens
gatcaccagcccggcctg

SEQ ID NO: 1228581 - DNA, 20 bp, Homo sapiens
gatcaccagcccggcctgct

SEQ ID NO: 1228582 - DNA, 23 bp, Homo sapiens
gatcacgccactgcactccagcc

SEQ ID NO: 1228583 - DNA, 14 bp, Homo sapiens
gatcacgcctggct

SEQ ID NO: 1228584 - DNA, 15 bp, Homo sapiens
gatcacgcctggcta

SEQ ID NO: 1228585 - DNA, 13 bp, Homo sapiens
gatcactgaattt

SEQ ID NO: 1228586 - DNA, 16 bp, Homo sapiens
gatcactgaatttata

SEQ ID NO: 1228587 - DNA, 13 bp, Homo sapiens
gatcactggagcc

SEQ ID NO: 1228588 - DNA, 14 bp, Homo sapiens
gatcagaacatgaa

SEQ ID NO: 1228589 - DNA, 11 bp, Homo sapiens
gatcagacagc

SEQ ID NO: 1228590 - DNA, 16 bp, Homo sapiens
gatcagagcaggacct

SEQ ID NO: 1228591 - DNA, 14 bp, Homo sapiens
gatcagcaaattta

SEQ ID NO: 1228592 - DNA, 16 bp, Homo sapiens
gatcagcaaatttaag

SEQ ID NO: 1228593 - DNA, 15 bp, Homo sapiens
gatcagcagcgtgca

SEQ ID NO: 1228594 - DNA, 21 bp, Homo sapiens
gatcagcattgtgacttggag

SEQ ID NO: 1228595 - DNA, 20 bp, Homo sapiens
gatcagcattttagaaacta

SEQ ID NO: 1228596 - DNA, 15 bp, Homo sapiens
gatcagccattaaaa

SEQ ID NO: 1228597 - DNA, 19 bp, Homo sapiens
gatcagccattaaaataaa

SEQ ID NO: 1228598 - DNA, 23 bp, Homo sapiens
gatcagccccaccctggcctaga

SEQ ID NO: 1228599 - DNA, 15 bp, Homo sapiens
gatcagccccgcctg

SEQ ID NO: 1228600 - DNA, 20 bp, Homo sapiens
gatcagccccgcctgtcaca

SEQ ID NO: 1228601 - DNA, 18 bp, Homo sapiens
gataaccccaggcactgt

SEQ ID NO: 1228602 - DNA, 22 bp, Homo sapiens
gataaccccaggcactgtttgg

SEQ ID NO: 1228603 - DNA, 16 bp, Homo sapiens
gataactctctttcct

SEQ ID NO: 1228604 - DNA, 19 bp, Homo sapiens
gataactctctttccttga

SEQ ID NO: 1228605 - DNA, 11 bp, Homo sapiens
gataactctgt

SEQ ID NO: 1228606 - DNA, 14 bp, Homo sapiens
gataacttactgta

SEQ ID NO: 1228607 - DNA, 22 bp, Homo sapiens
gataacttcttgaaaaagatgg

SEQ ID NO: 1228608 - DNA, 18 bp, Homo sapiens
gataacttgctttcttct

SEQ ID NO: 1228609 - DNA, 16 bp, Homo sapiens
gataactttacagaaa

SEQ ID NO: 1228610 - DNA, 22 bp, Homo sapiens
gataagaatgctggttttccta

SEQ ID NO: 1228611 - DNA, 22 bp, Homo sapiens
gataagagtagaaactgcaggg

SEQ ID NO: 1228612 - DNA, 23 bp, Homo sapiens
gataagccactctgtcccttcct

SEQ ID NO: 1228613 - DNA, 16 bp, Homo sapiens
gataagggaaaagata

SEQ ID NO: 1228614 - DNA, 22 bp, Homo sapiens
gataaggggccttgctctgagc

SEQ ID NO: 1228615 - DNA, 14 bp, Homo sapiens
gataaggggtgggg

SEQ ID NO: 1228616 - DNA, 22 bp, Homo sapiens
gataaggggtgggggagaaaaa

SEQ ID NO: 1228617 - DNA, 16 bp, Homo sapiens
gataaggtctgtagta

SEQ ID NO: 1228618 - DNA, 14 bp, Homo sapiens
gataagtgtaaata

SEQ ID NO: 1228619 - DNA, 16 bp, Homo sapiens
gataagtgtatttttc

SEQ ID NO: 1228620 - DNA, 17 bp, Homo sapiens
gataataaaatttagac

SEQ ID NO: 1228621 - DNA, 14 bp, Homo sapiens
gataataatcttgg

SEQ ID NO: 1228622 - DNA, 18 bp, Homo sapiens
gataatacaccactacat

SEQ ID NO: 1228623 - DNA, 19 bp, Homo sapiens
gataataggtagcctgctg

SEQ ID NO: 1228624 - DNA, 16 bp, Homo sapiens
gataatataaaaagca

SEQ ID NO: 1228625 - DNA, 19 bp, Homo sapiens
gataatatataaacaataa

SEQ ID NO: 1228626 - DNA, 16 bp, Homo sapiens
gataatatattgtgtt

SEQ ID NO: 1228627 - DNA, 17 bp, Homo sapiens
gataatatatttgcaga

SEQ ID NO: 1228628 - DNA, 20 bp, Homo sapiens
gataatatgtttagttttac

SEQ ID NO: 1228629 - DNA, 15 bp, Homo sapiens
gataatattagtgat

SEQ ID NO: 1228630 - DNA, 22 bp, Homo sapiens
gataatcaattattacatttat

SEQ ID NO: 1228631 - DNA, 16 bp, Homo sapiens
gataatctcagtgctt

SEQ ID NO: 1228632 - DNA, 16 bp, Homo sapiens
gataatgaaataatca

SEQ ID NO: 1228633 - DNA, 15 bp, Homo sapiens
gataatgctgttgcc

SEQ ID NO: 1228634 - DNA, 14 bp, Homo sapiens
gataatggagaatg

SEQ ID NO: 1228635 - DNA, 15 bp, Homo sapiens
gataatgtattttaa

SEQ ID NO: 1228636 - DNA, 17 bp, Homo sapiens
gatggccccgcaaggcc

SEQ ID NO: 1228637 - DNA, 14 bp, Homo sapiens
gatggcccctccac

SEQ ID NO: 1228638 - DNA, 15 bp, Homo sapiens
gatggcccctccttg

SEQ ID NO: 1228639 - DNA, 23 bp, Homo sapiens
gatggcccctccttgcaaccagg

SEQ ID NO: 1228640 - DNA, 14 bp, Homo sapiens
gatggcctggctgc

SEQ ID NO: 1228641 - DNA, 17 bp, Homo sapiens
gatggcctttccttccc

SEQ ID NO: 1228642 - DNA, 16 bp, Homo sapiens
gatggcctttggaccc

SEQ ID NO: 1228643 - DNA, 22 bp, Homo sapiens
gatggcctttggacccagggcc

SEQ ID NO: 1228644 - DNA, 23 bp, Homo sapiens
gatggcctttggacccagggcct

SEQ ID NO: 1228645 - DNA, 18 bp, Homo sapiens
gatggcgaccaccaaagt

SEQ ID NO: 1228646 - DNA, 19 bp, Homo sapiens
gatggcgaccaccaaagtc

SEQ ID NO: 1228647 - DNA, 22 bp, Homo sapiens
gatggcgatggggactctgccg

SEQ ID NO: 1228648 - DNA, 17 bp, Homo sapiens
gatggcgcgggaggcac

SEQ ID NO: 1228649 - DNA, 15 bp, Homo sapiens
gatggcgggcactgg

SEQ ID NO: 1228650 - DNA, 17 bp, Homo sapiens
gatggctatgccttgca

SEQ ID NO: 1228651 - DNA, 14 bp, Homo sapiens
gatggctcctctca

SEQ ID NO: 1228652 - DNA, 13 bp, Homo sapiens
gatggctgtgcct

SEQ ID NO: 1228653 - DNA, 21 bp, Homo sapiens
gatggctgtggcatttccaaa

SEQ ID NO: 1228654 - DNA, 22 bp, Homo sapiens
gatggctgtggcatttccaaac

SEQ ID NO: 1228655 - DNA, 17 bp, Homo sapiens
gatggctttcagggcag

SEQ ID NO: 1228656 - DNA, 14 bp, Homo sapiens
gatgggaaaatatt

SEQ ID NO: 1228657 - DNA, 13 bp, Homo sapiens
gatgggaaggagg

SEQ ID NO: 1228658 - DNA, 15 bp, Homo sapiens
gatgggaaggagggg

SEQ ID NO: 1228659 - DNA, 23 bp, Homo sapiens
gatgggaaggttagaaaggcagc

SEQ ID NO: 1228660 - DNA, 16 bp, Homo sapiens
gatgggactcattgta

SEQ ID NO: 1228661 - DNA, 21 bp, Homo sapiens
gatgggaggagagccactggg

SEQ ID NO: 1228662 - DNA, 16 bp, Homo sapiens
gatgggagtctccctc

SEQ ID NO: 1228663 - DNA, 15 bp, Homo sapiens
gatgggatcctctcc

SEQ ID NO: 1228664 - DNA, 22 bp, Homo sapiens
gatgggcagatcttttctttaa

SEQ ID NO: 1228665 - DNA, 16 bp, Homo sapiens
gatgggcattgggctg

SEQ ID NO: 1228666 - DNA, 22 bp, Homo sapiens
gatgggcattgggctgacacct

SEQ ID NO: 1228667 - DNA, 12 bp, Homo sapiens
gatgggccaggg

SEQ ID NO: 1228668 - DNA, 16 bp, Homo sapiens
gatgggctggggcagg

SEQ ID NO: 1228669 - DNA, 14 bp, Homo sapiens
gatgggcttctgtt

SEQ ID NO: 1228670 - DNA, 23 bp, Homo sapiens
gatgggcttctgttctctgctga

SEQ ID NO: 1228671 - DNA, 21 bp, Homo sapiens
gatggggactctgccgctgtg

SEQ ID NO: 1228672 - DNA, 20 bp, Homo sapiens
gatggggagggaaagacggt

SEQ ID NO: 1228673 - DNA, 18 bp, Homo sapiens
gatggggcaagacagaaa

SEQ ID NO: 1228674 - DNA, 22 bp, Homo sapiens
gatggggcaagacagaaaagtg

SEQ ID NO: 1228675 - DNA, 21 bp, Homo sapiens
gatggggcgggggtgtgtctg

SEQ ID NO: 1228676 - DNA, 19 bp, Homo sapiens
gatggggctcccgcccgtg

SEQ ID NO: 1228677 - DNA, 16 bp, Homo sapiens
gatgggggatgggcca

SEQ ID NO: 1228678 - DNA, 17 bp, Homo sapiens
gatgggggcttcttcct

SEQ ID NO: 1228679 - DNA, 22 bp, Homo sapiens
gatgggggcttcttcctcacac

SEQ ID NO: 1228680 - DNA, 19 bp, Homo sapiens
gatggggtctgtgactgga

SEQ ID NO: 1228681 - DNA, 23 bp, Homo sapiens
gatggggtctgtgactggatctt

SEQ ID NO: 1228682 - DNA, 15 bp, Homo sapiens
gatgggtattaaact

SEQ ID NO: 1228683 - DNA, 14 bp, Homo sapiens
gatgggtcccctcc

SEQ ID NO: 1228684 - DNA, 21 bp, Homo sapiens
gatgggtctgatattaatcaa

SEQ ID NO: 1228685 - DNA, 13 bp, Homo sapiens
gatgggtgcagga

SEQ ID NO: 1228686 - DNA, 16 bp, Homo sapiens
gatgggtgttgctgtt

SEQ ID NO: 1228687 - DNA, 23 bp, Homo sapiens
gatgggttctaattttggatgga

SEQ ID NO: 1228688 - DNA, 18 bp, Homo sapiens
gatgggtttgacaaggtt

SEQ ID NO: 1228689 - DNA, 22 bp, Homo sapiens
gatggtaagagaaaagagagaa

SEQ ID NO: 1228690 - DNA, 18 bp, Homo sapiens
gatggtccatttgttcct

SEQ ID NO: 1228691 - DNA, 22 bp, Homo sapiens
gatggtccatttgttcctgctt

SEQ ID NO: 1228692 - DNA, 13 bp, Homo sapiens
gatggtcctgggg

SEQ ID NO: 1228693 - DNA, 15 bp, Homo sapiens
gatggtcctggggct

SEQ ID NO: 1228694 - DNA, 21 bp, Homo sapiens
gatggtcctggggctctgtgc

SEQ ID NO: 1228695 - DNA, 13 bp, Homo sapiens
gatggtctcgatc

SEQ ID NO: 1228696 - DNA, 18 bp, Homo sapiens
gatggtctctctccctct

SEQ ID NO: 1228697 - DNA, 23 bp, Homo sapiens
gatggtctctctccctctgtctt

SEQ ID NO: 1228698 - DNA, 13 bp, Homo sapiens
gatggtgagctgg

SEQ ID NO: 1228699 - DNA, 14 bp, Homo sapiens
gatggtgagctggg

SEQ ID NO: 1228700 - DNA, 15 bp, Homo sapiens
gatggtgagctggga

SEQ ID NO: 1228701 - DNA, 15 bp, Homo sapiens
gatggtgcccctagg

SEQ ID NO: 1228702 - DNA, 18 bp, Homo sapiens
gatggtggctgtgtctct

SEQ ID NO: 1228703 - DNA, 21 bp, Homo sapiens
gatggtgtcattctgcctgct

SEQ ID NO: 1228704 - DNA, 15 bp, Homo sapiens
gatggtgtccttccc

SEQ ID NO: 1228705 - DNA, 17 bp, Homo sapiens
gatggtgtgggtgtcct

SEQ ID NO: 1228706 - DNA, 20 bp, Homo sapiens
gatggtgttaaagctgtaca

SEQ ID NO: 1228707 - DNA, 18 bp, Homo sapiens
gatggttaaaaaggccaa

SEQ ID NO: 1228708 - DNA, 17 bp, Homo sapiens
gatggttttaaactttc

SEQ ID NO: 1228709 - DNA, 18 bp, Homo sapiens
gatgtaaaagactttttt

SEQ ID NO: 1228710 - DNA, 16 bp, Homo sapiens
gatgtaaacagtgcct

SEQ ID NO: 1228711 - DNA, 20 bp, Homo sapiens
gatgtaaacagtgcctgctg

SEQ ID NO: 1228712 - DNA, 13 bp, Homo sapiens
gatgtaaagatgt

SEQ ID NO: 1228713 - DNA, 14 bp, Homo sapiens
gatgtaaagatgtt

SEQ ID NO: 1228714 - DNA, 20 bp, Homo sapiens
gatgtaatctctctgcagct

SEQ ID NO: 1228715 - DNA, 23 bp, Homo sapiens
gatgtaatctctctgcagctgcc

SEQ ID NO: 1228716 - DNA, 13 bp, Homo sapiens
gatgtaatgtttt

SEQ ID NO: 1228717 - DNA, 17 bp, Homo sapiens
gatgtacagtctgtcat

SEQ ID NO: 1228718 - DNA, 18 bp, Homo sapiens
gatgtacagtctgtcatg

SEQ ID NO: 1228719 - DNA, 22 bp, Homo sapiens
gatgtacatttaataatatcaa

SEQ ID NO: 1228720 - DNA, 15 bp, Homo sapiens
gatgtacatttccaa

SEQ ID NO: 1228721 - DNA, 14 bp, Homo sapiens
gatgtaccagtttg

SEQ ID NO: 1228722 - DNA, 22 bp, Homo sapiens
gatgtactgcaaagtcgccagt

SEQ ID NO: 1228723 - DNA, 15 bp, Homo sapiens
gatgtacttaagagt

SEQ ID NO: 1228724 - DNA, 15 bp, Homo sapiens
gatgtagagttttta

SEQ ID NO: 1228725 - DNA, 14 bp, Homo sapiens
gatgtagatttatt

SEQ ID NO: 1228726 - DNA, 15 bp, Homo sapiens
gatgtagatttattt

SEQ ID NO: 1228727 - DNA, 20 bp, Homo sapiens
gatgtagggtaaggtgcctt

SEQ ID NO: 1228728 - DNA, 21 bp, Homo sapiens
gatgtagggtaaggtgccttc

SEQ ID NO: 1228729 - DNA, 15 bp, Homo sapiens
gatgtatatgtttat

SEQ ID NO: 1228730 - DNA, 14 bp, Homo sapiens
gatgtatattcctt

SEQ ID NO: 1228731 - DNA, 21 bp, Homo sapiens
gatgtatatttaattaaagca

SEQ ID NO: 1228732 - DNA, 22 bp, Homo sapiens
gatgtatgaaggcttttggtct

SEQ ID NO: 1228733 - DNA, 19 bp, Homo sapiens
gatgtatgcagctatctgg

SEQ ID NO: 1228734 - DNA, 14 bp, Homo sapiens
gatgtatgtgtgaa

SEQ ID NO: 1228735 - DNA, 23 bp, Homo sapiens
gatgtattacatgactgtttctt

SEQ ID NO: 1228736 - DNA, 15 bp, Homo sapiens
gatgtattttcatag

SEQ ID NO: 1228737 - DNA, 18 bp, Homo sapiens
gatgtattttcatagtga

SEQ ID NO: 1228738 - DNA, 22 bp, Homo sapiens
gatgtatttttgatgtatatat

SEQ ID NO: 1228739 - DNA, 18 bp, Homo sapiens
gatgtcaatttctgtgtt

SEQ ID NO: 1228740 - DNA, 15 bp, Homo sapiens
gatgtcacagggcca

SEQ ID NO: 1228741 - DNA, 12 bp, Homo sapiens
gatgtcagcctt

SEQ ID NO: 1228742 - DNA, 13 bp, Homo sapiens
gatgtcatatcat

SEQ ID NO: 1228743 - DNA, 21 bp, Homo sapiens
gatgtcatgtacttcctgtgt

SEQ ID NO: 1228744 - DNA, 17 bp, Homo sapiens
gatgtcccaacttgtaa

SEQ ID NO: 1228745 - DNA, 15 bp, Homo sapiens
gatgtcccctgcggg

SEQ ID NO: 1228746 - DNA, 16 bp, Homo sapiens
gatgtcccctgtccca

SEQ ID NO: 1228747 - DNA, 20 bp, Homo sapiens
gatgtccctgggccagggtc

SEQ ID NO: 1228748 - DNA, 19 bp, Homo sapiens
gatgtcccttgatgcacag

SEQ ID NO: 1228749 - DNA, 16 bp, Homo sapiens
gatgtcctgactttgc

SEQ ID NO: 1228750 - DNA, 18 bp, Homo sapiens
gatgtctacagaaaatgc

SEQ ID NO: 1228751 - DNA, 14 bp, Homo sapiens
gatgtctcagagcc

SEQ ID NO: 1228752 - DNA, 15 bp, Homo sapiens
gatgtctcctcaagc

SEQ ID NO: 1228753 - DNA, 22 bp, Homo sapiens
gatgtctcctcaagcctgtggg

SEQ ID NO: 1228754 - DNA, 23 bp, Homo sapiens
gatgtctcctcaagcctgtgggc

SEQ ID NO: 1228755 - DNA, 13 bp, Homo sapiens
gatgtctcttgta

SEQ ID NO: 1228756 - DNA, 22 bp, Homo sapiens
gatgtcttcatcacttcttcca

SEQ ID NO: 1228757 - DNA, 22 bp, Homo sapiens
gatgtcttccttggagggggga

SEQ ID NO: 1228758 - DNA, 14 bp, Homo sapiens
gatgtcttctgcct

SEQ ID NO: 1228759 - DNA, 16 bp, Homo sapiens
gatgtctttttattaa

SEQ ID NO: 1228760 - DNA, 20 bp, Homo sapiens
gatgtgaagataatttgcat

SEQ ID NO: 1228761 - DNA, 12 bp, Homo sapiens
gatgtgaagcca

SEQ ID NO: 1228762 - DNA, 21 bp, Homo sapiens
gatgtgaattgcctgcagaga

SEQ ID NO: 1228763 - DNA, 22 bp, Homo sapiens
gatgtgaattgcctgcagagag

SEQ ID NO: 1228764 - DNA, 11 bp, Homo sapiens
gatgtgacttt

SEQ ID NO: 1228765 - DNA, 13 bp, Homo sapiens
gatgtgagtcctg

SEQ ID NO: 1228766 - DNA, 17 bp, Homo sapiens
gatgtgcaacctgtggc

SEQ ID NO: 1228767 - DNA, 21 bp, Homo sapiens
gatgtgcaacctgtggctcag

SEQ ID NO: 1228768 - DNA, 12 bp, Homo sapiens
gatgtgcaagcg

SEQ ID NO: 1228769 - DNA, 20 bp, Homo sapiens
gatgtgcaataatttgtaca

SEQ ID NO: 1228770 - DNA, 23 bp, Homo sapiens
gatgtgcatttttgtgaaatgaa

SEQ ID NO: 1228771 - DNA, 21 bp, Homo sapiens
gatgtgctttgcattcctaca

SEQ ID NO: 1228772 - DNA, 11 bp, Homo sapiens
gatgtgctttt

SEQ ID NO: 1228773 - DNA, 16 bp, Homo sapiens
gatgtgcttttctcca

SEQ ID NO: 1228774 - DNA, 21 bp, Homo sapiens
gatgtggaggaagagccacct

SEQ ID NO: 1228775 - DNA, 22 bp, Homo sapiens
gatgtgggccaagtccactgtc

SEQ ID NO: 1228776 - DNA, 13 bp, Homo sapiens
gatgtggggctga

SEQ ID NO: 1228777 - DNA, 12 bp, Homo sapiens
gatgtgtaaaca

SEQ ID NO: 1228778 - DNA, 17 bp, Homo sapiens
gatgtgtaaacaggtat

SEQ ID NO: 1228779 - DNA, 13 bp, Homo sapiens
gatgtgtcctcag

SEQ ID NO: 1228780 - DNA, 13 bp, Homo sapiens
gatgtgtctgtat

SEQ ID NO: 1228781 - DNA, 19 bp, Homo sapiens
gatgtgtgagcatcctgca

SEQ ID NO: 1228782 - DNA, 14 bp, Homo sapiens
gatgtgtgtgtgtg

SEQ ID NO: 1228783 - DNA, 15 bp, Homo sapiens
gatgtgtgtgtgtgc

SEQ ID NO: 1228784 - DNA, 14 bp, Homo sapiens
gatgtgttcttatt

SEQ ID NO: 1228785 - DNA, 14 bp, Homo sapiens
gatgttaaatggaa

SEQ ID NO: 1228786 - DNA, 19 bp, Homo sapiens
gatgttaatttactttctg

SEQ ID NO: 1228787 - DNA, 18 bp, Homo sapiens
gatgttacaagtttgcta

SEQ ID NO: 1228788 - DNA, 19 bp, Homo sapiens
gatgttacaagtttgctaa

SEQ ID NO: 1228789 - DNA, 17 bp, Homo sapiens
gatgttactaccttatt

SEQ ID NO: 1228790 - DNA, 15 bp, Homo sapiens
gatgttatgaacagc

SEQ ID NO: 1228791 - DNA, 17 bp, Homo sapiens
gatgttatgaacagctg

SEQ ID NO: 1228792 - DNA, 18 bp, Homo sapiens
gatgttcactgtggcatt

SEQ ID NO: 1228793 - DNA, 17 bp, Homo sapiens
gatgttcagagtggctc

SEQ ID NO: 1228794 - DNA, 22 bp, Homo sapiens
gatgttcagcactgtcccttgc

SEQ ID NO: 1228795 - DNA, 14 bp, Homo sapiens
gatgttccttacca

SEQ ID NO: 1228796 - DNA, 19 bp, Homo sapiens
gatgttctaagtctttcca

SEQ ID NO: 1228797 - DNA, 14 bp, Homo sapiens
gatgttctcctgat

SEQ ID NO: 1228798 - DNA, 12 bp, Homo sapiens
gatgttgaactt

SEQ ID NO: 1228799 - DNA, 23 bp, Homo sapiens
gatgttgaatgcccacaggcaaa

SEQ ID NO: 1228800 - DNA, 13 bp, Homo sapiens
gatgttgataatt

SEQ ID NO: 1228801 - DNA, 21 bp, Homo sapiens
gatgttgcttctgaatcactg

SEQ ID NO: 1228802 - DNA, 20 bp, Homo sapiens
gatgttgtgtattgtggttt

SEQ ID NO: 1228803 - DNA, 20 bp, Homo sapiens
gatgtttaacaaatctaatc

SEQ ID NO: 1228804 - DNA, 17 bp, Homo sapiens
gatgtttacctggtgct

SEQ ID NO: 1228805 - DNA, 14 bp, Homo sapiens
gatgtttataaact

SEQ ID NO: 1228806 - DNA, 12 bp, Homo sapiens
gatgtttccaga

SEQ ID NO: 1228807 - DNA, 19 bp, Homo sapiens
gatgtttcttttgtatgta

SEQ ID NO: 1228808 - DNA, 23 bp, Homo sapiens
gatgtttcttttgtatgtaaatg

SEQ ID NO: 1228809 - DNA, 19 bp, Homo sapiens
gatgtttgaaaatgctctt

SEQ ID NO: 1228810 - DNA, 16 bp, Homo sapiens
gatgtttgagcagtgg

SEQ ID NO: 1228811 - DNA, 14 bp, Homo sapiens
gatgtttgtggcct

SEQ ID NO: 1228812 - DNA, 20 bp, Homo sapiens
gatgttttacgcaaggaagg

SEQ ID NO: 1228813 - DNA, 17 bp, Homo sapiens
gatgttttgggatcagg

SEQ ID NO: 1228814 - DNA, 20 bp, Homo sapiens
gatgttttgggatcaggagc

SEQ ID NO: 1228815 - DNA, 18 bp, Homo sapiens
gatgttttgttcaaagtt

SEQ ID NO: 1228816 - DNA, 21 bp, Homo sapiens
gatgtttttaaaagtttcaat

SEQ ID NO: 1228817 - DNA, 12 bp, Homo sapiens
gattaaaggaag

SEQ ID NO: 1228818 - DNA, 13 bp, Homo sapiens
gattaaaggaagg

SEQ ID NO: 1228819 - DNA, 15 bp, Homo sapiens
gattaaaggaaggaa

SEQ ID NO: 1228820 - DNA, 12 bp, Homo sapiens
gattaaatacat

SEQ ID NO: 1228821 - DNA, 13 bp, Homo sapiens
gattaaatacata

SEQ ID NO: 1228822 - DNA, 17 bp, Homo sapiens
gattaaattctgggtga

SEQ ID NO: 1228823 - DNA, 12 bp, Homo sapiens
gattaaattctt

SEQ ID NO: 1228824 - DNA, 22 bp, Homo sapiens
gattaacctgaaagaacataca

SEQ ID NO: 1228825 - DNA, 19 bp, Homo sapiens
gattaacttatttagagat

SEQ ID NO: 1228826 - DNA, 23 bp, Homo sapiens
gattaataacctgccagtcccag

SEQ ID NO: 1228827 - DNA, 13 bp, Homo sapiens
gattaatcaaagg

SEQ ID NO: 1228828 - DNA, 20 bp, Homo sapiens
gattaatcaaaggcatatct

SEQ ID NO: 1228829 - DNA, 16 bp, Homo sapiens
gattaatgttttcatt

SEQ ID NO: 1228830 - DNA, 17 bp, Homo sapiens
gattacaaatcagaagt

SEQ ID NO: 1228831 - DNA, 19 bp, Homo sapiens
gattacaaatcagaagtca

SEQ ID NO: 1228832 - DNA, 20 bp, Homo sapiens
gattacaaatcagaagtcat

SEQ ID NO: 1228833 - DNA, 18 bp, Homo sapiens
gattacaggcatgtgcca

SEQ ID NO: 1228834 - DNA, 18 bp, Homo sapiens
gattacatagatcagcca

SEQ ID NO: 1228835 - DNA, 19 bp, Homo sapiens
gattacatagatcagccat

SEQ ID NO: 1228836 - DNA, 16 bp, Homo sapiens
gattaccagtctgatt

SEQ ID NO: 1228837 - DNA, 14 bp, Homo sapiens
gattacctcctgag

SEQ ID NO: 1228838 - DNA, 19 bp, Homo sapiens
gattacgtgtatgtttctt

SEQ ID NO: 1228839 - DNA, 22 bp, Homo sapiens
gattactggcctttttcattta

SEQ ID NO: 1228840 - DNA, 18 bp, Homo sapiens
gattactgtcaataaaca

SEQ ID NO: 1228841 - DNA, 12 bp, Homo sapiens
gattacttaaat

SEQ ID NO: 1228842 - DNA, 18 bp, Homo sapiens
gattacttctctataaaa

SEQ ID NO: 1228843 - DNA, 14 bp, Homo sapiens
gattagacctttat

SEQ ID NO: 1228844 - DNA, 18 bp, Homo sapiens
gattagactggacagctt

SEQ ID NO: 1228845 - DNA, 17 bp, Homo sapiens
gattagagcctgtaaac

SEQ ID NO: 1228846 - DNA, 13 bp, Homo sapiens
gattagagggagg

SEQ ID NO: 1228847 - DNA, 17 bp, Homo sapiens
gattagagggaggtgtt

SEQ ID NO: 1228848 - DNA, 15 bp, Homo sapiens
gattagattgcaaag

SEQ ID NO: 1228849 - DNA, 13 bp, Homo sapiens
gattagctctgga

SEQ ID NO: 1228850 - DNA, 14 bp, Homo sapiens
gattagctctggac

SEQ ID NO: 1228851 - DNA, 16 bp, Homo sapiens
gattagctctggacca

SEQ ID NO: 1228852 - DNA, 20 bp, Homo sapiens
gattagggaaaatggatata

SEQ ID NO: 1228853 - DNA, 21 bp, Homo sapiens
gattaggtgaagggatggggg

SEQ ID NO: 1228854 - DNA, 18 bp, Homo sapiens
gattagtaaatatgtgaa

SEQ ID NO: 1228855 - DNA, 22 bp, Homo sapiens
gattagtaaatatgtgaagaaa

SEQ ID NO: 1228856 - DNA, 17 bp, Homo sapiens
gattagtataatatttc

SEQ ID NO: 1228857 - DNA, 17 bp, Homo sapiens
gattagtattcaggcac

SEQ ID NO: 1228858 - DNA, 22 bp, Homo sapiens
gattagttgaaaggcctcaaga

SEQ ID NO: 1228859 - DNA, 12 bp, Homo sapiens
gattagttggac

SEQ ID NO: 1228860 - DNA, 20 bp, Homo sapiens
gattataaaaaatgtaacat

SEQ ID NO: 1228861 - DNA, 21 bp, Homo sapiens
gattataaaaaatgtaacatc

SEQ ID NO: 1228862 - DNA, 13 bp, Homo sapiens
gattatatgggta

SEQ ID NO: 1228863 - DNA, 15 bp, Homo sapiens
gattatattcacaga

SEQ ID NO: 1228864 - DNA, 13 bp, Homo sapiens
gattatcgttttc

SEQ ID NO: 1228865 - DNA, 21 bp, Homo sapiens
gattatctgattcctttaaaa

SEQ ID NO: 1228866 - DNA, 17 bp, Homo sapiens
gattatcttcagcccag

SEQ ID NO: 1228867 - DNA, 19 bp, Homo sapiens
gattatgatgcatacagtt

SEQ ID NO: 1228868 - DNA, 15 bp, Homo sapiens
gattatggttttgtg

SEQ ID NO: 1228869 - DNA, 16 bp, Homo sapiens
gattatggttttgtga

SEQ ID NO: 1228870 - DNA, 17 bp, Homo sapiens
gattatggttttgtgat

SEQ ID NO: 1228871 - DNA, 12 bp, Homo sapiens
gattatgtgact

SEQ ID NO: 1228872 - DNA, 23 bp, Homo sapiens
gattattaactaatatgggcatt

SEQ ID NO: 1228873 - DNA, 14 bp, Homo sapiens
gattattacttctg

SEQ ID NO: 1228874 - DNA, 16 bp, Homo sapiens
gattattataaactat

SEQ ID NO: 1228875 - DNA, 15 bp, Homo sapiens
gatgccctcccctca

SEQ ID NO: 1228876 - DNA, 16 bp, Homo sapiens
gatgccctcccctcag

SEQ ID NO: 1228877 - DNA, 19 bp, Homo sapiens
gatgccctcccctcagcgc

SEQ ID NO: 1228878 - DNA, 19 bp, Homo sapiens
gatgccctggaggtggctg

SEQ ID NO: 1228879 - DNA, 20 bp, Homo sapiens
gatgccgaacattaggaatt

SEQ ID NO: 1228880 - DNA, 17 bp, Homo sapiens
gatgccgggcgccagga

SEQ ID NO: 1228881 - DNA, 19 bp, Homo sapiens
gatgccgggcgccaggaca

SEQ ID NO: 1228882 - DNA, 21 bp, Homo sapiens
gatgccgggcgccaggacagc

SEQ ID NO: 1228883 - DNA, 23 bp, Homo sapiens
gatgcctaaaaattcccttcctg

SEQ ID NO: 1228884 - DNA, 12 bp, Homo sapiens
gatgcctaagta

SEQ ID NO: 1228885 - DNA, 16 bp, Homo sapiens
gatgcctcaccacacc

SEQ ID NO: 1228886 - DNA, 19 bp, Homo sapiens
gatgcctcaccacacccag

SEQ ID NO: 1228887 - DNA, 12 bp, Homo sapiens
gatgcctccacc

SEQ ID NO: 1228888 - DNA, 20 bp, Homo sapiens
gatgcctccaccgctgccta

SEQ ID NO: 1228889 - DNA, 18 bp, Homo sapiens
gatgcctggcctgccaga

SEQ ID NO: 1228890 - DNA, 23 bp, Homo sapiens
gatgcctgttaatttataatgta

SEQ ID NO: 1228891 - DNA, 12 bp, Homo sapiens
gatgccttcatg

SEQ ID NO: 1228892 - DNA, 15 bp, Homo sapiens
gatgccttttctgtg

SEQ ID NO: 1228893 - DNA, 18 bp, Homo sapiens
gatgccttttttgtagtt

SEQ ID NO: 1228894 - DNA, 14 bp, Homo sapiens
gatgcgcagtgcct

SEQ ID NO: 1228895 - DNA, 22 bp, Homo sapiens
gatgcggccattcaaggggagc

SEQ ID NO: 1228896 - DNA, 21 bp, Homo sapiens
gatgcggctttctctgcctct

SEQ ID NO: 1228897 - DNA, 16 bp, Homo sapiens
gatgcggtggctcacg

SEQ ID NO: 1228898 - DNA, 14 bp, Homo sapiens
gatgcgtgggaggc

SEQ ID NO: 1228899 - DNA, 16 bp, Homo sapiens
gatgcgttcgcctctg

SEQ ID NO: 1228900 - DNA, 20 bp, Homo sapiens
gatgcgttgttacaggaagt

SEQ ID NO: 1228901 - DNA, 16 bp, Homo sapiens
gatgcgtttgcctcct

SEQ ID NO: 1228902 - DNA, 17 bp, Homo sapiens
gatgcgtttgcctcctg

SEQ ID NO: 1228903 - DNA, 16 bp, Homo sapiens
gatgctaaagatgatg

SEQ ID NO: 1228904 - DNA, 14 bp, Homo sapiens
gatgctaatcttgt

SEQ ID NO: 1228905 - DNA, 14 bp, Homo sapiens
gatgctaatttatt

SEQ ID NO: 1228906 - DNA, 20 bp, Homo sapiens
gatgctagaaaaatgttctt

SEQ ID NO: 1228907 - DNA, 21 bp, Homo sapiens
gatgctccgaggactggactg

SEQ ID NO: 1228908 - DNA, 22 bp, Homo sapiens
gatgctccgaggactggactgt

SEQ ID NO: 1228909 - DNA, 14 bp, Homo sapiens
gatgctccttgggc

SEQ ID NO: 1228910 - DNA, 16 bp, Homo sapiens
gatgctccttgggccc

SEQ ID NO: 1228911 - DNA, 20 bp, Homo sapiens
gatgctgactgtactcctcc

SEQ ID NO: 1228912 - DNA, 13 bp, Homo sapiens
gatgctgagctgt

SEQ ID NO: 1228913 - DNA, 18 bp, Homo sapiens
gatgctgaggatgattga

SEQ ID NO: 1228914 - DNA, 16 bp, Homo sapiens
gatgctgcagcagagt

SEQ ID NO: 1228915 - DNA, 23 bp, Homo sapiens
gatgctgccccgttccctgtcag

SEQ ID NO: 1228916 - DNA, 16 bp, Homo sapiens
gatgctgcctgagtca

SEQ ID NO: 1228917 - DNA, 11 bp, Homo sapiens
gatgctgcttt

SEQ ID NO: 1228918 - DNA, 23 bp, Homo sapiens
gatgctgggcacttcatctgatc

SEQ ID NO: 1228919 - DNA, 20 bp, Homo sapiens
gatgctgggctctgttcttg

SEQ ID NO: 1228920 - DNA, 13 bp, Homo sapiens
gatgctgggctgg

SEQ ID NO: 1228921 - DNA, 14 bp, Homo sapiens
gatgctgggctggg

SEQ ID NO: 1228922 - DNA, 20 bp, Homo sapiens
gatgctgggttggtgcacag

SEQ ID NO: 1228923 - DNA, 18 bp, Homo sapiens
gatgctgtagacatctgt

SEQ ID NO: 1228924 - DNA, 22 bp, Homo sapiens
gatgctgtcactggcagagcac

SEQ ID NO: 1228925 - DNA, 13 bp, Homo sapiens
gatgctgtgcctg

SEQ ID NO: 1228926 - DNA, 16 bp, Homo sapiens
gatgcttctctccttg

SEQ ID NO: 1228927 - DNA, 15 bp, Homo sapiens
gatgcttctgggaga

SEQ ID NO: 1228928 - DNA, 14 bp, Homo sapiens
gatgcttgtacata

SEQ ID NO: 1228929 - DNA, 16 bp, Homo sapiens
gatgcttttatagctg

SEQ ID NO: 1228930 - DNA, 12 bp, Homo sapiens
gatggaaaataa

SEQ ID NO: 1228931 - DNA, 13 bp, Homo sapiens
gatggaaaataaa

SEQ ID NO: 1228932 - DNA, 16 bp, Homo sapiens
gatggaaaataaacat

SEQ ID NO: 1228933 - DNA, 17 bp, Homo sapiens
gatggaaaataaacatc

SEQ ID NO: 1228934 - DNA, 20 bp, Homo sapiens
gatggaacccttttggcccc

SEQ ID NO: 1228935 - DNA, 22 bp, Homo sapiens
gatggaacccttttggcccccg

SEQ ID NO: 1228936 - DNA, 17 bp, Homo sapiens
gatggaacgggcatggg

SEQ ID NO: 1228937 - DNA, 18 bp, Homo sapiens
gatggaactgtgtattta

SEQ ID NO: 1228938 - DNA, 15 bp, Homo sapiens
gatggaagatggtcc

SEQ ID NO: 1228939 - DNA, 19 bp, Homo sapiens
gatggaagtcacctttctg

SEQ ID NO: 1228940 - DNA, 21 bp, Homo sapiens
gatggaagttgcagtgagctg

SEQ ID NO: 1228941 - DNA, 22 bp, Homo sapiens
gatggaatgtgccacctgtccg

SEQ ID NO: 1228942 - DNA, 15 bp, Homo sapiens
gatggaattcttcct

SEQ ID NO: 1228943 - DNA, 21 bp, Homo sapiens
gatggaattcttcctcctctg

SEQ ID NO: 1228944 - DNA, 20 bp, Homo sapiens
gatggaatttttctgtactt

SEQ ID NO: 1228945 - DNA, 18 bp, Homo sapiens
gatggacaaaggcctggc

SEQ ID NO: 1228946 - DNA, 18 bp, Homo sapiens
gatggacacccccagctg

SEQ ID NO: 1228947 - DNA, 17 bp, Homo sapiens
gatggacacgagccaca

SEQ ID NO: 1228948 - DNA, 17 bp, Homo sapiens
gatggacagacacctcc

SEQ ID NO: 1228949 - DNA, 12 bp, Homo sapiens
gatggacagact

SEQ ID NO: 1228950 - DNA, 23 bp, Homo sapiens
gatggacattttaggaatcacca

SEQ ID NO: 1228951 - DNA, 14 bp, Homo sapiens
gatggacccctccc

SEQ ID NO: 1228952 - DNA, 23 bp, Homo sapiens
gatggaccgggtgggcctggcct

SEQ ID NO: 1228953 - DNA, 13 bp, Homo sapiens
gatggacctgccc

SEQ ID NO: 1228954 - DNA, 24 bp, Homo sapiens
gatggacctgccccggacctacct

SEQ ID NO: 1228955 - DNA, 15 bp, Homo sapiens
gatggacgcaggccc

SEQ ID NO: 1228956 - DNA, 14 bp, Homo sapiens
gatggactctgaaa

SEQ ID NO: 1228957 - DNA, 18 bp, Homo sapiens
gatggacttacctggcag

SEQ ID NO: 1228958 - DNA, 16 bp, Homo sapiens
gatggagaaagaagtg

SEQ ID NO: 1228959 - DNA, 15 bp, Homo sapiens
gatggagagagggga

SEQ ID NO: 1228960 - DNA, 13 bp, Homo sapiens
gatggagaggctg

SEQ ID NO: 1228961 - DNA, 19 bp, Homo sapiens
gatggagagtggggagagg

SEQ ID NO: 1228962 - DNA, 12 bp, Homo sapiens
gatggaggaaaa

SEQ ID NO: 1228963 - DNA, 23 bp, Homo sapiens
gatggaggaaaaccaagccgtgg

SEQ ID NO: 1228964 - DNA, 21 bp, Homo sapiens
gatggaggaacccaagaaagg

SEQ ID NO: 1228965 - DNA, 18 bp, Homo sapiens
gatggagggcttggccca

SEQ ID NO: 1228966 - DNA, 13 bp, Homo sapiens
gatggagggtcca

SEQ ID NO: 1228967 - DNA, 18 bp, Homo sapiens
gatggagtgtgcagacag

SEQ ID NO: 1228968 - DNA, 19 bp, Homo sapiens
gatggagtgtgcagacagc

SEQ ID NO: 1228969 - DNA, 16 bp, Homo sapiens
gatggagtgttttagt

SEQ ID NO: 1228970 - DNA, 15 bp, Homo sapiens
gatggagtttcactt

SEQ ID NO: 1228971 - DNA, 16 bp, Homo sapiens
gatggagtttctctct

SEQ ID NO: 1228972 - DNA, 17 bp, Homo sapiens
gatggatggcacaatga

SEQ ID NO: 1228973 - DNA, 14 bp, Homo sapiens
gatggatggcagac

SEQ ID NO: 1228974 - DNA, 18 bp, Homo sapiens
gatggattctcagatatt

SEQ ID NO: 1228975 - DNA, 19 bp, Homo sapiens
gatggattctcagatattt

SEQ ID NO: 1228976 - DNA, 15 bp, Homo sapiens
gatggatttgaagca

SEQ ID NO: 1228977 - DNA, 15 bp, Homo sapiens
gatggatttgtatca

SEQ ID NO: 1228978 - DNA, 13 bp, Homo sapiens
gatggcacaatga

SEQ ID NO: 1228979 - DNA, 17 bp, Homo sapiens
gatggcacaatgaatgt

SEQ ID NO: 1228980 - DNA, 15 bp, Homo sapiens
gatggcaccagaggc

SEQ ID NO: 1228981 - DNA, 13 bp, Homo sapiens
gatggcaggagag

SEQ ID NO: 1228982 - DNA, 17 bp, Homo sapiens
gatggcaggcctgaccc

SEQ ID NO: 1228983 - DNA, 18 bp, Homo sapiens
gatggcaggcctgaccca

SEQ ID NO: 1228984 - DNA, 19 bp, Homo sapiens
gattgaggagttgcctgac

SEQ ID NO: 1228985 - DNA, 22 bp, Homo sapiens
gattgaggataaaaaggaagga

SEQ ID NO: 1228986 - DNA, 13 bp, Homo sapiens
gattgaggcctgc

SEQ ID NO: 1228987 - DNA, 16 bp, Homo sapiens
gattgagtctgtgcca

SEQ ID NO: 1228988 - DNA, 15 bp, Homo sapiens
gattgatcacacagt

SEQ ID NO: 1228989 - DNA, 17 bp, Homo sapiens
gattgatcacacagtgt

SEQ ID NO: 1228990 - DNA, 17 bp, Homo sapiens
gattgattcagtatctt

SEQ ID NO: 1228991 - DNA, 17 bp, Homo sapiens
gattgatttgaagaaca

SEQ ID NO: 1228992 - DNA, 16 bp, Homo sapiens
gattgcacgtggcctc

SEQ ID NO: 1228993 - DNA, 12 bp, Homo sapiens
gattgcagcttt

SEQ ID NO: 1228994 - DNA, 14 bp, Homo sapiens
gattgcatcctgct

SEQ ID NO: 1228995 - DNA, 12 bp, Homo sapiens
gattgccacagc

SEQ ID NO: 1228996 - DNA, 14 bp, Homo sapiens
gcaagggagaaaag

SEQ ID NO: 1228997 - DNA, 15 bp, Homo sapiens
gcaagggagaaaaga

SEQ ID NO: 1228998 - DNA, 15 bp, Homo sapiens
gcaagggcatcaggc

SEQ ID NO: 1228999 - DNA, 19 bp, Homo sapiens
gcaagggcatcaggcactg

SEQ ID NO: 1229000 - DNA, 12 bp, Homo sapiens
gcaagggcccag

SEQ ID NO: 1229001 - DNA, 13 bp, Homo sapiens
gcaagggcccaga

SEQ ID NO: 1229002 - DNA, 14 bp, Homo sapiens
gcaagggcccagag

SEQ ID NO: 1229003 - DNA, 15 bp, Homo sapiens
gcaagggcccagagt

SEQ ID NO: 1229004 - DNA, 14 bp, Homo sapiens
gcaagggcctggac

SEQ ID NO: 1229005 - DNA, 15 bp, Homo sapiens
gcaaggggaaaatct

SEQ ID NO: 1229006 - DNA, 21 bp, Homo sapiens
gcaaggggctgcatgacctac

SEQ ID NO: 1229007 - DNA, 13 bp, Homo sapiens
gcaagggtgcctc

SEQ ID NO: 1229008 - DNA, 18 bp, Homo sapiens
gcaagggttaaggcctga

SEQ ID NO: 1229009 - DNA, 18 bp, Homo sapiens
gcaagggttccctcaaga

SEQ ID NO: 1229010 - DNA, 13 bp, Homo sapiens
gcaaggtgaaacg

SEQ ID NO: 1229011 - DNA, 16 bp, Homo sapiens
gcaaggtgaaacgact

SEQ ID NO: 1229012 - DNA, 11 bp, Homo sapiens
gcaaggtggcc

SEQ ID NO: 1229013 - DNA, 22 bp, Homo sapiens
gcaaggtggcctctgcctgggg

SEQ ID NO: 1229014 - DNA, 14 bp, Homo sapiens
gcaagtaacttctg

SEQ ID NO: 1229015 - DNA, 20 bp, Homo sapiens
gcaagtaacttctgacttac

SEQ ID NO: 1229016 - DNA, 18 bp, Homo sapiens
gcaagtaagaatggccaa

SEQ ID NO: 1229017 - DNA, 20 bp, Homo sapiens
gcaagtacagcggctcccct

SEQ ID NO: 1229018 - DNA, 14 bp, Homo sapiens
gcaagtagcaggac

SEQ ID NO: 1229019 - DNA, 15 bp, Homo sapiens
gcaagtagcaggact

SEQ ID NO: 1229020 - DNA, 18 bp, Homo sapiens
gcaagtatgtgagtgtgt

SEQ ID NO: 1229021 - DNA, 17 bp, Homo sapiens
gcaagtcattagaatgt

SEQ ID NO: 1229022 - DNA, 22 bp, Homo sapiens
gcaagtccctgactctctgtga

SEQ ID NO: 1229023 - DNA, 18 bp, Homo sapiens
gcaagtcggggcctggga

SEQ ID NO: 1229024 - DNA, 21 bp, Homo sapiens
gcaagtctgcagcccggcgcc

SEQ ID NO: 1229025 - DNA, 21 bp, Homo sapiens
gcaagtctgtggccccacaac

SEQ ID NO: 1229026 - DNA, 18 bp, Homo sapiens
gcaagtgaaggtttacaa

SEQ ID NO: 1229027 - DNA, 21 bp, Homo sapiens
gcaagtgaaggtttacaattt

SEQ ID NO: 1229028 - DNA, 13 bp, Homo sapiens
gcaagtgaatttg

SEQ ID NO: 1229029 - DNA, 20 bp, Homo sapiens
gcaagtgaatttttctctaa

SEQ ID NO: 1229030 - DNA, 17 bp, Homo sapiens
gcaagtgagaggggagg

SEQ ID NO: 1229031 - DNA, 19 bp, Homo sapiens
gcaagtgagaggggaggga

SEQ ID NO: 1229032 - DNA, 20 bp, Homo sapiens
gcaagtgagaggggagggag

SEQ ID NO: 1229033 - DNA, 15 bp, Homo sapiens
gcaagtgagcagaga

SEQ ID NO: 1229034 - DNA, 20 bp, Homo sapiens
gcaagtgagtctggtggagg

SEQ ID NO: 1229035 - DNA, 19 bp, Homo sapiens
gcaagtggatggcccagca

SEQ ID NO: 1229036 - DNA, 20 bp, Homo sapiens
gcaagtggatggcccagcag

SEQ ID NO: 1229037 - DNA, 15 bp, Homo sapiens
gcaagtggatgggaa

SEQ ID NO: 1229038 - DNA, 21 bp, Homo sapiens
gcaagtggatgggaatttgtc

SEQ ID NO: 1229039 - DNA, 15 bp, Homo sapiens
gcaagtgtctgtgtg

SEQ ID NO: 1229040 - DNA, 16 bp, Homo sapiens
gcaagtgtctgtgtgc

SEQ ID NO: 1229041 - DNA, 23 bp, Homo sapiens
gcaagtgtgtatgtgcgtgtgtg

SEQ ID NO: 1229042 - DNA, 18 bp, Homo sapiens
gcaagtgtgtgagtgtga

SEQ ID NO: 1229043 - DNA, 17 bp, Homo sapiens
gcaagtgttcactgctc

SEQ ID NO: 1229044 - DNA, 20 bp, Homo sapiens
gcaagttctagagaagaggc

SEQ ID NO: 1229045 - DNA, 22 bp, Homo sapiens
gcaagtttctagctagaaatat

SEQ ID NO: 1229046 - DNA, 13 bp, Homo sapiens
gcaataaaaaaat

SEQ ID NO: 1229047 - DNA, 18 bp, Homo sapiens
gcaataaaaactgtctgt

SEQ ID NO: 1229048 - DNA, 17 bp, Homo sapiens
gcaataaatttatatac

SEQ ID NO: 1229049 - DNA, 21 bp, Homo sapiens
gcaataacgtttaagccaaaa

SEQ ID NO: 1229050 - DNA, 14 bp, Homo sapiens
gcaataactccaag

SEQ ID NO: 1229051 - DNA, 19 bp, Homo sapiens
gcaataactccaagcagac

SEQ ID NO: 1229052 - DNA, 15 bp, Homo sapiens
gcaataactctggga

SEQ ID NO: 1229053 - DNA, 13 bp, Homo sapiens
gcaataacttcta

SEQ ID NO: 1229054 - DNA, 15 bp, Homo sapiens
gcaataacttctata

SEQ ID NO: 1229055 - DNA, 13 bp, Homo sapiens
gcaataagaaatg

SEQ ID NO: 1229056 - DNA, 20 bp, Homo sapiens
gcaataagaaatgaacaaaa

SEQ ID NO: 1229057 - DNA, 21 bp, Homo sapiens
gcaataagaatttagggagaa

SEQ ID NO: 1229058 - DNA, 20 bp, Homo sapiens
gcaataatggtcccatccag

SEQ ID NO: 1229059 - DNA, 23 bp, Homo sapiens
gcaataatgtgcaaattttgcat

SEQ ID NO: 1229060 - DNA, 14 bp, Homo sapiens
gcaataattgtttc

SEQ ID NO: 1229061 - DNA, 18 bp, Homo sapiens
gcacacatcaccaggtgc

SEQ ID NO: 1229062 - DNA, 17 bp, Homo sapiens
gcacacatcttacctct

SEQ ID NO: 1229063 - DNA, 14 bp, Homo sapiens
gcacacatttttta

SEQ ID NO: 1229064 - DNA, 13 bp, Homo sapiens
gcacaccactgcc

SEQ ID NO: 1229065 - DNA, 16 bp, Homo sapiens
gcacaccactgccctg

SEQ ID NO: 1229066 - DNA, 17 bp, Homo sapiens
gcacaccactgccctgc

SEQ ID NO: 1229067 - DNA, 20 bp, Homo sapiens
gcacaccactgccctgcctg

SEQ ID NO: 1229068 - DNA, 15 bp, Homo sapiens
gcacaccagccgctg

SEQ ID NO: 1229069 - DNA, 14 bp, Homo sapiens
gcacacccactgcc

SEQ ID NO: 1229070 - DNA, 15 bp, Homo sapiens
gcacacccactgccc

SEQ ID NO: 1229071 - DNA, 14 bp, Homo sapiens
gcacaccctgcccc

SEQ ID NO: 1229072 - DNA, 13 bp, Homo sapiens
gcacacctctggg

SEQ ID NO: 1229073 - DNA, 20 bp, Homo sapiens
gcacacctgaatcagctgga

SEQ ID NO: 1229074 - DNA, 15 bp, Homo sapiens
gcacacgaagggtga

SEQ ID NO: 1229075 - DNA, 20 bp, Homo sapiens
gcacacgcacgcacacacac

SEQ ID NO: 1229076 - DNA, 19 bp, Homo sapiens
gcacacgcctcccactggg

SEQ ID NO: 1229077 - DNA, 15 bp, Homo sapiens
gcacacgtgtgtatg

SEQ ID NO: 1229078 - DNA, 16 bp, Homo sapiens
gcacacgtgtgtatga

SEQ ID NO: 1229079 - DNA, 15 bp, Homo sapiens
gcacactaaaccaag

SEQ ID NO: 1229080 - DNA, 17 bp, Homo sapiens
gcacactatttccctct

SEQ ID NO: 1229081 - DNA, 13 bp, Homo sapiens
gcacactccctct

SEQ ID NO: 1229082 - DNA, 21 bp, Homo sapiens
gcacactgctcttaagaaact

SEQ ID NO: 1229083 - DNA, 15 bp, Homo sapiens
gcacacttatttatg

SEQ ID NO: 1229084 - DNA, 11 bp, Homo sapiens
gcacacttccc

SEQ ID NO: 1229085 - DNA, 13 bp, Homo sapiens
gcacacttcccca

SEQ ID NO: 1229086 - DNA, 14 bp, Homo sapiens
gcacacttccccat

SEQ ID NO: 1229087 - DNA, 21 bp, Homo sapiens
gcacacttccccatctttgat

SEQ ID NO: 1229088 - DNA, 19 bp, Homo sapiens
gcacacttgtacccacagg

SEQ ID NO: 1229089 - DNA, 22 bp, Homo sapiens
gcacactttacacaagaatcta

SEQ ID NO: 1229090 - DNA, 21 bp, Homo sapiens
gcacagaaacctctactaaaa

SEQ ID NO: 1229091 - DNA, 17 bp, Homo sapiens
gcacagaaacttgaact

SEQ ID NO: 1229092 - DNA, 12 bp, Homo sapiens
gcacagaatatg

SEQ ID NO: 1229093 - DNA, 15 bp, Homo sapiens
gcacagaccaggcct

SEQ ID NO: 1229094 - DNA, 15 bp, Homo sapiens
gcacagacttctgga

SEQ ID NO: 1229095 - DNA, 13 bp, Homo sapiens
gcacagagaggga

SEQ ID NO: 1229096 - DNA, 15 bp, Homo sapiens
gcacagagccctgag

SEQ ID NO: 1229097 - DNA, 18 bp, Homo sapiens
gcacagagccctgagggg

SEQ ID NO: 1229098 - DNA, 22 bp, Homo sapiens
gcacagagccctgaggggctgg

SEQ ID NO: 1229099 - DNA, 22 bp, Homo sapiens
gcacagagcctggccccaggcc

SEQ ID NO: 1229100 - DNA, 18 bp, Homo sapiens
gcacagaggaggtcagca

SEQ ID NO: 1229101 - DNA, 18 bp, Homo sapiens
gcacagagggaagccatg

SEQ ID NO: 1229102 - DNA, 19 bp, Homo sapiens
gcacagagggctagggagg

SEQ ID NO: 1229103 - DNA, 20 bp, Homo sapiens
gcacagagggtcccattgtg

SEQ ID NO: 1229104 - DNA, 16 bp, Homo sapiens
gcacagatacctcatc

SEQ ID NO: 1229105 - DNA, 22 bp, Homo sapiens
gcacagatacctcatcatccac

SEQ ID NO: 1229106 - DNA, 22 bp, Homo sapiens
gcacagatgaggagcagctggg

SEQ ID NO: 1229107 - DNA, 15 bp, Homo sapiens
gcacagatgcccacg

SEQ ID NO: 1229108 - DNA, 22 bp, Homo sapiens
gcacagatggatttgcctgtgc

SEQ ID NO: 1229109 - DNA, 22 bp, Homo sapiens
gcacagcacaaattagttatat

SEQ ID NO: 1229110 - DNA, 20 bp, Homo sapiens
gcacagcaggacctgtgctt

SEQ ID NO: 1229111 - DNA, 17 bp, Homo sapiens
gcacagccaaatttaaa

SEQ ID NO: 1229112 - DNA, 22 bp, Homo sapiens
gcacagccaacacgcacctgcc

SEQ ID NO: 1229113 - DNA, 18 bp, Homo sapiens
gcacagccacctccgcca

SEQ ID NO: 1229114 - DNA, 23 bp, Homo sapiens
gcacagccacctccgccagaccc

SEQ ID NO: 1229115 - DNA, 13 bp, Homo sapiens
gcacagccagccc

SEQ ID NO: 1229116 - DNA, 12 bp, Homo sapiens
gcacagcccagg

SEQ ID NO: 1229117 - DNA, 14 bp, Homo sapiens
gcacagccctggga

SEQ ID NO: 1229118 - DNA, 23 bp, Homo sapiens
gcacagcctagggtcttgggggt

SEQ ID NO: 1229119 - DNA, 15 bp, Homo sapiens
gcacagcctcgggga

SEQ ID NO: 1229120 - DNA, 14 bp, Homo sapiens
gcacagctgccctg

SEQ ID NO: 1229121 - DNA, 17 bp, Homo sapiens
gcacagctgccctgctg

SEQ ID NO: 1229122 - DNA, 14 bp, Homo sapiens
gcacagctgggagc

SEQ ID NO: 1229123 - DNA, 23 bp, Homo sapiens
gcacagctgtagtggggttctag

SEQ ID NO: 1229124 - DNA, 13 bp, Homo sapiens
gcacagctgtctg

SEQ ID NO: 1229125 - DNA, 14 bp, Homo sapiens
gcacagctgtctgc

SEQ ID NO: 1229126 - DNA, 16 bp, Homo sapiens
gcacagctgtctgcca

SEQ ID NO: 1229127 - DNA, 18 bp, Homo sapiens
gcacagctgtctgccagg

SEQ ID NO: 1229128 - DNA, 18 bp, Homo sapiens
gcacagcttgacctgagg

SEQ ID NO: 1229129 - DNA, 20 bp, Homo sapiens
gcacagcttgacctgaggct

SEQ ID NO: 1229130 - DNA, 16 bp, Homo sapiens
gcacagcttgggtcag

SEQ ID NO: 1229131 - DNA, 15 bp, Homo sapiens
gcacatgcttagctt

SEQ ID NO: 1229132 - DNA, 14 bp, Homo sapiens
gcacatggccatag

SEQ ID NO: 1229133 - DNA, 14 bp, Homo sapiens
gcacatgtaataaa

SEQ ID NO: 1229134 - DNA, 22 bp, Homo sapiens
gcacatgtctgtcctcagagca

SEQ ID NO: 1229135 - DNA, 18 bp, Homo sapiens
gcacatgtgccacacagt

SEQ ID NO: 1229136 - DNA, 20 bp, Homo sapiens
gcacatgttactgcttcatt

SEQ ID NO: 1229137 - DNA, 18 bp, Homo sapiens
gcacattcgggaccaata

SEQ ID NO: 1229138 - DNA, 13 bp, Homo sapiens
gcacattgcccat

SEQ ID NO: 1229139 - DNA, 18 bp, Homo sapiens
gcacattgcctgttctgc

SEQ ID NO: 1229140 - DNA, 14 bp, Homo sapiens
gcaccaaaagaagt

SEQ ID NO: 1229141 - DNA, 15 bp, Homo sapiens
gcaccaaaagaagta

SEQ ID NO: 1229142 - DNA, 19 bp, Homo sapiens
gcaccaaaataagaaaaga

SEQ ID NO: 1229143 - DNA, 12 bp, Homo sapiens
gcaccaaagaca

SEQ ID NO: 1229144 - DNA, 15 bp, Homo sapiens
gcaccaacctcactg

SEQ ID NO: 1229145 - DNA, 18 bp, Homo sapiens
gcaccaacctcactgccc

SEQ ID NO: 1229146 - DNA, 22 bp, Homo sapiens
gcaccaacctcactgccctccc

SEQ ID NO: 1229147 - DNA, 14 bp, Homo sapiens
gcaccaagaaagct

SEQ ID NO: 1229148 - DNA, 19 bp, Homo sapiens
gcaccaagggacaggagaa

SEQ ID NO: 1229149 - DNA, 22 bp, Homo sapiens
gcaccaagggacaggagaagag

SEQ ID NO: 1229150 - DNA, 16 bp, Homo sapiens
gcaccaattatcatct

SEQ ID NO: 1229151 - DNA, 15 bp, Homo sapiens
gcaccacattgcctc

SEQ ID NO: 1229152 - DNA, 14 bp, Homo sapiens
gcaccaccaggagc

SEQ ID NO: 1229153 - DNA, 18 bp, Homo sapiens
gcaccaccaggagcagca

SEQ ID NO: 1229154 - DNA, 21 bp, Homo sapiens
gcaccaccaggagcagcagcc

SEQ ID NO: 1229155 - DNA, 20 bp, Homo sapiens
gcaccaccctagtcccttcc

SEQ ID NO: 1229156 - DNA, 16 bp, Homo sapiens
gcaccacctctgtggg

SEQ ID NO: 1229157 - DNA, 17 bp, Homo sapiens
gcaccacctctgtgggc

SEQ ID NO: 1229158 - DNA, 20 bp, Homo sapiens
gcaccacggcgtttttttac

SEQ ID NO: 1229159 - DNA, 14 bp, Homo sapiens
gcaccactctcctt

SEQ ID NO: 1229160 - DNA, 15 bp, Homo sapiens
gcaccactgctgagg

SEQ ID NO: 1229161 - DNA, 16 bp, Homo sapiens
gcaccactgctgagga

SEQ ID NO: 1229162 - DNA, 20 bp, Homo sapiens
gcaccactgctgaggagtct

SEQ ID NO: 1229163 - DNA, 23 bp, Homo sapiens
gcaccacttatttattgttgcct

SEQ ID NO: 1229164 - DNA, 19 bp, Homo sapiens
gcaccagagcaacctctca

SEQ ID NO: 1229165 - DNA, 21 bp, Homo sapiens
gcaccagaggctgcagaaggc

SEQ ID NO: 1229166 - DNA, 23 bp, Homo sapiens
gcaccagagtgaaagggctatgg

SEQ ID NO: 1229167 - DNA, 20 bp, Homo sapiens
gcaccagatgcaacctcact

SEQ ID NO: 1229168 - DNA, 11 bp, Homo sapiens
gcaccagccag

SEQ ID NO: 1229169 - DNA, 15 bp, Homo sapiens
gcaccagccccctgg

SEQ ID NO: 1229170 - DNA, 15 bp, Homo sapiens
gcaccagcgccccca

SEQ ID NO: 1229171 - DNA, 12 bp, Homo sapiens
gcaccagctctg

SEQ ID NO: 1229172 - DNA, 16 bp, Homo sapiens
gcaccagctctgtggc

SEQ ID NO: 1229173 - DNA, 19 bp, Homo sapiens
gcaccagctctgtggcctg

SEQ ID NO: 1229174 - DNA, 12 bp, Homo sapiens
gcaccagctgct

SEQ ID NO: 1229175 - DNA, 14 bp, Homo sapiens
gcaccagctgctct

SEQ ID NO: 1229176 - DNA, 15 bp, Homo sapiens
gcaccagctgctctg

SEQ ID NO: 1229177 - DNA, 16 bp, Homo sapiens
gcaccagctgctctgc

SEQ ID NO: 1229178 - DNA, 18 bp, Homo sapiens
gcaccagctgctctgccc

SEQ ID NO: 1229179 - DNA, 23 bp, Homo sapiens
gcaccaggcacgaacccacctgc

SEQ ID NO: 1229180 - DNA, 20 bp, Homo sapiens
gcaccagggcgctgggaagg

SEQ ID NO: 1229181 - DNA, 18 bp, Homo sapiens
gcaccaggggtttctcgc

SEQ ID NO: 1229182 - DNA, 23 bp, Homo sapiens
gcaccagggttgaccccagagga

SEQ ID NO: 1229183 - DNA, 21 bp, Homo sapiens
gcaccatccctttttgaagtg

SEQ ID NO: 1229184 - DNA, 22 bp, Homo sapiens
gcaccatgcaaatgtcttccag

SEQ ID NO: 1229185 - DNA, 17 bp, Homo sapiens
gcaccattctgactcgg

SEQ ID NO: 1229186 - DNA, 23 bp, Homo sapiens
gcaccattgcactctagcctggc

SEQ ID NO: 1229187 - DNA, 18 bp, Homo sapiens
gcacccaccgtggaggag

SEQ ID NO: 1229188 - DNA, 20 bp, Homo sapiens
gcacccacctgttttctgaa

SEQ ID NO: 1229189 - DNA, 15 bp, Homo sapiens
gcacccactcaccag

SEQ ID NO: 1229190 - DNA, 17 bp, Homo sapiens
gcacccagagcaccccc

SEQ ID NO: 1229191 - DNA, 21 bp, Homo sapiens
gcacccatctgtctgccaacc

SEQ ID NO: 1229192 - DNA, 23 bp, Homo sapiens
gcacccattatgcgctgtggcca

SEQ ID NO: 1229193 - DNA, 14 bp, Homo sapiens
gcaccccagcattc

SEQ ID NO: 1229194 - DNA, 19 bp, Homo sapiens
gcaccccagcattccagct

SEQ ID NO: 1229195 - DNA, 17 bp, Homo sapiens
gcaccccagcgtcaggc

SEQ ID NO: 1229196 - DNA, 20 bp, Homo sapiens
gcaccccagctaccccttct

SEQ ID NO: 1229197 - DNA, 18 bp, Homo sapiens
gcaccccatcccaccagc

SEQ ID NO: 1229198 - DNA, 22 bp, Homo sapiens
gcaccccatcccaccagccccg

SEQ ID NO: 1229199 - DNA, 17 bp, Homo sapiens
gcacccccaagcctggg

SEQ ID NO: 1229200 - DNA, 13 bp, Homo sapiens
gcacccccaccca

SEQ ID NO: 1229201 - DNA, 17 bp, Homo sapiens
gcacccccatgctgcct

SEQ ID NO: 1229202 - DNA, 16 bp, Homo sapiens
gcacccccgccaggcg

SEQ ID NO: 1229203 - DNA, 17 bp, Homo sapiens
gcacccccgccaggcgc

SEQ ID NO: 1229204 - DNA, 18 bp, Homo sapiens
gcacccccgccaggcgca

SEQ ID NO: 1229205 - DNA, 18 bp, Homo sapiens
gcaccccctcattcccct

SEQ ID NO: 1229206 - DNA, 14 bp, Homo sapiens
gcaccccctggaga

SEQ ID NO: 1229207 - DNA, 14 bp, Homo sapiens
gcaccccgctgcgg

SEQ ID NO: 1229208 - DNA, 16 bp, Homo sapiens
gcacccctactcacat

SEQ ID NO: 1229209 - DNA, 21 bp, Homo sapiens
gcacccctccctgcttgcaca

SEQ ID NO: 1229210 - DNA, 21 bp, Homo sapiens
gcacccctccgtgtggagcac

SEQ ID NO: 1229211 - DNA, 13 bp, Homo sapiens
gcacccctgggcc

SEQ ID NO: 1229212 - DNA, 16 bp, Homo sapiens
gcaccccttccatgtg

SEQ ID NO: 1229213 - DNA, 13 bp, Homo sapiens
gcaccccttctct

SEQ ID NO: 1229214 - DNA, 22 bp, Homo sapiens
gcacccctttcctccccataca

SEQ ID NO: 1229215 - DNA, 13 bp, Homo sapiens
gcacccgcctctc

SEQ ID NO: 1229216 - DNA, 15 bp, Homo sapiens
gcacccgcctctccc

SEQ ID NO: 1229217 - DNA, 16 bp, Homo sapiens
gcaccctcaggcaggt

SEQ ID NO: 1229218 - DNA, 12 bp, Homo sapiens
gcaccctcaggg

SEQ ID NO: 1229219 - DNA, 13 bp, Homo sapiens
gcaccctcaggga

SEQ ID NO: 1229220 - DNA, 19 bp, Homo sapiens
gcaccctcagggagcctcc

SEQ ID NO: 1229221 - DNA, 19 bp, Homo sapiens
gcaccctccaccctgtccc

SEQ ID NO: 1229222 - DNA, 19 bp, Homo sapiens
gcaccctcgatgaagccca

SEQ ID NO: 1229223 - DNA, 18 bp, Homo sapiens
gcaccctgcacctgctgc

SEQ ID NO: 1229224 - DNA, 19 bp, Homo sapiens
gcaccctgcacctgctgcg

SEQ ID NO: 1229225 - DNA, 15 bp, Homo sapiens
gcaccctgcgcctcc

SEQ ID NO: 1229226 - DNA, 20 bp, Homo sapiens
gcaccctgcgcctccagagg

SEQ ID NO: 1229227 - DNA, 21 bp, Homo sapiens
gcaccctggggcctggacctg

SEQ ID NO: 1229228 - DNA, 12 bp, Homo sapiens
gcaccctgggtg

SEQ ID NO: 1229229 - DNA, 14 bp, Homo sapiens
gcaccctggtctgt

SEQ ID NO: 1229230 - DNA, 12 bp, Homo sapiens
gcacccttcttt

SEQ ID NO: 1229231 - DNA, 17 bp, Homo sapiens
gcacccttctttcctct

SEQ ID NO: 1229232 - DNA, 19 bp, Homo sapiens
gcacccttctttcctcttc

SEQ ID NO: 1229233 - DNA, 18 bp, Homo sapiens
gcacccttcttttctcat

SEQ ID NO: 1229234 - DNA, 23 bp, Homo sapiens
gcagaatgaacccatagggagct

SEQ ID NO: 1229235 - DNA, 16 bp, Homo sapiens
gcagaatgactccacc

SEQ ID NO: 1229236 - DNA, 14 bp, Homo sapiens
gcagaatggctgca

SEQ ID NO: 1229237 - DNA, 13 bp, Homo sapiens
gcagaatgggcca

SEQ ID NO: 1229238 - DNA, 14 bp, Homo sapiens
gcagaattcattca

SEQ ID NO: 1229239 - DNA, 20 bp, Homo sapiens
gcagaattttaatgtgaaga

SEQ ID NO: 1229240 - DNA, 18 bp, Homo sapiens
gcagacaagagctgctgt

SEQ ID NO: 1229241 - DNA, 22 bp, Homo sapiens
gcagacaatagtatagaagtct

SEQ ID NO: 1229242 - DNA, 16 bp, Homo sapiens
gcagacacagggactt

SEQ ID NO: 1229243 - DNA, 18 bp, Homo sapiens
gcagacacagggacttga

SEQ ID NO: 1229244 - DNA, 23 bp, Homo sapiens
gcagacacagggacttgaagttg

SEQ ID NO: 1229245 - DNA, 20 bp, Homo sapiens
gcagacacctggactgagcc

SEQ ID NO: 1229246 - DNA, 15 bp, Homo sapiens
gcagacaccttggac

SEQ ID NO: 1229247 - DNA, 18 bp, Homo sapiens
gcagacagaaactggatt

SEQ ID NO: 1229248 - DNA, 13 bp, Homo sapiens
gcagacagagcca

SEQ ID NO: 1229249 - DNA, 22 bp, Homo sapiens
gcagacagagccaggagaagct

SEQ ID NO: 1229250 - DNA, 16 bp, Homo sapiens
gcagacagcagctcag

SEQ ID NO: 1229251 - DNA, 14 bp, Homo sapiens
gcagacagccatgc

SEQ ID NO: 1229252 - DNA, 14 bp, Homo sapiens
gcagacaggaggaa

SEQ ID NO: 1229253 - DNA, 17 bp, Homo sapiens
gcagacaggaggaatca

SEQ ID NO: 1229254 - DNA, 20 bp, Homo sapiens
gcagacaggctggcattcta

SEQ ID NO: 1229255 - DNA, 17 bp, Homo sapiens
gcagacatctctggagc

SEQ ID NO: 1229256 - DNA, 21 bp, Homo sapiens
gcagacatgccttggtgccgg

SEQ ID NO: 1229257 - DNA, 20 bp, Homo sapiens
gcagacattctcaaagcctc

SEQ ID NO: 1229258 - DNA, 17 bp, Homo sapiens
gcagaccacattgcttt

SEQ ID NO: 1229259 - DNA, 22 bp, Homo sapiens
gcagacccagcttagagttctt

SEQ ID NO: 1229260 - DNA, 16 bp, Homo sapiens
gcagaccctgaaccca

SEQ ID NO: 1229261 - DNA, 22 bp, Homo sapiens
gcagaccctgaacccacacctg

SEQ ID NO: 1229262 - DNA, 21 bp, Homo sapiens
gcagacctaagccctgccccg

SEQ ID NO: 1229263 - DNA, 17 bp, Homo sapiens
gcagacctcaagccatc

SEQ ID NO: 1229264 - DNA, 21 bp, Homo sapiens
gcagaccttactcaggggatg

SEQ ID NO: 1229265 - DNA, 22 bp, Homo sapiens
gcagacggtctgtgtgctgttt

SEQ ID NO: 1229266 - DNA, 15 bp, Homo sapiens
gcagactacacagga

SEQ ID NO: 1229267 - DNA, 15 bp, Homo sapiens
gcagactatgcaaac

SEQ ID NO: 1229268 - DNA, 15 bp, Homo sapiens
gcagactcagctctg

SEQ ID NO: 1229269 - DNA, 21 bp, Homo sapiens
gcagactcctcagatctgaac

SEQ ID NO: 1229270 - DNA, 15 bp, Homo sapiens
gcagacttcccagct

SEQ ID NO: 1229271 - DNA, 20 bp, Homo sapiens
gcagagaaacgcgctccttg

SEQ ID NO: 1229272 - DNA, 20 bp, Homo sapiens
gcagagaagaataagacata

SEQ ID NO: 1229273 - DNA, 15 bp, Homo sapiens
gcagagaaggcctct

SEQ ID NO: 1229274 - DNA, 15 bp, Homo sapiens
gcagagaagttctca

SEQ ID NO: 1229275 - DNA, 20 bp, Homo sapiens
gcagagaatcatacttagca

SEQ ID NO: 1229276 - DNA, 10 bp, Homo sapiens
gcagagaatg

SEQ ID NO: 1229277 - DNA, 14 bp, Homo sapiens
gcagagagaagcct

SEQ ID NO: 1229278 - DNA, 22 bp, Homo sapiens
gcagagagagaggacagagggg

SEQ ID NO: 1229279 - DNA, 12 bp, Homo sapiens
gcagagaggaag

SEQ ID NO: 1229280 - DNA, 14 bp, Homo sapiens
gcagagaggaagtg

SEQ ID NO: 1229281 - DNA, 17 bp, Homo sapiens
gcagagaggtggccacc

SEQ ID NO: 1229282 - DNA, 18 bp, Homo sapiens
gcagagcaaatgagggag

SEQ ID NO: 1229283 - DNA, 12 bp, Homo sapiens
gcagagcaataa

SEQ ID NO: 1229284 - DNA, 15 bp, Homo sapiens
gcagagcaataacac

SEQ ID NO: 1229285 - DNA, 16 bp, Homo sapiens
gcagagcaataacact

SEQ ID NO: 1229286 - DNA, 15 bp, Homo sapiens
gcagagcacagccca

SEQ ID NO: 1229287 - DNA, 15 bp, Homo sapiens
gcagagcaggaagga

SEQ ID NO: 1229288 - DNA, 20 bp, Homo sapiens
gcagagcaggggcagggtga

SEQ ID NO: 1229289 - DNA, 11 bp, Homo sapiens
gcagagccaag

SEQ ID NO: 1229290 - DNA, 12 bp, Homo sapiens
gcagagccaagg

SEQ ID NO: 1229291 - DNA, 13 bp, Homo sapiens
gcagagccaaggc

SEQ ID NO: 1229292 - DNA, 12 bp, Homo sapiens
gcagagccatgg

SEQ ID NO: 1229293 - DNA, 15 bp, Homo sapiens
gcagagccatgggcc

SEQ ID NO: 1229294 - DNA, 16 bp, Homo sapiens
gcagagccatgggcct

SEQ ID NO: 1229295 - DNA, 18 bp, Homo sapiens
gcagagccatgggcctgg

SEQ ID NO: 1229296 - DNA, 21 bp, Homo sapiens
gcagagccatgggcctgggcc

SEQ ID NO: 1229297 - DNA, 22 bp, Homo sapiens
gcagagccatgggcctgggcct

SEQ ID NO: 1229298 - DNA, 16 bp, Homo sapiens
gcagagcccaagggaa

SEQ ID NO: 1229299 - DNA, 16 bp, Homo sapiens
gcagagcccaccagcc

SEQ ID NO: 1229300 - DNA, 17 bp, Homo sapiens
gcagagcccaccagcca

SEQ ID NO: 1229301 - DNA, 21 bp, Homo sapiens
gcagagcccaccagccagccc

SEQ ID NO: 1229302 - DNA, 18 bp, Homo sapiens
gcagagcccggccccacc

SEQ ID NO: 1229303 - DNA, 17 bp, Homo sapiens
gcagagcctcctgggaa

SEQ ID NO: 1229304 - DNA, 11 bp, Homo sapiens
gcagagcctgt

SEQ ID NO: 1229305 - DNA, 16 bp, Homo sapiens
gcagagccttctcaga

SEQ ID NO: 1229306 - DNA, 19 bp, Homo sapiens
gcagagccttctcagaagc

SEQ ID NO: 1229307 - DNA, 14 bp, Homo sapiens
gcagagcgggaggg

SEQ ID NO: 1229308 - DNA, 16 bp, Homo sapiens
gcagagcgggagggag

SEQ ID NO: 1229309 - DNA, 23 bp, Homo sapiens
gcagagctctcccctcctgctgg

SEQ ID NO: 1229310 - DNA, 12 bp, Homo sapiens
gcagagctggct

SEQ ID NO: 1229311 - DNA, 15 bp, Homo sapiens
gcagagctggctctg

SEQ ID NO: 1229312 - DNA, 23 bp, Homo sapiens
gcagagctggctctgagcgcctc

SEQ ID NO: 1229313 - DNA, 20 bp, Homo sapiens
gcagagctggggctgccagc

SEQ ID NO: 1229314 - DNA, 22 bp, Homo sapiens
gcagagctggggctgccagcct

SEQ ID NO: 1229315 - DNA, 16 bp, Homo sapiens
gcagagcttttcagat

SEQ ID NO: 1229316 - DNA, 13 bp, Homo sapiens
gcagaggacgcac

SEQ ID NO: 1229317 - DNA, 14 bp, Homo sapiens
gcagaggacgcacg

SEQ ID NO: 1229318 - DNA, 20 bp, Homo sapiens
gcagaggacgcacgctcgct

SEQ ID NO: 1229319 - DNA, 24 bp, Homo sapiens
gcagaggacgcacgctcgctgcca

SEQ ID NO: 1229320 - DNA, 12 bp, Homo sapiens
gcagaggagccc

SEQ ID NO: 1229321 - DNA, 16 bp, Homo sapiens
gcagaggcagtggcca

SEQ ID NO: 1229322 - DNA, 14 bp, Homo sapiens
gcagaggcctgggc

SEQ ID NO: 1229323 - DNA, 22 bp, Homo sapiens
gcagaggctggaggcagggcct

SEQ ID NO: 1229324 - DNA, 12 bp, Homo sapiens
gcagaggctggc

SEQ ID NO: 1229325 - DNA, 16 bp, Homo sapiens
gcagaggctggcacca

SEQ ID NO: 1229326 - DNA, 15 bp, Homo sapiens
gcagaggctgtggct

SEQ ID NO: 1229327 - DNA, 21 bp, Homo sapiens
gcagaggcttccgtgtcctct

SEQ ID NO: 1229328 - DNA, 22 bp, Homo sapiens
gcagagggaatgttccctgcac

SEQ ID NO: 1229329 - DNA, 16 bp, Homo sapiens
gcagagggagaatcca

SEQ ID NO: 1229330 - DNA, 21 bp, Homo sapiens
gcagagggagaatccaagggt

SEQ ID NO: 1229331 - DNA, 21 bp, Homo sapiens
gcagagggagacggccctgct

SEQ ID NO: 1229332 - DNA, 18 bp, Homo sapiens
gcagagggcagaggctgg

SEQ ID NO: 1229333 - DNA, 19 bp, Homo sapiens
gcagagggcagaggctgga

SEQ ID NO: 1229334 - DNA, 16 bp, Homo sapiens
gcagagggctggaggc

SEQ ID NO: 1229335 - DNA, 18 bp, Homo sapiens
gcagagggctggaggccc

SEQ ID NO: 1229336 - DNA, 23 bp, Homo sapiens
gcagagggctggaggcccaggct

SEQ ID NO: 1229337 - DNA, 15 bp, Homo sapiens
gcagaggggcagccg

SEQ ID NO: 1229338 - DNA, 21 bp, Homo sapiens
gcagaggggcagccgctagga

SEQ ID NO: 1229339 - DNA, 22 bp, Homo sapiens
gcagaggggcagccgctaggag

SEQ ID NO: 1229340 - DNA, 17 bp, Homo sapiens
gcagaggggcgttctcc

SEQ ID NO: 1229341 - DNA, 23 bp, Homo sapiens
gcagaggggcgttctcccaaaga

SEQ ID NO: 1229342 - DNA, 18 bp, Homo sapiens
gcagaggggctttctgga

SEQ ID NO: 1229343 - DNA, 21 bp, Homo sapiens
gcagaggggctttctggagag

SEQ ID NO: 1229344 - DNA, 18 bp, Homo sapiens
gcagagggggagtagcca

SEQ ID NO: 1229345 - DNA, 21 bp, Homo sapiens
gcagaggtaaaagtgtgagca

SEQ ID NO: 1229346 - DNA, 15 bp, Homo sapiens
gcagaggtcccagcc

SEQ ID NO: 1229347 - DNA, 16 bp, Homo sapiens
gcagaggtcccagccc

SEQ ID NO: 1229348 - DNA, 19 bp, Homo sapiens
gcagaggtcccagccccag

SEQ ID NO: 1229349 - DNA, 16 bp, Homo sapiens
gcagaggtgattctta

SEQ ID NO: 1229350 - DNA, 14 bp, Homo sapiens
gcagaggtggccag

SEQ ID NO: 1229351 - DNA, 22 bp, Homo sapiens
gccagttgggctcgcactgccc

SEQ ID NO: 1229352 - DNA, 14 bp, Homo sapiens
gccagtttctctgc

SEQ ID NO: 1229353 - DNA, 20 bp, Homo sapiens
gccagttttgtttcctttca

SEQ ID NO: 1229354 - DNA, 20 bp, Homo sapiens
gccagtttttaaaatgctgc

SEQ ID NO: 1229355 - DNA, 21 bp, Homo sapiens
gccagtttttaaaatgctgct

SEQ ID NO: 1229356 - DNA, 21 bp, Homo sapiens
gccataaaacattaagaaaat

SEQ ID NO: 1229357 - DNA, 22 bp, Homo sapiens
gccataaaacattaagaaaatc

SEQ ID NO: 1229358 - DNA, 16 bp, Homo sapiens
gccataaaagcattgt

SEQ ID NO: 1229359 - DNA, 20 bp, Homo sapiens
gccataaaagcattgtctct

SEQ ID NO: 1229360 - DNA, 22 bp, Homo sapiens
gccataaaattgcagtttcatg

SEQ ID NO: 1229361 - DNA, 14 bp, Homo sapiens
gccataacgtgccc

SEQ ID NO: 1229362 - DNA, 20 bp, Homo sapiens
gccataacgtgcccccagag

SEQ ID NO: 1229363 - DNA, 16 bp, Homo sapiens
gccataagggggtggg

SEQ ID NO: 1229364 - DNA, 11 bp, Homo sapiens
gccataataaa

SEQ ID NO: 1229365 - DNA, 19 bp, Homo sapiens
gccatacataaaagaaata

SEQ ID NO: 1229366 - DNA, 18 bp, Homo sapiens
gccatacattaaggagca

SEQ ID NO: 1229367 - DNA, 14 bp, Homo sapiens
gccatactgtgtcc

SEQ ID NO: 1229368 - DNA, 17 bp, Homo sapiens
gccatagaccctgaggc

SEQ ID NO: 1229369 - DNA, 13 bp, Homo sapiens
gccatagaggccc

SEQ ID NO: 1229370 - DNA, 18 bp, Homo sapiens
gccatagaggcccaggca

SEQ ID NO: 1229371 - DNA, 19 bp, Homo sapiens
gccatagaggcccaggcac

SEQ ID NO: 1229372 - DNA, 20 bp, Homo sapiens
gccatagaggcccaggcacc

SEQ ID NO: 1229373 - DNA, 17 bp, Homo sapiens
gccatagcataatatga

SEQ ID NO: 1229374 - DNA, 17 bp, Homo sapiens
gccatagctgatcatgt

SEQ ID NO: 1229375 - DNA, 13 bp, Homo sapiens
gccataggccaag

SEQ ID NO: 1229376 - DNA, 14 bp, Homo sapiens
gccataggccaagg

SEQ ID NO: 1229377 - DNA, 15 bp, Homo sapiens
gccataggccaaggt

SEQ ID NO: 1229378 - DNA, 19 bp, Homo sapiens
gccatagggggctgcacgg

SEQ ID NO: 1229379 - DNA, 14 bp, Homo sapiens
gccatagggtctgc

SEQ ID NO: 1229380 - DNA, 19 bp, Homo sapiens
gccatagggtctgcagcct

SEQ ID NO: 1229381 - DNA, 24 bp, Homo sapiens
gccatagggtctgcagcctgctgg

SEQ ID NO: 1229382 - DNA, 16 bp, Homo sapiens
gccatataagtttgaa

SEQ ID NO: 1229383 - DNA, 22 bp, Homo sapiens
gccatataagtttgaaggaaac

SEQ ID NO: 1229384 - DNA, 23 bp, Homo sapiens
gccatataagtttgaaggaaaca

SEQ ID NO: 1229385 - DNA, 21 bp, Homo sapiens
gccatatataacagatacatt

SEQ ID NO: 1229386 - DNA, 23 bp, Homo sapiens
gccatatataacagatacatttc

SEQ ID NO: 1229387 - DNA, 19 bp, Homo sapiens
gccatatatgaccagaagc

SEQ ID NO: 1229388 - DNA, 20 bp, Homo sapiens
gccatatatgaccagaagcc

SEQ ID NO: 1229389 - DNA, 17 bp, Homo sapiens
gccatattttcaccatt

SEQ ID NO: 1229390 - DNA, 15 bp, Homo sapiens
gccatcaaaatgctt

SEQ ID NO: 1229391 - DNA, 18 bp, Homo sapiens
gccatcaaaatgcttttt

SEQ ID NO: 1229392 - DNA, 19 bp, Homo sapiens
gccatcaaaatgcttttta

SEQ ID NO: 1229393 - DNA, 17 bp, Homo sapiens
gccatcaacaagagttg

SEQ ID NO: 1229394 - DNA, 15 bp, Homo sapiens
gccatcaagagactg

SEQ ID NO: 1229395 - DNA, 16 bp, Homo sapiens
gccatcaccctcaccc

SEQ ID NO: 1229396 - DNA, 17 bp, Homo sapiens
gccatcaccgctgggtg

SEQ ID NO: 1229397 - DNA, 12 bp, Homo sapiens
gccatcacgctt

SEQ ID NO: 1229398 - DNA, 15 bp, Homo sapiens
gccatcactcagccc

SEQ ID NO: 1229399 - DNA, 21 bp, Homo sapiens
gccatcactcagcccctaccc

SEQ ID NO: 1229400 - DNA, 16 bp, Homo sapiens
gccatcactggtccag

SEQ ID NO: 1229401 - DNA, 17 bp, Homo sapiens
gccatcacttctccccg

SEQ ID NO: 1229402 - DNA, 12 bp, Homo sapiens
gccatcagccat

SEQ ID NO: 1229403 - DNA, 18 bp, Homo sapiens
gccatcagccatggccct

SEQ ID NO: 1229404 - DNA, 13 bp, Homo sapiens
gccatcagggccc

SEQ ID NO: 1229405 - DNA, 17 bp, Homo sapiens
gccatcagggccctgcc

SEQ ID NO: 1229406 - DNA, 22 bp, Homo sapiens
gccatcagggccctgccccagg

SEQ ID NO: 1229407 - DNA, 13 bp, Homo sapiens
gccatcagggtgg

SEQ ID NO: 1229408 - DNA, 22 bp, Homo sapiens
gccatcagggtgggccactctc

SEQ ID NO: 1229409 - DNA, 23 bp, Homo sapiens
gccatcatctcctgccttcctcc

SEQ ID NO: 1229410 - DNA, 13 bp, Homo sapiens
gccatccaaaagg

SEQ ID NO: 1229411 - DNA, 20 bp, Homo sapiens
gccatccaaataagaaacct

SEQ ID NO: 1229412 - DNA, 15 bp, Homo sapiens
gccatccagggtctg

SEQ ID NO: 1229413 - DNA, 15 bp, Homo sapiens
gccatccattctgga

SEQ ID NO: 1229414 - DNA, 15 bp, Homo sapiens
gccatccccctctca

SEQ ID NO: 1229415 - DNA, 19 bp, Homo sapiens
gccatccccctctcacgcc

SEQ ID NO: 1229416 - DNA, 16 bp, Homo sapiens
gccatcccgcttagcc

SEQ ID NO: 1229417 - DNA, 18 bp, Homo sapiens
gccatcccgcttagcctg

SEQ ID NO: 1229418 - DNA, 22 bp, Homo sapiens
gccatcccgcttagcctgcctc

SEQ ID NO: 1229419 - DNA, 13 bp, Homo sapiens
gccatccctgggc

SEQ ID NO: 1229420 - DNA, 21 bp, Homo sapiens
gccatccctgggcccctccac

SEQ ID NO: 1229421 - DNA, 17 bp, Homo sapiens
gccatcccttcggagcc

SEQ ID NO: 1229422 - DNA, 18 bp, Homo sapiens
gccatcccttcggagcca

SEQ ID NO: 1229423 - DNA, 18 bp, Homo sapiens
gccatccctttttttaca

SEQ ID NO: 1229424 - DNA, 23 bp, Homo sapiens
gccatccgcagactgcttggcca

SEQ ID NO: 1229425 - DNA, 18 bp, Homo sapiens
gccatccggtcccctgcc

SEQ ID NO: 1229426 - DNA, 23 bp, Homo sapiens
gccatccggtcccctgcctggaa

SEQ ID NO: 1229427 - DNA, 14 bp, Homo sapiens
gccatcctacccag

SEQ ID NO: 1229428 - DNA, 15 bp, Homo sapiens
gccatcctccctcca

SEQ ID NO: 1229429 - DNA, 14 bp, Homo sapiens
gccatcctgatgga

SEQ ID NO: 1229430 - DNA, 19 bp, Homo sapiens
gccatctcagattctgtct

SEQ ID NO: 1229431 - DNA, 15 bp, Homo sapiens
gccatctcaggagat

SEQ ID NO: 1229432 - DNA, 21 bp, Homo sapiens
gccatctcatgaggggagagg

SEQ ID NO: 1229433 - DNA, 17 bp, Homo sapiens
gccatctgacagcaggc

SEQ ID NO: 1229434 - DNA, 13 bp, Homo sapiens
gccatctgcccag

SEQ ID NO: 1229435 - DNA, 19 bp, Homo sapiens
gccatctgcccaggggtgc

SEQ ID NO: 1229436 - DNA, 17 bp, Homo sapiens
gccatctgcgcagggtg

SEQ ID NO: 1229437 - DNA, 18 bp, Homo sapiens
gccatctgcgcagggtgg

SEQ ID NO: 1229438 - DNA, 17 bp, Homo sapiens
gccatctgtaaatatcc

SEQ ID NO: 1229439 - DNA, 20 bp, Homo sapiens
gccatctgtaaatatcccag

SEQ ID NO: 1229440 - DNA, 20 bp, Homo sapiens
gccatctgtacatattactg

SEQ ID NO: 1229441 - DNA, 12 bp, Homo sapiens
gccatcttcagg

SEQ ID NO: 1229442 - DNA, 15 bp, Homo sapiens
gccatcttctccccg

SEQ ID NO: 1229443 - DNA, 19 bp, Homo sapiens
gccatcttctccccgaggc

SEQ ID NO: 1229444 - DNA, 18 bp, Homo sapiens
gccatctttttatgcaaa

SEQ ID NO: 1229445 - DNA, 23 bp, Homo sapiens
gccatctttttatgcaaaagtca

SEQ ID NO: 1229446 - DNA, 14 bp, Homo sapiens
gccatgaagcatta

SEQ ID NO: 1229447 - DNA, 16 bp, Homo sapiens
gccatgaagggaccct

SEQ ID NO: 1229448 - DNA, 19 bp, Homo sapiens
gccatgaatctctgcctct

SEQ ID NO: 1229449 - DNA, 15 bp, Homo sapiens
gccatgacagaggct

SEQ ID NO: 1229450 - DNA, 15 bp, Homo sapiens
gccatgacttttctg

SEQ ID NO: 1229451 - DNA, 23 bp, Homo sapiens
gccatgagatgatacatccaaag

SEQ ID NO: 1229452 - DNA, 17 bp, Homo sapiens
gccatgagctccagacc

SEQ ID NO: 1229453 - DNA, 21 bp, Homo sapiens
gccatgagtattagcttaccc

SEQ ID NO: 1229454 - DNA, 15 bp, Homo sapiens
gccatgatagctggg

SEQ ID NO: 1229455 - DNA, 14 bp, Homo sapiens
gccatgatgtatat

SEQ ID NO: 1229456 - DNA, 17 bp, Homo sapiens
gccatgatgtccttgga

SEQ ID NO: 1229457 - DNA, 22 bp, Homo sapiens
gccatgatttttggtatttatg

SEQ ID NO: 1229458 - DNA, 20 bp, Homo sapiens
gccatgccactgccaggcac

SEQ ID NO: 1229459 - DNA, 13 bp, Homo sapiens
gccatgccagctg

SEQ ID NO: 1229460 - DNA, 14 bp, Homo sapiens
gccatgccagctgg

SEQ ID NO: 1229461 - DNA, 18 bp, Homo sapiens
gccatgccagcttatctc

SEQ ID NO: 1229462 - DNA, 19 bp, Homo sapiens
gccatgccagcttatctca

SEQ ID NO: 1229463 - DNA, 18 bp, Homo sapiens
gccatgccaggaacctgt

SEQ ID NO: 1229464 - DNA, 15 bp, Homo sapiens
gccatgccccacccc

SEQ ID NO: 1229465 - DNA, 16 bp, Homo sapiens
gccatgcgaggggcca

SEQ ID NO: 1229466 - DNA, 20 bp, Homo sapiens
gccatgcgccccctccgccc

SEQ ID NO: 1229467 - DNA, 14 bp, Homo sapiens
gccatgctcctggc

SEQ ID NO: 1229468 - DNA, 24 bp, Homo sapiens
gccatgctcctggcccactgcatc

SEQ ID NO: 1229469 - DNA, 13 bp, Homo sapiens
gccatgctgaggc

SEQ ID NO: 1229470 - DNA, 18 bp, Homo sapiens
gccatgctgaggcctggg

SEQ ID NO: 1229471 - DNA, 19 bp, Homo sapiens
gccatgctgaggcctgggc

SEQ ID NO: 1229472 - DNA, 20 bp, Homo sapiens
gccatgctgaggcctgggcc

SEQ ID NO: 1229473 - DNA, 14 bp, Homo sapiens
gccatgctggctca

SEQ ID NO: 1229474 - DNA, 16 bp, Homo sapiens
gccatgctgggccact

SEQ ID NO: 1229475 - DNA, 21 bp, Homo sapiens
gcccagcaggcaggcactgtg

SEQ ID NO: 1229476 - DNA, 13 bp, Homo sapiens
gcccagcaggccc

SEQ ID NO: 1229477 - DNA, 16 bp, Homo sapiens
gcccagcaggcccagc

SEQ ID NO: 1229478 - DNA, 20 bp, Homo sapiens
gcccagcatgcaggtggtgg

SEQ ID NO: 1229479 - DNA, 18 bp, Homo sapiens
gcccagcattgctggttc

SEQ ID NO: 1229480 - DNA, 19 bp, Homo sapiens
gcccagcattgctggttct

SEQ ID NO: 1229481 - DNA, 17 bp, Homo sapiens
gcccagccaaaccctgt

SEQ ID NO: 1229482 - DNA, 21 bp, Homo sapiens
gcccagccaaaccctgtctga

SEQ ID NO: 1229483 - DNA, 13 bp, Homo sapiens
gcccagccacccc

SEQ ID NO: 1229484 - DNA, 13 bp, Homo sapiens
gcccagccactcc

SEQ ID NO: 1229485 - DNA, 19 bp, Homo sapiens
gcccagccactccaagccc

SEQ ID NO: 1229486 - DNA, 12 bp, Homo sapiens
gcccagccagcc

SEQ ID NO: 1229487 - DNA, 13 bp, Homo sapiens
gcccagccaggcc

SEQ ID NO: 1229488 - DNA, 17 bp, Homo sapiens
gcccagccaggccccag

SEQ ID NO: 1229489 - DNA, 22 bp, Homo sapiens
gcccagccattaccatggagac

SEQ ID NO: 1229490 - DNA, 14 bp, Homo sapiens
gcccagcccagagc

SEQ ID NO: 1229491 - DNA, 16 bp, Homo sapiens
gcccagcccagagcca

SEQ ID NO: 1229492 - DNA, 13 bp, Homo sapiens
gcccagcccagct

SEQ ID NO: 1229493 - DNA, 16 bp, Homo sapiens
gcccagcccagctggt

SEQ ID NO: 1229494 - DNA, 23 bp, Homo sapiens
gcccagccccactcctctgctga

SEQ ID NO: 1229495 - DNA, 18 bp, Homo sapiens
gcccagcccctactgctg

SEQ ID NO: 1229496 - DNA, 14 bp, Homo sapiens
gcccagcccctaga

SEQ ID NO: 1229497 - DNA, 16 bp, Homo sapiens
gcccagccggcctctc

SEQ ID NO: 1229498 - DNA, 19 bp, Homo sapiens
gcccagtgctgctgtaaat

SEQ ID NO: 1229499 - DNA, 23 bp, Homo sapiens
gcccagtgcttctccaacactga

SEQ ID NO: 1229500 - DNA, 13 bp, Homo sapiens
gcccagtgggctg

SEQ ID NO: 1229501 - DNA, 16 bp, Homo sapiens
gcccagtgttttcttt

SEQ ID NO: 1229502 - DNA, 21 bp, Homo sapiens
gcccagtgttttctttgagga

SEQ ID NO: 1229503 - DNA, 22 bp, Homo sapiens
gcccagtgttttctttgaggac

SEQ ID NO: 1229504 - DNA, 20 bp, Homo sapiens
gcccataaggccagaaactc

SEQ ID NO: 1229505 - DNA, 22 bp, Homo sapiens
gcccatacccgtgacagtggct

SEQ ID NO: 1229506 - DNA, 14 bp, Homo sapiens
gcccatactcagcc

SEQ ID NO: 1229507 - DNA, 17 bp, Homo sapiens
gcccatactcagcctgc

SEQ ID NO: 1229508 - DNA, 15 bp, Homo sapiens
gcccatactgagcct

SEQ ID NO: 1229509 - DNA, 17 bp, Homo sapiens
gcccatcaagtgcagtc

SEQ ID NO: 1229510 - DNA, 17 bp, Homo sapiens
gcccatcacagggttgg

SEQ ID NO: 1229511 - DNA, 21 bp, Homo sapiens
gcccatcacagggttgggccc

SEQ ID NO: 1229512 - DNA, 13 bp, Homo sapiens
gcccatcaggcag

SEQ ID NO: 1229513 - DNA, 15 bp, Homo sapiens
gcccatcaggcagtg

SEQ ID NO: 1229514 - DNA, 20 bp, Homo sapiens
gcccatccattaggccagca

SEQ ID NO: 1229515 - DNA, 14 bp, Homo sapiens
gcccatccctgacc

SEQ ID NO: 1229516 - DNA, 17 bp, Homo sapiens
gcccatctcagcctcct

SEQ ID NO: 1229517 - DNA, 16 bp, Homo sapiens
gcccatctcaggtgcc

SEQ ID NO: 1229518 - DNA, 17 bp, Homo sapiens
gcccatctccctgcttt

SEQ ID NO: 1229519 - DNA, 18 bp, Homo sapiens
gcccatctccctgctttg

SEQ ID NO: 1229520 - DNA, 14 bp, Homo sapiens
gcccatctcggagc

SEQ ID NO: 1229521 - DNA, 18 bp, Homo sapiens
gcccatctcggagcatcc

SEQ ID NO: 1229522 - DNA, 19 bp, Homo sapiens
gcccatgaagaaagcccct

SEQ ID NO: 1229523 - DNA, 17 bp, Homo sapiens
gcccatgagtccttgaa

SEQ ID NO: 1229524 - DNA, 19 bp, Homo sapiens
gcccatggacaggctggct

SEQ ID NO: 1229525 - DNA, 21 bp, Homo sapiens
gcccatggacaggctggctcc

SEQ ID NO: 1229526 - DNA, 20 bp, Homo sapiens
gcccccagtccccacccctg

SEQ ID NO: 1229527 - DNA, 18 bp, Homo sapiens
gcccccagtggggacagg

SEQ ID NO: 1229528 - DNA, 17 bp, Homo sapiens
gcccccatctccccagg

SEQ ID NO: 1229529 - DNA, 19 bp, Homo sapiens
gcccccatctccccaggcc

SEQ ID NO: 1229530 - DNA, 16 bp, Homo sapiens
gcccccatctgtcttc

SEQ ID NO: 1229531 - DNA, 15 bp, Homo sapiens
gcccccattctccca

SEQ ID NO: 1229532 - DNA, 16 bp, Homo sapiens
gcccccattctcccag

SEQ ID NO: 1229533 - DNA, 18 bp, Homo sapiens
gcccccattctcccagtc

SEQ ID NO: 1229534 - DNA, 17 bp, Homo sapiens
gcccccatttcacccat

SEQ ID NO: 1229535 - DNA, 18 bp, Homo sapiens
gccccccacacttccctg

SEQ ID NO: 1229536 - DNA, 19 bp, Homo sapiens
gccccccacacttccctgg

SEQ ID NO: 1229537 - DNA, 19 bp, Homo sapiens
gccccccacccctggaaga

SEQ ID NO: 1229538 - DNA, 16 bp, Homo sapiens
gccccccactccccct

SEQ ID NO: 1229539 - DNA, 20 bp, Homo sapiens
gccccccagaaagctgccag

SEQ ID NO: 1229540 - DNA, 13 bp, Homo sapiens
gccccccagagcc

SEQ ID NO: 1229541 - DNA, 21 bp, Homo sapiens
gccccccagagccagggctgt

SEQ ID NO: 1229542 - DNA, 14 bp, Homo sapiens
gccccccagggcta

SEQ ID NO: 1229543 - DNA, 19 bp, Homo sapiens
gcccccccaacactgtgcc

SEQ ID NO: 1229544 - DNA, 22 bp, Homo sapiens
gcccccccaacactgtgccctg

SEQ ID NO: 1229545 - DNA, 20 bp, Homo sapiens
gcccccccacccacccccag

SEQ ID NO: 1229546 - DNA, 22 bp, Homo sapiens
gcccccccacccacccccaggc

SEQ ID NO: 1229547 - DNA, 23 bp, Homo sapiens
gcccccccactccagcccgcagc

SEQ ID NO: 1229548 - DNA, 16 bp, Homo sapiens
gcccccccccacccct

SEQ ID NO: 1229549 - DNA, 17 bp, Homo sapiens
gcccccccccacccctg

SEQ ID NO: 1229550 - DNA, 23 bp, Homo sapiens
gccccccccttgaatctgcaggg

SEQ ID NO: 1229551 - DNA, 14 bp, Homo sapiens
gcccccccttccac

SEQ ID NO: 1229552 - DNA, 23 bp, Homo sapiens
gcccccccttcccccttttttgt

SEQ ID NO: 1229553 - DNA, 14 bp, Homo sapiens
gccccccgcccctc

SEQ ID NO: 1229554 - DNA, 16 bp, Homo sapiens
gccccccgccctcatg

SEQ ID NO: 1229555 - DNA, 19 bp, Homo sapiens
gccccccgcgctcgcccag

SEQ ID NO: 1229556 - DNA, 11 bp, Homo sapiens
gcccccctcct

SEQ ID NO: 1229557 - DNA, 13 bp, Homo sapiens
gcccccctcctcc

SEQ ID NO: 1229558 - DNA, 16 bp, Homo sapiens
gcccccctcctccagt

SEQ ID NO: 1229559 - DNA, 22 bp, Homo sapiens
gcccccgagccctgactcctgg

SEQ ID NO: 1229560 - DNA, 14 bp, Homo sapiens
gcccccgagctggg

SEQ ID NO: 1229561 - DNA, 15 bp, Homo sapiens
gcccccgccccacag

SEQ ID NO: 1229562 - DNA, 14 bp, Homo sapiens
gcccccgccccagg

SEQ ID NO: 1229563 - DNA, 15 bp, Homo sapiens
gcccccgccccaggc

SEQ ID NO: 1229564 - DNA, 16 bp, Homo sapiens
gcccccgccccaggct

SEQ ID NO: 1229565 - DNA, 16 bp, Homo sapiens
gcccccgcccccggcg

SEQ ID NO: 1229566 - DNA, 16 bp, Homo sapiens
gcccccgccccctccc

SEQ ID NO: 1229567 - DNA, 20 bp, Homo sapiens
gcccctgggatgggaccagg

SEQ ID NO: 1229568 - DNA, 22 bp, Homo sapiens
gcccctgggatgggaccaggga

SEQ ID NO: 1229569 - DNA, 19 bp, Homo sapiens
gcccctgggcccttgtgct

SEQ ID NO: 1229570 - DNA, 20 bp, Homo sapiens
gcccctgggcccttgtgctc

SEQ ID NO: 1229571 - DNA, 20 bp, Homo sapiens
gcccctgggcttggcctgct

SEQ ID NO: 1229572 - DNA, 22 bp, Homo sapiens
gcccctggggacagagccaccc

SEQ ID NO: 1229573 - DNA, 16 bp, Homo sapiens
gcccctggggcccagc

SEQ ID NO: 1229574 - DNA, 18 bp, Homo sapiens
gcccctggggcccagccc

SEQ ID NO: 1229575 - DNA, 15 bp, Homo sapiens
gcccctggggtggcc

SEQ ID NO: 1229576 - DNA, 21 bp, Homo sapiens
gcccctgggtgggtggtgggg

SEQ ID NO: 1229577 - DNA, 19 bp, Homo sapiens
gcccctggtgccctgagac

SEQ ID NO: 1229578 - DNA, 15 bp, Homo sapiens
gcccctgtcccaccc

SEQ ID NO: 1229579 - DNA, 18 bp, Homo sapiens
gcccctgtcccacctggc

SEQ ID NO: 1229580 - DNA, 19 bp, Homo sapiens
gcccctgtcccacctggct

SEQ ID NO: 1229581 - DNA, 17 bp, Homo sapiens
gcccctgtccccagtcc

SEQ ID NO: 1229582 - DNA, 18 bp, Homo sapiens
gcccctgtcgcccaccca

SEQ ID NO: 1229583 - DNA, 18 bp, Homo sapiens
gcccctgtctagagaggg

SEQ ID NO: 1229584 - DNA, 19 bp, Homo sapiens
gcccctgtctagagaggga

SEQ ID NO: 1229585 - DNA, 16 bp, Homo sapiens
gcccctgtctcggggc

SEQ ID NO: 1229586 - DNA, 16 bp, Homo sapiens
gcccctgtgctgcggg

SEQ ID NO: 1229587 - DNA, 11 bp, Homo sapiens
gcccctgtggc

SEQ ID NO: 1229588 - DNA, 17 bp, Homo sapiens
gcccctgtggccaactg

SEQ ID NO: 1229589 - DNA, 20 bp, Homo sapiens
gcccctgtggccctggccac

SEQ ID NO: 1229590 - DNA, 19 bp, Homo sapiens
gccccttaaccccaaggac

SEQ ID NO: 1229591 - DNA, 20 bp, Homo sapiens
gccccttcatccgcctgtgg

SEQ ID NO: 1229592 - DNA, 22 bp, Homo sapiens
gccccttccatggtactgtagc

SEQ ID NO: 1229593 - DNA, 12 bp, Homo sapiens
gccccttccccc

SEQ ID NO: 1229594 - DNA, 19 bp, Homo sapiens
gccccttctccccttcctg

SEQ ID NO: 1229595 - DNA, 22 bp, Homo sapiens
gccccttctccccttcctggac

SEQ ID NO: 1229596 - DNA, 17 bp, Homo sapiens
gccccttctgctcagct

SEQ ID NO: 1229597 - DNA, 18 bp, Homo sapiens
gccccttgcaagccataa

SEQ ID NO: 1229598 - DNA, 13 bp, Homo sapiens
gccccttgccatc

SEQ ID NO: 1229599 - DNA, 20 bp, Homo sapiens
gccccttgctgatgctcctc

SEQ ID NO: 1229600 - DNA, 14 bp, Homo sapiens
gccccttggagaga

SEQ ID NO: 1229601 - DNA, 15 bp, Homo sapiens
gccccttggagagag

SEQ ID NO: 1229602 - DNA, 22 bp, Homo sapiens
gccccttggctggatcagggaa

SEQ ID NO: 1229603 - DNA, 19 bp, Homo sapiens
gccccttgtcctgaagccc

SEQ ID NO: 1229604 - DNA, 13 bp, Homo sapiens
gcccctttataaa

SEQ ID NO: 1229605 - DNA, 12 bp, Homo sapiens
gcccctttcccc

SEQ ID NO: 1229606 - DNA, 13 bp, Homo sapiens
gcccctttccttc

SEQ ID NO: 1229607 - DNA, 17 bp, Homo sapiens
gcccctttgcctctgtc

SEQ ID NO: 1229608 - DNA, 18 bp, Homo sapiens
gcccctttgcctctgtcc

SEQ ID NO: 1229609 - DNA, 19 bp, Homo sapiens
gccccttttacttttttat

SEQ ID NO: 1229610 - DNA, 18 bp, Homo sapiens
gccccttttctctgctct

SEQ ID NO: 1229611 - DNA, 23 bp, Homo sapiens
gcccctttttcatatgttgctca

SEQ ID NO: 1229612 - DNA, 17 bp, Homo sapiens
gcccgaaactaagccag

SEQ ID NO: 1229613 - DNA, 21 bp, Homo sapiens
gcccgaaactaagccaggcct

SEQ ID NO: 1229614 - DNA, 22 bp, Homo sapiens
gcccgaaactaagccaggcctg

SEQ ID NO: 1229615 - DNA, 14 bp, Homo sapiens
gcccgacagcctgg

SEQ ID NO: 1229616 - DNA, 15 bp, Homo sapiens
gcccgacagcctggc

SEQ ID NO: 1229617 - DNA, 16 bp, Homo sapiens
gcccgacagcctggca

SEQ ID NO: 1229618 - DNA, 15 bp, Homo sapiens
gcccgacaggtgggc

SEQ ID NO: 1229619 - DNA, 22 bp, Homo sapiens
gcccgacaggtgggcctgggag

SEQ ID NO: 1229620 - DNA, 14 bp, Homo sapiens
gcccgacagtgcca

SEQ ID NO: 1229621 - DNA, 16 bp, Homo sapiens
gcccgacagtgccatc

SEQ ID NO: 1229622 - DNA, 14 bp, Homo sapiens
gcccgacatttctt

SEQ ID NO: 1229623 - DNA, 22 bp, Homo sapiens
gcccgagctggtgcattacaga

SEQ ID NO: 1229624 - DNA, 14 bp, Homo sapiens
gcccgagtccgccc

SEQ ID NO: 1229625 - DNA, 16 bp, Homo sapiens
gcccgatattctccct

SEQ ID NO: 1229626 - DNA, 15 bp, Homo sapiens
gcccgcacccccacc

SEQ ID NO: 1229627 - DNA, 16 bp, Homo sapiens
gcccgcacccccaccc

SEQ ID NO: 1229628 - DNA, 19 bp, Homo sapiens
gcccgcacccccacccttt

SEQ ID NO: 1229629 - DNA, 17 bp, Homo sapiens
gcccgcacccctccctg

SEQ ID NO: 1229630 - DNA, 16 bp, Homo sapiens
gcccgcagcccagacc

SEQ ID NO: 1229631 - DNA, 23 bp, Homo sapiens
gcccgcaggaactgggctgggcc

SEQ ID NO: 1229632 - DNA, 14 bp, Homo sapiens
gcccgcatgtgtgc

SEQ ID NO: 1229633 - DNA, 19 bp, Homo sapiens
gcccgcatgtgtgcctggc

SEQ ID NO: 1229634 - DNA, 21 bp, Homo sapiens
gcccgcatgtgtgcctggccg

SEQ ID NO: 1229635 - DNA, 18 bp, Homo sapiens
gcccgcccactgtcctgg

SEQ ID NO: 1229636 - DNA, 20 bp, Homo sapiens
gcccgcccactgtcctgggc

SEQ ID NO: 1229637 - DNA, 17 bp, Homo sapiens
gcccgccctcacctctg

SEQ ID NO: 1229638 - DNA, 15 bp, Homo sapiens
gcccgccttggcttt

SEQ ID NO: 1229639 - DNA, 14 bp, Homo sapiens
gcccgcgctcagga

SEQ ID NO: 1229640 - DNA, 19 bp, Homo sapiens
gcccgcggcgcgaccctcc

SEQ ID NO: 1229641 - DNA, 15 bp, Homo sapiens
gcccgcgggcacagc

SEQ ID NO: 1229642 - DNA, 19 bp, Homo sapiens
gcccgcgggcacagccagc

SEQ ID NO: 1229643 - DNA, 19 bp, Homo sapiens
gcccgcgtccaaccccggg

SEQ ID NO: 1229644 - DNA, 20 bp, Homo sapiens
gcccgctcccaacccccctc

SEQ ID NO: 1229645 - DNA, 23 bp, Homo sapiens
gcccgctcccaacccccctcctg

SEQ ID NO: 1229646 - DNA, 14 bp, Homo sapiens
gcccgctgcaatgc

SEQ ID NO: 1229647 - DNA, 22 bp, Homo sapiens
gcccgctgcagcctctgcctct

SEQ ID NO: 1229648 - DNA, 14 bp, Homo sapiens
gcccgctgggctga

SEQ ID NO: 1229649 - DNA, 18 bp, Homo sapiens
gcccgctgggctgagccc

SEQ ID NO: 1229650 - DNA, 14 bp, Homo sapiens
gcccgcttcaagct

SEQ ID NO: 1229651 - DNA, 17 bp, Homo sapiens
gcccgcttcaagctctc

SEQ ID NO: 1229652 - DNA, 21 bp, Homo sapiens
gcccggagattggacggcctg

SEQ ID NO: 1229653 - DNA, 19 bp, Homo sapiens
gcccggagtaatcaggcag

SEQ ID NO: 1229654 - DNA, 23 bp, Homo sapiens
gcccggagtaatcaggcagcctt

SEQ ID NO: 1229655 - DNA, 17 bp, Homo sapiens
gcccggcagggcgggca

SEQ ID NO: 1229656 - DNA, 18 bp, Homo sapiens
gcccggccagccatgtct

SEQ ID NO: 1229657 - DNA, 21 bp, Homo sapiens
gcccggcccaccagggactgc

SEQ ID NO: 1229658 - DNA, 14 bp, Homo sapiens
gcccggcccagcct

SEQ ID NO: 1229659 - DNA, 23 bp, Homo sapiens
gcccggccccaccccctgggcag

SEQ ID NO: 1229660 - DNA, 23 bp, Homo sapiens
gcccggccccacctccctgcgcc

SEQ ID NO: 1229661 - DNA, 15 bp, Homo sapiens
gcccggcccctcacc

SEQ ID NO: 1229662 - DNA, 19 bp, Homo sapiens
gcccggcccctcaccctct

SEQ ID NO: 1229663 - DNA, 18 bp, Homo sapiens
gcccggcctgctcccagc

SEQ ID NO: 1229664 - DNA, 22 bp, Homo sapiens
gcccggcctgctcccagcagcc

SEQ ID NO: 1229665 - DNA, 20 bp, Homo sapiens
gcccggcgccgggcaccaac

SEQ ID NO: 1229666 - DNA, 15 bp, Homo sapiens
gcccggcgcctgccc

SEQ ID NO: 1229667 - DNA, 16 bp, Homo sapiens
gcccggcgcctgccct

SEQ ID NO: 1229668 - DNA, 18 bp, Homo sapiens
gcccggcgcctgccctgc

SEQ ID NO: 1229669 - DNA, 22 bp, Homo sapiens
gcccggctaatgtttgtatttt

SEQ ID NO: 1229670 - DNA, 20 bp, Homo sapiens
gcccgggagcctaggaccac

SEQ ID NO: 1229671 - DNA, 20 bp, Homo sapiens
gcccgggcacccacaagccc

SEQ ID NO: 1229672 - DNA, 13 bp, Homo sapiens
gcccgggccgacc

SEQ ID NO: 1229673 - DNA, 12 bp, Homo sapiens
gcccgggctgcc

SEQ ID NO: 1229674 - DNA, 13 bp, Homo sapiens
gcccgggctgcct

SEQ ID NO: 1229675 - DNA, 14 bp, Homo sapiens
gcccgggctgcctg

SEQ ID NO: 1229676 - DNA, 13 bp, Homo sapiens
gcccggggcagca

SEQ ID NO: 1229677 - DNA, 21 bp, Homo sapiens
gcccggggcagcagcagccct

SEQ ID NO: 1229678 - DNA, 23 bp, Homo sapiens
gcccggggcagcagcagccctgc

SEQ ID NO: 1229679 - DNA, 13 bp, Homo sapiens
gcccggggtgggg

SEQ ID NO: 1229680 - DNA, 20 bp, Homo sapiens
gcccgggtgtgcctgccctg

SEQ ID NO: 1229681 - DNA, 17 bp, Homo sapiens
gcccgtcctgcctgtgg

SEQ ID NO: 1229682 - DNA, 18 bp, Homo sapiens
gcccgtcctgcctgtggc

SEQ ID NO: 1229683 - DNA, 18 bp, Homo sapiens
gcccgtgaagcagtgcct

SEQ ID NO: 1229684 - DNA, 19 bp, Homo sapiens
gcccgtgaagcagtgcctc

SEQ ID NO: 1229685 - DNA, 21 bp, Homo sapiens
gcccgtgaagcagtgcctcga

SEQ ID NO: 1229686 - DNA, 12 bp, Homo sapiens
gcccgtgcagta

SEQ ID NO: 1229687 - DNA, 17 bp, Homo sapiens
gcccgtgcagtacaggc

SEQ ID NO: 1229688 - DNA, 19 bp, Homo sapiens
gcccgtgcccgcaggaact

SEQ ID NO: 1229689 - DNA, 20 bp, Homo sapiens
gcccgtggcctggcatctgt

SEQ ID NO: 1229690 - DNA, 18 bp, Homo sapiens
gcccgtggcttggcatct

SEQ ID NO: 1229691 - DNA, 22 bp, Homo sapiens
gcccgtggcttggcatctgtgt

SEQ ID NO: 1229692 - DNA, 23 bp, Homo sapiens
gcccgtgtagtccccaaccgtgt

SEQ ID NO: 1229693 - DNA, 17 bp, Homo sapiens
gcccgtgtgacccgttc

SEQ ID NO: 1229694 - DNA, 13 bp, Homo sapiens
gcccgtgtggccc

SEQ ID NO: 1229695 - DNA, 12 bp, Homo sapiens
gccctaacttct

SEQ ID NO: 1229696 - DNA, 12 bp, Homo sapiens
gccctaagcctg

SEQ ID NO: 1229697 - DNA, 22 bp, Homo sapiens
gccctaagcctgtccccagacc

SEQ ID NO: 1229698 - DNA, 21 bp, Homo sapiens
gccctaagtgatttccacagg

SEQ ID NO: 1229699 - DNA, 16 bp, Homo sapiens
gccctaagtttgtact

SEQ ID NO: 1229700 - DNA, 21 bp, Homo sapiens
gccctacagaggtctctgccg

SEQ ID NO: 1229701 - DNA, 23 bp, Homo sapiens
gccctaccagcgcccgctgggct

SEQ ID NO: 1229702 - DNA, 14 bp, Homo sapiens
gccctactattcag

SEQ ID NO: 1229703 - DNA, 15 bp, Homo sapiens
gccctactcattggg

SEQ ID NO: 1229704 - DNA, 16 bp, Homo sapiens
gccctactccactgcc

SEQ ID NO: 1229705 - DNA, 21 bp, Homo sapiens
gccctactccactgccctggc

SEQ ID NO: 1229706 - DNA, 22 bp, Homo sapiens
gccctactccctgcagatgcca

SEQ ID NO: 1229707 - DNA, 17 bp, Homo sapiens
gccctagagcacactgt

SEQ ID NO: 1229708 - DNA, 21 bp, Homo sapiens
gccctagagcacactgtagca

SEQ ID NO: 1229709 - DNA, 17 bp, Homo sapiens
gccctagggtgctctga

SEQ ID NO: 1229710 - DNA, 14 bp, Homo sapiens
gccctatttctatg

SEQ ID NO: 1229711 - DNA, 19 bp, Homo sapiens
gccctcaaacttgactcta

SEQ ID NO: 1229712 - DNA, 15 bp, Homo sapiens
gccctcacatcttcc

SEQ ID NO: 1229713 - DNA, 21 bp, Homo sapiens
gccctcaccccaatccctgcc

SEQ ID NO: 1229714 - DNA, 15 bp, Homo sapiens
gccctcacctctgat

SEQ ID NO: 1229715 - DNA, 19 bp, Homo sapiens
gccctcagcgtcagacagc

SEQ ID NO: 1229716 - DNA, 17 bp, Homo sapiens
gccctcaggccattccc

SEQ ID NO: 1229717 - DNA, 15 bp, Homo sapiens
gccctcaggctcccc

SEQ ID NO: 1229718 - DNA, 16 bp, Homo sapiens
gccctcaggctcccca

SEQ ID NO: 1229719 - DNA, 19 bp, Homo sapiens
gccctcaggctccccagaa

SEQ ID NO: 1229720 - DNA, 19 bp, Homo sapiens
gccctcagggactgcaccc

SEQ ID NO: 1229721 - DNA, 19 bp, Homo sapiens
gccctcaggggacttgaat

SEQ ID NO: 1229722 - DNA, 13 bp, Homo sapiens
gccctcaggggcc

SEQ ID NO: 1229723 - DNA, 19 bp, Homo sapiens
gccctcagtagtccctgca

SEQ ID NO: 1229724 - DNA, 21 bp, Homo sapiens
gccctcagtcacccccacttc

SEQ ID NO: 1229725 - DNA, 23 bp, Homo sapiens
gccctcagtcagttcccggagca

SEQ ID NO: 1229726 - DNA, 11 bp, Homo sapiens
gccctcagtgc

SEQ ID NO: 1229727 - DNA, 22 bp, Homo sapiens
gccctcataaaccaatgtggca

SEQ ID NO: 1229728 - DNA, 13 bp, Homo sapiens
gccctcatcccac

SEQ ID NO: 1229729 - DNA, 22 bp, Homo sapiens
gccctcatggcccctctgacct

SEQ ID NO: 1229730 - DNA, 15 bp, Homo sapiens
gccctcatgggacct

SEQ ID NO: 1229731 - DNA, 21 bp, Homo sapiens
gccctcatgggacctgccctc

SEQ ID NO: 1229732 - DNA, 12 bp, Homo sapiens
gccctccaaaga

SEQ ID NO: 1229733 - DNA, 13 bp, Homo sapiens
gccctccaaagag

SEQ ID NO: 1229734 - DNA, 22 bp, Homo sapiens
gccctccatcccgacatggacc

SEQ ID NO: 1229735 - DNA, 14 bp, Homo sapiens
gccctccatccgtg

SEQ ID NO: 1229736 - DNA, 15 bp, Homo sapiens
gccctccatgcgcag

SEQ ID NO: 1229737 - DNA, 16 bp, Homo sapiens
gccctccatggtcctg

SEQ ID NO: 1229738 - DNA, 20 bp, Homo sapiens
gccctccatggtcctgtctg

SEQ ID NO: 1229739 - DNA, 11 bp, Homo sapiens
gccctcccagc

SEQ ID NO: 1229740 - DNA, 19 bp, Homo sapiens
gccctcccagcccattgct

SEQ ID NO: 1229741 - DNA, 14 bp, Homo sapiens
gccctcccaggacc

SEQ ID NO: 1229742 - DNA, 22 bp, Homo sapiens
gccctcccaggaccctccactc

SEQ ID NO: 1229743 - DNA, 22 bp, Homo sapiens
gccctcccatgttgcatgccta

SEQ ID NO: 1229744 - DNA, 19 bp, Homo sapiens
gccctccccatggagccag

SEQ ID NO: 1229745 - DNA, 20 bp, Homo sapiens
gccctcccccaaacagactc

SEQ ID NO: 1229746 - DNA, 18 bp, Homo sapiens
gccctcccccagctcctt

SEQ ID NO: 1229747 - DNA, 21 bp, Homo sapiens
gccctcccccagctccttggc

SEQ ID NO: 1229748 - DNA, 22 bp, Homo sapiens
gccctccccctcaacctcacca

SEQ ID NO: 1229749 - DNA, 17 bp, Homo sapiens
gccctcccctcagcgca

SEQ ID NO: 1229750 - DNA, 18 bp, Homo sapiens
gccctcccgcaccttcct

SEQ ID NO: 1229751 - DNA, 13 bp, Homo sapiens
gccctctcactcc

SEQ ID NO: 1229752 - DNA, 17 bp, Homo sapiens
gccctctcactccagcc

SEQ ID NO: 1229753 - DNA, 23 bp, Homo sapiens
gccctctccccacccctacccct

SEQ ID NO: 1229754 - DNA, 23 bp, Homo sapiens
gccctctccctgtgttctgggct

SEQ ID NO: 1229755 - DNA, 16 bp, Homo sapiens
gccctctcctccccct

SEQ ID NO: 1229756 - DNA, 17 bp, Homo sapiens
gccctctcctccccctc

SEQ ID NO: 1229757 - DNA, 22 bp, Homo sapiens
gccctctcctccccctcctagg

SEQ ID NO: 1229758 - DNA, 23 bp, Homo sapiens
gccctctcctccccctcctaggg

SEQ ID NO: 1229759 - DNA, 16 bp, Homo sapiens
gccctctgcctgcact

SEQ ID NO: 1229760 - DNA, 17 bp, Homo sapiens
gccctctgctcaggcct

SEQ ID NO: 1229761 - DNA, 20 bp, Homo sapiens
gccctctgctctgcctggag

SEQ ID NO: 1229762 - DNA, 18 bp, Homo sapiens
gccctctgctgctgcccg

SEQ ID NO: 1229763 - DNA, 14 bp, Homo sapiens
gccctctggagtgg

SEQ ID NO: 1229764 - DNA, 19 bp, Homo sapiens
gccctctggagtggccact

SEQ ID NO: 1229765 - DNA, 17 bp, Homo sapiens
gccctcttagtagggac

SEQ ID NO: 1229766 - DNA, 12 bp, Homo sapiens
gccctcttcctg

SEQ ID NO: 1229767 - DNA, 12 bp, Homo sapiens
gccctcttctcc

SEQ ID NO: 1229768 - DNA, 14 bp, Homo sapiens
gccctcttctcctt

SEQ ID NO: 1229769 - DNA, 15 bp, Homo sapiens
gccctcttgccagcc

SEQ ID NO: 1229770 - DNA, 17 bp, Homo sapiens
gccctcttgccagcctc

SEQ ID NO: 1229771 - DNA, 20 bp, Homo sapiens
gccctcttgccagcctcctt

SEQ ID NO: 1229772 - DNA, 22 bp, Homo sapiens
gccctcttgccagcctccttgc

SEQ ID NO: 1229773 - DNA, 23 bp, Homo sapiens
gccctcttgccagcctccttgct

SEQ ID NO: 1229774 - DNA, 17 bp, Homo sapiens
gccctcttgcccgcacc

SEQ ID NO: 1229775 - DNA, 20 bp, Homo sapiens
gccctctttaatgctgtctt

SEQ ID NO: 1229776 - DNA, 14 bp, Homo sapiens
gccctgaaccacga

SEQ ID NO: 1229777 - DNA, 17 bp, Homo sapiens
gccctgaaccacgaggc

SEQ ID NO: 1229778 - DNA, 18 bp, Homo sapiens
gccctgaagaatggcgcc

SEQ ID NO: 1229779 - DNA, 19 bp, Homo sapiens
gccctgaagcctccgtgga

SEQ ID NO: 1229780 - DNA, 17 bp, Homo sapiens
gccctgaatttcttctt

SEQ ID NO: 1229781 - DNA, 20 bp, Homo sapiens
gccctgaatttcttcttttc

SEQ ID NO: 1229782 - DNA, 16 bp, Homo sapiens
gccctgacctcccagc

SEQ ID NO: 1229783 - DNA, 13 bp, Homo sapiens
gccctgactcctg

SEQ ID NO: 1229784 - DNA, 17 bp, Homo sapiens
gccctgactcctggact

SEQ ID NO: 1229785 - DNA, 19 bp, Homo sapiens
gccctgactcctggactcc

SEQ ID NO: 1229786 - DNA, 20 bp, Homo sapiens
gccctgactcctggactccg

SEQ ID NO: 1229787 - DNA, 21 bp, Homo sapiens
gccctgactgtcagggagggc

SEQ ID NO: 1229788 - DNA, 16 bp, Homo sapiens
gccctgacttctggag

SEQ ID NO: 1229789 - DNA, 17 bp, Homo sapiens
gccctgacttctggaga

SEQ ID NO: 1229790 - DNA, 13 bp, Homo sapiens
gccctgagacaga

SEQ ID NO: 1229791 - DNA, 16 bp, Homo sapiens
gccctgagctcggtgg

SEQ ID NO: 1229792 - DNA, 22 bp, Homo sapiens
gccctgaggcggaggctgtgct

SEQ ID NO: 1229793 - DNA, 13 bp, Homo sapiens
gccctgaggggct

SEQ ID NO: 1229794 - DNA, 16 bp, Homo sapiens
gccctgaggggctggg

SEQ ID NO: 1229795 - DNA, 18 bp, Homo sapiens
gccctgaggggctgggct

SEQ ID NO: 1229796 - DNA, 18 bp, Homo sapiens
gccctgaggggctgggga

SEQ ID NO: 1229797 - DNA, 22 bp, Homo sapiens
gccctgaggtgaaagggagcta

SEQ ID NO: 1229798 - DNA, 14 bp, Homo sapiens
gccctgaggtgtgg

SEQ ID NO: 1229799 - DNA, 22 bp, Homo sapiens
gccctgaggtgtgggggctgca

SEQ ID NO: 1229800 - DNA, 22 bp, Homo sapiens
gccctgagtaatcgcttaaaga

SEQ ID NO: 1229801 - DNA, 23 bp, Homo sapiens
gccctgagtggatctccaaggac

SEQ ID NO: 1229802 - DNA, 22 bp, Homo sapiens
gccctgagtggtcactggtcag

SEQ ID NO: 1229803 - DNA, 23 bp, Homo sapiens
gccctgagtggtcactggtcagg

SEQ ID NO: 1229804 - DNA, 14 bp, Homo sapiens
gccctgcagagcaa

SEQ ID NO: 1229805 - DNA, 17 bp, Homo sapiens
gccctgcagagcaataa

SEQ ID NO: 1229806 - DNA, 19 bp, Homo sapiens
gccctgcagagcaataaca

SEQ ID NO: 1229807 - DNA, 15 bp, Homo sapiens
gccctgcagcatccc

SEQ ID NO: 1229808 - DNA, 19 bp, Homo sapiens
gccctgcagcccaccagac

SEQ ID NO: 1229809 - DNA, 14 bp, Homo sapiens
gccctgcaggagca

SEQ ID NO: 1229810 - DNA, 14 bp, Homo sapiens
gccctgcaggcaca

SEQ ID NO: 1229811 - DNA, 19 bp, Homo sapiens
gccctgcaggctgcaggag

SEQ ID NO: 1229812 - DNA, 22 bp, Homo sapiens
gccctgcaggctgcaggagggc

SEQ ID NO: 1229813 - DNA, 23 bp, Homo sapiens
gccctgcaggctgcaggagggca

SEQ ID NO: 1229814 - DNA, 17 bp, Homo sapiens
gccctgcatgctgccca

SEQ ID NO: 1229815 - DNA, 23 bp, Homo sapiens
gccctgcatgctgcccagccact

SEQ ID NO: 1229816 - DNA, 18 bp, Homo sapiens
gccctgccaagcagcaga

SEQ ID NO: 1229817 - DNA, 24 bp, Homo sapiens
gccctgccacgtcccgctgcctcc

SEQ ID NO: 1229818 - DNA, 13 bp, Homo sapiens
gccctgccactca

SEQ ID NO: 1229819 - DNA, 19 bp, Homo sapiens
gccctgccattggcctctt

SEQ ID NO: 1229820 - DNA, 19 bp, Homo sapiens
gccctgcccaagtgaccag

SEQ ID NO: 1229821 - DNA, 21 bp, Homo sapiens
gccctgcccaagtgaccaggg

SEQ ID NO: 1229822 - DNA, 19 bp, Homo sapiens
gccctgcccatactgagcc

SEQ ID NO: 1229823 - DNA, 21 bp, Homo sapiens
gccctgcccatactgagcctg

SEQ ID NO: 1229824 - DNA, 13 bp, Homo sapiens
gccctgccccaca

SEQ ID NO: 1229825 - DNA, 16 bp, Homo sapiens
gccctgccccacccca

SEQ ID NO: 1229826 - DNA, 14 bp, Homo sapiens
gccctgccccagcc

SEQ ID NO: 1229827 - DNA, 15 bp, Homo sapiens
gccctgccccagccc

SEQ ID NO: 1229828 - DNA, 17 bp, Homo sapiens
gccctgccccagcccct

SEQ ID NO: 1229829 - DNA, 18 bp, Homo sapiens
gccctgccccagccccta

SEQ ID NO: 1229830 - DNA, 14 bp, Homo sapiens
gccctgccccaggc

SEQ ID NO: 1229831 - DNA, 16 bp, Homo sapiens
gccctgccccaggcct

SEQ ID NO: 1229832 - DNA, 22 bp, Homo sapiens
gccctgccccaggcctggacgg

SEQ ID NO: 1229833 - DNA, 16 bp, Homo sapiens
gccctgccccgccttc

SEQ ID NO: 1229834 - DNA, 15 bp, Homo sapiens
gccctgcccctagga

SEQ ID NO: 1229835 - DNA, 22 bp, Homo sapiens
gccctgcccctaggatgctgca

SEQ ID NO: 1229836 - DNA, 14 bp, Homo sapiens
gccctgccctgtac

SEQ ID NO: 1229837 - DNA, 11 bp, Homo sapiens
gccctgccctt

SEQ ID NO: 1229838 - DNA, 12 bp, Homo sapiens
gccctgcctccc

SEQ ID NO: 1229839 - DNA, 14 bp, Homo sapiens
gccctgcctccctt

SEQ ID NO: 1229840 - DNA, 12 bp, Homo sapiens
gccctgcctcct

SEQ ID NO: 1229841 - DNA, 13 bp, Homo sapiens
gccctgcctcctg

SEQ ID NO: 1229842 - DNA, 18 bp, Homo sapiens
gccctgcctcctggagga

SEQ ID NO: 1229843 - DNA, 21 bp, Homo sapiens
gccctgcctgacccatccctt

SEQ ID NO: 1229844 - DNA, 19 bp, Homo sapiens
gccctgcctgaggaggagg

SEQ ID NO: 1229845 - DNA, 15 bp, Homo sapiens
gccctgcctgagggc

SEQ ID NO: 1229846 - DNA, 16 bp, Homo sapiens
gccctgcctgagggcc

SEQ ID NO: 1229847 - DNA, 13 bp, Homo sapiens
gccctgcctgccc

SEQ ID NO: 1229848 - DNA, 23 bp, Homo sapiens
gccctgcctgcctcttggcctca

SEQ ID NO: 1229849 - DNA, 15 bp, Homo sapiens
gccctgcctgggcct

SEQ ID NO: 1229850 - DNA, 20 bp, Homo sapiens
gccctgcctgggccttggct

SEQ ID NO: 1229851 - DNA, 15 bp, Homo sapiens
gccctgcgggccaca

SEQ ID NO: 1229852 - DNA, 20 bp, Homo sapiens
gccctgcgggccacagggca

SEQ ID NO: 1229853 - DNA, 18 bp, Homo sapiens
gccctgcgttggagccac

SEQ ID NO: 1229854 - DNA, 22 bp, Homo sapiens
gccctgcgttggagccactcct

SEQ ID NO: 1229855 - DNA, 18 bp, Homo sapiens
gccctgctcctccctggc

SEQ ID NO: 1229856 - DNA, 19 bp, Homo sapiens
gccctgctcctccctggct

SEQ ID NO: 1229857 - DNA, 14 bp, Homo sapiens
gccctgctcctgca

SEQ ID NO: 1229858 - DNA, 17 bp, Homo sapiens
gcccttccagtgggatt

SEQ ID NO: 1229859 - DNA, 22 bp, Homo sapiens
gcccttccatgtcgcctctgca

SEQ ID NO: 1229860 - DNA, 11 bp, Homo sapiens
gcccttccctg

SEQ ID NO: 1229861 - DNA, 22 bp, Homo sapiens
gcccttccctgagtgcgggctg

SEQ ID NO: 1229862 - DNA, 17 bp, Homo sapiens
gcccttccctgtccctc

SEQ ID NO: 1229863 - DNA, 16 bp, Homo sapiens
gcccttccgtagtttg

SEQ ID NO: 1229864 - DNA, 21 bp, Homo sapiens
gcccttcctcctgatggagtg

SEQ ID NO: 1229865 - DNA, 15 bp, Homo sapiens
gcccttcctctccac

SEQ ID NO: 1229866 - DNA, 21 bp, Homo sapiens
gcccttcctctccactgcctt

SEQ ID NO: 1229867 - DNA, 14 bp, Homo sapiens
gcccttccttgggc

SEQ ID NO: 1229868 - DNA, 17 bp, Homo sapiens
gcccttcggtcacctgt

SEQ ID NO: 1229869 - DNA, 14 bp, Homo sapiens
gcccttctctttga

SEQ ID NO: 1229870 - DNA, 22 bp, Homo sapiens
gcccttctttgtcccctgggtc

SEQ ID NO: 1229871 - DNA, 22 bp, Homo sapiens
gcccttgaaccccctccctgtc

SEQ ID NO: 1229872 - DNA, 18 bp, Homo sapiens
gcccttgactgtacagag

SEQ ID NO: 1229873 - DNA, 19 bp, Homo sapiens
gcccttgactgtacagaga

SEQ ID NO: 1229874 - DNA, 13 bp, Homo sapiens
gcctctcccaccc

SEQ ID NO: 1229875 - DNA, 22 bp, Homo sapiens
gcctctcccacccggccacagc

SEQ ID NO: 1229876 - DNA, 18 bp, Homo sapiens
gcctctcccaggctgtcc

SEQ ID NO: 1229877 - DNA, 23 bp, Homo sapiens
gcctctccccaggtccagctctg

SEQ ID NO: 1229878 - DNA, 19 bp, Homo sapiens
gcctctccccgctctggat

SEQ ID NO: 1229879 - DNA, 15 bp, Homo sapiens
gcctctcccggctgc

SEQ ID NO: 1229880 - DNA, 22 bp, Homo sapiens
gcctctcccggctgcctgccgc

SEQ ID NO: 1229881 - DNA, 17 bp, Homo sapiens
gcctctcccgtcagggc

SEQ ID NO: 1229882 - DNA, 18 bp, Homo sapiens
gcctctcccgtcagggcc

SEQ ID NO: 1229883 - DNA, 23 bp, Homo sapiens
gcctctcccgtcagggcccaagt

SEQ ID NO: 1229884 - DNA, 16 bp, Homo sapiens
gcctctcctgccctct

SEQ ID NO: 1229885 - DNA, 20 bp, Homo sapiens
gcctctctcaggagtatctt

SEQ ID NO: 1229886 - DNA, 14 bp, Homo sapiens
gcctctctccttgg

SEQ ID NO: 1229887 - DNA, 21 bp, Homo sapiens
gcctctctccttggccacaga

SEQ ID NO: 1229888 - DNA, 23 bp, Homo sapiens
gcctctctccttggccacagact

SEQ ID NO: 1229889 - DNA, 19 bp, Homo sapiens
gcctctctctctctcctca

SEQ ID NO: 1229890 - DNA, 23 bp, Homo sapiens
gcctctctctctctcctcaggac

SEQ ID NO: 1229891 - DNA, 14 bp, Homo sapiens
gcctctctctgctc

SEQ ID NO: 1229892 - DNA, 15 bp, Homo sapiens
gcctctctctgctcc

SEQ ID NO: 1229893 - DNA, 14 bp, Homo sapiens
gcctctctgcctgg

SEQ ID NO: 1229894 - DNA, 14 bp, Homo sapiens
gcctctctgctata

SEQ ID NO: 1229895 - DNA, 17 bp, Homo sapiens
gcctctctggaaagagg

SEQ ID NO: 1229896 - DNA, 21 bp, Homo sapiens
gcctctctggaaagaggctct

SEQ ID NO: 1229897 - DNA, 13 bp, Homo sapiens
gcctctctggcct

SEQ ID NO: 1229898 - DNA, 14 bp, Homo sapiens
gcctctctggggga

SEQ ID NO: 1229899 - DNA, 16 bp, Homo sapiens
gcctctctgggggagg

SEQ ID NO: 1229900 - DNA, 15 bp, Homo sapiens
gcctctcttcttccc

SEQ ID NO: 1229901 - DNA, 18 bp, Homo sapiens
gcctctgacagcagcctg

SEQ ID NO: 1229902 - DNA, 18 bp, Homo sapiens
gcctctgacagtccacag

SEQ ID NO: 1229903 - DNA, 20 bp, Homo sapiens
gcctctgacagtccacaggg

SEQ ID NO: 1229904 - DNA, 23 bp, Homo sapiens
gcctctgacagtccacaggggcc

SEQ ID NO: 1229905 - DNA, 18 bp, Homo sapiens
gcctctgcaactgcaaga

SEQ ID NO: 1229906 - DNA, 22 bp, Homo sapiens
gcctctgcaactgctcagctct

SEQ ID NO: 1229907 - DNA, 21 bp, Homo sapiens
gcctctgcactcccacgcctg

SEQ ID NO: 1229908 - DNA, 23 bp, Homo sapiens
gcctctgccaaaggatgtgatat

SEQ ID NO: 1229909 - DNA, 10 bp, Homo sapiens
gcctctgccc

SEQ ID NO: 1229910 - DNA, 14 bp, Homo sapiens
gcctctgcccgcag

SEQ ID NO: 1229911 - DNA, 15 bp, Homo sapiens
gcctctgcccgcaga

SEQ ID NO: 1229912 - DNA, 22 bp, Homo sapiens
gcctctgcccgcagagcccacg

SEQ ID NO: 1229913 - DNA, 13 bp, Homo sapiens
gcctctgccctgc

SEQ ID NO: 1229914 - DNA, 15 bp, Homo sapiens
gcctctgcctggggc

SEQ ID NO: 1229915 - DNA, 16 bp, Homo sapiens
gcctctgcgtcttttt

SEQ ID NO: 1229916 - DNA, 12 bp, Homo sapiens
gcctctgctccc

SEQ ID NO: 1229917 - DNA, 14 bp, Homo sapiens
gcctctgctccctc

SEQ ID NO: 1229918 - DNA, 11 bp, Homo sapiens
gcctctgctgc

SEQ ID NO: 1229919 - DNA, 15 bp, Homo sapiens
gcctctgctgccatg

SEQ ID NO: 1229920 - DNA, 14 bp, Homo sapiens
gcctctgctgcccc

SEQ ID NO: 1229921 - DNA, 15 bp, Homo sapiens
gcctctgctgccccc

SEQ ID NO: 1229922 - DNA, 16 bp, Homo sapiens
gcctctgctgccccct

SEQ ID NO: 1229923 - DNA, 22 bp, Homo sapiens
gcctctgctggaaggggcagca

SEQ ID NO: 1229924 - DNA, 23 bp, Homo sapiens
gcctctgctggaaggggcagcag

SEQ ID NO: 1229925 - DNA, 17 bp, Homo sapiens
gcctctggaggcctctg

SEQ ID NO: 1229926 - DNA, 20 bp, Homo sapiens
gcctctggaggcctctggcc

SEQ ID NO: 1229927 - DNA, 12 bp, Homo sapiens
gcctctggcccc

SEQ ID NO: 1229928 - DNA, 24 bp, Homo sapiens
gcctctggcccctcacccaccatg

SEQ ID NO: 1229929 - DNA, 12 bp, Homo sapiens
gcctctggccct

SEQ ID NO: 1229930 - DNA, 21 bp, Homo sapiens
gcctctggctagaggccagcc

SEQ ID NO: 1229931 - DNA, 22 bp, Homo sapiens
gcctctggctagaggccagccc

SEQ ID NO: 1229932 - DNA, 21 bp, Homo sapiens
gcctctggcttccctaaactg

SEQ ID NO: 1229933 - DNA, 14 bp, Homo sapiens
gcctctgggactgg

SEQ ID NO: 1229934 - DNA, 13 bp, Homo sapiens
gcctctgggcagc

SEQ ID NO: 1229935 - DNA, 13 bp, Homo sapiens
gcctctgggccat

SEQ ID NO: 1229936 - DNA, 15 bp, Homo sapiens
gcctctggttgcctc

SEQ ID NO: 1229937 - DNA, 18 bp, Homo sapiens
gcctctggttgcctcccc

SEQ ID NO: 1229938 - DNA, 16 bp, Homo sapiens
gcctctgtccaaacat

SEQ ID NO: 1229939 - DNA, 18 bp, Homo sapiens
gcctctgtgattacatag

SEQ ID NO: 1229940 - DNA, 20 bp, Homo sapiens
gcctctgtgattacatagat

SEQ ID NO: 1229941 - DNA, 11 bp, Homo sapiens
gcctctgtgct

SEQ ID NO: 1229942 - DNA, 17 bp, Homo sapiens
gcctctgtgctgtgtgt

SEQ ID NO: 1229943 - DNA, 14 bp, Homo sapiens
gcctctgtgtacaa

SEQ ID NO: 1229944 - DNA, 21 bp, Homo sapiens
gcctctgtgtagccgccctga

SEQ ID NO: 1229945 - DNA, 21 bp, Homo sapiens
gcctctgtgtccttccctgca

SEQ ID NO: 1229946 - DNA, 21 bp, Homo sapiens
gcctcttattccaggagaagg

SEQ ID NO: 1229947 - DNA, 17 bp, Homo sapiens
gcctcttcaaattagaa

SEQ ID NO: 1229948 - DNA, 13 bp, Homo sapiens
gcctcttccaccc

SEQ ID NO: 1229949 - DNA, 21 bp, Homo sapiens
gcctcttccagtcttcctgac

SEQ ID NO: 1229950 - DNA, 12 bp, Homo sapiens
gcctcttcctcc

SEQ ID NO: 1229951 - DNA, 22 bp, Homo sapiens
gcctcttcctccctcattccac

SEQ ID NO: 1229952 - DNA, 13 bp, Homo sapiens
gcctcttcctctg

SEQ ID NO: 1229953 - DNA, 23 bp, Homo sapiens
gcctcttcctctgggcagcgcta

SEQ ID NO: 1229954 - DNA, 22 bp, Homo sapiens
gcctcttctacttgtaaaatgc

SEQ ID NO: 1229955 - DNA, 12 bp, Homo sapiens
gcctcttctcta

SEQ ID NO: 1229956 - DNA, 20 bp, Homo sapiens
gcctcttctcttgacagtct

SEQ ID NO: 1229957 - DNA, 14 bp, Homo sapiens
gcctcttctgggag

SEQ ID NO: 1229958 - DNA, 15 bp, Homo sapiens
gcctcttgaccaggc

SEQ ID NO: 1229959 - DNA, 20 bp, Homo sapiens
gcctcttgaccaggctgcct

SEQ ID NO: 1229960 - DNA, 19 bp, Homo sapiens
gcctcttgagcagtggctg

SEQ ID NO: 1229961 - DNA, 22 bp, Homo sapiens
gcctcttgagttcctctgcagt

SEQ ID NO: 1229962 - DNA, 24 bp, Homo sapiens
gcctcttgagttcctctgcagttt

SEQ ID NO: 1229963 - DNA, 23 bp, Homo sapiens
gcctcttgcccgtcggccctgcg

SEQ ID NO: 1229964 - DNA, 16 bp, Homo sapiens
gcctcttgctgaaagc

SEQ ID NO: 1229965 - DNA, 19 bp, Homo sapiens
gcctcttggacctctgctc

SEQ ID NO: 1229966 - DNA, 20 bp, Homo sapiens
gcctcttggacctctgctct

SEQ ID NO: 1229967 - DNA, 21 bp, Homo sapiens
gcctcttggataccagctcag

SEQ ID NO: 1229968 - DNA, 16 bp, Homo sapiens
gcctcttgtacagtta

SEQ ID NO: 1229969 - DNA, 16 bp, Homo sapiens
gcctcttgtcccttgg

SEQ ID NO: 1229970 - DNA, 14 bp, Homo sapiens
gcctcttgtgctca

SEQ ID NO: 1229971 - DNA, 20 bp, Homo sapiens
gcctcttgtgctcacgctcc

SEQ ID NO: 1229972 - DNA, 22 bp, Homo sapiens
gcctcttgtgctcacgctcccc

SEQ ID NO: 1229973 - DNA, 13 bp, Homo sapiens
gcctcttgttgca

SEQ ID NO: 1229974 - DNA, 15 bp, Homo sapiens
gcctcttgtttctgt

SEQ ID NO: 1229975 - DNA, 19 bp, Homo sapiens
gcctcttgtttctgtgccc

SEQ ID NO: 1229976 - DNA, 16 bp, Homo sapiens
gcctctttcatccact

SEQ ID NO: 1229977 - DNA, 12 bp, Homo sapiens
gcctctttccct

SEQ ID NO: 1229978 - DNA, 18 bp, Homo sapiens
gcctctttgccccgactc

SEQ ID NO: 1229979 - DNA, 16 bp, Homo sapiens
gcctctttttgccctt

SEQ ID NO: 1229980 - DNA, 15 bp, Homo sapiens
gcctgaaaaatggga

SEQ ID NO: 1229981 - DNA, 22 bp, Homo sapiens
gcctgaaacccgccctcagggg

SEQ ID NO: 1229982 - DNA, 22 bp, Homo sapiens
gcctgaacactcagttgcaggg

SEQ ID NO: 1229983 - DNA, 15 bp, Homo sapiens
gcctgaacatccttc

SEQ ID NO: 1229984 - DNA, 15 bp, Homo sapiens
gcctgaactccagag

SEQ ID NO: 1229985 - DNA, 14 bp, Homo sapiens
gcctgaactgagga

SEQ ID NO: 1229986 - DNA, 16 bp, Homo sapiens
gcctgaactgaggcct

SEQ ID NO: 1229987 - DNA, 20 bp, Homo sapiens
gcctgaagagtcctctgaat

SEQ ID NO: 1229988 - DNA, 17 bp, Homo sapiens
gcctgaaggggcgtctg

SEQ ID NO: 1229989 - DNA, 23 bp, Homo sapiens
gcctgaataaagagccctaagtt

SEQ ID NO: 1229990 - DNA, 23 bp, Homo sapiens
gcctgaatcatgagcctgctgga

SEQ ID NO: 1229991 - DNA, 22 bp, Homo sapiens
gcctgacacactaaccaagctg

SEQ ID NO: 1229992 - DNA, 20 bp, Homo sapiens
gcctgacaccccctccccgc

SEQ ID NO: 1229993 - DNA, 16 bp, Homo sapiens
gcctgacactgagccc

SEQ ID NO: 1229994 - DNA, 20 bp, Homo sapiens
gcctgacactgagccccacc

SEQ ID NO: 1229995 - DNA, 19 bp, Homo sapiens
gcctgacagccttccccag

SEQ ID NO: 1229996 - DNA, 15 bp, Homo sapiens
gcctgaccaaacagc

SEQ ID NO: 1229997 - DNA, 15 bp, Homo sapiens
gcctgaccccttgct

SEQ ID NO: 1229998 - DNA, 16 bp, Homo sapiens
gcctggatggcccctc

SEQ ID NO: 1229999 - DNA, 21 bp, Homo sapiens
gcctggatggcccctccttgc

SEQ ID NO: 1230000 - DNA, 18 bp, Homo sapiens
gcctggattcatttcctg

SEQ ID NO: 1230001 - DNA, 21 bp, Homo sapiens
gcctggattcatttcctgccc

SEQ ID NO: 1230002 - DNA, 20 bp, Homo sapiens
gcctggcaatagaccgagac

SEQ ID NO: 1230003 - DNA, 13 bp, Homo sapiens
gcctggcacaggg

SEQ ID NO: 1230004 - DNA, 14 bp, Homo sapiens
gcctggcacagggc

SEQ ID NO: 1230005 - DNA, 18 bp, Homo sapiens
gcctggcacatcagaaag

SEQ ID NO: 1230006 - DNA, 21 bp, Homo sapiens
gcctggcagccgtgccttcag

SEQ ID NO: 1230007 - DNA, 22 bp, Homo sapiens
gcctggcagccgtgccttcagc

SEQ ID NO: 1230008 - DNA, 20 bp, Homo sapiens
gcctggcagtccgtgggacg

SEQ ID NO: 1230009 - DNA, 11 bp, Homo sapiens
gcctggcatct

SEQ ID NO: 1230010 - DNA, 14 bp, Homo sapiens
gcctggccaccagc

SEQ ID NO: 1230011 - DNA, 17 bp, Homo sapiens
gcctggccaccagccat

SEQ ID NO: 1230012 - DNA, 15 bp, Homo sapiens
gcctggccaggagca

SEQ ID NO: 1230013 - DNA, 17 bp, Homo sapiens
gcctggccaggagcagg

SEQ ID NO: 1230014 - DNA, 19 bp, Homo sapiens
gcctggccaggagctcttc

SEQ ID NO: 1230015 - DNA, 14 bp, Homo sapiens
gcctggccaggcag

SEQ ID NO: 1230016 - DNA, 14 bp, Homo sapiens
gcctggccagtcct

SEQ ID NO: 1230017 - DNA, 15 bp, Homo sapiens
gcctggccagtcctg

SEQ ID NO: 1230018 - DNA, 16 bp, Homo sapiens
gcctggccagtcctgg

SEQ ID NO: 1230019 - DNA, 20 bp, Homo sapiens
gcctggccagtcctggtcct

SEQ ID NO: 1230020 - DNA, 16 bp, Homo sapiens
gcctggccatcatggc

SEQ ID NO: 1230021 - DNA, 17 bp, Homo sapiens
gcctggccatgctgtcc

SEQ ID NO: 1230022 - DNA, 10 bp, Homo sapiens
gcctggcccc

SEQ ID NO: 1230023 - DNA, 18 bp, Homo sapiens
gcctggccccagcctggg

SEQ ID NO: 1230024 - DNA, 15 bp, Homo sapiens
gcctggccccaggcc

SEQ ID NO: 1230025 - DNA, 16 bp, Homo sapiens
gcctggccccatggtc

SEQ ID NO: 1230026 - DNA, 17 bp, Homo sapiens
gcctggccctccccaca

SEQ ID NO: 1230027 - DNA, 15 bp, Homo sapiens
gcctggccctccctc

SEQ ID NO: 1230028 - DNA, 18 bp, Homo sapiens
gcctggccggcaacccca

SEQ ID NO: 1230029 - DNA, 23 bp, Homo sapiens
gcctggcctcgcctgcctttctg

SEQ ID NO: 1230030 - DNA, 15 bp, Homo sapiens
gcctggcctgagctg

SEQ ID NO: 1230031 - DNA, 18 bp, Homo sapiens
gcctggcctgagctgggg

SEQ ID NO: 1230032 - DNA, 13 bp, Homo sapiens
gcctggcctggcc

SEQ ID NO: 1230033 - DNA, 13 bp, Homo sapiens
gcctggcctggct

SEQ ID NO: 1230034 - DNA, 22 bp, Homo sapiens
gcctggccttgtcctcagccag

SEQ ID NO: 1230035 - DNA, 13 bp, Homo sapiens
gcctggcggcctg

SEQ ID NO: 1230036 - DNA, 18 bp, Homo sapiens
gcctggcggcctgtgggt

SEQ ID NO: 1230037 - DNA, 20 bp, Homo sapiens
gcctggcggggttggccctt

SEQ ID NO: 1230038 - DNA, 22 bp, Homo sapiens
gcctggctccccacgagtcacc

SEQ ID NO: 1230039 - DNA, 23 bp, Homo sapiens
gcctggctccccgagggctcaga

SEQ ID NO: 1230040 - DNA, 14 bp, Homo sapiens
gcctggctctgccc

SEQ ID NO: 1230041 - DNA, 14 bp, Homo sapiens
gcctggctgcctgg

SEQ ID NO: 1230042 - DNA, 18 bp, Homo sapiens
gcctggctggagagctgc

SEQ ID NO: 1230043 - DNA, 16 bp, Homo sapiens
gcctggctgtggaggc

SEQ ID NO: 1230044 - DNA, 17 bp, Homo sapiens
gcctggctgtggaggcc

SEQ ID NO: 1230045 - DNA, 20 bp, Homo sapiens
gcctggctgtggaggcctga

SEQ ID NO: 1230046 - DNA, 17 bp, Homo sapiens
gcctggcttctggagcc

SEQ ID NO: 1230047 - DNA, 14 bp, Homo sapiens
gcctggcttgctcc

SEQ ID NO: 1230048 - DNA, 20 bp, Homo sapiens
gcctggctttggtccccagc

SEQ ID NO: 1230049 - DNA, 23 bp, Homo sapiens
gcctggctttggtccccagcatt

SEQ ID NO: 1230050 - DNA, 14 bp, Homo sapiens
gcctgggaagccca

SEQ ID NO: 1230051 - DNA, 15 bp, Homo sapiens
gcctgggaatgtatt

SEQ ID NO: 1230052 - DNA, 16 bp, Homo sapiens
gcctgggacacacaca

SEQ ID NO: 1230053 - DNA, 21 bp, Homo sapiens
gcctgggacacttccctgggc

SEQ ID NO: 1230054 - DNA, 23 bp, Homo sapiens
gcctgggacacttccctgggcct

SEQ ID NO: 1230055 - DNA, 19 bp, Homo sapiens
gcctgtggagctcagcccc

SEQ ID NO: 1230056 - DNA, 12 bp, Homo sapiens
gcctgtggcaga

SEQ ID NO: 1230057 - DNA, 21 bp, Homo sapiens
gcctgtggcagaaaagaggag

SEQ ID NO: 1230058 - DNA, 16 bp, Homo sapiens
gcctgtggcggtgcct

SEQ ID NO: 1230059 - DNA, 21 bp, Homo sapiens
gcctgtggcttggagtggcca

SEQ ID NO: 1230060 - DNA, 17 bp, Homo sapiens
gcctgtgggagggggag

SEQ ID NO: 1230061 - DNA, 15 bp, Homo sapiens
gcctgtgggagtaga

SEQ ID NO: 1230062 - DNA, 22 bp, Homo sapiens
gcctgtgggcctcacctgcccc

SEQ ID NO: 1230063 - DNA, 18 bp, Homo sapiens
gcctgtgggtctctgaag

SEQ ID NO: 1230064 - DNA, 13 bp, Homo sapiens
gcctgtggtgaag

SEQ ID NO: 1230065 - DNA, 15 bp, Homo sapiens
gcctgtggtgaagtg

SEQ ID NO: 1230066 - DNA, 18 bp, Homo sapiens
gcctgtggtgaagtgtgg

SEQ ID NO: 1230067 - DNA, 21 bp, Homo sapiens
gcctgtggtgaagtgtggctg

SEQ ID NO: 1230068 - DNA, 23 bp, Homo sapiens
gcctgtggtggctccccctctgc

SEQ ID NO: 1230069 - DNA, 20 bp, Homo sapiens
gcctgtgtccagcagctgcg

SEQ ID NO: 1230070 - DNA, 22 bp, Homo sapiens
gcctgtgtccagcagctgcggg

SEQ ID NO: 1230071 - DNA, 14 bp, Homo sapiens
gcctgtgtccatgc

SEQ ID NO: 1230072 - DNA, 19 bp, Homo sapiens
gcctgtgtccatgcgctca

SEQ ID NO: 1230073 - DNA, 20 bp, Homo sapiens
gcctgtgtccatgcgctcag

SEQ ID NO: 1230074 - DNA, 23 bp, Homo sapiens
gcctgtgtccatgcgctcagggc

SEQ ID NO: 1230075 - DNA, 21 bp, Homo sapiens
gcctgtgtgacatcagtggca

SEQ ID NO: 1230076 - DNA, 15 bp, Homo sapiens
gcctgtgtgtgggtg

SEQ ID NO: 1230077 - DNA, 14 bp, Homo sapiens
gcctgtgtgttctg

SEQ ID NO: 1230078 - DNA, 24 bp, Homo sapiens
gcctgtgttagtgtctgtccatct

SEQ ID NO: 1230079 - DNA, 19 bp, Homo sapiens
gcctgttaatttataatgt

SEQ ID NO: 1230080 - DNA, 23 bp, Homo sapiens
gcctgttcccattcttgcatggc

SEQ ID NO: 1230081 - DNA, 12 bp, Homo sapiens
gcctgttctgct

SEQ ID NO: 1230082 - DNA, 20 bp, Homo sapiens
gcctgttgctatagagccta

SEQ ID NO: 1230083 - DNA, 22 bp, Homo sapiens
gcctgttgctttcttcctgcat

SEQ ID NO: 1230084 - DNA, 18 bp, Homo sapiens
gcctgttggcaggcccac

SEQ ID NO: 1230085 - DNA, 19 bp, Homo sapiens
gcctgttggcaggcccact

SEQ ID NO: 1230086 - DNA, 19 bp, Homo sapiens
gcctgtttcccaggcccac

SEQ ID NO: 1230087 - DNA, 16 bp, Homo sapiens
gcctgtttctgcagcc

SEQ ID NO: 1230088 - DNA, 21 bp, Homo sapiens
gcctgtttctgcagcccttgg

SEQ ID NO: 1230089 - DNA, 12 bp, Homo sapiens
gcctgtttgatg

SEQ ID NO: 1230090 - DNA, 14 bp, Homo sapiens
gcctgtttgatgta

SEQ ID NO: 1230091 - DNA, 16 bp, Homo sapiens
gcctgtttggcctctc

SEQ ID NO: 1230092 - DNA, 14 bp, Homo sapiens
gccttaaaaccaaa

SEQ ID NO: 1230093 - DNA, 19 bp, Homo sapiens
gccttaaaaggggcccaag

SEQ ID NO: 1230094 - DNA, 20 bp, Homo sapiens
gccttaaaaggggcccaagc

SEQ ID NO: 1230095 - DNA, 14 bp, Homo sapiens
gccttaaaatgcat

SEQ ID NO: 1230096 - DNA, 23 bp, Homo sapiens
gccttaaacctgaagatgtctcc

SEQ ID NO: 1230097 - DNA, 16 bp, Homo sapiens
gccttaaagaaagtcg

SEQ ID NO: 1230098 - DNA, 13 bp, Homo sapiens
gccttaaattttt

SEQ ID NO: 1230099 - DNA, 19 bp, Homo sapiens
gccttaactaagactcccg

SEQ ID NO: 1230100 - DNA, 14 bp, Homo sapiens
gccttaagcaaatt

SEQ ID NO: 1230101 - DNA, 14 bp, Homo sapiens
gccttaagcagaac

SEQ ID NO: 1230102 - DNA, 15 bp, Homo sapiens
gccttaagcagaaca

SEQ ID NO: 1230103 - DNA, 19 bp, Homo sapiens
gccttaagcagaacaaatg

SEQ ID NO: 1230104 - DNA, 23 bp, Homo sapiens
gccttaagcagaacaaatgtgtt

SEQ ID NO: 1230105 - DNA, 16 bp, Homo sapiens
gccttaataaatatgt

SEQ ID NO: 1230106 - DNA, 15 bp, Homo sapiens
gccttaatacttttt

SEQ ID NO: 1230107 - DNA, 17 bp, Homo sapiens
gccttaatttccttttt

SEQ ID NO: 1230108 - DNA, 21 bp, Homo sapiens
gccttaatttcctttttgaca

SEQ ID NO: 1230109 - DNA, 17 bp, Homo sapiens
gccttacatctggctgg

SEQ ID NO: 1230110 - DNA, 13 bp, Homo sapiens
gccttacctcctg

SEQ ID NO: 1230111 - DNA, 15 bp, Homo sapiens
gccttacctcctgcc

SEQ ID NO: 1230112 - DNA, 18 bp, Homo sapiens
gccttaccttggggctgg

SEQ ID NO: 1230113 - DNA, 17 bp, Homo sapiens
gccttagcctcttggaa

SEQ ID NO: 1230114 - DNA, 12 bp, Homo sapiens
gccttagctgcc

SEQ ID NO: 1230115 - DNA, 22 bp, Homo sapiens
gccttagggaagctggcctgag

SEQ ID NO: 1230116 - DNA, 15 bp, Homo sapiens
gccttggctcagaca

SEQ ID NO: 1230117 - DNA, 16 bp, Homo sapiens
gccttggctcagacat

SEQ ID NO: 1230118 - DNA, 20 bp, Homo sapiens
gccttggctgacatgaagct

SEQ ID NO: 1230119 - DNA, 15 bp, Homo sapiens
gccttggctgggcct

SEQ ID NO: 1230120 - DNA, 15 bp, Homo sapiens
gccttggctttctcc

SEQ ID NO: 1230121 - DNA, 17 bp, Homo sapiens
gccttgggccggtgctg

SEQ ID NO: 1230122 - DNA, 22 bp, Homo sapiens
gccttgggctatttggactcag

SEQ ID NO: 1230123 - DNA, 21 bp, Homo sapiens
gccttgggggggctgcctttg

SEQ ID NO: 1230124 - DNA, 19 bp, Homo sapiens
gccttggggtgggggccag

SEQ ID NO: 1230125 - DNA, 21 bp, Homo sapiens
gccttgggtctcagctgctga

SEQ ID NO: 1230126 - DNA, 18 bp, Homo sapiens
gccttgggttccaaccag

SEQ ID NO: 1230127 - DNA, 22 bp, Homo sapiens
gccttgggttccaaccaggcag

SEQ ID NO: 1230128 - DNA, 16 bp, Homo sapiens
gccttggtatgtgcca

SEQ ID NO: 1230129 - DNA, 19 bp, Homo sapiens
gccttggtatgtgccaggc

SEQ ID NO: 1230130 - DNA, 12 bp, Homo sapiens
gccttggtcctt

SEQ ID NO: 1230131 - DNA, 16 bp, Homo sapiens
gccttggtggagcagc

SEQ ID NO: 1230132 - DNA, 17 bp, Homo sapiens
gccttggtggagcagcc

SEQ ID NO: 1230133 - DNA, 21 bp, Homo sapiens
gccttggtggagcagccagag

SEQ ID NO: 1230134 - DNA, 22 bp, Homo sapiens
gccttggtggagcagccagagc

SEQ ID NO: 1230135 - DNA, 24 bp, Homo sapiens
gccttggtggagcagccagagctg

SEQ ID NO: 1230136 - DNA, 17 bp, Homo sapiens
gccttggtgtccacctg

SEQ ID NO: 1230137 - DNA, 21 bp, Homo sapiens
gccttggtgtccacctggccc

SEQ ID NO: 1230138 - DNA, 22 bp, Homo sapiens
gccttggtgtccacctggcccc

SEQ ID NO: 1230139 - DNA, 21 bp, Homo sapiens
gccttggttctggccacccca

SEQ ID NO: 1230140 - DNA, 23 bp, Homo sapiens
gccttggtttttactgctctgag

SEQ ID NO: 1230141 - DNA, 23 bp, Homo sapiens
gccttgtaaataaccacaaggtc

SEQ ID NO: 1230142 - DNA, 14 bp, Homo sapiens
gccttgtacttgct

SEQ ID NO: 1230143 - DNA, 12 bp, Homo sapiens
gccttgtataaa

SEQ ID NO: 1230144 - DNA, 16 bp, Homo sapiens
gccttgtcctcccagg

SEQ ID NO: 1230145 - DNA, 20 bp, Homo sapiens
gccttgtgagatccttcaca

SEQ ID NO: 1230146 - DNA, 13 bp, Homo sapiens
gccttgtgccctg

SEQ ID NO: 1230147 - DNA, 21 bp, Homo sapiens
gccttgtgtcctcctgttccg

SEQ ID NO: 1230148 - DNA, 23 bp, Homo sapiens
gccttgtgtggcttggaggaaat

SEQ ID NO: 1230149 - DNA, 14 bp, Homo sapiens
gccttgtgtgtcag

SEQ ID NO: 1230150 - DNA, 14 bp, Homo sapiens
gccttgttcctgct

SEQ ID NO: 1230151 - DNA, 16 bp, Homo sapiens
gccttgttcctgctct

SEQ ID NO: 1230152 - DNA, 19 bp, Homo sapiens
gcctttaaatctgtgatga

SEQ ID NO: 1230153 - DNA, 18 bp, Homo sapiens
gcctttaagaaccttaat

SEQ ID NO: 1230154 - DNA, 21 bp, Homo sapiens
gcctttaagccaaagaaacaa

SEQ ID NO: 1230155 - DNA, 18 bp, Homo sapiens
gcctttaatattttgtaa

SEQ ID NO: 1230156 - DNA, 22 bp, Homo sapiens
gcctttaatattttgtaatatt

SEQ ID NO: 1230157 - DNA, 16 bp, Homo sapiens
gcctttatctcagcca

SEQ ID NO: 1230158 - DNA, 18 bp, Homo sapiens
gcctttatctcagccatc

SEQ ID NO: 1230159 - DNA, 19 bp, Homo sapiens
gcctttatctcagccatcc

SEQ ID NO: 1230160 - DNA, 17 bp, Homo sapiens
gcctttatcttgaagtc

SEQ ID NO: 1230161 - DNA, 19 bp, Homo sapiens
gcctttatgttttttgtaa

SEQ ID NO: 1230162 - DNA, 19 bp, Homo sapiens
gcctttcagaagtgattta

SEQ ID NO: 1230163 - DNA, 20 bp, Homo sapiens
gcctttccagagaactgcag

SEQ ID NO: 1230164 - DNA, 20 bp, Homo sapiens
gcctttcctcaaaactggag

SEQ ID NO: 1230165 - DNA, 14 bp, Homo sapiens
gcctttcctgtgcc

SEQ ID NO: 1230166 - DNA, 16 bp, Homo sapiens
gcctttccttccctct

SEQ ID NO: 1230167 - DNA, 14 bp, Homo sapiens
gcctttctaagact

SEQ ID NO: 1230168 - DNA, 14 bp, Homo sapiens
gcctttctcccccg

SEQ ID NO: 1230169 - DNA, 12 bp, Homo sapiens
gcctttctcctc

SEQ ID NO: 1230170 - DNA, 22 bp, Homo sapiens
gcctttctcgtggtagaagcca

SEQ ID NO: 1230171 - DNA, 14 bp, Homo sapiens
gcctttctgcagtt

SEQ ID NO: 1230172 - DNA, 12 bp, Homo sapiens
gcctttcttctg

SEQ ID NO: 1230173 - DNA, 14 bp, Homo sapiens
gcctttcttctgcc

SEQ ID NO: 1230174 - DNA, 14 bp, Homo sapiens
gcctttcttctgtg

SEQ ID NO: 1230175 - DNA, 23 bp, Homo sapiens
gcctttgagcccacaaagcctta

SEQ ID NO: 1230176 - DNA, 19 bp, Homo sapiens
gcctttgatcacaggagca

SEQ ID NO: 1230177 - DNA, 15 bp, Homo sapiens
gcctttgcaaatcag

SEQ ID NO: 1230178 - DNA, 18 bp, Homo sapiens
gcctttgcaagatgcttg

SEQ ID NO: 1230179 - DNA, 15 bp, Homo sapiens
gcctttgcctccccg

SEQ ID NO: 1230180 - DNA, 17 bp, Homo sapiens
gcctttggacccagggc

SEQ ID NO: 1230181 - DNA, 15 bp, Homo sapiens
gcctttggaggggaa

SEQ ID NO: 1230182 - DNA, 16 bp, Homo sapiens
gcctttggtgaattcc

SEQ ID NO: 1230183 - DNA, 22 bp, Homo sapiens
gcctttgtaaccacaactttca

SEQ ID NO: 1230184 - DNA, 11 bp, Homo sapiens
gcctttgtaag

SEQ ID NO: 1230185 - DNA, 17 bp, Homo sapiens
gcctttgtaagtgcagg

SEQ ID NO: 1230186 - DNA, 16 bp, Homo sapiens
gcctttgtatgtggaa

SEQ ID NO: 1230187 - DNA, 15 bp, Homo sapiens
gcctttgtccccaca

SEQ ID NO: 1230188 - DNA, 21 bp, Homo sapiens
gcctttgtccccacacagcct

SEQ ID NO: 1230189 - DNA, 15 bp, Homo sapiens
gcctttgtcttgtac

SEQ ID NO: 1230190 - DNA, 18 bp, Homo sapiens
gcctttgtcttgtacttc

SEQ ID NO: 1230191 - DNA, 22 bp, Homo sapiens
gccttttatcccaaagttgttg

SEQ ID NO: 1230192 - DNA, 13 bp, Homo sapiens
gccttttcagccc

SEQ ID NO: 1230193 - DNA, 23 bp, Homo sapiens
gccttttccaaatgcccaaggat

SEQ ID NO: 1230194 - DNA, 17 bp, Homo sapiens
gccttttccacacgcat

SEQ ID NO: 1230195 - DNA, 23 bp, Homo sapiens
gccttttctggtccctcttctct

SEQ ID NO: 1230196 - DNA, 12 bp, Homo sapiens
gccttttctgtg

SEQ ID NO: 1230197 - DNA, 14 bp, Homo sapiens
gccttttgcacccc

SEQ ID NO: 1230198 - DNA, 19 bp, Homo sapiens
gccttttgcacccctccca

SEQ ID NO: 1230199 - DNA, 14 bp, Homo sapiens
gccttttgcccgga

SEQ ID NO: 1230200 - DNA, 13 bp, Homo sapiens
gccttttgtgtga

SEQ ID NO: 1230201 - DNA, 17 bp, Homo sapiens
gccttttgtttctagaa

SEQ ID NO: 1230202 - DNA, 18 bp, Homo sapiens
gcctttttcatttatcta

SEQ ID NO: 1230203 - DNA, 22 bp, Homo sapiens
gcctttttcatttatctataat

SEQ ID NO: 1230204 - DNA, 22 bp, Homo sapiens
gcctttttctgagatgctcact

SEQ ID NO: 1230205 - DNA, 15 bp, Homo sapiens
gcgaaccacccaaaa

SEQ ID NO: 1230206 - DNA, 22 bp, Homo sapiens
gcgaactgggttctttggaagc

SEQ ID NO: 1230207 - DNA, 21 bp, Homo sapiens
gcgaacttcacataggaaggg

SEQ ID NO: 1230208 - DNA, 15 bp, Homo sapiens
gcgaaggggccctgg

SEQ ID NO: 1230209 - DNA, 18 bp, Homo sapiens
gcgacatctctgactttc

SEQ ID NO: 1230210 - DNA, 15 bp, Homo sapiens
gcgaccaccaaagtc

SEQ ID NO: 1230211 - DNA, 17 bp, Homo sapiens
gcgaccatgtggccaca

SEQ ID NO: 1230212 - DNA, 12 bp, Homo sapiens
gcgaccccagac

SEQ ID NO: 1230213 - DNA, 19 bp, Homo sapiens
gcgacccttggtgtttccc

SEQ ID NO: 1230214 - DNA, 14 bp, Homo sapiens
gcgaccgccccctc

SEQ ID NO: 1230215 - DNA, 22 bp, Homo sapiens
gcgacctcagttgtcctgccct

SEQ ID NO: 1230216 - DNA, 23 bp, Homo sapiens
gcgacctctctgcctctcttctt

SEQ ID NO: 1230217 - DNA, 16 bp, Homo sapiens
gcgacggagagaaaaa

SEQ ID NO: 1230218 - DNA, 21 bp, Homo sapiens
gcgactaatttcaaaatgctt

SEQ ID NO: 1230219 - DNA, 18 bp, Homo sapiens
gcgactccgttggccact

SEQ ID NO: 1230220 - DNA, 14 bp, Homo sapiens
gcgacttccacaaa

SEQ ID NO: 1230221 - DNA, 19 bp, Homo sapiens
gcgacttccacaaacctgg

SEQ ID NO: 1230222 - DNA, 16 bp, Homo sapiens
gcgactttctgcctgg

SEQ ID NO: 1230223 - DNA, 19 bp, Homo sapiens
gcgacttttgttctcttct

SEQ ID NO: 1230224 - DNA, 22 bp, Homo sapiens
gcgagacgcacacagctgagca

SEQ ID NO: 1230225 - DNA, 16 bp, Homo sapiens
gcgagactctgtctca

SEQ ID NO: 1230226 - DNA, 14 bp, Homo sapiens
gcgagaggcagcaa

SEQ ID NO: 1230227 - DNA, 16 bp, Homo sapiens
gcgagagtctgtctca

SEQ ID NO: 1230228 - DNA, 14 bp, Homo sapiens
gcgagccacaggaa

SEQ ID NO: 1230229 - DNA, 17 bp, Homo sapiens
gcgagccacaggaacgg

SEQ ID NO: 1230230 - DNA, 19 bp, Homo sapiens
gcgagcccctcggctctgg

SEQ ID NO: 1230231 - DNA, 21 bp, Homo sapiens
gcgtgccgtgtgagtgtgaca

SEQ ID NO: 1230232 - DNA, 23 bp, Homo sapiens
gcgtgcgtgttagtgtgtgtgca

SEQ ID NO: 1230233 - DNA, 23 bp, Homo sapiens
gcgtgctagaggttgcagcatga

SEQ ID NO: 1230234 - DNA, 16 bp, Homo sapiens
gcgtgctgagaggcga

SEQ ID NO: 1230235 - DNA, 20 bp, Homo sapiens
gcgtgctggcgacactcagg

SEQ ID NO: 1230236 - DNA, 21 bp, Homo sapiens
gcgtgctggcgacactcaggg

SEQ ID NO: 1230237 - DNA, 14 bp, Homo sapiens
gcgtggaaggggga

SEQ ID NO: 1230238 - DNA, 15 bp, Homo sapiens
gcgtggaagggggag

SEQ ID NO: 1230239 - DNA, 14 bp, Homo sapiens
gcgtggaggagagg

SEQ ID NO: 1230240 - DNA, 16 bp, Homo sapiens
gcgtggaggagaggag

SEQ ID NO: 1230241 - DNA, 22 bp, Homo sapiens
gcgtggatcgagtgtagctgtg

SEQ ID NO: 1230242 - DNA, 12 bp, Homo sapiens
gcgtggcccagg

SEQ ID NO: 1230243 - DNA, 17 bp, Homo sapiens
gcgtggcccaggccggg

SEQ ID NO: 1230244 - DNA, 15 bp, Homo sapiens
gcgtggccttgggag

SEQ ID NO: 1230245 - DNA, 18 bp, Homo sapiens
gcgtggccttgggaggac

SEQ ID NO: 1230246 - DNA, 13 bp, Homo sapiens
gcgtggctgtggc

SEQ ID NO: 1230247 - DNA, 14 bp, Homo sapiens
gcgtggctgtggca

SEQ ID NO: 1230248 - DNA, 13 bp, Homo sapiens
gcgtgggaggcag

SEQ ID NO: 1230249 - DNA, 13 bp, Homo sapiens
gcgtggggagggc

SEQ ID NO: 1230250 - DNA, 13 bp, Homo sapiens
gcgtgggtctctg

SEQ ID NO: 1230251 - DNA, 15 bp, Homo sapiens
gcgtgggtctctggg

SEQ ID NO: 1230252 - DNA, 16 bp, Homo sapiens
gcgtgggtctctgggg

SEQ ID NO: 1230253 - DNA, 18 bp, Homo sapiens
gcgtgggtctctggggac

SEQ ID NO: 1230254 - DNA, 15 bp, Homo sapiens
gcgtggtagtgcaag

SEQ ID NO: 1230255 - DNA, 15 bp, Homo sapiens
gcgtggttcctttct

SEQ ID NO: 1230256 - DNA, 20 bp, Homo sapiens
gcgtgtgcaggccgacagtc

SEQ ID NO: 1230257 - DNA, 16 bp, Homo sapiens
gcgtgtgctcctctcc

SEQ ID NO: 1230258 - DNA, 12 bp, Homo sapiens
gcgtgtggagca

SEQ ID NO: 1230259 - DNA, 13 bp, Homo sapiens
gcgtgtggagcag

SEQ ID NO: 1230260 - DNA, 19 bp, Homo sapiens
gcgtgtggctcacgtgtgt

SEQ ID NO: 1230261 - DNA, 21 bp, Homo sapiens
gcgtgtggtttccctgcccct

SEQ ID NO: 1230262 - DNA, 22 bp, Homo sapiens
gcgtgtggtttccctgcccctg

SEQ ID NO: 1230263 - DNA, 14 bp, Homo sapiens
gcgtgtgtcaggga

SEQ ID NO: 1230264 - DNA, 17 bp, Homo sapiens
gcgtgtgtgacactgat

SEQ ID NO: 1230265 - DNA, 22 bp, Homo sapiens
gcgttaaaggctcgattttgta

SEQ ID NO: 1230266 - DNA, 17 bp, Homo sapiens
gcgttacaccctttctt

SEQ ID NO: 1230267 - DNA, 18 bp, Homo sapiens
gcgttcacctccctgctc

SEQ ID NO: 1230268 - DNA, 15 bp, Homo sapiens
gcgttcagcccctga

SEQ ID NO: 1230269 - DNA, 18 bp, Homo sapiens
gcgttcccttctccccct

SEQ ID NO: 1230270 - DNA, 23 bp, Homo sapiens
gcgttctaccaggcaaattcact

SEQ ID NO: 1230271 - DNA, 16 bp, Homo sapiens
gcgttctcccaaagat

SEQ ID NO: 1230272 - DNA, 13 bp, Homo sapiens
gcgttctcccagc

SEQ ID NO: 1230273 - DNA, 12 bp, Homo sapiens
gcgttctcctgc

SEQ ID NO: 1230274 - DNA, 22 bp, Homo sapiens
gcgttctgggagctcaaggcca

SEQ ID NO: 1230275 - DNA, 15 bp, Homo sapiens
gcgttcttgtaattt

SEQ ID NO: 1230276 - DNA, 22 bp, Homo sapiens
gcgttcttgtaattttacacgc

SEQ ID NO: 1230277 - DNA, 14 bp, Homo sapiens
gcgttggagccact

SEQ ID NO: 1230278 - DNA, 21 bp, Homo sapiens
gcgttggagccactcctgtcc

SEQ ID NO: 1230279 - DNA, 23 bp, Homo sapiens
gcgttgttgcatgtttgaaatga

SEQ ID NO: 1230280 - DNA, 23 bp, Homo sapiens
gcgtttagtttctagaggcctca

SEQ ID NO: 1230281 - DNA, 18 bp, Homo sapiens
gcgtttctatgacacatg

SEQ ID NO: 1230282 - DNA, 15 bp, Homo sapiens
gcgtttgcacggttt

SEQ ID NO: 1230283 - DNA, 13 bp, Homo sapiens
gcgtttgcctcct

SEQ ID NO: 1230284 - DNA, 16 bp, Homo sapiens
gcgtttggggccctct

SEQ ID NO: 1230285 - DNA, 14 bp, Homo sapiens
gcgtttttctcgtc

SEQ ID NO: 1230286 - DNA, 20 bp, Homo sapiens
gcgtttttctcgtccccctc

SEQ ID NO: 1230287 - DNA, 23 bp, Homo sapiens
gcgtttttctcgtccccctccct

SEQ ID NO: 1230288 - DNA, 13 bp, Homo sapiens
gctaaaaaataaa

SEQ ID NO: 1230289 - DNA, 18 bp, Homo sapiens
gctaaaaatgagcttgat

SEQ ID NO: 1230290 - DNA, 22 bp, Homo sapiens
gctaaaaatgagcttgattaaa

SEQ ID NO: 1230291 - DNA, 14 bp, Homo sapiens
gctaaaagaagaga

SEQ ID NO: 1230292 - DNA, 13 bp, Homo sapiens
gctaaaaggaaaa

SEQ ID NO: 1230293 - DNA, 17 bp, Homo sapiens
gctaaactccttcctgg

SEQ ID NO: 1230294 - DNA, 21 bp, Homo sapiens
gctaaactgaatctatggctt

SEQ ID NO: 1230295 - DNA, 15 bp, Homo sapiens
gctaaagaagtttga

SEQ ID NO: 1230296 - DNA, 23 bp, Homo sapiens
gctaaagagcccttgcctcccca

SEQ ID NO: 1230297 - DNA, 21 bp, Homo sapiens
gctaaagataattgctattta

SEQ ID NO: 1230298 - DNA, 13 bp, Homo sapiens
gctaaagccagga

SEQ ID NO: 1230299 - DNA, 19 bp, Homo sapiens
gctaaataaaatttgttgc

SEQ ID NO: 1230300 - DNA, 23 bp, Homo sapiens
gctaaatggtcgcccaggagaca

SEQ ID NO: 1230301 - DNA, 16 bp, Homo sapiens
gctaaatgtttaaaga

SEQ ID NO: 1230302 - DNA, 18 bp, Homo sapiens
gctaaattacaattgtca

SEQ ID NO: 1230303 - DNA, 18 bp, Homo sapiens
gctaaattctatgttaaa

SEQ ID NO: 1230304 - DNA, 14 bp, Homo sapiens
gctaacaaagacaa

SEQ ID NO: 1230305 - DNA, 21 bp, Homo sapiens
gctaacccccttctactgagc

SEQ ID NO: 1230306 - DNA, 14 bp, Homo sapiens
gctaacctctctga

SEQ ID NO: 1230307 - DNA, 14 bp, Homo sapiens
gctaactccgagag

SEQ ID NO: 1230308 - DNA, 15 bp, Homo sapiens
gctaagaaatgctga

SEQ ID NO: 1230309 - DNA, 13 bp, Homo sapiens
gctaagagaagta

SEQ ID NO: 1230310 - DNA, 15 bp, Homo sapiens
gctaagctaggaatg

SEQ ID NO: 1230311 - DNA, 19 bp, Homo sapiens
gctaagctaggaatgaaat

SEQ ID NO: 1230312 - DNA, 22 bp, Homo sapiens
gctaagctcacgtcctgagaaa

SEQ ID NO: 1230313 - DNA, 17 bp, Homo sapiens
gctaaggacatttccca

SEQ ID NO: 1230314 - DNA, 14 bp, Homo sapiens
gctaaggctgctgg

SEQ ID NO: 1230315 - DNA, 16 bp, Homo sapiens
gctaaggctgctggct

SEQ ID NO: 1230316 - DNA, 20 bp, Homo sapiens
gctaagggtgggtgctcaga

SEQ ID NO: 1230317 - DNA, 21 bp, Homo sapiens
gctaagggtgggtgctcagaa

SEQ ID NO: 1230318 - DNA, 22 bp, Homo sapiens
gctaagggtgggtgctcagaat

SEQ ID NO: 1230319 - DNA, 16 bp, Homo sapiens
gctaaggtccctgggg

SEQ ID NO: 1230320 - DNA, 22 bp, Homo sapiens
gctaagtacacaataagcaaaa

SEQ ID NO: 1230321 - DNA, 20 bp, Homo sapiens
gctaagtatcaggggaaaaa

SEQ ID NO: 1230322 - DNA, 21 bp, Homo sapiens
gctaagtatcaggggaaaaaa

SEQ ID NO: 1230323 - DNA, 14 bp, Homo sapiens
gctaagtctttccc

SEQ ID NO: 1230324 - DNA, 13 bp, Homo sapiens
gctaagtgaaaag

SEQ ID NO: 1230325 - DNA, 17 bp, Homo sapiens
gctaagttgggatctag

SEQ ID NO: 1230326 - DNA, 21 bp, Homo sapiens
gctaataaaaagcttttgtct

SEQ ID NO: 1230327 - DNA, 23 bp, Homo sapiens
gctaataaaattcgctttctaaa

SEQ ID NO: 1230328 - DNA, 20 bp, Homo sapiens
gctaataaactgtattaaat

SEQ ID NO: 1230329 - DNA, 22 bp, Homo sapiens
gctaataaactgtattaaatct

SEQ ID NO: 1230330 - DNA, 23 bp, Homo sapiens
gctaataaactttgtgctgatct

SEQ ID NO: 1230331 - DNA, 21 bp, Homo sapiens
gctaatcaaagccagggtctc

SEQ ID NO: 1230332 - DNA, 23 bp, Homo sapiens
gctaatcatgtgggtgagccagt

SEQ ID NO: 1230333 - DNA, 14 bp, Homo sapiens
gctaatctgcctgg

SEQ ID NO: 1230334 - DNA, 18 bp, Homo sapiens
gctaatctgtagggctgg

SEQ ID NO: 1230335 - DNA, 19 bp, Homo sapiens
gctaatgaactctttcaaa

SEQ ID NO: 1230336 - DNA, 21 bp, Homo sapiens
gctaatgaagggaaaggatat

SEQ ID NO: 1230337 - DNA, 20 bp, Homo sapiens
gctaatgcaaattaaaacat

SEQ ID NO: 1230338 - DNA, 13 bp, Homo sapiens
gctaatgtaaact

SEQ ID NO: 1230339 - DNA, 22 bp, Homo sapiens
gctaatgttgctggatcaggaa

SEQ ID NO: 1230340 - DNA, 19 bp, Homo sapiens
gctaatgtttgtattttta

SEQ ID NO: 1230341 - DNA, 16 bp, Homo sapiens
gctaattagaaatcaa

SEQ ID NO: 1230342 - DNA, 17 bp, Homo sapiens
gctaattcaaggaattt

SEQ ID NO: 1230343 - DNA, 22 bp, Homo sapiens
gctaattcaaggaatttcttaa

SEQ ID NO: 1230344 - DNA, 16 bp, Homo sapiens
gctaattctactcaca

SEQ ID NO: 1230345 - DNA, 15 bp, Homo sapiens
gctaattctgggaag

SEQ ID NO: 1230346 - DNA, 18 bp, Homo sapiens
gctaattctgggaaggga

SEQ ID NO: 1230347 - DNA, 19 bp, Homo sapiens
gctaattgggagtccaggc

SEQ ID NO: 1230348 - DNA, 15 bp, Homo sapiens
gctaatttaaagaga

SEQ ID NO: 1230349 - DNA, 12 bp, Homo sapiens
gctaatttgcat

SEQ ID NO: 1230350 - DNA, 13 bp, Homo sapiens
gctaatttgcatt

SEQ ID NO: 1230351 - DNA, 15 bp, Homo sapiens
gctaatttgcattaa

SEQ ID NO: 1230352 - DNA, 20 bp, Homo sapiens
gctaatttgttttggatata

SEQ ID NO: 1230353 - DNA, 18 bp, Homo sapiens
gctaatttttattaattt

SEQ ID NO: 1230354 - DNA, 22 bp, Homo sapiens
gctaatttttttaatgtttttt

SEQ ID NO: 1230355 - DNA, 16 bp, Homo sapiens
gctacaaatttatgca

SEQ ID NO: 1230356 - DNA, 17 bp, Homo sapiens
gctacaaatttatgcat

SEQ ID NO: 1230357 - DNA, 18 bp, Homo sapiens
gctacaaatttatgcatt

SEQ ID NO: 1230358 - DNA, 18 bp, Homo sapiens
gctacaaggtaggctgca

SEQ ID NO: 1230359 - DNA, 16 bp, Homo sapiens
gctacaatttgttaat

SEQ ID NO: 1230360 - DNA, 16 bp, Homo sapiens
gctacacagacccctc

SEQ ID NO: 1230361 - DNA, 17 bp, Homo sapiens
gctacagaatagggtgg

SEQ ID NO: 1230362 - DNA, 17 bp, Homo sapiens
gctacagcaatttctaa

SEQ ID NO: 1230363 - DNA, 19 bp, Homo sapiens
gctacagcaatttctaatt

SEQ ID NO: 1230364 - DNA, 12 bp, Homo sapiens
gctacaggactg

SEQ ID NO: 1230365 - DNA, 20 bp, Homo sapiens
gctacaggatggtgggcagg

SEQ ID NO: 1230366 - DNA, 23 bp, Homo sapiens
gctacagggcgagactctgtctc

SEQ ID NO: 1230367 - DNA, 23 bp, Homo sapiens
gctacaggggaaggtggcctctg

SEQ ID NO: 1230368 - DNA, 14 bp, Homo sapiens
gctacatcccagcc

SEQ ID NO: 1230369 - DNA, 13 bp, Homo sapiens
gctacattcctca

SEQ ID NO: 1230370 - DNA, 18 bp, Homo sapiens
gctacattcctcagctgc

SEQ ID NO: 1230371 - DNA, 15 bp, Homo sapiens
gctaccagtatttag

SEQ ID NO: 1230372 - DNA, 21 bp, Homo sapiens
gctaccagtatttagaagcca

SEQ ID NO: 1230373 - DNA, 22 bp, Homo sapiens
gctaccagtatttagaagccaa

SEQ ID NO: 1230374 - DNA, 17 bp, Homo sapiens
gctacccacttctaaat

SEQ ID NO: 1230375 - DNA, 21 bp, Homo sapiens
gctacccaggaggctgaggtg

SEQ ID NO: 1230376 - DNA, 20 bp, Homo sapiens
gctacccccatgctggaggt

SEQ ID NO: 1230377 - DNA, 13 bp, Homo sapiens
gctaccccttgtg

SEQ ID NO: 1230378 - DNA, 15 bp, Homo sapiens
gctaccccttgtggg

SEQ ID NO: 1230379 - DNA, 22 bp, Homo sapiens
gctaccctttttctccagctgg

SEQ ID NO: 1230380 - DNA, 17 bp, Homo sapiens
gctaccgccctgggctg

SEQ ID NO: 1230381 - DNA, 23 bp, Homo sapiens
gctaccgccctgggctggactgg

SEQ ID NO: 1230382 - DNA, 21 bp, Homo sapiens
gctacctaaaaaaagatgttt

SEQ ID NO: 1230383 - DNA, 17 bp, Homo sapiens
gctacctcaagggggac

SEQ ID NO: 1230384 - DNA, 14 bp, Homo sapiens
gctacctcactggg

SEQ ID NO: 1230385 - DNA, 20 bp, Homo sapiens
gctacctttgtattctctcc

SEQ ID NO: 1230386 - DNA, 13 bp, Homo sapiens
gctacctttttat

SEQ ID NO: 1230387 - DNA, 22 bp, Homo sapiens
gctacggggaaaatgcattttc

SEQ ID NO: 1230388 - DNA, 17 bp, Homo sapiens
gctacgtgcctcccgag

SEQ ID NO: 1230389 - DNA, 18 bp, Homo sapiens
gctacgttagcagcccag

SEQ ID NO: 1230390 - DNA, 19 bp, Homo sapiens
gctacgttcctattgtcat

SEQ ID NO: 1230391 - DNA, 14 bp, Homo sapiens
gctactaatgatgt

SEQ ID NO: 1230392 - DNA, 16 bp, Homo sapiens
gctactaatgatgttt

SEQ ID NO: 1230393 - DNA, 19 bp, Homo sapiens
gctactacccgagcccagc

SEQ ID NO: 1230394 - DNA, 20 bp, Homo sapiens
gctactacccgagcccagct

SEQ ID NO: 1230395 - DNA, 19 bp, Homo sapiens
gctactcagaagcctgagg

SEQ ID NO: 1230396 - DNA, 12 bp, Homo sapiens
gctactcagcag

SEQ ID NO: 1230397 - DNA, 21 bp, Homo sapiens
gctactcagcagccctcctca

SEQ ID NO: 1230398 - DNA, 22 bp, Homo sapiens
gctactcagcagccctcctcac

SEQ ID NO: 1230399 - DNA, 15 bp, Homo sapiens
gctactcaggaggct

SEQ ID NO: 1230400 - DNA, 17 bp, Homo sapiens
gctactcaggaggctga

SEQ ID NO: 1230401 - DNA, 23 bp, Homo sapiens
gctactcaggaggctgaggcaga

SEQ ID NO: 1230402 - DNA, 21 bp, Homo sapiens
gctactcccctttcttccaaa

SEQ ID NO: 1230403 - DNA, 16 bp, Homo sapiens
gctactcctgtgctct

SEQ ID NO: 1230404 - DNA, 17 bp, Homo sapiens
gctactcgggaggctga

SEQ ID NO: 1230405 - DNA, 18 bp, Homo sapiens
gctactcgggaggctgag

SEQ ID NO: 1230406 - DNA, 12 bp, Homo sapiens
gctactctgtcc

SEQ ID NO: 1230407 - DNA, 16 bp, Homo sapiens
gctactctgtccaggc

SEQ ID NO: 1230408 - DNA, 21 bp, Homo sapiens
gctactctgtccaggccactg

SEQ ID NO: 1230409 - DNA, 14 bp, Homo sapiens
gctactcttgactt

SEQ ID NO: 1230410 - DNA, 16 bp, Homo sapiens
gctactgaaccagcca

SEQ ID NO: 1230411 - DNA, 18 bp, Homo sapiens
gctactgaaccagccacg

SEQ ID NO: 1230412 - DNA, 16 bp, Homo sapiens
gctactgatgaaatct

SEQ ID NO: 1230413 - DNA, 17 bp, Homo sapiens
gctactgatttcctttg

SEQ ID NO: 1230414 - DNA, 17 bp, Homo sapiens
gctactgatttttgtga

SEQ ID NO: 1230415 - DNA, 21 bp, Homo sapiens
gctactgcactccagcctggg

SEQ ID NO: 1230416 - DNA, 22 bp, Homo sapiens
gctactggacttgaatggttaa

SEQ ID NO: 1230417 - DNA, 12 bp, Homo sapiens
gctactggcagc

SEQ ID NO: 1230418 - DNA, 20 bp, Homo sapiens
gctactggcagctcctctcc

SEQ ID NO: 1230419 - DNA, 18 bp, Homo sapiens
gctactgtaattttatat

SEQ ID NO: 1230420 - DNA, 22 bp, Homo sapiens
gctactgtaattttatatgaag

SEQ ID NO: 1230421 - DNA, 16 bp, Homo sapiens
gctactgtctcactga

SEQ ID NO: 1230422 - DNA, 19 bp, Homo sapiens
gctactgtgtgtgtgaatg

SEQ ID NO: 1230423 - DNA, 21 bp, Homo sapiens
gctactgtgtgtgtgaatgaa

SEQ ID NO: 1230424 - DNA, 17 bp, Homo sapiens
gctacttaattcctttc

SEQ ID NO: 1230425 - DNA, 23 bp, Homo sapiens
gctacttaattcctttctcatcc

SEQ ID NO: 1230426 - DNA, 23 bp, Homo sapiens
gctacttgcttgaagttttcagt

SEQ ID NO: 1230427 - DNA, 13 bp, Homo sapiens
gctacttgggagg

SEQ ID NO: 1230428 - DNA, 21 bp, Homo sapiens
gctactttatttatacactgt

SEQ ID NO: 1230429 - DNA, 16 bp, Homo sapiens
gctactttgctgctat

SEQ ID NO: 1230430 - DNA, 20 bp, Homo sapiens
gctagaaaaaaaaaacactt

SEQ ID NO: 1230431 - DNA, 22 bp, Homo sapiens
gctagaagatccacatcctcta

SEQ ID NO: 1230432 - DNA, 13 bp, Homo sapiens
gctagaaggccac

SEQ ID NO: 1230433 - DNA, 15 bp, Homo sapiens
gctagaatacttttt

SEQ ID NO: 1230434 - DNA, 16 bp, Homo sapiens
gctagacacatgaagg

SEQ ID NO: 1230435 - DNA, 15 bp, Homo sapiens
gctagacaggaaccc

SEQ ID NO: 1230436 - DNA, 16 bp, Homo sapiens
gctagactggagtgag

SEQ ID NO: 1230437 - DNA, 17 bp, Homo sapiens
gctagagaaggaccaga

SEQ ID NO: 1230438 - DNA, 19 bp, Homo sapiens
gctagagataaaacagaat

SEQ ID NO: 1230439 - DNA, 13 bp, Homo sapiens
gctagagcagaca

SEQ ID NO: 1230440 - DNA, 18 bp, Homo sapiens
gctagagcagacaggcct

SEQ ID NO: 1230441 - DNA, 18 bp, Homo sapiens
gctagaggccagccccac

SEQ ID NO: 1230442 - DNA, 21 bp, Homo sapiens
gctagaggttcaaagatattt

SEQ ID NO: 1230443 - DNA, 16 bp, Homo sapiens
gctagagtcctcactc

SEQ ID NO: 1230444 - DNA, 18 bp, Homo sapiens
gctagagtcctcactccc

SEQ ID NO: 1230445 - DNA, 14 bp, Homo sapiens
gctagagtttttgt

SEQ ID NO: 1230446 - DNA, 18 bp, Homo sapiens
gctagattttaatttatt

SEQ ID NO: 1230447 - DNA, 19 bp, Homo sapiens
gctagcaaatggcagaacc

SEQ ID NO: 1230448 - DNA, 17 bp, Homo sapiens
gctagcacttggagcca

SEQ ID NO: 1230449 - DNA, 22 bp, Homo sapiens
gctagcagcagggagggcttct

SEQ ID NO: 1230450 - DNA, 11 bp, Homo sapiens
gctagcagccc

SEQ ID NO: 1230451 - DNA, 20 bp, Homo sapiens
gctagcaggccccctaggat

SEQ ID NO: 1230452 - DNA, 19 bp, Homo sapiens
gctagcagtaaaagatgaa

SEQ ID NO: 1230453 - DNA, 14 bp, Homo sapiens
gctagcatccctga

SEQ ID NO: 1230454 - DNA, 10 bp, Homo sapiens
gctagccctg

SEQ ID NO: 1230455 - DNA, 14 bp, Homo sapiens
gctagccctgagcc

SEQ ID NO: 1230456 - DNA, 19 bp, Homo sapiens
gctagccctgagcccggcc

SEQ ID NO: 1230457 - DNA, 20 bp, Homo sapiens
gctagcgctgccgcacccca

SEQ ID NO: 1230458 - DNA, 23 bp, Homo sapiens
gctagcgctgccgcaccccagag

SEQ ID NO: 1230459 - DNA, 14 bp, Homo sapiens
gctagctagccagc

SEQ ID NO: 1230460 - DNA, 17 bp, Homo sapiens
gctagctagccagccaa

SEQ ID NO: 1230461 - DNA, 14 bp, Homo sapiens
gctagctagcgcac

SEQ ID NO: 1230462 - DNA, 19 bp, Homo sapiens
gctagctattgcaaatgag

SEQ ID NO: 1230463 - DNA, 22 bp, Homo sapiens
gctagctctttggtctattttc

SEQ ID NO: 1230464 - DNA, 17 bp, Homo sapiens
gctagctgtagaaatgt

SEQ ID NO: 1230465 - DNA, 18 bp, Homo sapiens
gctagctgtagaaatgta

SEQ ID NO: 1230466 - DNA, 18 bp, Homo sapiens
gctagcttctgcttttct

SEQ ID NO: 1230467 - DNA, 12 bp, Homo sapiens
gctaggactgag

SEQ ID NO: 1230468 - DNA, 15 bp, Homo sapiens
gctaggactgaggag

SEQ ID NO: 1230469 - DNA, 19 bp, Homo sapiens
gcctgcagggtggtgctgg

SEQ ID NO: 1230470 - DNA, 23 bp, Homo sapiens
gcctgcagggtggtgctgggact

SEQ ID NO: 1230471 - DNA, 23 bp, Homo sapiens
gcctgcataggagtttggaggaa

SEQ ID NO: 1230472 - DNA, 14 bp, Homo sapiens
gcctgcatcttctt

SEQ ID NO: 1230473 - DNA, 15 bp, Homo sapiens
gcctgcatggagaag

SEQ ID NO: 1230474 - DNA, 12 bp, Homo sapiens
gcctgcattctg

SEQ ID NO: 1230475 - DNA, 21 bp, Homo sapiens
gcctgcattgagcttgcatgc

SEQ ID NO: 1230476 - DNA, 21 bp, Homo sapiens
gcctgcatttcctcgcagcct

SEQ ID NO: 1230477 - DNA, 16 bp, Homo sapiens
gcctgccactctctgg

SEQ ID NO: 1230478 - DNA, 21 bp, Homo sapiens
gcctgccactctctgggactc

SEQ ID NO: 1230479 - DNA, 13 bp, Homo sapiens
gcctgcccacctc

SEQ ID NO: 1230480 - DNA, 17 bp, Homo sapiens
gcctgcccacctctccc

SEQ ID NO: 1230481 - DNA, 23 bp, Homo sapiens
gcctgcccacctctccctgcatc

SEQ ID NO: 1230482 - DNA, 12 bp, Homo sapiens
gcctgcccagac

SEQ ID NO: 1230483 - DNA, 14 bp, Homo sapiens
gcctgcccagactg

SEQ ID NO: 1230484 - DNA, 13 bp, Homo sapiens
gcctgcccagcct

SEQ ID NO: 1230485 - DNA, 14 bp, Homo sapiens
gcctgccccacacg

SEQ ID NO: 1230486 - DNA, 22 bp, Homo sapiens
gcctgccccacccaccccacag

SEQ ID NO: 1230487 - DNA, 21 bp, Homo sapiens
gcctgccccctgggctggggc

SEQ ID NO: 1230488 - DNA, 21 bp, Homo sapiens
gcctgccccgcccccagtccc

SEQ ID NO: 1230489 - DNA, 21 bp, Homo sapiens
gcctgcccctaccctggactt

SEQ ID NO: 1230490 - DNA, 23 bp, Homo sapiens
gcctgcccctgctgcttgggacg

SEQ ID NO: 1230491 - DNA, 19 bp, Homo sapiens
gcctgccctccccagagca

SEQ ID NO: 1230492 - DNA, 14 bp, Homo sapiens
gcctgccctcccgc

SEQ ID NO: 1230493 - DNA, 15 bp, Homo sapiens
gcctgccctcccgca

SEQ ID NO: 1230494 - DNA, 17 bp, Homo sapiens
gcctgccctcccgcacc

SEQ ID NO: 1230495 - DNA, 19 bp, Homo sapiens
gcctgccctcccgcacctt

SEQ ID NO: 1230496 - DNA, 11 bp, Homo sapiens
gcctgccctgc

SEQ ID NO: 1230497 - DNA, 15 bp, Homo sapiens
gcctgccctgcccaa

SEQ ID NO: 1230498 - DNA, 17 bp, Homo sapiens
gcctgccctgcccaagt

SEQ ID NO: 1230499 - DNA, 22 bp, Homo sapiens
gcctgccctgccttgccgctcc

SEQ ID NO: 1230500 - DNA, 12 bp, Homo sapiens
gcctgccctgga

SEQ ID NO: 1230501 - DNA, 19 bp, Homo sapiens
gcctgccgctgcacctgcc

SEQ ID NO: 1230502 - DNA, 14 bp, Homo sapiens
gcctgccgctgcag

SEQ ID NO: 1230503 - DNA, 19 bp, Homo sapiens
gcctgccggacacagcacc

SEQ ID NO: 1230504 - DNA, 22 bp, Homo sapiens
gcctgccgtgcatggctcctgt

SEQ ID NO: 1230505 - DNA, 13 bp, Homo sapiens
gcctgcctcaccc

SEQ ID NO: 1230506 - DNA, 12 bp, Homo sapiens
gcctgcctccta

SEQ ID NO: 1230507 - DNA, 13 bp, Homo sapiens
gcctgcctcttgg

SEQ ID NO: 1230508 - DNA, 16 bp, Homo sapiens
gcctgcctgcctccac

SEQ ID NO: 1230509 - DNA, 13 bp, Homo sapiens
gcctgcctggcag

SEQ ID NO: 1230510 - DNA, 15 bp, Homo sapiens
gcctgcctggcaggc

SEQ ID NO: 1230511 - DNA, 16 bp, Homo sapiens
gcctgcctggcccctc

SEQ ID NO: 1230512 - DNA, 22 bp, Homo sapiens
gcctgcctgtctgtctctccat

SEQ ID NO: 1230513 - DNA, 15 bp, Homo sapiens
gcctgcgagacccaa

SEQ ID NO: 1230514 - DNA, 22 bp, Homo sapiens
gcctgcgcccagagctggcctc

SEQ ID NO: 1230515 - DNA, 15 bp, Homo sapiens
gcctgcgcctgctgc

SEQ ID NO: 1230516 - DNA, 21 bp, Homo sapiens
gcctgcggcccagaagtttcc

SEQ ID NO: 1230517 - DNA, 17 bp, Homo sapiens
gctcctggctgccaggc

SEQ ID NO: 1230518 - DNA, 19 bp, Homo sapiens
gctcctggctgccaggcgt

SEQ ID NO: 1230519 - DNA, 15 bp, Homo sapiens
gctcctggctgtgcc

SEQ ID NO: 1230520 - DNA, 12 bp, Homo sapiens
gctcctgggacc

SEQ ID NO: 1230521 - DNA, 22 bp, Homo sapiens
gctcctggggagaaagaggggc

SEQ ID NO: 1230522 - DNA, 15 bp, Homo sapiens
gctcctggggagctc

SEQ ID NO: 1230523 - DNA, 12 bp, Homo sapiens
gctcctggggca

SEQ ID NO: 1230524 - DNA, 12 bp, Homo sapiens
gctcctgggttg

SEQ ID NO: 1230525 - DNA, 21 bp, Homo sapiens
gctcctgtacttgtcctcagc

SEQ ID NO: 1230526 - DNA, 23 bp, Homo sapiens
gctcctgtacttgtcctcagctt

SEQ ID NO: 1230527 - DNA, 13 bp, Homo sapiens
gctcctgtcctcc

SEQ ID NO: 1230528 - DNA, 17 bp, Homo sapiens
gctcctgtctgccagcc

SEQ ID NO: 1230529 - DNA, 19 bp, Homo sapiens
gctcctgtctgccagccag

SEQ ID NO: 1230530 - DNA, 20 bp, Homo sapiens
gctcctgtctgccagccagc

SEQ ID NO: 1230531 - DNA, 17 bp, Homo sapiens
gctcctgtggcaggagg

SEQ ID NO: 1230532 - DNA, 18 bp, Homo sapiens
gctcctgtggcaggaggc

SEQ ID NO: 1230533 - DNA, 15 bp, Homo sapiens
gctcctgtggcccca

SEQ ID NO: 1230534 - DNA, 18 bp, Homo sapiens
gctccttcactgaacatg

SEQ ID NO: 1230535 - DNA, 12 bp, Homo sapiens
gctccttccaga

SEQ ID NO: 1230536 - DNA, 16 bp, Homo sapiens
gctccttcccctgcac

SEQ ID NO: 1230537 - DNA, 23 bp, Homo sapiens
gctccttcccctgcacctggcct

SEQ ID NO: 1230538 - DNA, 14 bp, Homo sapiens
gctccttgctgcat

SEQ ID NO: 1230539 - DNA, 22 bp, Homo sapiens
gctccttggcacccccatgctg

SEQ ID NO: 1230540 - DNA, 11 bp, Homo sapiens
gctccttgggc

SEQ ID NO: 1230541 - DNA, 14 bp, Homo sapiens
gctcctttctcctg

SEQ ID NO: 1230542 - DNA, 17 bp, Homo sapiens
gctcctttctcctgtga

SEQ ID NO: 1230543 - DNA, 22 bp, Homo sapiens
gctcctttgtgtgtgtgtcagc

SEQ ID NO: 1230544 - DNA, 17 bp, Homo sapiens
gctccttttgtccccag

SEQ ID NO: 1230545 - DNA, 16 bp, Homo sapiens
gctcctttttctccct

SEQ ID NO: 1230546 - DNA, 18 bp, Homo sapiens
gctcctttttctccctct

SEQ ID NO: 1230547 - DNA, 16 bp, Homo sapiens
gctcgaatctctgtgc

SEQ ID NO: 1230548 - DNA, 18 bp, Homo sapiens
gctcgactatagaaaact

SEQ ID NO: 1230549 - DNA, 17 bp, Homo sapiens
gctcgagcagtcctgcc

SEQ ID NO: 1230550 - DNA, 20 bp, Homo sapiens
gctcgagtcacattctgctt

SEQ ID NO: 1230551 - DNA, 15 bp, Homo sapiens
gctcgatgactgtga

SEQ ID NO: 1230552 - DNA, 14 bp, Homo sapiens
gctcgatgcctttg

SEQ ID NO: 1230553 - DNA, 18 bp, Homo sapiens
gctcgatgcctttgctgt

SEQ ID NO: 1230554 - DNA, 17 bp, Homo sapiens
gctcgatgtttgccatg

SEQ ID NO: 1230555 - DNA, 14 bp, Homo sapiens
gctcgcactgccca

SEQ ID NO: 1230556 - DNA, 23 bp, Homo sapiens
gctcgcagcccccgcgccctccc

SEQ ID NO: 1230557 - DNA, 18 bp, Homo sapiens
gctcgccacgctcagtgc

SEQ ID NO: 1230558 - DNA, 12 bp, Homo sapiens
gctcgcccagca

SEQ ID NO: 1230559 - DNA, 17 bp, Homo sapiens
gctcgccccacccaggg

SEQ ID NO: 1230560 - DNA, 18 bp, Homo sapiens
gctcgccccacccagggc

SEQ ID NO: 1230561 - DNA, 13 bp, Homo sapiens
gctcgcccctccc

SEQ ID NO: 1230562 - DNA, 23 bp, Homo sapiens
gctcgcccctcccctcagcctgc

SEQ ID NO: 1230563 - DNA, 16 bp, Homo sapiens
gctcgccgtgtctcag

SEQ ID NO: 1230564 - DNA, 15 bp, Homo sapiens
gctcggccgtgggcc

SEQ ID NO: 1230565 - DNA, 18 bp, Homo sapiens
gctcgggaagggagggga

SEQ ID NO: 1230566 - DNA, 15 bp, Homo sapiens
gctcggggaggcaga

SEQ ID NO: 1230567 - DNA, 17 bp, Homo sapiens
gctcggggaggcagaga

SEQ ID NO: 1230568 - DNA, 21 bp, Homo sapiens
gctcggggtaaaaagtggctg

SEQ ID NO: 1230569 - DNA, 14 bp, Homo sapiens
gctcggggtccacc

SEQ ID NO: 1230570 - DNA, 12 bp, Homo sapiens
gctcggtggacc

SEQ ID NO: 1230571 - DNA, 12 bp, Homo sapiens
gctcgtgcagta

SEQ ID NO: 1230572 - DNA, 22 bp, Homo sapiens
gctcgtggactgagtgggaagc

SEQ ID NO: 1230573 - DNA, 21 bp, Homo sapiens
gctcgtggactgtgctggtgc

SEQ ID NO: 1230574 - DNA, 15 bp, Homo sapiens
gctcgtgtatcctgg

SEQ ID NO: 1230575 - DNA, 22 bp, Homo sapiens
gctcgttccggtccccacagac

SEQ ID NO: 1230576 - DNA, 18 bp, Homo sapiens
gctcgtttttcagcaccc

SEQ ID NO: 1230577 - DNA, 18 bp, Homo sapiens
gctctaataagtttgtgt

SEQ ID NO: 1230578 - DNA, 15 bp, Homo sapiens
gctctaattcacagt

SEQ ID NO: 1230579 - DNA, 20 bp, Homo sapiens
gctctacagctaatcagcat

SEQ ID NO: 1230580 - DNA, 20 bp, Homo sapiens
gctctacatcttctgcctta

SEQ ID NO: 1230581 - DNA, 13 bp, Homo sapiens
gctctacccatga

SEQ ID NO: 1230582 - DNA, 19 bp, Homo sapiens
gctctacccatgagcctgc

SEQ ID NO: 1230583 - DNA, 17 bp, Homo sapiens
gctctaccctgtctgtc

SEQ ID NO: 1230584 - DNA, 19 bp, Homo sapiens
gctctaccctgtctgtccc

SEQ ID NO: 1230585 - DNA, 15 bp, Homo sapiens
gctctacctctcttt

SEQ ID NO: 1230586 - DNA, 17 bp, Homo sapiens
gctctacctctctttct

SEQ ID NO: 1230587 - DNA, 15 bp, Homo sapiens
gctctaccttcctgt

SEQ ID NO: 1230588 - DNA, 16 bp, Homo sapiens
gctctactttgagaag

SEQ ID NO: 1230589 - DNA, 12 bp, Homo sapiens
gctctagaaagt

SEQ ID NO: 1230590 - DNA, 16 bp, Homo sapiens
gctctagacaaccctg

SEQ ID NO: 1230591 - DNA, 16 bp, Homo sapiens
gctctagagagaggga

SEQ ID NO: 1230592 - DNA, 18 bp, Homo sapiens
gctctagagagagggaga

SEQ ID NO: 1230593 - DNA, 13 bp, Homo sapiens
gctctagccagga

SEQ ID NO: 1230594 - DNA, 16 bp, Homo sapiens
gctctagccaggagtc

SEQ ID NO: 1230595 - DNA, 20 bp, Homo sapiens
gctctagccaggagtctgtg

SEQ ID NO: 1230596 - DNA, 24 bp, Homo sapiens
gctctagccaggagtctgtgctct

SEQ ID NO: 1230597 - DNA, 15 bp, Homo sapiens
gctctagctggcagg

SEQ ID NO: 1230598 - DNA, 16 bp, Homo sapiens
gctctagctggcagga

SEQ ID NO: 1230599 - DNA, 15 bp, Homo sapiens
gctctagtgccttct

SEQ ID NO: 1230600 - DNA, 20 bp, Homo sapiens
gctctagtgggacagcccag

SEQ ID NO: 1230601 - DNA, 19 bp, Homo sapiens
gctctatcgcccaggctgg

SEQ ID NO: 1230602 - DNA, 16 bp, Homo sapiens
gctctatgcctgcact

SEQ ID NO: 1230603 - DNA, 22 bp, Homo sapiens
gctctatgcctgcactgggaag

SEQ ID NO: 1230604 - DNA, 17 bp, Homo sapiens
gctctatgtctgccttc

SEQ ID NO: 1230605 - DNA, 16 bp, Homo sapiens
gctctatgtttgtatt

SEQ ID NO: 1230606 - DNA, 22 bp, Homo sapiens
gctctattaagattggaaatgt

SEQ ID NO: 1230607 - DNA, 17 bp, Homo sapiens
gctctattgtagcattt

SEQ ID NO: 1230608 - DNA, 19 bp, Homo sapiens
gctctatttccccacccca

SEQ ID NO: 1230609 - DNA, 18 bp, Homo sapiens
gctctcaagttatcaggg

SEQ ID NO: 1230610 - DNA, 18 bp, Homo sapiens
gctctcacccccatccct

SEQ ID NO: 1230611 - DNA, 17 bp, Homo sapiens
gctctcacctggccctg

SEQ ID NO: 1230612 - DNA, 13 bp, Homo sapiens
gctctcagctttc

SEQ ID NO: 1230613 - DNA, 21 bp, Homo sapiens
gctctccaaaggggctgctgg

SEQ ID NO: 1230614 - DNA, 16 bp, Homo sapiens
gctctccaagtgccag

SEQ ID NO: 1230615 - DNA, 15 bp, Homo sapiens
gctctccacctcagc

SEQ ID NO: 1230616 - DNA, 11 bp, Homo sapiens
gctctccaggc

SEQ ID NO: 1230617 - DNA, 14 bp, Homo sapiens
gctctccaggccag

SEQ ID NO: 1230618 - DNA, 15 bp, Homo sapiens
gctctccaggccagg

SEQ ID NO: 1230619 - DNA, 16 bp, Homo sapiens
gctctccaggccaggt

SEQ ID NO: 1230620 - DNA, 21 bp, Homo sapiens
gctctcccacatcccactgga

SEQ ID NO: 1230621 - DNA, 11 bp, Homo sapiens
gctctcccacc

SEQ ID NO: 1230622 - DNA, 18 bp, Homo sapiens
gctctccccggcaggcct

SEQ ID NO: 1230623 - DNA, 16 bp, Homo sapiens
gctctcccctcctgct

SEQ ID NO: 1230624 - DNA, 18 bp, Homo sapiens
gctctcccctcctgctgg

SEQ ID NO: 1230625 - DNA, 19 bp, Homo sapiens
gctctcccctcctgctggg

SEQ ID NO: 1230626 - DNA, 20 bp, Homo sapiens
gctctcccctcctgctgggc

SEQ ID NO: 1230627 - DNA, 22 bp, Homo sapiens
gctctcccctctcgccccatcc

SEQ ID NO: 1230628 - DNA, 11 bp, Homo sapiens
gctctccctct

SEQ ID NO: 1230629 - DNA, 15 bp, Homo sapiens
gctctccctcttctc

SEQ ID NO: 1230630 - DNA, 19 bp, Homo sapiens
gctctcctcagaagaaaga

SEQ ID NO: 1230631 - DNA, 22 bp, Homo sapiens
gctctcctcgagccctccccca

SEQ ID NO: 1230632 - DNA, 22 bp, Homo sapiens
gctctcctcttgccactgcctc

SEQ ID NO: 1230633 - DNA, 18 bp, Homo sapiens
gctctcgaggaaagtggt

SEQ ID NO: 1230634 - DNA, 17 bp, Homo sapiens
gctctcgggactagctg

SEQ ID NO: 1230635 - DNA, 14 bp, Homo sapiens
gctctcgttctcct

SEQ ID NO: 1230636 - DNA, 19 bp, Homo sapiens
gctctcgttctccttcccc

SEQ ID NO: 1230637 - DNA, 16 bp, Homo sapiens
gctctctcacccagcc

SEQ ID NO: 1230638 - DNA, 13 bp, Homo sapiens
gctctctccagga

SEQ ID NO: 1230639 - DNA, 17 bp, Homo sapiens
gctctctctccctgcct

SEQ ID NO: 1230640 - DNA, 19 bp, Homo sapiens
gctctctctccctgccttt

SEQ ID NO: 1230641 - DNA, 19 bp, Homo sapiens
gctctctgacgcttgtgac

SEQ ID NO: 1230642 - DNA, 21 bp, Homo sapiens
gctgaaaactaatgtactgta

SEQ ID NO: 1230643 - DNA, 14 bp, Homo sapiens
gctgaaagaggagg

SEQ ID NO: 1230644 - DNA, 14 bp, Homo sapiens
gctgaaagccaagg

SEQ ID NO: 1230645 - DNA, 23 bp, Homo sapiens
gctgaaatatccacccagcaggc

SEQ ID NO: 1230646 - DNA, 19 bp, Homo sapiens
gctgaaattttagaaatat

SEQ ID NO: 1230647 - DNA, 14 bp, Homo sapiens
gctgaacatgcctg

SEQ ID NO: 1230648 - DNA, 17 bp, Homo sapiens
gctgaacatgcctgcca

SEQ ID NO: 1230649 - DNA, 22 bp, Homo sapiens
gctgaacccattttgagtgact

SEQ ID NO: 1230650 - DNA, 16 bp, Homo sapiens
gctgaaccctgtgctg

SEQ ID NO: 1230651 - DNA, 17 bp, Homo sapiens
gctgaaccctgtgctgg

SEQ ID NO: 1230652 - DNA, 15 bp, Homo sapiens
gctgaactcagcaca

SEQ ID NO: 1230653 - DNA, 19 bp, Homo sapiens
gctgaactcagcacattcg

SEQ ID NO: 1230654 - DNA, 15 bp, Homo sapiens
gctgaactccttgtt

SEQ ID NO: 1230655 - DNA, 19 bp, Homo sapiens
gctgaactcttcagaacac

SEQ ID NO: 1230656 - DNA, 16 bp, Homo sapiens
gctgaacttggagagg

SEQ ID NO: 1230657 - DNA, 17 bp, Homo sapiens
gctgaagagagggacag

SEQ ID NO: 1230658 - DNA, 16 bp, Homo sapiens
gctgaagctggagcag

SEQ ID NO: 1230659 - DNA, 22 bp, Homo sapiens
gctgaaggacagaacattgcct

SEQ ID NO: 1230660 - DNA, 22 bp, Homo sapiens
gctgaaggtccaggcttgcctc

SEQ ID NO: 1230661 - DNA, 18 bp, Homo sapiens
gctgaagtctctttttct

SEQ ID NO: 1230662 - DNA, 20 bp, Homo sapiens
gctgaagtctctttttcttc

SEQ ID NO: 1230663 - DNA, 20 bp, Homo sapiens
gctgaagtgcatccaaaggt

SEQ ID NO: 1230664 - DNA, 14 bp, Homo sapiens
gctgaagttggcca

SEQ ID NO: 1230665 - DNA, 22 bp, Homo sapiens
gctgaatacagaggcaactgca

SEQ ID NO: 1230666 - DNA, 23 bp, Homo sapiens
gctgaatacgctaagcctggaag

SEQ ID NO: 1230667 - DNA, 16 bp, Homo sapiens
gctgaatgaagctgcc

SEQ ID NO: 1230668 - DNA, 22 bp, Homo sapiens
gctgaatgccccctgcttactt

SEQ ID NO: 1230669 - DNA, 13 bp, Homo sapiens
gctgaatgcctcc

SEQ ID NO: 1230670 - DNA, 23 bp, Homo sapiens
gctgaatgttgggactgctaaat

SEQ ID NO: 1230671 - DNA, 14 bp, Homo sapiens
gctgaattatctat

SEQ ID NO: 1230672 - DNA, 13 bp, Homo sapiens
gctgaattccttt

SEQ ID NO: 1230673 - DNA, 21 bp, Homo sapiens
gctgaattcctttacaactaa

SEQ ID NO: 1230674 - DNA, 19 bp, Homo sapiens
gctgacaacttagctcagg

SEQ ID NO: 1230675 - DNA, 17 bp, Homo sapiens
gctgacacctaccatgc

SEQ ID NO: 1230676 - DNA, 19 bp, Homo sapiens
gctgacagcactaaacttg

SEQ ID NO: 1230677 - DNA, 15 bp, Homo sapiens
gctgacagctcttca

SEQ ID NO: 1230678 - DNA, 20 bp, Homo sapiens
gctgacaggtgatgctctgg

SEQ ID NO: 1230679 - DNA, 21 bp, Homo sapiens
gctgacaggtgatgctctggc

SEQ ID NO: 1230680 - DNA, 17 bp, Homo sapiens
gctgacattcacctgcc

SEQ ID NO: 1230681 - DNA, 23 bp, Homo sapiens
gctgaccaaatggccagttttct

SEQ ID NO: 1230682 - DNA, 14 bp, Homo sapiens
gctgaccaagagag

SEQ ID NO: 1230683 - DNA, 16 bp, Homo sapiens
gctgaccacagcacag

SEQ ID NO: 1230684 - DNA, 17 bp, Homo sapiens
gctgaccacagcacagc

SEQ ID NO: 1230685 - DNA, 22 bp, Homo sapiens
gctgaccagctggagtgagggc

SEQ ID NO: 1230686 - DNA, 13 bp, Homo sapiens
gctgacccaggaa

SEQ ID NO: 1230687 - DNA, 19 bp, Homo sapiens
gctgaccccaaagagcctg

SEQ ID NO: 1230688 - DNA, 22 bp, Homo sapiens
gctgaccccgagaagtgctctt

SEQ ID NO: 1230689 - DNA, 12 bp, Homo sapiens
gctgacccctct

SEQ ID NO: 1230690 - DNA, 15 bp, Homo sapiens
gctgacccctctggt

SEQ ID NO: 1230691 - DNA, 16 bp, Homo sapiens
gctgacctcaaccctg

SEQ ID NO: 1230692 - DNA, 18 bp, Homo sapiens
gctgacctcccagtgacc

SEQ ID NO: 1230693 - DNA, 13 bp, Homo sapiens
gctgacctgggcc

SEQ ID NO: 1230694 - DNA, 22 bp, Homo sapiens
gctgaccttggaggaatgacaa

SEQ ID NO: 1230695 - DNA, 19 bp, Homo sapiens
gctgacgggacccacatgc

SEQ ID NO: 1230696 - DNA, 17 bp, Homo sapiens
gctgacggtgcagtctg

SEQ ID NO: 1230697 - DNA, 15 bp, Homo sapiens
gctgacgtgtgaggg

SEQ ID NO: 1230698 - DNA, 17 bp, Homo sapiens
gctgactcacacctgaa

SEQ ID NO: 1230699 - DNA, 13 bp, Homo sapiens
gctgactggggct

SEQ ID NO: 1230700 - DNA, 19 bp, Homo sapiens
gctgactgtactcctccca

SEQ ID NO: 1230701 - DNA, 21 bp, Homo sapiens
gctgactgtactcctcccagg

SEQ ID NO: 1230702 - DNA, 22 bp, Homo sapiens
gctgactgttttctcttgagag

SEQ ID NO: 1230703 - DNA, 14 bp, Homo sapiens
gctgactgtttttt

SEQ ID NO: 1230704 - DNA, 20 bp, Homo sapiens
gctgagaaaagtattctcaa

SEQ ID NO: 1230705 - DNA, 14 bp, Homo sapiens
gctgagaagaatga

SEQ ID NO: 1230706 - DNA, 23 bp, Homo sapiens
gctgagaagaggaggaggtgggg

SEQ ID NO: 1230707 - DNA, 14 bp, Homo sapiens
gctgagaaggcagt

SEQ ID NO: 1230708 - DNA, 21 bp, Homo sapiens
gctgagacctgggatttgaga

SEQ ID NO: 1230709 - DNA, 9 bp, Homo sapiens
gctgagact

SEQ ID NO: 1230710 - DNA, 15 bp, Homo sapiens
gctgagactgtgctg

SEQ ID NO: 1230711 - DNA, 14 bp, Homo sapiens
gctgagagacccaa

SEQ ID NO: 1230712 - DNA, 20 bp, Homo sapiens
gctgagagacccaaggagga

SEQ ID NO: 1230713 - DNA, 15 bp, Homo sapiens
gctgagagccccagc

SEQ ID NO: 1230714 - DNA, 17 bp, Homo sapiens
gctgagagccccagctg

SEQ ID NO: 1230715 - DNA, 13 bp, Homo sapiens
gctgagagccctg

SEQ ID NO: 1230716 - DNA, 21 bp, Homo sapiens
gctgagagtctgaaagacaga

SEQ ID NO: 1230717 - DNA, 22 bp, Homo sapiens
gctgagagtctgaaagacagaa

SEQ ID NO: 1230718 - DNA, 22 bp, Homo sapiens
gctgagcacttagcaggcaccg

SEQ ID NO: 1230719 - DNA, 20 bp, Homo sapiens
gctgagcagcctctggacag

SEQ ID NO: 1230720 - DNA, 15 bp, Homo sapiens
gctgagcaggacagc

SEQ ID NO: 1230721 - DNA, 20 bp, Homo sapiens
gctgagcaggacagccagca

SEQ ID NO: 1230722 - DNA, 16 bp, Homo sapiens
gctgctggcttcaggg

SEQ ID NO: 1230723 - DNA, 12 bp, Homo sapiens
gctgctgggcta

SEQ ID NO: 1230724 - DNA, 15 bp, Homo sapiens
gctgctggggcatgt

SEQ ID NO: 1230725 - DNA, 17 bp, Homo sapiens
gctgctggggcatgtgt

SEQ ID NO: 1230726 - DNA, 22 bp, Homo sapiens
gctgctggggcatgtgtgcctg

SEQ ID NO: 1230727 - DNA, 20 bp, Homo sapiens
gctgctggggcctcagacga

SEQ ID NO: 1230728 - DNA, 21 bp, Homo sapiens
gctgctgggggcaactggcca

SEQ ID NO: 1230729 - DNA, 22 bp, Homo sapiens
gctgctgggggcaactggccat

SEQ ID NO: 1230730 - DNA, 17 bp, Homo sapiens
gctgctgtaactgctga

SEQ ID NO: 1230731 - DNA, 12 bp, Homo sapiens
gctgctgtcctt

SEQ ID NO: 1230732 - DNA, 14 bp, Homo sapiens
gctgctgtgaattt

SEQ ID NO: 1230733 - DNA, 18 bp, Homo sapiens
gctgctgtgatgccgtcc

SEQ ID NO: 1230734 - DNA, 20 bp, Homo sapiens
gctgctgtgatgccgtcctg

SEQ ID NO: 1230735 - DNA, 14 bp, Homo sapiens
gctgctgtgcccag

SEQ ID NO: 1230736 - DNA, 15 bp, Homo sapiens
gctgctgtgcccagc

SEQ ID NO: 1230737 - DNA, 14 bp, Homo sapiens
gctgctgtgcctgc

SEQ ID NO: 1230738 - DNA, 11 bp, Homo sapiens
gctgctgtgct

SEQ ID NO: 1230739 - DNA, 18 bp, Homo sapiens
gctgctgtgctctgggga

SEQ ID NO: 1230740 - DNA, 18 bp, Homo sapiens
gctgctgtgtgtgagcag

SEQ ID NO: 1230741 - DNA, 17 bp, Homo sapiens
gctgctgttctcaggac

SEQ ID NO: 1230742 - DNA, 21 bp, Homo sapiens
gctgctgttctcaggacagca

SEQ ID NO: 1230743 - DNA, 19 bp, Homo sapiens
gctgcttaggaaacctcac

SEQ ID NO: 1230744 - DNA, 13 bp, Homo sapiens
gctgcttccagga

SEQ ID NO: 1230745 - DNA, 14 bp, Homo sapiens
gctgcttcccagag

SEQ ID NO: 1230746 - DNA, 20 bp, Homo sapiens
gctgcttccctctgcctgtc

SEQ ID NO: 1230747 - DNA, 14 bp, Homo sapiens
gctgcttcctcctg

SEQ ID NO: 1230748 - DNA, 14 bp, Homo sapiens
gctgcttcctgtga

SEQ ID NO: 1230749 - DNA, 17 bp, Homo sapiens
gctgcttcctgtgacag

SEQ ID NO: 1230750 - DNA, 23 bp, Homo sapiens
gctgcttcctgtgacagtgaaat

SEQ ID NO: 1230751 - DNA, 13 bp, Homo sapiens
gctgcttctcccc

SEQ ID NO: 1230752 - DNA, 17 bp, Homo sapiens
gctgcttctgctccagc

SEQ ID NO: 1230753 - DNA, 15 bp, Homo sapiens
gctgcttctgctgcc

SEQ ID NO: 1230754 - DNA, 14 bp, Homo sapiens
gctgcttcttgctt

SEQ ID NO: 1230755 - DNA, 16 bp, Homo sapiens
gctgcttgacctagct

SEQ ID NO: 1230756 - DNA, 22 bp, Homo sapiens
gctgcttgagttgcctgatgct

SEQ ID NO: 1230757 - DNA, 15 bp, Homo sapiens
gctgcttgcagccag

SEQ ID NO: 1230758 - DNA, 14 bp, Homo sapiens
gctgcttgtcctgc

SEQ ID NO: 1230759 - DNA, 18 bp, Homo sapiens
gctgcttgtcctgctctc

SEQ ID NO: 1230760 - DNA, 18 bp, Homo sapiens
gctgcttgtgcctccctt

SEQ ID NO: 1230761 - DNA, 14 bp, Homo sapiens
gctgcttgtgggcc

SEQ ID NO: 1230762 - DNA, 13 bp, Homo sapiens
gctgctttcttct

SEQ ID NO: 1230763 - DNA, 15 bp, Homo sapiens
gctgctttgtgggct

SEQ ID NO: 1230764 - DNA, 15 bp, Homo sapiens
gctgcttttcttaag

SEQ ID NO: 1230765 - DNA, 18 bp, Homo sapiens
gctgctttttggcacagt

SEQ ID NO: 1230766 - DNA, 22 bp, Homo sapiens
gctggaaaagggtcttgggaaa

SEQ ID NO: 1230767 - DNA, 18 bp, Homo sapiens
gctggaaaccaagtcagg

SEQ ID NO: 1230768 - DNA, 20 bp, Homo sapiens
gctggaaaccaagtcaggcc

SEQ ID NO: 1230769 - DNA, 22 bp, Homo sapiens
gctggaaccagttacgactgaa

SEQ ID NO: 1230770 - DNA, 18 bp, Homo sapiens
gctggaagaacatcaaga

SEQ ID NO: 1230771 - DNA, 18 bp, Homo sapiens
gctggaagatcctgcggg

SEQ ID NO: 1230772 - DNA, 13 bp, Homo sapiens
gctggaagctgtc

SEQ ID NO: 1230773 - DNA, 17 bp, Homo sapiens
gctggaaggcagggcag

SEQ ID NO: 1230774 - DNA, 17 bp, Homo sapiens
gctggaagggaggaagg

SEQ ID NO: 1230775 - DNA, 22 bp, Homo sapiens
gctggaagggaggaaggccttt

SEQ ID NO: 1230776 - DNA, 15 bp, Homo sapiens
gctggaatgagggag

SEQ ID NO: 1230777 - DNA, 14 bp, Homo sapiens
gctggaatgctggg

SEQ ID NO: 1230778 - DNA, 16 bp, Homo sapiens
gctggaattaaaacaa

SEQ ID NO: 1230779 - DNA, 13 bp, Homo sapiens
gctggacagaggg

SEQ ID NO: 1230780 - DNA, 14 bp, Homo sapiens
gctggacagagggg

SEQ ID NO: 1230781 - DNA, 21 bp, Homo sapiens
gctggacagaggggactctgg

SEQ ID NO: 1230782 - DNA, 13 bp, Homo sapiens
gctggacagcggc

SEQ ID NO: 1230783 - DNA, 21 bp, Homo sapiens
gctggacatactgctggagtc

SEQ ID NO: 1230784 - DNA, 19 bp, Homo sapiens
gctggacatgagatggaga

SEQ ID NO: 1230785 - DNA, 18 bp, Homo sapiens
gctggaccagctggcctg

SEQ ID NO: 1230786 - DNA, 18 bp, Homo sapiens
gctggaccctgcttcacc

SEQ ID NO: 1230787 - DNA, 23 bp, Homo sapiens
gctggacctatgtcctaaggaca

SEQ ID NO: 1230788 - DNA, 21 bp, Homo sapiens
gctggacggggactggggatg

SEQ ID NO: 1230789 - DNA, 14 bp, Homo sapiens
gctggactacccac

SEQ ID NO: 1230790 - DNA, 16 bp, Homo sapiens
gctggactctgcatcc

SEQ ID NO: 1230791 - DNA, 20 bp, Homo sapiens
gctggactggaggcccctgg

SEQ ID NO: 1230792 - DNA, 16 bp, Homo sapiens
gctggactggaggtgg

SEQ ID NO: 1230793 - DNA, 18 bp, Homo sapiens
gctggactgttccaggcc

SEQ ID NO: 1230794 - DNA, 19 bp, Homo sapiens
gctggactgttccaggccc

SEQ ID NO: 1230795 - DNA, 21 bp, Homo sapiens
gctggactgttccaggccctc

SEQ ID NO: 1230796 - DNA, 22 bp, Homo sapiens
gctggacttctacctgccctca

SEQ ID NO: 1230797 - DNA, 21 bp, Homo sapiens
gctggactttaaaaaaacaat

SEQ ID NO: 1230798 - DNA, 16 bp, Homo sapiens
gctggagaagctcacc

SEQ ID NO: 1230799 - DNA, 22 bp, Homo sapiens
gctggagataacagcctcttgc

SEQ ID NO: 1230800 - DNA, 23 bp, Homo sapiens
gctggagataacagcctcttgcc

SEQ ID NO: 1230801 - DNA, 16 bp, Homo sapiens
gctggagcccacagcg

SEQ ID NO: 1230802 - DNA, 21 bp, Homo sapiens
gctggagcctagaacaggcct

SEQ ID NO: 1230803 - DNA, 12 bp, Homo sapiens
gctggagcctgg

SEQ ID NO: 1230804 - DNA, 15 bp, Homo sapiens
gctggagctcttgga

SEQ ID NO: 1230805 - DNA, 22 bp, Homo sapiens
gctggaggagcagcagcttggg

SEQ ID NO: 1230806 - DNA, 22 bp, Homo sapiens
gctggaggaggggaagctgggc

SEQ ID NO: 1230807 - DNA, 13 bp, Homo sapiens
gctggaggcaggg

SEQ ID NO: 1230808 - DNA, 16 bp, Homo sapiens
gctggaggcagggcct

SEQ ID NO: 1230809 - DNA, 21 bp, Homo sapiens
gctggaggcagggccttgccc

SEQ ID NO: 1230810 - DNA, 14 bp, Homo sapiens
gctggaggcccagg

SEQ ID NO: 1230811 - DNA, 15 bp, Homo sapiens
gctggaggcccaggc

SEQ ID NO: 1230812 - DNA, 14 bp, Homo sapiens
gctggaggcctcag

SEQ ID NO: 1230813 - DNA, 19 bp, Homo sapiens
gctggaggcctcaggtgct

SEQ ID NO: 1230814 - DNA, 13 bp, Homo sapiens
gctggaggggctg

SEQ ID NO: 1230815 - DNA, 14 bp, Homo sapiens
gctggaggggctgt

SEQ ID NO: 1230816 - DNA, 14 bp, Homo sapiens
gctggagtccagtg

SEQ ID NO: 1230817 - DNA, 15 bp, Homo sapiens
gctggagtgcagtgg

SEQ ID NO: 1230818 - DNA, 20 bp, Homo sapiens
gctggagtgcagtggcacaa

SEQ ID NO: 1230819 - DNA, 19 bp, Homo sapiens
gctggagtgcagtggtgca

SEQ ID NO: 1230820 - DNA, 17 bp, Homo sapiens
gctggagtgctgcttgt

SEQ ID NO: 1230821 - DNA, 15 bp, Homo sapiens
gctggagtgtgaggg

SEQ ID NO: 1230822 - DNA, 19 bp, Homo sapiens
gctggagttccggcctggg

SEQ ID NO: 1230823 - DNA, 15 bp, Homo sapiens
gctggatactggaca

SEQ ID NO: 1230824 - DNA, 16 bp, Homo sapiens
gctggatagacttggg

SEQ ID NO: 1230825 - DNA, 19 bp, Homo sapiens
gctggatagacttgggatg

SEQ ID NO: 1230826 - DNA, 18 bp, Homo sapiens
gctggatataatgtattt

SEQ ID NO: 1230827 - DNA, 18 bp, Homo sapiens
gctgtcctcaggtggcca

SEQ ID NO: 1230828 - DNA, 19 bp, Homo sapiens
gctgtcctcaggtggccat

SEQ ID NO: 1230829 - DNA, 21 bp, Homo sapiens
gctgtcctcaggtggccatgc

SEQ ID NO: 1230830 - DNA, 15 bp, Homo sapiens
gctgtcctccttcct

SEQ ID NO: 1230831 - DNA, 17 bp, Homo sapiens
gctgtcctccttcctgg

SEQ ID NO: 1230832 - DNA, 20 bp, Homo sapiens
gctgtcctccttcctgggac

SEQ ID NO: 1230833 - DNA, 21 bp, Homo sapiens
gctgtcctccttcctgggacc

SEQ ID NO: 1230834 - DNA, 19 bp, Homo sapiens
gctgtcctctcccccttca

SEQ ID NO: 1230835 - DNA, 19 bp, Homo sapiens
gctgtcctctcgagcccag

SEQ ID NO: 1230836 - DNA, 23 bp, Homo sapiens
gctgtcctgcgttcagcccctga

SEQ ID NO: 1230837 - DNA, 21 bp, Homo sapiens
gctgtccttccccttccccgt

SEQ ID NO: 1230838 - DNA, 19 bp, Homo sapiens
gctgtcgccccaggccctc

SEQ ID NO: 1230839 - DNA, 21 bp, Homo sapiens
gctgtcgccccaggccctccc

SEQ ID NO: 1230840 - DNA, 14 bp, Homo sapiens
gctgtcgtctgact

SEQ ID NO: 1230841 - DNA, 19 bp, Homo sapiens
gctgtctagaatgtggatt

SEQ ID NO: 1230842 - DNA, 14 bp, Homo sapiens
gctgtctccagacc

SEQ ID NO: 1230843 - DNA, 22 bp, Homo sapiens
gctgtctccagacccccacccc

SEQ ID NO: 1230844 - DNA, 14 bp, Homo sapiens
gctgtctctctggg

SEQ ID NO: 1230845 - DNA, 13 bp, Homo sapiens
gctgtctctgctc

SEQ ID NO: 1230846 - DNA, 13 bp, Homo sapiens
gctgtctgccagg

SEQ ID NO: 1230847 - DNA, 15 bp, Homo sapiens
gctgtctgccaggca

SEQ ID NO: 1230848 - DNA, 16 bp, Homo sapiens
gctgtctgccaggcac

SEQ ID NO: 1230849 - DNA, 13 bp, Homo sapiens
gctgtctgcctgt

SEQ ID NO: 1230850 - DNA, 13 bp, Homo sapiens
gctgtctggccag

SEQ ID NO: 1230851 - DNA, 19 bp, Homo sapiens
gctgtctgggtgtccgcca

SEQ ID NO: 1230852 - DNA, 23 bp, Homo sapiens
gctgtctgggtgtccgccatcca

SEQ ID NO: 1230853 - DNA, 21 bp, Homo sapiens
gctgtctggtgaggtggccca

SEQ ID NO: 1230854 - DNA, 22 bp, Homo sapiens
gctgtctggtgaggtggcccag

SEQ ID NO: 1230855 - DNA, 21 bp, Homo sapiens
gctgtcttaaactaaatgtgc

SEQ ID NO: 1230856 - DNA, 13 bp, Homo sapiens
gctgtcttcccct

SEQ ID NO: 1230857 - DNA, 13 bp, Homo sapiens
gctgtcttctgga

SEQ ID NO: 1230858 - DNA, 23 bp, Homo sapiens
gctgtcttctggacaggctctgc

SEQ ID NO: 1230859 - DNA, 19 bp, Homo sapiens
gctgtcttgatgactgctg

SEQ ID NO: 1230860 - DNA, 15 bp, Homo sapiens
gctgtcttgccccag

SEQ ID NO: 1230861 - DNA, 12 bp, Homo sapiens
gctgtctttgca

SEQ ID NO: 1230862 - DNA, 16 bp, Homo sapiens
gctgtctttgcagggc

SEQ ID NO: 1230863 - DNA, 22 bp, Homo sapiens
gctgtctttgtggactgtgggt

SEQ ID NO: 1230864 - DNA, 13 bp, Homo sapiens
gctgtgaaccctg

SEQ ID NO: 1230865 - DNA, 19 bp, Homo sapiens
gctgtgaagacccaggaga

SEQ ID NO: 1230866 - DNA, 17 bp, Homo sapiens
gctgtgacaaccctggc

SEQ ID NO: 1230867 - DNA, 19 bp, Homo sapiens
gctgtgacaaccctggcct

SEQ ID NO: 1230868 - DNA, 21 bp, Homo sapiens
gctgtgacaaccctggcctca

SEQ ID NO: 1230869 - DNA, 22 bp, Homo sapiens
gctgtgaccatttataatgtta

SEQ ID NO: 1230870 - DNA, 16 bp, Homo sapiens
gctgtgactctgggca

SEQ ID NO: 1230871 - DNA, 16 bp, Homo sapiens
gctgtgacttctccag

SEQ ID NO: 1230872 - DNA, 17 bp, Homo sapiens
gctgtgacttctccagg

SEQ ID NO: 1230873 - DNA, 15 bp, Homo sapiens
gctgtgagacagtgg

SEQ ID NO: 1230874 - DNA, 20 bp, Homo sapiens
gctgtgagacagtgggaaat

SEQ ID NO: 1230875 - DNA, 20 bp, Homo sapiens
gctgtgagccatgcctccct

SEQ ID NO: 1230876 - DNA, 21 bp, Homo sapiens
gctgtgagccatgcctccctg

SEQ ID NO: 1230877 - DNA, 12 bp, Homo sapiens
gctgtgagcccc

SEQ ID NO: 1230878 - DNA, 16 bp, Homo sapiens
gctgtgagcccctggt

SEQ ID NO: 1230879 - DNA, 11 bp, Homo sapiens
gctgtgaggaa

SEQ ID NO: 1230880 - DNA, 18 bp, Homo sapiens
gctgtgaggaatgctctg

SEQ ID NO: 1230881 - DNA, 21 bp, Homo sapiens
gctgtgaggaatgctctgtgc

SEQ ID NO: 1230882 - DNA, 13 bp, Homo sapiens
gctgtgaggctgt

SEQ ID NO: 1230883 - DNA, 18 bp, Homo sapiens
gctgtgaggctgtcctgt

SEQ ID NO: 1230884 - DNA, 15 bp, Homo sapiens
gctgtgatgctgtgt

SEQ ID NO: 1230885 - DNA, 16 bp, Homo sapiens
gctgtgcagctctcta

SEQ ID NO: 1230886 - DNA, 17 bp, Homo sapiens
gctgtgcccagcaggcc

SEQ ID NO: 1230887 - DNA, 18 bp, Homo sapiens
gctgtgcccagcaggccc

SEQ ID NO: 1230888 - DNA, 20 bp, Homo sapiens
gctgtgcccagcaggcccag

SEQ ID NO: 1230889 - DNA, 21 bp, Homo sapiens
gctgtgcccagcaggcccagc

SEQ ID NO: 1230890 - DNA, 23 bp, Homo sapiens
gctgtgcccagcaggcccagcat

SEQ ID NO: 1230891 - DNA, 12 bp, Homo sapiens
gctgtgcctctg

SEQ ID NO: 1230892 - DNA, 14 bp, Homo sapiens
gctgtgcctctgcc

SEQ ID NO: 1230893 - DNA, 16 bp, Homo sapiens
gctgtgcctctgcctg

SEQ ID NO: 1230894 - DNA, 12 bp, Homo sapiens
gctgtgcctgct

SEQ ID NO: 1230895 - DNA, 14 bp, Homo sapiens
gctgtgcctgctag

SEQ ID NO: 1230896 - DNA, 15 bp, Homo sapiens
gctgtgcctgctaga

SEQ ID NO: 1230897 - DNA, 17 bp, Homo sapiens
gctgtgcctgctagagc

SEQ ID NO: 1230898 - DNA, 22 bp, Homo sapiens
gctgtgcctgctagagcaaccc

SEQ ID NO: 1230899 - DNA, 22 bp, Homo sapiens
gctgtgcctgctcagcagccag

SEQ ID NO: 1230900 - DNA, 16 bp, Homo sapiens
gctgtgcgcccagggc

SEQ ID NO: 1230901 - DNA, 14 bp, Homo sapiens
gctgtgcggcctca

SEQ ID NO: 1230902 - DNA, 18 bp, Homo sapiens
gctgtgctccatatttga

SEQ ID NO: 1230903 - DNA, 14 bp, Homo sapiens
gctgtgctgggagg

SEQ ID NO: 1230904 - DNA, 19 bp, Homo sapiens
gctgtgcttgaaggccctg

SEQ ID NO: 1230905 - DNA, 23 bp, Homo sapiens
gctgtgcttgaaggccctgctga

SEQ ID NO: 1230906 - DNA, 20 bp, Homo sapiens
gctgtggagcaaaaggcagc

SEQ ID NO: 1230907 - DNA, 12 bp, Homo sapiens
gctgtggcacag

SEQ ID NO: 1230908 - DNA, 12 bp, Homo sapiens
gctgtggcagcc

SEQ ID NO: 1230909 - DNA, 20 bp, Homo sapiens
gctgtggcagccgtcccagg

SEQ ID NO: 1230910 - DNA, 21 bp, Homo sapiens
gctgtggccaggcctgcagac

SEQ ID NO: 1230911 - DNA, 14 bp, Homo sapiens
gctgtggccagggt

SEQ ID NO: 1230912 - DNA, 17 bp, Homo sapiens
gctgtggccagggtgag

SEQ ID NO: 1230913 - DNA, 12 bp, Homo sapiens
gctgtggccctg

SEQ ID NO: 1230914 - DNA, 16 bp, Homo sapiens
gctgtggccctggagg

SEQ ID NO: 1230915 - DNA, 13 bp, Homo sapiens
gctgtggctggtg

SEQ ID NO: 1230916 - DNA, 21 bp, Homo sapiens
gctgtgggcaggcaagccctt

SEQ ID NO: 1230917 - DNA, 16 bp, Homo sapiens
gctgtgggtgcagctg

SEQ ID NO: 1230918 - DNA, 16 bp, Homo sapiens
gctgtgggtgtgggtg

SEQ ID NO: 1230919 - DNA, 22 bp, Homo sapiens
gctgtggtacaaatgtgataat

SEQ ID NO: 1230920 - DNA, 15 bp, Homo sapiens
gctgtggtcagcaga

SEQ ID NO: 1230921 - DNA, 16 bp, Homo sapiens
gctgtgtaagatttgt

SEQ ID NO: 1230922 - DNA, 14 bp, Homo sapiens
gctgtgtccttgca

SEQ ID NO: 1230923 - DNA, 21 bp, Homo sapiens
gctgtgtccttgcacctgcat

SEQ ID NO: 1230924 - DNA, 14 bp, Homo sapiens
gctgtgtctaaact

SEQ ID NO: 1230925 - DNA, 13 bp, Homo sapiens
gctgtgtctgcca

SEQ ID NO: 1230926 - DNA, 20 bp, Homo sapiens
gctgtgtgcccaagtgggca

SEQ ID NO: 1230927 - DNA, 15 bp, Homo sapiens
gctgtgtgcctgggg

SEQ ID NO: 1230928 - DNA, 11 bp, Homo sapiens
gctgtgtggcc

SEQ ID NO: 1230929 - DNA, 15 bp, Homo sapiens
gctgtgtggccaacc

SEQ ID NO: 1230930 - DNA, 16 bp, Homo sapiens
gctgtgtggccaacca

SEQ ID NO: 1230931 - DNA, 22 bp, Homo sapiens
gctgtgtggccaaccaggaccc

SEQ ID NO: 1230932 - DNA, 23 bp, Homo sapiens
gctgtgtggccaaccaggaccca

SEQ ID NO: 1230933 - DNA, 13 bp, Homo sapiens
gctgtgtgtgagc

SEQ ID NO: 1230934 - DNA, 18 bp, Homo sapiens
gctgtgtgttagttccca

SEQ ID NO: 1230935 - DNA, 22 bp, Homo sapiens
gctgtgtttatatggaagaaag

SEQ ID NO: 1230936 - DNA, 19 bp, Homo sapiens
gctgtgtttgcagcctgct

SEQ ID NO: 1230937 - DNA, 13 bp, Homo sapiens
gctgttaaactgt

SEQ ID NO: 1230938 - DNA, 15 bp, Homo sapiens
gctgttaaactgtta

SEQ ID NO: 1230939 - DNA, 22 bp, Homo sapiens
gctgttaaactgttagcactgt

SEQ ID NO: 1230940 - DNA, 15 bp, Homo sapiens
gctgttaaatacagg

SEQ ID NO: 1230941 - DNA, 22 bp, Homo sapiens
gctgttactgcttctctttgtg

SEQ ID NO: 1230942 - DNA, 23 bp, Homo sapiens
gctgttaggggttattggtgtaa

SEQ ID NO: 1230943 - DNA, 15 bp, Homo sapiens
gctgttattatgaag

SEQ ID NO: 1230944 - DNA, 20 bp, Homo sapiens
gctgttcacccacagggcta

SEQ ID NO: 1230945 - DNA, 22 bp, Homo sapiens
gctgttcacccacagggctaag

SEQ ID NO: 1230946 - DNA, 14 bp, Homo sapiens
gctgttcatgctcc

SEQ ID NO: 1230947 - DNA, 12 bp, Homo sapiens
gctgttccagac

SEQ ID NO: 1230948 - DNA, 21 bp, Homo sapiens
gctgttccagactcaggttcc

SEQ ID NO: 1230949 - DNA, 12 bp, Homo sapiens
gctgttcccttt

SEQ ID NO: 1230950 - DNA, 12 bp, Homo sapiens
gctgttcctgtg

SEQ ID NO: 1230951 - DNA, 20 bp, Homo sapiens
gctgttcctgtgttcttcgt

SEQ ID NO: 1230952 - DNA, 18 bp, Homo sapiens
gcttaggtgccaggctgt

SEQ ID NO: 1230953 - DNA, 17 bp, Homo sapiens
gcttagtatttctcagg

SEQ ID NO: 1230954 - DNA, 17 bp, Homo sapiens
gcttagtcactgcctgc

SEQ ID NO: 1230955 - DNA, 12 bp, Homo sapiens
gcttagtttgtg

SEQ ID NO: 1230956 - DNA, 20 bp, Homo sapiens
gcttagtttgtgtgttgtct

SEQ ID NO: 1230957 - DNA, 13 bp, Homo sapiens
gcttataaacaca

SEQ ID NO: 1230958 - DNA, 18 bp, Homo sapiens
gcttataagttaaaacaa

SEQ ID NO: 1230959 - DNA, 18 bp, Homo sapiens
gcttatacgaaataattg

SEQ ID NO: 1230960 - DNA, 22 bp, Homo sapiens
gcttatacgaaataattgttgt

SEQ ID NO: 1230961 - DNA, 23 bp, Homo sapiens
gcttatacgaaataattgttgtt

SEQ ID NO: 1230962 - DNA, 20 bp, Homo sapiens
gcttatatctggcctctgct

SEQ ID NO: 1230963 - DNA, 14 bp, Homo sapiens
gcttatcctgctag

SEQ ID NO: 1230964 - DNA, 22 bp, Homo sapiens
gcttatctcttttatatttgta

SEQ ID NO: 1230965 - DNA, 16 bp, Homo sapiens
gcttatctttctttcc

SEQ ID NO: 1230966 - DNA, 21 bp, Homo sapiens
gcttatctttgcacatgttaa

SEQ ID NO: 1230967 - DNA, 18 bp, Homo sapiens
gcttatgacatcacttgt

SEQ ID NO: 1230968 - DNA, 19 bp, Homo sapiens
gcttatgagatctaatgtg

SEQ ID NO: 1230969 - DNA, 15 bp, Homo sapiens
gcttatgcttgtgta

SEQ ID NO: 1230970 - DNA, 16 bp, Homo sapiens
gcttatgttaaactct

SEQ ID NO: 1230971 - DNA, 15 bp, Homo sapiens
gcttattacatttta

SEQ ID NO: 1230972 - DNA, 16 bp, Homo sapiens
gcttattctcaaagca

SEQ ID NO: 1230973 - DNA, 11 bp, Homo sapiens
gcttatttgga

SEQ ID NO: 1230974 - DNA, 15 bp, Homo sapiens
gcttatttttatgtg

SEQ ID NO: 1230975 - DNA, 21 bp, Homo sapiens
gcttctgcaccctccaccctg

SEQ ID NO: 1230976 - DNA, 20 bp, Homo sapiens
gcttctgcgtccaccaggcc

SEQ ID NO: 1230977 - DNA, 14 bp, Homo sapiens
gcttctgctccagc

SEQ ID NO: 1230978 - DNA, 16 bp, Homo sapiens
gcttctgctccagccc

SEQ ID NO: 1230979 - DNA, 16 bp, Homo sapiens
gcttctgctgcctagg

SEQ ID NO: 1230980 - DNA, 14 bp, Homo sapiens
gcttctgctggagg

SEQ ID NO: 1230981 - DNA, 14 bp, Homo sapiens
gcttctgcttttct

SEQ ID NO: 1230982 - DNA, 15 bp, Homo sapiens
gcttctgcttttctg

SEQ ID NO: 1230983 - DNA, 23 bp, Homo sapiens
gcttctgcttttctgccctggct

SEQ ID NO: 1230984 - DNA, 15 bp, Homo sapiens
gcttctggctcccat

SEQ ID NO: 1230985 - DNA, 16 bp, Homo sapiens
gcttctggtactctcc

SEQ ID NO: 1230986 - DNA, 17 bp, Homo sapiens
gcttctggtactctcct

SEQ ID NO: 1230987 - DNA, 18 bp, Homo sapiens
gcttctggtactctccta

SEQ ID NO: 1230988 - DNA, 14 bp, Homo sapiens
gcttctgtaccaca

SEQ ID NO: 1230989 - DNA, 17 bp, Homo sapiens
gcttctgtaccacacta

SEQ ID NO: 1230990 - DNA, 18 bp, Homo sapiens
gcttctgtgcactagcct

SEQ ID NO: 1230991 - DNA, 15 bp, Homo sapiens
gcttctgtgtaccac

SEQ ID NO: 1230992 - DNA, 11 bp, Homo sapiens
gcttctgttct

SEQ ID NO: 1230993 - DNA, 16 bp, Homo sapiens
gcttctgttctctgct

SEQ ID NO: 1230994 - DNA, 18 bp, Homo sapiens
gcttctgttctctgctga

SEQ ID NO: 1230995 - DNA, 17 bp, Homo sapiens
gcttctgttggcagagc

SEQ ID NO: 1230996 - DNA, 13 bp, Homo sapiens
gcttcttaaaaac

SEQ ID NO: 1230997 - DNA, 15 bp, Homo sapiens
gcttcttaaaaactg

SEQ ID NO: 1230998 - DNA, 24 bp, Homo sapiens
gcttcttaaaaactgtgtatcatt

SEQ ID NO: 1230999 - DNA, 16 bp, Homo sapiens
gcttcttcagatcagt

SEQ ID NO: 1231000 - DNA, 13 bp, Homo sapiens
gcttcttcatctt

SEQ ID NO: 1231001 - DNA, 14 bp, Homo sapiens
gcttcttcccctct

SEQ ID NO: 1231002 - DNA, 22 bp, Homo sapiens
gcttcttcctaggtccaagccc

SEQ ID NO: 1231003 - DNA, 20 bp, Homo sapiens
gcttcttcctcacactgctg

SEQ ID NO: 1231004 - DNA, 16 bp, Homo sapiens
gcttcttccttcttgt

SEQ ID NO: 1231005 - DNA, 22 bp, Homo sapiens
gcttcttcgttaatagattatt

SEQ ID NO: 1231006 - DNA, 20 bp, Homo sapiens
gcttcttctcctatgtgtaa

SEQ ID NO: 1231007 - DNA, 14 bp, Homo sapiens
gcttcttctgcccc

SEQ ID NO: 1231008 - DNA, 16 bp, Homo sapiens
gcttcttcttccaaat

SEQ ID NO: 1231009 - DNA, 15 bp, Homo sapiens
gcttcttgcctctgt

SEQ ID NO: 1231010 - DNA, 19 bp, Homo sapiens
gcttcttgcctctgtgctg

SEQ ID NO: 1231011 - DNA, 20 bp, Homo sapiens
gcttcttggagctttggaat

SEQ ID NO: 1231012 - DNA, 23 bp, Homo sapiens
gcttcttttgccaactgaagcct

SEQ ID NO: 1231013 - DNA, 19 bp, Homo sapiens
gcttgaacctgggaggcag

SEQ ID NO: 1231014 - DNA, 20 bp, Homo sapiens
gcttgaacctgggaggcaga

SEQ ID NO: 1231015 - DNA, 22 bp, Homo sapiens
gcttgaacttagatgttaaatg

SEQ ID NO: 1231016 - DNA, 21 bp, Homo sapiens
gcttgaagatcgttagtatct

SEQ ID NO: 1231017 - DNA, 15 bp, Homo sapiens
gcttgaagccaaaga

SEQ ID NO: 1231018 - DNA, 16 bp, Homo sapiens
gcttgaaggccctgct

SEQ ID NO: 1231019 - DNA, 18 bp, Homo sapiens
gcttgaaggccctgctga

SEQ ID NO: 1231020 - DNA, 13 bp, Homo sapiens
gcttgaatgtgag

SEQ ID NO: 1231021 - DNA, 13 bp, Homo sapiens
gcttgacatacct

SEQ ID NO: 1231022 - DNA, 14 bp, Homo sapiens
gcttgacataccta

SEQ ID NO: 1231023 - DNA, 18 bp, Homo sapiens
gcttgaccgtactctcac

SEQ ID NO: 1231024 - DNA, 14 bp, Homo sapiens
gcttgacctgaggc

SEQ ID NO: 1231025 - DNA, 16 bp, Homo sapiens
gcttgactcaggattt

SEQ ID NO: 1231026 - DNA, 17 bp, Homo sapiens
gcttgactcccaagttt

SEQ ID NO: 1231027 - DNA, 21 bp, Homo sapiens
gcttgagacaaatcctttctg

SEQ ID NO: 1231028 - DNA, 21 bp, Homo sapiens
gcttgagagccctgaggccta

SEQ ID NO: 1231029 - DNA, 14 bp, Homo sapiens
gcttgagcccagga

SEQ ID NO: 1231030 - DNA, 18 bp, Homo sapiens
gcttgagcctggctgtcc

SEQ ID NO: 1231031 - DNA, 14 bp, Homo sapiens
gcttgagctagaga

SEQ ID NO: 1231032 - DNA, 23 bp, Homo sapiens
gcttgagctagagataaaacaga

SEQ ID NO: 1231033 - DNA, 14 bp, Homo sapiens
gcttgatccagaag

SEQ ID NO: 1231034 - DNA, 15 bp, Homo sapiens
gcttgatccagaaga

SEQ ID NO: 1231035 - DNA, 19 bp, Homo sapiens
gcttgatctgtgatttctt

SEQ ID NO: 1231036 - DNA, 14 bp, Homo sapiens
gcttgatgaagcaa

SEQ ID NO: 1231037 - DNA, 13 bp, Homo sapiens
gcttgattaaatc

SEQ ID NO: 1231038 - DNA, 23 bp, Homo sapiens
gcttgcaagtatgttttagcatg

SEQ ID NO: 1231039 - DNA, 17 bp, Homo sapiens
gcttgcacacttcccca

SEQ ID NO: 1231040 - DNA, 18 bp, Homo sapiens
gcttgcagccaggagaag

SEQ ID NO: 1231041 - DNA, 22 bp, Homo sapiens
gcttgcagccaggagaaggtca

SEQ ID NO: 1231042 - DNA, 23 bp, Homo sapiens
gcttgcataataagctaaagagg

SEQ ID NO: 1231043 - DNA, 15 bp, Homo sapiens
gcttgcatcctattt

SEQ ID NO: 1231044 - DNA, 19 bp, Homo sapiens
gcttgcatcctatttggtg

SEQ ID NO: 1231045 - DNA, 21 bp, Homo sapiens
gcttgccaaagtacagaattt

SEQ ID NO: 1231046 - DNA, 21 bp, Homo sapiens
gcttgccacactcttcttcaa

SEQ ID NO: 1231047 - DNA, 13 bp, Homo sapiens
gcttgcccagggt

SEQ ID NO: 1231048 - DNA, 22 bp, Homo sapiens
gcttgcccagtacatttaaatt

SEQ ID NO: 1231049 - DNA, 22 bp, Homo sapiens
gcttgccccactctgcctgcct

SEQ ID NO: 1231050 - DNA, 21 bp, Homo sapiens
gcttgccccaggactctggca

SEQ ID NO: 1231051 - DNA, 23 bp, Homo sapiens
gcttgccccaggactctggcact

SEQ ID NO: 1231052 - DNA, 12 bp, Homo sapiens
gcttgccccggc

SEQ ID NO: 1231053 - DNA, 16 bp, Homo sapiens
gcttgcccgctcccac

SEQ ID NO: 1231054 - DNA, 17 bp, Homo sapiens
gcttgcccgctcccaca

SEQ ID NO: 1231055 - DNA, 14 bp, Homo sapiens
gcttgcctgggctg

SEQ ID NO: 1231056 - DNA, 23 bp, Homo sapiens
gcttgcctgggctgggcagcctt

SEQ ID NO: 1231057 - DNA, 23 bp, Homo sapiens
gcttgcgccgagaccgcagaggg

SEQ ID NO: 1231058 - DNA, 18 bp, Homo sapiens
gcttgcggcaaaaggaaa

SEQ ID NO: 1231059 - DNA, 19 bp, Homo sapiens
gcttgcgtagaattgcagg

SEQ ID NO: 1231060 - DNA, 14 bp, Homo sapiens
gcttgctcattttt

SEQ ID NO: 1231061 - DNA, 14 bp, Homo sapiens
gcttgctgaggggc

SEQ ID NO: 1231062 - DNA, 19 bp, Homo sapiens
gcttgcttagagtgcccag

SEQ ID NO: 1231063 - DNA, 22 bp, Homo sapiens
gcttgcttagagtgcccagcag

SEQ ID NO: 1231064 - DNA, 14 bp, Homo sapiens
gcttgcttggggaa

SEQ ID NO: 1231065 - DNA, 12 bp, Homo sapiens
gcttgcttttct

SEQ ID NO: 1231066 - DNA, 15 bp, Homo sapiens
gcttgcttttgcctc

SEQ ID NO: 1231067 - DNA, 12 bp, Homo sapiens
gcttggaagcca

SEQ ID NO: 1231068 - DNA, 16 bp, Homo sapiens
gcttggaccagatcta

SEQ ID NO: 1231069 - DNA, 16 bp, Homo sapiens
gcttggacttcctggg

SEQ ID NO: 1231070 - DNA, 10 bp, Homo sapiens
ggaagccagg

SEQ ID NO: 1231071 - DNA, 12 bp, Homo sapiens
ggaagccaggta

SEQ ID NO: 1231072 - DNA, 15 bp, Homo sapiens
ggaagccaggtacag

SEQ ID NO: 1231073 - DNA, 18 bp, Homo sapiens
ggaagccagtcaccttct

SEQ ID NO: 1231074 - DNA, 20 bp, Homo sapiens
ggaagccatattcacacctc

SEQ ID NO: 1231075 - DNA, 20 bp, Homo sapiens
ggaagccatcccttttttta

SEQ ID NO: 1231076 - DNA, 17 bp, Homo sapiens
ggaagcccatcctgacc

SEQ ID NO: 1231077 - DNA, 13 bp, Homo sapiens
ggaagcccctggg

SEQ ID NO: 1231078 - DNA, 12 bp, Homo sapiens
ggaagccctcct

SEQ ID NO: 1231079 - DNA, 15 bp, Homo sapiens
ggaagccctggattt

SEQ ID NO: 1231080 - DNA, 17 bp, Homo sapiens
ggaagccggtgtccctg

SEQ ID NO: 1231081 - DNA, 18 bp, Homo sapiens
ggaagccgtctgactcca

SEQ ID NO: 1231082 - DNA, 21 bp, Homo sapiens
ggaagccgtctgactccagag

SEQ ID NO: 1231083 - DNA, 21 bp, Homo sapiens
ggaagccgttgaatctgggag

SEQ ID NO: 1231084 - DNA, 13 bp, Homo sapiens
ggaagcctgaact

SEQ ID NO: 1231085 - DNA, 20 bp, Homo sapiens
ggaagcctgaactgaggcct

SEQ ID NO: 1231086 - DNA, 14 bp, Homo sapiens
ggaagcctgcagtc

SEQ ID NO: 1231087 - DNA, 16 bp, Homo sapiens
ggaagcctgtgccagc

SEQ ID NO: 1231088 - DNA, 13 bp, Homo sapiens
ggaagccttgctc

SEQ ID NO: 1231089 - DNA, 22 bp, Homo sapiens
ggaagcggaggttgcagggagc

SEQ ID NO: 1231090 - DNA, 15 bp, Homo sapiens
ggaagctagtctttt

SEQ ID NO: 1231091 - DNA, 17 bp, Homo sapiens
ggaagctagtcttttgc

SEQ ID NO: 1231092 - DNA, 16 bp, Homo sapiens
ggaagctcccacccca

SEQ ID NO: 1231093 - DNA, 14 bp, Homo sapiens
ggaagctccttcct

SEQ ID NO: 1231094 - DNA, 15 bp, Homo sapiens
ggaagctccttcctg

SEQ ID NO: 1231095 - DNA, 16 bp, Homo sapiens
ggaagctgattaaaac

SEQ ID NO: 1231096 - DNA, 23 bp, Homo sapiens
ggaagctgccacccctcttctgc

SEQ ID NO: 1231097 - DNA, 14 bp, Homo sapiens
ggaagctgggccca

SEQ ID NO: 1231098 - DNA, 19 bp, Homo sapiens
ggaagctgtactcagagca

SEQ ID NO: 1231099 - DNA, 17 bp, Homo sapiens
ggaagctgtgtccttgc

SEQ ID NO: 1231100 - DNA, 21 bp, Homo sapiens
ggaagctgtgtccttgcacct

SEQ ID NO: 1231101 - DNA, 23 bp, Homo sapiens
ggaagctgtgtccttgcacctgc

SEQ ID NO: 1231102 - DNA, 12 bp, Homo sapiens
ggaaggaaacaa

SEQ ID NO: 1231103 - DNA, 17 bp, Homo sapiens
ggaaggaaataaacatt

SEQ ID NO: 1231104 - DNA, 18 bp, Homo sapiens
ggaaggaactctggcttc

SEQ ID NO: 1231105 - DNA, 23 bp, Homo sapiens
ggaaggaactctggcttccaggt

SEQ ID NO: 1231106 - DNA, 23 bp, Homo sapiens
ggaaggaatgtcagggccaggtg

SEQ ID NO: 1231107 - DNA, 13 bp, Homo sapiens
ggaaggacacagc

SEQ ID NO: 1231108 - DNA, 15 bp, Homo sapiens
ggaaggacacagcag

SEQ ID NO: 1231109 - DNA, 14 bp, Homo sapiens
ggaaggacccctca

SEQ ID NO: 1231110 - DNA, 16 bp, Homo sapiens
ggaaggagagatgacc

SEQ ID NO: 1231111 - DNA, 15 bp, Homo sapiens
ggaaggagagcctgc

SEQ ID NO: 1231112 - DNA, 17 bp, Homo sapiens
ggaaggagagcctgctg

SEQ ID NO: 1231113 - DNA, 14 bp, Homo sapiens
ggaaggaggcagac

SEQ ID NO: 1231114 - DNA, 13 bp, Homo sapiens
ggaaggaggggag

SEQ ID NO: 1231115 - DNA, 13 bp, Homo sapiens
ggaaggatctgct

SEQ ID NO: 1231116 - DNA, 22 bp, Homo sapiens
ggaaggatctgctgaggcccag

SEQ ID NO: 1231117 - DNA, 19 bp, Homo sapiens
ggaaggcaaaggcagagga

SEQ ID NO: 1231118 - DNA, 18 bp, Homo sapiens
ggaaggcagacagcaggc

SEQ ID NO: 1231119 - DNA, 12 bp, Homo sapiens
ggaaggcagagg

SEQ ID NO: 1231120 - DNA, 13 bp, Homo sapiens
ggaaggcagctgc

SEQ ID NO: 1231121 - DNA, 14 bp, Homo sapiens
ggaaggcagctgct

SEQ ID NO: 1231122 - DNA, 16 bp, Homo sapiens
ggaaggcagctgctct

SEQ ID NO: 1231123 - DNA, 14 bp, Homo sapiens
ggaaggcagggcag

SEQ ID NO: 1231124 - DNA, 17 bp, Homo sapiens
ggaaggcagggcagagg

SEQ ID NO: 1231125 - DNA, 18 bp, Homo sapiens
ggaaggcagggcagaggg

SEQ ID NO: 1231126 - DNA, 19 bp, Homo sapiens
ggaaggccgggtgcgaaag

SEQ ID NO: 1231127 - DNA, 13 bp, Homo sapiens
ggaaggcctccct

SEQ ID NO: 1231128 - DNA, 16 bp, Homo sapiens
ggaaggccttccactg

SEQ ID NO: 1231129 - DNA, 15 bp, Homo sapiens
ggaaggcgctgggtg

SEQ ID NO: 1231130 - DNA, 19 bp, Homo sapiens
ggaaggctactggcattaa

SEQ ID NO: 1231131 - DNA, 14 bp, Homo sapiens
ggaaggctctgtca

SEQ ID NO: 1231132 - DNA, 15 bp, Homo sapiens
ggaaggctggctgag

SEQ ID NO: 1231133 - DNA, 15 bp, Homo sapiens
ggaagggaccaaggc

SEQ ID NO: 1231134 - DNA, 22 bp, Homo sapiens
ggaagggaccaaggcaaggcag

SEQ ID NO: 1231135 - DNA, 13 bp, Homo sapiens
ggaagggacctgg

SEQ ID NO: 1231136 - DNA, 21 bp, Homo sapiens
ggaagggagagttctttgctg

SEQ ID NO: 1231137 - DNA, 23 bp, Homo sapiens
ggaagggagtgaggggctgtgac

SEQ ID NO: 1231138 - DNA, 16 bp, Homo sapiens
ggaagggataatttat

SEQ ID NO: 1231139 - DNA, 21 bp, Homo sapiens
ggaagggcaggaaggagagcc

SEQ ID NO: 1231140 - DNA, 14 bp, Homo sapiens
ggaagggcaggcac

SEQ ID NO: 1231141 - DNA, 13 bp, Homo sapiens
ggaagggcatgca

SEQ ID NO: 1231142 - DNA, 13 bp, Homo sapiens
ggaagggccaccc

SEQ ID NO: 1231143 - DNA, 15 bp, Homo sapiens
ggaagggccaccctg

SEQ ID NO: 1231144 - DNA, 17 bp, Homo sapiens
ggaagggccaccctgct

SEQ ID NO: 1231145 - DNA, 20 bp, Homo sapiens
ggaagggccaccctgctgca

SEQ ID NO: 1231146 - DNA, 11 bp, Homo sapiens
ggaagggccag

SEQ ID NO: 1231147 - DNA, 20 bp, Homo sapiens
ggaagggctttggttccttc

SEQ ID NO: 1231148 - DNA, 24 bp, Homo sapiens
ggaagggctttggttccttctctg

SEQ ID NO: 1231149 - DNA, 16 bp, Homo sapiens
ggaaggggacccccgc

SEQ ID NO: 1231150 - DNA, 14 bp, Homo sapiens
ggaaggggaggagg

SEQ ID NO: 1231151 - DNA, 15 bp, Homo sapiens
ggaaggggaggaggg

SEQ ID NO: 1231152 - DNA, 15 bp, Homo sapiens
ggaaggggatggagg

SEQ ID NO: 1231153 - DNA, 15 bp, Homo sapiens
ggaaggggcagcagg

SEQ ID NO: 1231154 - DNA, 15 bp, Homo sapiens
ggaaggggccagagg

SEQ ID NO: 1231155 - DNA, 16 bp, Homo sapiens
ggaaggggcttctgga

SEQ ID NO: 1231156 - DNA, 12 bp, Homo sapiens
ggaagggggagg

SEQ ID NO: 1231157 - DNA, 14 bp, Homo sapiens
ggaagggggaggag

SEQ ID NO: 1231158 - DNA, 16 bp, Homo sapiens
ggaagggggtccaccc

SEQ ID NO: 1231159 - DNA, 15 bp, Homo sapiens
ggaaggggtcctgca

SEQ ID NO: 1231160 - DNA, 18 bp, Homo sapiens
ggaaggggtcctgcaggg

SEQ ID NO: 1231161 - DNA, 18 bp, Homo sapiens
ggaaggggtgcaggtggg

SEQ ID NO: 1231162 - DNA, 16 bp, Homo sapiens
ggaagggtggggagaa

SEQ ID NO: 1231163 - DNA, 14 bp, Homo sapiens
ggaagggttttctt

SEQ ID NO: 1231164 - DNA, 18 bp, Homo sapiens
ggaaggtaaaaacccagc

SEQ ID NO: 1231165 - DNA, 19 bp, Homo sapiens
ggaaggtaaaaacccagcg

SEQ ID NO: 1231166 - DNA, 15 bp, Homo sapiens
ggaaggtggccacag

SEQ ID NO: 1231167 - DNA, 16 bp, Homo sapiens
ggaaggtggccacagc

SEQ ID NO: 1231168 - DNA, 12 bp, Homo sapiens
ggaaggtggggc

SEQ ID NO: 1231169 - DNA, 14 bp, Homo sapiens
ggaaggtggggccc

SEQ ID NO: 1231170 - DNA, 18 bp, Homo sapiens
ggaaggtggggccctgcc

SEQ ID NO: 1231171 - DNA, 20 bp, Homo sapiens
ggaaggtggggccctgcccc

SEQ ID NO: 1231172 - DNA, 19 bp, Homo sapiens
ggaaggtgtgatgtcagaa

SEQ ID NO: 1231173 - DNA, 19 bp, Homo sapiens
ggaaggttagaaaggcagc

SEQ ID NO: 1231174 - DNA, 18 bp, Homo sapiens
ggaaggttggcgggggca

SEQ ID NO: 1231175 - DNA, 18 bp, Homo sapiens
ggaagtaggggcaagctc

SEQ ID NO: 1231176 - DNA, 16 bp, Homo sapiens
ggaagtagtccttggc

SEQ ID NO: 1231177 - DNA, 17 bp, Homo sapiens
ggaagtatgagtgctga

SEQ ID NO: 1231178 - DNA, 19 bp, Homo sapiens
ggaagtcagtacgatcaag

SEQ ID NO: 1231179 - DNA, 12 bp, Homo sapiens
ggaagtcatggg

SEQ ID NO: 1231180 - DNA, 22 bp, Homo sapiens
ggaagtcatgggaacgcagcct

SEQ ID NO: 1231181 - DNA, 20 bp, Homo sapiens
ggaagtgaagactggaagct

SEQ ID NO: 1231182 - DNA, 22 bp, Homo sapiens
ggaagtgaatccttaaccctaa

SEQ ID NO: 1231183 - DNA, 18 bp, Homo sapiens
ggaagtgacaaggcccca

SEQ ID NO: 1231184 - DNA, 19 bp, Homo sapiens
ggaagtgacaaggccccag

SEQ ID NO: 1231185 - DNA, 22 bp, Homo sapiens
ggaagtgacaaggccccagaga

SEQ ID NO: 1231186 - DNA, 15 bp, Homo sapiens
ggaagtgaggcccaa

SEQ ID NO: 1231187 - DNA, 15 bp, Homo sapiens
ggaagtggcagttct

SEQ ID NO: 1231188 - DNA, 17 bp, Homo sapiens
ggaagtggctgtccctg

SEQ ID NO: 1231189 - DNA, 15 bp, Homo sapiens
ggaagtggggacaga

SEQ ID NO: 1231190 - DNA, 17 bp, Homo sapiens
ggaagtggggacagatt

SEQ ID NO: 1231191 - DNA, 19 bp, Homo sapiens
ggaagtgtaacagctgagg

SEQ ID NO: 1231192 - DNA, 13 bp, Homo sapiens
ggaagtgttcaga

SEQ ID NO: 1231193 - DNA, 23 bp, Homo sapiens
ggaagttatggcagtgatgccga

SEQ ID NO: 1231194 - DNA, 17 bp, Homo sapiens
ggaagttcttcaagagg

SEQ ID NO: 1231195 - DNA, 20 bp, Homo sapiens
ggaagttggggcactgggcg

SEQ ID NO: 1231196 - DNA, 16 bp, Homo sapiens
ggaatgtagggcctgc

SEQ ID NO: 1231197 - DNA, 15 bp, Homo sapiens
ggaatgtgccacctg

SEQ ID NO: 1231198 - DNA, 17 bp, Homo sapiens
ggaatgtgcccctggcc

SEQ ID NO: 1231199 - DNA, 22 bp, Homo sapiens
ggaatgtggttagttaactgaa

SEQ ID NO: 1231200 - DNA, 19 bp, Homo sapiens
ggaatgttccctgcaccct

SEQ ID NO: 1231201 - DNA, 20 bp, Homo sapiens
ggaatgttccctgcaccctg

SEQ ID NO: 1231202 - DNA, 21 bp, Homo sapiens
ggaatgtttgggcagaaggga

SEQ ID NO: 1231203 - DNA, 22 bp, Homo sapiens
ggaatgtttttccctccccaga

SEQ ID NO: 1231204 - DNA, 23 bp, Homo sapiens
ggaatgtttttccctccccagaa

SEQ ID NO: 1231205 - DNA, 13 bp, Homo sapiens
ggaattaaaacaa

SEQ ID NO: 1231206 - DNA, 15 bp, Homo sapiens
ggaattaaatagtgt

SEQ ID NO: 1231207 - DNA, 16 bp, Homo sapiens
ggaattaacctggtgc

SEQ ID NO: 1231208 - DNA, 17 bp, Homo sapiens
ggaattaacctggtgct

SEQ ID NO: 1231209 - DNA, 20 bp, Homo sapiens
ggaattaacctggtgctgga

SEQ ID NO: 1231210 - DNA, 19 bp, Homo sapiens
ggaattacatgtaaaacat

SEQ ID NO: 1231211 - DNA, 22 bp, Homo sapiens
ggaattattgtaccattttcta

SEQ ID NO: 1231212 - DNA, 13 bp, Homo sapiens
ggaattcatgcaa

SEQ ID NO: 1231213 - DNA, 14 bp, Homo sapiens
ggaattccaacttg

SEQ ID NO: 1231214 - DNA, 19 bp, Homo sapiens
ggaattccaacttgaagga

SEQ ID NO: 1231215 - DNA, 20 bp, Homo sapiens
ggaattcctcttttgcttaa

SEQ ID NO: 1231216 - DNA, 23 bp, Homo sapiens
ggaattcctgctatgacagctgg

SEQ ID NO: 1231217 - DNA, 18 bp, Homo sapiens
ggaattcgatgcccccct

SEQ ID NO: 1231218 - DNA, 20 bp, Homo sapiens
ggaattcgtgttatgaatct

SEQ ID NO: 1231219 - DNA, 16 bp, Homo sapiens
ggaattctaaataaat

SEQ ID NO: 1231220 - DNA, 20 bp, Homo sapiens
ggaattgacttcgactgtga

SEQ ID NO: 1231221 - DNA, 17 bp, Homo sapiens
ggaattgatttgcattg

SEQ ID NO: 1231222 - DNA, 18 bp, Homo sapiens
ggaattgatttgcattga

SEQ ID NO: 1231223 - DNA, 23 bp, Homo sapiens
ggaattgtggctatcctgattat

SEQ ID NO: 1231224 - DNA, 16 bp, Homo sapiens
ggaattgtttatacac

SEQ ID NO: 1231225 - DNA, 14 bp, Homo sapiens
ggaatttaaaatta

SEQ ID NO: 1231226 - DNA, 18 bp, Homo sapiens
ggaatttaaaattaagta

SEQ ID NO: 1231227 - DNA, 15 bp, Homo sapiens
ggaatttccctgtgt

SEQ ID NO: 1231228 - DNA, 18 bp, Homo sapiens
ggaatttcttaacttctt

SEQ ID NO: 1231229 - DNA, 23 bp, Homo sapiens
ggaatttcttttccttcattcat

SEQ ID NO: 1231230 - DNA, 20 bp, Homo sapiens
ggaatttgagagttcacaga

SEQ ID NO: 1231231 - DNA, 13 bp, Homo sapiens
ggaatttgattgc

SEQ ID NO: 1231232 - DNA, 16 bp, Homo sapiens
ggaatttgcctgctgg

SEQ ID NO: 1231233 - DNA, 13 bp, Homo sapiens
ggaatttgtcagc

SEQ ID NO: 1231234 - DNA, 18 bp, Homo sapiens
ggaattttataagctgaa

SEQ ID NO: 1231235 - DNA, 17 bp, Homo sapiens
ggaattttgagaaaaat

SEQ ID NO: 1231236 - DNA, 13 bp, Homo sapiens
ggaattttgtctc

SEQ ID NO: 1231237 - DNA, 16 bp, Homo sapiens
ggacaaaagggccagg

SEQ ID NO: 1231238 - DNA, 19 bp, Homo sapiens
ggacaaaagggccaggtgc

SEQ ID NO: 1231239 - DNA, 15 bp, Homo sapiens
ggacaaacagctcag

SEQ ID NO: 1231240 - DNA, 15 bp, Homo sapiens
ggacaaacccttctt

SEQ ID NO: 1231241 - DNA, 14 bp, Homo sapiens
ggacaaagaaaacg

SEQ ID NO: 1231242 - DNA, 22 bp, Homo sapiens
ggacaaagaattccaaagcaaa

SEQ ID NO: 1231243 - DNA, 21 bp, Homo sapiens
ggacaaagattctccacttgg

SEQ ID NO: 1231244 - DNA, 15 bp, Homo sapiens
ggacaaaggcctggc

SEQ ID NO: 1231245 - DNA, 13 bp, Homo sapiens
ggacaaattagca

SEQ ID NO: 1231246 - DNA, 13 bp, Homo sapiens
ggacaacactgat

SEQ ID NO: 1231247 - DNA, 16 bp, Homo sapiens
ggacaacagtgctttg

SEQ ID NO: 1231248 - DNA, 22 bp, Homo sapiens
ggacctgccccggacctacctc

SEQ ID NO: 1231249 - DNA, 15 bp, Homo sapiens
ggacctgcctagcat

SEQ ID NO: 1231250 - DNA, 19 bp, Homo sapiens
ggacctgcctcctgcctgc

SEQ ID NO: 1231251 - DNA, 23 bp, Homo sapiens
ggacctgcctcctgcctgcccct

SEQ ID NO: 1231252 - DNA, 17 bp, Homo sapiens
ggacctggtaccctcct

SEQ ID NO: 1231253 - DNA, 13 bp, Homo sapiens
ggacctgtccccc

SEQ ID NO: 1231254 - DNA, 14 bp, Homo sapiens
ggacctgtccccca

SEQ ID NO: 1231255 - DNA, 15 bp, Homo sapiens
ggacctgtcccccac

SEQ ID NO: 1231256 - DNA, 20 bp, Homo sapiens
ggacctgtcccccactctct

SEQ ID NO: 1231257 - DNA, 18 bp, Homo sapiens
ggacctgtgttcttgctg

SEQ ID NO: 1231258 - DNA, 12 bp, Homo sapiens
ggaccttcctgc

SEQ ID NO: 1231259 - DNA, 17 bp, Homo sapiens
ggaccttcgggctgtgc

SEQ ID NO: 1231260 - DNA, 21 bp, Homo sapiens
ggaccttggcgctctcagctt

SEQ ID NO: 1231261 - DNA, 18 bp, Homo sapiens
ggacctttccaccacagc

SEQ ID NO: 1231262 - DNA, 20 bp, Homo sapiens
ggacctttccaccacagcca

SEQ ID NO: 1231263 - DNA, 15 bp, Homo sapiens
ggacgcacagtgcag

SEQ ID NO: 1231264 - DNA, 19 bp, Homo sapiens
ggacgcaggccctgtccag

SEQ ID NO: 1231265 - DNA, 21 bp, Homo sapiens
ggacgcaggccctgtccagcc

SEQ ID NO: 1231266 - DNA, 19 bp, Homo sapiens
ggacgccaacttctcccac

SEQ ID NO: 1231267 - DNA, 20 bp, Homo sapiens
ggacgccaacttctcccacc

SEQ ID NO: 1231268 - DNA, 23 bp, Homo sapiens
ggacgccaacttctcccacccct

SEQ ID NO: 1231269 - DNA, 20 bp, Homo sapiens
ggacgccactcatttcatct

SEQ ID NO: 1231270 - DNA, 14 bp, Homo sapiens
ggacgcctgggggt

SEQ ID NO: 1231271 - DNA, 20 bp, Homo sapiens
ggacgcctgggggtgccagg

SEQ ID NO: 1231272 - DNA, 14 bp, Homo sapiens
ggacgcggaggagg

SEQ ID NO: 1231273 - DNA, 15 bp, Homo sapiens
ggacgcggaggagga

SEQ ID NO: 1231274 - DNA, 20 bp, Homo sapiens
ggacgcttttgagtgggccc

SEQ ID NO: 1231275 - DNA, 21 bp, Homo sapiens
ggacgcttttgagtgggccct

SEQ ID NO: 1231276 - DNA, 14 bp, Homo sapiens
ggacggaggtcccc

SEQ ID NO: 1231277 - DNA, 18 bp, Homo sapiens
ggacggcattcctgctta

SEQ ID NO: 1231278 - DNA, 15 bp, Homo sapiens
ggacggctcctcaga

SEQ ID NO: 1231279 - DNA, 17 bp, Homo sapiens
ggacggggcaggcgctg

SEQ ID NO: 1231280 - DNA, 19 bp, Homo sapiens
ggacggtgccaagggcccc

SEQ ID NO: 1231281 - DNA, 15 bp, Homo sapiens
ggacggtttctagcc

SEQ ID NO: 1231282 - DNA, 21 bp, Homo sapiens
ggacggtttctagcctctgag

SEQ ID NO: 1231283 - DNA, 13 bp, Homo sapiens
ggacgtaaaattt

SEQ ID NO: 1231284 - DNA, 22 bp, Homo sapiens
ggacgtcatcggaggctgggcc

SEQ ID NO: 1231285 - DNA, 16 bp, Homo sapiens
ggacgtccctgcccat

SEQ ID NO: 1231286 - DNA, 18 bp, Homo sapiens
ggacgtgcactgacagcc

SEQ ID NO: 1231287 - DNA, 14 bp, Homo sapiens
ggacgtgctggcct

SEQ ID NO: 1231288 - DNA, 12 bp, Homo sapiens
ggacgtgctggg

SEQ ID NO: 1231289 - DNA, 15 bp, Homo sapiens
ggacgtgtacagcac

SEQ ID NO: 1231290 - DNA, 16 bp, Homo sapiens
ggacgtgtacagcaca

SEQ ID NO: 1231291 - DNA, 17 bp, Homo sapiens
ggacgtgtacagcacag

SEQ ID NO: 1231292 - DNA, 18 bp, Homo sapiens
ggacgtgtacagcacaga

SEQ ID NO: 1231293 - DNA, 19 bp, Homo sapiens
ggactaacataaaatctgt

SEQ ID NO: 1231294 - DNA, 21 bp, Homo sapiens
ggactaacataaaatctgtga

SEQ ID NO: 1231295 - DNA, 23 bp, Homo sapiens
ggactaagatgaaatgcactgta

SEQ ID NO: 1231296 - DNA, 16 bp, Homo sapiens
ggactaccgcaggccc

SEQ ID NO: 1231297 - DNA, 22 bp, Homo sapiens
ggactagaaaaacttgggtctc

SEQ ID NO: 1231298 - DNA, 18 bp, Homo sapiens
ggactagagggacctctc

SEQ ID NO: 1231299 - DNA, 15 bp, Homo sapiens
ggactatagcccagg

SEQ ID NO: 1231300 - DNA, 19 bp, Homo sapiens
ggactatgaaaagctagaa

SEQ ID NO: 1231301 - DNA, 19 bp, Homo sapiens
ggactcaagggtccagaag

SEQ ID NO: 1231302 - DNA, 21 bp, Homo sapiens
ggactcaccaacttgccacat

SEQ ID NO: 1231303 - DNA, 24 bp, Homo sapiens
ggactcaggaacttttgttaggaa

SEQ ID NO: 1231304 - DNA, 15 bp, Homo sapiens
ggactcattgtagaa

SEQ ID NO: 1231305 - DNA, 23 bp, Homo sapiens
ggactccaggcccaaggctcccg

SEQ ID NO: 1231306 - DNA, 21 bp, Homo sapiens
ggactcccaaccctggcttgg

SEQ ID NO: 1231307 - DNA, 15 bp, Homo sapiens
ggactcccagcagag

SEQ ID NO: 1231308 - DNA, 13 bp, Homo sapiens
ggactcccagtga

SEQ ID NO: 1231309 - DNA, 18 bp, Homo sapiens
ggactccccaggccaggc

SEQ ID NO: 1231310 - DNA, 19 bp, Homo sapiens
ggactgtgcctcaggccag

SEQ ID NO: 1231311 - DNA, 17 bp, Homo sapiens
ggactgtttcagtgtga

SEQ ID NO: 1231312 - DNA, 15 bp, Homo sapiens
ggactgttttcaata

SEQ ID NO: 1231313 - DNA, 21 bp, Homo sapiens
ggactgttttttcctgagctt

SEQ ID NO: 1231314 - DNA, 19 bp, Homo sapiens
ggacttaacggctccagga

SEQ ID NO: 1231315 - DNA, 21 bp, Homo sapiens
ggacttcacgaagtgttgcat

SEQ ID NO: 1231316 - DNA, 16 bp, Homo sapiens
ggacttcctggggccc

SEQ ID NO: 1231317 - DNA, 14 bp, Homo sapiens
ggacttgaatggtt

SEQ ID NO: 1231318 - DNA, 20 bp, Homo sapiens
ggacttggagagcaaaggcc

SEQ ID NO: 1231319 - DNA, 20 bp, Homo sapiens
ggacttggagggtctggggg

SEQ ID NO: 1231320 - DNA, 13 bp, Homo sapiens
ggacttggctgtc

SEQ ID NO: 1231321 - DNA, 15 bp, Homo sapiens
ggacttggcttcaga

SEQ ID NO: 1231322 - DNA, 19 bp, Homo sapiens
ggacttgtatatttgtaca

SEQ ID NO: 1231323 - DNA, 12 bp, Homo sapiens
ggacttgtgtct

SEQ ID NO: 1231324 - DNA, 18 bp, Homo sapiens
ggactttaaaaaaacaat

SEQ ID NO: 1231325 - DNA, 17 bp, Homo sapiens
ggactttatttatttct

SEQ ID NO: 1231326 - DNA, 18 bp, Homo sapiens
ggactttatttatttcta

SEQ ID NO: 1231327 - DNA, 22 bp, Homo sapiens
ggactttctctaataataaata

SEQ ID NO: 1231328 - DNA, 16 bp, Homo sapiens
ggactttgcagccggc

SEQ ID NO: 1231329 - DNA, 16 bp, Homo sapiens
ggacttttttgattaa

SEQ ID NO: 1231330 - DNA, 15 bp, Homo sapiens
ggagaaaaaaaaagt

SEQ ID NO: 1231331 - DNA, 15 bp, Homo sapiens
ggagaaaaaatcact

SEQ ID NO: 1231332 - DNA, 16 bp, Homo sapiens
ggagaaaagtgggctg

SEQ ID NO: 1231333 - DNA, 14 bp, Homo sapiens
ggagaaacagagac

SEQ ID NO: 1231334 - DNA, 14 bp, Homo sapiens
ggagaaaccagctt

SEQ ID NO: 1231335 - DNA, 20 bp, Homo sapiens
ggagaaagaagtggagacag

SEQ ID NO: 1231336 - DNA, 13 bp, Homo sapiens
ggagaaagccggg

SEQ ID NO: 1231337 - DNA, 18 bp, Homo sapiens
ggagaaagccgggggagg

SEQ ID NO: 1231338 - DNA, 21 bp, Homo sapiens
ggagaaagccgggggaggggc

SEQ ID NO: 1231339 - DNA, 22 bp, Homo sapiens
ggagaaagccgggggaggggcc

SEQ ID NO: 1231340 - DNA, 19 bp, Homo sapiens
ggagaaagggagcgaggtc

SEQ ID NO: 1231341 - DNA, 17 bp, Homo sapiens
ggagaaagtaagtcttt

SEQ ID NO: 1231342 - DNA, 13 bp, Homo sapiens
ggagaaataattg

SEQ ID NO: 1231343 - DNA, 18 bp, Homo sapiens
ggagaaatgcaataactc

SEQ ID NO: 1231344 - DNA, 14 bp, Homo sapiens
ggagaaattgacag

SEQ ID NO: 1231345 - DNA, 14 bp, Homo sapiens
ggagaagagccctg

SEQ ID NO: 1231346 - DNA, 21 bp, Homo sapiens
ggagaagatttcagagctgag

SEQ ID NO: 1231347 - DNA, 16 bp, Homo sapiens
ggagaagcaccagcaa

SEQ ID NO: 1231348 - DNA, 15 bp, Homo sapiens
ggagaagcagtgagc

SEQ ID NO: 1231349 - DNA, 19 bp, Homo sapiens
ggagaagcagtgagccgca

SEQ ID NO: 1231350 - DNA, 18 bp, Homo sapiens
ggagaagcggctggcagc

SEQ ID NO: 1231351 - DNA, 15 bp, Homo sapiens
ggagaagcgggctgg

SEQ ID NO: 1231352 - DNA, 23 bp, Homo sapiens
ggagaagcgggctgggggtagcc

SEQ ID NO: 1231353 - DNA, 17 bp, Homo sapiens
ggagaaggaaggagact

SEQ ID NO: 1231354 - DNA, 18 bp, Homo sapiens
ggagaaggaagggcagag

SEQ ID NO: 1231355 - DNA, 12 bp, Homo sapiens
ggagaaggatct

SEQ ID NO: 1231356 - DNA, 14 bp, Homo sapiens
ggagaaggatctag

SEQ ID NO: 1231357 - DNA, 19 bp, Homo sapiens
ggagaagggggctctgccc

SEQ ID NO: 1231358 - DNA, 22 bp, Homo sapiens
ggagaaggtcagcgagaaggag

SEQ ID NO: 1231359 - DNA, 22 bp, Homo sapiens
ggagaaggtctccaagggaggg

SEQ ID NO: 1231360 - DNA, 22 bp, Homo sapiens
ggagaagtctcagctaagctca

SEQ ID NO: 1231361 - DNA, 19 bp, Homo sapiens
ggagaatactttgcttcat

SEQ ID NO: 1231362 - DNA, 23 bp, Homo sapiens
ggagaatactttgcttcatagta

SEQ ID NO: 1231363 - DNA, 17 bp, Homo sapiens
ggagaatatttactaac

SEQ ID NO: 1231364 - DNA, 18 bp, Homo sapiens
ggagaatcacttaagcct

SEQ ID NO: 1231365 - DNA, 14 bp, Homo sapiens
ggagaatcatgtga

SEQ ID NO: 1231366 - DNA, 19 bp, Homo sapiens
ggagaatcgctcctgcagc

SEQ ID NO: 1231367 - DNA, 21 bp, Homo sapiens
ggaccaataaaatttctaaga

SEQ ID NO: 1231368 - DNA, 17 bp, Homo sapiens
ggaccaatgtccttgtg

SEQ ID NO: 1231369 - DNA, 16 bp, Homo sapiens
ggaccaattctggaca

SEQ ID NO: 1231370 - DNA, 21 bp, Homo sapiens
ggaccaattctggacagacag

SEQ ID NO: 1231371 - DNA, 22 bp, Homo sapiens
ggaccaattctggacagacaga

SEQ ID NO: 1231372 - DNA, 17 bp, Homo sapiens
ggaccacagtgggtggc

SEQ ID NO: 1231373 - DNA, 21 bp, Homo sapiens
ggaccacatctgtcctcaccc

SEQ ID NO: 1231374 - DNA, 17 bp, Homo sapiens
ggaccaccaatggattg

SEQ ID NO: 1231375 - DNA, 13 bp, Homo sapiens
ggaccaccagccc

SEQ ID NO: 1231376 - DNA, 15 bp, Homo sapiens
ggaccaccagcccca

SEQ ID NO: 1231377 - DNA, 18 bp, Homo sapiens
ggaccaccagccccagca

SEQ ID NO: 1231378 - DNA, 15 bp, Homo sapiens
ggaccaccctgagcc

SEQ ID NO: 1231379 - DNA, 17 bp, Homo sapiens
ggaccaccgttcagtca

SEQ ID NO: 1231380 - DNA, 16 bp, Homo sapiens
ggaccacgccgccctc

SEQ ID NO: 1231381 - DNA, 16 bp, Homo sapiens
ggaccactcagcccct

SEQ ID NO: 1231382 - DNA, 18 bp, Homo sapiens
ggaccactcgaggcctgc

SEQ ID NO: 1231383 - DNA, 15 bp, Homo sapiens
ggaccagcatctggt

SEQ ID NO: 1231384 - DNA, 15 bp, Homo sapiens
ggaccagccagcagc

SEQ ID NO: 1231385 - DNA, 20 bp, Homo sapiens
ggaccagcccattggccgag

SEQ ID NO: 1231386 - DNA, 15 bp, Homo sapiens
ggaccagctggcctg

SEQ ID NO: 1231387 - DNA, 19 bp, Homo sapiens
ggaccagctggggcgtggg

SEQ ID NO: 1231388 - DNA, 17 bp, Homo sapiens
ggaccaggacaggacca

SEQ ID NO: 1231389 - DNA, 15 bp, Homo sapiens
ggaccaggactccct

SEQ ID NO: 1231390 - DNA, 19 bp, Homo sapiens
ggaccaggcctggagggca

SEQ ID NO: 1231391 - DNA, 20 bp, Homo sapiens
ggaccaggcctggagggcac

SEQ ID NO: 1231392 - DNA, 19 bp, Homo sapiens
ggaccagggccctgggcag

SEQ ID NO: 1231393 - DNA, 13 bp, Homo sapiens
ggaccagggtgga

SEQ ID NO: 1231394 - DNA, 23 bp, Homo sapiens
ggaccagtgggatgggctctacc

SEQ ID NO: 1231395 - DNA, 15 bp, Homo sapiens
ggaccagtttgcaga

SEQ ID NO: 1231396 - DNA, 17 bp, Homo sapiens
ggaccatcatcctactg

SEQ ID NO: 1231397 - DNA, 19 bp, Homo sapiens
ggaccatctgctgcagtta

SEQ ID NO: 1231398 - DNA, 21 bp, Homo sapiens
ggaccatgtgtcacttgtgct

SEQ ID NO: 1231399 - DNA, 24 bp, Homo sapiens
ggaccattgacctcagctgcacat

SEQ ID NO: 1231400 - DNA, 18 bp, Homo sapiens
ggacccaaaacacaggaa

SEQ ID NO: 1231401 - DNA, 19 bp, Homo sapiens
ggacccacccagcccctct

SEQ ID NO: 1231402 - DNA, 14 bp, Homo sapiens
ggacccaccccaac

SEQ ID NO: 1231403 - DNA, 21 bp, Homo sapiens
ggacccagagtcccaggcccc

SEQ ID NO: 1231404 - DNA, 12 bp, Homo sapiens
ggacccagctcc

SEQ ID NO: 1231405 - DNA, 19 bp, Homo sapiens
ggacccagctcctctgagc

SEQ ID NO: 1231406 - DNA, 13 bp, Homo sapiens
ggacccaggccct

SEQ ID NO: 1231407 - DNA, 18 bp, Homo sapiens
ggacccaggccctccatg

SEQ ID NO: 1231408 - DNA, 14 bp, Homo sapiens
ggacccagggatga

SEQ ID NO: 1231409 - DNA, 17 bp, Homo sapiens
ggacccagggcctgact

SEQ ID NO: 1231410 - DNA, 20 bp, Homo sapiens
ggacccatagatcttctgaa

SEQ ID NO: 1231411 - DNA, 12 bp, Homo sapiens
ggaccccagctg

SEQ ID NO: 1231412 - DNA, 21 bp, Homo sapiens
ggaccccagctgggaggcaag

SEQ ID NO: 1231413 - DNA, 12 bp, Homo sapiens
ggaccccagggt

SEQ ID NO: 1231414 - DNA, 14 bp, Homo sapiens
ggaccccatctgtg

SEQ ID NO: 1231415 - DNA, 21 bp, Homo sapiens
ggaccccattctgagctcccc

SEQ ID NO: 1231416 - DNA, 22 bp, Homo sapiens
ggacccccgaggggagggcagg

SEQ ID NO: 1231417 - DNA, 22 bp, Homo sapiens
ggaccccctcgccagcttggct

SEQ ID NO: 1231418 - DNA, 14 bp, Homo sapiens
ggaccccctgcccg

SEQ ID NO: 1231419 - DNA, 21 bp, Homo sapiens
ggacccctaatgtcagcttgg

SEQ ID NO: 1231420 - DNA, 17 bp, Homo sapiens
ggacccctcaccacccc

SEQ ID NO: 1231421 - DNA, 21 bp, Homo sapiens
ggacccctcgcaaccctgcct

SEQ ID NO: 1231422 - DNA, 14 bp, Homo sapiens
ggacccctgccttc

SEQ ID NO: 1231423 - DNA, 20 bp, Homo sapiens
ggacccctgctcccagcctg

SEQ ID NO: 1231424 - DNA, 14 bp, Homo sapiens
ggacccctggctct

SEQ ID NO: 1231425 - DNA, 18 bp, Homo sapiens
ggacccctggggtggcca

SEQ ID NO: 1231426 - DNA, 19 bp, Homo sapiens
ggacccctggggtggccag

SEQ ID NO: 1231427 - DNA, 22 bp, Homo sapiens
ggacccctggggtggccagggc

SEQ ID NO: 1231428 - DNA, 23 bp, Homo sapiens
ggacccctggggtggccagggct

SEQ ID NO: 1231429 - DNA, 12 bp, Homo sapiens
ggacccgccagc

SEQ ID NO: 1231430 - DNA, 15 bp, Homo sapiens
ggacccgcctgctcc

SEQ ID NO: 1231431 - DNA, 14 bp, Homo sapiens
ggacccgctctgga

SEQ ID NO: 1231432 - DNA, 19 bp, Homo sapiens
ggacccgctctggaccaac

SEQ ID NO: 1231433 - DNA, 15 bp, Homo sapiens
ggagagcggctgccc

SEQ ID NO: 1231434 - DNA, 17 bp, Homo sapiens
ggagagctagcagcagg

SEQ ID NO: 1231435 - DNA, 14 bp, Homo sapiens
ggagagctggtgac

SEQ ID NO: 1231436 - DNA, 20 bp, Homo sapiens
ggagagctggtgactttggg

SEQ ID NO: 1231437 - DNA, 17 bp, Homo sapiens
ggagagctggtgcccgg

SEQ ID NO: 1231438 - DNA, 16 bp, Homo sapiens
ggagagctttgtgctt

SEQ ID NO: 1231439 - DNA, 13 bp, Homo sapiens
ggagaggaagaga

SEQ ID NO: 1231440 - DNA, 18 bp, Homo sapiens
ggagaggaagagaagccc

SEQ ID NO: 1231441 - DNA, 13 bp, Homo sapiens
ggagaggactctg

SEQ ID NO: 1231442 - DNA, 14 bp, Homo sapiens
ggagaggagaaaaa

SEQ ID NO: 1231443 - DNA, 15 bp, Homo sapiens
ggagaggagaaaaaa

SEQ ID NO: 1231444 - DNA, 11 bp, Homo sapiens
ggagaggagac

SEQ ID NO: 1231445 - DNA, 21 bp, Homo sapiens
ggagaggcagcatgcttgggc

SEQ ID NO: 1231446 - DNA, 23 bp, Homo sapiens
ggagaggcagcatgcttgggctg

SEQ ID NO: 1231447 - DNA, 13 bp, Homo sapiens
ggagaggcctggg

SEQ ID NO: 1231448 - DNA, 16 bp, Homo sapiens
ggagaggcggcctcgt

SEQ ID NO: 1231449 - DNA, 13 bp, Homo sapiens
ggagaggctgtct

SEQ ID NO: 1231450 - DNA, 14 bp, Homo sapiens
ggagaggctgtctg

SEQ ID NO: 1231451 - DNA, 16 bp, Homo sapiens
ggagaggctgtctggg

SEQ ID NO: 1231452 - DNA, 18 bp, Homo sapiens
ggagagggctagccctga

SEQ ID NO: 1231453 - DNA, 15 bp, Homo sapiens
ggagaggggcacagg

SEQ ID NO: 1231454 - DNA, 13 bp, Homo sapiens
ggagagggggagg

SEQ ID NO: 1231455 - DNA, 14 bp, Homo sapiens
ggagagggggccgg

SEQ ID NO: 1231456 - DNA, 12 bp, Homo sapiens
ggagaggggggc

SEQ ID NO: 1231457 - DNA, 19 bp, Homo sapiens
ggagaggggtgcacccact

SEQ ID NO: 1231458 - DNA, 23 bp, Homo sapiens
ggagagggtctggagaagcagtg

SEQ ID NO: 1231459 - DNA, 14 bp, Homo sapiens
ggagaggtcaccag

SEQ ID NO: 1231460 - DNA, 15 bp, Homo sapiens
ggagaggtgccagca

SEQ ID NO: 1231461 - DNA, 16 bp, Homo sapiens
ggagaggtgccagcaa

SEQ ID NO: 1231462 - DNA, 18 bp, Homo sapiens
ggagaggtggctgcgccc

SEQ ID NO: 1231463 - DNA, 22 bp, Homo sapiens
ggagagtcccagagcaggaggc

SEQ ID NO: 1231464 - DNA, 21 bp, Homo sapiens
ggagagtggcaggtgggctgc

SEQ ID NO: 1231465 - DNA, 18 bp, Homo sapiens
ggagagtggttgttgcca

SEQ ID NO: 1231466 - DNA, 21 bp, Homo sapiens
ggagagtggttgttgccaact

SEQ ID NO: 1231467 - DNA, 23 bp, Homo sapiens
ggagagtgtgcaactggccagcc

SEQ ID NO: 1231468 - DNA, 18 bp, Homo sapiens
ggagagtgtgtgggcagg

SEQ ID NO: 1231469 - DNA, 21 bp, Homo sapiens
ggagagtgtgtgggcagggtt

SEQ ID NO: 1231470 - DNA, 21 bp, Homo sapiens
ggagagttcaagcctgtggga

SEQ ID NO: 1231471 - DNA, 21 bp, Homo sapiens
ggagataaaagcaattctgac

SEQ ID NO: 1231472 - DNA, 23 bp, Homo sapiens
ggagatatttatggggggagaac

SEQ ID NO: 1231473 - DNA, 18 bp, Homo sapiens
ggagatctgaacccagct

SEQ ID NO: 1231474 - DNA, 19 bp, Homo sapiens
ggagatctgaacccagctg

SEQ ID NO: 1231475 - DNA, 18 bp, Homo sapiens
ggagatgaccagggatgc

SEQ ID NO: 1231476 - DNA, 18 bp, Homo sapiens
ggagatgaggccagacca

SEQ ID NO: 1231477 - DNA, 17 bp, Homo sapiens
ggagatgagttgcagtt

SEQ ID NO: 1231478 - DNA, 17 bp, Homo sapiens
ggagatgcaaggtgctg

SEQ ID NO: 1231479 - DNA, 18 bp, Homo sapiens
ggagatgcaaggtgctgg

SEQ ID NO: 1231480 - DNA, 18 bp, Homo sapiens
ggagatgcagctactgga

SEQ ID NO: 1231481 - DNA, 20 bp, Homo sapiens
ggagatgcagctactggaat

SEQ ID NO: 1231482 - DNA, 20 bp, Homo sapiens
ggagatgcatcgggaaagaa

SEQ ID NO: 1231483 - DNA, 21 bp, Homo sapiens
ggagatgcttctctccttgcc

SEQ ID NO: 1231484 - DNA, 17 bp, Homo sapiens
ggagccacaggcagggg

SEQ ID NO: 1231485 - DNA, 14 bp, Homo sapiens
ggagccaccagttc

SEQ ID NO: 1231486 - DNA, 18 bp, Homo sapiens
ggagccacgcctatgccc

SEQ ID NO: 1231487 - DNA, 16 bp, Homo sapiens
ggagccactcctgtcc

SEQ ID NO: 1231488 - DNA, 17 bp, Homo sapiens
ggagccactcctgtccc

SEQ ID NO: 1231489 - DNA, 16 bp, Homo sapiens
ggagccagagagaaca

SEQ ID NO: 1231490 - DNA, 15 bp, Homo sapiens
ggagccagcctccct

SEQ ID NO: 1231491 - DNA, 21 bp, Homo sapiens
ggagccagctccctctattta

SEQ ID NO: 1231492 - DNA, 13 bp, Homo sapiens
ggagccaggctct

SEQ ID NO: 1231493 - DNA, 13 bp, Homo sapiens
ggagccagggcag

SEQ ID NO: 1231494 - DNA, 20 bp, Homo sapiens
ggagccaggttgtcgggccc

SEQ ID NO: 1231495 - DNA, 22 bp, Homo sapiens
ggagccatcccttcggagccaa

SEQ ID NO: 1231496 - DNA, 18 bp, Homo sapiens
ggagccatggaaggtgcc

SEQ ID NO: 1231497 - DNA, 21 bp, Homo sapiens
ggagccatggaaggtgccaga

SEQ ID NO: 1231498 - DNA, 16 bp, Homo sapiens
ggagcccacactgcca

SEQ ID NO: 1231499 - DNA, 20 bp, Homo sapiens
ggagcccacagcgagcctgt

SEQ ID NO: 1231500 - DNA, 13 bp, Homo sapiens
ggagcccagaggg

SEQ ID NO: 1231501 - DNA, 19 bp, Homo sapiens
ggagcccagccctccccat

SEQ ID NO: 1231502 - DNA, 13 bp, Homo sapiens
ggagcccagcctg

SEQ ID NO: 1231503 - DNA, 19 bp, Homo sapiens
ggagcccagtgaagcctct

SEQ ID NO: 1231504 - DNA, 18 bp, Homo sapiens
ggagcccagtgggctgca

SEQ ID NO: 1231505 - DNA, 22 bp, Homo sapiens
ggagccccaggcctctgtgtcc

SEQ ID NO: 1231506 - DNA, 17 bp, Homo sapiens
ggagccccattcctggg

SEQ ID NO: 1231507 - DNA, 21 bp, Homo sapiens
ggagcccccaacacaggcaag

SEQ ID NO: 1231508 - DNA, 21 bp, Homo sapiens
ggagcccccagatagagctgg

SEQ ID NO: 1231509 - DNA, 23 bp, Homo sapiens
ggagcccccagatagagctgggt

SEQ ID NO: 1231510 - DNA, 22 bp, Homo sapiens
ggagcccctcctcccccggctg

SEQ ID NO: 1231511 - DNA, 13 bp, Homo sapiens
ggagcccctgggt

SEQ ID NO: 1231512 - DNA, 22 bp, Homo sapiens
ggagcccctgggtgggtggtgg

SEQ ID NO: 1231513 - DNA, 19 bp, Homo sapiens
ggagccccttctgctcagc

SEQ ID NO: 1231514 - DNA, 21 bp, Homo sapiens
ggagccccttctgctcagctc

SEQ ID NO: 1231515 - DNA, 21 bp, Homo sapiens
ggagcccgcttcaagctctct

SEQ ID NO: 1231516 - DNA, 15 bp, Homo sapiens
ggagcccgtgcagta

SEQ ID NO: 1231517 - DNA, 14 bp, Homo sapiens
ggagccctgggttc

SEQ ID NO: 1231518 - DNA, 14 bp, Homo sapiens
ggagcccttctctt

SEQ ID NO: 1231519 - DNA, 13 bp, Homo sapiens
ggagcccttgggt

SEQ ID NO: 1231520 - DNA, 19 bp, Homo sapiens
ggagccgaagcccaggggc

SEQ ID NO: 1231521 - DNA, 22 bp, Homo sapiens
ggagccgaagcccaggggccgg

SEQ ID NO: 1231522 - DNA, 17 bp, Homo sapiens
ggagccgcgggacagcc

SEQ ID NO: 1231523 - DNA, 14 bp, Homo sapiens
ggagccgctggcag

SEQ ID NO: 1231524 - DNA, 17 bp, Homo sapiens
ggagccgggtctgcctc

SEQ ID NO: 1231525 - DNA, 18 bp, Homo sapiens
ggagccgggtctgcctct

SEQ ID NO: 1231526 - DNA, 21 bp, Homo sapiens
ggagcctagcggagcccagcc

SEQ ID NO: 1231527 - DNA, 22 bp, Homo sapiens
ggagcctagcggagcccagcct

SEQ ID NO: 1231528 - DNA, 23 bp, Homo sapiens
ggagcctagcggagcccagcctg

SEQ ID NO: 1231529 - DNA, 14 bp, Homo sapiens
ggagcctagctcct

SEQ ID NO: 1231530 - DNA, 14 bp, Homo sapiens
ggagcctaggacca

SEQ ID NO: 1231531 - DNA, 21 bp, Homo sapiens
ggagcctaggaccactcagcc

SEQ ID NO: 1231532 - DNA, 22 bp, Homo sapiens
ggagcctaggaccactcagccc

SEQ ID NO: 1231533 - DNA, 19 bp, Homo sapiens
ggagcctcatccgaggcag

SEQ ID NO: 1231534 - DNA, 20 bp, Homo sapiens
ggagcctccccatctgtcca

SEQ ID NO: 1231535 - DNA, 16 bp, Homo sapiens
ggagcctccccctcag

SEQ ID NO: 1231536 - DNA, 21 bp, Homo sapiens
ggagcctctttttccttcttc

SEQ ID NO: 1231537 - DNA, 13 bp, Homo sapiens
ggagcctgaggca

SEQ ID NO: 1231538 - DNA, 15 bp, Homo sapiens
ggagcctgaggcagg

SEQ ID NO: 1231539 - DNA, 23 bp, Homo sapiens
ggagcctgcatttcctcgcagcc

SEQ ID NO: 1231540 - DNA, 20 bp, Homo sapiens
ggagcctgtgttagtgtctg

SEQ ID NO: 1231541 - DNA, 20 bp, Homo sapiens
ggagccttgataatacttga

SEQ ID NO: 1231542 - DNA, 21 bp, Homo sapiens
ggagccttgataatacttgac

SEQ ID NO: 1231543 - DNA, 20 bp, Homo sapiens
ggagccttgctgggccaggg

SEQ ID NO: 1231544 - DNA, 21 bp, Homo sapiens
ggagccttgctgggccaggga

SEQ ID NO: 1231545 - DNA, 20 bp, Homo sapiens
ggagcgatccaggggaagcc

SEQ ID NO: 1231546 - DNA, 13 bp, Homo sapiens
ggagcgcaggcag

SEQ ID NO: 1231547 - DNA, 22 bp, Homo sapiens
ggagcgcccgccgtctgctccg

SEQ ID NO: 1231548 - DNA, 21 bp, Homo sapiens
ggagcgctagtgccttgccca

SEQ ID NO: 1231549 - DNA, 19 bp, Homo sapiens
ggagcggaggttgcagtga

SEQ ID NO: 1231550 - DNA, 13 bp, Homo sapiens
ggagcgggcaggg

SEQ ID NO: 1231551 - DNA, 16 bp, Homo sapiens
ggagcgggcagggccg

SEQ ID NO: 1231552 - DNA, 16 bp, Homo sapiens
ggagcgtcagggttgg

SEQ ID NO: 1231553 - DNA, 13 bp, Homo sapiens
ggagcgtctggga

SEQ ID NO: 1231554 - DNA, 18 bp, Homo sapiens
ggagcgttctctgtccta

SEQ ID NO: 1231555 - DNA, 17 bp, Homo sapiens
ggagcgtttgctgtgcc

SEQ ID NO: 1231556 - DNA, 20 bp, Homo sapiens
ggagcgtttgctgtgccagg

SEQ ID NO: 1231557 - DNA, 22 bp, Homo sapiens
ggagcgtttgctgtgccaggag

SEQ ID NO: 1231558 - DNA, 23 bp, Homo sapiens
ggagctcactgtggtgtctgtgt

SEQ ID NO: 1231559 - DNA, 13 bp, Homo sapiens
ggagctcctggga

SEQ ID NO: 1231560 - DNA, 17 bp, Homo sapiens
ggagctcctgggaccct

SEQ ID NO: 1231561 - DNA, 20 bp, Homo sapiens
ggagctcgcccctcccctca

SEQ ID NO: 1231562 - DNA, 18 bp, Homo sapiens
ggagctctcaattttatg

SEQ ID NO: 1231563 - DNA, 16 bp, Homo sapiens
ggagctctgcgccagg

SEQ ID NO: 1231564 - DNA, 18 bp, Homo sapiens
ggagctctgcgccaggca

SEQ ID NO: 1231565 - DNA, 20 bp, Homo sapiens
ggagctctgcgccaggcaga

SEQ ID NO: 1231566 - DNA, 23 bp, Homo sapiens
ggagctctgggaatttggagtga

SEQ ID NO: 1231567 - DNA, 20 bp, Homo sapiens
ggagctctggggacagcttc

SEQ ID NO: 1231568 - DNA, 13 bp, Homo sapiens
ggagctcttggaa

SEQ ID NO: 1231569 - DNA, 14 bp, Homo sapiens
ggagctcttggaag

SEQ ID NO: 1231570 - DNA, 14 bp, Homo sapiens
ggagctgagggagg

SEQ ID NO: 1231571 - DNA, 16 bp, Homo sapiens
ggagctgagggaggga

SEQ ID NO: 1231572 - DNA, 18 bp, Homo sapiens
ggagctgaggtttagatg

SEQ ID NO: 1231573 - DNA, 16 bp, Homo sapiens
ggagctgagtcacctc

SEQ ID NO: 1231574 - DNA, 17 bp, Homo sapiens
ggagctgatggcagctg

SEQ ID NO: 1231575 - DNA, 21 bp, Homo sapiens
ggagctgcacaaagtcagcag

SEQ ID NO: 1231576 - DNA, 22 bp, Homo sapiens
ggagctgcacaaagtcagcagg

SEQ ID NO: 1231577 - DNA, 15 bp, Homo sapiens
ggagctgcagagcag

SEQ ID NO: 1231578 - DNA, 15 bp, Homo sapiens
ggagctgccacagag

SEQ ID NO: 1231579 - DNA, 13 bp, Homo sapiens
ggagctgcccaga

SEQ ID NO: 1231580 - DNA, 21 bp, Homo sapiens
ggagctgccgtgcctgtgtcc

SEQ ID NO: 1231581 - DNA, 12 bp, Homo sapiens
ggagctgcctgc

SEQ ID NO: 1231582 - DNA, 14 bp, Homo sapiens
ggagctgcctgcag

SEQ ID NO: 1231583 - DNA, 20 bp, Homo sapiens
ggagctgcctgcagcacatg

SEQ ID NO: 1231584 - DNA, 18 bp, Homo sapiens
ggagctgctatagcctgg

SEQ ID NO: 1231585 - DNA, 14 bp, Homo sapiens
ggagctgctggctg

SEQ ID NO: 1231586 - DNA, 17 bp, Homo sapiens
ggagctgctggctgacc

SEQ ID NO: 1231587 - DNA, 22 bp, Homo sapiens
ggagctgctggctgacctgggc

SEQ ID NO: 1231588 - DNA, 23 bp, Homo sapiens
ggagctgctggctgacctgggcc

SEQ ID NO: 1231589 - DNA, 13 bp, Homo sapiens
ggagctgctgggc

SEQ ID NO: 1231590 - DNA, 18 bp, Homo sapiens
ggagctggccccgccgcc

SEQ ID NO: 1231591 - DNA, 14 bp, Homo sapiens
ggagctggctgtgc

SEQ ID NO: 1231592 - DNA, 16 bp, Homo sapiens
ggagctggctgtgcct

SEQ ID NO: 1231593 - DNA, 18 bp, Homo sapiens
ggagctggctgtgcctgc

SEQ ID NO: 1231594 - DNA, 20 bp, Homo sapiens
ggagctggctgtgcctgctt

SEQ ID NO: 1231595 - DNA, 20 bp, Homo sapiens
ggagctgggagccaggctct

SEQ ID NO: 1231596 - DNA, 15 bp, Homo sapiens
ggagctgggaggaaa

SEQ ID NO: 1231597 - DNA, 14 bp, Homo sapiens
ggagctggggtctg

SEQ ID NO: 1231598 - DNA, 22 bp, Homo sapiens
ggagctggggtctgggcagtgc

SEQ ID NO: 1231599 - DNA, 22 bp, Homo sapiens
ggagctggtctgccaggggctt

SEQ ID NO: 1231600 - DNA, 17 bp, Homo sapiens
ggagcttaagccactgc

SEQ ID NO: 1231601 - DNA, 18 bp, Homo sapiens
ggagcttaagccactgcc

SEQ ID NO: 1231602 - DNA, 20 bp, Homo sapiens
ggagcttacccaagctgtgg

SEQ ID NO: 1231603 - DNA, 21 bp, Homo sapiens
ggagcttacccaagctgtggc

SEQ ID NO: 1231604 - DNA, 21 bp, Homo sapiens
ggagcttagccaatgtgggag

SEQ ID NO: 1231605 - DNA, 17 bp, Homo sapiens
ggagcttgggactcagg

SEQ ID NO: 1231606 - DNA, 22 bp, Homo sapiens
ggagcttgggactcaggtctgt

SEQ ID NO: 1231607 - DNA, 16 bp, Homo sapiens
ggagtccactttgttt

SEQ ID NO: 1231608 - DNA, 19 bp, Homo sapiens
ggagtccagggtttctctg

SEQ ID NO: 1231609 - DNA, 20 bp, Homo sapiens
ggagtccagggtttctctgc

SEQ ID NO: 1231610 - DNA, 21 bp, Homo sapiens
ggagtcccctccccggcccta

SEQ ID NO: 1231611 - DNA, 23 bp, Homo sapiens
ggagtcccctccccggccctacc

SEQ ID NO: 1231612 - DNA, 16 bp, Homo sapiens
ggagtcccgtcaggac

SEQ ID NO: 1231613 - DNA, 20 bp, Homo sapiens
ggagtccctatagtttcacc

SEQ ID NO: 1231614 - DNA, 19 bp, Homo sapiens
ggagtcctctccagagagg

SEQ ID NO: 1231615 - DNA, 17 bp, Homo sapiens
ggagtcggttagtcatt

SEQ ID NO: 1231616 - DNA, 22 bp, Homo sapiens
ggagtcgtggggtgtgctggga

SEQ ID NO: 1231617 - DNA, 14 bp, Homo sapiens
ggagtctcaggagg

SEQ ID NO: 1231618 - DNA, 18 bp, Homo sapiens
ggagtctcaggaggaggc

SEQ ID NO: 1231619 - DNA, 22 bp, Homo sapiens
ggagtctcccactgcaacttgt

SEQ ID NO: 1231620 - DNA, 12 bp, Homo sapiens
ggagtctccctc

SEQ ID NO: 1231621 - DNA, 17 bp, Homo sapiens
ggatatgggtcctctgg

SEQ ID NO: 1231622 - DNA, 12 bp, Homo sapiens
ggatattataga

SEQ ID NO: 1231623 - DNA, 18 bp, Homo sapiens
ggatattgatttaaaatt

SEQ ID NO: 1231624 - DNA, 21 bp, Homo sapiens
ggatggaggggtggtcctgac

SEQ ID NO: 1231625 - DNA, 15 bp, Homo sapiens
ggatggcaccagagg

SEQ ID NO: 1231626 - DNA, 14 bp, Homo sapiens
ggcaacatctttat

SEQ ID NO: 1231627 - DNA, 18 bp, Homo sapiens
ggcaccttccgacatccc

SEQ ID NO: 1231628 - DNA, 19 bp, Homo sapiens
ggcacgaacccacctgctg

SEQ ID NO: 1231629 - DNA, 19 bp, Homo sapiens
ggcacgccaacagcccccc

SEQ ID NO: 1231630 - DNA, 20 bp, Homo sapiens
ggcacgccctactccactgc

SEQ ID NO: 1231631 - DNA, 21 bp, Homo sapiens
ggcacgccctactccactgcc

SEQ ID NO: 1231632 - DNA, 13 bp, Homo sapiens
ggcacggcaggcg

SEQ ID NO: 1231633 - DNA, 21 bp, Homo sapiens
gggaaccactcccaccacagg

SEQ ID NO: 1231634 - DNA, 19 bp, Homo sapiens
gggaaccatgaagacagga

SEQ ID NO: 1231635 - DNA, 18 bp, Homo sapiens
gggaaccccgcagcccgt

SEQ ID NO: 1231636 - DNA, 19 bp, Homo sapiens
gggaacctagtactctctg

SEQ ID NO: 1231637 - DNA, 11 bp, Homo sapiens
gggaacctccc

SEQ ID NO: 1231638 - DNA, 13 bp, Homo sapiens
gggaacctgtgtc

SEQ ID NO: 1231639 - DNA, 15 bp, Homo sapiens
gggaacctgtgtccg

SEQ ID NO: 1231640 - DNA, 15 bp, Homo sapiens
gggaacgcagcctcc

SEQ ID NO: 1231641 - DNA, 17 bp, Homo sapiens
gggaacgtgactgcccc

SEQ ID NO: 1231642 - DNA, 18 bp, Homo sapiens
gggaacgtgactgcccca

SEQ ID NO: 1231643 - DNA, 17 bp, Homo sapiens
gggaacgtgtgtccagg

SEQ ID NO: 1231644 - DNA, 14 bp, Homo sapiens
gggaactccactct

SEQ ID NO: 1231645 - DNA, 20 bp, Homo sapiens
gggaactgaatcaggaaact

SEQ ID NO: 1231646 - DNA, 18 bp, Homo sapiens
gggaactgacgctggaga

SEQ ID NO: 1231647 - DNA, 19 bp, Homo sapiens
gggaacttgcgagtccaag

SEQ ID NO: 1231648 - DNA, 15 bp, Homo sapiens
gggaagaaaaagcaa

SEQ ID NO: 1231649 - DNA, 16 bp, Homo sapiens
gggaagaagcagagag

SEQ ID NO: 1231650 - DNA, 17 bp, Homo sapiens
gggaagaagcagagaga

SEQ ID NO: 1231651 - DNA, 20 bp, Homo sapiens
gggaagacaggtctagactt

SEQ ID NO: 1231652 - DNA, 16 bp, Homo sapiens
gggaagagaagacaaa

SEQ ID NO: 1231653 - DNA, 20 bp, Homo sapiens
gggaagagaagagggcccag

SEQ ID NO: 1231654 - DNA, 17 bp, Homo sapiens
gggaagagctcccctcc

SEQ ID NO: 1231655 - DNA, 18 bp, Homo sapiens
gggaagaggatgagcaga

SEQ ID NO: 1231656 - DNA, 18 bp, Homo sapiens
gggaagagggagaccaaa

SEQ ID NO: 1231657 - DNA, 23 bp, Homo sapiens
gggaagatgtctcagagccttcc

SEQ ID NO: 1231658 - DNA, 15 bp, Homo sapiens
gggaagcagggacac

SEQ ID NO: 1231659 - DNA, 19 bp, Homo sapiens
gggaagcccatcctgacca

SEQ ID NO: 1231660 - DNA, 20 bp, Homo sapiens
gggaagcctgtgccagcacc

SEQ ID NO: 1231661 - DNA, 21 bp, Homo sapiens
gggaagcgtcgccccagtggc

SEQ ID NO: 1231662 - DNA, 15 bp, Homo sapiens
gggaagctggagtgc

SEQ ID NO: 1231663 - DNA, 16 bp, Homo sapiens
gggaagctggcctgag

SEQ ID NO: 1231664 - DNA, 22 bp, Homo sapiens
gggaagctgtactcagagcaga

SEQ ID NO: 1231665 - DNA, 23 bp, Homo sapiens
gggaagctttgtacctttagagt

SEQ ID NO: 1231666 - DNA, 14 bp, Homo sapiens
gggaaggaaacaaa

SEQ ID NO: 1231667 - DNA, 13 bp, Homo sapiens
gggaaggacacag

SEQ ID NO: 1231668 - DNA, 17 bp, Homo sapiens
gggaaggacacagcagt

SEQ ID NO: 1231669 - DNA, 21 bp, Homo sapiens
gggaaggacacagcagtattg

SEQ ID NO: 1231670 - DNA, 20 bp, Homo sapiens
gggaaggagggacttggctg

SEQ ID NO: 1231671 - DNA, 21 bp, Homo sapiens
gggaaggatgtttagcagtgg

SEQ ID NO: 1231672 - DNA, 23 bp, Homo sapiens
gggaaggatgtttagcagtggct

SEQ ID NO: 1231673 - DNA, 13 bp, Homo sapiens
gggaaggatttaa

SEQ ID NO: 1231674 - DNA, 18 bp, Homo sapiens
gggaaggcagaggctggc

SEQ ID NO: 1231675 - DNA, 15 bp, Homo sapiens
gggaaggccctgagg

SEQ ID NO: 1231676 - DNA, 18 bp, Homo sapiens
gggaaggccctgaggcgg

SEQ ID NO: 1231677 - DNA, 19 bp, Homo sapiens
gggaaggccctgaggcgga

SEQ ID NO: 1231678 - DNA, 16 bp, Homo sapiens
gggaagggagagcggg

SEQ ID NO: 1231679 - DNA, 13 bp, Homo sapiens
gggaagggcaggc

SEQ ID NO: 1231680 - DNA, 17 bp, Homo sapiens
gggaagggccaccctgc

SEQ ID NO: 1231681 - DNA, 12 bp, Homo sapiens
gggaagggccag

SEQ ID NO: 1231682 - DNA, 13 bp, Homo sapiens
gggaagggccagt

SEQ ID NO: 1231683 - DNA, 16 bp, Homo sapiens
gggaagggccagtctg

SEQ ID NO: 1231684 - DNA, 22 bp, Homo sapiens
gggaagggccagtctgggctgc

SEQ ID NO: 1231685 - DNA, 18 bp, Homo sapiens
gggaaggggacccccgcc

SEQ ID NO: 1231686 - DNA, 13 bp, Homo sapiens
gggaaggggagga

SEQ ID NO: 1231687 - DNA, 13 bp, Homo sapiens
gggaaggggatgg

SEQ ID NO: 1231688 - DNA, 19 bp, Homo sapiens
gggaaggggatggacaccc

SEQ ID NO: 1231689 - DNA, 17 bp, Homo sapiens
gggaaggggatggaggc

SEQ ID NO: 1231690 - DNA, 13 bp, Homo sapiens
gggaaggggccgg

SEQ ID NO: 1231691 - DNA, 17 bp, Homo sapiens
gggaaggggcctccctc

SEQ ID NO: 1231692 - DNA, 19 bp, Homo sapiens
gggaaggggtgcaggtggg

SEQ ID NO: 1231693 - DNA, 20 bp, Homo sapiens
gggaaggtggggccctgccc

SEQ ID NO: 1231694 - DNA, 22 bp, Homo sapiens
gggaaggtggggccctgcccct

SEQ ID NO: 1231695 - DNA, 22 bp, Homo sapiens
gggaagtacgtcccagcggcct

SEQ ID NO: 1231696 - DNA, 23 bp, Homo sapiens
gggaagtgaagactggaagctaa

SEQ ID NO: 1231697 - DNA, 18 bp, Homo sapiens
gggaagttgtctccttcc

SEQ ID NO: 1231698 - DNA, 22 bp, Homo sapiens
gggaagtttatttgagaaaata

SEQ ID NO: 1231699 - DNA, 23 bp, Homo sapiens
gggaatagtctagatggctcctc

SEQ ID NO: 1231700 - DNA, 12 bp, Homo sapiens
gggaatatttta

SEQ ID NO: 1231701 - DNA, 22 bp, Homo sapiens
gggaatccaagcctccacagcg

SEQ ID NO: 1231702 - DNA, 16 bp, Homo sapiens
gggaatgagcccagag

SEQ ID NO: 1231703 - DNA, 18 bp, Homo sapiens
gggaatgagcccagagaa

SEQ ID NO: 1231704 - DNA, 22 bp, Homo sapiens
gggaatgagcccagagaacagc

SEQ ID NO: 1231705 - DNA, 22 bp, Homo sapiens
gggaatgatagcccagaacaaa

SEQ ID NO: 1231706 - DNA, 14 bp, Homo sapiens
gggaatgcagcagg

SEQ ID NO: 1231707 - DNA, 17 bp, Homo sapiens
gggaatggaataactat

SEQ ID NO: 1231708 - DNA, 20 bp, Homo sapiens
gggaatggatggggagaatg

SEQ ID NO: 1231709 - DNA, 13 bp, Homo sapiens
gggaatgggagag

SEQ ID NO: 1231710 - DNA, 11 bp, Homo sapiens
gggaatgtttg

SEQ ID NO: 1231711 - DNA, 17 bp, Homo sapiens
gggaattaaaaagaaga

SEQ ID NO: 1231712 - DNA, 13 bp, Homo sapiens
gggaatttcctct

SEQ ID NO: 1231713 - DNA, 20 bp, Homo sapiens
gggaattttccccgtgacat

SEQ ID NO: 1231714 - DNA, 22 bp, Homo sapiens
gggacaacaatgaatcagaaca

SEQ ID NO: 1231715 - DNA, 18 bp, Homo sapiens
gggacacaaaactccgcc

SEQ ID NO: 1231716 - DNA, 17 bp, Homo sapiens
gggacacatgcccctcc

SEQ ID NO: 1231717 - DNA, 16 bp, Homo sapiens
gggacaccgtggggaa

SEQ ID NO: 1231718 - DNA, 16 bp, Homo sapiens
gggacacctgggagaa

SEQ ID NO: 1231719 - DNA, 15 bp, Homo sapiens
gggacactggcccca

SEQ ID NO: 1231720 - DNA, 16 bp, Homo sapiens
gggacactgggcagca

SEQ ID NO: 1231721 - DNA, 20 bp, Homo sapiens
gggacagaaaccaaggcccc

SEQ ID NO: 1231722 - DNA, 14 bp, Homo sapiens
gggacagacaggag

SEQ ID NO: 1231723 - DNA, 14 bp, Homo sapiens
gggacagagccacc

SEQ ID NO: 1231724 - DNA, 18 bp, Homo sapiens
gggacagagccaccccat

SEQ ID NO: 1231725 - DNA, 16 bp, Homo sapiens
gggacagagctgagga

SEQ ID NO: 1231726 - DNA, 14 bp, Homo sapiens
gggacagaggccct

SEQ ID NO: 1231727 - DNA, 18 bp, Homo sapiens
gggacagccagagctggg

SEQ ID NO: 1231728 - DNA, 20 bp, Homo sapiens
gggacagccagagctgggtg

SEQ ID NO: 1231729 - DNA, 17 bp, Homo sapiens
gggacaggagaagagag

SEQ ID NO: 1231730 - DNA, 22 bp, Homo sapiens
gggacaggctggaatgagggag

SEQ ID NO: 1231731 - DNA, 14 bp, Homo sapiens
gggacagggcaggc

SEQ ID NO: 1231732 - DNA, 21 bp, Homo sapiens
gggacaggtgggcctggcggc

SEQ ID NO: 1231733 - DNA, 19 bp, Homo sapiens
gggacagtgcgtgatttct

SEQ ID NO: 1231734 - DNA, 15 bp, Homo sapiens
gggacagttggcaga

SEQ ID NO: 1231735 - DNA, 16 bp, Homo sapiens
gggacagttggcagag

SEQ ID NO: 1231736 - DNA, 15 bp, Homo sapiens
gggacatctctttga

SEQ ID NO: 1231737 - DNA, 17 bp, Homo sapiens
gggacatgccctgtgtg

SEQ ID NO: 1231738 - DNA, 18 bp, Homo sapiens
gggacatgctcacctcta

SEQ ID NO: 1231739 - DNA, 15 bp, Homo sapiens
gggacatggggcaag

SEQ ID NO: 1231740 - DNA, 17 bp, Homo sapiens
gggacatggggcaagcc

SEQ ID NO: 1231741 - DNA, 22 bp, Homo sapiens
gggacatggggcaagccagggc

SEQ ID NO: 1231742 - DNA, 15 bp, Homo sapiens
gggacattgggaagg

SEQ ID NO: 1231743 - DNA, 16 bp, Homo sapiens
gggaccaaaggtcagg

SEQ ID NO: 1231744 - DNA, 17 bp, Homo sapiens
gggaccaaaggtcaggg

SEQ ID NO: 1231745 - DNA, 16 bp, Homo sapiens
gggaccaactgggccc

SEQ ID NO: 1231746 - DNA, 13 bp, Homo sapiens
gggaccaaggacc

SEQ ID NO: 1231747 - DNA, 12 bp, Homo sapiens
gggaccaaggca

SEQ ID NO: 1231748 - DNA, 18 bp, Homo sapiens
gggaccaattctggacag

SEQ ID NO: 1231749 - DNA, 13 bp, Homo sapiens
gggaccacatctg

SEQ ID NO: 1231750 - DNA, 16 bp, Homo sapiens
gggaccattgacctca

SEQ ID NO: 1231751 - DNA, 15 bp, Homo sapiens
gggacccacccagcc

SEQ ID NO: 1231752 - DNA, 22 bp, Homo sapiens
gggacccagagtcccaggcccc

SEQ ID NO: 1231753 - DNA, 14 bp, Homo sapiens
gggacccagctact

SEQ ID NO: 1231754 - DNA, 21 bp, Homo sapiens
gggacccagctactctgtcca

SEQ ID NO: 1231755 - DNA, 22 bp, Homo sapiens
gggacccagctactctgtccag

SEQ ID NO: 1231756 - DNA, 24 bp, Homo sapiens
gggacccagctactctgtccaggc

SEQ ID NO: 1231757 - DNA, 17 bp, Homo sapiens
gggacccagctcctctg

SEQ ID NO: 1231758 - DNA, 20 bp, Homo sapiens
gggacccagctcctctgagc

SEQ ID NO: 1231759 - DNA, 21 bp, Homo sapiens
gggacccagctcctctgagcc

SEQ ID NO: 1231760 - DNA, 23 bp, Homo sapiens
gggacccagctcctctgagccat

SEQ ID NO: 1231761 - DNA, 13 bp, Homo sapiens
gggacccaggctc

SEQ ID NO: 1231762 - DNA, 13 bp, Homo sapiens
gggaccccccccc

SEQ ID NO: 1231763 - DNA, 18 bp, Homo sapiens
gggacccccgccccctgc

SEQ ID NO: 1231764 - DNA, 21 bp, Homo sapiens
gggacccccgccccctgccct

SEQ ID NO: 1231765 - DNA, 24 bp, Homo sapiens
gggacccccgccccctgccctccc

SEQ ID NO: 1231766 - DNA, 22 bp, Homo sapiens
gggaccccctcgccagcttggc

SEQ ID NO: 1231767 - DNA, 23 bp, Homo sapiens
gggacccctcgcaaccctgcctg

SEQ ID NO: 1231768 - DNA, 23 bp, Homo sapiens
gggacccggggtctcctggacct

SEQ ID NO: 1231769 - DNA, 14 bp, Homo sapiens
gggaccctgggtgg

SEQ ID NO: 1231770 - DNA, 16 bp, Homo sapiens
gggacccttgcctgcc

SEQ ID NO: 1231771 - DNA, 18 bp, Homo sapiens
gggacccttgcctgcctc

SEQ ID NO: 1231772 - DNA, 22 bp, Homo sapiens
gggacccttgcctgcctcctag

SEQ ID NO: 1231773 - DNA, 18 bp, Homo sapiens
gggacccttgttggggag

SEQ ID NO: 1231774 - DNA, 22 bp, Homo sapiens
gggacccttgttggggagtggg

SEQ ID NO: 1231775 - DNA, 15 bp, Homo sapiens
gggaccgcctggccc

SEQ ID NO: 1231776 - DNA, 16 bp, Homo sapiens
gggaccgcctggccct

SEQ ID NO: 1231777 - DNA, 17 bp, Homo sapiens
gggaccgcctggccctc

SEQ ID NO: 1231778 - DNA, 19 bp, Homo sapiens
gggaccgcctggccctccc

SEQ ID NO: 1231779 - DNA, 19 bp, Homo sapiens
gggaccggtgctgcaggag

SEQ ID NO: 1231780 - DNA, 20 bp, Homo sapiens
gggaccggtgctgcaggagt

SEQ ID NO: 1231781 - DNA, 18 bp, Homo sapiens
gggaccgtccaggggaga

SEQ ID NO: 1231782 - DNA, 14 bp, Homo sapiens
gggaccgtgcccca

SEQ ID NO: 1231783 - DNA, 18 bp, Homo sapiens
gggaccgtgccccacctc

SEQ ID NO: 1231784 - DNA, 16 bp, Homo sapiens
gggaccgtgcgagctg

SEQ ID NO: 1231785 - DNA, 18 bp, Homo sapiens
gggacctcaggggcacct

SEQ ID NO: 1231786 - DNA, 13 bp, Homo sapiens
gggacctcctccc

SEQ ID NO: 1231787 - DNA, 19 bp, Homo sapiens
gggacctgccaggcagggg

SEQ ID NO: 1231788 - DNA, 18 bp, Homo sapiens
gggacctggtaccctcct

SEQ ID NO: 1231789 - DNA, 18 bp, Homo sapiens
gggacctgtcccccactc

SEQ ID NO: 1231790 - DNA, 23 bp, Homo sapiens
gggacctgtcccccactctctca

SEQ ID NO: 1231791 - DNA, 14 bp, Homo sapiens
gggacgcctgccct

SEQ ID NO: 1231792 - DNA, 16 bp, Homo sapiens
gggacgcctgccctgc

SEQ ID NO: 1231793 - DNA, 22 bp, Homo sapiens
gggacgcctgggggtgccagga

SEQ ID NO: 1231794 - DNA, 19 bp, Homo sapiens
gggacgggcaagtgagagg

SEQ ID NO: 1231795 - DNA, 23 bp, Homo sapiens
gggacgggcaagtgagaggggag

SEQ ID NO: 1231796 - DNA, 14 bp, Homo sapiens
gggacggggctgac

SEQ ID NO: 1231797 - DNA, 18 bp, Homo sapiens
gggacgtggctcagccag

SEQ ID NO: 1231798 - DNA, 22 bp, Homo sapiens
gggacgtggctcagccagcact

SEQ ID NO: 1231799 - DNA, 16 bp, Homo sapiens
gggactcagccctgag

SEQ ID NO: 1231800 - DNA, 15 bp, Homo sapiens
gggactcccagcaga

SEQ ID NO: 1231801 - DNA, 18 bp, Homo sapiens
gggactcccagcagagcc

SEQ ID NO: 1231802 - DNA, 19 bp, Homo sapiens
gggactcccagcagagccc

SEQ ID NO: 1231803 - DNA, 22 bp, Homo sapiens
gggactcctcaaaccacttgcc

SEQ ID NO: 1231804 - DNA, 22 bp, Homo sapiens
gggactctgagcgggaggcaga

SEQ ID NO: 1231805 - DNA, 12 bp, Homo sapiens
gggactctgccg

SEQ ID NO: 1231806 - DNA, 12 bp, Homo sapiens
gggactctggca

SEQ ID NO: 1231807 - DNA, 11 bp, Homo sapiens
gggactgagag

SEQ ID NO: 1231808 - DNA, 12 bp, Homo sapiens
gggactgagaga

SEQ ID NO: 1231809 - DNA, 19 bp, Homo sapiens
gggactgagccagtcccag

SEQ ID NO: 1231810 - DNA, 16 bp, Homo sapiens
gggactgctaaataaa

SEQ ID NO: 1231811 - DNA, 15 bp, Homo sapiens
gggactgctgctgcc

SEQ ID NO: 1231812 - DNA, 18 bp, Homo sapiens
gggactgctgctgcctgg

SEQ ID NO: 1231813 - DNA, 22 bp, Homo sapiens
gggactgctgctgcctggccac

SEQ ID NO: 1231814 - DNA, 15 bp, Homo sapiens
gggactgctggctca

SEQ ID NO: 1231815 - DNA, 18 bp, Homo sapiens
gggactgggagtcagagc

SEQ ID NO: 1231816 - DNA, 12 bp, Homo sapiens
gggactgggttt

SEQ ID NO: 1231817 - DNA, 20 bp, Homo sapiens
gggactgggtttggacccca

SEQ ID NO: 1231818 - DNA, 21 bp, Homo sapiens
gggactgggtttggaccccag

SEQ ID NO: 1231819 - DNA, 14 bp, Homo sapiens
gggactggtcccgg

SEQ ID NO: 1231820 - DNA, 16 bp, Homo sapiens
gggactgtcacactgg

SEQ ID NO: 1231821 - DNA, 21 bp, Homo sapiens
gggactgtcacactggtgctg

SEQ ID NO: 1231822 - DNA, 13 bp, Homo sapiens
gggacttgaagtt

SEQ ID NO: 1231823 - DNA, 18 bp, Homo sapiens
gggacttggagagcaaag

SEQ ID NO: 1231824 - DNA, 14 bp, Homo sapiens
gggacttggctgtc

SEQ ID NO: 1231825 - DNA, 18 bp, Homo sapiens
gggagaaaagacggatgg

SEQ ID NO: 1231826 - DNA, 22 bp, Homo sapiens
gggagaaaagacggatggcagg

SEQ ID NO: 1231827 - DNA, 14 bp, Homo sapiens
gggagaaaatcatc

SEQ ID NO: 1231828 - DNA, 15 bp, Homo sapiens
gggagaaataatgca

SEQ ID NO: 1231829 - DNA, 16 bp, Homo sapiens
gggagaaatcatcctg

SEQ ID NO: 1231830 - DNA, 14 bp, Homo sapiens
gggagaaatgccag

SEQ ID NO: 1231831 - DNA, 14 bp, Homo sapiens
gggagaagaagaat

SEQ ID NO: 1231832 - DNA, 20 bp, Homo sapiens
gggagaaggaagggcagaga

SEQ ID NO: 1231833 - DNA, 21 bp, Homo sapiens
gggagaaggcatgagaaagaa

SEQ ID NO: 1231834 - DNA, 23 bp, Homo sapiens
gggagaaggtctccaagggaggg

SEQ ID NO: 1231835 - DNA, 17 bp, Homo sapiens
gggagaagtagctagta

SEQ ID NO: 1231836 - DNA, 18 bp, Homo sapiens
gggagaagtgggggcagc

SEQ ID NO: 1231837 - DNA, 15 bp, Homo sapiens
gggagaatcatgtga

SEQ ID NO: 1231838 - DNA, 12 bp, Homo sapiens
gggagaatctga

SEQ ID NO: 1231839 - DNA, 23 bp, Homo sapiens
gggagaattgcacacagatgtga

SEQ ID NO: 1231840 - DNA, 14 bp, Homo sapiens
gggagacactggcc

SEQ ID NO: 1231841 - DNA, 14 bp, Homo sapiens
gggagacagcagcc

SEQ ID NO: 1231842 - DNA, 15 bp, Homo sapiens
gggagacagcagcct

SEQ ID NO: 1231843 - DNA, 18 bp, Homo sapiens
gggagacagcagcctgta

SEQ ID NO: 1231844 - DNA, 23 bp, Homo sapiens
gggagacagcttctctgcagtaa

SEQ ID NO: 1231845 - DNA, 18 bp, Homo sapiens
gggagacaggagcctagc

SEQ ID NO: 1231846 - DNA, 16 bp, Homo sapiens
gggagacatggaccag

SEQ ID NO: 1231847 - DNA, 21 bp, Homo sapiens
gggagacatggaccagcatct

SEQ ID NO: 1231848 - DNA, 16 bp, Homo sapiens
gggagactgggctgag

SEQ ID NO: 1231849 - DNA, 22 bp, Homo sapiens
gggagagagagagagagaggac

SEQ ID NO: 1231850 - DNA, 14 bp, Homo sapiens
gggagagccagctc

SEQ ID NO: 1231851 - DNA, 12 bp, Homo sapiens
gggagagcccag

SEQ ID NO: 1231852 - DNA, 12 bp, Homo sapiens
gggagagcctgg

SEQ ID NO: 1231853 - DNA, 19 bp, Homo sapiens
gggagagcgcctcttcctc

SEQ ID NO: 1231854 - DNA, 22 bp, Homo sapiens
gggagagctgagccagttgtcc

SEQ ID NO: 1231855 - DNA, 17 bp, Homo sapiens
gggagaggctgggaggt

SEQ ID NO: 1231856 - DNA, 18 bp, Homo sapiens
gggagagggatttccctg

SEQ ID NO: 1231857 - DNA, 12 bp, Homo sapiens
gggagaggggga

SEQ ID NO: 1231858 - DNA, 19 bp, Homo sapiens
gggagaggtcaccagctgc

SEQ ID NO: 1231859 - DNA, 16 bp, Homo sapiens
gggagaggtggcagga

SEQ ID NO: 1231860 - DNA, 16 bp, Homo sapiens
gggagatgcttctctc

SEQ ID NO: 1231861 - DNA, 15 bp, Homo sapiens
gggagatggtcagtg

SEQ ID NO: 1231862 - DNA, 22 bp, Homo sapiens
gggagatggtcagtgtggagag

SEQ ID NO: 1231863 - DNA, 15 bp, Homo sapiens
gggagccagtgtgcc

SEQ ID NO: 1231864 - DNA, 15 bp, Homo sapiens
gggagccatttgaga

SEQ ID NO: 1231865 - DNA, 22 bp, Homo sapiens
gggagcccccgccccgccccac

SEQ ID NO: 1231866 - DNA, 10 bp, Homo sapiens
gggagccctc

SEQ ID NO: 1231867 - DNA, 12 bp, Homo sapiens
gggagccctcag

SEQ ID NO: 1231868 - DNA, 14 bp, Homo sapiens
gggagccctcaggc

SEQ ID NO: 1231869 - DNA, 16 bp, Homo sapiens
gggagccctcaggctc

SEQ ID NO: 1231870 - DNA, 21 bp, Homo sapiens
gggagccctcaggctccccag

SEQ ID NO: 1231871 - DNA, 20 bp, Homo sapiens
gggagccctgaccttggctg

SEQ ID NO: 1231872 - DNA, 20 bp, Homo sapiens
gggagccggtaactgtcctg

SEQ ID NO: 1231873 - DNA, 14 bp, Homo sapiens
gggagcctccccat

SEQ ID NO: 1231874 - DNA, 13 bp, Homo sapiens
gggagcctccccc

SEQ ID NO: 1231875 - DNA, 20 bp, Homo sapiens
gggagcctccccctcagatg

SEQ ID NO: 1231876 - DNA, 16 bp, Homo sapiens
gggagcctcgcccctc

SEQ ID NO: 1231877 - DNA, 21 bp, Homo sapiens
gggagcctttggttctggcca

SEQ ID NO: 1231878 - DNA, 22 bp, Homo sapiens
gggagcctttggttctggccag

SEQ ID NO: 1231879 - DNA, 16 bp, Homo sapiens
gggagcgtctgggaac

SEQ ID NO: 1231880 - DNA, 23 bp, Homo sapiens
gggagctccactctgcttctctg

SEQ ID NO: 1231881 - DNA, 19 bp, Homo sapiens
gggagctcctgggaccctt

SEQ ID NO: 1231882 - DNA, 12 bp, Homo sapiens
gggagctctgca

SEQ ID NO: 1231883 - DNA, 23 bp, Homo sapiens
gggagctctggggacagcttcct

SEQ ID NO: 1231884 - DNA, 19 bp, Homo sapiens
gggagctgagcagcctctg

SEQ ID NO: 1231885 - DNA, 12 bp, Homo sapiens
gggagctgaggc

SEQ ID NO: 1231886 - DNA, 15 bp, Homo sapiens
gggagctgcacacac

SEQ ID NO: 1231887 - DNA, 17 bp, Homo sapiens
gggagctgcagagcagc

SEQ ID NO: 1231888 - DNA, 22 bp, Homo sapiens
gggagctgctggctgacctggg

SEQ ID NO: 1231889 - DNA, 12 bp, Homo sapiens
gggagctgggag

SEQ ID NO: 1231890 - DNA, 18 bp, Homo sapiens
gggagctgggagccaggc

SEQ ID NO: 1231891 - DNA, 18 bp, Homo sapiens
gggagcttgggactcagg

SEQ ID NO: 1231892 - DNA, 20 bp, Homo sapiens
gggaggaaagggcctggcca

SEQ ID NO: 1231893 - DNA, 18 bp, Homo sapiens
gggaggaagttggctgag

SEQ ID NO: 1231894 - DNA, 12 bp, Homo sapiens
gggaggacaggc

SEQ ID NO: 1231895 - DNA, 16 bp, Homo sapiens
gggaggacaggcaggc

SEQ ID NO: 1231896 - DNA, 18 bp, Homo sapiens
gggaggaccagggccctg

SEQ ID NO: 1231897 - DNA, 13 bp, Homo sapiens
gggaggagcagca

SEQ ID NO: 1231898 - DNA, 15 bp, Homo sapiens
gggaggagcagcaag

SEQ ID NO: 1231899 - DNA, 15 bp, Homo sapiens
gggaggaggacttgg

SEQ ID NO: 1231900 - DNA, 13 bp, Homo sapiens
gggaggagggaga

SEQ ID NO: 1231901 - DNA, 14 bp, Homo sapiens
gggaggagggagag

SEQ ID NO: 1231902 - DNA, 17 bp, Homo sapiens
gggaggatcactggagc

SEQ ID NO: 1231903 - DNA, 22 bp, Homo sapiens
gggaggatcactggagcccagg

SEQ ID NO: 1231904 - DNA, 23 bp, Homo sapiens
gggaggatcactggagcccagga

SEQ ID NO: 1231905 - DNA, 23 bp, Homo sapiens
gggaggattgcttgagctcagga

SEQ ID NO: 1231906 - DNA, 12 bp, Homo sapiens
gggaggcaccag

SEQ ID NO: 1231907 - DNA, 14 bp, Homo sapiens
gggaggcaccagct

SEQ ID NO: 1231908 - DNA, 15 bp, Homo sapiens
gggaggcacctccag

SEQ ID NO: 1231909 - DNA, 17 bp, Homo sapiens
gggaggcagagcgggag

SEQ ID NO: 1231910 - DNA, 13 bp, Homo sapiens
gggaggcagccgg

SEQ ID NO: 1231911 - DNA, 16 bp, Homo sapiens
gggaggcagcgtgggc

SEQ ID NO: 1231912 - DNA, 23 bp, Homo sapiens
gggaggcagcgtgggctctgcca

SEQ ID NO: 1231913 - DNA, 13 bp, Homo sapiens
gggaggcagggct

SEQ ID NO: 1231914 - DNA, 14 bp, Homo sapiens
gggaggcagggctg

SEQ ID NO: 1231915 - DNA, 14 bp, Homo sapiens
gggaggccaaggca

SEQ ID NO: 1231916 - DNA, 19 bp, Homo sapiens
gggaggccaaggcaggtag

SEQ ID NO: 1231917 - DNA, 13 bp, Homo sapiens
gggaggccacgtc

SEQ ID NO: 1231918 - DNA, 12 bp, Homo sapiens
gggaggccaggc

SEQ ID NO: 1231919 - DNA, 11 bp, Homo sapiens
gggaggccctg

SEQ ID NO: 1231920 - DNA, 19 bp, Homo sapiens
gggaggccgaggtgggcag

SEQ ID NO: 1231921 - DNA, 18 bp, Homo sapiens
gggaggcggagagtacag

SEQ ID NO: 1231922 - DNA, 13 bp, Homo sapiens
gggaggcggggag

SEQ ID NO: 1231923 - DNA, 15 bp, Homo sapiens
gggaggcggggagga

SEQ ID NO: 1231924 - DNA, 18 bp, Homo sapiens
gggaggcgtgcccccctc

SEQ ID NO: 1231925 - DNA, 17 bp, Homo sapiens
gggaggctgagacagga

SEQ ID NO: 1231926 - DNA, 18 bp, Homo sapiens
gggaggctgaggcaggag

SEQ ID NO: 1231927 - DNA, 14 bp, Homo sapiens
gggaggctgaggcg

SEQ ID NO: 1231928 - DNA, 22 bp, Homo sapiens
gggaggctgcactggagccaca

SEQ ID NO: 1231929 - DNA, 14 bp, Homo sapiens
gggaggctggggcc

SEQ ID NO: 1231930 - DNA, 12 bp, Homo sapiens
gggagggaaggg

SEQ ID NO: 1231931 - DNA, 18 bp, Homo sapiens
gggagggaagggccaccc

SEQ ID NO: 1231932 - DNA, 20 bp, Homo sapiens
gggagggaagggccaccctg

SEQ ID NO: 1231933 - DNA, 13 bp, Homo sapiens
gggagggagccat

SEQ ID NO: 1231934 - DNA, 16 bp, Homo sapiens
gggagggagccatgga

SEQ ID NO: 1231935 - DNA, 16 bp, Homo sapiens
gggagggatcagcccc

SEQ ID NO: 1231936 - DNA, 22 bp, Homo sapiens
gggagggattctggttccaggg

SEQ ID NO: 1231937 - DNA, 13 bp, Homo sapiens
gggagggcagcag

SEQ ID NO: 1231938 - DNA, 11 bp, Homo sapiens
gggagggcagg

SEQ ID NO: 1231939 - DNA, 16 bp, Homo sapiens
gggagggcaggatggc

SEQ ID NO: 1231940 - DNA, 21 bp, Homo sapiens
gggagggccagggaggcagag

SEQ ID NO: 1231941 - DNA, 22 bp, Homo sapiens
gggagggctcctggggcagaga

SEQ ID NO: 1231942 - DNA, 13 bp, Homo sapiens
gggaggggaaatg

SEQ ID NO: 1231943 - DNA, 11 bp, Homo sapiens
gggagtgggtg

SEQ ID NO: 1231944 - DNA, 20 bp, Homo sapiens
gggagtgttctgtgggcttg

SEQ ID NO: 1231945 - DNA, 20 bp, Homo sapiens
gggagttcgagaccaacctg

SEQ ID NO: 1231946 - DNA, 22 bp, Homo sapiens
gggagttgtcaagtctctgctg

SEQ ID NO: 1231947 - DNA, 19 bp, Homo sapiens
gggataaccccaggcactg

SEQ ID NO: 1231948 - DNA, 23 bp, Homo sapiens
gggataaccccaggcactgtttg

SEQ ID NO: 1231949 - DNA, 23 bp, Homo sapiens
gggataagaattgtctctgggct

SEQ ID NO: 1231950 - DNA, 19 bp, Homo sapiens
gggataatgtccccactcc

SEQ ID NO: 1231951 - DNA, 20 bp, Homo sapiens
gggatagtccttcctggcat

SEQ ID NO: 1231952 - DNA, 22 bp, Homo sapiens
gggatagtgttctgctcctgct

SEQ ID NO: 1231953 - DNA, 22 bp, Homo sapiens
gggatataaaaacagattctga

SEQ ID NO: 1231954 - DNA, 23 bp, Homo sapiens
gggatataaaaacagattctgat

SEQ ID NO: 1231955 - DNA, 15 bp, Homo sapiens
gggatataggagagg

SEQ ID NO: 1231956 - DNA, 22 bp, Homo sapiens
gggatcaaccagctaagaaaag

SEQ ID NO: 1231957 - DNA, 17 bp, Homo sapiens
gggatcaataggaaagc

SEQ ID NO: 1231958 - DNA, 13 bp, Homo sapiens
gggatcacaaggt

SEQ ID NO: 1231959 - DNA, 12 bp, Homo sapiens
gggatcactggc

SEQ ID NO: 1231960 - DNA, 23 bp, Homo sapiens
gggatcagcctccgccattccaa

SEQ ID NO: 1231961 - DNA, 21 bp, Homo sapiens
gggatcatttttccaggactc

SEQ ID NO: 1231962 - DNA, 22 bp, Homo sapiens
gggatccaatatgactcagaga

SEQ ID NO: 1231963 - DNA, 17 bp, Homo sapiens
gggatccccgcctggcc

SEQ ID NO: 1231964 - DNA, 19 bp, Homo sapiens
gggatccccgcctggccag

SEQ ID NO: 1231965 - DNA, 20 bp, Homo sapiens
gggatccccgcctggccagg

SEQ ID NO: 1231966 - DNA, 12 bp, Homo sapiens
gggatcctgccc

SEQ ID NO: 1231967 - DNA, 20 bp, Homo sapiens
gggatctgatgaaaaggtca

SEQ ID NO: 1231968 - DNA, 22 bp, Homo sapiens
gggatctggggggtggggagga

SEQ ID NO: 1231969 - DNA, 19 bp, Homo sapiens
gggatctggtcctacccat

SEQ ID NO: 1231970 - DNA, 13 bp, Homo sapiens
gggatcttcccac

SEQ ID NO: 1231971 - DNA, 15 bp, Homo sapiens
gggatgagccgctgt

SEQ ID NO: 1231972 - DNA, 20 bp, Homo sapiens
gggatgagctcaagcaggaa

SEQ ID NO: 1231973 - DNA, 16 bp, Homo sapiens
gggatgcaaggtagca

SEQ ID NO: 1231974 - DNA, 13 bp, Homo sapiens
gggatgcagtgat

SEQ ID NO: 1231975 - DNA, 20 bp, Homo sapiens
gggatgccactcctccctcc

SEQ ID NO: 1231976 - DNA, 13 bp, Homo sapiens
gggatgcctcacc

SEQ ID NO: 1231977 - DNA, 15 bp, Homo sapiens
gggatgcctcaccac

SEQ ID NO: 1231978 - DNA, 20 bp, Homo sapiens
gggatgcgtgggaggcagaa

SEQ ID NO: 1231979 - DNA, 19 bp, Homo sapiens
gggatggacaggaaagggc

SEQ ID NO: 1231980 - DNA, 13 bp, Homo sapiens
gggatggaggcca

SEQ ID NO: 1231981 - DNA, 22 bp, Homo sapiens
gggatggcatttggtctcaggc

SEQ ID NO: 1231982 - DNA, 16 bp, Homo sapiens
gggatgggtggggagg

SEQ ID NO: 1231983 - DNA, 14 bp, Homo sapiens
gggatggtagtttt

SEQ ID NO: 1231984 - DNA, 20 bp, Homo sapiens
gggatggtcggatctcacag

SEQ ID NO: 1231985 - DNA, 17 bp, Homo sapiens
gggatggtgcccctagg

SEQ ID NO: 1231986 - DNA, 17 bp, Homo sapiens
gggatggtggcacaggc

SEQ ID NO: 1231987 - DNA, 16 bp, Homo sapiens
gggatgtatttttctt

SEQ ID NO: 1231988 - DNA, 14 bp, Homo sapiens
gggatgtgacatgc

SEQ ID NO: 1231989 - DNA, 20 bp, Homo sapiens
gggattaatatgaaaactta

SEQ ID NO: 1231990 - DNA, 13 bp, Homo sapiens
gggattcctgacc

SEQ ID NO: 1231991 - DNA, 22 bp, Homo sapiens
gggattctctattggaggtgag

SEQ ID NO: 1231992 - DNA, 18 bp, Homo sapiens
gggattgaagggtcctgc

SEQ ID NO: 1231993 - DNA, 14 bp, Homo sapiens
gggattggggggaa

SEQ ID NO: 1231994 - DNA, 18 bp, Homo sapiens
gggattgtctcagggccg

SEQ ID NO: 1231995 - DNA, 15 bp, Homo sapiens
gggatttaatttcca

SEQ ID NO: 1231996 - DNA, 13 bp, Homo sapiens
gggatttctggga

SEQ ID NO: 1231997 - DNA, 20 bp, Homo sapiens
gggcaaaagggcagctgtga

SEQ ID NO: 1231998 - DNA, 18 bp, Homo sapiens
gggcaaagccacaaggct

SEQ ID NO: 1231999 - DNA, 20 bp, Homo sapiens
gggcaaagccacaaggctgg

SEQ ID NO: 1232000 - DNA, 21 bp, Homo sapiens
gggcaaaggtttgaagacaca

SEQ ID NO: 1232001 - DNA, 14 bp, Homo sapiens
gggcaacactgcag

SEQ ID NO: 1232002 - DNA, 22 bp, Homo sapiens
gggcaacagagcaagatcctgt

SEQ ID NO: 1232003 - DNA, 22 bp, Homo sapiens
gggcaacatagtgagattctgt

SEQ ID NO: 1232004 - DNA, 21 bp, Homo sapiens
gggcaagacagaaaagtgcct

SEQ ID NO: 1232005 - DNA, 12 bp, Homo sapiens
gggcaagagatg

SEQ ID NO: 1232006 - DNA, 12 bp, Homo sapiens
gggcaagccagg

SEQ ID NO: 1232007 - DNA, 16 bp, Homo sapiens
gggcagtcagtggagg

SEQ ID NO: 1232008 - DNA, 17 bp, Homo sapiens
gggcagtcattatccag

SEQ ID NO: 1232009 - DNA, 21 bp, Homo sapiens
gggcagtccttactcccccac

SEQ ID NO: 1232010 - DNA, 17 bp, Homo sapiens
gggcagtgccacagcct

SEQ ID NO: 1232011 - DNA, 16 bp, Homo sapiens
gggcagtgccacccgc

SEQ ID NO: 1232012 - DNA, 14 bp, Homo sapiens
gggcagtgccccag

SEQ ID NO: 1232013 - DNA, 15 bp, Homo sapiens
gggcagtgccccagg

SEQ ID NO: 1232014 - DNA, 18 bp, Homo sapiens
gggcagtgccccagggag

SEQ ID NO: 1232015 - DNA, 21 bp, Homo sapiens
gggcagtggtaagctctggct

SEQ ID NO: 1232016 - DNA, 19 bp, Homo sapiens
gggcagttagagcagcctc

SEQ ID NO: 1232017 - DNA, 14 bp, Homo sapiens
gggcagttctccca

SEQ ID NO: 1232018 - DNA, 19 bp, Homo sapiens
gggcagttctcccagggag

SEQ ID NO: 1232019 - DNA, 16 bp, Homo sapiens
gggcatcaggcactgg

SEQ ID NO: 1232020 - DNA, 21 bp, Homo sapiens
gggcatccacccagtgctgcc

SEQ ID NO: 1232021 - DNA, 14 bp, Homo sapiens
gggcatcgcaggag

SEQ ID NO: 1232022 - DNA, 20 bp, Homo sapiens
gggcatctgagtccagctcc

SEQ ID NO: 1232023 - DNA, 22 bp, Homo sapiens
gggcatctgtctgtctgtgggc

SEQ ID NO: 1232024 - DNA, 23 bp, Homo sapiens
gggcatctgtctgtctgtgggct

SEQ ID NO: 1232025 - DNA, 15 bp, Homo sapiens
gggcatcttctggct

SEQ ID NO: 1232026 - DNA, 17 bp, Homo sapiens
gggcatcttgctggcta

SEQ ID NO: 1232027 - DNA, 23 bp, Homo sapiens
gggcatgagctgctgtgcccagc

SEQ ID NO: 1232028 - DNA, 23 bp, Homo sapiens
gggcatgcacacggctggtcact

SEQ ID NO: 1232029 - DNA, 16 bp, Homo sapiens
gggcatgccaccctca

SEQ ID NO: 1232030 - DNA, 22 bp, Homo sapiens
gggcatggcaaatcaggggcca

SEQ ID NO: 1232031 - DNA, 15 bp, Homo sapiens
gggcatggccaggtg

SEQ ID NO: 1232032 - DNA, 17 bp, Homo sapiens
gggcatggccgcttcta

SEQ ID NO: 1232033 - DNA, 22 bp, Homo sapiens
gggcatggccgcttctagagcc

SEQ ID NO: 1232034 - DNA, 14 bp, Homo sapiens
gggcatggcgtgga

SEQ ID NO: 1232035 - DNA, 16 bp, Homo sapiens
gggcatggcgtggagg

SEQ ID NO: 1232036 - DNA, 15 bp, Homo sapiens
gggcatgggcctctc

SEQ ID NO: 1232037 - DNA, 17 bp, Homo sapiens
gggcatgggttggcagg

SEQ ID NO: 1232038 - DNA, 19 bp, Homo sapiens
gggcatggttccttccctg

SEQ ID NO: 1232039 - DNA, 21 bp, Homo sapiens
gggcatgtattggcctggagg

SEQ ID NO: 1232040 - DNA, 16 bp, Homo sapiens
gggcatgtgtatgtgt

SEQ ID NO: 1232041 - DNA, 23 bp, Homo sapiens
gggcatgtgtgcctgtggcagaa

SEQ ID NO: 1232042 - DNA, 23 bp, Homo sapiens
gggcattcacaacccgagttacc

SEQ ID NO: 1232043 - DNA, 13 bp, Homo sapiens
gggcattgcagcc

SEQ ID NO: 1232044 - DNA, 14 bp, Homo sapiens
gggcattgcagcct

SEQ ID NO: 1232045 - DNA, 23 bp, Homo sapiens
gggcattgggctgacacctacca

SEQ ID NO: 1232046 - DNA, 17 bp, Homo sapiens
gggcattttacccttgc

SEQ ID NO: 1232047 - DNA, 13 bp, Homo sapiens
gggcattttcctc

SEQ ID NO: 1232048 - DNA, 17 bp, Homo sapiens
gggccaaagaaggcagg

SEQ ID NO: 1232049 - DNA, 18 bp, Homo sapiens
gggccaaagaaggcaggg

SEQ ID NO: 1232050 - DNA, 19 bp, Homo sapiens
gggccaaagaaggcaggga

SEQ ID NO: 1232051 - DNA, 23 bp, Homo sapiens
gggccaaatccgctctcttcctg

SEQ ID NO: 1232052 - DNA, 22 bp, Homo sapiens
gggccaacttgagggcccagag

SEQ ID NO: 1232053 - DNA, 17 bp, Homo sapiens
gggccaagtccactgtc

SEQ ID NO: 1232054 - DNA, 19 bp, Homo sapiens
gggccaagtccactgtcct

SEQ ID NO: 1232055 - DNA, 23 bp, Homo sapiens
gggccacacctgagcgctgtgga

SEQ ID NO: 1232056 - DNA, 19 bp, Homo sapiens
gggccacatagatgctgat

SEQ ID NO: 1232057 - DNA, 16 bp, Homo sapiens
gggccaccaaagctgc

SEQ ID NO: 1232058 - DNA, 18 bp, Homo sapiens
gggccaccacctttggct

SEQ ID NO: 1232059 - DNA, 11 bp, Homo sapiens
gggccaccctg

SEQ ID NO: 1232060 - DNA, 14 bp, Homo sapiens
gggccaccctgctg

SEQ ID NO: 1232061 - DNA, 19 bp, Homo sapiens
gggccaccctgctgcacta

SEQ ID NO: 1232062 - DNA, 16 bp, Homo sapiens
gggccacgccccagcc

SEQ ID NO: 1232063 - DNA, 18 bp, Homo sapiens
gggccacgccccagcccg

SEQ ID NO: 1232064 - DNA, 21 bp, Homo sapiens
gggccacgccccagcccgaca

SEQ ID NO: 1232065 - DNA, 14 bp, Homo sapiens
gggccacgtgccag

SEQ ID NO: 1232066 - DNA, 19 bp, Homo sapiens
gggccacgtgccaggcccg

SEQ ID NO: 1232067 - DNA, 18 bp, Homo sapiens
gggccacgtggatgggca

SEQ ID NO: 1232068 - DNA, 23 bp, Homo sapiens
gggccacgtgtgctgtggccagg

SEQ ID NO: 1232069 - DNA, 18 bp, Homo sapiens
gggccagaaggagggcag

SEQ ID NO: 1232070 - DNA, 21 bp, Homo sapiens
gggccagagagcaggggagct

SEQ ID NO: 1232071 - DNA, 11 bp, Homo sapiens
gggccagagct

SEQ ID NO: 1232072 - DNA, 18 bp, Homo sapiens
gggccagagctagggctg

SEQ ID NO: 1232073 - DNA, 23 bp, Homo sapiens
gggccagagctagggctgctgct

SEQ ID NO: 1232074 - DNA, 19 bp, Homo sapiens
gggcccaagaactgcagat

SEQ ID NO: 1232075 - DNA, 18 bp, Homo sapiens
gggcccaagccccatctc

SEQ ID NO: 1232076 - DNA, 17 bp, Homo sapiens
gggcccaagttgcagtg

SEQ ID NO: 1232077 - DNA, 15 bp, Homo sapiens
gggcccacagagcct

SEQ ID NO: 1232078 - DNA, 17 bp, Homo sapiens
gggcccacagagcctgg

SEQ ID NO: 1232079 - DNA, 10 bp, Homo sapiens
gggcccacct

SEQ ID NO: 1232080 - DNA, 22 bp, Homo sapiens
gggcccacttggggccttcccc

SEQ ID NO: 1232081 - DNA, 11 bp, Homo sapiens
gggcccagaac

SEQ ID NO: 1232082 - DNA, 20 bp, Homo sapiens
gggcccagaactgcccccac

SEQ ID NO: 1232083 - DNA, 17 bp, Homo sapiens
gggcccagagcccttga

SEQ ID NO: 1232084 - DNA, 14 bp, Homo sapiens
gggcccagattcta

SEQ ID NO: 1232085 - DNA, 16 bp, Homo sapiens
gggcccagccaggagc

SEQ ID NO: 1232086 - DNA, 21 bp, Homo sapiens
gggcccagccaggagcagatg

SEQ ID NO: 1232087 - DNA, 19 bp, Homo sapiens
gggcccagcccagagccac

SEQ ID NO: 1232088 - DNA, 16 bp, Homo sapiens
gggcccagctgtagcc

SEQ ID NO: 1232089 - DNA, 17 bp, Homo sapiens
gggcccaggaccagctg

SEQ ID NO: 1232090 - DNA, 19 bp, Homo sapiens
gggcccaggaccagctggg

SEQ ID NO: 1232091 - DNA, 17 bp, Homo sapiens
gggcccaggactctggc

SEQ ID NO: 1232092 - DNA, 14 bp, Homo sapiens
gggcccaggaggac

SEQ ID NO: 1232093 - DNA, 14 bp, Homo sapiens
gggcccaggcaaat

SEQ ID NO: 1232094 - DNA, 14 bp, Homo sapiens
gggcccaggcaggt

SEQ ID NO: 1232095 - DNA, 17 bp, Homo sapiens
gggcccaggcaggtctg

SEQ ID NO: 1232096 - DNA, 11 bp, Homo sapiens
gggcccaggcc

SEQ ID NO: 1232097 - DNA, 12 bp, Homo sapiens
gggcccaggcca

SEQ ID NO: 1232098 - DNA, 17 bp, Homo sapiens
gggcccaggggctgtgg

SEQ ID NO: 1232099 - DNA, 13 bp, Homo sapiens
gggccccacctac

SEQ ID NO: 1232100 - DNA, 22 bp, Homo sapiens
gggccccacctacttgtgactg

SEQ ID NO: 1232101 - DNA, 17 bp, Homo sapiens
gggccccacctcggcac

SEQ ID NO: 1232102 - DNA, 13 bp, Homo sapiens
gggccccactgga

SEQ ID NO: 1232103 - DNA, 14 bp, Homo sapiens
gggccccactggac

SEQ ID NO: 1232104 - DNA, 17 bp, Homo sapiens
gggccccactggctgga

SEQ ID NO: 1232105 - DNA, 12 bp, Homo sapiens
gggccccagacc

SEQ ID NO: 1232106 - DNA, 16 bp, Homo sapiens
gggccccagaccccag

SEQ ID NO: 1232107 - DNA, 17 bp, Homo sapiens
gggccccagatctgcct

SEQ ID NO: 1232108 - DNA, 21 bp, Homo sapiens
gggccccagatctgcctgggc

SEQ ID NO: 1232109 - DNA, 14 bp, Homo sapiens
gggccccagcgtct

SEQ ID NO: 1232110 - DNA, 23 bp, Homo sapiens
gggccccaggcccgcgggcacag

SEQ ID NO: 1232111 - DNA, 14 bp, Homo sapiens
gggccccaggggca

SEQ ID NO: 1232112 - DNA, 22 bp, Homo sapiens
gggccccatcctcatccctgac

SEQ ID NO: 1232113 - DNA, 15 bp, Homo sapiens
gggccccatcttgat

SEQ ID NO: 1232114 - DNA, 13 bp, Homo sapiens
gggccccatgctc

SEQ ID NO: 1232115 - DNA, 17 bp, Homo sapiens
gggccccatgctctgcc

SEQ ID NO: 1232116 - DNA, 19 bp, Homo sapiens
gggcccccctccccccact

SEQ ID NO: 1232117 - DNA, 12 bp, Homo sapiens
gggcccccgccc

SEQ ID NO: 1232118 - DNA, 16 bp, Homo sapiens
gggcccccgccccgcc

SEQ ID NO: 1232119 - DNA, 17 bp, Homo sapiens
gggccccgccagggctg

SEQ ID NO: 1232120 - DNA, 20 bp, Homo sapiens
gggccccgccagggctgggg

SEQ ID NO: 1232121 - DNA, 21 bp, Homo sapiens
gggccccgccagggctgggga

SEQ ID NO: 1232122 - DNA, 14 bp, Homo sapiens
gggccccggggctg

SEQ ID NO: 1232123 - DNA, 17 bp, Homo sapiens
gggccccggggctggca

SEQ ID NO: 1232124 - DNA, 18 bp, Homo sapiens
gggccccggggctggcaa

SEQ ID NO: 1232125 - DNA, 16 bp, Homo sapiens
gggcccctcagagccc

SEQ ID NO: 1232126 - DNA, 10 bp, Homo sapiens
gggcccctcc

SEQ ID NO: 1232127 - DNA, 18 bp, Homo sapiens
gggcccctccacgcctcc

SEQ ID NO: 1232128 - DNA, 13 bp, Homo sapiens
gggcccctcccct

SEQ ID NO: 1232129 - DNA, 13 bp, Homo sapiens
gggcccctccctc

SEQ ID NO: 1232130 - DNA, 23 bp, Homo sapiens
gggcccctgggcttggcctgctg

SEQ ID NO: 1232131 - DNA, 15 bp, Homo sapiens
gggcccctggggaca

SEQ ID NO: 1232132 - DNA, 16 bp, Homo sapiens
gggcccctgtccccag

SEQ ID NO: 1232133 - DNA, 17 bp, Homo sapiens
gggccccttgctgatgc

SEQ ID NO: 1232134 - DNA, 16 bp, Homo sapiens
gggcccgcctggcaga

SEQ ID NO: 1232135 - DNA, 16 bp, Homo sapiens
gggcccgctgcctctt

SEQ ID NO: 1232136 - DNA, 19 bp, Homo sapiens
gggcccgctgcctcttggc

SEQ ID NO: 1232137 - DNA, 23 bp, Homo sapiens
gggcccggccacacccagcggcc

SEQ ID NO: 1232138 - DNA, 16 bp, Homo sapiens
gggcccggccagccat

SEQ ID NO: 1232139 - DNA, 15 bp, Homo sapiens
gggcccgggcaccca

SEQ ID NO: 1232140 - DNA, 18 bp, Homo sapiens
gggcccgggcccccgccc

SEQ ID NO: 1232141 - DNA, 22 bp, Homo sapiens
gggcccgggttgggtcaccaga

SEQ ID NO: 1232142 - DNA, 12 bp, Homo sapiens
gggccctcaggc

SEQ ID NO: 1232143 - DNA, 14 bp, Homo sapiens
gggccctcccttgg

SEQ ID NO: 1232144 - DNA, 23 bp, Homo sapiens
gggccctcctgaaacttacacac

SEQ ID NO: 1232145 - DNA, 17 bp, Homo sapiens
gggccctctatgctggc

SEQ ID NO: 1232146 - DNA, 17 bp, Homo sapiens
gggccctctctctgggc

SEQ ID NO: 1232147 - DNA, 16 bp, Homo sapiens
gggccctctctgctct

SEQ ID NO: 1232148 - DNA, 19 bp, Homo sapiens
gggccctcttgccagcctc

SEQ ID NO: 1232149 - DNA, 17 bp, Homo sapiens
gggccctctttccctgc

SEQ ID NO: 1232150 - DNA, 17 bp, Homo sapiens
gggccctgcaggctgca

SEQ ID NO: 1232151 - DNA, 12 bp, Homo sapiens
gggccctgcccc

SEQ ID NO: 1232152 - DNA, 19 bp, Homo sapiens
gggccctgccccaggcctg

SEQ ID NO: 1232153 - DNA, 20 bp, Homo sapiens
gggccctgccccaggcctgg

SEQ ID NO: 1232154 - DNA, 21 bp, Homo sapiens
gggccctgccccaggcctgga

SEQ ID NO: 1232155 - DNA, 22 bp, Homo sapiens
gggccctgccccaggcctggac

SEQ ID NO: 1232156 - DNA, 12 bp, Homo sapiens
gggccctgcctg

SEQ ID NO: 1232157 - DNA, 13 bp, Homo sapiens
gggccctggaggc

SEQ ID NO: 1232158 - DNA, 16 bp, Homo sapiens
gggccctgggcagggc

SEQ ID NO: 1232159 - DNA, 12 bp, Homo sapiens
gggccctgggcc

SEQ ID NO: 1232160 - DNA, 13 bp, Homo sapiens
gggccctgggcct

SEQ ID NO: 1232161 - DNA, 14 bp, Homo sapiens
gggccctgggcctc

SEQ ID NO: 1232162 - DNA, 20 bp, Homo sapiens
gggccctgtggagtccagct

SEQ ID NO: 1232163 - DNA, 22 bp, Homo sapiens
gggccctgtggagtccagctct

SEQ ID NO: 1232164 - DNA, 22 bp, Homo sapiens
gggcccttcttgctgccctgcc

SEQ ID NO: 1232165 - DNA, 17 bp, Homo sapiens
gggcccttggagcgtgg

SEQ ID NO: 1232166 - DNA, 18 bp, Homo sapiens
gggcccttggccccagag

SEQ ID NO: 1232167 - DNA, 17 bp, Homo sapiens
gggcccttggggcctgg

SEQ ID NO: 1232168 - DNA, 18 bp, Homo sapiens
gggcccttggggcctggc

SEQ ID NO: 1232169 - DNA, 16 bp, Homo sapiens
gggccgaccctgcggc

SEQ ID NO: 1232170 - DNA, 14 bp, Homo sapiens
gggccgactaagag

SEQ ID NO: 1232171 - DNA, 17 bp, Homo sapiens
gggccgcaagggcctgg

SEQ ID NO: 1232172 - DNA, 14 bp, Homo sapiens
gggccgcagggccc

SEQ ID NO: 1232173 - DNA, 15 bp, Homo sapiens
gggccgcagggccca

SEQ ID NO: 1232174 - DNA, 14 bp, Homo sapiens
gggccgcccgctcc

SEQ ID NO: 1232175 - DNA, 18 bp, Homo sapiens
gggccgcctgccctgcct

SEQ ID NO: 1232176 - DNA, 16 bp, Homo sapiens
gggccgctctgatttc

SEQ ID NO: 1232177 - DNA, 20 bp, Homo sapiens
gggccggacctgagcccgca

SEQ ID NO: 1232178 - DNA, 18 bp, Homo sapiens
gggccggcggctctgagc

SEQ ID NO: 1232179 - DNA, 20 bp, Homo sapiens
gggccgggcaggtcctgccc

SEQ ID NO: 1232180 - DNA, 21 bp, Homo sapiens
gggccgggcaggtcctgccca

SEQ ID NO: 1232181 - DNA, 14 bp, Homo sapiens
gggccgggcctggg

SEQ ID NO: 1232182 - DNA, 21 bp, Homo sapiens
gggccggggagggggcacggc

SEQ ID NO: 1232183 - DNA, 14 bp, Homo sapiens
gggccggggcaggg

SEQ ID NO: 1232184 - DNA, 14 bp, Homo sapiens
gggccggggggagg

SEQ ID NO: 1232185 - DNA, 15 bp, Homo sapiens
gggccggggggaggg

SEQ ID NO: 1232186 - DNA, 17 bp, Homo sapiens
gggccggggggagggga

SEQ ID NO: 1232187 - DNA, 12 bp, Homo sapiens
gggccggtgagg

SEQ ID NO: 1232188 - DNA, 18 bp, Homo sapiens
gggccggtgaggggaggg

SEQ ID NO: 1232189 - DNA, 23 bp, Homo sapiens
gggccggtgaggggaggggcctc

SEQ ID NO: 1232190 - DNA, 20 bp, Homo sapiens
gggccgtaccccaccctcag

SEQ ID NO: 1232191 - DNA, 16 bp, Homo sapiens
gggccgtcccctctcc

SEQ ID NO: 1232192 - DNA, 17 bp, Homo sapiens
gggccgtcccctctccc

SEQ ID NO: 1232193 - DNA, 18 bp, Homo sapiens
gggccgtcccctctcccc

SEQ ID NO: 1232194 - DNA, 22 bp, Homo sapiens
gggcctttctcctccccacctg

SEQ ID NO: 1232195 - DNA, 16 bp, Homo sapiens
gggccttttggatatg

SEQ ID NO: 1232196 - DNA, 18 bp, Homo sapiens
gggcgatcgcggcggagc

SEQ ID NO: 1232197 - DNA, 16 bp, Homo sapiens
gggcgccaggacagca

SEQ ID NO: 1232198 - DNA, 19 bp, Homo sapiens
gggcgcccccccctcccca

SEQ ID NO: 1232199 - DNA, 20 bp, Homo sapiens
gggcgccgtgctgggcagcc

SEQ ID NO: 1232200 - DNA, 24 bp, Homo sapiens
gggcgccgtgctgggcagcccgct

SEQ ID NO: 1232201 - DNA, 18 bp, Homo sapiens
gggcgcgatcccacacag

SEQ ID NO: 1232202 - DNA, 20 bp, Homo sapiens
gggcgctcaggacccaggcc

SEQ ID NO: 1232203 - DNA, 19 bp, Homo sapiens
gggcgctgctgggagcaga

SEQ ID NO: 1232204 - DNA, 13 bp, Homo sapiens
gggcgctggccca

SEQ ID NO: 1232205 - DNA, 15 bp, Homo sapiens
gggcgctgggaaggg

SEQ ID NO: 1232206 - DNA, 12 bp, Homo sapiens
gggcgctgtcct

SEQ ID NO: 1232207 - DNA, 13 bp, Homo sapiens
gggcgctgtcctg

SEQ ID NO: 1232208 - DNA, 17 bp, Homo sapiens
gggcgctgtcctgcgtt

SEQ ID NO: 1232209 - DNA, 21 bp, Homo sapiens
gggcggacaaaagggccaggt

SEQ ID NO: 1232210 - DNA, 13 bp, Homo sapiens
gggcggagctggg

SEQ ID NO: 1232211 - DNA, 14 bp, Homo sapiens
gggcggagctgggg

SEQ ID NO: 1232212 - DNA, 17 bp, Homo sapiens
gggcggcaggggcctgg

SEQ ID NO: 1232213 - DNA, 15 bp, Homo sapiens
gggcggcccgtggac

SEQ ID NO: 1232214 - DNA, 12 bp, Homo sapiens
gggcggctgggt

SEQ ID NO: 1232215 - DNA, 17 bp, Homo sapiens
gggcgggcagagggctg

SEQ ID NO: 1232216 - DNA, 12 bp, Homo sapiens
gggcgggccagg

SEQ ID NO: 1232217 - DNA, 13 bp, Homo sapiens
gggcgggccaggg

SEQ ID NO: 1232218 - DNA, 12 bp, Homo sapiens
gggcgggctcag

SEQ ID NO: 1232219 - DNA, 15 bp, Homo sapiens
gggcgggctcagagc

SEQ ID NO: 1232220 - DNA, 21 bp, Homo sapiens
gggcgggctcagagctttgtc

SEQ ID NO: 1232221 - DNA, 13 bp, Homo sapiens
gggcggggactgc

SEQ ID NO: 1232222 - DNA, 18 bp, Homo sapiens
gggcgggtgacgcccacc

SEQ ID NO: 1232223 - DNA, 21 bp, Homo sapiens
gggcgggtgacgcccaccttc

SEQ ID NO: 1232224 - DNA, 13 bp, Homo sapiens
gggcggtgtcagg

SEQ ID NO: 1232225 - DNA, 15 bp, Homo sapiens
gggcgtccagctcag

SEQ ID NO: 1232226 - DNA, 20 bp, Homo sapiens
gggcgtctcccccagagtgc

SEQ ID NO: 1232227 - DNA, 14 bp, Homo sapiens
gggcgtctgactcc

SEQ ID NO: 1232228 - DNA, 20 bp, Homo sapiens
gggcgtggatcgagtgtagc

SEQ ID NO: 1232229 - DNA, 18 bp, Homo sapiens
gggcgtggctggcctttc

SEQ ID NO: 1232230 - DNA, 18 bp, Homo sapiens
gggcgtgggtctctgggg

SEQ ID NO: 1232231 - DNA, 13 bp, Homo sapiens
gggctaaatgaag

SEQ ID NO: 1232232 - DNA, 20 bp, Homo sapiens
gggctaagagctagcgctgc

SEQ ID NO: 1232233 - DNA, 12 bp, Homo sapiens
ggggtggccagg

SEQ ID NO: 1232234 - DNA, 20 bp, Homo sapiens
ggggtggcctggccctcctg

SEQ ID NO: 1232235 - DNA, 13 bp, Homo sapiens
ggggtgggacagg

SEQ ID NO: 1232236 - DNA, 13 bp, Homo sapiens
ggggtgggcagca

SEQ ID NO: 1232237 - DNA, 14 bp, Homo sapiens
ggggtgggccaggc

SEQ ID NO: 1232238 - DNA, 17 bp, Homo sapiens
ggggtgggccaggctga

SEQ ID NO: 1232239 - DNA, 13 bp, Homo sapiens
ggggtgggctggt

SEQ ID NO: 1232240 - DNA, 11 bp, Homo sapiens
ggggtggggag

SEQ ID NO: 1232241 - DNA, 12 bp, Homo sapiens
ggggtggggagg

SEQ ID NO: 1232242 - DNA, 15 bp, Homo sapiens
ggggtggggagggtg

SEQ ID NO: 1232243 - DNA, 18 bp, Homo sapiens
ggggtgggggtggaggct

SEQ ID NO: 1232244 - DNA, 16 bp, Homo sapiens
ggggtggggtcatgcc

SEQ ID NO: 1232245 - DNA, 22 bp, Homo sapiens
ggggtgtaacttcctgctgcac

SEQ ID NO: 1232246 - DNA, 14 bp, Homo sapiens
ggggtgtcagaagc

SEQ ID NO: 1232247 - DNA, 17 bp, Homo sapiens
ggggtgtccgagaggct

SEQ ID NO: 1232248 - DNA, 19 bp, Homo sapiens
ggggtgtggctccttccca

SEQ ID NO: 1232249 - DNA, 18 bp, Homo sapiens
ggggttaagtctcctgtc

SEQ ID NO: 1232250 - DNA, 20 bp, Homo sapiens
ggggttcataggtcactggc

SEQ ID NO: 1232251 - DNA, 21 bp, Homo sapiens
ggggttccctcctagctctcc

SEQ ID NO: 1232252 - DNA, 22 bp, Homo sapiens
ggggttcccttgagggctgcag

SEQ ID NO: 1232253 - DNA, 23 bp, Homo sapiens
ggggttcccttgagggctgcagt

SEQ ID NO: 1232254 - DNA, 20 bp, Homo sapiens
ggggttctagaaaatatagt

SEQ ID NO: 1232255 - DNA, 14 bp, Homo sapiens
ggggttctggcagg

SEQ ID NO: 1232256 - DNA, 22 bp, Homo sapiens
ggggttctttcttcctctgctg

SEQ ID NO: 1232257 - DNA, 13 bp, Homo sapiens
ggggttgaagaaa

SEQ ID NO: 1232258 - DNA, 19 bp, Homo sapiens
ggggttggctgttccagac

SEQ ID NO: 1232259 - DNA, 15 bp, Homo sapiens
ggggttggggtggga

SEQ ID NO: 1232260 - DNA, 16 bp, Homo sapiens
ggggttggggtgggag

SEQ ID NO: 1232261 - DNA, 17 bp, Homo sapiens
ggggttgtgaggcctgg

SEQ ID NO: 1232262 - DNA, 18 bp, Homo sapiens
ggggtttgggagtcaggc

SEQ ID NO: 1232263 - DNA, 23 bp, Homo sapiens
ggggtttgggcccctcagagccc

SEQ ID NO: 1232264 - DNA, 18 bp, Homo sapiens
ggggtttgttttgcaatg

SEQ ID NO: 1232265 - DNA, 23 bp, Homo sapiens
ggggttttcgaagctcagcccac

SEQ ID NO: 1232266 - DNA, 15 bp, Homo sapiens
gggtaaaatactttt

SEQ ID NO: 1232267 - DNA, 21 bp, Homo sapiens
gggtaaaatacttttactctg

SEQ ID NO: 1232268 - DNA, 13 bp, Homo sapiens
gggtaaactgtgg

SEQ ID NO: 1232269 - DNA, 15 bp, Homo sapiens
gggtaactggggggc

SEQ ID NO: 1232270 - DNA, 17 bp, Homo sapiens
gggtaactggggggcca

SEQ ID NO: 1232271 - DNA, 13 bp, Homo sapiens
gggtaagagagga

SEQ ID NO: 1232272 - DNA, 14 bp, Homo sapiens
gggtaagccagagc

SEQ ID NO: 1232273 - DNA, 17 bp, Homo sapiens
gggtaagccagagcctg

SEQ ID NO: 1232274 - DNA, 18 bp, Homo sapiens
gggtaagccagagcctgg

SEQ ID NO: 1232275 - DNA, 17 bp, Homo sapiens
gggtacatttctctgag

SEQ ID NO: 1232276 - DNA, 14 bp, Homo sapiens
gggtacctcatgag

SEQ ID NO: 1232277 - DNA, 19 bp, Homo sapiens
gggtactcttgatgtgaag

SEQ ID NO: 1232278 - DNA, 24 bp, Homo sapiens
gggtagaccttgagggtgggccag

SEQ ID NO: 1232279 - DNA, 22 bp, Homo sapiens
gggtagatgatttctagcaggc

SEQ ID NO: 1232280 - DNA, 14 bp, Homo sapiens
gggtagatttctct

SEQ ID NO: 1232281 - DNA, 22 bp, Homo sapiens
gggttggggtggttgaggctaa

SEQ ID NO: 1232282 - DNA, 13 bp, Homo sapiens
gggttgtgagccc

SEQ ID NO: 1232283 - DNA, 23 bp, Homo sapiens
gggttgtgaggcctggccaggca

SEQ ID NO: 1232284 - DNA, 15 bp, Homo sapiens
gggttgtgtgtctgt

SEQ ID NO: 1232285 - DNA, 17 bp, Homo sapiens
gggttgtttccaggaga

SEQ ID NO: 1232286 - DNA, 20 bp, Homo sapiens
gggtttcaccatgttggcca

SEQ ID NO: 1232287 - DNA, 16 bp, Homo sapiens
gggtttcgactggtcc

SEQ ID NO: 1232288 - DNA, 17 bp, Homo sapiens
gggtttcgactggtcca

SEQ ID NO: 1232289 - DNA, 22 bp, Homo sapiens
gggtttgcccagtcctgggttg

SEQ ID NO: 1232290 - DNA, 18 bp, Homo sapiens
gggtttggccagggaggc

SEQ ID NO: 1232291 - DNA, 23 bp, Homo sapiens
gggtttggcccaagactgggctg

SEQ ID NO: 1232292 - DNA, 20 bp, Homo sapiens
gggtttggcgggccaaggac

SEQ ID NO: 1232293 - DNA, 22 bp, Homo sapiens
gggtttggcgggccaaggactg

SEQ ID NO: 1232294 - DNA, 16 bp, Homo sapiens
gggtttgggcccctca

SEQ ID NO: 1232295 - DNA, 22 bp, Homo sapiens
gggtttgtacatttttgggggg

SEQ ID NO: 1232296 - DNA, 23 bp, Homo sapiens
gggttttcccatgactcttggag

SEQ ID NO: 1232297 - DNA, 19 bp, Homo sapiens
gggtttttagagaatgtgt

SEQ ID NO: 1232298 - DNA, 19 bp, Homo sapiens
gggtttttattatttttac

SEQ ID NO: 1232299 - DNA, 14 bp, Homo sapiens
gggtttttgctgtt

SEQ ID NO: 1232300 - DNA, 21 bp, Homo sapiens
gggttttttttttctgaataa

SEQ ID NO: 1232301 - DNA, 18 bp, Homo sapiens
ggtaaaaagtattttttc

SEQ ID NO: 1232302 - DNA, 16 bp, Homo sapiens
ggtaaaaatgctgctc

SEQ ID NO: 1232303 - DNA, 17 bp, Homo sapiens
ggtaaaaatgctgctct

SEQ ID NO: 1232304 - DNA, 23 bp, Homo sapiens
ggtaaaagtgtgagcagtgagtt

SEQ ID NO: 1232305 - DNA, 23 bp, Homo sapiens
ggtaaaatacttttactctgcct

SEQ ID NO: 1232306 - DNA, 22 bp, Homo sapiens
ggtcccacctccagcccgggag

SEQ ID NO: 1232307 - DNA, 14 bp, Homo sapiens
ggtcccagccaccc

SEQ ID NO: 1232308 - DNA, 18 bp, Homo sapiens
ggtcccagccccaggcct

SEQ ID NO: 1232309 - DNA, 13 bp, Homo sapiens
ggtcccagcctgg

SEQ ID NO: 1232310 - DNA, 14 bp, Homo sapiens
ggtcccagctccct

SEQ ID NO: 1232311 - DNA, 18 bp, Homo sapiens
ggtcccaggaagcaggga

SEQ ID NO: 1232312 - DNA, 14 bp, Homo sapiens
ggtcccagggctgc

SEQ ID NO: 1232313 - DNA, 11 bp, Homo sapiens
ggtcccatcca

SEQ ID NO: 1232314 - DNA, 21 bp, Homo sapiens
ggtccccactcaccccctttg

SEQ ID NO: 1232315 - DNA, 17 bp, Homo sapiens
ggtcccccgactgcctg

SEQ ID NO: 1232316 - DNA, 22 bp, Homo sapiens
ggtccccgttccaccccaagag

SEQ ID NO: 1232317 - DNA, 13 bp, Homo sapiens
ggtcccctcccca

SEQ ID NO: 1232318 - DNA, 14 bp, Homo sapiens
ggtcccctccctcg

SEQ ID NO: 1232319 - DNA, 11 bp, Homo sapiens
ggtcccctccg

SEQ ID NO: 1232320 - DNA, 14 bp, Homo sapiens
ggtcccctctgtgc

SEQ ID NO: 1232321 - DNA, 13 bp, Homo sapiens
ggtcccctgccac

SEQ ID NO: 1232322 - DNA, 22 bp, Homo sapiens
ggtcccctgccaccgactgccc

SEQ ID NO: 1232323 - DNA, 16 bp, Homo sapiens
ggtcccctgcctggaa

SEQ ID NO: 1232324 - DNA, 17 bp, Homo sapiens
ggtcccctgcctggaac

SEQ ID NO: 1232325 - DNA, 20 bp, Homo sapiens
ggtcccggtgtatcctggcc

SEQ ID NO: 1232326 - DNA, 22 bp, Homo sapiens
ggtcccggttcagacccctgcc

SEQ ID NO: 1232327 - DNA, 16 bp, Homo sapiens
ggtccctcactccaca

SEQ ID NO: 1232328 - DNA, 19 bp, Homo sapiens
ggtccctcaggttcctttt

SEQ ID NO: 1232329 - DNA, 17 bp, Homo sapiens
ggtccctcggagctgcc

SEQ ID NO: 1232330 - DNA, 22 bp, Homo sapiens
ggtccctcgtccacaggggcag

SEQ ID NO: 1232331 - DNA, 16 bp, Homo sapiens
ggtccctcttctctcc

SEQ ID NO: 1232332 - DNA, 21 bp, Homo sapiens
ggtccctgcagaagccagaag

SEQ ID NO: 1232333 - DNA, 13 bp, Homo sapiens
ggtccctgcctta

SEQ ID NO: 1232334 - DNA, 14 bp, Homo sapiens
ggtccctgccttag

SEQ ID NO: 1232335 - DNA, 22 bp, Homo sapiens
ggtcccttaaggcacagtggga

SEQ ID NO: 1232336 - DNA, 20 bp, Homo sapiens
ggtcccttccatgccctggg

SEQ ID NO: 1232337 - DNA, 21 bp, Homo sapiens
ggtcccttcccgacccagcca

SEQ ID NO: 1232338 - DNA, 14 bp, Homo sapiens
ggtccgcaccagct

SEQ ID NO: 1232339 - DNA, 14 bp, Homo sapiens
ggtccgcggcctgc

SEQ ID NO: 1232340 - DNA, 19 bp, Homo sapiens
ggtccggcgccccgcaccc

SEQ ID NO: 1232341 - DNA, 13 bp, Homo sapiens
ggtcctagcccag

SEQ ID NO: 1232342 - DNA, 21 bp, Homo sapiens
ggtcctagcccagtgcttctc

SEQ ID NO: 1232343 - DNA, 17 bp, Homo sapiens
ggtcctagcccttccct

SEQ ID NO: 1232344 - DNA, 23 bp, Homo sapiens
ggtcctcacccctcgccaccttt

SEQ ID NO: 1232345 - DNA, 21 bp, Homo sapiens
ggtcctcagagaatttctacc

SEQ ID NO: 1232346 - DNA, 14 bp, Homo sapiens
ggtcctcagctgct

SEQ ID NO: 1232347 - DNA, 18 bp, Homo sapiens
ggtcctcaggtcagctgg

SEQ ID NO: 1232348 - DNA, 19 bp, Homo sapiens
ggtcctcaggtcagctggg

SEQ ID NO: 1232349 - DNA, 21 bp, Homo sapiens
ggtcctcaggtcagctgggag

SEQ ID NO: 1232350 - DNA, 22 bp, Homo sapiens
ggtcctcaggtcagctgggagc

SEQ ID NO: 1232351 - DNA, 19 bp, Homo sapiens
ggtcctcctcgctcctcct

SEQ ID NO: 1232352 - DNA, 23 bp, Homo sapiens
ggtcctcctcgctcctccttccc

SEQ ID NO: 1232353 - DNA, 15 bp, Homo sapiens
ggtcctctggagccc

SEQ ID NO: 1232354 - DNA, 13 bp, Homo sapiens
ggtcctctgtcag

SEQ ID NO: 1232355 - DNA, 23 bp, Homo sapiens
ggtcctctgtcagtcacagccac

SEQ ID NO: 1232356 - DNA, 23 bp, Homo sapiens
ggtcctcttttcctggcagctgc

SEQ ID NO: 1232357 - DNA, 17 bp, Homo sapiens
ggtcctgaaagtaactc

SEQ ID NO: 1232358 - DNA, 13 bp, Homo sapiens
ggtcctgagacct

SEQ ID NO: 1232359 - DNA, 14 bp, Homo sapiens
ggtcctgcaggggg

SEQ ID NO: 1232360 - DNA, 22 bp, Homo sapiens
ggtcctgcccatgtgtcccctc

SEQ ID NO: 1232361 - DNA, 11 bp, Homo sapiens
ggtcctgccct

SEQ ID NO: 1232362 - DNA, 19 bp, Homo sapiens
ggtcctggacacctcccag

SEQ ID NO: 1232363 - DNA, 12 bp, Homo sapiens
ggtcctggccat

SEQ ID NO: 1232364 - DNA, 15 bp, Homo sapiens
ggtcctggctcctga

SEQ ID NO: 1232365 - DNA, 16 bp, Homo sapiens
ggtcctggctcctgag

SEQ ID NO: 1232366 - DNA, 14 bp, Homo sapiens
ggtcctggggcctc

SEQ ID NO: 1232367 - DNA, 15 bp, Homo sapiens
ggtcctggggctctg

SEQ ID NO: 1232368 - DNA, 15 bp, Homo sapiens
ggtcctgggggcagg

SEQ ID NO: 1232369 - DNA, 14 bp, Homo sapiens
ggtcctggtgccct

SEQ ID NO: 1232370 - DNA, 19 bp, Homo sapiens
ggtcctgtctctgcacaga

SEQ ID NO: 1232371 - DNA, 23 bp, Homo sapiens
ggtcctgtggatgggatcctctc

SEQ ID NO: 1232372 - DNA, 22 bp, Homo sapiens
ggtccttcctttaggtctggtt

SEQ ID NO: 1232373 - DNA, 19 bp, Homo sapiens
ggtcctttaggcagcctgc

SEQ ID NO: 1232374 - DNA, 12 bp, Homo sapiens
ggtcctttctcc

SEQ ID NO: 1232375 - DNA, 21 bp, Homo sapiens
ggtcctttgggaaaggagaag

SEQ ID NO: 1232376 - DNA, 15 bp, Homo sapiens
ggtcctttggggtga

SEQ ID NO: 1232377 - DNA, 16 bp, Homo sapiens
ggtccttttgacactg

SEQ ID NO: 1232378 - DNA, 17 bp, Homo sapiens
ggtcgaggattctgtgc

SEQ ID NO: 1232379 - DNA, 12 bp, Homo sapiens
ggtcgcccagga

SEQ ID NO: 1232380 - DNA, 15 bp, Homo sapiens
ggtcggaagcctgtc

SEQ ID NO: 1232381 - DNA, 16 bp, Homo sapiens
ggtcggaagcctgtcc

SEQ ID NO: 1232382 - DNA, 13 bp, Homo sapiens
ggtcggccctgcc

SEQ ID NO: 1232383 - DNA, 15 bp, Homo sapiens
ggtcggccctgccca

SEQ ID NO: 1232384 - DNA, 20 bp, Homo sapiens
ggtcggccgccatagcccca

SEQ ID NO: 1232385 - DNA, 14 bp, Homo sapiens
ggtcgggcagccag

SEQ ID NO: 1232386 - DNA, 12 bp, Homo sapiens
ggtcgtctttgt

SEQ ID NO: 1232387 - DNA, 18 bp, Homo sapiens
ggtcgtctttgtgtatgg

SEQ ID NO: 1232388 - DNA, 16 bp, Homo sapiens
ggtcgttttccaaaga

SEQ ID NO: 1232389 - DNA, 17 bp, Homo sapiens
ggtcgttttccaaagag

SEQ ID NO: 1232390 - DNA, 19 bp, Homo sapiens
ggtctaaataggatcctgg

SEQ ID NO: 1232391 - DNA, 14 bp, Homo sapiens
ggtctaagcaagtg

SEQ ID NO: 1232392 - DNA, 13 bp, Homo sapiens
ggtctaccaggaa

SEQ ID NO: 1232393 - DNA, 14 bp, Homo sapiens
ggtctaggacacag

SEQ ID NO: 1232394 - DNA, 21 bp, Homo sapiens
ggtctataaaataaacttctt

SEQ ID NO: 1232395 - DNA, 21 bp, Homo sapiens
ggtctcaaactcctgggctca

SEQ ID NO: 1232396 - DNA, 21 bp, Homo sapiens
ggtctcacagtgttgcccagg

SEQ ID NO: 1232397 - DNA, 21 bp, Homo sapiens
ggtctcaccggctctcacctg

SEQ ID NO: 1232398 - DNA, 15 bp, Homo sapiens
ggtctcactctgtcg

SEQ ID NO: 1232399 - DNA, 17 bp, Homo sapiens
ggtctcactctgtcgct

SEQ ID NO: 1232400 - DNA, 19 bp, Homo sapiens
ggtctcactctgttgccca

SEQ ID NO: 1232401 - DNA, 20 bp, Homo sapiens
ggtctcacttataccaaagg

SEQ ID NO: 1232402 - DNA, 15 bp, Homo sapiens
ggtctcatctcttca

SEQ ID NO: 1232403 - DNA, 18 bp, Homo sapiens
ggtctcccaaagtgctgg

SEQ ID NO: 1232404 - DNA, 20 bp, Homo sapiens
ggtctcccaaagtgctggga

SEQ ID NO: 1232405 - DNA, 15 bp, Homo sapiens
ggtctccctctcctg

SEQ ID NO: 1232406 - DNA, 17 bp, Homo sapiens
ggtctccctctcctgcc

SEQ ID NO: 1232407 - DNA, 11 bp, Homo sapiens
ggtctccctgg

SEQ ID NO: 1232408 - DNA, 12 bp, Homo sapiens
ggtctccctggc

SEQ ID NO: 1232409 - DNA, 24 bp, Homo sapiens
ggtctccctggctccctcctccag

SEQ ID NO: 1232410 - DNA, 11 bp, Homo sapiens
ggtctccctgt

SEQ ID NO: 1232411 - DNA, 17 bp, Homo sapiens
ggtctcccttccgtcca

SEQ ID NO: 1232412 - DNA, 21 bp, Homo sapiens
ggtctcccttccgtccatccc

SEQ ID NO: 1232413 - DNA, 15 bp, Homo sapiens
ggtctccgagagagg

SEQ ID NO: 1232414 - DNA, 21 bp, Homo sapiens
ggtctcctcagggtggggggt

SEQ ID NO: 1232415 - DNA, 17 bp, Homo sapiens
ggtctccttggctgtct

SEQ ID NO: 1232416 - DNA, 16 bp, Homo sapiens
ggtctcgatctcctga

SEQ ID NO: 1232417 - DNA, 16 bp, Homo sapiens
ggtctcgcagcctgaa

SEQ ID NO: 1232418 - DNA, 20 bp, Homo sapiens
ggtctcgcagcctgaagcct

SEQ ID NO: 1232419 - DNA, 20 bp, Homo sapiens
ggtctcggatgacaccctgg

SEQ ID NO: 1232420 - DNA, 19 bp, Homo sapiens
ggtgagaactcagaagaga

SEQ ID NO: 1232421 - DNA, 15 bp, Homo sapiens
ggtgagaagcagagg

SEQ ID NO: 1232422 - DNA, 18 bp, Homo sapiens
ggtgagaatcctgcctct

SEQ ID NO: 1232423 - DNA, 19 bp, Homo sapiens
ggtgagaccccgcactgca

SEQ ID NO: 1232424 - DNA, 21 bp, Homo sapiens
ggtgagaccccgcactgcaga

SEQ ID NO: 1232425 - DNA, 12 bp, Homo sapiens
ggtgagagagac

SEQ ID NO: 1232426 - DNA, 19 bp, Homo sapiens
ggtgagagagacaggcagc

SEQ ID NO: 1232427 - DNA, 18 bp, Homo sapiens
ggtgagaggcaggaatgg

SEQ ID NO: 1232428 - DNA, 21 bp, Homo sapiens
ggtgagcctagccctgggaca

SEQ ID NO: 1232429 - DNA, 22 bp, Homo sapiens
ggtgagcgatcatttatttcat

SEQ ID NO: 1232430 - DNA, 16 bp, Homo sapiens
ggtgagctgcacctga

SEQ ID NO: 1232431 - DNA, 15 bp, Homo sapiens
ggtgaggcccagcct

SEQ ID NO: 1232432 - DNA, 17 bp, Homo sapiens
ggtgaggggcaggacct

SEQ ID NO: 1232433 - DNA, 23 bp, Homo sapiens
ggtgaggtctgttccttttatat

SEQ ID NO: 1232434 - DNA, 11 bp, Homo sapiens
ggtgaggtggc

SEQ ID NO: 1232435 - DNA, 15 bp, Homo sapiens
ggtgaggtggcccag

SEQ ID NO: 1232436 - DNA, 16 bp, Homo sapiens
ggtgaggtggcccagg

SEQ ID NO: 1232437 - DNA, 20 bp, Homo sapiens
ggtgagtcccctactccctc

SEQ ID NO: 1232438 - DNA, 20 bp, Homo sapiens
ggtgagtcttggcggcagca

SEQ ID NO: 1232439 - DNA, 15 bp, Homo sapiens
ggtgagtggaaggga

SEQ ID NO: 1232440 - DNA, 20 bp, Homo sapiens
ggtgagtttgagctgccttc

SEQ ID NO: 1232441 - DNA, 14 bp, Homo sapiens
ggtgataagggaaa

SEQ ID NO: 1232442 - DNA, 18 bp, Homo sapiens
ggtgataaggggccttgc

SEQ ID NO: 1232443 - DNA, 19 bp, Homo sapiens
ggtgatcaattaaatgtag

SEQ ID NO: 1232444 - DNA, 20 bp, Homo sapiens
ggtgatccgcctacctcagc

SEQ ID NO: 1232445 - DNA, 14 bp, Homo sapiens
ggtgatcctctatt

SEQ ID NO: 1232446 - DNA, 17 bp, Homo sapiens
ggtgatcctctattttg

SEQ ID NO: 1232447 - DNA, 12 bp, Homo sapiens
ggtgatgactta

SEQ ID NO: 1232448 - DNA, 14 bp, Homo sapiens
ggtgatgctctggc

SEQ ID NO: 1232449 - DNA, 24 bp, Homo sapiens
ggtgatgctctggcttgccccagg

SEQ ID NO: 1232450 - DNA, 15 bp, Homo sapiens
ggtgatggccagagg

SEQ ID NO: 1232451 - DNA, 15 bp, Homo sapiens
ggtgatgtaaatagt

SEQ ID NO: 1232452 - DNA, 22 bp, Homo sapiens
ggtgattacataatctgtacaa

SEQ ID NO: 1232453 - DNA, 15 bp, Homo sapiens
ggtgattttaaagaa

SEQ ID NO: 1232454 - DNA, 18 bp, Homo sapiens
ggtgcaaagactctgagc

SEQ ID NO: 1232455 - DNA, 18 bp, Homo sapiens
ggtgcaaagttccctact

SEQ ID NO: 1232456 - DNA, 15 bp, Homo sapiens
ggtgcaaattcagaa

SEQ ID NO: 1232457 - DNA, 22 bp, Homo sapiens
ggtgcacattttccacggaaac

SEQ ID NO: 1232458 - DNA, 16 bp, Homo sapiens
ggtgcacccacctgtt

SEQ ID NO: 1232459 - DNA, 15 bp, Homo sapiens
ggtgcactttgtaaa

SEQ ID NO: 1232460 - DNA, 23 bp, Homo sapiens
ggtgcagacagaagtctcctcaa

SEQ ID NO: 1232461 - DNA, 15 bp, Homo sapiens
ggtgcagccccaggg

SEQ ID NO: 1232462 - DNA, 14 bp, Homo sapiens
ggtgcagctgggct

SEQ ID NO: 1232463 - DNA, 14 bp, Homo sapiens
ggtgcagctgggtg

SEQ ID NO: 1232464 - DNA, 17 bp, Homo sapiens
ggtgcaggcagccttga

SEQ ID NO: 1232465 - DNA, 12 bp, Homo sapiens
ggtgcagggaga

SEQ ID NO: 1232466 - DNA, 22 bp, Homo sapiens
ggtgcagggagacatctgcacc

SEQ ID NO: 1232467 - DNA, 18 bp, Homo sapiens
ggtgcaggggccaggggt

SEQ ID NO: 1232468 - DNA, 13 bp, Homo sapiens
ggtgcaggtgggg

SEQ ID NO: 1232469 - DNA, 17 bp, Homo sapiens
ggtgcatctgcaggcac

SEQ ID NO: 1232470 - DNA, 17 bp, Homo sapiens
ggtgccaaatagcccca

SEQ ID NO: 1232471 - DNA, 13 bp, Homo sapiens
ggtgccaagatgg

SEQ ID NO: 1232472 - DNA, 17 bp, Homo sapiens
ggtttacaatttacaaa

SEQ ID NO: 1232473 - DNA, 14 bp, Homo sapiens
ggtttacccagtgg

SEQ ID NO: 1232474 - DNA, 17 bp, Homo sapiens
ggtttaggctggtggcc

SEQ ID NO: 1232475 - DNA, 22 bp, Homo sapiens
ggtttaggctggtggcccagga

SEQ ID NO: 1232476 - DNA, 23 bp, Homo sapiens
ggtttagtatatgtcttgagagg

SEQ ID NO: 1232477 - DNA, 14 bp, Homo sapiens
ggtttatgactctt

SEQ ID NO: 1232478 - DNA, 22 bp, Homo sapiens
ggtttcaatgcatacaataaaa

SEQ ID NO: 1232479 - DNA, 12 bp, Homo sapiens
ggtttcaccatg

SEQ ID NO: 1232480 - DNA, 19 bp, Homo sapiens
ggtttcaccatgttggcca

SEQ ID NO: 1232481 - DNA, 16 bp, Homo sapiens
ggtttcaccttccctc

SEQ ID NO: 1232482 - DNA, 12 bp, Homo sapiens
ggtttcagaaat

SEQ ID NO: 1232483 - DNA, 13 bp, Homo sapiens
ggtttcagaaatg

SEQ ID NO: 1232484 - DNA, 19 bp, Homo sapiens
ggtttcagccaaggggctg

SEQ ID NO: 1232485 - DNA, 17 bp, Homo sapiens
gtaaacagaataaaagt

SEQ ID NO: 1232486 - DNA, 20 bp, Homo sapiens
gtaaacagatggcactttga

SEQ ID NO: 1232487 - DNA, 20 bp, Homo sapiens
gtaaacaggtatttttttaa

SEQ ID NO: 1232488 - DNA, 14 bp, Homo sapiens
gtaaacagtgcctg

SEQ ID NO: 1232489 - DNA, 17 bp, Homo sapiens
gtaaacagtgcctgctg

SEQ ID NO: 1232490 - DNA, 22 bp, Homo sapiens
gtaaacagtgcctgctgaatga

SEQ ID NO: 1232491 - DNA, 20 bp, Homo sapiens
gtaaacagtttttattaaaa

SEQ ID NO: 1232492 - DNA, 22 bp, Homo sapiens
gtaaacattcctccagcctccc

SEQ ID NO: 1232493 - DNA, 13 bp, Homo sapiens
gtaaaccaaagcc

SEQ ID NO: 1232494 - DNA, 23 bp, Homo sapiens
gtaaaccacataatttttgtaca

SEQ ID NO: 1232495 - DNA, 12 bp, Homo sapiens
gtaaaccactga

SEQ ID NO: 1232496 - DNA, 16 bp, Homo sapiens
gtaaaccactgaaaaa

SEQ ID NO: 1232497 - DNA, 18 bp, Homo sapiens
gtaaaccactgaaaaaat

SEQ ID NO: 1232498 - DNA, 19 bp, Homo sapiens
gtaaaccactgaaaaaata

SEQ ID NO: 1232499 - DNA, 22 bp, Homo sapiens
gtaaaccactgaaaaaatatat

SEQ ID NO: 1232500 - DNA, 20 bp, Homo sapiens
gtaaacctagtaaaaccttg

SEQ ID NO: 1232501 - DNA, 16 bp, Homo sapiens
gtaaactatttatctg

SEQ ID NO: 1232502 - DNA, 15 bp, Homo sapiens
gtaaactcaaaactt

SEQ ID NO: 1232503 - DNA, 24 bp, Homo sapiens
gtaaactgtgcaccaagcaggaaa

SEQ ID NO: 1232504 - DNA, 15 bp, Homo sapiens
gtaaatatgtgaaga

SEQ ID NO: 1232505 - DNA, 15 bp, Homo sapiens
gtaaatatttactct

SEQ ID NO: 1232506 - DNA, 13 bp, Homo sapiens
gtaaatattttaa

SEQ ID NO: 1232507 - DNA, 23 bp, Homo sapiens
gtaaatattttaaagaattgtgt

SEQ ID NO: 1232508 - DNA, 18 bp, Homo sapiens
gtaaatcagaaagtaaca

SEQ ID NO: 1232509 - DNA, 19 bp, Homo sapiens
gtaaatcctagacttgaaa

SEQ ID NO: 1232510 - DNA, 17 bp, Homo sapiens
gtaaatcctgccattta

SEQ ID NO: 1232511 - DNA, 19 bp, Homo sapiens
gtaaatcctgccatttaaa

SEQ ID NO: 1232512 - DNA, 15 bp, Homo sapiens
gtaaatcctttttct

SEQ ID NO: 1232513 - DNA, 16 bp, Homo sapiens
gtaaatcctttttctt

SEQ ID NO: 1232514 - DNA, 22 bp, Homo sapiens
gtaaatcctttttctttataaa

SEQ ID NO: 1232515 - DNA, 20 bp, Homo sapiens
gtaaatctaacattattact

SEQ ID NO: 1232516 - DNA, 14 bp, Homo sapiens
gtaaatgagaagac

SEQ ID NO: 1232517 - DNA, 15 bp, Homo sapiens
gtaaatgattttaat

SEQ ID NO: 1232518 - DNA, 21 bp, Homo sapiens
gtaaatgattttaattttata

SEQ ID NO: 1232519 - DNA, 19 bp, Homo sapiens
gtaaatgggggtgcatttg

SEQ ID NO: 1232520 - DNA, 16 bp, Homo sapiens
gtaaatggtatgtcat

SEQ ID NO: 1232521 - DNA, 18 bp, Homo sapiens
gtaaatggttaaatttta

SEQ ID NO: 1232522 - DNA, 15 bp, Homo sapiens
gtaaatgttattatt

SEQ ID NO: 1232523 - DNA, 19 bp, Homo sapiens
gtaaatgtttcttttccct

SEQ ID NO: 1232524 - DNA, 16 bp, Homo sapiens
gtaaattaacttttat

SEQ ID NO: 1232525 - DNA, 21 bp, Homo sapiens
gtaaattaacttttataaact

SEQ ID NO: 1232526 - DNA, 23 bp, Homo sapiens
gtaaattaacttttataaacttt

SEQ ID NO: 1232527 - DNA, 14 bp, Homo sapiens
gtaaattatatttg

SEQ ID NO: 1232528 - DNA, 20 bp, Homo sapiens
gtaaattatatttgtgctat

SEQ ID NO: 1232529 - DNA, 19 bp, Homo sapiens
gtaaattattgtaaacttt

SEQ ID NO: 1232530 - DNA, 14 bp, Homo sapiens
gtaaattatttgct

SEQ ID NO: 1232531 - DNA, 16 bp, Homo sapiens
gtaaattatttgctaa

SEQ ID NO: 1232532 - DNA, 19 bp, Homo sapiens
gtaaattgaatcagtataa

SEQ ID NO: 1232533 - DNA, 17 bp, Homo sapiens
gtaaattgcacagagca

SEQ ID NO: 1232534 - DNA, 15 bp, Homo sapiens
gtaaattggaaacat

SEQ ID NO: 1232535 - DNA, 13 bp, Homo sapiens
gtaaatttttgaa

SEQ ID NO: 1232536 - DNA, 16 bp, Homo sapiens
gtaaatttttgaaaaa

SEQ ID NO: 1232537 - DNA, 13 bp, Homo sapiens
gtaacaaaaataa

SEQ ID NO: 1232538 - DNA, 16 bp, Homo sapiens
gtaacaagaaaacata

SEQ ID NO: 1232539 - DNA, 17 bp, Homo sapiens
gtaacaatacaaatgga

SEQ ID NO: 1232540 - DNA, 18 bp, Homo sapiens
gtaacaatacaaatggat

SEQ ID NO: 1232541 - DNA, 19 bp, Homo sapiens
gtaacaatacaaatggatt

SEQ ID NO: 1232542 - DNA, 18 bp, Homo sapiens
gtaacaatacatgagaaa

SEQ ID NO: 1232543 - DNA, 19 bp, Homo sapiens
gtaacaattttaatgctat

SEQ ID NO: 1232544 - DNA, 17 bp, Homo sapiens
gtaacacaagccacaga

SEQ ID NO: 1232545 - DNA, 20 bp, Homo sapiens
gtaacacaagccacagaagc

SEQ ID NO: 1232546 - DNA, 14 bp, Homo sapiens
gtaacacagtcatt

SEQ ID NO: 1232547 - DNA, 22 bp, Homo sapiens
gtaacactaatatatttaaaaa

SEQ ID NO: 1232548 - DNA, 12 bp, Homo sapiens
gtaacactacag

SEQ ID NO: 1232549 - DNA, 21 bp, Homo sapiens
gtaacactttaaaaccagtta

SEQ ID NO: 1232550 - DNA, 16 bp, Homo sapiens
gtaacactttacaatg

SEQ ID NO: 1232551 - DNA, 17 bp, Homo sapiens
gtaacagacacacgatg

SEQ ID NO: 1232552 - DNA, 20 bp, Homo sapiens
gtaacaggaaaattttaaaa

SEQ ID NO: 1232553 - DNA, 20 bp, Homo sapiens
gtaacaggtctcctcttaaa

SEQ ID NO: 1232554 - DNA, 17 bp, Homo sapiens
gtaacagtcaaatatca

SEQ ID NO: 1232555 - DNA, 18 bp, Homo sapiens
gtaacagttcatgtttgc

SEQ ID NO: 1232556 - DNA, 23 bp, Homo sapiens
gtaacatcataattacattccta

SEQ ID NO: 1232557 - DNA, 23 bp, Homo sapiens
gtaacatgatgttaactttgtgg

SEQ ID NO: 1232558 - DNA, 20 bp, Homo sapiens
gtaacatgcatactttattg

SEQ ID NO: 1232559 - DNA, 23 bp, Homo sapiens
gtaacatgtgttaagtattttca

SEQ ID NO: 1232560 - DNA, 14 bp, Homo sapiens
gtaacattgtaaag

SEQ ID NO: 1232561 - DNA, 16 bp, Homo sapiens
gtaacatttatagaag

SEQ ID NO: 1232562 - DNA, 13 bp, Homo sapiens
gtaacatttctgt

SEQ ID NO: 1232563 - DNA, 15 bp, Homo sapiens
gtaacatttctgttc

SEQ ID NO: 1232564 - DNA, 17 bp, Homo sapiens
gtaacatttctgttctc

SEQ ID NO: 1232565 - DNA, 19 bp, Homo sapiens
gtaacatttgctgttttaa

SEQ ID NO: 1232566 - DNA, 13 bp, Homo sapiens
gtaaccaagctgt

SEQ ID NO: 1232567 - DNA, 17 bp, Homo sapiens
gtaaccaggccccagcc

SEQ ID NO: 1232568 - DNA, 20 bp, Homo sapiens
gtaaccaggccccagcctcc

SEQ ID NO: 1232569 - DNA, 14 bp, Homo sapiens
gtaaccctggtggt

SEQ ID NO: 1232570 - DNA, 21 bp, Homo sapiens
gtaaccctggtggttgctgtt

SEQ ID NO: 1232571 - DNA, 12 bp, Homo sapiens
gtaacctcagct

SEQ ID NO: 1232572 - DNA, 20 bp, Homo sapiens
gtaacctcttcagaggccct

SEQ ID NO: 1232573 - DNA, 21 bp, Homo sapiens
gtaacgtgattgattcagtat

SEQ ID NO: 1232574 - DNA, 22 bp, Homo sapiens
gtaactaaaataattttgtaat

SEQ ID NO: 1232575 - DNA, 12 bp, Homo sapiens
gtaactaactgc

SEQ ID NO: 1232576 - DNA, 17 bp, Homo sapiens
gtaactaactgcttcat

SEQ ID NO: 1232577 - DNA, 15 bp, Homo sapiens
gtaactaattttgtt

SEQ ID NO: 1232578 - DNA, 10 bp, Homo sapiens
gtaactacaa

SEQ ID NO: 1232579 - DNA, 20 bp, Homo sapiens
gtaactaggtttttgcttct

SEQ ID NO: 1232580 - DNA, 22 bp, Homo sapiens
gtaactattaaccttttttgtc

SEQ ID NO: 1232581 - DNA, 23 bp, Homo sapiens
gtaactattaaccttttttgtct

SEQ ID NO: 1232582 - DNA, 19 bp, Homo sapiens
gtaactattgggtgaatat

SEQ ID NO: 1232583 - DNA, 17 bp, Homo sapiens
gtaactccaccaaccca

SEQ ID NO: 1232584 - DNA, 21 bp, Homo sapiens
gtaactcttacctaaactgag

SEQ ID NO: 1232585 - DNA, 13 bp, Homo sapiens
gtaactgacaact

SEQ ID NO: 1232586 - DNA, 23 bp, Homo sapiens
gtaactgcacctgggcagctcct

SEQ ID NO: 1232587 - DNA, 18 bp, Homo sapiens
gtaactgcattgagaact

SEQ ID NO: 1232588 - DNA, 22 bp, Homo sapiens
gtaactgcattgagaactgcat

SEQ ID NO: 1232589 - DNA, 14 bp, Homo sapiens
gtaactgcccagcc

SEQ ID NO: 1232590 - DNA, 14 bp, Homo sapiens
gtaactgctcagag

SEQ ID NO: 1232591 - DNA, 20 bp, Homo sapiens
gtaatgccacacattgtgct

SEQ ID NO: 1232592 - DNA, 20 bp, Homo sapiens
gtaatgcttagagaatgttc

SEQ ID NO: 1232593 - DNA, 14 bp, Homo sapiens
gtaatggagcatca

SEQ ID NO: 1232594 - DNA, 23 bp, Homo sapiens
gtaatggcagttatattttgcag

SEQ ID NO: 1232595 - DNA, 12 bp, Homo sapiens
gtaatgggcctg

SEQ ID NO: 1232596 - DNA, 16 bp, Homo sapiens
gtaatgggcctgccca

SEQ ID NO: 1232597 - DNA, 23 bp, Homo sapiens
gtaatggtactgactttgcttgc

SEQ ID NO: 1232598 - DNA, 14 bp, Homo sapiens
gtaatggtgtagaa

SEQ ID NO: 1232599 - DNA, 17 bp, Homo sapiens
gtaatggtgtagaacac

SEQ ID NO: 1232600 - DNA, 19 bp, Homo sapiens
gtaatgtatcaaatacatt

SEQ ID NO: 1232601 - DNA, 22 bp, Homo sapiens
gtaatgtcaccaccttcccagc

SEQ ID NO: 1232602 - DNA, 23 bp, Homo sapiens
gtaatgtcagactttgctgcatt

SEQ ID NO: 1232603 - DNA, 21 bp, Homo sapiens
gtaatgttactgatcatgcat

SEQ ID NO: 1232604 - DNA, 19 bp, Homo sapiens
gtaatgttttctttgcaaa

SEQ ID NO: 1232605 - DNA, 21 bp, Homo sapiens
gtaatgttttctttgcaaagt

SEQ ID NO: 1232606 - DNA, 19 bp, Homo sapiens
gtaattaaaagcaaatcat

SEQ ID NO: 1232607 - DNA, 17 bp, Homo sapiens
gtaattaactgtaaact

SEQ ID NO: 1232608 - DNA, 17 bp, Homo sapiens
gtaattaagtactatgt

SEQ ID NO: 1232609 - DNA, 18 bp, Homo sapiens
gtaattaataaagaaaaa

SEQ ID NO: 1232610 - DNA, 21 bp, Homo sapiens
gtaattagtgccacttaatgt

SEQ ID NO: 1232611 - DNA, 21 bp, Homo sapiens
gtaactgctcagagctttaaa

SEQ ID NO: 1232612 - DNA, 17 bp, Homo sapiens
gtaactgctgagccact

SEQ ID NO: 1232613 - DNA, 14 bp, Homo sapiens
gtaactgctttctg

SEQ ID NO: 1232614 - DNA, 15 bp, Homo sapiens
gtaactgtcctgtcc

SEQ ID NO: 1232615 - DNA, 16 bp, Homo sapiens
gtaactgtcctgtcct

SEQ ID NO: 1232616 - DNA, 17 bp, Homo sapiens
gtaactgtcctgtcctg

SEQ ID NO: 1232617 - DNA, 14 bp, Homo sapiens
gtaacttaaaatag

SEQ ID NO: 1232618 - DNA, 15 bp, Homo sapiens
gtaacttacacctgg

SEQ ID NO: 1232619 - DNA, 14 bp, Homo sapiens
gtaacttagcttta

SEQ ID NO: 1232620 - DNA, 15 bp, Homo sapiens
gtaacttatattgaa

SEQ ID NO: 1232621 - DNA, 13 bp, Homo sapiens
gtaacttcctgct

SEQ ID NO: 1232622 - DNA, 16 bp, Homo sapiens
gtaacttcctgctgca

SEQ ID NO: 1232623 - DNA, 20 bp, Homo sapiens
gtaacttcttatggaattga

SEQ ID NO: 1232624 - DNA, 15 bp, Homo sapiens
gtaactttaaacatc

SEQ ID NO: 1232625 - DNA, 12 bp, Homo sapiens
gtaactttatgt

SEQ ID NO: 1232626 - DNA, 14 bp, Homo sapiens
gtaactttctctta

SEQ ID NO: 1232627 - DNA, 17 bp, Homo sapiens
gtaacttttgtaagaca

SEQ ID NO: 1232628 - DNA, 17 bp, Homo sapiens
gtaacttttttgtgtat

SEQ ID NO: 1232629 - DNA, 22 bp, Homo sapiens
gtaacttttttgtgtatgtact

SEQ ID NO: 1232630 - DNA, 16 bp, Homo sapiens
gtaagaaaagctgatg

SEQ ID NO: 1232631 - DNA, 19 bp, Homo sapiens
gtaagaaagccaccttgtt

SEQ ID NO: 1232632 - DNA, 12 bp, Homo sapiens
gtaagaaatact

SEQ ID NO: 1232633 - DNA, 13 bp, Homo sapiens
gtaagaactgtac

SEQ ID NO: 1232634 - DNA, 16 bp, Homo sapiens
gtaagaactgtacatt

SEQ ID NO: 1232635 - DNA, 17 bp, Homo sapiens
gtaagaactgtacattg

SEQ ID NO: 1232636 - DNA, 20 bp, Homo sapiens
gtaagaactgtacattgtga

SEQ ID NO: 1232637 - DNA, 12 bp, Homo sapiens
gtaagaagtttg

SEQ ID NO: 1232638 - DNA, 22 bp, Homo sapiens
gtacattcttccatcatcactg

SEQ ID NO: 1232639 - DNA, 19 bp, Homo sapiens
gtactggccagtgtcattt

SEQ ID NO: 1232640 - DNA, 20 bp, Homo sapiens
gtactggctctttattcatt

SEQ ID NO: 1232641 - DNA, 23 bp, Homo sapiens
gtactgggaatggaaggctttgc

SEQ ID NO: 1232642 - DNA, 18 bp, Homo sapiens
gtactgggagaatcacta

SEQ ID NO: 1232643 - DNA, 20 bp, Homo sapiens
gtactgggttaatggctagt

SEQ ID NO: 1232644 - DNA, 15 bp, Homo sapiens
gtactgtaactgctc

SEQ ID NO: 1232645 - DNA, 23 bp, Homo sapiens
gtactgtaactgctcagagcttt

SEQ ID NO: 1232646 - DNA, 14 bp, Homo sapiens
gtactgtacagggt

SEQ ID NO: 1232647 - DNA, 14 bp, Homo sapiens
gtactgtacataaa

SEQ ID NO: 1232648 - DNA, 22 bp, Homo sapiens
gtactgtacataaattccagag

SEQ ID NO: 1232649 - DNA, 19 bp, Homo sapiens
gtactgtctgttatgattt

SEQ ID NO: 1232650 - DNA, 15 bp, Homo sapiens
gtactgttctgtgtc

SEQ ID NO: 1232651 - DNA, 18 bp, Homo sapiens
gtactgttctgtgtcttt

SEQ ID NO: 1232652 - DNA, 18 bp, Homo sapiens
gtactgttgctttaatat

SEQ ID NO: 1232653 - DNA, 20 bp, Homo sapiens
gtactgttgctttaatatga

SEQ ID NO: 1232654 - DNA, 15 bp, Homo sapiens
gtactgtttaatgtt

SEQ ID NO: 1232655 - DNA, 19 bp, Homo sapiens
gtactgtttaatgttctgt

SEQ ID NO: 1232656 - DNA, 12 bp, Homo sapiens
gtacttaaatga

SEQ ID NO: 1232657 - DNA, 13 bp, Homo sapiens
gtacttaaatgag

SEQ ID NO: 1232658 - DNA, 14 bp, Homo sapiens
gtacttaaatgagt

SEQ ID NO: 1232659 - DNA, 19 bp, Homo sapiens
gtacttagagtttctgttt

SEQ ID NO: 1232660 - DNA, 18 bp, Homo sapiens
gtacttattactgctaag

SEQ ID NO: 1232661 - DNA, 18 bp, Homo sapiens
gtacttcaggggcacttc

SEQ ID NO: 1232662 - DNA, 13 bp, Homo sapiens
gtacttcccgggc

SEQ ID NO: 1232663 - DNA, 21 bp, Homo sapiens
gtacttcctcctgatggccaa

SEQ ID NO: 1232664 - DNA, 13 bp, Homo sapiens
gtacttcctgtgt

SEQ ID NO: 1232665 - DNA, 16 bp, Homo sapiens
gtacttctctgtgtgc

SEQ ID NO: 1232666 - DNA, 15 bp, Homo sapiens
gtacttctgtgttca

SEQ ID NO: 1232667 - DNA, 15 bp, Homo sapiens
gtacttcttctgtaa

SEQ ID NO: 1232668 - DNA, 23 bp, Homo sapiens
gtacttgccctgaccatgcattt

SEQ ID NO: 1232669 - DNA, 20 bp, Homo sapiens
gtacttgcttgtattgtaaa

SEQ ID NO: 1232670 - DNA, 16 bp, Homo sapiens
gtacttggagggctca

SEQ ID NO: 1232671 - DNA, 22 bp, Homo sapiens
gtacttggtttttttttttctt

SEQ ID NO: 1232672 - DNA, 11 bp, Homo sapiens
gtacttgtcaa

SEQ ID NO: 1232673 - DNA, 17 bp, Homo sapiens
gtacttgtcaaagaagg

SEQ ID NO: 1232674 - DNA, 19 bp, Homo sapiens
gtacttgtcatatgtagcc

SEQ ID NO: 1232675 - DNA, 17 bp, Homo sapiens
gtacttgtcctcagctt

SEQ ID NO: 1232676 - DNA, 16 bp, Homo sapiens
gtacttgtggttctct

SEQ ID NO: 1232677 - DNA, 16 bp, Homo sapiens
gtacttgtttctctgt

SEQ ID NO: 1232678 - DNA, 15 bp, Homo sapiens
gtactttatcatgaa

SEQ ID NO: 1232679 - DNA, 14 bp, Homo sapiens
gtactttattcttg

SEQ ID NO: 1232680 - DNA, 21 bp, Homo sapiens
gtactttatttttctgataga

SEQ ID NO: 1232681 - DNA, 18 bp, Homo sapiens
gtactttatttttgtata

SEQ ID NO: 1232682 - DNA, 14 bp, Homo sapiens
gtactttggaggcc

SEQ ID NO: 1232683 - DNA, 22 bp, Homo sapiens
gtactttgtgtttagctacctt

SEQ ID NO: 1232684 - DNA, 20 bp, Homo sapiens
gtacttttatgatgtatatt

SEQ ID NO: 1232685 - DNA, 20 bp, Homo sapiens
gtacttttcattctctttta

SEQ ID NO: 1232686 - DNA, 22 bp, Homo sapiens
gtacttttcattctcttttaat

SEQ ID NO: 1232687 - DNA, 18 bp, Homo sapiens
gtacttttgagtgtgtgt

SEQ ID NO: 1232688 - DNA, 19 bp, Homo sapiens
gtacttttgagtgtgtgtg

SEQ ID NO: 1232689 - DNA, 22 bp, Homo sapiens
gtacttttgagtgtgtgtgtgc

SEQ ID NO: 1232690 - DNA, 24 bp, Homo sapiens
gtacttttgagtgtgtgtgtgcat

SEQ ID NO: 1232691 - DNA, 21 bp, Homo sapiens
gtacttttttaaatattttct

SEQ ID NO: 1232692 - DNA, 12 bp, Homo sapiens
gtagaaaaacat

SEQ ID NO: 1232693 - DNA, 22 bp, Homo sapiens
gtagaaaaaggggcctgagtgg

SEQ ID NO: 1232694 - DNA, 13 bp, Homo sapiens
gtagaaaaattat

SEQ ID NO: 1232695 - DNA, 16 bp, Homo sapiens
gtagaaaagttgcaga

SEQ ID NO: 1232696 - DNA, 13 bp, Homo sapiens
gtagaaaatgtga

SEQ ID NO: 1232697 - DNA, 19 bp, Homo sapiens
gtagaaacggggtttcacc

SEQ ID NO: 1232698 - DNA, 15 bp, Homo sapiens
gtagaaactgcaggg

SEQ ID NO: 1232699 - DNA, 22 bp, Homo sapiens
gtagaaagacatctgcctgtaa

SEQ ID NO: 1232700 - DNA, 22 bp, Homo sapiens
gtagaaagttgtaaaatagaaa

SEQ ID NO: 1232701 - DNA, 16 bp, Homo sapiens
gtagaaataatatgca

SEQ ID NO: 1232702 - DNA, 17 bp, Homo sapiens
gtagaaataatatgcat

SEQ ID NO: 1232703 - DNA, 20 bp, Homo sapiens
gtagaaatatctgaaaatgt

SEQ ID NO: 1232704 - DNA, 21 bp, Homo sapiens
gtagaaatatctgaaaatgta

SEQ ID NO: 1232705 - DNA, 14 bp, Homo sapiens
gtagaaatgatgat

SEQ ID NO: 1232706 - DNA, 19 bp, Homo sapiens
gtagaacgtaaccacggaa

SEQ ID NO: 1232707 - DNA, 21 bp, Homo sapiens
gtagaactcactctgggctgt

SEQ ID NO: 1232708 - DNA, 21 bp, Homo sapiens
gtagaactcttaaatactttt

SEQ ID NO: 1232709 - DNA, 20 bp, Homo sapiens
gtagaactttattaagtaaa

SEQ ID NO: 1232710 - DNA, 22 bp, Homo sapiens
gtagaagatggactctgaaaaa

SEQ ID NO: 1232711 - DNA, 11 bp, Homo sapiens
gtagaagccag

SEQ ID NO: 1232712 - DNA, 15 bp, Homo sapiens
gtagaaggtgagagg

SEQ ID NO: 1232713 - DNA, 12 bp, Homo sapiens
gtagaagtagtt

SEQ ID NO: 1232714 - DNA, 18 bp, Homo sapiens
gtagaagttctagtgttt

SEQ ID NO: 1232715 - DNA, 15 bp, Homo sapiens
gtagaataaatgaag

SEQ ID NO: 1232716 - DNA, 15 bp, Homo sapiens
gtagaataggcaggg

SEQ ID NO: 1232717 - DNA, 11 bp, Homo sapiens
gtagaatattc

SEQ ID NO: 1232718 - DNA, 21 bp, Homo sapiens
gtagaatctcttcatgcttga

SEQ ID NO: 1232719 - DNA, 19 bp, Homo sapiens
gtagaatgattaatcaaag

SEQ ID NO: 1232720 - DNA, 21 bp, Homo sapiens
gtagaatgtaaagcttgtctg

SEQ ID NO: 1232721 - DNA, 14 bp, Homo sapiens
gtagaattgcattg

SEQ ID NO: 1232722 - DNA, 18 bp, Homo sapiens
gtagaattgggaagctgg

SEQ ID NO: 1232723 - DNA, 19 bp, Homo sapiens
gtagaattttagtcctgaa

SEQ ID NO: 1232724 - DNA, 21 bp, Homo sapiens
gtagaatttttaaaaaagtga

SEQ ID NO: 1232725 - DNA, 15 bp, Homo sapiens
gtagacatctgtcct

SEQ ID NO: 1232726 - DNA, 20 bp, Homo sapiens
gtagaccttgttacttctga

SEQ ID NO: 1232727 - DNA, 22 bp, Homo sapiens
gtagaccttgttacttctgagg

SEQ ID NO: 1232728 - DNA, 10 bp, Homo sapiens
gtagactagt

SEQ ID NO: 1232729 - DNA, 19 bp, Homo sapiens
gtagactctaagatacact

SEQ ID NO: 1232730 - DNA, 22 bp, Homo sapiens
gtagactgagggattttagcct

SEQ ID NO: 1232731 - DNA, 17 bp, Homo sapiens
gtagactgatggaacag

SEQ ID NO: 1232732 - DNA, 23 bp, Homo sapiens
gtagacttctggttgtatttcta

SEQ ID NO: 1232733 - DNA, 12 bp, Homo sapiens
gtagagaatgtg

SEQ ID NO: 1232734 - DNA, 14 bp, Homo sapiens
gtagagaatgtgtg

SEQ ID NO: 1232735 - DNA, 14 bp, Homo sapiens
gtagagatttttat

SEQ ID NO: 1232736 - DNA, 14 bp, Homo sapiens
gtagagcaaaacta

SEQ ID NO: 1232737 - DNA, 12 bp, Homo sapiens
gtagagccagct

SEQ ID NO: 1232738 - DNA, 14 bp, Homo sapiens
gtagagccagcttg

SEQ ID NO: 1232739 - DNA, 17 bp, Homo sapiens
gtagagctagctgccac

SEQ ID NO: 1232740 - DNA, 20 bp, Homo sapiens
gtagagtgtagactgtggct

SEQ ID NO: 1232741 - DNA, 16 bp, Homo sapiens
gtagagttcactgttg

SEQ ID NO: 1232742 - DNA, 19 bp, Homo sapiens
gtagagttgatcaaaatca

SEQ ID NO: 1232743 - DNA, 14 bp, Homo sapiens
gtagatagaaataa

SEQ ID NO: 1232744 - DNA, 16 bp, Homo sapiens
gtagatagtatgcact

SEQ ID NO: 1232745 - DNA, 23 bp, Homo sapiens
gtagatagtatgcactatataca

SEQ ID NO: 1232746 - DNA, 22 bp, Homo sapiens
gtagatccagatccagactgta

SEQ ID NO: 1232747 - DNA, 17 bp, Homo sapiens
gtagatcgcttgagccc

SEQ ID NO: 1232748 - DNA, 18 bp, Homo sapiens
gtagatcgcttgagccca

SEQ ID NO: 1232749 - DNA, 19 bp, Homo sapiens
gtagatcgcttgagcccag

SEQ ID NO: 1232750 - DNA, 20 bp, Homo sapiens
gtagatcgcttgagcccagg

SEQ ID NO: 1232751 - DNA, 21 bp, Homo sapiens
gtagatctatattagatcaaa

SEQ ID NO: 1232752 - DNA, 19 bp, Homo sapiens
gtagatgggggaactgtga

SEQ ID NO: 1232753 - DNA, 17 bp, Homo sapiens
gtagatggtgacctggg

SEQ ID NO: 1232754 - DNA, 13 bp, Homo sapiens
gtagatgtagcat

SEQ ID NO: 1232755 - DNA, 14 bp, Homo sapiens
gtagatgtagcatt

SEQ ID NO: 1232756 - DNA, 18 bp, Homo sapiens
gtagatttgaaaattgta

SEQ ID NO: 1232757 - DNA, 20 bp, Homo sapiens
gtagatttgaaaattgtata

SEQ ID NO: 1232758 - DNA, 15 bp, Homo sapiens
gtagatttttaacaa

SEQ ID NO: 1232759 - DNA, 17 bp, Homo sapiens
gtagcaaaacaaattca

SEQ ID NO: 1232760 - DNA, 21 bp, Homo sapiens
gtagcaagttctagagaagag

SEQ ID NO: 1232761 - DNA, 23 bp, Homo sapiens
gtagcacaagttatttaaatctg

SEQ ID NO: 1232762 - DNA, 16 bp, Homo sapiens
gtagcacatgtatgct

SEQ ID NO: 1232763 - DNA, 18 bp, Homo sapiens
gtagcacatgtctgtcct

SEQ ID NO: 1232764 - DNA, 16 bp, Homo sapiens
gtagcacgctgcctgc

SEQ ID NO: 1232765 - DNA, 20 bp, Homo sapiens
gtagcactactacagaaatt

SEQ ID NO: 1232766 - DNA, 22 bp, Homo sapiens
gtagcacttacgtaaaacattt

SEQ ID NO: 1232767 - DNA, 12 bp, Homo sapiens
gtagcagcaggc

SEQ ID NO: 1232768 - DNA, 12 bp, Homo sapiens
gtagcagcctgg

SEQ ID NO: 1232769 - DNA, 18 bp, Homo sapiens
gtagcagctatatatttc

SEQ ID NO: 1232770 - DNA, 17 bp, Homo sapiens
gtagcaggactaggcat

SEQ ID NO: 1232771 - DNA, 18 bp, Homo sapiens
gtagcaggactaggcatg

SEQ ID NO: 1232772 - DNA, 18 bp, Homo sapiens
gtagcaggtaccactgat

SEQ ID NO: 1232773 - DNA, 19 bp, Homo sapiens
gtagcataaataaaactga

SEQ ID NO: 1232774 - DNA, 13 bp, Homo sapiens
gtagcataactgt

SEQ ID NO: 1232775 - DNA, 15 bp, Homo sapiens
gtagcatcttcctct

SEQ ID NO: 1232776 - DNA, 16 bp, Homo sapiens
gtagcatcttcctctg

SEQ ID NO: 1232777 - DNA, 18 bp, Homo sapiens
gtagcatcttcctctgca

SEQ ID NO: 1232778 - DNA, 16 bp, Homo sapiens
gtagcatcttctggag

SEQ ID NO: 1232779 - DNA, 12 bp, Homo sapiens
gtagcatgagag

SEQ ID NO: 1232780 - DNA, 15 bp, Homo sapiens
gtagcatggactctg

SEQ ID NO: 1232781 - DNA, 16 bp, Homo sapiens
gtagcatggactctgg

SEQ ID NO: 1232782 - DNA, 21 bp, Homo sapiens
gtagcattctttggagttaaa

SEQ ID NO: 1232783 - DNA, 14 bp, Homo sapiens
gtagcattgttcca

SEQ ID NO: 1232784 - DNA, 20 bp, Homo sapiens
gtagcatttaaaatggaaaa

SEQ ID NO: 1232785 - DNA, 15 bp, Homo sapiens
gtagcattttaaaca

SEQ ID NO: 1232786 - DNA, 20 bp, Homo sapiens
gtagcattttcctgtttact

SEQ ID NO: 1232787 - DNA, 18 bp, Homo sapiens
gtagccaaggtgggctga

SEQ ID NO: 1232788 - DNA, 19 bp, Homo sapiens
gtagccagcacacagggca

SEQ ID NO: 1232789 - DNA, 18 bp, Homo sapiens
gtagccaggtatggctct

SEQ ID NO: 1232790 - DNA, 20 bp, Homo sapiens
gtagccatcccatgaacaca

SEQ ID NO: 1232791 - DNA, 16 bp, Homo sapiens
gtagccatggctcagg

SEQ ID NO: 1232792 - DNA, 20 bp, Homo sapiens
gtagccatggctcaggcaag

SEQ ID NO: 1232793 - DNA, 21 bp, Homo sapiens
gtagccatggctcaggcaagc

SEQ ID NO: 1232794 - DNA, 19 bp, Homo sapiens
gtagccccagtgacagcta

SEQ ID NO: 1232795 - DNA, 19 bp, Homo sapiens
gtagccccctggcctctgt

SEQ ID NO: 1232796 - DNA, 17 bp, Homo sapiens
gtagccccgccccagcc

SEQ ID NO: 1232797 - DNA, 19 bp, Homo sapiens
gtagccccgccccagccct

SEQ ID NO: 1232798 - DNA, 14 bp, Homo sapiens
gtagccctttctgt

SEQ ID NO: 1232799 - DNA, 13 bp, Homo sapiens
gtagccgccctga

SEQ ID NO: 1232800 - DNA, 14 bp, Homo sapiens
gtagcctaaagggc

SEQ ID NO: 1232801 - DNA, 21 bp, Homo sapiens
gtagcctccgtttatgggcct

SEQ ID NO: 1232802 - DNA, 21 bp, Homo sapiens
gtagcctctcctgtatttaac

SEQ ID NO: 1232803 - DNA, 14 bp, Homo sapiens
gtagcctgctgtgg

SEQ ID NO: 1232804 - DNA, 11 bp, Homo sapiens
gtagccttttt

SEQ ID NO: 1232805 - DNA, 22 bp, Homo sapiens
gtagcgaccccagactgtagag

SEQ ID NO: 1232806 - DNA, 13 bp, Homo sapiens
gtagcgagctgct

SEQ ID NO: 1232807 - DNA, 23 bp, Homo sapiens
gtagcggaaaagttgtcttaaaa

SEQ ID NO: 1232808 - DNA, 15 bp, Homo sapiens
gtagcgtcctgagga

SEQ ID NO: 1232809 - DNA, 18 bp, Homo sapiens
gtagcgttttttaaatgt

SEQ ID NO: 1232810 - DNA, 22 bp, Homo sapiens
gtagctacctacatgctgaaaa

SEQ ID NO: 1232811 - DNA, 21 bp, Homo sapiens
gtagctattagcggctcctcg

SEQ ID NO: 1232812 - DNA, 19 bp, Homo sapiens
gtagctcaagtttaaaagc

SEQ ID NO: 1232813 - DNA, 14 bp, Homo sapiens
gtagctcggcacca

SEQ ID NO: 1232814 - DNA, 14 bp, Homo sapiens
gtagctctgcctcc

SEQ ID NO: 1232815 - DNA, 13 bp, Homo sapiens
gtagctgagggga

SEQ ID NO: 1232816 - DNA, 16 bp, Homo sapiens
gtagctgcaaaaataa

SEQ ID NO: 1232817 - DNA, 22 bp, Homo sapiens
gtagctgggaaagcataaagct

SEQ ID NO: 1232818 - DNA, 13 bp, Homo sapiens
gtagctgggcctg

SEQ ID NO: 1232819 - DNA, 16 bp, Homo sapiens
gtagctgggcctgtgc

SEQ ID NO: 1232820 - DNA, 22 bp, Homo sapiens
gtagctggtggttgtgcctttt

SEQ ID NO: 1232821 - DNA, 14 bp, Homo sapiens
gtagcttcagtcat

SEQ ID NO: 1232822 - DNA, 19 bp, Homo sapiens
gtagcttgctccctgtgtc

SEQ ID NO: 1232823 - DNA, 18 bp, Homo sapiens
gtagcttgtatcaaatgt

SEQ ID NO: 1232824 - DNA, 22 bp, Homo sapiens
gtagctttaaaaccacagctgg

SEQ ID NO: 1232825 - DNA, 17 bp, Homo sapiens
gtagctttcccaaataa

SEQ ID NO: 1232826 - DNA, 12 bp, Homo sapiens
gtagctttgctc

SEQ ID NO: 1232827 - DNA, 19 bp, Homo sapiens
gtaggaaaaataaaaacag

SEQ ID NO: 1232828 - DNA, 14 bp, Homo sapiens
gtaggaaagggcgc

SEQ ID NO: 1232829 - DNA, 13 bp, Homo sapiens
gtaggaaatgtgg

SEQ ID NO: 1232830 - DNA, 21 bp, Homo sapiens
gtaggaacggtaaatttctgt

SEQ ID NO: 1232831 - DNA, 13 bp, Homo sapiens
gtaggaagcaaca

SEQ ID NO: 1232832 - DNA, 14 bp, Homo sapiens
gtaggaaggggagg

SEQ ID NO: 1232833 - DNA, 15 bp, Homo sapiens
gtaggaatcctttga

SEQ ID NO: 1232834 - DNA, 15 bp, Homo sapiens
gtaggaatctgcctt

SEQ ID NO: 1232835 - DNA, 21 bp, Homo sapiens
gtaggaatctgccttccagcc

SEQ ID NO: 1232836 - DNA, 19 bp, Homo sapiens
gtaggaccaagcatcttgg

SEQ ID NO: 1232837 - DNA, 15 bp, Homo sapiens
gtaggactccttatt

SEQ ID NO: 1232838 - DNA, 15 bp, Homo sapiens
gtaggactgtagaaa

SEQ ID NO: 1232839 - DNA, 17 bp, Homo sapiens
gtaggagagcactgcct

SEQ ID NO: 1232840 - DNA, 20 bp, Homo sapiens
gtaggagagcactgcctcta

SEQ ID NO: 1232841 - DNA, 22 bp, Homo sapiens
gtaggtgtctctgggcctgtgt

SEQ ID NO: 1232842 - DNA, 21 bp, Homo sapiens
gtaggttccccagagagcagg

SEQ ID NO: 1232843 - DNA, 15 bp, Homo sapiens
gtagtaattgacatg

SEQ ID NO: 1232844 - DNA, 14 bp, Homo sapiens
gtagtaatttcctt

SEQ ID NO: 1232845 - DNA, 20 bp, Homo sapiens
gtagtactccttaagaacac

SEQ ID NO: 1232846 - DNA, 19 bp, Homo sapiens
gtagtacttcttctgtaat

SEQ ID NO: 1232847 - DNA, 21 bp, Homo sapiens
gtagtacttcttctgtaatat

SEQ ID NO: 1232848 - DNA, 20 bp, Homo sapiens
gtagtagccctttctgtgtg

SEQ ID NO: 1232849 - DNA, 22 bp, Homo sapiens
gtagtagcgttttttaaatgta

SEQ ID NO: 1232850 - DNA, 12 bp, Homo sapiens
gtagtatgttat

SEQ ID NO: 1232851 - DNA, 22 bp, Homo sapiens
gtagtattaaaagttgcatttg

SEQ ID NO: 1232852 - DNA, 20 bp, Homo sapiens
gtagtattttttgtataatt

SEQ ID NO: 1232853 - DNA, 14 bp, Homo sapiens
gtagtcaaaaacaa

SEQ ID NO: 1232854 - DNA, 14 bp, Homo sapiens
gtagtcaataaaac

SEQ ID NO: 1232855 - DNA, 18 bp, Homo sapiens
gtagtcagactgacacta

SEQ ID NO: 1232856 - DNA, 21 bp, Homo sapiens
gtagtcattcttacaattgca

SEQ ID NO: 1232857 - DNA, 12 bp, Homo sapiens
gtagtccatcac

SEQ ID NO: 1232858 - DNA, 12 bp, Homo sapiens
gtagtccccaac

SEQ ID NO: 1232859 - DNA, 12 bp, Homo sapiens
gtagtcctgtga

SEQ ID NO: 1232860 - DNA, 16 bp, Homo sapiens
gtagtcttgatgacca

SEQ ID NO: 1232861 - DNA, 20 bp, Homo sapiens
gtagtgcatttttaaacttg

SEQ ID NO: 1232862 - DNA, 13 bp, Homo sapiens
gtagtgccccacc

SEQ ID NO: 1232863 - DNA, 14 bp, Homo sapiens
gtagtgccccacct

SEQ ID NO: 1232864 - DNA, 17 bp, Homo sapiens
gtagtggaagagcagcc

SEQ ID NO: 1232865 - DNA, 19 bp, Homo sapiens
gtagtggaagagcagcctg

SEQ ID NO: 1232866 - DNA, 22 bp, Homo sapiens
gtagtggcttcttttgaactgt

SEQ ID NO: 1232867 - DNA, 13 bp, Homo sapiens
gtagttaaataac

SEQ ID NO: 1232868 - DNA, 14 bp, Homo sapiens
gtagttaaataact

SEQ ID NO: 1232869 - DNA, 15 bp, Homo sapiens
gtagttaggaaataa

SEQ ID NO: 1232870 - DNA, 13 bp, Homo sapiens
gtagttccctgaa

SEQ ID NO: 1232871 - DNA, 18 bp, Homo sapiens
gtagttgacaattctgca

SEQ ID NO: 1232872 - DNA, 17 bp, Homo sapiens
gtagttgccttaaaata

SEQ ID NO: 1232873 - DNA, 17 bp, Homo sapiens
gtagttgggtagaaaaa

SEQ ID NO: 1232874 - DNA, 20 bp, Homo sapiens
gtagttgtattcttctgtat

SEQ ID NO: 1232875 - DNA, 22 bp, Homo sapiens
gtagttgtattcttctgtattt

SEQ ID NO: 1232876 - DNA, 12 bp, Homo sapiens
gtagttgtcttt

SEQ ID NO: 1232877 - DNA, 23 bp, Homo sapiens
gtagttttaattcaacatcaaaa

SEQ ID NO: 1232878 - DNA, 15 bp, Homo sapiens
gtagttttttcatct

SEQ ID NO: 1232879 - DNA, 19 bp, Homo sapiens
gtataaaaattatcaaaaa

SEQ ID NO: 1232880 - DNA, 16 bp, Homo sapiens
gtataaaactttcctc

SEQ ID NO: 1232881 - DNA, 18 bp, Homo sapiens
gtataaaactttcctcgc

SEQ ID NO: 1232882 - DNA, 23 bp, Homo sapiens
gtataaaatccatagatttattt

SEQ ID NO: 1232883 - DNA, 17 bp, Homo sapiens
gtataaactatcagttt

SEQ ID NO: 1232884 - DNA, 12 bp, Homo sapiens
gtataaactttt

SEQ ID NO: 1232885 - DNA, 20 bp, Homo sapiens
gtataaagcaactgttatga

SEQ ID NO: 1232886 - DNA, 16 bp, Homo sapiens
gtataaagctcagaag

SEQ ID NO: 1232887 - DNA, 12 bp, Homo sapiens
gtataaataaga

SEQ ID NO: 1232888 - DNA, 14 bp, Homo sapiens
gtataaatatcagt

SEQ ID NO: 1232889 - DNA, 19 bp, Homo sapiens
gtataaatccaatatcatg

SEQ ID NO: 1232890 - DNA, 17 bp, Homo sapiens
gtataaatggttgtctg

SEQ ID NO: 1232891 - DNA, 21 bp, Homo sapiens
gtataaattaaataaactgtt

SEQ ID NO: 1232892 - DNA, 12 bp, Homo sapiens
gtataaattaat

SEQ ID NO: 1232893 - DNA, 20 bp, Homo sapiens
gtataaattatcttatgaaa

SEQ ID NO: 1232894 - DNA, 12 bp, Homo sapiens
gtataaatttat

SEQ ID NO: 1232895 - DNA, 20 bp, Homo sapiens
gtataaccaagtgtgctctt

SEQ ID NO: 1232896 - DNA, 20 bp, Homo sapiens
gtataacttcttaaaagttg

SEQ ID NO: 1232897 - DNA, 17 bp, Homo sapiens
gtataagatttttgaaa

SEQ ID NO: 1232898 - DNA, 17 bp, Homo sapiens
gtataagcactgaaaaa

SEQ ID NO: 1232899 - DNA, 22 bp, Homo sapiens
gtataagcactgaaaaacaaca

SEQ ID NO: 1232900 - DNA, 16 bp, Homo sapiens
gtataagtaagaaaat

SEQ ID NO: 1232901 - DNA, 17 bp, Homo sapiens
gtataagtaagaaaata

SEQ ID NO: 1232902 - DNA, 18 bp, Homo sapiens
gtataagtaagaaaatat

SEQ ID NO: 1232903 - DNA, 21 bp, Homo sapiens
gtataagtggaggcactttag

SEQ ID NO: 1232904 - DNA, 16 bp, Homo sapiens
gtataagttgctgtaa

SEQ ID NO: 1232905 - DNA, 19 bp, Homo sapiens
gtataagttgctgtaaaat

SEQ ID NO: 1232906 - DNA, 21 bp, Homo sapiens
gtataagttgctgtaaaattt

SEQ ID NO: 1232907 - DNA, 17 bp, Homo sapiens
gtataatagagataagt

SEQ ID NO: 1232908 - DNA, 14 bp, Homo sapiens
gtataatctcctct

SEQ ID NO: 1232909 - DNA, 18 bp, Homo sapiens
gtataatgtttaaatcat

SEQ ID NO: 1232910 - DNA, 13 bp, Homo sapiens
gtataatgtttat

SEQ ID NO: 1232911 - DNA, 22 bp, Homo sapiens
gtataattatggtgggtgatta

SEQ ID NO: 1232912 - DNA, 22 bp, Homo sapiens
gtataattttttaaagttactt

SEQ ID NO: 1232913 - DNA, 17 bp, Homo sapiens
gtatacaacaggagaga

SEQ ID NO: 1232914 - DNA, 14 bp, Homo sapiens
gtatacaactgcct

SEQ ID NO: 1232915 - DNA, 14 bp, Homo sapiens
gtatacacacatat

SEQ ID NO: 1232916 - DNA, 18 bp, Homo sapiens
gtatacacacatatacat

SEQ ID NO: 1232917 - DNA, 18 bp, Homo sapiens
gtatacattgaattcatt

SEQ ID NO: 1232918 - DNA, 14 bp, Homo sapiens
gtataccaatgtgt

SEQ ID NO: 1232919 - DNA, 22 bp, Homo sapiens
gtataccaatgtgttttctgta

SEQ ID NO: 1232920 - DNA, 15 bp, Homo sapiens
gtatacctcctatat

SEQ ID NO: 1232921 - DNA, 14 bp, Homo sapiens
gtatacgtataaat

SEQ ID NO: 1232922 - DNA, 18 bp, Homo sapiens
gtatactgtaaaagttat

SEQ ID NO: 1232923 - DNA, 20 bp, Homo sapiens
gtatactgtaaaagttataa

SEQ ID NO: 1232924 - DNA, 12 bp, Homo sapiens
gtatatgtcatt

SEQ ID NO: 1232925 - DNA, 13 bp, Homo sapiens
gtatatgtctcag

SEQ ID NO: 1232926 - DNA, 19 bp, Homo sapiens
gtatatgtgaaaaaaatga

SEQ ID NO: 1232927 - DNA, 13 bp, Homo sapiens
gtatatgttgtaa

SEQ ID NO: 1232928 - DNA, 18 bp, Homo sapiens
gtatatgttgtaataaaa

SEQ ID NO: 1232929 - DNA, 23 bp, Homo sapiens
gtatattaagaagcaataactat

SEQ ID NO: 1232930 - DNA, 18 bp, Homo sapiens
gtatattacaatgatcac

SEQ ID NO: 1232931 - DNA, 16 bp, Homo sapiens
gtatattatgtattta

SEQ ID NO: 1232932 - DNA, 12 bp, Homo sapiens
gtatattcagga

SEQ ID NO: 1232933 - DNA, 15 bp, Homo sapiens
gtatattcatatatt

SEQ ID NO: 1232934 - DNA, 17 bp, Homo sapiens
gtatattccatgtataa

SEQ ID NO: 1232935 - DNA, 21 bp, Homo sapiens
gtatattggtgtatattatat

SEQ ID NO: 1232936 - DNA, 19 bp, Homo sapiens
gtatattgtgtttgtgtat

SEQ ID NO: 1232937 - DNA, 20 bp, Homo sapiens
gtatattgtgtttgtgtatt

SEQ ID NO: 1232938 - DNA, 23 bp, Homo sapiens
gtatatttgctgcaaagagaaac

SEQ ID NO: 1232939 - DNA, 14 bp, Homo sapiens
gtatatttgtcatg

SEQ ID NO: 1232940 - DNA, 17 bp, Homo sapiens
gtatatttgtcatgaca

SEQ ID NO: 1232941 - DNA, 20 bp, Homo sapiens
gtatatttgtgatagcactt

SEQ ID NO: 1232942 - DNA, 23 bp, Homo sapiens
gtatatttgtgatagcactttct

SEQ ID NO: 1232943 - DNA, 20 bp, Homo sapiens
gtatatttttgtctgcagct

SEQ ID NO: 1232944 - DNA, 17 bp, Homo sapiens
gtatcaaagaaaaacaa

SEQ ID NO: 1232945 - DNA, 14 bp, Homo sapiens
gtatcaaatctgta

SEQ ID NO: 1232946 - DNA, 12 bp, Homo sapiens
gtatcacagtgt

SEQ ID NO: 1232947 - DNA, 13 bp, Homo sapiens
gtatcacagtgtt

SEQ ID NO: 1232948 - DNA, 18 bp, Homo sapiens
gtatcagaagagagggga

SEQ ID NO: 1232949 - DNA, 12 bp, Homo sapiens
gtatcagctctc

SEQ ID NO: 1232950 - DNA, 24 bp, Homo sapiens
gtatcagtgtttatgtgctattaa

SEQ ID NO: 1232951 - DNA, 16 bp, Homo sapiens
gtatcagttatatgat

SEQ ID NO: 1232952 - DNA, 18 bp, Homo sapiens
gtatcagttatatgatat

SEQ ID NO: 1232953 - DNA, 13 bp, Homo sapiens
gtatcatcagtgt

SEQ ID NO: 1232954 - DNA, 14 bp, Homo sapiens
gtatcatgaagcct

SEQ ID NO: 1232955 - DNA, 17 bp, Homo sapiens
gtatcatgccctgtgca

SEQ ID NO: 1232956 - DNA, 13 bp, Homo sapiens
gtatcattaaaat

SEQ ID NO: 1232957 - DNA, 16 bp, Homo sapiens
gtatcattaaaatata

SEQ ID NO: 1232958 - DNA, 17 bp, Homo sapiens
gtatcattaaaatatat

SEQ ID NO: 1232959 - DNA, 18 bp, Homo sapiens
gtatcatttttgtgcaca

SEQ ID NO: 1232960 - DNA, 18 bp, Homo sapiens
gtatccaatgtcttttga

SEQ ID NO: 1232961 - DNA, 19 bp, Homo sapiens
gtatccactttgcacagct

SEQ ID NO: 1232962 - DNA, 13 bp, Homo sapiens
gtatccagaggaa

SEQ ID NO: 1232963 - DNA, 20 bp, Homo sapiens
gtatccaggttccctcccag

SEQ ID NO: 1232964 - DNA, 11 bp, Homo sapiens
gtatccagtca

SEQ ID NO: 1232965 - DNA, 14 bp, Homo sapiens
gtatccatatttta

SEQ ID NO: 1232966 - DNA, 15 bp, Homo sapiens
gtatccatattttat

SEQ ID NO: 1232967 - DNA, 14 bp, Homo sapiens
gtatccatgctctt

SEQ ID NO: 1232968 - DNA, 18 bp, Homo sapiens
gtatcccagacccctctc

SEQ ID NO: 1232969 - DNA, 21 bp, Homo sapiens
gtatcccctgcctcctgccac

SEQ ID NO: 1232970 - DNA, 19 bp, Homo sapiens
gtatcccgagtctgggaca

SEQ ID NO: 1232971 - DNA, 22 bp, Homo sapiens
gtatcctaaactttagacttcc

SEQ ID NO: 1232972 - DNA, 21 bp, Homo sapiens
gtatcctccctggcagacaca

SEQ ID NO: 1232973 - DNA, 21 bp, Homo sapiens
gtatcctggaacaatatttta

SEQ ID NO: 1232974 - DNA, 16 bp, Homo sapiens
gtatcctggccctggg

SEQ ID NO: 1232975 - DNA, 17 bp, Homo sapiens
gtatcctggggctccct

SEQ ID NO: 1232976 - DNA, 18 bp, Homo sapiens
gtatcctgggggacccaa

SEQ ID NO: 1232977 - DNA, 18 bp, Homo sapiens
gtatctaagaataataaa

SEQ ID NO: 1232978 - DNA, 18 bp, Homo sapiens
gtatctacaatacatata

SEQ ID NO: 1232979 - DNA, 22 bp, Homo sapiens
gtatctacagtaatgaaatgtt

SEQ ID NO: 1232980 - DNA, 13 bp, Homo sapiens
gtatctagtgcag

SEQ ID NO: 1232981 - DNA, 18 bp, Homo sapiens
gtatctagtgcagctgat

SEQ ID NO: 1232982 - DNA, 20 bp, Homo sapiens
gtatctatttttttttcttt

SEQ ID NO: 1232983 - DNA, 11 bp, Homo sapiens
gtatctcagaa

SEQ ID NO: 1232984 - DNA, 18 bp, Homo sapiens
gtatctcagaaagtgcct

SEQ ID NO: 1232985 - DNA, 22 bp, Homo sapiens
gtatctcagaaagtgcctgaca

SEQ ID NO: 1232986 - DNA, 23 bp, Homo sapiens
gtatctcatactgtctgggatta

SEQ ID NO: 1232987 - DNA, 22 bp, Homo sapiens
gtatctctttcacattgtttgc

SEQ ID NO: 1232988 - DNA, 21 bp, Homo sapiens
gtatctggattcaaatttatt

SEQ ID NO: 1232989 - DNA, 20 bp, Homo sapiens
gtatctgtgaagtagttctg

SEQ ID NO: 1232990 - DNA, 18 bp, Homo sapiens
gtatctgtgcttctaata

SEQ ID NO: 1232991 - DNA, 21 bp, Homo sapiens
gtatcttagagtttacagttt

SEQ ID NO: 1232992 - DNA, 23 bp, Homo sapiens
gtatcttagagtttacagtttgt

SEQ ID NO: 1232993 - DNA, 12 bp, Homo sapiens
gtatcttccttt

SEQ ID NO: 1232994 - DNA, 14 bp, Homo sapiens
gtatcttcctttct

SEQ ID NO: 1232995 - DNA, 19 bp, Homo sapiens
gtatcttcctttcttgtct

SEQ ID NO: 1232996 - DNA, 21 bp, Homo sapiens
gtatcttcctttcttgtcttt

SEQ ID NO: 1232997 - DNA, 21 bp, Homo sapiens
gtatcttggggcaagactgca

SEQ ID NO: 1232998 - DNA, 16 bp, Homo sapiens
gtatcttgtgcttctt

SEQ ID NO: 1232999 - DNA, 17 bp, Homo sapiens
gtatctttattaaaaca

SEQ ID NO: 1233000 - DNA, 19 bp, Homo sapiens
gtatctttattaaaacaaa

SEQ ID NO: 1233001 - DNA, 15 bp, Homo sapiens
gtatctttccaggct

SEQ ID NO: 1233002 - DNA, 22 bp, Homo sapiens
gtatctttgggtctttgataaa

SEQ ID NO: 1233003 - DNA, 13 bp, Homo sapiens
gtatcttttgata

SEQ ID NO: 1233004 - DNA, 20 bp, Homo sapiens
gtatgaaagtgcctgccttg

SEQ ID NO: 1233005 - DNA, 16 bp, Homo sapiens
gtatgaaatatatgtg

SEQ ID NO: 1233006 - DNA, 17 bp, Homo sapiens
gtatgaaatatatgtga

SEQ ID NO: 1233007 - DNA, 20 bp, Homo sapiens
gtatgaaatatatgtgaaag

SEQ ID NO: 1233008 - DNA, 14 bp, Homo sapiens
gtatgaagagctgt

SEQ ID NO: 1233009 - DNA, 18 bp, Homo sapiens
gtatgaagagctgtcttc

SEQ ID NO: 1233010 - DNA, 20 bp, Homo sapiens
gtatgaagagctgtcttccc

SEQ ID NO: 1233011 - DNA, 18 bp, Homo sapiens
gtatgaataaaaggctgg

SEQ ID NO: 1233012 - DNA, 19 bp, Homo sapiens
gtatgaataaaaggctgga

SEQ ID NO: 1233013 - DNA, 19 bp, Homo sapiens
gtatgaataaagacaccta

SEQ ID NO: 1233014 - DNA, 17 bp, Homo sapiens
gtatgaataatgaaaat

SEQ ID NO: 1233015 - DNA, 22 bp, Homo sapiens
gtatgaataatgaaaataaaac

SEQ ID NO: 1233016 - DNA, 16 bp, Homo sapiens
gtatgaatctatgcca

SEQ ID NO: 1233017 - DNA, 14 bp, Homo sapiens
gtatgactaaagag

SEQ ID NO: 1233018 - DNA, 20 bp, Homo sapiens
gtatgactaaagagagaatg

SEQ ID NO: 1233019 - DNA, 14 bp, Homo sapiens
gtatgacttctgct

SEQ ID NO: 1233020 - DNA, 14 bp, Homo sapiens
gtatgagatggtta

SEQ ID NO: 1233021 - DNA, 17 bp, Homo sapiens
gtatgagatggttaaaa

SEQ ID NO: 1233022 - DNA, 15 bp, Homo sapiens
gtatgaggcatttgt

SEQ ID NO: 1233023 - DNA, 21 bp, Homo sapiens
gtatgaggtcctcaggtcagc

SEQ ID NO: 1233024 - DNA, 16 bp, Homo sapiens
gtatgatgtgttgtga

SEQ ID NO: 1233025 - DNA, 16 bp, Homo sapiens
gtatgatttgttttga

SEQ ID NO: 1233026 - DNA, 13 bp, Homo sapiens
gtatgcaaaataa

SEQ ID NO: 1233027 - DNA, 13 bp, Homo sapiens
gtatgcagggagc

SEQ ID NO: 1233028 - DNA, 19 bp, Homo sapiens
gtatgcagttgataagagg

SEQ ID NO: 1233029 - DNA, 20 bp, Homo sapiens
gtatgccacacctggcctta

SEQ ID NO: 1233030 - DNA, 16 bp, Homo sapiens
gtatgccttaagcaga

SEQ ID NO: 1233031 - DNA, 22 bp, Homo sapiens
gtatgcctttaaatctgtgatg

SEQ ID NO: 1233032 - DNA, 13 bp, Homo sapiens
gtatgctgctttt

SEQ ID NO: 1233033 - DNA, 18 bp, Homo sapiens
gtatgctggccagcaccc

SEQ ID NO: 1233034 - DNA, 23 bp, Homo sapiens
gtatgctggccagcaccctctcc

SEQ ID NO: 1233035 - DNA, 16 bp, Homo sapiens
gtatgctttccctgag

SEQ ID NO: 1233036 - DNA, 22 bp, Homo sapiens
gtatgctttccctgaggaatga

SEQ ID NO: 1233037 - DNA, 21 bp, Homo sapiens
gtatggaaaaaccatttgaag

SEQ ID NO: 1233038 - DNA, 21 bp, Homo sapiens
gtatggccatgccctagaccc

SEQ ID NO: 1233039 - DNA, 14 bp, Homo sapiens
gtatggcccaggca

SEQ ID NO: 1233040 - DNA, 14 bp, Homo sapiens
gtatggctctgcac

SEQ ID NO: 1233041 - DNA, 14 bp, Homo sapiens
gtatggtaatcttt

SEQ ID NO: 1233042 - DNA, 17 bp, Homo sapiens
gtatggttcaagattgt

SEQ ID NO: 1233043 - DNA, 11 bp, Homo sapiens
gtatgtaaatg

SEQ ID NO: 1233044 - DNA, 13 bp, Homo sapiens
gtatgtaaatgtg

SEQ ID NO: 1233045 - DNA, 15 bp, Homo sapiens
gtatgtaaatgtgca

SEQ ID NO: 1233046 - DNA, 16 bp, Homo sapiens
gtatgtaatggaactt

SEQ ID NO: 1233047 - DNA, 11 bp, Homo sapiens
gtatgtacaat

SEQ ID NO: 1233048 - DNA, 10 bp, Homo sapiens
gtatgtatac

SEQ ID NO: 1233049 - DNA, 13 bp, Homo sapiens
gtatgtcactatt

SEQ ID NO: 1233050 - DNA, 14 bp, Homo sapiens
gtatgtcactattt

SEQ ID NO: 1233051 - DNA, 15 bp, Homo sapiens
gtatgtcagaaaaaa

SEQ ID NO: 1233052 - DNA, 12 bp, Homo sapiens
gtatgtctgttt

SEQ ID NO: 1233053 - DNA, 23 bp, Homo sapiens
gtatgtctgtttttgtatcttta

SEQ ID NO: 1233054 - DNA, 22 bp, Homo sapiens
gtatgtgagctgtaaaaatgtt

SEQ ID NO: 1233055 - DNA, 19 bp, Homo sapiens
gtatgtgagtagtcttatg

SEQ ID NO: 1233056 - DNA, 15 bp, Homo sapiens
gtatgtgccaggctt

SEQ ID NO: 1233057 - DNA, 22 bp, Homo sapiens
gtatgtggaagtatacctggct

SEQ ID NO: 1233058 - DNA, 18 bp, Homo sapiens
gtatgtgtatgtgtgtga

SEQ ID NO: 1233059 - DNA, 15 bp, Homo sapiens
gtatgtgtggctgtg

SEQ ID NO: 1233060 - DNA, 23 bp, Homo sapiens
gtatgtgtgtgtgggtgtgtgcg

SEQ ID NO: 1233061 - DNA, 22 bp, Homo sapiens
gtatgttaaagcatcagagatg

SEQ ID NO: 1233062 - DNA, 14 bp, Homo sapiens
gtatgttatacaac

SEQ ID NO: 1233063 - DNA, 13 bp, Homo sapiens
gtatgttgtcaaa

SEQ ID NO: 1233064 - DNA, 12 bp, Homo sapiens
gtatgttgtcat

SEQ ID NO: 1233065 - DNA, 13 bp, Homo sapiens
gtatgttgtcata

SEQ ID NO: 1233066 - DNA, 16 bp, Homo sapiens
gtatgttgtcataaca

SEQ ID NO: 1233067 - DNA, 13 bp, Homo sapiens
gtatgtttcttct

SEQ ID NO: 1233068 - DNA, 14 bp, Homo sapiens
gtatgtttgcacac

SEQ ID NO: 1233069 - DNA, 22 bp, Homo sapiens
gtatgttttaattgcatttaaa

SEQ ID NO: 1233070 - DNA, 16 bp, Homo sapiens
gtatgtttttttccaa

SEQ ID NO: 1233071 - DNA, 20 bp, Homo sapiens
gtattaaaaagcctgcattc

SEQ ID NO: 1233072 - DNA, 18 bp, Homo sapiens
gtattaaaagttgcattt

SEQ ID NO: 1233073 - DNA, 19 bp, Homo sapiens
gtattaaaggggggagggg

SEQ ID NO: 1233074 - DNA, 16 bp, Homo sapiens
gtattaagaaaggaag

SEQ ID NO: 1233075 - DNA, 22 bp, Homo sapiens
gtattaagcctaccgtatttca

SEQ ID NO: 1233076 - DNA, 12 bp, Homo sapiens
gtattaataaag

SEQ ID NO: 1233077 - DNA, 19 bp, Homo sapiens
gtattaataaagcattctt

SEQ ID NO: 1233078 - DNA, 13 bp, Homo sapiens
gtattaatctgtt

SEQ ID NO: 1233079 - DNA, 14 bp, Homo sapiens
gtattaatctgttt

SEQ ID NO: 1233080 - DNA, 17 bp, Homo sapiens
gtattaatctgtttgtg

SEQ ID NO: 1233081 - DNA, 22 bp, Homo sapiens
gtattaatttctgataaagttc

SEQ ID NO: 1233082 - DNA, 18 bp, Homo sapiens
gtattaattttgatataa

SEQ ID NO: 1233083 - DNA, 16 bp, Homo sapiens
gtattacacaagccaa

SEQ ID NO: 1233084 - DNA, 16 bp, Homo sapiens
gtattacactctgtaa

SEQ ID NO: 1233085 - DNA, 13 bp, Homo sapiens
gtattacactgta

SEQ ID NO: 1233086 - DNA, 22 bp, Homo sapiens
gtattacactgtatttgtatct

SEQ ID NO: 1233087 - DNA, 19 bp, Homo sapiens
gtattacagctttcacagt

SEQ ID NO: 1233088 - DNA, 18 bp, Homo sapiens
gtattacatctaatgctt

SEQ ID NO: 1233089 - DNA, 20 bp, Homo sapiens
gtattacatgactgtttctt

SEQ ID NO: 1233090 - DNA, 20 bp, Homo sapiens
gtattaccaccctttcacaa

SEQ ID NO: 1233091 - DNA, 20 bp, Homo sapiens
gtattactgctgctgtgctt

SEQ ID NO: 1233092 - DNA, 18 bp, Homo sapiens
gtattactttctgccgct

SEQ ID NO: 1233093 - DNA, 20 bp, Homo sapiens
gtattagtatggttcaagat

SEQ ID NO: 1233094 - DNA, 13 bp, Homo sapiens
gtattataaaagc

SEQ ID NO: 1233095 - DNA, 14 bp, Homo sapiens
gtattataattgtt

SEQ ID NO: 1233096 - DNA, 18 bp, Homo sapiens
gtattatcacatcaagca

SEQ ID NO: 1233097 - DNA, 23 bp, Homo sapiens
gtattatcacatcaagcatgcaa

SEQ ID NO: 1233098 - DNA, 17 bp, Homo sapiens
gtattatctgttgcctt

SEQ ID NO: 1233099 - DNA, 12 bp, Homo sapiens
gtattatgctgt

SEQ ID NO: 1233100 - DNA, 21 bp, Homo sapiens
gtattattacaaatattgtca

SEQ ID NO: 1233101 - DNA, 23 bp, Homo sapiens
gtattattattaaagaaaaatgc

SEQ ID NO: 1233102 - DNA, 15 bp, Homo sapiens
gtattattctgtttt

SEQ ID NO: 1233103 - DNA, 20 bp, Homo sapiens
gtattatttctccatcccct

SEQ ID NO: 1233104 - DNA, 18 bp, Homo sapiens
gtattcaacaatttcaat

SEQ ID NO: 1233105 - DNA, 21 bp, Homo sapiens
gtattcaagcaaacatcaaat

SEQ ID NO: 1233106 - DNA, 18 bp, Homo sapiens
gtattcaataccgctcag

SEQ ID NO: 1233107 - DNA, 21 bp, Homo sapiens
gtattcacgccattggttgga

SEQ ID NO: 1233108 - DNA, 15 bp, Homo sapiens
gtattcagaaattaa

SEQ ID NO: 1233109 - DNA, 19 bp, Homo sapiens
gtattcagaaattaaaata

SEQ ID NO: 1233110 - DNA, 17 bp, Homo sapiens
gtattcaggcactgaga

SEQ ID NO: 1233111 - DNA, 22 bp, Homo sapiens
gtattcagtgagggtcttctta

SEQ ID NO: 1233112 - DNA, 12 bp, Homo sapiens
gtatttcccttc

SEQ ID NO: 1233113 - DNA, 21 bp, Homo sapiens
gtatttccttccactgtagct

SEQ ID NO: 1233114 - DNA, 17 bp, Homo sapiens
gtatttctccagaccca

SEQ ID NO: 1233115 - DNA, 21 bp, Homo sapiens
gtatttctctattttcataat

SEQ ID NO: 1233116 - DNA, 22 bp, Homo sapiens
gtatttctctattttcataatc

SEQ ID NO: 1233117 - DNA, 22 bp, Homo sapiens
gtatttcttatacgcttttctt

SEQ ID NO: 1233118 - DNA, 14 bp, Homo sapiens
gtatttgaaactga

SEQ ID NO: 1233119 - DNA, 17 bp, Homo sapiens
gtatttgagaagataat

SEQ ID NO: 1233120 - DNA, 19 bp, Homo sapiens
gtatttgcaccaacatagt

SEQ ID NO: 1233121 - DNA, 22 bp, Homo sapiens
gtatttgcttttttgttttggc

SEQ ID NO: 1233122 - DNA, 18 bp, Homo sapiens
gtatttggaatatttgaa

SEQ ID NO: 1233123 - DNA, 20 bp, Homo sapiens
gtatttgggaagtgaagact

SEQ ID NO: 1233124 - DNA, 22 bp, Homo sapiens
gtatttggtccaaaaaaaggaa

SEQ ID NO: 1233125 - DNA, 13 bp, Homo sapiens
gtatttgtaatta

SEQ ID NO: 1233126 - DNA, 15 bp, Homo sapiens
gtatttgtattaata

SEQ ID NO: 1233127 - DNA, 20 bp, Homo sapiens
gtatttgtattaataaagca

SEQ ID NO: 1233128 - DNA, 23 bp, Homo sapiens
gtatttgttaatttagaaaactt

SEQ ID NO: 1233129 - DNA, 13 bp, Homo sapiens
gtattttaacact

SEQ ID NO: 1233130 - DNA, 12 bp, Homo sapiens
gtattttcatag

SEQ ID NO: 1233131 - DNA, 12 bp, Homo sapiens
gtattttccagc

SEQ ID NO: 1233132 - DNA, 21 bp, Homo sapiens
gtattttccagccttatgtgt

SEQ ID NO: 1233133 - DNA, 11 bp, Homo sapiens
gtattttcctg

SEQ ID NO: 1233134 - DNA, 12 bp, Homo sapiens
gtattttcctgg

SEQ ID NO: 1233135 - DNA, 15 bp, Homo sapiens
gtattttctttctct

SEQ ID NO: 1233136 - DNA, 16 bp, Homo sapiens
gtattttgaataccat

SEQ ID NO: 1233137 - DNA, 18 bp, Homo sapiens
gtattttgtattgtttca

SEQ ID NO: 1233138 - DNA, 24 bp, Homo sapiens
gtattttgtgtcctccaggagctt

SEQ ID NO: 1233139 - DNA, 12 bp, Homo sapiens
gtattttgtgtg

SEQ ID NO: 1233140 - DNA, 16 bp, Homo sapiens
gtattttgttaaagct

SEQ ID NO: 1233141 - DNA, 17 bp, Homo sapiens
gtattttgttaaagctg

SEQ ID NO: 1233142 - DNA, 19 bp, Homo sapiens
gtattttgtttttgtctta

SEQ ID NO: 1233143 - DNA, 19 bp, Homo sapiens
gtatttttaaaaaatatgt

SEQ ID NO: 1233144 - DNA, 14 bp, Homo sapiens
gtatttttaatggg

SEQ ID NO: 1233145 - DNA, 17 bp, Homo sapiens
gtatttttactattgaa

SEQ ID NO: 1233146 - DNA, 21 bp, Homo sapiens
gtatttttagaataagaattt

SEQ ID NO: 1233147 - DNA, 22 bp, Homo sapiens
gtatttttagaataagaatttg

SEQ ID NO: 1233148 - DNA, 15 bp, Homo sapiens
gtatttttagtagag

SEQ ID NO: 1233149 - DNA, 14 bp, Homo sapiens
gtatttttatataa

SEQ ID NO: 1233150 - DNA, 16 bp, Homo sapiens
gtatttttcaaggcat

SEQ ID NO: 1233151 - DNA, 21 bp, Homo sapiens
gtatttttcaataaagcattt

SEQ ID NO: 1233152 - DNA, 19 bp, Homo sapiens
gtatttttccaatcacagt

SEQ ID NO: 1233153 - DNA, 15 bp, Homo sapiens
gtattttttaaaaca

SEQ ID NO: 1233154 - DNA, 21 bp, Homo sapiens
gtattttttatttacatttta

SEQ ID NO: 1233155 - DNA, 16 bp, Homo sapiens
gtatttttttaaatca

SEQ ID NO: 1233156 - DNA, 14 bp, Homo sapiens
gtatttttttaact

SEQ ID NO: 1233157 - DNA, 14 bp, Homo sapiens
gtatttttttacta

SEQ ID NO: 1233158 - DNA, 14 bp, Homo sapiens
gtatttttttgcaa

SEQ ID NO: 1233159 - DNA, 17 bp, Homo sapiens
gtatttttttgcaagtg

SEQ ID NO: 1233160 - DNA, 22 bp, Homo sapiens
gtattttttttttaaataaaag

SEQ ID NO: 1233161 - DNA, 19 bp, Homo sapiens
gtcaaaaaattatttgcta

SEQ ID NO: 1233162 - DNA, 14 bp, Homo sapiens
gtcaaaacactgtg

SEQ ID NO: 1233163 - DNA, 14 bp, Homo sapiens
gtcaaaaggtgcct

SEQ ID NO: 1233164 - DNA, 15 bp, Homo sapiens
gtcaaaagttggtgt

SEQ ID NO: 1233165 - DNA, 20 bp, Homo sapiens
gtcaaacattcgtgagctgg

SEQ ID NO: 1233166 - DNA, 23 bp, Homo sapiens
gtcaaacattcgtgagctgggga

SEQ ID NO: 1233167 - DNA, 16 bp, Homo sapiens
gtcaaactgtagaaat

SEQ ID NO: 1233168 - DNA, 20 bp, Homo sapiens
gtcacagctgcagctgggcc

SEQ ID NO: 1233169 - DNA, 18 bp, Homo sapiens
gtcacaggactctgcctc

SEQ ID NO: 1233170 - DNA, 13 bp, Homo sapiens
gtcacaggctggg

SEQ ID NO: 1233171 - DNA, 15 bp, Homo sapiens
gtcacaggctgggtc

SEQ ID NO: 1233172 - DNA, 17 bp, Homo sapiens
gtcacaggctgggtcaa

SEQ ID NO: 1233173 - DNA, 21 bp, Homo sapiens
gtcacaggctgggtcaaaaga

SEQ ID NO: 1233174 - DNA, 20 bp, Homo sapiens
gtcacagtcctatgtacaga

SEQ ID NO: 1233175 - DNA, 14 bp, Homo sapiens
gtcacatacaatta

SEQ ID NO: 1233176 - DNA, 15 bp, Homo sapiens
gtcacatccaactgg

SEQ ID NO: 1233177 - DNA, 14 bp, Homo sapiens
gtcacattcaggaa

SEQ ID NO: 1233178 - DNA, 16 bp, Homo sapiens
gtcacattcaggaaga

SEQ ID NO: 1233179 - DNA, 22 bp, Homo sapiens
gtcacattgccatcactcttgt

SEQ ID NO: 1233180 - DNA, 13 bp, Homo sapiens
gtcacatttgaat

SEQ ID NO: 1233181 - DNA, 20 bp, Homo sapiens
gtcacatttgaattcttgat

SEQ ID NO: 1233182 - DNA, 22 bp, Homo sapiens
gtcaccaaatagtgtgaaatat

SEQ ID NO: 1233183 - DNA, 22 bp, Homo sapiens
gtcaccaaatcagctgctacta

SEQ ID NO: 1233184 - DNA, 22 bp, Homo sapiens
gtcaccaaggcagtgcatgcat

SEQ ID NO: 1233185 - DNA, 15 bp, Homo sapiens
gtcaccaccacccct

SEQ ID NO: 1233186 - DNA, 19 bp, Homo sapiens
gtcaccaccacccctacca

SEQ ID NO: 1233187 - DNA, 16 bp, Homo sapiens
gtcaccacccagccct

SEQ ID NO: 1233188 - DNA, 22 bp, Homo sapiens
gtcaccacccagcccttccttg

SEQ ID NO: 1233189 - DNA, 13 bp, Homo sapiens
gtcaccacctctc

SEQ ID NO: 1233190 - DNA, 11 bp, Homo sapiens
gtcaccacctt

SEQ ID NO: 1233191 - DNA, 17 bp, Homo sapiens
gtcaccaccttcccagc

SEQ ID NO: 1233192 - DNA, 19 bp, Homo sapiens
gtcaccaccttcccagctc

SEQ ID NO: 1233193 - DNA, 20 bp, Homo sapiens
gtcaccaccttcccagctct

SEQ ID NO: 1233194 - DNA, 22 bp, Homo sapiens
gtcaccaccttcccagctctcc

SEQ ID NO: 1233195 - DNA, 16 bp, Homo sapiens
gtcaccacgactggcc

SEQ ID NO: 1233196 - DNA, 17 bp, Homo sapiens
gtcaccacgactggcca

SEQ ID NO: 1233197 - DNA, 21 bp, Homo sapiens
gtcaccacgactggccagggc

SEQ ID NO: 1233198 - DNA, 17 bp, Homo sapiens
gtcaccagacggggctg

SEQ ID NO: 1233199 - DNA, 13 bp, Homo sapiens
gtcaccagagact

SEQ ID NO: 1233200 - DNA, 15 bp, Homo sapiens
gtcaccagcaacatc

SEQ ID NO: 1233201 - DNA, 23 bp, Homo sapiens
gtcaccagctatctgtcatctct

SEQ ID NO: 1233202 - DNA, 13 bp, Homo sapiens
gtcaccagctgct

SEQ ID NO: 1233203 - DNA, 15 bp, Homo sapiens
gtcaccaggacttgg

SEQ ID NO: 1233204 - DNA, 16 bp, Homo sapiens
gtcaccaggacttggg

SEQ ID NO: 1233205 - DNA, 19 bp, Homo sapiens
gtcaccaggctggagtgca

SEQ ID NO: 1233206 - DNA, 19 bp, Homo sapiens
gtcaccatcctcagaggct

SEQ ID NO: 1233207 - DNA, 15 bp, Homo sapiens
gtcacccaaagcctg

SEQ ID NO: 1233208 - DNA, 17 bp, Homo sapiens
gtcacccaaagcctgtc

SEQ ID NO: 1233209 - DNA, 15 bp, Homo sapiens
gtcacccaacatcaa

SEQ ID NO: 1233210 - DNA, 17 bp, Homo sapiens
gtcacccccacttccca

SEQ ID NO: 1233211 - DNA, 19 bp, Homo sapiens
gtcacccccacttcccact

SEQ ID NO: 1233212 - DNA, 15 bp, Homo sapiens
gtcacccctccagga

SEQ ID NO: 1233213 - DNA, 19 bp, Homo sapiens
gtcacccctccctccctct

SEQ ID NO: 1233214 - DNA, 16 bp, Homo sapiens
gtcaccctcctcacag

SEQ ID NO: 1233215 - DNA, 16 bp, Homo sapiens
gtcaccctgcagagct

SEQ ID NO: 1233216 - DNA, 14 bp, Homo sapiens
gtcaccctggcctg

SEQ ID NO: 1233217 - DNA, 20 bp, Homo sapiens
gtcaccctgtgaccctctca

SEQ ID NO: 1233218 - DNA, 14 bp, Homo sapiens
gtcaccctgtgggt

SEQ ID NO: 1233219 - DNA, 21 bp, Homo sapiens
gtcaccctgtgggtgtctccc

SEQ ID NO: 1233220 - DNA, 17 bp, Homo sapiens
gtccaattagtttcctt

SEQ ID NO: 1233221 - DNA, 17 bp, Homo sapiens
gtccaattgtgtagacg

SEQ ID NO: 1233222 - DNA, 15 bp, Homo sapiens
gtccacaggggcagg

SEQ ID NO: 1233223 - DNA, 17 bp, Homo sapiens
gtccacaggggcaggcc

SEQ ID NO: 1233224 - DNA, 18 bp, Homo sapiens
gtccacaggggcaggcct

SEQ ID NO: 1233225 - DNA, 20 bp, Homo sapiens
gtccacaggggcaggcctgg

SEQ ID NO: 1233226 - DNA, 20 bp, Homo sapiens
gtccacaggggccaccacct

SEQ ID NO: 1233227 - DNA, 19 bp, Homo sapiens
gtccacatccccagagccc

SEQ ID NO: 1233228 - DNA, 20 bp, Homo sapiens
gtccacatccccagagccca

SEQ ID NO: 1233229 - DNA, 21 bp, Homo sapiens
gtccacatccccagagcccag

SEQ ID NO: 1233230 - DNA, 22 bp, Homo sapiens
gtccacatccccagagcccagc

SEQ ID NO: 1233231 - DNA, 21 bp, Homo sapiens
gtccaccagacccacctggag

SEQ ID NO: 1233232 - DNA, 19 bp, Homo sapiens
gtccaccaggcctcactgg

SEQ ID NO: 1233233 - DNA, 24 bp, Homo sapiens
gtccaccaggcctcactggctcat

SEQ ID NO: 1233234 - DNA, 14 bp, Homo sapiens
gtccacccagcaaa

SEQ ID NO: 1233235 - DNA, 16 bp, Homo sapiens
gtccacccaggctgca

SEQ ID NO: 1233236 - DNA, 13 bp, Homo sapiens
gtccacccttcca

SEQ ID NO: 1233237 - DNA, 18 bp, Homo sapiens
gtccaccggcccctggca

SEQ ID NO: 1233238 - DNA, 14 bp, Homo sapiens
gtccacctgtgggt

SEQ ID NO: 1233239 - DNA, 15 bp, Homo sapiens
gtccacgactgtctc

SEQ ID NO: 1233240 - DNA, 16 bp, Homo sapiens
gtccacgactgtctcc

SEQ ID NO: 1233241 - DNA, 17 bp, Homo sapiens
gtccacggacccccaga

SEQ ID NO: 1233242 - DNA, 17 bp, Homo sapiens
gtccactctcggggccc

SEQ ID NO: 1233243 - DNA, 18 bp, Homo sapiens
gtccactctcggggccct

SEQ ID NO: 1233244 - DNA, 19 bp, Homo sapiens
gtccactctcggggccctt

SEQ ID NO: 1233245 - DNA, 20 bp, Homo sapiens
gtccactctcggggcccttg

SEQ ID NO: 1233246 - DNA, 21 bp, Homo sapiens
gtccactctcggggcccttgg

SEQ ID NO: 1233247 - DNA, 12 bp, Homo sapiens
gtccactgtcac

SEQ ID NO: 1233248 - DNA, 15 bp, Homo sapiens
gtccagaagaatatt

SEQ ID NO: 1233249 - DNA, 22 bp, Homo sapiens
gtccagaagaatattcaggact

SEQ ID NO: 1233250 - DNA, 14 bp, Homo sapiens
gtccagacccaagt

SEQ ID NO: 1233251 - DNA, 16 bp, Homo sapiens
gtccagagaccacacc

SEQ ID NO: 1233252 - DNA, 20 bp, Homo sapiens
gtccagagagagaagtgccc

SEQ ID NO: 1233253 - DNA, 22 bp, Homo sapiens
gtccagagccggcatccttgcc

SEQ ID NO: 1233254 - DNA, 22 bp, Homo sapiens
gtccagagcttgtgctcctctt

SEQ ID NO: 1233255 - DNA, 16 bp, Homo sapiens
gtccagagcttttcag

SEQ ID NO: 1233256 - DNA, 14 bp, Homo sapiens
gtccagaggctgca

SEQ ID NO: 1233257 - DNA, 22 bp, Homo sapiens
gtccagagtagtttctttctgt

SEQ ID NO: 1233258 - DNA, 17 bp, Homo sapiens
gtccagatttacactgg

SEQ ID NO: 1233259 - DNA, 22 bp, Homo sapiens
gtccagatttacactgggagag

SEQ ID NO: 1233260 - DNA, 14 bp, Homo sapiens
gtccagcagctgcg

SEQ ID NO: 1233261 - DNA, 13 bp, Homo sapiens
gtccagccacccc

SEQ ID NO: 1233262 - DNA, 21 bp, Homo sapiens
gtccagccacccccaggcatc

SEQ ID NO: 1233263 - DNA, 19 bp, Homo sapiens
gtccagcccccagtgcgct

SEQ ID NO: 1233264 - DNA, 20 bp, Homo sapiens
gtccagccgccattgccacc

SEQ ID NO: 1233265 - DNA, 13 bp, Homo sapiens
gtccagcctgggc

SEQ ID NO: 1233266 - DNA, 22 bp, Homo sapiens
gtccagctcagccctggcctgg

SEQ ID NO: 1233267 - DNA, 18 bp, Homo sapiens
gtccagctcccgctgtgg

SEQ ID NO: 1233268 - DNA, 13 bp, Homo sapiens
gtccagctctact

SEQ ID NO: 1233269 - DNA, 15 bp, Homo sapiens
gtccagctctgacat

SEQ ID NO: 1233270 - DNA, 19 bp, Homo sapiens
gtccagctgcccttccgca

SEQ ID NO: 1233271 - DNA, 21 bp, Homo sapiens
gtccagctgcccttccgcagt

SEQ ID NO: 1233272 - DNA, 12 bp, Homo sapiens
gtccagctggcc

SEQ ID NO: 1233273 - DNA, 15 bp, Homo sapiens
gtccagcttccaaag

SEQ ID NO: 1233274 - DNA, 17 bp, Homo sapiens
gtccagcttccaaagcc

SEQ ID NO: 1233275 - DNA, 17 bp, Homo sapiens
gtccagcttgctcttca

SEQ ID NO: 1233276 - DNA, 19 bp, Homo sapiens
gtccaggaaggcagctgct

SEQ ID NO: 1233277 - DNA, 12 bp, Homo sapiens
gtccaggagcta

SEQ ID NO: 1233278 - DNA, 12 bp, Homo sapiens
gtccaggatctc

SEQ ID NO: 1233279 - DNA, 22 bp, Homo sapiens
gtccaggatctccactgataag

SEQ ID NO: 1233280 - DNA, 15 bp, Homo sapiens
gtccaggcacaggat

SEQ ID NO: 1233281 - DNA, 12 bp, Homo sapiens
gtccaggcagct

SEQ ID NO: 1233282 - DNA, 20 bp, Homo sapiens
gtccaggcagctccctcctg

SEQ ID NO: 1233283 - DNA, 21 bp, Homo sapiens
gtccaggccagtgggcctggt

SEQ ID NO: 1233284 - DNA, 18 bp, Homo sapiens
gtccaggcccgtgggcgc

SEQ ID NO: 1233285 - DNA, 12 bp, Homo sapiens
gtccaggccctt

SEQ ID NO: 1233286 - DNA, 17 bp, Homo sapiens
gtccaggcctctctctg

SEQ ID NO: 1233287 - DNA, 20 bp, Homo sapiens
gtccaggcctctctctgctc

SEQ ID NO: 1233288 - DNA, 20 bp, Homo sapiens
gtccaggctctgggcacagt

SEQ ID NO: 1233289 - DNA, 13 bp, Homo sapiens
gtccaggctgccg

SEQ ID NO: 1233290 - DNA, 19 bp, Homo sapiens
gtccaggctggtcttgaat

SEQ ID NO: 1233291 - DNA, 13 bp, Homo sapiens
gtccagggaagct

SEQ ID NO: 1233292 - DNA, 20 bp, Homo sapiens
gtccagggaagctggccgag

SEQ ID NO: 1233293 - DNA, 20 bp, Homo sapiens
gtccagggccctgagctcgg

SEQ ID NO: 1233294 - DNA, 21 bp, Homo sapiens
gtccagggcctgacaccccct

SEQ ID NO: 1233295 - DNA, 19 bp, Homo sapiens
gtccaggggagatggggag

SEQ ID NO: 1233296 - DNA, 15 bp, Homo sapiens
gtccagggtcctcta

SEQ ID NO: 1233297 - DNA, 15 bp, Homo sapiens
gtccagtcatcctgc

SEQ ID NO: 1233298 - DNA, 21 bp, Homo sapiens
gtccagtgcattttgtttctg

SEQ ID NO: 1233299 - DNA, 18 bp, Homo sapiens
gtccagtgctctgcctca

SEQ ID NO: 1233300 - DNA, 19 bp, Homo sapiens
gtccatcccccttcttcct

SEQ ID NO: 1233301 - DNA, 22 bp, Homo sapiens
gtccatccccttcccccatccc

SEQ ID NO: 1233302 - DNA, 15 bp, Homo sapiens
gtccatccgactgcc

SEQ ID NO: 1233303 - DNA, 13 bp, Homo sapiens
gtccatcctgacc

SEQ ID NO: 1233304 - DNA, 13 bp, Homo sapiens
gtccatggcacca

SEQ ID NO: 1233305 - DNA, 16 bp, Homo sapiens
gtccatggcaccagcc

SEQ ID NO: 1233306 - DNA, 17 bp, Homo sapiens
gtccatggcaccagccc

SEQ ID NO: 1233307 - DNA, 20 bp, Homo sapiens
gtccatggcaccagccccct

SEQ ID NO: 1233308 - DNA, 18 bp, Homo sapiens
gtccatgggtctggcctg

SEQ ID NO: 1233309 - DNA, 13 bp, Homo sapiens
gtccattctccca

SEQ ID NO: 1233310 - DNA, 21 bp, Homo sapiens
gtccattcttcagtgtctctg

SEQ ID NO: 1233311 - DNA, 15 bp, Homo sapiens
gtccatttgttcctg

SEQ ID NO: 1233312 - DNA, 16 bp, Homo sapiens
gtccatttgttcctgc

SEQ ID NO: 1233313 - DNA, 13 bp, Homo sapiens
gtccattttctaa

SEQ ID NO: 1233314 - DNA, 15 bp, Homo sapiens
gtcccaacttgtaaa

SEQ ID NO: 1233315 - DNA, 18 bp, Homo sapiens
gtcccaagagccataagg

SEQ ID NO: 1233316 - DNA, 20 bp, Homo sapiens
gtcccaaggaatcagcagga

SEQ ID NO: 1233317 - DNA, 13 bp, Homo sapiens
gtcccaaggagct

SEQ ID NO: 1233318 - DNA, 14 bp, Homo sapiens
gtcccaattaaaat

SEQ ID NO: 1233319 - DNA, 20 bp, Homo sapiens
gtcccaattcggggcctgct

SEQ ID NO: 1233320 - DNA, 22 bp, Homo sapiens
gtcccaattcggggcctgctgg

SEQ ID NO: 1233321 - DNA, 17 bp, Homo sapiens
gtcccacactggtgact

SEQ ID NO: 1233322 - DNA, 12 bp, Homo sapiens
gtcccacactgt

SEQ ID NO: 1233323 - DNA, 15 bp, Homo sapiens
gtcccacactgtggc

SEQ ID NO: 1233324 - DNA, 20 bp, Homo sapiens
gtcccacccacacagctgcc

SEQ ID NO: 1233325 - DNA, 21 bp, Homo sapiens
gtcccacccacacagctgccc

SEQ ID NO: 1233326 - DNA, 16 bp, Homo sapiens
gtcccaccccacctct

SEQ ID NO: 1233327 - DNA, 21 bp, Homo sapiens
gtcccacccccacccccagct

SEQ ID NO: 1233328 - DNA, 19 bp, Homo sapiens
gtcccacccccttccccca

SEQ ID NO: 1233329 - DNA, 13 bp, Homo sapiens
gtcccacctcttc

SEQ ID NO: 1233330 - DNA, 15 bp, Homo sapiens
gtcccacctggctcc

SEQ ID NO: 1233331 - DNA, 17 bp, Homo sapiens
gtcccacctggctcccc

SEQ ID NO: 1233332 - DNA, 16 bp, Homo sapiens
gtcccacgtgtcttcc

SEQ ID NO: 1233333 - DNA, 19 bp, Homo sapiens
gtcccagagcaggaggccc

SEQ ID NO: 1233334 - DNA, 22 bp, Homo sapiens
gtcccagagcaggaggcccctg

SEQ ID NO: 1233335 - DNA, 17 bp, Homo sapiens
gtcccagagccctggac

SEQ ID NO: 1233336 - DNA, 21 bp, Homo sapiens
gtcccagagcttattggccac

SEQ ID NO: 1233337 - DNA, 19 bp, Homo sapiens
gtcccagaggttatctgcc

SEQ ID NO: 1233338 - DNA, 15 bp, Homo sapiens
gtcccagatcgtctc

SEQ ID NO: 1233339 - DNA, 13 bp, Homo sapiens
gtcccagatgctg

SEQ ID NO: 1233340 - DNA, 14 bp, Homo sapiens
gtcccagcatccct

SEQ ID NO: 1233341 - DNA, 15 bp, Homo sapiens
gtcccagcatccctg

SEQ ID NO: 1233342 - DNA, 21 bp, Homo sapiens
gtcccagccaccccgggctct

SEQ ID NO: 1233343 - DNA, 13 bp, Homo sapiens
gtcccagccccag

SEQ ID NO: 1233344 - DNA, 14 bp, Homo sapiens
gtcccagccccagg

SEQ ID NO: 1233345 - DNA, 16 bp, Homo sapiens
gtcccagccccaggcc

SEQ ID NO: 1233346 - DNA, 18 bp, Homo sapiens
gtcccagccccaggcctg

SEQ ID NO: 1233347 - DNA, 22 bp, Homo sapiens
gtcccagccccaggcctggcct

SEQ ID NO: 1233348 - DNA, 23 bp, Homo sapiens
gtcccagccccaggcctggcctc

SEQ ID NO: 1233349 - DNA, 15 bp, Homo sapiens
gtcccagcctggggc

SEQ ID NO: 1233350 - DNA, 13 bp, Homo sapiens
gtcccagcctggt

SEQ ID NO: 1233351 - DNA, 22 bp, Homo sapiens
gtcccagctacttgggagcctg

SEQ ID NO: 1233352 - DNA, 20 bp, Homo sapiens
gtcccaggaagccggtgcct

SEQ ID NO: 1233353 - DNA, 19 bp, Homo sapiens
gtcccaggagctgcccaga

SEQ ID NO: 1233354 - DNA, 12 bp, Homo sapiens
gtcccaggcaga

SEQ ID NO: 1233355 - DNA, 16 bp, Homo sapiens
gtcccaggcatgcagc

SEQ ID NO: 1233356 - DNA, 19 bp, Homo sapiens
gtcccaggcatgcagctgc

SEQ ID NO: 1233357 - DNA, 22 bp, Homo sapiens
gtcccaggcatgcagctgcctg

SEQ ID NO: 1233358 - DNA, 23 bp, Homo sapiens
gtcccaggcatgcagctgcctgg

SEQ ID NO: 1233359 - DNA, 22 bp, Homo sapiens
gtcccagggctctgcaggccac

SEQ ID NO: 1233360 - DNA, 14 bp, Homo sapiens
gtcccagggctgca

SEQ ID NO: 1233361 - DNA, 19 bp, Homo sapiens
gtcccagtattctcagagc

SEQ ID NO: 1233362 - DNA, 17 bp, Homo sapiens
gtcccagtcagaaataa

SEQ ID NO: 1233363 - DNA, 23 bp, Homo sapiens
gtcccagtgctcaccagccctgc

SEQ ID NO: 1233364 - DNA, 20 bp, Homo sapiens
gtcccagtgggaggggcagg

SEQ ID NO: 1233365 - DNA, 23 bp, Homo sapiens
gtcccagtgggaggggcaggctg

SEQ ID NO: 1233366 - DNA, 16 bp, Homo sapiens
gtcccatatcctgcct

SEQ ID NO: 1233367 - DNA, 15 bp, Homo sapiens
gtcccatccagctac

SEQ ID NO: 1233368 - DNA, 21 bp, Homo sapiens
gtcccatccagctaccaccac

SEQ ID NO: 1233369 - DNA, 16 bp, Homo sapiens
gtcccatccaggcagt

SEQ ID NO: 1233370 - DNA, 17 bp, Homo sapiens
gtcccatccaggcagtc

SEQ ID NO: 1233371 - DNA, 15 bp, Homo sapiens
gtcccatcttcactc

SEQ ID NO: 1233372 - DNA, 23 bp, Homo sapiens
gtcccatgacccacccctgtgct

SEQ ID NO: 1233373 - DNA, 22 bp, Homo sapiens
gtcccatggacactccagtgcc

SEQ ID NO: 1233374 - DNA, 16 bp, Homo sapiens
gtcccatggctgaagc

SEQ ID NO: 1233375 - DNA, 21 bp, Homo sapiens
gtcccatggggaaaccctgga

SEQ ID NO: 1233376 - DNA, 23 bp, Homo sapiens
gtcccatggggaaaccctggagc

SEQ ID NO: 1233377 - DNA, 15 bp, Homo sapiens
gtcccattccctggg

SEQ ID NO: 1233378 - DNA, 17 bp, Homo sapiens
gtcccattccctgggat

SEQ ID NO: 1233379 - DNA, 20 bp, Homo sapiens
gtcccattctagatcctgca

SEQ ID NO: 1233380 - DNA, 21 bp, Homo sapiens
gtcccattttccccttcctca

SEQ ID NO: 1233381 - DNA, 11 bp, Homo sapiens
gtccccaaagt

SEQ ID NO: 1233382 - DNA, 22 bp, Homo sapiens
gtccccaacgtcccctccgccg

SEQ ID NO: 1233383 - DNA, 21 bp, Homo sapiens
gtccccaagattcacacctga

SEQ ID NO: 1233384 - DNA, 24 bp, Homo sapiens
gtccccacagactgccccagccaa

SEQ ID NO: 1233385 - DNA, 14 bp, Homo sapiens
gtccccacccctgc

SEQ ID NO: 1233386 - DNA, 16 bp, Homo sapiens
gtccccaccctccact

SEQ ID NO: 1233387 - DNA, 17 bp, Homo sapiens
gtccccaccctccactc

SEQ ID NO: 1233388 - DNA, 20 bp, Homo sapiens
gtccccacgaggggacccat

SEQ ID NO: 1233389 - DNA, 14 bp, Homo sapiens
gtccccactcaccc

SEQ ID NO: 1233390 - DNA, 17 bp, Homo sapiens
gtccccactcaccccct

SEQ ID NO: 1233391 - DNA, 13 bp, Homo sapiens
gtccccactcccg

SEQ ID NO: 1233392 - DNA, 17 bp, Homo sapiens
gtccccagaccaaccct

SEQ ID NO: 1233393 - DNA, 12 bp, Homo sapiens
gtccccagccct

SEQ ID NO: 1233394 - DNA, 14 bp, Homo sapiens
gtccccagccctgg

SEQ ID NO: 1233395 - DNA, 15 bp, Homo sapiens
gtccccagccctggg

SEQ ID NO: 1233396 - DNA, 13 bp, Homo sapiens
gtccccagccctt

SEQ ID NO: 1233397 - DNA, 19 bp, Homo sapiens
gtccccagcccttctgcct

SEQ ID NO: 1233398 - DNA, 15 bp, Homo sapiens
gtccccaggcccagc

SEQ ID NO: 1233399 - DNA, 17 bp, Homo sapiens
gtccccaggcctggctc

SEQ ID NO: 1233400 - DNA, 13 bp, Homo sapiens
gtccccagggccc

SEQ ID NO: 1233401 - DNA, 22 bp, Homo sapiens
gtccccagggcccctccctctg

SEQ ID NO: 1233402 - DNA, 18 bp, Homo sapiens
gtccccaggtcctgtctc

SEQ ID NO: 1233403 - DNA, 15 bp, Homo sapiens
gtccccatcatccca

SEQ ID NO: 1233404 - DNA, 20 bp, Homo sapiens
gtccccatccagcgagagag

SEQ ID NO: 1233405 - DNA, 12 bp, Homo sapiens
gtccccatccca

SEQ ID NO: 1233406 - DNA, 15 bp, Homo sapiens
gtccccatccccacc

SEQ ID NO: 1233407 - DNA, 17 bp, Homo sapiens
gtccccatccccaccag

SEQ ID NO: 1233408 - DNA, 12 bp, Homo sapiens
gtccccatttct

SEQ ID NO: 1233409 - DNA, 16 bp, Homo sapiens
gtcccccaactctgag

SEQ ID NO: 1233410 - DNA, 17 bp, Homo sapiens
gtcccccactctctcac

SEQ ID NO: 1233411 - DNA, 23 bp, Homo sapiens
gtcccccagcatcgggggcctgc

SEQ ID NO: 1233412 - DNA, 13 bp, Homo sapiens
gtcccccagctct

SEQ ID NO: 1233413 - DNA, 15 bp, Homo sapiens
gtcccccaggctgga

SEQ ID NO: 1233414 - DNA, 18 bp, Homo sapiens
gtcccccaggctggagtg

SEQ ID NO: 1233415 - DNA, 14 bp, Homo sapiens
gtccccccccaggc

SEQ ID NO: 1233416 - DNA, 16 bp, Homo sapiens
gtccccccccaggccc

SEQ ID NO: 1233417 - DNA, 17 bp, Homo sapiens
gtccccccccaggccct

SEQ ID NO: 1233418 - DNA, 19 bp, Homo sapiens
gtccccccccaggccctcc

SEQ ID NO: 1233419 - DNA, 13 bp, Homo sapiens
gtccccccttgaa

SEQ ID NO: 1233420 - DNA, 20 bp, Homo sapiens
gtccccccttgaagcaataa

SEQ ID NO: 1233421 - DNA, 23 bp, Homo sapiens
gtcccccgaccaatccccagcct

SEQ ID NO: 1233422 - DNA, 16 bp, Homo sapiens
gtcccccgactgcctg

SEQ ID NO: 1233423 - DNA, 22 bp, Homo sapiens
gtccccctacccaccgatggag

SEQ ID NO: 1233424 - DNA, 14 bp, Homo sapiens
gtcctcactcccag

SEQ ID NO: 1233425 - DNA, 16 bp, Homo sapiens
gtcctcactcccagtc

SEQ ID NO: 1233426 - DNA, 17 bp, Homo sapiens
gtcctcactgtcctgtt

SEQ ID NO: 1233427 - DNA, 21 bp, Homo sapiens
gtcctcagatgggaattgcac

SEQ ID NO: 1233428 - DNA, 16 bp, Homo sapiens
gtcctcagggagcagg

SEQ ID NO: 1233429 - DNA, 21 bp, Homo sapiens
gtcctcaggtacagcgggctg

SEQ ID NO: 1233430 - DNA, 23 bp, Homo sapiens
gtcctcaggtacagcgggctgtg

SEQ ID NO: 1233431 - DNA, 13 bp, Homo sapiens
gtcctcaggtcag

SEQ ID NO: 1233432 - DNA, 17 bp, Homo sapiens
gtcctcaggtcagctgg

SEQ ID NO: 1233433 - DNA, 19 bp, Homo sapiens
gtcctcaggtcagctggga

SEQ ID NO: 1233434 - DNA, 16 bp, Homo sapiens
gtcctcatctccagcc

SEQ ID NO: 1233435 - DNA, 20 bp, Homo sapiens
gtcctccactttgctggttc

SEQ ID NO: 1233436 - DNA, 20 bp, Homo sapiens
gtcctccagaagcctctggc

SEQ ID NO: 1233437 - DNA, 21 bp, Homo sapiens
gtcctccagaagcctctggct

SEQ ID NO: 1233438 - DNA, 15 bp, Homo sapiens
gtcctccaggagctt

SEQ ID NO: 1233439 - DNA, 22 bp, Homo sapiens
gtcctccatccacgtggcctct

SEQ ID NO: 1233440 - DNA, 22 bp, Homo sapiens
gtcctccatcccaacagccatg

SEQ ID NO: 1233441 - DNA, 17 bp, Homo sapiens
gtcctcccacagacctg

SEQ ID NO: 1233442 - DNA, 20 bp, Homo sapiens
gtcctcccacagacctgcag

SEQ ID NO: 1233443 - DNA, 22 bp, Homo sapiens
gtcctcccacagacctgcagtg

SEQ ID NO: 1233444 - DNA, 16 bp, Homo sapiens
gtcctcccatcccctg

SEQ ID NO: 1233445 - DNA, 17 bp, Homo sapiens
gtcctcccatcccctgg

SEQ ID NO: 1233446 - DNA, 20 bp, Homo sapiens
gtcctcccatcccctggact

SEQ ID NO: 1233447 - DNA, 15 bp, Homo sapiens
gtcctccccctgcca

SEQ ID NO: 1233448 - DNA, 19 bp, Homo sapiens
gtcctccccctgccagtgc

SEQ ID NO: 1233449 - DNA, 20 bp, Homo sapiens
gtcctccccctgccagtgcc

SEQ ID NO: 1233450 - DNA, 13 bp, Homo sapiens
gtcctccccttgg

SEQ ID NO: 1233451 - DNA, 18 bp, Homo sapiens
gtcctccccttgggcggc

SEQ ID NO: 1233452 - DNA, 12 bp, Homo sapiens
gtcctcccgggc

SEQ ID NO: 1233453 - DNA, 17 bp, Homo sapiens
gtcctcccgggccctcc

SEQ ID NO: 1233454 - DNA, 14 bp, Homo sapiens
gtcctccctcagcc

SEQ ID NO: 1233455 - DNA, 15 bp, Homo sapiens
gtcctccctcagcct

SEQ ID NO: 1233456 - DNA, 19 bp, Homo sapiens
gtcctccctcagcctcccc

SEQ ID NO: 1233457 - DNA, 22 bp, Homo sapiens
gtcctccctccctcccttcctt

SEQ ID NO: 1233458 - DNA, 15 bp, Homo sapiens
gtcctccctgacttt

SEQ ID NO: 1233459 - DNA, 19 bp, Homo sapiens
gtcctccctgatcccaccc

SEQ ID NO: 1233460 - DNA, 16 bp, Homo sapiens
gtcctccgtagggtct

SEQ ID NO: 1233461 - DNA, 15 bp, Homo sapiens
gtcctcctcacctca

SEQ ID NO: 1233462 - DNA, 17 bp, Homo sapiens
gtcctcctcacctcatg

SEQ ID NO: 1233463 - DNA, 17 bp, Homo sapiens
gtcctcctctacctctc

SEQ ID NO: 1233464 - DNA, 18 bp, Homo sapiens
gtcctcctctacctctct

SEQ ID NO: 1233465 - DNA, 20 bp, Homo sapiens
gtcctcctctacctctctcc

SEQ ID NO: 1233466 - DNA, 14 bp, Homo sapiens
gtcctcctggaagg

SEQ ID NO: 1233467 - DNA, 14 bp, Homo sapiens
gtcctcctgggagc

SEQ ID NO: 1233468 - DNA, 12 bp, Homo sapiens
gtcctccttcct

SEQ ID NO: 1233469 - DNA, 13 bp, Homo sapiens
gtcctccttcctg

SEQ ID NO: 1233470 - DNA, 14 bp, Homo sapiens
gtcctccttcctgg

SEQ ID NO: 1233471 - DNA, 16 bp, Homo sapiens
gtcctccttcctggga

SEQ ID NO: 1233472 - DNA, 18 bp, Homo sapiens
gtcctccttcctgggacc

SEQ ID NO: 1233473 - DNA, 20 bp, Homo sapiens
gtcctcgaattctcagacga

SEQ ID NO: 1233474 - DNA, 16 bp, Homo sapiens
gtccttgcagacagaa

SEQ ID NO: 1233475 - DNA, 17 bp, Homo sapiens
gtccttgccccactcct

SEQ ID NO: 1233476 - DNA, 15 bp, Homo sapiens
gtccttgcctcctgg

SEQ ID NO: 1233477 - DNA, 14 bp, Homo sapiens
gtccttgctttggg

SEQ ID NO: 1233478 - DNA, 14 bp, Homo sapiens
gtccttggctcccg

SEQ ID NO: 1233479 - DNA, 14 bp, Homo sapiens
gtcctttaggcagc

SEQ ID NO: 1233480 - DNA, 20 bp, Homo sapiens
gtcctttccaaggcttctcc

SEQ ID NO: 1233481 - DNA, 15 bp, Homo sapiens
gtcctttccatctgt

SEQ ID NO: 1233482 - DNA, 15 bp, Homo sapiens
gtcctttctgtgaag

SEQ ID NO: 1233483 - DNA, 18 bp, Homo sapiens
gtcctttgcgcctgtgac

SEQ ID NO: 1233484 - DNA, 22 bp, Homo sapiens
gtccttttatttctccatcttt

SEQ ID NO: 1233485 - DNA, 22 bp, Homo sapiens
gtccttttcagaagtgagcttt

SEQ ID NO: 1233486 - DNA, 20 bp, Homo sapiens
gtccttttgacactgctcta

SEQ ID NO: 1233487 - DNA, 21 bp, Homo sapiens
gtccttttgacactgctctaa

SEQ ID NO: 1233488 - DNA, 19 bp, Homo sapiens
gtccttttgtgaaatcagt

SEQ ID NO: 1233489 - DNA, 17 bp, Homo sapiens
gtcgaattaatagcttt

SEQ ID NO: 1233490 - DNA, 20 bp, Homo sapiens
gtcgagcactctaattagag

SEQ ID NO: 1233491 - DNA, 22 bp, Homo sapiens
gtcgaggattctgtgcctccag

SEQ ID NO: 1233492 - DNA, 12 bp, Homo sapiens
gtcgaggcagga

SEQ ID NO: 1233493 - DNA, 16 bp, Homo sapiens
gtcgagtctttgtgtg

SEQ ID NO: 1233494 - DNA, 13 bp, Homo sapiens
gtcgattagactg

SEQ ID NO: 1233495 - DNA, 17 bp, Homo sapiens
gtcgcaggatccgctgc

SEQ ID NO: 1233496 - DNA, 17 bp, Homo sapiens
gtcgccagtcactgctg

SEQ ID NO: 1233497 - DNA, 19 bp, Homo sapiens
gtcgccagtcactgctgca

SEQ ID NO: 1233498 - DNA, 15 bp, Homo sapiens
gtcgcccacccagct

SEQ ID NO: 1233499 - DNA, 12 bp, Homo sapiens
gtcgcccaggag

SEQ ID NO: 1233500 - DNA, 15 bp, Homo sapiens
gtcgccccaggccct

SEQ ID NO: 1233501 - DNA, 22 bp, Homo sapiens
gtcgccccaggccctccctgac

SEQ ID NO: 1233502 - DNA, 18 bp, Homo sapiens
gtcgcccttctcccggcc

SEQ ID NO: 1233503 - DNA, 14 bp, Homo sapiens
gtcgctatgtgact

SEQ ID NO: 1233504 - DNA, 15 bp, Homo sapiens
gtcgctatgtgactt

SEQ ID NO: 1233505 - DNA, 22 bp, Homo sapiens
gtcgctcagtctgttcactgca

SEQ ID NO: 1233506 - DNA, 20 bp, Homo sapiens
gtcgctctgctggcctggcc

SEQ ID NO: 1233507 - DNA, 14 bp, Homo sapiens
gtcggaagcctgtc

SEQ ID NO: 1233508 - DNA, 15 bp, Homo sapiens
gtcggagctgcctgc

SEQ ID NO: 1233509 - DNA, 16 bp, Homo sapiens
gtcggagtgtgggcgc

SEQ ID NO: 1233510 - DNA, 13 bp, Homo sapiens
gtcggatctcaca

SEQ ID NO: 1233511 - DNA, 15 bp, Homo sapiens
gtcggcatgccagga

SEQ ID NO: 1233512 - DNA, 12 bp, Homo sapiens
gtcggccctgcg

SEQ ID NO: 1233513 - DNA, 21 bp, Homo sapiens
gtcggccctgcgtcggccctg

SEQ ID NO: 1233514 - DNA, 15 bp, Homo sapiens
gtcggctaagtggga

SEQ ID NO: 1233515 - DNA, 20 bp, Homo sapiens
gtcgggaccacatctgtcct

SEQ ID NO: 1233516 - DNA, 14 bp, Homo sapiens
gtcgggcagccagc

SEQ ID NO: 1233517 - DNA, 15 bp, Homo sapiens
gtcgggcagccagca

SEQ ID NO: 1233518 - DNA, 16 bp, Homo sapiens
gtcgggcttgcggtgg

SEQ ID NO: 1233519 - DNA, 13 bp, Homo sapiens
gtcggtcttgcaa

SEQ ID NO: 1233520 - DNA, 12 bp, Homo sapiens
gtcgtaaagatt

SEQ ID NO: 1233521 - DNA, 11 bp, Homo sapiens
gtcgtctttgt

SEQ ID NO: 1233522 - DNA, 18 bp, Homo sapiens
gtcgtgcctgtgtccatg

SEQ ID NO: 1233523 - DNA, 15 bp, Homo sapiens
gtcgtggcagataat

SEQ ID NO: 1233524 - DNA, 14 bp, Homo sapiens
gtcgtgggatggca

SEQ ID NO: 1233525 - DNA, 19 bp, Homo sapiens
gtcgtggggtgtgctggga

SEQ ID NO: 1233526 - DNA, 14 bp, Homo sapiens
gtcgtgggtgtgtg

SEQ ID NO: 1233527 - DNA, 15 bp, Homo sapiens
gtcgtggttcttaaa

SEQ ID NO: 1233528 - DNA, 16 bp, Homo sapiens
gtcgtggttcttaaat

SEQ ID NO: 1233529 - DNA, 23 bp, Homo sapiens
gtcgttaaaaacagatttggaaa

SEQ ID NO: 1233530 - DNA, 15 bp, Homo sapiens
gtcgttcccagtgtg

SEQ ID NO: 1233531 - DNA, 19 bp, Homo sapiens
gtcgtttgtgaacgctgtg

SEQ ID NO: 1233532 - DNA, 19 bp, Homo sapiens
gtcgttttcataacttgct

SEQ ID NO: 1233533 - DNA, 16 bp, Homo sapiens
gtcgttttccaaagag

SEQ ID NO: 1233534 - DNA, 12 bp, Homo sapiens
gtctaaaaacac

SEQ ID NO: 1233535 - DNA, 21 bp, Homo sapiens
gtctaaaaagacctggccttt

SEQ ID NO: 1233536 - DNA, 23 bp, Homo sapiens
gtctaaaaagacctggcctttca

SEQ ID NO: 1233537 - DNA, 12 bp, Homo sapiens
gtctaaacataa

SEQ ID NO: 1233538 - DNA, 13 bp, Homo sapiens
gtctaaactgagc

SEQ ID NO: 1233539 - DNA, 23 bp, Homo sapiens
gtctaaaggggttttttgggaag

SEQ ID NO: 1233540 - DNA, 21 bp, Homo sapiens
gtctaaagtgtttagctgtca

SEQ ID NO: 1233541 - DNA, 16 bp, Homo sapiens
gtctaaatatttcctt

SEQ ID NO: 1233542 - DNA, 15 bp, Homo sapiens
gtctaaatgctgaaa

SEQ ID NO: 1233543 - DNA, 16 bp, Homo sapiens
gtctaactcagaatta

SEQ ID NO: 1233544 - DNA, 19 bp, Homo sapiens
gtctaactgtggaatataa

SEQ ID NO: 1233545 - DNA, 20 bp, Homo sapiens
gtctaactgtggaatataaa

SEQ ID NO: 1233546 - DNA, 21 bp, Homo sapiens
gtctaatctagatatcgactt

SEQ ID NO: 1233547 - DNA, 19 bp, Homo sapiens
gtctaatgatattttatgc

SEQ ID NO: 1233548 - DNA, 22 bp, Homo sapiens
gtctaatgattcaaatgtttta

SEQ ID NO: 1233549 - DNA, 14 bp, Homo sapiens
gtctacagaaaatg

SEQ ID NO: 1233550 - DNA, 19 bp, Homo sapiens
gtctaccctgtcctttgca

SEQ ID NO: 1233551 - DNA, 18 bp, Homo sapiens
gtctacctcatctctgaa

SEQ ID NO: 1233552 - DNA, 21 bp, Homo sapiens
gtctacctcatctctgaaaat

SEQ ID NO: 1233553 - DNA, 19 bp, Homo sapiens
gtctactgtggtgatctgt

SEQ ID NO: 1233554 - DNA, 17 bp, Homo sapiens
gtctacttcttaaaatt

SEQ ID NO: 1233555 - DNA, 19 bp, Homo sapiens
gtctacttcttaaaattca

SEQ ID NO: 1233556 - DNA, 21 bp, Homo sapiens
gtctactttttaatttttaag

SEQ ID NO: 1233557 - DNA, 13 bp, Homo sapiens
gtctagaatgtgg

SEQ ID NO: 1233558 - DNA, 21 bp, Homo sapiens
gtctagagagggaggcaagcc

SEQ ID NO: 1233559 - DNA, 20 bp, Homo sapiens
gtctcactctgtcgctcagg

SEQ ID NO: 1233560 - DNA, 23 bp, Homo sapiens
gtctcactctgtcgctcaggctg

SEQ ID NO: 1233561 - DNA, 21 bp, Homo sapiens
gtctcactttttacccagaac

SEQ ID NO: 1233562 - DNA, 22 bp, Homo sapiens
gtctcactttttacccagaaca

SEQ ID NO: 1233563 - DNA, 17 bp, Homo sapiens
gtctcagaaactcccct

SEQ ID NO: 1233564 - DNA, 23 bp, Homo sapiens
gtctcagaaactcccctgggggt

SEQ ID NO: 1233565 - DNA, 21 bp, Homo sapiens
gtctcagacactaaatgcaga

SEQ ID NO: 1233566 - DNA, 16 bp, Homo sapiens
gtctcagagccttcca

SEQ ID NO: 1233567 - DNA, 17 bp, Homo sapiens
gtctcagagccttccat

SEQ ID NO: 1233568 - DNA, 22 bp, Homo sapiens
gtctcagatggtgtgtccagca

SEQ ID NO: 1233569 - DNA, 15 bp, Homo sapiens
gtctcagcctctgcc

SEQ ID NO: 1233570 - DNA, 17 bp, Homo sapiens
gtctcagcctctgccag

SEQ ID NO: 1233571 - DNA, 20 bp, Homo sapiens
gtctcagcctctgccagcgc

SEQ ID NO: 1233572 - DNA, 16 bp, Homo sapiens
gtctcaggaggaggct

SEQ ID NO: 1233573 - DNA, 13 bp, Homo sapiens
gtctcaggcagca

SEQ ID NO: 1233574 - DNA, 19 bp, Homo sapiens
gtctcaggcagcaccacac

SEQ ID NO: 1233575 - DNA, 18 bp, Homo sapiens
gtctcagggtgcagaggt

SEQ ID NO: 1233576 - DNA, 15 bp, Homo sapiens
gtctcaggtccctgc

SEQ ID NO: 1233577 - DNA, 16 bp, Homo sapiens
gtctcaggtccctgca

SEQ ID NO: 1233578 - DNA, 20 bp, Homo sapiens
gtctcaggtttgttttgtga

SEQ ID NO: 1233579 - DNA, 16 bp, Homo sapiens
gtctcagtgaagacta

SEQ ID NO: 1233580 - DNA, 19 bp, Homo sapiens
gtctcagttctcttgcttt

SEQ ID NO: 1233581 - DNA, 15 bp, Homo sapiens
gtctcagtttcactt

SEQ ID NO: 1233582 - DNA, 19 bp, Homo sapiens
gtctcagtttgtgtgtctt

SEQ ID NO: 1233583 - DNA, 19 bp, Homo sapiens
gtctcataggttgagcaat

SEQ ID NO: 1233584 - DNA, 13 bp, Homo sapiens
gtctcatccccag

SEQ ID NO: 1233585 - DNA, 15 bp, Homo sapiens
gtctcatcctccttt

SEQ ID NO: 1233586 - DNA, 14 bp, Homo sapiens
gtctcatctcctga

SEQ ID NO: 1233587 - DNA, 17 bp, Homo sapiens
gtctcatctcctgaccc

SEQ ID NO: 1233588 - DNA, 14 bp, Homo sapiens
gtctcatctcttca

SEQ ID NO: 1233589 - DNA, 19 bp, Homo sapiens
gtctcatctcttcaggttc

SEQ ID NO: 1233590 - DNA, 19 bp, Homo sapiens
gtctcatgtaatttgcatt

SEQ ID NO: 1233591 - DNA, 20 bp, Homo sapiens
gtctcattccgttgtctgtg

SEQ ID NO: 1233592 - DNA, 20 bp, Homo sapiens
gtctcattcgcctttgtctt

SEQ ID NO: 1233593 - DNA, 21 bp, Homo sapiens
gtctcattcgcctttgtcttg

SEQ ID NO: 1233594 - DNA, 16 bp, Homo sapiens
gtctcattgcttctga

SEQ ID NO: 1233595 - DNA, 19 bp, Homo sapiens
gtctcattttggtctgttt

SEQ ID NO: 1233596 - DNA, 23 bp, Homo sapiens
gtctccaaaaaaaaaaaaaatac

SEQ ID NO: 1233597 - DNA, 20 bp, Homo sapiens
gtctccagccccttctcaga

SEQ ID NO: 1233598 - DNA, 11 bp, Homo sapiens
gtctccagctg

SEQ ID NO: 1233599 - DNA, 15 bp, Homo sapiens
gtctccaggccatga

SEQ ID NO: 1233600 - DNA, 19 bp, Homo sapiens
gtctccagggcccccaccg

SEQ ID NO: 1233601 - DNA, 20 bp, Homo sapiens
gtctccagggcccccaccga

SEQ ID NO: 1233602 - DNA, 15 bp, Homo sapiens
gtctccaggggctgc

SEQ ID NO: 1233603 - DNA, 14 bp, Homo sapiens
gtctccatggccct

SEQ ID NO: 1233604 - DNA, 13 bp, Homo sapiens
gtctccatgtttg

SEQ ID NO: 1233605 - DNA, 22 bp, Homo sapiens
gtctccattttcttctctgtga

SEQ ID NO: 1233606 - DNA, 21 bp, Homo sapiens
gtctcccacacccaccctttt

SEQ ID NO: 1233607 - DNA, 14 bp, Homo sapiens
gtctcccaggctgc

SEQ ID NO: 1233608 - DNA, 16 bp, Homo sapiens
gtctcccagtgggtga

SEQ ID NO: 1233609 - DNA, 14 bp, Homo sapiens
gtctccccactcca

SEQ ID NO: 1233610 - DNA, 12 bp, Homo sapiens
gtctcccccaga

SEQ ID NO: 1233611 - DNA, 18 bp, Homo sapiens
gtctcccccagagtgctg

SEQ ID NO: 1233612 - DNA, 20 bp, Homo sapiens
gtctcccccagagtgctgtc

SEQ ID NO: 1233613 - DNA, 19 bp, Homo sapiens
gtctcccccgtgttcccct

SEQ ID NO: 1233614 - DNA, 14 bp, Homo sapiens
gtctcccctcctgc

SEQ ID NO: 1233615 - DNA, 18 bp, Homo sapiens
gtctcccctgttcccctc

SEQ ID NO: 1233616 - DNA, 16 bp, Homo sapiens
gtctccctcccctctc

SEQ ID NO: 1233617 - DNA, 18 bp, Homo sapiens
gtctccctcccctctcag

SEQ ID NO: 1233618 - DNA, 19 bp, Homo sapiens
gtctccctcccctctcaga

SEQ ID NO: 1233619 - DNA, 23 bp, Homo sapiens
gtctccctcccctctcagaacat

SEQ ID NO: 1233620 - DNA, 14 bp, Homo sapiens
gtctccctctcctg

SEQ ID NO: 1233621 - DNA, 19 bp, Homo sapiens
gtctccctctcctgcctac

SEQ ID NO: 1233622 - DNA, 22 bp, Homo sapiens
gtctccctctcctgcctactca

SEQ ID NO: 1233623 - DNA, 13 bp, Homo sapiens
gtctccctggcca

SEQ ID NO: 1233624 - DNA, 15 bp, Homo sapiens
gtctccctggctccc

SEQ ID NO: 1233625 - DNA, 18 bp, Homo sapiens
gtctccctggtgcctctg

SEQ ID NO: 1233626 - DNA, 14 bp, Homo sapiens
gtctccctgtgtta

SEQ ID NO: 1233627 - DNA, 22 bp, Homo sapiens
gtctccctgtgttacccaggct

SEQ ID NO: 1233628 - DNA, 23 bp, Homo sapiens
gtctcccttcttgggtagggcag

SEQ ID NO: 1233629 - DNA, 18 bp, Homo sapiens
gtctcctacctgctgctg

SEQ ID NO: 1233630 - DNA, 21 bp, Homo sapiens
gtctcctacctgctgctgcta

SEQ ID NO: 1233631 - DNA, 16 bp, Homo sapiens
gtctcctactctgtgt

SEQ ID NO: 1233632 - DNA, 16 bp, Homo sapiens
gtctcctactttgaaa

SEQ ID NO: 1233633 - DNA, 16 bp, Homo sapiens
gtctcctcaagcctgt

SEQ ID NO: 1233634 - DNA, 13 bp, Homo sapiens
gtctcctcagggt

SEQ ID NO: 1233635 - DNA, 12 bp, Homo sapiens
gtctcctcccct

SEQ ID NO: 1233636 - DNA, 16 bp, Homo sapiens
gtctcctccccttccc

SEQ ID NO: 1233637 - DNA, 19 bp, Homo sapiens
gtctcctccctcagctctc

SEQ ID NO: 1233638 - DNA, 16 bp, Homo sapiens
gtctcctccctgggct

SEQ ID NO: 1233639 - DNA, 21 bp, Homo sapiens
gtctcctccctgggctaagca

SEQ ID NO: 1233640 - DNA, 14 bp, Homo sapiens
gtctcctcttaaaa

SEQ ID NO: 1233641 - DNA, 22 bp, Homo sapiens
gtctcctcttaaaaaataaaaa

SEQ ID NO: 1233642 - DNA, 13 bp, Homo sapiens
gtctcctggacct

SEQ ID NO: 1233643 - DNA, 21 bp, Homo sapiens
gtctccttactctgagcccag

SEQ ID NO: 1233644 - DNA, 22 bp, Homo sapiens
gtctccttactctgagcccagg

SEQ ID NO: 1233645 - DNA, 16 bp, Homo sapiens
gtctccttccattcag

SEQ ID NO: 1233646 - DNA, 21 bp, Homo sapiens
gtctcctttctcagccacaaa

SEQ ID NO: 1233647 - DNA, 21 bp, Homo sapiens
gtctcctttctgactgtccct

SEQ ID NO: 1233648 - DNA, 16 bp, Homo sapiens
gtctcctttgcactga

SEQ ID NO: 1233649 - DNA, 18 bp, Homo sapiens
gtctcctttgcactgagg

SEQ ID NO: 1233650 - DNA, 19 bp, Homo sapiens
gtgagactgcaggtgggct

SEQ ID NO: 1233651 - DNA, 14 bp, Homo sapiens
gtgagactgcccca

SEQ ID NO: 1233652 - DNA, 23 bp, Homo sapiens
gtgagactgggaaggcttgggat

SEQ ID NO: 1233653 - DNA, 15 bp, Homo sapiens
gtgagagaatgtatt

SEQ ID NO: 1233654 - DNA, 13 bp, Homo sapiens
gtgagagaattta

SEQ ID NO: 1233655 - DNA, 18 bp, Homo sapiens
gtgagagacctctgccta

SEQ ID NO: 1233656 - DNA, 11 bp, Homo sapiens
gtgagagagac

SEQ ID NO: 1233657 - DNA, 11 bp, Homo sapiens
gtgagagagga

SEQ ID NO: 1233658 - DNA, 20 bp, Homo sapiens
gtgagagaggaggcctggac

SEQ ID NO: 1233659 - DNA, 14 bp, Homo sapiens
gtgagagatggggc

SEQ ID NO: 1233660 - DNA, 16 bp, Homo sapiens
gtgagagcccagtcat

SEQ ID NO: 1233661 - DNA, 12 bp, Homo sapiens
gtgagagcccat

SEQ ID NO: 1233662 - DNA, 12 bp, Homo sapiens
gtgagaggcagc

SEQ ID NO: 1233663 - DNA, 17 bp, Homo sapiens
gtgagaggcaggaatgg

SEQ ID NO: 1233664 - DNA, 21 bp, Homo sapiens
gtgagaggcaggaatgggggt

SEQ ID NO: 1233665 - DNA, 23 bp, Homo sapiens
gtgagagggcatgcgcacaaggc

SEQ ID NO: 1233666 - DNA, 14 bp, Homo sapiens
gtgagaggggaggg

SEQ ID NO: 1233667 - DNA, 17 bp, Homo sapiens
gtgagaggggagggctc

SEQ ID NO: 1233668 - DNA, 22 bp, Homo sapiens
gtgagaggggagggctcctggg

SEQ ID NO: 1233669 - DNA, 16 bp, Homo sapiens
gtgagagtcaaagctg

SEQ ID NO: 1233670 - DNA, 18 bp, Homo sapiens
gtgagagtgtgagcaggg

SEQ ID NO: 1233671 - DNA, 14 bp, Homo sapiens
gtgagagttgtctc

SEQ ID NO: 1233672 - DNA, 20 bp, Homo sapiens
gtgagatcacagcctccagg

SEQ ID NO: 1233673 - DNA, 22 bp, Homo sapiens
gtgagatcctctttactctggg

SEQ ID NO: 1233674 - DNA, 15 bp, Homo sapiens
gtgagtgtggctccc

SEQ ID NO: 1233675 - DNA, 14 bp, Homo sapiens
gtgagtgtgtgaag

SEQ ID NO: 1233676 - DNA, 15 bp, Homo sapiens
gtgagtgtgtgtgct

SEQ ID NO: 1233677 - DNA, 21 bp, Homo sapiens
gtgagtttgagctgccttccc

SEQ ID NO: 1233678 - DNA, 17 bp, Homo sapiens
gtgagtttgctggttgt

SEQ ID NO: 1233679 - DNA, 21 bp, Homo sapiens
gtgagtttgctggttgtaaat

SEQ ID NO: 1233680 - DNA, 19 bp, Homo sapiens
gtgagtttggtctggactg

SEQ ID NO: 1233681 - DNA, 21 bp, Homo sapiens
gtgagtttggtctggactgac

SEQ ID NO: 1233682 - DNA, 21 bp, Homo sapiens
gtgagttttactcttaaatca

SEQ ID NO: 1233683 - DNA, 16 bp, Homo sapiens
gtgcaattgtgaggga

SEQ ID NO: 1233684 - DNA, 22 bp, Homo sapiens
gtgcacagagacggtctggaag

SEQ ID NO: 1233685 - DNA, 19 bp, Homo sapiens
gtgcacagcacaaattagt

SEQ ID NO: 1233686 - DNA, 16 bp, Homo sapiens
gtgcacagtggcttct

SEQ ID NO: 1233687 - DNA, 22 bp, Homo sapiens
gtgcacatatccaggcaccagg

SEQ ID NO: 1233688 - DNA, 23 bp, Homo sapiens
gtgcaccatccctttttgaagtg

SEQ ID NO: 1233689 - DNA, 14 bp, Homo sapiens
gtgcacccacctgt

SEQ ID NO: 1233690 - DNA, 19 bp, Homo sapiens
gtgcacctccctccccagc

SEQ ID NO: 1233691 - DNA, 21 bp, Homo sapiens
gtgcaccttaccaactttctg

SEQ ID NO: 1233692 - DNA, 18 bp, Homo sapiens
gtgcacgtggagagctgg

SEQ ID NO: 1233693 - DNA, 18 bp, Homo sapiens
gtgcactgacctgtaggt

SEQ ID NO: 1233694 - DNA, 22 bp, Homo sapiens
gtgcactgggcaggttcctggg

SEQ ID NO: 1233695 - DNA, 23 bp, Homo sapiens
gtgcactgggcaggttcctgggg

SEQ ID NO: 1233696 - DNA, 15 bp, Homo sapiens
gtgcactgtcacttt

SEQ ID NO: 1233697 - DNA, 19 bp, Homo sapiens
gtgcactgtgaatcctggc

SEQ ID NO: 1233698 - DNA, 15 bp, Homo sapiens
gtgcactttgtaaat

SEQ ID NO: 1233699 - DNA, 14 bp, Homo sapiens
gtgcagaacacctg

SEQ ID NO: 1233700 - DNA, 18 bp, Homo sapiens
gtgcagaataatggaaac

SEQ ID NO: 1233701 - DNA, 21 bp, Homo sapiens
gtgcagaataatggaaacatt

SEQ ID NO: 1233702 - DNA, 16 bp, Homo sapiens
gtgcagacagaagtct

SEQ ID NO: 1233703 - DNA, 14 bp, Homo sapiens
gtgcagacagccat

SEQ ID NO: 1233704 - DNA, 16 bp, Homo sapiens
gtgcagacagccatgc

SEQ ID NO: 1233705 - DNA, 23 bp, Homo sapiens
gtgcagacaggccatgtgagcca

SEQ ID NO: 1233706 - DNA, 13 bp, Homo sapiens
gtgcagacccagt

SEQ ID NO: 1233707 - DNA, 20 bp, Homo sapiens
gtgcagaccttactcagggg

SEQ ID NO: 1233708 - DNA, 17 bp, Homo sapiens
gtgcagaggctgtggct

SEQ ID NO: 1233709 - DNA, 19 bp, Homo sapiens
gtgcagatgcaattgtttg

SEQ ID NO: 1233710 - DNA, 15 bp, Homo sapiens
gtgcagatgggctgt

SEQ ID NO: 1233711 - DNA, 23 bp, Homo sapiens
gtgcagatggtactgctgaggtc

SEQ ID NO: 1233712 - DNA, 14 bp, Homo sapiens
gtgcagcagcccag

SEQ ID NO: 1233713 - DNA, 18 bp, Homo sapiens
gtgcagccaaaggggagc

SEQ ID NO: 1233714 - DNA, 22 bp, Homo sapiens
gtgcagccaaaggggagccaga

SEQ ID NO: 1233715 - DNA, 11 bp, Homo sapiens
gtgcagccctc

SEQ ID NO: 1233716 - DNA, 20 bp, Homo sapiens
gtgcagccttcccctccctg

SEQ ID NO: 1233717 - DNA, 12 bp, Homo sapiens
gtgcagctgatt

SEQ ID NO: 1233718 - DNA, 13 bp, Homo sapiens
gtgcagctgattt

SEQ ID NO: 1233719 - DNA, 14 bp, Homo sapiens
gtgcagctgatttt

SEQ ID NO: 1233720 - DNA, 16 bp, Homo sapiens
gtgcagctgattttaa

SEQ ID NO: 1233721 - DNA, 15 bp, Homo sapiens
gtgcagctgggtggg

SEQ ID NO: 1233722 - DNA, 16 bp, Homo sapiens
gtgcaggacagctctt

SEQ ID NO: 1233723 - DNA, 17 bp, Homo sapiens
gtgcaggacagctcttg

SEQ ID NO: 1233724 - DNA, 12 bp, Homo sapiens
gtgcaggagcct

SEQ ID NO: 1233725 - DNA, 15 bp, Homo sapiens
gtgcaggtggggaga

SEQ ID NO: 1233726 - DNA, 20 bp, Homo sapiens
gtgcagtatagaataggcac

SEQ ID NO: 1233727 - DNA, 22 bp, Homo sapiens
gtgcagtatcatgccctgtgca

SEQ ID NO: 1233728 - DNA, 24 bp, Homo sapiens
gtgcagttcccccaacctcagact

SEQ ID NO: 1233729 - DNA, 16 bp, Homo sapiens
gtgcagttgctgttta

SEQ ID NO: 1233730 - DNA, 14 bp, Homo sapiens
gtgcagtttctttt

SEQ ID NO: 1233731 - DNA, 21 bp, Homo sapiens
gtgcagtttggtgtgtcctcc

SEQ ID NO: 1233732 - DNA, 19 bp, Homo sapiens
gtgcataagttaacttcca

SEQ ID NO: 1233733 - DNA, 14 bp, Homo sapiens
gtgcataatgataa

SEQ ID NO: 1233734 - DNA, 20 bp, Homo sapiens
gtgcataattcttccaaagg

SEQ ID NO: 1233735 - DNA, 21 bp, Homo sapiens
gtgcataccacttttgttctt

SEQ ID NO: 1233736 - DNA, 19 bp, Homo sapiens
gtgcatactggcattggcc

SEQ ID NO: 1233737 - DNA, 20 bp, Homo sapiens
gtgcatagcgtcctgccctg

SEQ ID NO: 1233738 - DNA, 16 bp, Homo sapiens
gtgcatatagaaaaca

SEQ ID NO: 1233739 - DNA, 22 bp, Homo sapiens
gtgcatatagaaaacaaaggag

SEQ ID NO: 1233740 - DNA, 14 bp, Homo sapiens
gtgcatatgttaaa

SEQ ID NO: 1233741 - DNA, 15 bp, Homo sapiens
gtgcatccccacgac

SEQ ID NO: 1233742 - DNA, 14 bp, Homo sapiens
gtgcatcccccctg

SEQ ID NO: 1233743 - DNA, 20 bp, Homo sapiens
gtgcatcctcctcagccccc

SEQ ID NO: 1233744 - DNA, 21 bp, Homo sapiens
gtgcatccttgtaatacctga

SEQ ID NO: 1233745 - DNA, 14 bp, Homo sapiens
gtgcatctcagccc

SEQ ID NO: 1233746 - DNA, 23 bp, Homo sapiens
gtgcatctgcaggcaccgggctg

SEQ ID NO: 1233747 - DNA, 13 bp, Homo sapiens
gtgcatctggtgt

SEQ ID NO: 1233748 - DNA, 14 bp, Homo sapiens
gtgcatctggtgta

SEQ ID NO: 1233749 - DNA, 18 bp, Homo sapiens
gtgcatgatcttgagcaa

SEQ ID NO: 1233750 - DNA, 17 bp, Homo sapiens
gtgcatggaagttgggg

SEQ ID NO: 1233751 - DNA, 18 bp, Homo sapiens
gtgcatggaagttggggc

SEQ ID NO: 1233752 - DNA, 21 bp, Homo sapiens
gtgcatggaggccctcctgtg

SEQ ID NO: 1233753 - DNA, 13 bp, Homo sapiens
gtgcatggctcct

SEQ ID NO: 1233754 - DNA, 17 bp, Homo sapiens
gtgcatgtatgtataca

SEQ ID NO: 1233755 - DNA, 14 bp, Homo sapiens
gtgcatgtcctttg

SEQ ID NO: 1233756 - DNA, 13 bp, Homo sapiens
gtgcatgtgtgtg

SEQ ID NO: 1233757 - DNA, 14 bp, Homo sapiens
gtgcattacagaga

SEQ ID NO: 1233758 - DNA, 23 bp, Homo sapiens
gtgcattacagagaggagaaaca

SEQ ID NO: 1233759 - DNA, 19 bp, Homo sapiens
gtgcattatctagatactg

SEQ ID NO: 1233760 - DNA, 19 bp, Homo sapiens
gtgcattcttttaaaagac

SEQ ID NO: 1233761 - DNA, 22 bp, Homo sapiens
gtgcatttaaactctgccagaa

SEQ ID NO: 1233762 - DNA, 20 bp, Homo sapiens
gtgcatttcacctgtgacaa

SEQ ID NO: 1233763 - DNA, 22 bp, Homo sapiens
gtgcatttcacctgtgacaaag

SEQ ID NO: 1233764 - DNA, 19 bp, Homo sapiens
gtgcatttgaggggccagg

SEQ ID NO: 1233765 - DNA, 19 bp, Homo sapiens
gtgcatttgaggtctgttc

SEQ ID NO: 1233766 - DNA, 20 bp, Homo sapiens
gtgcatttgaggtctgttct

SEQ ID NO: 1233767 - DNA, 21 bp, Homo sapiens
gtgcatttgaggtctgttctt

SEQ ID NO: 1233768 - DNA, 21 bp, Homo sapiens
gtgcatttggtggtttcagaa

SEQ ID NO: 1233769 - DNA, 23 bp, Homo sapiens
gtgcatttgtgctagaaattttc

SEQ ID NO: 1233770 - DNA, 16 bp, Homo sapiens
gtgcatttttaaactt

SEQ ID NO: 1233771 - DNA, 17 bp, Homo sapiens
gtgccaaatagccccag

SEQ ID NO: 1233772 - DNA, 18 bp, Homo sapiens
gtgccaaatagccccaga

SEQ ID NO: 1233773 - DNA, 19 bp, Homo sapiens
gtgccaaatagccccagac

SEQ ID NO: 1233774 - DNA, 20 bp, Homo sapiens
gtgccaaatagccccagact

SEQ ID NO: 1233775 - DNA, 19 bp, Homo sapiens
gtgccaaccccacccagct

SEQ ID NO: 1233776 - DNA, 13 bp, Homo sapiens
gtgccaagccttc

SEQ ID NO: 1233777 - DNA, 17 bp, Homo sapiens
gtgccaagggccccagg

SEQ ID NO: 1233778 - DNA, 16 bp, Homo sapiens
gtgccaagtggacagt

SEQ ID NO: 1233779 - DNA, 17 bp, Homo sapiens
gtgccaatgatgtgacc

SEQ ID NO: 1233780 - DNA, 14 bp, Homo sapiens
gtgccaatttcaag

SEQ ID NO: 1233781 - DNA, 18 bp, Homo sapiens
gtgccacagcctgctggc

SEQ ID NO: 1233782 - DNA, 13 bp, Homo sapiens
gtgccacattttc

SEQ ID NO: 1233783 - DNA, 18 bp, Homo sapiens
gtgccaccccgagggctg

SEQ ID NO: 1233784 - DNA, 22 bp, Homo sapiens
gtgccacctatgcctgtggtga

SEQ ID NO: 1233785 - DNA, 14 bp, Homo sapiens
gtgccacctgtccg

SEQ ID NO: 1233786 - DNA, 21 bp, Homo sapiens
gtgccacctgtccggcccagt

SEQ ID NO: 1233787 - DNA, 20 bp, Homo sapiens
gtgccaccttgtgtgtttaa

SEQ ID NO: 1233788 - DNA, 16 bp, Homo sapiens
gtgccactccctgagc

SEQ ID NO: 1233789 - DNA, 17 bp, Homo sapiens
gtgccactccctgagct

SEQ ID NO: 1233790 - DNA, 13 bp, Homo sapiens
gtgccactgaccg

SEQ ID NO: 1233791 - DNA, 21 bp, Homo sapiens
gtgccactgaccgggatccag

SEQ ID NO: 1233792 - DNA, 22 bp, Homo sapiens
gtgccactgacttgctgtgtga

SEQ ID NO: 1233793 - DNA, 17 bp, Homo sapiens
gtgccactgcccgagct

SEQ ID NO: 1233794 - DNA, 21 bp, Homo sapiens
gtgccacttcttaaaggcctg

SEQ ID NO: 1233795 - DNA, 22 bp, Homo sapiens
gtgccagacaaataggagtgag

SEQ ID NO: 1233796 - DNA, 21 bp, Homo sapiens
gtgccagaggaatcctggcag

SEQ ID NO: 1233797 - DNA, 14 bp, Homo sapiens
gtgccagaggtggg

SEQ ID NO: 1233798 - DNA, 21 bp, Homo sapiens
gtgccagatataactgtcttg

SEQ ID NO: 1233799 - DNA, 15 bp, Homo sapiens
gtgccagcagcctcg

SEQ ID NO: 1233800 - DNA, 22 bp, Homo sapiens
gtgccagcagcctcgcacaggc

SEQ ID NO: 1233801 - DNA, 20 bp, Homo sapiens
gtgccagcaggggggctgtg

SEQ ID NO: 1233802 - DNA, 21 bp, Homo sapiens
gtgccagccaatccctggcca

SEQ ID NO: 1233803 - DNA, 15 bp, Homo sapiens
gtgcctgtcccaccc

SEQ ID NO: 1233804 - DNA, 22 bp, Homo sapiens
gtgcctgtccttgaaaaacaaa

SEQ ID NO: 1233805 - DNA, 16 bp, Homo sapiens
gtgcctgtgaggcagg

SEQ ID NO: 1233806 - DNA, 18 bp, Homo sapiens
gtgcctgtgggaggggga

SEQ ID NO: 1233807 - DNA, 13 bp, Homo sapiens
gtgcctgtgtcca

SEQ ID NO: 1233808 - DNA, 21 bp, Homo sapiens
gtgcctgttgctttcttcctg

SEQ ID NO: 1233809 - DNA, 22 bp, Homo sapiens
gtgcctgttgctttcttcctgc

SEQ ID NO: 1233810 - DNA, 19 bp, Homo sapiens
gtgccttaaaaggagagaa

SEQ ID NO: 1233811 - DNA, 17 bp, Homo sapiens
gtgccttacctcctgcc

SEQ ID NO: 1233812 - DNA, 19 bp, Homo sapiens
gtgccttacctcctgccca

SEQ ID NO: 1233813 - DNA, 20 bp, Homo sapiens
gtgccttacctcctgcccag

SEQ ID NO: 1233814 - DNA, 18 bp, Homo sapiens
gtgccttatgttgaaaaa

SEQ ID NO: 1233815 - DNA, 17 bp, Homo sapiens
gtgccttccataattat

SEQ ID NO: 1233816 - DNA, 23 bp, Homo sapiens
gtgccttcctgtttttcacattt

SEQ ID NO: 1233817 - DNA, 23 bp, Homo sapiens
gtgccttcttattctcactccac

SEQ ID NO: 1233818 - DNA, 12 bp, Homo sapiens
gtgccttgccca

SEQ ID NO: 1233819 - DNA, 14 bp, Homo sapiens
gtgccttgcccaca

SEQ ID NO: 1233820 - DNA, 19 bp, Homo sapiens
gtgccttggggaatttcct

SEQ ID NO: 1233821 - DNA, 14 bp, Homo sapiens
gtgctgccccttgc

SEQ ID NO: 1233822 - DNA, 21 bp, Homo sapiens
gtgctgcccgtcttcagccta

SEQ ID NO: 1233823 - DNA, 13 bp, Homo sapiens
gtgctgccctgtg

SEQ ID NO: 1233824 - DNA, 21 bp, Homo sapiens
gtgctgcctggccctccccac

SEQ ID NO: 1233825 - DNA, 22 bp, Homo sapiens
gtgctgcctggccctccccaca

SEQ ID NO: 1233826 - DNA, 20 bp, Homo sapiens
gtgctgcgcctgcaggcaga

SEQ ID NO: 1233827 - DNA, 15 bp, Homo sapiens
gtgctgctgcaccaa

SEQ ID NO: 1233828 - DNA, 14 bp, Homo sapiens
gtgctgctgctgct

SEQ ID NO: 1233829 - DNA, 16 bp, Homo sapiens
gtgctgctgctgctat

SEQ ID NO: 1233830 - DNA, 12 bp, Homo sapiens
gtgctgcttctt

SEQ ID NO: 1233831 - DNA, 20 bp, Homo sapiens
gtgctggaactttagtgaaa

SEQ ID NO: 1233832 - DNA, 18 bp, Homo sapiens
gtgctggaattctaacaa

SEQ ID NO: 1233833 - DNA, 21 bp, Homo sapiens
gtgctggactttaaaaaaaca

SEQ ID NO: 1233834 - DNA, 17 bp, Homo sapiens
gtgctggagtctcctga

SEQ ID NO: 1233835 - DNA, 23 bp, Homo sapiens
gtgctggagtctcctgaggacac

SEQ ID NO: 1233836 - DNA, 19 bp, Homo sapiens
gtgctggcgacactcaggg

SEQ ID NO: 1233837 - DNA, 23 bp, Homo sapiens
gtgctggcgacactcagggcagc

SEQ ID NO: 1233838 - DNA, 19 bp, Homo sapiens
gtgctggctcacagtacag

SEQ ID NO: 1233839 - DNA, 20 bp, Homo sapiens
gtgctggctcacagtacagc

SEQ ID NO: 1233840 - DNA, 18 bp, Homo sapiens
gtgctggctgcccagacc

SEQ ID NO: 1233841 - DNA, 19 bp, Homo sapiens
gtgctgggaaatgcagaaa

SEQ ID NO: 1233842 - DNA, 13 bp, Homo sapiens
gtgctgggactga

SEQ ID NO: 1233843 - DNA, 18 bp, Homo sapiens
gtgctgggactgagccag

SEQ ID NO: 1233844 - DNA, 22 bp, Homo sapiens
gtgctgggactgagccagtccc

SEQ ID NO: 1233845 - DNA, 15 bp, Homo sapiens
gtgctgggaggaggg

SEQ ID NO: 1233846 - DNA, 17 bp, Homo sapiens
gtgctgggaggagggag

SEQ ID NO: 1233847 - DNA, 23 bp, Homo sapiens
gtgctgggaggtataggggtcct

SEQ ID NO: 1233848 - DNA, 19 bp, Homo sapiens
gtgctgggataactggcca

SEQ ID NO: 1233849 - DNA, 20 bp, Homo sapiens
gtgctgggattacaggcgtg

SEQ ID NO: 1233850 - DNA, 20 bp, Homo sapiens
gtgctgggattacaggtgta

SEQ ID NO: 1233851 - DNA, 14 bp, Homo sapiens
gtgctggggccagg

SEQ ID NO: 1233852 - DNA, 21 bp, Homo sapiens
gtgctgggggcacagctgtct

SEQ ID NO: 1233853 - DNA, 22 bp, Homo sapiens
gtgctgggggcacagctgtctg

SEQ ID NO: 1233854 - DNA, 21 bp, Homo sapiens
gtgctggtcagagagacctca

SEQ ID NO: 1233855 - DNA, 21 bp, Homo sapiens
gtgctggtcctaggtcctctg

SEQ ID NO: 1233856 - DNA, 21 bp, Homo sapiens
gtgctggtctattttgatttt

SEQ ID NO: 1233857 - DNA, 21 bp, Homo sapiens
gtgctggtgaacactgtgacc

SEQ ID NO: 1233858 - DNA, 22 bp, Homo sapiens
gtgctggtgcggatggacacta

SEQ ID NO: 1233859 - DNA, 21 bp, Homo sapiens
gtgctggtgggtctgagctgg

SEQ ID NO: 1233860 - DNA, 13 bp, Homo sapiens
gtgctggtgtcct

SEQ ID NO: 1233861 - DNA, 20 bp, Homo sapiens
gtgctgtacccttccacctc

SEQ ID NO: 1233862 - DNA, 19 bp, Homo sapiens
gtgctgtatggcccaggca

SEQ ID NO: 1233863 - DNA, 22 bp, Homo sapiens
gtgctgtcttgatgactgctga

SEQ ID NO: 1233864 - DNA, 17 bp, Homo sapiens
gtgctgtcttttgttct

SEQ ID NO: 1233865 - DNA, 21 bp, Homo sapiens
gtgctgtcttttgttctctga

SEQ ID NO: 1233866 - DNA, 13 bp, Homo sapiens
gtgctgtgaggga

SEQ ID NO: 1233867 - DNA, 13 bp, Homo sapiens
gtgctgtgcctgc

SEQ ID NO: 1233868 - DNA, 20 bp, Homo sapiens
gtgctgtgcctgctagagca

SEQ ID NO: 1233869 - DNA, 16 bp, Homo sapiens
gtgctgtggccaggcc

SEQ ID NO: 1233870 - DNA, 16 bp, Homo sapiens
gtgctgtggccagggt

SEQ ID NO: 1233871 - DNA, 23 bp, Homo sapiens
gtgctgtggccagggtgagagct

SEQ ID NO: 1233872 - DNA, 16 bp, Homo sapiens
gtgctgtggcctgggc

SEQ ID NO: 1233873 - DNA, 17 bp, Homo sapiens
gtgctgtggcctgggca

SEQ ID NO: 1233874 - DNA, 13 bp, Homo sapiens
gtgctgtgggcag

SEQ ID NO: 1233875 - DNA, 15 bp, Homo sapiens
gtgctgtgggcagca

SEQ ID NO: 1233876 - DNA, 20 bp, Homo sapiens
gtgctgtgggcagcaccctc

SEQ ID NO: 1233877 - DNA, 15 bp, Homo sapiens
gtgctgtgggcctca

SEQ ID NO: 1233878 - DNA, 16 bp, Homo sapiens
gtgctgtgtaccctgg

SEQ ID NO: 1233879 - DNA, 17 bp, Homo sapiens
gtgctgttggtggcagt

SEQ ID NO: 1233880 - DNA, 19 bp, Homo sapiens
gtgctgtttattaatctta

SEQ ID NO: 1233881 - DNA, 17 bp, Homo sapiens
gtgcttaagcagaagca

SEQ ID NO: 1233882 - DNA, 22 bp, Homo sapiens
gtgcttagcaaaaaataatgac

SEQ ID NO: 1233883 - DNA, 21 bp, Homo sapiens
gtgcttattctcaaagcagga

SEQ ID NO: 1233884 - DNA, 13 bp, Homo sapiens
gtgcttcacattt

SEQ ID NO: 1233885 - DNA, 14 bp, Homo sapiens
gtgcttcagccctg

SEQ ID NO: 1233886 - DNA, 22 bp, Homo sapiens
gtgcttcccccacccctccacg

SEQ ID NO: 1233887 - DNA, 15 bp, Homo sapiens
gtgcttcctgctgta

SEQ ID NO: 1233888 - DNA, 16 bp, Homo sapiens
gtgcttcgactactgc

SEQ ID NO: 1233889 - DNA, 13 bp, Homo sapiens
gtgcttctgctca

SEQ ID NO: 1233890 - DNA, 18 bp, Homo sapiens
gtgcttcttcacttaccc

SEQ ID NO: 1233891 - DNA, 14 bp, Homo sapiens
gtgcttgactctca

SEQ ID NO: 1233892 - DNA, 17 bp, Homo sapiens
gtgcttgcatcctattt

SEQ ID NO: 1233893 - DNA, 20 bp, Homo sapiens
gtgcttgcttagagtgccca

SEQ ID NO: 1233894 - DNA, 15 bp, Homo sapiens
gtgcttgggctccac

SEQ ID NO: 1233895 - DNA, 19 bp, Homo sapiens
gtgcttggggctatttgtg

SEQ ID NO: 1233896 - DNA, 20 bp, Homo sapiens
gtgcttgttagagagaaaga

SEQ ID NO: 1233897 - DNA, 20 bp, Homo sapiens
gtgcttgttccctctccctg

SEQ ID NO: 1233898 - DNA, 19 bp, Homo sapiens
gtgcttgtttacagcacta

SEQ ID NO: 1233899 - DNA, 13 bp, Homo sapiens
gtgcttgttttat

SEQ ID NO: 1233900 - DNA, 20 bp, Homo sapiens
gtgcttgttttataaaattt

SEQ ID NO: 1233901 - DNA, 20 bp, Homo sapiens
gtgctttattgaattagaaa

SEQ ID NO: 1233902 - DNA, 22 bp, Homo sapiens
gtgctttattgaattagaaaat

SEQ ID NO: 1233903 - DNA, 11 bp, Homo sapiens
gtgctttcctg

SEQ ID NO: 1233904 - DNA, 17 bp, Homo sapiens
gtgctttctgcatgctt

SEQ ID NO: 1233905 - DNA, 15 bp, Homo sapiens
gtgcttttaaatgca

SEQ ID NO: 1233906 - DNA, 19 bp, Homo sapiens
gtgcttttcctatttgttt

SEQ ID NO: 1233907 - DNA, 23 bp, Homo sapiens
gtgcttttctgttttcaagtgta

SEQ ID NO: 1233908 - DNA, 14 bp, Homo sapiens
gtgcttttgatgtg

SEQ ID NO: 1233909 - DNA, 18 bp, Homo sapiens
gtgctttttataaaaaga

SEQ ID NO: 1233910 - DNA, 22 bp, Homo sapiens
gtgctttttccttttcatctgt

SEQ ID NO: 1233911 - DNA, 23 bp, Homo sapiens
gtggaaaaatgcccatttttgct

SEQ ID NO: 1233912 - DNA, 16 bp, Homo sapiens
gtggaaaacagggtgc

SEQ ID NO: 1233913 - DNA, 16 bp, Homo sapiens
gtggaaaacttatgct

SEQ ID NO: 1233914 - DNA, 21 bp, Homo sapiens
gtggaaaacttatgctgattt

SEQ ID NO: 1233915 - DNA, 20 bp, Homo sapiens
gtggaaaagcttaaaaaaat

SEQ ID NO: 1233916 - DNA, 14 bp, Homo sapiens
gtggaaagcctctg

SEQ ID NO: 1233917 - DNA, 23 bp, Homo sapiens
gtggaaagcctctgctgccatgg

SEQ ID NO: 1233918 - DNA, 16 bp, Homo sapiens
gtggaaataatttgaa

SEQ ID NO: 1233919 - DNA, 22 bp, Homo sapiens
gtggaacagtcacccttctggg

SEQ ID NO: 1233920 - DNA, 19 bp, Homo sapiens
gtggaacataaaaaggaca

SEQ ID NO: 1233921 - DNA, 13 bp, Homo sapiens
gtggaacattctg

SEQ ID NO: 1233922 - DNA, 21 bp, Homo sapiens
gtggaaccactgactactggc

SEQ ID NO: 1233923 - DNA, 14 bp, Homo sapiens
gtggaacctctgtc

SEQ ID NO: 1233924 - DNA, 17 bp, Homo sapiens
gtggaacctctgtctca

SEQ ID NO: 1233925 - DNA, 22 bp, Homo sapiens
gtggaacgtttttcctgttctt

SEQ ID NO: 1233926 - DNA, 23 bp, Homo sapiens
gtggaactacattagtacacagc

SEQ ID NO: 1233927 - DNA, 18 bp, Homo sapiens
gtggaactgcgttatgaa

SEQ ID NO: 1233928 - DNA, 20 bp, Homo sapiens
gtggaagaagggagaagaaa

SEQ ID NO: 1233929 - DNA, 16 bp, Homo sapiens
tagaagtctttcagtg

SEQ ID NO: 1233930 - DNA, 13 bp, Homo sapiens
tagaataaaagct

SEQ ID NO: 1233931 - DNA, 19 bp, Homo sapiens
tagaataaaagctataaag

SEQ ID NO: 1233932 - DNA, 21 bp, Homo sapiens
tagaataaaagctataaagta

SEQ ID NO: 1233933 - DNA, 15 bp, Homo sapiens
tagaataaatgaaga

SEQ ID NO: 1233934 - DNA, 14 bp, Homo sapiens
tagaataaatggtt

SEQ ID NO: 1233935 - DNA, 17 bp, Homo sapiens
tagaataaatggtttct

SEQ ID NO: 1233936 - DNA, 17 bp, Homo sapiens
tagaataacctttcaga

SEQ ID NO: 1233937 - DNA, 20 bp, Homo sapiens
tagaataacctttcagaatt

SEQ ID NO: 1233938 - DNA, 22 bp, Homo sapiens
tagaataatctattatttggag

SEQ ID NO: 1233939 - DNA, 12 bp, Homo sapiens
tagaataattct

SEQ ID NO: 1233940 - DNA, 22 bp, Homo sapiens
tagaatacattgatacaaagta

SEQ ID NO: 1233941 - DNA, 15 bp, Homo sapiens
tagaataggcagggg

SEQ ID NO: 1233942 - DNA, 17 bp, Homo sapiens
tagagaactaaactagt

SEQ ID NO: 1233943 - DNA, 13 bp, Homo sapiens
tagagaagcaagt

SEQ ID NO: 1233944 - DNA, 13 bp, Homo sapiens
tagagaaggaccc

SEQ ID NO: 1233945 - DNA, 18 bp, Homo sapiens
tagagaatgggatgtgtg

SEQ ID NO: 1233946 - DNA, 14 bp, Homo sapiens
tagagaatgtgttt

SEQ ID NO: 1233947 - DNA, 17 bp, Homo sapiens
tagagaatgttccagac

SEQ ID NO: 1233948 - DNA, 15 bp, Homo sapiens
tagagactgtagatt

SEQ ID NO: 1233949 - DNA, 19 bp, Homo sapiens
tagagactgtagattgctt

SEQ ID NO: 1233950 - DNA, 14 bp, Homo sapiens
tagagagaaagaga

SEQ ID NO: 1233951 - DNA, 13 bp, Homo sapiens
tagagagagaggt

SEQ ID NO: 1233952 - DNA, 22 bp, Homo sapiens
tagagagagaggtatttaactg

SEQ ID NO: 1233953 - DNA, 21 bp, Homo sapiens
tagagagaggaggcagccccc

SEQ ID NO: 1233954 - DNA, 20 bp, Homo sapiens
tagagagatgagaagccagg

SEQ ID NO: 1233955 - DNA, 20 bp, Homo sapiens
tagagagcatctgcaacaaa

SEQ ID NO: 1233956 - DNA, 18 bp, Homo sapiens
tagagaggtagcgagctg

SEQ ID NO: 1233957 - DNA, 20 bp, Homo sapiens
tagagaggtttttcttggga

SEQ ID NO: 1233958 - DNA, 17 bp, Homo sapiens
tagagatgactgagtcc

SEQ ID NO: 1233959 - DNA, 14 bp, Homo sapiens
tagagatgcattca

SEQ ID NO: 1233960 - DNA, 17 bp, Homo sapiens
tagagatggagtttgct

SEQ ID NO: 1233961 - DNA, 21 bp, Homo sapiens
tagagatgtgcctgtgggagg

SEQ ID NO: 1233962 - DNA, 21 bp, Homo sapiens
tagatccacgtgtggcctccg

SEQ ID NO: 1233963 - DNA, 21 bp, Homo sapiens
tagatccagatccagactgta

SEQ ID NO: 1233964 - DNA, 20 bp, Homo sapiens
tagatccattaatttaaatg

SEQ ID NO: 1233965 - DNA, 21 bp, Homo sapiens
tagatcctgagctcacagagt

SEQ ID NO: 1233966 - DNA, 13 bp, Homo sapiens
tagatcctgcacc

SEQ ID NO: 1233967 - DNA, 22 bp, Homo sapiens
tagatcgatgatatgaccagaa

SEQ ID NO: 1233968 - DNA, 18 bp, Homo sapiens
tagatcgcttgagcccag

SEQ ID NO: 1233969 - DNA, 12 bp, Homo sapiens
tagatctccagc

SEQ ID NO: 1233970 - DNA, 13 bp, Homo sapiens
tagatctccagcg

SEQ ID NO: 1233971 - DNA, 21 bp, Homo sapiens
tagatctgatggtgagctggg

SEQ ID NO: 1233972 - DNA, 13 bp, Homo sapiens
tagatcttctgaa

SEQ ID NO: 1233973 - DNA, 15 bp, Homo sapiens
tagatgaactcaact

SEQ ID NO: 1233974 - DNA, 16 bp, Homo sapiens
tagatgaagttttaca

SEQ ID NO: 1233975 - DNA, 12 bp, Homo sapiens
tagatgataaag

SEQ ID NO: 1233976 - DNA, 22 bp, Homo sapiens
tagatgattttttgaaagttaa

SEQ ID NO: 1233977 - DNA, 17 bp, Homo sapiens
tagatgcaggaggctca

SEQ ID NO: 1233978 - DNA, 17 bp, Homo sapiens
tagatgcatcactgggt

SEQ ID NO: 1233979 - DNA, 10 bp, Homo sapiens
tagatgctga

SEQ ID NO: 1233980 - DNA, 16 bp, Homo sapiens
tagatgctgaatatct

SEQ ID NO: 1233981 - DNA, 23 bp, Homo sapiens
tagatgctgactgtactcctccc

SEQ ID NO: 1233982 - DNA, 20 bp, Homo sapiens
tagatgctgatgatttgttt

SEQ ID NO: 1233983 - DNA, 20 bp, Homo sapiens
tagatgctttcctaaatcag

SEQ ID NO: 1233984 - DNA, 22 bp, Homo sapiens
tagatgggtctggctgagctga

SEQ ID NO: 1233985 - DNA, 15 bp, Homo sapiens
tagatggtgaaattt

SEQ ID NO: 1233986 - DNA, 23 bp, Homo sapiens
tagatgtagataaactcagaaat

SEQ ID NO: 1233987 - DNA, 12 bp, Homo sapiens
tagatgtagcat

SEQ ID NO: 1233988 - DNA, 19 bp, Homo sapiens
tagatgtatgcacacacat

SEQ ID NO: 1233989 - DNA, 20 bp, Homo sapiens
tagatgtatgcacacacata

SEQ ID NO: 1233990 - DNA, 19 bp, Homo sapiens
tagatgtcttcatcacttc

SEQ ID NO: 1233991 - DNA, 21 bp, Homo sapiens
tagatgtctttaggcagcagc

SEQ ID NO: 1233992 - DNA, 13 bp, Homo sapiens
tagatgtcttttc

SEQ ID NO: 1233993 - DNA, 20 bp, Homo sapiens
tagatgtcttttcccattta

SEQ ID NO: 1233994 - DNA, 18 bp, Homo sapiens
tagatgtgcaacctgtgg

SEQ ID NO: 1233995 - DNA, 19 bp, Homo sapiens
tagatgtgcaacctgtggc

SEQ ID NO: 1233996 - DNA, 22 bp, Homo sapiens
tagatgtgcatttttgtgaaat

SEQ ID NO: 1233997 - DNA, 14 bp, Homo sapiens
tagatgttgtcttg

SEQ ID NO: 1233998 - DNA, 19 bp, Homo sapiens
tagatgtttaacaaatcta

SEQ ID NO: 1233999 - DNA, 22 bp, Homo sapiens
tagatgttttgggatcaggagc

SEQ ID NO: 1234000 - DNA, 23 bp, Homo sapiens
tagatgttttgggatcaggagcc

SEQ ID NO: 1234001 - DNA, 23 bp, Homo sapiens
tagattaatactctatttttaca

SEQ ID NO: 1234002 - DNA, 22 bp, Homo sapiens
tagattaatgacgtatacatag

SEQ ID NO: 1234003 - DNA, 18 bp, Homo sapiens
tagattagctctggacca

SEQ ID NO: 1234004 - DNA, 17 bp, Homo sapiens
tagattatggagctttt

SEQ ID NO: 1234005 - DNA, 19 bp, Homo sapiens
tagattatttctgtatttg

SEQ ID NO: 1234006 - DNA, 15 bp, Homo sapiens
tagattcacctgtaa

SEQ ID NO: 1234007 - DNA, 16 bp, Homo sapiens
tagattcacctgtaaa

SEQ ID NO: 1234008 - DNA, 19 bp, Homo sapiens
tagattcaggtaatacaaa

SEQ ID NO: 1234009 - DNA, 14 bp, Homo sapiens
tagattgattgtat

SEQ ID NO: 1234010 - DNA, 16 bp, Homo sapiens
tagattgcaaagcaat

SEQ ID NO: 1234011 - DNA, 23 bp, Homo sapiens
tagattgcagaaaattctgtgcc

SEQ ID NO: 1234012 - DNA, 15 bp, Homo sapiens
tagattggttctgtt

SEQ ID NO: 1234013 - DNA, 16 bp, Homo sapiens
tagattgttaaaataa

SEQ ID NO: 1234014 - DNA, 19 bp, Homo sapiens
tagatttattttacattta

SEQ ID NO: 1234015 - DNA, 21 bp, Homo sapiens
tagatttatttttcagttcca

SEQ ID NO: 1234016 - DNA, 22 bp, Homo sapiens
tagatttatttttcagttccaa

SEQ ID NO: 1234017 - DNA, 16 bp, Homo sapiens
tagatttcatagttca

SEQ ID NO: 1234018 - DNA, 22 bp, Homo sapiens
tagatttcatagttcagaattt

SEQ ID NO: 1234019 - DNA, 22 bp, Homo sapiens
tagatttctatgatcctttttt

SEQ ID NO: 1234020 - DNA, 23 bp, Homo sapiens
tagatttctcacactctaactgt

SEQ ID NO: 1234021 - DNA, 15 bp, Homo sapiens
tagatttctcttggg

SEQ ID NO: 1234022 - DNA, 13 bp, Homo sapiens
tagatttctgaca

SEQ ID NO: 1234023 - DNA, 13 bp, Homo sapiens
tagatttgaaaat

SEQ ID NO: 1234024 - DNA, 15 bp, Homo sapiens
tagatttgaaaattg

SEQ ID NO: 1234025 - DNA, 11 bp, Homo sapiens
tagatttgtcc

SEQ ID NO: 1234026 - DNA, 23 bp, Homo sapiens
tagatttgtccttttatttctcc

SEQ ID NO: 1234027 - DNA, 18 bp, Homo sapiens
tagattttaatttatttg

SEQ ID NO: 1234028 - DNA, 13 bp, Homo sapiens
tagattttctgct

SEQ ID NO: 1234029 - DNA, 21 bp, Homo sapiens
tagatttttaatggttaagaa

SEQ ID NO: 1234030 - DNA, 15 bp, Homo sapiens
tagatttttgattca

SEQ ID NO: 1234031 - DNA, 12 bp, Homo sapiens
tagattttttca

SEQ ID NO: 1234032 - DNA, 14 bp, Homo sapiens
tagcaaaagaagaa

SEQ ID NO: 1234033 - DNA, 15 bp, Homo sapiens
tagcaaaataaaaca

SEQ ID NO: 1234034 - DNA, 23 bp, Homo sapiens
tagcaaaataaaacatagcaaat

SEQ ID NO: 1234035 - DNA, 21 bp, Homo sapiens
tagcaaaattcttaagtatgt

SEQ ID NO: 1234036 - DNA, 12 bp, Homo sapiens
tagcaaacagag

SEQ ID NO: 1234037 - DNA, 12 bp, Homo sapiens
tagcaaagaatt

SEQ ID NO: 1234038 - DNA, 14 bp, Homo sapiens
tagcaaagaattga

SEQ ID NO: 1234039 - DNA, 11 bp, Homo sapiens
tagcaaagatt

SEQ ID NO: 1234040 - DNA, 23 bp, Homo sapiens
tagcaaataatttcctggtgtga

SEQ ID NO: 1234041 - DNA, 12 bp, Homo sapiens
tagcaaatgcag

SEQ ID NO: 1234042 - DNA, 18 bp, Homo sapiens
tagcaacaacaattggta

SEQ ID NO: 1234043 - DNA, 19 bp, Homo sapiens
tagcaacaacaattggtaa

SEQ ID NO: 1234044 - DNA, 12 bp, Homo sapiens
tagcaacaggaa

SEQ ID NO: 1234045 - DNA, 18 bp, Homo sapiens
tagcaactgctggggaga

SEQ ID NO: 1234046 - DNA, 17 bp, Homo sapiens
tagcaacttttgtgtaa

SEQ ID NO: 1234047 - DNA, 19 bp, Homo sapiens
tagcaagaacacctaaccc

SEQ ID NO: 1234048 - DNA, 21 bp, Homo sapiens
tagcaagacctgaaaatatgt

SEQ ID NO: 1234049 - DNA, 14 bp, Homo sapiens
tagcaagagagcag

SEQ ID NO: 1234050 - DNA, 14 bp, Homo sapiens
tagcaaggctgggt

SEQ ID NO: 1234051 - DNA, 23 bp, Homo sapiens
tagcaaggtttggtgcaaagtat

SEQ ID NO: 1234052 - DNA, 18 bp, Homo sapiens
tagcaagttacagtgatg

SEQ ID NO: 1234053 - DNA, 17 bp, Homo sapiens
tagcaagttctagagaa

SEQ ID NO: 1234054 - DNA, 18 bp, Homo sapiens
tagcaagttctagagaag

SEQ ID NO: 1234055 - DNA, 21 bp, Homo sapiens
tagcaataagctggactagtg

SEQ ID NO: 1234056 - DNA, 22 bp, Homo sapiens
tagcaataagctggactagtgt

SEQ ID NO: 1234057 - DNA, 14 bp, Homo sapiens
tagcaatgtgcctt

SEQ ID NO: 1234058 - DNA, 16 bp, Homo sapiens
tagcaattggttgttt

SEQ ID NO: 1234059 - DNA, 22 bp, Homo sapiens
tagcaattggttgtttaacact

SEQ ID NO: 1234060 - DNA, 13 bp, Homo sapiens
tagcacaagttat

SEQ ID NO: 1234061 - DNA, 12 bp, Homo sapiens
tagcacagcagc

SEQ ID NO: 1234062 - DNA, 23 bp, Homo sapiens
tagcacaggttagggtgtgtgcc

SEQ ID NO: 1234063 - DNA, 22 bp, Homo sapiens
tagcacatacacccccttgtag

SEQ ID NO: 1234064 - DNA, 21 bp, Homo sapiens
tagcacatgtctgtcctcaga

SEQ ID NO: 1234065 - DNA, 10 bp, Homo sapiens
tagcaccctg

SEQ ID NO: 1234066 - DNA, 22 bp, Homo sapiens
tagcaccttcagggctgagttc

SEQ ID NO: 1234067 - DNA, 22 bp, Homo sapiens
tagcactcctcaagactttgat

SEQ ID NO: 1234068 - DNA, 14 bp, Homo sapiens
tagcactcttgttt

SEQ ID NO: 1234069 - DNA, 17 bp, Homo sapiens
tagcactgttgatgtat

SEQ ID NO: 1234070 - DNA, 19 bp, Homo sapiens
tagcactgttgatgtatct

SEQ ID NO: 1234071 - DNA, 16 bp, Homo sapiens
tagcacttacgtaaaa

SEQ ID NO: 1234072 - DNA, 23 bp, Homo sapiens
tagcacttacgtaaaacatttgt

SEQ ID NO: 1234073 - DNA, 16 bp, Homo sapiens
tagcacttgacctttt

SEQ ID NO: 1234074 - DNA, 23 bp, Homo sapiens
tagcagaaggttgcacctccccc

SEQ ID NO: 1234075 - DNA, 17 bp, Homo sapiens
tagcagacagaaactgg

SEQ ID NO: 1234076 - DNA, 18 bp, Homo sapiens
tagcagacagaaactgga

SEQ ID NO: 1234077 - DNA, 19 bp, Homo sapiens
tagcagacagaaactggat

SEQ ID NO: 1234078 - DNA, 22 bp, Homo sapiens
tagcagactttcccaaatgtat

SEQ ID NO: 1234079 - DNA, 18 bp, Homo sapiens
tagcagaggtttaaatgt

SEQ ID NO: 1234080 - DNA, 17 bp, Homo sapiens
tagcagatctgttttgt

SEQ ID NO: 1234081 - DNA, 14 bp, Homo sapiens
tagcagatggagta

SEQ ID NO: 1234082 - DNA, 14 bp, Homo sapiens
tagcagattttaat

SEQ ID NO: 1234083 - DNA, 20 bp, Homo sapiens
tagcagattttaattttgaa

SEQ ID NO: 1234084 - DNA, 11 bp, Homo sapiens
tagcagcactt

SEQ ID NO: 1234085 - DNA, 12 bp, Homo sapiens
tagcagcaggct

SEQ ID NO: 1234086 - DNA, 14 bp, Homo sapiens
tagcagcaggctca

SEQ ID NO: 1234087 - DNA, 15 bp, Homo sapiens
tagcagcaggctcag

SEQ ID NO: 1234088 - DNA, 17 bp, Homo sapiens
tagcagcaggctcaggc

SEQ ID NO: 1234089 - DNA, 12 bp, Homo sapiens
tagcagcctggg

SEQ ID NO: 1234090 - DNA, 20 bp, Homo sapiens
tagcagcctggggtgacctc

SEQ ID NO: 1234091 - DNA, 10 bp, Homo sapiens
tagcagctgg

SEQ ID NO: 1234092 - DNA, 20 bp, Homo sapiens
tagcagctttgtctctgtca

SEQ ID NO: 1234093 - DNA, 15 bp, Homo sapiens
tagcaggactaggca

SEQ ID NO: 1234094 - DNA, 16 bp, Homo sapiens
tagcaggactaggcat

SEQ ID NO: 1234095 - DNA, 18 bp, Homo sapiens
tagcaggccccctaggat

SEQ ID NO: 1234096 - DNA, 17 bp, Homo sapiens
tagcaggggcaccttcc

SEQ ID NO: 1234097 - DNA, 17 bp, Homo sapiens
tagcaggtaccactgat

SEQ ID NO: 1234098 - DNA, 22 bp, Homo sapiens
tagcaggtggtcctgagacctg

SEQ ID NO: 1234099 - DNA, 21 bp, Homo sapiens
tagcagtggctggtgcccatg

SEQ ID NO: 1234100 - DNA, 20 bp, Homo sapiens
tagcagtgtctgtaaaagag

SEQ ID NO: 1234101 - DNA, 14 bp, Homo sapiens
tagcagttctgcaa

SEQ ID NO: 1234102 - DNA, 16 bp, Homo sapiens
tagcagttctgcaaat

SEQ ID NO: 1234103 - DNA, 17 bp, Homo sapiens
tagcagttctgcaaata

SEQ ID NO: 1234104 - DNA, 21 bp, Homo sapiens
tagcagttgctcacatgtctt

SEQ ID NO: 1234105 - DNA, 15 bp, Homo sapiens
tagcataaataaaac

SEQ ID NO: 1234106 - DNA, 13 bp, Homo sapiens
tagcataactgta

SEQ ID NO: 1234107 - DNA, 20 bp, Homo sapiens
tagcataatatgaagccttt

SEQ ID NO: 1234108 - DNA, 21 bp, Homo sapiens
tagcataatatgaagcctttg

SEQ ID NO: 1234109 - DNA, 16 bp, Homo sapiens
tagcatacgtacacat

SEQ ID NO: 1234110 - DNA, 17 bp, Homo sapiens
tagcatacgtacacatt

SEQ ID NO: 1234111 - DNA, 15 bp, Homo sapiens
tagcatactgtgtat

SEQ ID NO: 1234112 - DNA, 16 bp, Homo sapiens
tagcatactgtgtatg

SEQ ID NO: 1234113 - DNA, 18 bp, Homo sapiens
tagcatactgtgtatgtt

SEQ ID NO: 1234114 - DNA, 22 bp, Homo sapiens
tagcatctcaggagatttcatg

SEQ ID NO: 1234115 - DNA, 14 bp, Homo sapiens
tagcccttcagatt

SEQ ID NO: 1234116 - DNA, 13 bp, Homo sapiens
tagcccttccctg

SEQ ID NO: 1234117 - DNA, 18 bp, Homo sapiens
tagcccttccctgagtgc

SEQ ID NO: 1234118 - DNA, 13 bp, Homo sapiens
tagccctttaaaa

SEQ ID NO: 1234119 - DNA, 14 bp, Homo sapiens
tagccgacctcagc

SEQ ID NO: 1234120 - DNA, 15 bp, Homo sapiens
tagccgacctcagcc

SEQ ID NO: 1234121 - DNA, 15 bp, Homo sapiens
tagccgactgtcttg

SEQ ID NO: 1234122 - DNA, 21 bp, Homo sapiens
tagccgatatcagaatttgtg

SEQ ID NO: 1234123 - DNA, 22 bp, Homo sapiens
tagccgatatcagaatttgtgt

SEQ ID NO: 1234124 - DNA, 22 bp, Homo sapiens
tagccgcaccctgcacctgctg

SEQ ID NO: 1234125 - DNA, 13 bp, Homo sapiens
tagccgccctgag

SEQ ID NO: 1234126 - DNA, 14 bp, Homo sapiens
tagccgccctgaga

SEQ ID NO: 1234127 - DNA, 16 bp, Homo sapiens
tagccggccactttgg

SEQ ID NO: 1234128 - DNA, 22 bp, Homo sapiens
tagccgggcgtggtggcaggca

SEQ ID NO: 1234129 - DNA, 23 bp, Homo sapiens
tagccgggtgtggcacgcacctg

SEQ ID NO: 1234130 - DNA, 15 bp, Homo sapiens
tagccgtccatggca

SEQ ID NO: 1234131 - DNA, 16 bp, Homo sapiens
tagcctaaagggcagg

SEQ ID NO: 1234132 - DNA, 17 bp, Homo sapiens
tagcctaaagggcaggg

SEQ ID NO: 1234133 - DNA, 22 bp, Homo sapiens
tagcctaaagtatacaactgcc

SEQ ID NO: 1234134 - DNA, 15 bp, Homo sapiens
tagcctaatttacca

SEQ ID NO: 1234135 - DNA, 18 bp, Homo sapiens
tagcctcacttttaatga

SEQ ID NO: 1234136 - DNA, 23 bp, Homo sapiens
tagcctcacttttaatgaacaaa

SEQ ID NO: 1234137 - DNA, 12 bp, Homo sapiens
tagcctccctga

SEQ ID NO: 1234138 - DNA, 19 bp, Homo sapiens
tagcctccttcgcaggcat

SEQ ID NO: 1234139 - DNA, 18 bp, Homo sapiens
tagcctgaggtcccctcg

SEQ ID NO: 1234140 - DNA, 12 bp, Homo sapiens
tagcctgcaccg

SEQ ID NO: 1234141 - DNA, 23 bp, Homo sapiens
tagcctgcagaagtaagcctcat

SEQ ID NO: 1234142 - DNA, 10 bp, Homo sapiens
tagcctgcct

SEQ ID NO: 1234143 - DNA, 14 bp, Homo sapiens
tagcctgcctcacc

SEQ ID NO: 1234144 - DNA, 20 bp, Homo sapiens
tagcctggactaaaggcatc

SEQ ID NO: 1234145 - DNA, 19 bp, Homo sapiens
tagcctggcaacagagcga

SEQ ID NO: 1234146 - DNA, 14 bp, Homo sapiens
tagcctggctctgc

SEQ ID NO: 1234147 - DNA, 13 bp, Homo sapiens
tagcctgggccag

SEQ ID NO: 1234148 - DNA, 16 bp, Homo sapiens
tagcctgggccagaga

SEQ ID NO: 1234149 - DNA, 18 bp, Homo sapiens
tagcctgtgcctctggga

SEQ ID NO: 1234150 - DNA, 20 bp, Homo sapiens
tagcctgtgcctctgggact

SEQ ID NO: 1234151 - DNA, 15 bp, Homo sapiens
tagccttatcctctg

SEQ ID NO: 1234152 - DNA, 23 bp, Homo sapiens
tagccttgatttgttcttacagt

SEQ ID NO: 1234153 - DNA, 22 bp, Homo sapiens
tagccttgcccggattctggga

SEQ ID NO: 1234154 - DNA, 12 bp, Homo sapiens
tagccttggggt

SEQ ID NO: 1234155 - DNA, 16 bp, Homo sapiens
tagccttgtgccctgc

SEQ ID NO: 1234156 - DNA, 17 bp, Homo sapiens
tagcctttttgtataaa

SEQ ID NO: 1234157 - DNA, 14 bp, Homo sapiens
tagcgaccccagac

SEQ ID NO: 1234158 - DNA, 15 bp, Homo sapiens
tagcgaccccagact

SEQ ID NO: 1234159 - DNA, 16 bp, Homo sapiens
tagcgaccccagactg

SEQ ID NO: 1234160 - DNA, 16 bp, Homo sapiens
tagcgatctctcctgg

SEQ ID NO: 1234161 - DNA, 16 bp, Homo sapiens
tagggaaaccttggag

SEQ ID NO: 1234162 - DNA, 14 bp, Homo sapiens
tagggaaaggtttt

SEQ ID NO: 1234163 - DNA, 17 bp, Homo sapiens
tagggaaaggttttgta

SEQ ID NO: 1234164 - DNA, 16 bp, Homo sapiens
tagggaaatgaaagaa

SEQ ID NO: 1234165 - DNA, 15 bp, Homo sapiens
tagggaacaatttgg

SEQ ID NO: 1234166 - DNA, 15 bp, Homo sapiens
tagggaactctgggg

SEQ ID NO: 1234167 - DNA, 17 bp, Homo sapiens
tagggaagaaaaagcaa

SEQ ID NO: 1234168 - DNA, 13 bp, Homo sapiens
tagggaagataat

SEQ ID NO: 1234169 - DNA, 14 bp, Homo sapiens
tagggaagcaggga

SEQ ID NO: 1234170 - DNA, 14 bp, Homo sapiens
tagggaagggcctg

SEQ ID NO: 1234171 - DNA, 13 bp, Homo sapiens
tagggaagtaaaa

SEQ ID NO: 1234172 - DNA, 15 bp, Homo sapiens
tagggaagtaaaaaa

SEQ ID NO: 1234173 - DNA, 14 bp, Homo sapiens
tagggaatctggat

SEQ ID NO: 1234174 - DNA, 15 bp, Homo sapiens
tagggaattcttctg

SEQ ID NO: 1234175 - DNA, 20 bp, Homo sapiens
tagggacaggaccccagctc

SEQ ID NO: 1234176 - DNA, 21 bp, Homo sapiens
tagggacaggaccccagctct

SEQ ID NO: 1234177 - DNA, 21 bp, Homo sapiens
tagggactgccaggctgtttc

SEQ ID NO: 1234178 - DNA, 17 bp, Homo sapiens
tagggagaatgcagaga

SEQ ID NO: 1234179 - DNA, 23 bp, Homo sapiens
tagggagacagggtaggaaaggg

SEQ ID NO: 1234180 - DNA, 21 bp, Homo sapiens
tagggagagggaagagggaga

SEQ ID NO: 1234181 - DNA, 13 bp, Homo sapiens
tagggagatattt

SEQ ID NO: 1234182 - DNA, 19 bp, Homo sapiens
tagggagtggttcctgtgg

SEQ ID NO: 1234183 - DNA, 22 bp, Homo sapiens
tagggagttcatctggagggtt

SEQ ID NO: 1234184 - DNA, 15 bp, Homo sapiens
tagggatataaaaac

SEQ ID NO: 1234185 - DNA, 18 bp, Homo sapiens
tagggatataaaaacaga

SEQ ID NO: 1234186 - DNA, 22 bp, Homo sapiens
tagggatatggcaggactcctg

SEQ ID NO: 1234187 - DNA, 23 bp, Homo sapiens
tagggatcaaccagctaagaaaa

SEQ ID NO: 1234188 - DNA, 19 bp, Homo sapiens
tagggattgtccctgtgtt

SEQ ID NO: 1234189 - DNA, 20 bp, Homo sapiens
tagggcaagggtgcctcagg

SEQ ID NO: 1234190 - DNA, 20 bp, Homo sapiens
tagggcacatgaaaaatttt

SEQ ID NO: 1234191 - DNA, 20 bp, Homo sapiens
tagggcagattttcatgcaa

SEQ ID NO: 1234192 - DNA, 11 bp, Homo sapiens
tagggcagctt

SEQ ID NO: 1234193 - DNA, 22 bp, Homo sapiens
tagggcaggagtgagaggtctc

SEQ ID NO: 1234194 - DNA, 24 bp, Homo sapiens
tagggcattgtatctgtctttcca

SEQ ID NO: 1234195 - DNA, 11 bp, Homo sapiens
tagggccaggc

SEQ ID NO: 1234196 - DNA, 13 bp, Homo sapiens
tagggccttggtt

SEQ ID NO: 1234197 - DNA, 23 bp, Homo sapiens
tagggcgtgtggtttccctgccc

SEQ ID NO: 1234198 - DNA, 23 bp, Homo sapiens
tagggctacaaaacctgatgtta

SEQ ID NO: 1234199 - DNA, 15 bp, Homo sapiens
tagggctgaggggcc

SEQ ID NO: 1234200 - DNA, 13 bp, Homo sapiens
tagggctgctgct

SEQ ID NO: 1234201 - DNA, 16 bp, Homo sapiens
tagggctggggactgg

SEQ ID NO: 1234202 - DNA, 21 bp, Homo sapiens
tagggctgttgctagggagag

SEQ ID NO: 1234203 - DNA, 22 bp, Homo sapiens
tagggctgttgctagggagagg

SEQ ID NO: 1234204 - DNA, 13 bp, Homo sapiens
tagggcttttatt

SEQ ID NO: 1234205 - DNA, 16 bp, Homo sapiens
tagggcttttattttt

SEQ ID NO: 1234206 - DNA, 23 bp, Homo sapiens
taggggacacttccctctgtttc

SEQ ID NO: 1234207 - DNA, 13 bp, Homo sapiens
taggggcagcctc

SEQ ID NO: 1234208 - DNA, 17 bp, Homo sapiens
taggggcagggaggcaa

SEQ ID NO: 1234209 - DNA, 22 bp, Homo sapiens
taggggccacctcctccccctg

SEQ ID NO: 1234210 - DNA, 23 bp, Homo sapiens
taggggcgggggcggaggaggac

SEQ ID NO: 1234211 - DNA, 21 bp, Homo sapiens
taggggcttataataaaggac

SEQ ID NO: 1234212 - DNA, 14 bp, Homo sapiens
tagggggctgcacg

SEQ ID NO: 1234213 - DNA, 15 bp, Homo sapiens
tagggggctgcacgg

SEQ ID NO: 1234214 - DNA, 14 bp, Homo sapiens
taggggtagctggt

SEQ ID NO: 1234215 - DNA, 17 bp, Homo sapiens
taggggtcctgggggca

SEQ ID NO: 1234216 - DNA, 15 bp, Homo sapiens
taggggttctattta

SEQ ID NO: 1234217 - DNA, 15 bp, Homo sapiens
taggggttgaagaaa

SEQ ID NO: 1234218 - DNA, 13 bp, Homo sapiens
taggggttgctaa

SEQ ID NO: 1234219 - DNA, 13 bp, Homo sapiens
tagggtaaatcag

SEQ ID NO: 1234220 - DNA, 13 bp, Homo sapiens
tagggtataatgt

SEQ ID NO: 1234221 - DNA, 19 bp, Homo sapiens
tagggtctgcagcctgctg

SEQ ID NO: 1234222 - DNA, 13 bp, Homo sapiens
tagggtctttctt

SEQ ID NO: 1234223 - DNA, 15 bp, Homo sapiens
tagggtgtgtgttca

SEQ ID NO: 1234224 - DNA, 19 bp, Homo sapiens
tagggttttgcaataactt

SEQ ID NO: 1234225 - DNA, 19 bp, Homo sapiens
tagggttttttttaatgtg

SEQ ID NO: 1234226 - DNA, 22 bp, Homo sapiens
tagggttttttttaatgtgaat

SEQ ID NO: 1234227 - DNA, 18 bp, Homo sapiens
taggtaacttattagaaa

SEQ ID NO: 1234228 - DNA, 19 bp, Homo sapiens
taggtaacttattagaaac

SEQ ID NO: 1234229 - DNA, 15 bp, Homo sapiens
taggtagactttgct

SEQ ID NO: 1234230 - DNA, 19 bp, Homo sapiens
taggtagcctgctgtgggg

SEQ ID NO: 1234231 - DNA, 14 bp, Homo sapiens
taggtaggaaatgt

SEQ ID NO: 1234232 - DNA, 14 bp, Homo sapiens
taggtaggaagagc

SEQ ID NO: 1234233 - DNA, 19 bp, Homo sapiens
taggtagtttggatatttt

SEQ ID NO: 1234234 - DNA, 14 bp, Homo sapiens
taggtatttaagac

SEQ ID NO: 1234235 - DNA, 15 bp, Homo sapiens
taggtctcaatattt

SEQ ID NO: 1234236 - DNA, 17 bp, Homo sapiens
taggtctcatctcttca

SEQ ID NO: 1234237 - DNA, 18 bp, Homo sapiens
taggtctcttctcccaga

SEQ ID NO: 1234238 - DNA, 12 bp, Homo sapiens
taggtctgaaat

SEQ ID NO: 1234239 - DNA, 22 bp, Homo sapiens
taggtctgaaatttttcttctt

SEQ ID NO: 1234240 - DNA, 12 bp, Homo sapiens
taggtctttctc

SEQ ID NO: 1234241 - DNA, 14 bp, Homo sapiens
taggtgaagggatg

SEQ ID NO: 1234242 - DNA, 15 bp, Homo sapiens
taggtgaagggatgg

SEQ ID NO: 1234243 - DNA, 16 bp, Homo sapiens
taggtgacatgtctac

SEQ ID NO: 1234244 - DNA, 20 bp, Homo sapiens
taggtgactaaaagggcttc

SEQ ID NO: 1234245 - DNA, 15 bp, Homo sapiens
taggtgagaaaaaaa

SEQ ID NO: 1234246 - DNA, 13 bp, Homo sapiens
taggtgagcctgg

SEQ ID NO: 1234247 - DNA, 14 bp, Homo sapiens
taggtgagcctggg

SEQ ID NO: 1234248 - DNA, 15 bp, Homo sapiens
taggtgagcctgggc

SEQ ID NO: 1234249 - DNA, 17 bp, Homo sapiens
taggtgagcctgggcag

SEQ ID NO: 1234250 - DNA, 23 bp, Homo sapiens
taggtgatgggcagatcttttct

SEQ ID NO: 1234251 - DNA, 22 bp, Homo sapiens
taggtgatgtttgctcttgttt

SEQ ID NO: 1234252 - DNA, 14 bp, Homo sapiens
taggtgcagctcct

SEQ ID NO: 1234253 - DNA, 19 bp, Homo sapiens
taggtgctatttgtcatct

SEQ ID NO: 1234254 - DNA, 18 bp, Homo sapiens
taggtggaggttgtgcat

SEQ ID NO: 1234255 - DNA, 21 bp, Homo sapiens
taggtgggccagcccctccca

SEQ ID NO: 1234256 - DNA, 20 bp, Homo sapiens
taggtgggttgaaagccaag

SEQ ID NO: 1234257 - DNA, 16 bp, Homo sapiens
taggtgtcatttccat

SEQ ID NO: 1234258 - DNA, 20 bp, Homo sapiens
taggtgtctctgggcctgtg

SEQ ID NO: 1234259 - DNA, 21 bp, Homo sapiens
taggtgtgactgaatttcttt

SEQ ID NO: 1234260 - DNA, 13 bp, Homo sapiens
taggtgtggggga

SEQ ID NO: 1234261 - DNA, 14 bp, Homo sapiens
taggttaaagctaa

SEQ ID NO: 1234262 - DNA, 14 bp, Homo sapiens
taggttcagccaag

SEQ ID NO: 1234263 - DNA, 20 bp, Homo sapiens
taggttccctgttcttcctc

SEQ ID NO: 1234264 - DNA, 17 bp, Homo sapiens
taggttgacattcagaa

SEQ ID NO: 1234265 - DNA, 18 bp, Homo sapiens
taggttgacattcagaaa

SEQ ID NO: 1234266 - DNA, 17 bp, Homo sapiens
taggttggacagccccc

SEQ ID NO: 1234267 - DNA, 21 bp, Homo sapiens
taggttggcaaaaaggcagga

SEQ ID NO: 1234268 - DNA, 13 bp, Homo sapiens
taggttgggacac

SEQ ID NO: 1234269 - DNA, 20 bp, Homo sapiens
taggttgttaccaagtatga

SEQ ID NO: 1234270 - DNA, 22 bp, Homo sapiens
taggttgttaccaagtatgaag

SEQ ID NO: 1234271 - DNA, 20 bp, Homo sapiens
taggtttctaaaaagtcaga

SEQ ID NO: 1234272 - DNA, 17 bp, Homo sapiens
taggtttctctccctcc

SEQ ID NO: 1234273 - DNA, 23 bp, Homo sapiens
taggtttgtcccagtcagaaata

SEQ ID NO: 1234274 - DNA, 19 bp, Homo sapiens
taggtttttttgtatagta

SEQ ID NO: 1234275 - DNA, 20 bp, Homo sapiens
tagtaaaagtggtctctgct

SEQ ID NO: 1234276 - DNA, 13 bp, Homo sapiens
tagtaaagaaatt

SEQ ID NO: 1234277 - DNA, 17 bp, Homo sapiens
tagtaaatatgtgaaga

SEQ ID NO: 1234278 - DNA, 13 bp, Homo sapiens
tagtaaatgttat

SEQ ID NO: 1234279 - DNA, 23 bp, Homo sapiens
tagtaacaatacatgagaaagat

SEQ ID NO: 1234280 - DNA, 14 bp, Homo sapiens
tagtaacactaata

SEQ ID NO: 1234281 - DNA, 15 bp, Homo sapiens
tagtaacactaatat

SEQ ID NO: 1234282 - DNA, 22 bp, Homo sapiens
tagtaacactaatatatttaaa

SEQ ID NO: 1234283 - DNA, 22 bp, Homo sapiens
tagtaactactttttatactcc

SEQ ID NO: 1234284 - DNA, 21 bp, Homo sapiens
tagtaagatctctttctaaag

SEQ ID NO: 1234285 - DNA, 16 bp, Homo sapiens
tagtaagatgcactga

SEQ ID NO: 1234286 - DNA, 23 bp, Homo sapiens
taggagttcgagaccagcctggc

SEQ ID NO: 1234287 - DNA, 15 bp, Homo sapiens
taggagttctctgat

SEQ ID NO: 1234288 - DNA, 18 bp, Homo sapiens
taggagttctctgatgca

SEQ ID NO: 1234289 - DNA, 22 bp, Homo sapiens
taggagttctctgatgcagaaa

SEQ ID NO: 1234290 - DNA, 23 bp, Homo sapiens
taggagttctctgatgcagaaat

SEQ ID NO: 1234291 - DNA, 23 bp, Homo sapiens
taggagtttagggaacaatttgg

SEQ ID NO: 1234292 - DNA, 22 bp, Homo sapiens
taggagttttgttccagaggag

SEQ ID NO: 1234293 - DNA, 21 bp, Homo sapiens
taggataaaaagccagggctg

SEQ ID NO: 1234294 - DNA, 14 bp, Homo sapiens
taggataatataaa

SEQ ID NO: 1234295 - DNA, 19 bp, Homo sapiens
taggataatataaaaagca

SEQ ID NO: 1234296 - DNA, 15 bp, Homo sapiens
taggatagacactgg

SEQ ID NO: 1234297 - DNA, 17 bp, Homo sapiens
taggatgactgctgtga

SEQ ID NO: 1234298 - DNA, 14 bp, Homo sapiens
taggatgctgcagc

SEQ ID NO: 1234299 - DNA, 23 bp, Homo sapiens
taggatgtatattttatataaag

SEQ ID NO: 1234300 - DNA, 14 bp, Homo sapiens
taggatgtgatgat

SEQ ID NO: 1234301 - DNA, 16 bp, Homo sapiens
taggatgttgcttctg

SEQ ID NO: 1234302 - DNA, 19 bp, Homo sapiens
taggattccccctgccctg

SEQ ID NO: 1234303 - DNA, 15 bp, Homo sapiens
taggattgcttcaat

SEQ ID NO: 1234304 - DNA, 12 bp, Homo sapiens
taggatttaaca

SEQ ID NO: 1234305 - DNA, 14 bp, Homo sapiens
taggatttatgtat

SEQ ID NO: 1234306 - DNA, 21 bp, Homo sapiens
taggatttatgtattttgaaa

SEQ ID NO: 1234307 - DNA, 16 bp, Homo sapiens
taggatttatttaaaa

SEQ ID NO: 1234308 - DNA, 22 bp, Homo sapiens
taggatttatttaaaatagcaa

SEQ ID NO: 1234309 - DNA, 13 bp, Homo sapiens
taggattttcaca

SEQ ID NO: 1234310 - DNA, 17 bp, Homo sapiens
taggattttgtgtcttt

SEQ ID NO: 1234311 - DNA, 13 bp, Homo sapiens
taggatttttaga

SEQ ID NO: 1234312 - DNA, 14 bp, Homo sapiens
taggatttttagaa

SEQ ID NO: 1234313 - DNA, 16 bp, Homo sapiens
taggcaagtttgttca

SEQ ID NO: 1234314 - DNA, 14 bp, Homo sapiens
taggcacaaggttg

SEQ ID NO: 1234315 - DNA, 17 bp, Homo sapiens
taggcactgttcaatac

SEQ ID NO: 1234316 - DNA, 22 bp, Homo sapiens
taggcacttttattttcattgt

SEQ ID NO: 1234317 - DNA, 21 bp, Homo sapiens
taggcagagccataatggact

SEQ ID NO: 1234318 - DNA, 13 bp, Homo sapiens
taggcagcagctt

SEQ ID NO: 1234319 - DNA, 16 bp, Homo sapiens
taggcagcctctctgc

SEQ ID NO: 1234320 - DNA, 14 bp, Homo sapiens
taggcagcctgccg

SEQ ID NO: 1234321 - DNA, 12 bp, Homo sapiens
taggcaggacca

SEQ ID NO: 1234322 - DNA, 14 bp, Homo sapiens
taggcaggacctgt

SEQ ID NO: 1234323 - DNA, 18 bp, Homo sapiens
taggcataaattaaaatg

SEQ ID NO: 1234324 - DNA, 16 bp, Homo sapiens
taggcatcccagggga

SEQ ID NO: 1234325 - DNA, 21 bp, Homo sapiens
taggcatgagggatcacaggg

SEQ ID NO: 1234326 - DNA, 20 bp, Homo sapiens
taggcatgtcagaggacccc

SEQ ID NO: 1234327 - DNA, 22 bp, Homo sapiens
taggcatgtcagaggaccccag

SEQ ID NO: 1234328 - DNA, 23 bp, Homo sapiens
taggcatgtcagaggaccccagg

SEQ ID NO: 1234329 - DNA, 21 bp, Homo sapiens
taggcatgtcccacccacccg

SEQ ID NO: 1234330 - DNA, 16 bp, Homo sapiens
taggcattaacacaaa

SEQ ID NO: 1234331 - DNA, 18 bp, Homo sapiens
taggcattaacacaaagg

SEQ ID NO: 1234332 - DNA, 19 bp, Homo sapiens
taggcattaatgtttctat

SEQ ID NO: 1234333 - DNA, 13 bp, Homo sapiens
taggccactcctc

SEQ ID NO: 1234334 - DNA, 22 bp, Homo sapiens
taggccagggcatgtgtatgtg

SEQ ID NO: 1234335 - DNA, 15 bp, Homo sapiens
taggccatctgtaaa

SEQ ID NO: 1234336 - DNA, 19 bp, Homo sapiens
taggccatctgtaaatatc

SEQ ID NO: 1234337 - DNA, 23 bp, Homo sapiens
taggccatgggtggaaagtgctc

SEQ ID NO: 1234338 - DNA, 17 bp, Homo sapiens
taggcccaggcctgggt

SEQ ID NO: 1234339 - DNA, 11 bp, Homo sapiens
taggcccccca

SEQ ID NO: 1234340 - DNA, 13 bp, Homo sapiens
taggcccttgtcc

SEQ ID NO: 1234341 - DNA, 19 bp, Homo sapiens
taggcccttgtcctgccag

SEQ ID NO: 1234342 - DNA, 14 bp, Homo sapiens
taggcctcatttct

SEQ ID NO: 1234343 - DNA, 18 bp, Homo sapiens
taggcctcatttctttgt

SEQ ID NO: 1234344 - DNA, 23 bp, Homo sapiens
taggccttcctctctccagatgt

SEQ ID NO: 1234345 - DNA, 15 bp, Homo sapiens
taggcggcgattttt

SEQ ID NO: 1234346 - DNA, 15 bp, Homo sapiens
taggcggtcatgtgt

SEQ ID NO: 1234347 - DNA, 17 bp, Homo sapiens
taggcggtcatgtgtgc

SEQ ID NO: 1234348 - DNA, 19 bp, Homo sapiens
taggcggtcatgtgtgcat

SEQ ID NO: 1234349 - DNA, 20 bp, Homo sapiens
taggcggtcatgtgtgcatg

SEQ ID NO: 1234350 - DNA, 20 bp, Homo sapiens
taggctattttctaaagact

SEQ ID NO: 1234351 - DNA, 14 bp, Homo sapiens
taggctcagtggta

SEQ ID NO: 1234352 - DNA, 22 bp, Homo sapiens
taggctcctgccagtgtggaac

SEQ ID NO: 1234353 - DNA, 20 bp, Homo sapiens
taggctctgcacagatggat

SEQ ID NO: 1234354 - DNA, 21 bp, Homo sapiens
taggctctgcacagatggatt

SEQ ID NO: 1234355 - DNA, 20 bp, Homo sapiens
taggctcttatgtgtgcctt

SEQ ID NO: 1234356 - DNA, 21 bp, Homo sapiens
taggctcttatgtgtgccttt

SEQ ID NO: 1234357 - DNA, 21 bp, Homo sapiens
taggctgcaaaattaaatcta

SEQ ID NO: 1234358 - DNA, 17 bp, Homo sapiens
taggctggagaagctca

SEQ ID NO: 1234359 - DNA, 21 bp, Homo sapiens
taggctggagaagctcaccca

SEQ ID NO: 1234360 - DNA, 18 bp, Homo sapiens
taggctggtggcccagga

SEQ ID NO: 1234361 - DNA, 16 bp, Homo sapiens
taggctgtggggtggg

SEQ ID NO: 1234362 - DNA, 20 bp, Homo sapiens
taggctgtggggtgggctgg

SEQ ID NO: 1234363 - DNA, 19 bp, Homo sapiens
taggctgttccctttgcct

SEQ ID NO: 1234364 - DNA, 18 bp, Homo sapiens
taggcttagtttgtgtgt

SEQ ID NO: 1234365 - DNA, 16 bp, Homo sapiens
tagggaaaagttcata

SEQ ID NO: 1234366 - DNA, 16 bp, Homo sapiens
tagtaagttaatgtat

SEQ ID NO: 1234367 - DNA, 18 bp, Homo sapiens
tagtaataccaaagacta

SEQ ID NO: 1234368 - DNA, 14 bp, Homo sapiens
tagtaatagcctgg

SEQ ID NO: 1234369 - DNA, 23 bp, Homo sapiens
tagtaatagtccaatatttggcg

SEQ ID NO: 1234370 - DNA, 14 bp, Homo sapiens
tagtaatctgcatt

SEQ ID NO: 1234371 - DNA, 13 bp, Homo sapiens
tagtaatctgtat

SEQ ID NO: 1234372 - DNA, 14 bp, Homo sapiens
tagtaatctgtata

SEQ ID NO: 1234373 - DNA, 14 bp, Homo sapiens
tagtaatttgtaaa

SEQ ID NO: 1234374 - DNA, 16 bp, Homo sapiens
tagtaccaatcatttt

SEQ ID NO: 1234375 - DNA, 20 bp, Homo sapiens
tagtacctcaaagtaaaaat

SEQ ID NO: 1234376 - DNA, 15 bp, Homo sapiens
tagtacctgaaaagt

SEQ ID NO: 1234377 - DNA, 16 bp, Homo sapiens
tagtacctgaaaagta

SEQ ID NO: 1234378 - DNA, 18 bp, Homo sapiens
tagtacctgaaaagtaac

SEQ ID NO: 1234379 - DNA, 21 bp, Homo sapiens
tagtactcctgcaaaatttta

SEQ ID NO: 1234380 - DNA, 19 bp, Homo sapiens
tagtactccttaagaacac

SEQ ID NO: 1234381 - DNA, 14 bp, Homo sapiens
tagtactctctgct

SEQ ID NO: 1234382 - DNA, 16 bp, Homo sapiens
tagtacttcttctgta

SEQ ID NO: 1234383 - DNA, 20 bp, Homo sapiens
tagtagaaagacatctgcct

SEQ ID NO: 1234384 - DNA, 16 bp, Homo sapiens
tagtagcaatgtgcct

SEQ ID NO: 1234385 - DNA, 19 bp, Homo sapiens
tagtagccctttctgtgtg

SEQ ID NO: 1234386 - DNA, 15 bp, Homo sapiens
tagtagtttttacaa

SEQ ID NO: 1234387 - DNA, 16 bp, Homo sapiens
tagtataaagaaaagt

SEQ ID NO: 1234388 - DNA, 16 bp, Homo sapiens
tagtataatatttctt

SEQ ID NO: 1234389 - DNA, 16 bp, Homo sapiens
tagtatacgtataaat

SEQ ID NO: 1234390 - DNA, 15 bp, Homo sapiens
tagtatagaagtctg

SEQ ID NO: 1234391 - DNA, 19 bp, Homo sapiens
tagtataggtctcaatatt

SEQ ID NO: 1234392 - DNA, 23 bp, Homo sapiens
tagtatagtagaaagacatctgc

SEQ ID NO: 1234393 - DNA, 19 bp, Homo sapiens
tagtatatctggacaagcc

SEQ ID NO: 1234394 - DNA, 16 bp, Homo sapiens
tagtatatttatactc

SEQ ID NO: 1234395 - DNA, 15 bp, Homo sapiens
tagtatcattttagg

SEQ ID NO: 1234396 - DNA, 15 bp, Homo sapiens
tagtatctaacatgt

SEQ ID NO: 1234397 - DNA, 15 bp, Homo sapiens
tagtatctatatgac

SEQ ID NO: 1234398 - DNA, 16 bp, Homo sapiens
tagtatctatatgact

SEQ ID NO: 1234399 - DNA, 11 bp, Homo sapiens
tagtatctgta

SEQ ID NO: 1234400 - DNA, 13 bp, Homo sapiens
tagtatgaaaatg

SEQ ID NO: 1234401 - DNA, 13 bp, Homo sapiens
tagtatgggaaaa

SEQ ID NO: 1234402 - DNA, 16 bp, Homo sapiens
tagtatggttcaagat

SEQ ID NO: 1234403 - DNA, 19 bp, Homo sapiens
tagtatgtctgtttttgta

SEQ ID NO: 1234404 - DNA, 18 bp, Homo sapiens
tagtattaaaagttgcat

SEQ ID NO: 1234405 - DNA, 19 bp, Homo sapiens
tagtattaaaagttgcatt

SEQ ID NO: 1234406 - DNA, 15 bp, Homo sapiens
tagtattacaccacc

SEQ ID NO: 1234407 - DNA, 23 bp, Homo sapiens
tagtattaccaccctttcacaag

SEQ ID NO: 1234408 - DNA, 22 bp, Homo sapiens
tagtattatcttgttcaggaaa

SEQ ID NO: 1234409 - DNA, 19 bp, Homo sapiens
tagtattcaggcactgaga

SEQ ID NO: 1234410 - DNA, 16 bp, Homo sapiens
tagtattgttgtcctt

SEQ ID NO: 1234411 - DNA, 22 bp, Homo sapiens
tagtattgttgtccttttcata

SEQ ID NO: 1234412 - DNA, 20 bp, Homo sapiens
tagtatttatgggtggattt

SEQ ID NO: 1234413 - DNA, 15 bp, Homo sapiens
tagtatttctcagga

SEQ ID NO: 1234414 - DNA, 12 bp, Homo sapiens
tagtatttgatt

SEQ ID NO: 1234415 - DNA, 17 bp, Homo sapiens
tagtatttgattcaaaa

SEQ ID NO: 1234416 - DNA, 13 bp, Homo sapiens
tagtattttaaaa

SEQ ID NO: 1234417 - DNA, 21 bp, Homo sapiens
tagtatttttactattataat

SEQ ID NO: 1234418 - DNA, 23 bp, Homo sapiens
tagtattttttacattttacaca

SEQ ID NO: 1234419 - DNA, 18 bp, Homo sapiens
tagtattttttgtataat

SEQ ID NO: 1234420 - DNA, 19 bp, Homo sapiens
tagtattttttgtataatt

SEQ ID NO: 1234421 - DNA, 21 bp, Homo sapiens
tagtatttttttcttaccaaa

SEQ ID NO: 1234422 - DNA, 13 bp, Homo sapiens
tagtcaagctcct

SEQ ID NO: 1234423 - DNA, 14 bp, Homo sapiens
tagtcaagctcctc

SEQ ID NO: 1234424 - DNA, 18 bp, Homo sapiens
tagtcactgctgctactg

SEQ ID NO: 1234425 - DNA, 15 bp, Homo sapiens
tagtcagaagcaggt

SEQ ID NO: 1234426 - DNA, 15 bp, Homo sapiens
tagtcagctgccttt

SEQ ID NO: 1234427 - DNA, 17 bp, Homo sapiens
tagtcatccaacaagaa

SEQ ID NO: 1234428 - DNA, 22 bp, Homo sapiens
tagtcatcttaaatttcaaacc

SEQ ID NO: 1234429 - DNA, 17 bp, Homo sapiens
tagtcattgatagaact

SEQ ID NO: 1234430 - DNA, 18 bp, Homo sapiens
tagtcattgatagaacta

SEQ ID NO: 1234431 - DNA, 13 bp, Homo sapiens
tagtccaaaatta

SEQ ID NO: 1234432 - DNA, 21 bp, Homo sapiens
tagtccaaatgtgatcaactg

SEQ ID NO: 1234433 - DNA, 13 bp, Homo sapiens
tagtccaatattt

SEQ ID NO: 1234434 - DNA, 15 bp, Homo sapiens
tagtccaatatttgg

SEQ ID NO: 1234435 - DNA, 16 bp, Homo sapiens
tagtccaatttttact

SEQ ID NO: 1234436 - DNA, 19 bp, Homo sapiens
tagtccacggacccccaga

SEQ ID NO: 1234437 - DNA, 14 bp, Homo sapiens
tagtcccagctact

SEQ ID NO: 1234438 - DNA, 22 bp, Homo sapiens
tagtcccccaactctgagccca

SEQ ID NO: 1234439 - DNA, 21 bp, Homo sapiens
tagtccccctgttttctgttt

SEQ ID NO: 1234440 - DNA, 18 bp, Homo sapiens
tagtccctcatgcaaatc

SEQ ID NO: 1234441 - DNA, 23 bp, Homo sapiens
tagtcccttcccctccctggctc

SEQ ID NO: 1234442 - DNA, 19 bp, Homo sapiens
tagtcctgtctcccacttc

SEQ ID NO: 1234443 - DNA, 11 bp, Homo sapiens
tagtcctgtga

SEQ ID NO: 1234444 - DNA, 13 bp, Homo sapiens
tagtccttggcat

SEQ ID NO: 1234445 - DNA, 22 bp, Homo sapiens
tagtcctttctgtgaagctaat

SEQ ID NO: 1234446 - DNA, 22 bp, Homo sapiens
tagtcctttttccaatgtttta

SEQ ID NO: 1234447 - DNA, 18 bp, Homo sapiens
tagtcgggacttgtaaca

SEQ ID NO: 1234448 - DNA, 18 bp, Homo sapiens
tagtcgggcagggcccct

SEQ ID NO: 1234449 - DNA, 14 bp, Homo sapiens
tagtcgggtgccag

SEQ ID NO: 1234450 - DNA, 13 bp, Homo sapiens
tagtctacagttg

SEQ ID NO: 1234451 - DNA, 16 bp, Homo sapiens
tagtctacttcttaaa

SEQ ID NO: 1234452 - DNA, 19 bp, Homo sapiens
tagtctacttcttaaaatt

SEQ ID NO: 1234453 - DNA, 18 bp, Homo sapiens
tagtctagatggctcctc

SEQ ID NO: 1234454 - DNA, 12 bp, Homo sapiens
tagtctcctggg

SEQ ID NO: 1234455 - DNA, 13 bp, Homo sapiens
tagtctcctgggt

SEQ ID NO: 1234456 - DNA, 19 bp, Homo sapiens
tagtctcctttgcactgag

SEQ ID NO: 1234457 - DNA, 17 bp, Homo sapiens
tagtctctgtgctttga

SEQ ID NO: 1234458 - DNA, 20 bp, Homo sapiens
tagtctgaggccccttaact

SEQ ID NO: 1234459 - DNA, 23 bp, Homo sapiens
tagtctgcaaaatgaggaatgta

SEQ ID NO: 1234460 - DNA, 13 bp, Homo sapiens
tagtctggtttct

SEQ ID NO: 1234461 - DNA, 20 bp, Homo sapiens
tagtctgtgtaactttaaac

SEQ ID NO: 1234462 - DNA, 17 bp, Homo sapiens
tagtcttaagaactgct

SEQ ID NO: 1234463 - DNA, 17 bp, Homo sapiens
tagtcttagtaatagca

SEQ ID NO: 1234464 - DNA, 17 bp, Homo sapiens
tagtcttatgtaaagta

SEQ ID NO: 1234465 - DNA, 19 bp, Homo sapiens
tagtcttccagtttaatga

SEQ ID NO: 1234466 - DNA, 22 bp, Homo sapiens
tagtcttctcaaattagaaagt

SEQ ID NO: 1234467 - DNA, 14 bp, Homo sapiens
tagtcttctcatag

SEQ ID NO: 1234468 - DNA, 23 bp, Homo sapiens
tagtcttggaagctgtttggaaa

SEQ ID NO: 1234469 - DNA, 21 bp, Homo sapiens
tagtcttgtcccaattaaaat

SEQ ID NO: 1234470 - DNA, 18 bp, Homo sapiens
tagtctttagctattact

SEQ ID NO: 1234471 - DNA, 14 bp, Homo sapiens
tagtcttttgcttt

SEQ ID NO: 1234472 - DNA, 11 bp, Homo sapiens
tagtgaaaaat

SEQ ID NO: 1234473 - DNA, 11 bp, Homo sapiens
tagtgaaaatt

SEQ ID NO: 1234474 - DNA, 21 bp, Homo sapiens
tagtgaaacataataataatg

SEQ ID NO: 1234475 - DNA, 14 bp, Homo sapiens
tagtgaaacttttc

SEQ ID NO: 1234476 - DNA, 16 bp, Homo sapiens
tagtgaacaattcggt

SEQ ID NO: 1234477 - DNA, 20 bp, Homo sapiens
tagtgaacaattcggtggta

SEQ ID NO: 1234478 - DNA, 19 bp, Homo sapiens
tagtgaaggcttctctctg

SEQ ID NO: 1234479 - DNA, 18 bp, Homo sapiens
tagtgaatactgctacag

SEQ ID NO: 1234480 - DNA, 21 bp, Homo sapiens
tagtgaatcacgtaaagctag

SEQ ID NO: 1234481 - DNA, 12 bp, Homo sapiens
tagtgaatgact

SEQ ID NO: 1234482 - DNA, 14 bp, Homo sapiens
tagtgacacacact

SEQ ID NO: 1234483 - DNA, 22 bp, Homo sapiens
tagtgaccatcttcataatttg

SEQ ID NO: 1234484 - DNA, 22 bp, Homo sapiens
tagtgaccccttccctgtcctt

SEQ ID NO: 1234485 - DNA, 17 bp, Homo sapiens
tagtgacctgtgtttca

SEQ ID NO: 1234486 - DNA, 16 bp, Homo sapiens
tagtgagtcagcacct

SEQ ID NO: 1234487 - DNA, 17 bp, Homo sapiens
tagtgagtcagcacctt

SEQ ID NO: 1234488 - DNA, 16 bp, Homo sapiens
tagtgatcatttaaaa

SEQ ID NO: 1234489 - DNA, 17 bp, Homo sapiens
tagtgatcatttaaaaa

SEQ ID NO: 1234490 - DNA, 18 bp, Homo sapiens
tagtgatcatttaaaaag

SEQ ID NO: 1234491 - DNA, 15 bp, Homo sapiens
tagtgatcctgtcct

SEQ ID NO: 1234492 - DNA, 13 bp, Homo sapiens
tagtgatggttcc

SEQ ID NO: 1234493 - DNA, 14 bp, Homo sapiens
tagtgatggttccc

SEQ ID NO: 1234494 - DNA, 18 bp, Homo sapiens
tagtgatggttcccctgt

SEQ ID NO: 1234495 - DNA, 14 bp, Homo sapiens
tagtgattctgatt

SEQ ID NO: 1234496 - DNA, 22 bp, Homo sapiens
tagtgatttccttaatgaaaaa

SEQ ID NO: 1234497 - DNA, 12 bp, Homo sapiens
tagtgcaaaatg

SEQ ID NO: 1234498 - DNA, 14 bp, Homo sapiens
tagtgcaaatcata

SEQ ID NO: 1234499 - DNA, 18 bp, Homo sapiens
tagtgcaatagtgcaaca

SEQ ID NO: 1234500 - DNA, 21 bp, Homo sapiens
tagtgcaattccaagaaaata

SEQ ID NO: 1234501 - DNA, 13 bp, Homo sapiens
tagtgcagctgat

SEQ ID NO: 1234502 - DNA, 15 bp, Homo sapiens
tagtgcagctgattt

SEQ ID NO: 1234503 - DNA, 20 bp, Homo sapiens
tagtgcagctgattttaaca

SEQ ID NO: 1234504 - DNA, 20 bp, Homo sapiens
tagtgccagaattttaggaa

SEQ ID NO: 1234505 - DNA, 21 bp, Homo sapiens
tagtgccagaattttaggaac

SEQ ID NO: 1234506 - DNA, 16 bp, Homo sapiens
tagtgccaggagggca

SEQ ID NO: 1234507 - DNA, 14 bp, Homo sapiens
tagtgccccagact

SEQ ID NO: 1234508 - DNA, 17 bp, Homo sapiens
tagtgcggacaagtttt

SEQ ID NO: 1234509 - DNA, 17 bp, Homo sapiens
tagtgctgtgaaaaaaa

SEQ ID NO: 1234510 - DNA, 16 bp, Homo sapiens
tagtggaaaataggct

SEQ ID NO: 1234511 - DNA, 14 bp, Homo sapiens
tagtggaagagcag

SEQ ID NO: 1234512 - DNA, 18 bp, Homo sapiens
tagtggaagagcagcctg

SEQ ID NO: 1234513 - DNA, 21 bp, Homo sapiens
tagtggaagagcagcctgatg

SEQ ID NO: 1234514 - DNA, 22 bp, Homo sapiens
tagtggaggaggtggcttcatg

SEQ ID NO: 1234515 - DNA, 21 bp, Homo sapiens
tagtggatgactgttgatgaa

SEQ ID NO: 1234516 - DNA, 15 bp, Homo sapiens
tagtggatggaatat

SEQ ID NO: 1234517 - DNA, 17 bp, Homo sapiens
tagtggattactgccat

SEQ ID NO: 1234518 - DNA, 14 bp, Homo sapiens
tagtggcttcaaaa

SEQ ID NO: 1234519 - DNA, 15 bp, Homo sapiens
tagtgggccagggct

SEQ ID NO: 1234520 - DNA, 15 bp, Homo sapiens
tagtggtatgtctct

SEQ ID NO: 1234521 - DNA, 11 bp, Homo sapiens
tagtgtaaaat

SEQ ID NO: 1234522 - DNA, 19 bp, Homo sapiens
tagtgtaaaataagaatga

SEQ ID NO: 1234523 - DNA, 14 bp, Homo sapiens
tagtgtaagaactg

SEQ ID NO: 1234524 - DNA, 17 bp, Homo sapiens
tagtgtaagaactgtac

SEQ ID NO: 1234525 - DNA, 15 bp, Homo sapiens
tagtgtaataatgtt

SEQ ID NO: 1234526 - DNA, 15 bp, Homo sapiens
tagtgtacattacca

SEQ ID NO: 1234527 - DNA, 23 bp, Homo sapiens
tagtgtacctcctctcagtgttt

SEQ ID NO: 1234528 - DNA, 23 bp, Homo sapiens
tagtgtagctgtgtggctttcct

SEQ ID NO: 1234529 - DNA, 14 bp, Homo sapiens
tagtgtataaaaac

SEQ ID NO: 1234530 - DNA, 15 bp, Homo sapiens
tagtgtatactctgt

SEQ ID NO: 1234531 - DNA, 15 bp, Homo sapiens
tagtgtatgattact

SEQ ID NO: 1234532 - DNA, 19 bp, Homo sapiens
tagtgtatgattactggcc

SEQ ID NO: 1234533 - DNA, 23 bp, Homo sapiens
tagtgtccaggctggtctgaaac

SEQ ID NO: 1234534 - DNA, 15 bp, Homo sapiens
tagtgtcctgcccac

SEQ ID NO: 1234535 - DNA, 21 bp, Homo sapiens
tagtgtctggatcagtaaaat

SEQ ID NO: 1234536 - DNA, 18 bp, Homo sapiens
tagtgtctgtccatctgt

SEQ ID NO: 1234537 - DNA, 19 bp, Homo sapiens
tagtgtgagtggcagccat

SEQ ID NO: 1234538 - DNA, 20 bp, Homo sapiens
tagtgtgagtggcagccatg

SEQ ID NO: 1234539 - DNA, 18 bp, Homo sapiens
tagtgtggaaattaagaa

SEQ ID NO: 1234540 - DNA, 15 bp, Homo sapiens
tagtgtgtgtgcatg

SEQ ID NO: 1234541 - DNA, 15 bp, Homo sapiens
tagtgtgttctgatt

SEQ ID NO: 1234542 - DNA, 19 bp, Homo sapiens
tagtgtgttctgattagaa

SEQ ID NO: 1234543 - DNA, 20 bp, Homo sapiens
tagtgtgttctgattagaaa

SEQ ID NO: 1234544 - DNA, 12 bp, Homo sapiens
tagtgtgttgtg

SEQ ID NO: 1234545 - DNA, 20 bp, Homo sapiens
tagtgttcaaaacaaaatga

SEQ ID NO: 1234546 - DNA, 13 bp, Homo sapiens
tagtgttcacaaa

SEQ ID NO: 1234547 - DNA, 16 bp, Homo sapiens
tagtgttcacaaactg

SEQ ID NO: 1234548 - DNA, 21 bp, Homo sapiens
tagtgttcacaaactgtgaaa

SEQ ID NO: 1234549 - DNA, 20 bp, Homo sapiens
tagtgttctgctcctgcttt

SEQ ID NO: 1234550 - DNA, 23 bp, Homo sapiens
tagtgttctgctcctgcttttct

SEQ ID NO: 1234551 - DNA, 12 bp, Homo sapiens
tagtgttctgtt

SEQ ID NO: 1234552 - DNA, 16 bp, Homo sapiens
tagtgtttaactggca

SEQ ID NO: 1234553 - DNA, 22 bp, Homo sapiens
tagttaaaagactgcagctgct

SEQ ID NO: 1234554 - DNA, 17 bp, Homo sapiens
tagttaaagaaaggaaa

SEQ ID NO: 1234555 - DNA, 21 bp, Homo sapiens
tagttaaagaaaggaaaagaa

SEQ ID NO: 1234556 - DNA, 14 bp, Homo sapiens
tagttaatattttg

SEQ ID NO: 1234557 - DNA, 16 bp, Homo sapiens
tagttacctactgagt

SEQ ID NO: 1234558 - DNA, 17 bp, Homo sapiens
tagttacctactgagta

SEQ ID NO: 1234559 - DNA, 18 bp, Homo sapiens
tagttaccttatagttac

SEQ ID NO: 1234560 - DNA, 22 bp, Homo sapiens
tagttacgtataatgctttctg

SEQ ID NO: 1234561 - DNA, 15 bp, Homo sapiens
tagttagccctcagt

SEQ ID NO: 1234562 - DNA, 18 bp, Homo sapiens
tagttaggaaataaaacc

SEQ ID NO: 1234563 - DNA, 21 bp, Homo sapiens
tagttaggaaataaaaccttt

SEQ ID NO: 1234564 - DNA, 19 bp, Homo sapiens
tagttatacttatttgtat

SEQ ID NO: 1234565 - DNA, 14 bp, Homo sapiens
tagttatagtgttt

SEQ ID NO: 1234566 - DNA, 13 bp, Homo sapiens
tagttatttgtat

SEQ ID NO: 1234567 - DNA, 16 bp, Homo sapiens
tagttatttttctctt

SEQ ID NO: 1234568 - DNA, 11 bp, Homo sapiens
tagttcaatgc

SEQ ID NO: 1234569 - DNA, 15 bp, Homo sapiens
tagttcagacacttt

SEQ ID NO: 1234570 - DNA, 21 bp, Homo sapiens
tagttcagtagaattaccatt

SEQ ID NO: 1234571 - DNA, 14 bp, Homo sapiens
tagttccagtttct

SEQ ID NO: 1234572 - DNA, 21 bp, Homo sapiens
tagttccccaaatacaaagtt

SEQ ID NO: 1234573 - DNA, 15 bp, Homo sapiens
tagttccctttgcca

SEQ ID NO: 1234574 - DNA, 20 bp, Homo sapiens
tagttcctcattagcatttt

SEQ ID NO: 1234575 - DNA, 12 bp, Homo sapiens
tagttcctgcta

SEQ ID NO: 1234576 - DNA, 16 bp, Homo sapiens
tagttcctgctacaac

SEQ ID NO: 1234577 - DNA, 16 bp, Homo sapiens
tagttcctgtggccag

SEQ ID NO: 1234578 - DNA, 18 bp, Homo sapiens
tagttcctgtggccagga

SEQ ID NO: 1234579 - DNA, 14 bp, Homo sapiens
tagttctataagaa

SEQ ID NO: 1234580 - DNA, 22 bp, Homo sapiens
tagttctcaatcactgctcccc

SEQ ID NO: 1234581 - DNA, 16 bp, Homo sapiens
tagttctgccaggcaa

SEQ ID NO: 1234582 - DNA, 13 bp, Homo sapiens
tagttctgctgcc

SEQ ID NO: 1234583 - DNA, 15 bp, Homo sapiens
tagttctgctgccct

SEQ ID NO: 1234584 - DNA, 15 bp, Homo sapiens
tagttctgtgcctcc

SEQ ID NO: 1234585 - DNA, 16 bp, Homo sapiens
tagttctgtgcctccc

SEQ ID NO: 1234586 - DNA, 16 bp, Homo sapiens
tagttctgtgtagaga

SEQ ID NO: 1234587 - DNA, 12 bp, Homo sapiens
tagttctgttgt

SEQ ID NO: 1234588 - DNA, 22 bp, Homo sapiens
tagttctgtttggtgtgtccca

SEQ ID NO: 1234589 - DNA, 15 bp, Homo sapiens
tagttcttgaattgt

SEQ ID NO: 1234590 - DNA, 16 bp, Homo sapiens
tagttcttgaattgtt

SEQ ID NO: 1234591 - DNA, 18 bp, Homo sapiens
tagttcttgaattgttat

SEQ ID NO: 1234592 - DNA, 22 bp, Homo sapiens
tagttcttgaattgttatgaaa

SEQ ID NO: 1234593 - DNA, 14 bp, Homo sapiens
tagttcttgtgcat

SEQ ID NO: 1234594 - DNA, 19 bp, Homo sapiens
tagttcttgtgcatgttta

SEQ ID NO: 1234595 - DNA, 21 bp, Homo sapiens
tagttcttgtgcatgtttact

SEQ ID NO: 1234596 - DNA, 20 bp, Homo sapiens
tagttctttcctccccctgc

SEQ ID NO: 1234597 - DNA, 15 bp, Homo sapiens
tagttgaaaaatcta

SEQ ID NO: 1234598 - DNA, 17 bp, Homo sapiens
tagttgacaacctagaa

SEQ ID NO: 1234599 - DNA, 15 bp, Homo sapiens
tagttgacaattctg

SEQ ID NO: 1234600 - DNA, 18 bp, Homo sapiens
tagttgacaattctgcat

SEQ ID NO: 1234601 - DNA, 20 bp, Homo sapiens
tagttgacaattctgcatgt

SEQ ID NO: 1234602 - DNA, 14 bp, Homo sapiens
tagttgactcacag

SEQ ID NO: 1234603 - DNA, 13 bp, Homo sapiens
tagttgagcccca

SEQ ID NO: 1234604 - DNA, 23 bp, Homo sapiens
tagttgaggccgaggataaagaa

SEQ ID NO: 1234605 - DNA, 19 bp, Homo sapiens
tagttgcagaaacattttg

SEQ ID NO: 1234606 - DNA, 21 bp, Homo sapiens
tagttgccaacagttgtatgt

SEQ ID NO: 1234607 - DNA, 17 bp, Homo sapiens
tagttgcgttacaccct

SEQ ID NO: 1234608 - DNA, 17 bp, Homo sapiens
tagttgcttaattttga

SEQ ID NO: 1234609 - DNA, 17 bp, Homo sapiens
tagttggcagaaataca

SEQ ID NO: 1234610 - DNA, 16 bp, Homo sapiens
tagttggctagtactt

SEQ ID NO: 1234611 - DNA, 15 bp, Homo sapiens
tagttggtgttcaaa

SEQ ID NO: 1234612 - DNA, 14 bp, Homo sapiens
tagttggtttgtat

SEQ ID NO: 1234613 - DNA, 16 bp, Homo sapiens
tagttggtttgtatga

SEQ ID NO: 1234614 - DNA, 20 bp, Homo sapiens
tagttgtagacaaagtacat

SEQ ID NO: 1234615 - DNA, 19 bp, Homo sapiens
tagttgtattcttctgtat

SEQ ID NO: 1234616 - DNA, 17 bp, Homo sapiens
tagttgtctttcctggc

SEQ ID NO: 1234617 - DNA, 16 bp, Homo sapiens
tagttgtggaaagata

SEQ ID NO: 1234618 - DNA, 21 bp, Homo sapiens
tagttgtttctagactataaa

SEQ ID NO: 1234619 - DNA, 13 bp, Homo sapiens
tagtttactgttt

SEQ ID NO: 1234620 - DNA, 14 bp, Homo sapiens
tagtttactgtttt

SEQ ID NO: 1234621 - DNA, 13 bp, Homo sapiens
tagtttaggagaa

SEQ ID NO: 1234622 - DNA, 14 bp, Homo sapiens
tagtttaggagaaa

SEQ ID NO: 1234623 - DNA, 21 bp, Homo sapiens
tagtttatattactctcattc

SEQ ID NO: 1234624 - DNA, 23 bp, Homo sapiens
tagtttcaccactcctctccctt

SEQ ID NO: 1234625 - DNA, 16 bp, Homo sapiens
tagtttcacgtaaata

SEQ ID NO: 1234626 - DNA, 17 bp, Homo sapiens
tagtttcagtaaataat

SEQ ID NO: 1234627 - DNA, 18 bp, Homo sapiens
tagtttctagtgtcactg

SEQ ID NO: 1234628 - DNA, 14 bp, Homo sapiens
tagtttctttggga

SEQ ID NO: 1234629 - DNA, 17 bp, Homo sapiens
tagtttgactcagtata

SEQ ID NO: 1234630 - DNA, 21 bp, Homo sapiens
tagtttgattaaattcttgca

SEQ ID NO: 1234631 - DNA, 18 bp, Homo sapiens
tagtttgattattatgtt

SEQ ID NO: 1234632 - DNA, 17 bp, Homo sapiens
tagtttggaaataaaaa

SEQ ID NO: 1234633 - DNA, 12 bp, Homo sapiens
tagtttgtctat

SEQ ID NO: 1234634 - DNA, 15 bp, Homo sapiens
tagtttgtctatttt

SEQ ID NO: 1234635 - DNA, 22 bp, Homo sapiens
tagtttgtctattttaaaataa

SEQ ID NO: 1234636 - DNA, 23 bp, Homo sapiens
tagtttgtgatgtaaggcactgt

SEQ ID NO: 1234637 - DNA, 17 bp, Homo sapiens
tagttttaatctcttaa

SEQ ID NO: 1234638 - DNA, 13 bp, Homo sapiens
tagttttacacta

SEQ ID NO: 1234639 - DNA, 14 bp, Homo sapiens
tagttttagttgca

SEQ ID NO: 1234640 - DNA, 18 bp, Homo sapiens
tagttttatggcatgatt

SEQ ID NO: 1234641 - DNA, 17 bp, Homo sapiens
tagttttcagtttgtat

SEQ ID NO: 1234642 - DNA, 15 bp, Homo sapiens
tagttttgtcaaact

SEQ ID NO: 1234643 - DNA, 13 bp, Homo sapiens
tagttttgtttaa

SEQ ID NO: 1234644 - DNA, 18 bp, Homo sapiens
tagtttttacctaccaca

SEQ ID NO: 1234645 - DNA, 14 bp, Homo sapiens
tagtttttcacttt

SEQ ID NO: 1234646 - DNA, 17 bp, Homo sapiens
tagtttttgaaaattat

SEQ ID NO: 1234647 - DNA, 13 bp, Homo sapiens
tagttttttcatc

SEQ ID NO: 1234648 - DNA, 21 bp, Homo sapiens
tagttttttcatcttcagttg

SEQ ID NO: 1234649 - DNA, 23 bp, Homo sapiens
tagttttttttttttttatgtga

SEQ ID NO: 1234650 - DNA, 13 bp, Homo sapiens
tataaaaaatatg

SEQ ID NO: 1234651 - DNA, 17 bp, Homo sapiens
tataaaaaatatgtatt

SEQ ID NO: 1234652 - DNA, 14 bp, Homo sapiens
tataaaaaatcttt

SEQ ID NO: 1234653 - DNA, 15 bp, Homo sapiens
tataaaaaatggttc

SEQ ID NO: 1234654 - DNA, 16 bp, Homo sapiens
tataaaaaatgtaaca

SEQ ID NO: 1234655 - DNA, 17 bp, Homo sapiens
tataaaaaatgtaacat

SEQ ID NO: 1234656 - DNA, 13 bp, Homo sapiens
tataaaaaggaaa

SEQ ID NO: 1234657 - DNA, 22 bp, Homo sapiens
tataaaaatataaattgtacat

SEQ ID NO: 1234658 - DNA, 21 bp, Homo sapiens
tataaaaattatcaaaaagct

SEQ ID NO: 1234659 - DNA, 19 bp, Homo sapiens
tataaaactgcgttaaagg

SEQ ID NO: 1234660 - DNA, 16 bp, Homo sapiens
tataaaagacaaaact

SEQ ID NO: 1234661 - DNA, 14 bp, Homo sapiens
tataaaagactgac

SEQ ID NO: 1234662 - DNA, 22 bp, Homo sapiens
tataaaagctcagatgacattt

SEQ ID NO: 1234663 - DNA, 15 bp, Homo sapiens
tataaaagctttctg

SEQ ID NO: 1234664 - DNA, 18 bp, Homo sapiens
tataaaaggatgttacaa

SEQ ID NO: 1234665 - DNA, 21 bp, Homo sapiens
tataaaaggatgttacaagtt

SEQ ID NO: 1234666 - DNA, 19 bp, Homo sapiens
tataaaaggcaaatgtgta

SEQ ID NO: 1234667 - DNA, 23 bp, Homo sapiens
tataaaataaaaagtcacaatga

SEQ ID NO: 1234668 - DNA, 13 bp, Homo sapiens
tataaaataaact

SEQ ID NO: 1234669 - DNA, 13 bp, Homo sapiens
tataaaataaata

SEQ ID NO: 1234670 - DNA, 19 bp, Homo sapiens
tataaaataaatatatata

SEQ ID NO: 1234671 - DNA, 22 bp, Homo sapiens
tataaaataaatatatataaac

SEQ ID NO: 1234672 - DNA, 12 bp, Homo sapiens
tataaaataact

SEQ ID NO: 1234673 - DNA, 19 bp, Homo sapiens
tataaaataactaaaatgt

SEQ ID NO: 1234674 - DNA, 12 bp, Homo sapiens
tataaaatagac

SEQ ID NO: 1234675 - DNA, 23 bp, Homo sapiens
tataaaatatgaagacataaacc

SEQ ID NO: 1234676 - DNA, 22 bp, Homo sapiens
tataaaatccaaaatgaatgca

SEQ ID NO: 1234677 - DNA, 14 bp, Homo sapiens
tataaaatgggaag

SEQ ID NO: 1234678 - DNA, 17 bp, Homo sapiens
tataaaatgggaagact

SEQ ID NO: 1234679 - DNA, 19 bp, Homo sapiens
tataaaatgtattcaagca

SEQ ID NO: 1234680 - DNA, 23 bp, Homo sapiens
tataaaattaaatgccttgtata

SEQ ID NO: 1234681 - DNA, 20 bp, Homo sapiens
tataaacatgaccctgggct

SEQ ID NO: 1234682 - DNA, 20 bp, Homo sapiens
tataaacctaaaaaagatat

SEQ ID NO: 1234683 - DNA, 22 bp, Homo sapiens
tataaactgctgtcaataaatg

SEQ ID NO: 1234684 - DNA, 11 bp, Homo sapiens
tataaacttta

SEQ ID NO: 1234685 - DNA, 13 bp, Homo sapiens
tataaactttacc

SEQ ID NO: 1234686 - DNA, 18 bp, Homo sapiens
tataaactttaccttttt

SEQ ID NO: 1234687 - DNA, 15 bp, Homo sapiens
tataaagaacaaggt

SEQ ID NO: 1234688 - DNA, 19 bp, Homo sapiens
tataaagaagaacttgcat

SEQ ID NO: 1234689 - DNA, 18 bp, Homo sapiens
tataaagacaagtatgaa

SEQ ID NO: 1234690 - DNA, 11 bp, Homo sapiens
tataaagatat

SEQ ID NO: 1234691 - DNA, 12 bp, Homo sapiens
tataaagcattt

SEQ ID NO: 1234692 - DNA, 16 bp, Homo sapiens
tataaaggaccctgtt

SEQ ID NO: 1234693 - DNA, 19 bp, Homo sapiens
tataaaggaccctgtttct

SEQ ID NO: 1234694 - DNA, 16 bp, Homo sapiens
tataaaggataaagaa

SEQ ID NO: 1234695 - DNA, 16 bp, Homo sapiens
tataaaggttgacaat

SEQ ID NO: 1234696 - DNA, 14 bp, Homo sapiens
tataaagtagaaat

SEQ ID NO: 1234697 - DNA, 22 bp, Homo sapiens
tataaagttggttcacttcaaa

SEQ ID NO: 1234698 - DNA, 14 bp, Homo sapiens
tataaataaaattg

SEQ ID NO: 1234699 - DNA, 20 bp, Homo sapiens
tataaataagagcatgattt

SEQ ID NO: 1234700 - DNA, 20 bp, Homo sapiens
tataaatatatatttttcaa

SEQ ID NO: 1234701 - DNA, 23 bp, Homo sapiens
tataaatatatatttttcaaata

SEQ ID NO: 1234702 - DNA, 15 bp, Homo sapiens
tataaatatatttaa

SEQ ID NO: 1234703 - DNA, 21 bp, Homo sapiens
tataaatatcagtattctgac

SEQ ID NO: 1234704 - DNA, 23 bp, Homo sapiens
tataaatatcagtattctgacat

SEQ ID NO: 1234705 - DNA, 15 bp, Homo sapiens
tataaatatcatgca

SEQ ID NO: 1234706 - DNA, 16 bp, Homo sapiens
tataaatatccccagg

SEQ ID NO: 1234707 - DNA, 20 bp, Homo sapiens
tataaatattaggcataaat

SEQ ID NO: 1234708 - DNA, 20 bp, Homo sapiens
tataaatcaatgtcacttaa

SEQ ID NO: 1234709 - DNA, 15 bp, Homo sapiens
tataaatgaaaaaca

SEQ ID NO: 1234710 - DNA, 13 bp, Homo sapiens
tataaatgagcaa

SEQ ID NO: 1234711 - DNA, 17 bp, Homo sapiens
tataaatgcaataagaa

SEQ ID NO: 1234712 - DNA, 15 bp, Homo sapiens
tataaatgcaatatt

SEQ ID NO: 1234713 - DNA, 12 bp, Homo sapiens
tataaatgtaca

SEQ ID NO: 1234714 - DNA, 12 bp, Homo sapiens
tataaatgttta

SEQ ID NO: 1234715 - DNA, 22 bp, Homo sapiens
tataaatgtttggaaaggttct

SEQ ID NO: 1234716 - DNA, 19 bp, Homo sapiens
tataaattaaataaactgt

SEQ ID NO: 1234717 - DNA, 20 bp, Homo sapiens
tataaattaaatatatgtat

SEQ ID NO: 1234718 - DNA, 16 bp, Homo sapiens
tataaattaatacaga

SEQ ID NO: 1234719 - DNA, 19 bp, Homo sapiens
tataaatttaagaaaacaa

SEQ ID NO: 1234720 - DNA, 21 bp, Homo sapiens
tataaatttaagaaaacaagt

SEQ ID NO: 1234721 - DNA, 15 bp, Homo sapiens
tataaatttatttac

SEQ ID NO: 1234722 - DNA, 21 bp, Homo sapiens
tataaattttttttgtttcat

SEQ ID NO: 1234723 - DNA, 14 bp, Homo sapiens
tataacagatacat

SEQ ID NO: 1234724 - DNA, 16 bp, Homo sapiens
tataacagcaaatgaa

SEQ ID NO: 1234725 - DNA, 20 bp, Homo sapiens
tataaccagtgttgtggatt

SEQ ID NO: 1234726 - DNA, 14 bp, Homo sapiens
tataaccccagcct

SEQ ID NO: 1234727 - DNA, 15 bp, Homo sapiens
tataaccccagctcc

SEQ ID NO: 1234728 - DNA, 17 bp, Homo sapiens
tataacctagttaaaga

SEQ ID NO: 1234729 - DNA, 22 bp, Homo sapiens
tataacctgatgccataaatac

SEQ ID NO: 1234730 - DNA, 20 bp, Homo sapiens
tataactaagggggtagaag

SEQ ID NO: 1234731 - DNA, 16 bp, Homo sapiens
tataactagctagaag

SEQ ID NO: 1234732 - DNA, 12 bp, Homo sapiens
tataactgtctt

SEQ ID NO: 1234733 - DNA, 15 bp, Homo sapiens
tataactgtcttgtt

SEQ ID NO: 1234734 - DNA, 21 bp, Homo sapiens
tataactgtcttgtttcagtg

SEQ ID NO: 1234735 - DNA, 21 bp, Homo sapiens
tataactgttttagaaattgg

SEQ ID NO: 1234736 - DNA, 19 bp, Homo sapiens
tataacttaaaaaaatgac

SEQ ID NO: 1234737 - DNA, 22 bp, Homo sapiens
tataacttaaaaatgtaaatat

SEQ ID NO: 1234738 - DNA, 18 bp, Homo sapiens
tataacttaaaatatttt

SEQ ID NO: 1234739 - DNA, 19 bp, Homo sapiens
tataacttaatgaaaacaa

SEQ ID NO: 1234740 - DNA, 19 bp, Homo sapiens
tataacttatattgtaaga

SEQ ID NO: 1234741 - DNA, 24 bp, Homo sapiens
tataacttatattgtaagaaatac

SEQ ID NO: 1234742 - DNA, 16 bp, Homo sapiens
tataacttcttaaaag

SEQ ID NO: 1234743 - DNA, 19 bp, Homo sapiens
tataacttttgatgacttc

SEQ ID NO: 1234744 - DNA, 13 bp, Homo sapiens
tataagaaaaact

SEQ ID NO: 1234745 - DNA, 19 bp, Homo sapiens
tataagaaaagtaatgaag

SEQ ID NO: 1234746 - DNA, 16 bp, Homo sapiens
tataagaagcaatctt

SEQ ID NO: 1234747 - DNA, 21 bp, Homo sapiens
tataagaagcaatctttgaaa

SEQ ID NO: 1234748 - DNA, 23 bp, Homo sapiens
tataagaagcaatctttgaaata

SEQ ID NO: 1234749 - DNA, 22 bp, Homo sapiens
tataagaagccttaatttgcac

SEQ ID NO: 1234750 - DNA, 16 bp, Homo sapiens
tataagaataaaatgt

SEQ ID NO: 1234751 - DNA, 19 bp, Homo sapiens
tataagacatttgtttgct

SEQ ID NO: 1234752 - DNA, 19 bp, Homo sapiens
tataagactaaatgattag

SEQ ID NO: 1234753 - DNA, 18 bp, Homo sapiens
tataagagaagtctcatt

SEQ ID NO: 1234754 - DNA, 19 bp, Homo sapiens
tataagagggctttttaaa

SEQ ID NO: 1234755 - DNA, 22 bp, Homo sapiens
tataagagggctttttaaattt

SEQ ID NO: 1234756 - DNA, 15 bp, Homo sapiens
tataagatttttgaa

SEQ ID NO: 1234757 - DNA, 13 bp, Homo sapiens
tataagcaaaaac

SEQ ID NO: 1234758 - DNA, 22 bp, Homo sapiens
tataagcaagaaggcaaaaata

SEQ ID NO: 1234759 - DNA, 15 bp, Homo sapiens
tataagcactgaaaa

SEQ ID NO: 1234760 - DNA, 18 bp, Homo sapiens
tataagcactgaaaaaca

SEQ ID NO: 1234761 - DNA, 22 bp, Homo sapiens
tataagccacttgtcttgaaaa

SEQ ID NO: 1234762 - DNA, 16 bp, Homo sapiens
tataagcccactgtta

SEQ ID NO: 1234763 - DNA, 16 bp, Homo sapiens
tataaggaaagcaata

SEQ ID NO: 1234764 - DNA, 20 bp, Homo sapiens
tataagggccctgccctgta

SEQ ID NO: 1234765 - DNA, 17 bp, Homo sapiens
tataaggtacatatttt

SEQ ID NO: 1234766 - DNA, 21 bp, Homo sapiens
tataaggtgctctctttctgt

SEQ ID NO: 1234767 - DNA, 23 bp, Homo sapiens
tataagtaaagtgattaaagtgc

SEQ ID NO: 1234768 - DNA, 18 bp, Homo sapiens
tataagtaaatatattat

SEQ ID NO: 1234769 - DNA, 23 bp, Homo sapiens
tataagtaaatatattatatatg

SEQ ID NO: 1234770 - DNA, 16 bp, Homo sapiens
tataagtaagaaaata

SEQ ID NO: 1234771 - DNA, 18 bp, Homo sapiens
tataagtactagatgcat

SEQ ID NO: 1234772 - DNA, 15 bp, Homo sapiens
tataagtagtaaatc

SEQ ID NO: 1234773 - DNA, 23 bp, Homo sapiens
tataagtagttggtttgtatgag

SEQ ID NO: 1234774 - DNA, 19 bp, Homo sapiens
tataagtcaagcacatgta

SEQ ID NO: 1234775 - DNA, 19 bp, Homo sapiens
tataagtggtgcttagaaa

SEQ ID NO: 1234776 - DNA, 20 bp, Homo sapiens
tataagtggtgcttagaaaa

SEQ ID NO: 1234777 - DNA, 21 bp, Homo sapiens
tataagtggtgcttagaaaat

SEQ ID NO: 1234778 - DNA, 13 bp, Homo sapiens
tataagtgtacat

SEQ ID NO: 1234779 - DNA, 14 bp, Homo sapiens
tataagtgtacata

SEQ ID NO: 1234780 - DNA, 14 bp, Homo sapiens
tataagttgtacca

SEQ ID NO: 1234781 - DNA, 22 bp, Homo sapiens
tataagttgtaccaaaacatcc

SEQ ID NO: 1234782 - DNA, 13 bp, Homo sapiens
tataataaaaata

SEQ ID NO: 1234783 - DNA, 13 bp, Homo sapiens
tataataaaagaa

SEQ ID NO: 1234784 - DNA, 12 bp, Homo sapiens
tataataaaagg

SEQ ID NO: 1234785 - DNA, 22 bp, Homo sapiens
tataataaaggactgtaatctt

SEQ ID NO: 1234786 - DNA, 11 bp, Homo sapiens
tataataactt

SEQ ID NO: 1234787 - DNA, 14 bp, Homo sapiens
tataataactttat

SEQ ID NO: 1234788 - DNA, 14 bp, Homo sapiens
tataatactctgtt

SEQ ID NO: 1234789 - DNA, 16 bp, Homo sapiens
tataatacttgcaact

SEQ ID NO: 1234790 - DNA, 15 bp, Homo sapiens
tataatactttgtat

SEQ ID NO: 1234791 - DNA, 21 bp, Homo sapiens
tataatactttgtatacaagt

SEQ ID NO: 1234792 - DNA, 17 bp, Homo sapiens
tataatagcaacttttg

SEQ ID NO: 1234793 - DNA, 17 bp, Homo sapiens
tataatatttcttaatt

SEQ ID NO: 1234794 - DNA, 13 bp, Homo sapiens
tataatcaagatg

SEQ ID NO: 1234795 - DNA, 17 bp, Homo sapiens
tataatcacttggggtt

SEQ ID NO: 1234796 - DNA, 16 bp, Homo sapiens
tataatcatcaagtaa

SEQ ID NO: 1234797 - DNA, 22 bp, Homo sapiens
tataatcatcaagtaatacaaa

SEQ ID NO: 1234798 - DNA, 17 bp, Homo sapiens
tataatcatgctcatgt

SEQ ID NO: 1234799 - DNA, 20 bp, Homo sapiens
tataatcatgctcatgtata

SEQ ID NO: 1234800 - DNA, 15 bp, Homo sapiens
tataatcattagttt

SEQ ID NO: 1234801 - DNA, 18 bp, Homo sapiens
tataatctcaaaggagaa

SEQ ID NO: 1234802 - DNA, 19 bp, Homo sapiens
tataatctcctctgctcat

SEQ ID NO: 1234803 - DNA, 14 bp, Homo sapiens
tataatctgtcaaa

SEQ ID NO: 1234804 - DNA, 19 bp, Homo sapiens
tataatctgtcaaaacact

SEQ ID NO: 1234805 - DNA, 16 bp, Homo sapiens
tataatcttataattg

SEQ ID NO: 1234806 - DNA, 21 bp, Homo sapiens
tataatcttggcttcttaaaa

SEQ ID NO: 1234807 - DNA, 20 bp, Homo sapiens
tataatgaaatctgtttgtt

SEQ ID NO: 1234808 - DNA, 11 bp, Homo sapiens
tataatgaacc

SEQ ID NO: 1234809 - DNA, 13 bp, Homo sapiens
tataatgaataaa

SEQ ID NO: 1234810 - DNA, 20 bp, Homo sapiens
tataatgaatgaaacatttt

SEQ ID NO: 1234811 - DNA, 17 bp, Homo sapiens
tataatgatctaagaag

SEQ ID NO: 1234812 - DNA, 16 bp, Homo sapiens
tataatgctttctgag

SEQ ID NO: 1234813 - DNA, 22 bp, Homo sapiens
tataatggaaacatttacaata

SEQ ID NO: 1234814 - DNA, 19 bp, Homo sapiens
tataatggacagattaata

SEQ ID NO: 1234815 - DNA, 13 bp, Homo sapiens
tataatgtatttg

SEQ ID NO: 1234816 - DNA, 16 bp, Homo sapiens
tataatgtatttgaaa

SEQ ID NO: 1234817 - DNA, 19 bp, Homo sapiens
tataatgtatttgaaaatt

SEQ ID NO: 1234818 - DNA, 17 bp, Homo sapiens
tataatgtcattaaaca

SEQ ID NO: 1234819 - DNA, 20 bp, Homo sapiens
tataatgttgataatatata

SEQ ID NO: 1234820 - DNA, 18 bp, Homo sapiens
tataatgtttattaaatg

SEQ ID NO: 1234821 - DNA, 20 bp, Homo sapiens
tataatgtttattaaatgct

SEQ ID NO: 1234822 - DNA, 18 bp, Homo sapiens
tataattaaagatgccat

SEQ ID NO: 1234823 - DNA, 19 bp, Homo sapiens
tataattatcggaagcagt

SEQ ID NO: 1234824 - DNA, 15 bp, Homo sapiens
tataattctcattaa

SEQ ID NO: 1234825 - DNA, 16 bp, Homo sapiens
tataattctcattaaa

SEQ ID NO: 1234826 - DNA, 20 bp, Homo sapiens
tataattggatttcctaata

SEQ ID NO: 1234827 - DNA, 22 bp, Homo sapiens
tataattggatttcctaatact

SEQ ID NO: 1234828 - DNA, 15 bp, Homo sapiens
tataattgtttataa

SEQ ID NO: 1234829 - DNA, 14 bp, Homo sapiens
tataatttaaatga

SEQ ID NO: 1234830 - DNA, 16 bp, Homo sapiens
tataatttaaatgata

SEQ ID NO: 1234831 - DNA, 22 bp, Homo sapiens
tataatttaacttcagagggaa

SEQ ID NO: 1234832 - DNA, 18 bp, Homo sapiens
tataatttaataaaaagg

SEQ ID NO: 1234833 - DNA, 20 bp, Homo sapiens
tataatttaataaaaaggaa

SEQ ID NO: 1234834 - DNA, 16 bp, Homo sapiens
tataatttaatgcatg

SEQ ID NO: 1234835 - DNA, 20 bp, Homo sapiens
tataatttccatttacttaa

SEQ ID NO: 1234836 - DNA, 14 bp, Homo sapiens
tataatttcctcac

SEQ ID NO: 1234837 - DNA, 17 bp, Homo sapiens
tataatttgagtgtata

SEQ ID NO: 1234838 - DNA, 20 bp, Homo sapiens
tataatttgggtgactagaa

SEQ ID NO: 1234839 - DNA, 19 bp, Homo sapiens
tataatttttaaagtatat

SEQ ID NO: 1234840 - DNA, 20 bp, Homo sapiens
tataatttttttatgttttg

SEQ ID NO: 1234841 - DNA, 16 bp, Homo sapiens
tatacaaattagaaaa

SEQ ID NO: 1234842 - DNA, 19 bp, Homo sapiens
tatacaaccttcatttaaa

SEQ ID NO: 1234843 - DNA, 20 bp, Homo sapiens
tatacaaccttcatttaaaa

SEQ ID NO: 1234844 - DNA, 21 bp, Homo sapiens
tatacaacgattgtatttgtg

SEQ ID NO: 1234845 - DNA, 15 bp, Homo sapiens
tatacaactgcctgg

SEQ ID NO: 1234846 - DNA, 13 bp, Homo sapiens
tatacaagtactg

SEQ ID NO: 1234847 - DNA, 19 bp, Homo sapiens
tatacaagtactggtaaga

SEQ ID NO: 1234848 - DNA, 18 bp, Homo sapiens
tatacaataacccagtta

SEQ ID NO: 1234849 - DNA, 20 bp, Homo sapiens
tatacaataacccagttact

SEQ ID NO: 1234850 - DNA, 22 bp, Homo sapiens
tatacaatttccatatagtcta

SEQ ID NO: 1234851 - DNA, 23 bp, Homo sapiens
tatacacaatatacgaaaagcca

SEQ ID NO: 1234852 - DNA, 14 bp, Homo sapiens
tatacacacacaca

SEQ ID NO: 1234853 - DNA, 17 bp, Homo sapiens
tatacacataagcataa

SEQ ID NO: 1234854 - DNA, 12 bp, Homo sapiens
tatacacataca

SEQ ID NO: 1234855 - DNA, 13 bp, Homo sapiens
tatacacatacat

SEQ ID NO: 1234856 - DNA, 16 bp, Homo sapiens
tatacacatacataca

SEQ ID NO: 1234857 - DNA, 21 bp, Homo sapiens
tatacacatacatacacatac

SEQ ID NO: 1234858 - DNA, 14 bp, Homo sapiens
tatacaccagcaat

SEQ ID NO: 1234859 - DNA, 19 bp, Homo sapiens
tatacacgaatagacatca

SEQ ID NO: 1234860 - DNA, 12 bp, Homo sapiens
tatacactgtgt

SEQ ID NO: 1234861 - DNA, 19 bp, Homo sapiens
tatacacttggatttcatt

SEQ ID NO: 1234862 - DNA, 20 bp, Homo sapiens
tatacagaacagagggccag

SEQ ID NO: 1234863 - DNA, 12 bp, Homo sapiens
tatacagatttt

SEQ ID NO: 1234864 - DNA, 18 bp, Homo sapiens
tatacagtaactttatgt

SEQ ID NO: 1234865 - DNA, 22 bp, Homo sapiens
tatacagtaactttatgtgtaa

SEQ ID NO: 1234866 - DNA, 18 bp, Homo sapiens
tatacagttataaaatta

SEQ ID NO: 1234867 - DNA, 20 bp, Homo sapiens
tatacagttataaaattaaa

SEQ ID NO: 1234868 - DNA, 19 bp, Homo sapiens
tatacagttgaaaacttgt

SEQ ID NO: 1234869 - DNA, 11 bp, Homo sapiens
tatacagtttg

SEQ ID NO: 1234870 - DNA, 15 bp, Homo sapiens
tatacagtttgactt

SEQ ID NO: 1234871 - DNA, 15 bp, Homo sapiens
tatacatacatgtat

SEQ ID NO: 1234872 - DNA, 13 bp, Homo sapiens
tatacatatatat

SEQ ID NO: 1234873 - DNA, 15 bp, Homo sapiens
tatacatatctttat

SEQ ID NO: 1234874 - DNA, 15 bp, Homo sapiens
tatacatgccagtga

SEQ ID NO: 1234875 - DNA, 14 bp, Homo sapiens
tatacatgttggaa

SEQ ID NO: 1234876 - DNA, 21 bp, Homo sapiens
tatacattagttttaatctct

SEQ ID NO: 1234877 - DNA, 17 bp, Homo sapiens
tatacattctttatctt

SEQ ID NO: 1234878 - DNA, 17 bp, Homo sapiens
tatacattgaattcatt

SEQ ID NO: 1234879 - DNA, 23 bp, Homo sapiens
tatacatttcataaggcctgccc

SEQ ID NO: 1234880 - DNA, 13 bp, Homo sapiens
tatacatttctgt

SEQ ID NO: 1234881 - DNA, 13 bp, Homo sapiens
tatacattttcta

SEQ ID NO: 1234882 - DNA, 17 bp, Homo sapiens
tatacattttctaaata

SEQ ID NO: 1234883 - DNA, 22 bp, Homo sapiens
tatacattttctaaataaaaat

SEQ ID NO: 1234884 - DNA, 22 bp, Homo sapiens
tataccaaagcacattttaaaa

SEQ ID NO: 1234885 - DNA, 13 bp, Homo sapiens
tataccagagacc

SEQ ID NO: 1234886 - DNA, 17 bp, Homo sapiens
tataccagatgaacatt

SEQ ID NO: 1234887 - DNA, 17 bp, Homo sapiens
tataccagcaatatatc

SEQ ID NO: 1234888 - DNA, 13 bp, Homo sapiens
tataccatatgtc

SEQ ID NO: 1234889 - DNA, 12 bp, Homo sapiens
tataccttattt

SEQ ID NO: 1234890 - DNA, 21 bp, Homo sapiens
tataccttatttatttttgtg

SEQ ID NO: 1234891 - DNA, 18 bp, Homo sapiens
tataccttctgacagccc

SEQ ID NO: 1234892 - DNA, 13 bp, Homo sapiens
tatacctttcctt

SEQ ID NO: 1234893 - DNA, 13 bp, Homo sapiens
tatacctttgaaa

SEQ ID NO: 1234894 - DNA, 14 bp, Homo sapiens
tatacgaaaagcca

SEQ ID NO: 1234895 - DNA, 16 bp, Homo sapiens
tatactatatttatgg

SEQ ID NO: 1234896 - DNA, 13 bp, Homo sapiens
tatactatgaaat

SEQ ID NO: 1234897 - DNA, 16 bp, Homo sapiens
tatactcattagaatt

SEQ ID NO: 1234898 - DNA, 23 bp, Homo sapiens
tatactcctgtcacctagaacgt

SEQ ID NO: 1234899 - DNA, 22 bp, Homo sapiens
tatactctttctgtatatactt

SEQ ID NO: 1234900 - DNA, 20 bp, Homo sapiens
tatactgaaagatctctgtc

SEQ ID NO: 1234901 - DNA, 16 bp, Homo sapiens
tatactgcatactttt

SEQ ID NO: 1234902 - DNA, 16 bp, Homo sapiens
tatactggaaatgtaa

SEQ ID NO: 1234903 - DNA, 15 bp, Homo sapiens
tatactgggtttcaa

SEQ ID NO: 1234904 - DNA, 19 bp, Homo sapiens
tatactgggtttcaagaaa

SEQ ID NO: 1234905 - DNA, 15 bp, Homo sapiens
tatactggttattga

SEQ ID NO: 1234906 - DNA, 20 bp, Homo sapiens
tatactgtaaaagttataat

SEQ ID NO: 1234907 - DNA, 21 bp, Homo sapiens
tatactgtacaataaaaacat

SEQ ID NO: 1234908 - DNA, 18 bp, Homo sapiens
tatactgtatgtgccaaa

SEQ ID NO: 1234909 - DNA, 17 bp, Homo sapiens
tatactgtgaaatgagt

SEQ ID NO: 1234910 - DNA, 22 bp, Homo sapiens
tatactgtgtgggatacttagt

SEQ ID NO: 1234911 - DNA, 23 bp, Homo sapiens
tatactgtgtgtgagtgtgaata

SEQ ID NO: 1234912 - DNA, 18 bp, Homo sapiens
tatacttaaaatgacaaa

SEQ ID NO: 1234913 - DNA, 19 bp, Homo sapiens
tatacttaaaatgacaaag

SEQ ID NO: 1234914 - DNA, 16 bp, Homo sapiens
tatacttaatctaaga

SEQ ID NO: 1234915 - DNA, 15 bp, Homo sapiens
tatactttacaggaa

SEQ ID NO: 1234916 - DNA, 13 bp, Homo sapiens
tatactttattga

SEQ ID NO: 1234917 - DNA, 15 bp, Homo sapiens
tatactttattgaaa

SEQ ID NO: 1234918 - DNA, 17 bp, Homo sapiens
tatacttttttcttatt

SEQ ID NO: 1234919 - DNA, 20 bp, Homo sapiens
tatagaaaaaaacattctat

SEQ ID NO: 1234920 - DNA, 15 bp, Homo sapiens
tatagaaaatcttca

SEQ ID NO: 1234921 - DNA, 17 bp, Homo sapiens
tatagaaacaatactgt

SEQ ID NO: 1234922 - DNA, 17 bp, Homo sapiens
tatagaacttcatggat

SEQ ID NO: 1234923 - DNA, 11 bp, Homo sapiens
tatagaagaaa

SEQ ID NO: 1234924 - DNA, 13 bp, Homo sapiens
tatagaagcgatt

SEQ ID NO: 1234925 - DNA, 22 bp, Homo sapiens
tatagaataatgtgggaagaaa

SEQ ID NO: 1234926 - DNA, 17 bp, Homo sapiens
tatagacattctcacat

SEQ ID NO: 1234927 - DNA, 11 bp, Homo sapiens
tatagactcta

SEQ ID NO: 1234928 - DNA, 16 bp, Homo sapiens
tatagagatgcattca

SEQ ID NO: 1234929 - DNA, 17 bp, Homo sapiens
tatagagattgtacatt

SEQ ID NO: 1234930 - DNA, 21 bp, Homo sapiens
tatagaggaccctaacacagt

SEQ ID NO: 1234931 - DNA, 21 bp, Homo sapiens
tatagaggctagcttctgctt

SEQ ID NO: 1234932 - DNA, 15 bp, Homo sapiens
tatagatataatgaa

SEQ ID NO: 1234933 - DNA, 14 bp, Homo sapiens
tatagcaaatgcag

SEQ ID NO: 1234934 - DNA, 17 bp, Homo sapiens
tatagcaaatgcagaac

SEQ ID NO: 1234935 - DNA, 14 bp, Homo sapiens
tatagcaactaatg

SEQ ID NO: 1234936 - DNA, 17 bp, Homo sapiens
tatagcattgataatct

SEQ ID NO: 1234937 - DNA, 20 bp, Homo sapiens
tatagcattgataatcttca

SEQ ID NO: 1234938 - DNA, 19 bp, Homo sapiens
tatagccaactgctaatgc

SEQ ID NO: 1234939 - DNA, 17 bp, Homo sapiens
tatagccaatataacta

SEQ ID NO: 1234940 - DNA, 21 bp, Homo sapiens
tatagccacatccctttgaaa

SEQ ID NO: 1234941 - DNA, 22 bp, Homo sapiens
tatagctaggtgacatatacat

SEQ ID NO: 1234942 - DNA, 18 bp, Homo sapiens
tatagctctaataagttt

SEQ ID NO: 1234943 - DNA, 21 bp, Homo sapiens
tatagctgcaagtgtatctcc

SEQ ID NO: 1234944 - DNA, 16 bp, Homo sapiens
tatagctgtacaaata

SEQ ID NO: 1234945 - DNA, 19 bp, Homo sapiens
tataggaacatatgaaaat

SEQ ID NO: 1234946 - DNA, 20 bp, Homo sapiens
tataggatagacactggaca

SEQ ID NO: 1234947 - DNA, 15 bp, Homo sapiens
tataggatcatttgt

SEQ ID NO: 1234948 - DNA, 17 bp, Homo sapiens
tataggcagcttctaag

SEQ ID NO: 1234949 - DNA, 23 bp, Homo sapiens
tataggccagggcatgtgtatgt

SEQ ID NO: 1234950 - DNA, 13 bp, Homo sapiens
tataggccatctg

SEQ ID NO: 1234951 - DNA, 20 bp, Homo sapiens
tataggccatctgtaaatat

SEQ ID NO: 1234952 - DNA, 17 bp, Homo sapiens
tataggctattttctaa

SEQ ID NO: 1234953 - DNA, 19 bp, Homo sapiens
tatagggttttttttaatg

SEQ ID NO: 1234954 - DNA, 15 bp, Homo sapiens
tataggtaacgtgat

SEQ ID NO: 1234955 - DNA, 20 bp, Homo sapiens
tataggtctcttctcccaga

SEQ ID NO: 1234956 - DNA, 21 bp, Homo sapiens
tataggtgttggttttggggg

SEQ ID NO: 1234957 - DNA, 16 bp, Homo sapiens
tataggtttattacaa

SEQ ID NO: 1234958 - DNA, 18 bp, Homo sapiens
tataggtttgattcaaca

SEQ ID NO: 1234959 - DNA, 12 bp, Homo sapiens
tatagtacatga

SEQ ID NO: 1234960 - DNA, 18 bp, Homo sapiens
tatagtagttacttgtga

SEQ ID NO: 1234961 - DNA, 13 bp, Homo sapiens
tatagtatatctg

SEQ ID NO: 1234962 - DNA, 15 bp, Homo sapiens
tatagtatatttata

SEQ ID NO: 1234963 - DNA, 23 bp, Homo sapiens
tatagtatgtgacttttctgatt

SEQ ID NO: 1234964 - DNA, 18 bp, Homo sapiens
tatagtatttgattcaaa

SEQ ID NO: 1234965 - DNA, 15 bp, Homo sapiens
tatagtcaatggctt

SEQ ID NO: 1234966 - DNA, 18 bp, Homo sapiens
tatagtggatgatataca

SEQ ID NO: 1234967 - DNA, 20 bp, Homo sapiens
tatagtggatgatatacaca

SEQ ID NO: 1234968 - DNA, 19 bp, Homo sapiens
tatagtgtataccacctgt

SEQ ID NO: 1234969 - DNA, 22 bp, Homo sapiens
tatagtgtataccacctgtaca

SEQ ID NO: 1234970 - DNA, 22 bp, Homo sapiens
tatagtgtccccatgggctccc

SEQ ID NO: 1234971 - DNA, 18 bp, Homo sapiens
tatagtgttcacaaactg

SEQ ID NO: 1234972 - DNA, 19 bp, Homo sapiens
tatagtgttcacaaactgt

SEQ ID NO: 1234973 - DNA, 16 bp, Homo sapiens
tatagttaatattttg

SEQ ID NO: 1234974 - DNA, 18 bp, Homo sapiens
tatagttactgtgtaatt

SEQ ID NO: 1234975 - DNA, 19 bp, Homo sapiens
tatagttatatgtacagtt

SEQ ID NO: 1234976 - DNA, 17 bp, Homo sapiens
tatagttccttgcctta

SEQ ID NO: 1234977 - DNA, 18 bp, Homo sapiens
tatagttgttttatatgt

SEQ ID NO: 1234978 - DNA, 18 bp, Homo sapiens
tatagtttgtacatgcat

SEQ ID NO: 1234979 - DNA, 15 bp, Homo sapiens
tatagttttactttt

SEQ ID NO: 1234980 - DNA, 18 bp, Homo sapiens
tatataaaaagaaaagat

SEQ ID NO: 1234981 - DNA, 19 bp, Homo sapiens
tatataaaataaatatata

SEQ ID NO: 1234982 - DNA, 23 bp, Homo sapiens
tatataaaataaatatatataaa

SEQ ID NO: 1234983 - DNA, 14 bp, Homo sapiens
tatataaacaataa

SEQ ID NO: 1234984 - DNA, 23 bp, Homo sapiens
tatataaacaataaaaacaactt

SEQ ID NO: 1234985 - DNA, 14 bp, Homo sapiens
tatataaacctaaa

SEQ ID NO: 1234986 - DNA, 16 bp, Homo sapiens
tatataaagtattctt

SEQ ID NO: 1234987 - DNA, 19 bp, Homo sapiens
tatataaagtattcttttt

SEQ ID NO: 1234988 - DNA, 13 bp, Homo sapiens
tatataataaatt

SEQ ID NO: 1234989 - DNA, 14 bp, Homo sapiens
tatataataacttt

SEQ ID NO: 1234990 - DNA, 21 bp, Homo sapiens
tatataataactttattgcat

SEQ ID NO: 1234991 - DNA, 22 bp, Homo sapiens
tatataataactttattgcata

SEQ ID NO: 1234992 - DNA, 23 bp, Homo sapiens
tatataatactgactgagaatat

SEQ ID NO: 1234993 - DNA, 17 bp, Homo sapiens
tatataatcatgctcat

SEQ ID NO: 1234994 - DNA, 14 bp, Homo sapiens
tatataatttactt

SEQ ID NO: 1234995 - DNA, 17 bp, Homo sapiens
tatataatttactttgt

SEQ ID NO: 1234996 - DNA, 15 bp, Homo sapiens
tatataatttcctca

SEQ ID NO: 1234997 - DNA, 19 bp, Homo sapiens
tatataatttcctcactgc

SEQ ID NO: 1234998 - DNA, 22 bp, Homo sapiens
tatataatttgagtgtatatat

SEQ ID NO: 1234999 - DNA, 22 bp, Homo sapiens
tatatacaataacataatttgt

SEQ ID NO: 1235000 - DNA, 15 bp, Homo sapiens
tatatacacatacat

SEQ ID NO: 1235001 - DNA, 16 bp, Homo sapiens
tatatacacatacata

SEQ ID NO: 1235002 - DNA, 23 bp, Homo sapiens
tatatacatcacgttaaagtagg

SEQ ID NO: 1235003 - DNA, 16 bp, Homo sapiens
tatataccaaagcaca

SEQ ID NO: 1235004 - DNA, 12 bp, Homo sapiens
tatatacttttt

SEQ ID NO: 1235005 - DNA, 16 bp, Homo sapiens
tatatagagatgtttt

SEQ ID NO: 1235006 - DNA, 17 bp, Homo sapiens
tatatagcaaaatgatt

SEQ ID NO: 1235007 - DNA, 14 bp, Homo sapiens
tatatagcttgaaa

SEQ ID NO: 1235008 - DNA, 22 bp, Homo sapiens
tatataggaaactaagcattgt

SEQ ID NO: 1235009 - DNA, 23 bp, Homo sapiens
tatataggctattttctaaagac

SEQ ID NO: 1235010 - DNA, 17 bp, Homo sapiens
tatataggttgtgcaaa

SEQ ID NO: 1235011 - DNA, 11 bp, Homo sapiens
tatatagtata

SEQ ID NO: 1235012 - DNA, 13 bp, Homo sapiens
tatatagtatatt

SEQ ID NO: 1235013 - DNA, 18 bp, Homo sapiens
tatatagtatatttatac

SEQ ID NO: 1235014 - DNA, 19 bp, Homo sapiens
tatatagtatatttatact

SEQ ID NO: 1235015 - DNA, 15 bp, Homo sapiens
tatatagtctttgca

SEQ ID NO: 1235016 - DNA, 18 bp, Homo sapiens
tatatagttccttgcctt

SEQ ID NO: 1235017 - DNA, 22 bp, Homo sapiens
tatatagtttattgacaataat

SEQ ID NO: 1235018 - DNA, 12 bp, Homo sapiens
tatatataaaat

SEQ ID NO: 1235019 - DNA, 16 bp, Homo sapiens
tatatataaacctaaa

SEQ ID NO: 1235020 - DNA, 15 bp, Homo sapiens
tatatatacacatac

SEQ ID NO: 1235021 - DNA, 13 bp, Homo sapiens
tatatatacagta

SEQ ID NO: 1235022 - DNA, 12 bp, Homo sapiens
tatatatacata

SEQ ID NO: 1235023 - DNA, 12 bp, Homo sapiens
tatatatagtaa

SEQ ID NO: 1235024 - DNA, 14 bp, Homo sapiens
tatatatataaaat

SEQ ID NO: 1235025 - DNA, 14 bp, Homo sapiens
tatatatataaaca

SEQ ID NO: 1235026 - DNA, 16 bp, Homo sapiens
tatatatatacacata

SEQ ID NO: 1235027 - DNA, 14 bp, Homo sapiens
tatatatatagtaa

SEQ ID NO: 1235028 - DNA, 15 bp, Homo sapiens
tatatatatatagta

SEQ ID NO: 1235029 - DNA, 13 bp, Homo sapiens
tatatatatatat

SEQ ID NO: 1235030 - DNA, 14 bp, Homo sapiens
tatatatatatatg

SEQ ID NO: 1235031 - DNA, 15 bp, Homo sapiens
tatatatatatgtac

SEQ ID NO: 1235032 - DNA, 16 bp, Homo sapiens
tatatatatatgtata

SEQ ID NO: 1235033 - DNA, 13 bp, Homo sapiens
tatatatatattt

SEQ ID NO: 1235034 - DNA, 14 bp, Homo sapiens
tatatatatttgta

SEQ ID NO: 1235035 - DNA, 22 bp, Homo sapiens
tatatatcatattggtattcac

SEQ ID NO: 1235036 - DNA, 17 bp, Homo sapiens
tatatatctattattca

SEQ ID NO: 1235037 - DNA, 18 bp, Homo sapiens
tatatatctgataaaatt

SEQ ID NO: 1235038 - DNA, 21 bp, Homo sapiens
tatatatctgcttcagtggag

SEQ ID NO: 1235039 - DNA, 13 bp, Homo sapiens
tatatatcttata

SEQ ID NO: 1235040 - DNA, 20 bp, Homo sapiens
tatatatgatcattgaaata

SEQ ID NO: 1235041 - DNA, 23 bp, Homo sapiens
tatatatgatgtggacatatgta

SEQ ID NO: 1235042 - DNA, 15 bp, Homo sapiens
tatatatggatcaga

SEQ ID NO: 1235043 - DNA, 17 bp, Homo sapiens
tatatatggcatattta

SEQ ID NO: 1235044 - DNA, 17 bp, Homo sapiens
tatatatgtacagttat

SEQ ID NO: 1235045 - DNA, 12 bp, Homo sapiens
tatatatgtgta

SEQ ID NO: 1235046 - DNA, 21 bp, Homo sapiens
tatatatgtgtatgcacagta

SEQ ID NO: 1235047 - DNA, 16 bp, Homo sapiens
tatatatgtgtatgta

SEQ ID NO: 1235048 - DNA, 23 bp, Homo sapiens
tatatattaggatctgcaaacaa

SEQ ID NO: 1235049 - DNA, 19 bp, Homo sapiens
tatatattgaaagttgctt

SEQ ID NO: 1235050 - DNA, 21 bp, Homo sapiens
tatatattgaaagttgctttt

SEQ ID NO: 1235051 - DNA, 14 bp, Homo sapiens
tatatatttacaga

SEQ ID NO: 1235052 - DNA, 19 bp, Homo sapiens
tatatatttatatatatga

SEQ ID NO: 1235053 - DNA, 20 bp, Homo sapiens
tatatatttatatatatgat

SEQ ID NO: 1235054 - DNA, 13 bp, Homo sapiens
tatatatttctat

SEQ ID NO: 1235055 - DNA, 21 bp, Homo sapiens
tatatattttatatgttcata

SEQ ID NO: 1235056 - DNA, 19 bp, Homo sapiens
tatatatttttcaaataga

SEQ ID NO: 1235057 - DNA, 22 bp, Homo sapiens
tatatatttttggttgtcaata

SEQ ID NO: 1235058 - DNA, 11 bp, Homo sapiens
tatatcagcct

SEQ ID NO: 1235059 - DNA, 15 bp, Homo sapiens
tatatcatacagttt

SEQ ID NO: 1235060 - DNA, 22 bp, Homo sapiens
tatatcatacagttttcattga

SEQ ID NO: 1235061 - DNA, 17 bp, Homo sapiens
tatatcatgaaacactt

SEQ ID NO: 1235062 - DNA, 16 bp, Homo sapiens
tatatcatgaagcctt

SEQ ID NO: 1235063 - DNA, 15 bp, Homo sapiens
tatatccatgtactg

SEQ ID NO: 1235064 - DNA, 18 bp, Homo sapiens
tatatccatgtactgtag

SEQ ID NO: 1235065 - DNA, 23 bp, Homo sapiens
tatatcctctggaaaaggctttc

SEQ ID NO: 1235066 - DNA, 18 bp, Homo sapiens
tatatcctgtgactgtct

SEQ ID NO: 1235067 - DNA, 17 bp, Homo sapiens
tatatcgttatcactgt

SEQ ID NO: 1235068 - DNA, 20 bp, Homo sapiens
tatatcgttatcactgtgca

SEQ ID NO: 1235069 - DNA, 13 bp, Homo sapiens
tatatctacacat

SEQ ID NO: 1235070 - DNA, 16 bp, Homo sapiens
tatatctatatgtact

SEQ ID NO: 1235071 - DNA, 19 bp, Homo sapiens
tatatctcttttggtccca

SEQ ID NO: 1235072 - DNA, 18 bp, Homo sapiens
tatatctgataaaattgt

SEQ ID NO: 1235073 - DNA, 21 bp, Homo sapiens
tatatctgataaaattgtgat

SEQ ID NO: 1235074 - DNA, 13 bp, Homo sapiens
tatatctgcaaaa

SEQ ID NO: 1235075 - DNA, 19 bp, Homo sapiens
tatatctgggttaagtgtt

SEQ ID NO: 1235076 - DNA, 13 bp, Homo sapiens
tatatctgtttgt

SEQ ID NO: 1235077 - DNA, 15 bp, Homo sapiens
tatatcttataactg

SEQ ID NO: 1235078 - DNA, 15 bp, Homo sapiens
tatatcttgtttaca

SEQ ID NO: 1235079 - DNA, 16 bp, Homo sapiens
tatatgaataaagtgt

SEQ ID NO: 1235080 - DNA, 14 bp, Homo sapiens
tatatgaccagaag

SEQ ID NO: 1235081 - DNA, 16 bp, Homo sapiens
tatatgagagaatcac

SEQ ID NO: 1235082 - DNA, 21 bp, Homo sapiens
tatatgatattctttaaacaa

SEQ ID NO: 1235083 - DNA, 17 bp, Homo sapiens
tatatgattctctgtgg

SEQ ID NO: 1235084 - DNA, 15 bp, Homo sapiens
tatatgatttatagt

SEQ ID NO: 1235085 - DNA, 21 bp, Homo sapiens
tatatgatttatagtttgtac

SEQ ID NO: 1235086 - DNA, 17 bp, Homo sapiens
tatatgatttttatcca

SEQ ID NO: 1235087 - DNA, 18 bp, Homo sapiens
tatatgccttaagccaat

SEQ ID NO: 1235088 - DNA, 21 bp, Homo sapiens
tatatgctctgcatgttacat

SEQ ID NO: 1235089 - DNA, 17 bp, Homo sapiens
tatatgcttttggaagt

SEQ ID NO: 1235090 - DNA, 14 bp, Homo sapiens
tatatggatcagag

SEQ ID NO: 1235091 - DNA, 18 bp, Homo sapiens
tatatggcagagttgtaa

SEQ ID NO: 1235092 - DNA, 22 bp, Homo sapiens
tatatggcagagttgtaaatat

SEQ ID NO: 1235093 - DNA, 20 bp, Homo sapiens
tatatggggatggtagtttt

SEQ ID NO: 1235094 - DNA, 21 bp, Homo sapiens
tatatggggatggtagttttt

SEQ ID NO: 1235095 - DNA, 22 bp, Homo sapiens
tatatggttctccaagaaactg

SEQ ID NO: 1235096 - DNA, 21 bp, Homo sapiens
tatatgtacagtttattgata

SEQ ID NO: 1235097 - DNA, 14 bp, Homo sapiens
tatatgtatatgta

SEQ ID NO: 1235098 - DNA, 17 bp, Homo sapiens
tatatgtatatgtatat

SEQ ID NO: 1235099 - DNA, 18 bp, Homo sapiens
tatatgtatatgtatata

SEQ ID NO: 1235100 - DNA, 12 bp, Homo sapiens
tatatgtatgta

SEQ ID NO: 1235101 - DNA, 16 bp, Homo sapiens
tatatgtatgtaaaaa

SEQ ID NO: 1235102 - DNA, 17 bp, Homo sapiens
tatatgtatttaaaaac

SEQ ID NO: 1235103 - DNA, 18 bp, Homo sapiens
tatatgtatttaaaaaca

SEQ ID NO: 1235104 - DNA, 20 bp, Homo sapiens
tatatgtatttaaaaacaaa

SEQ ID NO: 1235105 - DNA, 14 bp, Homo sapiens
tatatgtatttaag

SEQ ID NO: 1235106 - DNA, 17 bp, Homo sapiens
tatatgtatttttatat

SEQ ID NO: 1235107 - DNA, 12 bp, Homo sapiens
tatatgtcaata

SEQ ID NO: 1235108 - DNA, 14 bp, Homo sapiens
tatatgtctgtgtg

SEQ ID NO: 1235109 - DNA, 19 bp, Homo sapiens
tatatgtgaaaaaaatgag

SEQ ID NO: 1235110 - DNA, 14 bp, Homo sapiens
tatatgtgagaaat

SEQ ID NO: 1235111 - DNA, 20 bp, Homo sapiens
tatatgtggactaaatatct

SEQ ID NO: 1235112 - DNA, 16 bp, Homo sapiens
tatatgtgtatacata

SEQ ID NO: 1235113 - DNA, 14 bp, Homo sapiens
tatatgtgtatgca

SEQ ID NO: 1235114 - DNA, 22 bp, Homo sapiens
tatatgtgtgtttaaataaagt

SEQ ID NO: 1235115 - DNA, 18 bp, Homo sapiens
tatatgtgtttttcacat

SEQ ID NO: 1235116 - DNA, 16 bp, Homo sapiens
tatatgtttacacaat

SEQ ID NO: 1235117 - DNA, 18 bp, Homo sapiens
tatattaaaaaagagaca

SEQ ID NO: 1235118 - DNA, 13 bp, Homo sapiens
tatattaaaaata

SEQ ID NO: 1235119 - DNA, 15 bp, Homo sapiens
tatattaaaaatata

SEQ ID NO: 1235120 - DNA, 18 bp, Homo sapiens
tatattaaaaatataaaa

SEQ ID NO: 1235121 - DNA, 21 bp, Homo sapiens
tatattaaaaatataaaactg

SEQ ID NO: 1235122 - DNA, 23 bp, Homo sapiens
tatattaaaaatataaaactgcg

SEQ ID NO: 1235123 - DNA, 22 bp, Homo sapiens
tatattaaacaaagtttcagag

SEQ ID NO: 1235124 - DNA, 14 bp, Homo sapiens
tatattaaagtaaa

SEQ ID NO: 1235125 - DNA, 13 bp, Homo sapiens
tatattaaatgag

SEQ ID NO: 1235126 - DNA, 14 bp, Homo sapiens
tatattaatattta

SEQ ID NO: 1235127 - DNA, 15 bp, Homo sapiens
tatattaatgtactt

SEQ ID NO: 1235128 - DNA, 22 bp, Homo sapiens
tatattacactacacactgtgt

SEQ ID NO: 1235129 - DNA, 17 bp, Homo sapiens
tatattactgatttaga

SEQ ID NO: 1235130 - DNA, 18 bp, Homo sapiens
tatattactgatttagaa

SEQ ID NO: 1235131 - DNA, 17 bp, Homo sapiens
tatattacttttgtaaa

SEQ ID NO: 1235132 - DNA, 19 bp, Homo sapiens
tatattacttttgtaaata

SEQ ID NO: 1235133 - DNA, 22 bp, Homo sapiens
tatattagatcaaatagttgca

SEQ ID NO: 1235134 - DNA, 15 bp, Homo sapiens
tatattagtgaagat

SEQ ID NO: 1235135 - DNA, 22 bp, Homo sapiens
tatattagtgaagatggtttca

SEQ ID NO: 1235136 - DNA, 15 bp, Homo sapiens
tatattatatatgga

SEQ ID NO: 1235137 - DNA, 14 bp, Homo sapiens
tatattatgtttaa

SEQ ID NO: 1235138 - DNA, 14 bp, Homo sapiens
tatattatttgcag

SEQ ID NO: 1235139 - DNA, 16 bp, Homo sapiens
tatattattttactgc

SEQ ID NO: 1235140 - DNA, 12 bp, Homo sapiens
tatattcacaga

SEQ ID NO: 1235141 - DNA, 15 bp, Homo sapiens
tatattcacagtttt

SEQ ID NO: 1235142 - DNA, 16 bp, Homo sapiens
tatattcacagttttt

SEQ ID NO: 1235143 - DNA, 18 bp, Homo sapiens
tatattcatctaataaat

SEQ ID NO: 1235144 - DNA, 20 bp, Homo sapiens
tatattcatctaataaatca

SEQ ID NO: 1235145 - DNA, 21 bp, Homo sapiens
tatattccgtatttaaagttg

SEQ ID NO: 1235146 - DNA, 21 bp, Homo sapiens
tatattgaacttttgtactga

SEQ ID NO: 1235147 - DNA, 17 bp, Homo sapiens
tatattgaagacaattt

SEQ ID NO: 1235148 - DNA, 18 bp, Homo sapiens
tatattgaagacaatttg

SEQ ID NO: 1235149 - DNA, 16 bp, Homo sapiens
tatattgctgcatttt

SEQ ID NO: 1235150 - DNA, 19 bp, Homo sapiens
tatattgggtgtagatttc

SEQ ID NO: 1235151 - DNA, 18 bp, Homo sapiens
tatattggtgtatattat

SEQ ID NO: 1235152 - DNA, 20 bp, Homo sapiens
tatattgtaagaaatactgt

SEQ ID NO: 1235153 - DNA, 16 bp, Homo sapiens
tatattgtatattctg

SEQ ID NO: 1235154 - DNA, 21 bp, Homo sapiens
tatattgtatattctggaaaa

SEQ ID NO: 1235155 - DNA, 12 bp, Homo sapiens
tatattgtgaac

SEQ ID NO: 1235156 - DNA, 18 bp, Homo sapiens
tatattgtgtttgtgtat

SEQ ID NO: 1235157 - DNA, 15 bp, Homo sapiens
tatattgttgaagag

SEQ ID NO: 1235158 - DNA, 18 bp, Homo sapiens
tatatttaaaaattgttt

SEQ ID NO: 1235159 - DNA, 21 bp, Homo sapiens
tatatttaaaaattgtttctt

SEQ ID NO: 1235160 - DNA, 14 bp, Homo sapiens
tatatttaaactca

SEQ ID NO: 1235161 - DNA, 19 bp, Homo sapiens
tatatttaactctctttat

SEQ ID NO: 1235162 - DNA, 11 bp, Homo sapiens
tatatttaatg

SEQ ID NO: 1235163 - DNA, 22 bp, Homo sapiens
tatatttataactcatcataaa

SEQ ID NO: 1235164 - DNA, 23 bp, Homo sapiens
tatatttataactcatcataaaa

SEQ ID NO: 1235165 - DNA, 16 bp, Homo sapiens
tatatttattcataat

SEQ ID NO: 1235166 - DNA, 20 bp, Homo sapiens
tatatttcacttttgttctg

SEQ ID NO: 1235167 - DNA, 16 bp, Homo sapiens
tatatttcagatgtaa

SEQ ID NO: 1235168 - DNA, 14 bp, Homo sapiens
tatatttcctttat

SEQ ID NO: 1235169 - DNA, 19 bp, Homo sapiens
tatatttcctttatgtgaa

SEQ ID NO: 1235170 - DNA, 22 bp, Homo sapiens
tatatttctacagagaaaatga

SEQ ID NO: 1235171 - DNA, 23 bp, Homo sapiens
tatatttctacagagaaaatgaa

SEQ ID NO: 1235172 - DNA, 14 bp, Homo sapiens
tatatttcttcttc

SEQ ID NO: 1235173 - DNA, 12 bp, Homo sapiens
tatatttgacat

SEQ ID NO: 1235174 - DNA, 22 bp, Homo sapiens
tatatttgcagataattctgga

SEQ ID NO: 1235175 - DNA, 12 bp, Homo sapiens
tatatttgcatt

SEQ ID NO: 1235176 - DNA, 13 bp, Homo sapiens
tatatttgcatta

SEQ ID NO: 1235177 - DNA, 21 bp, Homo sapiens
tatatttgctgcaaagagaaa

SEQ ID NO: 1235178 - DNA, 14 bp, Homo sapiens
tatatttgcttttt

SEQ ID NO: 1235179 - DNA, 14 bp, Homo sapiens
tatatttggaaaga

SEQ ID NO: 1235180 - DNA, 16 bp, Homo sapiens
tatatttggaaagaga

SEQ ID NO: 1235181 - DNA, 14 bp, Homo sapiens
tatatttgtaacat

SEQ ID NO: 1235182 - DNA, 13 bp, Homo sapiens
tatatttgtacaa

SEQ ID NO: 1235183 - DNA, 21 bp, Homo sapiens
tatatttgtgatagcactttc

SEQ ID NO: 1235184 - DNA, 16 bp, Homo sapiens
tatatttgtgtattta

SEQ ID NO: 1235185 - DNA, 21 bp, Homo sapiens
tatatttgtgtattttcctgg

SEQ ID NO: 1235186 - DNA, 21 bp, Homo sapiens
tatatttgtttcatttctgca

SEQ ID NO: 1235187 - DNA, 12 bp, Homo sapiens
tatattttaata

SEQ ID NO: 1235188 - DNA, 16 bp, Homo sapiens
tatattttacaatttt

SEQ ID NO: 1235189 - DNA, 14 bp, Homo sapiens
tatattttatgaac

SEQ ID NO: 1235190 - DNA, 17 bp, Homo sapiens
tatattttatgaacatt

SEQ ID NO: 1235191 - DNA, 20 bp, Homo sapiens
tatattttatgaacattgta

SEQ ID NO: 1235192 - DNA, 22 bp, Homo sapiens
tatattttatgaacattgtact

SEQ ID NO: 1235193 - DNA, 17 bp, Homo sapiens
tatattttatttcaatg

SEQ ID NO: 1235194 - DNA, 14 bp, Homo sapiens
tatattttctgttt

SEQ ID NO: 1235195 - DNA, 13 bp, Homo sapiens
tatattttgattt

SEQ ID NO: 1235196 - DNA, 12 bp, Homo sapiens
tatattttggga

SEQ ID NO: 1235197 - DNA, 13 bp, Homo sapiens
tatatttttatct

SEQ ID NO: 1235198 - DNA, 22 bp, Homo sapiens
tatatttttatctatataaaat

SEQ ID NO: 1235199 - DNA, 18 bp, Homo sapiens
tatatttttcaaatagat

SEQ ID NO: 1235200 - DNA, 20 bp, Homo sapiens
tatatttttcaaatagattt

SEQ ID NO: 1235201 - DNA, 15 bp, Homo sapiens
tatatttttcacagt

SEQ ID NO: 1235202 - DNA, 13 bp, Homo sapiens
tatatttttctga

SEQ ID NO: 1235203 - DNA, 15 bp, Homo sapiens
tatatttttgtacat

SEQ ID NO: 1235204 - DNA, 23 bp, Homo sapiens
tatatttttgtatgtcactattt

SEQ ID NO: 1235205 - DNA, 12 bp, Homo sapiens
tatatttttgtc

SEQ ID NO: 1235206 - DNA, 20 bp, Homo sapiens
tatatttttgtgttttcttg

SEQ ID NO: 1235207 - DNA, 24 bp, Homo sapiens
tatatttttgtgttttcttgtaaa

SEQ ID NO: 1235208 - DNA, 15 bp, Homo sapiens
tatattttttgtctg

SEQ ID NO: 1235209 - DNA, 21 bp, Homo sapiens
tatcaaaaagctaatgtgcag

SEQ ID NO: 1235210 - DNA, 22 bp, Homo sapiens
tatcaaaaagctaatgtgcagg

SEQ ID NO: 1235211 - DNA, 23 bp, Homo sapiens
tatcaaaccctagccttgcttgt

SEQ ID NO: 1235212 - DNA, 16 bp, Homo sapiens
tatcaaagaaaaacaa

SEQ ID NO: 1235213 - DNA, 20 bp, Homo sapiens
tatcaaagagaagatgcctg

SEQ ID NO: 1235214 - DNA, 18 bp, Homo sapiens
tatcaaagtcattaaaga

SEQ ID NO: 1235215 - DNA, 14 bp, Homo sapiens
tatcaaataaaata

SEQ ID NO: 1235216 - DNA, 16 bp, Homo sapiens
tatcaaataaaatatc

SEQ ID NO: 1235217 - DNA, 17 bp, Homo sapiens
tatcaaataaaatatca

SEQ ID NO: 1235218 - DNA, 12 bp, Homo sapiens
tatcaaataata

SEQ ID NO: 1235219 - DNA, 13 bp, Homo sapiens
tatcaaataataa

SEQ ID NO: 1235220 - DNA, 13 bp, Homo sapiens
tatcaaatctgta

SEQ ID NO: 1235221 - DNA, 16 bp, Homo sapiens
tatcaaatctgtatat

SEQ ID NO: 1235222 - DNA, 21 bp, Homo sapiens
tatcaaatgcagtatatttct

SEQ ID NO: 1235223 - DNA, 23 bp, Homo sapiens
tatcaaatgcagtatatttcttc

SEQ ID NO: 1235224 - DNA, 21 bp, Homo sapiens
tatcaacactgttactttcgt

SEQ ID NO: 1235225 - DNA, 17 bp, Homo sapiens
tatcaaccccagacact

SEQ ID NO: 1235226 - DNA, 19 bp, Homo sapiens
tatcaacttcgctagaaaa

SEQ ID NO: 1235227 - DNA, 13 bp, Homo sapiens
tatcaactttaat

SEQ ID NO: 1235228 - DNA, 15 bp, Homo sapiens
tatcaactttaatca

SEQ ID NO: 1235229 - DNA, 23 bp, Homo sapiens
tatcaagccagtacgtgctaaca

SEQ ID NO: 1235230 - DNA, 19 bp, Homo sapiens
tatcaagtatagaaaatct

SEQ ID NO: 1235231 - DNA, 18 bp, Homo sapiens
tatcaagtattatacctt

SEQ ID NO: 1235232 - DNA, 14 bp, Homo sapiens
tatcaagtgtcttc

SEQ ID NO: 1235233 - DNA, 17 bp, Homo sapiens
tatcaatatctaatata

SEQ ID NO: 1235234 - DNA, 22 bp, Homo sapiens
tatcaatatctaatatatatga

SEQ ID NO: 1235235 - DNA, 12 bp, Homo sapiens
tatcaatgtgtc

SEQ ID NO: 1235236 - DNA, 15 bp, Homo sapiens
tatcaatgtgtcttt

SEQ ID NO: 1235237 - DNA, 22 bp, Homo sapiens
tatcaatttttcccagtatttt

SEQ ID NO: 1235238 - DNA, 20 bp, Homo sapiens
tatcacacactttctcttca

SEQ ID NO: 1235239 - DNA, 13 bp, Homo sapiens
tatcacagtgttt

SEQ ID NO: 1235240 - DNA, 12 bp, Homo sapiens
tatctaaagttt

SEQ ID NO: 1235241 - DNA, 13 bp, Homo sapiens
tatctaagaataa

SEQ ID NO: 1235242 - DNA, 13 bp, Homo sapiens
tatctaatttata

SEQ ID NO: 1235243 - DNA, 16 bp, Homo sapiens
tatctacagtaatgaa

SEQ ID NO: 1235244 - DNA, 20 bp, Homo sapiens
tatctacctgttctgtagct

SEQ ID NO: 1235245 - DNA, 21 bp, Homo sapiens
tatctacctgttctgtagctt

SEQ ID NO: 1235246 - DNA, 20 bp, Homo sapiens
tatctactgataaagaaaga

SEQ ID NO: 1235247 - DNA, 12 bp, Homo sapiens
tatctagaaaga

SEQ ID NO: 1235248 - DNA, 15 bp, Homo sapiens
tatctagaaagaaaa

SEQ ID NO: 1235249 - DNA, 19 bp, Homo sapiens
tatctagaactatcatttt

SEQ ID NO: 1235250 - DNA, 20 bp, Homo sapiens
tatctagcatttatttctct

SEQ ID NO: 1235251 - DNA, 13 bp, Homo sapiens
tatctataattta

SEQ ID NO: 1235252 - DNA, 14 bp, Homo sapiens
tatctataatttac

SEQ ID NO: 1235253 - DNA, 16 bp, Homo sapiens
tatctataatttacct

SEQ ID NO: 1235254 - DNA, 20 bp, Homo sapiens
tatctatacatatctttatt

SEQ ID NO: 1235255 - DNA, 16 bp, Homo sapiens
tatctatacctgcctt

SEQ ID NO: 1235256 - DNA, 15 bp, Homo sapiens
tatctatataaaata

SEQ ID NO: 1235257 - DNA, 17 bp, Homo sapiens
tatctatctatttgagg

SEQ ID NO: 1235258 - DNA, 14 bp, Homo sapiens
tatctatcttccaa

SEQ ID NO: 1235259 - DNA, 18 bp, Homo sapiens
tatctatggccctgcaaa

SEQ ID NO: 1235260 - DNA, 21 bp, Homo sapiens
tatctatggccctgcaaaaat

SEQ ID NO: 1235261 - DNA, 16 bp, Homo sapiens
tatctatgtggaaaac

SEQ ID NO: 1235262 - DNA, 17 bp, Homo sapiens
tatctattaaagtgact

SEQ ID NO: 1235263 - DNA, 18 bp, Homo sapiens
tatctattaatatatgta

SEQ ID NO: 1235264 - DNA, 14 bp, Homo sapiens
tatctatttgtaca

SEQ ID NO: 1235265 - DNA, 15 bp, Homo sapiens
tatctatttgtacaa

SEQ ID NO: 1235266 - DNA, 16 bp, Homo sapiens
tatctatttgtacaat

SEQ ID NO: 1235267 - DNA, 15 bp, Homo sapiens
tatctcagatgttaa

SEQ ID NO: 1235268 - DNA, 16 bp, Homo sapiens
tatctcagatgttaaa

SEQ ID NO: 1235269 - DNA, 13 bp, Homo sapiens
tatctcagccata

SEQ ID NO: 1235270 - DNA, 22 bp, Homo sapiens
tatctcagtctaaggtctcatg

SEQ ID NO: 1235271 - DNA, 21 bp, Homo sapiens
tatctcatagggatgctgtga

SEQ ID NO: 1235272 - DNA, 18 bp, Homo sapiens
tatctccagcggccctgt

SEQ ID NO: 1235273 - DNA, 22 bp, Homo sapiens
tatctccatgatgatagttgaa

SEQ ID NO: 1235274 - DNA, 14 bp, Homo sapiens
tatctcctgacaga

SEQ ID NO: 1235275 - DNA, 16 bp, Homo sapiens
tatctccttcccctac

SEQ ID NO: 1235276 - DNA, 20 bp, Homo sapiens
tatctctctctctttttgga

SEQ ID NO: 1235277 - DNA, 12 bp, Homo sapiens
tatctctgtgtt

SEQ ID NO: 1235278 - DNA, 13 bp, Homo sapiens
tatctcttgccct

SEQ ID NO: 1235279 - DNA, 22 bp, Homo sapiens
tatctctttgatctacttgcct

SEQ ID NO: 1235280 - DNA, 16 bp, Homo sapiens
tatctcttttatattt

SEQ ID NO: 1235281 - DNA, 22 bp, Homo sapiens
tatctcttttgaatccatgctt

SEQ ID NO: 1235282 - DNA, 14 bp, Homo sapiens
tatctgaaaatgta

SEQ ID NO: 1235283 - DNA, 14 bp, Homo sapiens
tatctgaaccaaga

SEQ ID NO: 1235284 - DNA, 17 bp, Homo sapiens
tatctgaaggaccccag

SEQ ID NO: 1235285 - DNA, 20 bp, Homo sapiens
tatctgaatttttaaacaag

SEQ ID NO: 1235286 - DNA, 17 bp, Homo sapiens
tatctgagggaggaggc

SEQ ID NO: 1235287 - DNA, 22 bp, Homo sapiens
tatctgattttgtgcaaaagct

SEQ ID NO: 1235288 - DNA, 22 bp, Homo sapiens
tatctgcaagtgaggtgtgtca

SEQ ID NO: 1235289 - DNA, 12 bp, Homo sapiens
tatctgcactct

SEQ ID NO: 1235290 - DNA, 19 bp, Homo sapiens
tatctgcagaatgggccac

SEQ ID NO: 1235291 - DNA, 11 bp, Homo sapiens
tatctgcagcg

SEQ ID NO: 1235292 - DNA, 15 bp, Homo sapiens
tatctgcaggcagac

SEQ ID NO: 1235293 - DNA, 17 bp, Homo sapiens
tatctgcaggcagacac

SEQ ID NO: 1235294 - DNA, 21 bp, Homo sapiens
tatctgcaggcagacacggat

SEQ ID NO: 1235295 - DNA, 15 bp, Homo sapiens
tatctgcatgtgtca

SEQ ID NO: 1235296 - DNA, 17 bp, Homo sapiens
tatctgcatgtgtcatg

SEQ ID NO: 1235297 - DNA, 13 bp, Homo sapiens
tatctgcctggcc

SEQ ID NO: 1235298 - DNA, 20 bp, Homo sapiens
tatctggaagttgagactta

SEQ ID NO: 1235299 - DNA, 23 bp, Homo sapiens
tatctggaggccttccagctgct

SEQ ID NO: 1235300 - DNA, 18 bp, Homo sapiens
tatctggattcaaattta

SEQ ID NO: 1235301 - DNA, 13 bp, Homo sapiens
tatctggcactgt

SEQ ID NO: 1235302 - DNA, 15 bp, Homo sapiens
tatctggcctctgct

SEQ ID NO: 1235303 - DNA, 16 bp, Homo sapiens
tatctggcgttctttg

SEQ ID NO: 1235304 - DNA, 23 bp, Homo sapiens
tatctgggattatggttttgtga

SEQ ID NO: 1235305 - DNA, 21 bp, Homo sapiens
tatctgggattattctttgaa

SEQ ID NO: 1235306 - DNA, 17 bp, Homo sapiens
tatctggggagctcctg

SEQ ID NO: 1235307 - DNA, 21 bp, Homo sapiens
tatctggggagctcctggcca

SEQ ID NO: 1235308 - DNA, 17 bp, Homo sapiens
tatctgggttaagtgtt

SEQ ID NO: 1235309 - DNA, 19 bp, Homo sapiens
tatctggtatatgtcatta

SEQ ID NO: 1235310 - DNA, 19 bp, Homo sapiens
tatctggtattaaatgcca

SEQ ID NO: 1235311 - DNA, 18 bp, Homo sapiens
tatctggtgcctcctcaa

SEQ ID NO: 1235312 - DNA, 20 bp, Homo sapiens
tatctgtaattaatattcct

SEQ ID NO: 1235313 - DNA, 17 bp, Homo sapiens
tatctgtcacaataaat

SEQ ID NO: 1235314 - DNA, 18 bp, Homo sapiens
tatctgtcatatagtaaa

SEQ ID NO: 1235315 - DNA, 15 bp, Homo sapiens
tatctgtctttccac

SEQ ID NO: 1235316 - DNA, 20 bp, Homo sapiens
tatctgtgcttctaatatta

SEQ ID NO: 1235317 - DNA, 21 bp, Homo sapiens
tatctgtggagttcctgctcc

SEQ ID NO: 1235318 - DNA, 22 bp, Homo sapiens
tatctgtggagttcctgctccg

SEQ ID NO: 1235319 - DNA, 11 bp, Homo sapiens
tatctgtggga

SEQ ID NO: 1235320 - DNA, 15 bp, Homo sapiens
tatctgttgccttat

SEQ ID NO: 1235321 - DNA, 20 bp, Homo sapiens
tatcttaatatatacatttt

SEQ ID NO: 1235322 - DNA, 15 bp, Homo sapiens
tatcttataactgtt

SEQ ID NO: 1235323 - DNA, 18 bp, Homo sapiens
tatcttatactgtacaat

SEQ ID NO: 1235324 - DNA, 13 bp, Homo sapiens
tatcttcaaactt

SEQ ID NO: 1235325 - DNA, 14 bp, Homo sapiens
tatcttcaaacttt

SEQ ID NO: 1235326 - DNA, 18 bp, Homo sapiens
tatcttcaaactttcact

SEQ ID NO: 1235327 - DNA, 20 bp, Homo sapiens
tatcttcaccctcatccttt

SEQ ID NO: 1235328 - DNA, 16 bp, Homo sapiens
tatcttcatgtaaatt

SEQ ID NO: 1235329 - DNA, 23 bp, Homo sapiens
tatcttcgttagtaatctgtata

SEQ ID NO: 1235330 - DNA, 19 bp, Homo sapiens
tatcttctttattattcct

SEQ ID NO: 1235331 - DNA, 15 bp, Homo sapiens
tatcttctttcctca

SEQ ID NO: 1235332 - DNA, 20 bp, Homo sapiens
tatcttgaaacttgtgaaat

SEQ ID NO: 1235333 - DNA, 16 bp, Homo sapiens
tatcttgatacattca

SEQ ID NO: 1235334 - DNA, 18 bp, Homo sapiens
tatcttgatacattcaaa

SEQ ID NO: 1235335 - DNA, 17 bp, Homo sapiens
tatcttggacaaatcac

SEQ ID NO: 1235336 - DNA, 11 bp, Homo sapiens
tatcttggcct

SEQ ID NO: 1235337 - DNA, 12 bp, Homo sapiens
tatcttgggtgt

SEQ ID NO: 1235338 - DNA, 23 bp, Homo sapiens
tatcttgggtgtattctctgtaa

SEQ ID NO: 1235339 - DNA, 15 bp, Homo sapiens
tatcttgtctctggg

SEQ ID NO: 1235340 - DNA, 17 bp, Homo sapiens
tatcttgtctctgggct

SEQ ID NO: 1235341 - DNA, 12 bp, Homo sapiens
tatcttgtgctt

SEQ ID NO: 1235342 - DNA, 14 bp, Homo sapiens
tatctttatacaga

SEQ ID NO: 1235343 - DNA, 14 bp, Homo sapiens
tatctttattaatc

SEQ ID NO: 1235344 - DNA, 22 bp, Homo sapiens
tatgaaaaacatcccaaacttt

SEQ ID NO: 1235345 - DNA, 15 bp, Homo sapiens
tatgaaaaagaagaa

SEQ ID NO: 1235346 - DNA, 13 bp, Homo sapiens
tatgaaaaatgta

SEQ ID NO: 1235347 - DNA, 16 bp, Homo sapiens
tatgaaaaatgtaaat

SEQ ID NO: 1235348 - DNA, 19 bp, Homo sapiens
tatgaaaaattggggagga

SEQ ID NO: 1235349 - DNA, 21 bp, Homo sapiens
tatgaaaaccaaattttaaaa

SEQ ID NO: 1235350 - DNA, 19 bp, Homo sapiens
tatgaaaagctagaattga

SEQ ID NO: 1235351 - DNA, 12 bp, Homo sapiens
tatgaaaagtgg

SEQ ID NO: 1235352 - DNA, 19 bp, Homo sapiens
tatgaaaatgagcatcaga

SEQ ID NO: 1235353 - DNA, 16 bp, Homo sapiens
tatgaaaatgagccct

SEQ ID NO: 1235354 - DNA, 17 bp, Homo sapiens
tatgaaaatgagccctg

SEQ ID NO: 1235355 - DNA, 14 bp, Homo sapiens
tatgaaaatggaaa

SEQ ID NO: 1235356 - DNA, 16 bp, Homo sapiens
tatgaaacatatcatg

SEQ ID NO: 1235357 - DNA, 14 bp, Homo sapiens
tatgaaataaaaag

SEQ ID NO: 1235358 - DNA, 19 bp, Homo sapiens
tatgaaataaagaaattgc

SEQ ID NO: 1235359 - DNA, 16 bp, Homo sapiens
tatgaaatatatgtga

SEQ ID NO: 1235360 - DNA, 14 bp, Homo sapiens
tatgaacaacagta

SEQ ID NO: 1235361 - DNA, 22 bp, Homo sapiens
tatgaacacagacaaagtgcta

SEQ ID NO: 1235362 - DNA, 23 bp, Homo sapiens
tatgaacacagacaaagtgctat

SEQ ID NO: 1235363 - DNA, 17 bp, Homo sapiens
tatgaacacttaaatta

SEQ ID NO: 1235364 - DNA, 10 bp, Homo sapiens
tatgaacaga

SEQ ID NO: 1235365 - DNA, 14 bp, Homo sapiens
tatgaacagctgtg

SEQ ID NO: 1235366 - DNA, 21 bp, Homo sapiens
tatgaacagggcccaggcctg

SEQ ID NO: 1235367 - DNA, 13 bp, Homo sapiens
tatgaacattgta

SEQ ID NO: 1235368 - DNA, 15 bp, Homo sapiens
tatgaacattgtact

SEQ ID NO: 1235369 - DNA, 23 bp, Homo sapiens
tatgaacattgtactgttgcttt

SEQ ID NO: 1235370 - DNA, 15 bp, Homo sapiens
tatgaacctattttc

SEQ ID NO: 1235371 - DNA, 17 bp, Homo sapiens
tatgaacctattttcat

SEQ ID NO: 1235372 - DNA, 21 bp, Homo sapiens
tatgaacctattttcatttgt

SEQ ID NO: 1235373 - DNA, 20 bp, Homo sapiens
tatgaacttgagatctgtat

SEQ ID NO: 1235374 - DNA, 14 bp, Homo sapiens
tatgaagaactgag

SEQ ID NO: 1235375 - DNA, 15 bp, Homo sapiens
tatgaagagctgtct

SEQ ID NO: 1235376 - DNA, 21 bp, Homo sapiens
tatgaagagctgtcttcccct

SEQ ID NO: 1235377 - DNA, 13 bp, Homo sapiens
tatgaagcctttg

SEQ ID NO: 1235378 - DNA, 18 bp, Homo sapiens
tatgaagcctttggtgaa

SEQ ID NO: 1235379 - DNA, 23 bp, Homo sapiens
tatgaatatgatccctaatgtgt

SEQ ID NO: 1235380 - DNA, 21 bp, Homo sapiens
tatgaatctatgccaaagatc

SEQ ID NO: 1235381 - DNA, 19 bp, Homo sapiens
tatgaatgcccccagctgg

SEQ ID NO: 1235382 - DNA, 13 bp, Homo sapiens
tatgaatgtcaca

SEQ ID NO: 1235383 - DNA, 14 bp, Homo sapiens
tatgaatgtcacat

SEQ ID NO: 1235384 - DNA, 14 bp, Homo sapiens
tatgaattattcaa

SEQ ID NO: 1235385 - DNA, 18 bp, Homo sapiens
tatgaattattcaattta

SEQ ID NO: 1235386 - DNA, 18 bp, Homo sapiens
tatgaattcaagaaagga

SEQ ID NO: 1235387 - DNA, 19 bp, Homo sapiens
tatgaattgtctaaagtta

SEQ ID NO: 1235388 - DNA, 15 bp, Homo sapiens
tatgaatttaaatat

SEQ ID NO: 1235389 - DNA, 17 bp, Homo sapiens
tatgaatttaaatataa

SEQ ID NO: 1235390 - DNA, 20 bp, Homo sapiens
tatgaatttaaatataattc

SEQ ID NO: 1235391 - DNA, 21 bp, Homo sapiens
tatgaatttaaatataattct

SEQ ID NO: 1235392 - DNA, 16 bp, Homo sapiens
tatgacaaattcaaga

SEQ ID NO: 1235393 - DNA, 12 bp, Homo sapiens
tatgacacatgc

SEQ ID NO: 1235394 - DNA, 15 bp, Homo sapiens
tatgacagttatact

SEQ ID NO: 1235395 - DNA, 21 bp, Homo sapiens
tatgacataagcaatcatttt

SEQ ID NO: 1235396 - DNA, 22 bp, Homo sapiens
tatgacataagcaatcatttta

SEQ ID NO: 1235397 - DNA, 12 bp, Homo sapiens
tatgacatttaa

SEQ ID NO: 1235398 - DNA, 22 bp, Homo sapiens
tatgacatttaaatgtaactta

SEQ ID NO: 1235399 - DNA, 22 bp, Homo sapiens
tatgaccaaaattttaagtagg

SEQ ID NO: 1235400 - DNA, 14 bp, Homo sapiens
tatgacccacactg

SEQ ID NO: 1235401 - DNA, 15 bp, Homo sapiens
tatgacctaagtcag

SEQ ID NO: 1235402 - DNA, 23 bp, Homo sapiens
tatgacgcggctcaaaaggaaac

SEQ ID NO: 1235403 - DNA, 19 bp, Homo sapiens
tatgacggaagaacataga

SEQ ID NO: 1235404 - DNA, 12 bp, Homo sapiens
tatgactaaaga

SEQ ID NO: 1235405 - DNA, 13 bp, Homo sapiens
tatgactaaagag

SEQ ID NO: 1235406 - DNA, 15 bp, Homo sapiens
tatgactaaagagag

SEQ ID NO: 1235407 - DNA, 19 bp, Homo sapiens
tatgactaaagagagaatg

SEQ ID NO: 1235408 - DNA, 17 bp, Homo sapiens
tatgactgctccccagc

SEQ ID NO: 1235409 - DNA, 18 bp, Homo sapiens
tatgactgctccccagcc

SEQ ID NO: 1235410 - DNA, 16 bp, Homo sapiens
tatgagacaggaaaaa

SEQ ID NO: 1235411 - DNA, 22 bp, Homo sapiens
tatgagacagggtcttgctctg

SEQ ID NO: 1235412 - DNA, 15 bp, Homo sapiens
tatgagactttatgt

SEQ ID NO: 1235413 - DNA, 21 bp, Homo sapiens
tatgagatggccatgctcaac

SEQ ID NO: 1235414 - DNA, 21 bp, Homo sapiens
tatgagatggttaaaaaggcc

SEQ ID NO: 1235415 - DNA, 13 bp, Homo sapiens
tatgagcatcctg

SEQ ID NO: 1235416 - DNA, 21 bp, Homo sapiens
tatgagcctgccctcactccc

SEQ ID NO: 1235417 - DNA, 12 bp, Homo sapiens
tatgagctgagg

SEQ ID NO: 1235418 - DNA, 12 bp, Homo sapiens
tatgagcttcaa

SEQ ID NO: 1235419 - DNA, 14 bp, Homo sapiens
tatgagcttcaata

SEQ ID NO: 1235420 - DNA, 17 bp, Homo sapiens
tatgaggacaaggtata

SEQ ID NO: 1235421 - DNA, 15 bp, Homo sapiens
tatgaggcatttgtt

SEQ ID NO: 1235422 - DNA, 15 bp, Homo sapiens
tatgagggaaaatga

SEQ ID NO: 1235423 - DNA, 16 bp, Homo sapiens
tatgaggtcctcaggt

SEQ ID NO: 1235424 - DNA, 16 bp, Homo sapiens
tatgagtcaatgtgca

SEQ ID NO: 1235425 - DNA, 12 bp, Homo sapiens
tatgagttcttc

SEQ ID NO: 1235426 - DNA, 15 bp, Homo sapiens
tatgagttcttcgta

SEQ ID NO: 1235427 - DNA, 23 bp, Homo sapiens
tatgagtttttgatagctttatt

SEQ ID NO: 1235428 - DNA, 17 bp, Homo sapiens
tatgataaagttgtaaa

SEQ ID NO: 1235429 - DNA, 21 bp, Homo sapiens
tatgataaagttgtaaataat

SEQ ID NO: 1235430 - DNA, 20 bp, Homo sapiens
tatgatagcgggaaaaggag

SEQ ID NO: 1235431 - DNA, 24 bp, Homo sapiens
tatgataggttattttgatgtaaa

SEQ ID NO: 1235432 - DNA, 22 bp, Homo sapiens
tatgatattccccatttcctgt

SEQ ID NO: 1235433 - DNA, 23 bp, Homo sapiens
tatgatattgtttaaaattcagt

SEQ ID NO: 1235434 - DNA, 19 bp, Homo sapiens
tatgatatttcttgctttc

SEQ ID NO: 1235435 - DNA, 17 bp, Homo sapiens
tatgatcagaagaacat

SEQ ID NO: 1235436 - DNA, 16 bp, Homo sapiens
tatgatcagtgttact

SEQ ID NO: 1235437 - DNA, 17 bp, Homo sapiens
tatgatcagtgttactg

SEQ ID NO: 1235438 - DNA, 14 bp, Homo sapiens
tatgatccagagca

SEQ ID NO: 1235439 - DNA, 19 bp, Homo sapiens
tatgatccttttttgtcat

SEQ ID NO: 1235440 - DNA, 15 bp, Homo sapiens
tatgatcgcgccact

SEQ ID NO: 1235441 - DNA, 13 bp, Homo sapiens
tatgatctaatac

SEQ ID NO: 1235442 - DNA, 17 bp, Homo sapiens
tatgatgcatacagttt

SEQ ID NO: 1235443 - DNA, 19 bp, Homo sapiens
tatgatgctaatcttgtcc

SEQ ID NO: 1235444 - DNA, 13 bp, Homo sapiens
tatgatggatggc

SEQ ID NO: 1235445 - DNA, 21 bp, Homo sapiens
tatgatggatggcagactctt

SEQ ID NO: 1235446 - DNA, 20 bp, Homo sapiens
tatgatggcaggagaatcag

SEQ ID NO: 1235447 - DNA, 20 bp, Homo sapiens
tatgatgggcttctgttctc

SEQ ID NO: 1235448 - DNA, 17 bp, Homo sapiens
tatgatgtaatctctct

SEQ ID NO: 1235449 - DNA, 18 bp, Homo sapiens
tatgatgtgttgtgatag

SEQ ID NO: 1235450 - DNA, 14 bp, Homo sapiens
tatgatgttaaaaa

SEQ ID NO: 1235451 - DNA, 17 bp, Homo sapiens
tatgatgttagaagaag

SEQ ID NO: 1235452 - DNA, 15 bp, Homo sapiens
tatgattactggcct

SEQ ID NO: 1235453 - DNA, 21 bp, Homo sapiens
tatgattattaacgatgtcca

SEQ ID NO: 1235454 - DNA, 14 bp, Homo sapiens
tatgattctgcttt

SEQ ID NO: 1235455 - DNA, 19 bp, Homo sapiens
tatgattggttcagttttt

SEQ ID NO: 1235456 - DNA, 17 bp, Homo sapiens
tatgatttaaaaacaac

SEQ ID NO: 1235457 - DNA, 19 bp, Homo sapiens
tattaacaattaattgtct

SEQ ID NO: 1235458 - DNA, 13 bp, Homo sapiens
tattaacatacct

SEQ ID NO: 1235459 - DNA, 18 bp, Homo sapiens
tattaacatattctaaat

SEQ ID NO: 1235460 - DNA, 13 bp, Homo sapiens
tattaacttttaa

SEQ ID NO: 1235461 - DNA, 16 bp, Homo sapiens
tattaacttttaatgg

SEQ ID NO: 1235462 - DNA, 16 bp, Homo sapiens
tattaagaaagactat

SEQ ID NO: 1235463 - DNA, 13 bp, Homo sapiens
tattaagaaagga

SEQ ID NO: 1235464 - DNA, 21 bp, Homo sapiens
tattaagaaaggaagcattgt

SEQ ID NO: 1235465 - DNA, 20 bp, Homo sapiens
tattaagaagcaataactat

SEQ ID NO: 1235466 - DNA, 21 bp, Homo sapiens
tattaagaatcttagataact

SEQ ID NO: 1235467 - DNA, 21 bp, Homo sapiens
tattaagacaatagcacttaa

SEQ ID NO: 1235468 - DNA, 18 bp, Homo sapiens
tattaagacagtgtacaa

SEQ ID NO: 1235469 - DNA, 22 bp, Homo sapiens
tattatgtcctgtgagatgtgt

SEQ ID NO: 1235470 - DNA, 21 bp, Homo sapiens
tattatgtctcttctgagcta

SEQ ID NO: 1235471 - DNA, 20 bp, Homo sapiens
tattatgtttgatttctcta

SEQ ID NO: 1235472 - DNA, 14 bp, Homo sapiens
tattattaatttat

SEQ ID NO: 1235473 - DNA, 21 bp, Homo sapiens
tattattaccagcatttgtcc

SEQ ID NO: 1235474 - DNA, 19 bp, Homo sapiens
tattattactctacactga

SEQ ID NO: 1235475 - DNA, 19 bp, Homo sapiens
tattattagaaattagaaa

SEQ ID NO: 1235476 - DNA, 15 bp, Homo sapiens
tattattataatctt

SEQ ID NO: 1235477 - DNA, 22 bp, Homo sapiens
tattattataatcttataattg

SEQ ID NO: 1235478 - DNA, 13 bp, Homo sapiens
tattattatatat

SEQ ID NO: 1235479 - DNA, 14 bp, Homo sapiens
tattattatatata

SEQ ID NO: 1235480 - DNA, 16 bp, Homo sapiens
tattattattaaagaa

SEQ ID NO: 1235481 - DNA, 22 bp, Homo sapiens
tattattcaaaccaatttcttc

SEQ ID NO: 1235482 - DNA, 17 bp, Homo sapiens
tattattcatcttttca

SEQ ID NO: 1235483 - DNA, 22 bp, Homo sapiens
tattattcctagtctttccagt

SEQ ID NO: 1235484 - DNA, 14 bp, Homo sapiens
tattattctgtttt

SEQ ID NO: 1235485 - DNA, 23 bp, Homo sapiens
tattattctgttttgcacagtta

SEQ ID NO: 1235486 - DNA, 14 bp, Homo sapiens
tattattgaaattg

SEQ ID NO: 1235487 - DNA, 23 bp, Homo sapiens
tattatttacatcactttgtgaa

SEQ ID NO: 1235488 - DNA, 18 bp, Homo sapiens
tattatttattgtattag

SEQ ID NO: 1235489 - DNA, 16 bp, Homo sapiens
tattatttcaatgtga

SEQ ID NO: 1235490 - DNA, 22 bp, Homo sapiens
tattatttctgttcttacaaat

SEQ ID NO: 1235491 - DNA, 13 bp, Homo sapiens
tattatttcttct

SEQ ID NO: 1235492 - DNA, 15 bp, Homo sapiens
tattatttcttctct

SEQ ID NO: 1235493 - DNA, 13 bp, Homo sapiens
tattatttgatat

SEQ ID NO: 1235494 - DNA, 14 bp, Homo sapiens
tattatttgatatc

SEQ ID NO: 1235495 - DNA, 16 bp, Homo sapiens
tattatttgatatctg

SEQ ID NO: 1235496 - DNA, 20 bp, Homo sapiens
tattatttgcagtgcagtat

SEQ ID NO: 1235497 - DNA, 15 bp, Homo sapiens
tattatttggagtta

SEQ ID NO: 1235498 - DNA, 14 bp, Homo sapiens
tattatttgtctta

SEQ ID NO: 1235499 - DNA, 22 bp, Homo sapiens
tattattttaattttttctctt

SEQ ID NO: 1235500 - DNA, 13 bp, Homo sapiens
tattattttactg

SEQ ID NO: 1235501 - DNA, 15 bp, Homo sapiens
tattattttcacctg

SEQ ID NO: 1235502 - DNA, 22 bp, Homo sapiens
tattatttttacctaaagacgt

SEQ ID NO: 1235503 - DNA, 19 bp, Homo sapiens
tattatttttttaaacaaa

SEQ ID NO: 1235504 - DNA, 23 bp, Homo sapiens
tattcaaaaattatctatagcta

SEQ ID NO: 1235505 - DNA, 19 bp, Homo sapiens
tattcaaaccaatttcttc

SEQ ID NO: 1235506 - DNA, 21 bp, Homo sapiens
tattcaaaccaatttcttcct

SEQ ID NO: 1235507 - DNA, 18 bp, Homo sapiens
tattcaaagcagcagcca

SEQ ID NO: 1235508 - DNA, 18 bp, Homo sapiens
tattcaacaatttcaata

SEQ ID NO: 1235509 - DNA, 17 bp, Homo sapiens
tattcaagaatgaaaaa

SEQ ID NO: 1235510 - DNA, 17 bp, Homo sapiens
tattcaagcaaacatca

SEQ ID NO: 1235511 - DNA, 16 bp, Homo sapiens
tattcaagtaacactt

SEQ ID NO: 1235512 - DNA, 17 bp, Homo sapiens
tattcaagtaacacttt

SEQ ID NO: 1235513 - DNA, 17 bp, Homo sapiens
tattcaagtgcctcttg

SEQ ID NO: 1235514 - DNA, 20 bp, Homo sapiens
tattcaagttattgtacagc

SEQ ID NO: 1235515 - DNA, 22 bp, Homo sapiens
tattcaataccgctcagtattt

SEQ ID NO: 1235516 - DNA, 23 bp, Homo sapiens
tattcacagaaagctagatatgc

SEQ ID NO: 1235517 - DNA, 16 bp, Homo sapiens
tattcaccctccactt

SEQ ID NO: 1235518 - DNA, 23 bp, Homo sapiens
tattcacgccattggttggaagc

SEQ ID NO: 1235519 - DNA, 14 bp, Homo sapiens
tattcactgtaagt

SEQ ID NO: 1235520 - DNA, 15 bp, Homo sapiens
tattcagaactattt

SEQ ID NO: 1235521 - DNA, 22 bp, Homo sapiens
tattcagaactatttaaaataa

SEQ ID NO: 1235522 - DNA, 14 bp, Homo sapiens
tattcagataatta

SEQ ID NO: 1235523 - DNA, 19 bp, Homo sapiens
tattcagccagcttaaacc

SEQ ID NO: 1235524 - DNA, 19 bp, Homo sapiens
tattcagctagaatttctg

SEQ ID NO: 1235525 - DNA, 17 bp, Homo sapiens
tattcagcttcatttgt

SEQ ID NO: 1235526 - DNA, 18 bp, Homo sapiens
tattcaggcactgagaat

SEQ ID NO: 1235527 - DNA, 15 bp, Homo sapiens
tattcagtgctgtgg

SEQ ID NO: 1235528 - DNA, 18 bp, Homo sapiens
tattcagtgctgtggcct

SEQ ID NO: 1235529 - DNA, 14 bp, Homo sapiens
tattcatgccatct

SEQ ID NO: 1235530 - DNA, 20 bp, Homo sapiens
tattcattaagtaatctttt

SEQ ID NO: 1235531 - DNA, 14 bp, Homo sapiens
tattcattattcct

SEQ ID NO: 1235532 - DNA, 19 bp, Homo sapiens
tattcattctgcattgcta

SEQ ID NO: 1235533 - DNA, 15 bp, Homo sapiens
tattcatttaaaatg

SEQ ID NO: 1235534 - DNA, 16 bp, Homo sapiens
tattcattttctctaa

SEQ ID NO: 1235535 - DNA, 16 bp, Homo sapiens
tattcattttgcttct

SEQ ID NO: 1235536 - DNA, 21 bp, Homo sapiens
tattccaaaaaggttgctgtt

SEQ ID NO: 1235537 - DNA, 22 bp, Homo sapiens
tattccaacccagccacgactg

SEQ ID NO: 1235538 - DNA, 14 bp, Homo sapiens
tattccaaggaaaa

SEQ ID NO: 1235539 - DNA, 19 bp, Homo sapiens
tattccaaggaaaattgaa

SEQ ID NO: 1235540 - DNA, 16 bp, Homo sapiens
tattccaccattcaca

SEQ ID NO: 1235541 - DNA, 18 bp, Homo sapiens
tattccaccttaaattaa

SEQ ID NO: 1235542 - DNA, 19 bp, Homo sapiens
tattccaccttaaattaaa

SEQ ID NO: 1235543 - DNA, 22 bp, Homo sapiens
tattccaccttaaattaaacaa

SEQ ID NO: 1235544 - DNA, 16 bp, Homo sapiens
tattccagaagaacaa

SEQ ID NO: 1235545 - DNA, 13 bp, Homo sapiens
tattccaggagaa

SEQ ID NO: 1235546 - DNA, 16 bp, Homo sapiens
tattccatgagctgct

SEQ ID NO: 1235547 - DNA, 15 bp, Homo sapiens
tattcccaagtatgc

SEQ ID NO: 1235548 - DNA, 20 bp, Homo sapiens
tattcccaagtatgccttaa

SEQ ID NO: 1235549 - DNA, 16 bp, Homo sapiens
tattccctcatccttt

SEQ ID NO: 1235550 - DNA, 22 bp, Homo sapiens
tattcccttaactctaaccctg

SEQ ID NO: 1235551 - DNA, 14 bp, Homo sapiens
tattcccttgtatt

SEQ ID NO: 1235552 - DNA, 21 bp, Homo sapiens
tattcctagtggatgactgtt

SEQ ID NO: 1235553 - DNA, 20 bp, Homo sapiens
tattcctatatagtttattg

SEQ ID NO: 1235554 - DNA, 16 bp, Homo sapiens
tattcctcaaaaaatt

SEQ ID NO: 1235555 - DNA, 19 bp, Homo sapiens
tattcctcagattgctgaa

SEQ ID NO: 1235556 - DNA, 18 bp, Homo sapiens
tattcctcctgctcatat

SEQ ID NO: 1235557 - DNA, 21 bp, Homo sapiens
tattcctgcatttgtgaaatg

SEQ ID NO: 1235558 - DNA, 19 bp, Homo sapiens
tattcctgtaaataagagt

SEQ ID NO: 1235559 - DNA, 12 bp, Homo sapiens
tattcctttgaa

SEQ ID NO: 1235560 - DNA, 20 bp, Homo sapiens
tattccttttgtgtacagtg

SEQ ID NO: 1235561 - DNA, 21 bp, Homo sapiens
tattccttttgtgtacagtgt

SEQ ID NO: 1235562 - DNA, 23 bp, Homo sapiens
tattcggcatttaacttacattt

SEQ ID NO: 1235563 - DNA, 15 bp, Homo sapiens
tattctaaaaccatt

SEQ ID NO: 1235564 - DNA, 18 bp, Homo sapiens
tattctaagttagactct

SEQ ID NO: 1235565 - DNA, 17 bp, Homo sapiens
tattctacacatgtaaa

SEQ ID NO: 1235566 - DNA, 22 bp, Homo sapiens
tattctacacatgtaaaatatg

SEQ ID NO: 1235567 - DNA, 15 bp, Homo sapiens
tattctacatttcac

SEQ ID NO: 1235568 - DNA, 19 bp, Homo sapiens
tattctactgtactttttt

SEQ ID NO: 1235569 - DNA, 16 bp, Homo sapiens
tattctagcctgcatt

SEQ ID NO: 1235570 - DNA, 21 bp, Homo sapiens
tattctagcctgcattgagct

SEQ ID NO: 1235571 - DNA, 17 bp, Homo sapiens
tattctatatgaattta

SEQ ID NO: 1235572 - DNA, 19 bp, Homo sapiens
tattctatatgaatttaaa

SEQ ID NO: 1235573 - DNA, 14 bp, Homo sapiens
tattctattctaat

SEQ ID NO: 1235574 - DNA, 22 bp, Homo sapiens
tattctattgtattatttggag

SEQ ID NO: 1235575 - DNA, 18 bp, Homo sapiens
tattctcaaagatgcatt

SEQ ID NO: 1235576 - DNA, 16 bp, Homo sapiens
tattctcaaagcagga

SEQ ID NO: 1235577 - DNA, 14 bp, Homo sapiens
tattctcaccagga

SEQ ID NO: 1235578 - DNA, 15 bp, Homo sapiens
tattctcaccaggaa

SEQ ID NO: 1235579 - DNA, 16 bp, Homo sapiens
tattctcactccacca

SEQ ID NO: 1235580 - DNA, 22 bp, Homo sapiens
tattctcactccaccacccaaa

SEQ ID NO: 1235581 - DNA, 15 bp, Homo sapiens
tattctcagagcatg

SEQ ID NO: 1235582 - DNA, 18 bp, Homo sapiens
tattctcagagcatgtgt

SEQ ID NO: 1235583 - DNA, 23 bp, Homo sapiens
tattctcataggagactgcgtca

SEQ ID NO: 1235584 - DNA, 18 bp, Homo sapiens
tattctcattatgttgat

SEQ ID NO: 1235585 - DNA, 13 bp, Homo sapiens
tattctctctatg

SEQ ID NO: 1235586 - DNA, 19 bp, Homo sapiens
tattctctgagctgtgcag

SEQ ID NO: 1235587 - DNA, 17 bp, Homo sapiens
tattctgacatgtaaga

SEQ ID NO: 1235588 - DNA, 12 bp, Homo sapiens
tattctgagcct

SEQ ID NO: 1235589 - DNA, 14 bp, Homo sapiens
tattctgattccac

SEQ ID NO: 1235590 - DNA, 12 bp, Homo sapiens
tattctggaaaa

SEQ ID NO: 1235591 - DNA, 20 bp, Homo sapiens
tattctggaaaaaaaatata

SEQ ID NO: 1235592 - DNA, 18 bp, Homo sapiens
tattctgtcagtgttaaa

SEQ ID NO: 1235593 - DNA, 13 bp, Homo sapiens
tattgtacagttt

SEQ ID NO: 1235594 - DNA, 14 bp, Homo sapiens
tattgtacagtttt

SEQ ID NO: 1235595 - DNA, 11 bp, Homo sapiens
tattgtacata

SEQ ID NO: 1235596 - DNA, 22 bp, Homo sapiens
tattgtacataaaagaattttt

SEQ ID NO: 1235597 - DNA, 17 bp, Homo sapiens
tattgtaccattttcta

SEQ ID NO: 1235598 - DNA, 14 bp, Homo sapiens
tattgtacctctct

SEQ ID NO: 1235599 - DNA, 16 bp, Homo sapiens
tattgtagcatttctt

SEQ ID NO: 1235600 - DNA, 15 bp, Homo sapiens
tattgtataaaaagt

SEQ ID NO: 1235601 - DNA, 16 bp, Homo sapiens
tattgtatattacaat

SEQ ID NO: 1235602 - DNA, 17 bp, Homo sapiens
tattgtattatttggag

SEQ ID NO: 1235603 - DNA, 22 bp, Homo sapiens
tattgtcaacactatataaata

SEQ ID NO: 1235604 - DNA, 23 bp, Homo sapiens
tattgtcagccatcgtcctggga

SEQ ID NO: 1235605 - DNA, 18 bp, Homo sapiens
tattgtcatctttttcta

SEQ ID NO: 1235606 - DNA, 20 bp, Homo sapiens
tattgtcatctttttctaga

SEQ ID NO: 1235607 - DNA, 21 bp, Homo sapiens
tattgtcatggggatcaattt

SEQ ID NO: 1235608 - DNA, 17 bp, Homo sapiens
tattgtcattaaaggta

SEQ ID NO: 1235609 - DNA, 19 bp, Homo sapiens
tattgtcgctatgtgactt

SEQ ID NO: 1235610 - DNA, 19 bp, Homo sapiens
tattgtctactctgaagac

SEQ ID NO: 1235611 - DNA, 14 bp, Homo sapiens
tattgtctgtaaat

SEQ ID NO: 1235612 - DNA, 19 bp, Homo sapiens
tattgtgaagtacatatta

SEQ ID NO: 1235613 - DNA, 13 bp, Homo sapiens
tattgtgaatatt

SEQ ID NO: 1235614 - DNA, 20 bp, Homo sapiens
tattgtgaatatttggaatt

SEQ ID NO: 1235615 - DNA, 16 bp, Homo sapiens
tattgtgacttcactg

SEQ ID NO: 1235616 - DNA, 17 bp, Homo sapiens
tattgtgacttcactgt

SEQ ID NO: 1235617 - DNA, 19 bp, Homo sapiens
tattgtgacttcactgtat

SEQ ID NO: 1235618 - DNA, 13 bp, Homo sapiens
tattgtgattacg

SEQ ID NO: 1235619 - DNA, 23 bp, Homo sapiens
tattgtgattacgtgtatgtttc

SEQ ID NO: 1235620 - DNA, 16 bp, Homo sapiens
tattgtgattctgttt

SEQ ID NO: 1235621 - DNA, 17 bp, Homo sapiens
tattgtgctcagagaca

SEQ ID NO: 1235622 - DNA, 22 bp, Homo sapiens
tattgtgctgggtcccagcctg

SEQ ID NO: 1235623 - DNA, 16 bp, Homo sapiens
tattgtgtttgtgtat

SEQ ID NO: 1235624 - DNA, 15 bp, Homo sapiens
tattgttagaaaatg

SEQ ID NO: 1235625 - DNA, 19 bp, Homo sapiens
tattgttagggtcagccat

SEQ ID NO: 1235626 - DNA, 20 bp, Homo sapiens
tattgttagggtcagccatt

SEQ ID NO: 1235627 - DNA, 21 bp, Homo sapiens
tattgttagggtcagccattt

SEQ ID NO: 1235628 - DNA, 17 bp, Homo sapiens
tattgttccaagacatt

SEQ ID NO: 1235629 - DNA, 21 bp, Homo sapiens
tattgttcccagtgacacttc

SEQ ID NO: 1235630 - DNA, 18 bp, Homo sapiens
tattgttcccctaagtgg

SEQ ID NO: 1235631 - DNA, 16 bp, Homo sapiens
tattgttctatttttg

SEQ ID NO: 1235632 - DNA, 17 bp, Homo sapiens
tattgttgcattgcttt

SEQ ID NO: 1235633 - DNA, 14 bp, Homo sapiens
tattgttgtccttt

SEQ ID NO: 1235634 - DNA, 22 bp, Homo sapiens
tattgtttattctttttaaagt

SEQ ID NO: 1235635 - DNA, 18 bp, Homo sapiens
tattgtttcaattgcatc

SEQ ID NO: 1235636 - DNA, 14 bp, Homo sapiens
tattgtttctagaa

SEQ ID NO: 1235637 - DNA, 12 bp, Homo sapiens
tattgtttctgc

SEQ ID NO: 1235638 - DNA, 14 bp, Homo sapiens
tattgtttgaaatg

SEQ ID NO: 1235639 - DNA, 18 bp, Homo sapiens
tattgtttgaaatgtcga

SEQ ID NO: 1235640 - DNA, 13 bp, Homo sapiens
tattgtttgctgt

SEQ ID NO: 1235641 - DNA, 20 bp, Homo sapiens
tattgttttcccaagtgtaa

SEQ ID NO: 1235642 - DNA, 18 bp, Homo sapiens
tattgtttttatttctag

SEQ ID NO: 1235643 - DNA, 14 bp, Homo sapiens
tatttaaaaaacta

SEQ ID NO: 1235644 - DNA, 20 bp, Homo sapiens
tatttaaaaaactaaaaact

SEQ ID NO: 1235645 - DNA, 16 bp, Homo sapiens
tatttaaaaaattaaa

SEQ ID NO: 1235646 - DNA, 17 bp, Homo sapiens
tatttaaaaaattaaaa

SEQ ID NO: 1235647 - DNA, 13 bp, Homo sapiens
tatttaaaaataa

SEQ ID NO: 1235648 - DNA, 17 bp, Homo sapiens
tatttaaaaataagtca

SEQ ID NO: 1235649 - DNA, 16 bp, Homo sapiens
tatttaaaaatatttc

SEQ ID NO: 1235650 - DNA, 19 bp, Homo sapiens
tatttaaaaatatttcaga

SEQ ID NO: 1235651 - DNA, 18 bp, Homo sapiens
tatttaaaaatatttttg

SEQ ID NO: 1235652 - DNA, 12 bp, Homo sapiens
tatttaaaaatg

SEQ ID NO: 1235653 - DNA, 13 bp, Homo sapiens
tatttaaaaatgt

SEQ ID NO: 1235654 - DNA, 18 bp, Homo sapiens
tatttaaaaatgtcttgc

SEQ ID NO: 1235655 - DNA, 22 bp, Homo sapiens
tatttaaaaattgtttcttgac

SEQ ID NO: 1235656 - DNA, 14 bp, Homo sapiens
tatttaaaactctg

SEQ ID NO: 1235657 - DNA, 12 bp, Homo sapiens
tatttaaaataa

SEQ ID NO: 1235658 - DNA, 14 bp, Homo sapiens
tatttaaaatagca

SEQ ID NO: 1235659 - DNA, 21 bp, Homo sapiens
tatttaaaatagcaaaagaag

SEQ ID NO: 1235660 - DNA, 19 bp, Homo sapiens
tatttaaaccgctaaaaga

SEQ ID NO: 1235661 - DNA, 17 bp, Homo sapiens
tatttaaactcaagaca

SEQ ID NO: 1235662 - DNA, 12 bp, Homo sapiens
tatttaaagaaa

SEQ ID NO: 1235663 - DNA, 20 bp, Homo sapiens
tatttaaagaagaaacgtct

SEQ ID NO: 1235664 - DNA, 17 bp, Homo sapiens
tatttaaagacaaagac

SEQ ID NO: 1235665 - DNA, 17 bp, Homo sapiens
tatttaaagatctttta

SEQ ID NO: 1235666 - DNA, 21 bp, Homo sapiens
tatttaaagctttcaacatgt

SEQ ID NO: 1235667 - DNA, 15 bp, Homo sapiens
tatttaaataaaatc

SEQ ID NO: 1235668 - DNA, 22 bp, Homo sapiens
tatttaaatattaaatatgtta

SEQ ID NO: 1235669 - DNA, 21 bp, Homo sapiens
tatttaaatgcatgtcttaaa

SEQ ID NO: 1235670 - DNA, 16 bp, Homo sapiens
tatttaaatgggaata

SEQ ID NO: 1235671 - DNA, 13 bp, Homo sapiens
tatttaaatgtga

SEQ ID NO: 1235672 - DNA, 14 bp, Homo sapiens
tatttaaattacaa

SEQ ID NO: 1235673 - DNA, 18 bp, Homo sapiens
tatttaactacatctgcc

SEQ ID NO: 1235674 - DNA, 21 bp, Homo sapiens
tatttaactgccttgtgtaca

SEQ ID NO: 1235675 - DNA, 22 bp, Homo sapiens
tatttaactggtgcactttgta

SEQ ID NO: 1235676 - DNA, 12 bp, Homo sapiens
tatttaactttt

SEQ ID NO: 1235677 - DNA, 13 bp, Homo sapiens
tatttaacttttt

SEQ ID NO: 1235678 - DNA, 14 bp, Homo sapiens
tatttaactttttt

SEQ ID NO: 1235679 - DNA, 21 bp, Homo sapiens
tatttaagaaaatacaataaa

SEQ ID NO: 1235680 - DNA, 13 bp, Homo sapiens
tatttaagactga

SEQ ID NO: 1235681 - DNA, 19 bp, Homo sapiens
tatttaagatgtacattta

SEQ ID NO: 1235682 - DNA, 18 bp, Homo sapiens
tatttaagcaacatcttt

SEQ ID NO: 1235683 - DNA, 20 bp, Homo sapiens
tatttaaggaatcaaatctt

SEQ ID NO: 1235684 - DNA, 21 bp, Homo sapiens
tatttaaggaatcaaatctta

SEQ ID NO: 1235685 - DNA, 18 bp, Homo sapiens
tatttaaggtagcttcag

SEQ ID NO: 1235686 - DNA, 17 bp, Homo sapiens
tatttaagtaaatacag

SEQ ID NO: 1235687 - DNA, 16 bp, Homo sapiens
tatttaagtatatagt

SEQ ID NO: 1235688 - DNA, 17 bp, Homo sapiens
tatttaagtatatagta

SEQ ID NO: 1235689 - DNA, 22 bp, Homo sapiens
tatttaagtatatagtatattt

SEQ ID NO: 1235690 - DNA, 15 bp, Homo sapiens
tatttaagttatcaa

SEQ ID NO: 1235691 - DNA, 19 bp, Homo sapiens
tatttaatagcaaagaatt

SEQ ID NO: 1235692 - DNA, 15 bp, Homo sapiens
tatttaatatgctta

SEQ ID NO: 1235693 - DNA, 14 bp, Homo sapiens
tatttaatatttaa

SEQ ID NO: 1235694 - DNA, 15 bp, Homo sapiens
tatttaatgaaagac

SEQ ID NO: 1235695 - DNA, 21 bp, Homo sapiens
tatttaatgaaagactgtaca

SEQ ID NO: 1235696 - DNA, 17 bp, Homo sapiens
tatttaatgcattaaac

SEQ ID NO: 1235697 - DNA, 22 bp, Homo sapiens
tatttaatgcattaaacctgtc

SEQ ID NO: 1235698 - DNA, 17 bp, Homo sapiens
tatttaatggaagtgta

SEQ ID NO: 1235699 - DNA, 18 bp, Homo sapiens
tatttaatgttttaaatg

SEQ ID NO: 1235700 - DNA, 21 bp, Homo sapiens
tatttaatgttttaaatgtac

SEQ ID NO: 1235701 - DNA, 11 bp, Homo sapiens
tatttaatttg

SEQ ID NO: 1235702 - DNA, 11 bp, Homo sapiens
tatttacaaga

SEQ ID NO: 1235703 - DNA, 14 bp, Homo sapiens
tatttacattttat

SEQ ID NO: 1235704 - DNA, 15 bp, Homo sapiens
tatttacattttata

SEQ ID NO: 1235705 - DNA, 23 bp, Homo sapiens
tatttacattttatatttttgta

SEQ ID NO: 1235706 - DNA, 17 bp, Homo sapiens
tatttacccctccccta

SEQ ID NO: 1235707 - DNA, 20 bp, Homo sapiens
tatttaccgttgcttgaaat

SEQ ID NO: 1235708 - DNA, 14 bp, Homo sapiens
tatttaccttgaaa

SEQ ID NO: 1235709 - DNA, 21 bp, Homo sapiens
tatttactaactaaataccat

SEQ ID NO: 1235710 - DNA, 17 bp, Homo sapiens
tatttactctttgcaaa

SEQ ID NO: 1235711 - DNA, 14 bp, Homo sapiens
tatttactgagctt

SEQ ID NO: 1235712 - DNA, 23 bp, Homo sapiens
tatttactgctctttattgcaga

SEQ ID NO: 1235713 - DNA, 18 bp, Homo sapiens
tatttacttcttatacat

SEQ ID NO: 1235714 - DNA, 17 bp, Homo sapiens
tatttagattgttaaaa

SEQ ID NO: 1235715 - DNA, 19 bp, Homo sapiens
tatttagattgttaaaata

SEQ ID NO: 1235716 - DNA, 11 bp, Homo sapiens
tatttagcatg

SEQ ID NO: 1235717 - DNA, 14 bp, Homo sapiens
tatttagctctgaa

SEQ ID NO: 1235718 - DNA, 17 bp, Homo sapiens
tatttagctttacatat

SEQ ID NO: 1235719 - DNA, 19 bp, Homo sapiens
tatttagggccttttctgt

SEQ ID NO: 1235720 - DNA, 18 bp, Homo sapiens
tatttagtaaagtttgtt

SEQ ID NO: 1235721 - DNA, 21 bp, Homo sapiens
tatttagtaaagtttgttgaa

SEQ ID NO: 1235722 - DNA, 23 bp, Homo sapiens
tatttagttacgtataatgcttt

SEQ ID NO: 1235723 - DNA, 17 bp, Homo sapiens
tatttagttatagtttc

SEQ ID NO: 1235724 - DNA, 13 bp, Homo sapiens
tatttataaaaat

SEQ ID NO: 1235725 - DNA, 15 bp, Homo sapiens
tatttataaaacttc

SEQ ID NO: 1235726 - DNA, 17 bp, Homo sapiens
tatttataaaacttctc

SEQ ID NO: 1235727 - DNA, 19 bp, Homo sapiens
tatttataaatatatttaa

SEQ ID NO: 1235728 - DNA, 20 bp, Homo sapiens
tatttataacaacctaaatt

SEQ ID NO: 1235729 - DNA, 14 bp, Homo sapiens
tatttataagcaga

SEQ ID NO: 1235730 - DNA, 12 bp, Homo sapiens
tatttatactct

SEQ ID NO: 1235731 - DNA, 15 bp, Homo sapiens
tatttatactctaga

SEQ ID NO: 1235732 - DNA, 17 bp, Homo sapiens
tatttatagtaaccatt

SEQ ID NO: 1235733 - DNA, 13 bp, Homo sapiens
tatttatatatat

SEQ ID NO: 1235734 - DNA, 14 bp, Homo sapiens
tatttatatatatg

SEQ ID NO: 1235735 - DNA, 16 bp, Homo sapiens
tatttatatatgtatt

SEQ ID NO: 1235736 - DNA, 13 bp, Homo sapiens
tatttatatattt

SEQ ID NO: 1235737 - DNA, 18 bp, Homo sapiens
tatttatatatttataac

SEQ ID NO: 1235738 - DNA, 13 bp, Homo sapiens
tatttatatcttg

SEQ ID NO: 1235739 - DNA, 13 bp, Homo sapiens
tatttatatttca

SEQ ID NO: 1235740 - DNA, 14 bp, Homo sapiens
tatttatatttcac

SEQ ID NO: 1235741 - DNA, 16 bp, Homo sapiens
tatttatatttcacta

SEQ ID NO: 1235742 - DNA, 14 bp, Homo sapiens
tatttatatttgga

SEQ ID NO: 1235743 - DNA, 16 bp, Homo sapiens
tatttatatttggaaa

SEQ ID NO: 1235744 - DNA, 16 bp, Homo sapiens
tatttatcaaaatgta

SEQ ID NO: 1235745 - DNA, 17 bp, Homo sapiens
tatttatcaaaatgtag

SEQ ID NO: 1235746 - DNA, 20 bp, Homo sapiens
tatttatcaaaatgtagctt

SEQ ID NO: 1235747 - DNA, 14 bp, Homo sapiens
tatttatccctttc

SEQ ID NO: 1235748 - DNA, 22 bp, Homo sapiens
tatttatctccgcaggctattt

SEQ ID NO: 1235749 - DNA, 15 bp, Homo sapiens
tatttatctgagcaa

SEQ ID NO: 1235750 - DNA, 16 bp, Homo sapiens
tatttatcttcttcac

SEQ ID NO: 1235751 - DNA, 13 bp, Homo sapiens
tatttatgaattg

SEQ ID NO: 1235752 - DNA, 18 bp, Homo sapiens
tatttatgcttaaaatat

SEQ ID NO: 1235753 - DNA, 20 bp, Homo sapiens
tatttatgcttaaaatatgt

SEQ ID NO: 1235754 - DNA, 21 bp, Homo sapiens
tatttatgcttaaaatatgta

SEQ ID NO: 1235755 - DNA, 13 bp, Homo sapiens
tatttatggtttc

SEQ ID NO: 1235756 - DNA, 13 bp, Homo sapiens
tatttatgtaatt

SEQ ID NO: 1235757 - DNA, 23 bp, Homo sapiens
tatttattaaacagatttttaca

SEQ ID NO: 1235758 - DNA, 12 bp, Homo sapiens
tatttattaaat

SEQ ID NO: 1235759 - DNA, 13 bp, Homo sapiens
tatttattaaatt

SEQ ID NO: 1235760 - DNA, 13 bp, Homo sapiens
tatttattaatat

SEQ ID NO: 1235761 - DNA, 13 bp, Homo sapiens
tatttattacata

SEQ ID NO: 1235762 - DNA, 20 bp, Homo sapiens
tatttattacataatttagt

SEQ ID NO: 1235763 - DNA, 12 bp, Homo sapiens
tatttattactg

SEQ ID NO: 1235764 - DNA, 15 bp, Homo sapiens
tatttattactgtcc

SEQ ID NO: 1235765 - DNA, 20 bp, Homo sapiens
tatttattatgctttattgg

SEQ ID NO: 1235766 - DNA, 17 bp, Homo sapiens
tatttattattaattta

SEQ ID NO: 1235767 - DNA, 15 bp, Homo sapiens
tatttattcactgta

SEQ ID NO: 1235768 - DNA, 24 bp, Homo sapiens
tatttattcagcttcatttgtgtc

SEQ ID NO: 1235769 - DNA, 20 bp, Homo sapiens
tatttattgactttgacaat

SEQ ID NO: 1235770 - DNA, 14 bp, Homo sapiens
tatttattgattaa

SEQ ID NO: 1235771 - DNA, 22 bp, Homo sapiens
tatttattgcattgctggtaga

SEQ ID NO: 1235772 - DNA, 10 bp, Homo sapiens
tatttattgt

SEQ ID NO: 1235773 - DNA, 14 bp, Homo sapiens
tatttattgtatta

SEQ ID NO: 1235774 - DNA, 23 bp, Homo sapiens
tatttattgtgctgggtcccagc

SEQ ID NO: 1235775 - DNA, 11 bp, Homo sapiens
tatttattgtt

SEQ ID NO: 1235776 - DNA, 15 bp, Homo sapiens
tatttattgttagaa

SEQ ID NO: 1235777 - DNA, 16 bp, Homo sapiens
tatttattgtttattt

SEQ ID NO: 1235778 - DNA, 13 bp, Homo sapiens
tatttatttaaat

SEQ ID NO: 1235779 - DNA, 15 bp, Homo sapiens
tatttatttacaaat

SEQ ID NO: 1235780 - DNA, 12 bp, Homo sapiens
tatttatttcta

SEQ ID NO: 1235781 - DNA, 20 bp, Homo sapiens
tatttcaaaatatacattca

SEQ ID NO: 1235782 - DNA, 15 bp, Homo sapiens
tatttcaactaatgt

SEQ ID NO: 1235783 - DNA, 19 bp, Homo sapiens
tatttcaagggttgcttct

SEQ ID NO: 1235784 - DNA, 14 bp, Homo sapiens
tatttcaataacag

SEQ ID NO: 1235785 - DNA, 16 bp, Homo sapiens
tatttcaatgtaatta

SEQ ID NO: 1235786 - DNA, 15 bp, Homo sapiens
tatttcacagagcac

SEQ ID NO: 1235787 - DNA, 23 bp, Homo sapiens
tatttcacagagcacgcctgcca

SEQ ID NO: 1235788 - DNA, 18 bp, Homo sapiens
tatttcactaaatgtaaa

SEQ ID NO: 1235789 - DNA, 20 bp, Homo sapiens
tatttcactaaatgtaaaat

SEQ ID NO: 1235790 - DNA, 21 bp, Homo sapiens
tatttcagatatcaaaattct

SEQ ID NO: 1235791 - DNA, 19 bp, Homo sapiens
tatttcagatgtaatgttt

SEQ ID NO: 1235792 - DNA, 21 bp, Homo sapiens
tatttcagatgtaatgttttc

SEQ ID NO: 1235793 - DNA, 19 bp, Homo sapiens
tatttcagggacctcaggg

SEQ ID NO: 1235794 - DNA, 18 bp, Homo sapiens
tatttcagtattttccag

SEQ ID NO: 1235795 - DNA, 22 bp, Homo sapiens
tatttcagtattttccagcctt

SEQ ID NO: 1235796 - DNA, 15 bp, Homo sapiens
tatttcagtgtgcat

SEQ ID NO: 1235797 - DNA, 17 bp, Homo sapiens
tatttcagtgttacctg

SEQ ID NO: 1235798 - DNA, 19 bp, Homo sapiens
tatttcagtgttacctgtg

SEQ ID NO: 1235799 - DNA, 20 bp, Homo sapiens
tatttcagtgttacctgtgt

SEQ ID NO: 1235800 - DNA, 13 bp, Homo sapiens
tatttcatatact

SEQ ID NO: 1235801 - DNA, 20 bp, Homo sapiens
tatttcatcatattatacag

SEQ ID NO: 1235802 - DNA, 21 bp, Homo sapiens
tatttcatcatattatacaga

SEQ ID NO: 1235803 - DNA, 12 bp, Homo sapiens
tatttcatttta

SEQ ID NO: 1235804 - DNA, 14 bp, Homo sapiens
tatttccactaaaa

SEQ ID NO: 1235805 - DNA, 17 bp, Homo sapiens
tatttccactgaacaaa

SEQ ID NO: 1235806 - DNA, 21 bp, Homo sapiens
tatttccattccagaatatct

SEQ ID NO: 1235807 - DNA, 21 bp, Homo sapiens
tatttcccatttgtgccagag

SEQ ID NO: 1235808 - DNA, 15 bp, Homo sapiens
tatttcccctgtcag

SEQ ID NO: 1235809 - DNA, 15 bp, Homo sapiens
tatttcccttccaaa

SEQ ID NO: 1235810 - DNA, 15 bp, Homo sapiens
tatttcctaatcaaa

SEQ ID NO: 1235811 - DNA, 17 bp, Homo sapiens
tatttcctgacttgagt

SEQ ID NO: 1235812 - DNA, 15 bp, Homo sapiens
tatttccttaaactg

SEQ ID NO: 1235813 - DNA, 17 bp, Homo sapiens
tatttcctttatgtgaa

SEQ ID NO: 1235814 - DNA, 15 bp, Homo sapiens
tatttcgaaagctgc

SEQ ID NO: 1235815 - DNA, 14 bp, Homo sapiens
tatttctaagtatt

SEQ ID NO: 1235816 - DNA, 11 bp, Homo sapiens
tatttctactg

SEQ ID NO: 1235817 - DNA, 12 bp, Homo sapiens
tatttctactgt

SEQ ID NO: 1235818 - DNA, 16 bp, Homo sapiens
tatttctactgtcaaa

SEQ ID NO: 1235819 - DNA, 13 bp, Homo sapiens
tatttctagaagc

SEQ ID NO: 1235820 - DNA, 13 bp, Homo sapiens
tatttctagcaga

SEQ ID NO: 1235821 - DNA, 14 bp, Homo sapiens
tatttctagcagag

SEQ ID NO: 1235822 - DNA, 13 bp, Homo sapiens
tatttctagccat

SEQ ID NO: 1235823 - DNA, 14 bp, Homo sapiens
tatttctatgacaa

SEQ ID NO: 1235824 - DNA, 19 bp, Homo sapiens
tatttctatgacaaattca

SEQ ID NO: 1235825 - DNA, 14 bp, Homo sapiens
tatttctatgtaaa

SEQ ID NO: 1235826 - DNA, 16 bp, Homo sapiens
tatttctatgtaaatt

SEQ ID NO: 1235827 - DNA, 19 bp, Homo sapiens
tatttctatgtaaattatt

SEQ ID NO: 1235828 - DNA, 12 bp, Homo sapiens
tatttctatgtc

SEQ ID NO: 1235829 - DNA, 12 bp, Homo sapiens
tattttacattt

SEQ ID NO: 1235830 - DNA, 13 bp, Homo sapiens
tattttacattta

SEQ ID NO: 1235831 - DNA, 20 bp, Homo sapiens
tattttacatttagagtatt

SEQ ID NO: 1235832 - DNA, 12 bp, Homo sapiens
tattttactatt

SEQ ID NO: 1235833 - DNA, 16 bp, Homo sapiens
tattttagaataaatt

SEQ ID NO: 1235834 - DNA, 21 bp, Homo sapiens
tattttagcagttctgcaaat

SEQ ID NO: 1235835 - DNA, 22 bp, Homo sapiens
tattttagcagttctgcaaata

SEQ ID NO: 1235836 - DNA, 13 bp, Homo sapiens
tattttagtatac

SEQ ID NO: 1235837 - DNA, 19 bp, Homo sapiens
tattttataacatgttaaa

SEQ ID NO: 1235838 - DNA, 21 bp, Homo sapiens
tattttatataataaagtatt

SEQ ID NO: 1235839 - DNA, 16 bp, Homo sapiens
tattttatatcataca

SEQ ID NO: 1235840 - DNA, 15 bp, Homo sapiens
tattttatatgagag

SEQ ID NO: 1235841 - DNA, 13 bp, Homo sapiens
tattttatgaaca

SEQ ID NO: 1235842 - DNA, 17 bp, Homo sapiens
tattttatgaacattgt

SEQ ID NO: 1235843 - DNA, 16 bp, Homo sapiens
tattttatggttatgt

SEQ ID NO: 1235844 - DNA, 23 bp, Homo sapiens
tattttatggttatgtttttctg

SEQ ID NO: 1235845 - DNA, 21 bp, Homo sapiens
tattttattacatctttcaca

SEQ ID NO: 1235846 - DNA, 14 bp, Homo sapiens
tattttattcagta

SEQ ID NO: 1235847 - DNA, 13 bp, Homo sapiens
tattttattccct

SEQ ID NO: 1235848 - DNA, 19 bp, Homo sapiens
tattttattccctttcaca

SEQ ID NO: 1235849 - DNA, 19 bp, Homo sapiens
tattttattttttaccata

SEQ ID NO: 1235850 - DNA, 17 bp, Homo sapiens
tattttatttttttcta

SEQ ID NO: 1235851 - DNA, 12 bp, Homo sapiens
tattttcaaaga

SEQ ID NO: 1235852 - DNA, 22 bp, Homo sapiens
tattttcaaattgtatctagtg

SEQ ID NO: 1235853 - DNA, 16 bp, Homo sapiens
tattttcaagaaactg

SEQ ID NO: 1235854 - DNA, 21 bp, Homo sapiens
tattttcaaggccctcagcat

SEQ ID NO: 1235855 - DNA, 19 bp, Homo sapiens
tattttcaatagccactaa

SEQ ID NO: 1235856 - DNA, 16 bp, Homo sapiens
tattttcagctcaatt

SEQ ID NO: 1235857 - DNA, 21 bp, Homo sapiens
tattttcagtcaaaactttaa

SEQ ID NO: 1235858 - DNA, 17 bp, Homo sapiens
tattttcagtgcatcat

SEQ ID NO: 1235859 - DNA, 19 bp, Homo sapiens
tattttcagtgcatcatta

SEQ ID NO: 1235860 - DNA, 11 bp, Homo sapiens
tattttcatag

SEQ ID NO: 1235861 - DNA, 12 bp, Homo sapiens
tattttcatagt

SEQ ID NO: 1235862 - DNA, 15 bp, Homo sapiens
tattttcccttttta

SEQ ID NO: 1235863 - DNA, 21 bp, Homo sapiens
tattttcctatattacggttt

SEQ ID NO: 1235864 - DNA, 16 bp, Homo sapiens
tattttcctccccagc

SEQ ID NO: 1235865 - DNA, 15 bp, Homo sapiens
tattttctaaagact

SEQ ID NO: 1235866 - DNA, 14 bp, Homo sapiens
tattttctatttta

SEQ ID NO: 1235867 - DNA, 20 bp, Homo sapiens
tattttctggtagatagaaa

SEQ ID NO: 1235868 - DNA, 13 bp, Homo sapiens
tattttctgtcag

SEQ ID NO: 1235869 - DNA, 22 bp, Homo sapiens
tattttctgtcagatgagaaca

SEQ ID NO: 1235870 - DNA, 19 bp, Homo sapiens
tattttcttcatccaactt

SEQ ID NO: 1235871 - DNA, 15 bp, Homo sapiens
tattttcttgtttaa

SEQ ID NO: 1235872 - DNA, 22 bp, Homo sapiens
tattttgaaaaagagaacagaa

SEQ ID NO: 1235873 - DNA, 12 bp, Homo sapiens
tattttgaatca

SEQ ID NO: 1235874 - DNA, 16 bp, Homo sapiens
tattttgaatcaataa

SEQ ID NO: 1235875 - DNA, 17 bp, Homo sapiens
tattttgacataaagtt

SEQ ID NO: 1235876 - DNA, 22 bp, Homo sapiens
tattttgataaaatgtaaattt

SEQ ID NO: 1235877 - DNA, 21 bp, Homo sapiens
tattttgcagttcccacatta

SEQ ID NO: 1235878 - DNA, 13 bp, Homo sapiens
tattttgctccct

SEQ ID NO: 1235879 - DNA, 18 bp, Homo sapiens
tattttgctccctctgtt

SEQ ID NO: 1235880 - DNA, 22 bp, Homo sapiens
tattttgctccctctgttaggt

SEQ ID NO: 1235881 - DNA, 14 bp, Homo sapiens
tattttgctggaat

SEQ ID NO: 1235882 - DNA, 12 bp, Homo sapiens
tattttgctttg

SEQ ID NO: 1235883 - DNA, 18 bp, Homo sapiens
tattttggaataagcatt

SEQ ID NO: 1235884 - DNA, 21 bp, Homo sapiens
tattttggaataagcattgtt

SEQ ID NO: 1235885 - DNA, 12 bp, Homo sapiens
tattttggaatt

SEQ ID NO: 1235886 - DNA, 21 bp, Homo sapiens
tattttggaattggtgtatat

SEQ ID NO: 1235887 - DNA, 16 bp, Homo sapiens
tattttggagaaatta

SEQ ID NO: 1235888 - DNA, 22 bp, Homo sapiens
tattttggagtgtaggtgactt

SEQ ID NO: 1235889 - DNA, 20 bp, Homo sapiens
tattttggattgtatattgt

SEQ ID NO: 1235890 - DNA, 20 bp, Homo sapiens
tattttggcttcatttcaat

SEQ ID NO: 1235891 - DNA, 21 bp, Homo sapiens
tattttggcttcatttcaatc

SEQ ID NO: 1235892 - DNA, 18 bp, Homo sapiens
tattttggctttctccct

SEQ ID NO: 1235893 - DNA, 19 bp, Homo sapiens
tattttgggcctgttcctt

SEQ ID NO: 1235894 - DNA, 14 bp, Homo sapiens
tattttggtacttt

SEQ ID NO: 1235895 - DNA, 19 bp, Homo sapiens
tattttggttcttagttct

SEQ ID NO: 1235896 - DNA, 14 bp, Homo sapiens
tattttgtaaaatg

SEQ ID NO: 1235897 - DNA, 16 bp, Homo sapiens
tattttgtaaaatgta

SEQ ID NO: 1235898 - DNA, 18 bp, Homo sapiens
tattttgtaaaatgtatt

SEQ ID NO: 1235899 - DNA, 19 bp, Homo sapiens
tattttgtaaaatgtatta

SEQ ID NO: 1235900 - DNA, 13 bp, Homo sapiens
tattttgtaaact

SEQ ID NO: 1235901 - DNA, 20 bp, Homo sapiens
tattttgtaaactcaaaata

SEQ ID NO: 1235902 - DNA, 20 bp, Homo sapiens
tattttgtactttgtggaga

SEQ ID NO: 1235903 - DNA, 19 bp, Homo sapiens
tattttgtcttattcttaa

SEQ ID NO: 1235904 - DNA, 14 bp, Homo sapiens
tattttgtgaacta

SEQ ID NO: 1235905 - DNA, 17 bp, Homo sapiens
tattttgtgctcattta

SEQ ID NO: 1235906 - DNA, 19 bp, Homo sapiens
tattttgtggttctatttt

SEQ ID NO: 1235907 - DNA, 12 bp, Homo sapiens
tattttgttaaa

SEQ ID NO: 1235908 - DNA, 19 bp, Homo sapiens
tattttgttgaccattttg

SEQ ID NO: 1235909 - DNA, 20 bp, Homo sapiens
tattttgttgaccattttgt

SEQ ID NO: 1235910 - DNA, 13 bp, Homo sapiens
tatttttaaaata

SEQ ID NO: 1235911 - DNA, 13 bp, Homo sapiens
tatttttaaagat

SEQ ID NO: 1235912 - DNA, 18 bp, Homo sapiens
tatttttaactctggatt

SEQ ID NO: 1235913 - DNA, 13 bp, Homo sapiens
tatttttaagaaa

SEQ ID NO: 1235914 - DNA, 15 bp, Homo sapiens
tatttttataattaa

SEQ ID NO: 1235915 - DNA, 15 bp, Homo sapiens
tatttttatacttta

SEQ ID NO: 1235916 - DNA, 23 bp, Homo sapiens
tatttttatataatatctaaagt

SEQ ID NO: 1235917 - DNA, 23 bp, Homo sapiens
tatttttatattaaagtaaatgg

SEQ ID NO: 1235918 - DNA, 16 bp, Homo sapiens
tatttttatatttcct

SEQ ID NO: 1235919 - DNA, 15 bp, Homo sapiens
tatttttatgtgcag

SEQ ID NO: 1235920 - DNA, 17 bp, Homo sapiens
tatttttatgtgcagcg

SEQ ID NO: 1235921 - DNA, 15 bp, Homo sapiens
tatttttcaaataga

SEQ ID NO: 1235922 - DNA, 16 bp, Homo sapiens
tatttttcaaatagat

SEQ ID NO: 1235923 - DNA, 17 bp, Homo sapiens
tatttttcaaatagatt

SEQ ID NO: 1235924 - DNA, 14 bp, Homo sapiens
tatttttcaaggaa

SEQ ID NO: 1235925 - DNA, 16 bp, Homo sapiens
tatttttcaaggcatt

SEQ ID NO: 1235926 - DNA, 22 bp, Homo sapiens
tatttttcactctaagtcatgt

SEQ ID NO: 1235927 - DNA, 13 bp, Homo sapiens
tatttttcatatt

SEQ ID NO: 1235928 - DNA, 19 bp, Homo sapiens
tatttttcatattgtgcca

SEQ ID NO: 1235929 - DNA, 21 bp, Homo sapiens
tatttttccctccgggcaggg

SEQ ID NO: 1235930 - DNA, 14 bp, Homo sapiens
tatttttctaaggt

SEQ ID NO: 1235931 - DNA, 12 bp, Homo sapiens
tatttttctctt

SEQ ID NO: 1235932 - DNA, 17 bp, Homo sapiens
tatttttctcttgtacc

SEQ ID NO: 1235933 - DNA, 18 bp, Homo sapiens
tatttttctcttgtacca

SEQ ID NO: 1235934 - DNA, 18 bp, Homo sapiens
tatttttctgtgaccatc

SEQ ID NO: 1235935 - DNA, 12 bp, Homo sapiens
tatttttcttga

SEQ ID NO: 1235936 - DNA, 13 bp, Homo sapiens
tatttttcttgct

SEQ ID NO: 1235937 - DNA, 22 bp, Homo sapiens
tatttttgaaaggcatgttcct

SEQ ID NO: 1235938 - DNA, 16 bp, Homo sapiens
tatttttgactgtttt

SEQ ID NO: 1235939 - DNA, 14 bp, Homo sapiens
tatttttgatgtat

SEQ ID NO: 1235940 - DNA, 19 bp, Homo sapiens
tatttttgcaaaataagtt

SEQ ID NO: 1235941 - DNA, 16 bp, Homo sapiens
tatttttgctgcttct

SEQ ID NO: 1235942 - DNA, 20 bp, Homo sapiens
tatttttggggcatcctgga

SEQ ID NO: 1235943 - DNA, 21 bp, Homo sapiens
tatttttggggcatcctggat

SEQ ID NO: 1235944 - DNA, 21 bp, Homo sapiens
tatttttgggggctttccttt

SEQ ID NO: 1235945 - DNA, 18 bp, Homo sapiens
tatttttgggtttggcca

SEQ ID NO: 1235946 - DNA, 20 bp, Homo sapiens
tatttttgtaattttaaata

SEQ ID NO: 1235947 - DNA, 14 bp, Homo sapiens
tatttttgtacata

SEQ ID NO: 1235948 - DNA, 20 bp, Homo sapiens
tatttttgtacatattgtta

SEQ ID NO: 1235949 - DNA, 17 bp, Homo sapiens
tatttttgtacttgatt

SEQ ID NO: 1235950 - DNA, 23 bp, Homo sapiens
tatttttgtagtgacctgtttat

SEQ ID NO: 1235951 - DNA, 18 bp, Homo sapiens
tatttttgtatttctcta

SEQ ID NO: 1235952 - DNA, 15 bp, Homo sapiens
tatttttgtctgcag

SEQ ID NO: 1235953 - DNA, 15 bp, Homo sapiens
tatttttgtgtttct

SEQ ID NO: 1235954 - DNA, 16 bp, Homo sapiens
tatttttgtgtttcta

SEQ ID NO: 1235955 - DNA, 15 bp, Homo sapiens
tattttttaaagact

SEQ ID NO: 1235956 - DNA, 15 bp, Homo sapiens
tattttttaagtatt

SEQ ID NO: 1235957 - DNA, 21 bp, Homo sapiens
tattttttaagtatttatata

SEQ ID NO: 1235958 - DNA, 16 bp, Homo sapiens
tattttttaatgtatt

SEQ ID NO: 1235959 - DNA, 12 bp, Homo sapiens
tattttttaatt

SEQ ID NO: 1235960 - DNA, 20 bp, Homo sapiens
tattttttacattttacaca

SEQ ID NO: 1235961 - DNA, 13 bp, Homo sapiens
tattttttattgt

SEQ ID NO: 1235962 - DNA, 17 bp, Homo sapiens
tattttttattgttttc

SEQ ID NO: 1235963 - DNA, 13 bp, Homo sapiens
tattttttcccaa

SEQ ID NO: 1235964 - DNA, 14 bp, Homo sapiens
tattttttcccaaa

SEQ ID NO: 1235965 - DNA, 12 bp, Homo sapiens
tattttttcctt

SEQ ID NO: 1235966 - DNA, 14 bp, Homo sapiens
tattttttctatga

SEQ ID NO: 1235967 - DNA, 12 bp, Homo sapiens
tattttttgggc

SEQ ID NO: 1235968 - DNA, 14 bp, Homo sapiens
tattttttgggcca

SEQ ID NO: 1235969 - DNA, 22 bp, Homo sapiens
tattttttgggccattacccca

SEQ ID NO: 1235970 - DNA, 14 bp, Homo sapiens
tattttttgtataa

SEQ ID NO: 1235971 - DNA, 17 bp, Homo sapiens
tattttttgtatagtat

SEQ ID NO: 1235972 - DNA, 21 bp, Homo sapiens
tatttttttaaatcaaggaaa

SEQ ID NO: 1235973 - DNA, 17 bp, Homo sapiens
tatttttttaactttac

SEQ ID NO: 1235974 - DNA, 16 bp, Homo sapiens
tatttttttaatttaa

SEQ ID NO: 1235975 - DNA, 17 bp, Homo sapiens
tatttttttcactgttt

SEQ ID NO: 1235976 - DNA, 15 bp, Homo sapiens
tatttttttctacct

SEQ ID NO: 1235977 - DNA, 23 bp, Homo sapiens
tatttttttctaccttgaggtct

SEQ ID NO: 1235978 - DNA, 21 bp, Homo sapiens
tcaaagcaattgaaatgcatt

SEQ ID NO: 1235979 - DNA, 23 bp, Homo sapiens
tcaaagcagagtgggacttggag

SEQ ID NO: 1235980 - DNA, 14 bp, Homo sapiens
tcaaagcagcagcc

SEQ ID NO: 1235981 - DNA, 19 bp, Homo sapiens
tcaaagcaggggagtatgc

SEQ ID NO: 1235982 - DNA, 20 bp, Homo sapiens
tcaaagcatgggattattag

SEQ ID NO: 1235983 - DNA, 18 bp, Homo sapiens
tcaaagccaagtttatat

SEQ ID NO: 1235984 - DNA, 21 bp, Homo sapiens
tcaaagccacattatttctag

SEQ ID NO: 1235985 - DNA, 15 bp, Homo sapiens
tcaaagccagggtct

SEQ ID NO: 1235986 - DNA, 20 bp, Homo sapiens
tcaaagccctgcctctgtgt

SEQ ID NO: 1235987 - DNA, 21 bp, Homo sapiens
tcaaagccctgcctctgtgta

SEQ ID NO: 1235988 - DNA, 18 bp, Homo sapiens
tcaaagcctcttattttt

SEQ ID NO: 1235989 - DNA, 16 bp, Homo sapiens
tcaaagctgaatattt

SEQ ID NO: 1235990 - DNA, 11 bp, Homo sapiens
tcaaagctgcc

SEQ ID NO: 1235991 - DNA, 18 bp, Homo sapiens
tcaaagctgcctgtccct

SEQ ID NO: 1235992 - DNA, 21 bp, Homo sapiens
tcaaagcttggattaaataca

SEQ ID NO: 1235993 - DNA, 15 bp, Homo sapiens
tcaaagctttttcca

SEQ ID NO: 1235994 - DNA, 16 bp, Homo sapiens
tcaaagctttttccag

SEQ ID NO: 1235995 - DNA, 13 bp, Homo sapiens
tcaaaggagaaaa

SEQ ID NO: 1235996 - DNA, 23 bp, Homo sapiens
tcaaaggagaaaaaaaaccttgt

SEQ ID NO: 1235997 - DNA, 20 bp, Homo sapiens
tcaaaggagcgagcatgtcg

SEQ ID NO: 1235998 - DNA, 18 bp, Homo sapiens
tcaaaggcatctcccttc

SEQ ID NO: 1235999 - DNA, 20 bp, Homo sapiens
tcaaagggattgctttttcc

SEQ ID NO: 1236000 - DNA, 13 bp, Homo sapiens
tcaaagggcagtt

SEQ ID NO: 1236001 - DNA, 17 bp, Homo sapiens
tcaaagggcagttttga

SEQ ID NO: 1236002 - DNA, 18 bp, Homo sapiens
tcaaaggtttggaaggag

SEQ ID NO: 1236003 - DNA, 22 bp, Homo sapiens
tcaaagtaaaaaattaaagccc

SEQ ID NO: 1236004 - DNA, 14 bp, Homo sapiens
tcaaagtaaaaatt

SEQ ID NO: 1236005 - DNA, 16 bp, Homo sapiens
tcaaagtataatcttt

SEQ ID NO: 1236006 - DNA, 19 bp, Homo sapiens
tcaaagtataatctttcta

SEQ ID NO: 1236007 - DNA, 18 bp, Homo sapiens
tcaaagtatgcaatgctt

SEQ ID NO: 1236008 - DNA, 13 bp, Homo sapiens
tcaaagtcattaa

SEQ ID NO: 1236009 - DNA, 17 bp, Homo sapiens
tcaaagtcattaaagac

SEQ ID NO: 1236010 - DNA, 18 bp, Homo sapiens
tcaaagtcattaaagaca

SEQ ID NO: 1236011 - DNA, 21 bp, Homo sapiens
tcaaagtggtaaatactgtga

SEQ ID NO: 1236012 - DNA, 17 bp, Homo sapiens
tcaaagtggtacaggaa

SEQ ID NO: 1236013 - DNA, 18 bp, Homo sapiens
tcaaagtggtacaggaag

SEQ ID NO: 1236014 - DNA, 19 bp, Homo sapiens
tcaaagtggtacaggaagg

SEQ ID NO: 1236015 - DNA, 13 bp, Homo sapiens
tcaaagtgtatat

SEQ ID NO: 1236016 - DNA, 19 bp, Homo sapiens
tcaaagtgtatatttattc

SEQ ID NO: 1236017 - DNA, 20 bp, Homo sapiens
tcaaagtgtctagacatatt

SEQ ID NO: 1236018 - DNA, 18 bp, Homo sapiens
tcaaagtgttgtgttcct

SEQ ID NO: 1236019 - DNA, 20 bp, Homo sapiens
tcaaagtgttgtgttcctgg

SEQ ID NO: 1236020 - DNA, 18 bp, Homo sapiens
tcaaagttaattcaccta

SEQ ID NO: 1236021 - DNA, 23 bp, Homo sapiens
tcaaagttgtagttcttgtgcat

SEQ ID NO: 1236022 - DNA, 15 bp, Homo sapiens
tcaaataaaaattct

SEQ ID NO: 1236023 - DNA, 23 bp, Homo sapiens
tcaaataaaactagtgacagctt

SEQ ID NO: 1236024 - DNA, 16 bp, Homo sapiens
tcaaataaaatatcat

SEQ ID NO: 1236025 - DNA, 12 bp, Homo sapiens
tcaaataagaaa

SEQ ID NO: 1236026 - DNA, 13 bp, Homo sapiens
tcaaatacatctt

SEQ ID NO: 1236027 - DNA, 12 bp, Homo sapiens
tcaaatacttta

SEQ ID NO: 1236028 - DNA, 23 bp, Homo sapiens
tcaaatactttaaaggaaaaaat

SEQ ID NO: 1236029 - DNA, 20 bp, Homo sapiens
tcaaatagatttttgattca

SEQ ID NO: 1236030 - DNA, 23 bp, Homo sapiens
tcaaatagatttttgattcagct

SEQ ID NO: 1236031 - DNA, 15 bp, Homo sapiens
tcaaatagttgcata

SEQ ID NO: 1236032 - DNA, 19 bp, Homo sapiens
tcaaatatcatttactctt

SEQ ID NO: 1236033 - DNA, 16 bp, Homo sapiens
tcaaatcagtcttcct

SEQ ID NO: 1236034 - DNA, 17 bp, Homo sapiens
tcaaatcctcaccatcc

SEQ ID NO: 1236035 - DNA, 15 bp, Homo sapiens
tcaaatctaccactg

SEQ ID NO: 1236036 - DNA, 20 bp, Homo sapiens
tcaaatctaccactgtatga

SEQ ID NO: 1236037 - DNA, 18 bp, Homo sapiens
tcaaatctattcagacaa

SEQ ID NO: 1236038 - DNA, 21 bp, Homo sapiens
tcaaatctcctgctgatttca

SEQ ID NO: 1236039 - DNA, 14 bp, Homo sapiens
tcaaatctgggctc

SEQ ID NO: 1236040 - DNA, 19 bp, Homo sapiens
tcaaatctgtaatcagcaa

SEQ ID NO: 1236041 - DNA, 20 bp, Homo sapiens
tcaaatctgtatatgttgta

SEQ ID NO: 1236042 - DNA, 14 bp, Homo sapiens
tcaaatctgtgctc

SEQ ID NO: 1236043 - DNA, 21 bp, Homo sapiens
tcaaatgaaactctttcattc

SEQ ID NO: 1236044 - DNA, 13 bp, Homo sapiens
tcaaatgaaatgt

SEQ ID NO: 1236045 - DNA, 15 bp, Homo sapiens
tcaaatgaaatgtat

SEQ ID NO: 1236046 - DNA, 16 bp, Homo sapiens
tcaaatgacccaaaga

SEQ ID NO: 1236047 - DNA, 19 bp, Homo sapiens
tcaaatgcagtatatttct

SEQ ID NO: 1236048 - DNA, 18 bp, Homo sapiens
tcaaatgggctgctgctt

SEQ ID NO: 1236049 - DNA, 21 bp, Homo sapiens
tcaaatggtaggcatttccta

SEQ ID NO: 1236050 - DNA, 19 bp, Homo sapiens
tcaaatggtgtcatggctg

SEQ ID NO: 1236051 - DNA, 16 bp, Homo sapiens
tcaaatgtcagagcta

SEQ ID NO: 1236052 - DNA, 15 bp, Homo sapiens
tcaaatgttacagtt

SEQ ID NO: 1236053 - DNA, 19 bp, Homo sapiens
tcaaatgttacagtttata

SEQ ID NO: 1236054 - DNA, 17 bp, Homo sapiens
tcaaatgtttccttaaa

SEQ ID NO: 1236055 - DNA, 12 bp, Homo sapiens
tcaaatgtttta

SEQ ID NO: 1236056 - DNA, 23 bp, Homo sapiens
tcaagttcccaactgagtcatct

SEQ ID NO: 1236057 - DNA, 13 bp, Homo sapiens
tcaagttcttgga

SEQ ID NO: 1236058 - DNA, 18 bp, Homo sapiens
tcaagttgagatttttaa

SEQ ID NO: 1236059 - DNA, 22 bp, Homo sapiens
tcaagttgagatttttaagaac

SEQ ID NO: 1236060 - DNA, 23 bp, Homo sapiens
tcaagttgagatttttaagaact

SEQ ID NO: 1236061 - DNA, 17 bp, Homo sapiens
tcaagttggacttgttt

SEQ ID NO: 1236062 - DNA, 20 bp, Homo sapiens
tcaagttgtaaaaatgaaag

SEQ ID NO: 1236063 - DNA, 19 bp, Homo sapiens
tcaagttgttgactgtgat

SEQ ID NO: 1236064 - DNA, 14 bp, Homo sapiens
tcaagtttacactt

SEQ ID NO: 1236065 - DNA, 19 bp, Homo sapiens
tcaagtttgaccagtgcag

SEQ ID NO: 1236066 - DNA, 19 bp, Homo sapiens
tcaagttttgggtatgttt

SEQ ID NO: 1236067 - DNA, 21 bp, Homo sapiens
tcaagttttgggtatgtttaa

SEQ ID NO: 1236068 - DNA, 19 bp, Homo sapiens
tcaataaaaaaaagaaatg

SEQ ID NO: 1236069 - DNA, 23 bp, Homo sapiens
tcaataaaatgaacctgatcact

SEQ ID NO: 1236070 - DNA, 13 bp, Homo sapiens
tcaataaaatgtg

SEQ ID NO: 1236071 - DNA, 23 bp, Homo sapiens
tcaataaaatgtgatttttctga

SEQ ID NO: 1236072 - DNA, 16 bp, Homo sapiens
tcaataaacaacagct

SEQ ID NO: 1236073 - DNA, 12 bp, Homo sapiens
tcaataaactta

SEQ ID NO: 1236074 - DNA, 14 bp, Homo sapiens
tcaataaagaaaac

SEQ ID NO: 1236075 - DNA, 12 bp, Homo sapiens
tcaataaagcat

SEQ ID NO: 1236076 - DNA, 19 bp, Homo sapiens
tcaataaagcatttataaa

SEQ ID NO: 1236077 - DNA, 19 bp, Homo sapiens
tcaataaatgacacccaga

SEQ ID NO: 1236078 - DNA, 21 bp, Homo sapiens
tcaataaatgacacccagacc

SEQ ID NO: 1236079 - DNA, 15 bp, Homo sapiens
tcaataaattgcaac

SEQ ID NO: 1236080 - DNA, 21 bp, Homo sapiens
tcaataacagatggtgctgct

SEQ ID NO: 1236081 - DNA, 19 bp, Homo sapiens
tcaataatatattttctgt

SEQ ID NO: 1236082 - DNA, 19 bp, Homo sapiens
tcaataccgctcagtattt

SEQ ID NO: 1236083 - DNA, 21 bp, Homo sapiens
tcaatacgcctttaaaggttt

SEQ ID NO: 1236084 - DNA, 13 bp, Homo sapiens
tcaatactgagcc

SEQ ID NO: 1236085 - DNA, 23 bp, Homo sapiens
tcaatagccactaaccttgcctg

SEQ ID NO: 1236086 - DNA, 16 bp, Homo sapiens
tcaatataagaagcaa

SEQ ID NO: 1236087 - DNA, 20 bp, Homo sapiens
tcaatataagaagcaatctt

SEQ ID NO: 1236088 - DNA, 22 bp, Homo sapiens
tcaatataggagggaagatttt

SEQ ID NO: 1236089 - DNA, 16 bp, Homo sapiens
tcaatatattgaactt

SEQ ID NO: 1236090 - DNA, 16 bp, Homo sapiens
tcaatatcccaacatt

SEQ ID NO: 1236091 - DNA, 23 bp, Homo sapiens
tcaatatcccaacattctgcaat

SEQ ID NO: 1236092 - DNA, 24 bp, Homo sapiens
tcaatatcccaacattctgcaatg

SEQ ID NO: 1236093 - DNA, 15 bp, Homo sapiens
tcaatatctaatata

SEQ ID NO: 1236094 - DNA, 15 bp, Homo sapiens
tcaatatgaatctat

SEQ ID NO: 1236095 - DNA, 18 bp, Homo sapiens
tcaatatgcaagcagctt

SEQ ID NO: 1236096 - DNA, 19 bp, Homo sapiens
tcaatattaaatacagaca

SEQ ID NO: 1236097 - DNA, 13 bp, Homo sapiens
tcaatattatgaa

SEQ ID NO: 1236098 - DNA, 17 bp, Homo sapiens
tcaatattcctgaatga

SEQ ID NO: 1236099 - DNA, 19 bp, Homo sapiens
tcaatattgacatttgtag

SEQ ID NO: 1236100 - DNA, 13 bp, Homo sapiens
tcaatatttaaac

SEQ ID NO: 1236101 - DNA, 22 bp, Homo sapiens
tcaatatttagaaaattttgta

SEQ ID NO: 1236102 - DNA, 13 bp, Homo sapiens
tcaatatttatta

SEQ ID NO: 1236103 - DNA, 20 bp, Homo sapiens
tcaatcaatggtgcaaaaaa

SEQ ID NO: 1236104 - DNA, 15 bp, Homo sapiens
tcaatcagcctttag

SEQ ID NO: 1236105 - DNA, 21 bp, Homo sapiens
tcaatcagcctttaggtcttt

SEQ ID NO: 1236106 - DNA, 21 bp, Homo sapiens
tcaatcagtctcagaatgtca

SEQ ID NO: 1236107 - DNA, 14 bp, Homo sapiens
tcaatcatcaaaaa

SEQ ID NO: 1236108 - DNA, 15 bp, Homo sapiens
tcaatcatctgtgtg

SEQ ID NO: 1236109 - DNA, 14 bp, Homo sapiens
tcaatcatgtcagt

SEQ ID NO: 1236110 - DNA, 22 bp, Homo sapiens
tcaatcccctcattcaggaaaa

SEQ ID NO: 1236111 - DNA, 15 bp, Homo sapiens
tcaatcctacctgtt

SEQ ID NO: 1236112 - DNA, 14 bp, Homo sapiens
tcaatcctctaagc

SEQ ID NO: 1236113 - DNA, 18 bp, Homo sapiens
tcaatcctggtaaccaaa

SEQ ID NO: 1236114 - DNA, 20 bp, Homo sapiens
tcaatctcccgctgctgctg

SEQ ID NO: 1236115 - DNA, 16 bp, Homo sapiens
tcaatctctgttctgc

SEQ ID NO: 1236116 - DNA, 19 bp, Homo sapiens
tcaatctctgttctgctcc

SEQ ID NO: 1236117 - DNA, 13 bp, Homo sapiens
tcaatcttgttac

SEQ ID NO: 1236118 - DNA, 22 bp, Homo sapiens
tcaatgcagtcagtgtttcttt

SEQ ID NO: 1236119 - DNA, 17 bp, Homo sapiens
tcaatgcatacaataaa

SEQ ID NO: 1236120 - DNA, 12 bp, Homo sapiens
tcaatgccctgc

SEQ ID NO: 1236121 - DNA, 13 bp, Homo sapiens
tcaatgccctgcc

SEQ ID NO: 1236122 - DNA, 15 bp, Homo sapiens
tcaatgccctgccat

SEQ ID NO: 1236123 - DNA, 16 bp, Homo sapiens
tcaatgctagaaaatc

SEQ ID NO: 1236124 - DNA, 16 bp, Homo sapiens
tcaatgctttatttgt

SEQ ID NO: 1236125 - DNA, 15 bp, Homo sapiens
tcaatttctgaacac

SEQ ID NO: 1236126 - DNA, 23 bp, Homo sapiens
tcaatttctgtgttgccaagctc

SEQ ID NO: 1236127 - DNA, 13 bp, Homo sapiens
tcaatttgctgaa

SEQ ID NO: 1236128 - DNA, 13 bp, Homo sapiens
tcaatttggatat

SEQ ID NO: 1236129 - DNA, 22 bp, Homo sapiens
tcaatttggatatttggaggag

SEQ ID NO: 1236130 - DNA, 20 bp, Homo sapiens
tcaatttgtaattgcttaca

SEQ ID NO: 1236131 - DNA, 16 bp, Homo sapiens
tcaattttaaacatat

SEQ ID NO: 1236132 - DNA, 13 bp, Homo sapiens
tcaattttaaaga

SEQ ID NO: 1236133 - DNA, 21 bp, Homo sapiens
tcaattttatccctcacctgt

SEQ ID NO: 1236134 - DNA, 22 bp, Homo sapiens
tcaattttatccctcacctgta

SEQ ID NO: 1236135 - DNA, 18 bp, Homo sapiens
tcaattttcattaaactt

SEQ ID NO: 1236136 - DNA, 21 bp, Homo sapiens
tcaattttcattaaacttgaa

SEQ ID NO: 1236137 - DNA, 17 bp, Homo sapiens
tcaatttttcccagtat

SEQ ID NO: 1236138 - DNA, 19 bp, Homo sapiens
tcaatttttcccagtattt

SEQ ID NO: 1236139 - DNA, 19 bp, Homo sapiens
tcaatttttgtctcagaag

SEQ ID NO: 1236140 - DNA, 12 bp, Homo sapiens
tcaatttttgtt

SEQ ID NO: 1236141 - DNA, 16 bp, Homo sapiens
tcacaaactacctctg

SEQ ID NO: 1236142 - DNA, 21 bp, Homo sapiens
tcacaaactacctctggacag

SEQ ID NO: 1236143 - DNA, 12 bp, Homo sapiens
tcacaaactgtg

SEQ ID NO: 1236144 - DNA, 15 bp, Homo sapiens
tcacaaactgtgaaa

SEQ ID NO: 1236145 - DNA, 20 bp, Homo sapiens
tcacaaactgtgaaaatagt

SEQ ID NO: 1236146 - DNA, 15 bp, Homo sapiens
tcacaaacttttata

SEQ ID NO: 1236147 - DNA, 19 bp, Homo sapiens
tcacaaatgtcattgtcta

SEQ ID NO: 1236148 - DNA, 21 bp, Homo sapiens
tcacaaatgtcattgtctact

SEQ ID NO: 1236149 - DNA, 16 bp, Homo sapiens
tcacaaattgatcaag

SEQ ID NO: 1236150 - DNA, 12 bp, Homo sapiens
tcacaacagatc

SEQ ID NO: 1236151 - DNA, 13 bp, Homo sapiens
tcacaaccaagaa

SEQ ID NO: 1236152 - DNA, 12 bp, Homo sapiens
tcacaacctctc

SEQ ID NO: 1236153 - DNA, 16 bp, Homo sapiens
tcacaacttgggttct

SEQ ID NO: 1236154 - DNA, 15 bp, Homo sapiens
tcacaagaagaccag

SEQ ID NO: 1236155 - DNA, 13 bp, Homo sapiens
tcacaagaagatt

SEQ ID NO: 1236156 - DNA, 20 bp, Homo sapiens
tcacaagcaacagactctca

SEQ ID NO: 1236157 - DNA, 14 bp, Homo sapiens
tcacaagcctcctg

SEQ ID NO: 1236158 - DNA, 23 bp, Homo sapiens
tcacaagcctcctgtacctcagt

SEQ ID NO: 1236159 - DNA, 20 bp, Homo sapiens
tcacaagggacgctttggga

SEQ ID NO: 1236160 - DNA, 20 bp, Homo sapiens
tcacaagtctcctagacact

SEQ ID NO: 1236161 - DNA, 22 bp, Homo sapiens
tcacaagtgaaaaacatccaga

SEQ ID NO: 1236162 - DNA, 12 bp, Homo sapiens
tcacaataaatg

SEQ ID NO: 1236163 - DNA, 17 bp, Homo sapiens
tcacaataaatggccag

SEQ ID NO: 1236164 - DNA, 18 bp, Homo sapiens
tcacaataaatgtattca

SEQ ID NO: 1236165 - DNA, 16 bp, Homo sapiens
tcacaatagaaactca

SEQ ID NO: 1236166 - DNA, 22 bp, Homo sapiens
tcacaatagccgatatcagaat

SEQ ID NO: 1236167 - DNA, 15 bp, Homo sapiens
tcacaattatgtgca

SEQ ID NO: 1236168 - DNA, 23 bp, Homo sapiens
tcacacaaagactccttgtggac

SEQ ID NO: 1236169 - DNA, 14 bp, Homo sapiens
tcacacaagctcct

SEQ ID NO: 1236170 - DNA, 16 bp, Homo sapiens
tcacacaagctcctta

SEQ ID NO: 1236171 - DNA, 10 bp, Homo sapiens
tcacacacac

SEQ ID NO: 1236172 - DNA, 16 bp, Homo sapiens
tcacacaccctgaggt

SEQ ID NO: 1236173 - DNA, 14 bp, Homo sapiens
tcacacactggacc

SEQ ID NO: 1236174 - DNA, 21 bp, Homo sapiens
tcacacactggaccccactgg

SEQ ID NO: 1236175 - DNA, 21 bp, Homo sapiens
tcacacaggacccccttcccc

SEQ ID NO: 1236176 - DNA, 21 bp, Homo sapiens
tcacacagtagctccaacact

SEQ ID NO: 1236177 - DNA, 23 bp, Homo sapiens
tcacacagtgggtggtggatctg

SEQ ID NO: 1236178 - DNA, 19 bp, Homo sapiens
tcacacagtgttagtgctg

SEQ ID NO: 1236179 - DNA, 16 bp, Homo sapiens
tcacacatcacattcc

SEQ ID NO: 1236180 - DNA, 19 bp, Homo sapiens
tcacacatctgggtgccct

SEQ ID NO: 1236181 - DNA, 16 bp, Homo sapiens
tcacaccagctaagga

SEQ ID NO: 1236182 - DNA, 22 bp, Homo sapiens
tcacacccaccgtccgccctgc

SEQ ID NO: 1236183 - DNA, 23 bp, Homo sapiens
tcacacccaccgtccgccctgct

SEQ ID NO: 1236184 - DNA, 24 bp, Homo sapiens
tcacacccaccgtccgccctgctc

SEQ ID NO: 1236185 - DNA, 14 bp, Homo sapiens
tcacacccctgtcc

SEQ ID NO: 1236186 - DNA, 23 bp, Homo sapiens
tcacaccgttcgtacgcccagga

SEQ ID NO: 1236187 - DNA, 13 bp, Homo sapiens
tcacacctctggg

SEQ ID NO: 1236188 - DNA, 20 bp, Homo sapiens
tcacacctgaactgaacacc

SEQ ID NO: 1236189 - DNA, 20 bp, Homo sapiens
tcacacctgactctgaaatc

SEQ ID NO: 1236190 - DNA, 16 bp, Homo sapiens
tcacacctgccctaaa

SEQ ID NO: 1236191 - DNA, 17 bp, Homo sapiens
tcacactacagatcagg

SEQ ID NO: 1236192 - DNA, 21 bp, Homo sapiens
tcacactcaaggacaggagcc

SEQ ID NO: 1236193 - DNA, 23 bp, Homo sapiens
tcacactcctgggctctgaacac

SEQ ID NO: 1236194 - DNA, 18 bp, Homo sapiens
tcacactctaactgtata

SEQ ID NO: 1236195 - DNA, 17 bp, Homo sapiens
tcacactctctgcagcc

SEQ ID NO: 1236196 - DNA, 18 bp, Homo sapiens
tcacactctctgcagccc

SEQ ID NO: 1236197 - DNA, 19 bp, Homo sapiens
tcacactctctgcagccca

SEQ ID NO: 1236198 - DNA, 20 bp, Homo sapiens
tcacactctctgcagcccag

SEQ ID NO: 1236199 - DNA, 20 bp, Homo sapiens
tcacactgatgggctggggc

SEQ ID NO: 1236200 - DNA, 22 bp, Homo sapiens
tcacactgatgggctggggcag

SEQ ID NO: 1236201 - DNA, 20 bp, Homo sapiens
tcacactgcaagagccttgg

SEQ ID NO: 1236202 - DNA, 16 bp, Homo sapiens
tcacactgctgtcctc

SEQ ID NO: 1236203 - DNA, 24 bp, Homo sapiens
tcacactggatccatcttgagcca

SEQ ID NO: 1236204 - DNA, 16 bp, Homo sapiens
tcacactgggtggtgg

SEQ ID NO: 1236205 - DNA, 18 bp, Homo sapiens
tcacactggtctgctgtc

SEQ ID NO: 1236206 - DNA, 14 bp, Homo sapiens
tcacactggtgctg

SEQ ID NO: 1236207 - DNA, 15 bp, Homo sapiens
tcacactggttctca

SEQ ID NO: 1236208 - DNA, 18 bp, Homo sapiens
tcaccaaagtattaatgt

SEQ ID NO: 1236209 - DNA, 17 bp, Homo sapiens
tcaccaaatagtgtgaa

SEQ ID NO: 1236210 - DNA, 16 bp, Homo sapiens
tcaccaagctcacagt

SEQ ID NO: 1236211 - DNA, 21 bp, Homo sapiens
tcaccaagctcacagttcctc

SEQ ID NO: 1236212 - DNA, 22 bp, Homo sapiens
tcaccaagctcacagttcctcg

SEQ ID NO: 1236213 - DNA, 13 bp, Homo sapiens
tcaccaaggaaac

SEQ ID NO: 1236214 - DNA, 22 bp, Homo sapiens
tcaccaaggatcggactctgcc

SEQ ID NO: 1236215 - DNA, 15 bp, Homo sapiens
tcaccaaggcagtgc

SEQ ID NO: 1236216 - DNA, 18 bp, Homo sapiens
tcaccaaggcagtgcatg

SEQ ID NO: 1236217 - DNA, 22 bp, Homo sapiens
tcaccaaggcagtgcatgcatg

SEQ ID NO: 1236218 - DNA, 20 bp, Homo sapiens
tcaccacaagctgagcagga

SEQ ID NO: 1236219 - DNA, 18 bp, Homo sapiens
tcaccacagtaagttcct

SEQ ID NO: 1236220 - DNA, 21 bp, Homo sapiens
tcaccacagtaagttcctact

SEQ ID NO: 1236221 - DNA, 24 bp, Homo sapiens
tcaccaccaataaatcagaccatg

SEQ ID NO: 1236222 - DNA, 13 bp, Homo sapiens
tcaccaccacact

SEQ ID NO: 1236223 - DNA, 16 bp, Homo sapiens
tcaccaccacactaca

SEQ ID NO: 1236224 - DNA, 11 bp, Homo sapiens
tcaccacccag

SEQ ID NO: 1236225 - DNA, 14 bp, Homo sapiens
tcaccaccccctgt

SEQ ID NO: 1236226 - DNA, 18 bp, Homo sapiens
tcaccaccccctgtccca

SEQ ID NO: 1236227 - DNA, 21 bp, Homo sapiens
tcaccaccccctgtcccattc

SEQ ID NO: 1236228 - DNA, 14 bp, Homo sapiens
tcaccaccttccca

SEQ ID NO: 1236229 - DNA, 15 bp, Homo sapiens
tcaccaccttcccag

SEQ ID NO: 1236230 - DNA, 18 bp, Homo sapiens
tcaccaccttcccagctc

SEQ ID NO: 1236231 - DNA, 16 bp, Homo sapiens
tcaccacgtggggctc

SEQ ID NO: 1236232 - DNA, 17 bp, Homo sapiens
tcaccactaccagccag

SEQ ID NO: 1236233 - DNA, 20 bp, Homo sapiens
tcaccactaccagccagcct

SEQ ID NO: 1236234 - DNA, 23 bp, Homo sapiens
tcaccagaaccagttaagagaca

SEQ ID NO: 1236235 - DNA, 19 bp, Homo sapiens
tcaccagagactttagggg

SEQ ID NO: 1236236 - DNA, 21 bp, Homo sapiens
tcaccagatttgctaatttat

SEQ ID NO: 1236237 - DNA, 21 bp, Homo sapiens
tcaccagccccactgccagca

SEQ ID NO: 1236238 - DNA, 19 bp, Homo sapiens
tcaccagcccggcctgctc

SEQ ID NO: 1236239 - DNA, 17 bp, Homo sapiens
tcaccagcgttgggttt

SEQ ID NO: 1236240 - DNA, 18 bp, Homo sapiens
tcaccagctatctgtcat

SEQ ID NO: 1236241 - DNA, 15 bp, Homo sapiens
tcaccagctcctccc

SEQ ID NO: 1236242 - DNA, 20 bp, Homo sapiens
tcaccagctgcctcttctgt

SEQ ID NO: 1236243 - DNA, 21 bp, Homo sapiens
tcaccaggctggagtgcagtg

SEQ ID NO: 1236244 - DNA, 21 bp, Homo sapiens
tcaccagggtccgcaccagct

SEQ ID NO: 1236245 - DNA, 16 bp, Homo sapiens
tcaccaggtgcatctg

SEQ ID NO: 1236246 - DNA, 15 bp, Homo sapiens
tcaccagtctgtaaa

SEQ ID NO: 1236247 - DNA, 21 bp, Homo sapiens
tcaccagtctgtctactgtgg

SEQ ID NO: 1236248 - DNA, 14 bp, Homo sapiens
tcaccagtggcctt

SEQ ID NO: 1236249 - DNA, 20 bp, Homo sapiens
tcaccagtgtcccctccact

SEQ ID NO: 1236250 - DNA, 23 bp, Homo sapiens
tcaccagtgttcctgaagctgct

SEQ ID NO: 1236251 - DNA, 14 bp, Homo sapiens
tcaccagttaaaag

SEQ ID NO: 1236252 - DNA, 20 bp, Homo sapiens
tcaccagttaaaagcatttt

SEQ ID NO: 1236253 - DNA, 21 bp, Homo sapiens
tcaccagttaaaagcatttta

SEQ ID NO: 1236254 - DNA, 17 bp, Homo sapiens
tcaccatagttttgttt

SEQ ID NO: 1236255 - DNA, 23 bp, Homo sapiens
tcaccatagttttgtttaatttg

SEQ ID NO: 1236256 - DNA, 14 bp, Homo sapiens
tcaccatccacctt

SEQ ID NO: 1236257 - DNA, 21 bp, Homo sapiens
tcaccatctcaggccacctgc

SEQ ID NO: 1236258 - DNA, 15 bp, Homo sapiens
tcaccatcttggcca

SEQ ID NO: 1236259 - DNA, 16 bp, Homo sapiens
tcaccatgggaggtgg

SEQ ID NO: 1236260 - DNA, 16 bp, Homo sapiens
tcaccatgtaagcact

SEQ ID NO: 1236261 - DNA, 15 bp, Homo sapiens
tcaccatgttggcca

SEQ ID NO: 1236262 - DNA, 21 bp, Homo sapiens
tcaccatgttggccaggctgt

SEQ ID NO: 1236263 - DNA, 22 bp, Homo sapiens
tcaccattgtgaagcacctact

SEQ ID NO: 1236264 - DNA, 17 bp, Homo sapiens
tcaccatttgattatgt

SEQ ID NO: 1236265 - DNA, 21 bp, Homo sapiens
tcacccaaacacttctgcttt

SEQ ID NO: 1236266 - DNA, 16 bp, Homo sapiens
tcacccaaagcctgtc

SEQ ID NO: 1236267 - DNA, 22 bp, Homo sapiens
tcacccaaagcctgtcccagga

SEQ ID NO: 1236268 - DNA, 18 bp, Homo sapiens
tcacccaccatggaccag

SEQ ID NO: 1236269 - DNA, 14 bp, Homo sapiens
tcacccactcctat

SEQ ID NO: 1236270 - DNA, 23 bp, Homo sapiens
tcacccactctggtggccacttc

SEQ ID NO: 1236271 - DNA, 13 bp, Homo sapiens
tcacccagcctgg

SEQ ID NO: 1236272 - DNA, 17 bp, Homo sapiens
tcacccagctaatctgt

SEQ ID NO: 1236273 - DNA, 22 bp, Homo sapiens
tcacccaggctctggagccaga

SEQ ID NO: 1236274 - DNA, 19 bp, Homo sapiens
tcacccaggctggactgca

SEQ ID NO: 1236275 - DNA, 12 bp, Homo sapiens
tcaccccaccct

SEQ ID NO: 1236276 - DNA, 14 bp, Homo sapiens
tcaccccagaggcc

SEQ ID NO: 1236277 - DNA, 15 bp, Homo sapiens
tcaccccagctccga

SEQ ID NO: 1236278 - DNA, 13 bp, Homo sapiens
tcacccccagctt

SEQ ID NO: 1236279 - DNA, 14 bp, Homo sapiens
tcacccccatccct

SEQ ID NO: 1236280 - DNA, 13 bp, Homo sapiens
tcaccccccactc

SEQ ID NO: 1236281 - DNA, 14 bp, Homo sapiens
tcaccccccactca

SEQ ID NO: 1236282 - DNA, 20 bp, Homo sapiens
tcacccccgacggtgtggct

SEQ ID NO: 1236283 - DNA, 19 bp, Homo sapiens
tcaccccctcccaccccca

SEQ ID NO: 1236284 - DNA, 23 bp, Homo sapiens
tcaccccctcccacccccagccc

SEQ ID NO: 1236285 - DNA, 13 bp, Homo sapiens
tcacccctccagg

SEQ ID NO: 1236286 - DNA, 14 bp, Homo sapiens
tcacccctccagga

SEQ ID NO: 1236287 - DNA, 18 bp, Homo sapiens
tcacccctccctccctct

SEQ ID NO: 1236288 - DNA, 20 bp, Homo sapiens
tcacccctccctccctcttt

SEQ ID NO: 1236289 - DNA, 13 bp, Homo sapiens
tcacccctgcact

SEQ ID NO: 1236290 - DNA, 19 bp, Homo sapiens
tcaccctaccaactttact

SEQ ID NO: 1236291 - DNA, 15 bp, Homo sapiens
tcaccctacctgtgc

SEQ ID NO: 1236292 - DNA, 12 bp, Homo sapiens
tcaccctcaccc

SEQ ID NO: 1236293 - DNA, 14 bp, Homo sapiens
tcaccctccacctc

SEQ ID NO: 1236294 - DNA, 14 bp, Homo sapiens
tcaccctctgtccc

SEQ ID NO: 1236295 - DNA, 20 bp, Homo sapiens
tcaccctctgtccccacgag

SEQ ID NO: 1236296 - DNA, 18 bp, Homo sapiens
tcaccctcttcctgtgat

SEQ ID NO: 1236297 - DNA, 12 bp, Homo sapiens
tcaccctgcaga

SEQ ID NO: 1236298 - DNA, 23 bp, Homo sapiens
tcaccctgcagagctatggtgag

SEQ ID NO: 1236299 - DNA, 17 bp, Homo sapiens
tcaccctgcaggacttg

SEQ ID NO: 1236300 - DNA, 20 bp, Homo sapiens
tcaccctgcccgctcccaac

SEQ ID NO: 1236301 - DNA, 17 bp, Homo sapiens
tcaccctgggagccagt

SEQ ID NO: 1236302 - DNA, 13 bp, Homo sapiens
tcaccctggggat

SEQ ID NO: 1236303 - DNA, 15 bp, Homo sapiens
tcaccctggggctgc

SEQ ID NO: 1236304 - DNA, 19 bp, Homo sapiens
tcaccctgtgaccctctca

SEQ ID NO: 1236305 - DNA, 12 bp, Homo sapiens
tcaccctgtggg

SEQ ID NO: 1236306 - DNA, 23 bp, Homo sapiens
tcaccctgtgggaccgcctggcc

SEQ ID NO: 1236307 - DNA, 22 bp, Homo sapiens
tcaccctgtgggtgtctccctc

SEQ ID NO: 1236308 - DNA, 19 bp, Homo sapiens
tcacccttaacccaaggag

SEQ ID NO: 1236309 - DNA, 13 bp, Homo sapiens
tcacccttcctgg

SEQ ID NO: 1236310 - DNA, 15 bp, Homo sapiens
tcacccttcctggcc

SEQ ID NO: 1236311 - DNA, 17 bp, Homo sapiens
tcacccttcctggccca

SEQ ID NO: 1236312 - DNA, 22 bp, Homo sapiens
tcacccttcctggcccaggcct

SEQ ID NO: 1236313 - DNA, 12 bp, Homo sapiens
tcacccttctgg

SEQ ID NO: 1236314 - DNA, 13 bp, Homo sapiens
tcacccttctggg

SEQ ID NO: 1236315 - DNA, 22 bp, Homo sapiens
tcacccttgcaccgtcctcagc

SEQ ID NO: 1236316 - DNA, 13 bp, Homo sapiens
tcacccttgtcct

SEQ ID NO: 1236317 - DNA, 15 bp, Homo sapiens
tcaccctttgctgtg

SEQ ID NO: 1236318 - DNA, 16 bp, Homo sapiens
tcaccgacagcggcct

SEQ ID NO: 1236319 - DNA, 17 bp, Homo sapiens
tcaccgacgcgtctcct

SEQ ID NO: 1236320 - DNA, 22 bp, Homo sapiens
tcaccgactgaaaatattgttt

SEQ ID NO: 1236321 - DNA, 13 bp, Homo sapiens
tcaccgagcagag

SEQ ID NO: 1236322 - DNA, 14 bp, Homo sapiens
tcaccgagcagagg

SEQ ID NO: 1236323 - DNA, 20 bp, Homo sapiens
tcaccgcggacgtgctggcc

SEQ ID NO: 1236324 - DNA, 12 bp, Homo sapiens
tcaccgctgggt

SEQ ID NO: 1236325 - DNA, 15 bp, Homo sapiens
tcaccggctctcacc

SEQ ID NO: 1236326 - DNA, 20 bp, Homo sapiens
tcaccgggagggctgctggg

SEQ ID NO: 1236327 - DNA, 16 bp, Homo sapiens
tcaccgggatgaacct

SEQ ID NO: 1236328 - DNA, 19 bp, Homo sapiens
tcaccgtatctcaggaagt

SEQ ID NO: 1236329 - DNA, 19 bp, Homo sapiens
tcaccgtcccgcacagtgg

SEQ ID NO: 1236330 - DNA, 21 bp, Homo sapiens
tcaccgtggaccttcctgcca

SEQ ID NO: 1236331 - DNA, 16 bp, Homo sapiens
tcaccgtgggctccct

SEQ ID NO: 1236332 - DNA, 17 bp, Homo sapiens
tcaccgtgggctccctg

SEQ ID NO: 1236333 - DNA, 19 bp, Homo sapiens
tcacctaagcacttctaga

SEQ ID NO: 1236334 - DNA, 14 bp, Homo sapiens
tcacctaatgttta

SEQ ID NO: 1236335 - DNA, 21 bp, Homo sapiens
tcacctaatgtttatgagcca

SEQ ID NO: 1236336 - DNA, 23 bp, Homo sapiens
tcacctactcaatgcctggagac

SEQ ID NO: 1236337 - DNA, 20 bp, Homo sapiens
tcacctagaacgtgcatcct

SEQ ID NO: 1236338 - DNA, 14 bp, Homo sapiens
tcacctagagccag

SEQ ID NO: 1236339 - DNA, 15 bp, Homo sapiens
tcacctagagccaga

SEQ ID NO: 1236340 - DNA, 17 bp, Homo sapiens
tcacctagcatgtgtaa

SEQ ID NO: 1236341 - DNA, 13 bp, Homo sapiens
tcacctcagcctg

SEQ ID NO: 1236342 - DNA, 14 bp, Homo sapiens
tcacctcagcctgg

SEQ ID NO: 1236343 - DNA, 16 bp, Homo sapiens
tcacctcagcctggag

SEQ ID NO: 1236344 - DNA, 13 bp, Homo sapiens
tcacctcagctga

SEQ ID NO: 1236345 - DNA, 14 bp, Homo sapiens
tcacctcagctgat

SEQ ID NO: 1236346 - DNA, 18 bp, Homo sapiens
tcacctccaggttcaagt

SEQ ID NO: 1236347 - DNA, 17 bp, Homo sapiens
tcacctcccctccttgc

SEQ ID NO: 1236348 - DNA, 16 bp, Homo sapiens
tcacctccctgctcag

SEQ ID NO: 1236349 - DNA, 22 bp, Homo sapiens
tcacctcggagggatggagaaa

SEQ ID NO: 1236350 - DNA, 17 bp, Homo sapiens
tcacctcgtctccctgg

SEQ ID NO: 1236351 - DNA, 23 bp, Homo sapiens
tcacctctacccaaaccctaggt

SEQ ID NO: 1236352 - DNA, 15 bp, Homo sapiens
tcacctctactgtct

SEQ ID NO: 1236353 - DNA, 17 bp, Homo sapiens
tcacctctatccaaaga

SEQ ID NO: 1236354 - DNA, 10 bp, Homo sapiens
tcacctctga

SEQ ID NO: 1236355 - DNA, 17 bp, Homo sapiens
tcacctctgaggacaga

SEQ ID NO: 1236356 - DNA, 22 bp, Homo sapiens
tcacctctgatagactttgtga

SEQ ID NO: 1236357 - DNA, 12 bp, Homo sapiens
tcacctctgcct

SEQ ID NO: 1236358 - DNA, 13 bp, Homo sapiens
tcacctcttcctc

SEQ ID NO: 1236359 - DNA, 15 bp, Homo sapiens
tcacctcttcctctg

SEQ ID NO: 1236360 - DNA, 13 bp, Homo sapiens
tcacctcttgggg

SEQ ID NO: 1236361 - DNA, 17 bp, Homo sapiens
tcacctgaaacactgga

SEQ ID NO: 1236362 - DNA, 23 bp, Homo sapiens
tcacctgagcccggatgcttctc

SEQ ID NO: 1236363 - DNA, 14 bp, Homo sapiens
tcacctgcaagccc

SEQ ID NO: 1236364 - DNA, 16 bp, Homo sapiens
tcacctgcaagcccca

SEQ ID NO: 1236365 - DNA, 19 bp, Homo sapiens
tcacctgcaagccccaggg

SEQ ID NO: 1236366 - DNA, 22 bp, Homo sapiens
tcacctgcaagccccagggcct

SEQ ID NO: 1236367 - DNA, 13 bp, Homo sapiens
tcacctgcactaa

SEQ ID NO: 1236368 - DNA, 22 bp, Homo sapiens
tcacctgccccgtagagaatgt

SEQ ID NO: 1236369 - DNA, 20 bp, Homo sapiens
tcacctgcccctctgttctc

SEQ ID NO: 1236370 - DNA, 15 bp, Homo sapiens
tcacctgctccagaa

SEQ ID NO: 1236371 - DNA, 15 bp, Homo sapiens
tcacctgctggcccc

SEQ ID NO: 1236372 - DNA, 18 bp, Homo sapiens
tcacctggaggcaagagg

SEQ ID NO: 1236373 - DNA, 12 bp, Homo sapiens
tcacctggccct

SEQ ID NO: 1236374 - DNA, 14 bp, Homo sapiens
tcacctggccctgc

SEQ ID NO: 1236375 - DNA, 23 bp, Homo sapiens
tcacctggctgctaggccagagc

SEQ ID NO: 1236376 - DNA, 13 bp, Homo sapiens
tcacctgtaaaac

SEQ ID NO: 1236377 - DNA, 17 bp, Homo sapiens
tcacctgtactcttccg

SEQ ID NO: 1236378 - DNA, 14 bp, Homo sapiens
tcacctgtgacaaa

SEQ ID NO: 1236379 - DNA, 17 bp, Homo sapiens
tcacctgtgacaaagga

SEQ ID NO: 1236380 - DNA, 17 bp, Homo sapiens
tcacctgttatgtatga

SEQ ID NO: 1236381 - DNA, 21 bp, Homo sapiens
tcacctgtttttaagctgttt

SEQ ID NO: 1236382 - DNA, 15 bp, Homo sapiens
tcaccttcaaaatgt

SEQ ID NO: 1236383 - DNA, 16 bp, Homo sapiens
tcaccttcaaaatgtt

SEQ ID NO: 1236384 - DNA, 21 bp, Homo sapiens
tcaccttcaaaatgttctatt

SEQ ID NO: 1236385 - DNA, 22 bp, Homo sapiens
tcaccttcaaaatgttctattt

SEQ ID NO: 1236386 - DNA, 14 bp, Homo sapiens
tcaccttccatgtc

SEQ ID NO: 1236387 - DNA, 21 bp, Homo sapiens
tcaccttccatgtcaggccag

SEQ ID NO: 1236388 - DNA, 13 bp, Homo sapiens
tcaccttccctcg

SEQ ID NO: 1236389 - DNA, 13 bp, Homo sapiens
tcaccttcccttg

SEQ ID NO: 1236390 - DNA, 14 bp, Homo sapiens
tcaccttcctgtgg

SEQ ID NO: 1236391 - DNA, 20 bp, Homo sapiens
tcaccttctgggcaagggct

SEQ ID NO: 1236392 - DNA, 20 bp, Homo sapiens
tcaccttgcactcctcacac

SEQ ID NO: 1236393 - DNA, 19 bp, Homo sapiens
tcaccttgccgagagaggc

SEQ ID NO: 1236394 - DNA, 20 bp, Homo sapiens
tcacctttagaacaggagac

SEQ ID NO: 1236395 - DNA, 14 bp, Homo sapiens
tcacctttctgggc

SEQ ID NO: 1236396 - DNA, 16 bp, Homo sapiens
tcacctttctgggctt

SEQ ID NO: 1236397 - DNA, 23 bp, Homo sapiens
tcacctttctgggctttctcctg

SEQ ID NO: 1236398 - DNA, 21 bp, Homo sapiens
tcacctttgtaagacatttgt

SEQ ID NO: 1236399 - DNA, 17 bp, Homo sapiens
tcacctttgtgtatttt

SEQ ID NO: 1236400 - DNA, 18 bp, Homo sapiens
tcaccttttctgtggctg

SEQ ID NO: 1236401 - DNA, 13 bp, Homo sapiens
tcacgaactgttc

SEQ ID NO: 1236402 - DNA, 22 bp, Homo sapiens
tcacgaagtgttgcatggatgt

SEQ ID NO: 1236403 - DNA, 12 bp, Homo sapiens
tcacgacaatgt

SEQ ID NO: 1236404 - DNA, 13 bp, Homo sapiens
tcacgacgctgca

SEQ ID NO: 1236405 - DNA, 19 bp, Homo sapiens
tcacgagatcttccttccg

SEQ ID NO: 1236406 - DNA, 14 bp, Homo sapiens
tcacgattcatttt

SEQ ID NO: 1236407 - DNA, 13 bp, Homo sapiens
tcacgatttgcag

SEQ ID NO: 1236408 - DNA, 20 bp, Homo sapiens
tcacgccacccccgccccca

SEQ ID NO: 1236409 - DNA, 18 bp, Homo sapiens
tcacgccccgctgtgtcc

SEQ ID NO: 1236410 - DNA, 23 bp, Homo sapiens
tcacgccccgctgtgtcctccct

SEQ ID NO: 1236411 - DNA, 21 bp, Homo sapiens
tcacgcctatgatcccagcac

SEQ ID NO: 1236412 - DNA, 19 bp, Homo sapiens
tcacgcctgtaatcccagc

SEQ ID NO: 1236413 - DNA, 20 bp, Homo sapiens
tcacgcctgtaatcccagca

SEQ ID NO: 1236414 - DNA, 21 bp, Homo sapiens
tcacgcctgtaatcccagcac

SEQ ID NO: 1236415 - DNA, 22 bp, Homo sapiens
tcacgcctgtaatcccagcact

SEQ ID NO: 1236416 - DNA, 15 bp, Homo sapiens
tcacgcggcagcttc

SEQ ID NO: 1236417 - DNA, 18 bp, Homo sapiens
tcacgctccctgacttct

SEQ ID NO: 1236418 - DNA, 17 bp, Homo sapiens
tcacgctttcctgaatc

SEQ ID NO: 1236419 - DNA, 16 bp, Homo sapiens
tcacgctttttgaaaa

SEQ ID NO: 1236420 - DNA, 14 bp, Homo sapiens
tcacggaagagcct

SEQ ID NO: 1236421 - DNA, 16 bp, Homo sapiens
tcacggaagagccttg

SEQ ID NO: 1236422 - DNA, 23 bp, Homo sapiens
tcacggaccactcgaggcctgca

SEQ ID NO: 1236423 - DNA, 14 bp, Homo sapiens
tcacggctgcgcac

SEQ ID NO: 1236424 - DNA, 23 bp, Homo sapiens
tcacgggaccgtcagcatgggct

SEQ ID NO: 1236425 - DNA, 14 bp, Homo sapiens
tcacggggcctcca

SEQ ID NO: 1236426 - DNA, 17 bp, Homo sapiens
tcacggggcctccaacc

SEQ ID NO: 1236427 - DNA, 20 bp, Homo sapiens
tcacggggttccctcctagc

SEQ ID NO: 1236428 - DNA, 19 bp, Homo sapiens
tcacggggttggctgttcc

SEQ ID NO: 1236429 - DNA, 15 bp, Homo sapiens
tcacggtgacacagg

SEQ ID NO: 1236430 - DNA, 19 bp, Homo sapiens
tcacggtgacacaggtcag

SEQ ID NO: 1236431 - DNA, 20 bp, Homo sapiens
tcacgtaaatattcatatta

SEQ ID NO: 1236432 - DNA, 13 bp, Homo sapiens
tcacgtaccccac

SEQ ID NO: 1236433 - DNA, 14 bp, Homo sapiens
tcacgtgcaggaca

SEQ ID NO: 1236434 - DNA, 20 bp, Homo sapiens
tcacgtgcaggacagctctt

SEQ ID NO: 1236435 - DNA, 13 bp, Homo sapiens
tcacgtggcctcc

SEQ ID NO: 1236436 - DNA, 21 bp, Homo sapiens
tcacgtggcctccgcagtgtc

SEQ ID NO: 1236437 - DNA, 20 bp, Homo sapiens
tcacgttaccatttacatgt

SEQ ID NO: 1236438 - DNA, 22 bp, Homo sapiens
tcacgtttcatgtaatcctcaa

SEQ ID NO: 1236439 - DNA, 17 bp, Homo sapiens
tcacgtttggtgcttct

SEQ ID NO: 1236440 - DNA, 13 bp, Homo sapiens
tcactaaacttta

SEQ ID NO: 1236441 - DNA, 12 bp, Homo sapiens
tcactaaatctt

SEQ ID NO: 1236442 - DNA, 15 bp, Homo sapiens
tcactaaatgtaaaa

SEQ ID NO: 1236443 - DNA, 14 bp, Homo sapiens
tcactaacagggag

SEQ ID NO: 1236444 - DNA, 12 bp, Homo sapiens
tcactaaggact

SEQ ID NO: 1236445 - DNA, 19 bp, Homo sapiens
tcactaatcatgagaaaaa

SEQ ID NO: 1236446 - DNA, 19 bp, Homo sapiens
tcactacaagtcagctcca

SEQ ID NO: 1236447 - DNA, 19 bp, Homo sapiens
tcactacagggagaaaatc

SEQ ID NO: 1236448 - DNA, 13 bp, Homo sapiens
tcactaccctgat

SEQ ID NO: 1236449 - DNA, 19 bp, Homo sapiens
tcactaccctgattcttga

SEQ ID NO: 1236450 - DNA, 21 bp, Homo sapiens
tcactacgggggggagaagga

SEQ ID NO: 1236451 - DNA, 16 bp, Homo sapiens
tcactactttgtatca

SEQ ID NO: 1236452 - DNA, 16 bp, Homo sapiens
tcactagaagaaaagc

SEQ ID NO: 1236453 - DNA, 21 bp, Homo sapiens
tcactaggcccccacttgcct

SEQ ID NO: 1236454 - DNA, 22 bp, Homo sapiens
tcactaggcccccacttgcctc

SEQ ID NO: 1236455 - DNA, 23 bp, Homo sapiens
tcactaggcccccacttgcctct

SEQ ID NO: 1236456 - DNA, 15 bp, Homo sapiens
tcactagggctgagg

SEQ ID NO: 1236457 - DNA, 22 bp, Homo sapiens
tcactagtgaccccttccctgt

SEQ ID NO: 1236458 - DNA, 13 bp, Homo sapiens
tcactagtgccaa

SEQ ID NO: 1236459 - DNA, 17 bp, Homo sapiens
tcactataaatggtgtt

SEQ ID NO: 1236460 - DNA, 16 bp, Homo sapiens
tcactataatgatcta

SEQ ID NO: 1236461 - DNA, 15 bp, Homo sapiens
tcactatgcatttta

SEQ ID NO: 1236462 - DNA, 23 bp, Homo sapiens
tcactatggtatgctggccagca

SEQ ID NO: 1236463 - DNA, 22 bp, Homo sapiens
tcactattcttggaccatgcca

SEQ ID NO: 1236464 - DNA, 15 bp, Homo sapiens
tcactattgaaaaat

SEQ ID NO: 1236465 - DNA, 17 bp, Homo sapiens
tcactcaagaagcacac

SEQ ID NO: 1236466 - DNA, 15 bp, Homo sapiens
tcactcactcactcc

SEQ ID NO: 1236467 - DNA, 18 bp, Homo sapiens
tcactcactcactcccca

SEQ ID NO: 1236468 - DNA, 12 bp, Homo sapiens
tcactcactcca

SEQ ID NO: 1236469 - DNA, 15 bp, Homo sapiens
tcactcactccaaga

SEQ ID NO: 1236470 - DNA, 12 bp, Homo sapiens
tcactcactccc

SEQ ID NO: 1236471 - DNA, 14 bp, Homo sapiens
tcactcactcccca

SEQ ID NO: 1236472 - DNA, 15 bp, Homo sapiens
tcactcactctaaag

SEQ ID NO: 1236473 - DNA, 20 bp, Homo sapiens
tcactcagccaccctgagtt

SEQ ID NO: 1236474 - DNA, 20 bp, Homo sapiens
tcactcagcccctacccctg

SEQ ID NO: 1236475 - DNA, 11 bp, Homo sapiens
tcacactgtct

SEQ ID NO: 1236476 - DNA, 14 bp, Homo sapiens
tcacactgtcttcc

SEQ ID NO: 1236477 - DNA, 15 bp, Homo sapiens
tcacactgtcttccc

SEQ ID NO: 1236478 - DNA, 20 bp, Homo sapiens
tcacacttatattttatgaa

SEQ ID NO: 1236479 - DNA, 13 bp, Homo sapiens
tcacactttttat

SEQ ID NO: 1236480 - DNA, 18 bp, Homo sapiens
tcacactttttatttaat

SEQ ID NO: 1236481 - DNA, 19 bp, Homo sapiens
tcacagaaaaagcatgatg

SEQ ID NO: 1236482 - DNA, 21 bp, Homo sapiens
tcacagaaatcagaggagaga

SEQ ID NO: 1236483 - DNA, 12 bp, Homo sapiens
tcacagaagaat

SEQ ID NO: 1236484 - DNA, 13 bp, Homo sapiens
tcacagaaggatc

SEQ ID NO: 1236485 - DNA, 22 bp, Homo sapiens
tcacagaatcatatgattctgc

SEQ ID NO: 1236486 - DNA, 14 bp, Homo sapiens
tcacagacctggag

SEQ ID NO: 1236487 - DNA, 19 bp, Homo sapiens
tcacagagcacgcctgcca

SEQ ID NO: 1236488 - DNA, 20 bp, Homo sapiens
tcacagagcacgcctgccat

SEQ ID NO: 1236489 - DNA, 22 bp, Homo sapiens
tcacagagcacgcctgccatct

SEQ ID NO: 1236490 - DNA, 15 bp, Homo sapiens
tcacagagctttccg

SEQ ID NO: 1236491 - DNA, 20 bp, Homo sapiens
tcacagaggtctttcagctc

SEQ ID NO: 1236492 - DNA, 21 bp, Homo sapiens
tcacagatgggtattaaactt

SEQ ID NO: 1236493 - DNA, 22 bp, Homo sapiens
tcacagatgggtattaaacttg

SEQ ID NO: 1236494 - DNA, 18 bp, Homo sapiens
tcacagcagtgagactgg

SEQ ID NO: 1236495 - DNA, 19 bp, Homo sapiens
tcacagcccagaaccacag

SEQ ID NO: 1236496 - DNA, 13 bp, Homo sapiens
tcacagcccagcc

SEQ ID NO: 1236497 - DNA, 22 bp, Homo sapiens
tcacagcccgggtgtgcctgcc

SEQ ID NO: 1236498 - DNA, 15 bp, Homo sapiens
tcacagcctccaggg

SEQ ID NO: 1236499 - DNA, 17 bp, Homo sapiens
tcacagcctccagggcc

SEQ ID NO: 1236500 - DNA, 18 bp, Homo sapiens
tcacagcctccagggccc

SEQ ID NO: 1236501 - DNA, 14 bp, Homo sapiens
tcacagctgcagct

SEQ ID NO: 1236502 - DNA, 18 bp, Homo sapiens
tcacagctgcagctgggc

SEQ ID NO: 1236503 - DNA, 19 bp, Homo sapiens
tcacagctgcagctgggcc

SEQ ID NO: 1236504 - DNA, 16 bp, Homo sapiens
tcacaggactctgcct

SEQ ID NO: 1236505 - DNA, 17 bp, Homo sapiens
tcacaggactctgcctc

SEQ ID NO: 1236506 - DNA, 18 bp, Homo sapiens
tcacaggactctgcctcc

SEQ ID NO: 1236507 - DNA, 23 bp, Homo sapiens
tcacaggactctgcctcctcttc

SEQ ID NO: 1236508 - DNA, 19 bp, Homo sapiens
tcagagagtcaatgtcatt

SEQ ID NO: 1236509 - DNA, 16 bp, Homo sapiens
tcagagataggcctgt

SEQ ID NO: 1236510 - DNA, 21 bp, Homo sapiens
tcagagatcgtgtattgagat

SEQ ID NO: 1236511 - DNA, 23 bp, Homo sapiens
tcagagatgtccatttttacaag

SEQ ID NO: 1236512 - DNA, 15 bp, Homo sapiens
tcagagcactcccta

SEQ ID NO: 1236513 - DNA, 16 bp, Homo sapiens
tcagagcactccctaa

SEQ ID NO: 1236514 - DNA, 14 bp, Homo sapiens
tcagagcaggacct

SEQ ID NO: 1236515 - DNA, 15 bp, Homo sapiens
tcagagcaggaggcc

SEQ ID NO: 1236516 - DNA, 14 bp, Homo sapiens
tcagagcatgtgtc

SEQ ID NO: 1236517 - DNA, 13 bp, Homo sapiens
tcattttttctta

SEQ ID NO: 1236518 - DNA, 20 bp, Homo sapiens
tcatttttttctctctggag

SEQ ID NO: 1236519 - DNA, 18 bp, Homo sapiens
tcattttttttaagaaaa

SEQ ID NO: 1236520 - DNA, 18 bp, Homo sapiens
tcattttttttttatcag

SEQ ID NO: 1236521 - DNA, 19 bp, Homo sapiens
tccaaaaaaaaaaaaaata

SEQ ID NO: 1236522 - DNA, 21 bp, Homo sapiens
tccaaaaaaaaaaaaaataca

SEQ ID NO: 1236523 - DNA, 22 bp, Homo sapiens
tccaaaaaaaaaaaaaatacaa

SEQ ID NO: 1236524 - DNA, 23 bp, Homo sapiens
tccaaaaaaaaaaaaaatacaat

SEQ ID NO: 1236525 - DNA, 13 bp, Homo sapiens
tccaaaaaaagga

SEQ ID NO: 1236526 - DNA, 14 bp, Homo sapiens
tccaaaaaaaggaa

SEQ ID NO: 1236527 - DNA, 16 bp, Homo sapiens
tccaaaaaaaggaaaa

SEQ ID NO: 1236528 - DNA, 20 bp, Homo sapiens
tccaaaaaaaggaaaaataa

SEQ ID NO: 1236529 - DNA, 17 bp, Homo sapiens
tccaaaaatgtgtaaga

SEQ ID NO: 1236530 - DNA, 15 bp, Homo sapiens
tccaaaacttctctt

SEQ ID NO: 1236531 - DNA, 17 bp, Homo sapiens
tccaaaagcgccctcac

SEQ ID NO: 1236532 - DNA, 16 bp, Homo sapiens
tccaaaagctttttat

SEQ ID NO: 1236533 - DNA, 20 bp, Homo sapiens
tccaaaataatctatattaa

SEQ ID NO: 1236534 - DNA, 22 bp, Homo sapiens
tccaaaatgttggtcattttat

SEQ ID NO: 1236535 - DNA, 23 bp, Homo sapiens
tccaaaatttgaaatattaaaat

SEQ ID NO: 1236536 - DNA, 24 bp, Homo sapiens
tccaaaatttgtttgtcactgcca

SEQ ID NO: 1236537 - DNA, 12 bp, Homo sapiens
tccaaacaccgg

SEQ ID NO: 1236538 - DNA, 19 bp, Homo sapiens
tccaaacaccggcagaaaa

SEQ ID NO: 1236539 - DNA, 15 bp, Homo sapiens
tccaaacatccaaaa

SEQ ID NO: 1236540 - DNA, 16 bp, Homo sapiens
tccaaacatttcatcc

SEQ ID NO: 1236541 - DNA, 20 bp, Homo sapiens
tccaaaccagtttattctgt

SEQ ID NO: 1236542 - DNA, 12 bp, Homo sapiens
tccaaactaatt

SEQ ID NO: 1236543 - DNA, 22 bp, Homo sapiens
tccaaactcgcttaggtagaaa

SEQ ID NO: 1236544 - DNA, 19 bp, Homo sapiens
tccaaactgaagcagcctc

SEQ ID NO: 1236545 - DNA, 19 bp, Homo sapiens
tccaaactgattaaatatt

SEQ ID NO: 1236546 - DNA, 22 bp, Homo sapiens
tccaaacttggatttttgactc

SEQ ID NO: 1236547 - DNA, 15 bp, Homo sapiens
tccaaagactgtact

SEQ ID NO: 1236548 - DNA, 21 bp, Homo sapiens
tccaaagactgtactggccag

SEQ ID NO: 1236549 - DNA, 14 bp, Homo sapiens
tccaaagaggctgc

SEQ ID NO: 1236550 - DNA, 15 bp, Homo sapiens
tccaaagaggctgcc

SEQ ID NO: 1236551 - DNA, 20 bp, Homo sapiens
tccaaagagtagaattgcat

SEQ ID NO: 1236552 - DNA, 19 bp, Homo sapiens
tccaaagcaaaaccagaac

SEQ ID NO: 1236553 - DNA, 15 bp, Homo sapiens
tccaaagcagacagc

SEQ ID NO: 1236554 - DNA, 16 bp, Homo sapiens
tccaaagcttcccacg

SEQ ID NO: 1236555 - DNA, 20 bp, Homo sapiens
tccaaagctttattaccagt

SEQ ID NO: 1236556 - DNA, 23 bp, Homo sapiens
tccaaaggaataacctttctgga

SEQ ID NO: 1236557 - DNA, 23 bp, Homo sapiens
tccaaaggaatctccagttttca

SEQ ID NO: 1236558 - DNA, 18 bp, Homo sapiens
tccaaagggaatactcac

SEQ ID NO: 1236559 - DNA, 16 bp, Homo sapiens
tccaaaggggctgctg

SEQ ID NO: 1236560 - DNA, 17 bp, Homo sapiens
tccaaaggggctgctgg

SEQ ID NO: 1236561 - DNA, 13 bp, Homo sapiens
tccaaagtacact

SEQ ID NO: 1236562 - DNA, 14 bp, Homo sapiens
tccaaagtggagct

SEQ ID NO: 1236563 - DNA, 18 bp, Homo sapiens
tccaaagtggagctggga

SEQ ID NO: 1236564 - DNA, 15 bp, Homo sapiens
tccaaataaaatgtt

SEQ ID NO: 1236565 - DNA, 17 bp, Homo sapiens
tccaaataagaaaccta

SEQ ID NO: 1236566 - DNA, 19 bp, Homo sapiens
tccaaatattattcaagtg

SEQ ID NO: 1236567 - DNA, 18 bp, Homo sapiens
tccaaatctgatttcatt

SEQ ID NO: 1236568 - DNA, 18 bp, Homo sapiens
tccaaatgatcctagtaa

SEQ ID NO: 1236569 - DNA, 16 bp, Homo sapiens
tccaaatgcaatttga

SEQ ID NO: 1236570 - DNA, 13 bp, Homo sapiens
tccaaatgcccaa

SEQ ID NO: 1236571 - DNA, 14 bp, Homo sapiens
tccaaatgtccctc

SEQ ID NO: 1236572 - DNA, 22 bp, Homo sapiens
tccaaatgtcctccagaagcct

SEQ ID NO: 1236573 - DNA, 18 bp, Homo sapiens
tccaaatgtgtcagaata

SEQ ID NO: 1236574 - DNA, 23 bp, Homo sapiens
tccaaatgtttataaaggtaaaa

SEQ ID NO: 1236575 - DNA, 24 bp, Homo sapiens
tccaaatgtttataaaggtaaaat

SEQ ID NO: 1236576 - DNA, 12 bp, Homo sapiens
tccaaattatta

SEQ ID NO: 1236577 - DNA, 18 bp, Homo sapiens
tccaaattcagtttcata

SEQ ID NO: 1236578 - DNA, 16 bp, Homo sapiens
tccaaattgtttgtac

SEQ ID NO: 1236579 - DNA, 17 bp, Homo sapiens
tccaaattgtttgtaca

SEQ ID NO: 1236580 - DNA, 13 bp, Homo sapiens
tccaacaagaaga

SEQ ID NO: 1236581 - DNA, 16 bp, Homo sapiens
tccaacaagaagaaat

SEQ ID NO: 1236582 - DNA, 17 bp, Homo sapiens
tccaacaagaagaaata

SEQ ID NO: 1236583 - DNA, 21 bp, Homo sapiens
tccaacaagaagaaatatgaa

SEQ ID NO: 1236584 - DNA, 15 bp, Homo sapiens
tccaacaagcctcaa

SEQ ID NO: 1236585 - DNA, 19 bp, Homo sapiens
tccaacaccacagacacac

SEQ ID NO: 1236586 - DNA, 21 bp, Homo sapiens
tccaacaccacagacacacac

SEQ ID NO: 1236587 - DNA, 18 bp, Homo sapiens
tccaacactgaagtgctt

SEQ ID NO: 1236588 - DNA, 16 bp, Homo sapiens
tccaacactttgagca

SEQ ID NO: 1236589 - DNA, 17 bp, Homo sapiens
tccaacagaagaactgt

SEQ ID NO: 1236590 - DNA, 19 bp, Homo sapiens
tccaacagctcaagtcttc

SEQ ID NO: 1236591 - DNA, 21 bp, Homo sapiens
tccaacatttctcactgaaag

SEQ ID NO: 1236592 - DNA, 22 bp, Homo sapiens
tccaaccaagaggatttcttca

SEQ ID NO: 1236593 - DNA, 12 bp, Homo sapiens
tccaaccaggca

SEQ ID NO: 1236594 - DNA, 18 bp, Homo sapiens
tccaaccattcaaaaatt

SEQ ID NO: 1236595 - DNA, 20 bp, Homo sapiens
tccaacccaacccaatccct

SEQ ID NO: 1236596 - DNA, 17 bp, Homo sapiens
tccaaccccccacctgc

SEQ ID NO: 1236597 - DNA, 22 bp, Homo sapiens
tccaacccccgccacctcaggg

SEQ ID NO: 1236598 - DNA, 23 bp, Homo sapiens
tccaacccgtctggcccaccagg

SEQ ID NO: 1236599 - DNA, 13 bp, Homo sapiens
tccaaccctagca

SEQ ID NO: 1236600 - DNA, 14 bp, Homo sapiens
tccaaccctagcaa

SEQ ID NO: 1236601 - DNA, 13 bp, Homo sapiens
tccaaccctgccg

SEQ ID NO: 1236602 - DNA, 18 bp, Homo sapiens
tccaacctaacccctttc

SEQ ID NO: 1236603 - DNA, 16 bp, Homo sapiens
tccaacctctcggccc

SEQ ID NO: 1236604 - DNA, 14 bp, Homo sapiens
tccaacctggacaa

SEQ ID NO: 1236605 - DNA, 17 bp, Homo sapiens
tccaacgcccctgtggc

SEQ ID NO: 1236606 - DNA, 19 bp, Homo sapiens
tccaacgcccctgtggcca

SEQ ID NO: 1236607 - DNA, 20 bp, Homo sapiens
tccaacgcccctgtggccaa

SEQ ID NO: 1236608 - DNA, 21 bp, Homo sapiens
tccaacgcccctgtggccaac

SEQ ID NO: 1236609 - DNA, 21 bp, Homo sapiens
tccaactactaatagaataaa

SEQ ID NO: 1236610 - DNA, 23 bp, Homo sapiens
tccaactactaatagaataaagg

SEQ ID NO: 1236611 - DNA, 15 bp, Homo sapiens
tccaactagctggga

SEQ ID NO: 1236612 - DNA, 18 bp, Homo sapiens
tccaactcccttaaaata

SEQ ID NO: 1236613 - DNA, 21 bp, Homo sapiens
tccaactgcctaaggcccttt

SEQ ID NO: 1236614 - DNA, 16 bp, Homo sapiens
tccaactggatgttga

SEQ ID NO: 1236615 - DNA, 19 bp, Homo sapiens
tccaactggcactctgtgg

SEQ ID NO: 1236616 - DNA, 20 bp, Homo sapiens
tccaactgtatatattccca

SEQ ID NO: 1236617 - DNA, 19 bp, Homo sapiens
tccaactgtgttcattaga

SEQ ID NO: 1236618 - DNA, 15 bp, Homo sapiens
tccaacttcatttga

SEQ ID NO: 1236619 - DNA, 18 bp, Homo sapiens
tccaagaatggaagcctg

SEQ ID NO: 1236620 - DNA, 20 bp, Homo sapiens
tccaagacatgtctgttcta

SEQ ID NO: 1236621 - DNA, 16 bp, Homo sapiens
tccaagaccaccaggg

SEQ ID NO: 1236622 - DNA, 15 bp, Homo sapiens
tccaagacctggtgt

SEQ ID NO: 1236623 - DNA, 11 bp, Homo sapiens
tccaagactga

SEQ ID NO: 1236624 - DNA, 15 bp, Homo sapiens
tccaagactgaagac

SEQ ID NO: 1236625 - DNA, 17 bp, Homo sapiens
tccaagagaactaaagc

SEQ ID NO: 1236626 - DNA, 21 bp, Homo sapiens
tccaagagctacataatttag

SEQ ID NO: 1236627 - DNA, 16 bp, Homo sapiens
tccaagcacagagcct

SEQ ID NO: 1236628 - DNA, 23 bp, Homo sapiens
tccaagcacagagcctggcccca

SEQ ID NO: 1236629 - DNA, 14 bp, Homo sapiens
tccaagcagactcc

SEQ ID NO: 1236630 - DNA, 19 bp, Homo sapiens
tccaagcagactccagccc

SEQ ID NO: 1236631 - DNA, 23 bp, Homo sapiens
tccaagccccatcttctaaatgg

SEQ ID NO: 1236632 - DNA, 15 bp, Homo sapiens
tccaagccccctggc

SEQ ID NO: 1236633 - DNA, 16 bp, Homo sapiens
tccaagccccctggca

SEQ ID NO: 1236634 - DNA, 22 bp, Homo sapiens
tccaagccccctggcagctgcc

SEQ ID NO: 1236635 - DNA, 23 bp, Homo sapiens
tccaagccccctggcagctgccc

SEQ ID NO: 1236636 - DNA, 14 bp, Homo sapiens
tccaagcctccaca

SEQ ID NO: 1236637 - DNA, 23 bp, Homo sapiens
tccaagcctctctggcactttga

SEQ ID NO: 1236638 - DNA, 14 bp, Homo sapiens
tccaagcctgcctc

SEQ ID NO: 1236639 - DNA, 17 bp, Homo sapiens
tccaagcctgcctccca

SEQ ID NO: 1236640 - DNA, 12 bp, Homo sapiens
tccaagcctggc

SEQ ID NO: 1236641 - DNA, 15 bp, Homo sapiens
tccaagcctggcacc

SEQ ID NO: 1236642 - DNA, 18 bp, Homo sapiens
tccaagcctggcacccac

SEQ ID NO: 1236643 - DNA, 21 bp, Homo sapiens
tccaagcgaggtcaacagaga

SEQ ID NO: 1236644 - DNA, 23 bp, Homo sapiens
tccaagcgaggtcaacagagaag

SEQ ID NO: 1236645 - DNA, 16 bp, Homo sapiens
tccaaggaaaattgaa

SEQ ID NO: 1236646 - DNA, 22 bp, Homo sapiens
tccaaggaaacattttatcatt

SEQ ID NO: 1236647 - DNA, 21 bp, Homo sapiens
tccaaggaagggatgtatttg

SEQ ID NO: 1236648 - DNA, 19 bp, Homo sapiens
tccaaggagaaacagagac

SEQ ID NO: 1236649 - DNA, 20 bp, Homo sapiens
tccaaggagaaacagagaca

SEQ ID NO: 1236650 - DNA, 20 bp, Homo sapiens
tccaaggaggggctgtaaaa

SEQ ID NO: 1236651 - DNA, 19 bp, Homo sapiens
tccaaggccagaaggaggg

SEQ ID NO: 1236652 - DNA, 18 bp, Homo sapiens
tccaaggccctgcttttt

SEQ ID NO: 1236653 - DNA, 17 bp, Homo sapiens
tccaaggccgcggccca

SEQ ID NO: 1236654 - DNA, 23 bp, Homo sapiens
tccaagggagggtgcagccctct

SEQ ID NO: 1236655 - DNA, 22 bp, Homo sapiens
tccaagggcccggtttcccggc

SEQ ID NO: 1236656 - DNA, 14 bp, Homo sapiens
tccaagggccgtgc

SEQ ID NO: 1236657 - DNA, 23 bp, Homo sapiens
tccaagggccgtgcccttgccct

SEQ ID NO: 1236658 - DNA, 16 bp, Homo sapiens
tccaagggcttctgca

SEQ ID NO: 1236659 - DNA, 19 bp, Homo sapiens
tccaagggcttctgcaccc

SEQ ID NO: 1236660 - DNA, 22 bp, Homo sapiens
tccaagggcttctgcaccctcc

SEQ ID NO: 1236661 - DNA, 19 bp, Homo sapiens
tccaagggttgagagccag

SEQ ID NO: 1236662 - DNA, 21 bp, Homo sapiens
tccaagggtttcgactggtcc

SEQ ID NO: 1236663 - DNA, 14 bp, Homo sapiens
tccaaggtgcacat

SEQ ID NO: 1236664 - DNA, 14 bp, Homo sapiens
tccaaggtggcaga

SEQ ID NO: 1236665 - DNA, 18 bp, Homo sapiens
tccaaggtggcagatgtc

SEQ ID NO: 1236666 - DNA, 15 bp, Homo sapiens
tccaaggtttataaa

SEQ ID NO: 1236667 - DNA, 19 bp, Homo sapiens
tccaaggtttataaagcag

SEQ ID NO: 1236668 - DNA, 21 bp, Homo sapiens
tccaaggtttataaagcagat

SEQ ID NO: 1236669 - DNA, 14 bp, Homo sapiens
tccaagtaccaatg

SEQ ID NO: 1236670 - DNA, 14 bp, Homo sapiens
tccaagtcaacact

SEQ ID NO: 1236671 - DNA, 18 bp, Homo sapiens
tccaagtccaacctgcct

SEQ ID NO: 1236672 - DNA, 14 bp, Homo sapiens
tccaagtctccacc

SEQ ID NO: 1236673 - DNA, 19 bp, Homo sapiens
tccaagtctctctgtgaat

SEQ ID NO: 1236674 - DNA, 17 bp, Homo sapiens
tccaagtgaacactagc

SEQ ID NO: 1236675 - DNA, 17 bp, Homo sapiens
tccaagtgccagaggtg

SEQ ID NO: 1236676 - DNA, 20 bp, Homo sapiens
tccaagtgttataccaacta

SEQ ID NO: 1236677 - DNA, 19 bp, Homo sapiens
tccaagttcttcacctcta

SEQ ID NO: 1236678 - DNA, 16 bp, Homo sapiens
tccaagttggactggg

SEQ ID NO: 1236679 - DNA, 21 bp, Homo sapiens
tccaataaaaacattttgaag

SEQ ID NO: 1236680 - DNA, 18 bp, Homo sapiens
tccaataaagtgccttct

SEQ ID NO: 1236681 - DNA, 20 bp, Homo sapiens
tccaataaagtgccttctgg

SEQ ID NO: 1236682 - DNA, 23 bp, Homo sapiens
tccaataaagtgccttctgggct

SEQ ID NO: 1236683 - DNA, 15 bp, Homo sapiens
tccaataccctagaa

SEQ ID NO: 1236684 - DNA, 17 bp, Homo sapiens
tccaatagaaagaaact

SEQ ID NO: 1236685 - DNA, 23 bp, Homo sapiens
tccaatatcatgtcttgtgcata

SEQ ID NO: 1236686 - DNA, 18 bp, Homo sapiens
tccaatatgactcagaga

SEQ ID NO: 1236687 - DNA, 11 bp, Homo sapiens
tccaatatttg

SEQ ID NO: 1236688 - DNA, 12 bp, Homo sapiens
tccaatatttgg

SEQ ID NO: 1236689 - DNA, 17 bp, Homo sapiens
tccaatattttgccttt

SEQ ID NO: 1236690 - DNA, 14 bp, Homo sapiens
tccaatcctttcca

SEQ ID NO: 1236691 - DNA, 22 bp, Homo sapiens
tccaatgatacccaacagttta

SEQ ID NO: 1236692 - DNA, 17 bp, Homo sapiens
tccaatgctctggagtg

SEQ ID NO: 1236693 - DNA, 15 bp, Homo sapiens
tccaatgcttcttat

SEQ ID NO: 1236694 - DNA, 18 bp, Homo sapiens
tccaatggagttcagaga

SEQ ID NO: 1236695 - DNA, 18 bp, Homo sapiens
tccaatgtggttggtcaa

SEQ ID NO: 1236696 - DNA, 22 bp, Homo sapiens
tccaatgtggttggtcaaatca

SEQ ID NO: 1236697 - DNA, 21 bp, Homo sapiens
tccaatgttttattggggaat

SEQ ID NO: 1236698 - DNA, 23 bp, Homo sapiens
tccaattatttgactttaattta

SEQ ID NO: 1236699 - DNA, 19 bp, Homo sapiens
tccaattccttgcacatag

SEQ ID NO: 1236700 - DNA, 22 bp, Homo sapiens
tccaattctaaatccgacttga

SEQ ID NO: 1236701 - DNA, 15 bp, Homo sapiens
tccaattctgaaata

SEQ ID NO: 1236702 - DNA, 20 bp, Homo sapiens
tccaattctgaaatactttt

SEQ ID NO: 1236703 - DNA, 13 bp, Homo sapiens
tccaattgatgta

SEQ ID NO: 1236704 - DNA, 22 bp, Homo sapiens
tccaatttgtaaaaacagcatt

SEQ ID NO: 1236705 - DNA, 12 bp, Homo sapiens
tccacaaaataa

SEQ ID NO: 1236706 - DNA, 16 bp, Homo sapiens
tccacaagattcccag

SEQ ID NO: 1236707 - DNA, 23 bp, Homo sapiens
tccacaagattcccagagacagg

SEQ ID NO: 1236708 - DNA, 17 bp, Homo sapiens
tccacaaggaataaatg

SEQ ID NO: 1236709 - DNA, 12 bp, Homo sapiens
tccacacacaga

SEQ ID NO: 1236710 - DNA, 19 bp, Homo sapiens
tccacacacagaggaagag

SEQ ID NO: 1236711 - DNA, 14 bp, Homo sapiens
tccacacacgcagg

SEQ ID NO: 1236712 - DNA, 19 bp, Homo sapiens
tccacacacgcaggaactc

SEQ ID NO: 1236713 - DNA, 17 bp, Homo sapiens
tccacacattccagcca

SEQ ID NO: 1236714 - DNA, 18 bp, Homo sapiens
tccacacattccagccag

SEQ ID NO: 1236715 - DNA, 22 bp, Homo sapiens
tccacacattccagccaggccc

SEQ ID NO: 1236716 - DNA, 23 bp, Homo sapiens
tccacacattccagccaggccca

SEQ ID NO: 1236717 - DNA, 20 bp, Homo sapiens
tccacaccactgttgccttt

SEQ ID NO: 1236718 - DNA, 21 bp, Homo sapiens
tccacaccttttattgacaca

SEQ ID NO: 1236719 - DNA, 17 bp, Homo sapiens
tccacactgccggcagg

SEQ ID NO: 1236720 - DNA, 12 bp, Homo sapiens
tccacagagagg

SEQ ID NO: 1236721 - DNA, 16 bp, Homo sapiens
tccacagagtgagcca

SEQ ID NO: 1236722 - DNA, 20 bp, Homo sapiens
tccacagagtgagccagtga

SEQ ID NO: 1236723 - DNA, 18 bp, Homo sapiens
tccacagattcactttgt

SEQ ID NO: 1236724 - DNA, 17 bp, Homo sapiens
tccacagcaaccccagg

SEQ ID NO: 1236725 - DNA, 21 bp, Homo sapiens
tccacagcgagggcagctgct

SEQ ID NO: 1236726 - DNA, 21 bp, Homo sapiens
tccacaggacacgaaggctgc

SEQ ID NO: 1236727 - DNA, 22 bp, Homo sapiens
tccacaggacacgaaggctgcc

SEQ ID NO: 1236728 - DNA, 15 bp, Homo sapiens
tccacaggggcaggc

SEQ ID NO: 1236729 - DNA, 19 bp, Homo sapiens
tccacaggggcaggcctgg

SEQ ID NO: 1236730 - DNA, 14 bp, Homo sapiens
tccacaggggccac

SEQ ID NO: 1236731 - DNA, 18 bp, Homo sapiens
tccacaggggccaccacc

SEQ ID NO: 1236732 - DNA, 22 bp, Homo sapiens
tccacagtgttcatttgaaaga

SEQ ID NO: 1236733 - DNA, 19 bp, Homo sapiens
tccacagtgttgtgcccct

SEQ ID NO: 1236734 - DNA, 17 bp, Homo sapiens
tccacagtgtttatatt

SEQ ID NO: 1236735 - DNA, 15 bp, Homo sapiens
tccacagttatctta

SEQ ID NO: 1236736 - DNA, 22 bp, Homo sapiens
tccacagttatcttagctggat

SEQ ID NO: 1236737 - DNA, 15 bp, Homo sapiens
tccacatccccagag

SEQ ID NO: 1236738 - DNA, 18 bp, Homo sapiens
tccacatccccagagccc

SEQ ID NO: 1236739 - DNA, 19 bp, Homo sapiens
tccacatccccagagccca

SEQ ID NO: 1236740 - DNA, 22 bp, Homo sapiens
tccacatccccagagcccagct

SEQ ID NO: 1236741 - DNA, 12 bp, Homo sapiens
tccacatcctcc

SEQ ID NO: 1236742 - DNA, 12 bp, Homo sapiens
tccacatcctct

SEQ ID NO: 1236743 - DNA, 17 bp, Homo sapiens
tccacatctgcctcctc

SEQ ID NO: 1236744 - DNA, 16 bp, Homo sapiens
tccagagcttgtgctc

SEQ ID NO: 1236745 - DNA, 21 bp, Homo sapiens
tccagaggaacaagcatgtct

SEQ ID NO: 1236746 - DNA, 16 bp, Homo sapiens
tccagaggacctgaga

SEQ ID NO: 1236747 - DNA, 19 bp, Homo sapiens
tccagaggactctgcttaa

SEQ ID NO: 1236748 - DNA, 14 bp, Homo sapiens
tccagaggtcctcc

SEQ ID NO: 1236749 - DNA, 22 bp, Homo sapiens
tccagaggtgtcgggacatggt

SEQ ID NO: 1236750 - DNA, 20 bp, Homo sapiens
tccagagtccggaggcagca

SEQ ID NO: 1236751 - DNA, 14 bp, Homo sapiens
tccagagtctgagc

SEQ ID NO: 1236752 - DNA, 15 bp, Homo sapiens
tccagatagtgtagc

SEQ ID NO: 1236753 - DNA, 16 bp, Homo sapiens
tccagatccagactgt

SEQ ID NO: 1236754 - DNA, 15 bp, Homo sapiens
tccagatgcagggca

SEQ ID NO: 1236755 - DNA, 18 bp, Homo sapiens
tccagatgcagggcagtc

SEQ ID NO: 1236756 - DNA, 21 bp, Homo sapiens
tccagatgtaggggaagagat

SEQ ID NO: 1236757 - DNA, 19 bp, Homo sapiens
tccagatgtttccagactt

SEQ ID NO: 1236758 - DNA, 21 bp, Homo sapiens
tccagcaaaatggaagcaaag

SEQ ID NO: 1236759 - DNA, 24 bp, Homo sapiens
tccagcaaaatggaagcaaagaca

SEQ ID NO: 1236760 - DNA, 18 bp, Homo sapiens
tccagcaactgcccttcc

SEQ ID NO: 1236761 - DNA, 19 bp, Homo sapiens
tccagcaactgcccttcca

SEQ ID NO: 1236762 - DNA, 22 bp, Homo sapiens
tccagcaataagaaatgaacaa

SEQ ID NO: 1236763 - DNA, 21 bp, Homo sapiens
tccagcaattctcctgcctca

SEQ ID NO: 1236764 - DNA, 12 bp, Homo sapiens
tccagcacagcc

SEQ ID NO: 1236765 - DNA, 13 bp, Homo sapiens
tccagcaccttct

SEQ ID NO: 1236766 - DNA, 18 bp, Homo sapiens
tccagcaccttctttctg

SEQ ID NO: 1236767 - DNA, 20 bp, Homo sapiens
tccagcaccttctttctgga

SEQ ID NO: 1236768 - DNA, 20 bp, Homo sapiens
tccagcactcgattgttgta

SEQ ID NO: 1236769 - DNA, 23 bp, Homo sapiens
tccagcagaagacaaaaagacaa

SEQ ID NO: 1236770 - DNA, 14 bp, Homo sapiens
tccagcagaggtga

SEQ ID NO: 1236771 - DNA, 19 bp, Homo sapiens
tccagcagcagaatggaaa

SEQ ID NO: 1236772 - DNA, 12 bp, Homo sapiens
tccagcagggaa

SEQ ID NO: 1236773 - DNA, 16 bp, Homo sapiens
tccagcagtgaaactt

SEQ ID NO: 1236774 - DNA, 18 bp, Homo sapiens
tccagcatccagcctgtg

SEQ ID NO: 1236775 - DNA, 20 bp, Homo sapiens
tccagccacggagggaggca

SEQ ID NO: 1236776 - DNA, 13 bp, Homo sapiens
tccagccagcgcc

SEQ ID NO: 1236777 - DNA, 23 bp, Homo sapiens
tccagccaggcccaggccagccc

SEQ ID NO: 1236778 - DNA, 19 bp, Homo sapiens
tccagccatcaagagactg

SEQ ID NO: 1236779 - DNA, 24 bp, Homo sapiens
tccagccatcaagagactgagtca

SEQ ID NO: 1236780 - DNA, 15 bp, Homo sapiens
tccagcccacattgg

SEQ ID NO: 1236781 - DNA, 19 bp, Homo sapiens
tccagcccccagtgcgctc

SEQ ID NO: 1236782 - DNA, 14 bp, Homo sapiens
tccagcccctctgg

SEQ ID NO: 1236783 - DNA, 18 bp, Homo sapiens
tccagcccctctggtcgc

SEQ ID NO: 1236784 - DNA, 12 bp, Homo sapiens
tccagcccctgg

SEQ ID NO: 1236785 - DNA, 14 bp, Homo sapiens
tccagcccctggac

SEQ ID NO: 1236786 - DNA, 14 bp, Homo sapiens
tccagcccctgtcc

SEQ ID NO: 1236787 - DNA, 15 bp, Homo sapiens
tccagcccctgtccc

SEQ ID NO: 1236788 - DNA, 16 bp, Homo sapiens
tccagcccctgtccca

SEQ ID NO: 1236789 - DNA, 18 bp, Homo sapiens
tccagcccctttgcctct

SEQ ID NO: 1236790 - DNA, 15 bp, Homo sapiens
tccagcccgggagcc

SEQ ID NO: 1236791 - DNA, 13 bp, Homo sapiens
tccagccctgccc

SEQ ID NO: 1236792 - DNA, 19 bp, Homo sapiens
tccagccctgcccaccctc

SEQ ID NO: 1236793 - DNA, 20 bp, Homo sapiens
tccagccctgcccaccctcc

SEQ ID NO: 1236794 - DNA, 13 bp, Homo sapiens
tccagccctggtt

SEQ ID NO: 1236795 - DNA, 19 bp, Homo sapiens
tccagccgccattgccacc

SEQ ID NO: 1236796 - DNA, 21 bp, Homo sapiens
tccagccgccattgccaccag

SEQ ID NO: 1236797 - DNA, 23 bp, Homo sapiens
tccagccgccattgccaccagga

SEQ ID NO: 1236798 - DNA, 13 bp, Homo sapiens
tccagcctcccca

SEQ ID NO: 1236799 - DNA, 22 bp, Homo sapiens
tccagcctccctgtctccagct

SEQ ID NO: 1236800 - DNA, 16 bp, Homo sapiens
tccagcctctcccggc

SEQ ID NO: 1236801 - DNA, 17 bp, Homo sapiens
tccagcctctcccggct

SEQ ID NO: 1236802 - DNA, 22 bp, Homo sapiens
tccagcctctcccggctgcctg

SEQ ID NO: 1236803 - DNA, 23 bp, Homo sapiens
tccagcctctcccggctgcctgc

SEQ ID NO: 1236804 - DNA, 11 bp, Homo sapiens
tccagcctggg

SEQ ID NO: 1236805 - DNA, 12 bp, Homo sapiens
tccagcctggga

SEQ ID NO: 1236806 - DNA, 19 bp, Homo sapiens
tccagcctgggcagccagg

SEQ ID NO: 1236807 - DNA, 13 bp, Homo sapiens
tccagcctgggcg

SEQ ID NO: 1236808 - DNA, 19 bp, Homo sapiens
tccagccttatgtgttaca

SEQ ID NO: 1236809 - DNA, 17 bp, Homo sapiens
tccagcgagagagtttc

SEQ ID NO: 1236810 - DNA, 14 bp, Homo sapiens
tccagcggccctgt

SEQ ID NO: 1236811 - DNA, 18 bp, Homo sapiens
tccagctagtgccaaata

SEQ ID NO: 1236812 - DNA, 16 bp, Homo sapiens
tccagctcagaaccca

SEQ ID NO: 1236813 - DNA, 18 bp, Homo sapiens
tccagctcagaacccagg

SEQ ID NO: 1236814 - DNA, 21 bp, Homo sapiens
tccagctcagaacccagggct

SEQ ID NO: 1236815 - DNA, 15 bp, Homo sapiens
tccagctcagccctg

SEQ ID NO: 1236816 - DNA, 23 bp, Homo sapiens
tccagctcagccctggcctggct

SEQ ID NO: 1236817 - DNA, 18 bp, Homo sapiens
tccagctcccgctgtggc

SEQ ID NO: 1236818 - DNA, 19 bp, Homo sapiens
tccagctccctagactgca

SEQ ID NO: 1236819 - DNA, 13 bp, Homo sapiens
tccagctcctgta

SEQ ID NO: 1236820 - DNA, 18 bp, Homo sapiens
tccagctctgacatccct

SEQ ID NO: 1236821 - DNA, 19 bp, Homo sapiens
tccagctctgacatccctt

SEQ ID NO: 1236822 - DNA, 22 bp, Homo sapiens
tccagctctgacatcccttcct

SEQ ID NO: 1236823 - DNA, 14 bp, Homo sapiens
tccagctctgcccc

SEQ ID NO: 1236824 - DNA, 12 bp, Homo sapiens
tccagctctgga

SEQ ID NO: 1236825 - DNA, 14 bp, Homo sapiens
tccagctgcaccag

SEQ ID NO: 1236826 - DNA, 12 bp, Homo sapiens
tccagctgcccc

SEQ ID NO: 1236827 - DNA, 22 bp, Homo sapiens
tccagctgccccggcccctccc

SEQ ID NO: 1236828 - DNA, 20 bp, Homo sapiens
tccagctgcccctccctcag

SEQ ID NO: 1236829 - DNA, 11 bp, Homo sapiens
tccagctgcct

SEQ ID NO: 1236830 - DNA, 12 bp, Homo sapiens
tccagctgctgt

SEQ ID NO: 1236831 - DNA, 13 bp, Homo sapiens
tccagctggcctg

SEQ ID NO: 1236832 - DNA, 17 bp, Homo sapiens
tccagctgggaagccct

SEQ ID NO: 1236833 - DNA, 18 bp, Homo sapiens
tccagctgggacctaatg

SEQ ID NO: 1236834 - DNA, 13 bp, Homo sapiens
tccagctggggcc

SEQ ID NO: 1236835 - DNA, 17 bp, Homo sapiens
tccagctggggccagag

SEQ ID NO: 1236836 - DNA, 19 bp, Homo sapiens
tccagctggggccagaggc

SEQ ID NO: 1236837 - DNA, 21 bp, Homo sapiens
tccagctggggccagaggctg

SEQ ID NO: 1236838 - DNA, 22 bp, Homo sapiens
tccagctggggccagaggctgg

SEQ ID NO: 1236839 - DNA, 13 bp, Homo sapiens
tccagcttccaaa

SEQ ID NO: 1236840 - DNA, 15 bp, Homo sapiens
tccaggaaaaaataa

SEQ ID NO: 1236841 - DNA, 17 bp, Homo sapiens
tccaggaaaaaataaaa

SEQ ID NO: 1236842 - DNA, 18 bp, Homo sapiens
tccaggaaccacaccaca

SEQ ID NO: 1236843 - DNA, 18 bp, Homo sapiens
tccaggaactgcctgggc

SEQ ID NO: 1236844 - DNA, 13 bp, Homo sapiens
tccaggaagatcc

SEQ ID NO: 1236845 - DNA, 17 bp, Homo sapiens
tccaggaaggcagctgc

SEQ ID NO: 1236846 - DNA, 22 bp, Homo sapiens
tccaggaatgcctcctccctgg

SEQ ID NO: 1236847 - DNA, 16 bp, Homo sapiens
tccaggaatgctgggc

SEQ ID NO: 1236848 - DNA, 20 bp, Homo sapiens
tccaggaattcctcttttgc

SEQ ID NO: 1236849 - DNA, 16 bp, Homo sapiens
tccaggacgaggagga

SEQ ID NO: 1236850 - DNA, 14 bp, Homo sapiens
tccaggactctttg

SEQ ID NO: 1236851 - DNA, 17 bp, Homo sapiens
tccaggagaaagccggg

SEQ ID NO: 1236852 - DNA, 12 bp, Homo sapiens
tccaggagaagg

SEQ ID NO: 1236853 - DNA, 15 bp, Homo sapiens
tccaggagacatata

SEQ ID NO: 1236854 - DNA, 17 bp, Homo sapiens
tccaggagagcctgggg

SEQ ID NO: 1236855 - DNA, 22 bp, Homo sapiens
tccaggagattggatttgctgt

SEQ ID NO: 1236856 - DNA, 21 bp, Homo sapiens
tccaggagcatagaagccaca

SEQ ID NO: 1236857 - DNA, 23 bp, Homo sapiens
tccaggagcatagaagccacatc

SEQ ID NO: 1236858 - DNA, 14 bp, Homo sapiens
tccaggagcctggc

SEQ ID NO: 1236859 - DNA, 23 bp, Homo sapiens
tccaggagcctggctccgtccag

SEQ ID NO: 1236860 - DNA, 15 bp, Homo sapiens
tccaggagctcagga

SEQ ID NO: 1236861 - DNA, 18 bp, Homo sapiens
tccaggagctcaggaaga

SEQ ID NO: 1236862 - DNA, 20 bp, Homo sapiens
tccaggaggccttattttga

SEQ ID NO: 1236863 - DNA, 21 bp, Homo sapiens
tccaggagggctaattagaaa

SEQ ID NO: 1236864 - DNA, 16 bp, Homo sapiens
tccaggatcaggggtt

SEQ ID NO: 1236865 - DNA, 15 bp, Homo sapiens
tccaggatcctgcag

SEQ ID NO: 1236866 - DNA, 16 bp, Homo sapiens
tccaggatcctgcagg

SEQ ID NO: 1236867 - DNA, 19 bp, Homo sapiens
tccaggatcctgcaggaac

SEQ ID NO: 1236868 - DNA, 19 bp, Homo sapiens
tccaggattgaagagcatt

SEQ ID NO: 1236869 - DNA, 16 bp, Homo sapiens
tccaggcacagctgag

SEQ ID NO: 1236870 - DNA, 17 bp, Homo sapiens
tccaggcacagctgagt

SEQ ID NO: 1236871 - DNA, 20 bp, Homo sapiens
tccaggcaccctcagggagc

SEQ ID NO: 1236872 - DNA, 21 bp, Homo sapiens
tccaggcacccttctttcctc

SEQ ID NO: 1236873 - DNA, 18 bp, Homo sapiens
tccaggcagctccctcct

SEQ ID NO: 1236874 - DNA, 19 bp, Homo sapiens
tccaggcagctccctcctg

SEQ ID NO: 1236875 - DNA, 14 bp, Homo sapiens
tccaggcaggccag

SEQ ID NO: 1236876 - DNA, 16 bp, Homo sapiens
tccaggcaggccaggc

SEQ ID NO: 1236877 - DNA, 22 bp, Homo sapiens
tccaggcagtcgggggctggcc

SEQ ID NO: 1236878 - DNA, 23 bp, Homo sapiens
tccaggcagtcgggggctggcct

SEQ ID NO: 1236879 - DNA, 22 bp, Homo sapiens
tccaggcatatgtttccccatc

SEQ ID NO: 1236880 - DNA, 20 bp, Homo sapiens
tccaggccactgtggccaga

SEQ ID NO: 1236881 - DNA, 23 bp, Homo sapiens
tccaggccactgtggccagagct

SEQ ID NO: 1236882 - DNA, 17 bp, Homo sapiens
tccaggccagtgggcct

SEQ ID NO: 1236883 - DNA, 20 bp, Homo sapiens
tccaggccagtgggcctggt

SEQ ID NO: 1236884 - DNA, 18 bp, Homo sapiens
tccaggcccaaggctccc

SEQ ID NO: 1236885 - DNA, 18 bp, Homo sapiens
tccaggcccctgaggact

SEQ ID NO: 1236886 - DNA, 16 bp, Homo sapiens
tccaggccctccagtg

SEQ ID NO: 1236887 - DNA, 11 bp, Homo sapiens
tccaggccctt

SEQ ID NO: 1236888 - DNA, 15 bp, Homo sapiens
tccaggcctcagcct

SEQ ID NO: 1236889 - DNA, 16 bp, Homo sapiens
tccaggcctgatcttg

SEQ ID NO: 1236890 - DNA, 20 bp, Homo sapiens
tccaggcctgcagcaggagt

SEQ ID NO: 1236891 - DNA, 19 bp, Homo sapiens
tccaggcctgcctcccact

SEQ ID NO: 1236892 - DNA, 19 bp, Homo sapiens
tccaggcgatgtgcaagtg

SEQ ID NO: 1236893 - DNA, 18 bp, Homo sapiens
tccaggctctgggcacag

SEQ ID NO: 1236894 - DNA, 19 bp, Homo sapiens
tccaggctctgggcacagt

SEQ ID NO: 1236895 - DNA, 19 bp, Homo sapiens
tccaggctcttcctggacc

SEQ ID NO: 1236896 - DNA, 22 bp, Homo sapiens
tccaggctcttcctggacctga

SEQ ID NO: 1236897 - DNA, 23 bp, Homo sapiens
tccaggctctttggggtcagcca

SEQ ID NO: 1236898 - DNA, 22 bp, Homo sapiens
tccaggctttctggagttccca

SEQ ID NO: 1236899 - DNA, 18 bp, Homo sapiens
tccagggaagctggccga

SEQ ID NO: 1236900 - DNA, 18 bp, Homo sapiens
tccagggaatccaagcct

SEQ ID NO: 1236901 - DNA, 19 bp, Homo sapiens
tccagggaatccaagcctc

SEQ ID NO: 1236902 - DNA, 17 bp, Homo sapiens
tccagggacacacagcc

SEQ ID NO: 1236903 - DNA, 23 bp, Homo sapiens
tccagggacccttgcctgcctcc

SEQ ID NO: 1236904 - DNA, 15 bp, Homo sapiens
tccagggagcctaga

SEQ ID NO: 1236905 - DNA, 17 bp, Homo sapiens
tccagggatggagatgg

SEQ ID NO: 1236906 - DNA, 13 bp, Homo sapiens
tccagggatggcc

SEQ ID NO: 1236907 - DNA, 14 bp, Homo sapiens
tccagggcagcctc

SEQ ID NO: 1236908 - DNA, 17 bp, Homo sapiens
tccagggcagcggctcc

SEQ ID NO: 1236909 - DNA, 16 bp, Homo sapiens
tccagggcccaggttc

SEQ ID NO: 1236910 - DNA, 17 bp, Homo sapiens
tccagggcccccatctc

SEQ ID NO: 1236911 - DNA, 14 bp, Homo sapiens
tccagggcctgaca

SEQ ID NO: 1236912 - DNA, 20 bp, Homo sapiens
tccagggcctgacaccccct

SEQ ID NO: 1236913 - DNA, 18 bp, Homo sapiens
tccagggctggggtgagc

SEQ ID NO: 1236914 - DNA, 22 bp, Homo sapiens
tccagggctggggtgagcctga

SEQ ID NO: 1236915 - DNA, 22 bp, Homo sapiens
tccagggctgttggaggacccc

SEQ ID NO: 1236916 - DNA, 18 bp, Homo sapiens
tccaggggaagccagtga

SEQ ID NO: 1236917 - DNA, 18 bp, Homo sapiens
tccaggggagatggggag

SEQ ID NO: 1236918 - DNA, 20 bp, Homo sapiens
tccaggggcccttgggacag

SEQ ID NO: 1236919 - DNA, 15 bp, Homo sapiens
tccaggggctcctgg

SEQ ID NO: 1236920 - DNA, 18 bp, Homo sapiens
tccaggggctcctgggtt

SEQ ID NO: 1236921 - DNA, 18 bp, Homo sapiens
tccagggggaaggccaag

SEQ ID NO: 1236922 - DNA, 14 bp, Homo sapiens
tccagggtcccctg

SEQ ID NO: 1236923 - DNA, 13 bp, Homo sapiens
tccagggtctggc

SEQ ID NO: 1236924 - DNA, 18 bp, Homo sapiens
tccagggtctggcagagc

SEQ ID NO: 1236925 - DNA, 17 bp, Homo sapiens
tccagggtcttgggcta

SEQ ID NO: 1236926 - DNA, 14 bp, Homo sapiens
tccagggtggcagc

SEQ ID NO: 1236927 - DNA, 18 bp, Homo sapiens
tccagggtggcagcaaca

SEQ ID NO: 1236928 - DNA, 18 bp, Homo sapiens
tccagggttgatcacact

SEQ ID NO: 1236929 - DNA, 18 bp, Homo sapiens
tccagggtttctctgcag

SEQ ID NO: 1236930 - DNA, 15 bp, Homo sapiens
tccaggtaaatggta

SEQ ID NO: 1236931 - DNA, 23 bp, Homo sapiens
tccaggtagctcggcaccaacta

SEQ ID NO: 1236932 - DNA, 18 bp, Homo sapiens
tccaggtccaaacccttc

SEQ ID NO: 1236933 - DNA, 19 bp, Homo sapiens
tccaggtgtgcacagaaaa

SEQ ID NO: 1236934 - DNA, 21 bp, Homo sapiens
tccaggtgtgcacagaaaacc

SEQ ID NO: 1236935 - DNA, 17 bp, Homo sapiens
tccaggtgtgcacgtgg

SEQ ID NO: 1236936 - DNA, 17 bp, Homo sapiens
tccaggtttaagctgtt

SEQ ID NO: 1236937 - DNA, 14 bp, Homo sapiens
tccagtaacttttt

SEQ ID NO: 1236938 - DNA, 19 bp, Homo sapiens
tccagtaacttttttgtgt

SEQ ID NO: 1236939 - DNA, 19 bp, Homo sapiens
tccagtaatctaatatggc

SEQ ID NO: 1236940 - DNA, 20 bp, Homo sapiens
tccagtacgtcccgctgctg

SEQ ID NO: 1236941 - DNA, 19 bp, Homo sapiens
tccagtattcttgtcaaaa

SEQ ID NO: 1236942 - DNA, 16 bp, Homo sapiens
tccagtattgaaaact

SEQ ID NO: 1236943 - DNA, 21 bp, Homo sapiens
tccagtattgaaaacttcaaa

SEQ ID NO: 1236944 - DNA, 17 bp, Homo sapiens
tccagtcaaatctgggc

SEQ ID NO: 1236945 - DNA, 20 bp, Homo sapiens
tccagtcaaatctgggctca

SEQ ID NO: 1236946 - DNA, 14 bp, Homo sapiens
tccagtcacactcc

SEQ ID NO: 1236947 - DNA, 15 bp, Homo sapiens
tccagtcacactccc

SEQ ID NO: 1236948 - DNA, 14 bp, Homo sapiens
tccagtcagatgag

SEQ ID NO: 1236949 - DNA, 23 bp, Homo sapiens
tccagtcatcctgccctgcagca

SEQ ID NO: 1236950 - DNA, 17 bp, Homo sapiens
tccagtcgttatttctg

SEQ ID NO: 1236951 - DNA, 20 bp, Homo sapiens
tccagtcgttatttctgttt

SEQ ID NO: 1236952 - DNA, 14 bp, Homo sapiens
tccagtctcttgta

SEQ ID NO: 1236953 - DNA, 13 bp, Homo sapiens
tccagtctgctgc

SEQ ID NO: 1236954 - DNA, 19 bp, Homo sapiens
tccagtctgctgccctcca

SEQ ID NO: 1236955 - DNA, 20 bp, Homo sapiens
tccagtctgctgccctccat

SEQ ID NO: 1236956 - DNA, 22 bp, Homo sapiens
tccagtctgctgccctccatcc

SEQ ID NO: 1236957 - DNA, 17 bp, Homo sapiens
tccagtctggagagctg

SEQ ID NO: 1236958 - DNA, 19 bp, Homo sapiens
tccagtcttcctgacactt

SEQ ID NO: 1236959 - DNA, 18 bp, Homo sapiens
tccagtgaacattcccag

SEQ ID NO: 1236960 - DNA, 13 bp, Homo sapiens
tccagtgacatga

SEQ ID NO: 1236961 - DNA, 19 bp, Homo sapiens
tccagtgacatgattctga

SEQ ID NO: 1236962 - DNA, 20 bp, Homo sapiens
tccagtgacttgttctgagt

SEQ ID NO: 1236963 - DNA, 17 bp, Homo sapiens
tccagtgagatagaata

SEQ ID NO: 1236964 - DNA, 17 bp, Homo sapiens
tccagtgagtgaggttc

SEQ ID NO: 1236965 - DNA, 21 bp, Homo sapiens
tccagtgagtgtaaataattt

SEQ ID NO: 1236966 - DNA, 12 bp, Homo sapiens
tccagtgcagtc

SEQ ID NO: 1236967 - DNA, 16 bp, Homo sapiens
tccagtgcattttgtt

SEQ ID NO: 1236968 - DNA, 22 bp, Homo sapiens
tccagtgcattttgtttctgta

SEQ ID NO: 1236969 - DNA, 19 bp, Homo sapiens
tccagtgccgctcctgctt

SEQ ID NO: 1236970 - DNA, 20 bp, Homo sapiens
tccagtgccgctcctgcttc

SEQ ID NO: 1236971 - DNA, 14 bp, Homo sapiens
tccagtgctctgcc

SEQ ID NO: 1236972 - DNA, 15 bp, Homo sapiens
tccagtgctctgcct

SEQ ID NO: 1236973 - DNA, 22 bp, Homo sapiens
tccagtggaagttcttcaagag

SEQ ID NO: 1236974 - DNA, 23 bp, Homo sapiens
tccagtggaagttcttcaagagg

SEQ ID NO: 1236975 - DNA, 15 bp, Homo sapiens
tccagtggaccctgg

SEQ ID NO: 1236976 - DNA, 13 bp, Homo sapiens
tccagtggactct

SEQ ID NO: 1236977 - DNA, 15 bp, Homo sapiens
tccagtggactctgg

SEQ ID NO: 1236978 - DNA, 16 bp, Homo sapiens
tccagtggcagacaaa

SEQ ID NO: 1236979 - DNA, 22 bp, Homo sapiens
tccagtgggctgatgctgggac

SEQ ID NO: 1236980 - DNA, 12 bp, Homo sapiens
tccagtggtgaa

SEQ ID NO: 1236981 - DNA, 19 bp, Homo sapiens
tccagtggttgctgttgat

SEQ ID NO: 1236982 - DNA, 16 bp, Homo sapiens
tccagtggtttgagac

SEQ ID NO: 1236983 - DNA, 17 bp, Homo sapiens
tccagtgtccttagaac

SEQ ID NO: 1236984 - DNA, 18 bp, Homo sapiens
tccagtgtccttagaaca

SEQ ID NO: 1236985 - DNA, 15 bp, Homo sapiens
tccagtgtctcacag

SEQ ID NO: 1236986 - DNA, 16 bp, Homo sapiens
tccagtgtctcacagc

SEQ ID NO: 1236987 - DNA, 18 bp, Homo sapiens
tccagtgtgggcttgacc

SEQ ID NO: 1236988 - DNA, 19 bp, Homo sapiens
tccagtgtgggcttgacca

SEQ ID NO: 1236989 - DNA, 15 bp, Homo sapiens
tccagtgttgcctcc

SEQ ID NO: 1236990 - DNA, 23 bp, Homo sapiens
tccagtgttggctgtgtgacaga

SEQ ID NO: 1236991 - DNA, 14 bp, Homo sapiens
tccagttagttctc

SEQ ID NO: 1236992 - DNA, 15 bp, Homo sapiens
tccagttcctgctct

SEQ ID NO: 1236993 - DNA, 17 bp, Homo sapiens
tccagttcctttagaaa

SEQ ID NO: 1236994 - DNA, 23 bp, Homo sapiens
tccagttgaacactagtctgtgt

SEQ ID NO: 1236995 - DNA, 12 bp, Homo sapiens
tccagttgctgt

SEQ ID NO: 1236996 - DNA, 16 bp, Homo sapiens
tccagttgctgtggac

SEQ ID NO: 1236997 - DNA, 22 bp, Homo sapiens
tccagtttaagtaattgcctac

SEQ ID NO: 1236998 - DNA, 17 bp, Homo sapiens
tccagtttctttcccca

SEQ ID NO: 1236999 - DNA, 13 bp, Homo sapiens
tccagtttgcatt

SEQ ID NO: 1237000 - DNA, 17 bp, Homo sapiens
tccagtttgtcttggat

SEQ ID NO: 1237001 - DNA, 19 bp, Homo sapiens
tccagtttgtgtttttcta

SEQ ID NO: 1237002 - DNA, 17 bp, Homo sapiens
tccagtttgttctccgg

SEQ ID NO: 1237003 - DNA, 13 bp, Homo sapiens
tccataaacatga

SEQ ID NO: 1237004 - DNA, 13 bp, Homo sapiens
tccataaagaagc

SEQ ID NO: 1237005 - DNA, 20 bp, Homo sapiens
tccataaagaagcaataaag

SEQ ID NO: 1237006 - DNA, 13 bp, Homo sapiens
tccataaagaccc

SEQ ID NO: 1237007 - DNA, 18 bp, Homo sapiens
tccataaagtacaaatga

SEQ ID NO: 1237008 - DNA, 20 bp, Homo sapiens
tccataaagtacaaatgaag

SEQ ID NO: 1237009 - DNA, 14 bp, Homo sapiens
tccataactgaaca

SEQ ID NO: 1237010 - DNA, 16 bp, Homo sapiens
tccataagtaagaaat

SEQ ID NO: 1237011 - DNA, 18 bp, Homo sapiens
tccataatgctactgtct

SEQ ID NO: 1237012 - DNA, 22 bp, Homo sapiens
tccatacactttgttgcaagat

SEQ ID NO: 1237013 - DNA, 16 bp, Homo sapiens
tccatacctgcccctg

SEQ ID NO: 1237014 - DNA, 13 bp, Homo sapiens
tccatactcagga

SEQ ID NO: 1237015 - DNA, 20 bp, Homo sapiens
tccatagatttattttacat

SEQ ID NO: 1237016 - DNA, 21 bp, Homo sapiens
tccatagatttattttacatt

SEQ ID NO: 1237017 - DNA, 15 bp, Homo sapiens
tccatagcaacagga

SEQ ID NO: 1237018 - DNA, 17 bp, Homo sapiens
tccatagctccttccca

SEQ ID NO: 1237019 - DNA, 22 bp, Homo sapiens
tccataggactaccgcaggccc

SEQ ID NO: 1237020 - DNA, 21 bp, Homo sapiens
tccataggtttctctccctcc

SEQ ID NO: 1237021 - DNA, 17 bp, Homo sapiens
tccatatagtctattca

SEQ ID NO: 1237022 - DNA, 13 bp, Homo sapiens
tccatatcctggt

SEQ ID NO: 1237023 - DNA, 23 bp, Homo sapiens
tccatatcttaaagaaacagctt

SEQ ID NO: 1237024 - DNA, 22 bp, Homo sapiens
tccatatcttgcgaatccaagc

SEQ ID NO: 1237025 - DNA, 13 bp, Homo sapiens
tccatatggattt

SEQ ID NO: 1237026 - DNA, 18 bp, Homo sapiens
tccatatttgatttctaa

SEQ ID NO: 1237027 - DNA, 18 bp, Homo sapiens
tccatattttattactgt

SEQ ID NO: 1237028 - DNA, 23 bp, Homo sapiens
tccatattttattactgtttatt

SEQ ID NO: 1237029 - DNA, 21 bp, Homo sapiens
tccatcaccatttcttggcat

SEQ ID NO: 1237030 - DNA, 23 bp, Homo sapiens
tccatcaccctcttcctgtgatc

SEQ ID NO: 1237031 - DNA, 20 bp, Homo sapiens
tccatcacctgaaacactgg

SEQ ID NO: 1237032 - DNA, 22 bp, Homo sapiens
tccatcacctgaaacactggac

SEQ ID NO: 1237033 - DNA, 13 bp, Homo sapiens
tccatcagccagg

SEQ ID NO: 1237034 - DNA, 21 bp, Homo sapiens
tccatcaggtgaggtgtgctc

SEQ ID NO: 1237035 - DNA, 14 bp, Homo sapiens
tccatcatcactgt

SEQ ID NO: 1237036 - DNA, 18 bp, Homo sapiens
tccatcatcactgtaaag

SEQ ID NO: 1237037 - DNA, 14 bp, Homo sapiens
tccatcatgtctgt

SEQ ID NO: 1237038 - DNA, 22 bp, Homo sapiens
tccatcatgtctgtatactcct

SEQ ID NO: 1237039 - DNA, 14 bp, Homo sapiens
tccatcccatcatc

SEQ ID NO: 1237040 - DNA, 18 bp, Homo sapiens
tccatcccccttcttcct

SEQ ID NO: 1237041 - DNA, 19 bp, Homo sapiens
tccatcccccttcttcctc

SEQ ID NO: 1237042 - DNA, 22 bp, Homo sapiens
tccatcccccttcttcctcccc

SEQ ID NO: 1237043 - DNA, 12 bp, Homo sapiens
tccatcccctcc

SEQ ID NO: 1237044 - DNA, 13 bp, Homo sapiens
tccatcccctccc

SEQ ID NO: 1237045 - DNA, 21 bp, Homo sapiens
tccatcccctccctgcctgct

SEQ ID NO: 1237046 - DNA, 15 bp, Homo sapiens
tccatccccttcccc

SEQ ID NO: 1237047 - DNA, 23 bp, Homo sapiens
tccatccccttcccccatcccta

SEQ ID NO: 1237048 - DNA, 12 bp, Homo sapiens
tccatccctaga

SEQ ID NO: 1237049 - DNA, 13 bp, Homo sapiens
tccatccctgctc

SEQ ID NO: 1237050 - DNA, 16 bp, Homo sapiens
tccatccctgctctgg

SEQ ID NO: 1237051 - DNA, 15 bp, Homo sapiens
tccatccgactgccc

SEQ ID NO: 1237052 - DNA, 16 bp, Homo sapiens
tccatcctcccaggaa

SEQ ID NO: 1237053 - DNA, 13 bp, Homo sapiens
tccatcctgacct

SEQ ID NO: 1237054 - DNA, 17 bp, Homo sapiens
tccatcctgcaaaggcc

SEQ ID NO: 1237055 - DNA, 21 bp, Homo sapiens
tccatcgtctcatcctccttt

SEQ ID NO: 1237056 - DNA, 22 bp, Homo sapiens
tccatctacttttttatccacc

SEQ ID NO: 1237057 - DNA, 13 bp, Homo sapiens
tccatctccaggg

SEQ ID NO: 1237058 - DNA, 22 bp, Homo sapiens
tccatctcctataatctgtcaa

SEQ ID NO: 1237059 - DNA, 14 bp, Homo sapiens
tccatctctgactt

SEQ ID NO: 1237060 - DNA, 19 bp, Homo sapiens
tccatctgcatcttaacat

SEQ ID NO: 1237061 - DNA, 12 bp, Homo sapiens
tccatctgtcca

SEQ ID NO: 1237062 - DNA, 23 bp, Homo sapiens
tccatctgtccacatccccagag

SEQ ID NO: 1237063 - DNA, 13 bp, Homo sapiens
tccatctgtctgt

SEQ ID NO: 1237064 - DNA, 16 bp, Homo sapiens
tccatctgtctgtcct

SEQ ID NO: 1237065 - DNA, 18 bp, Homo sapiens
tccatcttgagccacagt

SEQ ID NO: 1237066 - DNA, 23 bp, Homo sapiens
tccatcttggtagttctgtgcct

SEQ ID NO: 1237067 - DNA, 13 bp, Homo sapiens
tccatctttacaa

SEQ ID NO: 1237068 - DNA, 18 bp, Homo sapiens
tccatctttctacagaga

SEQ ID NO: 1237069 - DNA, 18 bp, Homo sapiens
tccatgaaaacgttttat

SEQ ID NO: 1237070 - DNA, 22 bp, Homo sapiens
tccatgaaaacgttttattgtg

SEQ ID NO: 1237071 - DNA, 15 bp, Homo sapiens
tccatgaaaatacca

SEQ ID NO: 1237072 - DNA, 23 bp, Homo sapiens
tccatgaagaccacatccacaca

SEQ ID NO: 1237073 - DNA, 16 bp, Homo sapiens
tccatgacctcccctc

SEQ ID NO: 1237074 - DNA, 17 bp, Homo sapiens
tccatgactgcatttta

SEQ ID NO: 1237075 - DNA, 13 bp, Homo sapiens
tccatgagctgct

SEQ ID NO: 1237076 - DNA, 12 bp, Homo sapiens
tccatgatggag

SEQ ID NO: 1237077 - DNA, 12 bp, Homo sapiens
tccatgattcta

SEQ ID NO: 1237078 - DNA, 17 bp, Homo sapiens
tccatgcactttaattg

SEQ ID NO: 1237079 - DNA, 21 bp, Homo sapiens
tccatgcactttaattgaaga

SEQ ID NO: 1237080 - DNA, 21 bp, Homo sapiens
tccatgcagactcctcagatc

SEQ ID NO: 1237081 - DNA, 18 bp, Homo sapiens
tccatgccccagctctgg

SEQ ID NO: 1237082 - DNA, 14 bp, Homo sapiens
tccatgccctggga

SEQ ID NO: 1237083 - DNA, 21 bp, Homo sapiens
tccatgccctgggatgcctca

SEQ ID NO: 1237084 - DNA, 13 bp, Homo sapiens
tccatgcctctgg

SEQ ID NO: 1237085 - DNA, 15 bp, Homo sapiens
tccatgcctgagggt

SEQ ID NO: 1237086 - DNA, 15 bp, Homo sapiens
tccatgcgctcaggg

SEQ ID NO: 1237087 - DNA, 20 bp, Homo sapiens
tccatgcgtgtttctgactc

SEQ ID NO: 1237088 - DNA, 14 bp, Homo sapiens
tccatgcttcactc

SEQ ID NO: 1237089 - DNA, 21 bp, Homo sapiens
tccatggacaatataaactga

SEQ ID NO: 1237090 - DNA, 17 bp, Homo sapiens
tccatggcaattttgta

SEQ ID NO: 1237091 - DNA, 13 bp, Homo sapiens
tccatggcaccag

SEQ ID NO: 1237092 - DNA, 14 bp, Homo sapiens
tccatggcaccagc

SEQ ID NO: 1237093 - DNA, 16 bp, Homo sapiens
tccatggcaccagccc

SEQ ID NO: 1237094 - DNA, 18 bp, Homo sapiens
tccatggcaccagccccc

SEQ ID NO: 1237095 - DNA, 13 bp, Homo sapiens
tccatggccaccc

SEQ ID NO: 1237096 - DNA, 20 bp, Homo sapiens
tccatggccctgcaaaagga

SEQ ID NO: 1237097 - DNA, 16 bp, Homo sapiens
tccatggccctgtccc

SEQ ID NO: 1237098 - DNA, 18 bp, Homo sapiens
tccatggccctgtcccag

SEQ ID NO: 1237099 - DNA, 19 bp, Homo sapiens
tccatggccctgtcccagg

SEQ ID NO: 1237100 - DNA, 15 bp, Homo sapiens
tccatggcttcctcc

SEQ ID NO: 1237101 - DNA, 19 bp, Homo sapiens
tccatgggagccagctgct

SEQ ID NO: 1237102 - DNA, 23 bp, Homo sapiens
tccatgggagccagctgcttttt

SEQ ID NO: 1237103 - DNA, 15 bp, Homo sapiens
tccatgggcagagcc

SEQ ID NO: 1237104 - DNA, 15 bp, Homo sapiens
tccatgggccaccgc

SEQ ID NO: 1237105 - DNA, 20 bp, Homo sapiens
tccatgggctagtgtgagtg

SEQ ID NO: 1237106 - DNA, 16 bp, Homo sapiens
tccatgggtctggcct

SEQ ID NO: 1237107 - DNA, 15 bp, Homo sapiens
tccatggtcctgtct

SEQ ID NO: 1237108 - DNA, 13 bp, Homo sapiens
tccatgtactgta

SEQ ID NO: 1237109 - DNA, 21 bp, Homo sapiens
tccatgtactgtagtttttct

SEQ ID NO: 1237110 - DNA, 18 bp, Homo sapiens
tccatgtcaggccagcct

SEQ ID NO: 1237111 - DNA, 17 bp, Homo sapiens
tccatgtcgcctctgca

SEQ ID NO: 1237112 - DNA, 17 bp, Homo sapiens
tccatgtgaacagcata

SEQ ID NO: 1237113 - DNA, 20 bp, Homo sapiens
tccatgtgaccattctgcct

SEQ ID NO: 1237114 - DNA, 23 bp, Homo sapiens
tccatgtgattaatgttttcatt

SEQ ID NO: 1237115 - DNA, 19 bp, Homo sapiens
tccatgtgcatataaaggt

SEQ ID NO: 1237116 - DNA, 14 bp, Homo sapiens
tccatgtgccccct

SEQ ID NO: 1237117 - DNA, 13 bp, Homo sapiens
tccatgtggagaa

SEQ ID NO: 1237118 - DNA, 18 bp, Homo sapiens
tccatgtggttcttcaaa

SEQ ID NO: 1237119 - DNA, 17 bp, Homo sapiens
tccatgtgtggactcaa

SEQ ID NO: 1237120 - DNA, 21 bp, Homo sapiens
tccatgtgtggtggtgttttt

SEQ ID NO: 1237121 - DNA, 13 bp, Homo sapiens
tccatgtgtgtgc

SEQ ID NO: 1237122 - DNA, 18 bp, Homo sapiens
tccatgttagtttttact

SEQ ID NO: 1237123 - DNA, 20 bp, Homo sapiens
tccatgttattctctcacag

SEQ ID NO: 1237124 - DNA, 12 bp, Homo sapiens
tccatgttgctg

SEQ ID NO: 1237125 - DNA, 22 bp, Homo sapiens
tccatgttggtcaggctggtct

SEQ ID NO: 1237126 - DNA, 17 bp, Homo sapiens
tccatgtttgcaatgct

SEQ ID NO: 1237127 - DNA, 16 bp, Homo sapiens
tccatgtttgtaaaac

SEQ ID NO: 1237128 - DNA, 19 bp, Homo sapiens
tccattaaagtctgaatca

SEQ ID NO: 1237129 - DNA, 19 bp, Homo sapiens
tccattaatttaaatgatt

SEQ ID NO: 1237130 - DNA, 15 bp, Homo sapiens
tccattacgtgcatt

SEQ ID NO: 1237131 - DNA, 22 bp, Homo sapiens
tccattacgtgcatttaaactc

SEQ ID NO: 1237132 - DNA, 15 bp, Homo sapiens
tccattaggccagca

SEQ ID NO: 1237133 - DNA, 20 bp, Homo sapiens
tccattaggccagcaacgct

SEQ ID NO: 1237134 - DNA, 11 bp, Homo sapiens
tccattattta

SEQ ID NO: 1237135 - DNA, 12 bp, Homo sapiens
tccattatttat

SEQ ID NO: 1237136 - DNA, 18 bp, Homo sapiens
tccattattttgtattct

SEQ ID NO: 1237137 - DNA, 19 bp, Homo sapiens
tccattcacaagcctcctg

SEQ ID NO: 1237138 - DNA, 23 bp, Homo sapiens
tccattctccaggggtttacagt

SEQ ID NO: 1237139 - DNA, 14 bp, Homo sapiens
tccattctcccagg

SEQ ID NO: 1237140 - DNA, 19 bp, Homo sapiens
tccattcttcagtgtctct

SEQ ID NO: 1237141 - DNA, 16 bp, Homo sapiens
tccattcttcttgcta

SEQ ID NO: 1237142 - DNA, 17 bp, Homo sapiens
tccattgaactggaaga

SEQ ID NO: 1237143 - DNA, 22 bp, Homo sapiens
tccattgcttattcttgagcac

SEQ ID NO: 1237144 - DNA, 16 bp, Homo sapiens
tccattggatctgcaa

SEQ ID NO: 1237145 - DNA, 23 bp, Homo sapiens
tccattggttcttcctttccctg

SEQ ID NO: 1237146 - DNA, 17 bp, Homo sapiens
tccattgtaaatctgaa

SEQ ID NO: 1237147 - DNA, 21 bp, Homo sapiens
tccattgtaaatctgaagaaa

SEQ ID NO: 1237148 - DNA, 22 bp, Homo sapiens
tccattgtcatgagtccatgag

SEQ ID NO: 1237149 - DNA, 21 bp, Homo sapiens
tccattgtgtgatccagccct

SEQ ID NO: 1237150 - DNA, 23 bp, Homo sapiens
tccattgtgtggcctggtgggtc

SEQ ID NO: 1237151 - DNA, 16 bp, Homo sapiens
tccattgttgtgtctg

SEQ ID NO: 1237152 - DNA, 15 bp, Homo sapiens
tccattgtttaaaga

SEQ ID NO: 1237153 - DNA, 16 bp, Homo sapiens
tccatttaagacacat

SEQ ID NO: 1237154 - DNA, 20 bp, Homo sapiens
tccatttacttaagacttaa

SEQ ID NO: 1237155 - DNA, 22 bp, Homo sapiens
tccatttacttaagacttaatg

SEQ ID NO: 1237156 - DNA, 20 bp, Homo sapiens
tccatttagttctttgttat

SEQ ID NO: 1237157 - DNA, 17 bp, Homo sapiens
tccatttataaccccag

SEQ ID NO: 1237158 - DNA, 21 bp, Homo sapiens
tccatttcatctatttctgag

SEQ ID NO: 1237159 - DNA, 17 bp, Homo sapiens
tccatttccaaatgtgg

SEQ ID NO: 1237160 - DNA, 17 bp, Homo sapiens
tccatttcccacatctt

SEQ ID NO: 1237161 - DNA, 12 bp, Homo sapiens
tccatttctcaa

SEQ ID NO: 1237162 - DNA, 21 bp, Homo sapiens
tccatttctcaatcagtgcag

SEQ ID NO: 1237163 - DNA, 14 bp, Homo sapiens
tccatttctcatgt

SEQ ID NO: 1237164 - DNA, 11 bp, Homo sapiens
tccatttctga

SEQ ID NO: 1237165 - DNA, 16 bp, Homo sapiens
tccatttcttttactc

SEQ ID NO: 1237166 - DNA, 16 bp, Homo sapiens
tccatttgaacacatt

SEQ ID NO: 1237167 - DNA, 17 bp, Homo sapiens
tccatttggaattacaa

SEQ ID NO: 1237168 - DNA, 19 bp, Homo sapiens
tccatttggtcctttctcc

SEQ ID NO: 1237169 - DNA, 14 bp, Homo sapiens
tccatttgtgtgtg

SEQ ID NO: 1237170 - DNA, 18 bp, Homo sapiens
tccatttgttttcacact

SEQ ID NO: 1237171 - DNA, 16 bp, Homo sapiens
tccattttacacagca

SEQ ID NO: 1237172 - DNA, 14 bp, Homo sapiens
tccattttatgcag

SEQ ID NO: 1237173 - DNA, 15 bp, Homo sapiens
tccattttatgcaga

SEQ ID NO: 1237174 - DNA, 19 bp, Homo sapiens
tccattttcttctctgtga

SEQ ID NO: 1237175 - DNA, 15 bp, Homo sapiens
tccatttttgattta

SEQ ID NO: 1237176 - DNA, 15 bp, Homo sapiens
tccattttttgtatt

SEQ ID NO: 1237177 - DNA, 19 bp, Homo sapiens
tcccaaaatcccctcagcc

SEQ ID NO: 1237178 - DNA, 22 bp, Homo sapiens
tcccaaacccagtctcctctcc

SEQ ID NO: 1237179 - DNA, 18 bp, Homo sapiens
tcccaaactttaaaatgc

SEQ ID NO: 1237180 - DNA, 22 bp, Homo sapiens
tcccaaagcggccgatgggagt

SEQ ID NO: 1237181 - DNA, 15 bp, Homo sapiens
tcccaaagtcctctg

SEQ ID NO: 1237182 - DNA, 17 bp, Homo sapiens
tcccaaagtcctctgct

SEQ ID NO: 1237183 - DNA, 23 bp, Homo sapiens
tcccaaagtcctctgctccagca

SEQ ID NO: 1237184 - DNA, 19 bp, Homo sapiens
tcccaaagtgctgggatga

SEQ ID NO: 1237185 - DNA, 21 bp, Homo sapiens
tcccaaagtgttgggattaca

SEQ ID NO: 1237186 - DNA, 17 bp, Homo sapiens
tcccaaatctgtcagca

SEQ ID NO: 1237187 - DNA, 15 bp, Homo sapiens
tcccaacaagcagct

SEQ ID NO: 1237188 - DNA, 11 bp, Homo sapiens
tcccaacatcg

SEQ ID NO: 1237189 - DNA, 13 bp, Homo sapiens
tcccaacatggga

SEQ ID NO: 1237190 - DNA, 15 bp, Homo sapiens
tcccaacattctgca

SEQ ID NO: 1237191 - DNA, 17 bp, Homo sapiens
tcccaacatttcttaaa

SEQ ID NO: 1237192 - DNA, 17 bp, Homo sapiens
tcccaaccaaccagcag

SEQ ID NO: 1237193 - DNA, 20 bp, Homo sapiens
tcccaacccccctcctgctc

SEQ ID NO: 1237194 - DNA, 22 bp, Homo sapiens
tcccaacccccctcctgctcct

SEQ ID NO: 1237195 - DNA, 23 bp, Homo sapiens
tcccaacccccctcctgctcctc

SEQ ID NO: 1237196 - DNA, 23 bp, Homo sapiens
tcccaaccctgggctggggagga

SEQ ID NO: 1237197 - DNA, 16 bp, Homo sapiens
tcccaacctcaatgcc

SEQ ID NO: 1237198 - DNA, 19 bp, Homo sapiens
tcccaacgagcctcctcag

SEQ ID NO: 1237199 - DNA, 17 bp, Homo sapiens
tcccaactcctataatt

SEQ ID NO: 1237200 - DNA, 15 bp, Homo sapiens
tcccaactctagctg

SEQ ID NO: 1237201 - DNA, 16 bp, Homo sapiens
tcccaactctagctgg

SEQ ID NO: 1237202 - DNA, 22 bp, Homo sapiens
tcccaacttcatactggcagga

SEQ ID NO: 1237203 - DNA, 14 bp, Homo sapiens
tcccaacttgtaaa

SEQ ID NO: 1237204 - DNA, 12 bp, Homo sapiens
tcccaagacagt

SEQ ID NO: 1237205 - DNA, 22 bp, Homo sapiens
tcccaagagaaggggaagcact

SEQ ID NO: 1237206 - DNA, 18 bp, Homo sapiens
tcccaagagccataaggg

SEQ ID NO: 1237207 - DNA, 19 bp, Homo sapiens
tcccaaggaagctccttcc

SEQ ID NO: 1237208 - DNA, 23 bp, Homo sapiens
tcccaaggaagctccttcctgtt

SEQ ID NO: 1237209 - DNA, 15 bp, Homo sapiens
tcccaaggagctgat

SEQ ID NO: 1237210 - DNA, 21 bp, Homo sapiens
tcccaagggacagcaagtgag

SEQ ID NO: 1237211 - DNA, 16 bp, Homo sapiens
tcccaagtagctggga

SEQ ID NO: 1237212 - DNA, 22 bp, Homo sapiens
tcccaagtatgccttaagcaga

SEQ ID NO: 1237213 - DNA, 13 bp, Homo sapiens
tcccaagtccaca

SEQ ID NO: 1237214 - DNA, 17 bp, Homo sapiens
tcccaagtgccagtctt

SEQ ID NO: 1237215 - DNA, 16 bp, Homo sapiens
tcccaagttgtgcttg

SEQ ID NO: 1237216 - DNA, 19 bp, Homo sapiens
tcccaagtttccatagcaa

SEQ ID NO: 1237217 - DNA, 19 bp, Homo sapiens
tcccaatcaaagaattaca

SEQ ID NO: 1237218 - DNA, 21 bp, Homo sapiens
tcccaatcttaccagatgcta

SEQ ID NO: 1237219 - DNA, 23 bp, Homo sapiens
tcccaatgaaatactgagatgct

SEQ ID NO: 1237220 - DNA, 14 bp, Homo sapiens
tcccaattaggaag

SEQ ID NO: 1237221 - DNA, 16 bp, Homo sapiens
tcccaattgagaaaaa

SEQ ID NO: 1237222 - DNA, 20 bp, Homo sapiens
tcccacaaaagacagaccca

SEQ ID NO: 1237223 - DNA, 14 bp, Homo sapiens
tcccacaaaggaga

SEQ ID NO: 1237224 - DNA, 13 bp, Homo sapiens
tcccacacccacc

SEQ ID NO: 1237225 - DNA, 15 bp, Homo sapiens
tcccacacccaccct

SEQ ID NO: 1237226 - DNA, 16 bp, Homo sapiens
tcccacacccaccctt

SEQ ID NO: 1237227 - DNA, 19 bp, Homo sapiens
tcccacacccacccttttt

SEQ ID NO: 1237228 - DNA, 18 bp, Homo sapiens
tcccacaccgtgtaaacc

SEQ ID NO: 1237229 - DNA, 16 bp, Homo sapiens
tcccacacttcccacc

SEQ ID NO: 1237230 - DNA, 19 bp, Homo sapiens
tcccacacttgctggggct

SEQ ID NO: 1237231 - DNA, 12 bp, Homo sapiens
tcccacagacct

SEQ ID NO: 1237232 - DNA, 14 bp, Homo sapiens
tcccacagacctgc

SEQ ID NO: 1237233 - DNA, 17 bp, Homo sapiens
tcccacagacctgcagt

SEQ ID NO: 1237234 - DNA, 19 bp, Homo sapiens
tcccacagacctgcagtga

SEQ ID NO: 1237235 - DNA, 16 bp, Homo sapiens
tcccacagagtgctgg

SEQ ID NO: 1237236 - DNA, 22 bp, Homo sapiens
tcccacagcacaaccggtccct

SEQ ID NO: 1237237 - DNA, 21 bp, Homo sapiens
tcccacaggacatttctctaa

SEQ ID NO: 1237238 - DNA, 16 bp, Homo sapiens
tcccacaggagggcca

SEQ ID NO: 1237239 - DNA, 22 bp, Homo sapiens
tcccacaggcccttcctctcca

SEQ ID NO: 1237240 - DNA, 18 bp, Homo sapiens
tcccacaggttcaggcga

SEQ ID NO: 1237241 - DNA, 11 bp, Homo sapiens
tcccacagtgg

SEQ ID NO: 1237242 - DNA, 20 bp, Homo sapiens
tcccacatacgcagggggaa

SEQ ID NO: 1237243 - DNA, 22 bp, Homo sapiens
tcccacatccaactccagcaac

SEQ ID NO: 1237244 - DNA, 14 bp, Homo sapiens
tcccacatcccact

SEQ ID NO: 1237245 - DNA, 15 bp, Homo sapiens
tcccacatcccactg

SEQ ID NO: 1237246 - DNA, 16 bp, Homo sapiens
tcccacatcccactgg

SEQ ID NO: 1237247 - DNA, 13 bp, Homo sapiens
tcccacatctttc

SEQ ID NO: 1237248 - DNA, 19 bp, Homo sapiens
tcccacatgaggccatctc

SEQ ID NO: 1237249 - DNA, 22 bp, Homo sapiens
tcccacatgcctgcgcctgctg

SEQ ID NO: 1237250 - DNA, 17 bp, Homo sapiens
tcccaccaacctccagt

SEQ ID NO: 1237251 - DNA, 14 bp, Homo sapiens
tcccaccaactctg

SEQ ID NO: 1237252 - DNA, 17 bp, Homo sapiens
tcccaccaactctgcac

SEQ ID NO: 1237253 - DNA, 22 bp, Homo sapiens
tcccaccaactctgcactccat

SEQ ID NO: 1237254 - DNA, 18 bp, Homo sapiens
tcccaccaaggtcttcag

SEQ ID NO: 1237255 - DNA, 22 bp, Homo sapiens
tcccaccagaacgcaccccact

SEQ ID NO: 1237256 - DNA, 14 bp, Homo sapiens
tcccaccagccccg

SEQ ID NO: 1237257 - DNA, 14 bp, Homo sapiens
tcccaccagcctcc

SEQ ID NO: 1237258 - DNA, 14 bp, Homo sapiens
tcccaccattcctg

SEQ ID NO: 1237259 - DNA, 17 bp, Homo sapiens
tcccacccaacagctca

SEQ ID NO: 1237260 - DNA, 19 bp, Homo sapiens
tcccacccaacagctcaga

SEQ ID NO: 1237261 - DNA, 20 bp, Homo sapiens
tcccacccaacagctcagag

SEQ ID NO: 1237262 - DNA, 21 bp, Homo sapiens
tcccacccaagccctcctttg

SEQ ID NO: 1237263 - DNA, 19 bp, Homo sapiens
tcccacccacacagctgcc

SEQ ID NO: 1237264 - DNA, 22 bp, Homo sapiens
tcccacccacacagctgcccta

SEQ ID NO: 1237265 - DNA, 14 bp, Homo sapiens
tcccacccacccgc

SEQ ID NO: 1237266 - DNA, 15 bp, Homo sapiens
tcccacccacccgcc

SEQ ID NO: 1237267 - DNA, 23 bp, Homo sapiens
tcccacccacccgccgcctccca

SEQ ID NO: 1237268 - DNA, 14 bp, Homo sapiens
tcccaccccactca

SEQ ID NO: 1237269 - DNA, 14 bp, Homo sapiens
tcccaccccagaaa

SEQ ID NO: 1237270 - DNA, 22 bp, Homo sapiens
tcccaccccagaaatcactgtg

SEQ ID NO: 1237271 - DNA, 23 bp, Homo sapiens
tcccaccccagaaatcactgtga

SEQ ID NO: 1237272 - DNA, 12 bp, Homo sapiens
tcccacccccaa

SEQ ID NO: 1237273 - DNA, 21 bp, Homo sapiens
tcccacccccaacccccagag

SEQ ID NO: 1237274 - DNA, 22 bp, Homo sapiens
tcccacccccacccccagctca

SEQ ID NO: 1237275 - DNA, 17 bp, Homo sapiens
tcccacccccagccccg

SEQ ID NO: 1237276 - DNA, 14 bp, Homo sapiens
tcccacccccaggc

SEQ ID NO: 1237277 - DNA, 20 bp, Homo sapiens
tcccacccccatctctccct

SEQ ID NO: 1237278 - DNA, 21 bp, Homo sapiens
tcccacccccttctctgctcc

SEQ ID NO: 1237279 - DNA, 18 bp, Homo sapiens
tcccaccccggcctccac

SEQ ID NO: 1237280 - DNA, 18 bp, Homo sapiens
tcccaccccttggcccct

SEQ ID NO: 1237281 - DNA, 17 bp, Homo sapiens
tcccacccgatgctgct

SEQ ID NO: 1237282 - DNA, 20 bp, Homo sapiens
tcccacccgatgctgctttc

SEQ ID NO: 1237283 - DNA, 19 bp, Homo sapiens
tcccacccggacaggtggg

SEQ ID NO: 1237284 - DNA, 20 bp, Homo sapiens
tcccacccggccacagctgc

SEQ ID NO: 1237285 - DNA, 20 bp, Homo sapiens
tcccaccctaagggcagccc

SEQ ID NO: 1237286 - DNA, 21 bp, Homo sapiens
tcccaccctaagggcagccct

SEQ ID NO: 1237287 - DNA, 13 bp, Homo sapiens
tcccaccctccac

SEQ ID NO: 1237288 - DNA, 12 bp, Homo sapiens
tcccaccgggag

SEQ ID NO: 1237289 - DNA, 20 bp, Homo sapiens
tcccaccgtacaaccccctc

SEQ ID NO: 1237290 - DNA, 20 bp, Homo sapiens
tcccacctactgcactttcc

SEQ ID NO: 1237291 - DNA, 15 bp, Homo sapiens
tcccacctagtgccc

SEQ ID NO: 1237292 - DNA, 17 bp, Homo sapiens
tcccacctagtgcccca

SEQ ID NO: 1237293 - DNA, 22 bp, Homo sapiens
tcccacctagtgccccagactg

SEQ ID NO: 1237294 - DNA, 13 bp, Homo sapiens
tcccacctccagc

SEQ ID NO: 1237295 - DNA, 14 bp, Homo sapiens
tcccacctcccttc

SEQ ID NO: 1237296 - DNA, 16 bp, Homo sapiens
tcccacctcccttccc

SEQ ID NO: 1237297 - DNA, 23 bp, Homo sapiens
tcccacctctccttttgaggctt

SEQ ID NO: 1237298 - DNA, 12 bp, Homo sapiens
tcccacctggct

SEQ ID NO: 1237299 - DNA, 14 bp, Homo sapiens
tcccacctggctcc

SEQ ID NO: 1237300 - DNA, 15 bp, Homo sapiens
tcccacctggctccc

SEQ ID NO: 1237301 - DNA, 17 bp, Homo sapiens
tcccacggcctttctag

SEQ ID NO: 1237302 - DNA, 20 bp, Homo sapiens
tcccactatctgggtgcatg

SEQ ID NO: 1237303 - DNA, 13 bp, Homo sapiens
tcccactcaccag

SEQ ID NO: 1237304 - DNA, 13 bp, Homo sapiens
tcccactcccatc

SEQ ID NO: 1237305 - DNA, 12 bp, Homo sapiens
tcccactgggac

SEQ ID NO: 1237306 - DNA, 14 bp, Homo sapiens
tcccactgggactc

SEQ ID NO: 1237307 - DNA, 23 bp, Homo sapiens
tcccactgggactcccagcagag

SEQ ID NO: 1237308 - DNA, 15 bp, Homo sapiens
tcccactgttctgaa

SEQ ID NO: 1237309 - DNA, 22 bp, Homo sapiens
tcccacttagccgcaccctgca

SEQ ID NO: 1237310 - DNA, 20 bp, Homo sapiens
tcccacttcctcctacctgg

SEQ ID NO: 1237311 - DNA, 12 bp, Homo sapiens
tcccacttcctt

SEQ ID NO: 1237312 - DNA, 14 bp, Homo sapiens
tcccactttctgtt

SEQ ID NO: 1237313 - DNA, 17 bp, Homo sapiens
tcccactttgtctgtac

SEQ ID NO: 1237314 - DNA, 18 bp, Homo sapiens
tcccactttgtctgtaca

SEQ ID NO: 1237315 - DNA, 20 bp, Homo sapiens
tcccagaactattctggggg

SEQ ID NO: 1237316 - DNA, 18 bp, Homo sapiens
tcccagaatcccagccgg

SEQ ID NO: 1237317 - DNA, 20 bp, Homo sapiens
tcccagacaaggagagcgga

SEQ ID NO: 1237318 - DNA, 18 bp, Homo sapiens
tcccagacagctttttag

SEQ ID NO: 1237319 - DNA, 15 bp, Homo sapiens
tcccagacaggccct

SEQ ID NO: 1237320 - DNA, 21 bp, Homo sapiens
tcccagaccttaagacactgt

SEQ ID NO: 1237321 - DNA, 22 bp, Homo sapiens
tcccagacgaggggcttcctct

SEQ ID NO: 1237322 - DNA, 14 bp, Homo sapiens
tcccagactctgcc

SEQ ID NO: 1237323 - DNA, 23 bp, Homo sapiens
tcccagagaacaatcactattct

SEQ ID NO: 1237324 - DNA, 24 bp, Homo sapiens
tcccagagaacaatcactattctt

SEQ ID NO: 1237325 - DNA, 18 bp, Homo sapiens
tcccagagacaggaaaat

SEQ ID NO: 1237326 - DNA, 22 bp, Homo sapiens
tcccagagctcatcccccctgc

SEQ ID NO: 1237327 - DNA, 19 bp, Homo sapiens
tcccagagcttattggcca

SEQ ID NO: 1237328 - DNA, 21 bp, Homo sapiens
tcccagagcttattggccact

SEQ ID NO: 1237329 - DNA, 23 bp, Homo sapiens
tcccagagcttattggccactgg

SEQ ID NO: 1237330 - DNA, 20 bp, Homo sapiens
tcccagaggagccaccagtt

SEQ ID NO: 1237331 - DNA, 13 bp, Homo sapiens
tcccagaggtcca

SEQ ID NO: 1237332 - DNA, 17 bp, Homo sapiens
tcccagaggtccagccc

SEQ ID NO: 1237333 - DNA, 20 bp, Homo sapiens
tcccagaggttatctgcctg

SEQ ID NO: 1237334 - DNA, 21 bp, Homo sapiens
tcccagaggttatctgcctgg

SEQ ID NO: 1237335 - DNA, 22 bp, Homo sapiens
tcccagaggttatctgcctggc

SEQ ID NO: 1237336 - DNA, 14 bp, Homo sapiens
tcccagagtcagag

SEQ ID NO: 1237337 - DNA, 21 bp, Homo sapiens
tcccagagtcagaggagaaga

SEQ ID NO: 1237338 - DNA, 16 bp, Homo sapiens
tcccagatcgtctcca

SEQ ID NO: 1237339 - DNA, 18 bp, Homo sapiens
tcccagatcgtctccaat

SEQ ID NO: 1237340 - DNA, 23 bp, Homo sapiens
tcccagatgccttctagattcac

SEQ ID NO: 1237341 - DNA, 14 bp, Homo sapiens
tcccagatgtaaag

SEQ ID NO: 1237342 - DNA, 23 bp, Homo sapiens
tcccagcaagacctcatctgtgg

SEQ ID NO: 1237343 - DNA, 22 bp, Homo sapiens
tcccagcactatgctttccttc

SEQ ID NO: 1237344 - DNA, 14 bp, Homo sapiens
tcccagcactgcct

SEQ ID NO: 1237345 - DNA, 16 bp, Homo sapiens
tcccagcactgcctcc

SEQ ID NO: 1237346 - DNA, 18 bp, Homo sapiens
tcccagcactttgggagg

SEQ ID NO: 1237347 - DNA, 22 bp, Homo sapiens
tcccagcactttgggaggccta

SEQ ID NO: 1237348 - DNA, 22 bp, Homo sapiens
tcccagcagagcccaccagcca

SEQ ID NO: 1237349 - DNA, 19 bp, Homo sapiens
tcccagcatccctggagca

SEQ ID NO: 1237350 - DNA, 21 bp, Homo sapiens
tcccagcatccctggagcagg

SEQ ID NO: 1237351 - DNA, 14 bp, Homo sapiens
tcccagccaccccg

SEQ ID NO: 1237352 - DNA, 24 bp, Homo sapiens
tcccagccaccccgggctctctgc

SEQ ID NO: 1237353 - DNA, 22 bp, Homo sapiens
tcccagccagcccgccgcccgc

SEQ ID NO: 1237354 - DNA, 15 bp, Homo sapiens
tcccagcccaaagct

SEQ ID NO: 1237355 - DNA, 22 bp, Homo sapiens
tcccagcccacctcaacccaga

SEQ ID NO: 1237356 - DNA, 23 bp, Homo sapiens
tcccagcccacctcaacccagag

SEQ ID NO: 1237357 - DNA, 14 bp, Homo sapiens
tcccagcccattgc

SEQ ID NO: 1237358 - DNA, 16 bp, Homo sapiens
tcccagcccattgctg

SEQ ID NO: 1237359 - DNA, 19 bp, Homo sapiens
tcccagcccattgctgcca

SEQ ID NO: 1237360 - DNA, 15 bp, Homo sapiens
tcccagccccaggcc

SEQ ID NO: 1237361 - DNA, 17 bp, Homo sapiens
tcccagccccaggcctg

SEQ ID NO: 1237362 - DNA, 18 bp, Homo sapiens
tcccagccccaggcctgg

SEQ ID NO: 1237363 - DNA, 20 bp, Homo sapiens
tcccagccccaggcctggcc

SEQ ID NO: 1237364 - DNA, 22 bp, Homo sapiens
tcccagccccggcaagccacag

SEQ ID NO: 1237365 - DNA, 23 bp, Homo sapiens
tcccagccccggcaagccacagg

SEQ ID NO: 1237366 - DNA, 21 bp, Homo sapiens
tcccagccggccaatggaaac

SEQ ID NO: 1237367 - DNA, 17 bp, Homo sapiens
tcccagccgtggtcaac

SEQ ID NO: 1237368 - DNA, 13 bp, Homo sapiens
tcccagcctgctg

SEQ ID NO: 1237369 - DNA, 14 bp, Homo sapiens
tcccagcctgctga

SEQ ID NO: 1237370 - DNA, 16 bp, Homo sapiens
tcccagcctgctgaga

SEQ ID NO: 1237371 - DNA, 23 bp, Homo sapiens
tcccagcctggggctccctctct

SEQ ID NO: 1237372 - DNA, 24 bp, Homo sapiens
tcccagcctggggctccctctctg

SEQ ID NO: 1237373 - DNA, 18 bp, Homo sapiens
tcccagcgagccacagga

SEQ ID NO: 1237374 - DNA, 15 bp, Homo sapiens
tcccagcgctctggg

SEQ ID NO: 1237375 - DNA, 19 bp, Homo sapiens
tcccagcggcctcagggtc

SEQ ID NO: 1237376 - DNA, 24 bp, Homo sapiens
tcccagcgtttagtttctagaggc

SEQ ID NO: 1237377 - DNA, 16 bp, Homo sapiens
tcccagctactcagaa

SEQ ID NO: 1237378 - DNA, 21 bp, Homo sapiens
tcccagctactcagaagcctg

SEQ ID NO: 1237379 - DNA, 23 bp, Homo sapiens
tcccagctactcagaagcctgag

SEQ ID NO: 1237380 - DNA, 16 bp, Homo sapiens
tcccagctactcagga

SEQ ID NO: 1237381 - DNA, 16 bp, Homo sapiens
tcccagctacttggga

SEQ ID NO: 1237382 - DNA, 17 bp, Homo sapiens
tcccagctacttgggaa

SEQ ID NO: 1237383 - DNA, 23 bp, Homo sapiens
tcccagctacttgggagcctgag

SEQ ID NO: 1237384 - DNA, 18 bp, Homo sapiens
tcccagctacttgggagg

SEQ ID NO: 1237385 - DNA, 20 bp, Homo sapiens
tcccagctaggaagagcagg

SEQ ID NO: 1237386 - DNA, 16 bp, Homo sapiens
tcccagctccccccgc

SEQ ID NO: 1237387 - DNA, 21 bp, Homo sapiens
tcccagctccccccgcccacc

SEQ ID NO: 1237388 - DNA, 22 bp, Homo sapiens
tcccagctcctttctcctgtga

SEQ ID NO: 1237389 - DNA, 20 bp, Homo sapiens
tcccagctctagacaaccct

SEQ ID NO: 1237390 - DNA, 18 bp, Homo sapiens
tcccagctctccctctgg

SEQ ID NO: 1237391 - DNA, 21 bp, Homo sapiens
tcccagctctccctctggccc

SEQ ID NO: 1237392 - DNA, 12 bp, Homo sapiens
tcccagctgcac

SEQ ID NO: 1237393 - DNA, 13 bp, Homo sapiens
tcccagctgcttt

SEQ ID NO: 1237394 - DNA, 16 bp, Homo sapiens
tcccagctgctttact

SEQ ID NO: 1237395 - DNA, 13 bp, Homo sapiens
tcccagctgtgct

SEQ ID NO: 1237396 - DNA, 14 bp, Homo sapiens
tcccagctgtgctg

SEQ ID NO: 1237397 - DNA, 17 bp, Homo sapiens
tcccagctgtgctgtgg

SEQ ID NO: 1237398 - DNA, 19 bp, Homo sapiens
tcccagcttcggcatttga

SEQ ID NO: 1237399 - DNA, 17 bp, Homo sapiens
tcccagcttgcccccgc

SEQ ID NO: 1237400 - DNA, 23 bp, Homo sapiens
tcccaggaaccgaacatatcatt

SEQ ID NO: 1237401 - DNA, 14 bp, Homo sapiens
tcccaggaagcagg

SEQ ID NO: 1237402 - DNA, 15 bp, Homo sapiens
tcccaggaagcaggg

SEQ ID NO: 1237403 - DNA, 17 bp, Homo sapiens
tcccaggaagcagggag

SEQ ID NO: 1237404 - DNA, 23 bp, Homo sapiens
tcccaggaagcagggagagttgg

SEQ ID NO: 1237405 - DNA, 13 bp, Homo sapiens
tcccaggaagccg

SEQ ID NO: 1237406 - DNA, 23 bp, Homo sapiens
tcccaggaagccggtgcctgggt

SEQ ID NO: 1237407 - DNA, 18 bp, Homo sapiens
tcccaggactcaccctcc

SEQ ID NO: 1237408 - DNA, 15 bp, Homo sapiens
tcccaggagacagtt

SEQ ID NO: 1237409 - DNA, 22 bp, Homo sapiens
tcccaggagacagttcaagaaa

SEQ ID NO: 1237410 - DNA, 23 bp, Homo sapiens
tcccaggagctgcccagagttgc

SEQ ID NO: 1237411 - DNA, 14 bp, Homo sapiens
tcccaggcaagcag

SEQ ID NO: 1237412 - DNA, 23 bp, Homo sapiens
tcccaggcagcacagtgtgtgaa

SEQ ID NO: 1237413 - DNA, 18 bp, Homo sapiens
tcccaggcatgcagctgc

SEQ ID NO: 1237414 - DNA, 20 bp, Homo sapiens
tcccaggcatgcagctgcct

SEQ ID NO: 1237415 - DNA, 19 bp, Homo sapiens
tcccaggcccactgtgcct

SEQ ID NO: 1237416 - DNA, 18 bp, Homo sapiens
tcccaggcgccccttccc

SEQ ID NO: 1237417 - DNA, 20 bp, Homo sapiens
tcccaggcgccccttccccc

SEQ ID NO: 1237418 - DNA, 21 bp, Homo sapiens
tcccaggctctcaacagggga

SEQ ID NO: 1237419 - DNA, 20 bp, Homo sapiens
tcccaggctgggctctgcct

SEQ ID NO: 1237420 - DNA, 21 bp, Homo sapiens
tcccaggctgggctctgcctg

SEQ ID NO: 1237421 - DNA, 14 bp, Homo sapiens
tcccagggaaggac

SEQ ID NO: 1237422 - DNA, 16 bp, Homo sapiens
tcccagggaaggactt

SEQ ID NO: 1237423 - DNA, 19 bp, Homo sapiens
tcccagggaccagcacctt

SEQ ID NO: 1237424 - DNA, 20 bp, Homo sapiens
tcccagggagtgagcagcta

SEQ ID NO: 1237425 - DNA, 21 bp, Homo sapiens
tcccagggagtgagcagctac

SEQ ID NO: 1237426 - DNA, 16 bp, Homo sapiens
tcccagggccagggcc

SEQ ID NO: 1237427 - DNA, 17 bp, Homo sapiens
tcccagggccagggccc

SEQ ID NO: 1237428 - DNA, 22 bp, Homo sapiens
tcccagggccagggccctgcag

SEQ ID NO: 1237429 - DNA, 17 bp, Homo sapiens
tcccagggccctcccag

SEQ ID NO: 1237430 - DNA, 20 bp, Homo sapiens
tcccagggccctcccagccc

SEQ ID NO: 1237431 - DNA, 20 bp, Homo sapiens
tcccagggctctgcaggcca

SEQ ID NO: 1237432 - DNA, 17 bp, Homo sapiens
tcccaggggaccacacc

SEQ ID NO: 1237433 - DNA, 18 bp, Homo sapiens
tcccaggggactgttcct

SEQ ID NO: 1237434 - DNA, 19 bp, Homo sapiens
tcccaggggagccagctgc

SEQ ID NO: 1237435 - DNA, 11 bp, Homo sapiens
tcccagggtgg

SEQ ID NO: 1237436 - DNA, 20 bp, Homo sapiens
tcccagggtggaggaaggtg

SEQ ID NO: 1237437 - DNA, 14 bp, Homo sapiens
tcccaggtagctgg

SEQ ID NO: 1237438 - DNA, 21 bp, Homo sapiens
tcccaggtagctgggattaca

SEQ ID NO: 1237439 - DNA, 23 bp, Homo sapiens
tcccaggtgcgtgtgtctctgtc

SEQ ID NO: 1237440 - DNA, 18 bp, Homo sapiens
tcccagtacgatttgcag

SEQ ID NO: 1237441 - DNA, 22 bp, Homo sapiens
tcccagtataagatttttgaaa

SEQ ID NO: 1237442 - DNA, 19 bp, Homo sapiens
tcccagtattctcagagca

SEQ ID NO: 1237443 - DNA, 12 bp, Homo sapiens
tcccagtatttt

SEQ ID NO: 1237444 - DNA, 14 bp, Homo sapiens
tcccagtattttta

SEQ ID NO: 1237445 - DNA, 19 bp, Homo sapiens
tcccagtcactcctctcta

SEQ ID NO: 1237446 - DNA, 15 bp, Homo sapiens
tcccagtcagaaata

SEQ ID NO: 1237447 - DNA, 16 bp, Homo sapiens
tcccagtcagaaataa

SEQ ID NO: 1237448 - DNA, 18 bp, Homo sapiens
tcccagtctcatctcctg

SEQ ID NO: 1237449 - DNA, 19 bp, Homo sapiens
tcccagtctcatctcctga

SEQ ID NO: 1237450 - DNA, 22 bp, Homo sapiens
tcccagtctcatctcctgaccc

SEQ ID NO: 1237451 - DNA, 14 bp, Homo sapiens
tcccagtgacaaca

SEQ ID NO: 1237452 - DNA, 15 bp, Homo sapiens
tcccagtgacacttc

SEQ ID NO: 1237453 - DNA, 19 bp, Homo sapiens
tcccagtgacacttcagag

SEQ ID NO: 1237454 - DNA, 20 bp, Homo sapiens
tcccagtggcctcaaccctc

SEQ ID NO: 1237455 - DNA, 22 bp, Homo sapiens
tcccagtggcctcaaccctccc

SEQ ID NO: 1237456 - DNA, 10 bp, Homo sapiens
tcccagtggg

SEQ ID NO: 1237457 - DNA, 22 bp, Homo sapiens
tcccagtgggaggggcaggctg

SEQ ID NO: 1237458 - DNA, 20 bp, Homo sapiens
tcccagtgtcagtatttact

SEQ ID NO: 1237459 - DNA, 15 bp, Homo sapiens
tcccagttaaagatt

SEQ ID NO: 1237460 - DNA, 20 bp, Homo sapiens
tcccagttcaggagtcccaa

SEQ ID NO: 1237461 - DNA, 21 bp, Homo sapiens
tcccatagtggggcctgggag

SEQ ID NO: 1237462 - DNA, 15 bp, Homo sapiens
tcccatatcttgcct

SEQ ID NO: 1237463 - DNA, 14 bp, Homo sapiens
tcccatcaaaactc

SEQ ID NO: 1237464 - DNA, 18 bp, Homo sapiens
tcccatcaggctgttatt

SEQ ID NO: 1237465 - DNA, 15 bp, Homo sapiens
tcccatttctcactg

SEQ ID NO: 1237466 - DNA, 15 bp, Homo sapiens
tcccatttctgttgc

SEQ ID NO: 1237467 - DNA, 17 bp, Homo sapiens
tcccattttcatcctga

SEQ ID NO: 1237468 - DNA, 20 bp, Homo sapiens
tcccattttcatcctgagcc

SEQ ID NO: 1237469 - DNA, 13 bp, Homo sapiens
tcccattttcccc

SEQ ID NO: 1237470 - DNA, 18 bp, Homo sapiens
tccccaaacaggacagca

SEQ ID NO: 1237471 - DNA, 18 bp, Homo sapiens
tccccaaaccataaaacc

SEQ ID NO: 1237472 - DNA, 18 bp, Homo sapiens
tccccaaaggacgcctgc

SEQ ID NO: 1237473 - DNA, 17 bp, Homo sapiens
tccccaaagtaccacac

SEQ ID NO: 1237474 - DNA, 20 bp, Homo sapiens
tccccaaagtaccacactga

SEQ ID NO: 1237475 - DNA, 17 bp, Homo sapiens
tccccaacaggaatttt

SEQ ID NO: 1237476 - DNA, 16 bp, Homo sapiens
tccccaaccacagaga

SEQ ID NO: 1237477 - DNA, 22 bp, Homo sapiens
tccccaaccctaggttccctgt

SEQ ID NO: 1237478 - DNA, 19 bp, Homo sapiens
tccccaaccctgcccctgc

SEQ ID NO: 1237479 - DNA, 20 bp, Homo sapiens
tccccaaccctgcccctgcc

SEQ ID NO: 1237480 - DNA, 20 bp, Homo sapiens
tccccaacggggtggggagg

SEQ ID NO: 1237481 - DNA, 16 bp, Homo sapiens
tccccaacgtcccctc

SEQ ID NO: 1237482 - DNA, 18 bp, Homo sapiens
tccccaactccctgccat

SEQ ID NO: 1237483 - DNA, 18 bp, Homo sapiens
tccccaacttccctagtc

SEQ ID NO: 1237484 - DNA, 14 bp, Homo sapiens
tccccaagctggcc

SEQ ID NO: 1237485 - DNA, 21 bp, Homo sapiens
tccccaagggccaaacccact

SEQ ID NO: 1237486 - DNA, 18 bp, Homo sapiens
tccccaatccatgcttca

SEQ ID NO: 1237487 - DNA, 20 bp, Homo sapiens
tccccacacacaggccttct

SEQ ID NO: 1237488 - DNA, 16 bp, Homo sapiens
tccccacacagggcac

SEQ ID NO: 1237489 - DNA, 21 bp, Homo sapiens
tccccacacagggcactgact

SEQ ID NO: 1237490 - DNA, 13 bp, Homo sapiens
tccccacactcca

SEQ ID NO: 1237491 - DNA, 16 bp, Homo sapiens
tccccacactccactc

SEQ ID NO: 1237492 - DNA, 11 bp, Homo sapiens
tccccacagac

SEQ ID NO: 1237493 - DNA, 21 bp, Homo sapiens
tccccacagactgccccagcc

SEQ ID NO: 1237494 - DNA, 18 bp, Homo sapiens
tccccaccactgatatca

SEQ ID NO: 1237495 - DNA, 16 bp, Homo sapiens
tccccaccagctcgtt

SEQ ID NO: 1237496 - DNA, 14 bp, Homo sapiens
tccccacccaagag

SEQ ID NO: 1237497 - DNA, 13 bp, Homo sapiens
tccccaccccacc

SEQ ID NO: 1237498 - DNA, 13 bp, Homo sapiens
tccccaccccact

SEQ ID NO: 1237499 - DNA, 22 bp, Homo sapiens
tccccacccccctctctttctc

SEQ ID NO: 1237500 - DNA, 23 bp, Homo sapiens
tccccacccccctctctttctct

SEQ ID NO: 1237501 - DNA, 15 bp, Homo sapiens
tccccacccctaccc

SEQ ID NO: 1237502 - DNA, 19 bp, Homo sapiens
tccccacccctacccctgg

SEQ ID NO: 1237503 - DNA, 23 bp, Homo sapiens
tccccacccctacccctggctgt

SEQ ID NO: 1237504 - DNA, 14 bp, Homo sapiens
tccccaccctccac

SEQ ID NO: 1237505 - DNA, 16 bp, Homo sapiens
tccccaccctccactc

SEQ ID NO: 1237506 - DNA, 19 bp, Homo sapiens
tccccaccctcctcttgga

SEQ ID NO: 1237507 - DNA, 16 bp, Homo sapiens
tccccacctgtagctg

SEQ ID NO: 1237508 - DNA, 13 bp, Homo sapiens
tccccaccttccc

SEQ ID NO: 1237509 - DNA, 19 bp, Homo sapiens
tccccacgaggggacccat

SEQ ID NO: 1237510 - DNA, 22 bp, Homo sapiens
tccccacgaggggacccatggg

SEQ ID NO: 1237511 - DNA, 20 bp, Homo sapiens
tccccacgagtcacctgcaa

SEQ ID NO: 1237512 - DNA, 20 bp, Homo sapiens
tccccactaggttcttttcc

SEQ ID NO: 1237513 - DNA, 22 bp, Homo sapiens
tccccactcccccacccatggg

SEQ ID NO: 1237514 - DNA, 20 bp, Homo sapiens
tccccactgcctgcccaccc

SEQ ID NO: 1237515 - DNA, 22 bp, Homo sapiens
tccccactgcctgcccacccgt

SEQ ID NO: 1237516 - DNA, 15 bp, Homo sapiens
tccccactgctgagc

SEQ ID NO: 1237517 - DNA, 17 bp, Homo sapiens
tccccacttctgtgcca

SEQ ID NO: 1237518 - DNA, 21 bp, Homo sapiens
tccccacttgtccgctgggtg

SEQ ID NO: 1237519 - DNA, 17 bp, Homo sapiens
tccccagaaaggagact

SEQ ID NO: 1237520 - DNA, 16 bp, Homo sapiens
tccccagaactggctg

SEQ ID NO: 1237521 - DNA, 20 bp, Homo sapiens
tccccagaccaaccctggga

SEQ ID NO: 1237522 - DNA, 22 bp, Homo sapiens
tccccagaccaaccctgggacc

SEQ ID NO: 1237523 - DNA, 17 bp, Homo sapiens
tccccagactcagctcc

SEQ ID NO: 1237524 - DNA, 20 bp, Homo sapiens
tccccagagagcaggcaggg

SEQ ID NO: 1237525 - DNA, 23 bp, Homo sapiens
tccccagagagcaggcaggggca

SEQ ID NO: 1237526 - DNA, 21 bp, Homo sapiens
tccccagagcactgggttgca

SEQ ID NO: 1237527 - DNA, 12 bp, Homo sapiens
tccccagagccc

SEQ ID NO: 1237528 - DNA, 16 bp, Homo sapiens
tccccagagcccagct

SEQ ID NO: 1237529 - DNA, 18 bp, Homo sapiens
tccccagagcccagctct

SEQ ID NO: 1237530 - DNA, 18 bp, Homo sapiens
tccccccccaggccctcc

SEQ ID NO: 1237531 - DNA, 23 bp, Homo sapiens
tccccccccaggccctcccacca

SEQ ID NO: 1237532 - DNA, 16 bp, Homo sapiens
tcccccccctgtatag

SEQ ID NO: 1237533 - DNA, 14 bp, Homo sapiens
tccccccgcccacc

SEQ ID NO: 1237534 - DNA, 15 bp, Homo sapiens
tccccccgcccaccc

SEQ ID NO: 1237535 - DNA, 12 bp, Homo sapiens
tcccccctcact

SEQ ID NO: 1237536 - DNA, 19 bp, Homo sapiens
tcccccctctcctcccagc

SEQ ID NO: 1237537 - DNA, 18 bp, Homo sapiens
tccccccttgaagcaata

SEQ ID NO: 1237538 - DNA, 17 bp, Homo sapiens
tcccccgaatgcatttg

SEQ ID NO: 1237539 - DNA, 22 bp, Homo sapiens
tcccccgacactgctgcaccag

SEQ ID NO: 1237540 - DNA, 22 bp, Homo sapiens
tcccccgaccaatccccagcct

SEQ ID NO: 1237541 - DNA, 16 bp, Homo sapiens
tcccccgactgcctgt

SEQ ID NO: 1237542 - DNA, 22 bp, Homo sapiens
tcccccgcagtccccagccctt

SEQ ID NO: 1237543 - DNA, 15 bp, Homo sapiens
tccccctacccaccg

SEQ ID NO: 1237544 - DNA, 16 bp, Homo sapiens
tccccctacccaccga

SEQ ID NO: 1237545 - DNA, 17 bp, Homo sapiens
tccccctcaacctcacc

SEQ ID NO: 1237546 - DNA, 13 bp, Homo sapiens
tccccctccccag

SEQ ID NO: 1237547 - DNA, 16 bp, Homo sapiens
tccccctccccaggct

SEQ ID NO: 1237548 - DNA, 13 bp, Homo sapiens
tccccctccctgc

SEQ ID NO: 1237549 - DNA, 15 bp, Homo sapiens
tccccctcctagggg

SEQ ID NO: 1237550 - DNA, 17 bp, Homo sapiens
tccccctcctagggggt

SEQ ID NO: 1237551 - DNA, 12 bp, Homo sapiens
tccccctcctca

SEQ ID NO: 1237552 - DNA, 20 bp, Homo sapiens
tccccctctcacgccacccc

SEQ ID NO: 1237553 - DNA, 11 bp, Homo sapiens
tccccctctgc

SEQ ID NO: 1237554 - DNA, 13 bp, Homo sapiens
tccccctctggct

SEQ ID NO: 1237555 - DNA, 14 bp, Homo sapiens
tccccctctgtctt

SEQ ID NO: 1237556 - DNA, 13 bp, Homo sapiens
tccccctgcccca

SEQ ID NO: 1237557 - DNA, 19 bp, Homo sapiens
tccccctgcctcccattct

SEQ ID NO: 1237558 - DNA, 20 bp, Homo sapiens
tccccctgggctctgcccca

SEQ ID NO: 1237559 - DNA, 22 bp, Homo sapiens
tccccctgggctctgccccagc

SEQ ID NO: 1237560 - DNA, 21 bp, Homo sapiens
tccccctggggcttctcctga

SEQ ID NO: 1237561 - DNA, 13 bp, Homo sapiens
tccccctgtggaa

SEQ ID NO: 1237562 - DNA, 17 bp, Homo sapiens
tccccctgtggaatgtt

SEQ ID NO: 1237563 - DNA, 22 bp, Homo sapiens
tcccccttcacaaagcccaagg

SEQ ID NO: 1237564 - DNA, 12 bp, Homo sapiens
tcccccttcagc

SEQ ID NO: 1237565 - DNA, 19 bp, Homo sapiens
tcccccttcccttggaggg

SEQ ID NO: 1237566 - DNA, 10 bp, Homo sapiens
tcccccttct

SEQ ID NO: 1237567 - DNA, 15 bp, Homo sapiens
tcccccttctcccac

SEQ ID NO: 1237568 - DNA, 21 bp, Homo sapiens
tcccccttgaggattgtggaa

SEQ ID NO: 1237569 - DNA, 16 bp, Homo sapiens
tcccccttgtcttccc

SEQ ID NO: 1237570 - DNA, 23 bp, Homo sapiens
tcccccttgtcttcccccctctc

SEQ ID NO: 1237571 - DNA, 14 bp, Homo sapiens
tccccctttggggt

SEQ ID NO: 1237572 - DNA, 19 bp, Homo sapiens
tcccccttttttgtccccc

SEQ ID NO: 1237573 - DNA, 24 bp, Homo sapiens
tccccgaaacaggctactctcctc

SEQ ID NO: 1237574 - DNA, 17 bp, Homo sapiens
tccccgacagtggctct

SEQ ID NO: 1237575 - DNA, 15 bp, Homo sapiens
tccccgaccccccta

SEQ ID NO: 1237576 - DNA, 18 bp, Homo sapiens
tccccgaggagctgggcc

SEQ ID NO: 1237577 - DNA, 14 bp, Homo sapiens
tccccgaggctgcc

SEQ ID NO: 1237578 - DNA, 17 bp, Homo sapiens
tccccgaggctgcccca

SEQ ID NO: 1237579 - DNA, 22 bp, Homo sapiens
tccccgaggctgccccaggccg

SEQ ID NO: 1237580 - DNA, 12 bp, Homo sapiens
tccccgagggct

SEQ ID NO: 1237581 - DNA, 15 bp, Homo sapiens
tccccgagggctcag

SEQ ID NO: 1237582 - DNA, 15 bp, Homo sapiens
tccccgagtcctcag

SEQ ID NO: 1237583 - DNA, 22 bp, Homo sapiens
tccccgatccccgacagtggct

SEQ ID NO: 1237584 - DNA, 21 bp, Homo sapiens
tccccgatgtcccctgcgggc

SEQ ID NO: 1237585 - DNA, 20 bp, Homo sapiens
tccccgcagcccgcctgccg

SEQ ID NO: 1237586 - DNA, 21 bp, Homo sapiens
tccccgcagcccgcctgccgt

SEQ ID NO: 1237587 - DNA, 21 bp, Homo sapiens
tccccgcagtgtgcactaagg

SEQ ID NO: 1237588 - DNA, 22 bp, Homo sapiens
tccccgcagtgtgcactaaggg

SEQ ID NO: 1237589 - DNA, 13 bp, Homo sapiens
tccccgcccctgt

SEQ ID NO: 1237590 - DNA, 21 bp, Homo sapiens
tccccgcccctgtggccctgg

SEQ ID NO: 1237591 - DNA, 21 bp, Homo sapiens
tccccgcctcctcccactggg

SEQ ID NO: 1237592 - DNA, 14 bp, Homo sapiens
tccccgcctggcca

SEQ ID NO: 1237593 - DNA, 17 bp, Homo sapiens
tccccgcctggccagga

SEQ ID NO: 1237594 - DNA, 18 bp, Homo sapiens
tccccgcctggccaggag

SEQ ID NO: 1237595 - DNA, 14 bp, Homo sapiens
tccccgccttccct

SEQ ID NO: 1237596 - DNA, 13 bp, Homo sapiens
tccccgctccaca

SEQ ID NO: 1237597 - DNA, 18 bp, Homo sapiens
tccccgcttctgcctgca

SEQ ID NO: 1237598 - DNA, 13 bp, Homo sapiens
tccccggctcgag

SEQ ID NO: 1237599 - DNA, 15 bp, Homo sapiens
tccccgggggaggaa

SEQ ID NO: 1237600 - DNA, 22 bp, Homo sapiens
tccccggtaatgtcactgtttt

SEQ ID NO: 1237601 - DNA, 23 bp, Homo sapiens
tccccggtaatgtcactgttttt

SEQ ID NO: 1237602 - DNA, 22 bp, Homo sapiens
tccccggtcccttgagacctca

SEQ ID NO: 1237603 - DNA, 22 bp, Homo sapiens
tccccggttgctggtcaggtcc

SEQ ID NO: 1237604 - DNA, 16 bp, Homo sapiens
tccccgtcccctgcag

SEQ ID NO: 1237605 - DNA, 22 bp, Homo sapiens
tccccgtcccctgcagcctggg

SEQ ID NO: 1237606 - DNA, 17 bp, Homo sapiens
tccccgtccctgtcccc

SEQ ID NO: 1237607 - DNA, 21 bp, Homo sapiens
tccccgtccctgtcccccagc

SEQ ID NO: 1237608 - DNA, 15 bp, Homo sapiens
tccccgtctcattcc

SEQ ID NO: 1237609 - DNA, 22 bp, Homo sapiens
tcccctaaagcctcaaaacaaa

SEQ ID NO: 1237610 - DNA, 17 bp, Homo sapiens
tcccctaacccccagtc

SEQ ID NO: 1237611 - DNA, 23 bp, Homo sapiens
tcccctaaccctactttgcttcc

SEQ ID NO: 1237612 - DNA, 16 bp, Homo sapiens
tcccctactccctctt

SEQ ID NO: 1237613 - DNA, 19 bp, Homo sapiens
tcccctagacctccccctc

SEQ ID NO: 1237614 - DNA, 16 bp, Homo sapiens
tcccctatccacccag

SEQ ID NO: 1237615 - DNA, 14 bp, Homo sapiens
tcccctatcctccc

SEQ ID NO: 1237616 - DNA, 15 bp, Homo sapiens
tcccctatcctcccc

SEQ ID NO: 1237617 - DNA, 16 bp, Homo sapiens
tcccctcaacaccctg

SEQ ID NO: 1237618 - DNA, 18 bp, Homo sapiens
tcccctcaacaccctgct

SEQ ID NO: 1237619 - DNA, 20 bp, Homo sapiens
tcccctcacacacacccccc

SEQ ID NO: 1237620 - DNA, 22 bp, Homo sapiens
tcccctcacacacaccccccca

SEQ ID NO: 1237621 - DNA, 19 bp, Homo sapiens
tcccctcacatcctcctgc

SEQ ID NO: 1237622 - DNA, 15 bp, Homo sapiens
tcccctcacctcctc

SEQ ID NO: 1237623 - DNA, 20 bp, Homo sapiens
tcccctcacgcaagtgccag

SEQ ID NO: 1237624 - DNA, 16 bp, Homo sapiens
tcccctcactctgtca

SEQ ID NO: 1237625 - DNA, 21 bp, Homo sapiens
tcccctcactctgtcagccag

SEQ ID NO: 1237626 - DNA, 12 bp, Homo sapiens
tcccctcactgg

SEQ ID NO: 1237627 - DNA, 13 bp, Homo sapiens
tcccctcactgga

SEQ ID NO: 1237628 - DNA, 13 bp, Homo sapiens
tcccctcagagct

SEQ ID NO: 1237629 - DNA, 14 bp, Homo sapiens
tcccctcagcctct

SEQ ID NO: 1237630 - DNA, 15 bp, Homo sapiens
tcccctcagcctgcc

SEQ ID NO: 1237631 - DNA, 17 bp, Homo sapiens
tcccctcagcctgccca

SEQ ID NO: 1237632 - DNA, 18 bp, Homo sapiens
tcccctcagcctgcccac

SEQ ID NO: 1237633 - DNA, 13 bp, Homo sapiens
tcccctccacagc

SEQ ID NO: 1237634 - DNA, 19 bp, Homo sapiens
tcccctccacagctgcagc

SEQ ID NO: 1237635 - DNA, 19 bp, Homo sapiens
tcccctcccacctctcctt

SEQ ID NO: 1237636 - DNA, 20 bp, Homo sapiens
tcccctcccaggggagccag

SEQ ID NO: 1237637 - DNA, 23 bp, Homo sapiens
tcccctcccaggggagccagctg

SEQ ID NO: 1237638 - DNA, 11 bp, Homo sapiens
tcccctcccat

SEQ ID NO: 1237639 - DNA, 15 bp, Homo sapiens
tcccctccccagccc

SEQ ID NO: 1237640 - DNA, 17 bp, Homo sapiens
tcccctccccagcccaa

SEQ ID NO: 1237641 - DNA, 14 bp, Homo sapiens
tcccctccccagct

SEQ ID NO: 1237642 - DNA, 20 bp, Homo sapiens
tcccctccccagctcccttg

SEQ ID NO: 1237643 - DNA, 21 bp, Homo sapiens
tcccctccccgcgcgttcctt

SEQ ID NO: 1237644 - DNA, 18 bp, Homo sapiens
tcccctccccggccctac

SEQ ID NO: 1237645 - DNA, 15 bp, Homo sapiens
tcccctccctcgtgg

SEQ ID NO: 1237646 - DNA, 14 bp, Homo sapiens
tcccctccctcttc

SEQ ID NO: 1237647 - DNA, 22 bp, Homo sapiens
tcctccccaccttccccagact

SEQ ID NO: 1237648 - DNA, 13 bp, Homo sapiens
tcctccccagcag

SEQ ID NO: 1237649 - DNA, 23 bp, Homo sapiens
tcctccccatacacacacaaacc

SEQ ID NO: 1237650 - DNA, 22 bp, Homo sapiens
tcctccccattagagtcagcct

SEQ ID NO: 1237651 - DNA, 17 bp, Homo sapiens
tcctcccccggctgggc

SEQ ID NO: 1237652 - DNA, 18 bp, Homo sapiens
tcctcccccggctgggcc

SEQ ID NO: 1237653 - DNA, 13 bp, Homo sapiens
tcctccccctgcc

SEQ ID NO: 1237654 - DNA, 14 bp, Homo sapiens
tcctccccctgttc

SEQ ID NO: 1237655 - DNA, 16 bp, Homo sapiens
tcctccccctgttctg

SEQ ID NO: 1237656 - DNA, 22 bp, Homo sapiens
tcctccccctgttctgttgggg

SEQ ID NO: 1237657 - DNA, 11 bp, Homo sapiens
tcctccccctt

SEQ ID NO: 1237658 - DNA, 16 bp, Homo sapiens
tcctccccctttgggg

SEQ ID NO: 1237659 - DNA, 13 bp, Homo sapiens
tcctccccgcctc

SEQ ID NO: 1237660 - DNA, 18 bp, Homo sapiens
tcctcccctcctcttccc

SEQ ID NO: 1237661 - DNA, 13 bp, Homo sapiens
tcctccccttccc

SEQ ID NO: 1237662 - DNA, 17 bp, Homo sapiens
tcctccccttccctgca

SEQ ID NO: 1237663 - DNA, 18 bp, Homo sapiens
tcctccccttccctgcaa

SEQ ID NO: 1237664 - DNA, 13 bp, Homo sapiens
tcctccccttggg

SEQ ID NO: 1237665 - DNA, 20 bp, Homo sapiens
tcctccccttttaccactcc

SEQ ID NO: 1237666 - DNA, 20 bp, Homo sapiens
tcctcccgagctcctcttcc

SEQ ID NO: 1237667 - DNA, 14 bp, Homo sapiens
tcctcccgggccct

SEQ ID NO: 1237668 - DNA, 16 bp, Homo sapiens
tcctccctacttccaa

SEQ ID NO: 1237669 - DNA, 12 bp, Homo sapiens
tcctccctcagc

SEQ ID NO: 1237670 - DNA, 14 bp, Homo sapiens
tcctccctcagcct

SEQ ID NO: 1237671 - DNA, 15 bp, Homo sapiens
tcctccctcagtgcc

SEQ ID NO: 1237672 - DNA, 19 bp, Homo sapiens
tcctccctcatggctctgg

SEQ ID NO: 1237673 - DNA, 20 bp, Homo sapiens
tcctccctcatggctctggc

SEQ ID NO: 1237674 - DNA, 18 bp, Homo sapiens
tcctccctcattcatctt

SEQ ID NO: 1237675 - DNA, 13 bp, Homo sapiens
tcctccctcccag

SEQ ID NO: 1237676 - DNA, 19 bp, Homo sapiens
tcctccctcccagctgcac

SEQ ID NO: 1237677 - DNA, 13 bp, Homo sapiens
tcctccctcctgc

SEQ ID NO: 1237678 - DNA, 20 bp, Homo sapiens
tcctccctgacttttctgtg

SEQ ID NO: 1237679 - DNA, 14 bp, Homo sapiens
tcctccctgcatct

SEQ ID NO: 1237680 - DNA, 22 bp, Homo sapiens
tcctccctgcatctgaccagca

SEQ ID NO: 1237681 - DNA, 15 bp, Homo sapiens
tcctccctgcccatc

SEQ ID NO: 1237682 - DNA, 14 bp, Homo sapiens
tcctccctgctcct

SEQ ID NO: 1237683 - DNA, 16 bp, Homo sapiens
tcctccctgctcctca

SEQ ID NO: 1237684 - DNA, 20 bp, Homo sapiens
tcctccctgctcctcatggg

SEQ ID NO: 1237685 - DNA, 17 bp, Homo sapiens
tcctccctggctgccct

SEQ ID NO: 1237686 - DNA, 18 bp, Homo sapiens
tcctccctggctgccctg

SEQ ID NO: 1237687 - DNA, 19 bp, Homo sapiens
tcctccctggctgccctgg

SEQ ID NO: 1237688 - DNA, 22 bp, Homo sapiens
tcctccctggctgccctggccc

SEQ ID NO: 1237689 - DNA, 19 bp, Homo sapiens
tcctccctgggcagaaagt

SEQ ID NO: 1237690 - DNA, 22 bp, Homo sapiens
tcctccctgtgcccccagcctc

SEQ ID NO: 1237691 - DNA, 21 bp, Homo sapiens
tcctcccttccttttccctgc

SEQ ID NO: 1237692 - DNA, 15 bp, Homo sapiens
tcctcccttctgcta

SEQ ID NO: 1237693 - DNA, 18 bp, Homo sapiens
tcctcccttctgctactg

SEQ ID NO: 1237694 - DNA, 14 bp, Homo sapiens
tcctccgtccaccc

SEQ ID NO: 1237695 - DNA, 20 bp, Homo sapiens
tcctccgtccacccaggctg

SEQ ID NO: 1237696 - DNA, 19 bp, Homo sapiens
tcctcctaagtcccttcct

SEQ ID NO: 1237697 - DNA, 20 bp, Homo sapiens
tcctcctaagtcccttccta

SEQ ID NO: 1237698 - DNA, 13 bp, Homo sapiens
tcctcctacctca

SEQ ID NO: 1237699 - DNA, 21 bp, Homo sapiens
tcctcctcacccacctctggg

SEQ ID NO: 1237700 - DNA, 19 bp, Homo sapiens
tcctcctcagctgcatgga

SEQ ID NO: 1237701 - DNA, 12 bp, Homo sapiens
tcctcctccagg

SEQ ID NO: 1237702 - DNA, 13 bp, Homo sapiens
tcctcctccaggg

SEQ ID NO: 1237703 - DNA, 15 bp, Homo sapiens
tcctcctccagggtg

SEQ ID NO: 1237704 - DNA, 15 bp, Homo sapiens
tcctcctcccccaga

SEQ ID NO: 1237705 - DNA, 13 bp, Homo sapiens
tcctcctcccctc

SEQ ID NO: 1237706 - DNA, 22 bp, Homo sapiens
tcctcctcggaaccgctcacct

SEQ ID NO: 1237707 - DNA, 11 bp, Homo sapiens
tcctcctctgc

SEQ ID NO: 1237708 - DNA, 11 bp, Homo sapiens
tcctcctctgt

SEQ ID NO: 1237709 - DNA, 13 bp, Homo sapiens
tcctcctctttct

SEQ ID NO: 1237710 - DNA, 14 bp, Homo sapiens
tcctcctgaagcct

SEQ ID NO: 1237711 - DNA, 18 bp, Homo sapiens
tcctcctgatggagtgtg

SEQ ID NO: 1237712 - DNA, 13 bp, Homo sapiens
tcctcctgatggc

SEQ ID NO: 1237713 - DNA, 20 bp, Homo sapiens
tcctcctgatggccaagagc

SEQ ID NO: 1237714 - DNA, 23 bp, Homo sapiens
tcctcctgcagacacctggactg

SEQ ID NO: 1237715 - DNA, 20 bp, Homo sapiens
tcctcctgcagaccacgccc

SEQ ID NO: 1237716 - DNA, 19 bp, Homo sapiens
tcctcctgcccagctcctc

SEQ ID NO: 1237717 - DNA, 13 bp, Homo sapiens
tcctcctgctcct

SEQ ID NO: 1237718 - DNA, 22 bp, Homo sapiens
tcctcctggaaccttgctgtcc

SEQ ID NO: 1237719 - DNA, 13 bp, Homo sapiens
tcctcctggacac

SEQ ID NO: 1237720 - DNA, 22 bp, Homo sapiens
tcctcctgggccctctctgctc

SEQ ID NO: 1237721 - DNA, 17 bp, Homo sapiens
tcctcctgggggctggc

SEQ ID NO: 1237722 - DNA, 18 bp, Homo sapiens
tcctcctgggggctggct

SEQ ID NO: 1237723 - DNA, 16 bp, Homo sapiens
tcctcctgtattcctg

SEQ ID NO: 1237724 - DNA, 16 bp, Homo sapiens
tcctccttcactgttt

SEQ ID NO: 1237725 - DNA, 11 bp, Homo sapiens
tcctccttccc

SEQ ID NO: 1237726 - DNA, 16 bp, Homo sapiens
tcctccttcccaggga

SEQ ID NO: 1237727 - DNA, 12 bp, Homo sapiens
tcctccttcccc

SEQ ID NO: 1237728 - DNA, 23 bp, Homo sapiens
tcctccttccccccatctctgag

SEQ ID NO: 1237729 - DNA, 16 bp, Homo sapiens
tcctccttcctgggac

SEQ ID NO: 1237730 - DNA, 24 bp, Homo sapiens
tcctccttgcccagactacagggc

SEQ ID NO: 1237731 - DNA, 16 bp, Homo sapiens
tcctcgcagatgataa

SEQ ID NO: 1237732 - DNA, 14 bp, Homo sapiens
tcctcgcagcctct

SEQ ID NO: 1237733 - DNA, 21 bp, Homo sapiens
tcctcgcagcctctcagtgcc

SEQ ID NO: 1237734 - DNA, 13 bp, Homo sapiens
tcctcgccctggg

SEQ ID NO: 1237735 - DNA, 18 bp, Homo sapiens
tcctcgcctaggcctgtg

SEQ ID NO: 1237736 - DNA, 12 bp, Homo sapiens
tcctcgctcctc

SEQ ID NO: 1237737 - DNA, 18 bp, Homo sapiens
tcctcgctcctccttccc

SEQ ID NO: 1237738 - DNA, 21 bp, Homo sapiens
tcctcggagagcagcagcacc

SEQ ID NO: 1237739 - DNA, 14 bp, Homo sapiens
tcctcggagctggt

SEQ ID NO: 1237740 - DNA, 16 bp, Homo sapiens
tcctcggatcaccgag

SEQ ID NO: 1237741 - DNA, 14 bp, Homo sapiens
tcctcggccccctc

SEQ ID NO: 1237742 - DNA, 15 bp, Homo sapiens
tcctcggccccctcc

SEQ ID NO: 1237743 - DNA, 16 bp, Homo sapiens
tcctcggtactcccat

SEQ ID NO: 1237744 - DNA, 17 bp, Homo sapiens
tcctcggtggctctggg

SEQ ID NO: 1237745 - DNA, 18 bp, Homo sapiens
tcctcggtggctctgggg

SEQ ID NO: 1237746 - DNA, 19 bp, Homo sapiens
tcctcggtggctctggggt

SEQ ID NO: 1237747 - DNA, 19 bp, Homo sapiens
tcctcggtgggccagagct

SEQ ID NO: 1237748 - DNA, 20 bp, Homo sapiens
tcctcggtgggccagagctg

SEQ ID NO: 1237749 - DNA, 22 bp, Homo sapiens
tcctcgtgcagagctggggctg

SEQ ID NO: 1237750 - DNA, 15 bp, Homo sapiens
tcctcgttcctttct

SEQ ID NO: 1237751 - DNA, 21 bp, Homo sapiens
tcctcgttgggccgctctgat

SEQ ID NO: 1237752 - DNA, 17 bp, Homo sapiens
tcctctaaagaaacttg

SEQ ID NO: 1237753 - DNA, 21 bp, Homo sapiens
tcctctaaagcagaggcaaca

SEQ ID NO: 1237754 - DNA, 14 bp, Homo sapiens
tcctctaacatttt

SEQ ID NO: 1237755 - DNA, 15 bp, Homo sapiens
tcctctaactcactg

SEQ ID NO: 1237756 - DNA, 17 bp, Homo sapiens
tcctctacctctctcct

SEQ ID NO: 1237757 - DNA, 14 bp, Homo sapiens
tcctctactcttac

SEQ ID NO: 1237758 - DNA, 18 bp, Homo sapiens
tcctctacttaatgagat

SEQ ID NO: 1237759 - DNA, 19 bp, Homo sapiens
tcctctacttaatgagata

SEQ ID NO: 1237760 - DNA, 13 bp, Homo sapiens
tcctctagaaata

SEQ ID NO: 1237761 - DNA, 17 bp, Homo sapiens
tcctctagaagccaagg

SEQ ID NO: 1237762 - DNA, 15 bp, Homo sapiens
tcctctagccatccc

SEQ ID NO: 1237763 - DNA, 16 bp, Homo sapiens
tccccttcctcactgc

SEQ ID NO: 1237764 - DNA, 23 bp, Homo sapiens
tccccttcctcattatcaaacag

SEQ ID NO: 1237765 - DNA, 16 bp, Homo sapiens
tccccttcctggacac

SEQ ID NO: 1237766 - DNA, 23 bp, Homo sapiens
tccccttcctggacacactctca

SEQ ID NO: 1237767 - DNA, 12 bp, Homo sapiens
tccccttcctgt

SEQ ID NO: 1237768 - DNA, 16 bp, Homo sapiens
tccccttcctgttctt

SEQ ID NO: 1237769 - DNA, 21 bp, Homo sapiens
tccccttcctgttcttccttc

SEQ ID NO: 1237770 - DNA, 21 bp, Homo sapiens
tccccttcctgtttcagaccc

SEQ ID NO: 1237771 - DNA, 14 bp, Homo sapiens
tccccttcttcccg

SEQ ID NO: 1237772 - DNA, 13 bp, Homo sapiens
tccccttgcccag

SEQ ID NO: 1237773 - DNA, 17 bp, Homo sapiens
tccccttgcccagggct

SEQ ID NO: 1237774 - DNA, 14 bp, Homo sapiens
tccccttgcccttg

SEQ ID NO: 1237775 - DNA, 23 bp, Homo sapiens
tccccttgcccttgccctgacct

SEQ ID NO: 1237776 - DNA, 22 bp, Homo sapiens
tccccttgggcggctgagagcc

SEQ ID NO: 1237777 - DNA, 17 bp, Homo sapiens
tccccttggttctgcac

SEQ ID NO: 1237778 - DNA, 17 bp, Homo sapiens
tccccttgtctccctgg

SEQ ID NO: 1237779 - DNA, 20 bp, Homo sapiens
tcccctttgggggtgtgtgt

SEQ ID NO: 1237780 - DNA, 15 bp, Homo sapiens
tccccttttgcctgg

SEQ ID NO: 1237781 - DNA, 21 bp, Homo sapiens
tccccttttgcctggctgtgg

SEQ ID NO: 1237782 - DNA, 17 bp, Homo sapiens
tcccgaaagcctttcct

SEQ ID NO: 1237783 - DNA, 19 bp, Homo sapiens
tcccgaagccatcacttct

SEQ ID NO: 1237784 - DNA, 16 bp, Homo sapiens
tcccgacccagccagc

SEQ ID NO: 1237785 - DNA, 21 bp, Homo sapiens
tcccgacccagccagctgcag

SEQ ID NO: 1237786 - DNA, 22 bp, Homo sapiens
tcccgacccagccagctgcagg

SEQ ID NO: 1237787 - DNA, 23 bp, Homo sapiens
tcccgacccagccagctgcaggg

SEQ ID NO: 1237788 - DNA, 22 bp, Homo sapiens
tcccgagcacctccacatcctc

SEQ ID NO: 1237789 - DNA, 21 bp, Homo sapiens
tcccgagctactctcttgcca

SEQ ID NO: 1237790 - DNA, 15 bp, Homo sapiens
tcccgagctcctctt

SEQ ID NO: 1237791 - DNA, 15 bp, Homo sapiens
tcccgaggaagcaca

SEQ ID NO: 1237792 - DNA, 16 bp, Homo sapiens
tcccgaggaagcacag

SEQ ID NO: 1237793 - DNA, 16 bp, Homo sapiens
tcccgagtacagtctg

SEQ ID NO: 1237794 - DNA, 20 bp, Homo sapiens
tcccgagtagctgggattac

SEQ ID NO: 1237795 - DNA, 12 bp, Homo sapiens
tcccgagtctgg

SEQ ID NO: 1237796 - DNA, 15 bp, Homo sapiens
tcccgatgagggaag

SEQ ID NO: 1237797 - DNA, 16 bp, Homo sapiens
tcccgatggtctctct

SEQ ID NO: 1237798 - DNA, 16 bp, Homo sapiens
tcccgcaaggcctctc

SEQ ID NO: 1237799 - DNA, 22 bp, Homo sapiens
tcccgcacatggtgtggggggc

SEQ ID NO: 1237800 - DNA, 16 bp, Homo sapiens
tcccgcactctgcccc

SEQ ID NO: 1237801 - DNA, 18 bp, Homo sapiens
tcccgcactctgccccca

SEQ ID NO: 1237802 - DNA, 18 bp, Homo sapiens
tcccgccagactgttaga

SEQ ID NO: 1237803 - DNA, 14 bp, Homo sapiens
tcccgccccacctc

SEQ ID NO: 1237804 - DNA, 16 bp, Homo sapiens
tcccgccccccacact

SEQ ID NO: 1237805 - DNA, 18 bp, Homo sapiens
tcccgccccgggctggcc

SEQ ID NO: 1237806 - DNA, 20 bp, Homo sapiens
tcccgccccgggctggccct

SEQ ID NO: 1237807 - DNA, 15 bp, Homo sapiens
tcccgccctcacctg

SEQ ID NO: 1237808 - DNA, 22 bp, Homo sapiens
tcccgccctcacctgcagagaa

SEQ ID NO: 1237809 - DNA, 16 bp, Homo sapiens
tcccgccgcccgaccc

SEQ ID NO: 1237810 - DNA, 14 bp, Homo sapiens
tcctctagcttttc

SEQ ID NO: 1237811 - DNA, 15 bp, Homo sapiens
tcctctagcttttct

SEQ ID NO: 1237812 - DNA, 17 bp, Homo sapiens
tcctctagcttttctat

SEQ ID NO: 1237813 - DNA, 22 bp, Homo sapiens
tcctctagtgaatgtaggctgg

SEQ ID NO: 1237814 - DNA, 21 bp, Homo sapiens
tcctctagttgagtttctggc

SEQ ID NO: 1237815 - DNA, 14 bp, Homo sapiens
tcctgaagccagat

SEQ ID NO: 1237816 - DNA, 19 bp, Homo sapiens
tcctgaagccagatccacc

SEQ ID NO: 1237817 - DNA, 19 bp, Homo sapiens
tcctgaagcctctgccctg

SEQ ID NO: 1237818 - DNA, 15 bp, Homo sapiens
tcctgaattctattt

SEQ ID NO: 1237819 - DNA, 18 bp, Homo sapiens
tcctgacaacgtctcttc

SEQ ID NO: 1237820 - DNA, 19 bp, Homo sapiens
tcctgacaacgtctcttca

SEQ ID NO: 1237821 - DNA, 21 bp, Homo sapiens
tcctgacaagttcctaggaaa

SEQ ID NO: 1237822 - DNA, 13 bp, Homo sapiens
tcctgacacttta

SEQ ID NO: 1237823 - DNA, 14 bp, Homo sapiens
tcctgacatattca

SEQ ID NO: 1237824 - DNA, 19 bp, Homo sapiens
tcctgacatattcaagtga

SEQ ID NO: 1237825 - DNA, 14 bp, Homo sapiens
tcctgaccaccctc

SEQ ID NO: 1237826 - DNA, 19 bp, Homo sapiens
tcctgaccaccctcccctc

SEQ ID NO: 1237827 - DNA, 13 bp, Homo sapiens
tcctgacccaggc

SEQ ID NO: 1237828 - DNA, 15 bp, Homo sapiens
tcctgacccaggccg

SEQ ID NO: 1237829 - DNA, 17 bp, Homo sapiens
tcctgacccaggccgca

SEQ ID NO: 1237830 - DNA, 19 bp, Homo sapiens
tcctgacccaggccgcagc

SEQ ID NO: 1237831 - DNA, 14 bp, Homo sapiens
tcctgacccagtcc

SEQ ID NO: 1237832 - DNA, 16 bp, Homo sapiens
tcctgacccagtcccc

SEQ ID NO: 1237833 - DNA, 24 bp, Homo sapiens
tcctgacccctccctgcaggggct

SEQ ID NO: 1237834 - DNA, 16 bp, Homo sapiens
tcctgacccctgcctg

SEQ ID NO: 1237835 - DNA, 16 bp, Homo sapiens
tcctgaccctcccact

SEQ ID NO: 1237836 - DNA, 19 bp, Homo sapiens
tcctgacctcaggtgatcc

SEQ ID NO: 1237837 - DNA, 16 bp, Homo sapiens
tcctgaccttgtgatc

SEQ ID NO: 1237838 - DNA, 18 bp, Homo sapiens
tcctgacgaaactggccc

SEQ ID NO: 1237839 - DNA, 15 bp, Homo sapiens
tcctgacgccctgcg

SEQ ID NO: 1237840 - DNA, 19 bp, Homo sapiens
tcctgactcaacatgttac

SEQ ID NO: 1237841 - DNA, 13 bp, Homo sapiens
tcctgactgcccg

SEQ ID NO: 1237842 - DNA, 12 bp, Homo sapiens
tcctgacttgag

SEQ ID NO: 1237843 - DNA, 19 bp, Homo sapiens
tcctgagaaagcccacctg

SEQ ID NO: 1237844 - DNA, 13 bp, Homo sapiens
tcctgagaagcat

SEQ ID NO: 1237845 - DNA, 18 bp, Homo sapiens
tcctgagaaggcgaggag

SEQ ID NO: 1237846 - DNA, 19 bp, Homo sapiens
tcctgagagctgcatgtgt

SEQ ID NO: 1237847 - DNA, 23 bp, Homo sapiens
tcctgagcccaaccaggccctgc

SEQ ID NO: 1237848 - DNA, 13 bp, Homo sapiens
tcctgagccccgc

SEQ ID NO: 1237849 - DNA, 16 bp, Homo sapiens
tcctgagcctgtgggt

SEQ ID NO: 1237850 - DNA, 13 bp, Homo sapiens
tcctgagctagga

SEQ ID NO: 1237851 - DNA, 14 bp, Homo sapiens
tcctgagctggcct

SEQ ID NO: 1237852 - DNA, 19 bp, Homo sapiens
tcctgagcttggccagaag

SEQ ID NO: 1237853 - DNA, 22 bp, Homo sapiens
tcctgagcttggccagaagggg

SEQ ID NO: 1237854 - DNA, 18 bp, Homo sapiens
tcctgaggagccctgagg

SEQ ID NO: 1237855 - DNA, 13 bp, Homo sapiens
tcctgaggccagt

SEQ ID NO: 1237856 - DNA, 18 bp, Homo sapiens
tcctgaggctttggattt

SEQ ID NO: 1237857 - DNA, 17 bp, Homo sapiens
tcctgagggaggacctg

SEQ ID NO: 1237858 - DNA, 16 bp, Homo sapiens
tcctgaggggcatctg

SEQ ID NO: 1237859 - DNA, 22 bp, Homo sapiens
tcctgaggggcatctgcccctc

SEQ ID NO: 1237860 - DNA, 18 bp, Homo sapiens
tcctgagggttttctcat

SEQ ID NO: 1237861 - DNA, 15 bp, Homo sapiens
tcctgagtagctggg

SEQ ID NO: 1237862 - DNA, 18 bp, Homo sapiens
tcctgagtagctgggcct

SEQ ID NO: 1237863 - DNA, 14 bp, Homo sapiens
tcctgagtgcccca

SEQ ID NO: 1237864 - DNA, 20 bp, Homo sapiens
tcctgataaagcacagctgt

SEQ ID NO: 1237865 - DNA, 15 bp, Homo sapiens
tcctgatcagagccg

SEQ ID NO: 1237866 - DNA, 20 bp, Homo sapiens
tcctgatccactttggggga

SEQ ID NO: 1237867 - DNA, 21 bp, Homo sapiens
tcctgatccactttgggggag

SEQ ID NO: 1237868 - DNA, 16 bp, Homo sapiens
tcctgatcccagaccc

SEQ ID NO: 1237869 - DNA, 14 bp, Homo sapiens
tcctgatccctcca

SEQ ID NO: 1237870 - DNA, 23 bp, Homo sapiens
tcctgatgaaaaatatgtgcttg

SEQ ID NO: 1237871 - DNA, 14 bp, Homo sapiens
tcctgatgctggat

SEQ ID NO: 1237872 - DNA, 17 bp, Homo sapiens
tcctgatggacctgccc

SEQ ID NO: 1237873 - DNA, 13 bp, Homo sapiens
tcctgatggccaa

SEQ ID NO: 1237874 - DNA, 18 bp, Homo sapiens
tcctgatggccaagagca

SEQ ID NO: 1237875 - DNA, 20 bp, Homo sapiens
tcctgatggtcagctccctt

SEQ ID NO: 1237876 - DNA, 15 bp, Homo sapiens
tcctgattaaatgtc

SEQ ID NO: 1237877 - DNA, 14 bp, Homo sapiens
tcctgattccaaat

SEQ ID NO: 1237878 - DNA, 15 bp, Homo sapiens
tcctgatttctctga

SEQ ID NO: 1237879 - DNA, 17 bp, Homo sapiens
tcctgcaaaattttata

SEQ ID NO: 1237880 - DNA, 20 bp, Homo sapiens
tcctgcaaaggcccttgtca

SEQ ID NO: 1237881 - DNA, 17 bp, Homo sapiens
tcctgcaaagggaactg

SEQ ID NO: 1237882 - DNA, 17 bp, Homo sapiens
tcctgcaactcaaggac

SEQ ID NO: 1237883 - DNA, 23 bp, Homo sapiens
tcctgcacacagaatgctcaggg

SEQ ID NO: 1237884 - DNA, 20 bp, Homo sapiens
tcctgcacagttttctggct

SEQ ID NO: 1237885 - DNA, 20 bp, Homo sapiens
tcctgcaccccagcattcca

SEQ ID NO: 1237886 - DNA, 21 bp, Homo sapiens
tcctgcaccccagcattccag

SEQ ID NO: 1237887 - DNA, 21 bp, Homo sapiens
tcctgcacttacttgcttatt

SEQ ID NO: 1237888 - DNA, 12 bp, Homo sapiens
tcctgcagcccc

SEQ ID NO: 1237889 - DNA, 12 bp, Homo sapiens
tcctgcagcctc

SEQ ID NO: 1237890 - DNA, 15 bp, Homo sapiens
tcctgcagcctcctc

SEQ ID NO: 1237891 - DNA, 22 bp, Homo sapiens
tcctgcagcctcctcctgacca

SEQ ID NO: 1237892 - DNA, 20 bp, Homo sapiens
tcctgcaggaacgagcactg

SEQ ID NO: 1237893 - DNA, 24 bp, Homo sapiens
tcctgcaggaacgagcactggcca

SEQ ID NO: 1237894 - DNA, 19 bp, Homo sapiens
tcctgcaggccaggccagc

SEQ ID NO: 1237895 - DNA, 10 bp, Homo sapiens
tcctgcaggg

SEQ ID NO: 1237896 - DNA, 12 bp, Homo sapiens
tcctgcaggggg

SEQ ID NO: 1237897 - DNA, 15 bp, Homo sapiens
tcctgcagggggagg

SEQ ID NO: 1237898 - DNA, 16 bp, Homo sapiens
tcctgcagggggagga

SEQ ID NO: 1237899 - DNA, 16 bp, Homo sapiens
tcctgcagtgctcatt

SEQ ID NO: 1237900 - DNA, 13 bp, Homo sapiens
tcctgcagtttgg

SEQ ID NO: 1237901 - DNA, 16 bp, Homo sapiens
tcctgcatctctgtga

SEQ ID NO: 1237902 - DNA, 20 bp, Homo sapiens
tcctgcatggggcagaggct

SEQ ID NO: 1237903 - DNA, 11 bp, Homo sapiens
tcctgcatgtt

SEQ ID NO: 1237904 - DNA, 12 bp, Homo sapiens
tcctgcatttct

SEQ ID NO: 1237905 - DNA, 17 bp, Homo sapiens
tcctgccaccagtcact

SEQ ID NO: 1237906 - DNA, 22 bp, Homo sapiens
tcctgccaccagtcactgtccc

SEQ ID NO: 1237907 - DNA, 17 bp, Homo sapiens
tcctgccaccccttcct

SEQ ID NO: 1237908 - DNA, 20 bp, Homo sapiens
tcctgccaccccttcctccc

SEQ ID NO: 1237909 - DNA, 18 bp, Homo sapiens
tcctgccagctgccttcc

SEQ ID NO: 1237910 - DNA, 13 bp, Homo sapiens
tcctgccaggcac

SEQ ID NO: 1237911 - DNA, 13 bp, Homo sapiens
tcctgccaggcat

SEQ ID NO: 1237912 - DNA, 20 bp, Homo sapiens
tcctgccagggtgagcaggg

SEQ ID NO: 1237913 - DNA, 12 bp, Homo sapiens
tcctgccatcct

SEQ ID NO: 1237914 - DNA, 21 bp, Homo sapiens
tcctgccatgggtgcagaccc

SEQ ID NO: 1237915 - DNA, 15 bp, Homo sapiens
tcctgccatgtttag

SEQ ID NO: 1237916 - DNA, 14 bp, Homo sapiens
tcctgcccacccta

SEQ ID NO: 1237917 - DNA, 17 bp, Homo sapiens
tcctgcccaccctacca

SEQ ID NO: 1237918 - DNA, 20 bp, Homo sapiens
tcctgcccaccctaccagct

SEQ ID NO: 1237919 - DNA, 20 bp, Homo sapiens
tcctgcccacgcagacctgc

SEQ ID NO: 1237920 - DNA, 14 bp, Homo sapiens
tcctgcccagccac

SEQ ID NO: 1237921 - DNA, 17 bp, Homo sapiens
tcctgcccagctcctca

SEQ ID NO: 1237922 - DNA, 18 bp, Homo sapiens
tcctgcccagctcctcac

SEQ ID NO: 1237923 - DNA, 18 bp, Homo sapiens
tcctgcccaggactgcat

SEQ ID NO: 1237924 - DNA, 19 bp, Homo sapiens
tcctgcccaggagagccag

SEQ ID NO: 1237925 - DNA, 13 bp, Homo sapiens
tcctgcccagtgt

SEQ ID NO: 1237926 - DNA, 19 bp, Homo sapiens
tcctgcccagtgttgtttg

SEQ ID NO: 1237927 - DNA, 16 bp, Homo sapiens
tcctgcccatgtgtcc

SEQ ID NO: 1237928 - DNA, 18 bp, Homo sapiens
tcctgcccatgtgtcccc

SEQ ID NO: 1237929 - DNA, 13 bp, Homo sapiens
tcctgcccccaag

SEQ ID NO: 1237930 - DNA, 13 bp, Homo sapiens
tcctgccccctgc

SEQ ID NO: 1237931 - DNA, 12 bp, Homo sapiens
tcctgcccctct

SEQ ID NO: 1237932 - DNA, 18 bp, Homo sapiens
tcctgcccctctttctct

SEQ ID NO: 1237933 - DNA, 14 bp, Homo sapiens
tcctgccctacaga

SEQ ID NO: 1237934 - DNA, 12 bp, Homo sapiens
tcctgccctccc

SEQ ID NO: 1237935 - DNA, 19 bp, Homo sapiens
tcctgccctccggaggagc

SEQ ID NO: 1237936 - DNA, 13 bp, Homo sapiens
tcctgccctctgc

SEQ ID NO: 1237937 - DNA, 21 bp, Homo sapiens
tcctgccctctgctctgcctg

SEQ ID NO: 1237938 - DNA, 13 bp, Homo sapiens
tcctgccctgcag

SEQ ID NO: 1237939 - DNA, 13 bp, Homo sapiens
tcctgccctgcct

SEQ ID NO: 1237940 - DNA, 16 bp, Homo sapiens
tcctgcccttccctct

SEQ ID NO: 1237941 - DNA, 20 bp, Homo sapiens
tcctggctacatcccagcct

SEQ ID NO: 1237942 - DNA, 24 bp, Homo sapiens
tcctggctacatcccagcctgtgg

SEQ ID NO: 1237943 - DNA, 12 bp, Homo sapiens
tcctggctctgg

SEQ ID NO: 1237944 - DNA, 13 bp, Homo sapiens
tcctggctctggg

SEQ ID NO: 1237945 - DNA, 15 bp, Homo sapiens
tccttcccatgcctg

SEQ ID NO: 1237946 - DNA, 21 bp, Homo sapiens
tccttcccatgcctgtctctg

SEQ ID NO: 1237947 - DNA, 18 bp, Homo sapiens
tccttcccatttctctac

SEQ ID NO: 1237948 - DNA, 9 bp, Homo sapiens
tccttcccc

SEQ ID NO: 1237949 - DNA, 18 bp, Homo sapiens
tccttcccccatcccctt

SEQ ID NO: 1237950 - DNA, 19 bp, Homo sapiens
tccttccccccatctctga

SEQ ID NO: 1237951 - DNA, 10 bp, Homo sapiens
tccttcccct

SEQ ID NO: 1237952 - DNA, 12 bp, Homo sapiens
tccttcccctgc

SEQ ID NO: 1237953 - DNA, 14 bp, Homo sapiens
tccttccccttccc

SEQ ID NO: 1237954 - DNA, 16 bp, Homo sapiens
tccttccccttccccg

SEQ ID NO: 1237955 - DNA, 17 bp, Homo sapiens
tccttcccctttcccca

SEQ ID NO: 1237956 - DNA, 14 bp, Homo sapiens
tccttccctctctg

SEQ ID NO: 1237957 - DNA, 15 bp, Homo sapiens
tccttccctgatggc

SEQ ID NO: 1237958 - DNA, 12 bp, Homo sapiens
tccttccctgcc

SEQ ID NO: 1237959 - DNA, 15 bp, Homo sapiens
tccttccctggcttg

SEQ ID NO: 1237960 - DNA, 12 bp, Homo sapiens
tccttccctggg

SEQ ID NO: 1237961 - DNA, 18 bp, Homo sapiens
tccttccctgggaaggct

SEQ ID NO: 1237962 - DNA, 19 bp, Homo sapiens
tccttccctgggctgtgct

SEQ ID NO: 1237963 - DNA, 20 bp, Homo sapiens
tccttccctgggctgtgcta

SEQ ID NO: 1237964 - DNA, 16 bp, Homo sapiens
tccttcccttttctgt

SEQ ID NO: 1237965 - DNA, 18 bp, Homo sapiens
tccttcctatgcccaggt

SEQ ID NO: 1237966 - DNA, 19 bp, Homo sapiens
tccttcctccactgcgctt

SEQ ID NO: 1237967 - DNA, 17 bp, Homo sapiens
tccttcctggcctgaga

SEQ ID NO: 1237968 - DNA, 12 bp, Homo sapiens
tccttcctggga

SEQ ID NO: 1237969 - DNA, 19 bp, Homo sapiens
tccttcctgggaccccctc

SEQ ID NO: 1237970 - DNA, 21 bp, Homo sapiens
tccttcctgggaccccctcgc

SEQ ID NO: 1237971 - DNA, 23 bp, Homo sapiens
tccttcctgggaccccctcgcca

SEQ ID NO: 1237972 - DNA, 18 bp, Homo sapiens
tccttcctgtttgttttg

SEQ ID NO: 1237973 - DNA, 17 bp, Homo sapiens
tccttccttcaggactc

SEQ ID NO: 1237974 - DNA, 14 bp, Homo sapiens
tccttccttcccac

SEQ ID NO: 1237975 - DNA, 19 bp, Homo sapiens
tccttccttgctgtcctag

SEQ ID NO: 1237976 - DNA, 16 bp, Homo sapiens
tccttcctttttattc

SEQ ID NO: 1237977 - DNA, 20 bp, Homo sapiens
tccttcgaaaggccttcaga

SEQ ID NO: 1237978 - DNA, 21 bp, Homo sapiens
tccttcgtgaacatcccctcc

SEQ ID NO: 1237979 - DNA, 23 bp, Homo sapiens
tccttcgtgaacatcccctccca

SEQ ID NO: 1237980 - DNA, 16 bp, Homo sapiens
tccttcgtgtctctcc

SEQ ID NO: 1237981 - DNA, 20 bp, Homo sapiens
tccttctaagaggatacaaa

SEQ ID NO: 1237982 - DNA, 18 bp, Homo sapiens
tccttctaagataaaaat

SEQ ID NO: 1237983 - DNA, 21 bp, Homo sapiens
tccttctaccccaaggccagt

SEQ ID NO: 1237984 - DNA, 16 bp, Homo sapiens
tccttctagtttccca

SEQ ID NO: 1237985 - DNA, 18 bp, Homo sapiens
tccttctagtttcccaca

SEQ ID NO: 1237986 - DNA, 14 bp, Homo sapiens
tccttctcactgcc

SEQ ID NO: 1237987 - DNA, 13 bp, Homo sapiens
tccttctccagga

SEQ ID NO: 1237988 - DNA, 12 bp, Homo sapiens
tccttctccctt

SEQ ID NO: 1237989 - DNA, 19 bp, Homo sapiens
tccttctccttctcacaca

SEQ ID NO: 1237990 - DNA, 13 bp, Homo sapiens
tccttctctgggt

SEQ ID NO: 1237991 - DNA, 23 bp, Homo sapiens
tccttctctgggtctgattttct

SEQ ID NO: 1237992 - DNA, 20 bp, Homo sapiens
tccttctgagctccacctct

SEQ ID NO: 1237993 - DNA, 13 bp, Homo sapiens
tccttctgctccc

SEQ ID NO: 1237994 - DNA, 21 bp, Homo sapiens
tccttctgctcccaccccaga

SEQ ID NO: 1237995 - DNA, 22 bp, Homo sapiens
tccttctgctcccaccccagaa

SEQ ID NO: 1237996 - DNA, 14 bp, Homo sapiens
tccttcttcagcag

SEQ ID NO: 1237997 - DNA, 21 bp, Homo sapiens
tccttcttcagcaggaagggt

SEQ ID NO: 1237998 - DNA, 21 bp, Homo sapiens
tccttctttgggatagagaat

SEQ ID NO: 1237999 - DNA, 15 bp, Homo sapiens
tccttgaactgaggc

SEQ ID NO: 1238000 - DNA, 18 bp, Homo sapiens
tccttgaactgaggccct

SEQ ID NO: 1238001 - DNA, 17 bp, Homo sapiens
tccttgaagcaaatgtg

SEQ ID NO: 1238002 - DNA, 20 bp, Homo sapiens
tccttgacctgcattgtaaa

SEQ ID NO: 1238003 - DNA, 22 bp, Homo sapiens
tccttgactgtctagccactcc

SEQ ID NO: 1238004 - DNA, 17 bp, Homo sapiens
tccttgagacacggagc

SEQ ID NO: 1238005 - DNA, 22 bp, Homo sapiens
tccttgatctgtatatacaata

SEQ ID NO: 1238006 - DNA, 22 bp, Homo sapiens
tccttgatgccagagggccagc

SEQ ID NO: 1238007 - DNA, 23 bp, Homo sapiens
tccttgatgccagagggccagca

SEQ ID NO: 1238008 - DNA, 15 bp, Homo sapiens
tccttgcacccctca

SEQ ID NO: 1238009 - DNA, 20 bp, Homo sapiens
tccttgcacccctcactctg

SEQ ID NO: 1238010 - DNA, 21 bp, Homo sapiens
tccttgcacccctcactctgg

SEQ ID NO: 1238011 - DNA, 22 bp, Homo sapiens
tccttgcacccctcactctggc

SEQ ID NO: 1238012 - DNA, 19 bp, Homo sapiens
tccttgcacctcagcctcc

SEQ ID NO: 1238013 - DNA, 17 bp, Homo sapiens
tccttgcacctgcatcc

SEQ ID NO: 1238014 - DNA, 14 bp, Homo sapiens
tccttgcagcaggg

SEQ ID NO: 1238015 - DNA, 14 bp, Homo sapiens
tccttgccccactc

SEQ ID NO: 1238016 - DNA, 16 bp, Homo sapiens
tccttgccccactcct

SEQ ID NO: 1238017 - DNA, 17 bp, Homo sapiens
tccttgccccactcctc

SEQ ID NO: 1238018 - DNA, 20 bp, Homo sapiens
tccttgccccccgccctcat

SEQ ID NO: 1238019 - DNA, 15 bp, Homo sapiens
tccttgcctgtctaa

SEQ ID NO: 1238020 - DNA, 23 bp, Homo sapiens
tccttgcgcctcagccctcagtt

SEQ ID NO: 1238021 - DNA, 19 bp, Homo sapiens
tccttgctctccctcttct

SEQ ID NO: 1238022 - DNA, 20 bp, Homo sapiens
tccttgctctccctcttctc

SEQ ID NO: 1238023 - DNA, 14 bp, Homo sapiens
tccttgctctgcac

SEQ ID NO: 1238024 - DNA, 15 bp, Homo sapiens
tccttgctctgcacc

SEQ ID NO: 1238025 - DNA, 17 bp, Homo sapiens
tccttgctgaccccagg

SEQ ID NO: 1238026 - DNA, 17 bp, Homo sapiens
tccttgctgtcctaggc

SEQ ID NO: 1238027 - DNA, 17 bp, Homo sapiens
tccttgcttcctgtctt

SEQ ID NO: 1238028 - DNA, 16 bp, Homo sapiens
tccttggactccatcg

SEQ ID NO: 1238029 - DNA, 14 bp, Homo sapiens
tccttggagagcag

SEQ ID NO: 1238030 - DNA, 18 bp, Homo sapiens
tccttggagagcagctgg

SEQ ID NO: 1238031 - DNA, 19 bp, Homo sapiens
tccttggagagcagctggc

SEQ ID NO: 1238032 - DNA, 21 bp, Homo sapiens
tccttggcaggctgatttcta

SEQ ID NO: 1238033 - DNA, 21 bp, Homo sapiens
tccttggcggcaaaagcccat

SEQ ID NO: 1238034 - DNA, 15 bp, Homo sapiens
tccttggctgcagcc

SEQ ID NO: 1238035 - DNA, 19 bp, Homo sapiens
tccttggctgcagccatcc

SEQ ID NO: 1238036 - DNA, 22 bp, Homo sapiens
tccttggcttgcctggtggggg

SEQ ID NO: 1238037 - DNA, 22 bp, Homo sapiens
tccttgggccataattatgaaa

SEQ ID NO: 1238038 - DNA, 16 bp, Homo sapiens
tccttgggccctttga

SEQ ID NO: 1238039 - DNA, 17 bp, Homo sapiens
tccttgggcgtctcccc

SEQ ID NO: 1238040 - DNA, 21 bp, Homo sapiens
tccttgggcgtctcccccaga

SEQ ID NO: 1238041 - DNA, 16 bp, Homo sapiens
tccttgggctcctggc

SEQ ID NO: 1238042 - DNA, 18 bp, Homo sapiens
tccttgggctcctggctg

SEQ ID NO: 1238043 - DNA, 23 bp, Homo sapiens
tccttgggctcctggctgccagg

SEQ ID NO: 1238044 - DNA, 20 bp, Homo sapiens
tccttggggccttgtgtgat

SEQ ID NO: 1238045 - DNA, 18 bp, Homo sapiens
tccttgggggctcccagg

SEQ ID NO: 1238046 - DNA, 15 bp, Homo sapiens
tccttggggggccaa

SEQ ID NO: 1238047 - DNA, 23 bp, Homo sapiens
tccttggggttaagtctcctgtc

SEQ ID NO: 1238048 - DNA, 19 bp, Homo sapiens
tccttggtctatgtgctct

SEQ ID NO: 1238049 - DNA, 21 bp, Homo sapiens
tccttggtgtgaccctctgaa

SEQ ID NO: 1238050 - DNA, 15 bp, Homo sapiens
tccttgtatgttctt

SEQ ID NO: 1238051 - DNA, 20 bp, Homo sapiens
tccttgtcaatactgagcca

SEQ ID NO: 1238052 - DNA, 13 bp, Homo sapiens
tccttgtcactgg

SEQ ID NO: 1238053 - DNA, 19 bp, Homo sapiens
tccttgtggaatgctgcct

SEQ ID NO: 1238054 - DNA, 13 bp, Homo sapiens
tccttgtggactg

SEQ ID NO: 1238055 - DNA, 20 bp, Homo sapiens
tccttgtggtctttgctgct

SEQ ID NO: 1238056 - DNA, 23 bp, Homo sapiens
tccttgtggtctttgctgctgct

SEQ ID NO: 1238057 - DNA, 20 bp, Homo sapiens
tccttgtgttgaaggcagta

SEQ ID NO: 1238058 - DNA, 16 bp, Homo sapiens
tccttgtgttttgtcc

SEQ ID NO: 1238059 - DNA, 15 bp, Homo sapiens
tccttgttcatggag

SEQ ID NO: 1238060 - DNA, 17 bp, Homo sapiens
tccttgttcatggagag

SEQ ID NO: 1238061 - DNA, 20 bp, Homo sapiens
tccttgttcatggagagctg

SEQ ID NO: 1238062 - DNA, 16 bp, Homo sapiens
tccttgttggtcagag

SEQ ID NO: 1238063 - DNA, 23 bp, Homo sapiens
tccttgtttatcagatacatcac

SEQ ID NO: 1238064 - DNA, 13 bp, Homo sapiens
tcctttaattgta

SEQ ID NO: 1238065 - DNA, 21 bp, Homo sapiens
tcctttacaactaaataacac

SEQ ID NO: 1238066 - DNA, 19 bp, Homo sapiens
tcctttacattcaactttt

SEQ ID NO: 1238067 - DNA, 14 bp, Homo sapiens
tcctttaccctctt

SEQ ID NO: 1238068 - DNA, 17 bp, Homo sapiens
tcctttacctttcagtg

SEQ ID NO: 1238069 - DNA, 15 bp, Homo sapiens
tcctttactcctggc

SEQ ID NO: 1238070 - DNA, 16 bp, Homo sapiens
tcctttactcctggct

SEQ ID NO: 1238071 - DNA, 15 bp, Homo sapiens
tcctttactttccct

SEQ ID NO: 1238072 - DNA, 20 bp, Homo sapiens
tcctttactttcccttgctt

SEQ ID NO: 1238073 - DNA, 20 bp, Homo sapiens
tcctttatattttttgtctg

SEQ ID NO: 1238074 - DNA, 16 bp, Homo sapiens
tcctttatgtgaattt

SEQ ID NO: 1238075 - DNA, 23 bp, Homo sapiens
tcctttattataatcaaagctca

SEQ ID NO: 1238076 - DNA, 19 bp, Homo sapiens
tcctttatttaggaaacac

SEQ ID NO: 1238077 - DNA, 15 bp, Homo sapiens
tcctttattttattg

SEQ ID NO: 1238078 - DNA, 23 bp, Homo sapiens
tcctttattttattgaaatgtat

SEQ ID NO: 1238079 - DNA, 16 bp, Homo sapiens
tcctttcacaaccttc

SEQ ID NO: 1238080 - DNA, 14 bp, Homo sapiens
tcctggctgcactc

SEQ ID NO: 1238081 - DNA, 16 bp, Homo sapiens
tcctggctgcactctt

SEQ ID NO: 1238082 - DNA, 13 bp, Homo sapiens
tcctggctgccag

SEQ ID NO: 1238083 - DNA, 22 bp, Homo sapiens
tcctggctgcggcgtctgtctg

SEQ ID NO: 1238084 - DNA, 17 bp, Homo sapiens
tcctggctttccaggag

SEQ ID NO: 1238085 - DNA, 20 bp, Homo sapiens
tcctgggaaatattccctag

SEQ ID NO: 1238086 - DNA, 21 bp, Homo sapiens
tcctgggaaatattccctaga

SEQ ID NO: 1238087 - DNA, 22 bp, Homo sapiens
tcctgggaacacatctggctgc

SEQ ID NO: 1238088 - DNA, 17 bp, Homo sapiens
tcctgggaatggaataa

SEQ ID NO: 1238089 - DNA, 17 bp, Homo sapiens
tcctgggaccccctcgc

SEQ ID NO: 1238090 - DNA, 23 bp, Homo sapiens
tcctgggagcccccaccacaaac

SEQ ID NO: 1238091 - DNA, 12 bp, Homo sapiens
tcctgggaggat

SEQ ID NO: 1238092 - DNA, 18 bp, Homo sapiens
tcctgggaggatcctgag

SEQ ID NO: 1238093 - DNA, 20 bp, Homo sapiens
tcctgggatggcgatgggga

SEQ ID NO: 1238094 - DNA, 21 bp, Homo sapiens
tcctgggatggcgatggggac

SEQ ID NO: 1238095 - DNA, 15 bp, Homo sapiens
tcctgggcaggtggg

SEQ ID NO: 1238096 - DNA, 18 bp, Homo sapiens
tcctgggcatgggtccag

SEQ ID NO: 1238097 - DNA, 19 bp, Homo sapiens
tcctgggcatgggtccagg

SEQ ID NO: 1238098 - DNA, 20 bp, Homo sapiens
tcctgggcatgggtccaggg

SEQ ID NO: 1238099 - DNA, 17 bp, Homo sapiens
tcctgggccctctctgc

SEQ ID NO: 1238100 - DNA, 21 bp, Homo sapiens
tcctgggccctctctgctctg

SEQ ID NO: 1238101 - DNA, 14 bp, Homo sapiens
tcctgggcctgccc

SEQ ID NO: 1238102 - DNA, 15 bp, Homo sapiens
tcctgggcctgcccc

SEQ ID NO: 1238103 - DNA, 16 bp, Homo sapiens
tcctgggcctgtcccc

SEQ ID NO: 1238104 - DNA, 14 bp, Homo sapiens
tcctgggcgccctg

SEQ ID NO: 1238105 - DNA, 20 bp, Homo sapiens
tcctgggcgccctggaagcc

SEQ ID NO: 1238106 - DNA, 20 bp, Homo sapiens
tcctgggctcaagtgatcct

SEQ ID NO: 1238107 - DNA, 15 bp, Homo sapiens
tcctgggctctgaac

SEQ ID NO: 1238108 - DNA, 22 bp, Homo sapiens
tcctgggctctgaacacacacg

SEQ ID NO: 1238109 - DNA, 20 bp, Homo sapiens
tcctggggagctcctgggac

SEQ ID NO: 1238110 - DNA, 10 bp, Homo sapiens
tcctggggca

SEQ ID NO: 1238111 - DNA, 11 bp, Homo sapiens
tcctggggccg

SEQ ID NO: 1238112 - DNA, 20 bp, Homo sapiens
tcctggggccgcctgccctg

SEQ ID NO: 1238113 - DNA, 13 bp, Homo sapiens
tcctggggcctcg

SEQ ID NO: 1238114 - DNA, 15 bp, Homo sapiens
tcctggggctccctt

SEQ ID NO: 1238115 - DNA, 19 bp, Homo sapiens
tcctggggctctgtgcagg

SEQ ID NO: 1238116 - DNA, 22 bp, Homo sapiens
tcctgggggctggctcccaggg

SEQ ID NO: 1238117 - DNA, 23 bp, Homo sapiens
tcctgggggctggctcccagggt

SEQ ID NO: 1238118 - DNA, 18 bp, Homo sapiens
tcctgggggtggcaggca

SEQ ID NO: 1238119 - DNA, 19 bp, Homo sapiens
tcctgggggtggcaggcac

SEQ ID NO: 1238120 - DNA, 21 bp, Homo sapiens
tcctgggtgtgtttggcttgg

SEQ ID NO: 1238121 - DNA, 18 bp, Homo sapiens
tcctgggttcaagtgatt

SEQ ID NO: 1238122 - DNA, 20 bp, Homo sapiens
tcctgggttgtttccaggag

SEQ ID NO: 1238123 - DNA, 22 bp, Homo sapiens
tcctgggttttgtattctctga

SEQ ID NO: 1238124 - DNA, 23 bp, Homo sapiens
tcctgggttttgtattctctgag

SEQ ID NO: 1238125 - DNA, 15 bp, Homo sapiens
tcctggtacagcagg

SEQ ID NO: 1238126 - DNA, 17 bp, Homo sapiens
tcctggtacagcagggt

SEQ ID NO: 1238127 - DNA, 18 bp, Homo sapiens
tcctggtacagcagggtc

SEQ ID NO: 1238128 - DNA, 16 bp, Homo sapiens
tcctggtacccagcca

SEQ ID NO: 1238129 - DNA, 15 bp, Homo sapiens
tcctggtcctggaca

SEQ ID NO: 1238130 - DNA, 16 bp, Homo sapiens
tcctggtcctggacac

SEQ ID NO: 1238131 - DNA, 19 bp, Homo sapiens
tcctggtcctggacacctc

SEQ ID NO: 1238132 - DNA, 15 bp, Homo sapiens
tcctggtcctggctg

SEQ ID NO: 1238133 - DNA, 17 bp, Homo sapiens
tcctggtcctggctgca

SEQ ID NO: 1238134 - DNA, 16 bp, Homo sapiens
tcctggtgaggcccag

SEQ ID NO: 1238135 - DNA, 17 bp, Homo sapiens
tcctggtgaggcccagc

SEQ ID NO: 1238136 - DNA, 18 bp, Homo sapiens
tcctggtgctctctgcca

SEQ ID NO: 1238137 - DNA, 14 bp, Homo sapiens
tcctggtgtgggta

SEQ ID NO: 1238138 - DNA, 23 bp, Homo sapiens
tcctggtgtgggtaaagggacag

SEQ ID NO: 1238139 - DNA, 21 bp, Homo sapiens
tcctggttcccgtttctccac

SEQ ID NO: 1238140 - DNA, 22 bp, Homo sapiens
tcctggttccttcctatgccca

SEQ ID NO: 1238141 - DNA, 16 bp, Homo sapiens
tcctggtttcctttct

SEQ ID NO: 1238142 - DNA, 16 bp, Homo sapiens
tcctggtttttgccta

SEQ ID NO: 1238143 - DNA, 19 bp, Homo sapiens
tcctgtaaaggttacaagc

SEQ ID NO: 1238144 - DNA, 15 bp, Homo sapiens
tcctgtaataaagct

SEQ ID NO: 1238145 - DNA, 21 bp, Homo sapiens
tcctgtaattcctacctccct

SEQ ID NO: 1238146 - DNA, 15 bp, Homo sapiens
tcctgtacctcagtg

SEQ ID NO: 1238147 - DNA, 17 bp, Homo sapiens
tcctgtacctcagtgga

SEQ ID NO: 1238148 - DNA, 20 bp, Homo sapiens
tcctgtacctcagtggatct

SEQ ID NO: 1238149 - DNA, 20 bp, Homo sapiens
tcctgtacctcttgagcctt

SEQ ID NO: 1238150 - DNA, 22 bp, Homo sapiens
tcctgtacctcttgagccttga

SEQ ID NO: 1238151 - DNA, 20 bp, Homo sapiens
tcctgtagacctagggagga

SEQ ID NO: 1238152 - DNA, 23 bp, Homo sapiens
tcctgtagacctagggaggacct

SEQ ID NO: 1238153 - DNA, 19 bp, Homo sapiens
tcctgtagcatcttctgga

SEQ ID NO: 1238154 - DNA, 14 bp, Homo sapiens
tcctgtattcttgt

SEQ ID NO: 1238155 - DNA, 13 bp, Homo sapiens
tcctgtattgctt

SEQ ID NO: 1238156 - DNA, 18 bp, Homo sapiens
tcctgtcactcactgagg

SEQ ID NO: 1238157 - DNA, 17 bp, Homo sapiens
tcctgtcactgagcaca

SEQ ID NO: 1238158 - DNA, 17 bp, Homo sapiens
tcctgtccacacccagc

SEQ ID NO: 1238159 - DNA, 12 bp, Homo sapiens
tcctgtccactc

SEQ ID NO: 1238160 - DNA, 22 bp, Homo sapiens
tcctgtccactctcggggccct

SEQ ID NO: 1238161 - DNA, 22 bp, Homo sapiens
tcctgtcccgccttcctcctcc

SEQ ID NO: 1238162 - DNA, 14 bp, Homo sapiens
tcctgtccctgagg

SEQ ID NO: 1238163 - DNA, 15 bp, Homo sapiens
tcctgtccctgaggt

SEQ ID NO: 1238164 - DNA, 16 bp, Homo sapiens
tcctgtccctgaggtt

SEQ ID NO: 1238165 - DNA, 15 bp, Homo sapiens
tcctgtccctgtagc

SEQ ID NO: 1238166 - DNA, 22 bp, Homo sapiens
tcctgtccctgtagctcagtca

SEQ ID NO: 1238167 - DNA, 16 bp, Homo sapiens
tcctgtcctgcctcct

SEQ ID NO: 1238168 - DNA, 23 bp, Homo sapiens
tcctgtcctttacacattcggct

SEQ ID NO: 1238169 - DNA, 14 bp, Homo sapiens
tcctgtcctttctt

SEQ ID NO: 1238170 - DNA, 14 bp, Homo sapiens
tcctgtctctgcac

SEQ ID NO: 1238171 - DNA, 16 bp, Homo sapiens
tcctgtctgccagcca

SEQ ID NO: 1238172 - DNA, 22 bp, Homo sapiens
tcctgtctgccagccagcagcc

SEQ ID NO: 1238173 - DNA, 18 bp, Homo sapiens
tcctgtctgccctctggg

SEQ ID NO: 1238174 - DNA, 20 bp, Homo sapiens
tcctgtctgccctctgggtc

SEQ ID NO: 1238175 - DNA, 16 bp, Homo sapiens
tcctgtctggctcgga

SEQ ID NO: 1238176 - DNA, 13 bp, Homo sapiens
tcctgtctgttta

SEQ ID NO: 1238177 - DNA, 18 bp, Homo sapiens
tcctgtctttaaggaaaa

SEQ ID NO: 1238178 - DNA, 19 bp, Homo sapiens
tcctgtctttaaggaaaaa

SEQ ID NO: 1238179 - DNA, 16 bp, Homo sapiens
tcctgtctttacaaat

SEQ ID NO: 1238180 - DNA, 15 bp, Homo sapiens
tcctgtctttctgag

SEQ ID NO: 1238181 - DNA, 22 bp, Homo sapiens
tcctgtctttctgagcacactt

SEQ ID NO: 1238182 - DNA, 16 bp, Homo sapiens
tcctgtgaatgccact

SEQ ID NO: 1238183 - DNA, 16 bp, Homo sapiens
tcctgtgaatggaggc

SEQ ID NO: 1238184 - DNA, 19 bp, Homo sapiens
tcctgtgaatggaggcaga

SEQ ID NO: 1238185 - DNA, 24 bp, Homo sapiens
tcctgtgaatggaggcagagacct

SEQ ID NO: 1238186 - DNA, 18 bp, Homo sapiens
tcctgtgacttcagctct

SEQ ID NO: 1238187 - DNA, 21 bp, Homo sapiens
tcctgtgatccacccaaccct

SEQ ID NO: 1238188 - DNA, 15 bp, Homo sapiens
tcctgtgcagatgct

SEQ ID NO: 1238189 - DNA, 18 bp, Homo sapiens
tcctgtgccccagctgcc

SEQ ID NO: 1238190 - DNA, 21 bp, Homo sapiens
tcctgtgccccagctgccagg

SEQ ID NO: 1238191 - DNA, 22 bp, Homo sapiens
tcctgtgccccagctgccaggc

SEQ ID NO: 1238192 - DNA, 13 bp, Homo sapiens
tcctgtgcctggc

SEQ ID NO: 1238193 - DNA, 20 bp, Homo sapiens
tcctgtgctaagtctttccc

SEQ ID NO: 1238194 - DNA, 19 bp, Homo sapiens
tcctgtgctctggaggctg

SEQ ID NO: 1238195 - DNA, 13 bp, Homo sapiens
tcctgtgcttgct

SEQ ID NO: 1238196 - DNA, 19 bp, Homo sapiens
tctccccacgagggctggc

SEQ ID NO: 1238197 - DNA, 18 bp, Homo sapiens
tctccccaggcatttgcc

SEQ ID NO: 1238198 - DNA, 20 bp, Homo sapiens
tctccccaggtccagctctg

SEQ ID NO: 1238199 - DNA, 22 bp, Homo sapiens
tctccccaggtccagctctgga

SEQ ID NO: 1238200 - DNA, 14 bp, Homo sapiens
tctccccagtgcct

SEQ ID NO: 1238201 - DNA, 21 bp, Homo sapiens
tctccccagtgcctgccactc

SEQ ID NO: 1238202 - DNA, 21 bp, Homo sapiens
tctccccatccccttcctaaa

SEQ ID NO: 1238203 - DNA, 12 bp, Homo sapiens
tctcccccagag

SEQ ID NO: 1238204 - DNA, 20 bp, Homo sapiens
tctcccccgccctgccccgc

SEQ ID NO: 1238205 - DNA, 21 bp, Homo sapiens
tctccccctatttattgactt

SEQ ID NO: 1238206 - DNA, 14 bp, Homo sapiens
tctccccctcctga

SEQ ID NO: 1238207 - DNA, 12 bp, Homo sapiens
tctccccctggg

SEQ ID NO: 1238208 - DNA, 15 bp, Homo sapiens
tctcccccttcagct

SEQ ID NO: 1238209 - DNA, 20 bp, Homo sapiens
tctccccgaggctgccccag

SEQ ID NO: 1238210 - DNA, 21 bp, Homo sapiens
tctccccgaggctgccccagg

SEQ ID NO: 1238211 - DNA, 16 bp, Homo sapiens
tctccccgctctggat

SEQ ID NO: 1238212 - DNA, 23 bp, Homo sapiens
tctccccggcaggcctgagaatg

SEQ ID NO: 1238213 - DNA, 19 bp, Homo sapiens
tctccccggtaatgtcact

SEQ ID NO: 1238214 - DNA, 20 bp, Homo sapiens
tctccccggtaatgtcactg

SEQ ID NO: 1238215 - DNA, 20 bp, Homo sapiens
tctcccctcacatcctcctg

SEQ ID NO: 1238216 - DNA, 15 bp, Homo sapiens
tctcccctccctctt

SEQ ID NO: 1238217 - DNA, 22 bp, Homo sapiens
tctcccctccctcttccttccc

SEQ ID NO: 1238218 - DNA, 15 bp, Homo sapiens
tctcccctcccttgt

SEQ ID NO: 1238219 - DNA, 12 bp, Homo sapiens
tctcccctctcg

SEQ ID NO: 1238220 - DNA, 14 bp, Homo sapiens
tctcccctctctgc

SEQ ID NO: 1238221 - DNA, 20 bp, Homo sapiens
tctcccctgaatcctcagag

SEQ ID NO: 1238222 - DNA, 14 bp, Homo sapiens
tctcccctgccctg

SEQ ID NO: 1238223 - DNA, 15 bp, Homo sapiens
tctcccctgccctgc

SEQ ID NO: 1238224 - DNA, 17 bp, Homo sapiens
tctccccttcctggaca

SEQ ID NO: 1238225 - DNA, 18 bp, Homo sapiens
tctccccttcctggacac

SEQ ID NO: 1238226 - DNA, 13 bp, Homo sapiens
tctcccgtcaggg

SEQ ID NO: 1238227 - DNA, 20 bp, Homo sapiens
tctcccgtcagggcccaagt

SEQ ID NO: 1238228 - DNA, 22 bp, Homo sapiens
tctcccgtcagggcccaagtcc

SEQ ID NO: 1238229 - DNA, 15 bp, Homo sapiens
tctccctacctccct

SEQ ID NO: 1238230 - DNA, 20 bp, Homo sapiens
tctccctacctccctcctca

SEQ ID NO: 1238231 - DNA, 21 bp, Homo sapiens
tctccctacctccctcctcag

SEQ ID NO: 1238232 - DNA, 11 bp, Homo sapiens
tctccctcagg

SEQ ID NO: 1238233 - DNA, 12 bp, Homo sapiens
tctccctcaggg

SEQ ID NO: 1238234 - DNA, 12 bp, Homo sapiens
tctccctcccct

SEQ ID NO: 1238235 - DNA, 18 bp, Homo sapiens
tctccctcccctgccatt

SEQ ID NO: 1238236 - DNA, 19 bp, Homo sapiens
tctccctctcatgtccctc

SEQ ID NO: 1238237 - DNA, 21 bp, Homo sapiens
tctccctctcatgtccctcca

SEQ ID NO: 1238238 - DNA, 16 bp, Homo sapiens
tctccctctcctgcct

SEQ ID NO: 1238239 - DNA, 18 bp, Homo sapiens
tctccctctcctgcctac

SEQ ID NO: 1238240 - DNA, 12 bp, Homo sapiens
tctccctctggc

SEQ ID NO: 1238241 - DNA, 16 bp, Homo sapiens
tctccctctggccctg

SEQ ID NO: 1238242 - DNA, 19 bp, Homo sapiens
tctccctctggccctgcct

SEQ ID NO: 1238243 - DNA, 20 bp, Homo sapiens
tctccctctggccctgcctt

SEQ ID NO: 1238244 - DNA, 19 bp, Homo sapiens
tctccctctgtcttttctc

SEQ ID NO: 1238245 - DNA, 24 bp, Homo sapiens
tctccctgacatttctaacatatg

SEQ ID NO: 1238246 - DNA, 18 bp, Homo sapiens
tctccctgatggaccctc

SEQ ID NO: 1238247 - DNA, 23 bp, Homo sapiens
tctccctgatggaccctcagtct

SEQ ID NO: 1238248 - DNA, 21 bp, Homo sapiens
tctccctgcatcctgaggcca

SEQ ID NO: 1238249 - DNA, 16 bp, Homo sapiens
tctccctgccatcccc

SEQ ID NO: 1238250 - DNA, 17 bp, Homo sapiens
tctccctgccatccccc

SEQ ID NO: 1238251 - DNA, 19 bp, Homo sapiens
tctccctgccatccccctc

SEQ ID NO: 1238252 - DNA, 14 bp, Homo sapiens
tctccctgcctggc

SEQ ID NO: 1238253 - DNA, 15 bp, Homo sapiens
tctccctgcctggcc

SEQ ID NO: 1238254 - DNA, 16 bp, Homo sapiens
tctccctgctttggtc

SEQ ID NO: 1238255 - DNA, 15 bp, Homo sapiens
tctccctggagaagc

SEQ ID NO: 1238256 - DNA, 21 bp, Homo sapiens
tctccctggatctacctggag

SEQ ID NO: 1238257 - DNA, 13 bp, Homo sapiens
tctccctggctcc

SEQ ID NO: 1238258 - DNA, 20 bp, Homo sapiens
tctccctggctccctcctcc

SEQ ID NO: 1238259 - DNA, 18 bp, Homo sapiens
tctccctgggtctgggga

SEQ ID NO: 1238260 - DNA, 17 bp, Homo sapiens
tctccctggtgcctctg

SEQ ID NO: 1238261 - DNA, 18 bp, Homo sapiens
tctccctggtgcctctgt

SEQ ID NO: 1238262 - DNA, 19 bp, Homo sapiens
tctccctggtgcctctgtg

SEQ ID NO: 1238263 - DNA, 14 bp, Homo sapiens
tctccctgtacagt

SEQ ID NO: 1238264 - DNA, 12 bp, Homo sapiens
tctagggaaaaa

SEQ ID NO: 1238265 - DNA, 22 bp, Homo sapiens
tctagggaaaaaccagcgtgtg

SEQ ID NO: 1238266 - DNA, 23 bp, Homo sapiens
tctagggactgccaggctgtttc

SEQ ID NO: 1238267 - DNA, 20 bp, Homo sapiens
tctagggatataaaaacaga

SEQ ID NO: 1238268 - DNA, 22 bp, Homo sapiens
tctagggatataaaaacagatt

SEQ ID NO: 1238269 - DNA, 14 bp, Homo sapiens
tctagggcagggtg

SEQ ID NO: 1238270 - DNA, 14 bp, Homo sapiens
tctaggggcagcct

SEQ ID NO: 1238271 - DNA, 19 bp, Homo sapiens
tctaggggtagctggtggt

SEQ ID NO: 1238272 - DNA, 17 bp, Homo sapiens
tctaggtaggaaatgtg

SEQ ID NO: 1238273 - DNA, 20 bp, Homo sapiens
tctaggtaggaagagcccgc

SEQ ID NO: 1238274 - DNA, 19 bp, Homo sapiens
tctaggtgtggctgtgaag

SEQ ID NO: 1238275 - DNA, 17 bp, Homo sapiens
tctaggttaaagctaaa

SEQ ID NO: 1238276 - DNA, 21 bp, Homo sapiens
tctaggttaaagctaaactga

SEQ ID NO: 1238277 - DNA, 13 bp, Homo sapiens
tctaggttataca

SEQ ID NO: 1238278 - DNA, 16 bp, Homo sapiens
tctaggttatacaata

SEQ ID NO: 1238279 - DNA, 14 bp, Homo sapiens
tctaggttctaaaa

SEQ ID NO: 1238280 - DNA, 16 bp, Homo sapiens
tctagtaacaatacat

SEQ ID NO: 1238281 - DNA, 14 bp, Homo sapiens
tctagtacataatt

SEQ ID NO: 1238282 - DNA, 17 bp, Homo sapiens
tctagtacttgaaaaag

SEQ ID NO: 1238283 - DNA, 19 bp, Homo sapiens
tctagtagttgttctgaaa

SEQ ID NO: 1238284 - DNA, 12 bp, Homo sapiens
tctagtcattgt

SEQ ID NO: 1238285 - DNA, 16 bp, Homo sapiens
tctagtcattgtcata

SEQ ID NO: 1238286 - DNA, 14 bp, Homo sapiens
tctagtctctctgg

SEQ ID NO: 1238287 - DNA, 15 bp, Homo sapiens
tctagtctgagcttc

SEQ ID NO: 1238288 - DNA, 15 bp, Homo sapiens
tctagtgagcctggg

SEQ ID NO: 1238289 - DNA, 21 bp, Homo sapiens
tctagtgagcctgggccagga

SEQ ID NO: 1238290 - DNA, 19 bp, Homo sapiens
tctagtgctgtgaaaaaaa

SEQ ID NO: 1238291 - DNA, 19 bp, Homo sapiens
tctagtgggacagcccaga

SEQ ID NO: 1238292 - DNA, 24 bp, Homo sapiens
tctagtgggacagcccagagcctg

SEQ ID NO: 1238293 - DNA, 21 bp, Homo sapiens
tctagtgggttgacctttaaa

SEQ ID NO: 1238294 - DNA, 21 bp, Homo sapiens
tctagtgtatactctgtagtc

SEQ ID NO: 1238295 - DNA, 22 bp, Homo sapiens
tctagtgtatactctgtagtct

SEQ ID NO: 1238296 - DNA, 19 bp, Homo sapiens
tctagtgtccataaataaa

SEQ ID NO: 1238297 - DNA, 14 bp, Homo sapiens
tctagtgttttcaa

SEQ ID NO: 1238298 - DNA, 18 bp, Homo sapiens
tctagtgttttcaatttt

SEQ ID NO: 1238299 - DNA, 20 bp, Homo sapiens
tctagtgtttttttccctct

SEQ ID NO: 1238300 - DNA, 14 bp, Homo sapiens
tctagttcattgaa

SEQ ID NO: 1238301 - DNA, 13 bp, Homo sapiens
tctagttctagat

SEQ ID NO: 1238302 - DNA, 13 bp, Homo sapiens
tctagttctgttg

SEQ ID NO: 1238303 - DNA, 21 bp, Homo sapiens
tctagttctttcctccccctg

SEQ ID NO: 1238304 - DNA, 21 bp, Homo sapiens
tctagtttacagaaaaatctt

SEQ ID NO: 1238305 - DNA, 23 bp, Homo sapiens
tctagtttcagtaaataatgaaa

SEQ ID NO: 1238306 - DNA, 13 bp, Homo sapiens
tctagtttctagt

SEQ ID NO: 1238307 - DNA, 15 bp, Homo sapiens
tctagtttctagtgt

SEQ ID NO: 1238308 - DNA, 14 bp, Homo sapiens
tctagttttcagtt

SEQ ID NO: 1238309 - DNA, 17 bp, Homo sapiens
tctagttttcagtttgt

SEQ ID NO: 1238310 - DNA, 13 bp, Homo sapiens
tctagttttgtca

SEQ ID NO: 1238311 - DNA, 16 bp, Homo sapiens
tctataaaagaaacac

SEQ ID NO: 1238312 - DNA, 16 bp, Homo sapiens
tctataaaataaactt

SEQ ID NO: 1238313 - DNA, 20 bp, Homo sapiens
tctccaaaggggctgctggg

SEQ ID NO: 1238314 - DNA, 20 bp, Homo sapiens
tctccaaatattattcaagt

SEQ ID NO: 1238315 - DNA, 12 bp, Homo sapiens
tctccaaatgag

SEQ ID NO: 1238316 - DNA, 23 bp, Homo sapiens
tctccaaccccggaaaacattgc

SEQ ID NO: 1238317 - DNA, 17 bp, Homo sapiens
tctccaagaatggaagc

SEQ ID NO: 1238318 - DNA, 16 bp, Homo sapiens
tctccaaggaccaggt

SEQ ID NO: 1238319 - DNA, 18 bp, Homo sapiens
tctccaaggatcctctcc

SEQ ID NO: 1238320 - DNA, 20 bp, Homo sapiens
tctccaagggagggtgcagc

SEQ ID NO: 1238321 - DNA, 20 bp, Homo sapiens
tctccaagggcttctgcacc

SEQ ID NO: 1238322 - DNA, 23 bp, Homo sapiens
tctccaagggcttctgcaccctc

SEQ ID NO: 1238323 - DNA, 16 bp, Homo sapiens
tctccaagtctctctg

SEQ ID NO: 1238324 - DNA, 17 bp, Homo sapiens
tctccaagtctctctgt

SEQ ID NO: 1238325 - DNA, 21 bp, Homo sapiens
tctccaagtgccagaggtggg

SEQ ID NO: 1238326 - DNA, 23 bp, Homo sapiens
tctccaagtgccagaggtgggca

SEQ ID NO: 1238327 - DNA, 16 bp, Homo sapiens
tctccaatatcagtgc

SEQ ID NO: 1238328 - DNA, 18 bp, Homo sapiens
tctccaatatcagtgctc

SEQ ID NO: 1238329 - DNA, 15 bp, Homo sapiens
tctccaatgctctgg

SEQ ID NO: 1238330 - DNA, 16 bp, Homo sapiens
tctccaatgctctgga

SEQ ID NO: 1238331 - DNA, 21 bp, Homo sapiens
tctccacagatgtaattatgt

SEQ ID NO: 1238332 - DNA, 14 bp, Homo sapiens
tctccacagcaacc

SEQ ID NO: 1238333 - DNA, 15 bp, Homo sapiens
tctccacagtgttca

SEQ ID NO: 1238334 - DNA, 23 bp, Homo sapiens
tctccaccacccaacccaaacca

SEQ ID NO: 1238335 - DNA, 15 bp, Homo sapiens
tctccaccagcccct

SEQ ID NO: 1238336 - DNA, 21 bp, Homo sapiens
tctccacccaaaccccttccc

SEQ ID NO: 1238337 - DNA, 22 bp, Homo sapiens
tctccacccaaaccccttccca

SEQ ID NO: 1238338 - DNA, 11 bp, Homo sapiens
tctccacctca

SEQ ID NO: 1238339 - DNA, 16 bp, Homo sapiens
tctccacctcagcctt

SEQ ID NO: 1238340 - DNA, 18 bp, Homo sapiens
tctccacctcagccttgg

SEQ ID NO: 1238341 - DNA, 13 bp, Homo sapiens
tctccactccaga

SEQ ID NO: 1238342 - DNA, 14 bp, Homo sapiens
tctccactgccttc

SEQ ID NO: 1238343 - DNA, 14 bp, Homo sapiens
tctccactgctgga

SEQ ID NO: 1238344 - DNA, 18 bp, Homo sapiens
tctccactgctggacatg

SEQ ID NO: 1238345 - DNA, 12 bp, Homo sapiens
tctccactgtgc

SEQ ID NO: 1238346 - DNA, 14 bp, Homo sapiens
tctccacttctggt

SEQ ID NO: 1238347 - DNA, 17 bp, Homo sapiens
tctccacttctggtccc

SEQ ID NO: 1238348 - DNA, 21 bp, Homo sapiens
tctccacttctggtcccctgt

SEQ ID NO: 1238349 - DNA, 17 bp, Homo sapiens
tctccagaaacagctgc

SEQ ID NO: 1238350 - DNA, 19 bp, Homo sapiens
tctccagaaacagctgctt

SEQ ID NO: 1238351 - DNA, 21 bp, Homo sapiens
tctccagaaacagctgcttct

SEQ ID NO: 1238352 - DNA, 19 bp, Homo sapiens
tctccagaatgtaagaaaa

SEQ ID NO: 1238353 - DNA, 20 bp, Homo sapiens
tctccagaatgtaagaaaac

SEQ ID NO: 1238354 - DNA, 15 bp, Homo sapiens
tctccagagaggctc

SEQ ID NO: 1238355 - DNA, 14 bp, Homo sapiens
tctccagatgtttc

SEQ ID NO: 1238356 - DNA, 15 bp, Homo sapiens
tctccagatgtttcc

SEQ ID NO: 1238357 - DNA, 13 bp, Homo sapiens
tctccagccagca

SEQ ID NO: 1238358 - DNA, 22 bp, Homo sapiens
tctccagccccttctcagaatc

SEQ ID NO: 1238359 - DNA, 23 bp, Homo sapiens
tctccagccccttctcagaatct

SEQ ID NO: 1238360 - DNA, 20 bp, Homo sapiens
tctccagctcagaacccagg

SEQ ID NO: 1238361 - DNA, 15 bp, Homo sapiens
tctccagctgactaa

SEQ ID NO: 1238362 - DNA, 14 bp, Homo sapiens
tctccagctgcctg

SEQ ID NO: 1238363 - DNA, 18 bp, Homo sapiens
tctccagctgcctgggcc

SEQ ID NO: 1238364 - DNA, 11 bp, Homo sapiens
tctccagctgg

SEQ ID NO: 1238365 - DNA, 17 bp, Homo sapiens
tctccagctgggctctg

SEQ ID NO: 1238366 - DNA, 15 bp, Homo sapiens
tctccagcttcagct

SEQ ID NO: 1238367 - DNA, 13 bp, Homo sapiens
tctccaggaccaa

SEQ ID NO: 1238368 - DNA, 19 bp, Homo sapiens
tctccaggattgaagagca

SEQ ID NO: 1238369 - DNA, 17 bp, Homo sapiens
tctccaggcacccttct

SEQ ID NO: 1238370 - DNA, 11 bp, Homo sapiens
tctccaggcca

SEQ ID NO: 1238371 - DNA, 12 bp, Homo sapiens
tctccaggccag

SEQ ID NO: 1238372 - DNA, 11 bp, Homo sapiens
tctccagggaa

SEQ ID NO: 1238373 - DNA, 21 bp, Homo sapiens
tctccagggacccttgcctgc

SEQ ID NO: 1238374 - DNA, 23 bp, Homo sapiens
tctccagggacccttgcctgcct

SEQ ID NO: 1238375 - DNA, 13 bp, Homo sapiens
tctccctgtcaca

SEQ ID NO: 1238376 - DNA, 22 bp, Homo sapiens
tctccctgtcacacactggacc

SEQ ID NO: 1238377 - DNA, 19 bp, Homo sapiens
tctccctgtgttctgggct

SEQ ID NO: 1238378 - DNA, 15 bp, Homo sapiens
tctcccttccctcct

SEQ ID NO: 1238379 - DNA, 19 bp, Homo sapiens
tctcccttcccttccctca

SEQ ID NO: 1238380 - DNA, 23 bp, Homo sapiens
tctcccttcttgggtctgccctg

SEQ ID NO: 1238381 - DNA, 14 bp, Homo sapiens
tctcccttctttta

SEQ ID NO: 1238382 - DNA, 17 bp, Homo sapiens
tctccctttatgtatct

SEQ ID NO: 1238383 - DNA, 19 bp, Homo sapiens
tctccgacttcccctgggc

SEQ ID NO: 1238384 - DNA, 20 bp, Homo sapiens
tctccgcattggaagagccc

SEQ ID NO: 1238385 - DNA, 17 bp, Homo sapiens
tctccgcgccctccgac

SEQ ID NO: 1238386 - DNA, 16 bp, Homo sapiens
tctccggggccatttg

SEQ ID NO: 1238387 - DNA, 23 bp, Homo sapiens
tctccggggtctgtgctgtgcct

SEQ ID NO: 1238388 - DNA, 15 bp, Homo sapiens
tctccgggtcctcct

SEQ ID NO: 1238389 - DNA, 17 bp, Homo sapiens
tctccgggtcctcctaa

SEQ ID NO: 1238390 - DNA, 15 bp, Homo sapiens
tctccgggtgtggcc

SEQ ID NO: 1238391 - DNA, 18 bp, Homo sapiens
tctccgggtgtggcctca

SEQ ID NO: 1238392 - DNA, 17 bp, Homo sapiens
tctcctacctgctgctg

SEQ ID NO: 1238393 - DNA, 19 bp, Homo sapiens
tctcctagagacagaagca

SEQ ID NO: 1238394 - DNA, 20 bp, Homo sapiens
tctcctagagacagaagcag

SEQ ID NO: 1238395 - DNA, 19 bp, Homo sapiens
tctcctagcccctctctca

SEQ ID NO: 1238396 - DNA, 19 bp, Homo sapiens
tctcctataatctgtcaaa

SEQ ID NO: 1238397 - DNA, 18 bp, Homo sapiens
tctcctcaagcctgtggg

SEQ ID NO: 1238398 - DNA, 20 bp, Homo sapiens
tctcctcactctgtccctgt

SEQ ID NO: 1238399 - DNA, 19 bp, Homo sapiens
tctcctcaggacaaggcct

SEQ ID NO: 1238400 - DNA, 21 bp, Homo sapiens
tctcctcaggaccctcagccc

SEQ ID NO: 1238401 - DNA, 16 bp, Homo sapiens
tctcctcagggtgggg

SEQ ID NO: 1238402 - DNA, 16 bp, Homo sapiens
tctcctcatgttctgc

SEQ ID NO: 1238403 - DNA, 20 bp, Homo sapiens
tctcctccatgggagaaaat

SEQ ID NO: 1238404 - DNA, 15 bp, Homo sapiens
tctcctcccagctgc

SEQ ID NO: 1238405 - DNA, 16 bp, Homo sapiens
tctcctcccagctgct

SEQ ID NO: 1238406 - DNA, 17 bp, Homo sapiens
tctcctcccagctgctt

SEQ ID NO: 1238407 - DNA, 22 bp, Homo sapiens
tctcctcccagctgctttactt

SEQ ID NO: 1238408 - DNA, 12 bp, Homo sapiens
tctcctcccagg

SEQ ID NO: 1238409 - DNA, 15 bp, Homo sapiens
tctcctccccacccg

SEQ ID NO: 1238410 - DNA, 21 bp, Homo sapiens
tctcctccccacctgtagctg

SEQ ID NO: 1238411 - DNA, 13 bp, Homo sapiens
tctcctccctcag

SEQ ID NO: 1238412 - DNA, 14 bp, Homo sapiens
tctcctccctcagc

SEQ ID NO: 1238413 - DNA, 12 bp, Homo sapiens
tctcctccctgg

SEQ ID NO: 1238414 - DNA, 23 bp, Homo sapiens
tctcctccctgttatctgctaga

SEQ ID NO: 1238415 - DNA, 23 bp, Homo sapiens
tctcctcccttaccctcctctgc

SEQ ID NO: 1238416 - DNA, 14 bp, Homo sapiens
tctcctcggccccc

SEQ ID NO: 1238417 - DNA, 23 bp, Homo sapiens
tctcctctcagagtgacagtcat

SEQ ID NO: 1238418 - DNA, 12 bp, Homo sapiens
tctcctctccat

SEQ ID NO: 1238419 - DNA, 16 bp, Homo sapiens
tctcttcatgcttgac

SEQ ID NO: 1238420 - DNA, 19 bp, Homo sapiens
tctcttcatgcttgacata

SEQ ID NO: 1238421 - DNA, 19 bp, Homo sapiens
tctcttcattattctctgc

SEQ ID NO: 1238422 - DNA, 19 bp, Homo sapiens
tctcttcatttttttttca

SEQ ID NO: 1238423 - DNA, 23 bp, Homo sapiens
tctcttccagaagatgccctcca

SEQ ID NO: 1238424 - DNA, 16 bp, Homo sapiens
tctcttcccaggcctt

SEQ ID NO: 1238425 - DNA, 22 bp, Homo sapiens
tctcttccctccggactctaaa

SEQ ID NO: 1238426 - DNA, 19 bp, Homo sapiens
tctcttcctccgaggccag

SEQ ID NO: 1238427 - DNA, 22 bp, Homo sapiens
tctcttcctcttcccccaagat

SEQ ID NO: 1238428 - DNA, 13 bp, Homo sapiens
tctcttcctgccc

SEQ ID NO: 1238429 - DNA, 18 bp, Homo sapiens
tctcttcctgcccctctt

SEQ ID NO: 1238430 - DNA, 12 bp, Homo sapiens
tctcttcctgta

SEQ ID NO: 1238431 - DNA, 17 bp, Homo sapiens
tctcttcggcagggagg

SEQ ID NO: 1238432 - DNA, 15 bp, Homo sapiens
tctcttcgtcctgat

SEQ ID NO: 1238433 - DNA, 15 bp, Homo sapiens
tctcttctccactgg

SEQ ID NO: 1238434 - DNA, 12 bp, Homo sapiens
tctcttctctcc

SEQ ID NO: 1238435 - DNA, 14 bp, Homo sapiens
tctcttctctcttc

SEQ ID NO: 1238436 - DNA, 21 bp, Homo sapiens
tctcttctgagctatttcatc

SEQ ID NO: 1238437 - DNA, 18 bp, Homo sapiens
tctcttctgggttccttc

SEQ ID NO: 1238438 - DNA, 20 bp, Homo sapiens
tctcttctgtccatcagtgc

SEQ ID NO: 1238439 - DNA, 12 bp, Homo sapiens
tctcttctgttc

SEQ ID NO: 1238440 - DNA, 13 bp, Homo sapiens
tctcttctgttct

SEQ ID NO: 1238441 - DNA, 15 bp, Homo sapiens
tctcttcttgtttct

SEQ ID NO: 1238442 - DNA, 20 bp, Homo sapiens
tctcttctttattgcactag

SEQ ID NO: 1238443 - DNA, 21 bp, Homo sapiens
tctcttgagcatcaatcttgt

SEQ ID NO: 1238444 - DNA, 17 bp, Homo sapiens
tctcttgagcctgggag

SEQ ID NO: 1238445 - DNA, 14 bp, Homo sapiens
tctcttgagctggc

SEQ ID NO: 1238446 - DNA, 17 bp, Homo sapiens
tctcttgagctggcctc

SEQ ID NO: 1238447 - DNA, 18 bp, Homo sapiens
tctcttgaggccaggagt

SEQ ID NO: 1238448 - DNA, 13 bp, Homo sapiens
tctcttgctttct

SEQ ID NO: 1238449 - DNA, 17 bp, Homo sapiens
tctcttggctctactcc

SEQ ID NO: 1238450 - DNA, 16 bp, Homo sapiens
tctcttggtggggagg

SEQ ID NO: 1238451 - DNA, 14 bp, Homo sapiens
tctcttgtaccata

SEQ ID NO: 1238452 - DNA, 13 bp, Homo sapiens
tctcttgtagaag

SEQ ID NO: 1238453 - DNA, 23 bp, Homo sapiens
tctcttgtgatttggttgcactt

SEQ ID NO: 1238454 - DNA, 19 bp, Homo sapiens
tctctttaaaaggaaagaa

SEQ ID NO: 1238455 - DNA, 19 bp, Homo sapiens
tctctttaattttaactga

SEQ ID NO: 1238456 - DNA, 23 bp, Homo sapiens
tctctttagtataattgacctac

SEQ ID NO: 1238457 - DNA, 16 bp, Homo sapiens
tctctttccactttgt

SEQ ID NO: 1238458 - DNA, 13 bp, Homo sapiens
tctctttccttga

SEQ ID NO: 1238459 - DNA, 10 bp, Homo sapiens
tctctttctc

SEQ ID NO: 1238460 - DNA, 14 bp, Homo sapiens
tctctttctctcct

SEQ ID NO: 1238461 - DNA, 14 bp, Homo sapiens
tctctttctctctt

SEQ ID NO: 1238462 - DNA, 12 bp, Homo sapiens
tctctttctgtc

SEQ ID NO: 1238463 - DNA, 18 bp, Homo sapiens
tctctttggaaatagcat

SEQ ID NO: 1238464 - DNA, 19 bp, Homo sapiens
tctctttggaaatagcatg

SEQ ID NO: 1238465 - DNA, 13 bp, Homo sapiens
tctctttgtctgc

SEQ ID NO: 1238466 - DNA, 15 bp, Homo sapiens
tctctttgtctgcct

SEQ ID NO: 1238467 - DNA, 15 bp, Homo sapiens
tctctttgtgcagtg

SEQ ID NO: 1238468 - DNA, 14 bp, Homo sapiens
tctctttgttcaat

SEQ ID NO: 1238469 - DNA, 14 bp, Homo sapiens
tctctttgtttctg

SEQ ID NO: 1238470 - DNA, 19 bp, Homo sapiens
tctctttgtttctgtttct

SEQ ID NO: 1238471 - DNA, 20 bp, Homo sapiens
tctctttgtttctgtttctt

SEQ ID NO: 1238472 - DNA, 21 bp, Homo sapiens
tctctttgtttctgtttcttg

SEQ ID NO: 1238473 - DNA, 15 bp, Homo sapiens
tctcttttaaagtat

SEQ ID NO: 1238474 - DNA, 22 bp, Homo sapiens
tctcttttaaagtatttataaa

SEQ ID NO: 1238475 - DNA, 18 bp, Homo sapiens
tctcttttatgttcagct

SEQ ID NO: 1238476 - DNA, 17 bp, Homo sapiens
tctcttttattctgtta

SEQ ID NO: 1238477 - DNA, 12 bp, Homo sapiens
tctcttttccac

SEQ ID NO: 1238478 - DNA, 20 bp, Homo sapiens
tctcttttcccctttcctgt

SEQ ID NO: 1238479 - DNA, 17 bp, Homo sapiens
tctcttttcctctctgt

SEQ ID NO: 1238480 - DNA, 21 bp, Homo sapiens
tctcttttcctctctgtctgt

SEQ ID NO: 1238481 - DNA, 16 bp, Homo sapiens
tctcttttctctttct

SEQ ID NO: 1238482 - DNA, 18 bp, Homo sapiens
tctcttttgctttctgtt

SEQ ID NO: 1238483 - DNA, 14 bp, Homo sapiens
tctctttttcttcc

SEQ ID NO: 1238484 - DNA, 18 bp, Homo sapiens
tctctttttgctttcgaa

SEQ ID NO: 1238485 - DNA, 20 bp, Homo sapiens
tctctttttggaggtgctta

SEQ ID NO: 1238486 - DNA, 17 bp, Homo sapiens
tctcttttttattctgt

SEQ ID NO: 1238487 - DNA, 11 bp, Homo sapiens
tctgaaaacac

SEQ ID NO: 1238488 - DNA, 21 bp, Homo sapiens
tctgaaaagcaattgccctgt

SEQ ID NO: 1238489 - DNA, 13 bp, Homo sapiens
tctgaaaatgtat

SEQ ID NO: 1238490 - DNA, 14 bp, Homo sapiens
tctgaaaatgtatg

SEQ ID NO: 1238491 - DNA, 23 bp, Homo sapiens
tctgaaaatgtatgtgtaagtat

SEQ ID NO: 1238492 - DNA, 23 bp, Homo sapiens
tctgaaaattccagaaaggatat

SEQ ID NO: 1238493 - DNA, 20 bp, Homo sapiens
tctgaaaccagtgttaggga

SEQ ID NO: 1238494 - DNA, 15 bp, Homo sapiens
tctgaaaccttagtt

SEQ ID NO: 1238495 - DNA, 22 bp, Homo sapiens
tctgaaaccttagtttcaagag

SEQ ID NO: 1238496 - DNA, 20 bp, Homo sapiens
tctgaaagacagaatgtcac

SEQ ID NO: 1238497 - DNA, 14 bp, Homo sapiens
tctgaaagccacgt

SEQ ID NO: 1238498 - DNA, 16 bp, Homo sapiens
tctgaaaggagacatt

SEQ ID NO: 1238499 - DNA, 23 bp, Homo sapiens
tctgaaaggagacattgctctat

SEQ ID NO: 1238500 - DNA, 16 bp, Homo sapiens
tctgaaagtatatttt

SEQ ID NO: 1238501 - DNA, 22 bp, Homo sapiens
tctgaaagtatattttcctccc

SEQ ID NO: 1238502 - DNA, 14 bp, Homo sapiens
tctgaaatctcctt

SEQ ID NO: 1238503 - DNA, 21 bp, Homo sapiens
tctgaaatgtcagttctgata

SEQ ID NO: 1238504 - DNA, 17 bp, Homo sapiens
tctgaaattaaagaaat

SEQ ID NO: 1238505 - DNA, 19 bp, Homo sapiens
tctgaaattaaagaaatga

SEQ ID NO: 1238506 - DNA, 20 bp, Homo sapiens
tctgaaatttttttcctaag

SEQ ID NO: 1238507 - DNA, 13 bp, Homo sapiens
tctgaacacacac

SEQ ID NO: 1238508 - DNA, 22 bp, Homo sapiens
tctgaacacacacgccagctcc

SEQ ID NO: 1238509 - DNA, 12 bp, Homo sapiens
tctgaacacatt

SEQ ID NO: 1238510 - DNA, 22 bp, Homo sapiens
tctgaacagcagtaatcctggg

SEQ ID NO: 1238511 - DNA, 13 bp, Homo sapiens
tctgaacccagct

SEQ ID NO: 1238512 - DNA, 16 bp, Homo sapiens
tctgaaccccctttcc

SEQ ID NO: 1238513 - DNA, 12 bp, Homo sapiens
tctgaactcaaa

SEQ ID NO: 1238514 - DNA, 16 bp, Homo sapiens
tctgaactcaaactga

SEQ ID NO: 1238515 - DNA, 22 bp, Homo sapiens
tctgaactgaccttgaatcttt

SEQ ID NO: 1238516 - DNA, 16 bp, Homo sapiens
tctgaactgcaacact

SEQ ID NO: 1238517 - DNA, 23 bp, Homo sapiens
tctgaacttttaatgaactttga

SEQ ID NO: 1238518 - DNA, 15 bp, Homo sapiens
tctgaagaaaaatta

SEQ ID NO: 1238519 - DNA, 22 bp, Homo sapiens
tctgaagacctttaatggcttc

SEQ ID NO: 1238520 - DNA, 18 bp, Homo sapiens
tctgaagactgagaactt

SEQ ID NO: 1238521 - DNA, 19 bp, Homo sapiens
tctgaagactgagaacttt

SEQ ID NO: 1238522 - DNA, 20 bp, Homo sapiens
tctgaagagcctgaagctgg

SEQ ID NO: 1238523 - DNA, 17 bp, Homo sapiens
tctgaagagtatccttc

SEQ ID NO: 1238524 - DNA, 17 bp, Homo sapiens
tctgaagatcaatttct

SEQ ID NO: 1238525 - DNA, 12 bp, Homo sapiens
tctgaagcatgt

SEQ ID NO: 1238526 - DNA, 15 bp, Homo sapiens
tctgaagcatgtttc

SEQ ID NO: 1238527 - DNA, 21 bp, Homo sapiens
tctgaagcatgtttcatgttt

SEQ ID NO: 1238528 - DNA, 22 bp, Homo sapiens
tctgaagccatgtagccaccca

SEQ ID NO: 1238529 - DNA, 23 bp, Homo sapiens
tctgaagctcgcatccagacagt

SEQ ID NO: 1238530 - DNA, 13 bp, Homo sapiens
tctgaaggaagag

SEQ ID NO: 1238531 - DNA, 14 bp, Homo sapiens
tctgaaggaagaga

SEQ ID NO: 1238532 - DNA, 21 bp, Homo sapiens
tctgaaggaatagccagagag

SEQ ID NO: 1238533 - DNA, 23 bp, Homo sapiens
tctgaaggaatagccagagagga

SEQ ID NO: 1238534 - DNA, 20 bp, Homo sapiens
tctgaaggacacttcctgcc

SEQ ID NO: 1238535 - DNA, 21 bp, Homo sapiens
tctgaaggacacttcctgcct

SEQ ID NO: 1238536 - DNA, 13 bp, Homo sapiens
tctgaaggagagg

SEQ ID NO: 1238537 - DNA, 15 bp, Homo sapiens
tctgaaggagaggag

SEQ ID NO: 1238538 - DNA, 20 bp, Homo sapiens
tctgaaggagaggaggaatt

SEQ ID NO: 1238539 - DNA, 17 bp, Homo sapiens
tctgaaggcaaatataa

SEQ ID NO: 1238540 - DNA, 23 bp, Homo sapiens
tctgaaggcgtcaacgtgcattt

SEQ ID NO: 1238541 - DNA, 13 bp, Homo sapiens
tctgaagggaccc

SEQ ID NO: 1238542 - DNA, 20 bp, Homo sapiens
tctgaagggcatacaatgaa

SEQ ID NO: 1238543 - DNA, 17 bp, Homo sapiens
tctgaagtcacatcaca

SEQ ID NO: 1238544 - DNA, 19 bp, Homo sapiens
tctgcatatgttgaatact

SEQ ID NO: 1238545 - DNA, 21 bp, Homo sapiens
tctgcatatttctgtatattt

SEQ ID NO: 1238546 - DNA, 19 bp, Homo sapiens
tctgcatcatctgtagata

SEQ ID NO: 1238547 - DNA, 19 bp, Homo sapiens
tctgcatcccagcacctgc

SEQ ID NO: 1238548 - DNA, 21 bp, Homo sapiens
tctgcatcccagcacctgcct

SEQ ID NO: 1238549 - DNA, 22 bp, Homo sapiens
tctgcatcccagcacctgcctc

SEQ ID NO: 1238550 - DNA, 24 bp, Homo sapiens
tctgcatcccagcacctgcctcct

SEQ ID NO: 1238551 - DNA, 20 bp, Homo sapiens
tctgcatctgaccacgtgct

SEQ ID NO: 1238552 - DNA, 17 bp, Homo sapiens
tctgcatcttaacatgc

SEQ ID NO: 1238553 - DNA, 22 bp, Homo sapiens
tctgcatcttggggacatctct

SEQ ID NO: 1238554 - DNA, 16 bp, Homo sapiens
tctgcatgcttagagc

SEQ ID NO: 1238555 - DNA, 13 bp, Homo sapiens
tctgcatgtacta

SEQ ID NO: 1238556 - DNA, 14 bp, Homo sapiens
tctgcatgtactag

SEQ ID NO: 1238557 - DNA, 21 bp, Homo sapiens
tctgcattcatttttatagca

SEQ ID NO: 1238558 - DNA, 13 bp, Homo sapiens
tctgcattcctga

SEQ ID NO: 1238559 - DNA, 18 bp, Homo sapiens
tctgcattgctagataaa

SEQ ID NO: 1238560 - DNA, 23 bp, Homo sapiens
tctgcattgttattgtggaagat

SEQ ID NO: 1238561 - DNA, 15 bp, Homo sapiens
tctgcatttaaaaaa

SEQ ID NO: 1238562 - DNA, 10 bp, Homo sapiens
tctgcatttt

SEQ ID NO: 1238563 - DNA, 15 bp, Homo sapiens
tctgcattttaacaa

SEQ ID NO: 1238564 - DNA, 17 bp, Homo sapiens
tctgcattttcacccca

SEQ ID NO: 1238565 - DNA, 16 bp, Homo sapiens
tctgcattttgctatt

SEQ ID NO: 1238566 - DNA, 18 bp, Homo sapiens
tctgcattttgctattgt

SEQ ID NO: 1238567 - DNA, 13 bp, Homo sapiens
tctgccaaacaca

SEQ ID NO: 1238568 - DNA, 14 bp, Homo sapiens
tctgccaaacacat

SEQ ID NO: 1238569 - DNA, 13 bp, Homo sapiens
tctgccaatgtgg

SEQ ID NO: 1238570 - DNA, 14 bp, Homo sapiens
tctgccaatgtggg

SEQ ID NO: 1238571 - DNA, 10 bp, Homo sapiens
tctgccacca

SEQ ID NO: 1238572 - DNA, 22 bp, Homo sapiens
tctgccacccctaaactccagg

SEQ ID NO: 1238573 - DNA, 14 bp, Homo sapiens
tctgccacctcccc

SEQ ID NO: 1238574 - DNA, 20 bp, Homo sapiens
tctgccacctcccctatcca

SEQ ID NO: 1238575 - DNA, 16 bp, Homo sapiens
tctgccacttgtcaaa

SEQ ID NO: 1238576 - DNA, 13 bp, Homo sapiens
tctgccagccagc

SEQ ID NO: 1238577 - DNA, 12 bp, Homo sapiens
tctgccaggcaa

SEQ ID NO: 1238578 - DNA, 12 bp, Homo sapiens
tctgccaggcac

SEQ ID NO: 1238579 - DNA, 13 bp, Homo sapiens
tctgccaggcact

SEQ ID NO: 1238580 - DNA, 16 bp, Homo sapiens
tctgccaggcactctc

SEQ ID NO: 1238581 - DNA, 13 bp, Homo sapiens
tctgccaggccca

SEQ ID NO: 1238582 - DNA, 16 bp, Homo sapiens
tctgccaggcccatct

SEQ ID NO: 1238583 - DNA, 21 bp, Homo sapiens
tctgccaggggtaacctggcc

SEQ ID NO: 1238584 - DNA, 22 bp, Homo sapiens
tctgccaggggtaacctggcca

SEQ ID NO: 1238585 - DNA, 23 bp, Homo sapiens
tctgccagtcgggagagccaggc

SEQ ID NO: 1238586 - DNA, 19 bp, Homo sapiens
tctgccagtgacagacagg

SEQ ID NO: 1238587 - DNA, 13 bp, Homo sapiens
tctgccatctaat

SEQ ID NO: 1238588 - DNA, 18 bp, Homo sapiens
tctgccatctagccagcc

SEQ ID NO: 1238589 - DNA, 18 bp, Homo sapiens
tctgccatgatgtttaca

SEQ ID NO: 1238590 - DNA, 19 bp, Homo sapiens
tctgccatgttgccccttt

SEQ ID NO: 1238591 - DNA, 22 bp, Homo sapiens
tctgcccaagcagcctggagac

SEQ ID NO: 1238592 - DNA, 20 bp, Homo sapiens
tctgcccacagtctttccgt

SEQ ID NO: 1238593 - DNA, 18 bp, Homo sapiens
tctgcccacattggaccc

SEQ ID NO: 1238594 - DNA, 13 bp, Homo sapiens
tctgcccaccctc

SEQ ID NO: 1238595 - DNA, 15 bp, Homo sapiens
tctgcccaccctcct

SEQ ID NO: 1238596 - DNA, 17 bp, Homo sapiens
tctgcccacctggggtc

SEQ ID NO: 1238597 - DNA, 21 bp, Homo sapiens
tctgcccacctggggtctctc

SEQ ID NO: 1238598 - DNA, 19 bp, Homo sapiens
tctgcccacgatcccctcc

SEQ ID NO: 1238599 - DNA, 21 bp, Homo sapiens
tctgcccacgcagaggacgca

SEQ ID NO: 1238600 - DNA, 23 bp, Homo sapiens
tctgcccacgcagaggacgcacg

SEQ ID NO: 1238601 - DNA, 13 bp, Homo sapiens
tctgcccactcgg

SEQ ID NO: 1238602 - DNA, 19 bp, Homo sapiens
tctgcccacttccccttcc

SEQ ID NO: 1238603 - DNA, 13 bp, Homo sapiens
tctgcccagggag

SEQ ID NO: 1238604 - DNA, 21 bp, Homo sapiens
tctgcccaggggtgccccctc

SEQ ID NO: 1238605 - DNA, 13 bp, Homo sapiens
tctgccccaagca

SEQ ID NO: 1238606 - DNA, 14 bp, Homo sapiens
tctgccccaagcag

SEQ ID NO: 1238607 - DNA, 17 bp, Homo sapiens
tctgccccaagcagcca

SEQ ID NO: 1238608 - DNA, 20 bp, Homo sapiens
tctgccccaagcagccagcc

SEQ ID NO: 1238609 - DNA, 14 bp, Homo sapiens
tctgccccaagccc

SEQ ID NO: 1238610 - DNA, 15 bp, Homo sapiens
tctgccccaagcccc

SEQ ID NO: 1238611 - DNA, 16 bp, Homo sapiens
tctgccccaagccccc

SEQ ID NO: 1238612 - DNA, 13 bp, Homo sapiens
tctgccccaccct

SEQ ID NO: 1238613 - DNA, 15 bp, Homo sapiens
tctgccccaccctca

SEQ ID NO: 1238614 - DNA, 18 bp, Homo sapiens
tctgccccaccttgccag

SEQ ID NO: 1238615 - DNA, 20 bp, Homo sapiens
tctgccccaccttgccaggg

SEQ ID NO: 1238616 - DNA, 22 bp, Homo sapiens
tctgccccaccttgccagggca

SEQ ID NO: 1238617 - DNA, 17 bp, Homo sapiens
tctgccccacgctgtgg

SEQ ID NO: 1238618 - DNA, 10 bp, Homo sapiens
tctgccccag

SEQ ID NO: 1238619 - DNA, 14 bp, Homo sapiens
tctgccccagctct

SEQ ID NO: 1238620 - DNA, 15 bp, Homo sapiens
tctgccccaggccct

SEQ ID NO: 1238621 - DNA, 18 bp, Homo sapiens
tctgccccaggccctact

SEQ ID NO: 1238622 - DNA, 23 bp, Homo sapiens
tctgccccagtagtcagaagcag

SEQ ID NO: 1238623 - DNA, 18 bp, Homo sapiens
tctgccccatcctccagc

SEQ ID NO: 1238624 - DNA, 22 bp, Homo sapiens
tctgcccccgcgggttctagac

SEQ ID NO: 1238625 - DNA, 16 bp, Homo sapiens
tctgccccctccccca

SEQ ID NO: 1238626 - DNA, 19 bp, Homo sapiens
tctgcccctggacctggga

SEQ ID NO: 1238627 - DNA, 15 bp, Homo sapiens
tctgccccttgggca

SEQ ID NO: 1238628 - DNA, 21 bp, Homo sapiens
tctgcccgcagagcccacgcc

SEQ ID NO: 1238629 - DNA, 18 bp, Homo sapiens
tctgcccgggccccttgc

SEQ ID NO: 1238630 - DNA, 15 bp, Homo sapiens
tctgccctctccctg

SEQ ID NO: 1238631 - DNA, 16 bp, Homo sapiens
tctgccctctccctgt

SEQ ID NO: 1238632 - DNA, 16 bp, Homo sapiens
tctgccctctgctgct

SEQ ID NO: 1238633 - DNA, 17 bp, Homo sapiens
tctgccctgcccatact

SEQ ID NO: 1238634 - DNA, 23 bp, Homo sapiens
tctgccctgcccatactgagcct

SEQ ID NO: 1238635 - DNA, 14 bp, Homo sapiens
tctgccctgcctcc

SEQ ID NO: 1238636 - DNA, 15 bp, Homo sapiens
tctgccctgcctccc

SEQ ID NO: 1238637 - DNA, 19 bp, Homo sapiens
tctgccctgcctccctttc

SEQ ID NO: 1238638 - DNA, 20 bp, Homo sapiens
tctgccctgcctccctttct

SEQ ID NO: 1238639 - DNA, 17 bp, Homo sapiens
tctgccctgcctgagga

SEQ ID NO: 1238640 - DNA, 13 bp, Homo sapiens
tctgccctggctg

SEQ ID NO: 1238641 - DNA, 16 bp, Homo sapiens
tctgccctggctgctg

SEQ ID NO: 1238642 - DNA, 16 bp, Homo sapiens
tctgcccttcccctcc

SEQ ID NO: 1238643 - DNA, 15 bp, Homo sapiens
tctgccgctacctcc

SEQ ID NO: 1238644 - DNA, 18 bp, Homo sapiens
tctgccgctacctccctc

SEQ ID NO: 1238645 - DNA, 20 bp, Homo sapiens
tctgccgctacctccctccc

SEQ ID NO: 1238646 - DNA, 21 bp, Homo sapiens
tctgccggtcgggcagccagc

SEQ ID NO: 1238647 - DNA, 16 bp, Homo sapiens
tctgccggtgctcgga

SEQ ID NO: 1238648 - DNA, 15 bp, Homo sapiens
tctgcctacagccag

SEQ ID NO: 1238649 - DNA, 16 bp, Homo sapiens
tctgcctacagccagg

SEQ ID NO: 1238650 - DNA, 19 bp, Homo sapiens
tctgcctacgttctcttta

SEQ ID NO: 1238651 - DNA, 23 bp, Homo sapiens
tctgcctacgttctctttaaaag

SEQ ID NO: 1238652 - DNA, 20 bp, Homo sapiens
tctgcctcacatagcttaca

SEQ ID NO: 1238653 - DNA, 15 bp, Homo sapiens
tctgcctccctcacc

SEQ ID NO: 1238654 - DNA, 12 bp, Homo sapiens
tctgcctcctca

SEQ ID NO: 1238655 - DNA, 13 bp, Homo sapiens
tctgcctcctccc

SEQ ID NO: 1238656 - DNA, 13 bp, Homo sapiens
tctgcctcgctca

SEQ ID NO: 1238657 - DNA, 22 bp, Homo sapiens
tctgcctctccctgggtctggg

SEQ ID NO: 1238658 - DNA, 12 bp, Homo sapiens
tctgcctctggg

SEQ ID NO: 1238659 - DNA, 14 bp, Homo sapiens
tctgcctctgggca

SEQ ID NO: 1238660 - DNA, 16 bp, Homo sapiens
tctgcctctgggcagc

SEQ ID NO: 1238661 - DNA, 19 bp, Homo sapiens
tctgcctctgggcagcctg

SEQ ID NO: 1238662 - DNA, 15 bp, Homo sapiens
tctgcctcttctggg

SEQ ID NO: 1238663 - DNA, 19 bp, Homo sapiens
tctgcctgcctcctccctc

SEQ ID NO: 1238664 - DNA, 13 bp, Homo sapiens
tctgcctgctcca

SEQ ID NO: 1238665 - DNA, 9 bp, Homo sapiens
tctgcctgg

SEQ ID NO: 1238666 - DNA, 10 bp, Homo sapiens
tctgcctgga

SEQ ID NO: 1238667 - DNA, 21 bp, Homo sapiens
tctgcctggagtgtatgactg

SEQ ID NO: 1238668 - DNA, 12 bp, Homo sapiens
tctgcctggcct

SEQ ID NO: 1238669 - DNA, 16 bp, Homo sapiens
tctgcctggcctggct

SEQ ID NO: 1238670 - DNA, 13 bp, Homo sapiens
tctgcctgggcct

SEQ ID NO: 1238671 - DNA, 17 bp, Homo sapiens
tctgcctgggcctgtgc

SEQ ID NO: 1238672 - DNA, 20 bp, Homo sapiens
tctgcctgggcctgtgcagc

SEQ ID NO: 1238673 - DNA, 19 bp, Homo sapiens
tctggctcctcaaacagta

SEQ ID NO: 1238674 - DNA, 17 bp, Homo sapiens
tctggctgaaccctgtg

SEQ ID NO: 1238675 - DNA, 21 bp, Homo sapiens
tctggctgagctgaacccatt

SEQ ID NO: 1238676 - DNA, 21 bp, Homo sapiens
tctggctgccccaacctgctg

SEQ ID NO: 1238677 - DNA, 18 bp, Homo sapiens
tctggctgtctagaatgt

SEQ ID NO: 1238678 - DNA, 13 bp, Homo sapiens
tctggctgtggtc

SEQ ID NO: 1238679 - DNA, 13 bp, Homo sapiens
tctggctgtgtgg

SEQ ID NO: 1238680 - DNA, 19 bp, Homo sapiens
tctggctgtgtggccaagg

SEQ ID NO: 1238681 - DNA, 23 bp, Homo sapiens
tctggcttagacaccacctggag

SEQ ID NO: 1238682 - DNA, 15 bp, Homo sapiens
tctggcttcagcccc

SEQ ID NO: 1238683 - DNA, 20 bp, Homo sapiens
tctggcttcagcccccacca

SEQ ID NO: 1238684 - DNA, 21 bp, Homo sapiens
tctggcttcagcccccaccag

SEQ ID NO: 1238685 - DNA, 22 bp, Homo sapiens
tctggcttcagcccccaccagg

SEQ ID NO: 1238686 - DNA, 13 bp, Homo sapiens
tctggcttccagg

SEQ ID NO: 1238687 - DNA, 24 bp, Homo sapiens
tctggcttccaggtatctccagga

SEQ ID NO: 1238688 - DNA, 19 bp, Homo sapiens
tctggcttccctaaactgc

SEQ ID NO: 1238689 - DNA, 21 bp, Homo sapiens
tctggcttccctaaactgcag

SEQ ID NO: 1238690 - DNA, 23 bp, Homo sapiens
tctggcttccctaaactgcagcc

SEQ ID NO: 1238691 - DNA, 21 bp, Homo sapiens
tctggcttctagagatgtgcc

SEQ ID NO: 1238692 - DNA, 19 bp, Homo sapiens
tctggcttctgaagagcct

SEQ ID NO: 1238693 - DNA, 14 bp, Homo sapiens
tctggcttgactgg

SEQ ID NO: 1238694 - DNA, 22 bp, Homo sapiens
tctggcttgccccaggactctg

SEQ ID NO: 1238695 - DNA, 13 bp, Homo sapiens
tctggctttccca

SEQ ID NO: 1238696 - DNA, 22 bp, Homo sapiens
tctgggaaattgaagtgtcttc

SEQ ID NO: 1238697 - DNA, 15 bp, Homo sapiens
tctgggaacctccca

SEQ ID NO: 1238698 - DNA, 12 bp, Homo sapiens
tctgggaaggga

SEQ ID NO: 1238699 - DNA, 14 bp, Homo sapiens
tctgggaagggaag

SEQ ID NO: 1238700 - DNA, 17 bp, Homo sapiens
tctgggaattgtgtgtc

SEQ ID NO: 1238701 - DNA, 16 bp, Homo sapiens
tctgggacctcagttt

SEQ ID NO: 1238702 - DNA, 20 bp, Homo sapiens
tctgggactctcctcctccc

SEQ ID NO: 1238703 - DNA, 13 bp, Homo sapiens
tctgggacttcct

SEQ ID NO: 1238704 - DNA, 15 bp, Homo sapiens
tctgggacttccttg

SEQ ID NO: 1238705 - DNA, 16 bp, Homo sapiens
tctgggagagccagct

SEQ ID NO: 1238706 - DNA, 15 bp, Homo sapiens
tctgggagaggattt

SEQ ID NO: 1238707 - DNA, 16 bp, Homo sapiens
tctgggagccacgcct

SEQ ID NO: 1238708 - DNA, 17 bp, Homo sapiens
tctgggaggcaagaaaa

SEQ ID NO: 1238709 - DNA, 18 bp, Homo sapiens
tctgggaggcaagaaaag

SEQ ID NO: 1238710 - DNA, 20 bp, Homo sapiens
tctgggaggcaagaaaagga

SEQ ID NO: 1238711 - DNA, 11 bp, Homo sapiens
tctgggaggga

SEQ ID NO: 1238712 - DNA, 13 bp, Homo sapiens
tctgggagggcag

SEQ ID NO: 1238713 - DNA, 21 bp, Homo sapiens
tctgggagggcagcagggcta

SEQ ID NO: 1238714 - DNA, 16 bp, Homo sapiens
tctgggagtcacacag

SEQ ID NO: 1238715 - DNA, 23 bp, Homo sapiens
tctgggatatatggaggattctt

SEQ ID NO: 1238716 - DNA, 21 bp, Homo sapiens
tctgggatatggctgcccagg

SEQ ID NO: 1238717 - DNA, 15 bp, Homo sapiens
tctgggatggacagg

SEQ ID NO: 1238718 - DNA, 23 bp, Homo sapiens
tctgggatgtagaacttcaagaa

SEQ ID NO: 1238719 - DNA, 16 bp, Homo sapiens
tctgggattattcttt

SEQ ID NO: 1238720 - DNA, 15 bp, Homo sapiens
tctgggattctactt

SEQ ID NO: 1238721 - DNA, 20 bp, Homo sapiens
tctgggcaagtagcaggact

SEQ ID NO: 1238722 - DNA, 13 bp, Homo sapiens
tctgggcacagtg

SEQ ID NO: 1238723 - DNA, 14 bp, Homo sapiens
tctgggcacagtgc

SEQ ID NO: 1238724 - DNA, 18 bp, Homo sapiens
tctgggcacagtgctgcc

SEQ ID NO: 1238725 - DNA, 20 bp, Homo sapiens
tctgggcacagtgctgcccc

SEQ ID NO: 1238726 - DNA, 21 bp, Homo sapiens
tctgggcaccacaaaatatac

SEQ ID NO: 1238727 - DNA, 21 bp, Homo sapiens
tctgggcacgcctgctggccg

SEQ ID NO: 1238728 - DNA, 19 bp, Homo sapiens
tctgggcagagcctgtccc

SEQ ID NO: 1238729 - DNA, 18 bp, Homo sapiens
tctgggcagcacctctgg

SEQ ID NO: 1238730 - DNA, 13 bp, Homo sapiens
tctgggcagtgcc

SEQ ID NO: 1238731 - DNA, 21 bp, Homo sapiens
tctgggcagtgccacagcctg

SEQ ID NO: 1238732 - DNA, 17 bp, Homo sapiens
tctgggcattttcctcc

SEQ ID NO: 1238733 - DNA, 21 bp, Homo sapiens
tctgggcattttcctcctctg

SEQ ID NO: 1238734 - DNA, 22 bp, Homo sapiens
tctgggcattttcctcctctgc

SEQ ID NO: 1238735 - DNA, 12 bp, Homo sapiens
tctgggccaagt

SEQ ID NO: 1238736 - DNA, 16 bp, Homo sapiens
tctgggccaagttcct

SEQ ID NO: 1238737 - DNA, 12 bp, Homo sapiens
tctgggcctctg

SEQ ID NO: 1238738 - DNA, 14 bp, Homo sapiens
tctgggcctctgac

SEQ ID NO: 1238739 - DNA, 12 bp, Homo sapiens
tctgggcctctt

SEQ ID NO: 1238740 - DNA, 12 bp, Homo sapiens
tctgggcctgac

SEQ ID NO: 1238741 - DNA, 17 bp, Homo sapiens
tctgggcctgtgtgtgg

SEQ ID NO: 1238742 - DNA, 20 bp, Homo sapiens
tctgggcggcgggcggctgg

SEQ ID NO: 1238743 - DNA, 21 bp, Homo sapiens
tctgggcgtccagctcagccc

SEQ ID NO: 1238744 - DNA, 23 bp, Homo sapiens
tctgggctactgccactgtgtgc

SEQ ID NO: 1238745 - DNA, 16 bp, Homo sapiens
tctgggctatggacac

SEQ ID NO: 1238746 - DNA, 18 bp, Homo sapiens
tctgggctatggacacag

SEQ ID NO: 1238747 - DNA, 13 bp, Homo sapiens
tctgggctcaggg

SEQ ID NO: 1238748 - DNA, 18 bp, Homo sapiens
tctgggctcagggctgga

SEQ ID NO: 1238749 - DNA, 13 bp, Homo sapiens
tctgggctccaga

SEQ ID NO: 1238750 - DNA, 17 bp, Homo sapiens
tctgggctgctacccag

SEQ ID NO: 1238751 - DNA, 14 bp, Homo sapiens
tctgggctgtgggc

SEQ ID NO: 1238752 - DNA, 21 bp, Homo sapiens
tctgggcttatatctggcctc

SEQ ID NO: 1238753 - DNA, 19 bp, Homo sapiens
tctgggcttggggcttcct

SEQ ID NO: 1238754 - DNA, 17 bp, Homo sapiens
tctgggctttctcctgg

SEQ ID NO: 1238755 - DNA, 14 bp, Homo sapiens
tctggggaagtcag

SEQ ID NO: 1238756 - DNA, 21 bp, Homo sapiens
tctggggaattactttcctcc

SEQ ID NO: 1238757 - DNA, 11 bp, Homo sapiens
tctggggacag

SEQ ID NO: 1238758 - DNA, 17 bp, Homo sapiens
tctggggacagcttcct

SEQ ID NO: 1238759 - DNA, 13 bp, Homo sapiens
tctggggacaggc

SEQ ID NO: 1238760 - DNA, 13 bp, Homo sapiens
tctggggagctcc

SEQ ID NO: 1238761 - DNA, 15 bp, Homo sapiens
tctggggatgggtgg

SEQ ID NO: 1238762 - DNA, 16 bp, Homo sapiens
tctggggatgggtggg

SEQ ID NO: 1238763 - DNA, 17 bp, Homo sapiens
tctggggatgggtgggg

SEQ ID NO: 1238764 - DNA, 18 bp, Homo sapiens
tctggggatttctgggat

SEQ ID NO: 1238765 - DNA, 23 bp, Homo sapiens
tctggggcagcaccctataaatc

SEQ ID NO: 1238766 - DNA, 20 bp, Homo sapiens
tctggggcaggctgggccat

SEQ ID NO: 1238767 - DNA, 16 bp, Homo sapiens
tctggggctctgggat

SEQ ID NO: 1238768 - DNA, 16 bp, Homo sapiens
tctgggggacagagaa

SEQ ID NO: 1238769 - DNA, 17 bp, Homo sapiens
tctgggggacccaggtg

SEQ ID NO: 1238770 - DNA, 15 bp, Homo sapiens
tctgggggcagctgt

SEQ ID NO: 1238771 - DNA, 16 bp, Homo sapiens
tctgggggcagctgtc

SEQ ID NO: 1238772 - DNA, 19 bp, Homo sapiens
tctgggggcagctgtcctg

SEQ ID NO: 1238773 - DNA, 23 bp, Homo sapiens
tctggggggataatgtccccact

SEQ ID NO: 1238774 - DNA, 19 bp, Homo sapiens
tctggggggtggggaggag

SEQ ID NO: 1238775 - DNA, 13 bp, Homo sapiens
tctgggggtagga

SEQ ID NO: 1238776 - DNA, 13 bp, Homo sapiens
tctgggggtgagg

SEQ ID NO: 1238777 - DNA, 22 bp, Homo sapiens
tctggggtatgtgtgtgtgggt

SEQ ID NO: 1238778 - DNA, 16 bp, Homo sapiens
tctggggttcagcccc

SEQ ID NO: 1238779 - DNA, 19 bp, Homo sapiens
tctggggttcagcccctcc

SEQ ID NO: 1238780 - DNA, 22 bp, Homo sapiens
tctggggttcagcccctcctct

SEQ ID NO: 1238781 - DNA, 16 bp, Homo sapiens
tctgggtatctttcca

SEQ ID NO: 1238782 - DNA, 15 bp, Homo sapiens
tctgggtcagaacca

SEQ ID NO: 1238783 - DNA, 22 bp, Homo sapiens
tctggaaacctgtcattgtatt

SEQ ID NO: 1238784 - DNA, 15 bp, Homo sapiens
tctggaaactaccag

SEQ ID NO: 1238785 - DNA, 12 bp, Homo sapiens
tctggaaatctg

SEQ ID NO: 1238786 - DNA, 12 bp, Homo sapiens
tctggaaatttt

SEQ ID NO: 1238787 - DNA, 18 bp, Homo sapiens
tctggaaccccccaggcc

SEQ ID NO: 1238788 - DNA, 15 bp, Homo sapiens
tctggaacctgactt

SEQ ID NO: 1238789 - DNA, 18 bp, Homo sapiens
tctggaagacgtggctct

SEQ ID NO: 1238790 - DNA, 19 bp, Homo sapiens
tctggaagacgtggctctg

SEQ ID NO: 1238791 - DNA, 20 bp, Homo sapiens
tctggaagactgctcccggc

SEQ ID NO: 1238792 - DNA, 13 bp, Homo sapiens
tctgtcatctctc

SEQ ID NO: 1238793 - DNA, 16 bp, Homo sapiens
tctgtcatctctctgg

SEQ ID NO: 1238794 - DNA, 22 bp, Homo sapiens
tctgtcatctctctggggccct

SEQ ID NO: 1238795 - DNA, 22 bp, Homo sapiens
tctgtccaaaggaggctggcag

SEQ ID NO: 1238796 - DNA, 14 bp, Homo sapiens
tctgtccacatccc

SEQ ID NO: 1238797 - DNA, 18 bp, Homo sapiens
tctgtccacatccccaga

SEQ ID NO: 1238798 - DNA, 20 bp, Homo sapiens
tctgtccacatccccagagc

SEQ ID NO: 1238799 - DNA, 21 bp, Homo sapiens
tctgtccacatccccagagcc

SEQ ID NO: 1238800 - DNA, 23 bp, Homo sapiens
tctgtccacatccccagagccca

SEQ ID NO: 1238801 - DNA, 17 bp, Homo sapiens
tctgtccaccagaccca

SEQ ID NO: 1238802 - DNA, 19 bp, Homo sapiens
tctgtccagaggctgcaag

SEQ ID NO: 1238803 - DNA, 24 bp, Homo sapiens
tctgtccaggcactgctgcccagc

SEQ ID NO: 1238804 - DNA, 13 bp, Homo sapiens
tctgtccaggcca

SEQ ID NO: 1238805 - DNA, 21 bp, Homo sapiens
tctgtccaggccactgtggcc

SEQ ID NO: 1238806 - DNA, 23 bp, Homo sapiens
tctgtccaggccactgtggccag

SEQ ID NO: 1238807 - DNA, 13 bp, Homo sapiens
tctgtccagggcc

SEQ ID NO: 1238808 - DNA, 18 bp, Homo sapiens
tctgtccatcagtgcatg

SEQ ID NO: 1238809 - DNA, 12 bp, Homo sapiens
tgaggtgcctgc

SEQ ID NO: 1238810 - DNA, 16 bp, Homo sapiens
tgaggtgcctgctcag

SEQ ID NO: 1238811 - DNA, 21 bp, Homo sapiens
tgaggtgcctgctcaggtgct

SEQ ID NO: 1238812 - DNA, 22 bp, Homo sapiens
tgaggtgcctgctcaggtgcta

SEQ ID NO: 1238813 - DNA, 16 bp, Homo sapiens
tgaggtgcctgtccca

SEQ ID NO: 1238814 - DNA, 17 bp, Homo sapiens
tgaggtggcccaggccc

SEQ ID NO: 1238815 - DNA, 18 bp, Homo sapiens
tgaggtggcccaggcccc

SEQ ID NO: 1238816 - DNA, 21 bp, Homo sapiens
tgaggtggggaaggagggact

SEQ ID NO: 1238817 - DNA, 18 bp, Homo sapiens
tgaggtgggtctacctca

SEQ ID NO: 1238818 - DNA, 21 bp, Homo sapiens
tgaggtgggttttcttcccat

SEQ ID NO: 1238819 - DNA, 19 bp, Homo sapiens
tgaggtggtctgaatgttc

SEQ ID NO: 1238820 - DNA, 15 bp, Homo sapiens
tgaggtgtccaactg

SEQ ID NO: 1238821 - DNA, 18 bp, Homo sapiens
tgaggtgtcttaagcctt

SEQ ID NO: 1238822 - DNA, 23 bp, Homo sapiens
tgaggtgtgggggctgcagcatg

SEQ ID NO: 1238823 - DNA, 15 bp, Homo sapiens
tgaggtgtgtcacaa

SEQ ID NO: 1238824 - DNA, 18 bp, Homo sapiens
tgaggttcctctgcctgc

SEQ ID NO: 1238825 - DNA, 20 bp, Homo sapiens
tgaggttcctctgcctgccc

SEQ ID NO: 1238826 - DNA, 21 bp, Homo sapiens
tgaggttcctctgcctgcccc

SEQ ID NO: 1238827 - DNA, 19 bp, Homo sapiens
tgaggttgacctgtttctc

SEQ ID NO: 1238828 - DNA, 15 bp, Homo sapiens
tgaggttgcttacta

SEQ ID NO: 1238829 - DNA, 15 bp, Homo sapiens
tgaggttggatttgc

SEQ ID NO: 1238830 - DNA, 19 bp, Homo sapiens
tgaggtttcaaacctccct

SEQ ID NO: 1238831 - DNA, 15 bp, Homo sapiens
tgaggtttcaccctt

SEQ ID NO: 1238832 - DNA, 22 bp, Homo sapiens
tgaggttttatttcatttttca

SEQ ID NO: 1238833 - DNA, 22 bp, Homo sapiens
tgaggttttgaataaaaagtga

SEQ ID NO: 1238834 - DNA, 16 bp, Homo sapiens
tgaggtttttaaatat

SEQ ID NO: 1238835 - DNA, 17 bp, Homo sapiens
tgagtaaactgaggccc

SEQ ID NO: 1238836 - DNA, 17 bp, Homo sapiens
tgagtaacatttgctgt

SEQ ID NO: 1238837 - DNA, 19 bp, Homo sapiens
tgagtaacatttgctgttt

SEQ ID NO: 1238838 - DNA, 13 bp, Homo sapiens
tgagtaagagctg

SEQ ID NO: 1238839 - DNA, 16 bp, Homo sapiens
tgagtaagagctggtg

SEQ ID NO: 1238840 - DNA, 15 bp, Homo sapiens
tgatactaataaact

SEQ ID NO: 1238841 - DNA, 16 bp, Homo sapiens
tgatactaataaacta

SEQ ID NO: 1238842 - DNA, 21 bp, Homo sapiens
tgatactatcatactactgaa

SEQ ID NO: 1238843 - DNA, 18 bp, Homo sapiens
tgatactggaggaacact

SEQ ID NO: 1238844 - DNA, 16 bp, Homo sapiens
tgatactgtttcttgc

SEQ ID NO: 1238845 - DNA, 18 bp, Homo sapiens
tgatactgtttcttgcac

SEQ ID NO: 1238846 - DNA, 21 bp, Homo sapiens
tgatactgtttcttgcactga

SEQ ID NO: 1238847 - DNA, 23 bp, Homo sapiens
tgatacttcaggtgcttttgatg

SEQ ID NO: 1238848 - DNA, 15 bp, Homo sapiens
tgatacttttaagag

SEQ ID NO: 1238849 - DNA, 22 bp, Homo sapiens
tgatagacacatatgaggggga

SEQ ID NO: 1238850 - DNA, 18 bp, Homo sapiens
tgatagatcctttaaaaa

SEQ ID NO: 1238851 - DNA, 23 bp, Homo sapiens
tgatagcaagtgaatttttctct

SEQ ID NO: 1238852 - DNA, 15 bp, Homo sapiens
tgatagcactttcta

SEQ ID NO: 1238853 - DNA, 21 bp, Homo sapiens
tgatagcactttctacaatgt

SEQ ID NO: 1238854 - DNA, 19 bp, Homo sapiens
tgatagcatggggcccctg

SEQ ID NO: 1238855 - DNA, 23 bp, Homo sapiens
tgatagcccagaacaaaaagaaa

SEQ ID NO: 1238856 - DNA, 16 bp, Homo sapiens
tgatagctaacatttt

SEQ ID NO: 1238857 - DNA, 21 bp, Homo sapiens
tgatagctgtttcaaatgtgc

SEQ ID NO: 1238858 - DNA, 18 bp, Homo sapiens
tgataggaactgtctcaa

SEQ ID NO: 1238859 - DNA, 21 bp, Homo sapiens
tgataggaagcgtctggcaga

SEQ ID NO: 1238860 - DNA, 22 bp, Homo sapiens
tgataggttattttgatgtaaa

SEQ ID NO: 1238861 - DNA, 22 bp, Homo sapiens
tgatagtccaatttttactcag

SEQ ID NO: 1238862 - DNA, 16 bp, Homo sapiens
tgatagtcctttttcc

SEQ ID NO: 1238863 - DNA, 22 bp, Homo sapiens
tgatataaaggaccctgtttct

SEQ ID NO: 1238864 - DNA, 23 bp, Homo sapiens
tgatataatcttggcttcttaaa

SEQ ID NO: 1238865 - DNA, 13 bp, Homo sapiens
tgatatacacagt

SEQ ID NO: 1238866 - DNA, 23 bp, Homo sapiens
tgatatactccaggacttagaat

SEQ ID NO: 1238867 - DNA, 22 bp, Homo sapiens
tgatatacttttttcttattta

SEQ ID NO: 1238868 - DNA, 18 bp, Homo sapiens
tgatatagtcagctgcct

SEQ ID NO: 1238869 - DNA, 13 bp, Homo sapiens
tgatatcacctct

SEQ ID NO: 1238870 - DNA, 17 bp, Homo sapiens
tgatatcattcagcatc

SEQ ID NO: 1238871 - DNA, 16 bp, Homo sapiens
tgatatcccccagcct

SEQ ID NO: 1238872 - DNA, 15 bp, Homo sapiens
tgatatcgtgaaatc

SEQ ID NO: 1238873 - DNA, 16 bp, Homo sapiens
tgatatcgtgaaatcc

SEQ ID NO: 1238874 - DNA, 19 bp, Homo sapiens
tgatatctcaatctgcagc

SEQ ID NO: 1238875 - DNA, 14 bp, Homo sapiens
tgatatgatccaga

SEQ ID NO: 1238876 - DNA, 19 bp, Homo sapiens
tgatatgcatatttgttta

SEQ ID NO: 1238877 - DNA, 15 bp, Homo sapiens
tgatatgtaaacata

SEQ ID NO: 1238878 - DNA, 20 bp, Homo sapiens
tgatatgtaagtacttccac

SEQ ID NO: 1238879 - DNA, 16 bp, Homo sapiens
tgatatgttttatttc

SEQ ID NO: 1238880 - DNA, 17 bp, Homo sapiens
tgatattaaatttcaaa

SEQ ID NO: 1238881 - DNA, 20 bp, Homo sapiens
tgatattaaatttcaaatgc

SEQ ID NO: 1238882 - DNA, 15 bp, Homo sapiens
tgatattaatcaaaa

SEQ ID NO: 1238883 - DNA, 14 bp, Homo sapiens
tgatattatttctt

SEQ ID NO: 1238884 - DNA, 24 bp, Homo sapiens
tgatattatttcttctcttatcct

SEQ ID NO: 1238885 - DNA, 20 bp, Homo sapiens
tgatattcaaatggacaaac

SEQ ID NO: 1238886 - DNA, 16 bp, Homo sapiens
tgatattctgttgctt

SEQ ID NO: 1238887 - DNA, 17 bp, Homo sapiens
tgatattctttaaacaa

SEQ ID NO: 1238888 - DNA, 15 bp, Homo sapiens
tgatattgttctcca

SEQ ID NO: 1238889 - DNA, 14 bp, Homo sapiens
tgatattgtttaaa

SEQ ID NO: 1238890 - DNA, 16 bp, Homo sapiens
tgatattgtttaaaat

SEQ ID NO: 1238891 - DNA, 18 bp, Homo sapiens
tgatattgtttaaaattc

SEQ ID NO: 1238892 - DNA, 16 bp, Homo sapiens
tgatattgtttgctgt

SEQ ID NO: 1238893 - DNA, 16 bp, Homo sapiens
tgatatttatttcctg

SEQ ID NO: 1238894 - DNA, 19 bp, Homo sapiens
tgatatttatttcctgcta

SEQ ID NO: 1238895 - DNA, 15 bp, Homo sapiens
tgatatttcttgctt

SEQ ID NO: 1238896 - DNA, 22 bp, Homo sapiens
tgatattttcaacgcagccctg

SEQ ID NO: 1238897 - DNA, 17 bp, Homo sapiens
tgatatttttatgtgca

SEQ ID NO: 1238898 - DNA, 20 bp, Homo sapiens
tgatatttttatgtgcagcg

SEQ ID NO: 1238899 - DNA, 18 bp, Homo sapiens
tgatatttttccatttat

SEQ ID NO: 1238900 - DNA, 18 bp, Homo sapiens
tgatcaaaacctgtgcca

SEQ ID NO: 1238901 - DNA, 18 bp, Homo sapiens
tgatcaaagccacactct

SEQ ID NO: 1238902 - DNA, 15 bp, Homo sapiens
tgatcaagaatgcaa

SEQ ID NO: 1238903 - DNA, 16 bp, Homo sapiens
tgatcaataaaatgtg

SEQ ID NO: 1238904 - DNA, 19 bp, Homo sapiens
tgatcaataaaatgtgatt

SEQ ID NO: 1238905 - DNA, 16 bp, Homo sapiens
tgatcaatatttttat

SEQ ID NO: 1238906 - DNA, 21 bp, Homo sapiens
tgatcaatatttttatatcat

SEQ ID NO: 1238907 - DNA, 14 bp, Homo sapiens
tgatcaattaaatg

SEQ ID NO: 1238908 - DNA, 15 bp, Homo sapiens
tgatcacactctggg

SEQ ID NO: 1238909 - DNA, 20 bp, Homo sapiens
tgatcacatctaaagcttta

SEQ ID NO: 1238910 - DNA, 17 bp, Homo sapiens
tgatcacctcttgggga

SEQ ID NO: 1238911 - DNA, 14 bp, Homo sapiens
tgatcacgcctggc

SEQ ID NO: 1238912 - DNA, 22 bp, Homo sapiens
tgatcagaagaacatgatttta

SEQ ID NO: 1238913 - DNA, 23 bp, Homo sapiens
tgatcagaagactttaattatat

SEQ ID NO: 1238914 - DNA, 17 bp, Homo sapiens
tgatcagacatacagct

SEQ ID NO: 1238915 - DNA, 21 bp, Homo sapiens
tgatcagacatacagctgcct

SEQ ID NO: 1238916 - DNA, 18 bp, Homo sapiens
tgatcagaccataatgtt

SEQ ID NO: 1238917 - DNA, 22 bp, Homo sapiens
tgatcagagccgtggtcctttg

SEQ ID NO: 1238918 - DNA, 17 bp, Homo sapiens
tgatcagatgctgaatt

SEQ ID NO: 1238919 - DNA, 14 bp, Homo sapiens
tgatcagcattgtg

SEQ ID NO: 1238920 - DNA, 17 bp, Homo sapiens
tgatcagcattgtgact

SEQ ID NO: 1238921 - DNA, 17 bp, Homo sapiens
tgatcagggatccaata

SEQ ID NO: 1238922 - DNA, 18 bp, Homo sapiens
tgatcagtgttgttgctc

SEQ ID NO: 1238923 - DNA, 17 bp, Homo sapiens
tgatcatccctttctcc

SEQ ID NO: 1238924 - DNA, 20 bp, Homo sapiens
tgatcatcgccagaggtgct

SEQ ID NO: 1238925 - DNA, 19 bp, Homo sapiens
tgatcatgtactttttagt

SEQ ID NO: 1238926 - DNA, 16 bp, Homo sapiens
tgatcattttcccccc

SEQ ID NO: 1238927 - DNA, 13 bp, Homo sapiens
tgatccaactaat

SEQ ID NO: 1238928 - DNA, 16 bp, Homo sapiens
tgatccacccaaccct

SEQ ID NO: 1238929 - DNA, 12 bp, Homo sapiens
tgatccagaaga

SEQ ID NO: 1238930 - DNA, 22 bp, Homo sapiens
tgatccagaagagcccatatca

SEQ ID NO: 1238931 - DNA, 12 bp, Homo sapiens
tgatccagcctt

SEQ ID NO: 1238932 - DNA, 14 bp, Homo sapiens
tgatccagcctttc

SEQ ID NO: 1238933 - DNA, 19 bp, Homo sapiens
tgatccagcctttccaagt

SEQ ID NO: 1238934 - DNA, 14 bp, Homo sapiens
tgatccatccatct

SEQ ID NO: 1238935 - DNA, 18 bp, Homo sapiens
tgatccatccatctccag

SEQ ID NO: 1238936 - DNA, 14 bp, Homo sapiens
tgatcccaccccct

SEQ ID NO: 1238937 - DNA, 12 bp, Homo sapiens
tgatcccagcac

SEQ ID NO: 1238938 - DNA, 20 bp, Homo sapiens
tgatccctgtgttgtctcta

SEQ ID NO: 1238939 - DNA, 18 bp, Homo sapiens
tgatcccttctcctgccc

SEQ ID NO: 1238940 - DNA, 19 bp, Homo sapiens
tgatcccttgagatatgga

SEQ ID NO: 1238941 - DNA, 19 bp, Homo sapiens
tgatccgcccacctcagcc

SEQ ID NO: 1238942 - DNA, 22 bp, Homo sapiens
tgatccgcccacctcagcctcc

SEQ ID NO: 1238943 - DNA, 19 bp, Homo sapiens
tgatccgcctacctcagcc

SEQ ID NO: 1238944 - DNA, 15 bp, Homo sapiens
tgatccggtttcttt

SEQ ID NO: 1238945 - DNA, 18 bp, Homo sapiens
tgatcctcatatggccca

SEQ ID NO: 1238946 - DNA, 15 bp, Homo sapiens
tgatcctccaatgtc

SEQ ID NO: 1238947 - DNA, 17 bp, Homo sapiens
tgatcctccaatgtcta

SEQ ID NO: 1238948 - DNA, 14 bp, Homo sapiens
tgatcctctatttt

SEQ ID NO: 1238949 - DNA, 18 bp, Homo sapiens
tgatccttccacctcagt

SEQ ID NO: 1238950 - DNA, 16 bp, Homo sapiens
tgatccttcccctctt

SEQ ID NO: 1238951 - DNA, 22 bp, Homo sapiens
tgatccttctgagctccacctc

SEQ ID NO: 1238952 - DNA, 12 bp, Homo sapiens
tgatccttggaa

SEQ ID NO: 1238953 - DNA, 14 bp, Homo sapiens
tgatccttggaaac

SEQ ID NO: 1238954 - DNA, 17 bp, Homo sapiens
tgatcgaaaaaataatt

SEQ ID NO: 1238955 - DNA, 18 bp, Homo sapiens
tgatcgcccgataaagac

SEQ ID NO: 1238956 - DNA, 15 bp, Homo sapiens
tgatcgcctttccca

SEQ ID NO: 1238957 - DNA, 17 bp, Homo sapiens
tgatcgcctttcccagg

SEQ ID NO: 1238958 - DNA, 20 bp, Homo sapiens
tgatcgtctcggcccctctg

SEQ ID NO: 1238959 - DNA, 21 bp, Homo sapiens
tgatcgtctcggcccctctga

SEQ ID NO: 1238960 - DNA, 14 bp, Homo sapiens
tgatctacccgtgc

SEQ ID NO: 1238961 - DNA, 16 bp, Homo sapiens
tgatggtcagctccct

SEQ ID NO: 1238962 - DNA, 16 bp, Homo sapiens
tgatggtgacaggtgt

SEQ ID NO: 1238963 - DNA, 14 bp, Homo sapiens
tgatggtgagctgg

SEQ ID NO: 1238964 - DNA, 19 bp, Homo sapiens
tgatggtgtccttccctgc

SEQ ID NO: 1238965 - DNA, 16 bp, Homo sapiens
tgatggtgttaaagct

SEQ ID NO: 1238966 - DNA, 18 bp, Homo sapiens
tgatggtgttaaagctgt

SEQ ID NO: 1238967 - DNA, 19 bp, Homo sapiens
tgatggtgttaaagctgta

SEQ ID NO: 1238968 - DNA, 19 bp, Homo sapiens
tgatggttcttcacctcct

SEQ ID NO: 1238969 - DNA, 20 bp, Homo sapiens
tgatggttttttttttcttt

SEQ ID NO: 1238970 - DNA, 13 bp, Homo sapiens
tgatgtaaaaatg

SEQ ID NO: 1238971 - DNA, 13 bp, Homo sapiens
tgatgtaaatagt

SEQ ID NO: 1238972 - DNA, 18 bp, Homo sapiens
tgatgtaaatagtgattt

SEQ ID NO: 1238973 - DNA, 14 bp, Homo sapiens
tgatgtaaggactg

SEQ ID NO: 1238974 - DNA, 15 bp, Homo sapiens
tgatgtaaggactgt

SEQ ID NO: 1238975 - DNA, 20 bp, Homo sapiens
tgatgtaaggactgtaaaca

SEQ ID NO: 1238976 - DNA, 17 bp, Homo sapiens
tgatgtacagtctgtca

SEQ ID NO: 1238977 - DNA, 18 bp, Homo sapiens
tgatgtacagtctgtcat

SEQ ID NO: 1238978 - DNA, 14 bp, Homo sapiens
tgatgtacatgtgt

SEQ ID NO: 1238979 - DNA, 15 bp, Homo sapiens
tgatgtacctgatgc

SEQ ID NO: 1238980 - DNA, 20 bp, Homo sapiens
tgatgtagaaaagagacttc

SEQ ID NO: 1238981 - DNA, 20 bp, Homo sapiens
tgatgtagggtaaggtgcct

SEQ ID NO: 1238982 - DNA, 17 bp, Homo sapiens
tgatgtagtgcctcttt

SEQ ID NO: 1238983 - DNA, 12 bp, Homo sapiens
tgatgtatattt

SEQ ID NO: 1238984 - DNA, 22 bp, Homo sapiens
tgatgtatatttaattaaagca

SEQ ID NO: 1238985 - DNA, 14 bp, Homo sapiens
tgatgtatgtgtga

SEQ ID NO: 1238986 - DNA, 15 bp, Homo sapiens
tgatgtattacatga

SEQ ID NO: 1238987 - DNA, 19 bp, Homo sapiens
tgatgtattacatgactgt

SEQ ID NO: 1238988 - DNA, 15 bp, Homo sapiens
tgatgtcatgaaact

SEQ ID NO: 1238989 - DNA, 15 bp, Homo sapiens
tgatgtcatgtactt

SEQ ID NO: 1238990 - DNA, 22 bp, Homo sapiens
tgatgtcatgtacttcctgtgt

SEQ ID NO: 1238991 - DNA, 17 bp, Homo sapiens
tgatgtccttggactcc

SEQ ID NO: 1238992 - DNA, 16 bp, Homo sapiens
tgatgtctacagaaaa

SEQ ID NO: 1238993 - DNA, 17 bp, Homo sapiens
tgatgtctcttgtagaa

SEQ ID NO: 1238994 - DNA, 12 bp, Homo sapiens
tgatgtctggtc

SEQ ID NO: 1238995 - DNA, 22 bp, Homo sapiens
tgatgtgaagccaattcagaca

SEQ ID NO: 1238996 - DNA, 13 bp, Homo sapiens
tgatgtgactttt

SEQ ID NO: 1238997 - DNA, 16 bp, Homo sapiens
tgatgtgatattctgt

SEQ ID NO: 1238998 - DNA, 14 bp, Homo sapiens
tgatgtggaggaag

SEQ ID NO: 1238999 - DNA, 15 bp, Homo sapiens
tgatgtggaggaaga

SEQ ID NO: 1239000 - DNA, 16 bp, Homo sapiens
tgatgtggaggaagag

SEQ ID NO: 1239001 - DNA, 22 bp, Homo sapiens
tgatgtggaggaagagccacct

SEQ ID NO: 1239002 - DNA, 23 bp, Homo sapiens
tgatgtggaggaagagccacctg

SEQ ID NO: 1239003 - DNA, 16 bp, Homo sapiens
tgatgtggtgcctgag

SEQ ID NO: 1239004 - DNA, 16 bp, Homo sapiens
tgatgttaaaattcca

SEQ ID NO: 1239005 - DNA, 17 bp, Homo sapiens
tgatgttaaaattccat

SEQ ID NO: 1239006 - DNA, 20 bp, Homo sapiens
tgatgttaactttgtggtct

SEQ ID NO: 1239007 - DNA, 18 bp, Homo sapiens
tgatgttactgagatgtt

SEQ ID NO: 1239008 - DNA, 16 bp, Homo sapiens
tgatgttagcagaccc

SEQ ID NO: 1239009 - DNA, 17 bp, Homo sapiens
tgatgttcagagtggct

SEQ ID NO: 1239010 - DNA, 21 bp, Homo sapiens
tgatgttcagagtggctcact

SEQ ID NO: 1239011 - DNA, 18 bp, Homo sapiens
tgatgttccacctgccac

SEQ ID NO: 1239012 - DNA, 19 bp, Homo sapiens
tgatgttgaaatatgcata

SEQ ID NO: 1239013 - DNA, 15 bp, Homo sapiens
tgatgtttgcccaaa

SEQ ID NO: 1239014 - DNA, 13 bp, Homo sapiens
tgatgtttgtcct

SEQ ID NO: 1239015 - DNA, 18 bp, Homo sapiens
tgatgttttaaggatgct

SEQ ID NO: 1239016 - DNA, 21 bp, Homo sapiens
tgatgttttaaggatgcttgt

SEQ ID NO: 1239017 - DNA, 16 bp, Homo sapiens
tgatgttttgttcaaa

SEQ ID NO: 1239018 - DNA, 15 bp, Homo sapiens
tgattaaaatctctt

SEQ ID NO: 1239019 - DNA, 23 bp, Homo sapiens
tgattaaaatgcttcctcccagc

SEQ ID NO: 1239020 - DNA, 20 bp, Homo sapiens
tgattaaacgtgcagactat

SEQ ID NO: 1239021 - DNA, 17 bp, Homo sapiens
tgattaaattcttgcaa

SEQ ID NO: 1239022 - DNA, 19 bp, Homo sapiens
tgattaaattcttgcaaag

SEQ ID NO: 1239023 - DNA, 20 bp, Homo sapiens
tgattaaattcttgcaaagt

SEQ ID NO: 1239024 - DNA, 17 bp, Homo sapiens
tgattaacatctacaat

SEQ ID NO: 1239025 - DNA, 19 bp, Homo sapiens
tgattaaccacttcagctg

SEQ ID NO: 1239026 - DNA, 21 bp, Homo sapiens
tgattaactgtgaataataaa

SEQ ID NO: 1239027 - DNA, 11 bp, Homo sapiens
tgattaatcaa

SEQ ID NO: 1239028 - DNA, 13 bp, Homo sapiens
tgattaatcaaag

SEQ ID NO: 1239029 - DNA, 14 bp, Homo sapiens
tgattaatcaaagg

SEQ ID NO: 1239030 - DNA, 18 bp, Homo sapiens
tgattaatgttttcatta

SEQ ID NO: 1239031 - DNA, 18 bp, Homo sapiens
tgattgcagccttgacct

SEQ ID NO: 1239032 - DNA, 12 bp, Homo sapiens
tgattgcagctt

SEQ ID NO: 1239033 - DNA, 13 bp, Homo sapiens
tgattgctgccat

SEQ ID NO: 1239034 - DNA, 13 bp, Homo sapiens
tgattgctttgct

SEQ ID NO: 1239035 - DNA, 19 bp, Homo sapiens
tgattggaatagcttctgg

SEQ ID NO: 1239036 - DNA, 22 bp, Homo sapiens
tgattggacaggcatgggtgca

SEQ ID NO: 1239037 - DNA, 17 bp, Homo sapiens
tgattggattattcatt

SEQ ID NO: 1239038 - DNA, 18 bp, Homo sapiens
tgattggattattcattt

SEQ ID NO: 1239039 - DNA, 19 bp, Homo sapiens
tgattggattattcattta

SEQ ID NO: 1239040 - DNA, 16 bp, Homo sapiens
tgattgggtgggattt

SEQ ID NO: 1239041 - DNA, 23 bp, Homo sapiens
tgattgggtgggattttttccct

SEQ ID NO: 1239042 - DNA, 14 bp, Homo sapiens
tgattgtaaaatag

SEQ ID NO: 1239043 - DNA, 17 bp, Homo sapiens
tgattgtaaaatagctt

SEQ ID NO: 1239044 - DNA, 14 bp, Homo sapiens
tgattgtcttaata

SEQ ID NO: 1239045 - DNA, 22 bp, Homo sapiens
tgattgtgttgaagaagggtta

SEQ ID NO: 1239046 - DNA, 15 bp, Homo sapiens
tgattgtgttttcct

SEQ ID NO: 1239047 - DNA, 14 bp, Homo sapiens
tgattgtttacagt

SEQ ID NO: 1239048 - DNA, 15 bp, Homo sapiens
tgatttaaaaacaac

SEQ ID NO: 1239049 - DNA, 15 bp, Homo sapiens
tgatttaaaaacttg

SEQ ID NO: 1239050 - DNA, 12 bp, Homo sapiens
tgatttaaaatt

SEQ ID NO: 1239051 - DNA, 13 bp, Homo sapiens
tgatttaacactt

SEQ ID NO: 1239052 - DNA, 14 bp, Homo sapiens
tgatttaatgtttt

SEQ ID NO: 1239053 - DNA, 22 bp, Homo sapiens
tgatttaatgttttctgctgtt

SEQ ID NO: 1239054 - DNA, 22 bp, Homo sapiens
tgatttagtaatagtccaatat

SEQ ID NO: 1239055 - DNA, 21 bp, Homo sapiens
tgatttatatatggcatattt

SEQ ID NO: 1239056 - DNA, 23 bp, Homo sapiens
tgatttatatatggcatatttat

SEQ ID NO: 1239057 - DNA, 11 bp, Homo sapiens
tgatttcagaa

SEQ ID NO: 1239058 - DNA, 18 bp, Homo sapiens
tgatttcagtttttcatt

SEQ ID NO: 1239059 - DNA, 20 bp, Homo sapiens
tgatttcagtttttcatttg

SEQ ID NO: 1239060 - DNA, 15 bp, Homo sapiens
tgatttcataattca

SEQ ID NO: 1239061 - DNA, 15 bp, Homo sapiens
tgatttcattaatac

SEQ ID NO: 1239062 - DNA, 19 bp, Homo sapiens
tgatttcattacatttctg

SEQ ID NO: 1239063 - DNA, 13 bp, Homo sapiens
tgatttcatttca

SEQ ID NO: 1239064 - DNA, 12 bp, Homo sapiens
tgatttccaggc

SEQ ID NO: 1239065 - DNA, 13 bp, Homo sapiens
tgatttccaggcc

SEQ ID NO: 1239066 - DNA, 20 bp, Homo sapiens
tgatttccagtgagtgtaaa

SEQ ID NO: 1239067 - DNA, 22 bp, Homo sapiens
tgatttccatttctgatgtctc

SEQ ID NO: 1239068 - DNA, 20 bp, Homo sapiens
tgatttcctaaacataattg

SEQ ID NO: 1239069 - DNA, 15 bp, Homo sapiens
tgatttcctctaaag

SEQ ID NO: 1239070 - DNA, 15 bp, Homo sapiens
tgatttccttcaatg

SEQ ID NO: 1239071 - DNA, 16 bp, Homo sapiens
tgatttccttgaatgt

SEQ ID NO: 1239072 - DNA, 23 bp, Homo sapiens
tgatttccttgaatgtggcttga

SEQ ID NO: 1239073 - DNA, 11 bp, Homo sapiens
tgatttctagg

SEQ ID NO: 1239074 - DNA, 21 bp, Homo sapiens
tgatttctctgaacagaaaac

SEQ ID NO: 1239075 - DNA, 22 bp, Homo sapiens
tgatttctgcccttgttccagc

SEQ ID NO: 1239076 - DNA, 16 bp, Homo sapiens
tgatttcttcagaatt

SEQ ID NO: 1239077 - DNA, 16 bp, Homo sapiens
tgatttcttctcatta

SEQ ID NO: 1239078 - DNA, 16 bp, Homo sapiens
tgatttcttctccctc

SEQ ID NO: 1239079 - DNA, 18 bp, Homo sapiens
tgatttctttaaaagaat

SEQ ID NO: 1239080 - DNA, 16 bp, Homo sapiens
tgatttctttccagag

SEQ ID NO: 1239081 - DNA, 13 bp, Homo sapiens
tgatttgaattct

SEQ ID NO: 1239082 - DNA, 15 bp, Homo sapiens
tgatttgatgtgact

SEQ ID NO: 1239083 - DNA, 16 bp, Homo sapiens
tgatttgcatggattt

SEQ ID NO: 1239084 - DNA, 17 bp, Homo sapiens
tgatttgcatggatttt

SEQ ID NO: 1239085 - DNA, 15 bp, Homo sapiens
tgatttgcattgaac

SEQ ID NO: 1239086 - DNA, 20 bp, Homo sapiens
tgatttgctctttgacaact

SEQ ID NO: 1239087 - DNA, 20 bp, Homo sapiens
tgatttgggctgaatgtatg

SEQ ID NO: 1239088 - DNA, 15 bp, Homo sapiens
tgatttgtaccattc

SEQ ID NO: 1239089 - DNA, 12 bp, Homo sapiens
tgatttgtcctg

SEQ ID NO: 1239090 - DNA, 14 bp, Homo sapiens
tgatttgtcctgca

SEQ ID NO: 1239091 - DNA, 15 bp, Homo sapiens
tgatttgtggaaatg

SEQ ID NO: 1239092 - DNA, 15 bp, Homo sapiens
tgatttgttcttaca

SEQ ID NO: 1239093 - DNA, 23 bp, Homo sapiens
tgcaaacctgacccctgctcagt

SEQ ID NO: 1239094 - DNA, 17 bp, Homo sapiens
tgcaaaccttcctggga

SEQ ID NO: 1239095 - DNA, 17 bp, Homo sapiens
tgcaaactgctttattt

SEQ ID NO: 1239096 - DNA, 21 bp, Homo sapiens
tgcaaactgctttattttccc

SEQ ID NO: 1239097 - DNA, 12 bp, Homo sapiens
tgcaaagaaaat

SEQ ID NO: 1239098 - DNA, 16 bp, Homo sapiens
tgcaaagaaagaaaaa

SEQ ID NO: 1239099 - DNA, 22 bp, Homo sapiens
tgcaaagaaagaaaaaaaacca

SEQ ID NO: 1239100 - DNA, 16 bp, Homo sapiens
tgcaaagaccacctcc

SEQ ID NO: 1239101 - DNA, 13 bp, Homo sapiens
tgcaaagactctg

SEQ ID NO: 1239102 - DNA, 16 bp, Homo sapiens
tgcaaagactctgagc

SEQ ID NO: 1239103 - DNA, 13 bp, Homo sapiens
tgcaaagagaaac

SEQ ID NO: 1239104 - DNA, 15 bp, Homo sapiens
tgcaaagagaaaccg

SEQ ID NO: 1239105 - DNA, 14 bp, Homo sapiens
tgcaaagcccagct

SEQ ID NO: 1239106 - DNA, 17 bp, Homo sapiens
tgcaaagcccagcttga

SEQ ID NO: 1239107 - DNA, 17 bp, Homo sapiens
tgcaaagcgacagattc

SEQ ID NO: 1239108 - DNA, 12 bp, Homo sapiens
tgcaaagctttg

SEQ ID NO: 1239109 - DNA, 15 bp, Homo sapiens
tgcaaagtattgtaa

SEQ ID NO: 1239110 - DNA, 17 bp, Homo sapiens
tgcaaagtattgtaaat

SEQ ID NO: 1239111 - DNA, 13 bp, Homo sapiens
tgcaaataaagcc

SEQ ID NO: 1239112 - DNA, 15 bp, Homo sapiens
tgcaaatagaaaaca

SEQ ID NO: 1239113 - DNA, 18 bp, Homo sapiens
tgcaaatattagcaaaga

SEQ ID NO: 1239114 - DNA, 23 bp, Homo sapiens
tgcaaatattagcaaagaagctt

SEQ ID NO: 1239115 - DNA, 19 bp, Homo sapiens
tgcaaatattggttagtat

SEQ ID NO: 1239116 - DNA, 22 bp, Homo sapiens
tgcaaatattggttagtattta

SEQ ID NO: 1239117 - DNA, 14 bp, Homo sapiens
tgcaaatctgatgg

SEQ ID NO: 1239118 - DNA, 13 bp, Homo sapiens
tgcaaatgaatca

SEQ ID NO: 1239119 - DNA, 14 bp, Homo sapiens
tgcaaatgaatcat

SEQ ID NO: 1239120 - DNA, 15 bp, Homo sapiens
tgcaaattaaaacat

SEQ ID NO: 1239121 - DNA, 22 bp, Homo sapiens
tgcaaattaaaacatatttcat

SEQ ID NO: 1239122 - DNA, 14 bp, Homo sapiens
tgcaaattaacagt

SEQ ID NO: 1239123 - DNA, 15 bp, Homo sapiens
tgcaaattatttatt

SEQ ID NO: 1239124 - DNA, 13 bp, Homo sapiens
tgcaaattcagaa

SEQ ID NO: 1239125 - DNA, 19 bp, Homo sapiens
tgcaaatttctataaattt

SEQ ID NO: 1239126 - DNA, 22 bp, Homo sapiens
tgcaaatttctataaatttaag

SEQ ID NO: 1239127 - DNA, 17 bp, Homo sapiens
tgcaacaaaatgtagaa

SEQ ID NO: 1239128 - DNA, 12 bp, Homo sapiens
tgcaacactgga

SEQ ID NO: 1239129 - DNA, 13 bp, Homo sapiens
tgcaacatttatt

SEQ ID NO: 1239130 - DNA, 21 bp, Homo sapiens
tgcaacatttctgtatactgt

SEQ ID NO: 1239131 - DNA, 20 bp, Homo sapiens
tgcaaccagaattgtcctca

SEQ ID NO: 1239132 - DNA, 12 bp, Homo sapiens
tgcaaccaggaa

SEQ ID NO: 1239133 - DNA, 17 bp, Homo sapiens
tgcaaccaggaacagca

SEQ ID NO: 1239134 - DNA, 17 bp, Homo sapiens
tgcaaccaggcagctga

SEQ ID NO: 1239135 - DNA, 18 bp, Homo sapiens
tgcaaccaggcagctgag

SEQ ID NO: 1239136 - DNA, 18 bp, Homo sapiens
tgcaaccataagacaaac

SEQ ID NO: 1239137 - DNA, 13 bp, Homo sapiens
tgcaacctcacct

SEQ ID NO: 1239138 - DNA, 18 bp, Homo sapiens
tgcaacctcaccttcctg

SEQ ID NO: 1239139 - DNA, 21 bp, Homo sapiens
tgcaacctctacctcctgggt

SEQ ID NO: 1239140 - DNA, 21 bp, Homo sapiens
tgcaacctctgcctcccaggt

SEQ ID NO: 1239141 - DNA, 23 bp, Homo sapiens
tgcaacctgtggctcaggggagc

SEQ ID NO: 1239142 - DNA, 14 bp, Homo sapiens
tgcaacctgttgat

SEQ ID NO: 1239143 - DNA, 19 bp, Homo sapiens
tgcaactaactgactctgt

SEQ ID NO: 1239144 - DNA, 23 bp, Homo sapiens
tgcaactaactgactctgttatt

SEQ ID NO: 1239145 - DNA, 18 bp, Homo sapiens
tgcaactaaggacaaatt

SEQ ID NO: 1239146 - DNA, 19 bp, Homo sapiens
tgcaactaaggacaaatta

SEQ ID NO: 1239147 - DNA, 20 bp, Homo sapiens
tgcaactaaggacaaattag

SEQ ID NO: 1239148 - DNA, 21 bp, Homo sapiens
tgcaactaaggacaaattagc

SEQ ID NO: 1239149 - DNA, 16 bp, Homo sapiens
tgcaactcaaggactt

SEQ ID NO: 1239150 - DNA, 17 bp, Homo sapiens
tgcaactcaaggacttt

SEQ ID NO: 1239151 - DNA, 22 bp, Homo sapiens
tgcaactcactgattctctaca

SEQ ID NO: 1239152 - DNA, 20 bp, Homo sapiens
tgcaactgctcagctctggt

SEQ ID NO: 1239153 - DNA, 14 bp, Homo sapiens
tgcaactggccagc

SEQ ID NO: 1239154 - DNA, 15 bp, Homo sapiens
tgcaactggccagcc

SEQ ID NO: 1239155 - DNA, 17 bp, Homo sapiens
tgcaactggccagccaa

SEQ ID NO: 1239156 - DNA, 13 bp, Homo sapiens
tgcaacttcagtt

SEQ ID NO: 1239157 - DNA, 15 bp, Homo sapiens
tgcaacttcatgtca

SEQ ID NO: 1239158 - DNA, 21 bp, Homo sapiens
tgcaacttccgctgaggggtc

SEQ ID NO: 1239159 - DNA, 19 bp, Homo sapiens
tgcaacttctatcctttct

SEQ ID NO: 1239160 - DNA, 16 bp, Homo sapiens
tgcaatataacattct

SEQ ID NO: 1239161 - DNA, 20 bp, Homo sapiens
tgcaatataagcataaaaga

SEQ ID NO: 1239162 - DNA, 21 bp, Homo sapiens
tgcaatattaatgcctttaaa

SEQ ID NO: 1239163 - DNA, 17 bp, Homo sapiens
tgcaatcactttttgga

SEQ ID NO: 1239164 - DNA, 17 bp, Homo sapiens
tgcaatctaatctgaac

SEQ ID NO: 1239165 - DNA, 13 bp, Homo sapiens
tgcaatcttggct

SEQ ID NO: 1239166 - DNA, 18 bp, Homo sapiens
tgcaatcttggctcactg

SEQ ID NO: 1239167 - DNA, 21 bp, Homo sapiens
tgcaatgaaaggtactatatt

SEQ ID NO: 1239168 - DNA, 22 bp, Homo sapiens
tgcaatgaaaggtactatattt

SEQ ID NO: 1239169 - DNA, 15 bp, Homo sapiens
tgcaatgcctagact

SEQ ID NO: 1239170 - DNA, 12 bp, Homo sapiens
tgcaatgcttgt

SEQ ID NO: 1239171 - DNA, 21 bp, Homo sapiens
tgcaatggcagcattcccacc

SEQ ID NO: 1239172 - DNA, 19 bp, Homo sapiens
tgcaatgggggagggaggg

SEQ ID NO: 1239173 - DNA, 19 bp, Homo sapiens
tgcaatgtcacaacctctc

SEQ ID NO: 1239174 - DNA, 21 bp, Homo sapiens
tgcaatgtcacaacctctctg

SEQ ID NO: 1239175 - DNA, 19 bp, Homo sapiens
tgcaatgtctgagtgaacc

SEQ ID NO: 1239176 - DNA, 22 bp, Homo sapiens
tgcaatgtcttaaataaaacta

SEQ ID NO: 1239177 - DNA, 20 bp, Homo sapiens
tgcaattaaacttccaaaga

SEQ ID NO: 1239178 - DNA, 15 bp, Homo sapiens
tgcaattaaagtgat

SEQ ID NO: 1239179 - DNA, 19 bp, Homo sapiens
tgcaattcatgtaacagtt

SEQ ID NO: 1239180 - DNA, 21 bp, Homo sapiens
tgcaattcatgtaacagttgt

SEQ ID NO: 1239181 - DNA, 13 bp, Homo sapiens
tgcaattcccctc

SEQ ID NO: 1239182 - DNA, 14 bp, Homo sapiens
tgcaattcccctct

SEQ ID NO: 1239183 - DNA, 14 bp, Homo sapiens
tgcaattgctcttc

SEQ ID NO: 1239184 - DNA, 22 bp, Homo sapiens
tgcaatttattaaaatgattgt

SEQ ID NO: 1239185 - DNA, 23 bp, Homo sapiens
tgcaatttgattgactgcccatt

SEQ ID NO: 1239186 - DNA, 22 bp, Homo sapiens
tgcaatttgtttaaagaataaa

SEQ ID NO: 1239187 - DNA, 23 bp, Homo sapiens
tgcacaaaactacttttctaaaa

SEQ ID NO: 1239188 - DNA, 15 bp, Homo sapiens
tgcacaaaagcagat

SEQ ID NO: 1239189 - DNA, 12 bp, Homo sapiens
tgcacaaataca

SEQ ID NO: 1239190 - DNA, 14 bp, Homo sapiens
tgcacaagaatgga

SEQ ID NO: 1239191 - DNA, 13 bp, Homo sapiens
tgcacaagctcag

SEQ ID NO: 1239192 - DNA, 14 bp, Homo sapiens
tgcacaagctgcac

SEQ ID NO: 1239193 - DNA, 23 bp, Homo sapiens
tgcacaaggacattgtatgcagg

SEQ ID NO: 1239194 - DNA, 15 bp, Homo sapiens
tgcacaatatttctt

SEQ ID NO: 1239195 - DNA, 19 bp, Homo sapiens
tgcacaatatttcttttgt

SEQ ID NO: 1239196 - DNA, 16 bp, Homo sapiens
tgcacaatcagtttat

SEQ ID NO: 1239197 - DNA, 14 bp, Homo sapiens
tgcacacaaatatt

SEQ ID NO: 1239198 - DNA, 13 bp, Homo sapiens
tgcacacacagct

SEQ ID NO: 1239199 - DNA, 15 bp, Homo sapiens
tgcacacacagctcc

SEQ ID NO: 1239200 - DNA, 13 bp, Homo sapiens
tgcacacagacgg

SEQ ID NO: 1239201 - DNA, 11 bp, Homo sapiens
tgcacacagag

SEQ ID NO: 1239202 - DNA, 21 bp, Homo sapiens
tgcacacagatgtgaaatgaa

SEQ ID NO: 1239203 - DNA, 13 bp, Homo sapiens
tgcacacaggaca

SEQ ID NO: 1239204 - DNA, 17 bp, Homo sapiens
tgcacacaggacagcgg

SEQ ID NO: 1239205 - DNA, 13 bp, Homo sapiens
tgcacacagggca

SEQ ID NO: 1239206 - DNA, 13 bp, Homo sapiens
tgcacacagtgac

SEQ ID NO: 1239207 - DNA, 19 bp, Homo sapiens
tgcacacattaggcattga

SEQ ID NO: 1239208 - DNA, 20 bp, Homo sapiens
tgcacacattttttaaatgc

SEQ ID NO: 1239209 - DNA, 19 bp, Homo sapiens
tgcacaccccactcccaca

SEQ ID NO: 1239210 - DNA, 20 bp, Homo sapiens
tgcacacctactagtcacca

SEQ ID NO: 1239211 - DNA, 16 bp, Homo sapiens
tgcacacggctggtca

SEQ ID NO: 1239212 - DNA, 23 bp, Homo sapiens
tgcacacggctggtcactctgcc

SEQ ID NO: 1239213 - DNA, 15 bp, Homo sapiens
tgcacacgggcgagc

SEQ ID NO: 1239214 - DNA, 21 bp, Homo sapiens
tgcacacgggcgagctttctc

SEQ ID NO: 1239215 - DNA, 23 bp, Homo sapiens
tgcacacgggcgagctttctctc

SEQ ID NO: 1239216 - DNA, 21 bp, Homo sapiens
tgcacactagcctctccagga

SEQ ID NO: 1239217 - DNA, 12 bp, Homo sapiens
tgcacacttccc

SEQ ID NO: 1239218 - DNA, 22 bp, Homo sapiens
tgcacagaaaaccgagaatatt

SEQ ID NO: 1239219 - DNA, 17 bp, Homo sapiens
tgcacagaagggctctt

SEQ ID NO: 1239220 - DNA, 15 bp, Homo sapiens
tgcacagagaagctg

SEQ ID NO: 1239221 - DNA, 19 bp, Homo sapiens
tgcacagagggtcccattg

SEQ ID NO: 1239222 - DNA, 18 bp, Homo sapiens
tgcacagagttgttacat

SEQ ID NO: 1239223 - DNA, 19 bp, Homo sapiens
tgcacagagttgttacatt

SEQ ID NO: 1239224 - DNA, 23 bp, Homo sapiens
tgcacagagttgttacattttta

SEQ ID NO: 1239225 - DNA, 21 bp, Homo sapiens
tgcacagattctttttttctg

SEQ ID NO: 1239226 - DNA, 14 bp, Homo sapiens
tgcacagattgctg

SEQ ID NO: 1239227 - DNA, 20 bp, Homo sapiens
tgcacagattgctgaaactg

SEQ ID NO: 1239228 - DNA, 14 bp, Homo sapiens
tgcacagcaggacc

SEQ ID NO: 1239229 - DNA, 20 bp, Homo sapiens
tgcacagcaggacctgtgct

SEQ ID NO: 1239230 - DNA, 17 bp, Homo sapiens
tgcacagcgtcctgtcc

SEQ ID NO: 1239231 - DNA, 19 bp, Homo sapiens
tgcacagctgcttgtcctg

SEQ ID NO: 1239232 - DNA, 19 bp, Homo sapiens
tgcacagctgtagtacccc

SEQ ID NO: 1239233 - DNA, 18 bp, Homo sapiens
tgcacaggcacacagggc

SEQ ID NO: 1239234 - DNA, 18 bp, Homo sapiens
tgcacagggattctcaca

SEQ ID NO: 1239235 - DNA, 17 bp, Homo sapiens
tgcacaggggaaggaaa

SEQ ID NO: 1239236 - DNA, 17 bp, Homo sapiens
tgcacagtatttgtaat

SEQ ID NO: 1239237 - DNA, 20 bp, Homo sapiens
tgcacagtatttgtaattaa

SEQ ID NO: 1239238 - DNA, 23 bp, Homo sapiens
tgcacagtatttgtaattaaaag

SEQ ID NO: 1239239 - DNA, 17 bp, Homo sapiens
tgcacagtcactgctct

SEQ ID NO: 1239240 - DNA, 18 bp, Homo sapiens
tgcacagtccacagctga

SEQ ID NO: 1239241 - DNA, 15 bp, Homo sapiens
tgcacagtgacttct

SEQ ID NO: 1239242 - DNA, 16 bp, Homo sapiens
tgcacagtgacttctg

SEQ ID NO: 1239243 - DNA, 12 bp, Homo sapiens
tgcacagtgata

SEQ ID NO: 1239244 - DNA, 13 bp, Homo sapiens
tgcacagtggctt

SEQ ID NO: 1239245 - DNA, 17 bp, Homo sapiens
tgcacagtggcttcttt

SEQ ID NO: 1239246 - DNA, 24 bp, Homo sapiens
tgcacagttttctggctggagcct

SEQ ID NO: 1239247 - DNA, 22 bp, Homo sapiens
tgcacatagctatcaagtgtgc

SEQ ID NO: 1239248 - DNA, 22 bp, Homo sapiens
tgcacatcatattctattgttt

SEQ ID NO: 1239249 - DNA, 21 bp, Homo sapiens
tgcacatgactcgggggtggg

SEQ ID NO: 1239250 - DNA, 19 bp, Homo sapiens
tgcacatgcgcactctcat

SEQ ID NO: 1239251 - DNA, 19 bp, Homo sapiens
tgcacatgtgtgcgtgtgc

SEQ ID NO: 1239252 - DNA, 17 bp, Homo sapiens
tgcacatgtttcctcta

SEQ ID NO: 1239253 - DNA, 11 bp, Homo sapiens
tgcacattcct

SEQ ID NO: 1239254 - DNA, 15 bp, Homo sapiens
tgcacattcctggcc

SEQ ID NO: 1239255 - DNA, 16 bp, Homo sapiens
tgcacattcctggccc

SEQ ID NO: 1239256 - DNA, 12 bp, Homo sapiens
tgcacattgcct

SEQ ID NO: 1239257 - DNA, 14 bp, Homo sapiens
tgcacattgcctgt

SEQ ID NO: 1239258 - DNA, 11 bp, Homo sapiens
tgcacattgtt

SEQ ID NO: 1239259 - DNA, 13 bp, Homo sapiens
tgcacatttatat

SEQ ID NO: 1239260 - DNA, 20 bp, Homo sapiens
tgcacatttatatatatatg

SEQ ID NO: 1239261 - DNA, 19 bp, Homo sapiens
tgcacatttcaaaacaaga

SEQ ID NO: 1239262 - DNA, 16 bp, Homo sapiens
tgcacatttcagaaat

SEQ ID NO: 1239263 - DNA, 15 bp, Homo sapiens
tgcacatttctggat

SEQ ID NO: 1239264 - DNA, 17 bp, Homo sapiens
tgcacatttctggattg

SEQ ID NO: 1239265 - DNA, 17 bp, Homo sapiens
tgcacattttccacgga

SEQ ID NO: 1239266 - DNA, 21 bp, Homo sapiens
tgcaccaaactgcctcaatcc

SEQ ID NO: 1239267 - DNA, 16 bp, Homo sapiens
tgcaccaaagagaatg

SEQ ID NO: 1239268 - DNA, 18 bp, Homo sapiens
tgcaccaaagatgtcctg

SEQ ID NO: 1239269 - DNA, 21 bp, Homo sapiens
tgcaccaacctcactgccctc

SEQ ID NO: 1239270 - DNA, 12 bp, Homo sapiens
tgcaccaccaag

SEQ ID NO: 1239271 - DNA, 15 bp, Homo sapiens
tgcaccactgcactc

SEQ ID NO: 1239272 - DNA, 15 bp, Homo sapiens
tgcaccatccctttt

SEQ ID NO: 1239273 - DNA, 14 bp, Homo sapiens
tgcaccatctgctt

SEQ ID NO: 1239274 - DNA, 14 bp, Homo sapiens
tgcaccattttcaa

SEQ ID NO: 1239275 - DNA, 15 bp, Homo sapiens
tgcaccattttcaat

SEQ ID NO: 1239276 - DNA, 15 bp, Homo sapiens
tgcacccactcacca

SEQ ID NO: 1239277 - DNA, 16 bp, Homo sapiens
tgcacccactcaccag

SEQ ID NO: 1239278 - DNA, 13 bp, Homo sapiens
tgcacccagaaca

SEQ ID NO: 1239279 - DNA, 17 bp, Homo sapiens
tgcacccagctccaggg

SEQ ID NO: 1239280 - DNA, 18 bp, Homo sapiens
tgcacccagctccagggg

SEQ ID NO: 1239281 - DNA, 22 bp, Homo sapiens
tgcaccccaaagctttcctgcc

SEQ ID NO: 1239282 - DNA, 12 bp, Homo sapiens
tgcaccccagca

SEQ ID NO: 1239283 - DNA, 17 bp, Homo sapiens
tgcaccccagcgtcagg

SEQ ID NO: 1239284 - DNA, 15 bp, Homo sapiens
tgcacccctcccatt

SEQ ID NO: 1239285 - DNA, 23 bp, Homo sapiens
tgcacccctgagttgggcagcca

SEQ ID NO: 1239286 - DNA, 14 bp, Homo sapiens
tgcacccctggaac

SEQ ID NO: 1239287 - DNA, 15 bp, Homo sapiens
tgcaccccttctctc

SEQ ID NO: 1239288 - DNA, 19 bp, Homo sapiens
tgcacccctttcctcccca

SEQ ID NO: 1239289 - DNA, 16 bp, Homo sapiens
tgcacccgcctctccc

SEQ ID NO: 1239290 - DNA, 17 bp, Homo sapiens
tgcaccctcaggcaggt

SEQ ID NO: 1239291 - DNA, 14 bp, Homo sapiens
tgcaccctccaccc

SEQ ID NO: 1239292 - DNA, 15 bp, Homo sapiens
tgcaccctccaccct

SEQ ID NO: 1239293 - DNA, 18 bp, Homo sapiens
tgcaccctccaccctgtc

SEQ ID NO: 1239294 - DNA, 14 bp, Homo sapiens
tgcaccctctatcc

SEQ ID NO: 1239295 - DNA, 19 bp, Homo sapiens
tgcaccctgcgcctccaga

SEQ ID NO: 1239296 - DNA, 20 bp, Homo sapiens
tgcaccctgcgcctccagag

SEQ ID NO: 1239297 - DNA, 15 bp, Homo sapiens
tgcaccctggggcct

SEQ ID NO: 1239298 - DNA, 13 bp, Homo sapiens
tgcacccttcttt

SEQ ID NO: 1239299 - DNA, 14 bp, Homo sapiens
tgcacccttctttt

SEQ ID NO: 1239300 - DNA, 17 bp, Homo sapiens
tgcacccttcttttctc

SEQ ID NO: 1239301 - DNA, 20 bp, Homo sapiens
tgcaccgacccgaggcccag

SEQ ID NO: 1239302 - DNA, 16 bp, Homo sapiens
tgcaccgccgcagaag

SEQ ID NO: 1239303 - DNA, 20 bp, Homo sapiens
tgcaccgccgcagaagcagc

SEQ ID NO: 1239304 - DNA, 13 bp, Homo sapiens
tgcaccgcctgcc

SEQ ID NO: 1239305 - DNA, 14 bp, Homo sapiens
tgcaccgcctgccc

SEQ ID NO: 1239306 - DNA, 15 bp, Homo sapiens
tgcaccgcctgccct

SEQ ID NO: 1239307 - DNA, 17 bp, Homo sapiens
tgcaccgcctgccctcc

SEQ ID NO: 1239308 - DNA, 18 bp, Homo sapiens
tgcaccgcctgccctccc

SEQ ID NO: 1239309 - DNA, 16 bp, Homo sapiens
tgcaccgtcctcagca

SEQ ID NO: 1239310 - DNA, 14 bp, Homo sapiens
tgcacctaaagaaa

SEQ ID NO: 1239311 - DNA, 19 bp, Homo sapiens
tgcacctaccccttggaaa

SEQ ID NO: 1239312 - DNA, 19 bp, Homo sapiens
tgcacctagctgtgcaaga

SEQ ID NO: 1239313 - DNA, 16 bp, Homo sapiens
tgcacctcagcctccc

SEQ ID NO: 1239314 - DNA, 13 bp, Homo sapiens
tgcacctccccaa

SEQ ID NO: 1239315 - DNA, 18 bp, Homo sapiens
tgcacctccccccactgc

SEQ ID NO: 1239316 - DNA, 19 bp, Homo sapiens
tgcacctccccccactgca

SEQ ID NO: 1239317 - DNA, 17 bp, Homo sapiens
tgcacctcctaccctcc

SEQ ID NO: 1239318 - DNA, 19 bp, Homo sapiens
tgcacctcctaccctccca

SEQ ID NO: 1239319 - DNA, 17 bp, Homo sapiens
tgcacctgacctgctga

SEQ ID NO: 1239320 - DNA, 17 bp, Homo sapiens
tgcacctgccagcctgg

SEQ ID NO: 1239321 - DNA, 16 bp, Homo sapiens
tgcacctgcccagctc

SEQ ID NO: 1239322 - DNA, 12 bp, Homo sapiens
tgcacctgctgc

SEQ ID NO: 1239323 - DNA, 12 bp, Homo sapiens
tgcacctggcct

SEQ ID NO: 1239324 - DNA, 16 bp, Homo sapiens
tgcacctggcctgggc

SEQ ID NO: 1239325 - DNA, 17 bp, Homo sapiens
tgcacctgggcagctcc

SEQ ID NO: 1239326 - DNA, 19 bp, Homo sapiens
tgcacctgggcagctcctc

SEQ ID NO: 1239327 - DNA, 21 bp, Homo sapiens
tgcacctgggcagctcctccc

SEQ ID NO: 1239328 - DNA, 12 bp, Homo sapiens
tgcacctgtgca

SEQ ID NO: 1239329 - DNA, 20 bp, Homo sapiens
tgcaccttatatttctgtgt

SEQ ID NO: 1239330 - DNA, 23 bp, Homo sapiens
tgcacctttgtctggatgcacac

SEQ ID NO: 1239331 - DNA, 20 bp, Homo sapiens
tgcaccttttcatgtacagc

SEQ ID NO: 1239332 - DNA, 22 bp, Homo sapiens
tgcacctttttgcatgatatct

SEQ ID NO: 1239333 - DNA, 18 bp, Homo sapiens
tgcacgaccgccccagtt

SEQ ID NO: 1239334 - DNA, 15 bp, Homo sapiens
tgcacgacgccctct

SEQ ID NO: 1239335 - DNA, 15 bp, Homo sapiens
tgcacgcccatgtgt

SEQ ID NO: 1239336 - DNA, 14 bp, Homo sapiens
tgcacgctcccctc

SEQ ID NO: 1239337 - DNA, 18 bp, Homo sapiens
tgcacggctgctcggctt

SEQ ID NO: 1239338 - DNA, 16 bp, Homo sapiens
tgcacgtggagagctg

SEQ ID NO: 1239339 - DNA, 20 bp, Homo sapiens
tgcacgtggagagctggtgc

SEQ ID NO: 1239340 - DNA, 21 bp, Homo sapiens
tgcacgtggagagctggtgcc

SEQ ID NO: 1239341 - DNA, 16 bp, Homo sapiens
tgcacgtggcatgtgg

SEQ ID NO: 1239342 - DNA, 19 bp, Homo sapiens
tgcacgtggcctcttgagc

SEQ ID NO: 1239343 - DNA, 17 bp, Homo sapiens
tgcacgtggggcccact

SEQ ID NO: 1239344 - DNA, 17 bp, Homo sapiens
tgcacgttgctgaaggt

SEQ ID NO: 1239345 - DNA, 22 bp, Homo sapiens
tgcactaaaacccatcttcccc

SEQ ID NO: 1239346 - DNA, 18 bp, Homo sapiens
tgcactaaagccagcctg

SEQ ID NO: 1239347 - DNA, 22 bp, Homo sapiens
tgcactaaagccagcctgacct

SEQ ID NO: 1239348 - DNA, 15 bp, Homo sapiens
tgcactactcctctg

SEQ ID NO: 1239349 - DNA, 18 bp, Homo sapiens
tgcactactcctctgcag

SEQ ID NO: 1239350 - DNA, 14 bp, Homo sapiens
tgcactactgacat

SEQ ID NO: 1239351 - DNA, 15 bp, Homo sapiens
tgcactactgacatg

SEQ ID NO: 1239352 - DNA, 13 bp, Homo sapiens
tgcactagcattt

SEQ ID NO: 1239353 - DNA, 19 bp, Homo sapiens
tgcactagcattttcttga

SEQ ID NO: 1239354 - DNA, 14 bp, Homo sapiens
tgcactagcctgtg

SEQ ID NO: 1239355 - DNA, 15 bp, Homo sapiens
tgcactaggaattct

SEQ ID NO: 1239356 - DNA, 16 bp, Homo sapiens
tgcactaggaattctt

SEQ ID NO: 1239357 - DNA, 17 bp, Homo sapiens
tgcactcatcatatttt

SEQ ID NO: 1239358 - DNA, 15 bp, Homo sapiens
tgcactttgtaaatt

SEQ ID NO: 1239359 - DNA, 14 bp, Homo sapiens
tgcactttgtttag

SEQ ID NO: 1239360 - DNA, 18 bp, Homo sapiens
tgcactttgtttagaaaa

SEQ ID NO: 1239361 - DNA, 15 bp, Homo sapiens
tgcacttttgggcct

SEQ ID NO: 1239362 - DNA, 21 bp, Homo sapiens
tgcacttttttatgaagaaaa

SEQ ID NO: 1239363 - DNA, 17 bp, Homo sapiens
tgcagaaaagcacctgc

SEQ ID NO: 1239364 - DNA, 19 bp, Homo sapiens
tgcagaaaagcacctgccg

SEQ ID NO: 1239365 - DNA, 21 bp, Homo sapiens
tgcagaaaagcacctgccgac

SEQ ID NO: 1239366 - DNA, 20 bp, Homo sapiens
tgcagaaatagacaaaaagt

SEQ ID NO: 1239367 - DNA, 18 bp, Homo sapiens
tgcagaaccacaaacaat

SEQ ID NO: 1239368 - DNA, 17 bp, Homo sapiens
tgcagaactcctccaaa

SEQ ID NO: 1239369 - DNA, 14 bp, Homo sapiens
tgcagaactgccat

SEQ ID NO: 1239370 - DNA, 21 bp, Homo sapiens
tgcagaactgccattattttc

SEQ ID NO: 1239371 - DNA, 17 bp, Homo sapiens
tgcagaagaaggcatcg

SEQ ID NO: 1239372 - DNA, 20 bp, Homo sapiens
tgcagaagagggtgtgtttg

SEQ ID NO: 1239373 - DNA, 13 bp, Homo sapiens
tgcagaagccaga

SEQ ID NO: 1239374 - DNA, 15 bp, Homo sapiens
tgcagaaggaaaaat

SEQ ID NO: 1239375 - DNA, 17 bp, Homo sapiens
tgcagaaggaaatgatg

SEQ ID NO: 1239376 - DNA, 13 bp, Homo sapiens
tgcagaaggccaa

SEQ ID NO: 1239377 - DNA, 17 bp, Homo sapiens
tgcagaataatggaaac

SEQ ID NO: 1239378 - DNA, 21 bp, Homo sapiens
tgcagaataatggaaacatta

SEQ ID NO: 1239379 - DNA, 21 bp, Homo sapiens
tgcagaatacttgactcattt

SEQ ID NO: 1239380 - DNA, 17 bp, Homo sapiens
tgcagaatggcatttgc

SEQ ID NO: 1239381 - DNA, 21 bp, Homo sapiens
tgcagaatggcatttgcaata

SEQ ID NO: 1239382 - DNA, 18 bp, Homo sapiens
tgcagacaacaccttcct

SEQ ID NO: 1239383 - DNA, 19 bp, Homo sapiens
tgcagacaacaccttcctc

SEQ ID NO: 1239384 - DNA, 22 bp, Homo sapiens
tgcagacaacaccttcctcctg

SEQ ID NO: 1239385 - DNA, 16 bp, Homo sapiens
tgcagacacctggact

SEQ ID NO: 1239386 - DNA, 19 bp, Homo sapiens
tgcagacagaagtctcctc

SEQ ID NO: 1239387 - DNA, 16 bp, Homo sapiens
tgcagacagccatgcg

SEQ ID NO: 1239388 - DNA, 13 bp, Homo sapiens
tgcagacaggcca

SEQ ID NO: 1239389 - DNA, 14 bp, Homo sapiens
tgcagacagtctgt

SEQ ID NO: 1239390 - DNA, 21 bp, Homo sapiens
tgcagacagtctgttatgcac

SEQ ID NO: 1239391 - DNA, 21 bp, Homo sapiens
tgcagacatctctggagccag

SEQ ID NO: 1239392 - DNA, 23 bp, Homo sapiens
tgcagaccacgcccgtcctgcct

SEQ ID NO: 1239393 - DNA, 23 bp, Homo sapiens
tgcagaccatgaagtaaattatg

SEQ ID NO: 1239394 - DNA, 15 bp, Homo sapiens
tgcagaccatgccag

SEQ ID NO: 1239395 - DNA, 18 bp, Homo sapiens
tgcagacctcaagccatc

SEQ ID NO: 1239396 - DNA, 18 bp, Homo sapiens
tgcagacctcatgcccag

SEQ ID NO: 1239397 - DNA, 16 bp, Homo sapiens
tgcagaccttactcag

SEQ ID NO: 1239398 - DNA, 18 bp, Homo sapiens
tgcagaccttactcaggg

SEQ ID NO: 1239399 - DNA, 17 bp, Homo sapiens
tgcagactagaattcta

SEQ ID NO: 1239400 - DNA, 23 bp, Homo sapiens
tgcagactagaattctagtgctg

SEQ ID NO: 1239401 - DNA, 14 bp, Homo sapiens
tgcagactcagttt

SEQ ID NO: 1239402 - DNA, 19 bp, Homo sapiens
tgcagactcagtttgtcag

SEQ ID NO: 1239403 - DNA, 20 bp, Homo sapiens
tgcagactcagtttgtcaga

SEQ ID NO: 1239404 - DNA, 14 bp, Homo sapiens
tgcagactcctcag

SEQ ID NO: 1239405 - DNA, 20 bp, Homo sapiens
tgcagactcctcagatctga

SEQ ID NO: 1239406 - DNA, 22 bp, Homo sapiens
tgcagacttcccagctaggaag

SEQ ID NO: 1239407 - DNA, 20 bp, Homo sapiens
tgcagagaaagaaagggaaa

SEQ ID NO: 1239408 - DNA, 21 bp, Homo sapiens
tgcagagaagaataagacata

SEQ ID NO: 1239409 - DNA, 17 bp, Homo sapiens
tgcagagacaggacctg

SEQ ID NO: 1239410 - DNA, 19 bp, Homo sapiens
tgcagagactcatttcaca

SEQ ID NO: 1239411 - DNA, 17 bp, Homo sapiens
tgcagagatttcctcca

SEQ ID NO: 1239412 - DNA, 17 bp, Homo sapiens
tgcagagcaataacact

SEQ ID NO: 1239413 - DNA, 18 bp, Homo sapiens
tgcagagcaataacacta

SEQ ID NO: 1239414 - DNA, 12 bp, Homo sapiens
tgcagagcccgg

SEQ ID NO: 1239415 - DNA, 18 bp, Homo sapiens
tgcagagcccggccccac

SEQ ID NO: 1239416 - DNA, 22 bp, Homo sapiens
tgcagagccttctcagaagcac

SEQ ID NO: 1239417 - DNA, 18 bp, Homo sapiens
tgcagagctgacccagag

SEQ ID NO: 1239418 - DNA, 19 bp, Homo sapiens
tgcagagctttggccatta

SEQ ID NO: 1239419 - DNA, 15 bp, Homo sapiens
tgcagaggaccacag

SEQ ID NO: 1239420 - DNA, 17 bp, Homo sapiens
tgcagaggccagaggcc

SEQ ID NO: 1239421 - DNA, 13 bp, Homo sapiens
tgcagaggggaaa

SEQ ID NO: 1239422 - DNA, 22 bp, Homo sapiens
tgcagaggggctttctggagag

SEQ ID NO: 1239423 - DNA, 20 bp, Homo sapiens
tgcagaggtaaaagtgtgag

SEQ ID NO: 1239424 - DNA, 15 bp, Homo sapiens
tgcagaggtctgtgc

SEQ ID NO: 1239425 - DNA, 19 bp, Homo sapiens
tgcagaggtctgtgctgag

SEQ ID NO: 1239426 - DNA, 21 bp, Homo sapiens
tgcagaggtctgtgctgaggc

SEQ ID NO: 1239427 - DNA, 17 bp, Homo sapiens
tgcagataactttgact

SEQ ID NO: 1239428 - DNA, 18 bp, Homo sapiens
tgcagatggtactgctga

SEQ ID NO: 1239429 - DNA, 13 bp, Homo sapiens
tgcagatgtctta

SEQ ID NO: 1239430 - DNA, 13 bp, Homo sapiens
tgcagattcattt

SEQ ID NO: 1239431 - DNA, 16 bp, Homo sapiens
tgcagattcctgggcc

SEQ ID NO: 1239432 - DNA, 23 bp, Homo sapiens
tgcagattcctgggcctgtcccc

SEQ ID NO: 1239433 - DNA, 16 bp, Homo sapiens
tgcagattctatttcc

SEQ ID NO: 1239434 - DNA, 14 bp, Homo sapiens
tgcagattttctta

SEQ ID NO: 1239435 - DNA, 23 bp, Homo sapiens
tgcagcaataaagcagcgtttct

SEQ ID NO: 1239436 - DNA, 23 bp, Homo sapiens
tgcagcacatgcgggctcgccca

SEQ ID NO: 1239437 - DNA, 15 bp, Homo sapiens
tgcaggggcctggag

SEQ ID NO: 1239438 - DNA, 18 bp, Homo sapiens
tgcagggggaggaggact

SEQ ID NO: 1239439 - DNA, 20 bp, Homo sapiens
tgcagggggaggaggacttg

SEQ ID NO: 1239440 - DNA, 15 bp, Homo sapiens
tgcaggggtccctgc

SEQ ID NO: 1239441 - DNA, 22 bp, Homo sapiens
tgcaggggtgacggccctcatc

SEQ ID NO: 1239442 - DNA, 22 bp, Homo sapiens
tgcagggtcctcttctgggcct

SEQ ID NO: 1239443 - DNA, 23 bp, Homo sapiens
tgcagggtgacgcctgagacagc

SEQ ID NO: 1239444 - DNA, 18 bp, Homo sapiens
tgcagggtggtgctggga

SEQ ID NO: 1239445 - DNA, 19 bp, Homo sapiens
tgcaggtacttcctcctga

SEQ ID NO: 1239446 - DNA, 17 bp, Homo sapiens
tgcaggtgctgctgatg

SEQ ID NO: 1239447 - DNA, 13 bp, Homo sapiens
tgcaggtggcaga

SEQ ID NO: 1239448 - DNA, 17 bp, Homo sapiens
tgcaggtggcagagtga

SEQ ID NO: 1239449 - DNA, 21 bp, Homo sapiens
tgcaggtggtgtcgggccctt

SEQ ID NO: 1239450 - DNA, 23 bp, Homo sapiens
tgcaggtgtggagagagaggctt

SEQ ID NO: 1239451 - DNA, 20 bp, Homo sapiens
tgcaggttcttcttcctgaa

SEQ ID NO: 1239452 - DNA, 15 bp, Homo sapiens
tgcaggtttctcctt

SEQ ID NO: 1239453 - DNA, 14 bp, Homo sapiens
tgcagtaaatcttt

SEQ ID NO: 1239454 - DNA, 15 bp, Homo sapiens
tgcagtaaatctttt

SEQ ID NO: 1239455 - DNA, 21 bp, Homo sapiens
tgcagtaaatcttttacaact

SEQ ID NO: 1239456 - DNA, 11 bp, Homo sapiens
tgcagtaactg

SEQ ID NO: 1239457 - DNA, 18 bp, Homo sapiens
tgcagtaactgtttttta

SEQ ID NO: 1239458 - DNA, 21 bp, Homo sapiens
tgcagtaactgttttttaagt

SEQ ID NO: 1239459 - DNA, 16 bp, Homo sapiens
tgcagtacaggacata

SEQ ID NO: 1239460 - DNA, 18 bp, Homo sapiens
tgcagtacaggacatata

SEQ ID NO: 1239461 - DNA, 13 bp, Homo sapiens
tgcagtacaggca

SEQ ID NO: 1239462 - DNA, 16 bp, Homo sapiens
tgcagtacagtgtgtg

SEQ ID NO: 1239463 - DNA, 17 bp, Homo sapiens
tgcagtactttgtgcat

SEQ ID NO: 1239464 - DNA, 22 bp, Homo sapiens
tgcagtagagtcatctccatca

SEQ ID NO: 1239465 - DNA, 13 bp, Homo sapiens
tgcagtatagaat

SEQ ID NO: 1239466 - DNA, 14 bp, Homo sapiens
tgcagtatagaata

SEQ ID NO: 1239467 - DNA, 20 bp, Homo sapiens
tgcagtatgatggcaggaga

SEQ ID NO: 1239468 - DNA, 13 bp, Homo sapiens
tgcagtcacattg

SEQ ID NO: 1239469 - DNA, 15 bp, Homo sapiens
tgcagtcactggagg

SEQ ID NO: 1239470 - DNA, 14 bp, Homo sapiens
tgcagtcactgtga

SEQ ID NO: 1239471 - DNA, 16 bp, Homo sapiens
tgcagtcagtgtttct

SEQ ID NO: 1239472 - DNA, 21 bp, Homo sapiens
tgcagtcagtgtttcttttaa

SEQ ID NO: 1239473 - DNA, 13 bp, Homo sapiens
tgcagtcatttgt

SEQ ID NO: 1239474 - DNA, 21 bp, Homo sapiens
tgcagtcccacactgtgcaga

SEQ ID NO: 1239475 - DNA, 17 bp, Homo sapiens
tgcagtcctactcaagc

SEQ ID NO: 1239476 - DNA, 22 bp, Homo sapiens
tgcagtcggcatgccaggaccc

SEQ ID NO: 1239477 - DNA, 15 bp, Homo sapiens
tgcagtcgtgtaatt

SEQ ID NO: 1239478 - DNA, 22 bp, Homo sapiens
tgcagtcgtgtaattggcccaa

SEQ ID NO: 1239479 - DNA, 13 bp, Homo sapiens
tgcagtctaaccc

SEQ ID NO: 1239480 - DNA, 13 bp, Homo sapiens
tgcagtctgggtg

SEQ ID NO: 1239481 - DNA, 21 bp, Homo sapiens
tgcagtcttatttccaagtaa

SEQ ID NO: 1239482 - DNA, 13 bp, Homo sapiens
tgcagtgaattgt

SEQ ID NO: 1239483 - DNA, 18 bp, Homo sapiens
tgcagtgaatttgaataa

SEQ ID NO: 1239484 - DNA, 12 bp, Homo sapiens
tgcagtgagcag

SEQ ID NO: 1239485 - DNA, 13 bp, Homo sapiens
tgcagtgagcagg

SEQ ID NO: 1239486 - DNA, 20 bp, Homo sapiens
tgcagtgaggggccctccat

SEQ ID NO: 1239487 - DNA, 16 bp, Homo sapiens
tgcagtgcagtataga

SEQ ID NO: 1239488 - DNA, 17 bp, Homo sapiens
tgcagtgcagtatagaa

SEQ ID NO: 1239489 - DNA, 16 bp, Homo sapiens
tgcagtgcttccaagg

SEQ ID NO: 1239490 - DNA, 21 bp, Homo sapiens
tgcagtggcgcattctaggct

SEQ ID NO: 1239491 - DNA, 17 bp, Homo sapiens
tgcagtggctcacgcct

SEQ ID NO: 1239492 - DNA, 19 bp, Homo sapiens
tgcagtggtattaattttg

SEQ ID NO: 1239493 - DNA, 14 bp, Homo sapiens
tgcagtgtagattt

SEQ ID NO: 1239494 - DNA, 13 bp, Homo sapiens
tgcagtgtgcagg

SEQ ID NO: 1239495 - DNA, 20 bp, Homo sapiens
tgcagtgtggagttcacctt

SEQ ID NO: 1239496 - DNA, 14 bp, Homo sapiens
tgcagttaacagga

SEQ ID NO: 1239497 - DNA, 21 bp, Homo sapiens
tgcagttacactaaaaggtga

SEQ ID NO: 1239498 - DNA, 15 bp, Homo sapiens
tgcagttcagcacca

SEQ ID NO: 1239499 - DNA, 18 bp, Homo sapiens
tgcagttcagcaccaccc

SEQ ID NO: 1239500 - DNA, 19 bp, Homo sapiens
tgcagttcagcaccaccct

SEQ ID NO: 1239501 - DNA, 15 bp, Homo sapiens
tgcagttcctggccc

SEQ ID NO: 1239502 - DNA, 16 bp, Homo sapiens
tgcagttgacagcagg

SEQ ID NO: 1239503 - DNA, 20 bp, Homo sapiens
tgcagttgtgatataaagga

SEQ ID NO: 1239504 - DNA, 16 bp, Homo sapiens
tgcagtttatcattca

SEQ ID NO: 1239505 - DNA, 19 bp, Homo sapiens
tgcagtttatcattcaagt

SEQ ID NO: 1239506 - DNA, 15 bp, Homo sapiens
tgcagtttcatgtat

SEQ ID NO: 1239507 - DNA, 17 bp, Homo sapiens
tgcagtttcatgtatgt

SEQ ID NO: 1239508 - DNA, 14 bp, Homo sapiens
tgcagtttcttgtg

SEQ ID NO: 1239509 - DNA, 16 bp, Homo sapiens
tgcagtttcttgtgta

SEQ ID NO: 1239510 - DNA, 22 bp, Homo sapiens
tgcagtttcttgtgtagatttg

SEQ ID NO: 1239511 - DNA, 12 bp, Homo sapiens
tgcagtttcttt

SEQ ID NO: 1239512 - DNA, 14 bp, Homo sapiens
tgcagtttcttttc

SEQ ID NO: 1239513 - DNA, 15 bp, Homo sapiens
tgcagtttcttttca

SEQ ID NO: 1239514 - DNA, 18 bp, Homo sapiens
tgcagtttcttttcacat

SEQ ID NO: 1239515 - DNA, 13 bp, Homo sapiens
tgcagttttgtaa

SEQ ID NO: 1239516 - DNA, 15 bp, Homo sapiens
tgcagtttttataat

SEQ ID NO: 1239517 - DNA, 15 bp, Homo sapiens
tgcagtttttcattt

SEQ ID NO: 1239518 - DNA, 17 bp, Homo sapiens
tgcataaaaaaatgatg

SEQ ID NO: 1239519 - DNA, 18 bp, Homo sapiens
tgcataaaaaaatgatgc

SEQ ID NO: 1239520 - DNA, 17 bp, Homo sapiens
tgcataaagtcagtgcc

SEQ ID NO: 1239521 - DNA, 18 bp, Homo sapiens
tgcataagttcttaatgt

SEQ ID NO: 1239522 - DNA, 24 bp, Homo sapiens
tgcataataagctaaagaggctga

SEQ ID NO: 1239523 - DNA, 20 bp, Homo sapiens
tgcataatgataaaataaat

SEQ ID NO: 1239524 - DNA, 14 bp, Homo sapiens
tgcataatgtttaa

SEQ ID NO: 1239525 - DNA, 17 bp, Homo sapiens
tgcataatgtttctgga

SEQ ID NO: 1239526 - DNA, 12 bp, Homo sapiens
tgcataccactt

SEQ ID NO: 1239527 - DNA, 21 bp, Homo sapiens
tgcataccacttttgttcttg

SEQ ID NO: 1239528 - DNA, 16 bp, Homo sapiens
tgcatactcaaggtga

SEQ ID NO: 1239529 - DNA, 13 bp, Homo sapiens
tgcatactgaaaa

SEQ ID NO: 1239530 - DNA, 17 bp, Homo sapiens
tgcatactgagccaagt

SEQ ID NO: 1239531 - DNA, 12 bp, Homo sapiens
tgcatactttat

SEQ ID NO: 1239532 - DNA, 18 bp, Homo sapiens
tgcatactttttaaatgt

SEQ ID NO: 1239533 - DNA, 15 bp, Homo sapiens
tgcatagcagtatat

SEQ ID NO: 1239534 - DNA, 19 bp, Homo sapiens
tgcataggctcttaagcag

SEQ ID NO: 1239535 - DNA, 15 bp, Homo sapiens
tgcatagtcccagct

SEQ ID NO: 1239536 - DNA, 23 bp, Homo sapiens
tgcatataaaggttatgaaacat

SEQ ID NO: 1239537 - DNA, 16 bp, Homo sapiens
tgcatataacttatat

SEQ ID NO: 1239538 - DNA, 17 bp, Homo sapiens
tgcatataatgaataaa

SEQ ID NO: 1239539 - DNA, 16 bp, Homo sapiens
tgcatatagaaaacaa

SEQ ID NO: 1239540 - DNA, 17 bp, Homo sapiens
tgcatatctgcctcccc

SEQ ID NO: 1239541 - DNA, 15 bp, Homo sapiens
tgcatatgttgaata

SEQ ID NO: 1239542 - DNA, 13 bp, Homo sapiens
tgcatattataaa

SEQ ID NO: 1239543 - DNA, 20 bp, Homo sapiens
tgcatattataaaggataaa

SEQ ID NO: 1239544 - DNA, 13 bp, Homo sapiens
tgcatatttctgt

SEQ ID NO: 1239545 - DNA, 20 bp, Homo sapiens
tgcatatttctgtatatttg

SEQ ID NO: 1239546 - DNA, 17 bp, Homo sapiens
tgcatatttgttacttt

SEQ ID NO: 1239547 - DNA, 18 bp, Homo sapiens
tgcatatttgttacttta

SEQ ID NO: 1239548 - DNA, 17 bp, Homo sapiens
tgcatcaaccaggaaga

SEQ ID NO: 1239549 - DNA, 19 bp, Homo sapiens
tgcatcaagggctttatca

SEQ ID NO: 1239550 - DNA, 17 bp, Homo sapiens
tgcatcacactcaagga

SEQ ID NO: 1239551 - DNA, 18 bp, Homo sapiens
tgcatcacactcaaggac

SEQ ID NO: 1239552 - DNA, 19 bp, Homo sapiens
tgcatcacactcaaggaca

SEQ ID NO: 1239553 - DNA, 21 bp, Homo sapiens
tgcatcacactcaaggacagg

SEQ ID NO: 1239554 - DNA, 22 bp, Homo sapiens
tgcatcacactcaaggacagga

SEQ ID NO: 1239555 - DNA, 21 bp, Homo sapiens
tgcatcacgtaccccactggg

SEQ ID NO: 1239556 - DNA, 15 bp, Homo sapiens
tgcatcattactgtt

SEQ ID NO: 1239557 - DNA, 13 bp, Homo sapiens
tgcatccaactcc

SEQ ID NO: 1239558 - DNA, 20 bp, Homo sapiens
tgcatccagagattcatttt

SEQ ID NO: 1239559 - DNA, 21 bp, Homo sapiens
tgcatccagcctggggctgag

SEQ ID NO: 1239560 - DNA, 14 bp, Homo sapiens
tgcatccattcctc

SEQ ID NO: 1239561 - DNA, 16 bp, Homo sapiens
tgcatccattcctcag

SEQ ID NO: 1239562 - DNA, 17 bp, Homo sapiens
tgcatccattcctcagg

SEQ ID NO: 1239563 - DNA, 12 bp, Homo sapiens
tgcatcccagca

SEQ ID NO: 1239564 - DNA, 14 bp, Homo sapiens
tgcatcccagcacc

SEQ ID NO: 1239565 - DNA, 19 bp, Homo sapiens
tgcatcccagcacctgcct

SEQ ID NO: 1239566 - DNA, 17 bp, Homo sapiens
tgcatcccccccacctc

SEQ ID NO: 1239567 - DNA, 24 bp, Homo sapiens
tgcatcccgtacctcttcccatga

SEQ ID NO: 1239568 - DNA, 13 bp, Homo sapiens
tgcatccctgaga

SEQ ID NO: 1239569 - DNA, 12 bp, Homo sapiens
tgcatcctcctc

SEQ ID NO: 1239570 - DNA, 13 bp, Homo sapiens
tgcatcctcctca

SEQ ID NO: 1239571 - DNA, 16 bp, Homo sapiens
tgcatcctgaggccag

SEQ ID NO: 1239572 - DNA, 13 bp, Homo sapiens
tgcatccttgtaa

SEQ ID NO: 1239573 - DNA, 15 bp, Homo sapiens
tgcatccttgtaata

SEQ ID NO: 1239574 - DNA, 16 bp, Homo sapiens
tgcatccttgtaatac

SEQ ID NO: 1239575 - DNA, 18 bp, Homo sapiens
tgcatccttgtaatacct

SEQ ID NO: 1239576 - DNA, 21 bp, Homo sapiens
tgcatcgacactaaaaactga

SEQ ID NO: 1239577 - DNA, 14 bp, Homo sapiens
tgcatcgggaaaga

SEQ ID NO: 1239578 - DNA, 17 bp, Homo sapiens
tgcatcgggaaagaaga

SEQ ID NO: 1239579 - DNA, 17 bp, Homo sapiens
tgcatcgtttcatcttc

SEQ ID NO: 1239580 - DNA, 16 bp, Homo sapiens
tgcatctaatgaaaaa

SEQ ID NO: 1239581 - DNA, 14 bp, Homo sapiens
tgcatctactccca

SEQ ID NO: 1239582 - DNA, 18 bp, Homo sapiens
tgcatctcccagataatg

SEQ ID NO: 1239583 - DNA, 13 bp, Homo sapiens
tgcatctctgtga

SEQ ID NO: 1239584 - DNA, 23 bp, Homo sapiens
tgcatctgaccccggggggctgg

SEQ ID NO: 1239585 - DNA, 23 bp, Homo sapiens
tgcatctgggattcccaccaagg

SEQ ID NO: 1239586 - DNA, 22 bp, Homo sapiens
tgcatctgtataagtaagaaaa

SEQ ID NO: 1239587 - DNA, 18 bp, Homo sapiens
tgcatcttactgaaggta

SEQ ID NO: 1239588 - DNA, 15 bp, Homo sapiens
tgcatcttcttgcat

SEQ ID NO: 1239589 - DNA, 17 bp, Homo sapiens
tgcatcttcttgcatct

SEQ ID NO: 1239590 - DNA, 20 bp, Homo sapiens
tgcatcttggggacatctct

SEQ ID NO: 1239591 - DNA, 12 bp, Homo sapiens
tgcatctttccc

SEQ ID NO: 1239592 - DNA, 14 bp, Homo sapiens
tgcatctttccctg

SEQ ID NO: 1239593 - DNA, 16 bp, Homo sapiens
tgcatgaaaagtgcat

SEQ ID NO: 1239594 - DNA, 12 bp, Homo sapiens
tgccacccacca

SEQ ID NO: 1239595 - DNA, 17 bp, Homo sapiens
tgccacccacctccctg

SEQ ID NO: 1239596 - DNA, 21 bp, Homo sapiens
tgccacccacctccctgcctc

SEQ ID NO: 1239597 - DNA, 22 bp, Homo sapiens
tgccacccacctccctgcctcc

SEQ ID NO: 1239598 - DNA, 20 bp, Homo sapiens
tgccacccactcaggattgg

SEQ ID NO: 1239599 - DNA, 17 bp, Homo sapiens
tgccacccattcttccc

SEQ ID NO: 1239600 - DNA, 18 bp, Homo sapiens
tgccacccattcttcccg

SEQ ID NO: 1239601 - DNA, 15 bp, Homo sapiens
tgccacccccaggtc

SEQ ID NO: 1239602 - DNA, 16 bp, Homo sapiens
tgccacccccaggtct

SEQ ID NO: 1239603 - DNA, 21 bp, Homo sapiens
tgccacccccagttcctatga

SEQ ID NO: 1239604 - DNA, 18 bp, Homo sapiens
tgccacccccgctggagg

SEQ ID NO: 1239605 - DNA, 17 bp, Homo sapiens
tgccaccccgagggctg

SEQ ID NO: 1239606 - DNA, 20 bp, Homo sapiens
tgccacccctaaactccagg

SEQ ID NO: 1239607 - DNA, 15 bp, Homo sapiens
tgccacccctcttct

SEQ ID NO: 1239608 - DNA, 17 bp, Homo sapiens
tgccacccgtaggcagc

SEQ ID NO: 1239609 - DNA, 21 bp, Homo sapiens
tgccacccgtaggcagcctct

SEQ ID NO: 1239610 - DNA, 12 bp, Homo sapiens
tgccaccctacc

SEQ ID NO: 1239611 - DNA, 15 bp, Homo sapiens
tgccaccctcacaca

SEQ ID NO: 1239612 - DNA, 21 bp, Homo sapiens
tgccaccctcacacacacagc

SEQ ID NO: 1239613 - DNA, 16 bp, Homo sapiens
tgccaccctctgggag

SEQ ID NO: 1239614 - DNA, 17 bp, Homo sapiens
tgccaccgactgcccag

SEQ ID NO: 1239615 - DNA, 20 bp, Homo sapiens
tgccaccgactgcccagcca

SEQ ID NO: 1239616 - DNA, 22 bp, Homo sapiens
tgccaccgactgcccagccact

SEQ ID NO: 1239617 - DNA, 22 bp, Homo sapiens
tgccaccggcctgtgggtctct

SEQ ID NO: 1239618 - DNA, 16 bp, Homo sapiens
tgccacctatgcctgt

SEQ ID NO: 1239619 - DNA, 21 bp, Homo sapiens
tgccacctatgcctgtggtga

SEQ ID NO: 1239620 - DNA, 17 bp, Homo sapiens
tgccacctcccctatcc

SEQ ID NO: 1239621 - DNA, 21 bp, Homo sapiens
tgccacctcccctatccaccc

SEQ ID NO: 1239622 - DNA, 16 bp, Homo sapiens
tgccacgcacttcctc

SEQ ID NO: 1239623 - DNA, 20 bp, Homo sapiens
tgccacgcacttcctctctc

SEQ ID NO: 1239624 - DNA, 24 bp, Homo sapiens
tgccacgcacttcctctctcggag

SEQ ID NO: 1239625 - DNA, 21 bp, Homo sapiens
tgccacgtcccgctgcctcct

SEQ ID NO: 1239626 - DNA, 15 bp, Homo sapiens
tgccacgttccacag

SEQ ID NO: 1239627 - DNA, 19 bp, Homo sapiens
tgccacgttccacagttgc

SEQ ID NO: 1239628 - DNA, 20 bp, Homo sapiens
tgccacgttccacagttgcc

SEQ ID NO: 1239629 - DNA, 22 bp, Homo sapiens
tgccacgttggagaagcccgtg

SEQ ID NO: 1239630 - DNA, 23 bp, Homo sapiens
tgccactaagagattgcacagtc

SEQ ID NO: 1239631 - DNA, 18 bp, Homo sapiens
tgccactaattttagtat

SEQ ID NO: 1239632 - DNA, 22 bp, Homo sapiens
tgccactcacccttcctggccc

SEQ ID NO: 1239633 - DNA, 23 bp, Homo sapiens
tgccactcacccttcctggccca

SEQ ID NO: 1239634 - DNA, 17 bp, Homo sapiens
tgccactcattcctgta

SEQ ID NO: 1239635 - DNA, 20 bp, Homo sapiens
tgccactcccctaaactcca

SEQ ID NO: 1239636 - DNA, 16 bp, Homo sapiens
tgccactccctgagct

SEQ ID NO: 1239637 - DNA, 14 bp, Homo sapiens
tgccactcctccct

SEQ ID NO: 1239638 - DNA, 16 bp, Homo sapiens
tgccactcctccctcc

SEQ ID NO: 1239639 - DNA, 17 bp, Homo sapiens
tgccactcctccctccg

SEQ ID NO: 1239640 - DNA, 16 bp, Homo sapiens
tgccactctctgggac

SEQ ID NO: 1239641 - DNA, 20 bp, Homo sapiens
tgccactctctgggactctc

SEQ ID NO: 1239642 - DNA, 23 bp, Homo sapiens
tgccactgaccgggatccagttc

SEQ ID NO: 1239643 - DNA, 17 bp, Homo sapiens
tgccactgacttgctgt

SEQ ID NO: 1239644 - DNA, 12 bp, Homo sapiens
tgccactgccag

SEQ ID NO: 1239645 - DNA, 16 bp, Homo sapiens
tgccactgccaggcac

SEQ ID NO: 1239646 - DNA, 17 bp, Homo sapiens
tgccactgccaggcacc

SEQ ID NO: 1239647 - DNA, 23 bp, Homo sapiens
tgccactgccccccgaggctgct

SEQ ID NO: 1239648 - DNA, 21 bp, Homo sapiens
tgccactgcccgagctggtgc

SEQ ID NO: 1239649 - DNA, 20 bp, Homo sapiens
tgccactgcctcttcctccc

SEQ ID NO: 1239650 - DNA, 22 bp, Homo sapiens
tgccactgccttcgcttcttgc

SEQ ID NO: 1239651 - DNA, 14 bp, Homo sapiens
tgccactgggctct

SEQ ID NO: 1239652 - DNA, 15 bp, Homo sapiens
tgccactgggctctg

SEQ ID NO: 1239653 - DNA, 16 bp, Homo sapiens
tgccactgggctctgg

SEQ ID NO: 1239654 - DNA, 12 bp, Homo sapiens
tgccactgtgtg

SEQ ID NO: 1239655 - DNA, 13 bp, Homo sapiens
tgccactgtgtgc

SEQ ID NO: 1239656 - DNA, 16 bp, Homo sapiens
tgccactgtgtgcctt

SEQ ID NO: 1239657 - DNA, 14 bp, Homo sapiens
tgccacttaatgta

SEQ ID NO: 1239658 - DNA, 17 bp, Homo sapiens
tgccacttaatgtatgt

SEQ ID NO: 1239659 - DNA, 18 bp, Homo sapiens
tgccacttaatgtatgtt

SEQ ID NO: 1239660 - DNA, 20 bp, Homo sapiens
tgccacttaatgtatgttac

SEQ ID NO: 1239661 - DNA, 14 bp, Homo sapiens
tgccacttagaata

SEQ ID NO: 1239662 - DNA, 15 bp, Homo sapiens
tgccacttctgcggg

SEQ ID NO: 1239663 - DNA, 21 bp, Homo sapiens
tgccacttcttaaaggcctgg

SEQ ID NO: 1239664 - DNA, 16 bp, Homo sapiens
tgccacttgacattcc

SEQ ID NO: 1239665 - DNA, 22 bp, Homo sapiens
tgccacttgatggggcctgggt

SEQ ID NO: 1239666 - DNA, 23 bp, Homo sapiens
tgccacttgtcaaagaaggtgct

SEQ ID NO: 1239667 - DNA, 22 bp, Homo sapiens
tgccactttacccacctagaac

SEQ ID NO: 1239668 - DNA, 22 bp, Homo sapiens
tgccactttggcttctcctgtg

SEQ ID NO: 1239669 - DNA, 23 bp, Homo sapiens
tgccagaaacagtgggagccctg

SEQ ID NO: 1239670 - DNA, 17 bp, Homo sapiens
tgccagaagagaattca

SEQ ID NO: 1239671 - DNA, 13 bp, Homo sapiens
tgccagaaggaag

SEQ ID NO: 1239672 - DNA, 20 bp, Homo sapiens
tgccagaatactgggttctt

SEQ ID NO: 1239673 - DNA, 17 bp, Homo sapiens
tgccagaattttaggaa

SEQ ID NO: 1239674 - DNA, 20 bp, Homo sapiens
tgccagacaaataggagtga

SEQ ID NO: 1239675 - DNA, 20 bp, Homo sapiens
tgccagacactgagcttctg

SEQ ID NO: 1239676 - DNA, 21 bp, Homo sapiens
tgccagaccgcagagaggctc

SEQ ID NO: 1239677 - DNA, 21 bp, Homo sapiens
tgccagacgtgctcctgctga

SEQ ID NO: 1239678 - DNA, 23 bp, Homo sapiens
tgccagactctaggttatacaat

SEQ ID NO: 1239679 - DNA, 14 bp, Homo sapiens
tgccagacttaaat

SEQ ID NO: 1239680 - DNA, 18 bp, Homo sapiens
tgccagagaggtggggat

SEQ ID NO: 1239681 - DNA, 22 bp, Homo sapiens
tgccagagaggtggggatcctg

SEQ ID NO: 1239682 - DNA, 12 bp, Homo sapiens
tgccagagcagg

SEQ ID NO: 1239683 - DNA, 22 bp, Homo sapiens
tgccagagccggccgccttctc

SEQ ID NO: 1239684 - DNA, 21 bp, Homo sapiens
tgccagaggaatcctggcagc

SEQ ID NO: 1239685 - DNA, 23 bp, Homo sapiens
tgccagaggaatcctggcagccc

SEQ ID NO: 1239686 - DNA, 17 bp, Homo sapiens
tgccagagggccagcag

SEQ ID NO: 1239687 - DNA, 23 bp, Homo sapiens
tgccagagggccagcaggctcct

SEQ ID NO: 1239688 - DNA, 21 bp, Homo sapiens
tgccagatgcctttatggctg

SEQ ID NO: 1239689 - DNA, 16 bp, Homo sapiens
tgccagcaactgaata

SEQ ID NO: 1239690 - DNA, 18 bp, Homo sapiens
tgccagcaactgaataaa

SEQ ID NO: 1239691 - DNA, 23 bp, Homo sapiens
tgccagcaatgacatctcagggg

SEQ ID NO: 1239692 - DNA, 15 bp, Homo sapiens
tgccagcacaggggc

SEQ ID NO: 1239693 - DNA, 16 bp, Homo sapiens
tgccagcacaggggcc

SEQ ID NO: 1239694 - DNA, 18 bp, Homo sapiens
tgccagcacaggggcccc

SEQ ID NO: 1239695 - DNA, 19 bp, Homo sapiens
tgccagcaccacagccggt

SEQ ID NO: 1239696 - DNA, 10 bp, Homo sapiens
tgccagcagc

SEQ ID NO: 1239697 - DNA, 14 bp, Homo sapiens
tgccagcagcagca

SEQ ID NO: 1239698 - DNA, 15 bp, Homo sapiens
tgccagcagcagcag

SEQ ID NO: 1239699 - DNA, 13 bp, Homo sapiens
tgccagcagcctc

SEQ ID NO: 1239700 - DNA, 17 bp, Homo sapiens
tgccagctactcaggag

SEQ ID NO: 1239701 - DNA, 17 bp, Homo sapiens
tgccagctcagtcccat

SEQ ID NO: 1239702 - DNA, 14 bp, Homo sapiens
tgccagctccagtg

SEQ ID NO: 1239703 - DNA, 22 bp, Homo sapiens
tgccagctctgtatcaggaccc

SEQ ID NO: 1239704 - DNA, 22 bp, Homo sapiens
tgccagctgccttcctcatccc

SEQ ID NO: 1239705 - DNA, 18 bp, Homo sapiens
tgccagcttatctcaggg

SEQ ID NO: 1239706 - DNA, 21 bp, Homo sapiens
tgccaggaaacaagggaaggg

SEQ ID NO: 1239707 - DNA, 14 bp, Homo sapiens
tgccaggaacctgt

SEQ ID NO: 1239708 - DNA, 13 bp, Homo sapiens
tgccaggaccagc

SEQ ID NO: 1239709 - DNA, 15 bp, Homo sapiens
tgccaggaccagcct

SEQ ID NO: 1239710 - DNA, 23 bp, Homo sapiens
tgccaggaccccaggtcaggggc

SEQ ID NO: 1239711 - DNA, 16 bp, Homo sapiens
tgccaggacccgccag

SEQ ID NO: 1239712 - DNA, 19 bp, Homo sapiens
tgccaggacccgccagccc

SEQ ID NO: 1239713 - DNA, 12 bp, Homo sapiens
tgccaggactcc

SEQ ID NO: 1239714 - DNA, 21 bp, Homo sapiens
tgccaggactccccaggccag

SEQ ID NO: 1239715 - DNA, 14 bp, Homo sapiens
tgccaggagatggc

SEQ ID NO: 1239716 - DNA, 22 bp, Homo sapiens
tgccaggaggcggcagctcttc

SEQ ID NO: 1239717 - DNA, 21 bp, Homo sapiens
tgccaggagggcacagcaggg

SEQ ID NO: 1239718 - DNA, 20 bp, Homo sapiens
tgccaggcacctggcctgct

SEQ ID NO: 1239719 - DNA, 21 bp, Homo sapiens
tgccaggcacctggcctgctg

SEQ ID NO: 1239720 - DNA, 22 bp, Homo sapiens
tgccaggcacctggcctgctgg

SEQ ID NO: 1239721 - DNA, 12 bp, Homo sapiens
tgccaggcaggg

SEQ ID NO: 1239722 - DNA, 10 bp, Homo sapiens
tgccaggcat

SEQ ID NO: 1239723 - DNA, 14 bp, Homo sapiens
tgccaggccagcct

SEQ ID NO: 1239724 - DNA, 16 bp, Homo sapiens
tgccaggccagcctcc

SEQ ID NO: 1239725 - DNA, 22 bp, Homo sapiens
tgccaggcccatctcaggtgcc

SEQ ID NO: 1239726 - DNA, 23 bp, Homo sapiens
tgccaggcggacaaagttcagtg

SEQ ID NO: 1239727 - DNA, 18 bp, Homo sapiens
tgccaggcggccctgggg

SEQ ID NO: 1239728 - DNA, 21 bp, Homo sapiens
tgccaggcgttggtgccactt

SEQ ID NO: 1239729 - DNA, 23 bp, Homo sapiens
tgccaggctgcgtccctccgagc

SEQ ID NO: 1239730 - DNA, 24 bp, Homo sapiens
tgccaggctgcgtccctccgagct

SEQ ID NO: 1239731 - DNA, 16 bp, Homo sapiens
tgccaggcttgcctgg

SEQ ID NO: 1239732 - DNA, 16 bp, Homo sapiens
tgccagggcagggccc

SEQ ID NO: 1239733 - DNA, 16 bp, Homo sapiens
tgccagggcagggtct

SEQ ID NO: 1239734 - DNA, 17 bp, Homo sapiens
tgccagggcagggtctg

SEQ ID NO: 1239735 - DNA, 18 bp, Homo sapiens
tgccagggcttcctcttc

SEQ ID NO: 1239736 - DNA, 17 bp, Homo sapiens
tgccaggggcttgagaa

SEQ ID NO: 1239737 - DNA, 16 bp, Homo sapiens
tgccaggggtaacctg

SEQ ID NO: 1239738 - DNA, 21 bp, Homo sapiens
tgccaggggtaacctggccac

SEQ ID NO: 1239739 - DNA, 17 bp, Homo sapiens
tgccagggtgggctggg

SEQ ID NO: 1239740 - DNA, 19 bp, Homo sapiens
tgccagggtgggctgggga

SEQ ID NO: 1239741 - DNA, 14 bp, Homo sapiens
tgccaggtgagaaa

SEQ ID NO: 1239742 - DNA, 17 bp, Homo sapiens
tgccaggtgagaaactg

SEQ ID NO: 1239743 - DNA, 21 bp, Homo sapiens
tgccagtaacgcgtcttcctg

SEQ ID NO: 1239744 - DNA, 17 bp, Homo sapiens
tgccagtattttaaaat

SEQ ID NO: 1239745 - DNA, 13 bp, Homo sapiens
tgccagtattttt

SEQ ID NO: 1239746 - DNA, 19 bp, Homo sapiens
tgccagtccccctgcccca

SEQ ID NO: 1239747 - DNA, 13 bp, Homo sapiens
tgccagtcctggg

SEQ ID NO: 1239748 - DNA, 23 bp, Homo sapiens
tgccagtcgggagagccaggctt

SEQ ID NO: 1239749 - DNA, 17 bp, Homo sapiens
tgccagtctttaagatc

SEQ ID NO: 1239750 - DNA, 16 bp, Homo sapiens
tgccagtgaagtcctt

SEQ ID NO: 1239751 - DNA, 16 bp, Homo sapiens
tgccagtgacagacag

SEQ ID NO: 1239752 - DNA, 17 bp, Homo sapiens
tgccagtgacagacagg

SEQ ID NO: 1239753 - DNA, 13 bp, Homo sapiens
tgccagtgcctta

SEQ ID NO: 1239754 - DNA, 14 bp, Homo sapiens
tgccagttcctgta

SEQ ID NO: 1239755 - DNA, 23 bp, Homo sapiens
tgccagttgaaaatggattttta

SEQ ID NO: 1239756 - DNA, 19 bp, Homo sapiens
tgccagttttgtttccttt

SEQ ID NO: 1239757 - DNA, 20 bp, Homo sapiens
tgccagtttttaaaatgctg

SEQ ID NO: 1239758 - DNA, 20 bp, Homo sapiens
tgccataaaacattaagaaa

SEQ ID NO: 1239759 - DNA, 22 bp, Homo sapiens
tgccataaaacattaagaaaat

SEQ ID NO: 1239760 - DNA, 23 bp, Homo sapiens
tgccataaaacattaagaaaatc

SEQ ID NO: 1239761 - DNA, 17 bp, Homo sapiens
tgccataaaattgcagt

SEQ ID NO: 1239762 - DNA, 14 bp, Homo sapiens
tgccatactaatga

SEQ ID NO: 1239763 - DNA, 22 bp, Homo sapiens
tgccatactttgtctgaaaaat

SEQ ID NO: 1239764 - DNA, 20 bp, Homo sapiens
tgccatagagtttaacacaa

SEQ ID NO: 1239765 - DNA, 13 bp, Homo sapiens
tgccatagcataa

SEQ ID NO: 1239766 - DNA, 23 bp, Homo sapiens
tgccatagggtctgcagcctgct

SEQ ID NO: 1239767 - DNA, 21 bp, Homo sapiens
tgccatatataacagatacat

SEQ ID NO: 1239768 - DNA, 22 bp, Homo sapiens
tgccatatggaggactgtgaca

SEQ ID NO: 1239769 - DNA, 21 bp, Homo sapiens
tgccatattaaaatctgatgt

SEQ ID NO: 1239770 - DNA, 14 bp, Homo sapiens
tgccatattaaatt

SEQ ID NO: 1239771 - DNA, 17 bp, Homo sapiens
tgccatattttcaccat

SEQ ID NO: 1239772 - DNA, 15 bp, Homo sapiens
tgccatcaaatgaat

SEQ ID NO: 1239773 - DNA, 19 bp, Homo sapiens
tgccatcaccgctgggtgg

SEQ ID NO: 1239774 - DNA, 14 bp, Homo sapiens
tgccatcagcccct

SEQ ID NO: 1239775 - DNA, 23 bp, Homo sapiens
tgccatcagcccctgggaacagg

SEQ ID NO: 1239776 - DNA, 15 bp, Homo sapiens
tgccatcatgcctga

SEQ ID NO: 1239777 - DNA, 22 bp, Homo sapiens
tgccatcatttttgatgactac

SEQ ID NO: 1239778 - DNA, 15 bp, Homo sapiens
tgccatccagttttg

SEQ ID NO: 1239779 - DNA, 16 bp, Homo sapiens
tgccatccattctgga

SEQ ID NO: 1239780 - DNA, 15 bp, Homo sapiens
tgccatccccctctc

SEQ ID NO: 1239781 - DNA, 20 bp, Homo sapiens
tgccatccccctctcacgcc

SEQ ID NO: 1239782 - DNA, 21 bp, Homo sapiens
tgccatcctaaaagccacccc

SEQ ID NO: 1239783 - DNA, 14 bp, Homo sapiens
tgccatcggacagg

SEQ ID NO: 1239784 - DNA, 17 bp, Homo sapiens
tgccatctagccagccc

SEQ ID NO: 1239785 - DNA, 18 bp, Homo sapiens
tgccatctagccagcccc

SEQ ID NO: 1239786 - DNA, 12 bp, Homo sapiens
tgccatctgttt

SEQ ID NO: 1239787 - DNA, 13 bp, Homo sapiens
tgccatcttccca

SEQ ID NO: 1239788 - DNA, 17 bp, Homo sapiens
tgccatgacagaggctg

SEQ ID NO: 1239789 - DNA, 15 bp, Homo sapiens
tgccatgacatttca

SEQ ID NO: 1239790 - DNA, 16 bp, Homo sapiens
tgccatgacatttcat

SEQ ID NO: 1239791 - DNA, 18 bp, Homo sapiens
tgccatgacatttcatct

SEQ ID NO: 1239792 - DNA, 19 bp, Homo sapiens
tgccatgacatttcatctg

SEQ ID NO: 1239793 - DNA, 20 bp, Homo sapiens
tgccatgacatttcatctgg

SEQ ID NO: 1239794 - DNA, 14 bp, Homo sapiens
tgccatgatctgta

SEQ ID NO: 1239795 - DNA, 15 bp, Homo sapiens
tgccatgatgtatat

SEQ ID NO: 1239796 - DNA, 14 bp, Homo sapiens
tgccatgatgttta

SEQ ID NO: 1239797 - DNA, 22 bp, Homo sapiens
tgccatgatttttggtatttat

SEQ ID NO: 1239798 - DNA, 23 bp, Homo sapiens
tgccatgcaggaagaggcccact

SEQ ID NO: 1239799 - DNA, 14 bp, Homo sapiens
tgccatgccactgc

SEQ ID NO: 1239800 - DNA, 15 bp, Homo sapiens
tgccatgctgggcca

SEQ ID NO: 1239801 - DNA, 19 bp, Homo sapiens
tgccatgctttttggtgag

SEQ ID NO: 1239802 - DNA, 20 bp, Homo sapiens
tgccatggaattccctcctg

SEQ ID NO: 1239803 - DNA, 18 bp, Homo sapiens
tgccatggagatctgaag

SEQ ID NO: 1239804 - DNA, 14 bp, Homo sapiens
tgccatggatctga

SEQ ID NO: 1239805 - DNA, 18 bp, Homo sapiens
tgccatggatctgatctg

SEQ ID NO: 1239806 - DNA, 24 bp, Homo sapiens
tgccatggatctgatctgtaccat

SEQ ID NO: 1239807 - DNA, 20 bp, Homo sapiens
tgccatggccccccactccc

SEQ ID NO: 1239808 - DNA, 17 bp, Homo sapiens
tgccccgtcaccatctc

SEQ ID NO: 1239809 - DNA, 18 bp, Homo sapiens
tgccccgtcaccatctca

SEQ ID NO: 1239810 - DNA, 23 bp, Homo sapiens
tgccccgttccctgtcagaggct

SEQ ID NO: 1239811 - DNA, 23 bp, Homo sapiens
tgcccctaagctggctgtacctg

SEQ ID NO: 1239812 - DNA, 15 bp, Homo sapiens
tgcccctaagttatt

SEQ ID NO: 1239813 - DNA, 17 bp, Homo sapiens
tgcccctaatctctgta

SEQ ID NO: 1239814 - DNA, 18 bp, Homo sapiens
tgcccctaggatgctgca

SEQ ID NO: 1239815 - DNA, 23 bp, Homo sapiens
tgcccctaggatgctgcagcaga

SEQ ID NO: 1239816 - DNA, 17 bp, Homo sapiens
tgcccctagggtccctc

SEQ ID NO: 1239817 - DNA, 18 bp, Homo sapiens
tgcccctcagggggccag

SEQ ID NO: 1239818 - DNA, 23 bp, Homo sapiens
tgcccctcccccaacccccaccc

SEQ ID NO: 1239819 - DNA, 14 bp, Homo sapiens
tgcccctcccccag

SEQ ID NO: 1239820 - DNA, 15 bp, Homo sapiens
tgcccctcccccagc

SEQ ID NO: 1239821 - DNA, 16 bp, Homo sapiens
tgcccctcccccagcc

SEQ ID NO: 1239822 - DNA, 16 bp, Homo sapiens
tgcccctcccccagct

SEQ ID NO: 1239823 - DNA, 22 bp, Homo sapiens
tgcccctccccgtccctgtccc

SEQ ID NO: 1239824 - DNA, 13 bp, Homo sapiens
tgcccctccctca

SEQ ID NO: 1239825 - DNA, 12 bp, Homo sapiens
tgcccctcgcac

SEQ ID NO: 1239826 - DNA, 15 bp, Homo sapiens
tgcccctcgcacaca

SEQ ID NO: 1239827 - DNA, 17 bp, Homo sapiens
tgcccctcgcacacagg

SEQ ID NO: 1239828 - DNA, 12 bp, Homo sapiens
tgcccctctcac

SEQ ID NO: 1239829 - DNA, 14 bp, Homo sapiens
tgcccctctcacca

SEQ ID NO: 1239830 - DNA, 15 bp, Homo sapiens
tgcccctctgttctc

SEQ ID NO: 1239831 - DNA, 19 bp, Homo sapiens
tgcccctctgttctctccc

SEQ ID NO: 1239832 - DNA, 13 bp, Homo sapiens
tgcccctctttct

SEQ ID NO: 1239833 - DNA, 14 bp, Homo sapiens
tgcccctctttctc

SEQ ID NO: 1239834 - DNA, 17 bp, Homo sapiens
tgcccctctttctcttt

SEQ ID NO: 1239835 - DNA, 21 bp, Homo sapiens
tgcccctctttctctttcttc

SEQ ID NO: 1239836 - DNA, 18 bp, Homo sapiens
tgcccctgatgcagcctg

SEQ ID NO: 1239837 - DNA, 23 bp, Homo sapiens
tgcccctgatgcagcctgtggct

SEQ ID NO: 1239838 - DNA, 20 bp, Homo sapiens
tgcccctgcagtttggccct

SEQ ID NO: 1239839 - DNA, 16 bp, Homo sapiens
tgcccctgctccctct

SEQ ID NO: 1239840 - DNA, 13 bp, Homo sapiens
tgcccctggccca

SEQ ID NO: 1239841 - DNA, 22 bp, Homo sapiens
tgcccctgtaaggtttcaatgc

SEQ ID NO: 1239842 - DNA, 23 bp, Homo sapiens
tgcccctgtcccacctggctccc

SEQ ID NO: 1239843 - DNA, 12 bp, Homo sapiens
tgcccctgtctg

SEQ ID NO: 1239844 - DNA, 22 bp, Homo sapiens
tgcccctgtgctgcggggcctt

SEQ ID NO: 1239845 - DNA, 22 bp, Homo sapiens
tgccccttaagggttgaaggca

SEQ ID NO: 1239846 - DNA, 23 bp, Homo sapiens
tgccccttaagggttgaaggcag

SEQ ID NO: 1239847 - DNA, 19 bp, Homo sapiens
tgccccttcccatctcttc

SEQ ID NO: 1239848 - DNA, 17 bp, Homo sapiens
tgccccttctccccttc

SEQ ID NO: 1239849 - DNA, 19 bp, Homo sapiens
tgccccttctccccttcct

SEQ ID NO: 1239850 - DNA, 16 bp, Homo sapiens
tgccccttcttgggcc

SEQ ID NO: 1239851 - DNA, 14 bp, Homo sapiens
tgccccttgcaagc

SEQ ID NO: 1239852 - DNA, 16 bp, Homo sapiens
tgccccttgcaagcca

SEQ ID NO: 1239853 - DNA, 21 bp, Homo sapiens
tgccccttgggcatccaccca

SEQ ID NO: 1239854 - DNA, 21 bp, Homo sapiens
tgcccctttccttcactgccc

SEQ ID NO: 1239855 - DNA, 18 bp, Homo sapiens
tgcccctttctcttttcc

SEQ ID NO: 1239856 - DNA, 18 bp, Homo sapiens
tgcccgaaactaagccag

SEQ ID NO: 1239857 - DNA, 20 bp, Homo sapiens
tgcccgagctggtgcattac

SEQ ID NO: 1239858 - DNA, 19 bp, Homo sapiens
tgcccgagtccgcccatcc

SEQ ID NO: 1239859 - DNA, 14 bp, Homo sapiens
tgcccgcacccctc

SEQ ID NO: 1239860 - DNA, 19 bp, Homo sapiens
tgcccgcacccctccctgc

SEQ ID NO: 1239861 - DNA, 20 bp, Homo sapiens
tgcccgcacccctccctgct

SEQ ID NO: 1239862 - DNA, 16 bp, Homo sapiens
tgcccgcatgtgtgcc

SEQ ID NO: 1239863 - DNA, 23 bp, Homo sapiens
tgcccgccacatggtgtggccat

SEQ ID NO: 1239864 - DNA, 13 bp, Homo sapiens
tgcccgccagcct

SEQ ID NO: 1239865 - DNA, 18 bp, Homo sapiens
tgcccgccagcctcagtg

SEQ ID NO: 1239866 - DNA, 16 bp, Homo sapiens
tgcccgcgctcaggag

SEQ ID NO: 1239867 - DNA, 15 bp, Homo sapiens
tgcccgctcccaacc

SEQ ID NO: 1239868 - DNA, 21 bp, Homo sapiens
tgcccgctcccaacccccctc

SEQ ID NO: 1239869 - DNA, 23 bp, Homo sapiens
tgcccgctcccacagcttcctga

SEQ ID NO: 1239870 - DNA, 16 bp, Homo sapiens
tgcccgctcctcggga

SEQ ID NO: 1239871 - DNA, 19 bp, Homo sapiens
tgcccgctgcaatgcctag

SEQ ID NO: 1239872 - DNA, 23 bp, Homo sapiens
tgcccggccccaccccctgggca

SEQ ID NO: 1239873 - DNA, 18 bp, Homo sapiens
tgcccggcgcctgccctg

SEQ ID NO: 1239874 - DNA, 18 bp, Homo sapiens
tgcccggggaaaggcaag

SEQ ID NO: 1239875 - DNA, 21 bp, Homo sapiens
tgcccggggaaaggcaaggtc

SEQ ID NO: 1239876 - DNA, 14 bp, Homo sapiens
tgcccggggagctg

SEQ ID NO: 1239877 - DNA, 17 bp, Homo sapiens
tgcccggggagctgcag

SEQ ID NO: 1239878 - DNA, 14 bp, Homo sapiens
tgcccggggcagca

SEQ ID NO: 1239879 - DNA, 22 bp, Homo sapiens
tgcccggggcagcagcagccct

SEQ ID NO: 1239880 - DNA, 18 bp, Homo sapiens
tgcccggggcagctgcca

SEQ ID NO: 1239881 - DNA, 21 bp, Homo sapiens
tgcccgggggacgcctgccct

SEQ ID NO: 1239882 - DNA, 21 bp, Homo sapiens
tgcccggggtggggtgcactc

SEQ ID NO: 1239883 - DNA, 23 bp, Homo sapiens
tgcccggggtggggtgcactcgc

SEQ ID NO: 1239884 - DNA, 14 bp, Homo sapiens
tgcccgtcggccct

SEQ ID NO: 1239885 - DNA, 15 bp, Homo sapiens
tgcccgtcggccctg

SEQ ID NO: 1239886 - DNA, 16 bp, Homo sapiens
tgcccgtcttcagcct

SEQ ID NO: 1239887 - DNA, 15 bp, Homo sapiens
tgcccgtgcccgcag

SEQ ID NO: 1239888 - DNA, 17 bp, Homo sapiens
tgcccgtgcccgcagga

SEQ ID NO: 1239889 - DNA, 19 bp, Homo sapiens
tgcccgtgtagtccccaac

SEQ ID NO: 1239890 - DNA, 14 bp, Homo sapiens
tgccctaagccccc

SEQ ID NO: 1239891 - DNA, 16 bp, Homo sapiens
tgccctaagcccccag

SEQ ID NO: 1239892 - DNA, 19 bp, Homo sapiens
tgccctaagcccccagggc

SEQ ID NO: 1239893 - DNA, 12 bp, Homo sapiens
tgccctaagtga

SEQ ID NO: 1239894 - DNA, 18 bp, Homo sapiens
tgccctacagaggtctct

SEQ ID NO: 1239895 - DNA, 22 bp, Homo sapiens
tgccctacagcaccctgtggtc

SEQ ID NO: 1239896 - DNA, 19 bp, Homo sapiens
tgccctactcattggggtt

SEQ ID NO: 1239897 - DNA, 14 bp, Homo sapiens
tgccctagcgctct

SEQ ID NO: 1239898 - DNA, 15 bp, Homo sapiens
tgccctatgggcctg

SEQ ID NO: 1239899 - DNA, 16 bp, Homo sapiens
tgccctcaatcccagc

SEQ ID NO: 1239900 - DNA, 13 bp, Homo sapiens
tgccctcaccacc

SEQ ID NO: 1239901 - DNA, 15 bp, Homo sapiens
tgccctcaccaccac

SEQ ID NO: 1239902 - DNA, 21 bp, Homo sapiens
tgccctcaccccaatccctgc

SEQ ID NO: 1239903 - DNA, 17 bp, Homo sapiens
tgccctcactccctctg

SEQ ID NO: 1239904 - DNA, 21 bp, Homo sapiens
tgccctcactccctctgcaga

SEQ ID NO: 1239905 - DNA, 12 bp, Homo sapiens
tgccctcagggg

SEQ ID NO: 1239906 - DNA, 23 bp, Homo sapiens
tgccctcattactgggccttagt

SEQ ID NO: 1239907 - DNA, 18 bp, Homo sapiens
tgccctcattttatgtca

SEQ ID NO: 1239908 - DNA, 14 bp, Homo sapiens
tgccctccaaagag

SEQ ID NO: 1239909 - DNA, 18 bp, Homo sapiens
tgccctccacagccgcag

SEQ ID NO: 1239910 - DNA, 13 bp, Homo sapiens
tgccctccatccc

SEQ ID NO: 1239911 - DNA, 22 bp, Homo sapiens
tgccctcccaggaccctccact

SEQ ID NO: 1239912 - DNA, 16 bp, Homo sapiens
tgccctccccagagca

SEQ ID NO: 1239913 - DNA, 20 bp, Homo sapiens
tgccctccccagagcactgg

SEQ ID NO: 1239914 - DNA, 19 bp, Homo sapiens
tgccctcccctcagcgcag

SEQ ID NO: 1239915 - DNA, 20 bp, Homo sapiens
tgccctcccctcagcgcagg

SEQ ID NO: 1239916 - DNA, 13 bp, Homo sapiens
tgccctcccttct

SEQ ID NO: 1239917 - DNA, 20 bp, Homo sapiens
tgccctcccttctccctgga

SEQ ID NO: 1239918 - DNA, 18 bp, Homo sapiens
tgccctccgcctgggatc

SEQ ID NO: 1239919 - DNA, 13 bp, Homo sapiens
tgccctccggagg

SEQ ID NO: 1239920 - DNA, 22 bp, Homo sapiens
tgccctccggaggagcagcctc

SEQ ID NO: 1239921 - DNA, 22 bp, Homo sapiens
tgccctcctaaatgtcagctgt

SEQ ID NO: 1239922 - DNA, 16 bp, Homo sapiens
tgccctcctgagcctc

SEQ ID NO: 1239923 - DNA, 11 bp, Homo sapiens
tgccctcctgc

SEQ ID NO: 1239924 - DNA, 15 bp, Homo sapiens
tgccctcgctgcttc

SEQ ID NO: 1239925 - DNA, 19 bp, Homo sapiens
tgccctcgtctccctggcc

SEQ ID NO: 1239926 - DNA, 15 bp, Homo sapiens
tgccctcgtggccag

SEQ ID NO: 1239927 - DNA, 18 bp, Homo sapiens
tgccctcgtggccagccc

SEQ ID NO: 1239928 - DNA, 18 bp, Homo sapiens
tgccctctgctcaggcct

SEQ ID NO: 1239929 - DNA, 20 bp, Homo sapiens
tgccctctgctctgcctgga

SEQ ID NO: 1239930 - DNA, 22 bp, Homo sapiens
tgccctctgctctgcctggagt

SEQ ID NO: 1239931 - DNA, 12 bp, Homo sapiens
tgccctctgctg

SEQ ID NO: 1239932 - DNA, 17 bp, Homo sapiens
tgccatgtacctcccct

SEQ ID NO: 1239933 - DNA, 22 bp, Homo sapiens
tgccatgtacctcccctgcctt

SEQ ID NO: 1239934 - DNA, 16 bp, Homo sapiens
tgccatgtagacccct

SEQ ID NO: 1239935 - DNA, 16 bp, Homo sapiens
tgccatgtgaagaggg

SEQ ID NO: 1239936 - DNA, 21 bp, Homo sapiens
tgccatgttgcccctttctct

SEQ ID NO: 1239937 - DNA, 15 bp, Homo sapiens
tgccatgttggccag

SEQ ID NO: 1239938 - DNA, 21 bp, Homo sapiens
tgccatgtttagattccagga

SEQ ID NO: 1239939 - DNA, 19 bp, Homo sapiens
tgccatgtttttgccaaaa

SEQ ID NO: 1239940 - DNA, 15 bp, Homo sapiens
tgccattactactgt

SEQ ID NO: 1239941 - DNA, 19 bp, Homo sapiens
tgccattatatttgcatta

SEQ ID NO: 1239942 - DNA, 19 bp, Homo sapiens
tgccattcaaggcttattt

SEQ ID NO: 1239943 - DNA, 20 bp, Homo sapiens
tgccattccaaaatattatg

SEQ ID NO: 1239944 - DNA, 15 bp, Homo sapiens
tgccctctgctgctg

SEQ ID NO: 1239945 - DNA, 16 bp, Homo sapiens
tgccctctgctgctgc

SEQ ID NO: 1239946 - DNA, 13 bp, Homo sapiens
tgccctctgggtc

SEQ ID NO: 1239947 - DNA, 20 bp, Homo sapiens
tgccctcttaagatctgact

SEQ ID NO: 1239948 - DNA, 18 bp, Homo sapiens
tgccctgaccatgcattt

SEQ ID NO: 1239949 - DNA, 13 bp, Homo sapiens
tgccctgacctcc

SEQ ID NO: 1239950 - DNA, 14 bp, Homo sapiens
tgccctgacctccc

SEQ ID NO: 1239951 - DNA, 16 bp, Homo sapiens
tgccctgacctcccag

SEQ ID NO: 1239952 - DNA, 22 bp, Homo sapiens
tgccctgacctcccagccctat

SEQ ID NO: 1239953 - DNA, 15 bp, Homo sapiens
tgccctgagaagctg

SEQ ID NO: 1239954 - DNA, 14 bp, Homo sapiens
tgccctgcagagca

SEQ ID NO: 1239955 - DNA, 18 bp, Homo sapiens
tgccctgcagagcaataa

SEQ ID NO: 1239956 - DNA, 20 bp, Homo sapiens
tgccctgcagagcaataaca

SEQ ID NO: 1239957 - DNA, 13 bp, Homo sapiens
tgccctgcagcac

SEQ ID NO: 1239958 - DNA, 20 bp, Homo sapiens
tgccctgcccaagtgaccag

SEQ ID NO: 1239959 - DNA, 11 bp, Homo sapiens
tgccctgccct

SEQ ID NO: 1239960 - DNA, 17 bp, Homo sapiens
tgccctgcccttcctca

SEQ ID NO: 1239961 - DNA, 18 bp, Homo sapiens
tgccctgcccttcctcag

SEQ ID NO: 1239962 - DNA, 21 bp, Homo sapiens
tgccctgcctcagccaggccc

SEQ ID NO: 1239963 - DNA, 14 bp, Homo sapiens
tgccctgcctccct

SEQ ID NO: 1239964 - DNA, 14 bp, Homo sapiens
tgccctgcctgagg

SEQ ID NO: 1239965 - DNA, 16 bp, Homo sapiens
tgccctgcctgaggag

SEQ ID NO: 1239966 - DNA, 18 bp, Homo sapiens
tgccctgcctgcccactt

SEQ ID NO: 1239967 - DNA, 17 bp, Homo sapiens
tgccctgcctgggcctt

SEQ ID NO: 1239968 - DNA, 15 bp, Homo sapiens
tgccctgctcctaag

SEQ ID NO: 1239969 - DNA, 23 bp, Homo sapiens
tgccctgctgccgcctcccagcc

SEQ ID NO: 1239970 - DNA, 14 bp, Homo sapiens
tgccctgctggcct

SEQ ID NO: 1239971 - DNA, 15 bp, Homo sapiens
tgccctgctggcctg

SEQ ID NO: 1239972 - DNA, 13 bp, Homo sapiens
tgccctggaggga

SEQ ID NO: 1239973 - DNA, 16 bp, Homo sapiens
tgccctggatgcccag

SEQ ID NO: 1239974 - DNA, 22 bp, Homo sapiens
tgccctggcagggtcatcctgt

SEQ ID NO: 1239975 - DNA, 14 bp, Homo sapiens
tgccctggccctga

SEQ ID NO: 1239976 - DNA, 17 bp, Homo sapiens
tgccctggccctgaggt

SEQ ID NO: 1239977 - DNA, 21 bp, Homo sapiens
tgccctggctccagtgaaact

SEQ ID NO: 1239978 - DNA, 11 bp, Homo sapiens
tgccctggctg

SEQ ID NO: 1239979 - DNA, 12 bp, Homo sapiens
tgccctggctgc

SEQ ID NO: 1239980 - DNA, 18 bp, Homo sapiens
tgccctggctgctgcccc

SEQ ID NO: 1239981 - DNA, 22 bp, Homo sapiens
tgccctgggagctctgggactg

SEQ ID NO: 1239982 - DNA, 16 bp, Homo sapiens
tgccctgggatgcctc

SEQ ID NO: 1239983 - DNA, 18 bp, Homo sapiens
tgccctgggccaggcagg

SEQ ID NO: 1239984 - DNA, 21 bp, Homo sapiens
tgccctggtccagggaagctg

SEQ ID NO: 1239985 - DNA, 20 bp, Homo sapiens
tgccctggtgctgccacact

SEQ ID NO: 1239986 - DNA, 21 bp, Homo sapiens
tgccctggtgctgccacactt

SEQ ID NO: 1239987 - DNA, 14 bp, Homo sapiens
tgccctggtggaga

SEQ ID NO: 1239988 - DNA, 22 bp, Homo sapiens
tgccctggtggagaaagcactg

SEQ ID NO: 1239989 - DNA, 21 bp, Homo sapiens
tgccctgtccaaaagcgccct

SEQ ID NO: 1239990 - DNA, 20 bp, Homo sapiens
tgccctgtgccgcactctgg

SEQ ID NO: 1239991 - DNA, 13 bp, Homo sapiens
tgccctgtgtact

SEQ ID NO: 1239992 - DNA, 14 bp, Homo sapiens
tgccctgtgtggct

SEQ ID NO: 1239993 - DNA, 18 bp, Homo sapiens
tgccctgttctcttcaca

SEQ ID NO: 1239994 - DNA, 20 bp, Homo sapiens
tgccctgttgtgtatagatg

SEQ ID NO: 1239995 - DNA, 15 bp, Homo sapiens
tgcccttaaatcata

SEQ ID NO: 1239996 - DNA, 22 bp, Homo sapiens
tgcccttccccctgcaaaaaga

SEQ ID NO: 1239997 - DNA, 15 bp, Homo sapiens
tgcccttcccctccc

SEQ ID NO: 1239998 - DNA, 15 bp, Homo sapiens
tgcccttccctctgg

SEQ ID NO: 1239999 - DNA, 19 bp, Homo sapiens
tgcccttccctctgggcac

SEQ ID NO: 1240000 - DNA, 13 bp, Homo sapiens
tgcccttccctgt

SEQ ID NO: 1240001 - DNA, 20 bp, Homo sapiens
tgcccttccctgtccctcta

SEQ ID NO: 1240002 - DNA, 14 bp, Homo sapiens
tgcccttcctcagg

SEQ ID NO: 1240003 - DNA, 18 bp, Homo sapiens
tgcccttcctcagtttaa

SEQ ID NO: 1240004 - DNA, 17 bp, Homo sapiens
tgcccttctcaagactt

SEQ ID NO: 1240005 - DNA, 18 bp, Homo sapiens
tgcccttctcaagacttt

SEQ ID NO: 1240006 - DNA, 20 bp, Homo sapiens
tgcccttctcaagactttag

SEQ ID NO: 1240007 - DNA, 17 bp, Homo sapiens
tgcccttctctgcctcc

SEQ ID NO: 1240008 - DNA, 19 bp, Homo sapiens
tgcccttgcccttggagct

SEQ ID NO: 1240009 - DNA, 13 bp, Homo sapiens
tgcccttgctgcc

SEQ ID NO: 1240010 - DNA, 20 bp, Homo sapiens
tgcccttggcaccaccaggg

SEQ ID NO: 1240011 - DNA, 22 bp, Homo sapiens
tgcccttggcaccaccagggtg

SEQ ID NO: 1240012 - DNA, 11 bp, Homo sapiens
tgccctttgag

SEQ ID NO: 1240013 - DNA, 14 bp, Homo sapiens
tgccctttggggtc

SEQ ID NO: 1240014 - DNA, 16 bp, Homo sapiens
tgcccttttcaggaag

SEQ ID NO: 1240015 - DNA, 20 bp, Homo sapiens
tgccgaacattaggaattgt

SEQ ID NO: 1240016 - DNA, 17 bp, Homo sapiens
tgccgaagaattgtctt

SEQ ID NO: 1240017 - DNA, 21 bp, Homo sapiens
tgccgaccagagccccacacg

SEQ ID NO: 1240018 - DNA, 15 bp, Homo sapiens
tgccgaccgaggctg

SEQ ID NO: 1240019 - DNA, 22 bp, Homo sapiens
tgccgaccgaggctggagctgg

SEQ ID NO: 1240020 - DNA, 15 bp, Homo sapiens
tgccgacgtccccaa

SEQ ID NO: 1240021 - DNA, 12 bp, Homo sapiens
tgccgactcccc

SEQ ID NO: 1240022 - DNA, 14 bp, Homo sapiens
tgccgactcctggg

SEQ ID NO: 1240023 - DNA, 15 bp, Homo sapiens
tgccgactcctgggt

SEQ ID NO: 1240024 - DNA, 16 bp, Homo sapiens
tgccgagcctaatgaa

SEQ ID NO: 1240025 - DNA, 22 bp, Homo sapiens
tgccgatttcataccttatgct

SEQ ID NO: 1240026 - DNA, 12 bp, Homo sapiens
tgccgcacccca

SEQ ID NO: 1240027 - DNA, 21 bp, Homo sapiens
tgccgcaggcgcggcggctct

SEQ ID NO: 1240028 - DNA, 13 bp, Homo sapiens
tgccgcagggagg

SEQ ID NO: 1240029 - DNA, 17 bp, Homo sapiens
tgccgcagggagggctg

SEQ ID NO: 1240030 - DNA, 23 bp, Homo sapiens
tgccgcaggtgggtgctgccctg

SEQ ID NO: 1240031 - DNA, 15 bp, Homo sapiens
tgccgcatgctccct

SEQ ID NO: 1240032 - DNA, 17 bp, Homo sapiens
tgccgccccctcctgaa

SEQ ID NO: 1240033 - DNA, 18 bp, Homo sapiens
tgccgccgtctctgtccc

SEQ ID NO: 1240034 - DNA, 13 bp, Homo sapiens
tgccgcctcccag

SEQ ID NO: 1240035 - DNA, 16 bp, Homo sapiens
tgccgcctcccagcct

SEQ ID NO: 1240036 - DNA, 17 bp, Homo sapiens
tgccgcctcccagcctg

SEQ ID NO: 1240037 - DNA, 18 bp, Homo sapiens
tgccgcctcccagcctgg

SEQ ID NO: 1240038 - DNA, 14 bp, Homo sapiens
tgccgcctgctcct

SEQ ID NO: 1240039 - DNA, 15 bp, Homo sapiens
tgccgcctgctcctc

SEQ ID NO: 1240040 - DNA, 16 bp, Homo sapiens
tgccgcctgctcctca

SEQ ID NO: 1240041 - DNA, 15 bp, Homo sapiens
tgccgctacctccct

SEQ ID NO: 1240042 - DNA, 17 bp, Homo sapiens
tgccgctacctccctcc

SEQ ID NO: 1240043 - DNA, 15 bp, Homo sapiens
tgccgctccccttgg

SEQ ID NO: 1240044 - DNA, 16 bp, Homo sapiens
tgccgctccccttgga

SEQ ID NO: 1240045 - DNA, 15 bp, Homo sapiens
tgccgctcctgcttc

SEQ ID NO: 1240046 - DNA, 22 bp, Homo sapiens
tgccgctcctgcttcccctccc

SEQ ID NO: 1240047 - DNA, 16 bp, Homo sapiens
tgccgctgccgctgca

SEQ ID NO: 1240048 - DNA, 16 bp, Homo sapiens
tgccggatacaaactg

SEQ ID NO: 1240049 - DNA, 15 bp, Homo sapiens
tgccggatctgggct

SEQ ID NO: 1240050 - DNA, 14 bp, Homo sapiens
tgccggatgtgctt

SEQ ID NO: 1240051 - DNA, 19 bp, Homo sapiens
tgccggcggcagccccact

SEQ ID NO: 1240052 - DNA, 22 bp, Homo sapiens
tgccggcggcagccccacttca

SEQ ID NO: 1240053 - DNA, 14 bp, Homo sapiens
tgccgggcgccagg

SEQ ID NO: 1240054 - DNA, 17 bp, Homo sapiens
tgccgggcgccaggaca

SEQ ID NO: 1240055 - DNA, 21 bp, Homo sapiens
tgccgggcgccaggacagcag

SEQ ID NO: 1240056 - DNA, 22 bp, Homo sapiens
tgccgggctgagggcctgctgg

SEQ ID NO: 1240057 - DNA, 23 bp, Homo sapiens
tgccggggaggggcagagaggaa

SEQ ID NO: 1240058 - DNA, 19 bp, Homo sapiens
tgccgggttctagtctcct

SEQ ID NO: 1240059 - DNA, 14 bp, Homo sapiens
tgccgtcaccacca

SEQ ID NO: 1240060 - DNA, 16 bp, Homo sapiens
tgccgtcaccaccacc

SEQ ID NO: 1240061 - DNA, 18 bp, Homo sapiens
tgccgtctcatcttctct

SEQ ID NO: 1240062 - DNA, 20 bp, Homo sapiens
tgccgtctctcctgctctca

SEQ ID NO: 1240063 - DNA, 13 bp, Homo sapiens
tgccgtctctgga

SEQ ID NO: 1240064 - DNA, 14 bp, Homo sapiens
tgccgtctctggag

SEQ ID NO: 1240065 - DNA, 20 bp, Homo sapiens
tgccgtggattgcacgtggc

SEQ ID NO: 1240066 - DNA, 12 bp, Homo sapiens
tgccgtgtccaa

SEQ ID NO: 1240067 - DNA, 21 bp, Homo sapiens
tgccgtgtcccctgacagggc

SEQ ID NO: 1240068 - DNA, 16 bp, Homo sapiens
tgccgttactctccaa

SEQ ID NO: 1240069 - DNA, 19 bp, Homo sapiens
tgcctaaaaattcccttcc

SEQ ID NO: 1240070 - DNA, 20 bp, Homo sapiens
tgcctaaaaattcccttcct

SEQ ID NO: 1240071 - DNA, 21 bp, Homo sapiens
tgcctaaaaattcccttcctg

SEQ ID NO: 1240072 - DNA, 23 bp, Homo sapiens
tgcctaaaaattcccttcctgtt

SEQ ID NO: 1240073 - DNA, 19 bp, Homo sapiens
tgcctaaaattgtatgaaa

SEQ ID NO: 1240074 - DNA, 21 bp, Homo sapiens
tgcctaaaattgtatgaaaat

SEQ ID NO: 1240075 - DNA, 13 bp, Homo sapiens
tgcctaaagtgct

SEQ ID NO: 1240076 - DNA, 14 bp, Homo sapiens
tgcctaaagtgctg

SEQ ID NO: 1240077 - DNA, 15 bp, Homo sapiens
tgcctaaagtgctgc

SEQ ID NO: 1240078 - DNA, 17 bp, Homo sapiens
tgcctaaagtgctgcag

SEQ ID NO: 1240079 - DNA, 16 bp, Homo sapiens
tgcctaacttgtaaaa

SEQ ID NO: 1240080 - DNA, 13 bp, Homo sapiens
tgcctaagaagtt

SEQ ID NO: 1240081 - DNA, 21 bp, Homo sapiens
tgcctaataaacatccttcaa

SEQ ID NO: 1240082 - DNA, 18 bp, Homo sapiens
tgcctaattcctggcatg

SEQ ID NO: 1240083 - DNA, 14 bp, Homo sapiens
tgcctacaataaaa

SEQ ID NO: 1240084 - DNA, 18 bp, Homo sapiens
tgcctacacacacagcct

SEQ ID NO: 1240085 - DNA, 14 bp, Homo sapiens
tgcctacagccagg

SEQ ID NO: 1240086 - DNA, 21 bp, Homo sapiens
tgcctagacttcccaacagcc

SEQ ID NO: 1240087 - DNA, 23 bp, Homo sapiens
tgcctagatccacgtgtggcctc

SEQ ID NO: 1240088 - DNA, 18 bp, Homo sapiens
tgcctagcatggggtcag

SEQ ID NO: 1240089 - DNA, 20 bp, Homo sapiens
tgcctagcatggggtcagcc

SEQ ID NO: 1240090 - DNA, 22 bp, Homo sapiens
tgcctagcatggggtcagcccc

SEQ ID NO: 1240091 - DNA, 22 bp, Homo sapiens
tgcctagccccaggtcttttct

SEQ ID NO: 1240092 - DNA, 19 bp, Homo sapiens
tgcctagccctccccccag

SEQ ID NO: 1240093 - DNA, 21 bp, Homo sapiens
tgcctaggaggctggccaagg

SEQ ID NO: 1240094 - DNA, 13 bp, Homo sapiens
tgcctaggccaaa

SEQ ID NO: 1240095 - DNA, 22 bp, Homo sapiens
tgcctaggccaaatgcacaagc

SEQ ID NO: 1240096 - DNA, 14 bp, Homo sapiens
tgcctataatactt

SEQ ID NO: 1240097 - DNA, 18 bp, Homo sapiens
tgcctatagtcccagcta

SEQ ID NO: 1240098 - DNA, 15 bp, Homo sapiens
tgcctatctttaaac

SEQ ID NO: 1240099 - DNA, 15 bp, Homo sapiens
tgcctattgtaatat

SEQ ID NO: 1240100 - DNA, 17 bp, Homo sapiens
tgcctatttgtgtggac

SEQ ID NO: 1240101 - DNA, 22 bp, Homo sapiens
tgcctcaatgtgaatcagaccc

SEQ ID NO: 1240102 - DNA, 23 bp, Homo sapiens
tgcctcaatgtgaatcagaccct

SEQ ID NO: 1240103 - DNA, 18 bp, Homo sapiens
tgcctcaatgtgaccagg

SEQ ID NO: 1240104 - DNA, 19 bp, Homo sapiens
tgcctcacatttttttcta

SEQ ID NO: 1240105 - DNA, 23 bp, Homo sapiens
tgcctcaccacacccaggtctct

SEQ ID NO: 1240106 - DNA, 15 bp, Homo sapiens
tgcctcacctcgaaa

SEQ ID NO: 1240107 - DNA, 21 bp, Homo sapiens
tgcctcagacgttgcctgaga

SEQ ID NO: 1240108 - DNA, 20 bp, Homo sapiens
tgcctcagccagtggcacag

SEQ ID NO: 1240109 - DNA, 22 bp, Homo sapiens
tgcctcagccagtggcacagga

SEQ ID NO: 1240110 - DNA, 11 bp, Homo sapiens
tgcctcagcct

SEQ ID NO: 1240111 - DNA, 17 bp, Homo sapiens
tgcctcagcctcctgag

SEQ ID NO: 1240112 - DNA, 20 bp, Homo sapiens
tgcctcaggaccttttggtc

SEQ ID NO: 1240113 - DNA, 18 bp, Homo sapiens
tgcctcaggaggcaggac

SEQ ID NO: 1240114 - DNA, 16 bp, Homo sapiens
tgcctcaggccagggc

SEQ ID NO: 1240115 - DNA, 21 bp, Homo sapiens
tgcctcagtatatttaaactc

SEQ ID NO: 1240116 - DNA, 19 bp, Homo sapiens
tgcctcagtgtatttgtat

SEQ ID NO: 1240117 - DNA, 12 bp, Homo sapiens
tgcctcagtttt

SEQ ID NO: 1240118 - DNA, 15 bp, Homo sapiens
tgcctcagttttcct

SEQ ID NO: 1240119 - DNA, 19 bp, Homo sapiens
tgcctcagttttccttctg

SEQ ID NO: 1240120 - DNA, 23 bp, Homo sapiens
tgcctcatgcaaccgggccctct

SEQ ID NO: 1240121 - DNA, 17 bp, Homo sapiens
tgcctcatgccacacct

SEQ ID NO: 1240122 - DNA, 21 bp, Homo sapiens
tgcctcatttcttcctctgca

SEQ ID NO: 1240123 - DNA, 19 bp, Homo sapiens
tgcctccaagcggccctgt

SEQ ID NO: 1240124 - DNA, 23 bp, Homo sapiens
tgcctccaagcggccctgtgtgt

SEQ ID NO: 1240125 - DNA, 21 bp, Homo sapiens
tgcctccacatgctgcctggc

SEQ ID NO: 1240126 - DNA, 15 bp, Homo sapiens
tgcctccaccaccac

SEQ ID NO: 1240127 - DNA, 16 bp, Homo sapiens
tgcctccaccaccact

SEQ ID NO: 1240128 - DNA, 17 bp, Homo sapiens
tgcctccaccaccactg

SEQ ID NO: 1240129 - DNA, 23 bp, Homo sapiens
tgcctccaccaccactggccacc

SEQ ID NO: 1240130 - DNA, 22 bp, Homo sapiens
tgcctccacccgtcctccctca

SEQ ID NO: 1240131 - DNA, 13 bp, Homo sapiens
tgcctccaccgct

SEQ ID NO: 1240132 - DNA, 17 bp, Homo sapiens
tgcctccaccgctgcct

SEQ ID NO: 1240133 - DNA, 18 bp, Homo sapiens
tgcctccaccgctgccta

SEQ ID NO: 1240134 - DNA, 15 bp, Homo sapiens
tgcctccaggtgtgc

SEQ ID NO: 1240135 - DNA, 17 bp, Homo sapiens
tgcctcccaggcaagca

SEQ ID NO: 1240136 - DNA, 17 bp, Homo sapiens
tgcctcccatgcctggt

SEQ ID NO: 1240137 - DNA, 16 bp, Homo sapiens
tgcctcccattctgca

SEQ ID NO: 1240138 - DNA, 18 bp, Homo sapiens
tgcctcccattctgcacc

SEQ ID NO: 1240139 - DNA, 18 bp, Homo sapiens
tgcctccccaaccctgcc

SEQ ID NO: 1240140 - DNA, 21 bp, Homo sapiens
tgcctccccaaccctgcccct

SEQ ID NO: 1240141 - DNA, 22 bp, Homo sapiens
tgcctccccaaccctgcccctg

SEQ ID NO: 1240142 - DNA, 23 bp, Homo sapiens
tgcctccccaaccctgcccctgc

SEQ ID NO: 1240143 - DNA, 21 bp, Homo sapiens
tgcctccccatttcccatctg

SEQ ID NO: 1240144 - DNA, 12 bp, Homo sapiens
tgcctcccgaga

SEQ ID NO: 1240145 - DNA, 13 bp, Homo sapiens
tgcctccctctct

SEQ ID NO: 1240146 - DNA, 19 bp, Homo sapiens
tgcctccctctcttccggg

SEQ ID NO: 1240147 - DNA, 13 bp, Homo sapiens
tgcctccctgggc

SEQ ID NO: 1240148 - DNA, 11 bp, Homo sapiens
tgcctcccttc

SEQ ID NO: 1240149 - DNA, 14 bp, Homo sapiens
tgcctcccttccca

SEQ ID NO: 1240150 - DNA, 15 bp, Homo sapiens
tgcctcccttcccag

SEQ ID NO: 1240151 - DNA, 17 bp, Homo sapiens
tgcctccctttctggga

SEQ ID NO: 1240152 - DNA, 19 bp, Homo sapiens
tgcctccctttctgggagg

SEQ ID NO: 1240153 - DNA, 17 bp, Homo sapiens
tgcctcctagagtgcag

SEQ ID NO: 1240154 - DNA, 10 bp, Homo sapiens
tgcctcctca

SEQ ID NO: 1240155 - DNA, 11 bp, Homo sapiens
tgcctcctcaa

SEQ ID NO: 1240156 - DNA, 21 bp, Homo sapiens
tgcctcctcaaacccagtctc

SEQ ID NO: 1240157 - DNA, 13 bp, Homo sapiens
tgcctcctcccat

SEQ ID NO: 1240158 - DNA, 13 bp, Homo sapiens
tgcctcctccctc

SEQ ID NO: 1240159 - DNA, 22 bp, Homo sapiens
tgcctcctccctcccagctgca

SEQ ID NO: 1240160 - DNA, 23 bp, Homo sapiens
tgcctcctccctcccagctgcac

SEQ ID NO: 1240161 - DNA, 20 bp, Homo sapiens
tgcctcctcgttcctttctc

SEQ ID NO: 1240162 - DNA, 14 bp, Homo sapiens
tgcctcctcttcaa

SEQ ID NO: 1240163 - DNA, 16 bp, Homo sapiens
tgcctcctcttcaact

SEQ ID NO: 1240164 - DNA, 17 bp, Homo sapiens
tgcctcctgcagtttgg

SEQ ID NO: 1240165 - DNA, 22 bp, Homo sapiens
tgcctcctgcagtttgggagac

SEQ ID NO: 1240166 - DNA, 14 bp, Homo sapiens
tgcctcctgcctgc

SEQ ID NO: 1240167 - DNA, 16 bp, Homo sapiens
tgcctcctgctctctg

SEQ ID NO: 1240168 - DNA, 13 bp, Homo sapiens
tgcctcctggagg

SEQ ID NO: 1240169 - DNA, 18 bp, Homo sapiens
tgcctcctggtttccttt

SEQ ID NO: 1240170 - DNA, 13 bp, Homo sapiens
tgcctcctgtggg

SEQ ID NO: 1240171 - DNA, 14 bp, Homo sapiens
tgcctcctgttttc

SEQ ID NO: 1240172 - DNA, 20 bp, Homo sapiens
tgcctcctgttttctccctc

SEQ ID NO: 1240173 - DNA, 22 bp, Homo sapiens
tgcctcctgttttctccctctc

SEQ ID NO: 1240174 - DNA, 13 bp, Homo sapiens
tgcctcgaaacac

SEQ ID NO: 1240175 - DNA, 23 bp, Homo sapiens
tgcctcgaaacacagaaaccttt

SEQ ID NO: 1240176 - DNA, 14 bp, Homo sapiens
tgcctcgaggcacc

SEQ ID NO: 1240177 - DNA, 15 bp, Homo sapiens
tgcctcgaggcaccg

SEQ ID NO: 1240178 - DNA, 17 bp, Homo sapiens
tgcctcgagggccgcct

SEQ ID NO: 1240179 - DNA, 17 bp, Homo sapiens
tgcctcgctcaccgctg

SEQ ID NO: 1240180 - DNA, 16 bp, Homo sapiens
tgcctcggactccatg

SEQ ID NO: 1240181 - DNA, 15 bp, Homo sapiens
tgcctcggtggccct

SEQ ID NO: 1240182 - DNA, 17 bp, Homo sapiens
tgcctctacctgacact

SEQ ID NO: 1240183 - DNA, 23 bp, Homo sapiens
tgcctctacctgacactcccttg

SEQ ID NO: 1240184 - DNA, 15 bp, Homo sapiens
tgcctctatgccctg

SEQ ID NO: 1240185 - DNA, 19 bp, Homo sapiens
tgcctctatgccctgcaga

SEQ ID NO: 1240186 - DNA, 15 bp, Homo sapiens
tgcctctcctcagga

SEQ ID NO: 1240187 - DNA, 16 bp, Homo sapiens
tgcctctctggaaaga

SEQ ID NO: 1240188 - DNA, 21 bp, Homo sapiens
tgcctctctggaaagaggctc

SEQ ID NO: 1240189 - DNA, 19 bp, Homo sapiens
tgcctctcttcttcccctt

SEQ ID NO: 1240190 - DNA, 17 bp, Homo sapiens
tgcctctcttgcccctt

SEQ ID NO: 1240191 - DNA, 18 bp, Homo sapiens
tgcgcttatttggaaatt

SEQ ID NO: 1240192 - DNA, 16 bp, Homo sapiens
tgcgcttcatctcatg

SEQ ID NO: 1240193 - DNA, 17 bp, Homo sapiens
tgcgcttctgctggagg

SEQ ID NO: 1240194 - DNA, 14 bp, Homo sapiens
tgcgcttgcttttc

SEQ ID NO: 1240195 - DNA, 22 bp, Homo sapiens
tgcgcttggtaggtgtggtggc

SEQ ID NO: 1240196 - DNA, 14 bp, Homo sapiens
tgcggaagccatag

SEQ ID NO: 1240197 - DNA, 20 bp, Homo sapiens
tgcggaagccatagggggct

SEQ ID NO: 1240198 - DNA, 20 bp, Homo sapiens
tgcggacaccgtggcctggg

SEQ ID NO: 1240199 - DNA, 22 bp, Homo sapiens
tgcggaccaccctcactggctc

SEQ ID NO: 1240200 - DNA, 20 bp, Homo sapiens
tgcggacccttcccagccct

SEQ ID NO: 1240201 - DNA, 14 bp, Homo sapiens
tgcggacgggctgt

SEQ ID NO: 1240202 - DNA, 22 bp, Homo sapiens
tgcggaggaaggaggacccagg

SEQ ID NO: 1240203 - DNA, 22 bp, Homo sapiens
tgcggaggcggtggcagactag

SEQ ID NO: 1240204 - DNA, 17 bp, Homo sapiens
tgcggatctcagctttg

SEQ ID NO: 1240205 - DNA, 15 bp, Homo sapiens
tgcggatgagggcat

SEQ ID NO: 1240206 - DNA, 14 bp, Homo sapiens
tgcggcagggaaga

SEQ ID NO: 1240207 - DNA, 19 bp, Homo sapiens
tgcggccgcattccctgag

SEQ ID NO: 1240208 - DNA, 22 bp, Homo sapiens
tgcggccgccccccgcccctcg

SEQ ID NO: 1240209 - DNA, 14 bp, Homo sapiens
tgcggcggtcccag

SEQ ID NO: 1240210 - DNA, 15 bp, Homo sapiens
tgcggctgaactgag

SEQ ID NO: 1240211 - DNA, 14 bp, Homo sapiens
tgcgggacagagta

SEQ ID NO: 1240212 - DNA, 19 bp, Homo sapiens
tgcgggaccatctgatgtg

SEQ ID NO: 1240213 - DNA, 21 bp, Homo sapiens
tgcgggaccggtacagaaagg

SEQ ID NO: 1240214 - DNA, 12 bp, Homo sapiens
tgcgggaggctg

SEQ ID NO: 1240215 - DNA, 12 bp, Homo sapiens
tgcgggccacag

SEQ ID NO: 1240216 - DNA, 22 bp, Homo sapiens
tgcgggccagggtcctgtcgcc

SEQ ID NO: 1240217 - DNA, 23 bp, Homo sapiens
tgcgggcgcgggcagccacccaa

SEQ ID NO: 1240218 - DNA, 13 bp, Homo sapiens
tgcgggctccctc

SEQ ID NO: 1240219 - DNA, 15 bp, Homo sapiens
tgcgggctccctcct

SEQ ID NO: 1240220 - DNA, 16 bp, Homo sapiens
tgcgggctgaggccag

SEQ ID NO: 1240221 - DNA, 18 bp, Homo sapiens
tgcgggctgaggccagag

SEQ ID NO: 1240222 - DNA, 23 bp, Homo sapiens
tgcggggacaggctggaatgagg

SEQ ID NO: 1240223 - DNA, 13 bp, Homo sapiens
tgcgggtcctcag

SEQ ID NO: 1240224 - DNA, 17 bp, Homo sapiens
tgcgggtcctcagctgc

SEQ ID NO: 1240225 - DNA, 19 bp, Homo sapiens
tgcgggtcctcagctgctc

SEQ ID NO: 1240226 - DNA, 15 bp, Homo sapiens
tgcgggtctgaagga

SEQ ID NO: 1240227 - DNA, 18 bp, Homo sapiens
tgcgggtgaacaaagcag

SEQ ID NO: 1240228 - DNA, 16 bp, Homo sapiens
tgcggttaattttgaa

SEQ ID NO: 1240229 - DNA, 21 bp, Homo sapiens
tgcggttaattttgaagtgct

SEQ ID NO: 1240230 - DNA, 19 bp, Homo sapiens
tgcggttataaaaaatggt

SEQ ID NO: 1240231 - DNA, 23 bp, Homo sapiens
tgcggttcaggaaaattgaatgc

SEQ ID NO: 1240232 - DNA, 18 bp, Homo sapiens
tgcggtttccaaggtgca

SEQ ID NO: 1240233 - DNA, 17 bp, Homo sapiens
tgcgtacacagagaagg

SEQ ID NO: 1240234 - DNA, 19 bp, Homo sapiens
tgcgtagaattgcaggtct

SEQ ID NO: 1240235 - DNA, 20 bp, Homo sapiens
tgcgtatgccaccaacttac

SEQ ID NO: 1240236 - DNA, 12 bp, Homo sapiens
tgcgtattctgt

SEQ ID NO: 1240237 - DNA, 18 bp, Homo sapiens
tgcgtattctgtggccgc

SEQ ID NO: 1240238 - DNA, 13 bp, Homo sapiens
tgcgtccaccagg

SEQ ID NO: 1240239 - DNA, 17 bp, Homo sapiens
tgcgtccaccaggcctc

SEQ ID NO: 1240240 - DNA, 21 bp, Homo sapiens
tgcgtccaccaggcctcactg

SEQ ID NO: 1240241 - DNA, 13 bp, Homo sapiens
tgcgtccccactc

SEQ ID NO: 1240242 - DNA, 19 bp, Homo sapiens
tgcgtcctcctcacctcat

SEQ ID NO: 1240243 - DNA, 14 bp, Homo sapiens
tgcgtcctgcagag

SEQ ID NO: 1240244 - DNA, 15 bp, Homo sapiens
tgcgtcggccctggg

SEQ ID NO: 1240245 - DNA, 17 bp, Homo sapiens
tgcgtctccagtcatct

SEQ ID NO: 1240246 - DNA, 14 bp, Homo sapiens
tgcgtcttccgccc

SEQ ID NO: 1240247 - DNA, 22 bp, Homo sapiens
tgcgtgaaacacaccaggctgt

SEQ ID NO: 1240248 - DNA, 17 bp, Homo sapiens
tgcgtgccgtgtgagtg

SEQ ID NO: 1240249 - DNA, 17 bp, Homo sapiens
tgcgtgcgagcacacac

SEQ ID NO: 1240250 - DNA, 16 bp, Homo sapiens
tgcgtgcgtgtgcgtg

SEQ ID NO: 1240251 - DNA, 15 bp, Homo sapiens
tgcgtggatcaagct

SEQ ID NO: 1240252 - DNA, 22 bp, Homo sapiens
tgcgtggatcaagcttgtgtac

SEQ ID NO: 1240253 - DNA, 15 bp, Homo sapiens
tgcgtggcgtggccc

SEQ ID NO: 1240254 - DNA, 16 bp, Homo sapiens
tgcgtggctgtggcac

SEQ ID NO: 1240255 - DNA, 21 bp, Homo sapiens
tgcgtggctgtggcacagact

SEQ ID NO: 1240256 - DNA, 15 bp, Homo sapiens
tgcgtgggaggcaga

SEQ ID NO: 1240257 - DNA, 18 bp, Homo sapiens
tgcgtgggaggcagaaac

SEQ ID NO: 1240258 - DNA, 14 bp, Homo sapiens
tgcgtgggtgtgtg

SEQ ID NO: 1240259 - DNA, 15 bp, Homo sapiens
tgcgtggtgtggccc

SEQ ID NO: 1240260 - DNA, 18 bp, Homo sapiens
tgcgtgtccgtctgtctg

SEQ ID NO: 1240261 - DNA, 17 bp, Homo sapiens
tgcgtgtggcgtggccc

SEQ ID NO: 1240262 - DNA, 18 bp, Homo sapiens
tgcgtgtgtcagggatga

SEQ ID NO: 1240263 - DNA, 23 bp, Homo sapiens
tgcgtgttagtgtgtgtgcatgt

SEQ ID NO: 1240264 - DNA, 14 bp, Homo sapiens
tgcgtgttcagcag

SEQ ID NO: 1240265 - DNA, 16 bp, Homo sapiens
tgcgtgttcagcagaa

SEQ ID NO: 1240266 - DNA, 22 bp, Homo sapiens
tgcgtgtttgggtttttttcct

SEQ ID NO: 1240267 - DNA, 13 bp, Homo sapiens
tgcgttactaatt

SEQ ID NO: 1240268 - DNA, 16 bp, Homo sapiens
tgcgttaggcagggca

SEQ ID NO: 1240269 - DNA, 14 bp, Homo sapiens
tgcgttcagcccct

SEQ ID NO: 1240270 - DNA, 23 bp, Homo sapiens
tgcgttcagcccctgatctctga

SEQ ID NO: 1240271 - DNA, 23 bp, Homo sapiens
tgcgttctcccagcactgcctcc

SEQ ID NO: 1240272 - DNA, 24 bp, Homo sapiens
tgcgttctcccagcactgcctcct

SEQ ID NO: 1240273 - DNA, 14 bp, Homo sapiens
tgcgtttgcctcct

SEQ ID NO: 1240274 - DNA, 20 bp, Homo sapiens
tgcgttttctccgggtcctc

SEQ ID NO: 1240275 - DNA, 13 bp, Homo sapiens
tgcgttttggaag

SEQ ID NO: 1240276 - DNA, 13 bp, Homo sapiens
tgcgtttttacag

SEQ ID NO: 1240277 - DNA, 13 bp, Homo sapiens
tgctaaaagaaga

SEQ ID NO: 1240278 - DNA, 12 bp, Homo sapiens
tgctaaaagtgc

SEQ ID NO: 1240279 - DNA, 21 bp, Homo sapiens
tgctaaaatattttagatgtt

SEQ ID NO: 1240280 - DNA, 22 bp, Homo sapiens
tgctaaagcactttgcacttaa

SEQ ID NO: 1240281 - DNA, 18 bp, Homo sapiens
tgctaaagggagaaatgc

SEQ ID NO: 1240282 - DNA, 17 bp, Homo sapiens
tgctaaagttttcttcc

SEQ ID NO: 1240283 - DNA, 17 bp, Homo sapiens
tgctaaataaaatttgt

SEQ ID NO: 1240284 - DNA, 22 bp, Homo sapiens
tgctaaataaaatttgttgcat

SEQ ID NO: 1240285 - DNA, 23 bp, Homo sapiens
tgctaaataaaatttgttgcata

SEQ ID NO: 1240286 - DNA, 19 bp, Homo sapiens
tgctaaatgccatgtttat

SEQ ID NO: 1240287 - DNA, 16 bp, Homo sapiens
tgctaaattctatgtt

SEQ ID NO: 1240288 - DNA, 18 bp, Homo sapiens
tgctaaattctatgttaa

SEQ ID NO: 1240289 - DNA, 20 bp, Homo sapiens
tgctaaattctatgttaaat

SEQ ID NO: 1240290 - DNA, 15 bp, Homo sapiens
tgctaaattttcagt

SEQ ID NO: 1240291 - DNA, 15 bp, Homo sapiens
tgctaacccccaaat

SEQ ID NO: 1240292 - DNA, 13 bp, Homo sapiens
tgctaaccttttc

SEQ ID NO: 1240293 - DNA, 14 bp, Homo sapiens
tgctaagcatattt

SEQ ID NO: 1240294 - DNA, 23 bp, Homo sapiens
tgctaagctgatattatttcttc

SEQ ID NO: 1240295 - DNA, 16 bp, Homo sapiens
tgctaaggctcctcct

SEQ ID NO: 1240296 - DNA, 16 bp, Homo sapiens
tgctaaggctgctggc

SEQ ID NO: 1240297 - DNA, 16 bp, Homo sapiens
tgctaagtaatttaga

SEQ ID NO: 1240298 - DNA, 12 bp, Homo sapiens
tgctaagtattt

SEQ ID NO: 1240299 - DNA, 23 bp, Homo sapiens
tgctaagtgcttattacatttta

SEQ ID NO: 1240300 - DNA, 23 bp, Homo sapiens
tgctaatacctcttactttgctt

SEQ ID NO: 1240301 - DNA, 21 bp, Homo sapiens
tgctaatcaaagccagggtct

SEQ ID NO: 1240302 - DNA, 23 bp, Homo sapiens
tgctaatcagggaggtcattttg

SEQ ID NO: 1240303 - DNA, 22 bp, Homo sapiens
tgctaatcatgtgggtgagcca

SEQ ID NO: 1240304 - DNA, 13 bp, Homo sapiens
tgctaatcttctt

SEQ ID NO: 1240305 - DNA, 16 bp, Homo sapiens
tgctaatcttgtccct

SEQ ID NO: 1240306 - DNA, 23 bp, Homo sapiens
tgctaatgcaaattaaaacatat

SEQ ID NO: 1240307 - DNA, 14 bp, Homo sapiens
tgctaatgtaaact

SEQ ID NO: 1240308 - DNA, 19 bp, Homo sapiens
tgctaatgttgatcagcaa

SEQ ID NO: 1240309 - DNA, 22 bp, Homo sapiens
tgctaatgttgatcagcaaatt

SEQ ID NO: 1240310 - DNA, 19 bp, Homo sapiens
tgctaattcccaacatttc

SEQ ID NO: 1240311 - DNA, 14 bp, Homo sapiens
tgctacaaatttat

SEQ ID NO: 1240312 - DNA, 15 bp, Homo sapiens
tgctacaaatttatg

SEQ ID NO: 1240313 - DNA, 19 bp, Homo sapiens
tgctacaacttcagcagta

SEQ ID NO: 1240314 - DNA, 11 bp, Homo sapiens
tgctacacact

SEQ ID NO: 1240315 - DNA, 20 bp, Homo sapiens
tgctacagatgatagaggat

SEQ ID NO: 1240316 - DNA, 15 bp, Homo sapiens
tgctacatcagactc

SEQ ID NO: 1240317 - DNA, 17 bp, Homo sapiens
tgctacatcagactcta

SEQ ID NO: 1240318 - DNA, 19 bp, Homo sapiens
tgctacatcagactctaga

SEQ ID NO: 1240319 - DNA, 13 bp, Homo sapiens
tgctaccaaagca

SEQ ID NO: 1240320 - DNA, 13 bp, Homo sapiens
tgctaccagcgcc

SEQ ID NO: 1240321 - DNA, 21 bp, Homo sapiens
tgctacccttaataacataca

SEQ ID NO: 1240322 - DNA, 22 bp, Homo sapiens
tgctacctgggtccttttcaga

SEQ ID NO: 1240323 - DNA, 18 bp, Homo sapiens
tgctacgtgcctcccgag

SEQ ID NO: 1240324 - DNA, 15 bp, Homo sapiens
tgctactcctgtgct

SEQ ID NO: 1240325 - DNA, 17 bp, Homo sapiens
tgctactcctgtgctct

SEQ ID NO: 1240326 - DNA, 18 bp, Homo sapiens
tgctactgcactccagcc

SEQ ID NO: 1240327 - DNA, 21 bp, Homo sapiens
tgctactggacttgaatggtt

SEQ ID NO: 1240328 - DNA, 19 bp, Homo sapiens
tgctacttaattcctttct

SEQ ID NO: 1240329 - DNA, 21 bp, Homo sapiens
tgctacttatcatttttgtat

SEQ ID NO: 1240330 - DNA, 21 bp, Homo sapiens
tgctagaaaagacataatcat

SEQ ID NO: 1240331 - DNA, 14 bp, Homo sapiens
tgctagaaaatcga

SEQ ID NO: 1240332 - DNA, 16 bp, Homo sapiens
tgctagaaaatttagc

SEQ ID NO: 1240333 - DNA, 15 bp, Homo sapiens
tgctagaacaatggg

SEQ ID NO: 1240334 - DNA, 21 bp, Homo sapiens
tgctagaacaatgggaggctg

SEQ ID NO: 1240335 - DNA, 15 bp, Homo sapiens
tgctagaacatggtt

SEQ ID NO: 1240336 - DNA, 13 bp, Homo sapiens
tgctagaatactt

SEQ ID NO: 1240337 - DNA, 14 bp, Homo sapiens
tgctagagcaaccc

SEQ ID NO: 1240338 - DNA, 14 bp, Homo sapiens
tgctagagcagaca

SEQ ID NO: 1240339 - DNA, 13 bp, Homo sapiens
tgctagataaaag

SEQ ID NO: 1240340 - DNA, 20 bp, Homo sapiens
tgctagatgtgcaaatgcaa

SEQ ID NO: 1240341 - DNA, 20 bp, Homo sapiens
tgctagcaaatggcagaacc

SEQ ID NO: 1240342 - DNA, 18 bp, Homo sapiens
tgctagcacttggagcca

SEQ ID NO: 1240343 - DNA, 20 bp, Homo sapiens
tgctagccagcattccatat

SEQ ID NO: 1240344 - DNA, 17 bp, Homo sapiens
tgctagctagccagcca

SEQ ID NO: 1240345 - DNA, 18 bp, Homo sapiens
tgctagctagccagccaa

SEQ ID NO: 1240346 - DNA, 17 bp, Homo sapiens
tgctaggagctgacaat

SEQ ID NO: 1240347 - DNA, 23 bp, Homo sapiens
tgctaggccagagccatgccagg

SEQ ID NO: 1240348 - DNA, 19 bp, Homo sapiens
tgctaggcgagtgccagga

SEQ ID NO: 1240349 - DNA, 22 bp, Homo sapiens
tgctaggcgagtgccaggactc

SEQ ID NO: 1240350 - DNA, 19 bp, Homo sapiens
tgctaggcgctggggagac

SEQ ID NO: 1240351 - DNA, 22 bp, Homo sapiens
tgctagggaaacttcccgtccc

SEQ ID NO: 1240352 - DNA, 14 bp, Homo sapiens
tgctagggagaggg

SEQ ID NO: 1240353 - DNA, 14 bp, Homo sapiens
tgctaggtgggcca

SEQ ID NO: 1240354 - DNA, 19 bp, Homo sapiens
tgctaggtgggccagcccc

SEQ ID NO: 1240355 - DNA, 23 bp, Homo sapiens
tgctaggtgggccagcccctccc

SEQ ID NO: 1240356 - DNA, 23 bp, Homo sapiens
tgctagtactggggagaaataat

SEQ ID NO: 1240357 - DNA, 16 bp, Homo sapiens
tgctagtcttaagaac

SEQ ID NO: 1240358 - DNA, 15 bp, Homo sapiens
tgctagtgcatttca

SEQ ID NO: 1240359 - DNA, 19 bp, Homo sapiens
tgctagtgggccctctctc

SEQ ID NO: 1240360 - DNA, 13 bp, Homo sapiens
tgctagttttaca

SEQ ID NO: 1240361 - DNA, 20 bp, Homo sapiens
tgctataaagctagatgctt

SEQ ID NO: 1240362 - DNA, 16 bp, Homo sapiens
tgctataatcattagt

SEQ ID NO: 1240363 - DNA, 18 bp, Homo sapiens
tgctataatctgttttta

SEQ ID NO: 1240364 - DNA, 15 bp, Homo sapiens
tgctatacacacaca

SEQ ID NO: 1240365 - DNA, 17 bp, Homo sapiens
tgctatacatgttggaa

SEQ ID NO: 1240366 - DNA, 14 bp, Homo sapiens
tgctatagtatttg

SEQ ID NO: 1240367 - DNA, 20 bp, Homo sapiens
tgctatagtatttgattcaa

SEQ ID NO: 1240368 - DNA, 16 bp, Homo sapiens
tgctatatccagttcc

SEQ ID NO: 1240369 - DNA, 23 bp, Homo sapiens
tgctatatccagttcctgctctc

SEQ ID NO: 1240370 - DNA, 19 bp, Homo sapiens
tgctatcaacaataaaatt

SEQ ID NO: 1240371 - DNA, 14 bp, Homo sapiens
tgctatcacacagt

SEQ ID NO: 1240372 - DNA, 13 bp, Homo sapiens
tgctatcacatgt

SEQ ID NO: 1240373 - DNA, 22 bp, Homo sapiens
tgctatccccatctccctgcct

SEQ ID NO: 1240374 - DNA, 20 bp, Homo sapiens
tgctatcctgccaaaatcat

SEQ ID NO: 1240375 - DNA, 19 bp, Homo sapiens
tgctatcgccctcctttcc

SEQ ID NO: 1240376 - DNA, 21 bp, Homo sapiens
tgctatctctgtgtgcacaaa

SEQ ID NO: 1240377 - DNA, 17 bp, Homo sapiens
tgctatgaaaatgagca

SEQ ID NO: 1240378 - DNA, 15 bp, Homo sapiens
tgctatgacagctgg

SEQ ID NO: 1240379 - DNA, 17 bp, Homo sapiens
tgctatgacagctggct

SEQ ID NO: 1240380 - DNA, 15 bp, Homo sapiens
tgctatgcattttct

SEQ ID NO: 1240381 - DNA, 20 bp, Homo sapiens
tgctatgcattttcttcaca

SEQ ID NO: 1240382 - DNA, 21 bp, Homo sapiens
tgctatgccatttcttctctc

SEQ ID NO: 1240383 - DNA, 16 bp, Homo sapiens
tgctatgctgaagaca

SEQ ID NO: 1240384 - DNA, 20 bp, Homo sapiens
tgctatggcaggataagaaa

SEQ ID NO: 1240385 - DNA, 13 bp, Homo sapiens
tgctatgtaaggg

SEQ ID NO: 1240386 - DNA, 18 bp, Homo sapiens
tgctatgttactattttc

SEQ ID NO: 1240387 - DNA, 12 bp, Homo sapiens
tgctatgttctg

SEQ ID NO: 1240388 - DNA, 16 bp, Homo sapiens
tgctattgacaataaa

SEQ ID NO: 1240389 - DNA, 17 bp, Homo sapiens
tgctattgacaataaaa

SEQ ID NO: 1240390 - DNA, 18 bp, Homo sapiens
tgctattgacaataaaat

SEQ ID NO: 1240391 - DNA, 21 bp, Homo sapiens
tgctattgacaataaaatatt

SEQ ID NO: 1240392 - DNA, 15 bp, Homo sapiens
tgctattgtaaatat

SEQ ID NO: 1240393 - DNA, 17 bp, Homo sapiens
tgctattgtaaatatgt

SEQ ID NO: 1240394 - DNA, 21 bp, Homo sapiens
tgctattgtaaggtctttgta

SEQ ID NO: 1240395 - DNA, 21 bp, Homo sapiens
tgctatttgagcatgcacagc

SEQ ID NO: 1240396 - DNA, 15 bp, Homo sapiens
tgctcaaagaaatct

SEQ ID NO: 1240397 - DNA, 18 bp, Homo sapiens
tgctcaaatctattcaga

SEQ ID NO: 1240398 - DNA, 19 bp, Homo sapiens
tgctcaaatctattcagac

SEQ ID NO: 1240399 - DNA, 20 bp, Homo sapiens
tgctcaaggaccaagagcaa

SEQ ID NO: 1240400 - DNA, 19 bp, Homo sapiens
tgctcaagggttctttcct

SEQ ID NO: 1240401 - DNA, 15 bp, Homo sapiens
tgctcaatagcttga

SEQ ID NO: 1240402 - DNA, 12 bp, Homo sapiens
tgctcacaggca

SEQ ID NO: 1240403 - DNA, 14 bp, Homo sapiens
tgctcacaggcagg

SEQ ID NO: 1240404 - DNA, 17 bp, Homo sapiens
tgctcacagggatgctg

SEQ ID NO: 1240405 - DNA, 16 bp, Homo sapiens
tgctcacatgtctttg

SEQ ID NO: 1240406 - DNA, 13 bp, Homo sapiens
tgctcaccagccc

SEQ ID NO: 1240407 - DNA, 19 bp, Homo sapiens
tgctcaccgcccatcaggg

SEQ ID NO: 1240408 - DNA, 13 bp, Homo sapiens
tgctcacctctag

SEQ ID NO: 1240409 - DNA, 21 bp, Homo sapiens
tgctcacgactcttcctgcaa

SEQ ID NO: 1240410 - DNA, 23 bp, Homo sapiens
tgctcacgactcttcctgcaaag

SEQ ID NO: 1240411 - DNA, 21 bp, Homo sapiens
tgctcacgttaccttgacaca

SEQ ID NO: 1240412 - DNA, 21 bp, Homo sapiens
tgctcactcactcactccaag

SEQ ID NO: 1240413 - DNA, 17 bp, Homo sapiens
tgctcagaccagctctt

SEQ ID NO: 1240414 - DNA, 17 bp, Homo sapiens
tgctcagacccaacagc

SEQ ID NO: 1240415 - DNA, 20 bp, Homo sapiens
tgctcagagacctgaagtgt

SEQ ID NO: 1240416 - DNA, 19 bp, Homo sapiens
tgctcagagctttaaaagt

SEQ ID NO: 1240417 - DNA, 17 bp, Homo sapiens
tgctcagatagatctgt

SEQ ID NO: 1240418 - DNA, 18 bp, Homo sapiens
tgctcagcagccagtctc

SEQ ID NO: 1240419 - DNA, 21 bp, Homo sapiens
tgctcagcagccagtctcaga

SEQ ID NO: 1240420 - DNA, 22 bp, Homo sapiens
tgctcagccctgactggtgcta

SEQ ID NO: 1240421 - DNA, 14 bp, Homo sapiens
tgctgacctgctga

SEQ ID NO: 1240422 - DNA, 14 bp, Homo sapiens
tgctgaccttctgc

SEQ ID NO: 1240423 - DNA, 14 bp, Homo sapiens
tgctgaccttggag

SEQ ID NO: 1240424 - DNA, 21 bp, Homo sapiens
tgctgactgtactcctcccag

SEQ ID NO: 1240425 - DNA, 21 bp, Homo sapiens
tgctgactgttttctcttgag

SEQ ID NO: 1240426 - DNA, 24 bp, Homo sapiens
tgctgactgttttctcttgagagg

SEQ ID NO: 1240427 - DNA, 14 bp, Homo sapiens
tgctgagagaaata

SEQ ID NO: 1240428 - DNA, 23 bp, Homo sapiens
tgctgagagaaatatggaactta

SEQ ID NO: 1240429 - DNA, 21 bp, Homo sapiens
tgctgagagacccaaggagga

SEQ ID NO: 1240430 - DNA, 17 bp, Homo sapiens
tgctgagagcccccacc

SEQ ID NO: 1240431 - DNA, 19 bp, Homo sapiens
tgctgagaggcgagctcct

SEQ ID NO: 1240432 - DNA, 21 bp, Homo sapiens
tgctgagatgaggaggggagc

SEQ ID NO: 1240433 - DNA, 18 bp, Homo sapiens
tgctgagatgataaagtc

SEQ ID NO: 1240434 - DNA, 13 bp, Homo sapiens
tgctgagccactc

SEQ ID NO: 1240435 - DNA, 18 bp, Homo sapiens
tgctgagcctcacagcag

SEQ ID NO: 1240436 - DNA, 12 bp, Homo sapiens
tgctgagcctct

SEQ ID NO: 1240437 - DNA, 17 bp, Homo sapiens
tgctgagcctctgctcc

SEQ ID NO: 1240438 - DNA, 17 bp, Homo sapiens
tgctgagctggcccttg

SEQ ID NO: 1240439 - DNA, 10 bp, Homo sapiens
tgctgagctt

SEQ ID NO: 1240440 - DNA, 23 bp, Homo sapiens
tgctgagcttagccttgtgccct

SEQ ID NO: 1240441 - DNA, 14 bp, Homo sapiens
tgctgaggagtctg

SEQ ID NO: 1240442 - DNA, 20 bp, Homo sapiens
tgctgaggagtctgaggact

SEQ ID NO: 1240443 - DNA, 13 bp, Homo sapiens
tgctgaggccagg

SEQ ID NO: 1240444 - DNA, 15 bp, Homo sapiens
tgctgaggcccagtg

SEQ ID NO: 1240445 - DNA, 13 bp, Homo sapiens
tgctgaggcctgg

SEQ ID NO: 1240446 - DNA, 22 bp, Homo sapiens
tgctgagggccaataccctact

SEQ ID NO: 1240447 - DNA, 22 bp, Homo sapiens
tgctgagggtgtttcttcctgc

SEQ ID NO: 1240448 - DNA, 23 bp, Homo sapiens
tgctgaggttttgaataaaaagt

SEQ ID NO: 1240449 - DNA, 21 bp, Homo sapiens
tgctgagtcatctgttagggc

SEQ ID NO: 1240450 - DNA, 22 bp, Homo sapiens
tgctgagtcccaggctgagcct

SEQ ID NO: 1240451 - DNA, 16 bp, Homo sapiens
tgctgagtgctgggca

SEQ ID NO: 1240452 - DNA, 19 bp, Homo sapiens
tgctgagtgctgggcactg

SEQ ID NO: 1240453 - DNA, 18 bp, Homo sapiens
tgctgagttccggggtgc

SEQ ID NO: 1240454 - DNA, 17 bp, Homo sapiens
tgctgagttgttctaac

SEQ ID NO: 1240455 - DNA, 13 bp, Homo sapiens
tgctgataaaata

SEQ ID NO: 1240456 - DNA, 15 bp, Homo sapiens
tgctgataattgtgt

SEQ ID NO: 1240457 - DNA, 19 bp, Homo sapiens
tgctgataattgtgtattt

SEQ ID NO: 1240458 - DNA, 23 bp, Homo sapiens
tgctgatcatcgccagaggtgct

SEQ ID NO: 1240459 - DNA, 20 bp, Homo sapiens
tgctgatcgtagaaaatttg

SEQ ID NO: 1240460 - DNA, 15 bp, Homo sapiens
tgctgatgctcctcc

SEQ ID NO: 1240461 - DNA, 13 bp, Homo sapiens
tgctgatggcttg

SEQ ID NO: 1240462 - DNA, 21 bp, Homo sapiens
tgctgatggcttgacatgtgc

SEQ ID NO: 1240463 - DNA, 13 bp, Homo sapiens
tgctgatgggaag

SEQ ID NO: 1240464 - DNA, 20 bp, Homo sapiens
tgctgattcttgtaaatctt

SEQ ID NO: 1240465 - DNA, 23 bp, Homo sapiens
tgctgattgatttttttctcctt

SEQ ID NO: 1240466 - DNA, 17 bp, Homo sapiens
tgctgatttctagtgta

SEQ ID NO: 1240467 - DNA, 13 bp, Homo sapiens
tgctgcaaacctg

SEQ ID NO: 1240468 - DNA, 14 bp, Homo sapiens
tgctgcaaacctga

SEQ ID NO: 1240469 - DNA, 18 bp, Homo sapiens
tgctgcaaggtggcctct

SEQ ID NO: 1240470 - DNA, 22 bp, Homo sapiens
tgctgcaaggtggcctctgcct

SEQ ID NO: 1240471 - DNA, 18 bp, Homo sapiens
tgctgcacaaaagcagat

SEQ ID NO: 1240472 - DNA, 19 bp, Homo sapiens
tgctgcacagcaggacctg

SEQ ID NO: 1240473 - DNA, 13 bp, Homo sapiens
tgctgcaccagag

SEQ ID NO: 1240474 - DNA, 15 bp, Homo sapiens
tgctgcaccagagtg

SEQ ID NO: 1240475 - DNA, 16 bp, Homo sapiens
tgctgcaccagagtga

SEQ ID NO: 1240476 - DNA, 22 bp, Homo sapiens
tgctgcaccctgcgcctccaga

SEQ ID NO: 1240477 - DNA, 12 bp, Homo sapiens
tgctgcactagg

SEQ ID NO: 1240478 - DNA, 18 bp, Homo sapiens
tgctgcactaggacttgg

SEQ ID NO: 1240479 - DNA, 20 bp, Homo sapiens
tgctgcagcttctaactggt

SEQ ID NO: 1240480 - DNA, 12 bp, Homo sapiens
tgctgcaggccc

SEQ ID NO: 1240481 - DNA, 14 bp, Homo sapiens
tgctgcaggccctc

SEQ ID NO: 1240482 - DNA, 18 bp, Homo sapiens
tgctgcaggccctccctc

SEQ ID NO: 1240483 - DNA, 18 bp, Homo sapiens
tgctgcagtcatctactt

SEQ ID NO: 1240484 - DNA, 15 bp, Homo sapiens
tgctgcatgcctggt

SEQ ID NO: 1240485 - DNA, 17 bp, Homo sapiens
tgctgcatttaaaagat

SEQ ID NO: 1240486 - DNA, 23 bp, Homo sapiens
tgctgcatttaaaagatacagtt

SEQ ID NO: 1240487 - DNA, 12 bp, Homo sapiens
tgctgccaaaac

SEQ ID NO: 1240488 - DNA, 15 bp, Homo sapiens
tgctgccaaaaccac

SEQ ID NO: 1240489 - DNA, 17 bp, Homo sapiens
tgctgccaaaaccacat

SEQ ID NO: 1240490 - DNA, 17 bp, Homo sapiens
tgctgccaaccatacct

SEQ ID NO: 1240491 - DNA, 21 bp, Homo sapiens
tgctgccaaccataccttcct

SEQ ID NO: 1240492 - DNA, 23 bp, Homo sapiens
tgctgccaaggtggagggaagga

SEQ ID NO: 1240493 - DNA, 16 bp, Homo sapiens
tgctgccacacttcag

SEQ ID NO: 1240494 - DNA, 16 bp, Homo sapiens
tgctgccacagcaagg

SEQ ID NO: 1240495 - DNA, 15 bp, Homo sapiens
tgctgccagggcttc

SEQ ID NO: 1240496 - DNA, 23 bp, Homo sapiens
tgctgccatgacagaggctgcac

SEQ ID NO: 1240497 - DNA, 16 bp, Homo sapiens
tgctgccatgccactg

SEQ ID NO: 1240498 - DNA, 18 bp, Homo sapiens
tgctgccatgccactgcc

SEQ ID NO: 1240499 - DNA, 21 bp, Homo sapiens
tgctgccatttgatttttcta

SEQ ID NO: 1240500 - DNA, 17 bp, Homo sapiens
tgctgcccagccactcc

SEQ ID NO: 1240501 - DNA, 13 bp, Homo sapiens
tgctgccccagct

SEQ ID NO: 1240502 - DNA, 18 bp, Homo sapiens
tgctgccccatcagtgct

SEQ ID NO: 1240503 - DNA, 21 bp, Homo sapiens
tgctgccccatcagtgctccc

SEQ ID NO: 1240504 - DNA, 10 bp, Homo sapiens
tgctgccccc

SEQ ID NO: 1240505 - DNA, 14 bp, Homo sapiens
tgctgcccccaccc

SEQ ID NO: 1240506 - DNA, 15 bp, Homo sapiens
tgctgcccccacccc

SEQ ID NO: 1240507 - DNA, 22 bp, Homo sapiens
tgctgcccccttccccagccct

SEQ ID NO: 1240508 - DNA, 20 bp, Homo sapiens
tgctgccccgttccctgtca

SEQ ID NO: 1240509 - DNA, 22 bp, Homo sapiens
tgctgccccgttccctgtcaga

SEQ ID NO: 1240510 - DNA, 18 bp, Homo sapiens
tgctgcccctgtctggaa

SEQ ID NO: 1240511 - DNA, 15 bp, Homo sapiens
tgctgccccttgcaa

SEQ ID NO: 1240512 - DNA, 18 bp, Homo sapiens
tgctgccccttgcaagcc

SEQ ID NO: 1240513 - DNA, 20 bp, Homo sapiens
tgctgccccttgcaagccat

SEQ ID NO: 1240514 - DNA, 22 bp, Homo sapiens
tgctgccccttgcaagccataa

SEQ ID NO: 1240515 - DNA, 23 bp, Homo sapiens
tgctgcccggggtggggtgcact

SEQ ID NO: 1240516 - DNA, 22 bp, Homo sapiens
tgctgcccgtcttcagcctagc

SEQ ID NO: 1240517 - DNA, 16 bp, Homo sapiens
tgctgccctcttaaga

SEQ ID NO: 1240518 - DNA, 19 bp, Homo sapiens
tgctgccgcctcccagcct

SEQ ID NO: 1240519 - DNA, 20 bp, Homo sapiens
tgctgccgcctcccagcctg

SEQ ID NO: 1240520 - DNA, 21 bp, Homo sapiens
tgctgccgcctcccagcctgg

SEQ ID NO: 1240521 - DNA, 17 bp, Homo sapiens
tgctgcctccccaaccc

SEQ ID NO: 1240522 - DNA, 22 bp, Homo sapiens
tgctgcctccccaaccctgccc

SEQ ID NO: 1240523 - DNA, 20 bp, Homo sapiens
tgctgcctgctgagatgagg

SEQ ID NO: 1240524 - DNA, 18 bp, Homo sapiens
tgctgcctggccactgct

SEQ ID NO: 1240525 - DNA, 14 bp, Homo sapiens
tgctgcctgtcccc

SEQ ID NO: 1240526 - DNA, 12 bp, Homo sapiens
tgctgccttcag

SEQ ID NO: 1240527 - DNA, 15 bp, Homo sapiens
tgctgccttcaggga

SEQ ID NO: 1240528 - DNA, 17 bp, Homo sapiens
tgctgccttttctggag

SEQ ID NO: 1240529 - DNA, 21 bp, Homo sapiens
tgctgccttttctttaacttt

SEQ ID NO: 1240530 - DNA, 15 bp, Homo sapiens
tgctgcgtcagacca

SEQ ID NO: 1240531 - DNA, 20 bp, Homo sapiens
tgctgcgtcagaccagtact

SEQ ID NO: 1240532 - DNA, 18 bp, Homo sapiens
tgctgcgtccccactccc

SEQ ID NO: 1240533 - DNA, 21 bp, Homo sapiens
tgctgcgtccccactcccttg

SEQ ID NO: 1240534 - DNA, 15 bp, Homo sapiens
tgctgctactgcccc

SEQ ID NO: 1240535 - DNA, 14 bp, Homo sapiens
tgctgctactgtct

SEQ ID NO: 1240536 - DNA, 15 bp, Homo sapiens
tgctgctacttaatt

SEQ ID NO: 1240537 - DNA, 19 bp, Homo sapiens
tgctgctatcctgccaaaa

SEQ ID NO: 1240538 - DNA, 15 bp, Homo sapiens
tgctgctatgaaaat

SEQ ID NO: 1240539 - DNA, 17 bp, Homo sapiens
tgctgctattgctgtct

SEQ ID NO: 1240540 - DNA, 21 bp, Homo sapiens
tgctggggtacacagtgagag

SEQ ID NO: 1240541 - DNA, 13 bp, Homo sapiens
tgctggggtccag

SEQ ID NO: 1240542 - DNA, 14 bp, Homo sapiens
tgctggggtccagg

SEQ ID NO: 1240543 - DNA, 18 bp, Homo sapiens
tgctggggtccagggctg

SEQ ID NO: 1240544 - DNA, 20 bp, Homo sapiens
tgctgggtatgctctgtgac

SEQ ID NO: 1240545 - DNA, 17 bp, Homo sapiens
tgctgggtcccagcctg

SEQ ID NO: 1240546 - DNA, 16 bp, Homo sapiens
tgctgggtgcctccca

SEQ ID NO: 1240547 - DNA, 18 bp, Homo sapiens
tgctgggtgcctcccaca

SEQ ID NO: 1240548 - DNA, 16 bp, Homo sapiens
tgctgggttggtgcac

SEQ ID NO: 1240549 - DNA, 17 bp, Homo sapiens
tgctgggttggtgcaca

SEQ ID NO: 1240550 - DNA, 17 bp, Homo sapiens
tgctggtaacagtggct

SEQ ID NO: 1240551 - DNA, 18 bp, Homo sapiens
tgctggtatatggcttca

SEQ ID NO: 1240552 - DNA, 13 bp, Homo sapiens
tgctggtccgtgg

SEQ ID NO: 1240553 - DNA, 16 bp, Homo sapiens
tgctggtccgtgggac

SEQ ID NO: 1240554 - DNA, 13 bp, Homo sapiens
tgctggtgaacac

SEQ ID NO: 1240555 - DNA, 21 bp, Homo sapiens
tgctggtggtttttcagctcc

SEQ ID NO: 1240556 - DNA, 14 bp, Homo sapiens
tgctggttttccta

SEQ ID NO: 1240557 - DNA, 12 bp, Homo sapiens
tgctggtttttc

SEQ ID NO: 1240558 - DNA, 18 bp, Homo sapiens
tgctggtttttcagtttt

SEQ ID NO: 1240559 - DNA, 15 bp, Homo sapiens
tgctgtaaaatttgt

SEQ ID NO: 1240560 - DNA, 16 bp, Homo sapiens
tgctgtaaaatttgtg

SEQ ID NO: 1240561 - DNA, 20 bp, Homo sapiens
tgctgtaaataagcccagtg

SEQ ID NO: 1240562 - DNA, 21 bp, Homo sapiens
tgctgtaactcagacattcca

SEQ ID NO: 1240563 - DNA, 17 bp, Homo sapiens
tgctgtaactgctgagc

SEQ ID NO: 1240564 - DNA, 23 bp, Homo sapiens
tgctgtaactgctgagccactcg

SEQ ID NO: 1240565 - DNA, 15 bp, Homo sapiens
tgctgtacatctatt

SEQ ID NO: 1240566 - DNA, 16 bp, Homo sapiens
tgctgtacatctattt

SEQ ID NO: 1240567 - DNA, 17 bp, Homo sapiens
tgctgtacatctatttt

SEQ ID NO: 1240568 - DNA, 16 bp, Homo sapiens
tgctgtagatgacaac

SEQ ID NO: 1240569 - DNA, 15 bp, Homo sapiens
tgctgtatggcccag

SEQ ID NO: 1240570 - DNA, 17 bp, Homo sapiens
tgctgtatggcccaggc

SEQ ID NO: 1240571 - DNA, 19 bp, Homo sapiens
tgctgtatggcccaggcag

SEQ ID NO: 1240572 - DNA, 14 bp, Homo sapiens
tgctgtatgtgagc

SEQ ID NO: 1240573 - DNA, 16 bp, Homo sapiens
tgctgtatgtgagctg

SEQ ID NO: 1240574 - DNA, 19 bp, Homo sapiens
tgctgtatttgctgccaga

SEQ ID NO: 1240575 - DNA, 20 bp, Homo sapiens
tgctgtcactggcagagcac

SEQ ID NO: 1240576 - DNA, 13 bp, Homo sapiens
tgctgtcactgtt

SEQ ID NO: 1240577 - DNA, 16 bp, Homo sapiens
tgctgtcacttcttca

SEQ ID NO: 1240578 - DNA, 18 bp, Homo sapiens
tgctgtcacttcttcacc

SEQ ID NO: 1240579 - DNA, 20 bp, Homo sapiens
tgctgtccacatgacctcca

SEQ ID NO: 1240580 - DNA, 14 bp, Homo sapiens
tgctgtccaggcag

SEQ ID NO: 1240581 - DNA, 22 bp, Homo sapiens
tgctgtccaggcagctccctcc

SEQ ID NO: 1240582 - DNA, 12 bp, Homo sapiens
tgctgtccctcc

SEQ ID NO: 1240583 - DNA, 13 bp, Homo sapiens
tgctgtccctccc

SEQ ID NO: 1240584 - DNA, 15 bp, Homo sapiens
tgctgtccctgtcag

SEQ ID NO: 1240585 - DNA, 18 bp, Homo sapiens
tgctgtcctcaggtggcc

SEQ ID NO: 1240586 - DNA, 17 bp, Homo sapiens
tgctgtcctctccccct

SEQ ID NO: 1240587 - DNA, 18 bp, Homo sapiens
tgctgtcctctccccctt

SEQ ID NO: 1240588 - DNA, 19 bp, Homo sapiens
tgctgtcctctcccccttc

SEQ ID NO: 1240589 - DNA, 20 bp, Homo sapiens
tgctgtcctctcccccttca

SEQ ID NO: 1240590 - DNA, 13 bp, Homo sapiens
tgctgtcgggacc

SEQ ID NO: 1240591 - DNA, 18 bp, Homo sapiens
tgctgtcgggaccacatc

SEQ ID NO: 1240592 - DNA, 23 bp, Homo sapiens
tggagcaagaaggaaggaggcag

SEQ ID NO: 1240593 - DNA, 15 bp, Homo sapiens
tggatggaaggagac

SEQ ID NO: 1240594 - DNA, 20 bp, Homo sapiens
tggatggaaggttggatgga

SEQ ID NO: 1240595 - DNA, 17 bp, Homo sapiens
tggatggaatatcagaa

SEQ ID NO: 1240596 - DNA, 13 bp, Homo sapiens
tggatggacagac

SEQ ID NO: 1240597 - DNA, 14 bp, Homo sapiens
tggatggacagaca

SEQ ID NO: 1240598 - DNA, 16 bp, Homo sapiens
tggatggacagacacc

SEQ ID NO: 1240599 - DNA, 20 bp, Homo sapiens
tggatggacagacacctccc

SEQ ID NO: 1240600 - DNA, 14 bp, Homo sapiens
tggatggcacaatg

SEQ ID NO: 1240601 - DNA, 17 bp, Homo sapiens
tggatggcccagcaggc

SEQ ID NO: 1240602 - DNA, 14 bp, Homo sapiens
tggatggccccagc

SEQ ID NO: 1240603 - DNA, 15 bp, Homo sapiens
tggatggccccagca

SEQ ID NO: 1240604 - DNA, 18 bp, Homo sapiens
tggatggccgtggatgcg

SEQ ID NO: 1240605 - DNA, 17 bp, Homo sapiens
tggatgggaatttgtca

SEQ ID NO: 1240606 - DNA, 12 bp, Homo sapiens
tggatgggactc

SEQ ID NO: 1240607 - DNA, 22 bp, Homo sapiens
tggatgggactccatagctcct

SEQ ID NO: 1240608 - DNA, 18 bp, Homo sapiens
tggatgggggtgcaggca

SEQ ID NO: 1240609 - DNA, 18 bp, Homo sapiens
tggatggtcattgcagtt

SEQ ID NO: 1240610 - DNA, 22 bp, Homo sapiens
tggatggtttgttgttctgcct

SEQ ID NO: 1240611 - DNA, 16 bp, Homo sapiens
tggatgtctgtgagta

SEQ ID NO: 1240612 - DNA, 21 bp, Homo sapiens
tggatgtgaagctcacactga

SEQ ID NO: 1240613 - DNA, 20 bp, Homo sapiens
tggatgttatgaacagctgt

SEQ ID NO: 1240614 - DNA, 12 bp, Homo sapiens
tggatgttctga

SEQ ID NO: 1240615 - DNA, 12 bp, Homo sapiens
tggattaaaaca

SEQ ID NO: 1240616 - DNA, 15 bp, Homo sapiens
tggattaaaacaatt

SEQ ID NO: 1240617 - DNA, 13 bp, Homo sapiens
tggattaaagact

SEQ ID NO: 1240618 - DNA, 21 bp, Homo sapiens
tggattaaatacatatggatg

SEQ ID NO: 1240619 - DNA, 14 bp, Homo sapiens
tggattaaattagt

SEQ ID NO: 1240620 - DNA, 18 bp, Homo sapiens
tggattactattgcaaaa

SEQ ID NO: 1240621 - DNA, 16 bp, Homo sapiens
tggattataatcagaa

SEQ ID NO: 1240622 - DNA, 21 bp, Homo sapiens
tggattatgttatacaaggca

SEQ ID NO: 1240623 - DNA, 19 bp, Homo sapiens
tggattattcatttaaaat

SEQ ID NO: 1240624 - DNA, 13 bp, Homo sapiens
tggattatttcat

SEQ ID NO: 1240625 - DNA, 13 bp, Homo sapiens
tggattcagaaat

SEQ ID NO: 1240626 - DNA, 17 bp, Homo sapiens
tggattcattctcataa

SEQ ID NO: 1240627 - DNA, 16 bp, Homo sapiens
tggattcattgtctct

SEQ ID NO: 1240628 - DNA, 15 bp, Homo sapiens
tggattcatttcctg

SEQ ID NO: 1240629 - DNA, 23 bp, Homo sapiens
tggattcccccccctttcctaaa

SEQ ID NO: 1240630 - DNA, 17 bp, Homo sapiens
tggattcccttttgact

SEQ ID NO: 1240631 - DNA, 18 bp, Homo sapiens
tggattccgagtggtgac

SEQ ID NO: 1240632 - DNA, 13 bp, Homo sapiens
tggattctaaaat

SEQ ID NO: 1240633 - DNA, 19 bp, Homo sapiens
tggattctccctgggcctc

SEQ ID NO: 1240634 - DNA, 17 bp, Homo sapiens
tggattctctaaccttt

SEQ ID NO: 1240635 - DNA, 22 bp, Homo sapiens
tggattctcttagctactgtat

SEQ ID NO: 1240636 - DNA, 22 bp, Homo sapiens
tggattctgggaggcaagaaaa

SEQ ID NO: 1240637 - DNA, 23 bp, Homo sapiens
tggattgcccgcgctcaggaggt

SEQ ID NO: 1240638 - DNA, 22 bp, Homo sapiens
tggattgcgcctttgtattata

SEQ ID NO: 1240639 - DNA, 20 bp, Homo sapiens
tggattggaatgcagaggtc

SEQ ID NO: 1240640 - DNA, 23 bp, Homo sapiens
tggattggacaggagatcagcag

SEQ ID NO: 1240641 - DNA, 21 bp, Homo sapiens
tggattgggacgcacagtgca

SEQ ID NO: 1240642 - DNA, 14 bp, Homo sapiens
tggattgtggttcc

SEQ ID NO: 1240643 - DNA, 21 bp, Homo sapiens
tggattgtggttccatgcagc

SEQ ID NO: 1240644 - DNA, 14 bp, Homo sapiens
tggatttataaatg

SEQ ID NO: 1240645 - DNA, 16 bp, Homo sapiens
tggatttcatttgtaa

SEQ ID NO: 1240646 - DNA, 15 bp, Homo sapiens
tggatttcctaatac

SEQ ID NO: 1240647 - DNA, 13 bp, Homo sapiens
tggatttgacatt

SEQ ID NO: 1240648 - DNA, 12 bp, Homo sapiens
tggatttgctgt

SEQ ID NO: 1240649 - DNA, 17 bp, Homo sapiens
tggattttctactgtaa

SEQ ID NO: 1240650 - DNA, 15 bp, Homo sapiens
tggattttgaattag

SEQ ID NO: 1240651 - DNA, 23 bp, Homo sapiens
tggattttttatgtacaaccctg

SEQ ID NO: 1240652 - DNA, 17 bp, Homo sapiens
tggattttttattatta

SEQ ID NO: 1240653 - DNA, 22 bp, Homo sapiens
tggattttttattattattcaa

SEQ ID NO: 1240654 - DNA, 17 bp, Homo sapiens
tggcaaaaaaaaaaaag

SEQ ID NO: 1240655 - DNA, 12 bp, Homo sapiens
tggcaaaaaggc

SEQ ID NO: 1240656 - DNA, 21 bp, Homo sapiens
tggcaaaatatggtttggttt

SEQ ID NO: 1240657 - DNA, 17 bp, Homo sapiens
tggcaaacttcagactg

SEQ ID NO: 1240658 - DNA, 18 bp, Homo sapiens
tggcaaagcttttagaaa

SEQ ID NO: 1240659 - DNA, 18 bp, Homo sapiens
tggcaaatcaggggccag

SEQ ID NO: 1240660 - DNA, 19 bp, Homo sapiens
tggcaaatcaggggccaga

SEQ ID NO: 1240661 - DNA, 13 bp, Homo sapiens
tggcaaatgatga

SEQ ID NO: 1240662 - DNA, 14 bp, Homo sapiens
tggcaaatgatgat

SEQ ID NO: 1240663 - DNA, 22 bp, Homo sapiens
tggcaaatggaggcttttcact

SEQ ID NO: 1240664 - DNA, 15 bp, Homo sapiens
tggcaaattttaaaa

SEQ ID NO: 1240665 - DNA, 14 bp, Homo sapiens
tggcaacagagcga

SEQ ID NO: 1240666 - DNA, 22 bp, Homo sapiens
tggcaaccttgtctctatgcca

SEQ ID NO: 1240667 - DNA, 15 bp, Homo sapiens
tggcaagactactgg

SEQ ID NO: 1240668 - DNA, 18 bp, Homo sapiens
tggcaagagggtgacagc

SEQ ID NO: 1240669 - DNA, 15 bp, Homo sapiens
tggcaagatgtttct

SEQ ID NO: 1240670 - DNA, 12 bp, Homo sapiens
tggcaagctgca

SEQ ID NO: 1240671 - DNA, 13 bp, Homo sapiens
tggcaagctgcag

SEQ ID NO: 1240672 - DNA, 11 bp, Homo sapiens
tggcaaggaaa

SEQ ID NO: 1240673 - DNA, 12 bp, Homo sapiens
tggcaaggaaag

SEQ ID NO: 1240674 - DNA, 17 bp, Homo sapiens
tggcaagggggtgtcat

SEQ ID NO: 1240675 - DNA, 19 bp, Homo sapiens
tggcaagtcattagaatgt

SEQ ID NO: 1240676 - DNA, 19 bp, Homo sapiens
tggcaagtcggggcctggg

SEQ ID NO: 1240677 - DNA, 14 bp, Homo sapiens
tggcaagtgaattt

SEQ ID NO: 1240678 - DNA, 12 bp, Homo sapiens
tggcaataaact

SEQ ID NO: 1240679 - DNA, 19 bp, Homo sapiens
tggcaatagggtagaatga

SEQ ID NO: 1240680 - DNA, 15 bp, Homo sapiens
tggcaatattctgta

SEQ ID NO: 1240681 - DNA, 20 bp, Homo sapiens
tggcaatcaaacattttctg

SEQ ID NO: 1240682 - DNA, 20 bp, Homo sapiens
tggcaatcaatacagcttca

SEQ ID NO: 1240683 - DNA, 19 bp, Homo sapiens
tggcaatgccatcatctcc

SEQ ID NO: 1240684 - DNA, 23 bp, Homo sapiens
tggcaatgggccgtcccctctcc

SEQ ID NO: 1240685 - DNA, 14 bp, Homo sapiens
tggcaattctttga

SEQ ID NO: 1240686 - DNA, 23 bp, Homo sapiens
tggcaattctttgacctcaacct

SEQ ID NO: 1240687 - DNA, 17 bp, Homo sapiens
tggcaattgcactcatg

SEQ ID NO: 1240688 - DNA, 14 bp, Homo sapiens
tggcaattgtctat

SEQ ID NO: 1240689 - DNA, 12 bp, Homo sapiens
tggcaatttctt

SEQ ID NO: 1240690 - DNA, 13 bp, Homo sapiens
tggcaattttgta

SEQ ID NO: 1240691 - DNA, 14 bp, Homo sapiens
tggcaattttgtgg

SEQ ID NO: 1240692 - DNA, 23 bp, Homo sapiens
tggcacaatcatggctgattgca

SEQ ID NO: 1240693 - DNA, 10 bp, Homo sapiens
tggcacaatg

SEQ ID NO: 1240694 - DNA, 15 bp, Homo sapiens
tggcacaatgaatgt

SEQ ID NO: 1240695 - DNA, 15 bp, Homo sapiens
tggcacagaaggatc

SEQ ID NO: 1240696 - DNA, 15 bp, Homo sapiens
tggcacagaccaggc

SEQ ID NO: 1240697 - DNA, 17 bp, Homo sapiens
tggcacagaccaggcct

SEQ ID NO: 1240698 - DNA, 22 bp, Homo sapiens
tggcacagacttctggaaggct

SEQ ID NO: 1240699 - DNA, 23 bp, Homo sapiens
tggcacagacttctggaaggctg

SEQ ID NO: 1240700 - DNA, 23 bp, Homo sapiens
tggcacagaggtagtctcactgc

SEQ ID NO: 1240701 - DNA, 12 bp, Homo sapiens
tggcacaggcac

SEQ ID NO: 1240702 - DNA, 15 bp, Homo sapiens
tggcacaggcactga

SEQ ID NO: 1240703 - DNA, 16 bp, Homo sapiens
tggcacaggccccctt

SEQ ID NO: 1240704 - DNA, 23 bp, Homo sapiens
tggcacaggcccgccctctgcct

SEQ ID NO: 1240705 - DNA, 22 bp, Homo sapiens
tggcaccaccagggtggaccag

SEQ ID NO: 1240706 - DNA, 19 bp, Homo sapiens
tggcaccactgcactccag

SEQ ID NO: 1240707 - DNA, 20 bp, Homo sapiens
tggcaccagaggctgcagaa

SEQ ID NO: 1240708 - DNA, 16 bp, Homo sapiens
tggcaccagcagcctg

SEQ ID NO: 1240709 - DNA, 17 bp, Homo sapiens
tggcaccagcagcctgg

SEQ ID NO: 1240710 - DNA, 18 bp, Homo sapiens
tggcaccagcagcctgga

SEQ ID NO: 1240711 - DNA, 13 bp, Homo sapiens
tggcaccagcccc

SEQ ID NO: 1240712 - DNA, 19 bp, Homo sapiens
tggcaccagccccctggat

SEQ ID NO: 1240713 - DNA, 16 bp, Homo sapiens
tggcaccatggtgact

SEQ ID NO: 1240714 - DNA, 16 bp, Homo sapiens
tggcacccaccgtctc

SEQ ID NO: 1240715 - DNA, 23 bp, Homo sapiens
tggcacccaccgtctcggccctg

SEQ ID NO: 1240716 - DNA, 16 bp, Homo sapiens
tggcacccctttctag

SEQ ID NO: 1240717 - DNA, 13 bp, Homo sapiens
tggcacctcaggc

SEQ ID NO: 1240718 - DNA, 19 bp, Homo sapiens
tggcagtgtcccagggccc

SEQ ID NO: 1240719 - DNA, 18 bp, Homo sapiens
tggcagtgttttggttca

SEQ ID NO: 1240720 - DNA, 13 bp, Homo sapiens
tggcagttcttta

SEQ ID NO: 1240721 - DNA, 15 bp, Homo sapiens
tggcataaattacag

SEQ ID NO: 1240722 - DNA, 22 bp, Homo sapiens
tggcataaattacagtcatctg

SEQ ID NO: 1240723 - DNA, 14 bp, Homo sapiens
tggcataattttta

SEQ ID NO: 1240724 - DNA, 14 bp, Homo sapiens
tggcatacaaaata

SEQ ID NO: 1240725 - DNA, 19 bp, Homo sapiens
tggcatacaaaatatttaa

SEQ ID NO: 1240726 - DNA, 15 bp, Homo sapiens
tggcatagccccggc

SEQ ID NO: 1240727 - DNA, 16 bp, Homo sapiens
tggcatagccccggcc

SEQ ID NO: 1240728 - DNA, 16 bp, Homo sapiens
tggcatagctctgggg

SEQ ID NO: 1240729 - DNA, 20 bp, Homo sapiens
tggcatatatgtgatctggg

SEQ ID NO: 1240730 - DNA, 15 bp, Homo sapiens
tggcatcacagggca

SEQ ID NO: 1240731 - DNA, 16 bp, Homo sapiens
tggcatcctgtgaagt

SEQ ID NO: 1240732 - DNA, 16 bp, Homo sapiens
tggcatcgtagaagag

SEQ ID NO: 1240733 - DNA, 15 bp, Homo sapiens
tggcatctgacacaa

SEQ ID NO: 1240734 - DNA, 18 bp, Homo sapiens
tggcatctgacacaaaaa

SEQ ID NO: 1240735 - DNA, 11 bp, Homo sapiens
tggcatctgtg

SEQ ID NO: 1240736 - DNA, 13 bp, Homo sapiens
tggcatctgtgcg

SEQ ID NO: 1240737 - DNA, 13 bp, Homo sapiens
tggcatctgtgtg

SEQ ID NO: 1240738 - DNA, 17 bp, Homo sapiens
tggcatcttcaatatga

SEQ ID NO: 1240739 - DNA, 21 bp, Homo sapiens
tggcatctttgccttgggctg

SEQ ID NO: 1240740 - DNA, 19 bp, Homo sapiens
tggcatcttttggaggaaa

SEQ ID NO: 1240741 - DNA, 20 bp, Homo sapiens
tggcatgaatcgggctaagg

SEQ ID NO: 1240742 - DNA, 14 bp, Homo sapiens
tggccaggagcagg

SEQ ID NO: 1240743 - DNA, 16 bp, Homo sapiens
tggccaggagctcttc

SEQ ID NO: 1240744 - DNA, 20 bp, Homo sapiens
tggccaggagctcttcaggc

SEQ ID NO: 1240745 - DNA, 23 bp, Homo sapiens
tggccaggataatatatttgcag

SEQ ID NO: 1240746 - DNA, 16 bp, Homo sapiens
tggccaggcactgcct

SEQ ID NO: 1240747 - DNA, 17 bp, Homo sapiens
tggccaggcagatctgt

SEQ ID NO: 1240748 - DNA, 23 bp, Homo sapiens
tggccaggcagatctgtgcccca

SEQ ID NO: 1240749 - DNA, 15 bp, Homo sapiens
tggccaggctggtct

SEQ ID NO: 1240750 - DNA, 20 bp, Homo sapiens
tggccaggctggtcttgaac

SEQ ID NO: 1240751 - DNA, 14 bp, Homo sapiens
tggccagggaggcg

SEQ ID NO: 1240752 - DNA, 13 bp, Homo sapiens
tggccagggtgag

SEQ ID NO: 1240753 - DNA, 17 bp, Homo sapiens
tggccagggtgagagct

SEQ ID NO: 1240754 - DNA, 19 bp, Homo sapiens
tggccagggtgagagctgc

SEQ ID NO: 1240755 - DNA, 16 bp, Homo sapiens
tggccaggtggccact

SEQ ID NO: 1240756 - DNA, 17 bp, Homo sapiens
tggccaggtggccactc

SEQ ID NO: 1240757 - DNA, 14 bp, Homo sapiens
tggccagtccaggc

SEQ ID NO: 1240758 - DNA, 17 bp, Homo sapiens
tggccagtccaggctgc

SEQ ID NO: 1240759 - DNA, 21 bp, Homo sapiens
tggccagtccaggctgccgtg

SEQ ID NO: 1240760 - DNA, 23 bp, Homo sapiens
tggccagtccaggctgccgtggg

SEQ ID NO: 1240761 - DNA, 16 bp, Homo sapiens
tggccagtcctggtcc

SEQ ID NO: 1240762 - DNA, 17 bp, Homo sapiens
tggccagtcctggtcct

SEQ ID NO: 1240763 - DNA, 19 bp, Homo sapiens
tggccagtgagaagctgag

SEQ ID NO: 1240764 - DNA, 14 bp, Homo sapiens
tggccagtgtcatt

SEQ ID NO: 1240765 - DNA, 16 bp, Homo sapiens
tggccagttatccctt

SEQ ID NO: 1240766 - DNA, 22 bp, Homo sapiens
tggccatagaggcccaggcacc

SEQ ID NO: 1240767 - DNA, 16 bp, Homo sapiens
tggccatcactcagcc

SEQ ID NO: 1240768 - DNA, 17 bp, Homo sapiens
tggccatcactcagccc

SEQ ID NO: 1240769 - DNA, 15 bp, Homo sapiens
tggctgtctgcctgt

SEQ ID NO: 1240770 - DNA, 19 bp, Homo sapiens
tggctgtctgcctgtattt

SEQ ID NO: 1240771 - DNA, 19 bp, Homo sapiens
tggctgtgacaaccctggc

SEQ ID NO: 1240772 - DNA, 22 bp, Homo sapiens
tggctgtgacaaccctggcctc

SEQ ID NO: 1240773 - DNA, 18 bp, Homo sapiens
tggctgtgacctcttcaa

SEQ ID NO: 1240774 - DNA, 17 bp, Homo sapiens
tggctgtgcccagcagg

SEQ ID NO: 1240775 - DNA, 22 bp, Homo sapiens
tggctgtgcccagcaggcccag

SEQ ID NO: 1240776 - DNA, 23 bp, Homo sapiens
tggctgtgcccagcaggcccagc

SEQ ID NO: 1240777 - DNA, 19 bp, Homo sapiens
tggctgtgcctctgcctgt

SEQ ID NO: 1240778 - DNA, 13 bp, Homo sapiens
tggctgtgcctgc

SEQ ID NO: 1240779 - DNA, 19 bp, Homo sapiens
tggctgtgcctgcttctgt

SEQ ID NO: 1240780 - DNA, 14 bp, Homo sapiens
tggctgtggaggcc

SEQ ID NO: 1240781 - DNA, 21 bp, Homo sapiens
tggctgtggaggcctgatgct

SEQ ID NO: 1240782 - DNA, 16 bp, Homo sapiens
tggctgtggcacagac

SEQ ID NO: 1240783 - DNA, 15 bp, Homo sapiens
tggctgtggtcagca

SEQ ID NO: 1240784 - DNA, 17 bp, Homo sapiens
tggctgtgtctctcccc

SEQ ID NO: 1240785 - DNA, 15 bp, Homo sapiens
tggctgttcatgctc

SEQ ID NO: 1240786 - DNA, 17 bp, Homo sapiens
tggctgttccagactca

SEQ ID NO: 1240787 - DNA, 17 bp, Homo sapiens
tggctgttgagggccac

SEQ ID NO: 1240788 - DNA, 16 bp, Homo sapiens
tggcttaaagtgaagg

SEQ ID NO: 1240789 - DNA, 18 bp, Homo sapiens
tggcttaaagtgaaggaa

SEQ ID NO: 1240790 - DNA, 16 bp, Homo sapiens
tggcttaagtgagcag

SEQ ID NO: 1240791 - DNA, 20 bp, Homo sapiens
tggcttaagtgagcagaaca

SEQ ID NO: 1240792 - DNA, 21 bp, Homo sapiens
tggcttaagtgagcagaacag

SEQ ID NO: 1240793 - DNA, 19 bp, Homo sapiens
tggcttacctgacctcttg

SEQ ID NO: 1240794 - DNA, 22 bp, Homo sapiens
tggcttacctgacctcttgctg

SEQ ID NO: 1240795 - DNA, 15 bp, Homo sapiens
tggcttataaacaca

SEQ ID NO: 1240796 - DNA, 21 bp, Homo sapiens
tggcttataaacacattgaat

SEQ ID NO: 1240797 - DNA, 22 bp, Homo sapiens
tggcttatgtcatcagtaaagt

SEQ ID NO: 1240798 - DNA, 19 bp, Homo sapiens
tggcttatttaatatgctt

SEQ ID NO: 1240799 - DNA, 17 bp, Homo sapiens
tggcttcaaaatagaga

SEQ ID NO: 1240800 - DNA, 20 bp, Homo sapiens
tggcttcaagttgtaaaaat

SEQ ID NO: 1240801 - DNA, 16 bp, Homo sapiens
tggcttcagggagggt

SEQ ID NO: 1240802 - DNA, 12 bp, Homo sapiens
tggcttcatttc

SEQ ID NO: 1240803 - DNA, 22 bp, Homo sapiens
tggcttccaggtatctccagga

SEQ ID NO: 1240804 - DNA, 12 bp, Homo sapiens
tggccatccctg

SEQ ID NO: 1240805 - DNA, 14 bp, Homo sapiens
tggccatccctggg

SEQ ID NO: 1240806 - DNA, 15 bp, Homo sapiens
tggccatccctgggc

SEQ ID NO: 1240807 - DNA, 16 bp, Homo sapiens
tggccatccctgggcc

SEQ ID NO: 1240808 - DNA, 21 bp, Homo sapiens
tggccatccctgggcccctcc

SEQ ID NO: 1240809 - DNA, 23 bp, Homo sapiens
tggccatccctgggcccctccac

SEQ ID NO: 1240810 - DNA, 17 bp, Homo sapiens
tggccatcctacccagc

SEQ ID NO: 1240811 - DNA, 18 bp, Homo sapiens
tggccatctccctcccca

SEQ ID NO: 1240812 - DNA, 22 bp, Homo sapiens
tggccatgatgtccttggactc

SEQ ID NO: 1240813 - DNA, 23 bp, Homo sapiens
tggccatgatgtccttggactcc

SEQ ID NO: 1240814 - DNA, 14 bp, Homo sapiens
tggccatgcctcag

SEQ ID NO: 1240815 - DNA, 17 bp, Homo sapiens
tggccatgcctcagccc

SEQ ID NO: 1240816 - DNA, 14 bp, Homo sapiens
tggccatgctgtcc

SEQ ID NO: 1240817 - DNA, 16 bp, Homo sapiens
tggccatgctgtccct

SEQ ID NO: 1240818 - DNA, 18 bp, Homo sapiens
tggccatgctgtccctgc

SEQ ID NO: 1240819 - DNA, 22 bp, Homo sapiens
tggccatgctgtccctgcactg

SEQ ID NO: 1240820 - DNA, 21 bp, Homo sapiens
tggccatggaataaaccattt

SEQ ID NO: 1240821 - DNA, 18 bp, Homo sapiens
tggccatgtattatgaaa

SEQ ID NO: 1240822 - DNA, 17 bp, Homo sapiens
tggccatgtcacctggc

SEQ ID NO: 1240823 - DNA, 18 bp, Homo sapiens
tggccatgttatgctggt

SEQ ID NO: 1240824 - DNA, 13 bp, Homo sapiens
tggccatttctaa

SEQ ID NO: 1240825 - DNA, 16 bp, Homo sapiens
tggccatttctgtgga

SEQ ID NO: 1240826 - DNA, 20 bp, Homo sapiens
tggccatttgctagttctgc

SEQ ID NO: 1240827 - DNA, 15 bp, Homo sapiens
tggcccaagactggg

SEQ ID NO: 1240828 - DNA, 13 bp, Homo sapiens
tggcccaatgcct

SEQ ID NO: 1240829 - DNA, 20 bp, Homo sapiens
tggcccaccccccagcctcc

SEQ ID NO: 1240830 - DNA, 22 bp, Homo sapiens
tggcccaccccccagcctccag

SEQ ID NO: 1240831 - DNA, 20 bp, Homo sapiens
tggcccaccgtggcactaga

SEQ ID NO: 1240832 - DNA, 20 bp, Homo sapiens
tggcccacgcctgtaatccc

SEQ ID NO: 1240833 - DNA, 13 bp, Homo sapiens
tggcccactgcat

SEQ ID NO: 1240834 - DNA, 13 bp, Homo sapiens
tggcccagaaaca

SEQ ID NO: 1240835 - DNA, 20 bp, Homo sapiens
tggcccagcaggcaggcact

SEQ ID NO: 1240836 - DNA, 10 bp, Homo sapiens
tggcccagcc

SEQ ID NO: 1240837 - DNA, 22 bp, Homo sapiens
tggcccagccggcctctctggc

SEQ ID NO: 1240838 - DNA, 14 bp, Homo sapiens
tggcccagcggccc

SEQ ID NO: 1240839 - DNA, 19 bp, Homo sapiens
tggcccagcggcccctccc

SEQ ID NO: 1240840 - DNA, 17 bp, Homo sapiens
tggcccaggaccatcat

SEQ ID NO: 1240841 - DNA, 13 bp, Homo sapiens
tggcccaggagct

SEQ ID NO: 1240842 - DNA, 16 bp, Homo sapiens
tggcccaggagctctg

SEQ ID NO: 1240843 - DNA, 17 bp, Homo sapiens
tggcccaggagctctgc

SEQ ID NO: 1240844 - DNA, 20 bp, Homo sapiens
tggcccaggagctctgcgcc

SEQ ID NO: 1240845 - DNA, 15 bp, Homo sapiens
tggcccaggcagcct

SEQ ID NO: 1240846 - DNA, 14 bp, Homo sapiens
tggcccaggccggg

SEQ ID NO: 1240847 - DNA, 12 bp, Homo sapiens
tggcccaggcct

SEQ ID NO: 1240848 - DNA, 21 bp, Homo sapiens
tggcccaggccttgctgactc

SEQ ID NO: 1240849 - DNA, 16 bp, Homo sapiens
tggcccattcttgagt

SEQ ID NO: 1240850 - DNA, 13 bp, Homo sapiens
tggccccaccctg

SEQ ID NO: 1240851 - DNA, 22 bp, Homo sapiens
tggccccaccctgggccctggg

SEQ ID NO: 1240852 - DNA, 12 bp, Homo sapiens
tggccccagagg

SEQ ID NO: 1240853 - DNA, 20 bp, Homo sapiens
tggccccagccctgctgggg

SEQ ID NO: 1240854 - DNA, 15 bp, Homo sapiens
tggccccagcctggg

SEQ ID NO: 1240855 - DNA, 17 bp, Homo sapiens
tggccccagcctgggcc

SEQ ID NO: 1240856 - DNA, 15 bp, Homo sapiens
tggccccaggacctg

SEQ ID NO: 1240857 - DNA, 21 bp, Homo sapiens
tggccccagtgcggttcctca

SEQ ID NO: 1240858 - DNA, 18 bp, Homo sapiens
tggccccatccaaccact

SEQ ID NO: 1240859 - DNA, 19 bp, Homo sapiens
tggccccatgtctctcaga

SEQ ID NO: 1240860 - DNA, 23 bp, Homo sapiens
tggccccatgtctctcagaattc

SEQ ID NO: 1240861 - DNA, 13 bp, Homo sapiens
tggcccccaataa

SEQ ID NO: 1240862 - DNA, 14 bp, Homo sapiens
tggcccccaataaa

SEQ ID NO: 1240863 - DNA, 15 bp, Homo sapiens
tggcccccaataaag

SEQ ID NO: 1240864 - DNA, 20 bp, Homo sapiens
tggcccccaataaaggcagc

SEQ ID NO: 1240865 - DNA, 21 bp, Homo sapiens
tggcccccaataaaggcagct

SEQ ID NO: 1240866 - DNA, 13 bp, Homo sapiens
tggcccccagccc

SEQ ID NO: 1240867 - DNA, 19 bp, Homo sapiens
tggccccccaaagtgctgg

SEQ ID NO: 1240868 - DNA, 20 bp, Homo sapiens
tggccccccaaagtgctggg

SEQ ID NO: 1240869 - DNA, 19 bp, Homo sapiens
tggcccccgggcctgcaca

SEQ ID NO: 1240870 - DNA, 16 bp, Homo sapiens
tggccccctttcccgg

SEQ ID NO: 1240871 - DNA, 18 bp, Homo sapiens
tggccccctttcccgggc

SEQ ID NO: 1240872 - DNA, 20 bp, Homo sapiens
tggccccgcaaggcctccag

SEQ ID NO: 1240873 - DNA, 15 bp, Homo sapiens
tggccccgcctgcct

SEQ ID NO: 1240874 - DNA, 19 bp, Homo sapiens
tggccccgcctgcctgcca

SEQ ID NO: 1240875 - DNA, 16 bp, Homo sapiens
tggccccgtttctggt

SEQ ID NO: 1240876 - DNA, 19 bp, Homo sapiens
tggcccctagaatcagcct

SEQ ID NO: 1240877 - DNA, 18 bp, Homo sapiens
tggcccctcacatcctct

SEQ ID NO: 1240878 - DNA, 17 bp, Homo sapiens
tggcccctcacccacca

SEQ ID NO: 1240879 - DNA, 18 bp, Homo sapiens
tggcccctcacctgggcc

SEQ ID NO: 1240880 - DNA, 20 bp, Homo sapiens
tggcccctcacctgggcctt

SEQ ID NO: 1240881 - DNA, 22 bp, Homo sapiens
tggcccctccttgcaaccaggc

SEQ ID NO: 1240882 - DNA, 17 bp, Homo sapiens
tggcccctcgcctgtgg

SEQ ID NO: 1240883 - DNA, 16 bp, Homo sapiens
tggcccctctgacctg

SEQ ID NO: 1240884 - DNA, 18 bp, Homo sapiens
tggcccctctgacctgca

SEQ ID NO: 1240885 - DNA, 15 bp, Homo sapiens
tggcccctgagccca

SEQ ID NO: 1240886 - DNA, 18 bp, Homo sapiens
tggcccctgtctcggggc

SEQ ID NO: 1240887 - DNA, 12 bp, Homo sapiens
tggcccctgtgg

SEQ ID NO: 1240888 - DNA, 21 bp, Homo sapiens
tggccccttcacttctgacca

SEQ ID NO: 1240889 - DNA, 17 bp, Homo sapiens
tggcccgacagcctggc

SEQ ID NO: 1240890 - DNA, 16 bp, Homo sapiens
tggcccgccctcacct

SEQ ID NO: 1240891 - DNA, 20 bp, Homo sapiens
tggcccgccctcacctctga

SEQ ID NO: 1240892 - DNA, 19 bp, Homo sapiens
tggcccgtggcctggcatc

SEQ ID NO: 1240893 - DNA, 20 bp, Homo sapiens
tggcccgtggcctggcatct

SEQ ID NO: 1240894 - DNA, 20 bp, Homo sapiens
tggcccgtggcttggcatct

SEQ ID NO: 1240895 - DNA, 23 bp, Homo sapiens
tggcccgtggcttggcatctgtg

SEQ ID NO: 1240896 - DNA, 23 bp, Homo sapiens
tggccctccaccttgttcctgcc

SEQ ID NO: 1240897 - DNA, 15 bp, Homo sapiens
tggccctccctccct

SEQ ID NO: 1240898 - DNA, 16 bp, Homo sapiens
tggccctcctggctgt

SEQ ID NO: 1240899 - DNA, 22 bp, Homo sapiens
tggccctcggtggctgcacaga

SEQ ID NO: 1240900 - DNA, 14 bp, Homo sapiens
tggccctgactgtc

SEQ ID NO: 1240901 - DNA, 16 bp, Homo sapiens
tggccctgaggtgtgg

SEQ ID NO: 1240902 - DNA, 21 bp, Homo sapiens
tgggaagcagggaattcctgg

SEQ ID NO: 1240903 - DNA, 21 bp, Homo sapiens
tgggaagccatattcacacct

SEQ ID NO: 1240904 - DNA, 22 bp, Homo sapiens
tgggaagctgtactcagagcag

SEQ ID NO: 1240905 - DNA, 12 bp, Homo sapiens
tgggaaggaaac

SEQ ID NO: 1240906 - DNA, 19 bp, Homo sapiens
tgggaaggaaacaaatgtg

SEQ ID NO: 1240907 - DNA, 14 bp, Homo sapiens
tgggaaggaaaggc

SEQ ID NO: 1240908 - DNA, 15 bp, Homo sapiens
tgggaaggaaatata

SEQ ID NO: 1240909 - DNA, 20 bp, Homo sapiens
tgggaaggacacagcagtat

SEQ ID NO: 1240910 - DNA, 13 bp, Homo sapiens
tgggaaggacttg

SEQ ID NO: 1240911 - DNA, 17 bp, Homo sapiens
tgggaaggaggggagcc

SEQ ID NO: 1240912 - DNA, 15 bp, Homo sapiens
tgggaaggccagctg

SEQ ID NO: 1240913 - DNA, 14 bp, Homo sapiens
tgggaaggctaagt

SEQ ID NO: 1240914 - DNA, 19 bp, Homo sapiens
tgggaaggctaagttcagt

SEQ ID NO: 1240915 - DNA, 17 bp, Homo sapiens
tgggaaggcttgggatt

SEQ ID NO: 1240916 - DNA, 18 bp, Homo sapiens
tgggaaggcttgggattt

SEQ ID NO: 1240917 - DNA, 13 bp, Homo sapiens
tgggaagggagag

SEQ ID NO: 1240918 - DNA, 21 bp, Homo sapiens
tgggaagggagagcggggcag

SEQ ID NO: 1240919 - DNA, 23 bp, Homo sapiens
tgggaagggagagttctttgctg

SEQ ID NO: 1240920 - DNA, 19 bp, Homo sapiens
tgggaaggggacccccgcc

SEQ ID NO: 1240921 - DNA, 17 bp, Homo sapiens
tgggaaggggaggaccc

SEQ ID NO: 1240922 - DNA, 15 bp, Homo sapiens
tgggaaggggtcctg

SEQ ID NO: 1240923 - DNA, 19 bp, Homo sapiens
tgggaaggggtcctgcagg

SEQ ID NO: 1240924 - DNA, 21 bp, Homo sapiens
tgggaaggggtcctgcagggg

SEQ ID NO: 1240925 - DNA, 20 bp, Homo sapiens
tgggaagggtcatagaaagg

SEQ ID NO: 1240926 - DNA, 22 bp, Homo sapiens
tgggaaggttagaaaggcagcc

SEQ ID NO: 1240927 - DNA, 22 bp, Homo sapiens
tgggaagtggaggttgagtgag

SEQ ID NO: 1240928 - DNA, 16 bp, Homo sapiens
tgggaatatgtagagg

SEQ ID NO: 1240929 - DNA, 17 bp, Homo sapiens
tgggaatgaggtgggag

SEQ ID NO: 1240930 - DNA, 17 bp, Homo sapiens
tgggaatggaataacta

SEQ ID NO: 1240931 - DNA, 15 bp, Homo sapiens
tgggaatgggagagg

SEQ ID NO: 1240932 - DNA, 22 bp, Homo sapiens
tgggaatgtattattctgcagc

SEQ ID NO: 1240933 - DNA, 20 bp, Homo sapiens
tgggaatgttacattgtttg

SEQ ID NO: 1240934 - DNA, 14 bp, Homo sapiens
tgggaatttcaatg

SEQ ID NO: 1240935 - DNA, 15 bp, Homo sapiens
tgggaatttgtcagc

SEQ ID NO: 1240936 - DNA, 23 bp, Homo sapiens
tgggacaaaccagagcagagagc

SEQ ID NO: 1240937 - DNA, 17 bp, Homo sapiens
tgggacaagcagtccct

SEQ ID NO: 1240938 - DNA, 14 bp, Homo sapiens
tgggacacagaccc

SEQ ID NO: 1240939 - DNA, 16 bp, Homo sapiens
tgggacacagacccag

SEQ ID NO: 1240940 - DNA, 18 bp, Homo sapiens
tgggacacagacccagga

SEQ ID NO: 1240941 - DNA, 14 bp, Homo sapiens
tgggacaccaggga

SEQ ID NO: 1240942 - DNA, 22 bp, Homo sapiens
tgggacactgggcagcaaggct

SEQ ID NO: 1240943 - DNA, 22 bp, Homo sapiens
tgggacagaggagcaaggttta

SEQ ID NO: 1240944 - DNA, 11 bp, Homo sapiens
tgggacagcca

SEQ ID NO: 1240945 - DNA, 16 bp, Homo sapiens
tgggacagccagagct

SEQ ID NO: 1240946 - DNA, 22 bp, Homo sapiens
tgggacagggagggtgttttgg

SEQ ID NO: 1240947 - DNA, 16 bp, Homo sapiens
tgggacagggcatggc

SEQ ID NO: 1240948 - DNA, 21 bp, Homo sapiens
tgggaccacaggcatgcacca

SEQ ID NO: 1240949 - DNA, 22 bp, Homo sapiens
tgggacccaaaacacaggaagt

SEQ ID NO: 1240950 - DNA, 16 bp, Homo sapiens
tggggccctcttgcca

SEQ ID NO: 1240951 - DNA, 17 bp, Homo sapiens
tggggccctcttgccag

SEQ ID NO: 1240952 - DNA, 19 bp, Homo sapiens
tggggccctcttgccagcc

SEQ ID NO: 1240953 - DNA, 20 bp, Homo sapiens
tggggccctcttgccagcct

SEQ ID NO: 1240954 - DNA, 21 bp, Homo sapiens
tggggccctcttgccagcctc

SEQ ID NO: 1240955 - DNA, 23 bp, Homo sapiens
tggggccctcttgccagcctcct

SEQ ID NO: 1240956 - DNA, 12 bp, Homo sapiens
tggggccctgag

SEQ ID NO: 1240957 - DNA, 15 bp, Homo sapiens
tggggccctgggcct

SEQ ID NO: 1240958 - DNA, 19 bp, Homo sapiens
tggggcccttggccccaga

SEQ ID NO: 1240959 - DNA, 22 bp, Homo sapiens
tggggcccttggccccagagga

SEQ ID NO: 1240960 - DNA, 22 bp, Homo sapiens
tggggcccttgggccacgctct

SEQ ID NO: 1240961 - DNA, 23 bp, Homo sapiens
tggggccgaaaatgtttttaaag

SEQ ID NO: 1240962 - DNA, 19 bp, Homo sapiens
tggggccgccgcctctttc

SEQ ID NO: 1240963 - DNA, 18 bp, Homo sapiens
tggggcctacagctttga

SEQ ID NO: 1240964 - DNA, 18 bp, Homo sapiens
tggggcctagatccacac

SEQ ID NO: 1240965 - DNA, 22 bp, Homo sapiens
tggggcctcagcctggggctct

SEQ ID NO: 1240966 - DNA, 19 bp, Homo sapiens
tggggcctccagaagctgc

SEQ ID NO: 1240967 - DNA, 21 bp, Homo sapiens
tggggcctccagaagctgctc

SEQ ID NO: 1240968 - DNA, 12 bp, Homo sapiens
tggggcctgaga

SEQ ID NO: 1240969 - DNA, 13 bp, Homo sapiens
tggggcctgagag

SEQ ID NO: 1240970 - DNA, 16 bp, Homo sapiens
tggggcctgagagaat

SEQ ID NO: 1240971 - DNA, 13 bp, Homo sapiens
tggggcctggctt

SEQ ID NO: 1240972 - DNA, 14 bp, Homo sapiens
tggggcctggcttg

SEQ ID NO: 1240973 - DNA, 22 bp, Homo sapiens
tggggcctggcttgctccaggg

SEQ ID NO: 1240974 - DNA, 22 bp, Homo sapiens
tggggcctgggagggttcccct

SEQ ID NO: 1240975 - DNA, 16 bp, Homo sapiens
tggggccttccccctt

SEQ ID NO: 1240976 - DNA, 21 bp, Homo sapiens
tggggccttcccccttgtggg

SEQ ID NO: 1240977 - DNA, 23 bp, Homo sapiens
tggggccttcgggaccctggggc

SEQ ID NO: 1240978 - DNA, 19 bp, Homo sapiens
tggggcgtggggagggccg

SEQ ID NO: 1240979 - DNA, 15 bp, Homo sapiens
tggggctaaatgaag

SEQ ID NO: 1240980 - DNA, 23 bp, Homo sapiens
tggggctaggggaagggctttga

SEQ ID NO: 1240981 - DNA, 20 bp, Homo sapiens
tggggctcacttttcatcct

SEQ ID NO: 1240982 - DNA, 16 bp, Homo sapiens
tggggctcccagctcc

SEQ ID NO: 1240983 - DNA, 17 bp, Homo sapiens
tggggctccggagggga

SEQ ID NO: 1240984 - DNA, 23 bp, Homo sapiens
tggggctccggaggggacccagc

SEQ ID NO: 1240985 - DNA, 23 bp, Homo sapiens
tggggctcctccagggtggcagc

SEQ ID NO: 1240986 - DNA, 11 bp, Homo sapiens
tggggctcctt

SEQ ID NO: 1240987 - DNA, 21 bp, Homo sapiens
tggggctcgccccacccaggg

SEQ ID NO: 1240988 - DNA, 20 bp, Homo sapiens
tggggctcgtggccttcccc

SEQ ID NO: 1240989 - DNA, 21 bp, Homo sapiens
tggggctgaacatgcctgcca

SEQ ID NO: 1240990 - DNA, 23 bp, Homo sapiens
tggggctgagagagtataaataa

SEQ ID NO: 1240991 - DNA, 15 bp, Homo sapiens
tggggctgagctggg

SEQ ID NO: 1240992 - DNA, 17 bp, Homo sapiens
tggggctgccagcctga

SEQ ID NO: 1240993 - DNA, 21 bp, Homo sapiens
tggggctgccatagggtctgc

SEQ ID NO: 1240994 - DNA, 16 bp, Homo sapiens
tggggctgctcctcca

SEQ ID NO: 1240995 - DNA, 17 bp, Homo sapiens
tggggctgctcctccag

SEQ ID NO: 1240996 - DNA, 12 bp, Homo sapiens
tggggctgggca

SEQ ID NO: 1240997 - DNA, 20 bp, Homo sapiens
tggggctgggcaccgtgtcc

SEQ ID NO: 1240998 - DNA, 11 bp, Homo sapiens
tggggctgggg

SEQ ID NO: 1240999 - DNA, 23 bp, Homo sapiens
tggggctgtatttatctctgagg

SEQ ID NO: 1241000 - DNA, 22 bp, Homo sapiens
tggggctgtcgggggctgtgga

SEQ ID NO: 1241001 - DNA, 13 bp, Homo sapiens
tggggcttatggg

SEQ ID NO: 1241002 - DNA, 22 bp, Homo sapiens
tggggcttcaccagtctgtcta

SEQ ID NO: 1241003 - DNA, 16 bp, Homo sapiens
tgggggaaaaaaaaga

SEQ ID NO: 1241004 - DNA, 19 bp, Homo sapiens
tgggggaaaaaaaagaaaa

SEQ ID NO: 1241005 - DNA, 14 bp, Homo sapiens
tgggggaagccctg

SEQ ID NO: 1241006 - DNA, 16 bp, Homo sapiens
tgggggaagccctgga

SEQ ID NO: 1241007 - DNA, 16 bp, Homo sapiens
tgggggaaggcgctgg

SEQ ID NO: 1241008 - DNA, 23 bp, Homo sapiens
tgggggaaggcgctgggtgcctg

SEQ ID NO: 1241009 - DNA, 23 bp, Homo sapiens
tgggggaatgagcccagagaaca

SEQ ID NO: 1241010 - DNA, 11 bp, Homo sapiens
tgggggacctt

SEQ ID NO: 1241011 - DNA, 15 bp, Homo sapiens
tgggggactgggagt

SEQ ID NO: 1241012 - DNA, 23 bp, Homo sapiens
tgggggagaaaaaatcactgttt

SEQ ID NO: 1241013 - DNA, 14 bp, Homo sapiens
tgggggagagcagg

SEQ ID NO: 1241014 - DNA, 17 bp, Homo sapiens
tgggggagagcaggctg

SEQ ID NO: 1241015 - DNA, 14 bp, Homo sapiens
tgggggagagccgt

SEQ ID NO: 1241016 - DNA, 21 bp, Homo sapiens
tgggggaggagcctctggctt

SEQ ID NO: 1241017 - DNA, 12 bp, Homo sapiens
tgggggaggcag

SEQ ID NO: 1241018 - DNA, 16 bp, Homo sapiens
tgggggaggcagggct

SEQ ID NO: 1241019 - DNA, 18 bp, Homo sapiens
tgggggagggaagaccag

SEQ ID NO: 1241020 - DNA, 21 bp, Homo sapiens
tgggggagggaagaccagaat

SEQ ID NO: 1241021 - DNA, 17 bp, Homo sapiens
tgggggagttttcctct

SEQ ID NO: 1241022 - DNA, 20 bp, Homo sapiens
tgggggcacagctgtctgcc

SEQ ID NO: 1241023 - DNA, 21 bp, Homo sapiens
tgggggcacagctgtctgcca

SEQ ID NO: 1241024 - DNA, 16 bp, Homo sapiens
tgggggcactgaccag

SEQ ID NO: 1241025 - DNA, 21 bp, Homo sapiens
tgggggcactgaccaggccca

SEQ ID NO: 1241026 - DNA, 13 bp, Homo sapiens
tgggggcagaggg

SEQ ID NO: 1241027 - DNA, 17 bp, Homo sapiens
tgggggcagagggcaga

SEQ ID NO: 1241028 - DNA, 18 bp, Homo sapiens
tgggggcagagggcagag

SEQ ID NO: 1241029 - DNA, 13 bp, Homo sapiens
tgggggcagggct

SEQ ID NO: 1241030 - DNA, 14 bp, Homo sapiens
tgggggccacctgc

SEQ ID NO: 1241031 - DNA, 16 bp, Homo sapiens
tgggggccacctgcct

SEQ ID NO: 1241032 - DNA, 16 bp, Homo sapiens
tgggggccatgagctc

SEQ ID NO: 1241033 - DNA, 20 bp, Homo sapiens
tgggggcgccctctctgctc

SEQ ID NO: 1241034 - DNA, 19 bp, Homo sapiens
tgggggctcggggaggcag

SEQ ID NO: 1241035 - DNA, 17 bp, Homo sapiens
tgggggctggaggtgct

SEQ ID NO: 1241036 - DNA, 17 bp, Homo sapiens
tgggggctggctcccag

SEQ ID NO: 1241037 - DNA, 18 bp, Homo sapiens
tgggggctggctcccagg

SEQ ID NO: 1241038 - DNA, 21 bp, Homo sapiens
tgggggctgtctttgcagggc

SEQ ID NO: 1241039 - DNA, 17 bp, Homo sapiens
tgggggcttcttcctca

SEQ ID NO: 1241040 - DNA, 15 bp, Homo sapiens
tggggggacagagac

SEQ ID NO: 1241041 - DNA, 20 bp, Homo sapiens
tggggggacagagactcaga

SEQ ID NO: 1241042 - DNA, 12 bp, Homo sapiens
tggggggagaga

SEQ ID NO: 1241043 - DNA, 18 bp, Homo sapiens
tggggggataatgtcccc

SEQ ID NO: 1241044 - DNA, 22 bp, Homo sapiens
tggggggccaaagaaggcaggg

SEQ ID NO: 1241045 - DNA, 15 bp, Homo sapiens
tggggggccaacacc

SEQ ID NO: 1241046 - DNA, 21 bp, Homo sapiens
tggggggccaacaccagggat

SEQ ID NO: 1241047 - DNA, 19 bp, Homo sapiens
tggggggctgaggtgggag

SEQ ID NO: 1241048 - DNA, 22 bp, Homo sapiens
tggggggctttggcctgtgagc

SEQ ID NO: 1241049 - DNA, 17 bp, Homo sapiens
tgggggggctgcctttg

SEQ ID NO: 1241050 - DNA, 14 bp, Homo sapiens
tgggggggtggccg

SEQ ID NO: 1241051 - DNA, 15 bp, Homo sapiens
tgggggtagcagctg

SEQ ID NO: 1241052 - DNA, 16 bp, Homo sapiens
tgggggtagcagctgg

SEQ ID NO: 1241053 - DNA, 16 bp, Homo sapiens
tgggggtagcctggat

SEQ ID NO: 1241054 - DNA, 23 bp, Homo sapiens
tgggggtcagaagaagtgggagc

SEQ ID NO: 1241055 - DNA, 17 bp, Homo sapiens
tgggggtcatcagggag

SEQ ID NO: 1241056 - DNA, 14 bp, Homo sapiens
tgggggtgacccca

SEQ ID NO: 1241057 - DNA, 15 bp, Homo sapiens
tgggggtgcagatgg

SEQ ID NO: 1241058 - DNA, 12 bp, Homo sapiens
tgggggtgcatt

SEQ ID NO: 1241059 - DNA, 14 bp, Homo sapiens
tgggggtggcaggc

SEQ ID NO: 1241060 - DNA, 16 bp, Homo sapiens
tgggggtggcaggcac

SEQ ID NO: 1241061 - DNA, 16 bp, Homo sapiens
tgggggtgggccaggc

SEQ ID NO: 1241062 - DNA, 23 bp, Homo sapiens
tgggggtgggctgctggccatga

SEQ ID NO: 1241063 - DNA, 15 bp, Homo sapiens
tgggggttctttctt

SEQ ID NO: 1241064 - DNA, 19 bp, Homo sapiens
tgggggttctttcttcctc

SEQ ID NO: 1241065 - DNA, 22 bp, Homo sapiens
tgggggttctttcttcctctgc

SEQ ID NO: 1241066 - DNA, 18 bp, Homo sapiens
tggggtaagccagagcct

SEQ ID NO: 1241067 - DNA, 18 bp, Homo sapiens
tggggtaccatgtggcca

SEQ ID NO: 1241068 - DNA, 17 bp, Homo sapiens
tggggtactcttgatgt

SEQ ID NO: 1241069 - DNA, 19 bp, Homo sapiens
tggggtactcttgatgtga

SEQ ID NO: 1241070 - DNA, 21 bp, Homo sapiens
tggggtactcttgatgtgaag

SEQ ID NO: 1241071 - DNA, 18 bp, Homo sapiens
tggggtagaaacattgta

SEQ ID NO: 1241072 - DNA, 21 bp, Homo sapiens
tggggtagaccttgagggtgg

SEQ ID NO: 1241073 - DNA, 19 bp, Homo sapiens
tggggtatggattctaaaa

SEQ ID NO: 1241074 - DNA, 20 bp, Homo sapiens
tggggtatttaccacagcag

SEQ ID NO: 1241075 - DNA, 21 bp, Homo sapiens
tggggtcagccagggccaggg

SEQ ID NO: 1241076 - DNA, 23 bp, Homo sapiens
tggggtcagccccaagggctggg

SEQ ID NO: 1241077 - DNA, 16 bp, Homo sapiens
tggggtcatgaagggc

SEQ ID NO: 1241078 - DNA, 18 bp, Homo sapiens
tggggtcatgaagggctg

SEQ ID NO: 1241079 - DNA, 19 bp, Homo sapiens
tggggtcatgaagggctgg

SEQ ID NO: 1241080 - DNA, 14 bp, Homo sapiens
tggggtccagggct

SEQ ID NO: 1241081 - DNA, 15 bp, Homo sapiens
tggggtccagggctg

SEQ ID NO: 1241082 - DNA, 19 bp, Homo sapiens
tggggtccatccccttccc

SEQ ID NO: 1241083 - DNA, 15 bp, Homo sapiens
tggggtcccagggaa

SEQ ID NO: 1241084 - DNA, 15 bp, Homo sapiens
tggggtccctccacc

SEQ ID NO: 1241085 - DNA, 12 bp, Homo sapiens
tggggtcctggc

SEQ ID NO: 1241086 - DNA, 19 bp, Homo sapiens
tggggtcctggccatccca

SEQ ID NO: 1241087 - DNA, 16 bp, Homo sapiens
tggggtcctggggcct

SEQ ID NO: 1241088 - DNA, 13 bp, Homo sapiens
tggggtccttgga

SEQ ID NO: 1241089 - DNA, 15 bp, Homo sapiens
tggggtcggctcctg

SEQ ID NO: 1241090 - DNA, 23 bp, Homo sapiens
tggggtctcacagtgttgcccag

SEQ ID NO: 1241091 - DNA, 13 bp, Homo sapiens
tggggtctccctc

SEQ ID NO: 1241092 - DNA, 17 bp, Homo sapiens
tggggtctggcagcctc

SEQ ID NO: 1241093 - DNA, 18 bp, Homo sapiens
tggggtctggcagcctcc

SEQ ID NO: 1241094 - DNA, 19 bp, Homo sapiens
tggggtctgggagggggtg

SEQ ID NO: 1241095 - DNA, 15 bp, Homo sapiens
tggggtctgggcagt

SEQ ID NO: 1241096 - DNA, 16 bp, Homo sapiens
tggggtctgggcagtg

SEQ ID NO: 1241097 - DNA, 17 bp, Homo sapiens
tggggtctgggcagtgc

SEQ ID NO: 1241098 - DNA, 18 bp, Homo sapiens
tggggtctgggcagtgcc

SEQ ID NO: 1241099 - DNA, 18 bp, Homo sapiens
tggggtctgtgactggat

SEQ ID NO: 1241100 - DNA, 13 bp, Homo sapiens
tggggtgagcctg

SEQ ID NO: 1241101 - DNA, 16 bp, Homo sapiens
tggggtgcatcctcct

SEQ ID NO: 1241102 - DNA, 13 bp, Homo sapiens
tggggtgctggga

SEQ ID NO: 1241103 - DNA, 18 bp, Homo sapiens
tggggtgctgggaggagg

SEQ ID NO: 1241104 - DNA, 16 bp, Homo sapiens
tggggtggccagggct

SEQ ID NO: 1241105 - DNA, 17 bp, Homo sapiens
tggggtgggacagggag

SEQ ID NO: 1241106 - DNA, 18 bp, Homo sapiens
tggggtgggacagggagg

SEQ ID NO: 1241107 - DNA, 20 bp, Homo sapiens
tggggtgggagactttccat

SEQ ID NO: 1241108 - DNA, 13 bp, Homo sapiens
tggggtgggaggg

SEQ ID NO: 1241109 - DNA, 15 bp, Homo sapiens
tggggtgggagggcg

SEQ ID NO: 1241110 - DNA, 11 bp, Homo sapiens
tggggtggggg

SEQ ID NO: 1241111 - DNA, 15 bp, Homo sapiens
tggggtgggggccag

SEQ ID NO: 1241112 - DNA, 22 bp, Homo sapiens
tggggtggggggatggtaagag

SEQ ID NO: 1241113 - DNA, 16 bp, Homo sapiens
tggggtgggggtgggc

SEQ ID NO: 1241114 - DNA, 14 bp, Homo sapiens
tggggtggttgagg

SEQ ID NO: 1241115 - DNA, 18 bp, Homo sapiens
tggggtgtggggtggggt

SEQ ID NO: 1241116 - DNA, 21 bp, Homo sapiens
tggggtgtgttccaactgccc

SEQ ID NO: 1241117 - DNA, 21 bp, Homo sapiens
tggggtgttaatggtagcatt

SEQ ID NO: 1241118 - DNA, 14 bp, Homo sapiens
tggggttcagcccc

SEQ ID NO: 1241119 - DNA, 19 bp, Homo sapiens
tggggttcagcccctcctc

SEQ ID NO: 1241120 - DNA, 14 bp, Homo sapiens
tggggttcctgctg

SEQ ID NO: 1241121 - DNA, 20 bp, Homo sapiens
tggggttcgtggaaagggtg

SEQ ID NO: 1241122 - DNA, 12 bp, Homo sapiens
tggggttgtttt

SEQ ID NO: 1241123 - DNA, 16 bp, Homo sapiens
tggggtttcaccatat

SEQ ID NO: 1241124 - DNA, 12 bp, Homo sapiens
tggggtttgtac

SEQ ID NO: 1241125 - DNA, 21 bp, Homo sapiens
tggggttttttttttctgaat

SEQ ID NO: 1241126 - DNA, 15 bp, Homo sapiens
tgggtaaagggacag

SEQ ID NO: 1241127 - DNA, 22 bp, Homo sapiens
tgggtacatcaagtccatctga

SEQ ID NO: 1241128 - DNA, 21 bp, Homo sapiens
tgggtagaaaaattattagaa

SEQ ID NO: 1241129 - DNA, 21 bp, Homo sapiens
tgggtagaaagagatacagag

SEQ ID NO: 1241130 - DNA, 13 bp, Homo sapiens
tgggtagctgtaa

SEQ ID NO: 1241131 - DNA, 13 bp, Homo sapiens
tgggtagggcaga

SEQ ID NO: 1241132 - DNA, 18 bp, Homo sapiens
tgggtataagcagagagg

SEQ ID NO: 1241133 - DNA, 14 bp, Homo sapiens
tgggtatcccctgc

SEQ ID NO: 1241134 - DNA, 20 bp, Homo sapiens
tgggtatcccctgcctcctg

SEQ ID NO: 1241135 - DNA, 20 bp, Homo sapiens
tgggtatcctgcccagtgtt

SEQ ID NO: 1241136 - DNA, 16 bp, Homo sapiens
tgggtatgctctgtga

SEQ ID NO: 1241137 - DNA, 19 bp, Homo sapiens
tgggtcaccagacggggct

SEQ ID NO: 1241138 - DNA, 20 bp, Homo sapiens
tgggtcaccagacggggctg

SEQ ID NO: 1241139 - DNA, 21 bp, Homo sapiens
tgggtcaccagacggggctgg

SEQ ID NO: 1241140 - DNA, 15 bp, Homo sapiens
tgggtcactcattaa

SEQ ID NO: 1241141 - DNA, 19 bp, Homo sapiens
tgggtcagaacatgttaag

SEQ ID NO: 1241142 - DNA, 16 bp, Homo sapiens
tgggtcagaaccagag

SEQ ID NO: 1241143 - DNA, 13 bp, Homo sapiens
tgggtcaggcagg

SEQ ID NO: 1241144 - DNA, 17 bp, Homo sapiens
tgggtcaggttcttgcc

SEQ ID NO: 1241145 - DNA, 19 bp, Homo sapiens
tgggtcaggttcttgcctt

SEQ ID NO: 1241146 - DNA, 18 bp, Homo sapiens
tgggtcatgcactgaggt

SEQ ID NO: 1241147 - DNA, 16 bp, Homo sapiens
tgggtccaagagacat

SEQ ID NO: 1241148 - DNA, 12 bp, Homo sapiens
tgggtccaggaa

SEQ ID NO: 1241149 - DNA, 20 bp, Homo sapiens
tgggtccaggaaggcagctg

SEQ ID NO: 1241150 - DNA, 18 bp, Homo sapiens
tgggtccaggcctggcca

SEQ ID NO: 1241151 - DNA, 13 bp, Homo sapiens
tgggtccagggcc

SEQ ID NO: 1241152 - DNA, 21 bp, Homo sapiens
tgggtccagggcctgacaccc

SEQ ID NO: 1241153 - DNA, 15 bp, Homo sapiens
tgggtcccagcctgg

SEQ ID NO: 1241154 - DNA, 17 bp, Homo sapiens
tgggtcccccacgtgac

SEQ ID NO: 1241155 - DNA, 22 bp, Homo sapiens
tgggtccccctcagcaagccct

SEQ ID NO: 1241156 - DNA, 12 bp, Homo sapiens
tgggtcccctcc

SEQ ID NO: 1241157 - DNA, 18 bp, Homo sapiens
tgggtcccgcactctgcc

SEQ ID NO: 1241158 - DNA, 15 bp, Homo sapiens
tgggtccctgctccc

SEQ ID NO: 1241159 - DNA, 18 bp, Homo sapiens
tgggtccctgctcccctt

SEQ ID NO: 1241160 - DNA, 14 bp, Homo sapiens
tgggtcctgaagaa

SEQ ID NO: 1241161 - DNA, 17 bp, Homo sapiens
tgggtccttgatgccag

SEQ ID NO: 1241162 - DNA, 22 bp, Homo sapiens
tgggtccttgatgccagagggc

SEQ ID NO: 1241163 - DNA, 18 bp, Homo sapiens
tgggtccttttcagaagt

SEQ ID NO: 1241164 - DNA, 15 bp, Homo sapiens
tgggtcggccctgcc

SEQ ID NO: 1241165 - DNA, 17 bp, Homo sapiens
tgggtcggccctgccca

SEQ ID NO: 1241166 - DNA, 23 bp, Homo sapiens
tgggtctaaggggttggttgagg

SEQ ID NO: 1241167 - DNA, 21 bp, Homo sapiens
tgggtctacctcatctctgaa

SEQ ID NO: 1241168 - DNA, 12 bp, Homo sapiens
tgggtctcactc

SEQ ID NO: 1241169 - DNA, 14 bp, Homo sapiens
tgggtctctggaag

SEQ ID NO: 1241170 - DNA, 22 bp, Homo sapiens
tgggtctctggggaccctccag

SEQ ID NO: 1241171 - DNA, 17 bp, Homo sapiens
tgggtctgattttctca

SEQ ID NO: 1241172 - DNA, 18 bp, Homo sapiens
tgggtctgattttctcac

SEQ ID NO: 1241173 - DNA, 17 bp, Homo sapiens
tgggtctggctgagctg

SEQ ID NO: 1241174 - DNA, 14 bp, Homo sapiens
tgggtctgtgcatt

SEQ ID NO: 1241175 - DNA, 19 bp, Homo sapiens
tgggtctgtgtctcttttc

SEQ ID NO: 1241176 - DNA, 15 bp, Homo sapiens
tgggtgaagggagag

SEQ ID NO: 1241177 - DNA, 21 bp, Homo sapiens
tgggtgaatatggtggaaaat

SEQ ID NO: 1241178 - DNA, 17 bp, Homo sapiens
tgggtgacagagcgaga

SEQ ID NO: 1241179 - DNA, 13 bp, Homo sapiens
tgggtgagagaga

SEQ ID NO: 1241180 - DNA, 15 bp, Homo sapiens
tgggtgagagaggaa

SEQ ID NO: 1241181 - DNA, 17 bp, Homo sapiens
tgggtgattatttttta

SEQ ID NO: 1241182 - DNA, 17 bp, Homo sapiens
tgggtgccattcccagc

SEQ ID NO: 1241183 - DNA, 13 bp, Homo sapiens
tgggtgccctgaa

SEQ ID NO: 1241184 - DNA, 14 bp, Homo sapiens
tgggtgcctcctgc

SEQ ID NO: 1241185 - DNA, 15 bp, Homo sapiens
tgggtgcgtctccag

SEQ ID NO: 1241186 - DNA, 19 bp, Homo sapiens
tgggtgcgtctccagtcat

SEQ ID NO: 1241187 - DNA, 13 bp, Homo sapiens
tgggtgctcagaa

SEQ ID NO: 1241188 - DNA, 15 bp, Homo sapiens
tgggtgctcagaata

SEQ ID NO: 1241189 - DNA, 22 bp, Homo sapiens
tgggtgctcagaataaggcagg

SEQ ID NO: 1241190 - DNA, 13 bp, Homo sapiens
tgggtgctgccct

SEQ ID NO: 1241191 - DNA, 14 bp, Homo sapiens
tgggtgctgccctg

SEQ ID NO: 1241192 - DNA, 17 bp, Homo sapiens
tgggtgctgccctgtgt

SEQ ID NO: 1241193 - DNA, 14 bp, Homo sapiens
tgggtgctggctgc

SEQ ID NO: 1241194 - DNA, 18 bp, Homo sapiens
tgggtgctggctgcccag

SEQ ID NO: 1241195 - DNA, 24 bp, Homo sapiens
tgggtggaggaccgttctctgtcc

SEQ ID NO: 1241196 - DNA, 14 bp, Homo sapiens
tgggtggcacctcc

SEQ ID NO: 1241197 - DNA, 21 bp, Homo sapiens
tgggtggcccctgctgtctct

SEQ ID NO: 1241198 - DNA, 17 bp, Homo sapiens
tgggtggctcactactg

SEQ ID NO: 1241199 - DNA, 22 bp, Homo sapiens
tgggtggctttcaaggctgggg

SEQ ID NO: 1241200 - DNA, 16 bp, Homo sapiens
tggtctttgctccaga

SEQ ID NO: 1241201 - DNA, 14 bp, Homo sapiens
tggtgaaataataa

SEQ ID NO: 1241202 - DNA, 16 bp, Homo sapiens
tggtgaaataataaaa

SEQ ID NO: 1241203 - DNA, 18 bp, Homo sapiens
tggtgaaatttattagtt

SEQ ID NO: 1241204 - DNA, 20 bp, Homo sapiens
tggtgaagtgtggctggtgt

SEQ ID NO: 1241205 - DNA, 16 bp, Homo sapiens
tggtgaatttcacaag

SEQ ID NO: 1241206 - DNA, 16 bp, Homo sapiens
tggtgacaaaattcat

SEQ ID NO: 1241207 - DNA, 15 bp, Homo sapiens
tggtgacagccttgg

SEQ ID NO: 1241208 - DNA, 19 bp, Homo sapiens
tggtgacaggacgctgacc

SEQ ID NO: 1241209 - DNA, 13 bp, Homo sapiens
tggtgaccagact

SEQ ID NO: 1241210 - DNA, 18 bp, Homo sapiens
tggtgacctcctgtcact

SEQ ID NO: 1241211 - DNA, 17 bp, Homo sapiens
tggtgactgggaaagtt

SEQ ID NO: 1241212 - DNA, 13 bp, Homo sapiens
tggtgactgtccc

SEQ ID NO: 1241213 - DNA, 17 bp, Homo sapiens
tggtgactttggggaca

SEQ ID NO: 1241214 - DNA, 18 bp, Homo sapiens
tggtgactttggggacag

SEQ ID NO: 1241215 - DNA, 16 bp, Homo sapiens
tggtgagagtcaaagc

SEQ ID NO: 1241216 - DNA, 17 bp, Homo sapiens
tggtgagagtcaaagct

SEQ ID NO: 1241217 - DNA, 20 bp, Homo sapiens
tggtgagcctagccctggga

SEQ ID NO: 1241218 - DNA, 17 bp, Homo sapiens
tggtgaggcccagcctg

SEQ ID NO: 1241219 - DNA, 21 bp, Homo sapiens
tggtgaggcccagcctgtcct

SEQ ID NO: 1241220 - DNA, 18 bp, Homo sapiens
tggtgaggggctttctct

SEQ ID NO: 1241221 - DNA, 19 bp, Homo sapiens
tggtgaggggctttctctt

SEQ ID NO: 1241222 - DNA, 23 bp, Homo sapiens
tggtgagggtgccccgcctgagt

SEQ ID NO: 1241223 - DNA, 18 bp, Homo sapiens
tggtgagtcttggcggca

SEQ ID NO: 1241224 - DNA, 22 bp, Homo sapiens
tggtgagtcttggcggcagcag

SEQ ID NO: 1241225 - DNA, 21 bp, Homo sapiens
tggtgagtcttggttctaaag

SEQ ID NO: 1241226 - DNA, 18 bp, Homo sapiens
tggtgatcaattaaatgt

SEQ ID NO: 1241227 - DNA, 17 bp, Homo sapiens
tggtgatcctctatttt

SEQ ID NO: 1241228 - DNA, 20 bp, Homo sapiens
tggtgatgtcataataaagt

SEQ ID NO: 1241229 - DNA, 14 bp, Homo sapiens
tggtgatgtgcctg

SEQ ID NO: 1241230 - DNA, 16 bp, Homo sapiens
tggtgatgtgcctgta

SEQ ID NO: 1241231 - DNA, 19 bp, Homo sapiens
tggtgcaagttgaggactt

SEQ ID NO: 1241232 - DNA, 23 bp, Homo sapiens
tggtgcaagttgaggacttcttg

SEQ ID NO: 1241233 - DNA, 16 bp, Homo sapiens
tggtgcaatcacagct

SEQ ID NO: 1241234 - DNA, 13 bp, Homo sapiens
tggtgcagacaga

SEQ ID NO: 1241235 - DNA, 15 bp, Homo sapiens
tggtgcagacagaag

SEQ ID NO: 1241236 - DNA, 20 bp, Homo sapiens
tggtgcagaggtttcttgaa

SEQ ID NO: 1241237 - DNA, 17 bp, Homo sapiens
tggtgcatagcagatgg

SEQ ID NO: 1241238 - DNA, 14 bp, Homo sapiens
tggtgcatgggctc

SEQ ID NO: 1241239 - DNA, 10 bp, Homo sapiens
tggtgcatta

SEQ ID NO: 1241240 - DNA, 13 bp, Homo sapiens
tggtgcattacag

SEQ ID NO: 1241241 - DNA, 16 bp, Homo sapiens
tggtgcattacagaga

SEQ ID NO: 1241242 - DNA, 16 bp, Homo sapiens
tggtgcattctgtttc

SEQ ID NO: 1241243 - DNA, 22 bp, Homo sapiens
tggtgcattctgtttcctcttg

SEQ ID NO: 1241244 - DNA, 18 bp, Homo sapiens
tggtgccaaatagcccca

SEQ ID NO: 1241245 - DNA, 19 bp, Homo sapiens
tggtgccaaatagccccag

SEQ ID NO: 1241246 - DNA, 15 bp, Homo sapiens
tggtgccaatttcaa

SEQ ID NO: 1241247 - DNA, 21 bp, Homo sapiens
tggtgccagccttcctctgca

SEQ ID NO: 1241248 - DNA, 17 bp, Homo sapiens
tggtgcccatgaagagg

SEQ ID NO: 1241249 - DNA, 13 bp, Homo sapiens
tggtgccccacag

SEQ ID NO: 1241250 - DNA, 16 bp, Homo sapiens
tggtgccccccacccc

SEQ ID NO: 1241251 - DNA, 13 bp, Homo sapiens
tggtgcctctgtg

SEQ ID NO: 1241252 - DNA, 13 bp, Homo sapiens
tggtgcctgagag

SEQ ID NO: 1241253 - DNA, 14 bp, Homo sapiens
tggtgcctgagagg

SEQ ID NO: 1241254 - DNA, 18 bp, Homo sapiens
tggtgcctgagaggcagg

SEQ ID NO: 1241255 - DNA, 19 bp, Homo sapiens
tggtgcctgagaggcaggc

SEQ ID NO: 1241256 - DNA, 19 bp, Homo sapiens
tggtgcgggcacaataaat

SEQ ID NO: 1241257 - DNA, 18 bp, Homo sapiens
tggtgctataggctggag

SEQ ID NO: 1241258 - DNA, 14 bp, Homo sapiens
tggtgctatttgaa

SEQ ID NO: 1241259 - DNA, 14 bp, Homo sapiens
tggtgctcctgccc

SEQ ID NO: 1241260 - DNA, 20 bp, Homo sapiens
tggtgctcctgcccagccac

SEQ ID NO: 1241261 - DNA, 13 bp, Homo sapiens
tggtgctgccaca

SEQ ID NO: 1241262 - DNA, 18 bp, Homo sapiens
tggtgctgccacacttca

SEQ ID NO: 1241263 - DNA, 19 bp, Homo sapiens
tggtgctgctgctgctgtg

SEQ ID NO: 1241264 - DNA, 14 bp, Homo sapiens
tggtgctgggactg

SEQ ID NO: 1241265 - DNA, 19 bp, Homo sapiens
tggtgctgggactgagcca

SEQ ID NO: 1241266 - DNA, 21 bp, Homo sapiens
tggtgctgggactgagccagt

SEQ ID NO: 1241267 - DNA, 23 bp, Homo sapiens
tggtgctgtcttttgttctctga

SEQ ID NO: 1241268 - DNA, 22 bp, Homo sapiens
tggtgcttacacatctcagacc

SEQ ID NO: 1241269 - DNA, 11 bp, Homo sapiens
tggtgcttcag

SEQ ID NO: 1241270 - DNA, 16 bp, Homo sapiens
tggtgcttcagccctg

SEQ ID NO: 1241271 - DNA, 22 bp, Homo sapiens
tggtgcttcagccctggcccct

SEQ ID NO: 1241272 - DNA, 14 bp, Homo sapiens
tggtgcttccccca

SEQ ID NO: 1241273 - DNA, 18 bp, Homo sapiens
tggtggacagtcctggga

SEQ ID NO: 1241274 - DNA, 13 bp, Homo sapiens
tggtggaggagct

SEQ ID NO: 1241275 - DNA, 14 bp, Homo sapiens
tggtggaggagctg

SEQ ID NO: 1241276 - DNA, 17 bp, Homo sapiens
tggtggagggcacttca

SEQ ID NO: 1241277 - DNA, 18 bp, Homo sapiens
tggtggagggcacttcag

SEQ ID NO: 1241278 - DNA, 12 bp, Homo sapiens
tggtggaggggc

SEQ ID NO: 1241279 - DNA, 22 bp, Homo sapiens
tggtggaggggcgcccagggtc

SEQ ID NO: 1241280 - DNA, 19 bp, Homo sapiens
tggtggatctaagaagggc

SEQ ID NO: 1241281 - DNA, 19 bp, Homo sapiens
tggtggcaacattcattgc

SEQ ID NO: 1241282 - DNA, 16 bp, Homo sapiens
tggtggcaccagatgc

SEQ ID NO: 1241283 - DNA, 10 bp, Homo sapiens
tggtggcatg

SEQ ID NO: 1241284 - DNA, 19 bp, Homo sapiens
tggtggcccgacagcctgg

SEQ ID NO: 1241285 - DNA, 16 bp, Homo sapiens
tggtggccctgtgcct

SEQ ID NO: 1241286 - DNA, 19 bp, Homo sapiens
tggtggccctgtgcctggg

SEQ ID NO: 1241287 - DNA, 15 bp, Homo sapiens
tggtggcctggtccc

SEQ ID NO: 1241288 - DNA, 16 bp, Homo sapiens
tggtggcctggtccct

SEQ ID NO: 1241289 - DNA, 19 bp, Homo sapiens
tggtggctcatgcctgtga

SEQ ID NO: 1241290 - DNA, 14 bp, Homo sapiens
tggtggctcatggc

SEQ ID NO: 1241291 - DNA, 14 bp, Homo sapiens
tggtggctgtgtct

SEQ ID NO: 1241292 - DNA, 22 bp, Homo sapiens
tggtgggcccagaccactgtct

SEQ ID NO: 1241293 - DNA, 14 bp, Homo sapiens
tggtgggctggccc

SEQ ID NO: 1241294 - DNA, 15 bp, Homo sapiens
tggtgggctggccca

SEQ ID NO: 1241295 - DNA, 21 bp, Homo sapiens
tggtggggaggggcgctggcc

SEQ ID NO: 1241296 - DNA, 16 bp, Homo sapiens
tggtgggggcctcggt

SEQ ID NO: 1241297 - DNA, 18 bp, Homo sapiens
tggtgggggcctcggtgt

SEQ ID NO: 1241298 - DNA, 17 bp, Homo sapiens
tggtgggggtagagctg

SEQ ID NO: 1241299 - DNA, 18 bp, Homo sapiens
tggtgggggtagagctga

SEQ ID NO: 1241300 - DNA, 13 bp, Homo sapiens
tggtggggtggca

SEQ ID NO: 1241301 - DNA, 23 bp, Homo sapiens
tggtggggtgtgttccaactgcc

SEQ ID NO: 1241302 - DNA, 16 bp, Homo sapiens
tggtgggtgtggccag

SEQ ID NO: 1241303 - DNA, 19 bp, Homo sapiens
tggtgggttcaggggactc

SEQ ID NO: 1241304 - DNA, 14 bp, Homo sapiens
tggtggtagagaag

SEQ ID NO: 1241305 - DNA, 17 bp, Homo sapiens
tggtggtattctgtcat

SEQ ID NO: 1241306 - DNA, 14 bp, Homo sapiens
tggtggtattttat

SEQ ID NO: 1241307 - DNA, 16 bp, Homo sapiens
tggtggtattttattt

SEQ ID NO: 1241308 - DNA, 15 bp, Homo sapiens
tggtggtcagcccta

SEQ ID NO: 1241309 - DNA, 12 bp, Homo sapiens
tggtggtgggga

SEQ ID NO: 1241310 - DNA, 15 bp, Homo sapiens
tggtggttattttaa

SEQ ID NO: 1241311 - DNA, 19 bp, Homo sapiens
tggtggttttcagagcagg

SEQ ID NO: 1241312 - DNA, 16 bp, Homo sapiens
tggtggtttttgctct

SEQ ID NO: 1241313 - DNA, 17 bp, Homo sapiens
tggtgtaatttgaagat

SEQ ID NO: 1241314 - DNA, 15 bp, Homo sapiens
tggtgtagaacacta

SEQ ID NO: 1241315 - DNA, 18 bp, Homo sapiens
tggtgtagccctcccact

SEQ ID NO: 1241316 - DNA, 16 bp, Homo sapiens
tggtgtatatcatgaa

SEQ ID NO: 1241317 - DNA, 18 bp, Homo sapiens
tggtgtcagaccctggag

SEQ ID NO: 1241318 - DNA, 19 bp, Homo sapiens
tggtgtcagaccctggagg

SEQ ID NO: 1241319 - DNA, 13 bp, Homo sapiens
tggtgtcaggcag

SEQ ID NO: 1241320 - DNA, 14 bp, Homo sapiens
tggtgtccacctgg

SEQ ID NO: 1241321 - DNA, 13 bp, Homo sapiens
tggtgtccagctg

SEQ ID NO: 1241322 - DNA, 21 bp, Homo sapiens
tggtgtcccctatcctcccct

SEQ ID NO: 1241323 - DNA, 13 bp, Homo sapiens
tggtgtccccttc

SEQ ID NO: 1241324 - DNA, 23 bp, Homo sapiens
tggtgtccccttcccctgctgac

SEQ ID NO: 1241325 - DNA, 17 bp, Homo sapiens
tggtgtcctgaccaccc

SEQ ID NO: 1241326 - DNA, 21 bp, Homo sapiens
tggtttctacttcccctggga

SEQ ID NO: 1241327 - DNA, 23 bp, Homo sapiens
tggtttctacttcccctgggatg

SEQ ID NO: 1241328 - DNA, 15 bp, Homo sapiens
tggtttctgcttctc

SEQ ID NO: 1241329 - DNA, 13 bp, Homo sapiens
tggtttctgtccc

SEQ ID NO: 1241330 - DNA, 19 bp, Homo sapiens
tggtttgaaagattatgat

SEQ ID NO: 1241331 - DNA, 13 bp, Homo sapiens
tggtttgactcag

SEQ ID NO: 1241332 - DNA, 17 bp, Homo sapiens
tggtttgccatgtcgct

SEQ ID NO: 1241333 - DNA, 22 bp, Homo sapiens
tggtttgccatgtcgcttttgg

SEQ ID NO: 1241334 - DNA, 12 bp, Homo sapiens
tggtttgctagt

SEQ ID NO: 1241335 - DNA, 11 bp, Homo sapiens
tggtttggaat

SEQ ID NO: 1241336 - DNA, 17 bp, Homo sapiens
tggtttggaatattaaa

SEQ ID NO: 1241337 - DNA, 20 bp, Homo sapiens
tggtttggcatggtgagtgt

SEQ ID NO: 1241338 - DNA, 16 bp, Homo sapiens
tggtttgggaaagatg

SEQ ID NO: 1241339 - DNA, 20 bp, Homo sapiens
tggtttgggaatatccatgt

SEQ ID NO: 1241340 - DNA, 21 bp, Homo sapiens
tggtttgtaaattaactttta

SEQ ID NO: 1241341 - DNA, 11 bp, Homo sapiens
tggtttgtgtg

SEQ ID NO: 1241342 - DNA, 16 bp, Homo sapiens
tggtttgtttgcttaa

SEQ ID NO: 1241343 - DNA, 15 bp, Homo sapiens
tggttttaaaagcac

SEQ ID NO: 1241344 - DNA, 20 bp, Homo sapiens
tggttttaaacctttaatga

SEQ ID NO: 1241345 - DNA, 23 bp, Homo sapiens
tggttttaaacctttaatgagaa

SEQ ID NO: 1241346 - DNA, 16 bp, Homo sapiens
tggttttatactgaag

SEQ ID NO: 1241347 - DNA, 13 bp, Homo sapiens
tggttttatttgt

SEQ ID NO: 1241348 - DNA, 15 bp, Homo sapiens
tggttttcaaaataa

SEQ ID NO: 1241349 - DNA, 20 bp, Homo sapiens
tggttttcagagcaggaggc

SEQ ID NO: 1241350 - DNA, 20 bp, Homo sapiens
tggttttcccctccctgggt

SEQ ID NO: 1241351 - DNA, 16 bp, Homo sapiens
tggttttcctaaatgc

SEQ ID NO: 1241352 - DNA, 14 bp, Homo sapiens
tggttttcctgaaa

SEQ ID NO: 1241353 - DNA, 19 bp, Homo sapiens
tggttttctccaagagcta

SEQ ID NO: 1241354 - DNA, 20 bp, Homo sapiens
tggttttctccaagagctac

SEQ ID NO: 1241355 - DNA, 15 bp, Homo sapiens
tggttttctctctgg

SEQ ID NO: 1241356 - DNA, 12 bp, Homo sapiens
tggttttctgtt

SEQ ID NO: 1241357 - DNA, 15 bp, Homo sapiens
tggttttctgttctt

SEQ ID NO: 1241358 - DNA, 15 bp, Homo sapiens
tggtttttaaatttt

SEQ ID NO: 1241359 - DNA, 14 bp, Homo sapiens
tggtttttcagctc

SEQ ID NO: 1241360 - DNA, 19 bp, Homo sapiens
tggtttttggctctttcag

SEQ ID NO: 1241361 - DNA, 10 bp, Homo sapiens
tggttttttt

SEQ ID NO: 1241362 - DNA, 22 bp, Homo sapiens
tggttttttttttttttttggc

SEQ ID NO: 1241363 - DNA, 16 bp, Homo sapiens
tgtaaaaaatggaaaa

SEQ ID NO: 1241364 - DNA, 22 bp, Homo sapiens
tgtaaaaaatgtctcatgtcaa

SEQ ID NO: 1241365 - DNA, 16 bp, Homo sapiens
tgtaaaaacactgaaa

SEQ ID NO: 1241366 - DNA, 22 bp, Homo sapiens
tgtaaaaacagcattgctttct

SEQ ID NO: 1241367 - DNA, 24 bp, Homo sapiens
tgtaaaaacagcattgctttctga

SEQ ID NO: 1241368 - DNA, 16 bp, Homo sapiens
tgtaaaaactgaagaa

SEQ ID NO: 1241369 - DNA, 11 bp, Homo sapiens
tgtaaaaatga

SEQ ID NO: 1241370 - DNA, 13 bp, Homo sapiens
tgtaaaaatgtta

SEQ ID NO: 1241371 - DNA, 23 bp, Homo sapiens
tgtaaaacaaaaatgtaatgatc

SEQ ID NO: 1241372 - DNA, 14 bp, Homo sapiens
tgtaaaacaaaatt

SEQ ID NO: 1241373 - DNA, 12 bp, Homo sapiens
tgtaaaacaggt

SEQ ID NO: 1241374 - DNA, 13 bp, Homo sapiens
tgtaaaacaggta

SEQ ID NO: 1241375 - DNA, 14 bp, Homo sapiens
tgtaaaacaggtag

SEQ ID NO: 1241376 - DNA, 22 bp, Homo sapiens
tgtaaaacaggtagaattatct

SEQ ID NO: 1241377 - DNA, 19 bp, Homo sapiens
tgtaaaacatttattttga

SEQ ID NO: 1241378 - DNA, 13 bp, Homo sapiens
tgtaaaagaaatc

SEQ ID NO: 1241379 - DNA, 14 bp, Homo sapiens
tgtaaaataaaatt

SEQ ID NO: 1241380 - DNA, 16 bp, Homo sapiens
tgtaaaataattctga

SEQ ID NO: 1241381 - DNA, 16 bp, Homo sapiens
tgtaaaatagaaaaag

SEQ ID NO: 1241382 - DNA, 12 bp, Homo sapiens
tgtaaaatagct

SEQ ID NO: 1241383 - DNA, 17 bp, Homo sapiens
tgtaaaatagcttgtat

SEQ ID NO: 1241384 - DNA, 11 bp, Homo sapiens
tgtaaaatata

SEQ ID NO: 1241385 - DNA, 21 bp, Homo sapiens
tgtaaaatatagctgtacaaa

SEQ ID NO: 1241386 - DNA, 21 bp, Homo sapiens
tgtaaaatccacagctatatc

SEQ ID NO: 1241387 - DNA, 14 bp, Homo sapiens
tgtaaaatgagttt

SEQ ID NO: 1241388 - DNA, 16 bp, Homo sapiens
tgtaaaatgatactgt

SEQ ID NO: 1241389 - DNA, 17 bp, Homo sapiens
tgtaaaatgatactgta

SEQ ID NO: 1241390 - DNA, 22 bp, Homo sapiens
tgtaaaatgcttttcactttct

SEQ ID NO: 1241391 - DNA, 19 bp, Homo sapiens
tgtaaaatgtattatgtcc

SEQ ID NO: 1241392 - DNA, 17 bp, Homo sapiens
tgtaaaatgttgaataa

SEQ ID NO: 1241393 - DNA, 18 bp, Homo sapiens
tgtaaaatttatttatat

SEQ ID NO: 1241394 - DNA, 22 bp, Homo sapiens
tgtaaaatttatttatattccg

SEQ ID NO: 1241395 - DNA, 15 bp, Homo sapiens
tgtaaacaaactctt

SEQ ID NO: 1241396 - DNA, 17 bp, Homo sapiens
tgtaaacaacgtgtata

SEQ ID NO: 1241397 - DNA, 19 bp, Homo sapiens
tgtaaacaatgtaaagtaa

SEQ ID NO: 1241398 - DNA, 16 bp, Homo sapiens
tgtaaacagaataaaa

SEQ ID NO: 1241399 - DNA, 19 bp, Homo sapiens
tgtaaacagaataaaagtt

SEQ ID NO: 1241400 - DNA, 12 bp, Homo sapiens
tgtaaacagtgc

SEQ ID NO: 1241401 - DNA, 14 bp, Homo sapiens
tgtaaacagtgcct

SEQ ID NO: 1241402 - DNA, 14 bp, Homo sapiens
tgtaaacatgtgtt

SEQ ID NO: 1241403 - DNA, 12 bp, Homo sapiens
tgtaaaccaaag

SEQ ID NO: 1241404 - DNA, 13 bp, Homo sapiens
tgtaaaccaaagc

SEQ ID NO: 1241405 - DNA, 14 bp, Homo sapiens
tgtaaaccaaagcc

SEQ ID NO: 1241406 - DNA, 15 bp, Homo sapiens
tgtaaaccattgtaa

SEQ ID NO: 1241407 - DNA, 21 bp, Homo sapiens
tgtaaaccattgtaactatta

SEQ ID NO: 1241408 - DNA, 19 bp, Homo sapiens
tgtaaacgacaagaataat

SEQ ID NO: 1241409 - DNA, 21 bp, Homo sapiens
tgtaaacggtgctatttctat

SEQ ID NO: 1241410 - DNA, 12 bp, Homo sapiens
tgtaaactgcca

SEQ ID NO: 1241411 - DNA, 13 bp, Homo sapiens
tgtaaactgccat

SEQ ID NO: 1241412 - DNA, 15 bp, Homo sapiens
tgtaaactgtgcacc

SEQ ID NO: 1241413 - DNA, 13 bp, Homo sapiens
tgtaaactgtgta

SEQ ID NO: 1241414 - DNA, 22 bp, Homo sapiens
tgtaaactgtgtattccaagac

SEQ ID NO: 1241415 - DNA, 17 bp, Homo sapiens
tgtaaacttggaatcaa

SEQ ID NO: 1241416 - DNA, 18 bp, Homo sapiens
tgtaaactttatcactta

SEQ ID NO: 1241417 - DNA, 18 bp, Homo sapiens
tgtaaactttgtcatggt

SEQ ID NO: 1241418 - DNA, 22 bp, Homo sapiens
tgtaaagaagggatattaagaa

SEQ ID NO: 1241419 - DNA, 12 bp, Homo sapiens
tgtaaagaattg

SEQ ID NO: 1241420 - DNA, 22 bp, Homo sapiens
tgtaaagagaatcaactaggta

SEQ ID NO: 1241421 - DNA, 18 bp, Homo sapiens
tgtaaagatatttttatc

SEQ ID NO: 1241422 - DNA, 11 bp, Homo sapiens
tgtaaagatgt

SEQ ID NO: 1241423 - DNA, 14 bp, Homo sapiens
tgtaaagatttata

SEQ ID NO: 1241424 - DNA, 17 bp, Homo sapiens
tgtaaagctaaaataaa

SEQ ID NO: 1241425 - DNA, 15 bp, Homo sapiens
tgtaaagtatgtttt

SEQ ID NO: 1241426 - DNA, 19 bp, Homo sapiens
tgtaaagttggttggataa

SEQ ID NO: 1241427 - DNA, 17 bp, Homo sapiens
tgtaaataaaatgtgta

SEQ ID NO: 1241428 - DNA, 14 bp, Homo sapiens
tgtaaataaagccc

SEQ ID NO: 1241429 - DNA, 18 bp, Homo sapiens
tgtaaataaagccctggg

SEQ ID NO: 1241430 - DNA, 15 bp, Homo sapiens
tgtaaataatttatt

SEQ ID NO: 1241431 - DNA, 16 bp, Homo sapiens
tgtaaataatttatta

SEQ ID NO: 1241432 - DNA, 23 bp, Homo sapiens
tgtaaataattttctaagacagt

SEQ ID NO: 1241433 - DNA, 16 bp, Homo sapiens
tgtaaatacaggaaga

SEQ ID NO: 1241434 - DNA, 21 bp, Homo sapiens
tgtaaatactcatgaatgaaa

SEQ ID NO: 1241435 - DNA, 12 bp, Homo sapiens
tgtaaataggtt

SEQ ID NO: 1241436 - DNA, 12 bp, Homo sapiens
tgtaaatatata

SEQ ID NO: 1241437 - DNA, 18 bp, Homo sapiens
tgtaaatatataaatata

SEQ ID NO: 1241438 - DNA, 12 bp, Homo sapiens
tgtaatataaat

SEQ ID NO: 1241439 - DNA, 22 bp, Homo sapiens
tgtaatataaatttaagcaaac

SEQ ID NO: 1241440 - DNA, 23 bp, Homo sapiens
tgtaatatagaaaaaaacattct

SEQ ID NO: 1241441 - DNA, 16 bp, Homo sapiens
tgtaatatattgtaca

SEQ ID NO: 1241442 - DNA, 13 bp, Homo sapiens
tgtaatatgaaat

SEQ ID NO: 1241443 - DNA, 17 bp, Homo sapiens
tgtaatatggaaatctt

SEQ ID NO: 1241444 - DNA, 16 bp, Homo sapiens
tgtaatattctgtttt

SEQ ID NO: 1241445 - DNA, 21 bp, Homo sapiens
tgtaatattgtaaatactgga

SEQ ID NO: 1241446 - DNA, 14 bp, Homo sapiens
tgtaatatttacaa

SEQ ID NO: 1241447 - DNA, 15 bp, Homo sapiens
tgtaatatttacaat

SEQ ID NO: 1241448 - DNA, 17 bp, Homo sapiens
tgtaatatttacaatgt

SEQ ID NO: 1241449 - DNA, 19 bp, Homo sapiens
tgtaatatttacaatgtat

SEQ ID NO: 1241450 - DNA, 16 bp, Homo sapiens
tgtaatatttacataa

SEQ ID NO: 1241451 - DNA, 19 bp, Homo sapiens
tgtaatcaaacttctaggt

SEQ ID NO: 1241452 - DNA, 15 bp, Homo sapiens
tgtaatcaagccttt

SEQ ID NO: 1241453 - DNA, 19 bp, Homo sapiens
tgtaatcagctctcctggc

SEQ ID NO: 1241454 - DNA, 18 bp, Homo sapiens
tgtacttcttattgcaag

SEQ ID NO: 1241455 - DNA, 18 bp, Homo sapiens
tgtacttgatttgatgtg

SEQ ID NO: 1241456 - DNA, 22 bp, Homo sapiens
tgtacttggagtaattgcacat

SEQ ID NO: 1241457 - DNA, 16 bp, Homo sapiens
tgtacttgtcctcagc

SEQ ID NO: 1241458 - DNA, 18 bp, Homo sapiens
tgtacttgtcctcagctt

SEQ ID NO: 1241459 - DNA, 14 bp, Homo sapiens
tgtacttgtttgaa

SEQ ID NO: 1241460 - DNA, 18 bp, Homo sapiens
tgtacttgtttgaatatt

SEQ ID NO: 1241461 - DNA, 14 bp, Homo sapiens
tgtacttgtttgca

SEQ ID NO: 1241462 - DNA, 15 bp, Homo sapiens
tgtactttatatctt

SEQ ID NO: 1241463 - DNA, 19 bp, Homo sapiens
tgtactttatcatgaatgc

SEQ ID NO: 1241464 - DNA, 14 bp, Homo sapiens
tgtactttgccatt

SEQ ID NO: 1241465 - DNA, 18 bp, Homo sapiens
tgtactttgcttgctcat

SEQ ID NO: 1241466 - DNA, 16 bp, Homo sapiens
tgtacttttaaggcag

SEQ ID NO: 1241467 - DNA, 12 bp, Homo sapiens
tgtacttttcat

SEQ ID NO: 1241468 - DNA, 19 bp, Homo sapiens
tgtacttttctggttccaa

SEQ ID NO: 1241469 - DNA, 15 bp, Homo sapiens
tgtactttttagtaa

SEQ ID NO: 1241470 - DNA, 20 bp, Homo sapiens
tgtagaaaagaaaacattta

SEQ ID NO: 1241471 - DNA, 18 bp, Homo sapiens
tgtagaaaagggaactga

SEQ ID NO: 1241472 - DNA, 18 bp, Homo sapiens
tgtagaaactggaagctg

SEQ ID NO: 1241473 - DNA, 22 bp, Homo sapiens
tgtagaaaggaagccttgctca

SEQ ID NO: 1241474 - DNA, 23 bp, Homo sapiens
tgtagaaaggaagccttgctcat

SEQ ID NO: 1241475 - DNA, 21 bp, Homo sapiens
tgtagaaatgatgatgtggaa

SEQ ID NO: 1241476 - DNA, 12 bp, Homo sapiens
tgtagaaatgta

SEQ ID NO: 1241477 - DNA, 14 bp, Homo sapiens
tgtagaacactaat

SEQ ID NO: 1241478 - DNA, 23 bp, Homo sapiens
tgttactaccttattttccccga

SEQ ID NO: 1241479 - DNA, 18 bp, Homo sapiens
tgttactattttctacaa

SEQ ID NO: 1241480 - DNA, 15 bp, Homo sapiens
tgttactctggttct

SEQ ID NO: 1241481 - DNA, 20 bp, Homo sapiens
tgttactctggttctttgtt

SEQ ID NO: 1241482 - DNA, 19 bp, Homo sapiens
tgttactcttaattttaaa

SEQ ID NO: 1241483 - DNA, 16 bp, Homo sapiens
tgttactgagatgttt

SEQ ID NO: 1241484 - DNA, 14 bp, Homo sapiens
tgttactgatcatg

SEQ ID NO: 1241485 - DNA, 12 bp, Homo sapiens
tgttactgcctt

SEQ ID NO: 1241486 - DNA, 21 bp, Homo sapiens
tgttactgctgattcttgtaa

SEQ ID NO: 1241487 - DNA, 14 bp, Homo sapiens
tgttactgcttcat

SEQ ID NO: 1241488 - DNA, 13 bp, Homo sapiens
tgttactgcttct

SEQ ID NO: 1241489 - DNA, 15 bp, Homo sapiens
tgttactgcttctct

SEQ ID NO: 1241490 - DNA, 19 bp, Homo sapiens
tgttactgcttctctttgt

SEQ ID NO: 1241491 - DNA, 13 bp, Homo sapiens
tgttactgctttg

SEQ ID NO: 1241492 - DNA, 17 bp, Homo sapiens
tgttactgctttgcaaa

SEQ ID NO: 1241493 - DNA, 14 bp, Homo sapiens
tgttactgtaattc

SEQ ID NO: 1241494 - DNA, 16 bp, Homo sapiens
tgttactgtcttcagt

SEQ ID NO: 1241495 - DNA, 12 bp, Homo sapiens
tgttactttctt

SEQ ID NO: 1241496 - DNA, 21 bp, Homo sapiens
tgttactttctttcagatgtt

SEQ ID NO: 1241497 - DNA, 17 bp, Homo sapiens
tgttagatgtttgttga

SEQ ID NO: 1241498 - DNA, 17 bp, Homo sapiens
tgttagattaagaaata

SEQ ID NO: 1241499 - DNA, 12 bp, Homo sapiens
tgttagcaaaga

SEQ ID NO: 1241500 - DNA, 13 bp, Homo sapiens
tgttagcaaagat

SEQ ID NO: 1241501 - DNA, 20 bp, Homo sapiens
tgttagcactgttgatgtat

SEQ ID NO: 1241502 - DNA, 18 bp, Homo sapiens
tgttagcagagtctgtct

SEQ ID NO: 1241503 - DNA, 21 bp, Homo sapiens
tgttagcagagtctgtctctt

SEQ ID NO: 1241504 - DNA, 15 bp, Homo sapiens
tgttagccaggtgga

SEQ ID NO: 1241505 - DNA, 19 bp, Homo sapiens
tgttagcctcaatttctga

SEQ ID NO: 1241506 - DNA, 20 bp, Homo sapiens
tgttagcctgcaaacaacat

SEQ ID NO: 1241507 - DNA, 12 bp, Homo sapiens
tgttagccttag

SEQ ID NO: 1241508 - DNA, 22 bp, Homo sapiens
tgttagctccctgtggggcagg

SEQ ID NO: 1241509 - DNA, 16 bp, Homo sapiens
tgttaggaaaaaattg

SEQ ID NO: 1241510 - DNA, 19 bp, Homo sapiens
tgttaggaggctgcatgct

SEQ ID NO: 1241511 - DNA, 23 bp, Homo sapiens
tgttaggaggctgcatgctctgg

SEQ ID NO: 1241512 - DNA, 12 bp, Homo sapiens
tgttagggtcag

SEQ ID NO: 1241513 - DNA, 17 bp, Homo sapiens
tgttagggtcagccatt

SEQ ID NO: 1241514 - DNA, 18 bp, Homo sapiens
tgttaggtccattttcta

SEQ ID NO: 1241515 - DNA, 14 bp, Homo sapiens
tgttagtaaaggaa

SEQ ID NO: 1241516 - DNA, 23 bp, Homo sapiens
tgttagtaaataaaattaacaaa

SEQ ID NO: 1241517 - DNA, 15 bp, Homo sapiens
tgttagtactttgga

SEQ ID NO: 1241518 - DNA, 16 bp, Homo sapiens
tgttagtgctggtcag

SEQ ID NO: 1241519 - DNA, 15 bp, Homo sapiens
tgttagtgtgtgtgc

SEQ ID NO: 1241520 - DNA, 20 bp, Homo sapiens
tgttagtgtgtgtgcatgtg

SEQ ID NO: 1241521 - DNA, 12 bp, Homo sapiens
tgttagttccca

SEQ ID NO: 1241522 - DNA, 15 bp, Homo sapiens
tgttagttcccaaca

SEQ ID NO: 1241523 - DNA, 12 bp, Homo sapiens
tgttagttttgt

SEQ ID NO: 1241524 - DNA, 22 bp, Homo sapiens
tgttagttttgtaaaaactgaa

SEQ ID NO: 1241525 - DNA, 17 bp, Homo sapiens
tgttataaagacacatg

SEQ ID NO: 1241526 - DNA, 15 bp, Homo sapiens
tgttataaataaaat

SEQ ID NO: 1241527 - DNA, 22 bp, Homo sapiens
tgttatacaaccttcatttaaa

SEQ ID NO: 1241528 - DNA, 15 bp, Homo sapiens
tgttatacaaggcaa

SEQ ID NO: 1241529 - DNA, 16 bp, Homo sapiens
tgttatacaatacaga

SEQ ID NO: 1241530 - DNA, 15 bp, Homo sapiens
tgttatagaatactt

SEQ ID NO: 1241531 - DNA, 15 bp, Homo sapiens
tgttatatcatatgt

SEQ ID NO: 1241532 - DNA, 19 bp, Homo sapiens
tgttatattccaaggaaaa

SEQ ID NO: 1241533 - DNA, 20 bp, Homo sapiens
tgttatattccaaggaaaat

SEQ ID NO: 1241534 - DNA, 22 bp, Homo sapiens
tgttatattccaaggaaaattg

SEQ ID NO: 1241535 - DNA, 18 bp, Homo sapiens
tgttatatttaatgcatt

SEQ ID NO: 1241536 - DNA, 20 bp, Homo sapiens
tgttatatttaatgcattaa

SEQ ID NO: 1241537 - DNA, 20 bp, Homo sapiens
tgttatcaaaactttctttt

SEQ ID NO: 1241538 - DNA, 19 bp, Homo sapiens
tgttatcagctgggcagtg

SEQ ID NO: 1241539 - DNA, 21 bp, Homo sapiens
tgttatcccaagaccctgccc

SEQ ID NO: 1241540 - DNA, 16 bp, Homo sapiens
tgttatctaatacaaa

SEQ ID NO: 1241541 - DNA, 21 bp, Homo sapiens
tgttatcttatactgtacaat

SEQ ID NO: 1241542 - DNA, 15 bp, Homo sapiens
tgttatgaaaatcct

SEQ ID NO: 1241543 - DNA, 16 bp, Homo sapiens
tgttatgaacagctgt

SEQ ID NO: 1241544 - DNA, 20 bp, Homo sapiens
tgttatgaacagctgtgtct

SEQ ID NO: 1241545 - DNA, 15 bp, Homo sapiens
tgttatgaacatgca

SEQ ID NO: 1241546 - DNA, 14 bp, Homo sapiens
tgttatgaatctgt

SEQ ID NO: 1241547 - DNA, 18 bp, Homo sapiens
tgttatgatttccttcaa

SEQ ID NO: 1241548 - DNA, 15 bp, Homo sapiens
tgttatgcactgtgg

SEQ ID NO: 1241549 - DNA, 20 bp, Homo sapiens
tgttatgcactgtggtttca

SEQ ID NO: 1241550 - DNA, 16 bp, Homo sapiens
tgttatggtagaaaaa

SEQ ID NO: 1241551 - DNA, 16 bp, Homo sapiens
tgttatgtacaaacta

SEQ ID NO: 1241552 - DNA, 20 bp, Homo sapiens
tgttatgtactagtgttctg

SEQ ID NO: 1241553 - DNA, 12 bp, Homo sapiens
tgttatgtattt

SEQ ID NO: 1241554 - DNA, 14 bp, Homo sapiens
tgttatgtatttcc

SEQ ID NO: 1241555 - DNA, 14 bp, Homo sapiens
tgttattaaacaaa

SEQ ID NO: 1241556 - DNA, 22 bp, Homo sapiens
tgttattaaacgtatgcatgtg

SEQ ID NO: 1241557 - DNA, 23 bp, Homo sapiens
tgttattaaacgtatgcatgtga

SEQ ID NO: 1241558 - DNA, 14 bp, Homo sapiens
tgttattaaatgta

SEQ ID NO: 1241559 - DNA, 15 bp, Homo sapiens
tgttattaatgtttc

SEQ ID NO: 1241560 - DNA, 21 bp, Homo sapiens
tgttattaatgtttcttctcc

SEQ ID NO: 1241561 - DNA, 16 bp, Homo sapiens
tgttattaccaaaaca

SEQ ID NO: 1241562 - DNA, 17 bp, Homo sapiens
tgttattactgttccca

SEQ ID NO: 1241563 - DNA, 23 bp, Homo sapiens
tgttattagagattacctcctga

SEQ ID NO: 1241564 - DNA, 16 bp, Homo sapiens
tgttattatctgggct

SEQ ID NO: 1241565 - DNA, 23 bp, Homo sapiens
tgttattatctgggcttatatct

SEQ ID NO: 1241566 - DNA, 14 bp, Homo sapiens
tgttattatgaagg

SEQ ID NO: 1241567 - DNA, 16 bp, Homo sapiens
tgttattattagataa

SEQ ID NO: 1241568 - DNA, 15 bp, Homo sapiens
tgttattgaagtgtt

SEQ ID NO: 1241569 - DNA, 20 bp, Homo sapiens
tgttattgcatgctgataat

SEQ ID NO: 1241570 - DNA, 22 bp, Homo sapiens
tgttattgggcaagtgattgaa

SEQ ID NO: 1241571 - DNA, 13 bp, Homo sapiens
tgttattgtggaa

SEQ ID NO: 1241572 - DNA, 13 bp, Homo sapiens
tgttattgttgaa

SEQ ID NO: 1241573 - DNA, 16 bp, Homo sapiens
tgttattgttgaacat

SEQ ID NO: 1241574 - DNA, 22 bp, Homo sapiens
tgttattgttttgttaattaca

SEQ ID NO: 1241575 - DNA, 15 bp, Homo sapiens
tgttatttattatta

SEQ ID NO: 1241576 - DNA, 14 bp, Homo sapiens
tgttattttcagta

SEQ ID NO: 1241577 - DNA, 14 bp, Homo sapiens
tgttattttgcaac

SEQ ID NO: 1241578 - DNA, 17 bp, Homo sapiens
tgttatttttcaaggaa

SEQ ID NO: 1241579 - DNA, 18 bp, Homo sapiens
tgttatttttcaaggaag

SEQ ID NO: 1241580 - DNA, 13 bp, Homo sapiens
tgttcaaaatact

SEQ ID NO: 1241581 - DNA, 20 bp, Homo sapiens
tgttcaaacccagtcttgtg

SEQ ID NO: 1241582 - DNA, 17 bp, Homo sapiens
tgttcaaactactgtac

SEQ ID NO: 1241583 - DNA, 20 bp, Homo sapiens
tgttcaaactactgtacatt

SEQ ID NO: 1241584 - DNA, 20 bp, Homo sapiens
tgttcaaagactgtgaacag

SEQ ID NO: 1241585 - DNA, 16 bp, Homo sapiens
tgttcaaatgcatttt

SEQ ID NO: 1241586 - DNA, 16 bp, Homo sapiens
tgttcaatactgtatg

SEQ ID NO: 1241587 - DNA, 22 bp, Homo sapiens
tgttcaatagatttaggagcag

SEQ ID NO: 1241588 - DNA, 21 bp, Homo sapiens
tgttcaatggttctgaaataa

SEQ ID NO: 1241589 - DNA, 20 bp, Homo sapiens
tgttcacaaactacctctgg

SEQ ID NO: 1241590 - DNA, 17 bp, Homo sapiens
tgttcacaaactgtgaa

SEQ ID NO: 1241591 - DNA, 17 bp, Homo sapiens
tgttcacagaaaaagca

SEQ ID NO: 1241592 - DNA, 10 bp, Homo sapiens
tgttcacctt

SEQ ID NO: 1241593 - DNA, 18 bp, Homo sapiens
tgttcaccttcaaaatgt

SEQ ID NO: 1241594 - DNA, 22 bp, Homo sapiens
tgttcacggtgacacaggtcag

SEQ ID NO: 1241595 - DNA, 18 bp, Homo sapiens
tgttcactcactctaaag

SEQ ID NO: 1241596 - DNA, 18 bp, Homo sapiens
tgttcactgaaggtgatt

SEQ ID NO: 1241597 - DNA, 13 bp, Homo sapiens
tgttcacttaaat

SEQ ID NO: 1241598 - DNA, 17 bp, Homo sapiens
tgttggttcaaactttt

SEQ ID NO: 1241599 - DNA, 16 bp, Homo sapiens
tgttggttgttttttc

SEQ ID NO: 1241600 - DNA, 13 bp, Homo sapiens
tgttgtaaaacaa

SEQ ID NO: 1241601 - DNA, 15 bp, Homo sapiens
tgttgtaatagtcca

SEQ ID NO: 1241602 - DNA, 13 bp, Homo sapiens
tgttgtaatgctg

SEQ ID NO: 1241603 - DNA, 18 bp, Homo sapiens
tgttgtacacagtctgtt

SEQ ID NO: 1241604 - DNA, 17 bp, Homo sapiens
tgttgtacttgaaaatg

SEQ ID NO: 1241605 - DNA, 22 bp, Homo sapiens
tgttgtagatgctaacgtgtca

SEQ ID NO: 1241606 - DNA, 22 bp, Homo sapiens
tgttgtagattgattgtattgt

SEQ ID NO: 1241607 - DNA, 14 bp, Homo sapiens
tgttgtataaattt

SEQ ID NO: 1241608 - DNA, 13 bp, Homo sapiens
tgttgtattaaca

SEQ ID NO: 1241609 - DNA, 13 bp, Homo sapiens
tgttgtattttaa

SEQ ID NO: 1241610 - DNA, 11 bp, Homo sapiens
tgttgtcaaga

SEQ ID NO: 1241611 - DNA, 20 bp, Homo sapiens
tgttgtcaagaatagcattg

SEQ ID NO: 1241612 - DNA, 21 bp, Homo sapiens
tgttgtcagcaggcaggctgg

SEQ ID NO: 1241613 - DNA, 13 bp, Homo sapiens
tgttgtcagctga

SEQ ID NO: 1241614 - DNA, 14 bp, Homo sapiens
tgttgtcagctgaa

SEQ ID NO: 1241615 - DNA, 15 bp, Homo sapiens
tgttgtcataacatt

SEQ ID NO: 1241616 - DNA, 17 bp, Homo sapiens
tgttgtcataacattta

SEQ ID NO: 1241617 - DNA, 19 bp, Homo sapiens
tgttgtcataacatttaaa

SEQ ID NO: 1241618 - DNA, 15 bp, Homo sapiens
tgttgtcattgctgt

SEQ ID NO: 1241619 - DNA, 14 bp, Homo sapiens
tgttgtcattgtcc

SEQ ID NO: 1241620 - DNA, 21 bp, Homo sapiens
tgttgtcattgtccagctggg

SEQ ID NO: 1241621 - DNA, 17 bp, Homo sapiens
tgttgtccaacaataaa

SEQ ID NO: 1241622 - DNA, 15 bp, Homo sapiens
tgttgtcccatctgc

SEQ ID NO: 1241623 - DNA, 19 bp, Homo sapiens
tgttgtcccatctgccctc

SEQ ID NO: 1241624 - DNA, 12 bp, Homo sapiens
tgttgtcccttc

SEQ ID NO: 1241625 - DNA, 13 bp, Homo sapiens
tgttgtcccttct

SEQ ID NO: 1241626 - DNA, 18 bp, Homo sapiens
tgttgtcctgttaattta

SEQ ID NO: 1241627 - DNA, 14 bp, Homo sapiens
tgttgtctcatttt

SEQ ID NO: 1241628 - DNA, 15 bp, Homo sapiens
tgttgtcttcagcag

SEQ ID NO: 1241629 - DNA, 22 bp, Homo sapiens
tgttgtgaagctaatgtcacaa

SEQ ID NO: 1241630 - DNA, 15 bp, Homo sapiens
tgttgtgctttcaag

SEQ ID NO: 1241631 - DNA, 15 bp, Homo sapiens
tgttgtgggcttcct

SEQ ID NO: 1241632 - DNA, 17 bp, Homo sapiens
tgttgtgtgtatatgta

SEQ ID NO: 1241633 - DNA, 18 bp, Homo sapiens
tgttgtgtgtatatgtat

SEQ ID NO: 1241634 - DNA, 13 bp, Homo sapiens
tgttgtgtgtgca

SEQ ID NO: 1241635 - DNA, 14 bp, Homo sapiens
tgttgtgttcctgg

SEQ ID NO: 1241636 - DNA, 17 bp, Homo sapiens
tgttgtgttcctggctg

SEQ ID NO: 1241637 - DNA, 15 bp, Homo sapiens
tgttgttccttttga

SEQ ID NO: 1241638 - DNA, 18 bp, Homo sapiens
tgttgttctgcctggaga

SEQ ID NO: 1241639 - DNA, 11 bp, Homo sapiens
tgttgttctgt

SEQ ID NO: 1241640 - DNA, 18 bp, Homo sapiens
tgttgttctgttaactga

SEQ ID NO: 1241641 - DNA, 18 bp, Homo sapiens
tgttgttggcaagctgca

SEQ ID NO: 1241642 - DNA, 22 bp, Homo sapiens
tgttgttgtgtgtatatgtatt

SEQ ID NO: 1241643 - DNA, 16 bp, Homo sapiens
tgttgttgttgttctt

SEQ ID NO: 1241644 - DNA, 13 bp, Homo sapiens
tgttgtttaagtg

SEQ ID NO: 1241645 - DNA, 21 bp, Homo sapiens
tgttgtttcctaatatcaaat

SEQ ID NO: 1241646 - DNA, 16 bp, Homo sapiens
tgttgtttcttaaata

SEQ ID NO: 1241647 - DNA, 14 bp, Homo sapiens
tgttgtttgtaaat

SEQ ID NO: 1241648 - DNA, 15 bp, Homo sapiens
tgttgttttgtatga

SEQ ID NO: 1241649 - DNA, 20 bp, Homo sapiens
tgttgttttgttttaaatac

SEQ ID NO: 1241650 - DNA, 21 bp, Homo sapiens
tgtttaaaaaccgaataaatg

SEQ ID NO: 1241651 - DNA, 17 bp, Homo sapiens
tgtttaaaaagtaagtt

SEQ ID NO: 1241652 - DNA, 20 bp, Homo sapiens
tgtttaaaaattgaaaaaag

SEQ ID NO: 1241653 - DNA, 18 bp, Homo sapiens
tgtttaaaacttcagttt

SEQ ID NO: 1241654 - DNA, 21 bp, Homo sapiens
tgtttaaaataaaatgaaaat

SEQ ID NO: 1241655 - DNA, 15 bp, Homo sapiens
tgtttaaaattcagt

SEQ ID NO: 1241656 - DNA, 13 bp, Homo sapiens
tgtttaaaattct

SEQ ID NO: 1241657 - DNA, 23 bp, Homo sapiens
tgtttaaagaagctctccaggcc

SEQ ID NO: 1241658 - DNA, 14 bp, Homo sapiens
tgtttaaagaataa

SEQ ID NO: 1241659 - DNA, 18 bp, Homo sapiens
tgtttaaagaataaagtc

SEQ ID NO: 1241660 - DNA, 21 bp, Homo sapiens
tgtttaaagagaggttataga

SEQ ID NO: 1241661 - DNA, 12 bp, Homo sapiens
tgtttaaagttc

SEQ ID NO: 1241662 - DNA, 18 bp, Homo sapiens
tgtttaaataaagaccta

SEQ ID NO: 1241663 - DNA, 15 bp, Homo sapiens
tgtttaaataaagta

SEQ ID NO: 1241664 - DNA, 14 bp, Homo sapiens
tgtttaaatagcct

SEQ ID NO: 1241665 - DNA, 18 bp, Homo sapiens
tgtttaaatagcctaaat

SEQ ID NO: 1241666 - DNA, 20 bp, Homo sapiens
tgtttaaatagcctaaatga

SEQ ID NO: 1241667 - DNA, 19 bp, Homo sapiens
tgtttaaatcatgtatgtt

SEQ ID NO: 1241668 - DNA, 13 bp, Homo sapiens
tgtttaaatgcca

SEQ ID NO: 1241669 - DNA, 17 bp, Homo sapiens
tgtttaaatgccaaaat

SEQ ID NO: 1241670 - DNA, 14 bp, Homo sapiens
tgtttaaattgtaa

SEQ ID NO: 1241671 - DNA, 13 bp, Homo sapiens
tgtttaacaaatc

SEQ ID NO: 1241672 - DNA, 21 bp, Homo sapiens
tgtttaacaaatctaatctct

SEQ ID NO: 1241673 - DNA, 15 bp, Homo sapiens
tgtttaacatatata

SEQ ID NO: 1241674 - DNA, 17 bp, Homo sapiens
tgtttaacattcacagc

SEQ ID NO: 1241675 - DNA, 13 bp, Homo sapiens
tgtttaactggca

SEQ ID NO: 1241676 - DNA, 21 bp, Homo sapiens
tgtttaagtattaacttacaa

SEQ ID NO: 1241677 - DNA, 21 bp, Homo sapiens
tgtttaagtgttgtaaatatt

SEQ ID NO: 1241678 - DNA, 14 bp, Homo sapiens
tgtttaatatttaa

SEQ ID NO: 1241679 - DNA, 14 bp, Homo sapiens
tgtttaatttgctt

SEQ ID NO: 1241680 - DNA, 17 bp, Homo sapiens
tgtttaatttgcttcct

SEQ ID NO: 1241681 - DNA, 16 bp, Homo sapiens
tgtttacaataaagaa

SEQ ID NO: 1241682 - DNA, 15 bp, Homo sapiens
tgtttacacaattaa

SEQ ID NO: 1241683 - DNA, 16 bp, Homo sapiens
tgtttacactctttgt

SEQ ID NO: 1241684 - DNA, 17 bp, Homo sapiens
tgtttacagatccccaa

SEQ ID NO: 1241685 - DNA, 23 bp, Homo sapiens
tgtttacagcactactctgtgcc

SEQ ID NO: 1241686 - DNA, 18 bp, Homo sapiens
tgtttacaggtttgaatt

SEQ ID NO: 1241687 - DNA, 12 bp, Homo sapiens
tgtttacagtga

SEQ ID NO: 1241688 - DNA, 23 bp, Homo sapiens
tgtttacagtgaggactcggcca

SEQ ID NO: 1241689 - DNA, 22 bp, Homo sapiens
tgtttacatcaaagcttcttca

SEQ ID NO: 1241690 - DNA, 20 bp, Homo sapiens
tgtttacatggcgccctgcc

SEQ ID NO: 1241691 - DNA, 17 bp, Homo sapiens
tgtttacatttgatgca

SEQ ID NO: 1241692 - DNA, 17 bp, Homo sapiens
tgtttacatttttaaag

SEQ ID NO: 1241693 - DNA, 15 bp, Homo sapiens
tgtttacctggcagt

SEQ ID NO: 1241694 - DNA, 16 bp, Homo sapiens
tgtttacgatttcact

SEQ ID NO: 1241695 - DNA, 19 bp, Homo sapiens
tgtttactagggatccctc

SEQ ID NO: 1241696 - DNA, 17 bp, Homo sapiens
tgtttactatgtgccag

SEQ ID NO: 1241697 - DNA, 20 bp, Homo sapiens
tgtttactcattgaagcaga

SEQ ID NO: 1241698 - DNA, 12 bp, Homo sapiens
tgtttactgctt

SEQ ID NO: 1241699 - DNA, 19 bp, Homo sapiens
tgtttactttttggctgga

SEQ ID NO: 1241700 - DNA, 20 bp, Homo sapiens
tgtttactttttggctggag

SEQ ID NO: 1241701 - DNA, 16 bp, Homo sapiens
tgtttagataatacac

SEQ ID NO: 1241702 - DNA, 11 bp, Homo sapiens
tgtttagatgt

SEQ ID NO: 1241703 - DNA, 22 bp, Homo sapiens
tgtttagcagcagcctttaatg

SEQ ID NO: 1241704 - DNA, 22 bp, Homo sapiens
tgtttaggcctcatttctttgt

SEQ ID NO: 1241705 - DNA, 22 bp, Homo sapiens
tgtttagtacttttataatgaa

SEQ ID NO: 1241706 - DNA, 15 bp, Homo sapiens
tgtttagtagaaacg

SEQ ID NO: 1241707 - DNA, 19 bp, Homo sapiens
tgtttagttttacatttta

SEQ ID NO: 1241708 - DNA, 20 bp, Homo sapiens
tgtttataaaacaatgactt

SEQ ID NO: 1241709 - DNA, 16 bp, Homo sapiens
tgtttataataaaaat

SEQ ID NO: 1241710 - DNA, 14 bp, Homo sapiens
tgtttatactgtat

SEQ ID NO: 1241711 - DNA, 17 bp, Homo sapiens
tgtttatcagatacatc

SEQ ID NO: 1241712 - DNA, 19 bp, Homo sapiens
tgtttatcagatacatcac

SEQ ID NO: 1241713 - DNA, 22 bp, Homo sapiens
tgtttatcagatacatcactgc

SEQ ID NO: 1241714 - DNA, 16 bp, Homo sapiens
tgtttatcctttcata

SEQ ID NO: 1241715 - DNA, 18 bp, Homo sapiens
tgtttatcctttcatata

SEQ ID NO: 1241716 - DNA, 21 bp, Homo sapiens
tgtttatcctttcatatagtt

SEQ ID NO: 1241717 - DNA, 15 bp, Homo sapiens
tgtttatgagaaact

SEQ ID NO: 1241718 - DNA, 16 bp, Homo sapiens
tgtttattaaatgctt

SEQ ID NO: 1241719 - DNA, 14 bp, Homo sapiens
tgtttattaacaaa

SEQ ID NO: 1241720 - DNA, 16 bp, Homo sapiens
tgtttattaactactg

SEQ ID NO: 1241721 - DNA, 21 bp, Homo sapiens
tgtttattaatagaatgataa

SEQ ID NO: 1241722 - DNA, 22 bp, Homo sapiens
tgtttattaatagaatgataaa

SEQ ID NO: 1241723 - DNA, 14 bp, Homo sapiens
tgtttattaatctt

SEQ ID NO: 1241724 - DNA, 13 bp, Homo sapiens
tgtttattacaat

SEQ ID NO: 1241725 - DNA, 14 bp, Homo sapiens
tgtttattacaatt

SEQ ID NO: 1241726 - DNA, 22 bp, Homo sapiens
tgtttattacaatttttaataa

SEQ ID NO: 1241727 - DNA, 18 bp, Homo sapiens
tgtttattacttccatga

SEQ ID NO: 1241728 - DNA, 13 bp, Homo sapiens
tgtttattccttg

SEQ ID NO: 1241729 - DNA, 18 bp, Homo sapiens
tgtttattcttccagaat

SEQ ID NO: 1241730 - DNA, 13 bp, Homo sapiens
tgtttattgagct

SEQ ID NO: 1241731 - DNA, 12 bp, Homo sapiens
tgtttattttga

SEQ ID NO: 1241732 - DNA, 12 bp, Homo sapiens
tgtttatttttc

SEQ ID NO: 1241733 - DNA, 14 bp, Homo sapiens
tgtttatttttcat

SEQ ID NO: 1241734 - DNA, 16 bp, Homo sapiens
tgtttatttttcatat

SEQ ID NO: 1241735 - DNA, 18 bp, Homo sapiens
tgtttatttttcatattg

SEQ ID NO: 1241736 - DNA, 19 bp, Homo sapiens
tgtttatttttcatattgt

SEQ ID NO: 1241737 - DNA, 14 bp, Homo sapiens
tgtttcaaagcaca

SEQ ID NO: 1241738 - DNA, 18 bp, Homo sapiens
tgtttcaaatgcagaaac

SEQ ID NO: 1241739 - DNA, 17 bp, Homo sapiens
tgtttcaagtggggctc

SEQ ID NO: 1241740 - DNA, 21 bp, Homo sapiens
tgtttcaagtggggctcgcca

SEQ ID NO: 1241741 - DNA, 19 bp, Homo sapiens
tgtttcaatgacctgtatt

SEQ ID NO: 1241742 - DNA, 19 bp, Homo sapiens
tgtttcaattctgtaatta

SEQ ID NO: 1241743 - DNA, 21 bp, Homo sapiens
tgtttcaattctgtaattaca

SEQ ID NO: 1241744 - DNA, 22 bp, Homo sapiens
tgtttcaattctgtaattacat

SEQ ID NO: 1241745 - DNA, 23 bp, Homo sapiens
tgtttcaattctgtaattacata

SEQ ID NO: 1241746 - DNA, 22 bp, Homo sapiens
tgtttcactgaaatgtttggat

SEQ ID NO: 1241747 - DNA, 20 bp, Homo sapiens
tgtttcagattttttaaaat

SEQ ID NO: 1241748 - DNA, 16 bp, Homo sapiens
tgtttcaggtttccat

SEQ ID NO: 1241749 - DNA, 17 bp, Homo sapiens
tgtttcagtgtgagtca

SEQ ID NO: 1241750 - DNA, 14 bp, Homo sapiens
tgtttcatctaagt

SEQ ID NO: 1241751 - DNA, 14 bp, Homo sapiens
tgtttcatgttttg

SEQ ID NO: 1241752 - DNA, 21 bp, Homo sapiens
tgtttcatgttttgtgactat

SEQ ID NO: 1241753 - DNA, 22 bp, Homo sapiens
tgtttcatgttttgtgactata

SEQ ID NO: 1241754 - DNA, 21 bp, Homo sapiens
tgtttccaaatccctttcatg

SEQ ID NO: 1241755 - DNA, 18 bp, Homo sapiens
tgtttccaacctggagta

SEQ ID NO: 1241756 - DNA, 22 bp, Homo sapiens
tgtttccaacttgtctgggaat

SEQ ID NO: 1241757 - DNA, 22 bp, Homo sapiens
tgtttccagaattggtaaaaac

SEQ ID NO: 1241758 - DNA, 20 bp, Homo sapiens
tgtttccagacttccttgag

SEQ ID NO: 1241759 - DNA, 18 bp, Homo sapiens
tgtttccagcagaagaca

SEQ ID NO: 1241760 - DNA, 20 bp, Homo sapiens
tgtttccagcagaagacaaa

SEQ ID NO: 1241761 - DNA, 22 bp, Homo sapiens
tgtttcccgggcaatttaacaa

SEQ ID NO: 1241762 - DNA, 18 bp, Homo sapiens
tgtttcccttgctttgtt

SEQ ID NO: 1241763 - DNA, 19 bp, Homo sapiens
tgtttcccttgctttgttt

SEQ ID NO: 1241764 - DNA, 13 bp, Homo sapiens
tgtttcctgaaat

SEQ ID NO: 1241765 - DNA, 11 bp, Homo sapiens
tgtttcctgag

SEQ ID NO: 1241766 - DNA, 21 bp, Homo sapiens
tgtttcgctgatatatgtgtt

SEQ ID NO: 1241767 - DNA, 16 bp, Homo sapiens
tgtttctatctgattt

SEQ ID NO: 1241768 - DNA, 16 bp, Homo sapiens
tgtttctccccctggg

SEQ ID NO: 1241769 - DNA, 17 bp, Homo sapiens
tgtttctccccctgggc

SEQ ID NO: 1241770 - DNA, 12 bp, Homo sapiens
tgtttctcctta

SEQ ID NO: 1241771 - DNA, 21 bp, Homo sapiens
tgtttctccttagttggctgg

SEQ ID NO: 1241772 - DNA, 17 bp, Homo sapiens
tgtttctctgctgtcaa

SEQ ID NO: 1241773 - DNA, 22 bp, Homo sapiens
tgtttctctgttgtaagaatag

SEQ ID NO: 1241774 - DNA, 20 bp, Homo sapiens
tgtttctctttgtctgcctt

SEQ ID NO: 1241775 - DNA, 13 bp, Homo sapiens
tgtttctgaaaat

SEQ ID NO: 1241776 - DNA, 16 bp, Homo sapiens
tgtttctgacccactg

SEQ ID NO: 1241777 - DNA, 17 bp, Homo sapiens
tgtttctgatgacagtg

SEQ ID NO: 1241778 - DNA, 16 bp, Homo sapiens
tgtttctgcagccctt

SEQ ID NO: 1241779 - DNA, 20 bp, Homo sapiens
tgtttctgcagcccttgggc

SEQ ID NO: 1241780 - DNA, 22 bp, Homo sapiens
tgtttctgcagcccttgggcag

SEQ ID NO: 1241781 - DNA, 23 bp, Homo sapiens
tgtttctgcagcccttgggcagt

SEQ ID NO: 1241782 - DNA, 17 bp, Homo sapiens
tgtttctggatttcata

SEQ ID NO: 1241783 - DNA, 18 bp, Homo sapiens
tgtttctgggtccctgct

SEQ ID NO: 1241784 - DNA, 15 bp, Homo sapiens
tgtttctgttccaaa

SEQ ID NO: 1241785 - DNA, 22 bp, Homo sapiens
tgtttcttagagccaagtgtct

SEQ ID NO: 1241786 - DNA, 19 bp, Homo sapiens
tgtttcttcatttctctgc

SEQ ID NO: 1241787 - DNA, 13 bp, Homo sapiens
tgtttcttcctgc

SEQ ID NO: 1241788 - DNA, 23 bp, Homo sapiens
tgtttcttcttttcctttatcca

SEQ ID NO: 1241789 - DNA, 15 bp, Homo sapiens
tgtttcttgctctct

SEQ ID NO: 1241790 - DNA, 17 bp, Homo sapiens
tgtttcttttaagtata

SEQ ID NO: 1241791 - DNA, 13 bp, Homo sapiens
tgtttcttttgta

SEQ ID NO: 1241792 - DNA, 19 bp, Homo sapiens
tgtttgaaaacttcagaag

SEQ ID NO: 1241793 - DNA, 22 bp, Homo sapiens
tgtttgaaatgaggtctgttta

SEQ ID NO: 1241794 - DNA, 19 bp, Homo sapiens
tgtttgaagattatatgaa

SEQ ID NO: 1241795 - DNA, 22 bp, Homo sapiens
tgtttgaagattatatgaagtt

SEQ ID NO: 1241796 - DNA, 12 bp, Homo sapiens
tgtttgaatatt

SEQ ID NO: 1241797 - DNA, 22 bp, Homo sapiens
tgtttgacaaagttactgattc

SEQ ID NO: 1241798 - DNA, 14 bp, Homo sapiens
tgtttgacacctct

SEQ ID NO: 1241799 - DNA, 17 bp, Homo sapiens
tgtttgagaacccccta

SEQ ID NO: 1241800 - DNA, 11 bp, Homo sapiens
tgtttgagcac

SEQ ID NO: 1241801 - DNA, 22 bp, Homo sapiens
tgtttgagtttttcctcccagt

SEQ ID NO: 1241802 - DNA, 16 bp, Homo sapiens
tgtttgatttagtaat

SEQ ID NO: 1241803 - DNA, 20 bp, Homo sapiens
tgtttgcacctttctagttg

SEQ ID NO: 1241804 - DNA, 17 bp, Homo sapiens
tgtttgcagcctgctct

SEQ ID NO: 1241805 - DNA, 16 bp, Homo sapiens
tgtttgcatgagaaaa

SEQ ID NO: 1241806 - DNA, 19 bp, Homo sapiens
tgtttgcgtacttgtaata

SEQ ID NO: 1241807 - DNA, 17 bp, Homo sapiens
tgtttgctctaaattaa

SEQ ID NO: 1241808 - DNA, 14 bp, Homo sapiens
tgtttgctctcccg

SEQ ID NO: 1241809 - DNA, 14 bp, Homo sapiens
tgtttgcttaaaca

SEQ ID NO: 1241810 - DNA, 15 bp, Homo sapiens
tgtttgcttaaacaa

SEQ ID NO: 1241811 - DNA, 15 bp, Homo sapiens
tgtttgcttattgtt

SEQ ID NO: 1241812 - DNA, 18 bp, Homo sapiens
tgtttgcttcataaatga

SEQ ID NO: 1241813 - DNA, 14 bp, Homo sapiens
tgtttgcttccatt

SEQ ID NO: 1241814 - DNA, 16 bp, Homo sapiens
tgtttgcttcttgcca

SEQ ID NO: 1241815 - DNA, 17 bp, Homo sapiens
tgtttgcttcttgccat

SEQ ID NO: 1241816 - DNA, 19 bp, Homo sapiens
tgtttgcttcttgccatca

SEQ ID NO: 1241817 - DNA, 17 bp, Homo sapiens
tgtttggaaaagacagt

SEQ ID NO: 1241818 - DNA, 20 bp, Homo sapiens
tgtttggactgttttcaata

SEQ ID NO: 1241819 - DNA, 22 bp, Homo sapiens
tgtttggaggagcaaagttaaa

SEQ ID NO: 1241820 - DNA, 15 bp, Homo sapiens
tgtttggattgatat

SEQ ID NO: 1241821 - DNA, 15 bp, Homo sapiens
tgtttggcaaggaaa

SEQ ID NO: 1241822 - DNA, 17 bp, Homo sapiens
tgtttggcaaggaaagg

SEQ ID NO: 1241823 - DNA, 15 bp, Homo sapiens
tgtttggcaatgcta

SEQ ID NO: 1241824 - DNA, 22 bp, Homo sapiens
tgtttggcgtagcagagttaaa

SEQ ID NO: 1241825 - DNA, 17 bp, Homo sapiens
tgtttggcttataaaca

SEQ ID NO: 1241826 - DNA, 15 bp, Homo sapiens
tgtttgggagactgt

SEQ ID NO: 1241827 - DNA, 17 bp, Homo sapiens
tgtttgggatgaccagg

SEQ ID NO: 1241828 - DNA, 22 bp, Homo sapiens
tgtttgggcagaagggagaagg

SEQ ID NO: 1241829 - DNA, 22 bp, Homo sapiens
tgtttgggggaaaaaaaagaaa

SEQ ID NO: 1241830 - DNA, 15 bp, Homo sapiens
tgtttgggtatcctg

SEQ ID NO: 1241831 - DNA, 23 bp, Homo sapiens
tgtttgggtatcctgcccagtgt

SEQ ID NO: 1241832 - DNA, 11 bp, Homo sapiens
tgtttgtaaat

SEQ ID NO: 1241833 - DNA, 13 bp, Homo sapiens
tgtttgtaaataa

SEQ ID NO: 1241834 - DNA, 13 bp, Homo sapiens
tgtttgtacagta

SEQ ID NO: 1241835 - DNA, 12 bp, Homo sapiens
tgtttgtactgt

SEQ ID NO: 1241836 - DNA, 22 bp, Homo sapiens
tgtttgtattttttatttacat

SEQ ID NO: 1241837 - DNA, 17 bp, Homo sapiens
ttaaaggtttttgaaat

SEQ ID NO: 1241838 - DNA, 13 bp, Homo sapiens
ttaaagtaaactt

SEQ ID NO: 1241839 - DNA, 18 bp, Homo sapiens
ttaaagtaaacttgtgta

SEQ ID NO: 1241840 - DNA, 13 bp, Homo sapiens
ttaaagtatgcaa

SEQ ID NO: 1241841 - DNA, 20 bp, Homo sapiens
ttaaagtatgcattattaaa

SEQ ID NO: 1241842 - DNA, 23 bp, Homo sapiens
ttaaagtatttataaaaatataa

SEQ ID NO: 1241843 - DNA, 13 bp, Homo sapiens
ttaaagtatttct

SEQ ID NO: 1241844 - DNA, 19 bp, Homo sapiens
ttaaagtcacatccctgta

SEQ ID NO: 1241845 - DNA, 12 bp, Homo sapiens
ttaaagtctgaa

SEQ ID NO: 1241846 - DNA, 16 bp, Homo sapiens
ttaaagtgcagtcatt

SEQ ID NO: 1241847 - DNA, 18 bp, Homo sapiens
ttaaagtgcagtcatttg

SEQ ID NO: 1241848 - DNA, 20 bp, Homo sapiens
ttaaagttcttattttagta

SEQ ID NO: 1241849 - DNA, 20 bp, Homo sapiens
ttaaataaaaataatagact

SEQ ID NO: 1241850 - DNA, 20 bp, Homo sapiens
ttaaattttttttacatttt

SEQ ID NO: 1241851 - DNA, 16 bp, Homo sapiens
ttaacaaaaaatgtaa

SEQ ID NO: 1241852 - DNA, 21 bp, Homo sapiens
ttaacaaaaaatgtaattaac

SEQ ID NO: 1241853 - DNA, 11 bp, Homo sapiens
ttaacaaaagt

SEQ ID NO: 1241854 - DNA, 23 bp, Homo sapiens
ttaacaaacatcactctgctgct

SEQ ID NO: 1241855 - DNA, 20 bp, Homo sapiens
ttaacaaacgcattaagagg

SEQ ID NO: 1241856 - DNA, 14 bp, Homo sapiens
ttaacaaatcagat

SEQ ID NO: 1241857 - DNA, 20 bp, Homo sapiens
ttaacaaatctaatctctta

SEQ ID NO: 1241858 - DNA, 17 bp, Homo sapiens
ttaacaaatgactgtat

SEQ ID NO: 1241859 - DNA, 18 bp, Homo sapiens
ttaacaaatgtatcacta

SEQ ID NO: 1241860 - DNA, 22 bp, Homo sapiens
ttaacaacaataacactgtctc

SEQ ID NO: 1241861 - DNA, 13 bp, Homo sapiens
ttaacaacatggc

SEQ ID NO: 1241862 - DNA, 15 bp, Homo sapiens
ttaacaactcattct

SEQ ID NO: 1241863 - DNA, 14 bp, Homo sapiens
ttaacaagaacttt

SEQ ID NO: 1241864 - DNA, 12 bp, Homo sapiens
ttaacaaggaat

SEQ ID NO: 1241865 - DNA, 19 bp, Homo sapiens
ttaacaataactactgtgt

SEQ ID NO: 1241866 - DNA, 15 bp, Homo sapiens
ttaacaatattttat

SEQ ID NO: 1241867 - DNA, 19 bp, Homo sapiens
ttaacaatgcctattgtaa

SEQ ID NO: 1241868 - DNA, 16 bp, Homo sapiens
ttaacaattgtcttaa

SEQ ID NO: 1241869 - DNA, 15 bp, Homo sapiens
ttacccaagctgtgg

SEQ ID NO: 1241870 - DNA, 17 bp, Homo sapiens
ttacccaagtcttctcc

SEQ ID NO: 1241871 - DNA, 20 bp, Homo sapiens
ttacccaatgggaccgtgcc

SEQ ID NO: 1241872 - DNA, 14 bp, Homo sapiens
ttacccaatttccc

SEQ ID NO: 1241873 - DNA, 16 bp, Homo sapiens
ttacccacacacagat

SEQ ID NO: 1241874 - DNA, 18 bp, Homo sapiens
ttacccactcggtcccag

SEQ ID NO: 1241875 - DNA, 18 bp, Homo sapiens
ttacccactgccatgcac

SEQ ID NO: 1241876 - DNA, 21 bp, Homo sapiens
ttacccagtattactgctgct

SEQ ID NO: 1241877 - DNA, 22 bp, Homo sapiens
ttacccagtattactgctgctg

SEQ ID NO: 1241878 - DNA, 16 bp, Homo sapiens
ttaccccgagacctca

SEQ ID NO: 1241879 - DNA, 16 bp, Homo sapiens
ttaccctcctctgctg

SEQ ID NO: 1241880 - DNA, 13 bp, Homo sapiens
ttaccctctttgc

SEQ ID NO: 1241881 - DNA, 17 bp, Homo sapiens
ttaccctgatctggacc

SEQ ID NO: 1241882 - DNA, 13 bp, Homo sapiens
ttaccctgtgtca

SEQ ID NO: 1241883 - DNA, 19 bp, Homo sapiens
ttaccctgtgtcagagcct

SEQ ID NO: 1241884 - DNA, 22 bp, Homo sapiens
ttaccctttggccccactttga

SEQ ID NO: 1241885 - DNA, 20 bp, Homo sapiens
ttaccgagtatctgtaaccc

SEQ ID NO: 1241886 - DNA, 17 bp, Homo sapiens
ttaccgttgcttgaaat

SEQ ID NO: 1241887 - DNA, 14 bp, Homo sapiens
ttaccgtttcttcc

SEQ ID NO: 1241888 - DNA, 17 bp, Homo sapiens
ttacctaaacagatata

SEQ ID NO: 1241889 - DNA, 19 bp, Homo sapiens
ttacctaaacagatataaa

SEQ ID NO: 1241890 - DNA, 18 bp, Homo sapiens
ttacctaagattacaaat

SEQ ID NO: 1241891 - DNA, 14 bp, Homo sapiens
ttacctagaaatct

SEQ ID NO: 1241892 - DNA, 13 bp, Homo sapiens
ttacctagtgaaa

SEQ ID NO: 1241893 - DNA, 15 bp, Homo sapiens
ttacctagtgaaact

SEQ ID NO: 1241894 - DNA, 21 bp, Homo sapiens
ttacctagtgaaacttttcta

SEQ ID NO: 1241895 - DNA, 22 bp, Homo sapiens
ttacctagtgaaacttttctag

SEQ ID NO: 1241896 - DNA, 16 bp, Homo sapiens
ttacctatctgtggaa

SEQ ID NO: 1241897 - DNA, 14 bp, Homo sapiens
ttacctcaggtgtg

SEQ ID NO: 1241898 - DNA, 19 bp, Homo sapiens
ttacctcatccatgcactt

SEQ ID NO: 1241899 - DNA, 19 bp, Homo sapiens
ttacctcctgagaaaaaag

SEQ ID NO: 1241900 - DNA, 14 bp, Homo sapiens
ttacctcctgccca

SEQ ID NO: 1241901 - DNA, 21 bp, Homo sapiens
ttacctcggggagagggggag

SEQ ID NO: 1241902 - DNA, 23 bp, Homo sapiens
ttacctcggggagagggggaggt

SEQ ID NO: 1241903 - DNA, 17 bp, Homo sapiens
ttacctctggaaccccc

SEQ ID NO: 1241904 - DNA, 15 bp, Homo sapiens
ttacctcttaacaat

SEQ ID NO: 1241905 - DNA, 18 bp, Homo sapiens
ttacctcttgcccttggg

SEQ ID NO: 1241906 - DNA, 22 bp, Homo sapiens
ttacctgaaaacactgtgcaca

SEQ ID NO: 1241907 - DNA, 20 bp, Homo sapiens
ttacctgacctcttgctgtc

SEQ ID NO: 1241908 - DNA, 21 bp, Homo sapiens
ttacctggcttatttaatatg

SEQ ID NO: 1241909 - DNA, 15 bp, Homo sapiens
ttacctgtatacagt

SEQ ID NO: 1241910 - DNA, 13 bp, Homo sapiens
ttacctgtggata

SEQ ID NO: 1241911 - DNA, 13 bp, Homo sapiens
ttacctgtgtgct

SEQ ID NO: 1241912 - DNA, 18 bp, Homo sapiens
ttacctgttccattgttg

SEQ ID NO: 1241913 - DNA, 22 bp, Homo sapiens
ttacctgttttcgcacctacca

SEQ ID NO: 1241914 - DNA, 21 bp, Homo sapiens
ttaccttagattagctctgga

SEQ ID NO: 1241915 - DNA, 18 bp, Homo sapiens
ttaccttatagttactgt

SEQ ID NO: 1241916 - DNA, 16 bp, Homo sapiens
ttaagaacacaaagcg

SEQ ID NO: 1241917 - DNA, 16 bp, Homo sapiens
ttaagaacttcatttt

SEQ ID NO: 1241918 - DNA, 10 bp, Homo sapiens
ttaagaatat

SEQ ID NO: 1241919 - DNA, 20 bp, Homo sapiens
ttaagaatatctgtaatggt

SEQ ID NO: 1241920 - DNA, 19 bp, Homo sapiens
ttaagaatatgtttccttg

SEQ ID NO: 1241921 - DNA, 18 bp, Homo sapiens
ttaagaatgaagttctgc

SEQ ID NO: 1241922 - DNA, 23 bp, Homo sapiens
ttaagaatgcagattcctgggcc

SEQ ID NO: 1241923 - DNA, 19 bp, Homo sapiens
ttaagaattgagtaatggt

SEQ ID NO: 1241924 - DNA, 15 bp, Homo sapiens
ttaagacaaaaagcc

SEQ ID NO: 1241925 - DNA, 19 bp, Homo sapiens
ttaagacaaaaagccttga

SEQ ID NO: 1241926 - DNA, 20 bp, Homo sapiens
ttaagacactgaaaaatcta

SEQ ID NO: 1241927 - DNA, 20 bp, Homo sapiens
ttaagacagtgtacaaaact

SEQ ID NO: 1241928 - DNA, 22 bp, Homo sapiens
ttaagacagtgtacaaaactgt

SEQ ID NO: 1241929 - DNA, 23 bp, Homo sapiens
ttaagacagtgtacaaaactgta

SEQ ID NO: 1241930 - DNA, 13 bp, Homo sapiens
ttaagactagata

SEQ ID NO: 1241931 - DNA, 17 bp, Homo sapiens
ttaagactgaatgtttt

SEQ ID NO: 1241932 - DNA, 20 bp, Homo sapiens
ttaagactgataattttaca

SEQ ID NO: 1241933 - DNA, 14 bp, Homo sapiens
ttaagactgatttt

SEQ ID NO: 1241934 - DNA, 19 bp, Homo sapiens
ttaagagacagagaatctt

SEQ ID NO: 1241935 - DNA, 20 bp, Homo sapiens
ttaagagactctttattttt

SEQ ID NO: 1241936 - DNA, 23 bp, Homo sapiens
ttaagagactctttatttttctc

SEQ ID NO: 1241937 - DNA, 20 bp, Homo sapiens
ttaagagatacttacatttc

SEQ ID NO: 1241938 - DNA, 23 bp, Homo sapiens
ttaagagcagaacagatctttta

SEQ ID NO: 1241939 - DNA, 22 bp, Homo sapiens
ttaagagccatataagtttgaa

SEQ ID NO: 1241940 - DNA, 15 bp, Homo sapiens
ttaagagctatttgt

SEQ ID NO: 1241941 - DNA, 15 bp, Homo sapiens
ttagattgagaaatg

SEQ ID NO: 1241942 - DNA, 17 bp, Homo sapiens
ttagattggttctgttt

SEQ ID NO: 1241943 - DNA, 10 bp, Homo sapiens
ttagatttca

SEQ ID NO: 1241944 - DNA, 18 bp, Homo sapiens
ttagatttcatagttcag

SEQ ID NO: 1241945 - DNA, 21 bp, Homo sapiens
ttagatttctcacactctaac

SEQ ID NO: 1241946 - DNA, 18 bp, Homo sapiens
ttagcaaactgatgctga

SEQ ID NO: 1241947 - DNA, 19 bp, Homo sapiens
ttagcaaagagttaatata

SEQ ID NO: 1241948 - DNA, 20 bp, Homo sapiens
ttagcaaagagttaatatat

SEQ ID NO: 1241949 - DNA, 20 bp, Homo sapiens
ttagcaagaatcattttgtg

SEQ ID NO: 1241950 - DNA, 13 bp, Homo sapiens
ttagcacagagag

SEQ ID NO: 1241951 - DNA, 16 bp, Homo sapiens
ttagcaccgtttgtga

SEQ ID NO: 1241952 - DNA, 16 bp, Homo sapiens
ttagcactatttaaaa

SEQ ID NO: 1241953 - DNA, 18 bp, Homo sapiens
ttagcactgttgatgtat

SEQ ID NO: 1241954 - DNA, 19 bp, Homo sapiens
ttagcagagacaaagagtt

SEQ ID NO: 1241955 - DNA, 12 bp, Homo sapiens
ttagcagagtct

SEQ ID NO: 1241956 - DNA, 17 bp, Homo sapiens
ttagcagagtctgtctc

SEQ ID NO: 1241957 - DNA, 18 bp, Homo sapiens
ttagcagagtctgtctct

SEQ ID NO: 1241958 - DNA, 12 bp, Homo sapiens
ttagcagttctg

SEQ ID NO: 1241959 - DNA, 18 bp, Homo sapiens
ttagcagttctgcaaata

SEQ ID NO: 1241960 - DNA, 24 bp, Homo sapiens
ttagcatgacaagccccaggcagg

SEQ ID NO: 1241961 - DNA, 16 bp, Homo sapiens
ttagcatttttatgca

SEQ ID NO: 1241962 - DNA, 19 bp, Homo sapiens
ttagccaagccctaagcct

SEQ ID NO: 1241963 - DNA, 21 bp, Homo sapiens
ttagccagttcaaagtgtata

SEQ ID NO: 1241964 - DNA, 19 bp, Homo sapiens
ttagcccaagaggtctgag

SEQ ID NO: 1241965 - DNA, 16 bp, Homo sapiens
ttagcccctgaaagcc

SEQ ID NO: 1241966 - DNA, 15 bp, Homo sapiens
ttagccctgaacatt

SEQ ID NO: 1241967 - DNA, 16 bp, Homo sapiens
ttagccctgaacattt

SEQ ID NO: 1241968 - DNA, 21 bp, Homo sapiens
ttagccgcaccctgcacctgc

SEQ ID NO: 1241969 - DNA, 18 bp, Homo sapiens
ttagccgggcatggtggc

SEQ ID NO: 1241970 - DNA, 13 bp, Homo sapiens
ttagccgggcgtg

SEQ ID NO: 1241971 - DNA, 15 bp, Homo sapiens
ttagcctccctgaaa

SEQ ID NO: 1241972 - DNA, 12 bp, Homo sapiens
ttagcctctccc

SEQ ID NO: 1241973 - DNA, 13 bp, Homo sapiens
ttagcctctccca

SEQ ID NO: 1241974 - DNA, 18 bp, Homo sapiens
ttagcctcttccctctga

SEQ ID NO: 1241975 - DNA, 17 bp, Homo sapiens
ttagcctcttggaaatc

SEQ ID NO: 1241976 - DNA, 11 bp, Homo sapiens
ttagcctgcct

SEQ ID NO: 1241977 - DNA, 13 bp, Homo sapiens
ttagcctggacca

SEQ ID NO: 1241978 - DNA, 14 bp, Homo sapiens
ttagcctttgaatg

SEQ ID NO: 1241979 - DNA, 16 bp, Homo sapiens
ttagcgctctggacag

SEQ ID NO: 1241980 - DNA, 19 bp, Homo sapiens
ttagcggcaaacctttccc

SEQ ID NO: 1241981 - DNA, 21 bp, Homo sapiens
ttagcggcaaacctttccccc

SEQ ID NO: 1241982 - DNA, 14 bp, Homo sapiens
ttagcggctcctcg

SEQ ID NO: 1241983 - DNA, 13 bp, Homo sapiens
ttagcgtcaagac

SEQ ID NO: 1241984 - DNA, 14 bp, Homo sapiens
ttagcgttctggac

SEQ ID NO: 1241985 - DNA, 16 bp, Homo sapiens
ttagcgttctggactc

SEQ ID NO: 1241986 - DNA, 18 bp, Homo sapiens
ttagctaaatgcaattta

SEQ ID NO: 1241987 - DNA, 20 bp, Homo sapiens
ttagctaaatgcaatttaaa

SEQ ID NO: 1241988 - DNA, 15 bp, Homo sapiens
ttagctaataaaaag

SEQ ID NO: 1241989 - DNA, 18 bp, Homo sapiens
ttagctactgtatgcaaa

SEQ ID NO: 1241990 - DNA, 19 bp, Homo sapiens
ttagctatttatccctttc

SEQ ID NO: 1241991 - DNA, 13 bp, Homo sapiens
ttagctcatttga

SEQ ID NO: 1241992 - DNA, 18 bp, Homo sapiens
ttagctccataaagtaca

SEQ ID NO: 1241993 - DNA, 24 bp, Homo sapiens
ttagctccataaagtacaaatgaa

SEQ ID NO: 1241994 - DNA, 22 bp, Homo sapiens
ttagctccctgtggggcaggag

SEQ ID NO: 1241995 - DNA, 19 bp, Homo sapiens
ttagctctggaccagcctg

SEQ ID NO: 1241996 - DNA, 12 bp, Homo sapiens
ttagctcttaat

SEQ ID NO: 1241997 - DNA, 12 bp, Homo sapiens
ttagctgaggga

SEQ ID NO: 1241998 - DNA, 23 bp, Homo sapiens
ttagctgatgaacttattctgta

SEQ ID NO: 1241999 - DNA, 20 bp, Homo sapiens
ttagctggtgtcagcccctc

SEQ ID NO: 1242000 - DNA, 16 bp, Homo sapiens
ttagctgtgtgaaata

SEQ ID NO: 1242001 - DNA, 20 bp, Homo sapiens
ttagcttcctccagaggagg

SEQ ID NO: 1242002 - DNA, 20 bp, Homo sapiens
ttagctttgtgtttactttt

SEQ ID NO: 1242003 - DNA, 17 bp, Homo sapiens
ttaggaaacttgtagaa

SEQ ID NO: 1242004 - DNA, 19 bp, Homo sapiens
ttaggaaataaaacctttc

SEQ ID NO: 1242005 - DNA, 18 bp, Homo sapiens
ttaggaagcaagcttaat

SEQ ID NO: 1242006 - DNA, 15 bp, Homo sapiens
ttaggaatatgttca

SEQ ID NO: 1242007 - DNA, 18 bp, Homo sapiens
ttaggaatctcttcacta

SEQ ID NO: 1242008 - DNA, 12 bp, Homo sapiens
ttagtatgtctg

SEQ ID NO: 1242009 - DNA, 14 bp, Homo sapiens
ttagtattcattct

SEQ ID NO: 1242010 - DNA, 15 bp, Homo sapiens
ttagtattcattctg

SEQ ID NO: 1242011 - DNA, 14 bp, Homo sapiens
ttagtattcttgag

SEQ ID NO: 1242012 - DNA, 16 bp, Homo sapiens
ttagtattgttgtcct

SEQ ID NO: 1242013 - DNA, 14 bp, Homo sapiens
ttagtatttttact

SEQ ID NO: 1242014 - DNA, 14 bp, Homo sapiens
ttagtcacttaaaa

SEQ ID NO: 1242015 - DNA, 23 bp, Homo sapiens
ttagtcatccaacaagaagaaat

SEQ ID NO: 1242016 - DNA, 14 bp, Homo sapiens
ttagtcatgtgacc

SEQ ID NO: 1242017 - DNA, 19 bp, Homo sapiens
ttagtcatgtttatctgct

SEQ ID NO: 1242018 - DNA, 17 bp, Homo sapiens
ttagtccctcatgcaaa

SEQ ID NO: 1242019 - DNA, 12 bp, Homo sapiens
ttagtctcagtt

SEQ ID NO: 1242020 - DNA, 17 bp, Homo sapiens
ttagtctgcaaaatgag

SEQ ID NO: 1242021 - DNA, 16 bp, Homo sapiens
ttagtcttttgtaata

SEQ ID NO: 1242022 - DNA, 17 bp, Homo sapiens
ttagtcttttgtaatat

SEQ ID NO: 1242023 - DNA, 17 bp, Homo sapiens
ttagtgaaaattctgtt

SEQ ID NO: 1242024 - DNA, 18 bp, Homo sapiens
ttagtgaaaattctgttg

SEQ ID NO: 1242025 - DNA, 12 bp, Homo sapiens
ttagtgaagatg

SEQ ID NO: 1242026 - DNA, 15 bp, Homo sapiens
ttagtgattctgatt

SEQ ID NO: 1242027 - DNA, 18 bp, Homo sapiens
ttagtgattctgatttca

SEQ ID NO: 1242028 - DNA, 18 bp, Homo sapiens
ttagtgccacttaatgta

SEQ ID NO: 1242029 - DNA, 19 bp, Homo sapiens
ttagtgccacttaatgtat

SEQ ID NO: 1242030 - DNA, 20 bp, Homo sapiens
ttagtgccggctgtggagca

SEQ ID NO: 1242031 - DNA, 14 bp, Homo sapiens
ttagtgcctgtgtg

SEQ ID NO: 1242032 - DNA, 15 bp, Homo sapiens
ttagtgctaaacaag

SEQ ID NO: 1242033 - DNA, 17 bp, Homo sapiens
ttagtgcttcagagttt

SEQ ID NO: 1242034 - DNA, 14 bp, Homo sapiens
ttagtgctttacat

SEQ ID NO: 1242035 - DNA, 16 bp, Homo sapiens
ttagtgctttacatgc

SEQ ID NO: 1242036 - DNA, 11 bp, Homo sapiens
ttagtggagcc

SEQ ID NO: 1242037 - DNA, 20 bp, Homo sapiens
ttagtggctcaacattgtgt

SEQ ID NO: 1242038 - DNA, 15 bp, Homo sapiens
ttagtgggccagggc

SEQ ID NO: 1242039 - DNA, 16 bp, Homo sapiens
ttagtggtatgtctct

SEQ ID NO: 1242040 - DNA, 21 bp, Homo sapiens
ttagtgtccccccttgaagca

SEQ ID NO: 1242041 - DNA, 11 bp, Homo sapiens
ttagtgtctgt

SEQ ID NO: 1242042 - DNA, 12 bp, Homo sapiens
ttagtgtgaaat

SEQ ID NO: 1242043 - DNA, 21 bp, Homo sapiens
ttagtgtgacagtttccaaat

SEQ ID NO: 1242044 - DNA, 23 bp, Homo sapiens
ttagtgtgagcatcttgccagcc

SEQ ID NO: 1242045 - DNA, 14 bp, Homo sapiens
ttagtgtgccttcc

SEQ ID NO: 1242046 - DNA, 12 bp, Homo sapiens
ttagttaatatt

SEQ ID NO: 1242047 - DNA, 12 bp, Homo sapiens
ttagttaatctc

SEQ ID NO: 1242048 - DNA, 18 bp, Homo sapiens
ttagttaatgagccatca

SEQ ID NO: 1242049 - DNA, 19 bp, Homo sapiens
ttagttaccttatagttac

SEQ ID NO: 1242050 - DNA, 18 bp, Homo sapiens
ttagttatagtttcagat

SEQ ID NO: 1242051 - DNA, 22 bp, Homo sapiens
ttagttatagtttcagatatat

SEQ ID NO: 1242052 - DNA, 15 bp, Homo sapiens
ttagttcaatacagt

SEQ ID NO: 1242053 - DNA, 23 bp, Homo sapiens
ttagttccccaaatacaaagtta

SEQ ID NO: 1242054 - DNA, 14 bp, Homo sapiens
ttagttccttgagt

SEQ ID NO: 1242055 - DNA, 13 bp, Homo sapiens
ttagttctgttga

SEQ ID NO: 1242056 - DNA, 12 bp, Homo sapiens
ttagttcttgaa

SEQ ID NO: 1242057 - DNA, 15 bp, Homo sapiens
ttagttcttgaattg

SEQ ID NO: 1242058 - DNA, 12 bp, Homo sapiens
ttagttggaatg

SEQ ID NO: 1242059 - DNA, 16 bp, Homo sapiens
ttagttggacagttta

SEQ ID NO: 1242060 - DNA, 15 bp, Homo sapiens
ttagttggcatttgt

SEQ ID NO: 1242061 - DNA, 16 bp, Homo sapiens
ttagttggcatttgtt

SEQ ID NO: 1242062 - DNA, 17 bp, Homo sapiens
ttagttggctggaaact

SEQ ID NO: 1242063 - DNA, 19 bp, Homo sapiens
ttagttggctttcataaat

SEQ ID NO: 1242064 - DNA, 21 bp, Homo sapiens
ttagtttagtgtgtgtgcaga

SEQ ID NO: 1242065 - DNA, 20 bp, Homo sapiens
ttagtttcaagagtctaaac

SEQ ID NO: 1242066 - DNA, 20 bp, Homo sapiens
ttagtttcctttttaatatg

SEQ ID NO: 1242067 - DNA, 16 bp, Homo sapiens
ttagtttgatcagaca

SEQ ID NO: 1242068 - DNA, 15 bp, Homo sapiens
ttagtttgtgtgttg

SEQ ID NO: 1242069 - DNA, 20 bp, Homo sapiens
ttagttttagaggcattgtt

SEQ ID NO: 1242070 - DNA, 15 bp, Homo sapiens
ttagttttgtaactt

SEQ ID NO: 1242071 - DNA, 17 bp, Homo sapiens
ttagtttttgtaattta

SEQ ID NO: 1242072 - DNA, 17 bp, Homo sapiens
ttataaaaaatggttca

SEQ ID NO: 1242073 - DNA, 14 bp, Homo sapiens
ttataaaaatataa

SEQ ID NO: 1242074 - DNA, 17 bp, Homo sapiens
ttataaaaatataaatt

SEQ ID NO: 1242075 - DNA, 13 bp, Homo sapiens
ttataaaaatatt

SEQ ID NO: 1242076 - DNA, 16 bp, Homo sapiens
ttataaaaatattaag

SEQ ID NO: 1242077 - DNA, 23 bp, Homo sapiens
ttataaaacaatgacttttaaag

SEQ ID NO: 1242078 - DNA, 12 bp, Homo sapiens
ttataaaacttc

SEQ ID NO: 1242079 - DNA, 23 bp, Homo sapiens
ttataaaagaataaaattgcact

SEQ ID NO: 1242080 - DNA, 22 bp, Homo sapiens
ttataaaagggggtccgtggaa

SEQ ID NO: 1242081 - DNA, 15 bp, Homo sapiens
ttataaaagtgaata

SEQ ID NO: 1242082 - DNA, 22 bp, Homo sapiens
ttataaaataacatgctgccat

SEQ ID NO: 1242083 - DNA, 16 bp, Homo sapiens
ttataaaatcaagttt

SEQ ID NO: 1242084 - DNA, 19 bp, Homo sapiens
ttataaaatgtataaatta

SEQ ID NO: 1242085 - DNA, 18 bp, Homo sapiens
ttataaaattttgctttt

SEQ ID NO: 1242086 - DNA, 20 bp, Homo sapiens
ttataaactatttttttctt

SEQ ID NO: 1242087 - DNA, 23 bp, Homo sapiens
ttataaactatttttttcttaaa

SEQ ID NO: 1242088 - DNA, 13 bp, Homo sapiens
ttataaactggga

SEQ ID NO: 1242089 - DNA, 23 bp, Homo sapiens
ttataaagaccgtacaaactcag

SEQ ID NO: 1242090 - DNA, 22 bp, Homo sapiens
ttataaagataaaatatcctca

SEQ ID NO: 1242091 - DNA, 19 bp, Homo sapiens
ttataaagtggaagtatgt

SEQ ID NO: 1242092 - DNA, 13 bp, Homo sapiens
ttataaattaaat

SEQ ID NO: 1242093 - DNA, 12 bp, Homo sapiens
ttataaatttcg

SEQ ID NO: 1242094 - DNA, 17 bp, Homo sapiens
ttataaatttctatttt

SEQ ID NO: 1242095 - DNA, 19 bp, Homo sapiens
ttataaccttaatttatta

SEQ ID NO: 1242096 - DNA, 18 bp, Homo sapiens
ttataactctgtataata

SEQ ID NO: 1242097 - DNA, 18 bp, Homo sapiens
ttataactgaaggagaag

SEQ ID NO: 1242098 - DNA, 17 bp, Homo sapiens
ttataactgtaaagatg

SEQ ID NO: 1242099 - DNA, 18 bp, Homo sapiens
ttataactgtaaagatgt

SEQ ID NO: 1242100 - DNA, 14 bp, Homo sapiens
ttataactgtttta

SEQ ID NO: 1242101 - DNA, 13 bp, Homo sapiens
ttataacttaaaa

SEQ ID NO: 1242102 - DNA, 17 bp, Homo sapiens
ttataacttaaaatatt

SEQ ID NO: 1242103 - DNA, 14 bp, Homo sapiens
ttataagaaaaact

SEQ ID NO: 1242104 - DNA, 14 bp, Homo sapiens
ttataagcagattt

SEQ ID NO: 1242105 - DNA, 20 bp, Homo sapiens
ttataagcgtatttagactg

SEQ ID NO: 1242106 - DNA, 13 bp, Homo sapiens
ttataaggaaact

SEQ ID NO: 1242107 - DNA, 13 bp, Homo sapiens
ttataagggccct

SEQ ID NO: 1242108 - DNA, 15 bp, Homo sapiens
ttataagggccctgc

SEQ ID NO: 1242109 - DNA, 18 bp, Homo sapiens
ttataagtagcaggccaa

SEQ ID NO: 1242110 - DNA, 18 bp, Homo sapiens
ttataagtcattgtatgt

SEQ ID NO: 1242111 - DNA, 20 bp, Homo sapiens
ttataataactgaactgttt

SEQ ID NO: 1242112 - DNA, 14 bp, Homo sapiens
ttataataggaatt

SEQ ID NO: 1242113 - DNA, 21 bp, Homo sapiens
ttataatataatatggaacct

SEQ ID NO: 1242114 - DNA, 20 bp, Homo sapiens
ttataatctcaaaggagaaa

SEQ ID NO: 1242115 - DNA, 18 bp, Homo sapiens
ttataatgaaatctgttt

SEQ ID NO: 1242116 - DNA, 18 bp, Homo sapiens
ttataatgtatttgaaaa

SEQ ID NO: 1242117 - DNA, 20 bp, Homo sapiens
ttataatgttgtatttaatt

SEQ ID NO: 1242118 - DNA, 16 bp, Homo sapiens
ttataattccttctgc

SEQ ID NO: 1242119 - DNA, 23 bp, Homo sapiens
ttataattggtgctatttgaaga

SEQ ID NO: 1242120 - DNA, 13 bp, Homo sapiens
ttataattgttta

SEQ ID NO: 1242121 - DNA, 12 bp, Homo sapiens
ttataatttaaa

SEQ ID NO: 1242122 - DNA, 14 bp, Homo sapiens
ttataattttccta

SEQ ID NO: 1242123 - DNA, 20 bp, Homo sapiens
ttataattttttttaaaata

SEQ ID NO: 1242124 - DNA, 19 bp, Homo sapiens
ttatacaaccttcatttaa

SEQ ID NO: 1242125 - DNA, 23 bp, Homo sapiens
ttatacaataacccagttacttt

SEQ ID NO: 1242126 - DNA, 15 bp, Homo sapiens
ttatacaatatcatc

SEQ ID NO: 1242127 - DNA, 18 bp, Homo sapiens
ttatacaatggaataaat

SEQ ID NO: 1242128 - DNA, 22 bp, Homo sapiens
ttatacaatttccatatagtct

SEQ ID NO: 1242129 - DNA, 16 bp, Homo sapiens
ttatacacaactttgc

SEQ ID NO: 1242130 - DNA, 20 bp, Homo sapiens
ttatacactgtgtaaatacc

SEQ ID NO: 1242131 - DNA, 13 bp, Homo sapiens
ttatacagctgta

SEQ ID NO: 1242132 - DNA, 18 bp, Homo sapiens
ttataccagatgaacatt

SEQ ID NO: 1242133 - DNA, 13 bp, Homo sapiens
ttataccagctta

SEQ ID NO: 1242134 - DNA, 15 bp, Homo sapiens
ttatatatttataac

SEQ ID NO: 1242135 - DNA, 14 bp, Homo sapiens
ttatatatttctaa

SEQ ID NO: 1242136 - DNA, 20 bp, Homo sapiens
ttatatattttcatcctata

SEQ ID NO: 1242137 - DNA, 21 bp, Homo sapiens
ttatatcaaatgccttcatga

SEQ ID NO: 1242138 - DNA, 13 bp, Homo sapiens
ttatatcagcttt

SEQ ID NO: 1242139 - DNA, 19 bp, Homo sapiens
ttatatcagtcctctttca

SEQ ID NO: 1242140 - DNA, 19 bp, Homo sapiens
ttatatcatacagttttca

SEQ ID NO: 1242141 - DNA, 16 bp, Homo sapiens
ttatatcatatgtata

SEQ ID NO: 1242142 - DNA, 14 bp, Homo sapiens
ttatatcatgcaaa

SEQ ID NO: 1242143 - DNA, 12 bp, Homo sapiens
ttatatcttttg

SEQ ID NO: 1242144 - DNA, 19 bp, Homo sapiens
ttatatgaagaaaatcact

SEQ ID NO: 1242145 - DNA, 12 bp, Homo sapiens
ttatatgaagtt

SEQ ID NO: 1242146 - DNA, 15 bp, Homo sapiens
ttatatgatattctt

SEQ ID NO: 1242147 - DNA, 16 bp, Homo sapiens
ttatatgatattcttt

SEQ ID NO: 1242148 - DNA, 13 bp, Homo sapiens
ttatatgctaatt

SEQ ID NO: 1242149 - DNA, 22 bp, Homo sapiens
ttatatgcttcacatagcatgt

SEQ ID NO: 1242150 - DNA, 18 bp, Homo sapiens
ttatatgttcatattgga

SEQ ID NO: 1242151 - DNA, 16 bp, Homo sapiens
ttatattaaagtaaat

SEQ ID NO: 1242152 - DNA, 15 bp, Homo sapiens
ttatattactctcat

SEQ ID NO: 1242153 - DNA, 20 bp, Homo sapiens
ttatattacttttgtaaata

SEQ ID NO: 1242154 - DNA, 17 bp, Homo sapiens
ttatattagtgaagatg

SEQ ID NO: 1242155 - DNA, 16 bp, Homo sapiens
ttatattattccaaag

SEQ ID NO: 1242156 - DNA, 13 bp, Homo sapiens
ttatattccactt

SEQ ID NO: 1242157 - DNA, 23 bp, Homo sapiens
ttatattctcttatgatacttga

SEQ ID NO: 1242158 - DNA, 15 bp, Homo sapiens
ttatattgaagacaa

SEQ ID NO: 1242159 - DNA, 16 bp, Homo sapiens
ttatattgaagacaat

SEQ ID NO: 1242160 - DNA, 22 bp, Homo sapiens
ttatattgaagacaatttgata

SEQ ID NO: 1242161 - DNA, 14 bp, Homo sapiens
ttatattgtaagaa

SEQ ID NO: 1242162 - DNA, 16 bp, Homo sapiens
ttatattgtaagaaat

SEQ ID NO: 1242163 - DNA, 22 bp, Homo sapiens
ttatattgtaagaaatactgta

SEQ ID NO: 1242164 - DNA, 21 bp, Homo sapiens
ttatattgtatattctggaaa

SEQ ID NO: 1242165 - DNA, 18 bp, Homo sapiens
ttatatttaaaaattgtt

SEQ ID NO: 1242166 - DNA, 19 bp, Homo sapiens
ttatatttaaaaattgttt

SEQ ID NO: 1242167 - DNA, 13 bp, Homo sapiens
ttatatttaactc

SEQ ID NO: 1242168 - DNA, 11 bp, Homo sapiens
ttatatttaat

SEQ ID NO: 1242169 - DNA, 18 bp, Homo sapiens
ttatatttagttatagtt

SEQ ID NO: 1242170 - DNA, 19 bp, Homo sapiens
ttatatttatatttcaggt

SEQ ID NO: 1242171 - DNA, 18 bp, Homo sapiens
ttatatttatgtgtctgt

SEQ ID NO: 1242172 - DNA, 15 bp, Homo sapiens
ttatatttcagatgt

SEQ ID NO: 1242173 - DNA, 13 bp, Homo sapiens
ttatatttccttt

SEQ ID NO: 1242174 - DNA, 16 bp, Homo sapiens
ttatatttcctttatg

SEQ ID NO: 1242175 - DNA, 22 bp, Homo sapiens
ttatatttcctttatgtgaatt

SEQ ID NO: 1242176 - DNA, 14 bp, Homo sapiens
ttatatttctgtgt

SEQ ID NO: 1242177 - DNA, 15 bp, Homo sapiens
ttatatttctgtgta

SEQ ID NO: 1242178 - DNA, 22 bp, Homo sapiens
ttatatttgcattatgtattta

SEQ ID NO: 1242179 - DNA, 13 bp, Homo sapiens
ttatatttggaaa

SEQ ID NO: 1242180 - DNA, 14 bp, Homo sapiens
ttatatttggaaag

SEQ ID NO: 1242181 - DNA, 19 bp, Homo sapiens
ttatatttggaaagagacc

SEQ ID NO: 1242182 - DNA, 23 bp, Homo sapiens
ttatattttatgaacattgtact

SEQ ID NO: 1242183 - DNA, 17 bp, Homo sapiens
ttatattttgaaagaag

SEQ ID NO: 1242184 - DNA, 22 bp, Homo sapiens
ttatatttttgtacatattgtt

SEQ ID NO: 1242185 - DNA, 19 bp, Homo sapiens
ttatattttttgtctgttt

SEQ ID NO: 1242186 - DNA, 22 bp, Homo sapiens
ttatcaaaaagctaatgtgcag

SEQ ID NO: 1242187 - DNA, 16 bp, Homo sapiens
ttatcaaaactttctt

SEQ ID NO: 1242188 - DNA, 19 bp, Homo sapiens
ttatcaaaccctagccttg

SEQ ID NO: 1242189 - DNA, 15 bp, Homo sapiens
ttatcaacaatagtg

SEQ ID NO: 1242190 - DNA, 18 bp, Homo sapiens
ttatcaaccaactgcaca

SEQ ID NO: 1242191 - DNA, 12 bp, Homo sapiens
ttatcaacttta

SEQ ID NO: 1242192 - DNA, 14 bp, Homo sapiens
ttatcaagtgtctt

SEQ ID NO: 1242193 - DNA, 20 bp, Homo sapiens
ttatcaatgtgtctttctaa

SEQ ID NO: 1242194 - DNA, 18 bp, Homo sapiens
ttatcaattatattatgt

SEQ ID NO: 1242195 - DNA, 18 bp, Homo sapiens
ttatcaatttttcccagt

SEQ ID NO: 1242196 - DNA, 19 bp, Homo sapiens
ttatcaatttttcccagta

SEQ ID NO: 1242197 - DNA, 18 bp, Homo sapiens
ttatcacataagagagat

SEQ ID NO: 1242198 - DNA, 22 bp, Homo sapiens
ttatcacataagagagatgaga

SEQ ID NO: 1242199 - DNA, 17 bp, Homo sapiens
ttatcaccagctgcctc

SEQ ID NO: 1242200 - DNA, 18 bp, Homo sapiens
ttatcaccgtgggctccc

SEQ ID NO: 1242201 - DNA, 21 bp, Homo sapiens
ttatcaccgtgggctccctga

SEQ ID NO: 1242202 - DNA, 18 bp, Homo sapiens
ttatcacctcattctgaa

SEQ ID NO: 1242203 - DNA, 18 bp, Homo sapiens
ttatcactgacacaaaaa

SEQ ID NO: 1242204 - DNA, 16 bp, Homo sapiens
ttatcactttaagttt

SEQ ID NO: 1242205 - DNA, 17 bp, Homo sapiens
ttatcagatacatcact

SEQ ID NO: 1242206 - DNA, 14 bp, Homo sapiens
ttatcagtcaatat

SEQ ID NO: 1242207 - DNA, 19 bp, Homo sapiens
ttatcagtttgctaatgtt

SEQ ID NO: 1242208 - DNA, 17 bp, Homo sapiens
ttatcatatccttgccc

SEQ ID NO: 1242209 - DNA, 19 bp, Homo sapiens
ttatcatgacatgttatat

SEQ ID NO: 1242210 - DNA, 11 bp, Homo sapiens
ttatcatgcaa

SEQ ID NO: 1242211 - DNA, 16 bp, Homo sapiens
ttatcattaaaaatta

SEQ ID NO: 1242212 - DNA, 18 bp, Homo sapiens
ttatcattcaagtgtaaa

SEQ ID NO: 1242213 - DNA, 12 bp, Homo sapiens
ttatcattttca

SEQ ID NO: 1242214 - DNA, 19 bp, Homo sapiens
ttatcatttttgtataaaa

SEQ ID NO: 1242215 - DNA, 14 bp, Homo sapiens
ttatccaaatcttg

SEQ ID NO: 1242216 - DNA, 15 bp, Homo sapiens
ttatccaataaaaaa

SEQ ID NO: 1242217 - DNA, 20 bp, Homo sapiens
ttatccaattcaaaaataaa

SEQ ID NO: 1242218 - DNA, 20 bp, Homo sapiens
ttatccacttttcttcttcc

SEQ ID NO: 1242219 - DNA, 19 bp, Homo sapiens
ttatccattacgtgcattt

SEQ ID NO: 1242220 - DNA, 21 bp, Homo sapiens
ttatccattacgtgcatttaa

SEQ ID NO: 1242221 - DNA, 23 bp, Homo sapiens
ttatcccaaagttgttgtaacct

SEQ ID NO: 1242222 - DNA, 20 bp, Homo sapiens
ttatcccaagaccctgcccc

SEQ ID NO: 1242223 - DNA, 21 bp, Homo sapiens
ttatcccatttagtgtgaata

SEQ ID NO: 1242224 - DNA, 19 bp, Homo sapiens
ttatcctaaaacaaatagt

SEQ ID NO: 1242225 - DNA, 18 bp, Homo sapiens
ttatcctacagtacaatc

SEQ ID NO: 1242226 - DNA, 16 bp, Homo sapiens
ttatcctccaccgtct

SEQ ID NO: 1242227 - DNA, 20 bp, Homo sapiens
ttatcctcctgttctgaaac

SEQ ID NO: 1242228 - DNA, 17 bp, Homo sapiens
ttatcctgaaatttcag

SEQ ID NO: 1242229 - DNA, 22 bp, Homo sapiens
ttatcctgaactcttctgcaaa

SEQ ID NO: 1242230 - DNA, 21 bp, Homo sapiens
ttatcctgacatattcaagtg

SEQ ID NO: 1242231 - DNA, 16 bp, Homo sapiens
ttatcctgtattcttg

SEQ ID NO: 1242232 - DNA, 22 bp, Homo sapiens
ttatccttaggaaaatgcttct

SEQ ID NO: 1242233 - DNA, 15 bp, Homo sapiens
ttatcctttcatata

SEQ ID NO: 1242234 - DNA, 22 bp, Homo sapiens
ttatcctttcattaggcaaagt

SEQ ID NO: 1242235 - DNA, 13 bp, Homo sapiens
ttatcctttgtga

SEQ ID NO: 1242236 - DNA, 14 bp, Homo sapiens
ttatcgctttatgt

SEQ ID NO: 1242237 - DNA, 21 bp, Homo sapiens
ttatcgggagcagtgtcttcc

SEQ ID NO: 1242238 - DNA, 18 bp, Homo sapiens
ttatcgttttcttaaagt

SEQ ID NO: 1242239 - DNA, 15 bp, Homo sapiens
ttatctaaaagaaat

SEQ ID NO: 1242240 - DNA, 18 bp, Homo sapiens
ttatctaaatgaatgagc

SEQ ID NO: 1242241 - DNA, 15 bp, Homo sapiens
ttatctacctgttct

SEQ ID NO: 1242242 - DNA, 20 bp, Homo sapiens
ttatctacttccaaactaat

SEQ ID NO: 1242243 - DNA, 23 bp, Homo sapiens
ttatctagaaagaaaagaccctg

SEQ ID NO: 1242244 - DNA, 16 bp, Homo sapiens
ttatctagatactgta

SEQ ID NO: 1242245 - DNA, 17 bp, Homo sapiens
ttatctagatactgtat

SEQ ID NO: 1242246 - DNA, 19 bp, Homo sapiens
ttatctatacatatcttta

SEQ ID NO: 1242247 - DNA, 13 bp, Homo sapiens
ttatctatataaa

SEQ ID NO: 1242248 - DNA, 15 bp, Homo sapiens
ttatctatataaaat

SEQ ID NO: 1242249 - DNA, 16 bp, Homo sapiens
ttatctatgcagcatg

SEQ ID NO: 1242250 - DNA, 17 bp, Homo sapiens
ttatctatggaaatgtg

SEQ ID NO: 1242251 - DNA, 15 bp, Homo sapiens
ttatctatgtggaaa

SEQ ID NO: 1242252 - DNA, 22 bp, Homo sapiens
ttatctcagatgttaaaataaa

SEQ ID NO: 1242253 - DNA, 15 bp, Homo sapiens
ttatctctatttaat

SEQ ID NO: 1242254 - DNA, 19 bp, Homo sapiens
ttatctctatttaatattt

SEQ ID NO: 1242255 - DNA, 12 bp, Homo sapiens
ttatctctgtgt

SEQ ID NO: 1242256 - DNA, 17 bp, Homo sapiens
ttatctgaatttttaaa

SEQ ID NO: 1242257 - DNA, 21 bp, Homo sapiens
ttatctgaatttttaaacaag

SEQ ID NO: 1242258 - DNA, 16 bp, Homo sapiens
ttatctgatctgtgat

SEQ ID NO: 1242259 - DNA, 12 bp, Homo sapiens
ttatctgcctgg

SEQ ID NO: 1242260 - DNA, 16 bp, Homo sapiens
ttatctgcctggcctg

SEQ ID NO: 1242261 - DNA, 18 bp, Homo sapiens
ttatctgcctggcctggc

SEQ ID NO: 1242262 - DNA, 20 bp, Homo sapiens
ttatctgcctggcctggctc

SEQ ID NO: 1242263 - DNA, 19 bp, Homo sapiens
ttatctggaacaacttgta

SEQ ID NO: 1242264 - DNA, 22 bp, Homo sapiens
ttatctggaagatctgcaaaca

SEQ ID NO: 1242265 - DNA, 12 bp, Homo sapiens
ttatctgtcaca

SEQ ID NO: 1242266 - DNA, 22 bp, Homo sapiens
ttatctgtttcctgacattgtc

SEQ ID NO: 1242267 - DNA, 12 bp, Homo sapiens
ttatcttacatt

SEQ ID NO: 1242268 - DNA, 12 bp, Homo sapiens
ttatcttagctg

SEQ ID NO: 1242269 - DNA, 22 bp, Homo sapiens
ttatcttatactgtacaataaa

SEQ ID NO: 1242270 - DNA, 21 bp, Homo sapiens
ttatcttatgaaaaccaaatt

SEQ ID NO: 1242271 - DNA, 17 bp, Homo sapiens
ttatcttgaagtcagcc

SEQ ID NO: 1242272 - DNA, 16 bp, Homo sapiens
ttatcttgatacattc

SEQ ID NO: 1242273 - DNA, 17 bp, Homo sapiens
ttatcttggactgacat

SEQ ID NO: 1242274 - DNA, 14 bp, Homo sapiens
ttatcttgggactg

SEQ ID NO: 1242275 - DNA, 19 bp, Homo sapiens
ttatcttgggactgggttt

SEQ ID NO: 1242276 - DNA, 17 bp, Homo sapiens
ttatcttggttgaaaat

SEQ ID NO: 1242277 - DNA, 23 bp, Homo sapiens
ttatctttaccaaaaaccatgtt

SEQ ID NO: 1242278 - DNA, 17 bp, Homo sapiens
ttatctttatacagatt

SEQ ID NO: 1242279 - DNA, 23 bp, Homo sapiens
ttatctttccatgggagccagct

SEQ ID NO: 1242280 - DNA, 18 bp, Homo sapiens
ttatctttttaaaaactc

SEQ ID NO: 1242281 - DNA, 23 bp, Homo sapiens
ttatgaaaaaatatgaacctatt

SEQ ID NO: 1242282 - DNA, 16 bp, Homo sapiens
ttatgaaaaacatccc

SEQ ID NO: 1242283 - DNA, 23 bp, Homo sapiens
ttatgaaaaacatcccaaacttt

SEQ ID NO: 1242284 - DNA, 18 bp, Homo sapiens
ttatgaaaggtttacatt

SEQ ID NO: 1242285 - DNA, 20 bp, Homo sapiens
ttatgaaataaagaaattgc

SEQ ID NO: 1242286 - DNA, 13 bp, Homo sapiens
ttatgaaatctca

SEQ ID NO: 1242287 - DNA, 11 bp, Homo sapiens
ttatgaacagc

SEQ ID NO: 1242288 - DNA, 14 bp, Homo sapiens
ttatgaacattgta

SEQ ID NO: 1242289 - DNA, 15 bp, Homo sapiens
ttatgaacattgtac

SEQ ID NO: 1242290 - DNA, 16 bp, Homo sapiens
ttatgaacattgtact

SEQ ID NO: 1242291 - DNA, 19 bp, Homo sapiens
ttatgaacattgtactgtt

SEQ ID NO: 1242292 - DNA, 21 bp, Homo sapiens
ttatgaacattgtactgttgc

SEQ ID NO: 1242293 - DNA, 20 bp, Homo sapiens
ttatgaagtgcgtgaatgta

SEQ ID NO: 1242294 - DNA, 16 bp, Homo sapiens
ttatgaatatcattga

SEQ ID NO: 1242295 - DNA, 22 bp, Homo sapiens
ttatgaatatttataacagcat

SEQ ID NO: 1242296 - DNA, 14 bp, Homo sapiens
ttatgaatgaaaaa

SEQ ID NO: 1242297 - DNA, 19 bp, Homo sapiens
ttatgaattataaatgtgt

SEQ ID NO: 1242298 - DNA, 16 bp, Homo sapiens
ttatgacatcacttgt

SEQ ID NO: 1242299 - DNA, 21 bp, Homo sapiens
ttatgacatcacttgtacaaa

SEQ ID NO: 1242300 - DNA, 23 bp, Homo sapiens
ttatgacatcacttgtacaaaat

SEQ ID NO: 1242301 - DNA, 18 bp, Homo sapiens
ttatgacctaagtcaggt

SEQ ID NO: 1242302 - DNA, 18 bp, Homo sapiens
ttatgagatctaatgtga

SEQ ID NO: 1242303 - DNA, 22 bp, Homo sapiens
ttatgagatctaatgtgaaaat

SEQ ID NO: 1242304 - DNA, 20 bp, Homo sapiens
ttatgagcgtcactgcccac

SEQ ID NO: 1242305 - DNA, 21 bp, Homo sapiens
ttatgaggaaagcgtttctgt

SEQ ID NO: 1242306 - DNA, 19 bp, Homo sapiens
ttatgagttattcatattc

SEQ ID NO: 1242307 - DNA, 16 bp, Homo sapiens
ttatgagtttgccctc

SEQ ID NO: 1242308 - DNA, 13 bp, Homo sapiens
ttatgagtttttg

SEQ ID NO: 1242309 - DNA, 15 bp, Homo sapiens
ttatgagtttttgat

SEQ ID NO: 1242310 - DNA, 22 bp, Homo sapiens
ttatgatagcaaatggcctcat

SEQ ID NO: 1242311 - DNA, 18 bp, Homo sapiens
ttatgatagtggtatgac

SEQ ID NO: 1242312 - DNA, 19 bp, Homo sapiens
ttatgatattgtttaaaat

SEQ ID NO: 1242313 - DNA, 18 bp, Homo sapiens
ttatgatgcatacagttt

SEQ ID NO: 1242314 - DNA, 21 bp, Homo sapiens
ttatgatgcatacagttttct

SEQ ID NO: 1242315 - DNA, 13 bp, Homo sapiens
ttatgatgctaag

SEQ ID NO: 1242316 - DNA, 19 bp, Homo sapiens
ttatgattgcattgtatga

SEQ ID NO: 1242317 - DNA, 13 bp, Homo sapiens
ttatgcaaaagca

SEQ ID NO: 1242318 - DNA, 22 bp, Homo sapiens
ttatgcaaaagcagctaaatgt

SEQ ID NO: 1242319 - DNA, 22 bp, Homo sapiens
ttatgcaaggaaggaaagaaag

SEQ ID NO: 1242320 - DNA, 13 bp, Homo sapiens
ttatgcaagtcat

SEQ ID NO: 1242321 - DNA, 23 bp, Homo sapiens
ttatgcaattaggtttttcctta

SEQ ID NO: 1242322 - DNA, 11 bp, Homo sapiens
ttatgcacagc

SEQ ID NO: 1242323 - DNA, 20 bp, Homo sapiens
ttatgcacttttagaaatgc

SEQ ID NO: 1242324 - DNA, 22 bp, Homo sapiens
ttatgccaaatgttaactgcca

SEQ ID NO: 1242325 - DNA, 23 bp, Homo sapiens
ttatgccacccccgctggaggat

SEQ ID NO: 1242326 - DNA, 16 bp, Homo sapiens
ttatgcggttaatttt

SEQ ID NO: 1242327 - DNA, 24 bp, Homo sapiens
ttatgctgtattttaacactttgt

SEQ ID NO: 1242328 - DNA, 17 bp, Homo sapiens
ttatgctgtgacacatg

SEQ ID NO: 1242329 - DNA, 23 bp, Homo sapiens
ttatgcttgtgtatatgtataaa

SEQ ID NO: 1242330 - DNA, 22 bp, Homo sapiens
ttatggaaaaattgacaaaaaa

SEQ ID NO: 1242331 - DNA, 22 bp, Homo sapiens
ttatggaagattttaaattcac

SEQ ID NO: 1242332 - DNA, 23 bp, Homo sapiens
ttatggaattgatttgcattgaa

SEQ ID NO: 1242333 - DNA, 21 bp, Homo sapiens
ttatggagtcttgtgccaaac

SEQ ID NO: 1242334 - DNA, 15 bp, Homo sapiens
ttatggattaaaaac

SEQ ID NO: 1242335 - DNA, 14 bp, Homo sapiens
ttatggcaagtgat

SEQ ID NO: 1242336 - DNA, 16 bp, Homo sapiens
ttatggcagaagggaa

SEQ ID NO: 1242337 - DNA, 13 bp, Homo sapiens
ttatggcatgatt

SEQ ID NO: 1242338 - DNA, 16 bp, Homo sapiens
ttatggccgggcaggg

SEQ ID NO: 1242339 - DNA, 12 bp, Homo sapiens
ttatggcctcag

SEQ ID NO: 1242340 - DNA, 13 bp, Homo sapiens
ttatggcctcagc

SEQ ID NO: 1242341 - DNA, 18 bp, Homo sapiens
ttatggcctcagctgcct

SEQ ID NO: 1242342 - DNA, 20 bp, Homo sapiens
ttatggcgtttttctcgtcc

SEQ ID NO: 1242343 - DNA, 16 bp, Homo sapiens
ttatggctgctgggct

SEQ ID NO: 1242344 - DNA, 18 bp, Homo sapiens
ttatgggatgtaaacaat

SEQ ID NO: 1242345 - DNA, 14 bp, Homo sapiens
ttatgggtggcttt

SEQ ID NO: 1242346 - DNA, 21 bp, Homo sapiens
ttatggtttctgtctgaatta

SEQ ID NO: 1242347 - DNA, 12 bp, Homo sapiens
ttatgtaaagta

SEQ ID NO: 1242348 - DNA, 13 bp, Homo sapiens
ttatgtaaagtat

SEQ ID NO: 1242349 - DNA, 18 bp, Homo sapiens
ttatgtaagagcaccttc

SEQ ID NO: 1242350 - DNA, 13 bp, Homo sapiens
ttatgtaatttgt

SEQ ID NO: 1242351 - DNA, 11 bp, Homo sapiens
ttatgtacaaa

SEQ ID NO: 1242352 - DNA, 12 bp, Homo sapiens
ttatgtacaaac

SEQ ID NO: 1242353 - DNA, 14 bp, Homo sapiens
ttatgtacaaacta

SEQ ID NO: 1242354 - DNA, 11 bp, Homo sapiens
ttatgtacaac

SEQ ID NO: 1242355 - DNA, 13 bp, Homo sapiens
ttatgtacaaccc

SEQ ID NO: 1242356 - DNA, 17 bp, Homo sapiens
ttatgtacagaaaacat

SEQ ID NO: 1242357 - DNA, 19 bp, Homo sapiens
ttatgtagtttcttgtctt

SEQ ID NO: 1242358 - DNA, 17 bp, Homo sapiens
ttatgtatcagaagaga

SEQ ID NO: 1242359 - DNA, 21 bp, Homo sapiens
ttatgtatcagctctctgctg

SEQ ID NO: 1242360 - DNA, 19 bp, Homo sapiens
ttatgtatttcctggatgt

SEQ ID NO: 1242361 - DNA, 20 bp, Homo sapiens
ttatgtatttcctggatgtt

SEQ ID NO: 1242362 - DNA, 17 bp, Homo sapiens
ttatgtccactgtgtat

SEQ ID NO: 1242363 - DNA, 21 bp, Homo sapiens
ttatgtctgctgaataataaa

SEQ ID NO: 1242364 - DNA, 17 bp, Homo sapiens
ttatgtctgtggatttt

SEQ ID NO: 1242365 - DNA, 21 bp, Homo sapiens
ttatgtcttttgatgaataga

SEQ ID NO: 1242366 - DNA, 13 bp, Homo sapiens
ttatgtgaaaaat

SEQ ID NO: 1242367 - DNA, 20 bp, Homo sapiens
ttatgtgaaatgcttatgct

SEQ ID NO: 1242368 - DNA, 20 bp, Homo sapiens
ttatgtgaatttttaagctg

SEQ ID NO: 1242369 - DNA, 14 bp, Homo sapiens
ttatgtgacatttt

SEQ ID NO: 1242370 - DNA, 20 bp, Homo sapiens
ttatgtgatgccaaagatgt

SEQ ID NO: 1242371 - DNA, 15 bp, Homo sapiens
ttatgtgctattaat

SEQ ID NO: 1242372 - DNA, 21 bp, Homo sapiens
ttatgtggcttgtttatcctt

SEQ ID NO: 1242373 - DNA, 13 bp, Homo sapiens
ttatgtggtctta

SEQ ID NO: 1242374 - DNA, 12 bp, Homo sapiens
ttatgtgttaca

SEQ ID NO: 1242375 - DNA, 13 bp, Homo sapiens
ttatgtgttacat

SEQ ID NO: 1242376 - DNA, 20 bp, Homo sapiens
ttatgtgttacattattcca

SEQ ID NO: 1242377 - DNA, 14 bp, Homo sapiens
ttatgtgttatgaa

SEQ ID NO: 1242378 - DNA, 21 bp, Homo sapiens
ttatgtgtttggatacatctg

SEQ ID NO: 1242379 - DNA, 23 bp, Homo sapiens
ttatgtgtttggatacatctgct

SEQ ID NO: 1242380 - DNA, 15 bp, Homo sapiens
ttatgttacatctgt

SEQ ID NO: 1242381 - DNA, 18 bp, Homo sapiens
ttatgttcagaaatgtaa

SEQ ID NO: 1242382 - DNA, 19 bp, Homo sapiens
ttatgttgtttataataaa

SEQ ID NO: 1242383 - DNA, 18 bp, Homo sapiens
ttatgtttaaaagaaata

SEQ ID NO: 1242384 - DNA, 20 bp, Homo sapiens
ttatgtttgccactttgcaa

SEQ ID NO: 1242385 - DNA, 16 bp, Homo sapiens
ttatgttttctttctc

SEQ ID NO: 1242386 - DNA, 15 bp, Homo sapiens
ttatgttttgtttct

SEQ ID NO: 1242387 - DNA, 16 bp, Homo sapiens
ttatgttttgtttctg

SEQ ID NO: 1242388 - DNA, 22 bp, Homo sapiens
ttatgttttttaaaatatttat

SEQ ID NO: 1242389 - DNA, 23 bp, Homo sapiens
ttattaaaaatctcaaatttcta

SEQ ID NO: 1242390 - DNA, 16 bp, Homo sapiens
ttattaaaatcttaaa

SEQ ID NO: 1242391 - DNA, 19 bp, Homo sapiens
ttattaaaatgattgtaaa

SEQ ID NO: 1242392 - DNA, 11 bp, Homo sapiens
ttattaaatag

SEQ ID NO: 1242393 - DNA, 15 bp, Homo sapiens
ttattaaatgcttca

SEQ ID NO: 1242394 - DNA, 24 bp, Homo sapiens
ttattaaatgtagcttcagtcatt

SEQ ID NO: 1242395 - DNA, 17 bp, Homo sapiens
ttattaaattgtaaaac

SEQ ID NO: 1242396 - DNA, 19 bp, Homo sapiens
ttattaacaaattatgtta

SEQ ID NO: 1242397 - DNA, 21 bp, Homo sapiens
ttattaactaatatgggcatt

SEQ ID NO: 1242398 - DNA, 19 bp, Homo sapiens
ttattaagaggtaagactt

SEQ ID NO: 1242399 - DNA, 17 bp, Homo sapiens
ttattaagatggattct

SEQ ID NO: 1242400 - DNA, 19 bp, Homo sapiens
ttattaagatggattctca

SEQ ID NO: 1242401 - DNA, 20 bp, Homo sapiens
ttattaagatggattctcag

SEQ ID NO: 1242402 - DNA, 21 bp, Homo sapiens
ttattaagatggattctcaga

SEQ ID NO: 1242403 - DNA, 23 bp, Homo sapiens
ttattaagatggattctcagata

SEQ ID NO: 1242404 - DNA, 20 bp, Homo sapiens
ttattaagcagactggaaaa

SEQ ID NO: 1242405 - DNA, 20 bp, Homo sapiens
ttattaagccaggaaacatg

SEQ ID NO: 1242406 - DNA, 22 bp, Homo sapiens
ttattaagtctgggatgtagaa

SEQ ID NO: 1242407 - DNA, 17 bp, Homo sapiens
ttattaataatgaagta

SEQ ID NO: 1242408 - DNA, 18 bp, Homo sapiens
ttattaataccaaatatt

SEQ ID NO: 1242409 - DNA, 13 bp, Homo sapiens
ttattaatagaat

SEQ ID NO: 1242410 - DNA, 20 bp, Homo sapiens
ttattaatatgagttactga

SEQ ID NO: 1242411 - DNA, 13 bp, Homo sapiens
ttattaatgcact

SEQ ID NO: 1242412 - DNA, 17 bp, Homo sapiens
ttattaatgcactttct

SEQ ID NO: 1242413 - DNA, 14 bp, Homo sapiens
ttattaatgtttct

SEQ ID NO: 1242414 - DNA, 18 bp, Homo sapiens
ttattaatttttaaggat

SEQ ID NO: 1242415 - DNA, 17 bp, Homo sapiens
ttattacaaatgcaaat

SEQ ID NO: 1242416 - DNA, 17 bp, Homo sapiens
ttattacaagtggctcc

SEQ ID NO: 1242417 - DNA, 22 bp, Homo sapiens
ttattacaagtggctccccacc

SEQ ID NO: 1242418 - DNA, 12 bp, Homo sapiens
ttattacagtgt

SEQ ID NO: 1242419 - DNA, 13 bp, Homo sapiens
ttattacagtgtt

SEQ ID NO: 1242420 - DNA, 18 bp, Homo sapiens
ttattacatctttcacat

SEQ ID NO: 1242421 - DNA, 16 bp, Homo sapiens
ttattaccaaaacagg

SEQ ID NO: 1242422 - DNA, 19 bp, Homo sapiens
ttattaccccctccttcag

SEQ ID NO: 1242423 - DNA, 14 bp, Homo sapiens
ttattactaattct

SEQ ID NO: 1242424 - DNA, 19 bp, Homo sapiens
ttattactctacactgaaa

SEQ ID NO: 1242425 - DNA, 18 bp, Homo sapiens
ttattacttccatgaatt

SEQ ID NO: 1242426 - DNA, 22 bp, Homo sapiens
ttattacttctgtttgggagac

SEQ ID NO: 1242427 - DNA, 19 bp, Homo sapiens
ttattagaacattcacttt

SEQ ID NO: 1242428 - DNA, 20 bp, Homo sapiens
ttattagaatcaaacatttt

SEQ ID NO: 1242429 - DNA, 21 bp, Homo sapiens
ttattagaatcaaacattttg

SEQ ID NO: 1242430 - DNA, 19 bp, Homo sapiens
ttattagggagaaaattca

SEQ ID NO: 1242431 - DNA, 15 bp, Homo sapiens
ttattaggtcttaaa

SEQ ID NO: 1242432 - DNA, 20 bp, Homo sapiens
ttattagtaaatgcttatca

SEQ ID NO: 1242433 - DNA, 24 bp, Homo sapiens
ttattagtaccatagtaccattta

SEQ ID NO: 1242434 - DNA, 21 bp, Homo sapiens
ttattataatcttataattgt

SEQ ID NO: 1242435 - DNA, 22 bp, Homo sapiens
ttattataatcttataattgtt

SEQ ID NO: 1242436 - DNA, 22 bp, Homo sapiens
ttattatatatttacagaagaa

SEQ ID NO: 1242437 - DNA, 15 bp, Homo sapiens
ttattatgaaggaat

SEQ ID NO: 1242438 - DNA, 20 bp, Homo sapiens
ttattatgatgttagaagaa

SEQ ID NO: 1242439 - DNA, 14 bp, Homo sapiens
ttattattaaggta

SEQ ID NO: 1242440 - DNA, 13 bp, Homo sapiens
ttattattaataa

SEQ ID NO: 1242441 - DNA, 16 bp, Homo sapiens
ttattattttcacctg

SEQ ID NO: 1242442 - DNA, 13 bp, Homo sapiens
ttattcaaatgaa

SEQ ID NO: 1242443 - DNA, 13 bp, Homo sapiens
ttattcaacacat

SEQ ID NO: 1242444 - DNA, 19 bp, Homo sapiens
ttattcaagaatgaaaaat

SEQ ID NO: 1242445 - DNA, 18 bp, Homo sapiens
ttattcaattcctctggg

SEQ ID NO: 1242446 - DNA, 18 bp, Homo sapiens
ttattcaatttatttgaa

SEQ ID NO: 1242447 - DNA, 20 bp, Homo sapiens
ttattcaatttatttgaatg

SEQ ID NO: 1242448 - DNA, 23 bp, Homo sapiens
ttattcacaacctcaccaaacta

SEQ ID NO: 1242449 - DNA, 15 bp, Homo sapiens
ttattcactgtaagt

SEQ ID NO: 1242450 - DNA, 14 bp, Homo sapiens
ttattcagtgtcac

SEQ ID NO: 1242451 - DNA, 19 bp, Homo sapiens
ttattcattatttgtcaaa

SEQ ID NO: 1242452 - DNA, 12 bp, Homo sapiens
ttattcatttaa

SEQ ID NO: 1242453 - DNA, 16 bp, Homo sapiens
ttattcatttaaaatg

SEQ ID NO: 1242454 - DNA, 17 bp, Homo sapiens
ttattcatttaaaatga

SEQ ID NO: 1242455 - DNA, 20 bp, Homo sapiens
ttattccaaaccaaatttta

SEQ ID NO: 1242456 - DNA, 17 bp, Homo sapiens
ttattccagaatgctgt

SEQ ID NO: 1242457 - DNA, 22 bp, Homo sapiens
ttattccagaatgctgtacatc

SEQ ID NO: 1242458 - DNA, 14 bp, Homo sapiens
ttattccaggagaa

SEQ ID NO: 1242459 - DNA, 19 bp, Homo sapiens
ttattcccaagtatgcctt

SEQ ID NO: 1242460 - DNA, 21 bp, Homo sapiens
ttattcccaagtatgccttaa

SEQ ID NO: 1242461 - DNA, 15 bp, Homo sapiens
ttattccctcatcct

SEQ ID NO: 1242462 - DNA, 17 bp, Homo sapiens
ttattcctcagattgct

SEQ ID NO: 1242463 - DNA, 16 bp, Homo sapiens
ttattcctcctgctca

SEQ ID NO: 1242464 - DNA, 20 bp, Homo sapiens
ttattcctgataataattga

SEQ ID NO: 1242465 - DNA, 15 bp, Homo sapiens
ttattcctgtatgtt

SEQ ID NO: 1242466 - DNA, 16 bp, Homo sapiens
ttattcctttgaatat

SEQ ID NO: 1242467 - DNA, 17 bp, Homo sapiens
ttattcctttgaatatt

SEQ ID NO: 1242468 - DNA, 14 bp, Homo sapiens
ttattcgcccaccc

SEQ ID NO: 1242469 - DNA, 15 bp, Homo sapiens
ttattcgcccacccg

SEQ ID NO: 1242470 - DNA, 20 bp, Homo sapiens
ttattctaagccctttgcca

SEQ ID NO: 1242471 - DNA, 22 bp, Homo sapiens
ttattctgggcaccacaaaata

SEQ ID NO: 1242472 - DNA, 20 bp, Homo sapiens
ttattctgtagattctgtgg

SEQ ID NO: 1242473 - DNA, 11 bp, Homo sapiens
ttattctgtgg

SEQ ID NO: 1242474 - DNA, 16 bp, Homo sapiens
ttattctgtggttcta

SEQ ID NO: 1242475 - DNA, 18 bp, Homo sapiens
ttattctgtggttctata

SEQ ID NO: 1242476 - DNA, 12 bp, Homo sapiens
ttattctgttcc

SEQ ID NO: 1242477 - DNA, 15 bp, Homo sapiens
ttattcttccagaat

SEQ ID NO: 1242478 - DNA, 18 bp, Homo sapiens
ttattcttccagaatgct

SEQ ID NO: 1242479 - DNA, 12 bp, Homo sapiens
ttattcttctca

SEQ ID NO: 1242480 - DNA, 17 bp, Homo sapiens
ttattcttctcataaat

SEQ ID NO: 1242481 - DNA, 13 bp, Homo sapiens
ttattcttgctgg

SEQ ID NO: 1242482 - DNA, 15 bp, Homo sapiens
ttattctttactatt

SEQ ID NO: 1242483 - DNA, 13 bp, Homo sapiens
ttattctttttaa

SEQ ID NO: 1242484 - DNA, 16 bp, Homo sapiens
ttattctttttaaagt

SEQ ID NO: 1242485 - DNA, 22 bp, Homo sapiens
ttattgaaaggggacacctgta

SEQ ID NO: 1242486 - DNA, 17 bp, Homo sapiens
ttattgaattagaaaat

SEQ ID NO: 1242487 - DNA, 14 bp, Homo sapiens
ttattgacacagaa

SEQ ID NO: 1242488 - DNA, 11 bp, Homo sapiens
ttattgacact

SEQ ID NO: 1242489 - DNA, 14 bp, Homo sapiens
ttattgacactgaa

SEQ ID NO: 1242490 - DNA, 18 bp, Homo sapiens
ttattgagaaagagcact

SEQ ID NO: 1242491 - DNA, 13 bp, Homo sapiens
ttattgagaattt

SEQ ID NO: 1242492 - DNA, 19 bp, Homo sapiens
ttattgatattctaagaaa

SEQ ID NO: 1242493 - DNA, 15 bp, Homo sapiens
ttattgatcccacat

SEQ ID NO: 1242494 - DNA, 17 bp, Homo sapiens
ttattgcacattgttca

SEQ ID NO: 1242495 - DNA, 21 bp, Homo sapiens
ttattgcatatagatttagtt

SEQ ID NO: 1242496 - DNA, 15 bp, Homo sapiens
ttattgcctcccagg

SEQ ID NO: 1242497 - DNA, 18 bp, Homo sapiens
ttattgcctcccaggcaa

SEQ ID NO: 1242498 - DNA, 15 bp, Homo sapiens
ttattgcgctgctac

SEQ ID NO: 1242499 - DNA, 11 bp, Homo sapiens
ttattgctgcc

SEQ ID NO: 1242500 - DNA, 22 bp, Homo sapiens
ttattgctgccaaaaccacatg

SEQ ID NO: 1242501 - DNA, 17 bp, Homo sapiens
ttatttctgctctggaa

SEQ ID NO: 1242502 - DNA, 14 bp, Homo sapiens
ttatttcttaacct

SEQ ID NO: 1242503 - DNA, 14 bp, Homo sapiens
ttatttcttcgtga

SEQ ID NO: 1242504 - DNA, 12 bp, Homo sapiens
ttatttcttctc

SEQ ID NO: 1242505 - DNA, 22 bp, Homo sapiens
ttatttgaaaacatataaagca

SEQ ID NO: 1242506 - DNA, 19 bp, Homo sapiens
ttatttgattatttaagac

SEQ ID NO: 1242507 - DNA, 20 bp, Homo sapiens
ttatttgattatttaagact

SEQ ID NO: 1242508 - DNA, 21 bp, Homo sapiens
ttatttgcagtgcagtataga

SEQ ID NO: 1242509 - DNA, 11 bp, Homo sapiens
ttatttgcata

SEQ ID NO: 1242510 - DNA, 14 bp, Homo sapiens
ttatttgcatgtta

SEQ ID NO: 1242511 - DNA, 19 bp, Homo sapiens
ttatttgcatgttatgttt

SEQ ID NO: 1242512 - DNA, 16 bp, Homo sapiens
ttatttgctaagcata

SEQ ID NO: 1242513 - DNA, 23 bp, Homo sapiens
ttatttggaaccttgttttggac

SEQ ID NO: 1242514 - DNA, 20 bp, Homo sapiens
ttatttgtaaaccattgtaa

SEQ ID NO: 1242515 - DNA, 18 bp, Homo sapiens
ttatttgtaatagatgtt

SEQ ID NO: 1242516 - DNA, 13 bp, Homo sapiens
ttatttgtattca

SEQ ID NO: 1242517 - DNA, 16 bp, Homo sapiens
ttatttgtgtaataga

SEQ ID NO: 1242518 - DNA, 19 bp, Homo sapiens
ttatttgttctttttctga

SEQ ID NO: 1242519 - DNA, 12 bp, Homo sapiens
ttatttgttgag

SEQ ID NO: 1242520 - DNA, 14 bp, Homo sapiens
ttattttaaaatat

SEQ ID NO: 1242521 - DNA, 17 bp, Homo sapiens
ttattttaaacaaaata

SEQ ID NO: 1242522 - DNA, 24 bp, Homo sapiens
ttattttaatattttgtattttca

SEQ ID NO: 1242523 - DNA, 15 bp, Homo sapiens
ttattttacatttag

SEQ ID NO: 1242524 - DNA, 20 bp, Homo sapiens
ttattttacatttagagtat

SEQ ID NO: 1242525 - DNA, 16 bp, Homo sapiens
ttattttagcttcagt

SEQ ID NO: 1242526 - DNA, 10 bp, Homo sapiens
ttattttata

SEQ ID NO: 1242527 - DNA, 17 bp, Homo sapiens
ttattttatatcataca

SEQ ID NO: 1242528 - DNA, 16 bp, Homo sapiens
ttattttatcctctgg

SEQ ID NO: 1242529 - DNA, 13 bp, Homo sapiens
ttattttatgtct

SEQ ID NO: 1242530 - DNA, 16 bp, Homo sapiens
ttattttattgaaatg

SEQ ID NO: 1242531 - DNA, 15 bp, Homo sapiens
ttattttatttgctt

SEQ ID NO: 1242532 - DNA, 13 bp, Homo sapiens
ttattttcaagag

SEQ ID NO: 1242533 - DNA, 12 bp, Homo sapiens
ttattttcactg

SEQ ID NO: 1242534 - DNA, 14 bp, Homo sapiens
ttattttcctcccc

SEQ ID NO: 1242535 - DNA, 14 bp, Homo sapiens
ttattttctgtcag

SEQ ID NO: 1242536 - DNA, 15 bp, Homo sapiens
ttattttcttgttta

SEQ ID NO: 1242537 - DNA, 14 bp, Homo sapiens
ttattttgctgagt

SEQ ID NO: 1242538 - DNA, 22 bp, Homo sapiens
ttattttggaaaataaattatt

SEQ ID NO: 1242539 - DNA, 20 bp, Homo sapiens
ttattttgggcctgttcctt

SEQ ID NO: 1242540 - DNA, 13 bp, Homo sapiens
ttattttgtattc

SEQ ID NO: 1242541 - DNA, 19 bp, Homo sapiens
ttattttgtgctcatttaa

SEQ ID NO: 1242542 - DNA, 14 bp, Homo sapiens
ttatttttaaaata

SEQ ID NO: 1242543 - DNA, 20 bp, Homo sapiens
ttcagcacccccacccacct

SEQ ID NO: 1242544 - DNA, 23 bp, Homo sapiens
ttcagcacctacagtgtacagtc

SEQ ID NO: 1242545 - DNA, 13 bp, Homo sapiens
ttcagcactgtcc

SEQ ID NO: 1242546 - DNA, 15 bp, Homo sapiens
ttcagcactgtccct

SEQ ID NO: 1242547 - DNA, 13 bp, Homo sapiens
ttcagcagaacct

SEQ ID NO: 1242548 - DNA, 16 bp, Homo sapiens
ttcagcagaacctgca

SEQ ID NO: 1242549 - DNA, 17 bp, Homo sapiens
ttcagcagcaaattttc

SEQ ID NO: 1242550 - DNA, 20 bp, Homo sapiens
ttcagcagcaaattttcagc

SEQ ID NO: 1242551 - DNA, 20 bp, Homo sapiens
ttcagcatagaaggaagtgt

SEQ ID NO: 1242552 - DNA, 19 bp, Homo sapiens
ttcagcatccgcaggtgct

SEQ ID NO: 1242553 - DNA, 17 bp, Homo sapiens
ttcagcattaagctgtt

SEQ ID NO: 1242554 - DNA, 18 bp, Homo sapiens
ttcagcattaggctttta

SEQ ID NO: 1242555 - DNA, 15 bp, Homo sapiens
ttcagccagcttaaa

SEQ ID NO: 1242556 - DNA, 21 bp, Homo sapiens
ttcagccatcaacaagagttg

SEQ ID NO: 1242557 - DNA, 14 bp, Homo sapiens
ttcagcccccacca

SEQ ID NO: 1242558 - DNA, 16 bp, Homo sapiens
ttcagcccccaccagg

SEQ ID NO: 1242559 - DNA, 19 bp, Homo sapiens
ttcagcccctagtgctatt

SEQ ID NO: 1242560 - DNA, 15 bp, Homo sapiens
ttcagcccctcctct

SEQ ID NO: 1242561 - DNA, 20 bp, Homo sapiens
ttcagcccctcctctgccac

SEQ ID NO: 1242562 - DNA, 23 bp, Homo sapiens
ttcagcccctcctctgccacctc

SEQ ID NO: 1242563 - DNA, 16 bp, Homo sapiens
ttcagcctactgcctc

SEQ ID NO: 1242564 - DNA, 23 bp, Homo sapiens
ttcagcctagccgacctcagcct

SEQ ID NO: 1242565 - DNA, 19 bp, Homo sapiens
ttcagcctccctcagcccc

SEQ ID NO: 1242566 - DNA, 12 bp, Homo sapiens
ttcagccttaat

SEQ ID NO: 1242567 - DNA, 15 bp, Homo sapiens
ttcagccttcgtgtg

SEQ ID NO: 1242568 - DNA, 21 bp, Homo sapiens
ttcagccttctttttctggac

SEQ ID NO: 1242569 - DNA, 22 bp, Homo sapiens
ttcagctcaactcacagcttct

SEQ ID NO: 1242570 - DNA, 17 bp, Homo sapiens
ttcagctcattatgaaa

SEQ ID NO: 1242571 - DNA, 23 bp, Homo sapiens
ttcagctcctgagtagctgggcc

SEQ ID NO: 1242572 - DNA, 19 bp, Homo sapiens
ttcagctcttaaaaagaca

SEQ ID NO: 1242573 - DNA, 14 bp, Homo sapiens
ttcagctctttcca

SEQ ID NO: 1242574 - DNA, 19 bp, Homo sapiens
ttcagctctttccaaatta

SEQ ID NO: 1242575 - DNA, 20 bp, Homo sapiens
ttcagctctttccaaattaa

SEQ ID NO: 1242576 - DNA, 22 bp, Homo sapiens
ttcagcttcctgctgctggggc

SEQ ID NO: 1242577 - DNA, 22 bp, Homo sapiens
ttcagcttgaacctgcttcctg

SEQ ID NO: 1242578 - DNA, 14 bp, Homo sapiens
ttcaggaagatgaa

SEQ ID NO: 1242579 - DNA, 23 bp, Homo sapiens
ttcaggaattacactgtgccttt

SEQ ID NO: 1242580 - DNA, 18 bp, Homo sapiens
ttcaggaatttaaaatta

SEQ ID NO: 1242581 - DNA, 21 bp, Homo sapiens
ttcaggacataggcacaggca

SEQ ID NO: 1242582 - DNA, 19 bp, Homo sapiens
ttcaggagcgcaagataga

SEQ ID NO: 1242583 - DNA, 18 bp, Homo sapiens
ttcaggaggaatactgaa

SEQ ID NO: 1242584 - DNA, 19 bp, Homo sapiens
ttcaggaggccctggtgtc

SEQ ID NO: 1242585 - DNA, 14 bp, Homo sapiens
ttcaggaggctgga

SEQ ID NO: 1242586 - DNA, 12 bp, Homo sapiens
ttcaggagggat

SEQ ID NO: 1242587 - DNA, 17 bp, Homo sapiens
ttcaggagtcccaagga

SEQ ID NO: 1242588 - DNA, 17 bp, Homo sapiens
ttcaggagttggaatgt

SEQ ID NO: 1242589 - DNA, 17 bp, Homo sapiens
ttcaggatactctgtca

SEQ ID NO: 1242590 - DNA, 15 bp, Homo sapiens
ttcaggcagcactga

SEQ ID NO: 1242591 - DNA, 16 bp, Homo sapiens
ttcaggcatattttaa

SEQ ID NO: 1242592 - DNA, 16 bp, Homo sapiens
ttcaggcattttgttc

SEQ ID NO: 1242593 - DNA, 16 bp, Homo sapiens
ttcaggccagcccagc

SEQ ID NO: 1242594 - DNA, 17 bp, Homo sapiens
ttcaggctacctttttc

SEQ ID NO: 1242595 - DNA, 13 bp, Homo sapiens
ttcaggctgcttg

SEQ ID NO: 1242596 - DNA, 18 bp, Homo sapiens
ttcagggaatttcaggaa

SEQ ID NO: 1242597 - DNA, 22 bp, Homo sapiens
ttcagggaatttcaggaactag

SEQ ID NO: 1242598 - DNA, 17 bp, Homo sapiens
ttcagggaccgtccagg

SEQ ID NO: 1242599 - DNA, 17 bp, Homo sapiens
ttcagggacctcagggg

SEQ ID NO: 1242600 - DNA, 20 bp, Homo sapiens
ttcagggacctcaggggcac

SEQ ID NO: 1242601 - DNA, 13 bp, Homo sapiens
ttcagggaggggc

SEQ ID NO: 1242602 - DNA, 13 bp, Homo sapiens
ttcagggccagaa

SEQ ID NO: 1242603 - DNA, 16 bp, Homo sapiens
ttcagggccagaagga

SEQ ID NO: 1242604 - DNA, 15 bp, Homo sapiens
ttcaggggaagagaa

SEQ ID NO: 1242605 - DNA, 20 bp, Homo sapiens
ttcaggggaagagaagacaa

SEQ ID NO: 1242606 - DNA, 17 bp, Homo sapiens
ttcaggggaagggcagg

SEQ ID NO: 1242607 - DNA, 19 bp, Homo sapiens
ttcaggggctttgggccca

SEQ ID NO: 1242608 - DNA, 23 bp, Homo sapiens
ttcagggtgcagcccaatctgcc

SEQ ID NO: 1242609 - DNA, 22 bp, Homo sapiens
ttcaggtaaagggcaaataatg

SEQ ID NO: 1242610 - DNA, 16 bp, Homo sapiens
ttcaggtaacactaca

SEQ ID NO: 1242611 - DNA, 9 bp, Homo sapiens
ttcaggtac

SEQ ID NO: 1242612 - DNA, 14 bp, Homo sapiens
ttcaggtaggccct

SEQ ID NO: 1242613 - DNA, 22 bp, Homo sapiens
ttcaggtaggcccttgtcctgc

SEQ ID NO: 1242614 - DNA, 21 bp, Homo sapiens
ttcaggtatgtaaaagacttt

SEQ ID NO: 1242615 - DNA, 16 bp, Homo sapiens
ttcaggtccaggccag

SEQ ID NO: 1242616 - DNA, 20 bp, Homo sapiens
ttcaggtcccacgtctggcc

SEQ ID NO: 1242617 - DNA, 20 bp, Homo sapiens
ttcaggtggagagcactaga

SEQ ID NO: 1242618 - DNA, 23 bp, Homo sapiens
ttcaggtgtagtagttctgtgtt

SEQ ID NO: 1242619 - DNA, 13 bp, Homo sapiens
ttcaggtttttcc

SEQ ID NO: 1242620 - DNA, 16 bp, Homo sapiens
ttcagtaagctgtgtg

SEQ ID NO: 1242621 - DNA, 20 bp, Homo sapiens
ttcagtaagttatctttgaa

SEQ ID NO: 1242622 - DNA, 14 bp, Homo sapiens
ttcagtaatgtctt

SEQ ID NO: 1242623 - DNA, 21 bp, Homo sapiens
ttcagtacacttggtgtactg

SEQ ID NO: 1242624 - DNA, 22 bp, Homo sapiens
ttcagtaccctctcagctccag

SEQ ID NO: 1242625 - DNA, 14 bp, Homo sapiens
ttcagtactttttt

SEQ ID NO: 1242626 - DNA, 17 bp, Homo sapiens
ttcagtatcttagagtt

SEQ ID NO: 1242627 - DNA, 16 bp, Homo sapiens
ttcagtattttccagc

SEQ ID NO: 1242628 - DNA, 20 bp, Homo sapiens
ttcagtattttggagaaatt

SEQ ID NO: 1242629 - DNA, 21 bp, Homo sapiens
ttcagtcatataaaagctatg

SEQ ID NO: 1242630 - DNA, 15 bp, Homo sapiens
ttcagtcattaaatt

SEQ ID NO: 1242631 - DNA, 17 bp, Homo sapiens
ttcagtccaataggtgt

SEQ ID NO: 1242632 - DNA, 17 bp, Homo sapiens
ttcagtcccctctctct

SEQ ID NO: 1242633 - DNA, 12 bp, Homo sapiens
ttcagtcctgct

SEQ ID NO: 1242634 - DNA, 16 bp, Homo sapiens
ttcagtcctgctccag

SEQ ID NO: 1242635 - DNA, 19 bp, Homo sapiens
ttcagtcttggtggttcta

SEQ ID NO: 1242636 - DNA, 16 bp, Homo sapiens
ttcagtgagcccctcc

SEQ ID NO: 1242637 - DNA, 22 bp, Homo sapiens
ttcagtgagcccctccccagcc

SEQ ID NO: 1242638 - DNA, 15 bp, Homo sapiens
ttcagtgcacctgcc

SEQ ID NO: 1242639 - DNA, 21 bp, Homo sapiens
ttcagtgcagtttcttttcac

SEQ ID NO: 1242640 - DNA, 10 bp, Homo sapiens
ttcagtgccc

SEQ ID NO: 1242641 - DNA, 20 bp, Homo sapiens
ttcagtgccttcctctctct

SEQ ID NO: 1242642 - DNA, 21 bp, Homo sapiens
ttcagtgctgtggcctgggca

SEQ ID NO: 1242643 - DNA, 19 bp, Homo sapiens
ttcagtggaacacaaatga

SEQ ID NO: 1242644 - DNA, 23 bp, Homo sapiens
ttcagtggaacacaaatgaaaat

SEQ ID NO: 1242645 - DNA, 15 bp, Homo sapiens
ttcagtggaattgta

SEQ ID NO: 1242646 - DNA, 13 bp, Homo sapiens
ttcagtggaccct

SEQ ID NO: 1242647 - DNA, 23 bp, Homo sapiens
ttcagtggctggaattaaaacaa

SEQ ID NO: 1242648 - DNA, 14 bp, Homo sapiens
ttcagtgggagaaa

SEQ ID NO: 1242649 - DNA, 13 bp, Homo sapiens
ttcagtgtacatg

SEQ ID NO: 1242650 - DNA, 18 bp, Homo sapiens
ttcagtgtagcgggagga

SEQ ID NO: 1242651 - DNA, 18 bp, Homo sapiens
ttcagtgtcccaggcagc

SEQ ID NO: 1242652 - DNA, 15 bp, Homo sapiens
ttcagtgtctctgtt

SEQ ID NO: 1242653 - DNA, 17 bp, Homo sapiens
ttcagtgtgagtcagaa

SEQ ID NO: 1242654 - DNA, 19 bp, Homo sapiens
ttcagtgtgagtcagaatg

SEQ ID NO: 1242655 - DNA, 18 bp, Homo sapiens
ttcagttcatatgcagaa

SEQ ID NO: 1242656 - DNA, 22 bp, Homo sapiens
ttcagttcccaccatctgatta

SEQ ID NO: 1242657 - DNA, 18 bp, Homo sapiens
ttcagttgatcactggca

SEQ ID NO: 1242658 - DNA, 14 bp, Homo sapiens
ttcagttgcgaaac

SEQ ID NO: 1242659 - DNA, 15 bp, Homo sapiens
ttcagttgtctctga

SEQ ID NO: 1242660 - DNA, 23 bp, Homo sapiens
ttcagttgtttgtttttgcttgt

SEQ ID NO: 1242661 - DNA, 21 bp, Homo sapiens
ttcagtttgaaaatattttgt

SEQ ID NO: 1242662 - DNA, 15 bp, Homo sapiens
ttcagtttgtaaagt

SEQ ID NO: 1242663 - DNA, 13 bp, Homo sapiens
ttcagtttgtata

SEQ ID NO: 1242664 - DNA, 12 bp, Homo sapiens
ttcagttttcag

SEQ ID NO: 1242665 - DNA, 15 bp, Homo sapiens
ttcagtttttcattt

SEQ ID NO: 1242666 - DNA, 21 bp, Homo sapiens
ttcagtttttcatttgttttg

SEQ ID NO: 1242667 - DNA, 22 bp, Homo sapiens
ttcattccttcagatttggctt

SEQ ID NO: 1242668 - DNA, 18 bp, Homo sapiens
ttcattctccctttcact

SEQ ID NO: 1242669 - DNA, 15 bp, Homo sapiens
ttcattctcctgcct

SEQ ID NO: 1242670 - DNA, 14 bp, Homo sapiens
ttcattctctttta

SEQ ID NO: 1242671 - DNA, 12 bp, Homo sapiens
ttcattctgcat

SEQ ID NO: 1242672 - DNA, 15 bp, Homo sapiens
ttcattgcctttcca

SEQ ID NO: 1242673 - DNA, 16 bp, Homo sapiens
ttccatgttgctgcca

SEQ ID NO: 1242674 - DNA, 20 bp, Homo sapiens
ttccattattgagttcctcc

SEQ ID NO: 1242675 - DNA, 20 bp, Homo sapiens
ttccattgtagtggcctgtg

SEQ ID NO: 1242676 - DNA, 13 bp, Homo sapiens
ttccattgtgtga

SEQ ID NO: 1242677 - DNA, 20 bp, Homo sapiens
ttccatttacagtctctttc

SEQ ID NO: 1242678 - DNA, 23 bp, Homo sapiens
ttccatttctcaatcagtgcagt

SEQ ID NO: 1242679 - DNA, 12 bp, Homo sapiens
ttccatttctgg

SEQ ID NO: 1242680 - DNA, 13 bp, Homo sapiens
ttccatttgcaag

SEQ ID NO: 1242681 - DNA, 15 bp, Homo sapiens
ttccatttgcatttg

SEQ ID NO: 1242682 - DNA, 18 bp, Homo sapiens
ttccatttgcatttgttt

SEQ ID NO: 1242683 - DNA, 14 bp, Homo sapiens
ttccattttatgca

SEQ ID NO: 1242684 - DNA, 16 bp, Homo sapiens
ttccattttcccccac

SEQ ID NO: 1242685 - DNA, 16 bp, Homo sapiens
ttccattttttgtatt

SEQ ID NO: 1242686 - DNA, 22 bp, Homo sapiens
ttcctctccttcgtatcccgag

SEQ ID NO: 1242687 - DNA, 14 bp, Homo sapiens
ttcctctctccaga

SEQ ID NO: 1242688 - DNA, 13 bp, Homo sapiens
ttcctctctccca

SEQ ID NO: 1242689 - DNA, 22 bp, Homo sapiens
ttcctctctcggagccctcaga

SEQ ID NO: 1242690 - DNA, 13 bp, Homo sapiens
ttcctctgagcct

SEQ ID NO: 1242691 - DNA, 17 bp, Homo sapiens
ttcctctgagccttggg

SEQ ID NO: 1242692 - DNA, 11 bp, Homo sapiens
ttcctctgagg

SEQ ID NO: 1242693 - DNA, 18 bp, Homo sapiens
ttcctctgaggaagaagg

SEQ ID NO: 1242694 - DNA, 17 bp, Homo sapiens
ttcctctgcagttttga

SEQ ID NO: 1242695 - DNA, 13 bp, Homo sapiens
ttcctctgcattt

SEQ ID NO: 1242696 - DNA, 11 bp, Homo sapiens
ttcctctgcca

SEQ ID NO: 1242697 - DNA, 23 bp, Homo sapiens
ttcctctgccatgtttttcccct

SEQ ID NO: 1242698 - DNA, 14 bp, Homo sapiens
ttcctctgcctgcc

SEQ ID NO: 1242699 - DNA, 16 bp, Homo sapiens
ttcctctgcctgcccc

SEQ ID NO: 1242700 - DNA, 18 bp, Homo sapiens
ttcctctgggtttctaag

SEQ ID NO: 1242701 - DNA, 17 bp, Homo sapiens
ttcctctggttcctttc

SEQ ID NO: 1242702 - DNA, 14 bp, Homo sapiens
ttcctctgttcaca

SEQ ID NO: 1242703 - DNA, 13 bp, Homo sapiens
ttcctctgttcta

SEQ ID NO: 1242704 - DNA, 21 bp, Homo sapiens
ttcctcttagaagaatattgt

SEQ ID NO: 1242705 - DNA, 18 bp, Homo sapiens
ttcctcttccccttgccc

SEQ ID NO: 1242706 - DNA, 19 bp, Homo sapiens
ttcctcttccccttgccct

SEQ ID NO: 1242707 - DNA, 17 bp, Homo sapiens
ttcctcttgaccctgca

SEQ ID NO: 1242708 - DNA, 19 bp, Homo sapiens
ttcctcttgaccctgcacc

SEQ ID NO: 1242709 - DNA, 19 bp, Homo sapiens
ttcctcttgcctctctcag

SEQ ID NO: 1242710 - DNA, 18 bp, Homo sapiens
ttcctcttgtcctggccc

SEQ ID NO: 1242711 - DNA, 13 bp, Homo sapiens
ttcctctttctgc

SEQ ID NO: 1242712 - DNA, 14 bp, Homo sapiens
ttcctctttctgct

SEQ ID NO: 1242713 - DNA, 14 bp, Homo sapiens
ttcctctttgcttt

SEQ ID NO: 1242714 - DNA, 22 bp, Homo sapiens
ttcctctttgctttgctttctg

SEQ ID NO: 1242715 - DNA, 11 bp, Homo sapiens
ttcctgaagct

SEQ ID NO: 1242716 - DNA, 12 bp, Homo sapiens
ttcctgaagctg

SEQ ID NO: 1242717 - DNA, 20 bp, Homo sapiens
ttctaaaggctacctttgta

SEQ ID NO: 1242718 - DNA, 20 bp, Homo sapiens
ttctaaaggtgttgtccctt

SEQ ID NO: 1242719 - DNA, 19 bp, Homo sapiens
ttctaaagttttgcaacaa

SEQ ID NO: 1242720 - DNA, 18 bp, Homo sapiens
ttctaaataaaaatatgt

SEQ ID NO: 1242721 - DNA, 20 bp, Homo sapiens
ttctaaataaatttcccagt

SEQ ID NO: 1242722 - DNA, 13 bp, Homo sapiens
ttctaaatagcaa

SEQ ID NO: 1242723 - DNA, 18 bp, Homo sapiens
ttctaaatccgacttgaa

SEQ ID NO: 1242724 - DNA, 21 bp, Homo sapiens
ttctaaatctccaaaataaaa

SEQ ID NO: 1242725 - DNA, 12 bp, Homo sapiens
ttctaaatgaat

SEQ ID NO: 1242726 - DNA, 13 bp, Homo sapiens
ttctaaatgcata

SEQ ID NO: 1242727 - DNA, 21 bp, Homo sapiens
ttctaaattaatggtaaaata

SEQ ID NO: 1242728 - DNA, 14 bp, Homo sapiens
ttctaacaagtcat

SEQ ID NO: 1242729 - DNA, 17 bp, Homo sapiens
ttctaacatatgtatta

SEQ ID NO: 1242730 - DNA, 20 bp, Homo sapiens
ttctaaccttgaatgctgcc

SEQ ID NO: 1242731 - DNA, 23 bp, Homo sapiens
ttctaaccttgaatgctgccagt

SEQ ID NO: 1242732 - DNA, 14 bp, Homo sapiens
ttctaagaaaatgt

SEQ ID NO: 1242733 - DNA, 17 bp, Homo sapiens
ttctaagaaaatgtagt

SEQ ID NO: 1242734 - DNA, 18 bp, Homo sapiens
ttctaagaaatagagcca

SEQ ID NO: 1242735 - DNA, 18 bp, Homo sapiens
ttctaagaaatatctgtg

SEQ ID NO: 1242736 - DNA, 19 bp, Homo sapiens
ttctaagaaatatctgtga

SEQ ID NO: 1242737 - DNA, 18 bp, Homo sapiens
ttctaagaaatcaagtaa

SEQ ID NO: 1242738 - DNA, 12 bp, Homo sapiens
ttctaagaagac

SEQ ID NO: 1242739 - DNA, 16 bp, Homo sapiens
ttctaagacagttttt

SEQ ID NO: 1242740 - DNA, 17 bp, Homo sapiens
ttctaagacagttttta

SEQ ID NO: 1242741 - DNA, 12 bp, Homo sapiens
ttctaagagaag

SEQ ID NO: 1242742 - DNA, 23 bp, Homo sapiens
ttctaagcgcctattgtttgtaa

SEQ ID NO: 1242743 - DNA, 21 bp, Homo sapiens
ttctaaggggacctacagaca

SEQ ID NO: 1242744 - DNA, 15 bp, Homo sapiens
ttctaagtaaataca

SEQ ID NO: 1242745 - DNA, 17 bp, Homo sapiens
ttctaagtggcgtgtgc

SEQ ID NO: 1242746 - DNA, 23 bp, Homo sapiens
ttctaagtgtaacctcagtattt

SEQ ID NO: 1242747 - DNA, 16 bp, Homo sapiens
ttctaataaagtcatt

SEQ ID NO: 1242748 - DNA, 18 bp, Homo sapiens
ttctaatagaactcagtt

SEQ ID NO: 1242749 - DNA, 16 bp, Homo sapiens
ttctaatagtttttca

SEQ ID NO: 1242750 - DNA, 22 bp, Homo sapiens
ttctaatatatttttatattta

SEQ ID NO: 1242751 - DNA, 16 bp, Homo sapiens
ttctaatcacagtgtt

SEQ ID NO: 1242752 - DNA, 19 bp, Homo sapiens
ttctaatcacagtgttgca

SEQ ID NO: 1242753 - DNA, 23 bp, Homo sapiens
ttctaatgtgtgaatcagagcac

SEQ ID NO: 1242754 - DNA, 13 bp, Homo sapiens
ttctaatgtttct

SEQ ID NO: 1242755 - DNA, 23 bp, Homo sapiens
ttctaattccacaggtcatcaga

SEQ ID NO: 1242756 - DNA, 20 bp, Homo sapiens
ttctaatttatattatccat

SEQ ID NO: 1242757 - DNA, 17 bp, Homo sapiens
ttctaattttggatgga

SEQ ID NO: 1242758 - DNA, 15 bp, Homo sapiens
ttctacaagcatatt

SEQ ID NO: 1242759 - DNA, 18 bp, Homo sapiens
ttctacaagcatatttga

SEQ ID NO: 1242760 - DNA, 16 bp, Homo sapiens
ttctacaaggactcca

SEQ ID NO: 1242761 - DNA, 15 bp, Homo sapiens
ttctacaatgtgaac

SEQ ID NO: 1242762 - DNA, 18 bp, Homo sapiens
ttctacaatgtgaacttt

SEQ ID NO: 1242763 - DNA, 19 bp, Homo sapiens
ttctacaatgtgaacttta

SEQ ID NO: 1242764 - DNA, 13 bp, Homo sapiens
ttctacacctgga

SEQ ID NO: 1242765 - DNA, 16 bp, Homo sapiens
ttctacacctggacca

SEQ ID NO: 1242766 - DNA, 17 bp, Homo sapiens
ttctacagaaaaacaat

SEQ ID NO: 1242767 - DNA, 22 bp, Homo sapiens
ttctacagagaaaatgaatttg

SEQ ID NO: 1242768 - DNA, 16 bp, Homo sapiens
ttctacatgactgggc
